United States Patent 11,492,591 (UNIVERSAL DONOR STEM CELLS AND RELATED METHODS) - sequence listing, part 3

SEQ ID NO: 62295 - DNA, 20 bp, Artificial
  CRISPR gRNA sequence
agcatgagaatgtaatgatc

SEQ ID NO: 62296 - DNA, 20 bp, Artificial
  CRISPR gRNA sequence
tgagacagcatctaatctac

SEQ ID NO: 62297 - DNA, 20 bp, Artificial
  CRISPR gRNA sequence
gagacagcatctaatctacc

SEQ ID NO: 62298 - DNA, 20 bp, Artificial
  CRISPR gRNA sequence
agacagcatctaatctaccc

SEQ ID NO: 62299 - DNA, 20 bp, Artificial
  CRISPR gRNA sequence
atctacccattttagagatg

SEQ ID NO: 62300 - DNA, 20 bp, Artificial
  CRISPR gRNA sequence
cccattttagagatggtatg

SEQ ID NO: 62301 - DNA, 20 bp, Artificial
  CRISPR gRNA sequence
tagagatggtatgactgagg

SEQ ID NO: 62302 - DNA, 20 bp, Artificial
  CRISPR gRNA sequence
agagatggtatgactgaggc

SEQ ID NO: 62303 - DNA, 20 bp, Artificial
  CRISPR gRNA sequence
gagatggtatgactgaggct

SEQ ID NO: 62304 - DNA, 20 bp, Artificial
  CRISPR gRNA sequence
aggcttatataggaaaaagg

SEQ ID NO: 62305 - DNA, 20 bp, Artificial
  CRISPR gRNA sequence
atataggaaaaaggcttgct

SEQ ID NO: 62306 - DNA, 20 bp, Artificial
  CRISPR gRNA sequence
tataggaaaaaggcttgctc

SEQ ID NO: 62307 - DNA, 20 bp, Artificial
  CRISPR gRNA sequence
gctcaaggtcacactatgag

SEQ ID NO: 62308 - DNA, 20 bp, Artificial
  CRISPR gRNA sequence
ctcaaggtcacactatgagt

SEQ ID NO: 62309 - DNA, 20 bp, Artificial
  CRISPR gRNA sequence
aaggtcacactatgagtgta

SEQ ID NO: 62310 - DNA, 20 bp, Artificial
  CRISPR gRNA sequence
tgagtgtatcagctaggata

SEQ ID NO: 62311 - DNA, 20 bp, Artificial
  CRISPR gRNA sequence
ggataggccaggttacactg

SEQ ID NO: 62312 - DNA, 20 bp, Artificial
  CRISPR gRNA sequence
cactgtagtacatgcaccct

SEQ ID NO: 62313 - DNA, 20 bp, Artificial
  CRISPR gRNA sequence
tagtacatgcaccctccaaa

SEQ ID NO: 62314 - DNA, 20 bp, Artificial
  CRISPR gRNA sequence
caaagtcccagtgactcatg

SEQ ID NO: 62315 - DNA, 20 bp, Artificial
  CRISPR gRNA sequence
atggcaacaaaagtttattt

SEQ ID NO: 62316 - DNA, 20 bp, Artificial
  CRISPR gRNA sequence
atttcctgctcttgcttcct

SEQ ID NO: 62317 - DNA, 20 bp, Artificial
  CRISPR gRNA sequence
tttcctgctcttgcttcctg

SEQ ID NO: 62318 - DNA, 20 bp, Artificial
  CRISPR gRNA sequence
cctgctcttgcttcctgtct

SEQ ID NO: 62319 - DNA, 20 bp, Artificial
  CRISPR gRNA sequence
ctgctcttgcttcctgtctc

SEQ ID NO: 62320 - DNA, 20 bp, Artificial
  CRISPR gRNA sequence
ctcttgcttcctgtctcgtg

SEQ ID NO: 62321 - DNA, 20 bp, Artificial
  CRISPR gRNA sequence
ttgcttcctgtctcgtgtgg

SEQ ID NO: 62322 - DNA, 20 bp, Artificial
  CRISPR gRNA sequence
gcttcctgtctcgtgtggat

SEQ ID NO: 62323 - DNA, 20 bp, Artificial
  CRISPR gRNA sequence
cttcctgtctcgtgtggatt

SEQ ID NO: 62324 - DNA, 20 bp, Artificial
  CRISPR gRNA sequence
cctgtctcgtgtggattgac

SEQ ID NO: 62325 - DNA, 20 bp, Artificial
  CRISPR gRNA sequence
ctgtctcgtgtggattgact

SEQ ID NO: 62326 - DNA, 20 bp, Artificial
  CRISPR gRNA sequence
tctcgtgtggattgactggg

SEQ ID NO: 62327 - DNA, 20 bp, Artificial
  CRISPR gRNA sequence
gtgtggattgactgggattg

SEQ ID NO: 62328 - DNA, 20 bp, Artificial
  CRISPR gRNA sequence
actgggattgctcctccaca

SEQ ID NO: 62329 - DNA, 20 bp, Artificial
  CRISPR gRNA sequence
ggattgctcctccacatcat

SEQ ID NO: 62330 - DNA, 20 bp, Artificial
  CRISPR gRNA sequence
ctcctccacatcatcctgtc

SEQ ID NO: 62331 - DNA, 20 bp, Artificial
  CRISPR gRNA sequence
ctccacatcatcctgtctcc

SEQ ID NO: 62332 - DNA, 20 bp, Artificial
  CRISPR gRNA sequence
cacatcatcctgtctcccac

SEQ ID NO: 62333 - DNA, 20 bp, Artificial
  CRISPR gRNA sequence
tctcccacactcaggctaac

SEQ ID NO: 62334 - DNA, 20 bp, Artificial
  CRISPR gRNA sequence
ccacactcaggctaacaggg

SEQ ID NO: 62335 - DNA, 20 bp, Artificial
  CRISPR gRNA sequence
aggctaacagggtagccatg

SEQ ID NO: 62336 - DNA, 20 bp, Artificial
  CRISPR gRNA sequence
acagggtagccatgatttgc

SEQ ID NO: 62337 - DNA, 20 bp, Artificial
  CRISPR gRNA sequence
gcaatatttctggtccctgg

SEQ ID NO: 62338 - DNA, 20 bp, Artificial
  CRISPR gRNA sequence
caatatttctggtccctgga

SEQ ID NO: 62339 - DNA, 20 bp, Artificial
  CRISPR gRNA sequence
ctggtccctggagtagaaaa

SEQ ID NO: 62340 - DNA, 20 bp, Artificial
  CRISPR gRNA sequence
tggtccctggagtagaaaaa

SEQ ID NO: 62341 - DNA, 20 bp, Artificial
  CRISPR gRNA sequence
gtccctggagtagaaaaaaa

SEQ ID NO: 62342 - DNA, 20 bp, Artificial
  CRISPR gRNA sequence
gagtagaaaaaaagaaaaag

SEQ ID NO: 62343 - DNA, 20 bp, Artificial
  CRISPR gRNA sequence
tcaattacaccttggttctt

SEQ ID NO: 62344 - DNA, 20 bp, Artificial
  CRISPR gRNA sequence
caccttggttcttaaaacaa

SEQ ID NO: 62345 - DNA, 20 bp, Artificial
  CRISPR gRNA sequence
ggttcttaaaacaactacag

SEQ ID NO: 62346 - DNA, 20 bp, Artificial
  CRISPR gRNA sequence
gttcttaaaacaactacagg

SEQ ID NO: 62347 - DNA, 20 bp, Artificial
  CRISPR gRNA sequence
ttaaaacaactacaggcatg

SEQ ID NO: 62348 - DNA, 20 bp, Artificial
  CRISPR gRNA sequence
aaaacaactacaggcatgac

SEQ ID NO: 62349 - DNA, 20 bp, Artificial
  CRISPR gRNA sequence
aaacaactacaggcatgaca

SEQ ID NO: 62350 - DNA, 20 bp, Artificial
  CRISPR gRNA sequence
caggcatgacatgagtcttt

SEQ ID NO: 62351 - DNA, 20 bp, Artificial
  CRISPR gRNA sequence
ttttagcatgtttcattgac

SEQ ID NO: 62352 - DNA, 20 bp, Artificial
  CRISPR gRNA sequence
tttagcatgtttcattgacc

SEQ ID NO: 62353 - DNA, 20 bp, Artificial
  CRISPR gRNA sequence
ttagcatgtttcattgacca

SEQ ID NO: 62354 - DNA, 20 bp, Artificial
  CRISPR gRNA sequence
tagcatgtttcattgaccaa

SEQ ID NO: 62355 - DNA, 20 bp, Artificial
  CRISPR gRNA sequence
agcatgtttcattgaccaaa

SEQ ID NO: 62356 - DNA, 20 bp, Artificial
  CRISPR gRNA sequence
gcatgtttcattgaccaaag

SEQ ID NO: 62357 - DNA, 20 bp, Artificial
  CRISPR gRNA sequence
cattgaccaaagcaagtttc

SEQ ID NO: 62358 - DNA, 20 bp, Artificial
  CRISPR gRNA sequence
attgaccaaagcaagtttca

SEQ ID NO: 62359 - DNA, 20 bp, Artificial
  CRISPR gRNA sequence
accaaagcaagtttcatggc

SEQ ID NO: 62360 - DNA, 20 bp, Artificial
  CRISPR gRNA sequence
catggctgtgcccaatttca

SEQ ID NO: 62361 - DNA, 20 bp, Artificial
  CRISPR gRNA sequence
atggctgtgcccaatttcaa

SEQ ID NO: 62362 - DNA, 20 bp, Artificial
  CRISPR gRNA sequence
tgcccaatttcaaggaggca

SEQ ID NO: 62363 - DNA, 20 bp, Artificial
  CRISPR gRNA sequence
caaggaggcagagaagtgta

SEQ ID NO: 62364 - DNA, 20 bp, Artificial
  CRISPR gRNA sequence
aaggaggcagagaagtgtaa

SEQ ID NO: 62365 - DNA, 20 bp, Artificial
  CRISPR gRNA sequence
gaaagaggagaaagagtatc

SEQ ID NO: 62366 - DNA, 20 bp, Artificial
  CRISPR gRNA sequence
tgaacagccctaatgcctac

SEQ ID NO: 62367 - DNA, 20 bp, Artificial
  CRISPR gRNA sequence
atgcctaccacagagaatta

SEQ ID NO: 62368 - DNA, 20 bp, Artificial
  CRISPR gRNA sequence
ccacagagaattagtaacag

SEQ ID NO: 62369 - DNA, 20 bp, Artificial
  CRISPR gRNA sequence
gtaacagagctgggccatgg

SEQ ID NO: 62370 - DNA, 20 bp, Artificial
  CRISPR gRNA sequence
ggccatggatctttcaacca

SEQ ID NO: 62371 - DNA, 20 bp, Artificial
  CRISPR gRNA sequence
tcaaccatcgtcctctgtct

SEQ ID NO: 62372 - DNA, 20 bp, Artificial
  CRISPR gRNA sequence
caaccatcgtcctctgtctc

SEQ ID NO: 62373 - DNA, 20 bp, Artificial
  CRISPR gRNA sequence
aaccatcgtcctctgtctcc

SEQ ID NO: 62374 - DNA, 20 bp, Artificial
  CRISPR gRNA sequence
tgtctccaagattattcccc

SEQ ID NO: 62375 - DNA, 20 bp, Artificial
  CRISPR gRNA sequence
tctccaagattattccccat

SEQ ID NO: 62376 - DNA, 20 bp, Artificial
  CRISPR gRNA sequence
caagattattccccatggaa

SEQ ID NO: 62377 - DNA, 20 bp, Artificial
  CRISPR gRNA sequence
ttccccatggaaatctcaat

SEQ ID NO: 62378 - DNA, 20 bp, Artificial
  CRISPR gRNA sequence
cccatggaaatctcaatgac

SEQ ID NO: 62379 - DNA, 20 bp, Artificial
  CRISPR gRNA sequence
aatgactgataatgatgcca

SEQ ID NO: 62380 - DNA, 20 bp, Artificial
  CRISPR gRNA sequence
ataatgatgccatgtgcttt

SEQ ID NO: 62381 - DNA, 20 bp, Artificial
  CRISPR gRNA sequence
tttctcctgaggatggttag

SEQ ID NO: 62382 - DNA, 20 bp, Artificial
  CRISPR gRNA sequence
ttctcctgaggatggttagc

SEQ ID NO: 62383 - DNA, 20 bp, Artificial
  CRISPR gRNA sequence
tctcctgaggatggttagcc

SEQ ID NO: 62384 - DNA, 20 bp, Artificial
  CRISPR gRNA sequence
ctcctgaggatggttagcct

SEQ ID NO: 62385 - DNA, 20 bp, Artificial
  CRISPR gRNA sequence
tcctgaggatggttagcctt

SEQ ID NO: 62386 - DNA, 20 bp, Artificial
  CRISPR gRNA sequence
ctgaggatggttagccttaa

SEQ ID NO: 62387 - DNA, 20 bp, Artificial
  CRISPR gRNA sequence
aggatggttagccttaaaga

SEQ ID NO: 62388 - DNA, 20 bp, Artificial
  CRISPR gRNA sequence
gccttaaagagatttgtgtc

SEQ ID NO: 62389 - DNA, 20 bp, Artificial
  CRISPR gRNA sequence
aaagagatttgtgtcatatc

SEQ ID NO: 62390 - DNA, 20 bp, Artificial
  CRISPR gRNA sequence
aagagatttgtgtcatatcc

SEQ ID NO: 62391 - DNA, 20 bp, Artificial
  CRISPR gRNA sequence
gtgtcatatcctaaggggat

SEQ ID NO: 62392 - DNA, 20 bp, Artificial
  CRISPR gRNA sequence
tgtcatatcctaaggggata

SEQ ID NO: 62393 - DNA, 20 bp, Artificial
  CRISPR gRNA sequence
aggggatagaacactaatga

SEQ ID NO: 62394 - DNA, 20 bp, Artificial
  CRISPR gRNA sequence
atgatggaaacaaaggtatt

SEQ ID NO: 62395 - DNA, 20 bp, Artificial
  CRISPR gRNA sequence
tgttagactggctggaggag

SEQ ID NO: 62396 - DNA, 20 bp, Artificial
  CRISPR gRNA sequence
gactggctggaggagaaatt

SEQ ID NO: 62397 - DNA, 20 bp, Artificial
  CRISPR gRNA sequence
gctggaggagaaatttgagg

SEQ ID NO: 62398 - DNA, 20 bp, Artificial
  CRISPR gRNA sequence
gaggagaaatttgaggatga

SEQ ID NO: 62399 - DNA, 20 bp, Artificial
  CRISPR gRNA sequence
gaggatgagaaacatcacca

SEQ ID NO: 62400 - DNA, 20 bp, Artificial
  CRISPR gRNA sequence
aggatgagaaacatcaccag

SEQ ID NO: 62401 - DNA, 20 bp, Artificial
  CRISPR gRNA sequence
cttacttccatctggtgcca

SEQ ID NO: 62402 - DNA, 20 bp, Artificial
  CRISPR gRNA sequence
acttccatctggtgccatgc

SEQ ID NO: 62403 - DNA, 20 bp, Artificial
  CRISPR gRNA sequence
cttccatctggtgccatgct

SEQ ID NO: 62404 - DNA, 20 bp, Artificial
  CRISPR gRNA sequence
ccatctggtgccatgctgcc

SEQ ID NO: 62405 - DNA, 20 bp, Artificial
  CRISPR gRNA sequence
catctggtgccatgctgccc

SEQ ID NO: 62406 - DNA, 20 bp, Artificial
  CRISPR gRNA sequence
gtgccatgctgccctggacc

SEQ ID NO: 62407 - DNA, 20 bp, Artificial
  CRISPR gRNA sequence
ccctggaccatttcttcatg

SEQ ID NO: 62408 - DNA, 20 bp, Artificial
  CRISPR gRNA sequence
gaccatttcttcatgggtag

SEQ ID NO: 62409 - DNA, 20 bp, Artificial
  CRISPR gRNA sequence
cttcatgggtagcatggatg

SEQ ID NO: 62410 - DNA, 20 bp, Artificial
  CRISPR gRNA sequence
ttcatgggtagcatggatgc

SEQ ID NO: 62411 - DNA, 20 bp, Artificial
  CRISPR gRNA sequence
catgggtagcatggatgctg

SEQ ID NO: 62412 - DNA, 20 bp, Artificial
  CRISPR gRNA sequence
atgggtagcatggatgctgg

SEQ ID NO: 62413 - DNA, 20 bp, Artificial
  CRISPR gRNA sequence
gacaccatagcctggaaaag

SEQ ID NO: 62414 - DNA, 20 bp, Artificial
  CRISPR gRNA sequence
gaaaagaagttatgccctag

SEQ ID NO: 62415 - DNA, 20 bp, Artificial
  CRISPR gRNA sequence
tgccctaggctatggccaca

SEQ ID NO: 62416 - DNA, 20 bp, Artificial
  CRISPR gRNA sequence
ggctatggccacatcctttt

SEQ ID NO: 62417 - DNA, 20 bp, Artificial
  CRISPR gRNA sequence
tggccacatccttttgccga

SEQ ID NO: 62418 - DNA, 20 bp, Artificial
  CRISPR gRNA sequence
ttgccgagatcacacaaaat

SEQ ID NO: 62419 - DNA, 20 bp, Artificial
  CRISPR gRNA sequence
tgccgagatcacacaaaatc

SEQ ID NO: 62420 - DNA, 20 bp, Artificial
  CRISPR gRNA sequence
gccgagatcacacaaaatcc

SEQ ID NO: 62421 - DNA, 20 bp, Artificial
  CRISPR gRNA sequence
ccgagatcacacaaaatcca

SEQ ID NO: 62422 - DNA, 20 bp, Artificial
  CRISPR gRNA sequence
agccttgtctggtgccatct

SEQ ID NO: 62423 - DNA, 20 bp, Artificial
  CRISPR gRNA sequence
gccttgtctggtgccatcta

SEQ ID NO: 62424 - DNA, 20 bp, Artificial
  CRISPR gRNA sequence
gtctggtgccatctaggcct

SEQ ID NO: 62425 - DNA, 20 bp, Artificial
  CRISPR gRNA sequence
tctggtgccatctaggcctc

SEQ ID NO: 62426 - DNA, 20 bp, Artificial
  CRISPR gRNA sequence
gtgccatctaggcctccaag

SEQ ID NO: 62427 - DNA, 20 bp, Artificial
  CRISPR gRNA sequence
ggcctccaaggccttggaaa

SEQ ID NO: 62428 - DNA, 20 bp, Artificial
  CRISPR gRNA sequence
caaggccttggaaatttact

SEQ ID NO: 62429 - DNA, 20 bp, Artificial
  CRISPR gRNA sequence
ggaaatttactggcctggga

SEQ ID NO: 62430 - DNA, 20 bp, Artificial
  CRISPR gRNA sequence
gaaatttactggcctgggag

SEQ ID NO: 62431 - DNA, 20 bp, Artificial
  CRISPR gRNA sequence
actggcctgggaggcaagaa

SEQ ID NO: 62432 - DNA, 20 bp, Artificial
  CRISPR gRNA sequence
ctggcctgggaggcaagaaa

SEQ ID NO: 62433 - DNA, 20 bp, Artificial
  CRISPR gRNA sequence
gcctgggaggcaagaaacct

SEQ ID NO: 62434 - DNA, 20 bp, Artificial
  CRISPR gRNA sequence
ggaggcaagaaacctcagtt

SEQ ID NO: 62435 - DNA, 20 bp, Artificial
  CRISPR gRNA sequence
agttctcctcctgcctctgt

SEQ ID NO: 62436 - DNA, 20 bp, Artificial
  CRISPR gRNA sequence
tcctcctgcctctgtcatgg

SEQ ID NO: 62437 - DNA, 20 bp, Artificial
  CRISPR gRNA sequence
ctcctgcctctgtcatggac

SEQ ID NO: 62438 - DNA, 20 bp, Artificial
  CRISPR gRNA sequence
ctgcctctgtcatggacttg

SEQ ID NO: 62439 - DNA, 20 bp, Artificial
  CRISPR gRNA sequence
cctctgtcatggacttgctg

SEQ ID NO: 62440 - DNA, 20 bp, Artificial
  CRISPR gRNA sequence
tgtcatggacttgctgtgtg

SEQ ID NO: 62441 - DNA, 20 bp, Artificial
  CRISPR gRNA sequence
tcatggacttgctgtgtgac

SEQ ID NO: 62442 - DNA, 20 bp, Artificial
  CRISPR gRNA sequence
gctgtgtgactgtgggcaca

SEQ ID NO: 62443 - DNA, 20 bp, Artificial
  CRISPR gRNA sequence
ctgtgtgactgtgggcacac

SEQ ID NO: 62444 - DNA, 20 bp, Artificial
  CRISPR gRNA sequence
tgtgactgtgggcacaccct

SEQ ID NO: 62445 - DNA, 20 bp, Artificial
  CRISPR gRNA sequence
tgggcacaccctttgccctt

SEQ ID NO: 62446 - DNA, 20 bp, Artificial
  CRISPR gRNA sequence
tgcccttccttggccatggt

SEQ ID NO: 62447 - DNA, 20 bp, Artificial
  CRISPR gRNA sequence
gcccttccttggccatggtc

SEQ ID NO: 62448 - DNA, 20 bp, Artificial
  CRISPR gRNA sequence
cccttccttggccatggtct

SEQ ID NO: 62449 - DNA, 20 bp, Artificial
  CRISPR gRNA sequence
ccttggccatggtctttccg

SEQ ID NO: 62450 - DNA, 20 bp, Artificial
  CRISPR gRNA sequence
cttggccatggtctttccgt

SEQ ID NO: 62451 - DNA, 20 bp, Artificial
  CRISPR gRNA sequence
ggccatggtctttccgtctg

SEQ ID NO: 62452 - DNA, 20 bp, Artificial
  CRISPR gRNA sequence
gccatggtctttccgtctgc

SEQ ID NO: 62453 - DNA, 20 bp, Artificial
  CRISPR gRNA sequence
tccgtctgcttagtggaggt

SEQ ID NO: 62454 - DNA, 20 bp, Artificial
  CRISPR gRNA sequence
ccgtctgcttagtggaggtg

SEQ ID NO: 62455 - DNA, 20 bp, Artificial
  CRISPR gRNA sequence
cgtctgcttagtggaggtgg

SEQ ID NO: 62456 - DNA, 20 bp, Artificial
  CRISPR gRNA sequence
cttagtggaggtggtgatcc

SEQ ID NO: 62457 - DNA, 20 bp, Artificial
  CRISPR gRNA sequence
agtggaggtggtgatccctg

SEQ ID NO: 62458 - DNA, 20 bp, Artificial
  CRISPR gRNA sequence
gtggaggtggtgatccctgc

SEQ ID NO: 62459 - DNA, 20 bp, Artificial
  CRISPR gRNA sequence
cctgaggatcatggtgtgag

SEQ ID NO: 62460 - DNA, 20 bp, Artificial
  CRISPR gRNA sequence
aggatcatggtgtgagcatg

SEQ ID NO: 62461 - DNA, 20 bp, Artificial
  CRISPR gRNA sequence
cataaattctaagactctct

SEQ ID NO: 62462 - DNA, 20 bp, Artificial
  CRISPR gRNA sequence
ataaattctaagactctctg

SEQ ID NO: 62463 - DNA, 20 bp, Artificial
  CRISPR gRNA sequence
taagactctctgcctgagtg

SEQ ID NO: 62464 - DNA, 20 bp, Artificial
  CRISPR gRNA sequence
agactctctgcctgagtgag

SEQ ID NO: 62465 - DNA, 20 bp, Artificial
  CRISPR gRNA sequence
tctgcctgagtgaggaccta

SEQ ID NO: 62466 - DNA, 20 bp, Artificial
  CRISPR gRNA sequence
tgcctgagtgaggacctatt

SEQ ID NO: 62467 - DNA, 20 bp, Artificial
  CRISPR gRNA sequence
cctgagtgaggacctattgc

SEQ ID NO: 62468 - DNA, 20 bp, Artificial
  CRISPR gRNA sequence
agtgaggacctattgctatt

SEQ ID NO: 62469 - DNA, 20 bp, Artificial
  CRISPR gRNA sequence
ttgctattagcccagttgag

SEQ ID NO: 62470 - DNA, 20 bp, Artificial
  CRISPR gRNA sequence
ctattagcccagttgaggag

SEQ ID NO: 62471 - DNA, 20 bp, Artificial
  CRISPR gRNA sequence
ttagcccagttgaggagaaa

SEQ ID NO: 62472 - DNA, 20 bp, Artificial
  CRISPR gRNA sequence
gcccagttgaggagaaatga

SEQ ID NO: 62473 - DNA, 20 bp, Artificial
  CRISPR gRNA sequence
aggagaaatgaccagtgggg

SEQ ID NO: 62474 - DNA, 20 bp, Artificial
  CRISPR gRNA sequence
acagtacatccaagtatgtc

SEQ ID NO: 62475 - DNA, 20 bp, Artificial
  CRISPR gRNA sequence
tactgcatgcccagggagca

SEQ ID NO: 62476 - DNA, 20 bp, Artificial
  CRISPR gRNA sequence
ctgcatgcccagggagcagc

SEQ ID NO: 62477 - DNA, 20 bp, Artificial
  CRISPR gRNA sequence
catgcccagggagcagctgg

SEQ ID NO: 62478 - DNA, 20 bp, Artificial
  CRISPR gRNA sequence
ggctctaaaccccaggacgc

SEQ ID NO: 62479 - DNA, 20 bp, Artificial
  CRISPR gRNA sequence
taaaccccaggacgcatagt

SEQ ID NO: 62480 - DNA, 20 bp, Artificial
  CRISPR gRNA sequence
aaccccaggacgcatagtac

SEQ ID NO: 62481 - DNA, 20 bp, Artificial
  CRISPR gRNA sequence
gcctcagcctctgggaattg

SEQ ID NO: 62482 - DNA, 20 bp, Artificial
  CRISPR gRNA sequence
agcctctgggaattgggaag

SEQ ID NO: 62483 - DNA, 20 bp, Artificial
  CRISPR gRNA sequence
tgggaattgggaaggctggc

SEQ ID NO: 62484 - DNA, 20 bp, Artificial
  CRISPR gRNA sequence
ggaattgggaaggctggctt

SEQ ID NO: 62485 - DNA, 20 bp, Artificial
  CRISPR gRNA sequence
ggaaggctggcttctgggtg

SEQ ID NO: 62486 - DNA, 20 bp, Artificial
  CRISPR gRNA sequence
gcttctgggtggacctccta

SEQ ID NO: 62487 - DNA, 20 bp, Artificial
  CRISPR gRNA sequence
ctgggtggacctcctactct

SEQ ID NO: 62488 - DNA, 20 bp, Artificial
  CRISPR gRNA sequence
tgggtggacctcctactctt

SEQ ID NO: 62489 - DNA, 20 bp, Artificial
  CRISPR gRNA sequence
ggtggacctcctactctttt

SEQ ID NO: 62490 - DNA, 20 bp, Artificial
  CRISPR gRNA sequence
ctactcttttcagagttaga

SEQ ID NO: 62491 - DNA, 20 bp, Artificial
  CRISPR gRNA sequence
ctcttttcagagttagaggt

SEQ ID NO: 62492 - DNA, 20 bp, Artificial
  CRISPR gRNA sequence
ttttcagagttagaggtgga

SEQ ID NO: 62493 - DNA, 20 bp, Artificial
  CRISPR gRNA sequence
ttcagagttagaggtggact

SEQ ID NO: 62494 - DNA, 20 bp, Artificial
  CRISPR gRNA sequence
tcagagttagaggtggactc

SEQ ID NO: 62495 - DNA, 20 bp, Artificial
  CRISPR gRNA sequence
cagagttagaggtggactct

SEQ ID NO: 62496 - DNA, 20 bp, Artificial
  CRISPR gRNA sequence
agagttagaggtggactctc

SEQ ID NO: 62497 - DNA, 20 bp, Artificial
  CRISPR gRNA sequence
gaggtggactctctggagtt

SEQ ID NO: 62498 - DNA, 20 bp, Artificial
  CRISPR gRNA sequence
tctggagttgtgaggataaa

SEQ ID NO: 62499 - DNA, 20 bp, Artificial
  CRISPR gRNA sequence
tggagttgtgaggataaaat

SEQ ID NO: 62500 - DNA, 20 bp, Artificial
  CRISPR gRNA sequence
gagttgtgaggataaaataa

SEQ ID NO: 62501 - DNA, 20 bp, Artificial
  CRISPR gRNA sequence
tgaggataaaataaggtata

SEQ ID NO: 62502 - DNA, 20 bp, Artificial
  CRISPR gRNA sequence
agacagtgcctaatacacag

SEQ ID NO: 62503 - DNA, 20 bp, Artificial
  CRISPR gRNA sequence
gacagtgcctaatacacagt

SEQ ID NO: 62504 - DNA, 20 bp, Artificial
  CRISPR gRNA sequence
atacacagtgagtgctttcc

SEQ ID NO: 62505 - DNA, 20 bp, Artificial
  CRISPR gRNA sequence
tccaagtgtgtactgctatg

SEQ ID NO: 62506 - DNA, 20 bp, Artificial
  CRISPR gRNA sequence
ccaagtgtgtactgctatga

SEQ ID NO: 62507 - DNA, 20 bp, Artificial
  CRISPR gRNA sequence
caagtgtgtactgctatgag

SEQ ID NO: 62508 - DNA, 20 bp, Artificial
  CRISPR gRNA sequence
ctatgaggaaggacatagta

SEQ ID NO: 62509 - DNA, 20 bp, Artificial
  CRISPR gRNA sequence
tgaggaaggacatagtacca

SEQ ID NO: 62510 - DNA, 20 bp, Artificial
  CRISPR gRNA sequence
gatgatggaccaccatttag

SEQ ID NO: 62511 - DNA, 20 bp, Artificial
  CRISPR gRNA sequence
agttggccaatccccaactg

SEQ ID NO: 62512 - DNA, 20 bp, Artificial
  CRISPR gRNA sequence
gttggccaatccccaactgt

SEQ ID NO: 62513 - DNA, 20 bp, Artificial
  CRISPR gRNA sequence
gccaatccccaactgttgga

SEQ ID NO: 62514 - DNA, 20 bp, Artificial
  CRISPR gRNA sequence
ttggacatttaggttgtttc

SEQ ID NO: 62515 - DNA, 20 bp, Artificial
  CRISPR gRNA sequence
gacatttaggttgtttccaa

SEQ ID NO: 62516 - DNA, 20 bp, Artificial
  CRISPR gRNA sequence
aggttgtttccaatttttaa

SEQ ID NO: 62517 - DNA, 20 bp, Artificial
  CRISPR gRNA sequence
ggttgtttccaatttttaat

SEQ ID NO: 62518 - DNA, 20 bp, Artificial
  CRISPR gRNA sequence
tttccaatttttaataatta

SEQ ID NO: 62519 - DNA, 20 bp, Artificial
  CRISPR gRNA sequence
ccaatttttaataattataa

SEQ ID NO: 62520 - DNA, 20 bp, Artificial
  CRISPR gRNA sequence
caatttttaataattataaa

SEQ ID NO: 62521 - DNA, 20 bp, Artificial
  CRISPR gRNA sequence
ttaataattataaataatct

SEQ ID NO: 62522 - DNA, 20 bp, Artificial
  CRISPR gRNA sequence
taataattataaataatctt

SEQ ID NO: 62523 - DNA, 20 bp, Artificial
  CRISPR gRNA sequence
aataattataaataatcttg

SEQ ID NO: 62524 - DNA, 20 bp, Artificial
  CRISPR gRNA sequence
ataattataaataatcttgc

SEQ ID NO: 62525 - DNA, 20 bp, Artificial
  CRISPR gRNA sequence
taaataatcttgcagtgagc

SEQ ID NO: 62526 - DNA, 20 bp, Artificial
  CRISPR gRNA sequence
gcagtgagcatctttgcaat

SEQ ID NO: 62527 - DNA, 20 bp, Artificial
  CRISPR gRNA sequence
cagtgagcatctttgcaatt

SEQ ID NO: 62528 - DNA, 20 bp, Artificial
  CRISPR gRNA sequence
tgcaattaaatattgtatat

SEQ ID NO: 62529 - DNA, 20 bp, Artificial
  CRISPR gRNA sequence
gcaattaaatattgtatata

SEQ ID NO: 62530 - DNA, 20 bp, Artificial
  CRISPR gRNA sequence
caattaaatattgtatatac

SEQ ID NO: 62531 - DNA, 20 bp, Artificial
  CRISPR gRNA sequence
aatattgtatatacgttcat

SEQ ID NO: 62532 - DNA, 20 bp, Artificial
  CRISPR gRNA sequence
tatatacgttcatgatcgtt

SEQ ID NO: 62533 - DNA, 20 bp, Artificial
  CRISPR gRNA sequence
atgatcgtttgccaaggtta

SEQ ID NO: 62534 - DNA, 20 bp, Artificial
  CRISPR gRNA sequence
gccaaggttagagtcctaga

SEQ ID NO: 62535 - DNA, 20 bp, Artificial
  CRISPR gRNA sequence
ccaaggttagagtcctagaa

SEQ ID NO: 62536 - DNA, 20 bp, Artificial
  CRISPR gRNA sequence
gagtcctagaaatggaatta

SEQ ID NO: 62537 - DNA, 20 bp, Artificial
  CRISPR gRNA sequence
gaaatggaattactgaatca

SEQ ID NO: 62538 - DNA, 20 bp, Artificial
  CRISPR gRNA sequence
ctgaatcaaaggaactgcac

SEQ ID NO: 62539 - DNA, 20 bp, Artificial
  CRISPR gRNA sequence
aatcaaaggaactgcacatt

SEQ ID NO: 62540 - DNA, 20 bp, Artificial
  CRISPR gRNA sequence
cacattatttaggcttttgc

SEQ ID NO: 62541 - DNA, 20 bp, Artificial
  CRISPR gRNA sequence
tttaggcttttgctgtgtaa

SEQ ID NO: 62542 - DNA, 20 bp, Artificial
  CRISPR gRNA sequence
aggcttttgctgtgtaaatg

SEQ ID NO: 62543 - DNA, 20 bp, Artificial
  CRISPR gRNA sequence
ggcttttgctgtgtaaatgc

SEQ ID NO: 62544 - DNA, 20 bp, Artificial
  CRISPR gRNA sequence
ttgctgtgtaaatgccccgt

SEQ ID NO: 62545 - DNA, 20 bp, Artificial
  CRISPR gRNA sequence
tgctgtgtaaatgccccgtg

SEQ ID NO: 62546 - DNA, 20 bp, Artificial
  CRISPR gRNA sequence
gctgtgtaaatgccccgtgc

SEQ ID NO: 62547 - DNA, 20 bp, Artificial
  CRISPR gRNA sequence
ctgtgtaaatgccccgtgcc

SEQ ID NO: 62548 - DNA, 20 bp, Artificial
  CRISPR gRNA sequence
tgtaaatgccccgtgccctc

SEQ ID NO: 62549 - DNA, 20 bp, Artificial
  CRISPR gRNA sequence
tattggtacttctagaagga

SEQ ID NO: 62550 - DNA, 20 bp, Artificial
  CRISPR gRNA sequence
ttggtacttctagaaggagg

SEQ ID NO: 62551 - DNA, 20 bp, Artificial
  CRISPR gRNA sequence
gtacttctagaaggaggtgg

SEQ ID NO: 62552 - DNA, 20 bp, Artificial
  CRISPR gRNA sequence
ctagaaggaggtggtttaag

SEQ ID NO: 62553 - DNA, 20 bp, Artificial
  CRISPR gRNA sequence
tagaaggaggtggtttaaga

SEQ ID NO: 62554 - DNA, 20 bp, Artificial
  CRISPR gRNA sequence
gaaggaggtggtttaagagt

SEQ ID NO: 62555 - DNA, 20 bp, Artificial
  CRISPR gRNA sequence
aagagttccagttcggccat

SEQ ID NO: 62556 - DNA, 20 bp, Artificial
  CRISPR gRNA sequence
agagttccagttcggccatc

SEQ ID NO: 62557 - DNA, 20 bp, Artificial
  CRISPR gRNA sequence
cagttcggccatcatgatgg

SEQ ID NO: 62558 - DNA, 20 bp, Artificial
  CRISPR gRNA sequence
ggccatcatgatggctcaca

SEQ ID NO: 62559 - DNA, 20 bp, Artificial
  CRISPR gRNA sequence
acacctgtaatcccagcact

SEQ ID NO: 62560 - DNA, 20 bp, Artificial
  CRISPR gRNA sequence
taatcccagcactttgggag

SEQ ID NO: 62561 - DNA, 20 bp, Artificial
  CRISPR gRNA sequence
tgggaggccgaggtgggcag

SEQ ID NO: 62562 - DNA, 20 bp, Artificial
  CRISPR gRNA sequence
gggaggccgaggtgggcaga

SEQ ID NO: 62563 - DNA, 20 bp, Artificial
  CRISPR gRNA sequence
ggaggccgaggtgggcagat

SEQ ID NO: 62564 - DNA, 20 bp, Artificial
  CRISPR gRNA sequence
aggtcaggagtttgagccca

SEQ ID NO: 62565 - DNA, 20 bp, Artificial
  CRISPR gRNA sequence
gagcccagcctggccaacat

SEQ ID NO: 62566 - DNA, 20 bp, Artificial
  CRISPR gRNA sequence
agcccagcctggccaacatg

SEQ ID NO: 62567 - DNA, 20 bp, Artificial
  CRISPR gRNA sequence
gccaacatggtgaaacccca

SEQ ID NO: 62568 - DNA, 20 bp, Artificial
  CRISPR gRNA sequence
tactaaaaattacaaaaatt

SEQ ID NO: 62569 - DNA, 20 bp, Artificial
  CRISPR gRNA sequence
aaaattacaaaaattagctg

SEQ ID NO: 62570 - DNA, 20 bp, Artificial
  CRISPR gRNA sequence
caaaaattagctgggcattg

SEQ ID NO: 62571 - DNA, 20 bp, Artificial
  CRISPR gRNA sequence
gctgggcattgtggtgtgca

SEQ ID NO: 62572 - DNA, 20 bp, Artificial
  CRISPR gRNA sequence
ggcattgtggtgtgcacctg

SEQ ID NO: 62573 - DNA, 20 bp, Artificial
  CRISPR gRNA sequence
tggtgtgcacctgtaatccc

SEQ ID NO: 62574 - DNA, 20 bp, Artificial
  CRISPR gRNA sequence
taatcccagctactcgggag

SEQ ID NO: 62575 - DNA, 20 bp, Artificial
  CRISPR gRNA sequence
ctcgggaggctgaggcagaa

SEQ ID NO: 62576 - DNA, 20 bp, Artificial
  CRISPR gRNA sequence
gggaggctgaggcagaagaa

SEQ ID NO: 62577 - DNA, 20 bp, Artificial
  CRISPR gRNA sequence
aggcagaagaatcgcttgaa

SEQ ID NO: 62578 - DNA, 20 bp, Artificial
  CRISPR gRNA sequence
gaacccgggaggcggaggct

SEQ ID NO: 62579 - DNA, 20 bp, Artificial
  CRISPR gRNA sequence
aacccgggaggcggaggctg

SEQ ID NO: 62580 - DNA, 20 bp, Artificial
  CRISPR gRNA sequence
cagtgagccgagattgcacc

SEQ ID NO: 62581 - DNA, 20 bp, Artificial
  CRISPR gRNA sequence
caccattgcactccagcctg

SEQ ID NO: 62582 - DNA, 20 bp, Artificial
  CRISPR gRNA sequence
cactccagcctgggtgacag

SEQ ID NO: 62583 - DNA, 20 bp, Artificial
  CRISPR gRNA sequence
cagcctgggtgacagagcga

SEQ ID NO: 62584 - DNA, 20 bp, Artificial
  CRISPR gRNA sequence
ggtgacagagcgagactctg

SEQ ID NO: 62585 - DNA, 20 bp, Artificial
  CRISPR gRNA sequence
tgtctcaaaaaaaaaagagt

SEQ ID NO: 62586 - DNA, 20 bp, Artificial
  CRISPR gRNA sequence
tctcaaaaaaaaaagagttc

SEQ ID NO: 62587 - DNA, 20 bp, Artificial
  CRISPR gRNA sequence
aaaaaaaaaagagttccagt

SEQ ID NO: 62588 - DNA, 20 bp, Artificial
  CRISPR gRNA sequence
cagttcagaagggaagaatt

SEQ ID NO: 62589 - DNA, 20 bp, Artificial
  CRISPR gRNA sequence
agaagggaagaatttgctta

SEQ ID NO: 62590 - DNA, 20 bp, Artificial
  CRISPR gRNA sequence
gcttagcaaaagaggtgatg

SEQ ID NO: 62591 - DNA, 20 bp, Artificial
  CRISPR gRNA sequence
cttagcaaaagaggtgatgg

SEQ ID NO: 62592 - DNA, 20 bp, Artificial
  CRISPR gRNA sequence
agcaaaagaggtgatggtct

SEQ ID NO: 62593 - DNA, 20 bp, Artificial
  CRISPR gRNA sequence
gcaaaagaggtgatggtctg

SEQ ID NO: 62594 - DNA, 20 bp, Artificial
  CRISPR gRNA sequence
tgttagctaggattagagtt

SEQ ID NO: 62595 - DNA, 20 bp, Artificial
  CRISPR gRNA sequence
gctaggattagagttcactg

SEQ ID NO: 62596 - DNA, 20 bp, Artificial
  CRISPR gRNA sequence
ggattagagttcactgtgag

SEQ ID NO: 62597 - DNA, 20 bp, Artificial
  CRISPR gRNA sequence
gagttcactgtgagtagcag

SEQ ID NO: 62598 - DNA, 20 bp, Artificial
  CRISPR gRNA sequence
actgtgagtagcagaaagca

SEQ ID NO: 62599 - DNA, 20 bp, Artificial
  CRISPR gRNA sequence
tgagtagcagaaagcactaa

SEQ ID NO: 62600 - DNA, 20 bp, Artificial
  CRISPR gRNA sequence
aacaacagtggcttaaccag

SEQ ID NO: 62601 - DNA, 20 bp, Artificial
  CRISPR gRNA sequence
aaccagaatggaagtgtatt

SEQ ID NO: 62602 - DNA, 20 bp, Artificial
  CRISPR gRNA sequence
accagaatggaagtgtattt

SEQ ID NO: 62603 - DNA, 20 bp, Artificial
  CRISPR gRNA sequence
ccctgccatgtaacagaagt

SEQ ID NO: 62604 - DNA, 20 bp, Artificial
  CRISPR gRNA sequence
cctgccatgtaacagaagtc

SEQ ID NO: 62605 - DNA, 20 bp, Artificial
  CRISPR gRNA sequence
ccatgtaacagaagtccaaa

SEQ ID NO: 62606 - DNA, 20 bp, Artificial
  CRISPR gRNA sequence
taccttccaccttcctcagt

SEQ ID NO: 62607 - DNA, 20 bp, Artificial
  CRISPR gRNA sequence
accttccaccttcctcagta

SEQ ID NO: 62608 - DNA, 20 bp, Artificial
  CRISPR gRNA sequence
ccttccaccttcctcagtat

SEQ ID NO: 62609 - DNA, 20 bp, Artificial
  CRISPR gRNA sequence
ccaccttcctcagtatgggt

SEQ ID NO: 62610 - DNA, 20 bp, Artificial
  CRISPR gRNA sequence
caccttcctcagtatgggtt

SEQ ID NO: 62611 - DNA, 20 bp, Artificial
  CRISPR gRNA sequence
cctcagtatgggttccacct

SEQ ID NO: 62612 - DNA, 20 bp, Artificial
  CRISPR gRNA sequence
ctcagtatgggttccacctc

SEQ ID NO: 62613 - DNA, 20 bp, Artificial
  CRISPR gRNA sequence
agtatgggttccacctcatg

SEQ ID NO: 62614 - DNA, 20 bp, Artificial
  CRISPR gRNA sequence
cacctcatgattcaatatgg

SEQ ID NO: 62615 - DNA, 20 bp, Artificial
  CRISPR gRNA sequence
atgattcaatatggctgccc

SEQ ID NO: 62616 - DNA, 20 bp, Artificial
  CRISPR gRNA sequence
aatatggctgcccaagatcc

SEQ ID NO: 62617 - DNA, 20 bp, Artificial
  CRISPR gRNA sequence
cccaagatccagccatccca

SEQ ID NO: 62618 - DNA, 20 bp, Artificial
  CRISPR gRNA sequence
ctacttacattccactggcc

SEQ ID NO: 62619 - DNA, 20 bp, Artificial
  CRISPR gRNA sequence
tacttacattccactggcca

SEQ ID NO: 62620 - DNA, 20 bp, Artificial
  CRISPR gRNA sequence
cttacattccactggccaaa

SEQ ID NO: 62621 - DNA, 20 bp, Artificial
  CRISPR gRNA sequence
acattccactggccaaatta

SEQ ID NO: 62622 - DNA, 20 bp, Artificial
  CRISPR gRNA sequence
cattccactggccaaattac

SEQ ID NO: 62623 - DNA, 20 bp, Artificial
  CRISPR gRNA sequence
cactggccaaattacatggc

SEQ ID NO: 62624 - DNA, 20 bp, Artificial
  CRISPR gRNA sequence
gccaaattacatggctacat

SEQ ID NO: 62625 - DNA, 20 bp, Artificial
  CRISPR gRNA sequence
catggctacatataactgca

SEQ ID NO: 62626 - DNA, 20 bp, Artificial
  CRISPR gRNA sequence
catataactgcaagggagac

SEQ ID NO: 62627 - DNA, 20 bp, Artificial
  CRISPR gRNA sequence
caagggagactgggatataa

SEQ ID NO: 62628 - DNA, 20 bp, Artificial
  CRISPR gRNA sequence
ggatataataatctattcta

SEQ ID NO: 62629 - DNA, 20 bp, Artificial
  CRISPR gRNA sequence
ttctagatgaccagagaata

SEQ ID NO: 62630 - DNA, 20 bp, Artificial
  CRISPR gRNA sequence
tagatgaccagagaatattt

SEQ ID NO: 62631 - DNA, 20 bp, Artificial
  CRISPR gRNA sequence
gatgaccagagaatatttag

SEQ ID NO: 62632 - DNA, 20 bp, Artificial
  CRISPR gRNA sequence
agtagttctaatactgagga

SEQ ID NO: 62633 - DNA, 20 bp, Artificial
  CRISPR gRNA sequence
gtagttctaatactgaggaa

SEQ ID NO: 62634 - DNA, 20 bp, Artificial
  CRISPR gRNA sequence
taatactgaggaagaaggga

SEQ ID NO: 62635 - DNA, 20 bp, Artificial
  CRISPR gRNA sequence
atactgaggaagaagggaag

SEQ ID NO: 62636 - DNA, 20 bp, Artificial
  CRISPR gRNA sequence
aggaagaagggaagaacaga

SEQ ID NO: 62637 - DNA, 20 bp, Artificial
  CRISPR gRNA sequence
tgggagacaactagttgtct

SEQ ID NO: 62638 - DNA, 20 bp, Artificial
  CRISPR gRNA sequence
gggagacaactagttgtctc

SEQ ID NO: 62639 - DNA, 20 bp, Artificial
  CRISPR gRNA sequence
ggagacaactagttgtctct

SEQ ID NO: 62640 - DNA, 20 bp, Artificial
  CRISPR gRNA sequence
gttgtctctgccatgaggtt

SEQ ID NO: 62641 - DNA, 20 bp, Artificial
  CRISPR gRNA sequence
tctctgccatgaggttagct

SEQ ID NO: 62642 - DNA, 20 bp, Artificial
  CRISPR gRNA sequence
tgccatgaggttagctcaga

SEQ ID NO: 62643 - DNA, 20 bp, Artificial
  CRISPR gRNA sequence
ccatgaggttagctcagact

SEQ ID NO: 62644 - DNA, 20 bp, Artificial
  CRISPR gRNA sequence
gctcagactgagagcagcat

SEQ ID NO: 62645 - DNA, 20 bp, Artificial
  CRISPR gRNA sequence
agactgagagcagcataaat

SEQ ID NO: 62646 - DNA, 20 bp, Artificial
  CRISPR gRNA sequence
agagcagcataaatggttca

SEQ ID NO: 62647 - DNA, 20 bp, Artificial
  CRISPR gRNA sequence
atggaaataagaatgagtaa

SEQ ID NO: 62648 - DNA, 20 bp, Artificial
  CRISPR gRNA sequence
acgggactgtccacagggga

SEQ ID NO: 62649 - DNA, 20 bp, Artificial
  CRISPR gRNA sequence
tccacaggggatgaacaaga

SEQ ID NO: 62650 - DNA, 20 bp, Artificial
  CRISPR gRNA sequence
cagagagccagggtgcaggc

SEQ ID NO: 62651 - DNA, 20 bp, Artificial
  CRISPR gRNA sequence
atctctggagctgatccctg

SEQ ID NO: 62652 - DNA, 20 bp, Artificial
  CRISPR gRNA sequence
tggagctgatccctgggcag

SEQ ID NO: 62653 - DNA, 20 bp, Artificial
  CRISPR gRNA sequence
gagctgatccctgggcagag

SEQ ID NO: 62654 - DNA, 20 bp, Artificial
  CRISPR gRNA sequence
atccctgggcagagacatca

SEQ ID NO: 62655 - DNA, 20 bp, Artificial
  CRISPR gRNA sequence
ggcagagacatcaagactcc

SEQ ID NO: 62656 - DNA, 20 bp, Artificial
  CRISPR gRNA sequence
catggagaggccacttccct

SEQ ID NO: 62657 - DNA, 20 bp, Artificial
  CRISPR gRNA sequence
ccctgcctattttatgtcgc

SEQ ID NO: 62658 - DNA, 20 bp, Artificial
  CRISPR gRNA sequence
cctgcctattttatgtcgct

SEQ ID NO: 62659 - DNA, 20 bp, Artificial
  CRISPR gRNA sequence
cctattttatgtcgctcaaa

SEQ ID NO: 62660 - DNA, 20 bp, Artificial
  CRISPR gRNA sequence
ttttatgtcgctcaaatgta

SEQ ID NO: 62661 - DNA, 20 bp, Artificial
  CRISPR gRNA sequence
tatgtcgctcaaatgtaggg

SEQ ID NO: 62662 - DNA, 20 bp, Artificial
  CRISPR gRNA sequence
atgtcgctcaaatgtaggga

SEQ ID NO: 62663 - DNA, 20 bp, Artificial
  CRISPR gRNA sequence
tgtcgctcaaatgtagggac

SEQ ID NO: 62664 - DNA, 20 bp, Artificial
  CRISPR gRNA sequence
aaatgtagggactggttctt

SEQ ID NO: 62665 - DNA, 20 bp, Artificial
  CRISPR gRNA sequence
gttcttgactgcttgacttc

SEQ ID NO: 62666 - DNA, 20 bp, Artificial
  CRISPR gRNA sequence
ttgactgcttgacttcccta

SEQ ID NO: 62667 - DNA, 20 bp, Artificial
  CRISPR gRNA sequence
gactgcttgacttccctaga

SEQ ID NO: 62668 - DNA, 20 bp, Artificial
  CRISPR gRNA sequence
actgcttgacttccctagaa

SEQ ID NO: 62669 - DNA, 20 bp, Artificial
  CRISPR gRNA sequence
cttgacttccctagaaactc

SEQ ID NO: 62670 - DNA, 20 bp, Artificial
  CRISPR gRNA sequence
gacttccctagaaactccct

SEQ ID NO: 62671 - DNA, 20 bp, Artificial
  CRISPR gRNA sequence
acttccctagaaactccctt

SEQ ID NO: 62672 - DNA, 20 bp, Artificial
  CRISPR gRNA sequence
ccctagaaactcccttatcc

SEQ ID NO: 62673 - DNA, 20 bp, Artificial
  CRISPR gRNA sequence
cctagaaactcccttatccc

SEQ ID NO: 62674 - DNA, 20 bp, Artificial
  CRISPR gRNA sequence
gaaactcccttatcccccaa

SEQ ID NO: 62675 - DNA, 20 bp, Artificial
  CRISPR gRNA sequence
ccttatcccccaactcacct

SEQ ID NO: 62676 - DNA, 20 bp, Artificial
  CRISPR gRNA sequence
atcccccaactcaccttccc

SEQ ID NO: 62677 - DNA, 20 bp, Artificial
  CRISPR gRNA sequence
tcccccaactcaccttcccc

SEQ ID NO: 62678 - DNA, 20 bp, Artificial
  CRISPR gRNA sequence
accttccccagatcaccttc

SEQ ID NO: 62679 - DNA, 20 bp, Artificial
  CRISPR gRNA sequence
ccccagatcaccttccccct

SEQ ID NO: 62680 - DNA, 20 bp, Artificial
  CRISPR gRNA sequence
cccagatcaccttcccccta

SEQ ID NO: 62681 - DNA, 20 bp, Artificial
  CRISPR gRNA sequence
ccccctagttcatctgtacc

SEQ ID NO: 62682 - DNA, 20 bp, Artificial
  CRISPR gRNA sequence
cccctagttcatctgtaccc

SEQ ID NO: 62683 - DNA, 20 bp, Artificial
  CRISPR gRNA sequence
gttcatctgtaccccactca

SEQ ID NO: 62684 - DNA, 20 bp, Artificial
  CRISPR gRNA sequence
atctgtaccccactcacctg

SEQ ID NO: 62685 - DNA, 20 bp, Artificial
  CRISPR gRNA sequence
taccccactcacctgccctc

SEQ ID NO: 62686 - DNA, 20 bp, Artificial
  CRISPR gRNA sequence
acctgccctcaggtcacctg

SEQ ID NO: 62687 - DNA, 20 bp, Artificial
  CRISPR gRNA sequence
ccctcaggtcacctgcccca

SEQ ID NO: 62688 - DNA, 20 bp, Artificial
  CRISPR gRNA sequence
aggtcacctgccccacaact

SEQ ID NO: 62689 - DNA, 20 bp, Artificial
  CRISPR gRNA sequence
ccccacaactcacctgttct

SEQ ID NO: 62690 - DNA, 20 bp, Artificial
  CRISPR gRNA sequence
acctgttctccatctaatct

SEQ ID NO: 62691 - DNA, 20 bp, Artificial
  CRISPR gRNA sequence
ttctccatctaatcttcctc

SEQ ID NO: 62692 - DNA, 20 bp, Artificial
  CRISPR gRNA sequence
tccatctaatcttcctccca

SEQ ID NO: 62693 - DNA, 20 bp, Artificial
  CRISPR gRNA sequence
catctaatcttcctcccagc

SEQ ID NO: 62694 - DNA, 20 bp, Artificial
  CRISPR gRNA sequence
atcttcctcccagctcccct

SEQ ID NO: 62695 - DNA, 20 bp, Artificial
  CRISPR gRNA sequence
cctcccagctcccctgtccc

SEQ ID NO: 62696 - DNA, 20 bp, Artificial
  CRISPR gRNA sequence
ctcccagctcccctgtcccc

SEQ ID NO: 62697 - DNA, 20 bp, Artificial
  CRISPR gRNA sequence
ccagctcccctgtcccccaa

SEQ ID NO: 62698 - DNA, 20 bp, Artificial
  CRISPR gRNA sequence
ccctgtcccccaaatcacct

SEQ ID NO: 62699 - DNA, 20 bp, Artificial
  CRISPR gRNA sequence
tcccccaaatcacctgcccc

SEQ ID NO: 62700 - DNA, 20 bp, Artificial
  CRISPR gRNA sequence
cccccaatttgcttgtcctc

SEQ ID NO: 62701 - DNA, 20 bp, Artificial
  CRISPR gRNA sequence
gcttgtcctccagctcaccg

SEQ ID NO: 62702 - DNA, 20 bp, Artificial
  CRISPR gRNA sequence
cttgtcctccagctcaccgg

SEQ ID NO: 62703 - DNA, 20 bp, Artificial
  CRISPR gRNA sequence
gtcctccagctcaccggttc

SEQ ID NO: 62704 - DNA, 20 bp, Artificial
  CRISPR gRNA sequence
tcctccagctcaccggttcc

SEQ ID NO: 62705 - DNA, 20 bp, Artificial
  CRISPR gRNA sequence
cagctcaccggttccccagc

SEQ ID NO: 62706 - DNA, 20 bp, Artificial
  CRISPR gRNA sequence
accggttccccagctcatct

SEQ ID NO: 62707 - DNA, 20 bp, Artificial
  CRISPR gRNA sequence
cccagctcatcttccttcca

SEQ ID NO: 62708 - DNA, 20 bp, Artificial
  CRISPR gRNA sequence
atcttccttccagttcccct

SEQ ID NO: 62709 - DNA, 20 bp, Artificial
  CRISPR gRNA sequence
ccttccagttcccctgtccc

SEQ ID NO: 62710 - DNA, 20 bp, Artificial
  CRISPR gRNA sequence
cttccagttcccctgtcccc

SEQ ID NO: 62711 - DNA, 20 bp, Artificial
  CRISPR gRNA sequence
ccagttcccctgtcccccag

SEQ ID NO: 62712 - DNA, 20 bp, Artificial
  CRISPR gRNA sequence
cagttcccctgtcccccagc

SEQ ID NO: 62713 - DNA, 20 bp, Artificial
  CRISPR gRNA sequence
ccctgtcccccagctcacct

SEQ ID NO: 62714 - DNA, 20 bp, Artificial
  CRISPR gRNA sequence
tcccccagctcacctgcctg

SEQ ID NO: 62715 - DNA, 20 bp, Artificial
  CRISPR gRNA sequence
acctgcctgccctcagttca

SEQ ID NO: 62716 - DNA, 20 bp, Artificial
  CRISPR gRNA sequence
cctgccctcagttcacctgt

SEQ ID NO: 62717 - DNA, 20 bp, Artificial
  CRISPR gRNA sequence
ccctcagttcacctgtcccc

SEQ ID NO: 62718 - DNA, 20 bp, Artificial
  CRISPR gRNA sequence
agttcacctgtcccccagtt

SEQ ID NO: 62719 - DNA, 20 bp, Artificial
  CRISPR gRNA sequence
acctgtcccccagttcatct

SEQ ID NO: 62720 - DNA, 20 bp, Artificial
  CRISPR gRNA sequence
tcccccagttcatcttcctc

SEQ ID NO: 62721 - DNA, 20 bp, Artificial
  CRISPR gRNA sequence
atcttcctcctagctcccct

SEQ ID NO: 62722 - DNA, 20 bp, Artificial
  CRISPR gRNA sequence
cctcctagctcccctgtccc

SEQ ID NO: 62723 - DNA, 20 bp, Artificial
  CRISPR gRNA sequence
ctcctagctcccctgtcccc

SEQ ID NO: 62724 - DNA, 20 bp, Artificial
  CRISPR gRNA sequence
ctagctcccctgtcccctag

SEQ ID NO: 62725 - DNA, 20 bp, Artificial
  CRISPR gRNA sequence
gctcccctgtcccctagctc

SEQ ID NO: 62726 - DNA, 20 bp, Artificial
  CRISPR gRNA sequence
ccctgtcccctagctcacct

SEQ ID NO: 62727 - DNA, 20 bp, Artificial
  CRISPR gRNA sequence
tcccctagctcacctgtgcc

SEQ ID NO: 62728 - DNA, 20 bp, Artificial
  CRISPR gRNA sequence
gctcacctgtgccccagctc

SEQ ID NO: 62729 - DNA, 20 bp, Artificial
  CRISPR gRNA sequence
acctgtgccccagctcccct

SEQ ID NO: 62730 - DNA, 20 bp, Artificial
  CRISPR gRNA sequence
tgccccagctcccctgtccc

SEQ ID NO: 62731 - DNA, 20 bp, Artificial
  CRISPR gRNA sequence
ccctgtcccccagttcccct

SEQ ID NO: 62732 - DNA, 20 bp, Artificial
  CRISPR gRNA sequence
tcccccagttcccctgtccc

SEQ ID NO: 62733 - DNA, 20 bp, Artificial
  CRISPR gRNA sequence
ccctgtcccccagctcacct

SEQ ID NO: 62734 - DNA, 20 bp, Artificial
  CRISPR gRNA sequence
tcccccagctcacctccccc

SEQ ID NO: 62735 - DNA, 20 bp, Artificial
  CRISPR gRNA sequence
acctccccctcagctctcct

SEQ ID NO: 62736 - DNA, 20 bp, Artificial
  CRISPR gRNA sequence
cccctcagctctcctgtccc

SEQ ID NO: 62737 - DNA, 20 bp, Artificial
  CRISPR gRNA sequence
agctctcctgtcccccagct

SEQ ID NO: 62738 - DNA, 20 bp, Artificial
  CRISPR gRNA sequence
tcctgtcccccagctcatct

SEQ ID NO: 62739 - DNA, 20 bp, Artificial
  CRISPR gRNA sequence
ctgtcccccagctcatctgc

SEQ ID NO: 62740 - DNA, 20 bp, Artificial
  CRISPR gRNA sequence
tcccccagctcatctgcccc

SEQ ID NO: 62741 - DNA, 20 bp, Artificial
  CRISPR gRNA sequence
atctgcccccagtttacctg

SEQ ID NO: 62742 - DNA, 20 bp, Artificial
  CRISPR gRNA sequence
cccccagtttacctgtcccc

SEQ ID NO: 62743 - DNA, 20 bp, Artificial
  CRISPR gRNA sequence
acctgtcccctagctcacct

SEQ ID NO: 62744 - DNA, 20 bp, Artificial
  CRISPR gRNA sequence
cctgtcccctagctcacctc

SEQ ID NO: 62745 - DNA, 20 bp, Artificial
  CRISPR gRNA sequence
tcccctagctcacctccccc

SEQ ID NO: 62746 - DNA, 20 bp, Artificial
  CRISPR gRNA sequence
gctcacctcccccccagttt

SEQ ID NO: 62747 - DNA, 20 bp, Artificial
  CRISPR gRNA sequence
acctcccccccagtttacct

SEQ ID NO: 62748 - DNA, 20 bp, Artificial
  CRISPR gRNA sequence
ccccccagtttacctgtccc

SEQ ID NO: 62749 - DNA, 20 bp, Artificial
  CRISPR gRNA sequence
acctgtcccccagctcacct

SEQ ID NO: 62750 - DNA, 20 bp, Artificial
  CRISPR gRNA sequence
cctgtcccccagctcacctc

SEQ ID NO: 62751 - DNA, 20 bp, Artificial
  CRISPR gRNA sequence
tcccccagctcacctccccc

SEQ ID NO: 62752 - DNA, 20 bp, Artificial
  CRISPR gRNA sequence
acctccccccagtttgcctg

SEQ ID NO: 62753 - DNA, 20 bp, Artificial
  CRISPR gRNA sequence
cccccagtttgcctgtcccc

SEQ ID NO: 62754 - DNA, 20 bp, Artificial
  CRISPR gRNA sequence
gcctgtcccccagctcaact

SEQ ID NO: 62755 - DNA, 20 bp, Artificial
  CRISPR gRNA sequence
cctgtcccccagctcaactc

SEQ ID NO: 62756 - DNA, 20 bp, Artificial
  CRISPR gRNA sequence
tcccccagctcaactccccc

SEQ ID NO: 62757 - DNA, 20 bp, Artificial
  CRISPR gRNA sequence
aactccccccaagttcccct

SEQ ID NO: 62758 - DNA, 20 bp, Artificial
  CRISPR gRNA sequence
cccccaagttcccctgtccc

SEQ ID NO: 62759 - DNA, 20 bp, Artificial
  CRISPR gRNA sequence
ccctgtccctcagctcatct

SEQ ID NO: 62760 - DNA, 20 bp, Artificial
  CRISPR gRNA sequence
tccctcagctcatctgcccc

SEQ ID NO: 62761 - DNA, 20 bp, Artificial
  CRISPR gRNA sequence
agctcatctgcccccagttt

SEQ ID NO: 62762 - DNA, 20 bp, Artificial
  CRISPR gRNA sequence
atctgcccccagtttacctg

SEQ ID NO: 62763 - DNA, 20 bp, Artificial
  CRISPR gRNA sequence
cccccagtttacctgtcccc

SEQ ID NO: 62764 - DNA, 20 bp, Artificial
  CRISPR gRNA sequence
acctgtccccctcaactcac

SEQ ID NO: 62765 - DNA, 20 bp, Artificial
  CRISPR gRNA sequence
cctgtccccctcaactcacc

SEQ ID NO: 62766 - DNA, 20 bp, Artificial
  CRISPR gRNA sequence
tccccctcaactcacctatc

SEQ ID NO: 62767 - DNA, 20 bp, Artificial
  CRISPR gRNA sequence
aactcacctatcttccctgt

SEQ ID NO: 62768 - DNA, 20 bp, Artificial
  CRISPR gRNA sequence
acctatcttccctgtccctc

SEQ ID NO: 62769 - DNA, 20 bp, Artificial
  CRISPR gRNA sequence
tcttccctgtccctccaggg

SEQ ID NO: 62770 - DNA, 20 bp, Artificial
  CRISPR gRNA sequence
ccctgtccctccagggctgg

SEQ ID NO: 62771 - DNA, 20 bp, Artificial
  CRISPR gRNA sequence
cctgtccctccagggctggc

SEQ ID NO: 62772 - DNA, 20 bp, Artificial
  CRISPR gRNA sequence
tccctccagggctggctcct

SEQ ID NO: 62773 - DNA, 20 bp, Artificial
  CRISPR gRNA sequence
cagggctggctcctcatgga

SEQ ID NO: 62774 - DNA, 20 bp, Artificial
  CRISPR gRNA sequence
gctcctcatggaccccgttg

SEQ ID NO: 62775 - DNA, 20 bp, Artificial
  CRISPR gRNA sequence
ctcatggaccccgttggcct

SEQ ID NO: 62776 - DNA, 20 bp, Artificial
  CRISPR gRNA sequence
atggaccccgttggcctcca

SEQ ID NO: 62777 - DNA, 20 bp, Artificial
  CRISPR gRNA sequence
gcctccagctcggcaacaag

SEQ ID NO: 62778 - DNA, 20 bp, Artificial
  CRISPR gRNA sequence
cagctcggcaacaagaacct

SEQ ID NO: 62779 - DNA, 20 bp, Artificial
  CRISPR gRNA sequence
ggcaacaagaacctgtggag

SEQ ID NO: 62780 - DNA, 20 bp, Artificial
  CRISPR gRNA sequence
tggagctgtcttgtgaggct

SEQ ID NO: 62781 - DNA, 20 bp, Artificial
  CRISPR gRNA sequence
tcttgtgaggctgctcacca

SEQ ID NO: 62782 - DNA, 20 bp, Artificial
  CRISPR gRNA sequence
gtgaggctgctcaccaaaga

SEQ ID NO: 62783 - DNA, 20 bp, Artificial
  CRISPR gRNA sequence
tgaggctgctcaccaaagac

SEQ ID NO: 62784 - DNA, 20 bp, Artificial
  CRISPR gRNA sequence
ctcaccaaagacccagaatg

SEQ ID NO: 62785 - DNA, 20 bp, Artificial
  CRISPR gRNA sequence
accaaagacccagaatggct

SEQ ID NO: 62786 - DNA, 20 bp, Artificial
  CRISPR gRNA sequence
aacgccaagatgaagttctt

SEQ ID NO: 62787 - DNA, 20 bp, Artificial
  CRISPR gRNA sequence
ttcctccccaacacggacct

SEQ ID NO: 62788 - DNA, 20 bp, Artificial
  CRISPR gRNA sequence
cctccccaacacggacctgg

SEQ ID NO: 62789 - DNA, 20 bp, Artificial
  CRISPR gRNA sequence
ctccccaacacggacctgga

SEQ ID NO: 62790 - DNA, 20 bp, Artificial
  CRISPR gRNA sequence
cccaacacggacctggattc

SEQ ID NO: 62791 - DNA, 20 bp, Artificial
  CRISPR gRNA sequence
gattccaggaacgagacctt

SEQ ID NO: 62792 - DNA, 20 bp, Artificial
  CRISPR gRNA sequence
caggaacgagaccttggacc

SEQ ID NO: 62793 - DNA, 20 bp, Artificial
  CRISPR gRNA sequence
ggaccctgaacagagagtca

SEQ ID NO: 62794 - DNA, 20 bp, Artificial
  CRISPR gRNA sequence
gaccctgaacagagagtcat

SEQ ID NO: 62795 - DNA, 20 bp, Artificial
  CRISPR gRNA sequence
aacagagagtcatcctgcaa

SEQ ID NO: 62796 - DNA, 20 bp, Artificial
  CRISPR gRNA sequence
caactcaacaagctgcatgt

SEQ ID NO: 62797 - DNA, 20 bp, Artificial
  CRISPR gRNA sequence
aacaagctgcatgtccaggg

SEQ ID NO: 62798 - DNA, 20 bp, Artificial
  CRISPR gRNA sequence
catgtccagggttcggacac

SEQ ID NO: 62799 - DNA, 20 bp, Artificial
  CRISPR gRNA sequence
ggacacctggcagtctttca

SEQ ID NO: 62800 - DNA, 20 bp, Artificial
  CRISPR gRNA sequence
gcagtctttcattcattgtg

SEQ ID NO: 62801 - DNA, 20 bp, Artificial
  CRISPR gRNA sequence
tcattcattgtgtgtgcatg

SEQ ID NO: 62802 - DNA, 20 bp, Artificial
  CRISPR gRNA sequence
cattcattgtgtgtgcatgc

SEQ ID NO: 62803 - DNA, 20 bp, Artificial
  CRISPR gRNA sequence
attcattgtgtgtgcatgca

SEQ ID NO: 62804 - DNA, 20 bp, Artificial
  CRISPR gRNA sequence
attgtgtgtgcatgcagctg

SEQ ID NO: 62805 - DNA, 20 bp, Artificial
  CRISPR gRNA sequence
tgtgtgcatgcagctggagg

SEQ ID NO: 62806 - DNA, 20 bp, Artificial
  CRISPR gRNA sequence
gaggtgcctctggacctgga

SEQ ID NO: 62807 - DNA, 20 bp, Artificial
  CRISPR gRNA sequence
tggacctggaggtgctgctg

SEQ ID NO: 62808 - DNA, 20 bp, Artificial
  CRISPR gRNA sequence
gacctggaggtgctgctgct

SEQ ID NO: 62809 - DNA, 20 bp, Artificial
  CRISPR gRNA sequence
gaggtgctgctgctgagtac

SEQ ID NO: 62810 - DNA, 20 bp, Artificial
  CRISPR gRNA sequence
ctgctgagtacttttggcta

SEQ ID NO: 62811 - DNA, 20 bp, Artificial
  CRISPR gRNA sequence
ctgagtacttttggctatga

SEQ ID NO: 62812 - DNA, 20 bp, Artificial
  CRISPR gRNA sequence
agtacttttggctatgatga

SEQ ID NO: 62813 - DNA, 20 bp, Artificial
  CRISPR gRNA sequence
ttggctatgatgatggtaag

SEQ ID NO: 62814 - DNA, 20 bp, Artificial
  CRISPR gRNA sequence
tggctatgatgatggtaagg

SEQ ID NO: 62815 - DNA, 20 bp, Artificial
  CRISPR gRNA sequence
ggctatgatgatggtaaggg

SEQ ID NO: 62816 - DNA, 20 bp, Artificial
  CRISPR gRNA sequence
gctatgatgatggtaagggc

SEQ ID NO: 62817 - DNA, 20 bp, Artificial
  CRISPR gRNA sequence
tgatgatggtaagggcaggt

SEQ ID NO: 62818 - DNA, 20 bp, Artificial
  CRISPR gRNA sequence
cgtcatggggagccgggagg

SEQ ID NO: 62819 - DNA, 20 bp, Artificial
  CRISPR gRNA sequence
agtcagagagagggtgtagc

SEQ ID NO: 62820 - DNA, 20 bp, Artificial
  CRISPR gRNA sequence
aactctatatttctggacac

SEQ ID NO: 62821 - DNA, 20 bp, Artificial
  CRISPR gRNA sequence
tatatttctggacacttccc

SEQ ID NO: 62822 - DNA, 20 bp, Artificial
  CRISPR gRNA sequence
tatttctggacacttcccag

SEQ ID NO: 62823 - DNA, 20 bp, Artificial
  CRISPR gRNA sequence
ctggacacttcccagaacaa

SEQ ID NO: 62824 - DNA, 20 bp, Artificial
  CRISPR gRNA sequence
tggacacttcccagaacaaa

SEQ ID NO: 62825 - DNA, 20 bp, Artificial
  CRISPR gRNA sequence
gacacttcccagaacaaatt

SEQ ID NO: 62826 - DNA, 20 bp, Artificial
  CRISPR gRNA sequence
cccagaacaaatttcctaat

SEQ ID NO: 62827 - DNA, 20 bp, Artificial
  CRISPR gRNA sequence
ccagaacaaatttcctaatg

SEQ ID NO: 62828 - DNA, 20 bp, Artificial
  CRISPR gRNA sequence
cctaatgcgcccaaatctgc

SEQ ID NO: 62829 - DNA, 20 bp, Artificial
  CRISPR gRNA sequence
ctaatgcgcccaaatctgct

SEQ ID NO: 62830 - DNA, 20 bp, Artificial
  CRISPR gRNA sequence
atgcgcccaaatctgctggg

SEQ ID NO: 62831 - DNA, 20 bp, Artificial
  CRISPR gRNA sequence
ctggggcctggaggacccct

SEQ ID NO: 62832 - DNA, 20 bp, Artificial
  CRISPR gRNA sequence
gggcctggaggacccctcct

SEQ ID NO: 62833 - DNA, 20 bp, Artificial
  CRISPR gRNA sequence
gaggacccctccttctacct

SEQ ID NO: 62834 - DNA, 20 bp, Artificial
  CRISPR gRNA sequence
cttctacctggcttcactcg

SEQ ID NO: 62835 - DNA, 20 bp, Artificial
  CRISPR gRNA sequence
ctacctggcttcactcgaat

SEQ ID NO: 62836 - DNA, 20 bp, Artificial
  CRISPR gRNA sequence
tacctggcttcactcgaatt

SEQ ID NO: 62837 - DNA, 20 bp, Artificial
  CRISPR gRNA sequence
cctggcttcactcgaattgc

SEQ ID NO: 62838 - DNA, 20 bp, Artificial
  CRISPR gRNA sequence
gcttcactcgaattgctcga

SEQ ID NO: 62839 - DNA, 20 bp, Artificial
  CRISPR gRNA sequence
cactcgaattgctcgaattg

SEQ ID NO: 62840 - DNA, 20 bp, Artificial
  CRISPR gRNA sequence
actcgaattgctcgaattgc

SEQ ID NO: 62841 - DNA, 20 bp, Artificial
  CRISPR gRNA sequence
gaattgctcgaattgctgag

SEQ ID NO: 62842 - DNA, 20 bp, Artificial
  CRISPR gRNA sequence
ctcgaattgctgagtgactg

SEQ ID NO: 62843 - DNA, 20 bp, Artificial
  CRISPR gRNA sequence
gaattgctgagtgactgctt

SEQ ID NO: 62844 - DNA, 20 bp, Artificial
  CRISPR gRNA sequence
ctgagtgactgcttccagcc

SEQ ID NO: 62845 - DNA, 20 bp, Artificial
  CRISPR gRNA sequence
agtgactgcttccagccaca

SEQ ID NO: 62846 - DNA, 20 bp, Artificial
  CRISPR gRNA sequence
cttccagccacaaaatccca

SEQ ID NO: 62847 - DNA, 20 bp, Artificial
  CRISPR gRNA sequence
ccagccacaaaatcccacat

SEQ ID NO: 62848 - DNA, 20 bp, Artificial
  CRISPR gRNA sequence
cagccacaaaatcccacata

SEQ ID NO: 62849 - DNA, 20 bp, Artificial
  CRISPR gRNA sequence
atttcttcttttttggcggg

SEQ ID NO: 62850 - DNA, 20 bp, Artificial
  CRISPR gRNA sequence
tttcttcttttttggcgggg

SEQ ID NO: 62851 - DNA, 20 bp, Artificial
  CRISPR gRNA sequence
cttcttttttggcgggggtg

SEQ ID NO: 62852 - DNA, 20 bp, Artificial
  CRISPR gRNA sequence
ttcttttttggcgggggtgg

SEQ ID NO: 62853 - DNA, 20 bp, Artificial
  CRISPR gRNA sequence
cttttttggcgggggtgggg

SEQ ID NO: 62854 - DNA, 20 bp, Artificial
  CRISPR gRNA sequence
ttttttggcgggggtggggg

SEQ ID NO: 62855 - DNA, 20 bp, Artificial
  CRISPR gRNA sequence
ttttggcgggggtggggggg

SEQ ID NO: 62856 - DNA, 20 bp, Artificial
  CRISPR gRNA sequence
tttggcgggggtgggggggt

SEQ ID NO: 62857 - DNA, 20 bp, Artificial
  CRISPR gRNA sequence
ttggcgggggtgggggggtg

SEQ ID NO: 62858 - DNA, 20 bp, Artificial
  CRISPR gRNA sequence
tggcgggggtgggggggtgt

SEQ ID NO: 62859 - DNA, 20 bp, Artificial
  CRISPR gRNA sequence
ggcgggggtgggggggtgtt

SEQ ID NO: 62860 - DNA, 20 bp, Artificial
  CRISPR gRNA sequence
gcgggggtgggggggtgttt

SEQ ID NO: 62861 - DNA, 20 bp, Artificial
  CRISPR gRNA sequence
tttgtttgttgttgctcttg

SEQ ID NO: 62862 - DNA, 20 bp, Artificial
  CRISPR gRNA sequence
ttgtttgttgttgctcttgt

SEQ ID NO: 62863 - DNA, 20 bp, Artificial
  CRISPR gRNA sequence
tgtttgttgttgctcttgtt

SEQ ID NO: 62864 - DNA, 20 bp, Artificial
  CRISPR gRNA sequence
gtttgttgttgctcttgttg

SEQ ID NO: 62865 - DNA, 20 bp, Artificial
  CRISPR gRNA sequence
tttgttgttgctcttgttgg

SEQ ID NO: 62866 - DNA, 20 bp, Artificial
  CRISPR gRNA sequence
gttgttgctcttgttgggtt

SEQ ID NO: 62867 - DNA, 20 bp, Artificial
  CRISPR gRNA sequence
ttgttgctcttgttgggttt

SEQ ID NO: 62868 - DNA, 20 bp, Artificial
  CRISPR gRNA sequence
ttgctcttgttgggttttgt

SEQ ID NO: 62869 - DNA, 20 bp, Artificial
  CRISPR gRNA sequence
ctcttgttgggttttgtttg

SEQ ID NO: 62870 - DNA, 20 bp, Artificial
  CRISPR gRNA sequence
ttgttgggttttgtttgttt

SEQ ID NO: 62871 - DNA, 20 bp, Artificial
  CRISPR gRNA sequence
gttgggttttgtttgtttgt

SEQ ID NO: 62872 - DNA, 20 bp, Artificial
  CRISPR gRNA sequence
ttgggttttgtttgtttgtt

SEQ ID NO: 62873 - DNA, 20 bp, Artificial
  CRISPR gRNA sequence
ggttttgtttgtttgttttt

SEQ ID NO: 62874 - DNA, 20 bp, Artificial
  CRISPR gRNA sequence
tgtttgtttgttttttattt

SEQ ID NO: 62875 - DNA, 20 bp, Artificial
  CRISPR gRNA sequence
gtttgtttgttttttatttt

SEQ ID NO: 62876 - DNA, 20 bp, Artificial
  CRISPR gRNA sequence
tttgtttgttttttattttt

SEQ ID NO: 62877 - DNA, 20 bp, Artificial
  CRISPR gRNA sequence
gtttgttttttatttttgag

SEQ ID NO: 62878 - DNA, 20 bp, Artificial
  CRISPR gRNA sequence
tttgttttttatttttgaga

SEQ ID NO: 62879 - DNA, 20 bp, Artificial
  CRISPR gRNA sequence
gttttttatttttgagacaa

SEQ ID NO: 62880 - DNA, 20 bp, Artificial
  CRISPR gRNA sequence
ttttttatttttgagacaag

SEQ ID NO: 62881 - DNA, 20 bp, Artificial
  CRISPR gRNA sequence
tttatttttgagacaaggtc

SEQ ID NO: 62882 - DNA, 20 bp, Artificial
  CRISPR gRNA sequence
ttatttttgagacaaggtct

SEQ ID NO: 62883 - DNA, 20 bp, Artificial
  CRISPR gRNA sequence
tatttttgagacaaggtctt

SEQ ID NO: 62884 - DNA, 20 bp, Artificial
  CRISPR gRNA sequence
atttttgagacaaggtcttg

SEQ ID NO: 62885 - DNA, 20 bp, Artificial
  CRISPR gRNA sequence
tttttgagacaaggtcttgc

SEQ ID NO: 62886 - DNA, 20 bp, Artificial
  CRISPR gRNA sequence
ttgagacaaggtcttgctct

SEQ ID NO: 62887 - DNA, 20 bp, Artificial
  CRISPR gRNA sequence
tgagacaaggtcttgctctg

SEQ ID NO: 62888 - DNA, 20 bp, Artificial
  CRISPR gRNA sequence
gagacaaggtcttgctctgt

SEQ ID NO: 62889 - DNA, 20 bp, Artificial
  CRISPR gRNA sequence
agacaaggtcttgctctgtt

SEQ ID NO: 62890 - DNA, 20 bp, Artificial
  CRISPR gRNA sequence
gctctgttgcctaggctgga

SEQ ID NO: 62891 - DNA, 20 bp, Artificial
  CRISPR gRNA sequence
ctctgttgcctaggctggag

SEQ ID NO: 62892 - DNA, 20 bp, Artificial
  CRISPR gRNA sequence
tgttgcctaggctggagtgc

SEQ ID NO: 62893 - DNA, 20 bp, Artificial
  CRISPR gRNA sequence
ttgcctaggctggagtgcag

SEQ ID NO: 62894 - DNA, 20 bp, Artificial
  CRISPR gRNA sequence
cctaggctggagtgcagtgg

SEQ ID NO: 62895 - DNA, 20 bp, Artificial
  CRISPR gRNA sequence
ggctggagtgcagtggcaca

SEQ ID NO: 62896 - DNA, 20 bp, Artificial
  CRISPR gRNA sequence
gagtgcagtggcacaatcat

SEQ ID NO: 62897 - DNA, 20 bp, Artificial
  CRISPR gRNA sequence
actacagcatccaactccag

SEQ ID NO: 62898 - DNA, 20 bp, Artificial
  CRISPR gRNA sequence
cagcatccaactccaggact

SEQ ID NO: 62899 - DNA, 20 bp, Artificial
  CRISPR gRNA sequence
caggactcaggtgatccttc

SEQ ID NO: 62900 - DNA, 20 bp, Artificial
  CRISPR gRNA sequence
aggtgatccttcccacttca

SEQ ID NO: 62901 - DNA, 20 bp, Artificial
  CRISPR gRNA sequence
cccacttcagcctcccaagt

SEQ ID NO: 62902 - DNA, 20 bp, Artificial
  CRISPR gRNA sequence
ccacttcagcctcccaagta

SEQ ID NO: 62903 - DNA, 20 bp, Artificial
  CRISPR gRNA sequence
cagcctcccaagtagctgag

SEQ ID NO: 62904 - DNA, 20 bp, Artificial
  CRISPR gRNA sequence
agcctcccaagtagctgaga

SEQ ID NO: 62905 - DNA, 20 bp, Artificial
  CRISPR gRNA sequence
ccaagtagctgagactacag

SEQ ID NO: 62906 - DNA, 20 bp, Artificial
  CRISPR gRNA sequence
agactacagtagaactatag

SEQ ID NO: 62907 - DNA, 20 bp, Artificial
  CRISPR gRNA sequence
cagtagaactataggtgcat

SEQ ID NO: 62908 - DNA, 20 bp, Artificial
  CRISPR gRNA sequence
taggtgcatgccaccacatt

SEQ ID NO: 62909 - DNA, 20 bp, Artificial
  CRISPR gRNA sequence
ggctaatttttcattctttt

SEQ ID NO: 62910 - DNA, 20 bp, Artificial
  CRISPR gRNA sequence
atttttcattcttttgtaga

SEQ ID NO: 62911 - DNA, 20 bp, Artificial
  CRISPR gRNA sequence
ttcattcttttgtagagaca

SEQ ID NO: 62912 - DNA, 20 bp, Artificial
  CRISPR gRNA sequence
tcattcttttgtagagacag

SEQ ID NO: 62913 - DNA, 20 bp, Artificial
  CRISPR gRNA sequence
cattcttttgtagagacagg

SEQ ID NO: 62914 - DNA, 20 bp, Artificial
  CRISPR gRNA sequence
attcttttgtagagacagga

SEQ ID NO: 62915 - DNA, 20 bp, Artificial
  CRISPR gRNA sequence
ttttgtagagacaggacatc

SEQ ID NO: 62916 - DNA, 20 bp, Artificial
  CRISPR gRNA sequence
ttgtagagacaggacatcac

SEQ ID NO: 62917 - DNA, 20 bp, Artificial
  CRISPR gRNA sequence
tgtagagacaggacatcact

SEQ ID NO: 62918 - DNA, 20 bp, Artificial
  CRISPR gRNA sequence
gtagagacaggacatcactg

SEQ ID NO: 62919 - DNA, 20 bp, Artificial
  CRISPR gRNA sequence
tagagacaggacatcactgt

SEQ ID NO: 62920 - DNA, 20 bp, Artificial
  CRISPR gRNA sequence
tgttgcccaggctggtcttg

SEQ ID NO: 62921 - DNA, 20 bp, Artificial
  CRISPR gRNA sequence
cccaggctggtcttgaactc

SEQ ID NO: 62922 - DNA, 20 bp, Artificial
  CRISPR gRNA sequence
gtcttgaactcctggcctta

SEQ ID NO: 62923 - DNA, 20 bp, Artificial
  CRISPR gRNA sequence
gaactcctggccttaagtga

SEQ ID NO: 62924 - DNA, 20 bp, Artificial
  CRISPR gRNA sequence
aactcctggccttaagtgat

SEQ ID NO: 62925 - DNA, 20 bp, Artificial
  CRISPR gRNA sequence
ctggccttaagtgatcctcc

SEQ ID NO: 62926 - DNA, 20 bp, Artificial
  CRISPR gRNA sequence
gccttaagtgatcctcctcc

SEQ ID NO: 62927 - DNA, 20 bp, Artificial
  CRISPR gRNA sequence
aagtgatcctcctcccttgg

SEQ ID NO: 62928 - DNA, 20 bp, Artificial
  CRISPR gRNA sequence
agtgatcctcctcccttggc

SEQ ID NO: 62929 - DNA, 20 bp, Artificial
  CRISPR gRNA sequence
ctcccttggcctcccaaagt

SEQ ID NO: 62930 - DNA, 20 bp, Artificial
  CRISPR gRNA sequence
ccttggcctcccaaagtgct

SEQ ID NO: 62931 - DNA, 20 bp, Artificial
  CRISPR gRNA sequence
ggcctcccaaagtgctggga

SEQ ID NO: 62932 - DNA, 20 bp, Artificial
  CRISPR gRNA sequence
gcctcccaaagtgctgggat

SEQ ID NO: 62933 - DNA, 20 bp, Artificial
  CRISPR gRNA sequence
ccaaagtgctgggattatag

SEQ ID NO: 62934 - DNA, 20 bp, Artificial
  CRISPR gRNA sequence
ggattatagatgtgagccat

SEQ ID NO: 62935 - DNA, 20 bp, Artificial
  CRISPR gRNA sequence
tagatgtgagccatcacacc

SEQ ID NO: 62936 - DNA, 20 bp, Artificial
  CRISPR gRNA sequence
gctagaggtgtttttgtttg

SEQ ID NO: 62937 - DNA, 20 bp, Artificial
  CRISPR gRNA sequence
gaggtgtttttgtttgtttg

SEQ ID NO: 62938 - DNA, 20 bp, Artificial
  CRISPR gRNA sequence
ttgtttgtttgtttgttttg

SEQ ID NO: 62939 - DNA, 20 bp, Artificial
  CRISPR gRNA sequence
tgtttgtttgtttgttttgc

SEQ ID NO: 62940 - DNA, 20 bp, Artificial
  CRISPR gRNA sequence
gtttgtttgtttgttttgca

SEQ ID NO: 62941 - DNA, 20 bp, Artificial
  CRISPR gRNA sequence
tttgtttgtttgttttgcaa

SEQ ID NO: 62942 - DNA, 20 bp, Artificial
  CRISPR gRNA sequence
gtttgtttgttttgcaacat

SEQ ID NO: 62943 - DNA, 20 bp, Artificial
  CRISPR gRNA sequence
tttgtttgttttgcaacatg

SEQ ID NO: 62944 - DNA, 20 bp, Artificial
  CRISPR gRNA sequence
gtttgttttgcaacatggtc

SEQ ID NO: 62945 - DNA, 20 bp, Artificial
  CRISPR gRNA sequence
tttgttttgcaacatggtca

SEQ ID NO: 62946 - DNA, 20 bp, Artificial
  CRISPR gRNA sequence
gttttgcaacatggtcagaa

SEQ ID NO: 62947 - DNA, 20 bp, Artificial
  CRISPR gRNA sequence
ttttgcaacatggtcagaaa

SEQ ID NO: 62948 - DNA, 20 bp, Artificial
  CRISPR gRNA sequence
tgcaacatggtcagaaacag

SEQ ID NO: 62949 - DNA, 20 bp, Artificial
  CRISPR gRNA sequence
gcaacatggtcagaaacagt

SEQ ID NO: 62950 - DNA, 20 bp, Artificial
  CRISPR gRNA sequence
caacatggtcagaaacagtg

SEQ ID NO: 62951 - DNA, 20 bp, Artificial
  CRISPR gRNA sequence
ctgccctctactgatccgtg

SEQ ID NO: 62952 - DNA, 20 bp, Artificial
  CRISPR gRNA sequence
tgccctctactgatccgtgg

SEQ ID NO: 62953 - DNA, 20 bp, Artificial
  CRISPR gRNA sequence
ccctctactgatccgtgggg

SEQ ID NO: 62954 - DNA, 20 bp, Artificial
  CRISPR gRNA sequence
tactgatccgtggggatttc

SEQ ID NO: 62955 - DNA, 20 bp, Artificial
  CRISPR gRNA sequence
ctgatccgtggggatttctt

SEQ ID NO: 62956 - DNA, 20 bp, Artificial
  CRISPR gRNA sequence
atccgtggggatttcttggg

SEQ ID NO: 62957 - DNA, 20 bp, Artificial
  CRISPR gRNA sequence
cttgggcaccttctgtttgc

SEQ ID NO: 62958 - DNA, 20 bp, Artificial
  CRISPR gRNA sequence
ttgggcaccttctgtttgca

SEQ ID NO: 62959 - DNA, 20 bp, Artificial
  CRISPR gRNA sequence
gggcaccttctgtttgcaca

SEQ ID NO: 62960 - DNA, 20 bp, Artificial
  CRISPR gRNA sequence
ggcaccttctgtttgcacag

SEQ ID NO: 62961 - DNA, 20 bp, Artificial
  CRISPR gRNA sequence
ctgtttgcacagcactgagg

SEQ ID NO: 62962 - DNA, 20 bp, Artificial
  CRISPR gRNA sequence
tgtttgcacagcactgaggg

SEQ ID NO: 62963 - DNA, 20 bp, Artificial
  CRISPR gRNA sequence
tttgcacagcactgagggga

SEQ ID NO: 62964 - DNA, 20 bp, Artificial
  CRISPR gRNA sequence
gcacagcactgaggggaaac

SEQ ID NO: 62965 - DNA, 20 bp, Artificial
  CRISPR gRNA sequence
cacagcactgaggggaaaca

SEQ ID NO: 62966 - DNA, 20 bp, Artificial
  CRISPR gRNA sequence
aggggaaacacaggacattg

SEQ ID NO: 62967 - DNA, 20 bp, Artificial
  CRISPR gRNA sequence
aggggcaacagcgtttttgg

SEQ ID NO: 62968 - DNA, 20 bp, Artificial
  CRISPR gRNA sequence
ttggagagaaaatgggaact

SEQ ID NO: 62969 - DNA, 20 bp, Artificial
  CRISPR gRNA sequence
tggagagaaaatgggaactc

SEQ ID NO: 62970 - DNA, 20 bp, Artificial
  CRISPR gRNA sequence
ggagagaaaatgggaactca

SEQ ID NO: 62971 - DNA, 20 bp, Artificial
  CRISPR gRNA sequence
gagagaaaatgggaactcac

SEQ ID NO: 62972 - DNA, 20 bp, Artificial
  CRISPR gRNA sequence
acttaagaaccctacttcaa

SEQ ID NO: 62973 - DNA, 20 bp, Artificial
  CRISPR gRNA sequence
aagaaccctacttcaaggca

SEQ ID NO: 62974 - DNA, 20 bp, Artificial
  CRISPR gRNA sequence
agaaccctacttcaaggcag

SEQ ID NO: 62975 - DNA, 20 bp, Artificial
  CRISPR gRNA sequence
cttcaaggcagagtgtggga

SEQ ID NO: 62976 - DNA, 20 bp, Artificial
  CRISPR gRNA sequence
caaggcagagtgtgggaatt

SEQ ID NO: 62977 - DNA, 20 bp, Artificial
  CRISPR gRNA sequence
aaggcagagtgtgggaattg

SEQ ID NO: 62978 - DNA, 20 bp, Artificial
  CRISPR gRNA sequence
cggggggcggggcggcgcat

SEQ ID NO: 62979 - DNA, 20 bp, Artificial
  CRISPR gRNA sequence
tgcacacacatacataaact

SEQ ID NO: 62980 - DNA, 20 bp, Artificial
  CRISPR gRNA sequence
gcatgcacttgcatatacac

SEQ ID NO: 62981 - DNA, 20 bp, Artificial
  CRISPR gRNA sequence
catgcacttgcatatacaca

SEQ ID NO: 62982 - DNA, 20 bp, Artificial
  CRISPR gRNA sequence
gcatatacacacatttctgc

SEQ ID NO: 62983 - DNA, 20 bp, Artificial
  CRISPR gRNA sequence
catatacacacatttctgcc

SEQ ID NO: 62984 - DNA, 20 bp, Artificial
  CRISPR gRNA sequence
ctgcccagcactgccttcaa

SEQ ID NO: 62985 - DNA, 20 bp, Artificial
  CRISPR gRNA sequence
tgcccagcactgccttcaaa

SEQ ID NO: 62986 - DNA, 20 bp, Artificial
  CRISPR gRNA sequence
cccagcactgccttcaaagc

SEQ ID NO: 62987 - DNA, 20 bp, Artificial
  CRISPR gRNA sequence
ccttcaaagctcaccaccac

SEQ ID NO: 62988 - DNA, 20 bp, Artificial
  CRISPR gRNA sequence
caaagctcaccaccacattt

SEQ ID NO: 62989 - DNA, 20 bp, Artificial
  CRISPR gRNA sequence
aaagctcaccaccacatttt

SEQ ID NO: 62990 - DNA, 20 bp, Artificial
  CRISPR gRNA sequence
accaccacattttctccaca

SEQ ID NO: 62991 - DNA, 20 bp, Artificial
  CRISPR gRNA sequence
tctccacaacagataactga

SEQ ID NO: 62992 - DNA, 20 bp, Artificial
  CRISPR gRNA sequence
ctccacaacagataactgag

SEQ ID NO: 62993 - DNA, 20 bp, Artificial
  CRISPR gRNA sequence
tccacaacagataactgagt

SEQ ID NO: 62994 - DNA, 20 bp, Artificial
  CRISPR gRNA sequence
cacaacagataactgagtgt

SEQ ID NO: 62995 - DNA, 20 bp, Artificial
  CRISPR gRNA sequence
agtgttccatttagttctcc

SEQ ID NO: 62996 - DNA, 20 bp, Artificial
  CRISPR gRNA sequence
catttagttctcccttgctg

SEQ ID NO: 62997 - DNA, 20 bp, Artificial
  CRISPR gRNA sequence
agttctcccttgctgggtat

SEQ ID NO: 62998 - DNA, 20 bp, Artificial
  CRISPR gRNA sequence
gttctcccttgctgggtatc

SEQ ID NO: 62999 - DNA, 20 bp, Artificial
  CRISPR gRNA sequence
tcccttgctgggtatctccc

SEQ ID NO: 63000 - DNA, 20 bp, Artificial
  CRISPR gRNA sequence
ccttgctgggtatctccctg

SEQ ID NO: 63001 - DNA, 20 bp, Artificial
  CRISPR gRNA sequence
gctgggtatctccctgtgag

SEQ ID NO: 63002 - DNA, 20 bp, Artificial
  CRISPR gRNA sequence
ctgggtatctccctgtgaga

SEQ ID NO: 63003 - DNA, 20 bp, Artificial
  CRISPR gRNA sequence
ggtatctccctgtgagatga

SEQ ID NO: 63004 - DNA, 20 bp, Artificial
  CRISPR gRNA sequence
cctgtgagatgagccctgag

SEQ ID NO: 63005 - DNA, 20 bp, Artificial
  CRISPR gRNA sequence
tgagatgagccctgagccag

SEQ ID NO: 63006 - DNA, 20 bp, Artificial
  CRISPR gRNA sequence
agccaggcgccaggccagag

SEQ ID NO: 63007 - DNA, 20 bp, Artificial
  CRISPR gRNA sequence
gtccccagcatccctcgaca

SEQ ID NO: 63008 - DNA, 20 bp, Artificial
  CRISPR gRNA sequence
gacagccccataccacatta

SEQ ID NO: 63009 - DNA, 20 bp, Artificial
  CRISPR gRNA sequence
tactctcccctctcttgcag

SEQ ID NO: 63010 - DNA, 20 bp, Artificial
  CRISPR gRNA sequence
tcccctctcttgcagggttc

SEQ ID NO: 63011 - DNA, 20 bp, Artificial
  CRISPR gRNA sequence
ccctctcttgcagggttcac

SEQ ID NO: 63012 - DNA, 20 bp, Artificial
  CRISPR gRNA sequence
tcttgcagggttcaccagcc

SEQ ID NO: 63013 - DNA, 20 bp, Artificial
  CRISPR gRNA sequence
ttgcagggttcaccagccag

SEQ ID NO: 63014 - DNA, 20 bp, Artificial
  CRISPR gRNA sequence
gcagggttcaccagccagct

SEQ ID NO: 63015 - DNA, 20 bp, Artificial
  CRISPR gRNA sequence
cagggttcaccagccagctg

SEQ ID NO: 63016 - DNA, 20 bp, Artificial
  CRISPR gRNA sequence
accagccagctgggagctga

SEQ ID NO: 63017 - DNA, 20 bp, Artificial
  CRISPR gRNA sequence
ggagctgaggggaaaagcca

SEQ ID NO: 63018 - DNA, 20 bp, Artificial
  CRISPR gRNA sequence
aggggaaaagccaacctgaa

SEQ ID NO: 63019 - DNA, 20 bp, Artificial
  CRISPR gRNA sequence
aatctcagctccaccatggt

SEQ ID NO: 63020 - DNA, 20 bp, Artificial
  CRISPR gRNA sequence
agctccaccatggtgaggac

SEQ ID NO: 63021 - DNA, 20 bp, Artificial
  CRISPR gRNA sequence
caccatggtgaggactggag

SEQ ID NO: 63022 - DNA, 20 bp, Artificial
  CRISPR gRNA sequence
gagttggggggtgggaaggg

SEQ ID NO: 63023 - DNA, 20 bp, Artificial
  CRISPR gRNA sequence
gggggtgggaagggggtggt

SEQ ID NO: 63024 - DNA, 20 bp, Artificial
  CRISPR gRNA sequence
tgaagtccccacttccaagc

SEQ ID NO: 63025 - DNA, 20 bp, Artificial
  CRISPR gRNA sequence
ccaagctggaggaggctgtg

SEQ ID NO: 63026 - DNA, 20 bp, Artificial
  CRISPR gRNA sequence
caagctggaggaggctgtgg

SEQ ID NO: 63027 - DNA, 20 bp, Artificial
  CRISPR gRNA sequence
gaggaggctgtggaggctgt

SEQ ID NO: 63028 - DNA, 20 bp, Artificial
  CRISPR gRNA sequence
tggaggctgtggtggctggt

SEQ ID NO: 63029 - DNA, 20 bp, Artificial
  CRISPR gRNA sequence
tggtggctggtcacagccat

SEQ ID NO: 63030 - DNA, 20 bp, Artificial
  CRISPR gRNA sequence
gtcacagccatttctcatag

SEQ ID NO: 63031 - DNA, 20 bp, Artificial
  CRISPR gRNA sequence
ctcataggccatgctcttcg

SEQ ID NO: 63032 - DNA, 20 bp, Artificial
  CRISPR gRNA sequence
tcataggccatgctcttcgt

SEQ ID NO: 63033 - DNA, 20 bp, Artificial
  CRISPR gRNA sequence
ataggccatgctcttcgtct

SEQ ID NO: 63034 - DNA, 20 bp, Artificial
  CRISPR gRNA sequence
ttcgtctgtccctgacccat

SEQ ID NO: 63035 - DNA, 20 bp, Artificial
  CRISPR gRNA sequence
cgtctgtccctgacccattt

SEQ ID NO: 63036 - DNA, 20 bp, Artificial
  CRISPR gRNA sequence
gtctgtccctgacccatttg

SEQ ID NO: 63037 - DNA, 20 bp, Artificial
  CRISPR gRNA sequence
tccctgacccatttgcaagt

SEQ ID NO: 63038 - DNA, 20 bp, Artificial
  CRISPR gRNA sequence
acccatttgcaagtgtgtca

SEQ ID NO: 63039 - DNA, 20 bp, Artificial
  CRISPR gRNA sequence
gcaagtgtgtcaagccccta

SEQ ID NO: 63040 - DNA, 20 bp, Artificial
  CRISPR gRNA sequence
caagtgtgtcaagcccctaa

SEQ ID NO: 63041 - DNA, 20 bp, Artificial
  CRISPR gRNA sequence
actgtgtctcccagccccac

SEQ ID NO: 63042 - DNA, 20 bp, Artificial
  CRISPR gRNA sequence
tgtctcccagccccacctcc

SEQ ID NO: 63043 - DNA, 20 bp, Artificial
  CRISPR gRNA sequence
ccagccccacctcctcctgc

SEQ ID NO: 63044 - DNA, 20 bp, Artificial
  CRISPR gRNA sequence
ctcctgcagtgactttcaag

SEQ ID NO: 63045 - DNA, 20 bp, Artificial
  CRISPR gRNA sequence
ctgcagtgactttcaaggct

SEQ ID NO: 63046 - DNA, 20 bp, Artificial
  CRISPR gRNA sequence
cagtgactttcaaggcttta

SEQ ID NO: 63047 - DNA, 20 bp, Artificial
  CRISPR gRNA sequence
tcaaggctttagcttgtccc

SEQ ID NO: 63048 - DNA, 20 bp, Artificial
  CRISPR gRNA sequence
caaggctttagcttgtcccg

SEQ ID NO: 63049 - DNA, 20 bp, Artificial
  CRISPR gRNA sequence
aaggctttagcttgtcccgt

SEQ ID NO: 63050 - DNA, 20 bp, Artificial
  CRISPR gRNA sequence
tagcttgtcccgttaccaat

SEQ ID NO: 63051 - DNA, 20 bp, Artificial
  CRISPR gRNA sequence
agcttgtcccgttaccaatt

SEQ ID NO: 63052 - DNA, 20 bp, Artificial
  CRISPR gRNA sequence
gcttgtcccgttaccaattc

SEQ ID NO: 63053 - DNA, 20 bp, Artificial
  CRISPR gRNA sequence
gtcccgttaccaattctaaa

SEQ ID NO: 63054 - DNA, 20 bp, Artificial
  CRISPR gRNA sequence
tcccgttaccaattctaaag

SEQ ID NO: 63055 - DNA, 20 bp, Artificial
  CRISPR gRNA sequence
ccaattctaaagggtctaac

SEQ ID NO: 63056 - DNA, 20 bp, Artificial
  CRISPR gRNA sequence
taaagggtctaacctggaac

SEQ ID NO: 63057 - DNA, 20 bp, Artificial
  CRISPR gRNA sequence
aagggtctaacctggaaccc

SEQ ID NO: 63058 - DNA, 20 bp, Artificial
  CRISPR gRNA sequence
acctggaacccctcaggaag

SEQ ID NO: 63059 - DNA, 20 bp, Artificial
  CRISPR gRNA sequence
gaacccctcaggaagcctgt

SEQ ID NO: 63060 - DNA, 20 bp, Artificial
  CRISPR gRNA sequence
aggaagcctgttctcacttt

SEQ ID NO: 63061 - DNA, 20 bp, Artificial
  CRISPR gRNA sequence
ttctcactttcctgcccgca

SEQ ID NO: 63062 - DNA, 20 bp, Artificial
  CRISPR gRNA sequence
tcactttcctgcccgcaacc

SEQ ID NO: 63063 - DNA, 20 bp, Artificial
  CRISPR gRNA sequence
actttcctgcccgcaacccg

SEQ ID NO: 63064 - DNA, 20 bp, Artificial
  CRISPR gRNA sequence
tcctgcccgcaacccgcagg

SEQ ID NO: 63065 - DNA, 20 bp, Artificial
  CRISPR gRNA sequence
cctgcccgcaacccgcaggg

SEQ ID NO: 63066 - DNA, 20 bp, Artificial
  CRISPR gRNA sequence
ctgcccgcaacccgcagggc

SEQ ID NO: 63067 - DNA, 20 bp, Artificial
  CRISPR gRNA sequence
cccgcaacccgcagggcctc

SEQ ID NO: 63068 - DNA, 20 bp, Artificial
  CRISPR gRNA sequence
atctcccagccccaaagtgt

SEQ ID NO: 63069 - DNA, 20 bp, Artificial
  CRISPR gRNA sequence
ccagccccaaagtgtcaggc

SEQ ID NO: 63070 - DNA, 20 bp, Artificial
  CRISPR gRNA sequence
catggggaagccctaaccac

SEQ ID NO: 63071 - DNA, 20 bp, Artificial
  CRISPR gRNA sequence
atggggaagccctaaccacc

SEQ ID NO: 63072 - DNA, 20 bp, Artificial
  CRISPR gRNA sequence
accaccccctcccgacttgt

SEQ ID NO: 63073 - DNA, 20 bp, Artificial
  CRISPR gRNA sequence
ccgacttgtacaccttggac

SEQ ID NO: 63074 - DNA, 20 bp, Artificial
  CRISPR gRNA sequence
gtacaccttggacttgacac

SEQ ID NO: 63075 - DNA, 20 bp, Artificial
  CRISPR gRNA sequence
tacaccttggacttgacact

SEQ ID NO: 63076 - DNA, 20 bp, Artificial
  CRISPR gRNA sequence
ggacttgacactcacccaca

SEQ ID NO: 63077 - DNA, 20 bp, Artificial
  CRISPR gRNA sequence
gacttgacactcacccacag

SEQ ID NO: 63078 - DNA, 20 bp, Artificial
  CRISPR gRNA sequence
gacactcacccacagctgct

SEQ ID NO: 63079 - DNA, 20 bp, Artificial
  CRISPR gRNA sequence
acactcacccacagctgctg

SEQ ID NO: 63080 - DNA, 20 bp, Artificial
  CRISPR gRNA sequence
acccacagctgctgtcttca

SEQ ID NO: 63081 - DNA, 20 bp, Artificial
  CRISPR gRNA sequence
ctgtcttcagcgggggagcc

SEQ ID NO: 63082 - DNA, 20 bp, Artificial
  CRISPR gRNA sequence
tcttcagcgggggagccttt

SEQ ID NO: 63083 - DNA, 20 bp, Artificial
  CRISPR gRNA sequence
cagcgggggagcctttggct

SEQ ID NO: 63084 - DNA, 20 bp, Artificial
  CRISPR gRNA sequence
agcgggggagcctttggctg

SEQ ID NO: 63085 - DNA, 20 bp, Artificial
  CRISPR gRNA sequence
tggctgattttctgaaggag

SEQ ID NO: 63086 - DNA, 20 bp, Artificial
  CRISPR gRNA sequence
ggctgattttctgaaggagc

SEQ ID NO: 63087 - DNA, 20 bp, Artificial
  CRISPR gRNA sequence
gctgattttctgaaggagct

SEQ ID NO: 63088 - DNA, 20 bp, Artificial
  CRISPR gRNA sequence
attttctgaaggagctcgga

SEQ ID NO: 63089 - DNA, 20 bp, Artificial
  CRISPR gRNA sequence
tctgaaggagctcggaaggg

SEQ ID NO: 63090 - DNA, 20 bp, Artificial
  CRISPR gRNA sequence
ctgaaggagctcggaagggc

SEQ ID NO: 63091 - DNA, 20 bp, Artificial
  CRISPR gRNA sequence
tgaaggagctcggaagggcc

SEQ ID NO: 63092 - DNA, 20 bp, Artificial
  CRISPR gRNA sequence
aaggagctcggaagggccag

SEQ ID NO: 63093 - DNA, 20 bp, Artificial
  CRISPR gRNA sequence
ggaagggccagtgattaaat

SEQ ID NO: 63094 - DNA, 20 bp, Artificial
  CRISPR gRNA sequence
aataatgaccacctactgat

SEQ ID NO: 63095 - DNA, 20 bp, Artificial
  CRISPR gRNA sequence
ctgattcgtgggtcacactt

SEQ ID NO: 63096 - DNA, 20 bp, Artificial
  CRISPR gRNA sequence
attcgtgggtcacactttca

SEQ ID NO: 63097 - DNA, 20 bp, Artificial
  CRISPR gRNA sequence
gtgggtcacactttcatctc

SEQ ID NO: 63098 - DNA, 20 bp, Artificial
  CRISPR gRNA sequence
tcatctcagcaccttgattt

SEQ ID NO: 63099 - DNA, 20 bp, Artificial
  CRISPR gRNA sequence
catctcagcaccttgatttc

SEQ ID NO: 63100 - DNA, 20 bp, Artificial
  CRISPR gRNA sequence
atctcagcaccttgatttct

SEQ ID NO: 63101 - DNA, 20 bp, Artificial
  CRISPR gRNA sequence
agcaccttgatttctacaga

SEQ ID NO: 63102 - DNA, 20 bp, Artificial
  CRISPR gRNA sequence
gatttctacagaagcattga

SEQ ID NO: 63103 - DNA, 20 bp, Artificial
  CRISPR gRNA sequence
atttctacagaagcattgac

SEQ ID NO: 63104 - DNA, 20 bp, Artificial
  CRISPR gRNA sequence
ctacagaagcattgacttta

SEQ ID NO: 63105 - DNA, 20 bp, Artificial
  CRISPR gRNA sequence
tacagaagcattgactttac

SEQ ID NO: 63106 - DNA, 20 bp, Artificial
  CRISPR gRNA sequence
cagaagcattgactttactt

SEQ ID NO: 63107 - DNA, 20 bp, Artificial
  CRISPR gRNA sequence
actttacttatcgctgtgca

SEQ ID NO: 63108 - DNA, 20 bp, Artificial
  CRISPR gRNA sequence
tacttatcgctgtgcatggc

SEQ ID NO: 63109 - DNA, 20 bp, Artificial
  CRISPR gRNA sequence
acttatcgctgtgcatggca

SEQ ID NO: 63110 - DNA, 20 bp, Artificial
  CRISPR gRNA sequence
cttatcgctgtgcatggcag

SEQ ID NO: 63111 - DNA, 20 bp, Artificial
  CRISPR gRNA sequence
atcgctgtgcatggcagtaa

SEQ ID NO: 63112 - DNA, 20 bp, Artificial
  CRISPR gRNA sequence
tcgctgtgcatggcagtaat

SEQ ID NO: 63113 - DNA, 20 bp, Artificial
  CRISPR gRNA sequence
tgcatggcagtaatgccaac

SEQ ID NO: 63114 - DNA, 20 bp, Artificial
  CRISPR gRNA sequence
taacctcagctccccagtga

SEQ ID NO: 63115 - DNA, 20 bp, Artificial
  CRISPR gRNA sequence
agctccccagtgaatcaaaa

SEQ ID NO: 63116 - DNA, 20 bp, Artificial
  CRISPR gRNA sequence
cccagtgaatcaaaactgtc

SEQ ID NO: 63117 - DNA, 20 bp, Artificial
  CRISPR gRNA sequence
tccaagtccctggtccaata

SEQ ID NO: 63118 - DNA, 20 bp, Artificial
  CRISPR gRNA sequence
gtccaataggcccgcatcac

SEQ ID NO: 63119 - DNA, 20 bp, Artificial
  CRISPR gRNA sequence
agctggcatcattatctcat

SEQ ID NO: 63120 - DNA, 20 bp, Artificial
  CRISPR gRNA sequence
gcatcattatctcatggctg

SEQ ID NO: 63121 - DNA, 20 bp, Artificial
  CRISPR gRNA sequence
tctcatggctgtaaccagat

SEQ ID NO: 63122 - DNA, 20 bp, Artificial
  CRISPR gRNA sequence
atggctgtaaccagatctga

SEQ ID NO: 63123 - DNA, 20 bp, Artificial
  CRISPR gRNA sequence
taaccagatctgattgatat

SEQ ID NO: 63124 - DNA, 20 bp, Artificial
  CRISPR gRNA sequence
attgatatttggccagtgag

SEQ ID NO: 63125 - DNA, 20 bp, Artificial
  CRISPR gRNA sequence
atatttggccagtgagtccc

SEQ ID NO: 63126 - DNA, 20 bp, Artificial
  CRISPR gRNA sequence
ggccagtgagtcccttttta

SEQ ID NO: 63127 - DNA, 20 bp, Artificial
  CRISPR gRNA sequence
gccagtgagtccctttttaa

SEQ ID NO: 63128 - DNA, 20 bp, Artificial
  CRISPR gRNA sequence
tttaatataggatttgttaa

SEQ ID NO: 63129 - DNA, 20 bp, Artificial
  CRISPR gRNA sequence
ttaatataggatttgttaag

SEQ ID NO: 63130 - DNA, 20 bp, Artificial
  CRISPR gRNA sequence
taatataggatttgttaaga

SEQ ID NO: 63131 - DNA, 20 bp, Artificial
  CRISPR gRNA sequence
aatataggatttgttaagat

SEQ ID NO: 63132 - DNA, 20 bp, Artificial
  CRISPR gRNA sequence
atataggatttgttaagata

SEQ ID NO: 63133 - DNA, 20 bp, Artificial
  CRISPR gRNA sequence
gttaagatattgaagtgctc

SEQ ID NO: 63134 - DNA, 20 bp, Artificial
  CRISPR gRNA sequence
ttaagatattgaagtgctct

SEQ ID NO: 63135 - DNA, 20 bp, Artificial
  CRISPR gRNA sequence
agatattgaagtgctctcga

SEQ ID NO: 63136 - DNA, 20 bp, Artificial
  CRISPR gRNA sequence
aagtgctctcgaactggttc

SEQ ID NO: 63137 - DNA, 20 bp, Artificial
  CRISPR gRNA sequence
tcgaactggttccagcctcc

SEQ ID NO: 63138 - DNA, 20 bp, Artificial
  CRISPR gRNA sequence
gaactggttccagcctccta

SEQ ID NO: 63139 - DNA, 20 bp, Artificial
  CRISPR gRNA sequence
gttccagcctcctagctgga

SEQ ID NO: 63140 - DNA, 20 bp, Artificial
  CRISPR gRNA sequence
cagcctcctagctggacaag

SEQ ID NO: 63141 - DNA, 20 bp, Artificial
  CRISPR gRNA sequence
ctagctggacaaggagccca

SEQ ID NO: 63142 - DNA, 20 bp, Artificial
  CRISPR gRNA sequence
gctggacaaggagcccaggg

SEQ ID NO: 63143 - DNA, 20 bp, Artificial
  CRISPR gRNA sequence
gacaaggagcccagggccct

SEQ ID NO: 63144 - DNA, 20 bp, Artificial
  CRISPR gRNA sequence
ctccaggggctgttcctatt

SEQ ID NO: 63145 - DNA, 20 bp, Artificial
  CRISPR gRNA sequence
caggggctgttcctattggt

SEQ ID NO: 63146 - DNA, 20 bp, Artificial
  CRISPR gRNA sequence
ttcctattggtcacttagct

SEQ ID NO: 63147 - DNA, 20 bp, Artificial
  CRISPR gRNA sequence
ctattggtcacttagcttag

SEQ ID NO: 63148 - DNA, 20 bp, Artificial
  CRISPR gRNA sequence
ttggtcacttagcttagctg

SEQ ID NO: 63149 - DNA, 20 bp, Artificial
  CRISPR gRNA sequence
gtcacttagcttagctgtag

SEQ ID NO: 63150 - DNA, 20 bp, Artificial
  CRISPR gRNA sequence
agcttagctgtaggaggacc

SEQ ID NO: 63151 - DNA, 20 bp, Artificial
  CRISPR gRNA sequence
gcttagctgtaggaggaccc

SEQ ID NO: 63152 - DNA, 20 bp, Artificial
  CRISPR gRNA sequence
agctgtaggaggaccctgct

SEQ ID NO: 63153 - DNA, 20 bp, Artificial
  CRISPR gRNA sequence
gctgtaggaggaccctgctt

SEQ ID NO: 63154 - DNA, 20 bp, Artificial
  CRISPR gRNA sequence
taggaggaccctgcttgact

SEQ ID NO: 63155 - DNA, 20 bp, Artificial
  CRISPR gRNA sequence
cttgacttcttaaaattctt

SEQ ID NO: 63156 - DNA, 20 bp, Artificial
  CRISPR gRNA sequence
gacttcttaaaattctttcc

SEQ ID NO: 63157 - DNA, 20 bp, Artificial
  CRISPR gRNA sequence
acttcttaaaattctttcct

SEQ ID NO: 63158 - DNA, 20 bp, Artificial
  CRISPR gRNA sequence
cttaaaattctttcctgagt

SEQ ID NO: 63159 - DNA, 20 bp, Artificial
  CRISPR gRNA sequence
ttaaaattctttcctgagtc

SEQ ID NO: 63160 - DNA, 20 bp, Artificial
  CRISPR gRNA sequence
aaaattctttcctgagtcct

SEQ ID NO: 63161 - DNA, 20 bp, Artificial
  CRISPR gRNA sequence
aaattctttcctgagtcctc

SEQ ID NO: 63162 - DNA, 20 bp, Artificial
  CRISPR gRNA sequence
tttcctgagtcctctttcct

SEQ ID NO: 63163 - DNA, 20 bp, Artificial
  CRISPR gRNA sequence
tcctgagtcctctttccttt

SEQ ID NO: 63164 - DNA, 20 bp, Artificial
  CRISPR gRNA sequence
cctgagtcctctttcctttc

SEQ ID NO: 63165 - DNA, 20 bp, Artificial
  CRISPR gRNA sequence
ctgagtcctctttcctttct

SEQ ID NO: 63166 - DNA, 20 bp, Artificial
  CRISPR gRNA sequence
agtcctctttcctttctccc

SEQ ID NO: 63167 - DNA, 20 bp, Artificial
  CRISPR gRNA sequence
tttcctttctccctcccttc

SEQ ID NO: 63168 - DNA, 20 bp, Artificial
  CRISPR gRNA sequence
tcctttctccctcccttcct

SEQ ID NO: 63169 - DNA, 20 bp, Artificial
  CRISPR gRNA sequence
cctttctccctcccttcctt

SEQ ID NO: 63170 - DNA, 20 bp, Artificial
  CRISPR gRNA sequence
ctttctccctcccttccttt

SEQ ID NO: 63171 - DNA, 20 bp, Artificial
  CRISPR gRNA sequence
tctccctcccttcctttctg

SEQ ID NO: 63172 - DNA, 20 bp, Artificial
  CRISPR gRNA sequence
ctccctcccttcctttctgg

SEQ ID NO: 63173 - DNA, 20 bp, Artificial
  CRISPR gRNA sequence
tccctcccttcctttctggg

SEQ ID NO: 63174 - DNA, 20 bp, Artificial
  CRISPR gRNA sequence
cctcccttcctttctgggtc

SEQ ID NO: 63175 - DNA, 20 bp, Artificial
  CRISPR gRNA sequence
ccttcctttctgggtcccct

SEQ ID NO: 63176 - DNA, 20 bp, Artificial
  CRISPR gRNA sequence
cctttctgggtccccttcct

SEQ ID NO: 63177 - DNA, 20 bp, Artificial
  CRISPR gRNA sequence
ctttctgggtccccttcctt

SEQ ID NO: 63178 - DNA, 20 bp, Artificial
  CRISPR gRNA sequence
tctgggtccccttccttctt

SEQ ID NO: 63179 - DNA, 20 bp, Artificial
  CRISPR gRNA sequence
ctgggtccccttccttcttg

SEQ ID NO: 63180 - DNA, 20 bp, Artificial
  CRISPR gRNA sequence
tgggtccccttccttcttgt

SEQ ID NO: 63181 - DNA, 20 bp, Artificial
  CRISPR gRNA sequence
ggtccccttccttcttgttt

SEQ ID NO: 63182 - DNA, 20 bp, Artificial
  CRISPR gRNA sequence
ccttcttgttttccttcttc

SEQ ID NO: 63183 - DNA, 20 bp, Artificial
  CRISPR gRNA sequence
cttcttgttttccttcttcc

SEQ ID NO: 63184 - DNA, 20 bp, Artificial
  CRISPR gRNA sequence
cttgttttccttcttccttt

SEQ ID NO: 63185 - DNA, 20 bp, Artificial
  CRISPR gRNA sequence
ttgttttccttcttcctttc

SEQ ID NO: 63186 - DNA, 20 bp, Artificial
  CRISPR gRNA sequence
gttttccttcttcctttctc

SEQ ID NO: 63187 - DNA, 20 bp, Artificial
  CRISPR gRNA sequence
ttttccttcttcctttctca

SEQ ID NO: 63188 - DNA, 20 bp, Artificial
  CRISPR gRNA sequence
tccttcttcctttctcaaac

SEQ ID NO: 63189 - DNA, 20 bp, Artificial
  CRISPR gRNA sequence
ccttcttcctttctcaaact

SEQ ID NO: 63190 - DNA, 20 bp, Artificial
  CRISPR gRNA sequence
cttcttcctttctcaaactc

SEQ ID NO: 63191 - DNA, 20 bp, Artificial
  CRISPR gRNA sequence
cttcctttctcaaactcttc

SEQ ID NO: 63192 - DNA, 20 bp, Artificial
  CRISPR gRNA sequence
ttcctttctcaaactcttcc

SEQ ID NO: 63193 - DNA, 20 bp, Artificial
  CRISPR gRNA sequence
cctttctcaaactcttccag

SEQ ID NO: 63194 - DNA, 20 bp, Artificial
  CRISPR gRNA sequence
ctttctcaaactcttccaga

SEQ ID NO: 63195 - DNA, 20 bp, Artificial
  CRISPR gRNA sequence
tctcaaactcttccagaaag

SEQ ID NO: 63196 - DNA, 20 bp, Artificial
  CRISPR gRNA sequence
ctcaaactcttccagaaagg

SEQ ID NO: 63197 - DNA, 20 bp, Artificial
  CRISPR gRNA sequence
tcaaactcttccagaaaggc

SEQ ID NO: 63198 - DNA, 20 bp, Artificial
  CRISPR gRNA sequence
aaactcttccagaaaggcat

SEQ ID NO: 63199 - DNA, 20 bp, Artificial
  CRISPR gRNA sequence
ttccagaaaggcattaaagt

SEQ ID NO: 63200 - DNA, 20 bp, Artificial
  CRISPR gRNA sequence
ccagaaaggcattaaagtga

SEQ ID NO: 63201 - DNA, 20 bp, Artificial
  CRISPR gRNA sequence
cagaaaggcattaaagtgat

SEQ ID NO: 63202 - DNA, 20 bp, Artificial
  CRISPR gRNA sequence
aagtgattgttgaaaatcca

SEQ ID NO: 63203 - DNA, 20 bp, Artificial
  CRISPR gRNA sequence
ttgaaaatccatacaatgag

SEQ ID NO: 63204 - DNA, 20 bp, Artificial
  CRISPR gRNA sequence
aaaatccatacaatgagaca

SEQ ID NO: 63205 - DNA, 20 bp, Artificial
  CRISPR gRNA sequence
cagaaactattaagggaagt

SEQ ID NO: 63206 - DNA, 20 bp, Artificial
  CRISPR gRNA sequence
ttaagggaagtgaggaaatg

SEQ ID NO: 63207 - DNA, 20 bp, Artificial
  CRISPR gRNA sequence
agggaagtgaggaaatgtgg

SEQ ID NO: 63208 - DNA, 20 bp, Artificial
  CRISPR gRNA sequence
acagaggagggaggttgcag

SEQ ID NO: 63209 - DNA, 20 bp, Artificial
  CRISPR gRNA sequence
caggcctggccaaactcact

SEQ ID NO: 63210 - DNA, 20 bp, Artificial
  CRISPR gRNA sequence
gccaaactcactgggaactt

SEQ ID NO: 63211 - DNA, 20 bp, Artificial
  CRISPR gRNA sequence
actgggaacttcacttatat

SEQ ID NO: 63212 - DNA, 20 bp, Artificial
  CRISPR gRNA sequence
ggaacttcacttatatgacc

SEQ ID NO: 63213 - DNA, 20 bp, Artificial
  CRISPR gRNA sequence
cacttatatgaccaccggcg

SEQ ID NO: 63214 - DNA, 20 bp, Artificial
  CRISPR gRNA sequence
acttatatgaccaccggcgg

SEQ ID NO: 63215 - DNA, 20 bp, Artificial
  CRISPR gRNA sequence
atatgaccaccggcggcttc

SEQ ID NO: 63216 - DNA, 20 bp, Artificial
  CRISPR gRNA sequence
tatgaccaccggcggcttcc

SEQ ID NO: 63217 - DNA, 20 bp, Artificial
  CRISPR gRNA sequence
ccatagagcttggtccttcc

SEQ ID NO: 63218 - DNA, 20 bp, Artificial
  CRISPR gRNA sequence
catagagcttggtccttccc

SEQ ID NO: 63219 - DNA, 20 bp, Artificial
  CRISPR gRNA sequence
ggtccttccctgatggacag

SEQ ID NO: 63220 - DNA, 20 bp, Artificial
  CRISPR gRNA sequence
gtccttccctgatggacaga

SEQ ID NO: 63221 - DNA, 20 bp, Artificial
  CRISPR gRNA sequence
ccctgatggacagatggcca

SEQ ID NO: 63222 - DNA, 20 bp, Artificial
  CRISPR gRNA sequence
cctgatggacagatggccat

SEQ ID NO: 63223 - DNA, 20 bp, Artificial
  CRISPR gRNA sequence
atggacagatggccatttag

SEQ ID NO: 63224 - DNA, 20 bp, Artificial
  CRISPR gRNA sequence
agtgcttggagctgagtgtt

SEQ ID NO: 63225 - DNA, 20 bp, Artificial
  CRISPR gRNA sequence
gtgcttggagctgagtgttt

SEQ ID NO: 63226 - DNA, 20 bp, Artificial
  CRISPR gRNA sequence
ggagctgagtgtttctgggg

SEQ ID NO: 63227 - DNA, 20 bp, Artificial
  CRISPR gRNA sequence
gagctgagtgtttctggggg

SEQ ID NO: 63228 - DNA, 20 bp, Artificial
  CRISPR gRNA sequence
agtgtttctgggggctgctg

SEQ ID NO: 63229 - DNA, 20 bp, Artificial
  CRISPR gRNA sequence
ctgggggctgctggctgttg

SEQ ID NO: 63230 - DNA, 20 bp, Artificial
  CRISPR gRNA sequence
tgggggctgctggctgttgg

SEQ ID NO: 63231 - DNA, 20 bp, Artificial
  CRISPR gRNA sequence
ggggctgctggctgttggcc

SEQ ID NO: 63232 - DNA, 20 bp, Artificial
  CRISPR gRNA sequence
ctggctgttggccctgcttc

SEQ ID NO: 63233 - DNA, 20 bp, Artificial
  CRISPR gRNA sequence
gctgttggccctgcttcctg

SEQ ID NO: 63234 - DNA, 20 bp, Artificial
  CRISPR gRNA sequence
ttggccctgcttcctgcatc

SEQ ID NO: 63235 - DNA, 20 bp, Artificial
  CRISPR gRNA sequence
gccctgcttcctgcatcctg

SEQ ID NO: 63236 - DNA, 20 bp, Artificial
  CRISPR gRNA sequence
cttcctgcatcctggactgc

SEQ ID NO: 63237 - DNA, 20 bp, Artificial
  CRISPR gRNA sequence
cctgcatcctggactgcaag

SEQ ID NO: 63238 - DNA, 20 bp, Artificial
  CRISPR gRNA sequence
ctgcatcctggactgcaaga

SEQ ID NO: 63239 - DNA, 20 bp, Artificial
  CRISPR gRNA sequence
catcctggactgcaagactg

SEQ ID NO: 63240 - DNA, 20 bp, Artificial
  CRISPR gRNA sequence
gactgcaagactgccaggcc

SEQ ID NO: 63241 - DNA, 20 bp, Artificial
  CRISPR gRNA sequence
caagactgccaggcccagaa

SEQ ID NO: 63242 - DNA, 20 bp, Artificial
  CRISPR gRNA sequence
ccaggcccagaacatccacc

SEQ ID NO: 63243 - DNA, 20 bp, Artificial
  CRISPR gRNA sequence
ccaatgggggtgcctagaag

SEQ ID NO: 63244 - DNA, 20 bp, Artificial
  CRISPR gRNA sequence
caatgggggtgcctagaagt

SEQ ID NO: 63245 - DNA, 20 bp, Artificial
  CRISPR gRNA sequence
gaagtccactctgcaaatag

SEQ ID NO: 63246 - DNA, 20 bp, Artificial
  CRISPR gRNA sequence
tgcaaatagaagctggtgtt

SEQ ID NO: 63247 - DNA, 20 bp, Artificial
  CRISPR gRNA sequence
caaatagaagctggtgttga

SEQ ID NO: 63248 - DNA, 20 bp, Artificial
  CRISPR gRNA sequence
gtgttgacccagcctctgcc

SEQ ID NO: 63249 - DNA, 20 bp, Artificial
  CRISPR gRNA sequence
acccagcctctgcctgctgc

SEQ ID NO: 63250 - DNA, 20 bp, Artificial
  CRISPR gRNA sequence
tgcctgctgcctgcctttcc

SEQ ID NO: 63251 - DNA, 20 bp, Artificial
  CRISPR gRNA sequence
cctgctgcctgcctttccag

SEQ ID NO: 63252 - DNA, 20 bp, Artificial
  CRISPR gRNA sequence
ctgcctgcctttccagtccc

SEQ ID NO: 63253 - DNA, 20 bp, Artificial
  CRISPR gRNA sequence
cctgcctttccagtccctgc

SEQ ID NO: 63254 - DNA, 20 bp, Artificial
  CRISPR gRNA sequence
cctttccagtccctgcatgt

SEQ ID NO: 63255 - DNA, 20 bp, Artificial
  CRISPR gRNA sequence
tccagtccctgcatgtgggt

SEQ ID NO: 63256 - DNA, 20 bp, Artificial
  CRISPR gRNA sequence
ccagtccctgcatgtgggtg

SEQ ID NO: 63257 - DNA, 20 bp, Artificial
  CRISPR gRNA sequence
cagtccctgcatgtgggtgt

SEQ ID NO: 63258 - DNA, 20 bp, Artificial
  CRISPR gRNA sequence
catgtgggtgtacttggctg

SEQ ID NO: 63259 - DNA, 20 bp, Artificial
  CRISPR gRNA sequence
ggctgcctgccacctgtctg

SEQ ID NO: 63260 - DNA, 20 bp, Artificial
  CRISPR gRNA sequence
gctgcctgccacctgtctgt

SEQ ID NO: 63261 - DNA, 20 bp, Artificial
  CRISPR gRNA sequence
cctgccacctgtctgtggac

SEQ ID NO: 63262 - DNA, 20 bp, Artificial
  CRISPR gRNA sequence
ccacctgtctgtggactgga

SEQ ID NO: 63263 - DNA, 20 bp, Artificial
  CRISPR gRNA sequence
tctgtggactggagttcccc

SEQ ID NO: 63264 - DNA, 20 bp, Artificial
  CRISPR gRNA sequence
tggactggagttccccaaag

SEQ ID NO: 63265 - DNA, 20 bp, Artificial
  CRISPR gRNA sequence
gagttccccaaaggttctgg

SEQ ID NO: 63266 - DNA, 20 bp, Artificial
  CRISPR gRNA sequence
cccaaaggttctgggtaacc

SEQ ID NO: 63267 - DNA, 20 bp, Artificial
  CRISPR gRNA sequence
tgggtaacccctcagcccag

SEQ ID NO: 63268 - DNA, 20 bp, Artificial
  CRISPR gRNA sequence
ggtaacccctcagcccagat

SEQ ID NO: 63269 - DNA, 20 bp, Artificial
  CRISPR gRNA sequence
agcccagatccccagacccc

SEQ ID NO: 63270 - DNA, 20 bp, Artificial
  CRISPR gRNA sequence
ctccaccccttcctttgctt

SEQ ID NO: 63271 - DNA, 20 bp, Artificial
  CRISPR gRNA sequence
caccccttcctttgcttttt

SEQ ID NO: 63272 - DNA, 20 bp, Artificial
  CRISPR gRNA sequence
cctttgctttttcaggcctg

SEQ ID NO: 63273 - DNA, 20 bp, Artificial
  CRISPR gRNA sequence
ctttgctttttcaggcctga

SEQ ID NO: 63274 - DNA, 20 bp, Artificial
  CRISPR gRNA sequence
tgctttttcaggcctgaagc

SEQ ID NO: 63275 - DNA, 20 bp, Artificial
  CRISPR gRNA sequence
gctttttcaggcctgaagcg

SEQ ID NO: 63276 - DNA, 20 bp, Artificial
  CRISPR gRNA sequence
ctttttcaggcctgaagcgc

SEQ ID NO: 63277 - DNA, 20 bp, Artificial
  CRISPR gRNA sequence
tttcaggcctgaagcgccca

SEQ ID NO: 63278 - DNA, 20 bp, Artificial
  CRISPR gRNA sequence
ttcaggcctgaagcgcccac

SEQ ID NO: 63279 - DNA, 20 bp, Artificial
  CRISPR gRNA sequence
tcaggcctgaagcgcccaca

SEQ ID NO: 63280 - DNA, 20 bp, Artificial
  CRISPR gRNA sequence
caggcctgaagcgcccacat

SEQ ID NO: 63281 - DNA, 20 bp, Artificial
  CRISPR gRNA sequence
aggcctgaagcgcccacatc

SEQ ID NO: 63282 - DNA, 20 bp, Artificial
  CRISPR gRNA sequence
aagcgcccacatcagagctg

SEQ ID NO: 63283 - DNA, 20 bp, Artificial
  CRISPR gRNA sequence
tgggtcctcaccccgccgga

SEQ ID NO: 63284 - DNA, 20 bp, Artificial
  CRISPR gRNA sequence
accccgccggaagcagtgca

SEQ ID NO: 63285 - DNA, 20 bp, Artificial
  CRISPR gRNA sequence
ggtgggtaccagtgtgggga

SEQ ID NO: 63286 - DNA, 20 bp, Artificial
  CRISPR gRNA sequence
cctgggggccaagacccgga

SEQ ID NO: 63287 - DNA, 20 bp, Artificial
  CRISPR gRNA sequence
ggggccaagacccggaccct

SEQ ID NO: 63288 - DNA, 20 bp, Artificial
  CRISPR gRNA sequence
gaccttgtcccctgccaata

SEQ ID NO: 63289 - DNA, 20 bp, Artificial
  CRISPR gRNA sequence
gtcccctgccaataagcctc

SEQ ID NO: 63290 - DNA, 20 bp, Artificial
  CRISPR gRNA sequence
tcccctgccaataagcctcc

SEQ ID NO: 63291 - DNA, 20 bp, Artificial
  CRISPR gRNA sequence
ccaataagcctccagaggcc

SEQ ID NO: 63292 - DNA, 20 bp, Artificial
  CRISPR gRNA sequence
cagaggcccagtgactcttg

SEQ ID NO: 63293 - DNA, 20 bp, Artificial
  CRISPR gRNA sequence
ttgtctcgcaagtttccagg

SEQ ID NO: 63294 - DNA, 20 bp, Artificial
  CRISPR gRNA sequence
gtctcgcaagtttccaggag

SEQ ID NO: 63295 - DNA, 20 bp, Artificial
  CRISPR gRNA sequence
tctcgcaagtttccaggaga

SEQ ID NO: 63296 - DNA, 20 bp, Artificial
  CRISPR gRNA sequence
gcaagtttccaggagaaaag

SEQ ID NO: 63297 - DNA, 20 bp, Artificial
  CRISPR gRNA sequence
ccaggagaaaaggactggag

SEQ ID NO: 63298 - DNA, 20 bp, Artificial
  CRISPR gRNA sequence
caggagaaaaggactggagg

SEQ ID NO: 63299 - DNA, 20 bp, Artificial
  CRISPR gRNA sequence
gaggtcttgcacaggcagag

SEQ ID NO: 63300 - DNA, 20 bp, Artificial
  CRISPR gRNA sequence
gcacaggcagaggagaggcc

SEQ ID NO: 63301 - DNA, 20 bp, Artificial
  CRISPR gRNA sequence
cacaggcagaggagaggcct

SEQ ID NO: 63302 - DNA, 20 bp, Artificial
  CRISPR gRNA sequence
ggctggcagcgaaggggctc

SEQ ID NO: 63303 - DNA, 20 bp, Artificial
  CRISPR gRNA sequence
gcagcgaaggggctccccac

SEQ ID NO: 63304 - DNA, 20 bp, Artificial
  CRISPR gRNA sequence
cccacccatctggctgcatg

SEQ ID NO: 63305 - DNA, 20 bp, Artificial
  CRISPR gRNA sequence
gctgcatggggacttctctg

SEQ ID NO: 63306 - DNA, 20 bp, Artificial
  CRISPR gRNA sequence
catggggacttctctgaaga

SEQ ID NO: 63307 - DNA, 20 bp, Artificial
  CRISPR gRNA sequence
ctctgaagagggctccgctg

SEQ ID NO: 63308 - DNA, 20 bp, Artificial
  CRISPR gRNA sequence
tctgaagagggctccgctga

SEQ ID NO: 63309 - DNA, 20 bp, Artificial
  CRISPR gRNA sequence
tgaagagggctccgctgaag

SEQ ID NO: 63310 - DNA, 20 bp, Artificial
  CRISPR gRNA sequence
aagagggctccgctgaagga

SEQ ID NO: 63311 - DNA, 20 bp, Artificial
  CRISPR gRNA sequence
cgctgaaggagctggaagca

SEQ ID NO: 63312 - DNA, 20 bp, Artificial
  CRISPR gRNA sequence
aaggagctggaagcaccata

SEQ ID NO: 63313 - DNA, 20 bp, Artificial
  CRISPR gRNA sequence
gaagcaccatacaggtctca

SEQ ID NO: 63314 - DNA, 20 bp, Artificial
  CRISPR gRNA sequence
agcttcgctgtccaggcttt

SEQ ID NO: 63315 - DNA, 20 bp, Artificial
  CRISPR gRNA sequence
cgctgtccaggcttttccag

SEQ ID NO: 63316 - DNA, 20 bp, Artificial
  CRISPR gRNA sequence
gctgtccaggcttttccagg

SEQ ID NO: 63317 - DNA, 20 bp, Artificial
  CRISPR gRNA sequence
tccaggcttttccagggaca

SEQ ID NO: 63318 - DNA, 20 bp, Artificial
  CRISPR gRNA sequence
ttccagggacaccctatgtc

SEQ ID NO: 63319 - DNA, 20 bp, Artificial
  CRISPR gRNA sequence
tccagggacaccctatgtcc

SEQ ID NO: 63320 - DNA, 20 bp, Artificial
  CRISPR gRNA sequence
ccagggacaccctatgtcct

SEQ ID NO: 63321 - DNA, 20 bp, Artificial
  CRISPR gRNA sequence
cagggacaccctatgtcctc

SEQ ID NO: 63322 - DNA, 20 bp, Artificial
  CRISPR gRNA sequence
tgtcctcagtgttgaaggag

SEQ ID NO: 63323 - DNA, 20 bp, Artificial
  CRISPR gRNA sequence
agtgttgaaggagacccagg

SEQ ID NO: 63324 - DNA, 20 bp, Artificial
  CRISPR gRNA sequence
aaggagacccagggaggaga

SEQ ID NO: 63325 - DNA, 20 bp, Artificial
  CRISPR gRNA sequence
gggggtgagcagggatgggg

SEQ ID NO: 63326 - DNA, 20 bp, Artificial
  CRISPR gRNA sequence
ggggtgagcagggatgggga

SEQ ID NO: 63327 - DNA, 20 bp, Artificial
  CRISPR gRNA sequence
ggagaaaccttcaagacaga

SEQ ID NO: 63328 - DNA, 20 bp, Artificial
  CRISPR gRNA sequence
caagacagaggccctggggg

SEQ ID NO: 63329 - DNA, 20 bp, Artificial
  CRISPR gRNA sequence
aagacagaggccctgggggc

SEQ ID NO: 63330 - DNA, 20 bp, Artificial
  CRISPR gRNA sequence
ggggcccatggggagacatg

SEQ ID NO: 63331 - DNA, 20 bp, Artificial
  CRISPR gRNA sequence
cttagggcaggccaggccag

SEQ ID NO: 63332 - DNA, 20 bp, Artificial
  CRISPR gRNA sequence
agggcaggccaggccagtga

SEQ ID NO: 63333 - DNA, 20 bp, Artificial
  CRISPR gRNA sequence
gggcaggccaggccagtgag

SEQ ID NO: 63334 - DNA, 20 bp, Artificial
  CRISPR gRNA sequence
ctctcattcttgaccagttc

SEQ ID NO: 63335 - DNA, 20 bp, Artificial
  CRISPR gRNA sequence
tctcattcttgaccagttct

SEQ ID NO: 63336 - DNA, 20 bp, Artificial
  CRISPR gRNA sequence
tcattcttgaccagttctca

SEQ ID NO: 63337 - DNA, 20 bp, Artificial
  CRISPR gRNA sequence
attcttgaccagttctcaga

SEQ ID NO: 63338 - DNA, 20 bp, Artificial
  CRISPR gRNA sequence
ttgaccagttctcagaatgg

SEQ ID NO: 63339 - DNA, 20 bp, Artificial
  CRISPR gRNA sequence
gaccagttctcagaatggtc

SEQ ID NO: 63340 - DNA, 20 bp, Artificial
  CRISPR gRNA sequence
accagttctcagaatggtcc

SEQ ID NO: 63341 - DNA, 20 bp, Artificial
  CRISPR gRNA sequence
tcagaatggtcctcgttctc

SEQ ID NO: 63342 - DNA, 20 bp, Artificial
  CRISPR gRNA sequence
agaatggtcctcgttctcca

SEQ ID NO: 63343 - DNA, 20 bp, Artificial
  CRISPR gRNA sequence
gttctccacgagttgtccca

SEQ ID NO: 63344 - DNA, 20 bp, Artificial
  CRISPR gRNA sequence
tccacgagttgtcccactaa

SEQ ID NO: 63345 - DNA, 20 bp, Artificial
  CRISPR gRNA sequence
cacgagttgtcccactaact

SEQ ID NO: 63346 - DNA, 20 bp, Artificial
  CRISPR gRNA sequence
tcccactaactagagccttc

SEQ ID NO: 63347 - DNA, 20 bp, Artificial
  CRISPR gRNA sequence
actagagccttctctgcccc

SEQ ID NO: 63348 - DNA, 20 bp, Artificial
  CRISPR gRNA sequence
gagccttctctgcccccact

SEQ ID NO: 63349 - DNA, 20 bp, Artificial
  CRISPR gRNA sequence
ctctgcccccactgctgcca

SEQ ID NO: 63350 - DNA, 20 bp, Artificial
  CRISPR gRNA sequence
tctgcccccactgctgccaa

SEQ ID NO: 63351 - DNA, 20 bp, Artificial
  CRISPR gRNA sequence
tgcccccactgctgccaacc

SEQ ID NO: 63352 - DNA, 20 bp, Artificial
  CRISPR gRNA sequence
cccccactgctgccaaccat

SEQ ID NO: 63353 - DNA, 20 bp, Artificial
  CRISPR gRNA sequence
ctgccaaccatggctataac

SEQ ID NO: 63354 - DNA, 20 bp, Artificial
  CRISPR gRNA sequence
ccaaccatggctataaccag

SEQ ID NO: 63355 - DNA, 20 bp, Artificial
  CRISPR gRNA sequence
taaccagaggattcacatcc

SEQ ID NO: 63356 - DNA, 20 bp, Artificial
  CRISPR gRNA sequence
acatccgctcaaaatagttc

SEQ ID NO: 63357 - DNA, 20 bp, Artificial
  CRISPR gRNA sequence
aaaatagttcactaccttgg

SEQ ID NO: 63358 - DNA, 20 bp, Artificial
  CRISPR gRNA sequence
actaccttggcctttcccca

SEQ ID NO: 63359 - DNA, 20 bp, Artificial
  CRISPR gRNA sequence
ccttggcctttccccatagg

SEQ ID NO: 63360 - DNA, 20 bp, Artificial
  CRISPR gRNA sequence
ggcctttccccatagggttc

SEQ ID NO: 63361 - DNA, 20 bp, Artificial
  CRISPR gRNA sequence
gcctttccccatagggttcc

SEQ ID NO: 63362 - DNA, 20 bp, Artificial
  CRISPR gRNA sequence
tccccatagggttcccccaa

SEQ ID NO: 63363 - DNA, 20 bp, Artificial
  CRISPR gRNA sequence
ccccatagggttcccccaaa

SEQ ID NO: 63364 - DNA, 20 bp, Artificial
  CRISPR gRNA sequence
cccatagggttcccccaaaa

SEQ ID NO: 63365 - DNA, 20 bp, Artificial
  CRISPR gRNA sequence
ccccaaaagcagccccagcc

SEQ ID NO: 63366 - DNA, 20 bp, Artificial
  CRISPR gRNA sequence
tccctgggtcacctgagacc

SEQ ID NO: 63367 - DNA, 20 bp, Artificial
  CRISPR gRNA sequence
ccctgggtcacctgagacct

SEQ ID NO: 63368 - DNA, 20 bp, Artificial
  CRISPR gRNA sequence
cctgggtcacctgagacctc

SEQ ID NO: 63369 - DNA, 20 bp, Artificial
  CRISPR gRNA sequence
ggtcacctgagacctctcaa

SEQ ID NO: 63370 - DNA, 20 bp, Artificial
  CRISPR gRNA sequence
agacctctcaatgacccagg

SEQ ID NO: 63371 - DNA, 20 bp, Artificial
  CRISPR gRNA sequence
tcaatgacccaggaattaaa

SEQ ID NO: 63372 - DNA, 20 bp, Artificial
  CRISPR gRNA sequence
aatgacccaggaattaaaag

SEQ ID NO: 63373 - DNA, 20 bp, Artificial
  CRISPR gRNA sequence
aaaggttaacatctggcact

SEQ ID NO: 63374 - DNA, 20 bp, Artificial
  CRISPR gRNA sequence
acatctggcactgtaggggc

SEQ ID NO: 63375 - DNA, 20 bp, Artificial
  CRISPR gRNA sequence
gcactgtaggggcccagctc

SEQ ID NO: 63376 - DNA, 20 bp, Artificial
  CRISPR gRNA sequence
taggggcccagctcccacag

SEQ ID NO: 63377 - DNA, 20 bp, Artificial
  CRISPR gRNA sequence
ccacagttccgatcggtaat

SEQ ID NO: 63378 - DNA, 20 bp, Artificial
  CRISPR gRNA sequence
cgatcggtaatgcctaggcc

SEQ ID NO: 63379 - DNA, 20 bp, Artificial
  CRISPR gRNA sequence
ggcctacaggttgttagtgc

SEQ ID NO: 63380 - DNA, 20 bp, Artificial
  CRISPR gRNA sequence
caggttgttagtgctcaccc

SEQ ID NO: 63381 - DNA, 20 bp, Artificial
  CRISPR gRNA sequence
ttagtgctcacccctgggca

SEQ ID NO: 63382 - DNA, 20 bp, Artificial
  CRISPR gRNA sequence
gtgctcacccctgggcattg

SEQ ID NO: 63383 - DNA, 20 bp, Artificial
  CRISPR gRNA sequence
acccctgggcattgcagaac

SEQ ID NO: 63384 - DNA, 20 bp, Artificial
  CRISPR gRNA sequence
ggcattgcagaactgaaata

SEQ ID NO: 63385 - DNA, 20 bp, Artificial
  CRISPR gRNA sequence
cagaactgaaatattgggaa

SEQ ID NO: 63386 - DNA, 20 bp, Artificial
  CRISPR gRNA sequence
aaatattgggaagaggcact

SEQ ID NO: 63387 - DNA, 20 bp, Artificial
  CRISPR gRNA sequence
ggaagaggcactggggatcc

SEQ ID NO: 63388 - DNA, 20 bp, Artificial
  CRISPR gRNA sequence
gggatccagatattacagaa

SEQ ID NO: 63389 - DNA, 20 bp, Artificial
  CRISPR gRNA sequence
cagaaagaggttgtttcaat

SEQ ID NO: 63390 - DNA, 20 bp, Artificial
  CRISPR gRNA sequence
tttcaataagatattgcaaa

SEQ ID NO: 63391 - DNA, 20 bp, Artificial
  CRISPR gRNA sequence
caataagatattgcaaagta

SEQ ID NO: 63392 - DNA, 20 bp, Artificial
  CRISPR gRNA sequence
aataagatattgcaaagtag

SEQ ID NO: 63393 - DNA, 20 bp, Artificial
  CRISPR gRNA sequence
caaagtagctgggcgcggtg

SEQ ID NO: 63394 - DNA, 20 bp, Artificial
  CRISPR gRNA sequence
ggcgcggtggctcacacctg

SEQ ID NO: 63395 - DNA, 20 bp, Artificial
  CRISPR gRNA sequence
acacctgtaatcccagcact

SEQ ID NO: 63396 - DNA, 20 bp, Artificial
  CRISPR gRNA sequence
taatcccagcactttggagg

SEQ ID NO: 63397 - DNA, 20 bp, Artificial
  CRISPR gRNA sequence
tggagggctgaggcaggtgg

SEQ ID NO: 63398 - DNA, 20 bp, Artificial
  CRISPR gRNA sequence
ggagggctgaggcaggtgga

SEQ ID NO: 63399 - DNA, 20 bp, Artificial
  CRISPR gRNA sequence
gagggctgaggcaggtggat

SEQ ID NO: 63400 - DNA, 20 bp, Artificial
  CRISPR gRNA sequence
aggcaggtggatcagttgag

SEQ ID NO: 63401 - DNA, 20 bp, Artificial
  CRISPR gRNA sequence
agcccaggaattcaatacta

SEQ ID NO: 63402 - DNA, 20 bp, Artificial
  CRISPR gRNA sequence
aatactagcctggccaacgt

SEQ ID NO: 63403 - DNA, 20 bp, Artificial
  CRISPR gRNA sequence
gcctggccaacgtgacaaaa

SEQ ID NO: 63404 - DNA, 20 bp, Artificial
  CRISPR gRNA sequence
gccaacgtgacaaaaccttg

SEQ ID NO: 63405 - DNA, 20 bp, Artificial
  CRISPR gRNA sequence
gtctctactaaaaatacaaa

SEQ ID NO: 63406 - DNA, 20 bp, Artificial
  CRISPR gRNA sequence
tctctactaaaaatacaaaa

SEQ ID NO: 63407 - DNA, 20 bp, Artificial
  CRISPR gRNA sequence
tactaaaaatacaaaaatta

SEQ ID NO: 63408 - DNA, 20 bp, Artificial
  CRISPR gRNA sequence
ctaaaaatacaaaaattagc

SEQ ID NO: 63409 - DNA, 20 bp, Artificial
  CRISPR gRNA sequence
aaaatacaaaaattagctgg

SEQ ID NO: 63410 - DNA, 20 bp, Artificial
  CRISPR gRNA sequence
gctgggtgtggtggtgtgca

SEQ ID NO: 63411 - DNA, 20 bp, Artificial
  CRISPR gRNA sequence
ggtgtggtggtgtgcacctg

SEQ ID NO: 63412 - DNA, 20 bp, Artificial
  CRISPR gRNA sequence
tagtcccagctactcaggag

SEQ ID NO: 63413 - DNA, 20 bp, Artificial
  CRISPR gRNA sequence
ctcaggaggctgaggcagga

SEQ ID NO: 63414 - DNA, 20 bp, Artificial
  CRISPR gRNA sequence
aggaggctgaggcaggagga

SEQ ID NO: 63415 - DNA, 20 bp, Artificial
  CRISPR gRNA sequence
aggcaggaggatcacttgag

SEQ ID NO: 63416 - DNA, 20 bp, Artificial
  CRISPR gRNA sequence
gagaccaggagtttgcggct

SEQ ID NO: 63417 - DNA, 20 bp, Artificial
  CRISPR gRNA sequence
agaccaggagtttgcggcta

SEQ ID NO: 63418 - DNA, 20 bp, Artificial
  CRISPR gRNA sequence
gcggctacagtaagctagga

SEQ ID NO: 63419 - DNA, 20 bp, Artificial
  CRISPR gRNA sequence
cggctacagtaagctaggat

SEQ ID NO: 63420 - DNA, 20 bp, Artificial
  CRISPR gRNA sequence
cagtaagctaggatcgtgcc

SEQ ID NO: 63421 - DNA, 20 bp, Artificial
  CRISPR gRNA sequence
ggatcgtgccactgcactgg

SEQ ID NO: 63422 - DNA, 20 bp, Artificial
  CRISPR gRNA sequence
cactggagcctgggcaagac

SEQ ID NO: 63423 - DNA, 20 bp, Artificial
  CRISPR gRNA sequence
gagcctgggcaagactgaga

SEQ ID NO: 63424 - DNA, 20 bp, Artificial
  CRISPR gRNA sequence
ggcaagactgagactctgtc

SEQ ID NO: 63425 - DNA, 20 bp, Artificial
  CRISPR gRNA sequence
agactctgtctctgggaaaa

SEQ ID NO: 63426 - DNA, 20 bp, Artificial
  CRISPR gRNA sequence
tgtctctgggaaaaaagaaa

SEQ ID NO: 63427 - DNA, 20 bp, Artificial
  CRISPR gRNA sequence
tctctgggaaaaaagaaaaa

SEQ ID NO: 63428 - DNA, 20 bp, Artificial
  CRISPR gRNA sequence
tgggaaaaaagaaaaaaaag

SEQ ID NO: 63429 - DNA, 20 bp, Artificial
  CRISPR gRNA sequence
ggaaaaaagaaaaaaaagag

SEQ ID NO: 63430 - DNA, 20 bp, Artificial
  CRISPR gRNA sequence
caaaggaggtgccctattcc

SEQ ID NO: 63431 - DNA, 20 bp, Artificial
  CRISPR gRNA sequence
ttcccctccccccatcttac

SEQ ID NO: 63432 - DNA, 20 bp, Artificial
  CRISPR gRNA sequence
ccctccccccatcttactga

SEQ ID NO: 63433 - DNA, 20 bp, Artificial
  CRISPR gRNA sequence
cccccatcttactgaaccct

SEQ ID NO: 63434 - DNA, 20 bp, Artificial
  CRISPR gRNA sequence
actgaacccttacaccacgt

SEQ ID NO: 63435 - DNA, 20 bp, Artificial
  CRISPR gRNA sequence
ctgaacccttacaccacgtg

SEQ ID NO: 63436 - DNA, 20 bp, Artificial
  CRISPR gRNA sequence
aacccttacaccacgtgtac

SEQ ID NO: 63437 - DNA, 20 bp, Artificial
  CRISPR gRNA sequence
acaccacgtgtactattgca

SEQ ID NO: 63438 - DNA, 20 bp, Artificial
  CRISPR gRNA sequence
caccacgtgtactattgcag

SEQ ID NO: 63439 - DNA, 20 bp, Artificial
  CRISPR gRNA sequence
ttgcagaatggatagaaccg

SEQ ID NO: 63440 - DNA, 20 bp, Artificial
  CRISPR gRNA sequence
cagaatggatagaaccgtga

SEQ ID NO: 63441 - DNA, 20 bp, Artificial
  CRISPR gRNA sequence
ccccattcccacctgcctgt

SEQ ID NO: 63442 - DNA, 20 bp, Artificial
  CRISPR gRNA sequence
cccattcccacctgcctgtt

SEQ ID NO: 63443 - DNA, 20 bp, Artificial
  CRISPR gRNA sequence
ccacctgcctgtttaaatag

SEQ ID NO: 63444 - DNA, 20 bp, Artificial
  CRISPR gRNA sequence
cctgtttaaatagctaccgg

SEQ ID NO: 63445 - DNA, 20 bp, Artificial
  CRISPR gRNA sequence
tttaaatagctaccggagag

SEQ ID NO: 63446 - DNA, 20 bp, Artificial
  CRISPR gRNA sequence
aaatagctaccggagagcct

SEQ ID NO: 63447 - DNA, 20 bp, Artificial
  CRISPR gRNA sequence
aatagctaccggagagccta

SEQ ID NO: 63448 - DNA, 20 bp, Artificial
  CRISPR gRNA sequence
ccggagagcctatgctccct

SEQ ID NO: 63449 - DNA, 20 bp, Artificial
  CRISPR gRNA sequence
tgctcccttagaactgattc

SEQ ID NO: 63450 - DNA, 20 bp, Artificial
  CRISPR gRNA sequence
ccttagaactgattccttct

SEQ ID NO: 63451 - DNA, 20 bp, Artificial
  CRISPR gRNA sequence
agaactgattccttctggaa

SEQ ID NO: 63452 - DNA, 20 bp, Artificial
  CRISPR gRNA sequence
gaactgattccttctggaag

SEQ ID NO: 63453 - DNA, 20 bp, Artificial
  CRISPR gRNA sequence
attccttctggaagttgggg

SEQ ID NO: 63454 - DNA, 20 bp, Artificial
  CRISPR gRNA sequence
cttctggaagttggggtggc

SEQ ID NO: 63455 - DNA, 20 bp, Artificial
  CRISPR gRNA sequence
ctggaagttggggtggcaca

SEQ ID NO: 63456 - DNA, 20 bp, Artificial
  CRISPR gRNA sequence
tggaagttggggtggcacag

SEQ ID NO: 63457 - DNA, 20 bp, Artificial
  CRISPR gRNA sequence
gaagttggggtggcacagat

SEQ ID NO: 63458 - DNA, 20 bp, Artificial
  CRISPR gRNA sequence
gggtggcacagatcccccta

SEQ ID NO: 63459 - DNA, 20 bp, Artificial
  CRISPR gRNA sequence
tggtgctcttgacaccccca

SEQ ID NO: 63460 - DNA, 20 bp, Artificial
  CRISPR gRNA sequence
ttgacacccccaccctcacc

SEQ ID NO: 63461 - DNA, 20 bp, Artificial
  CRISPR gRNA sequence
gacacccccaccctcacccc

SEQ ID NO: 63462 - DNA, 20 bp, Artificial
  CRISPR gRNA sequence
acacccccaccctcacccca

SEQ ID NO: 63463 - DNA, 20 bp, Artificial
  CRISPR gRNA sequence
accccatcatacatacacat

SEQ ID NO: 63464 - DNA, 20 bp, Artificial
  CRISPR gRNA sequence
gggctacaggctcccaacag

SEQ ID NO: 63465 - DNA, 20 bp, Artificial
  CRISPR gRNA sequence
caggctcccaacagcccaat

SEQ ID NO: 63466 - DNA, 20 bp, Artificial
  CRISPR gRNA sequence
ccaacagcccaatactgggg

SEQ ID NO: 63467 - DNA, 20 bp, Artificial
  CRISPR gRNA sequence
gggcaagaagacatgagcag

SEQ ID NO: 63468 - DNA, 20 bp, Artificial
  CRISPR gRNA sequence
tcctcatgccatgtccctgc

SEQ ID NO: 63469 - DNA, 20 bp, Artificial
  CRISPR gRNA sequence
ctcatgccatgtccctgccc

SEQ ID NO: 63470 - DNA, 20 bp, Artificial
  CRISPR gRNA sequence
atgccatgtccctgcccctt

SEQ ID NO: 63471 - DNA, 20 bp, Artificial
  CRISPR gRNA sequence
ccccttgcagagttggccaa

SEQ ID NO: 63472 - DNA, 20 bp, Artificial
  CRISPR gRNA sequence
gcagagttggccaagaagta

SEQ ID NO: 63473 - DNA, 20 bp, Artificial
  CRISPR gRNA sequence
cagagttggccaagaagtac

SEQ ID NO: 63474 - DNA, 20 bp, Artificial
  CRISPR gRNA sequence
gccaagaagtacctgcagct

SEQ ID NO: 63475 - DNA, 20 bp, Artificial
  CRISPR gRNA sequence
cagctcctgcggacctctgc

SEQ ID NO: 63476 - DNA, 20 bp, Artificial
  CRISPR gRNA sequence
ctgcggacctctgcccagca

SEQ ID NO: 63477 - DNA, 20 bp, Artificial
  CRISPR gRNA sequence
cggacctctgcccagcagcg

SEQ ID NO: 63478 - DNA, 20 bp, Artificial
  CRISPR gRNA sequence
tgcccagcagcgctacagga

SEQ ID NO: 63479 - DNA, 20 bp, Artificial
  CRISPR gRNA sequence
cccagcagcgctacaggagc

SEQ ID NO: 63480 - DNA, 20 bp, Artificial
  CRISPR gRNA sequence
caggagccaaatccctgggt

SEQ ID NO: 63481 - DNA, 20 bp, Artificial
  CRISPR gRNA sequence
ggtcagggcagccccacgcc

SEQ ID NO: 63482 - DNA, 20 bp, Artificial
  CRISPR gRNA sequence
ccaccaggtctatgtccctc

SEQ ID NO: 63483 - DNA, 20 bp, Artificial
  CRISPR gRNA sequence
caccaggtctatgtccctcc

SEQ ID NO: 63484 - DNA, 20 bp, Artificial
  CRISPR gRNA sequence
tgtccctccaatcctgcgcc

SEQ ID NO: 63485 - DNA, 20 bp, Artificial
  CRISPR gRNA sequence
caatcctgcgccgggccaca

SEQ ID NO: 63486 - DNA, 20 bp, Artificial
  CRISPR gRNA sequence
cgccgggccacagcatcctt

SEQ ID NO: 63487 - DNA, 20 bp, Artificial
  CRISPR gRNA sequence
agacactccggagggggcca

SEQ ID NO: 63488 - DNA, 20 bp, Artificial
  CRISPR gRNA sequence
gacactccggagggggccat

SEQ ID NO: 63489 - DNA, 20 bp, Artificial
  CRISPR gRNA sequence
cggagggggccattatgggg

SEQ ID NO: 63490 - DNA, 20 bp, Artificial
  CRISPR gRNA sequence
tgggggacgtcaaggtggaa

SEQ ID NO: 63491 - DNA, 20 bp, Artificial
  CRISPR gRNA sequence
acgtgagcatctcggacctc

SEQ ID NO: 63492 - DNA, 20 bp, Artificial
  CRISPR gRNA sequence
ggacctcttcaacaccaggg

SEQ ID NO: 63493 - DNA, 20 bp, Artificial
  CRISPR gRNA sequence
ttcaacaccagggttaacaa

SEQ ID NO: 63494 - DNA, 20 bp, Artificial
  CRISPR gRNA sequence
caacaccagggttaacaagg

SEQ ID NO: 63495 - DNA, 20 bp, Artificial
  CRISPR gRNA sequence
aacaccagggttaacaaggg

SEQ ID NO: 63496 - DNA, 20 bp, Artificial
  CRISPR gRNA sequence
acaagggcccgagggtgacc

SEQ ID NO: 63497 - DNA, 20 bp, Artificial
  CRISPR gRNA sequence
ttggggaaggctggcatggg

SEQ ID NO: 63498 - DNA, 20 bp, Artificial
  CRISPR gRNA sequence
tggggaaggctggcatgggc

SEQ ID NO: 63499 - DNA, 20 bp, Artificial
  CRISPR gRNA sequence
ggggaaggctggcatgggca

SEQ ID NO: 63500 - DNA, 20 bp, Artificial
  CRISPR gRNA sequence
gggaaggctggcatgggcaa

SEQ ID NO: 63501 - DNA, 20 bp, Artificial
  CRISPR gRNA sequence
gcatgggcaagaccacgctg

SEQ ID NO: 63502 - DNA, 20 bp, Artificial
  CRISPR gRNA sequence
gcccaccggctctgccagaa

SEQ ID NO: 63503 - DNA, 20 bp, Artificial
  CRISPR gRNA sequence
tgccagaagtgggcagaggg

SEQ ID NO: 63504 - DNA, 20 bp, Artificial
  CRISPR gRNA sequence
ccagaagtgggcagagggcc

SEQ ID NO: 63505 - DNA, 20 bp, Artificial
  CRISPR gRNA sequence
aactgtttccaggccctgtt

SEQ ID NO: 63506 - DNA, 20 bp, Artificial
  CRISPR gRNA sequence
tttccaggccctgttccttt

SEQ ID NO: 63507 - DNA, 20 bp, Artificial
  CRISPR gRNA sequence
ccaggccctgttcctttttg

SEQ ID NO: 63508 - DNA, 20 bp, Artificial
  CRISPR gRNA sequence
caggccctgttcctttttga

SEQ ID NO: 63509 - DNA, 20 bp, Artificial
  CRISPR gRNA sequence
ttcctttttgaattccgcca

SEQ ID NO: 63510 - DNA, 20 bp, Artificial
  CRISPR gRNA sequence
ctttttgaattccgccagct

SEQ ID NO: 63511 - DNA, 20 bp, Artificial
  CRISPR gRNA sequence
tttgaattccgccagctcaa

SEQ ID NO: 63512 - DNA, 20 bp, Artificial
  CRISPR gRNA sequence
ttgaattccgccagctcaac

SEQ ID NO: 63513 - DNA, 20 bp, Artificial
  CRISPR gRNA sequence
tgaattccgccagctcaact

SEQ ID NO: 63514 - DNA, 20 bp, Artificial
  CRISPR gRNA sequence
gaattccgccagctcaactt

SEQ ID NO: 63515 - DNA, 20 bp, Artificial
  CRISPR gRNA sequence
aattccgccagctcaacttg

SEQ ID NO: 63516 - DNA, 20 bp, Artificial
  CRISPR gRNA sequence
cgccagctcaacttgatcac

SEQ ID NO: 63517 - DNA, 20 bp, Artificial
  CRISPR gRNA sequence
aacttgatcacgaggttcct

SEQ ID NO: 63518 - DNA, 20 bp, Artificial
  CRISPR gRNA sequence
gatcacgaggttcctgacac

SEQ ID NO: 63519 - DNA, 20 bp, Artificial
  CRISPR gRNA sequence
atcacgaggttcctgacacc

SEQ ID NO: 63520 - DNA, 20 bp, Artificial
  CRISPR gRNA sequence
ctgacaccgtccgagctcct

SEQ ID NO: 63521 - DNA, 20 bp, Artificial
  CRISPR gRNA sequence
acaccgtccgagctcctttt

SEQ ID NO: 63522 - DNA, 20 bp, Artificial
  CRISPR gRNA sequence
ctttttgatctgtacctgag

SEQ ID NO: 63523 - DNA, 20 bp, Artificial
  CRISPR gRNA sequence
tttgatctgtacctgagccc

SEQ ID NO: 63524 - DNA, 20 bp, Artificial
  CRISPR gRNA sequence
ttgatctgtacctgagccct

SEQ ID NO: 63525 - DNA, 20 bp, Artificial
  CRISPR gRNA sequence
tgatctgtacctgagccctg

SEQ ID NO: 63526 - DNA, 20 bp, Artificial
  CRISPR gRNA sequence
gatctgtacctgagccctga

SEQ ID NO: 63527 - DNA, 20 bp, Artificial
  CRISPR gRNA sequence
atctgtacctgagccctgaa

SEQ ID NO: 63528 - DNA, 20 bp, Artificial
  CRISPR gRNA sequence
tacctgagccctgaatcgga

SEQ ID NO: 63529 - DNA, 20 bp, Artificial
  CRISPR gRNA sequence
agccctgaatcggaccacga

SEQ ID NO: 63530 - DNA, 20 bp, Artificial
  CRISPR gRNA sequence
aatcggaccacgacactgtc

SEQ ID NO: 63531 - DNA, 20 bp, Artificial
  CRISPR gRNA sequence
tcttccagtacctggagaag

SEQ ID NO: 63532 - DNA, 20 bp, Artificial
  CRISPR gRNA sequence
ccagtacctggagaagaacg

SEQ ID NO: 63533 - DNA, 20 bp, Artificial
  CRISPR gRNA sequence
cagtacctggagaagaacgc

SEQ ID NO: 63534 - DNA, 20 bp, Artificial
  CRISPR gRNA sequence
gagaagaacgctgaccaagt

SEQ ID NO: 63535 - DNA, 20 bp, Artificial
  CRISPR gRNA sequence
accaagtcctgctgatcttt

SEQ ID NO: 63536 - DNA, 20 bp, Artificial
  CRISPR gRNA sequence
ctgatctttgatgggctaga

SEQ ID NO: 63537 - DNA, 20 bp, Artificial
  CRISPR gRNA sequence
atctttgatgggctagatga

SEQ ID NO: 63538 - DNA, 20 bp, Artificial
  CRISPR gRNA sequence
tgatgggctagatgaggccc

SEQ ID NO: 63539 - DNA, 20 bp, Artificial
  CRISPR gRNA sequence
gatgggctagatgaggccct

SEQ ID NO: 63540 - DNA, 20 bp, Artificial
  CRISPR gRNA sequence
atgggctagatgaggccctc

SEQ ID NO: 63541 - DNA, 20 bp, Artificial
  CRISPR gRNA sequence
gatgaggccctccagcctat

SEQ ID NO: 63542 - DNA, 20 bp, Artificial
  CRISPR gRNA sequence
cagcctatgggtcctgatgg

SEQ ID NO: 63543 - DNA, 20 bp, Artificial
  CRISPR gRNA sequence
tgggtcctgatggcccaggc

SEQ ID NO: 63544 - DNA, 20 bp, Artificial
  CRISPR gRNA sequence
atggcccaggcccagtcctc

SEQ ID NO: 63545 - DNA, 20 bp, Artificial
  CRISPR gRNA sequence
acccttttctcccatctctg

SEQ ID NO: 63546 - DNA, 20 bp, Artificial
  CRISPR gRNA sequence
ttctcccatctctgcaatgg

SEQ ID NO: 63547 - DNA, 20 bp, Artificial
  CRISPR gRNA sequence
tctcccatctctgcaatggg

SEQ ID NO: 63548 - DNA, 20 bp, Artificial
  CRISPR gRNA sequence
ctcccatctctgcaatggga

SEQ ID NO: 63549 - DNA, 20 bp, Artificial
  CRISPR gRNA sequence
tcccatctctgcaatgggac

SEQ ID NO: 63550 - DNA, 20 bp, Artificial
  CRISPR gRNA sequence
ccatctctgcaatgggaccc

SEQ ID NO: 63551 - DNA, 20 bp, Artificial
  CRISPR gRNA sequence
tgcaatgggaccctcctgcc

SEQ ID NO: 63552 - DNA, 20 bp, Artificial
  CRISPR gRNA sequence
caatgggaccctcctgcctg

SEQ ID NO: 63553 - DNA, 20 bp, Artificial
  CRISPR gRNA sequence
ctgcctggctgccgggtgat

SEQ ID NO: 63554 - DNA, 20 bp, Artificial
  CRISPR gRNA sequence
cctggctgccgggtgatggc

SEQ ID NO: 63555 - DNA, 20 bp, Artificial
  CRISPR gRNA sequence
gctgccgggtgatggctacc

SEQ ID NO: 63556 - DNA, 20 bp, Artificial
  CRISPR gRNA sequence
ccgggtgatggctacctccc

SEQ ID NO: 63557 - DNA, 20 bp, Artificial
  CRISPR gRNA sequence
cctcccgtccagggaagctg

SEQ ID NO: 63558 - DNA, 20 bp, Artificial
  CRISPR gRNA sequence
ccgtccagggaagctgcctg

SEQ ID NO: 63559 - DNA, 20 bp, Artificial
  CRISPR gRNA sequence
cctgcctgcctgcctgcaga

SEQ ID NO: 63560 - DNA, 20 bp, Artificial
  CRISPR gRNA sequence
cctgcctgcctgcagaggca

SEQ ID NO: 63561 - DNA, 20 bp, Artificial
  CRISPR gRNA sequence
cctgcctgcagaggcagcca

SEQ ID NO: 63562 - DNA, 20 bp, Artificial
  CRISPR gRNA sequence
cctgcagaggcagccatggt

SEQ ID NO: 63563 - DNA, 20 bp, Artificial
  CRISPR gRNA sequence
cagaggcagccatggtccac

SEQ ID NO: 63564 - DNA, 20 bp, Artificial
  CRISPR gRNA sequence
ggctttgatgggccacgggt

SEQ ID NO: 63565 - DNA, 20 bp, Artificial
  CRISPR gRNA sequence
tgatgggccacgggtggaag

SEQ ID NO: 63566 - DNA, 20 bp, Artificial
  CRISPR gRNA sequence
gatgggccacgggtggaaga

SEQ ID NO: 63567 - DNA, 20 bp, Artificial
  CRISPR gRNA sequence
atgggccacgggtggaagaa

SEQ ID NO: 63568 - DNA, 20 bp, Artificial
  CRISPR gRNA sequence
cttcagcgcccagccatcgc

SEQ ID NO: 63569 - DNA, 20 bp, Artificial
  CRISPR gRNA sequence
ttcagcgcccagccatcgcg

SEQ ID NO: 63570 - DNA, 20 bp, Artificial
  CRISPR gRNA sequence
cagcgcccagccatcgcggg

SEQ ID NO: 63571 - DNA, 20 bp, Artificial
  CRISPR gRNA sequence
agcgcccagccatcgcggga

SEQ ID NO: 63572 - DNA, 20 bp, Artificial
  CRISPR gRNA sequence
gtggagttacagacaaatgg

SEQ ID NO: 63573 - DNA, 20 bp, Artificial
  CRISPR gRNA sequence
cagacaaatggacgtctccg

SEQ ID NO: 63574 - DNA, 20 bp, Artificial
  CRISPR gRNA sequence
cgaagcctgtgtgcggtgcc

SEQ ID NO: 63575 - DNA, 20 bp, Artificial
  CRISPR gRNA sequence
tgtgcggtgcccgcactgtg

SEQ ID NO: 63576 - DNA, 20 bp, Artificial
  CRISPR gRNA sequence
tgccaagtcgcctgtctctg

SEQ ID NO: 63577 - DNA, 20 bp, Artificial
  CRISPR gRNA sequence
tctctgcctccaccatctgc

SEQ ID NO: 63578 - DNA, 20 bp, Artificial
  CRISPR gRNA sequence
tgcctccaccatctgcttcc

SEQ ID NO: 63579 - DNA, 20 bp, Artificial
  CRISPR gRNA sequence
cctccaccatctgcttcctg

SEQ ID NO: 63580 - DNA, 20 bp, Artificial
  CRISPR gRNA sequence
caccatctgcttcctgacca

SEQ ID NO: 63581 - DNA, 20 bp, Artificial
  CRISPR gRNA sequence
cttcctgaccacgccccagg

SEQ ID NO: 63582 - DNA, 20 bp, Artificial
  CRISPR gRNA sequence
cctgaccacgccccaggcca

SEQ ID NO: 63583 - DNA, 20 bp, Artificial
  CRISPR gRNA sequence
ctgaccacgccccaggccag

SEQ ID NO: 63584 - DNA, 20 bp, Artificial
  CRISPR gRNA sequence
accacgccccaggccagtct

SEQ ID NO: 63585 - DNA, 20 bp, Artificial
  CRISPR gRNA sequence
tggccctcctgcccaacatg

SEQ ID NO: 63586 - DNA, 20 bp, Artificial
  CRISPR gRNA sequence
ctgcccaacatgactcagct

SEQ ID NO: 63587 - DNA, 20 bp, Artificial
  CRISPR gRNA sequence
cccaacatgactcagctcta

SEQ ID NO: 63588 - DNA, 20 bp, Artificial
  CRISPR gRNA sequence
agctctatatgcagatggtg

SEQ ID NO: 63589 - DNA, 20 bp, Artificial
  CRISPR gRNA sequence
tatatgcagatggtgctcgc

SEQ ID NO: 63590 - DNA, 20 bp, Artificial
  CRISPR gRNA sequence
tatgcagatggtgctcgccc

SEQ ID NO: 63591 - DNA, 20 bp, Artificial
  CRISPR gRNA sequence
gccctcagcccccctgggca

SEQ ID NO: 63592 - DNA, 20 bp, Artificial
  CRISPR gRNA sequence
agcccccctgggcacttgcc

SEQ ID NO: 63593 - DNA, 20 bp, Artificial
  CRISPR gRNA sequence
ggcacttgcccacctcgtcc

SEQ ID NO: 63594 - DNA, 20 bp, Artificial
  CRISPR gRNA sequence
gcccacctcgtccctactgg

SEQ ID NO: 63595 - DNA, 20 bp, Artificial
  CRISPR gRNA sequence
cccacctcgtccctactgga

SEQ ID NO: 63596 - DNA, 20 bp, Artificial
  CRISPR gRNA sequence
gtccctactggacctggggg

SEQ ID NO: 63597 - DNA, 20 bp, Artificial
  CRISPR gRNA sequence
ctggacctgggggaggtggc

SEQ ID NO: 63598 - DNA, 20 bp, Artificial
  CRISPR gRNA sequence
gacctgggggaggtggccct

SEQ ID NO: 63599 - DNA, 20 bp, Artificial
  CRISPR gRNA sequence
ggggaggtggccctgagggg

SEQ ID NO: 63600 - DNA, 20 bp, Artificial
  CRISPR gRNA sequence
aggggcctggagacagggaa

SEQ ID NO: 63601 - DNA, 20 bp, Artificial
  CRISPR gRNA sequence
gagacagggaaggttatctt

SEQ ID NO: 63602 - DNA, 20 bp, Artificial
  CRISPR gRNA sequence
tcttctatgcaaaagatatt

SEQ ID NO: 63603 - DNA, 20 bp, Artificial
  CRISPR gRNA sequence
ctatgcaaaagatattgctc

SEQ ID NO: 63604 - DNA, 20 bp, Artificial
  CRISPR gRNA sequence
tatgcaaaagatattgctcc

SEQ ID NO: 63605 - DNA, 20 bp, Artificial
  CRISPR gRNA sequence
tgcaaaagatattgctccac

SEQ ID NO: 63606 - DNA, 20 bp, Artificial
  CRISPR gRNA sequence
ctccacccttgatagctttt

SEQ ID NO: 63607 - DNA, 20 bp, Artificial
  CRISPR gRNA sequence
cacccttgatagcttttggg

SEQ ID NO: 63608 - DNA, 20 bp, Artificial
  CRISPR gRNA sequence
gatagcttttggggccactc

SEQ ID NO: 63609 - DNA, 20 bp, Artificial
  CRISPR gRNA sequence
atagcttttggggccactca

SEQ ID NO: 63610 - DNA, 20 bp, Artificial
  CRISPR gRNA sequence
ttggggccactcacagcctg

SEQ ID NO: 63611 - DNA, 20 bp, Artificial
  CRISPR gRNA sequence
tggggccactcacagcctgc

SEQ ID NO: 63612 - DNA, 20 bp, Artificial
  CRISPR gRNA sequence
ggggccactcacagcctgct

SEQ ID NO: 63613 - DNA, 20 bp, Artificial
  CRISPR gRNA sequence
gggccactcacagcctgctg

SEQ ID NO: 63614 - DNA, 20 bp, Artificial
  CRISPR gRNA sequence
acagcctgctgacttccttc

SEQ ID NO: 63615 - DNA, 20 bp, Artificial
  CRISPR gRNA sequence
ctgacttccttctgcgtctg

SEQ ID NO: 63616 - DNA, 20 bp, Artificial
  CRISPR gRNA sequence
acttccttctgcgtctgcac

SEQ ID NO: 63617 - DNA, 20 bp, Artificial
  CRISPR gRNA sequence
ccttctgcgtctgcacaggc

SEQ ID NO: 63618 - DNA, 20 bp, Artificial
  CRISPR gRNA sequence
cttctgcgtctgcacaggcc

SEQ ID NO: 63619 - DNA, 20 bp, Artificial
  CRISPR gRNA sequence
ctgcgtctgcacaggccctg

SEQ ID NO: 63620 - DNA, 20 bp, Artificial
  CRISPR gRNA sequence
tgcgtctgcacaggccctgg

SEQ ID NO: 63621 - DNA, 20 bp, Artificial
  CRISPR gRNA sequence
cgtctgcacaggccctgggc

SEQ ID NO: 63622 - DNA, 20 bp, Artificial
  CRISPR gRNA sequence
cacaggccctgggcaccagc

SEQ ID NO: 63623 - DNA, 20 bp, Artificial
  CRISPR gRNA sequence
ggcaccagcagacaggctat

SEQ ID NO: 63624 - DNA, 20 bp, Artificial
  CRISPR gRNA sequence
tgctttcacccacctcagcc

SEQ ID NO: 63625 - DNA, 20 bp, Artificial
  CRISPR gRNA sequence
tcacccacctcagcctgcag

SEQ ID NO: 63626 - DNA, 20 bp, Artificial
  CRISPR gRNA sequence
cacccacctcagcctgcagg

SEQ ID NO: 63627 - DNA, 20 bp, Artificial
  CRISPR gRNA sequence
acccacctcagcctgcagga

SEQ ID NO: 63628 - DNA, 20 bp, Artificial
  CRISPR gRNA sequence
agcctgcaggagtttcttgc

SEQ ID NO: 63629 - DNA, 20 bp, Artificial
  CRISPR gRNA sequence
caggagtttcttgctgccct

SEQ ID NO: 63630 - DNA, 20 bp, Artificial
  CRISPR gRNA sequence
cttgctgccctgcacctgat

SEQ ID NO: 63631 - DNA, 20 bp, Artificial
  CRISPR gRNA sequence
ttgctgccctgcacctgatg

SEQ ID NO: 63632 - DNA, 20 bp, Artificial
  CRISPR gRNA sequence
gctgccctgcacctgatggc

SEQ ID NO: 63633 - DNA, 20 bp, Artificial
  CRISPR gRNA sequence
ctgccctgcacctgatggcc

SEQ ID NO: 63634 - DNA, 20 bp, Artificial
  CRISPR gRNA sequence
ccctgcacctgatggccagc

SEQ ID NO: 63635 - DNA, 20 bp, Artificial
  CRISPR gRNA sequence
cacctgatggccagccccaa

SEQ ID NO: 63636 - DNA, 20 bp, Artificial
  CRISPR gRNA sequence
atggccagccccaaggtgaa

SEQ ID NO: 63637 - DNA, 20 bp, Artificial
  CRISPR gRNA sequence
acccagtatgttaccctcca

SEQ ID NO: 63638 - DNA, 20 bp, Artificial
  CRISPR gRNA sequence
cccagtatgttaccctccat

SEQ ID NO: 63639 - DNA, 20 bp, Artificial
  CRISPR gRNA sequence
ccctccattcccgctgggta

SEQ ID NO: 63640 - DNA, 20 bp, Artificial
  CRISPR gRNA sequence
cattcccgctgggtacagcg

SEQ ID NO: 63641 - DNA, 20 bp, Artificial
  CRISPR gRNA sequence
ccgctgggtacagcggacca

SEQ ID NO: 63642 - DNA, 20 bp, Artificial
  CRISPR gRNA sequence
ggtacagcggaccaaagcta

SEQ ID NO: 63643 - DNA, 20 bp, Artificial
  CRISPR gRNA sequence
gactgggcctctcagaccac

SEQ ID NO: 63644 - DNA, 20 bp, Artificial
  CRISPR gRNA sequence
ggcctctcagaccacctccc

SEQ ID NO: 63645 - DNA, 20 bp, Artificial
  CRISPR gRNA sequence
tcagaccacctccccacctt

SEQ ID NO: 63646 - DNA, 20 bp, Artificial
  CRISPR gRNA sequence
agaccacctccccaccttcc

SEQ ID NO: 63647 - DNA, 20 bp, Artificial
  CRISPR gRNA sequence
cccaccttcctggcgggcct

SEQ ID NO: 63648 - DNA, 20 bp, Artificial
  CRISPR gRNA sequence
cctggcgggcctggcatcct

SEQ ID NO: 63649 - DNA, 20 bp, Artificial
  CRISPR gRNA sequence
ctggcgggcctggcatcctg

SEQ ID NO: 63650 - DNA, 20 bp, Artificial
  CRISPR gRNA sequence
gcgggcctggcatcctgcac

SEQ ID NO: 63651 - DNA, 20 bp, Artificial
  CRISPR gRNA sequence
gcatcctgcacctgccgccc

SEQ ID NO: 63652 - DNA, 20 bp, Artificial
  CRISPR gRNA sequence
cacctgccgccccttcctta

SEQ ID NO: 63653 - DNA, 20 bp, Artificial
  CRISPR gRNA sequence
ccgccccttccttagccacc

SEQ ID NO: 63654 - DNA, 20 bp, Artificial
  CRISPR gRNA sequence
ccttagccacctggcgcagg

SEQ ID NO: 63655 - DNA, 20 bp, Artificial
  CRISPR gRNA sequence
cttagccacctggcgcaggg

SEQ ID NO: 63656 - DNA, 20 bp, Artificial
  CRISPR gRNA sequence
agccacctggcgcagggcaa

SEQ ID NO: 63657 - DNA, 20 bp, Artificial
  CRISPR gRNA sequence
gccacctggcgcagggcaat

SEQ ID NO: 63658 - DNA, 20 bp, Artificial
  CRISPR gRNA sequence
gcgcagggcaatgaggactg

SEQ ID NO: 63659 - DNA, 20 bp, Artificial
  CRISPR gRNA sequence
tgtgggtgccaagcaggctg

SEQ ID NO: 63660 - DNA, 20 bp, Artificial
  CRISPR gRNA sequence
ctgtagtgcaggtgttgaag

SEQ ID NO: 63661 - DNA, 20 bp, Artificial
  CRISPR gRNA sequence
tagtgcaggtgttgaagaag

SEQ ID NO: 63662 - DNA, 20 bp, Artificial
  CRISPR gRNA sequence
aagaagttggccacccgcaa

SEQ ID NO: 63663 - DNA, 20 bp, Artificial
  CRISPR gRNA sequence
gccacccgcaagctcacagg

SEQ ID NO: 63664 - DNA, 20 bp, Artificial
  CRISPR gRNA sequence
acagggccaaaggttgtaga

SEQ ID NO: 63665 - DNA, 20 bp, Artificial
  CRISPR gRNA sequence
tagagctgtgtcactgtgtg

SEQ ID NO: 63666 - DNA, 20 bp, Artificial
  CRISPR gRNA sequence
tgtcactgtgtggatgagac

SEQ ID NO: 63667 - DNA, 20 bp, Artificial
  CRISPR gRNA sequence
tgtggatgagacacaggagc

SEQ ID NO: 63668 - DNA, 20 bp, Artificial
  CRISPR gRNA sequence
agctggccagtctcaccgca

SEQ ID NO: 63669 - DNA, 20 bp, Artificial
  CRISPR gRNA sequence
gccagtctcaccgcacaaag

SEQ ID NO: 63670 - DNA, 20 bp, Artificial
  CRISPR gRNA sequence
accgcacaaagcctccccta

SEQ ID NO: 63671 - DNA, 20 bp, Artificial
  CRISPR gRNA sequence
ccctatcaactgcccttcca

SEQ ID NO: 63672 - DNA, 20 bp, Artificial
  CRISPR gRNA sequence
tcaactgcccttccacaatt

SEQ ID NO: 63673 - DNA, 20 bp, Artificial
  CRISPR gRNA sequence
cccttccacaatttcccact

SEQ ID NO: 63674 - DNA, 20 bp, Artificial
  CRISPR gRNA sequence
ccacaatttcccactgacct

SEQ ID NO: 63675 - DNA, 20 bp, Artificial
  CRISPR gRNA sequence
cacaatttcccactgacctg

SEQ ID NO: 63676 - DNA, 20 bp, Artificial
  CRISPR gRNA sequence
cccactgacctgcaccgacc

SEQ ID NO: 63677 - DNA, 20 bp, Artificial
  CRISPR gRNA sequence
ccactgacctgcaccgacct

SEQ ID NO: 63678 - DNA, 20 bp, Artificial
  CRISPR gRNA sequence
acctgcaccgacctggccac

SEQ ID NO: 63679 - DNA, 20 bp, Artificial
  CRISPR gRNA sequence
caccgacctggccaccctga

SEQ ID NO: 63680 - DNA, 20 bp, Artificial
  CRISPR gRNA sequence
gccaccctgaccaacatcct

SEQ ID NO: 63681 - DNA, 20 bp, Artificial
  CRISPR gRNA sequence
accaacatcctagagcacag

SEQ ID NO: 63682 - DNA, 20 bp, Artificial
  CRISPR gRNA sequence
gagcacagggaggcccccat

SEQ ID NO: 63683 - DNA, 20 bp, Artificial
  CRISPR gRNA sequence
gattttgatggctgtcccct

SEQ ID NO: 63684 - DNA, 20 bp, Artificial
  CRISPR gRNA sequence
tgatggctgtcccctggagc

SEQ ID NO: 63685 - DNA, 20 bp, Artificial
  CRISPR gRNA sequence
gatggctgtcccctggagcc

SEQ ID NO: 63686 - DNA, 20 bp, Artificial
  CRISPR gRNA sequence
atggctgtcccctggagccc

SEQ ID NO: 63687 - DNA, 20 bp, Artificial
  CRISPR gRNA sequence
tcccctggagccccactgcc

SEQ ID NO: 63688 - DNA, 20 bp, Artificial
  CRISPR gRNA sequence
gagccccactgccctgaggc

SEQ ID NO: 63689 - DNA, 20 bp, Artificial
  CRISPR gRNA sequence
ccctgaggctctggtaggct

SEQ ID NO: 63690 - DNA, 20 bp, Artificial
  CRISPR gRNA sequence
aggctctggtaggctgtggg

SEQ ID NO: 63691 - DNA, 20 bp, Artificial
  CRISPR gRNA sequence
tggtaggctgtgggcagata

SEQ ID NO: 63692 - DNA, 20 bp, Artificial
  CRISPR gRNA sequence
gtaggctgtgggcagataga

SEQ ID NO: 63693 - DNA, 20 bp, Artificial
  CRISPR gRNA sequence
tgggcagatagagaatctca

SEQ ID NO: 63694 - DNA, 20 bp, Artificial
  CRISPR gRNA sequence
aggtgagtaagagtggagga

SEQ ID NO: 63695 - DNA, 20 bp, Artificial
  CRISPR gRNA sequence
ggcttttgggggagcagagg

SEQ ID NO: 63696 - DNA, 20 bp, Artificial
  CRISPR gRNA sequence
ttgggggagcagaggccaac

SEQ ID NO: 63697 - DNA, 20 bp, Artificial
  CRISPR gRNA sequence
tgggggagcagaggccaacc

SEQ ID NO: 63698 - DNA, 20 bp, Artificial
  CRISPR gRNA sequence
gggggagcagaggccaacca

SEQ ID NO: 63699 - DNA, 20 bp, Artificial
  CRISPR gRNA sequence
ggggagcagaggccaaccag

SEQ ID NO: 63700 - DNA, 20 bp, Artificial
  CRISPR gRNA sequence
gcaaacctctgccaagagga

SEQ ID NO: 63701 - DNA, 20 bp, Artificial
  CRISPR gRNA sequence
tgccaagaggactggataag

SEQ ID NO: 63702 - DNA, 20 bp, Artificial
  CRISPR gRNA sequence
ccaagaggactggataagaa

SEQ ID NO: 63703 - DNA, 20 bp, Artificial
  CRISPR gRNA sequence
gataagaatcttgaatatca

SEQ ID NO: 63704 - DNA, 20 bp, Artificial
  CRISPR gRNA sequence
gaatatcagaacataatggc

SEQ ID NO: 63705 - DNA, 20 bp, Artificial
  CRISPR gRNA sequence
aatatcagaacataatggcc

SEQ ID NO: 63706 - DNA, 20 bp, Artificial
  CRISPR gRNA sequence
caatgcaagagaggaagctc

SEQ ID NO: 63707 - DNA, 20 bp, Artificial
  CRISPR gRNA sequence
cataccttgacaggacctct

SEQ ID NO: 63708 - DNA, 20 bp, Artificial
  CRISPR gRNA sequence
gacaggacctctggagtcca

SEQ ID NO: 63709 - DNA, 20 bp, Artificial
  CRISPR gRNA sequence
acaggacctctggagtccaa

SEQ ID NO: 63710 - DNA, 20 bp, Artificial
  CRISPR gRNA sequence
tggagtccaaatggatcctc

SEQ ID NO: 63711 - DNA, 20 bp, Artificial
  CRISPR gRNA sequence
gagtccaaatggatcctcct

SEQ ID NO: 63712 - DNA, 20 bp, Artificial
  CRISPR gRNA sequence
ctcttgtctgtggtttctgg

SEQ ID NO: 63713 - DNA, 20 bp, Artificial
  CRISPR gRNA sequence
ttgtctgtggtttctggact

SEQ ID NO: 63714 - DNA, 20 bp, Artificial
  CRISPR gRNA sequence
gtctgtggtttctggactct

SEQ ID NO: 63715 - DNA, 20 bp, Artificial
  CRISPR gRNA sequence
tctgtggtttctggactctc

SEQ ID NO: 63716 - DNA, 20 bp, Artificial
  CRISPR gRNA sequence
tggtttctggactctcagtc

SEQ ID NO: 63717 - DNA, 20 bp, Artificial
  CRISPR gRNA sequence
ctggactctcagtctctctg

SEQ ID NO: 63718 - DNA, 20 bp, Artificial
  CRISPR gRNA sequence
tggactctcagtctctctgt

SEQ ID NO: 63719 - DNA, 20 bp, Artificial
  CRISPR gRNA sequence
gactctcagtctctctgtca

SEQ ID NO: 63720 - DNA, 20 bp, Artificial
  CRISPR gRNA sequence
tcagtctctctgtcaatcat

SEQ ID NO: 63721 - DNA, 20 bp, Artificial
  CRISPR gRNA sequence
agtctctctgtcaatcatgg

SEQ ID NO: 63722 - DNA, 20 bp, Artificial
  CRISPR gRNA sequence
tctgtcaatcatgggctgaa

SEQ ID NO: 63723 - DNA, 20 bp, Artificial
  CRISPR gRNA sequence
tgtcaatcatgggctgaaac

SEQ ID NO: 63724 - DNA, 20 bp, Artificial
  CRISPR gRNA sequence
tcaatcatgggctgaaacca

SEQ ID NO: 63725 - DNA, 20 bp, Artificial
  CRISPR gRNA sequence
aaaccacagatccaggctgt

SEQ ID NO: 63726 - DNA, 20 bp, Artificial
  CRISPR gRNA sequence
tctatagaggctggtggact

SEQ ID NO: 63727 - DNA, 20 bp, Artificial
  CRISPR gRNA sequence
tagaggctggtggactttgg

SEQ ID NO: 63728 - DNA, 20 bp, Artificial
  CRISPR gRNA sequence
gtggactttgggcaagtata

SEQ ID NO: 63729 - DNA, 20 bp, Artificial
  CRISPR gRNA sequence
tgggcaagtatatggagcac

SEQ ID NO: 63730 - DNA, 20 bp, Artificial
  CRISPR gRNA sequence
gggcaagtatatggagcaca

SEQ ID NO: 63731 - DNA, 20 bp, Artificial
  CRISPR gRNA sequence
ggcaagtatatggagcacac

SEQ ID NO: 63732 - DNA, 20 bp, Artificial
  CRISPR gRNA sequence
tctaggccagagtttcttcg

SEQ ID NO: 63733 - DNA, 20 bp, Artificial
  CRISPR gRNA sequence
ggccagagtttcttcgttcc

SEQ ID NO: 63734 - DNA, 20 bp, Artificial
  CRISPR gRNA sequence
cttcgttcctaaaacgaatc

SEQ ID NO: 63735 - DNA, 20 bp, Artificial
  CRISPR gRNA sequence
ttcgttcctaaaacgaatct

SEQ ID NO: 63736 - DNA, 20 bp, Artificial
  CRISPR gRNA sequence
cgttcctaaaacgaatctgt

SEQ ID NO: 63737 - DNA, 20 bp, Artificial
  CRISPR gRNA sequence
gttcctaaaacgaatctgta

SEQ ID NO: 63738 - DNA, 20 bp, Artificial
  CRISPR gRNA sequence
ctaaaacgaatctgtaacaa

SEQ ID NO: 63739 - DNA, 20 bp, Artificial
  CRISPR gRNA sequence
aaacgaatctgtaacaatag

SEQ ID NO: 63740 - DNA, 20 bp, Artificial
  CRISPR gRNA sequence
taacaatagccaactcatat

SEQ ID NO: 63741 - DNA, 20 bp, Artificial
  CRISPR gRNA sequence
atatggtcattgcaagaatg

SEQ ID NO: 63742 - DNA, 20 bp, Artificial
  CRISPR gRNA sequence
caagaatgagatgggatggt

SEQ ID NO: 63743 - DNA, 20 bp, Artificial
  CRISPR gRNA sequence
tgtagcacagtgcctagcac

SEQ ID NO: 63744 - DNA, 20 bp, Artificial
  CRISPR gRNA sequence
gtagcacagtgcctagcaca

SEQ ID NO: 63745 - DNA, 20 bp, Artificial
  CRISPR gRNA sequence
tagcacagtgcctagcacag

SEQ ID NO: 63746 - DNA, 20 bp, Artificial
  CRISPR gRNA sequence
gcacagagcaaaggctcagt

SEQ ID NO: 63747 - DNA, 20 bp, Artificial
  CRISPR gRNA sequence
agtgtgcatattagctagag

SEQ ID NO: 63748 - DNA, 20 bp, Artificial
  CRISPR gRNA sequence
gctagagaaaaggctaggct

SEQ ID NO: 63749 - DNA, 20 bp, Artificial
  CRISPR gRNA sequence
gagaaaaggctaggctgcag

SEQ ID NO: 63750 - DNA, 20 bp, Artificial
  CRISPR gRNA sequence
ggctgcagtaacagagaaac

SEQ ID NO: 63751 - DNA, 20 bp, Artificial
  CRISPR gRNA sequence
cagtaacagagaaacctcct

SEQ ID NO: 63752 - DNA, 20 bp, Artificial
  CRISPR gRNA sequence
ctccccaaatacagtaggtt

SEQ ID NO: 63753 - DNA, 20 bp, Artificial
  CRISPR gRNA sequence
cccaaatacagtaggttaaa

SEQ ID NO: 63754 - DNA, 20 bp, Artificial
  CRISPR gRNA sequence
aataatgtagaattttattt

SEQ ID NO: 63755 - DNA, 20 bp, Artificial
  CRISPR gRNA sequence
tatttctctctcatggaaga

SEQ ID NO: 63756 - DNA, 20 bp, Artificial
  CRISPR gRNA sequence
atttctctctcatggaagag

SEQ ID NO: 63757 - DNA, 20 bp, Artificial
  CRISPR gRNA sequence
tttctctctcatggaagagt

SEQ ID NO: 63758 - DNA, 20 bp, Artificial
  CRISPR gRNA sequence
ctctctcatggaagagtcag

SEQ ID NO: 63759 - DNA, 20 bp, Artificial
  CRISPR gRNA sequence
tctctcatggaagagtcaga

SEQ ID NO: 63760 - DNA, 20 bp, Artificial
  CRISPR gRNA sequence
tctcatggaagagtcagagg

SEQ ID NO: 63761 - DNA, 20 bp, Artificial
  CRISPR gRNA sequence
tcatggaagagtcagaggta

SEQ ID NO: 63762 - DNA, 20 bp, Artificial
  CRISPR gRNA sequence
atggaagagtcagaggtagg

SEQ ID NO: 63763 - DNA, 20 bp, Artificial
  CRISPR gRNA sequence
agctccacgcagtcatgcag

SEQ ID NO: 63764 - DNA, 20 bp, Artificial
  CRISPR gRNA sequence
cacgcagtcatgcaggtacc

SEQ ID NO: 63765 - DNA, 20 bp, Artificial
  CRISPR gRNA sequence
ccattttgctccattatccc

SEQ ID NO: 63766 - DNA, 20 bp, Artificial
  CRISPR gRNA sequence
tgctccattatccccttggg

SEQ ID NO: 63767 - DNA, 20 bp, Artificial
  CRISPR gRNA sequence
gctccattatccccttggga

SEQ ID NO: 63768 - DNA, 20 bp, Artificial
  CRISPR gRNA sequence
ctccattatccccttgggaa

SEQ ID NO: 63769 - DNA, 20 bp, Artificial
  CRISPR gRNA sequence
cattatccccttgggaatcc

SEQ ID NO: 63770 - DNA, 20 bp, Artificial
  CRISPR gRNA sequence
tccccttgggaatcctatct

SEQ ID NO: 63771 - DNA, 20 bp, Artificial
  CRISPR gRNA sequence
gggaatcctatctgcacagt

SEQ ID NO: 63772 - DNA, 20 bp, Artificial
  CRISPR gRNA sequence
ggaatcctatctgcacagtc

SEQ ID NO: 63773 - DNA, 20 bp, Artificial
  CRISPR gRNA sequence
tctgcacagtcaaagctacg

SEQ ID NO: 63774 - DNA, 20 bp, Artificial
  CRISPR gRNA sequence
cacagtcaaagctacgtcat

SEQ ID NO: 63775 - DNA, 20 bp, Artificial
  CRISPR gRNA sequence
cgtcatgggtatatctgtgc

SEQ ID NO: 63776 - DNA, 20 bp, Artificial
  CRISPR gRNA sequence
tgctctggcttgggaacaag

SEQ ID NO: 63777 - DNA, 20 bp, Artificial
  CRISPR gRNA sequence
tggcttgggaacaaggaaag

SEQ ID NO: 63778 - DNA, 20 bp, Artificial
  CRISPR gRNA sequence
gcttgggaacaaggaaagag

SEQ ID NO: 63779 - DNA, 20 bp, Artificial
  CRISPR gRNA sequence
gggaacaaggaaagagcatg

SEQ ID NO: 63780 - DNA, 20 bp, Artificial
  CRISPR gRNA sequence
ggaacaaggaaagagcatgg

SEQ ID NO: 63781 - DNA, 20 bp, Artificial
  CRISPR gRNA sequence
aagttcagtcctgaaactag

SEQ ID NO: 63782 - DNA, 20 bp, Artificial
  CRISPR gRNA sequence
agtcctgaaactaggataca

SEQ ID NO: 63783 - DNA, 20 bp, Artificial
  CRISPR gRNA sequence
aaactaggatacatcccttc

SEQ ID NO: 63784 - DNA, 20 bp, Artificial
  CRISPR gRNA sequence
ggatacatcccttccactca

SEQ ID NO: 63785 - DNA, 20 bp, Artificial
  CRISPR gRNA sequence
ccactcacattccattggtg

SEQ ID NO: 63786 - DNA, 20 bp, Artificial
  CRISPR gRNA sequence
cactcacattccattggtga

SEQ ID NO: 63787 - DNA, 20 bp, Artificial
  CRISPR gRNA sequence
acattccattggtgagaaca

SEQ ID NO: 63788 - DNA, 20 bp, Artificial
  CRISPR gRNA sequence
cattggtgagaacatagtca

SEQ ID NO: 63789 - DNA, 20 bp, Artificial
  CRISPR gRNA sequence
gtgagaacatagtcacctgg

SEQ ID NO: 63790 - DNA, 20 bp, Artificial
  CRISPR gRNA sequence
gccacactgagctgcaaggg

SEQ ID NO: 63791 - DNA, 20 bp, Artificial
  CRISPR gRNA sequence
agctgcaagggaggctggga

SEQ ID NO: 63792 - DNA, 20 bp, Artificial
  CRISPR gRNA sequence
caagggaggctgggaaatgt

SEQ ID NO: 63793 - DNA, 20 bp, Artificial
  CRISPR gRNA sequence
ggaaatgtgatctctggctg

SEQ ID NO: 63794 - DNA, 20 bp, Artificial
  CRISPR gRNA sequence
tggctgggaaaccatgttcc

SEQ ID NO: 63795 - DNA, 20 bp, Artificial
  CRISPR gRNA sequence
gctgggaaaccatgttcctc

SEQ ID NO: 63796 - DNA, 20 bp, Artificial
  CRISPR gRNA sequence
ggaaaccatgttcctcatga

SEQ ID NO: 63797 - DNA, 20 bp, Artificial
  CRISPR gRNA sequence
ctcatgatagctctattgct

SEQ ID NO: 63798 - DNA, 20 bp, Artificial
  CRISPR gRNA sequence
atgatagctctattgctgta

SEQ ID NO: 63799 - DNA, 20 bp, Artificial
  CRISPR gRNA sequence
tattgctgtagatgaagtgg

SEQ ID NO: 63800 - DNA, 20 bp, Artificial
  CRISPR gRNA sequence
ttgctgtagatgaagtggag

SEQ ID NO: 63801 - DNA, 20 bp, Artificial
  CRISPR gRNA sequence
ctgtagatgaagtggagaat

SEQ ID NO: 63802 - DNA, 20 bp, Artificial
  CRISPR gRNA sequence
tagatgaagtggagaatggg

SEQ ID NO: 63803 - DNA, 20 bp, Artificial
  CRISPR gRNA sequence
tggtggacgattagaagtct

SEQ ID NO: 63804 - DNA, 20 bp, Artificial
  CRISPR gRNA sequence
ggtggacgattagaagtctc

SEQ ID NO: 63805 - DNA, 20 bp, Artificial
  CRISPR gRNA sequence
gtggacgattagaagtctcg

SEQ ID NO: 63806 - DNA, 20 bp, Artificial
  CRISPR gRNA sequence
gaagtctcggccataatatg

SEQ ID NO: 63807 - DNA, 20 bp, Artificial
  CRISPR gRNA sequence
ggccataatatgtatttgtt

SEQ ID NO: 63808 - DNA, 20 bp, Artificial
  CRISPR gRNA sequence
gttagtactactgtattaag

SEQ ID NO: 63809 - DNA, 20 bp, Artificial
  CRISPR gRNA sequence
ttagtactactgtattaagc

SEQ ID NO: 63810 - DNA, 20 bp, Artificial
  CRISPR gRNA sequence
gtactactgtattaagcccc

SEQ ID NO: 63811 - DNA, 20 bp, Artificial
  CRISPR gRNA sequence
ctgtattaagccccatctct

SEQ ID NO: 63812 - DNA, 20 bp, Artificial
  CRISPR gRNA sequence
tattaagccccatctctctg

SEQ ID NO: 63813 - DNA, 20 bp, Artificial
  CRISPR gRNA sequence
agccccatctctctgagggg

SEQ ID NO: 63814 - DNA, 20 bp, Artificial
  CRISPR gRNA sequence
tctgaggggatggcgatgac

SEQ ID NO: 63815 - DNA, 20 bp, Artificial
  CRISPR gRNA sequence
tgaggggatggcgatgactt

SEQ ID NO: 63816 - DNA, 20 bp, Artificial
  CRISPR gRNA sequence
aggggatggcgatgacttct

SEQ ID NO: 63817 - DNA, 20 bp, Artificial
  CRISPR gRNA sequence
ctcagctctgcccagcactg

SEQ ID NO: 63818 - DNA, 20 bp, Artificial
  CRISPR gRNA sequence
tcagctctgcccagcactga

SEQ ID NO: 63819 - DNA, 20 bp, Artificial
  CRISPR gRNA sequence
agctctgcccagcactgatc

SEQ ID NO: 63820 - DNA, 20 bp, Artificial
  CRISPR gRNA sequence
tgcccagcactgatcctctg

SEQ ID NO: 63821 - DNA, 20 bp, Artificial
  CRISPR gRNA sequence
cccagcactgatcctctgac

SEQ ID NO: 63822 - DNA, 20 bp, Artificial
  CRISPR gRNA sequence
atcctctgacacttcgcttc

SEQ ID NO: 63823 - DNA, 20 bp, Artificial
  CRISPR gRNA sequence
tgacacttcgcttcttctta

SEQ ID NO: 63824 - DNA, 20 bp, Artificial
  CRISPR gRNA sequence
acacttcgcttcttcttatg

SEQ ID NO: 63825 - DNA, 20 bp, Artificial
  CRISPR gRNA sequence
cgcttcttcttatggcagct

SEQ ID NO: 63826 - DNA, 20 bp, Artificial
  CRISPR gRNA sequence
gcttcttcttatggcagctt

SEQ ID NO: 63827 - DNA, 20 bp, Artificial
  CRISPR gRNA sequence
cttcttatggcagctttaag

SEQ ID NO: 63828 - DNA, 20 bp, Artificial
  CRISPR gRNA sequence
ttcttatggcagctttaaga

SEQ ID NO: 63829 - DNA, 20 bp, Artificial
  CRISPR gRNA sequence
cttatggcagctttaagagc

SEQ ID NO: 63830 - DNA, 20 bp, Artificial
  CRISPR gRNA sequence
ttatggcagctttaagagca

SEQ ID NO: 63831 - DNA, 20 bp, Artificial
  CRISPR gRNA sequence
atggcagctttaagagcagg

SEQ ID NO: 63832 - DNA, 20 bp, Artificial
  CRISPR gRNA sequence
tggcagctttaagagcagga

SEQ ID NO: 63833 - DNA, 20 bp, Artificial
  CRISPR gRNA sequence
taagagcaggaagtgtgggg

SEQ ID NO: 63834 - DNA, 20 bp, Artificial
  CRISPR gRNA sequence
aagagcaggaagtgtgggga

SEQ ID NO: 63835 - DNA, 20 bp, Artificial
  CRISPR gRNA sequence
agagcaggaagtgtggggat

SEQ ID NO: 63836 - DNA, 20 bp, Artificial
  CRISPR gRNA sequence
tgcagaagccctctccagga

SEQ ID NO: 63837 - DNA, 20 bp, Artificial
  CRISPR gRNA sequence
gcagaagccctctccaggag

SEQ ID NO: 63838 - DNA, 20 bp, Artificial
  CRISPR gRNA sequence
cagaagccctctccaggagc

SEQ ID NO: 63839 - DNA, 20 bp, Artificial
  CRISPR gRNA sequence
tccaggagcttgccgacaat

SEQ ID NO: 63840 - DNA, 20 bp, Artificial
  CRISPR gRNA sequence
caggagcttgccgacaatgg

SEQ ID NO: 63841 - DNA, 20 bp, Artificial
  CRISPR gRNA sequence
gccgacaatggggaggctgc

SEQ ID NO: 63842 - DNA, 20 bp, Artificial
  CRISPR gRNA sequence
ccgacaatggggaggctgca

SEQ ID NO: 63843 - DNA, 20 bp, Artificial
  CRISPR gRNA sequence
cagatgctggggtgagccag

SEQ ID NO: 63844 - DNA, 20 bp, Artificial
  CRISPR gRNA sequence
gggtgagccaggccttggag

SEQ ID NO: 63845 - DNA, 20 bp, Artificial
  CRISPR gRNA sequence
ggagctgagaagggtcttca

SEQ ID NO: 63846 - DNA, 20 bp, Artificial
  CRISPR gRNA sequence
gagctgagaagggtcttcag

SEQ ID NO: 63847 - DNA, 20 bp, Artificial
  CRISPR gRNA sequence
agaagggtcttcagctgggg

SEQ ID NO: 63848 - DNA, 20 bp, Artificial
  CRISPR gRNA sequence
cagctggggatgcctggtac

SEQ ID NO: 63849 - DNA, 20 bp, Artificial
  CRISPR gRNA sequence
agctggggatgcctggtact

SEQ ID NO: 63850 - DNA, 20 bp, Artificial
  CRISPR gRNA sequence
gggatgcctggtactctcct

SEQ ID NO: 63851 - DNA, 20 bp, Artificial
  CRISPR gRNA sequence
gtactctcctccctctcctt

SEQ ID NO: 63852 - DNA, 20 bp, Artificial
  CRISPR gRNA sequence
tcctccctctccttaatcct

SEQ ID NO: 63853 - DNA, 20 bp, Artificial
  CRISPR gRNA sequence
ctccctctccttaatcctac

SEQ ID NO: 63854 - DNA, 20 bp, Artificial
  CRISPR gRNA sequence
cctctccttaatcctacaca

SEQ ID NO: 63855 - DNA, 20 bp, Artificial
  CRISPR gRNA sequence
tccttaatcctacacaaggc

SEQ ID NO: 63856 - DNA, 20 bp, Artificial
  CRISPR gRNA sequence
cttaatcctacacaaggcag

SEQ ID NO: 63857 - DNA, 20 bp, Artificial
  CRISPR gRNA sequence
aatcctacacaaggcagatt

SEQ ID NO: 63858 - DNA, 20 bp, Artificial
  CRISPR gRNA sequence
atcctacacaaggcagattc

SEQ ID NO: 63859 - DNA, 20 bp, Artificial
  CRISPR gRNA sequence
cacaaggcagattcctggcc

SEQ ID NO: 63860 - DNA, 20 bp, Artificial
  CRISPR gRNA sequence
ctggccccgcccttttcccc

SEQ ID NO: 63861 - DNA, 20 bp, Artificial
  CRISPR gRNA sequence
gccccgcccttttcccctcc

SEQ ID NO: 63862 - DNA, 20 bp, Artificial
  CRISPR gRNA sequence
ttcccctcctcgttcctccc

SEQ ID NO: 63863 - DNA, 20 bp, Artificial
  CRISPR gRNA sequence
tcccctcctcgttcctcccc

SEQ ID NO: 63864 - DNA, 20 bp, Artificial
  CRISPR gRNA sequence
cccctcctcgttcctcccca

SEQ ID NO: 63865 - DNA, 20 bp, Artificial
  CRISPR gRNA sequence
ccctcctcgttcctccccac

SEQ ID NO: 63866 - DNA, 20 bp, Artificial
  CRISPR gRNA sequence
ctcgttcctccccaccatct

SEQ ID NO: 63867 - DNA, 20 bp, Artificial
  CRISPR gRNA sequence
gttcctccccaccatctttg

SEQ ID NO: 63868 - DNA, 20 bp, Artificial
  CRISPR gRNA sequence
ctccccaccatctttgctta

SEQ ID NO: 63869 - DNA, 20 bp, Artificial
  CRISPR gRNA sequence
cccaccatctttgcttactc

SEQ ID NO: 63870 - DNA, 20 bp, Artificial
  CRISPR gRNA sequence
tgcttactctgtaggttagc

SEQ ID NO: 63871 - DNA, 20 bp, Artificial
  CRISPR gRNA sequence
gcttactctgtaggttagca

SEQ ID NO: 63872 - DNA, 20 bp, Artificial
  CRISPR gRNA sequence
cttactctgtaggttagcag

SEQ ID NO: 63873 - DNA, 20 bp, Artificial
  CRISPR gRNA sequence
actctgtaggttagcaggaa

SEQ ID NO: 63874 - DNA, 20 bp, Artificial
  CRISPR gRNA sequence
ctctgtaggttagcaggaag

SEQ ID NO: 63875 - DNA, 20 bp, Artificial
  CRISPR gRNA sequence
tgtaggttagcaggaagtaa

SEQ ID NO: 63876 - DNA, 20 bp, Artificial
  CRISPR gRNA sequence
taggttagcaggaagtaaaa

SEQ ID NO: 63877 - DNA, 20 bp, Artificial
  CRISPR gRNA sequence
gcaggaagtaaaatcactgc

SEQ ID NO: 63878 - DNA, 20 bp, Artificial
  CRISPR gRNA sequence
cccgaggcatcagccacctg

SEQ ID NO: 63879 - DNA, 20 bp, Artificial
  CRISPR gRNA sequence
gtgaaagctttgcctctctg

SEQ ID NO: 63880 - DNA, 20 bp, Artificial
  CRISPR gRNA sequence
tgcctctctgtccacagctg

SEQ ID NO: 63881 - DNA, 20 bp, Artificial
  CRISPR gRNA sequence
gcctctctgtccacagctga

SEQ ID NO: 63882 - DNA, 20 bp, Artificial
  CRISPR gRNA sequence
cctctctgtccacagctgaa

SEQ ID NO: 63883 - DNA, 20 bp, Artificial
  CRISPR gRNA sequence
tctgtccacagctgaaagaa

SEQ ID NO: 63884 - DNA, 20 bp, Artificial
  CRISPR gRNA sequence
tgtccacagctgaaagaagt

SEQ ID NO: 63885 - DNA, 20 bp, Artificial
  CRISPR gRNA sequence
tccacagctgaaagaagtca

SEQ ID NO: 63886 - DNA, 20 bp, Artificial
  CRISPR gRNA sequence
aaagaagtcaggtgagtgat

SEQ ID NO: 63887 - DNA, 20 bp, Artificial
  CRISPR gRNA sequence
caggagggctcactgactgg

SEQ ID NO: 63888 - DNA, 20 bp, Artificial
  CRISPR gRNA sequence
actgactggggagatgagcc

SEQ ID NO: 63889 - DNA, 20 bp, Artificial
  CRISPR gRNA sequence
actggggagatgagccactg

SEQ ID NO: 63890 - DNA, 20 bp, Artificial
  CRISPR gRNA sequence
gggagatgagccactgccca

SEQ ID NO: 63891 - DNA, 20 bp, Artificial
  CRISPR gRNA sequence
cccaggtcccagagtccccc

SEQ ID NO: 63892 - DNA, 20 bp, Artificial
  CRISPR gRNA sequence
gggcctgcatgttcctccaa

SEQ ID NO: 63893 - DNA, 20 bp, Artificial
  CRISPR gRNA sequence
catgttcctccaagtctgac

SEQ ID NO: 63894 - DNA, 20 bp, Artificial
  CRISPR gRNA sequence
ctccaagtctgaccagtagt

SEQ ID NO: 63895 - DNA, 20 bp, Artificial
  CRISPR gRNA sequence
caagtctgaccagtagtttt

SEQ ID NO: 63896 - DNA, 20 bp, Artificial
  CRISPR gRNA sequence
accagtagtttttcagtgag

SEQ ID NO: 63897 - DNA, 20 bp, Artificial
  CRISPR gRNA sequence
ttcagtgagacccagagagg

SEQ ID NO: 63898 - DNA, 20 bp, Artificial
  CRISPR gRNA sequence
tcagtgagacccagagaggg

SEQ ID NO: 63899 - DNA, 20 bp, Artificial
  CRISPR gRNA sequence
cagtgagacccagagaggga

SEQ ID NO: 63900 - DNA, 20 bp, Artificial
  CRISPR gRNA sequence
agtgagacccagagagggaa

SEQ ID NO: 63901 - DNA, 20 bp, Artificial
  CRISPR gRNA sequence
agtagggctgagtccaaacc

SEQ ID NO: 63902 - DNA, 20 bp, Artificial
  CRISPR gRNA sequence
agtccaaacccaaggctccc

SEQ ID NO: 63903 - DNA, 20 bp, Artificial
  CRISPR gRNA sequence
ccagagtccccagagcaagg

SEQ ID NO: 63904 - DNA, 20 bp, Artificial
  CRISPR gRNA sequence
ccttcatctaatattttaga

SEQ ID NO: 63905 - DNA, 20 bp, Artificial
  CRISPR gRNA sequence
cttcatctaatattttagac

SEQ ID NO: 63906 - DNA, 20 bp, Artificial
  CRISPR gRNA sequence
catctaatattttagactgt

SEQ ID NO: 63907 - DNA, 20 bp, Artificial
  CRISPR gRNA sequence
atctaatattttagactgtc

SEQ ID NO: 63908 - DNA, 20 bp, Artificial
  CRISPR gRNA sequence
atattttagactgtcttgga

SEQ ID NO: 63909 - DNA, 20 bp, Artificial
  CRISPR gRNA sequence
tagactgtcttggaggagca

SEQ ID NO: 63910 - DNA, 20 bp, Artificial
  CRISPR gRNA sequence
agactgtcttggaggagcat

SEQ ID NO: 63911 - DNA, 20 bp, Artificial
  CRISPR gRNA sequence
gactgtcttggaggagcatg

SEQ ID NO: 63912 - DNA, 20 bp, Artificial
  CRISPR gRNA sequence
tcttggaggagcatgagtgt

SEQ ID NO: 63913 - DNA, 20 bp, Artificial
  CRISPR gRNA sequence
ggaggagcatgagtgttaag

SEQ ID NO: 63914 - DNA, 20 bp, Artificial
  CRISPR gRNA sequence
gaggagcatgagtgttaagg

SEQ ID NO: 63915 - DNA, 20 bp, Artificial
  CRISPR gRNA sequence
aggctccctccctctttctg

SEQ ID NO: 63916 - DNA, 20 bp, Artificial
  CRISPR gRNA sequence
cctccctctttctgaaatcc

SEQ ID NO: 63917 - DNA, 20 bp, Artificial
  CRISPR gRNA sequence
cctctttctgaaatcccagg

SEQ ID NO: 63918 - DNA, 20 bp, Artificial
  CRISPR gRNA sequence
tttctgaaatcccaggagaa

SEQ ID NO: 63919 - DNA, 20 bp, Artificial
  CRISPR gRNA sequence
tctgaaatcccaggagaagg

SEQ ID NO: 63920 - DNA, 20 bp, Artificial
  CRISPR gRNA sequence
ctgaaatcccaggagaaggg

SEQ ID NO: 63921 - DNA, 20 bp, Artificial
  CRISPR gRNA sequence
tgaaatcccaggagaaggga

SEQ ID NO: 63922 - DNA, 20 bp, Artificial
  CRISPR gRNA sequence
aaatcccaggagaagggata

SEQ ID NO: 63923 - DNA, 20 bp, Artificial
  CRISPR gRNA sequence
tgggtacacataactacatg

SEQ ID NO: 63924 - DNA, 20 bp, Artificial
  CRISPR gRNA sequence
catgaagcaccacacacctt

SEQ ID NO: 63925 - DNA, 20 bp, Artificial
  CRISPR gRNA sequence
cacatttgttcacacatgtc

SEQ ID NO: 63926 - DNA, 20 bp, Artificial
  CRISPR gRNA sequence
acatttgttcacacatgtct

SEQ ID NO: 63927 - DNA, 20 bp, Artificial
  CRISPR gRNA sequence
gttcacacatgtctacactt

SEQ ID NO: 63928 - DNA, 20 bp, Artificial
  CRISPR gRNA sequence
ttcacacatgtctacacttg

SEQ ID NO: 63929 - DNA, 20 bp, Artificial
  CRISPR gRNA sequence
acacatgtctacacttgcac

SEQ ID NO: 63930 - DNA, 20 bp, Artificial
  CRISPR gRNA sequence
cacttgcacagaagtacaca

SEQ ID NO: 63931 - DNA, 20 bp, Artificial
  CRISPR gRNA sequence
gcacagaagtacacaggcat

SEQ ID NO: 63932 - DNA, 20 bp, Artificial
  CRISPR gRNA sequence
cacagaagtacacaggcata

SEQ ID NO: 63933 - DNA, 20 bp, Artificial
  CRISPR gRNA sequence
ataggtgtgcacatgtatgc

SEQ ID NO: 63934 - DNA, 20 bp, Artificial
  CRISPR gRNA sequence
taactacatgtacacatttt

SEQ ID NO: 63935 - DNA, 20 bp, Artificial
  CRISPR gRNA sequence
aactacatgtacacattttg

SEQ ID NO: 63936 - DNA, 20 bp, Artificial
  CRISPR gRNA sequence
actacatgtacacattttga

SEQ ID NO: 63937 - DNA, 20 bp, Artificial
  CRISPR gRNA sequence
catgtacacattttgatgcc

SEQ ID NO: 63938 - DNA, 20 bp, Artificial
  CRISPR gRNA sequence
tgatgccagcacactctaac

SEQ ID NO: 63939 - DNA, 20 bp, Artificial
  CRISPR gRNA sequence
gatgccagcacactctaact

SEQ ID NO: 63940 - DNA, 20 bp, Artificial
  CRISPR gRNA sequence
atgccagcacactctaacta

SEQ ID NO: 63941 - DNA, 20 bp, Artificial
  CRISPR gRNA sequence
taactaactaagcttgtatg

SEQ ID NO: 63942 - DNA, 20 bp, Artificial
  CRISPR gRNA sequence
actaactaagcttgtatgca

SEQ ID NO: 63943 - DNA, 20 bp, Artificial
  CRISPR gRNA sequence
actaagcttgtatgcacaaa

SEQ ID NO: 63944 - DNA, 20 bp, Artificial
  CRISPR gRNA sequence
agcttgtatgcacaaatata

SEQ ID NO: 63945 - DNA, 20 bp, Artificial
  CRISPR gRNA sequence
gtatgcacaaatatactcct

SEQ ID NO: 63946 - DNA, 20 bp, Artificial
  CRISPR gRNA sequence
tatgcacaaatatactcctg

SEQ ID NO: 63947 - DNA, 20 bp, Artificial
  CRISPR gRNA sequence
ctgccctgtgtctgggactc

SEQ ID NO: 63948 - DNA, 20 bp, Artificial
  CRISPR gRNA sequence
ccctgtgtctgggactcagt

SEQ ID NO: 63949 - DNA, 20 bp, Artificial
  CRISPR gRNA sequence
tgtctgggactcagtaccat

SEQ ID NO: 63950 - DNA, 20 bp, Artificial
  CRISPR gRNA sequence
ggactcagtaccatggggag

SEQ ID NO: 63951 - DNA, 20 bp, Artificial
  CRISPR gRNA sequence
agtaccatggggaggagtgg

SEQ ID NO: 63952 - DNA, 20 bp, Artificial
  CRISPR gRNA sequence
ctccctggcagaacgctgct

SEQ ID NO: 63953 - DNA, 20 bp, Artificial
  CRISPR gRNA sequence
cctggcagaacgctgctagt

SEQ ID NO: 63954 - DNA, 20 bp, Artificial
  CRISPR gRNA sequence
gcagaacgctgctagtttat

SEQ ID NO: 63955 - DNA, 20 bp, Artificial
  CRISPR gRNA sequence
ctagtttatatggcaccttt

SEQ ID NO: 63956 - DNA, 20 bp, Artificial
  CRISPR gRNA sequence
gtttatatggcacctttatg

SEQ ID NO: 63957 - DNA, 20 bp, Artificial
  CRISPR gRNA sequence
atatggcacctttatgacat

SEQ ID NO: 63958 - DNA, 20 bp, Artificial
  CRISPR gRNA sequence
tatggcacctttatgacatt

SEQ ID NO: 63959 - DNA, 20 bp, Artificial
  CRISPR gRNA sequence
tatgacatttagagaaggca

SEQ ID NO: 63960 - DNA, 20 bp, Artificial
  CRISPR gRNA sequence
atgacatttagagaaggcac

SEQ ID NO: 63961 - DNA, 20 bp, Artificial
  CRISPR gRNA sequence
tgacatttagagaaggcacc

SEQ ID NO: 63962 - DNA, 20 bp, Artificial
  CRISPR gRNA sequence
agagaaggcaccacttcatc

SEQ ID NO: 63963 - DNA, 20 bp, Artificial
  CRISPR gRNA sequence
gagaaggcaccacttcatcc

SEQ ID NO: 63964 - DNA, 20 bp, Artificial
  CRISPR gRNA sequence
catccacacagatgcagcct

SEQ ID NO: 63965 - DNA, 20 bp, Artificial
  CRISPR gRNA sequence
atccacacagatgcagcctg

SEQ ID NO: 63966 - DNA, 20 bp, Artificial
  CRISPR gRNA sequence
tcactaaggttcagcacttg

SEQ ID NO: 63967 - DNA, 20 bp, Artificial
  CRISPR gRNA sequence
aggttcagcacttgttgagt

SEQ ID NO: 63968 - DNA, 20 bp, Artificial
  CRISPR gRNA sequence
agcacttgttgagtgaaaat

SEQ ID NO: 63969 - DNA, 20 bp, Artificial
  CRISPR gRNA sequence
gttgagtgaaaataataagt

SEQ ID NO: 63970 - DNA, 20 bp, Artificial
  CRISPR gRNA sequence
ttgagtgaaaataataagtt

SEQ ID NO: 63971 - DNA, 20 bp, Artificial
  CRISPR gRNA sequence
agtgaaaataataagttgga

SEQ ID NO: 63972 - DNA, 20 bp, Artificial
  CRISPR gRNA sequence
gaccacagtccctattgtcg

SEQ ID NO: 63973 - DNA, 20 bp, Artificial
  CRISPR gRNA sequence
ttgtcgtctcggctgggcat

SEQ ID NO: 63974 - DNA, 20 bp, Artificial
  CRISPR gRNA sequence
tcgtctcggctgggcatctg

SEQ ID NO: 63975 - DNA, 20 bp, Artificial
  CRISPR gRNA sequence
ggctgggcatctgtgaaccg

SEQ ID NO: 63976 - DNA, 20 bp, Artificial
  CRISPR gRNA sequence
ggcatctgtgaaccgtgatt

SEQ ID NO: 63977 - DNA, 20 bp, Artificial
  CRISPR gRNA sequence
tgaaccgtgattaagccaag

SEQ ID NO: 63978 - DNA, 20 bp, Artificial
  CRISPR gRNA sequence
agccaaggttcagaagtact

SEQ ID NO: 63979 - DNA, 20 bp, Artificial
  CRISPR gRNA sequence
agaagtactgaacttgttga

SEQ ID NO: 63980 - DNA, 20 bp, Artificial
  CRISPR gRNA sequence
aacttgttgacatttttctt

SEQ ID NO: 63981 - DNA, 20 bp, Artificial
  CRISPR gRNA sequence
gttgacatttttcttccctg

SEQ ID NO: 63982 - DNA, 20 bp, Artificial
  CRISPR gRNA sequence
ttgacatttttcttccctgg

SEQ ID NO: 63983 - DNA, 20 bp, Artificial
  CRISPR gRNA sequence
acatttttcttccctggcta

SEQ ID NO: 63984 - DNA, 20 bp, Artificial
  CRISPR gRNA sequence
ttcttccctggctattgaaa

SEQ ID NO: 63985 - DNA, 20 bp, Artificial
  CRISPR gRNA sequence
tcttccctggctattgaaag

SEQ ID NO: 63986 - DNA, 20 bp, Artificial
  CRISPR gRNA sequence
cttccctggctattgaaagt

SEQ ID NO: 63987 - DNA, 20 bp, Artificial
  CRISPR gRNA sequence
ttccctggctattgaaagtg

SEQ ID NO: 63988 - DNA, 20 bp, Artificial
  CRISPR gRNA sequence
ccctggctattgaaagtgac

SEQ ID NO: 63989 - DNA, 20 bp, Artificial
  CRISPR gRNA sequence
cctggctattgaaagtgact

SEQ ID NO: 63990 - DNA, 20 bp, Artificial
  CRISPR gRNA sequence
gctattgaaagtgactttaa

SEQ ID NO: 63991 - DNA, 20 bp, Artificial
  CRISPR gRNA sequence
ttgaaagtgactttaatttt

SEQ ID NO: 63992 - DNA, 20 bp, Artificial
  CRISPR gRNA sequence
aaagtgactttaattttgtc

SEQ ID NO: 63993 - DNA, 20 bp, Artificial
  CRISPR gRNA sequence
taattttgtctttcatcacc

SEQ ID NO: 63994 - DNA, 20 bp, Artificial
  CRISPR gRNA sequence
aattttgtctttcatcaccc

SEQ ID NO: 63995 - DNA, 20 bp, Artificial
  CRISPR gRNA sequence
attttgtctttcatcaccca

SEQ ID NO: 63996 - DNA, 20 bp, Artificial
  CRISPR gRNA sequence
tgtctttcatcacccaccat

SEQ ID NO: 63997 - DNA, 20 bp, Artificial
  CRISPR gRNA sequence
gtctttcatcacccaccatt

SEQ ID NO: 63998 - DNA, 20 bp, Artificial
  CRISPR gRNA sequence
tctttcatcacccaccattg

SEQ ID NO: 63999 - DNA, 20 bp, Artificial
  CRISPR gRNA sequence
tcatcacccaccattgttct

SEQ ID NO: 64000 - DNA, 20 bp, Artificial
  CRISPR gRNA sequence
catcacccaccattgttctt

SEQ ID NO: 64001 - DNA, 20 bp, Artificial
  CRISPR gRNA sequence
atcacccaccattgttctta

SEQ ID NO: 64002 - DNA, 20 bp, Artificial
  CRISPR gRNA sequence
ttcttaatcaccctcactcc

SEQ ID NO: 64003 - DNA, 20 bp, Artificial
  CRISPR gRNA sequence
ttaatcaccctcactcccct

SEQ ID NO: 64004 - DNA, 20 bp, Artificial
  CRISPR gRNA sequence
aatcaccctcactcccctca

SEQ ID NO: 64005 - DNA, 20 bp, Artificial
  CRISPR gRNA sequence
atcaccctcactcccctcaa

SEQ ID NO: 64006 - DNA, 20 bp, Artificial
  CRISPR gRNA sequence
actcccctcaactcatctgt

SEQ ID NO: 64007 - DNA, 20 bp, Artificial
  CRISPR gRNA sequence
ccctcaactcatctgtctcc

SEQ ID NO: 64008 - DNA, 20 bp, Artificial
  CRISPR gRNA sequence
aactcatctgtctccccagc

SEQ ID NO: 64009 - DNA, 20 bp, Artificial
  CRISPR gRNA sequence
atctgtctccccagctagga

SEQ ID NO: 64010 - DNA, 20 bp, Artificial
  CRISPR gRNA sequence
tctccccagctaggaaccca

SEQ ID NO: 64011 - DNA, 20 bp, Artificial
  CRISPR gRNA sequence
cccagctaggaacccaggca

SEQ ID NO: 64012 - DNA, 20 bp, Artificial
  CRISPR gRNA sequence
ggaacccaggcaaggctggc

SEQ ID NO: 64013 - DNA, 20 bp, Artificial
  CRISPR gRNA sequence
gcttgtgaacaggtggggaa

SEQ ID NO: 64014 - DNA, 20 bp, Artificial
  CRISPR gRNA sequence
gtgaacaggtggggaaagtg

SEQ ID NO: 64015 - DNA, 20 bp, Artificial
  CRISPR gRNA sequence
tgaacaggtggggaaagtga

SEQ ID NO: 64016 - DNA, 20 bp, Artificial
  CRISPR gRNA sequence
ggctcagggctctgggtgag

SEQ ID NO: 64017 - DNA, 20 bp, Artificial
  CRISPR gRNA sequence
gctcagggctctgggtgagt

SEQ ID NO: 64018 - DNA, 20 bp, Artificial
  CRISPR gRNA sequence
agggctctgggtgagtcagg

SEQ ID NO: 64019 - DNA, 20 bp, Artificial
  CRISPR gRNA sequence
tgggtgagtcagggccacag

SEQ ID NO: 64020 - DNA, 20 bp, Artificial
  CRISPR gRNA sequence
ggtgagtcagggccacagcc

SEQ ID NO: 64021 - DNA, 20 bp, Artificial
  CRISPR gRNA sequence
gaagcgatgtctgcagcgtc

SEQ ID NO: 64022 - DNA, 20 bp, Artificial
  CRISPR gRNA sequence
cagcgtcccagtctagactt

SEQ ID NO: 64023 - DNA, 20 bp, Artificial
  CRISPR gRNA sequence
gactttactcattgcctggg

SEQ ID NO: 64024 - DNA, 20 bp, Artificial
  CRISPR gRNA sequence
tactcattgcctggggggcc

SEQ ID NO: 64025 - DNA, 20 bp, Artificial
  CRISPR gRNA sequence
actcattgcctggggggcct

SEQ ID NO: 64026 - DNA, 20 bp, Artificial
  CRISPR gRNA sequence
ctcattgcctggggggccta

SEQ ID NO: 64027 - DNA, 20 bp, Artificial
  CRISPR gRNA sequence
attgcctggggggcctatcc

SEQ ID NO: 64028 - DNA, 20 bp, Artificial
  CRISPR gRNA sequence
cctggggggcctatcccagg

SEQ ID NO: 64029 - DNA, 20 bp, Artificial
  CRISPR gRNA sequence
gggggcctatcccaggcaca

SEQ ID NO: 64030 - DNA, 20 bp, Artificial
  CRISPR gRNA sequence
tcccaggcacatcccaggca

SEQ ID NO: 64031 - DNA, 20 bp, Artificial
  CRISPR gRNA sequence
ggagcagggtgctaggtctc

SEQ ID NO: 64032 - DNA, 20 bp, Artificial
  CRISPR gRNA sequence
ggtctcctcattgtgcctca

SEQ ID NO: 64033 - DNA, 20 bp, Artificial
  CRISPR gRNA sequence
ctcattgtgcctcatgaaga

SEQ ID NO: 64034 - DNA, 20 bp, Artificial
  CRISPR gRNA sequence
attgtgcctcatgaagaggc

SEQ ID NO: 64035 - DNA, 20 bp, Artificial
  CRISPR gRNA sequence
tgcctcatgaagaggccgtc

SEQ ID NO: 64036 - DNA, 20 bp, Artificial
  CRISPR gRNA sequence
atgaagaggccgtcagtctg

SEQ ID NO: 64037 - DNA, 20 bp, Artificial
  CRISPR gRNA sequence
tcttctagatcccttgagcc

SEQ ID NO: 64038 - DNA, 20 bp, Artificial
  CRISPR gRNA sequence
ctagatcccttgagccgcca

SEQ ID NO: 64039 - DNA, 20 bp, Artificial
  CRISPR gRNA sequence
tagatcccttgagccgccag

SEQ ID NO: 64040 - DNA, 20 bp, Artificial
  CRISPR gRNA sequence
gatcccttgagccgccaggc

SEQ ID NO: 64041 - DNA, 20 bp, Artificial
  CRISPR gRNA sequence
gagccgccaggcaaaaactt

SEQ ID NO: 64042 - DNA, 20 bp, Artificial
  CRISPR gRNA sequence
agccgccaggcaaaaacttc

SEQ ID NO: 64043 - DNA, 20 bp, Artificial
  CRISPR gRNA sequence
ccccataggaacagaataga

SEQ ID NO: 64044 - DNA, 20 bp, Artificial
  CRISPR gRNA sequence
cccataggaacagaatagac

SEQ ID NO: 64045 - DNA, 20 bp, Artificial
  CRISPR gRNA sequence
aggccagcagagggtctttc

SEQ ID NO: 64046 - DNA, 20 bp, Artificial
  CRISPR gRNA sequence
tcctcctagccgtgcctgct

SEQ ID NO: 64047 - DNA, 20 bp, Artificial
  CRISPR gRNA sequence
cctcctagccgtgcctgctg

SEQ ID NO: 64048 - DNA, 20 bp, Artificial
  CRISPR gRNA sequence
ctcctagccgtgcctgctgg

SEQ ID NO: 64049 - DNA, 20 bp, Artificial
  CRISPR gRNA sequence
ctagccgtgcctgctggaat

SEQ ID NO: 64050 - DNA, 20 bp, Artificial
  CRISPR gRNA sequence
gccgtgcctgctggaatccg

SEQ ID NO: 64051 - DNA, 20 bp, Artificial
  CRISPR gRNA sequence
ctggaatccggcgagcaggc

SEQ ID NO: 64052 - DNA, 20 bp, Artificial
  CRISPR gRNA sequence
gaatccggcgagcaggccat

SEQ ID NO: 64053 - DNA, 20 bp, Artificial
  CRISPR gRNA sequence
tttctgggcccctgtcttat

SEQ ID NO: 64054 - DNA, 20 bp, Artificial
  CRISPR gRNA sequence
tctgggcccctgtcttatgt

SEQ ID NO: 64055 - DNA, 20 bp, Artificial
  CRISPR gRNA sequence
ctgggcccctgtcttatgtc

SEQ ID NO: 64056 - DNA, 20 bp, Artificial
  CRISPR gRNA sequence
tgggcccctgtcttatgtct

SEQ ID NO: 64057 - DNA, 20 bp, Artificial
  CRISPR gRNA sequence
ggcccctgtcttatgtctcc

SEQ ID NO: 64058 - DNA, 20 bp, Artificial
  CRISPR gRNA sequence
tcttatgtctcccacatgag

SEQ ID NO: 64059 - DNA, 20 bp, Artificial
  CRISPR gRNA sequence
atgtctcccacatgagggtg

SEQ ID NO: 64060 - DNA, 20 bp, Artificial
  CRISPR gRNA sequence
tgtctcccacatgagggtgg

SEQ ID NO: 64061 - DNA, 20 bp, Artificial
  CRISPR gRNA sequence
ccacatgagggtggccatcc

SEQ ID NO: 64062 - DNA, 20 bp, Artificial
  CRISPR gRNA sequence
tcacttgctaactggggctt

SEQ ID NO: 64063 - DNA, 20 bp, Artificial
  CRISPR gRNA sequence
gctaactggggcttgcaagt

SEQ ID NO: 64064 - DNA, 20 bp, Artificial
  CRISPR gRNA sequence
ctaactggggcttgcaagtg

SEQ ID NO: 64065 - DNA, 20 bp, Artificial
  CRISPR gRNA sequence
actggggcttgcaagtgccc

SEQ ID NO: 64066 - DNA, 20 bp, Artificial
  CRISPR gRNA sequence
gggcttgcaagtgccccaac

SEQ ID NO: 64067 - DNA, 20 bp, Artificial
  CRISPR gRNA sequence
gcaagtgccccaaccccagg

SEQ ID NO: 64068 - DNA, 20 bp, Artificial
  CRISPR gRNA sequence
caagtgccccaaccccaggg

SEQ ID NO: 64069 - DNA, 20 bp, Artificial
  CRISPR gRNA sequence
ggccttggtctcctcgcagt

SEQ ID NO: 64070 - DNA, 20 bp, Artificial
  CRISPR gRNA sequence
ggtctcctcgcagttttcgg

SEQ ID NO: 64071 - DNA, 20 bp, Artificial
  CRISPR gRNA sequence
gtctcctcgcagttttcggg

SEQ ID NO: 64072 - DNA, 20 bp, Artificial
  CRISPR gRNA sequence
ctcgcagttttcgggacaac

SEQ ID NO: 64073 - DNA, 20 bp, Artificial
  CRISPR gRNA sequence
gcagttttcgggacaaccag

SEQ ID NO: 64074 - DNA, 20 bp, Artificial
  CRISPR gRNA sequence
tcgggacaaccagctcagtg

SEQ ID NO: 64075 - DNA, 20 bp, Artificial
  CRISPR gRNA sequence
cgggacaaccagctcagtga

SEQ ID NO: 64076 - DNA, 20 bp, Artificial
  CRISPR gRNA sequence
gggacaaccagctcagtgac

SEQ ID NO: 64077 - DNA, 20 bp, Artificial
  CRISPR gRNA sequence
agtgaccaggtggtgctgaa

SEQ ID NO: 64078 - DNA, 20 bp, Artificial
  CRISPR gRNA sequence
aacattgtggaggttctccc

SEQ ID NO: 64079 - DNA, 20 bp, Artificial
  CRISPR gRNA sequence
tggaggttctccctcaccta

SEQ ID NO: 64080 - DNA, 20 bp, Artificial
  CRISPR gRNA sequence
tccctcacctaccacggctc

SEQ ID NO: 64081 - DNA, 20 bp, Artificial
  CRISPR gRNA sequence
cctcacctaccacggctccg

SEQ ID NO: 64082 - DNA, 20 bp, Artificial
  CRISPR gRNA sequence
acctaccacggctccggaag

SEQ ID NO: 64083 - DNA, 20 bp, Artificial
  CRISPR gRNA sequence
ccacggctccggaagcttga

SEQ ID NO: 64084 - DNA, 20 bp, Artificial
  CRISPR gRNA sequence
cggaagcttgagtaagtgat

SEQ ID NO: 64085 - DNA, 20 bp, Artificial
  CRISPR gRNA sequence
gagtaagtgatctttccact

SEQ ID NO: 64086 - DNA, 20 bp, Artificial
  CRISPR gRNA sequence
agtaagtgatctttccactg

SEQ ID NO: 64087 - DNA, 20 bp, Artificial
  CRISPR gRNA sequence
tccactgcctctgcagccca

SEQ ID NO: 64088 - DNA, 20 bp, Artificial
  CRISPR gRNA sequence
ccactgcctctgcagcccag

SEQ ID NO: 64089 - DNA, 20 bp, Artificial
  CRISPR gRNA sequence
cactgcctctgcagcccagt

SEQ ID NO: 64090 - DNA, 20 bp, Artificial
  CRISPR gRNA sequence
cctctgcagcccagtccctc

SEQ ID NO: 64091 - DNA, 20 bp, Artificial
  CRISPR gRNA sequence
tgcagcccagtccctctcta

SEQ ID NO: 64092 - DNA, 20 bp, Artificial
  CRISPR gRNA sequence
cagcccagtccctctctata

SEQ ID NO: 64093 - DNA, 20 bp, Artificial
  CRISPR gRNA sequence
tctatacctgattcacccca

SEQ ID NO: 64094 - DNA, 20 bp, Artificial
  CRISPR gRNA sequence
tatacctgattcaccccact

SEQ ID NO: 64095 - DNA, 20 bp, Artificial
  CRISPR gRNA sequence
tacctgattcaccccactcc

SEQ ID NO: 64096 - DNA, 20 bp, Artificial
  CRISPR gRNA sequence
attcaccccactcccttgca

SEQ ID NO: 64097 - DNA, 20 bp, Artificial
  CRISPR gRNA sequence
accccactcccttgcaaggc

SEQ ID NO: 64098 - DNA, 20 bp, Artificial
  CRISPR gRNA sequence
ccttgcaaggcaaggaaggt

SEQ ID NO: 64099 - DNA, 20 bp, Artificial
  CRISPR gRNA sequence
gcaaggcaaggaaggtctgg

SEQ ID NO: 64100 - DNA, 20 bp, Artificial
  CRISPR gRNA sequence
caaggcaaggaaggtctggg

SEQ ID NO: 64101 - DNA, 20 bp, Artificial
  CRISPR gRNA sequence
gggcccctggggtaggggat

SEQ ID NO: 64102 - DNA, 20 bp, Artificial
  CRISPR gRNA sequence
gggtaggggattccactcct

SEQ ID NO: 64103 - DNA, 20 bp, Artificial
  CRISPR gRNA sequence
cactcctgacacctttgcca

SEQ ID NO: 64104 - DNA, 20 bp, Artificial
  CRISPR gRNA sequence
ctgacacctttgccacaatc

SEQ ID NO: 64105 - DNA, 20 bp, Artificial
  CRISPR gRNA sequence
acacctttgccacaatcttg

SEQ ID NO: 64106 - DNA, 20 bp, Artificial
  CRISPR gRNA sequence
tgccacaatcttgcagcctg

SEQ ID NO: 64107 - DNA, 20 bp, Artificial
  CRISPR gRNA sequence
gccacaatcttgcagcctga

SEQ ID NO: 64108 - DNA, 20 bp, Artificial
  CRISPR gRNA sequence
ccacaatcttgcagcctgag

SEQ ID NO: 64109 - DNA, 20 bp, Artificial
  CRISPR gRNA sequence
gcagcctgagcagcaacagc

SEQ ID NO: 64110 - DNA, 20 bp, Artificial
  CRISPR gRNA sequence
cagcctgagcagcaacagca

SEQ ID NO: 64111 - DNA, 20 bp, Artificial
  CRISPR gRNA sequence
agcagcaacagcatctgcgt

SEQ ID NO: 64112 - DNA, 20 bp, Artificial
  CRISPR gRNA sequence
cgtgtcaaccctactctgct

SEQ ID NO: 64113 - DNA, 20 bp, Artificial
  CRISPR gRNA sequence
ctctgcttggcaagggtggc

SEQ ID NO: 64114 - DNA, 20 bp, Artificial
  CRISPR gRNA sequence
tgcttggcaagggtggcagt

SEQ ID NO: 64115 - DNA, 20 bp, Artificial
  CRISPR gRNA sequence
cttggcaagggtggcagtca

SEQ ID NO: 64116 - DNA, 20 bp, Artificial
  CRISPR gRNA sequence
ggcaagggtggcagtcacgt

SEQ ID NO: 64117 - DNA, 20 bp, Artificial
  CRISPR gRNA sequence
gcaagggtggcagtcacgtg

SEQ ID NO: 64118 - DNA, 20 bp, Artificial
  CRISPR gRNA sequence
ccgtcaggatgcttcaggcc

SEQ ID NO: 64119 - DNA, 20 bp, Artificial
  CRISPR gRNA sequence
caggccaggtgagcagaagg

SEQ ID NO: 64120 - DNA, 20 bp, Artificial
  CRISPR gRNA sequence
aggccaggtgagcagaagga

SEQ ID NO: 64121 - DNA, 20 bp, Artificial
  CRISPR gRNA sequence
ggccttatgggccttgagaa

SEQ ID NO: 64122 - DNA, 20 bp, Artificial
  CRISPR gRNA sequence
gccttatgggccttgagaaa

SEQ ID NO: 64123 - DNA, 20 bp, Artificial
  CRISPR gRNA sequence
atgggccttgagaaaagagg

SEQ ID NO: 64124 - DNA, 20 bp, Artificial
  CRISPR gRNA sequence
tgggccttgagaaaagagga

SEQ ID NO: 64125 - DNA, 20 bp, Artificial
  CRISPR gRNA sequence
gagaaaagaggaggggaaag

SEQ ID NO: 64126 - DNA, 20 bp, Artificial
  CRISPR gRNA sequence
agaaaagaggaggggaaagt

SEQ ID NO: 64127 - DNA, 20 bp, Artificial
  CRISPR gRNA sequence
gtctgcaggataaatctgtg

SEQ ID NO: 64128 - DNA, 20 bp, Artificial
  CRISPR gRNA sequence
caggataaatctgtgcatac

SEQ ID NO: 64129 - DNA, 20 bp, Artificial
  CRISPR gRNA sequence
tgcataccctactgttttac

SEQ ID NO: 64130 - DNA, 20 bp, Artificial
  CRISPR gRNA sequence
ctgttttactcacagcttta

SEQ ID NO: 64131 - DNA, 20 bp, Artificial
  CRISPR gRNA sequence
ttttactcacagctttacct

SEQ ID NO: 64132 - DNA, 20 bp, Artificial
  CRISPR gRNA sequence
tactcacagctttaccttca

SEQ ID NO: 64133 - DNA, 20 bp, Artificial
  CRISPR gRNA sequence
actcacagctttaccttcag

SEQ ID NO: 64134 - DNA, 20 bp, Artificial
  CRISPR gRNA sequence
ctcacagctttaccttcaga

SEQ ID NO: 64135 - DNA, 20 bp, Artificial
  CRISPR gRNA sequence
acagctttaccttcagaacc

SEQ ID NO: 64136 - DNA, 20 bp, Artificial
  CRISPR gRNA sequence
taccttcagaacctagctca

SEQ ID NO: 64137 - DNA, 20 bp, Artificial
  CRISPR gRNA sequence
accttcagaacctagctcag

SEQ ID NO: 64138 - DNA, 20 bp, Artificial
  CRISPR gRNA sequence
ccttcagaacctagctcagg

SEQ ID NO: 64139 - DNA, 20 bp, Artificial
  CRISPR gRNA sequence
cagaacctagctcaggcttg

SEQ ID NO: 64140 - DNA, 20 bp, Artificial
  CRISPR gRNA sequence
agaacctagctcaggcttgg

SEQ ID NO: 64141 - DNA, 20 bp, Artificial
  CRISPR gRNA sequence
gctcaggcttggcacctggt

SEQ ID NO: 64142 - DNA, 20 bp, Artificial
  CRISPR gRNA sequence
aggcttggcacctggtactt

SEQ ID NO: 64143 - DNA, 20 bp, Artificial
  CRISPR gRNA sequence
ggcacctggtacttggtata

SEQ ID NO: 64144 - DNA, 20 bp, Artificial
  CRISPR gRNA sequence
gcacctggtacttggtatat

SEQ ID NO: 64145 - DNA, 20 bp, Artificial
  CRISPR gRNA sequence
gtacttggtatatattgaat

SEQ ID NO: 64146 - DNA, 20 bp, Artificial
  CRISPR gRNA sequence
ggtatatattgaattaatgg

SEQ ID NO: 64147 - DNA, 20 bp, Artificial
  CRISPR gRNA sequence
gtatatattgaattaatgga

SEQ ID NO: 64148 - DNA, 20 bp, Artificial
  CRISPR gRNA sequence
aattaatggatggatgaaaa

SEQ ID NO: 64149 - DNA, 20 bp, Artificial
  CRISPR gRNA sequence
atggatggatgaaaagatgg

SEQ ID NO: 64150 - DNA, 20 bp, Artificial
  CRISPR gRNA sequence
aaaagatggatgggtggatg

SEQ ID NO: 64151 - DNA, 20 bp, Artificial
  CRISPR gRNA sequence
aaaagatggatgggtggatg

SEQ ID NO: 64152 - DNA, 20 bp, Artificial
  CRISPR gRNA sequence
aaaagatggatgggtggatg

SEQ ID NO: 64153 - DNA, 20 bp, Artificial
  CRISPR gRNA sequence
atgggtggatgaaaagatga

SEQ ID NO: 64154 - DNA, 20 bp, Artificial
  CRISPR gRNA sequence
gctgaaaagatggataggtg

SEQ ID NO: 64155 - DNA, 20 bp, Artificial
  CRISPR gRNA sequence
aaaagatggataggtgtgtg

SEQ ID NO: 64156 - DNA, 20 bp, Artificial
  CRISPR gRNA sequence
cgaagcacaggcatagccaa

SEQ ID NO: 64157 - DNA, 20 bp, Artificial
  CRISPR gRNA sequence
gctgtgtgttgccctccatg

SEQ ID NO: 64158 - DNA, 20 bp, Artificial
  CRISPR gRNA sequence
tgtgttgccctccatggtgc

SEQ ID NO: 64159 - DNA, 20 bp, Artificial
  CRISPR gRNA sequence
ccctccatggtgctgaacca

SEQ ID NO: 64160 - DNA, 20 bp, Artificial
  CRISPR gRNA sequence
catggtgctgaaccaatata

SEQ ID NO: 64161 - DNA, 20 bp, Artificial
  CRISPR gRNA sequence
aaccaatatagccagttttg

SEQ ID NO: 64162 - DNA, 20 bp, Artificial
  CRISPR gRNA sequence
tgatcatggggtaggttagg

SEQ ID NO: 64163 - DNA, 20 bp, Artificial
  CRISPR gRNA sequence
gatcatggggtaggttaggt

SEQ ID NO: 64164 - DNA, 20 bp, Artificial
  CRISPR gRNA sequence
atcatggggtaggttaggtg

SEQ ID NO: 64165 - DNA, 20 bp, Artificial
  CRISPR gRNA sequence
ggtgtcatttttcttactca

SEQ ID NO: 64166 - DNA, 20 bp, Artificial
  CRISPR gRNA sequence
ttcttactcataaaaatttc

SEQ ID NO: 64167 - DNA, 20 bp, Artificial
  CRISPR gRNA sequence
tcttactcataaaaatttct

SEQ ID NO: 64168 - DNA, 20 bp, Artificial
  CRISPR gRNA sequence
cttactcataaaaatttcta

SEQ ID NO: 64169 - DNA, 20 bp, Artificial
  CRISPR gRNA sequence
ttactcataaaaatttctat

SEQ ID NO: 64170 - DNA, 20 bp, Artificial
  CRISPR gRNA sequence
actcataaaaatttctatta

SEQ ID NO: 64171 - DNA, 20 bp, Artificial
  CRISPR gRNA sequence
ctcataaaaatttctattaa

SEQ ID NO: 64172 - DNA, 20 bp, Artificial
  CRISPR gRNA sequence
ataaaaatttctattaaaaa

SEQ ID NO: 64173 - DNA, 20 bp, Artificial
  CRISPR gRNA sequence
ctattaaaaaaaattcagcc

SEQ ID NO: 64174 - DNA, 20 bp, Artificial
  CRISPR gRNA sequence
tattaaaaaaaattcagccg

SEQ ID NO: 64175 - DNA, 20 bp, Artificial
  CRISPR gRNA sequence
ttaaaaaaaattcagccggg

SEQ ID NO: 64176 - DNA, 20 bp, Artificial
  CRISPR gRNA sequence
aaaaaaattcagccgggctc

SEQ ID NO: 64177 - DNA, 20 bp, Artificial
  CRISPR gRNA sequence
agccgggctcagtggctcat

SEQ ID NO: 64178 - DNA, 20 bp, Artificial
  CRISPR gRNA sequence
agtggctcatgcctgtaatt

SEQ ID NO: 64179 - DNA, 20 bp, Artificial
  CRISPR gRNA sequence
atgcctgtaattccaacact

SEQ ID NO: 64180 - DNA, 20 bp, Artificial
  CRISPR gRNA sequence
taattccaacactttggaag

SEQ ID NO: 64181 - DNA, 20 bp, Artificial
  CRISPR gRNA sequence
caacactttggaaggccaag

SEQ ID NO: 64182 - DNA, 20 bp, Artificial
  CRISPR gRNA sequence
tggaaggccaaggcaagagg

SEQ ID NO: 64183 - DNA, 20 bp, Artificial
  CRISPR gRNA sequence
ggaaggccaaggcaagagga

SEQ ID NO: 64184 - DNA, 20 bp, Artificial
  CRISPR gRNA sequence
gaaggccaaggcaagaggat

SEQ ID NO: 64185 - DNA, 20 bp, Artificial
  CRISPR gRNA sequence
cttgagctcaggagttcgag

SEQ ID NO: 64186 - DNA, 20 bp, Artificial
  CRISPR gRNA sequence
gagctcaggagttcgagacc

SEQ ID NO: 64187 - DNA, 20 bp, Artificial
  CRISPR gRNA sequence
agctcaggagttcgagacca

SEQ ID NO: 64188 - DNA, 20 bp, Artificial
  CRISPR gRNA sequence
aggagttcgagaccaacctg

SEQ ID NO: 64189 - DNA, 20 bp, Artificial
  CRISPR gRNA sequence
gagaccaacctgggcaacat

SEQ ID NO: 64190 - DNA, 20 bp, Artificial
  CRISPR gRNA sequence
ggcaacatagtctctacaaa

SEQ ID NO: 64191 - DNA, 20 bp, Artificial
  CRISPR gRNA sequence
tacaaaaaatgaacaaaatt

SEQ ID NO: 64192 - DNA, 20 bp, Artificial
  CRISPR gRNA sequence
caaaaaatgaacaaaattaa

SEQ ID NO: 64193 - DNA, 20 bp, Artificial
  CRISPR gRNA sequence
atggggcatggtggtgcatg

SEQ ID NO: 64194 - DNA, 20 bp, Artificial
  CRISPR gRNA sequence
tggttccagctatttgggag

SEQ ID NO: 64195 - DNA, 20 bp, Artificial
  CRISPR gRNA sequence
cagctatttgggaggctgag

SEQ ID NO: 64196 - DNA, 20 bp, Artificial
  CRISPR gRNA sequence
tttgggaggctgaggtggga

SEQ ID NO: 64197 - DNA, 20 bp, Artificial
  CRISPR gRNA sequence
gggaggctgaggtgggaaga

SEQ ID NO: 64198 - DNA, 20 bp, Artificial
  CRISPR gRNA sequence
ggaggctgaggtgggaagat

SEQ ID NO: 64199 - DNA, 20 bp, Artificial
  CRISPR gRNA sequence
aggtgggaagattgcttgag

SEQ ID NO: 64200 - DNA, 20 bp, Artificial
  CRISPR gRNA sequence
cttgagccgtggaggttgag

SEQ ID NO: 64201 - DNA, 20 bp, Artificial
  CRISPR gRNA sequence
gagccgtggaggttgaggct

SEQ ID NO: 64202 - DNA, 20 bp, Artificial
  CRISPR gRNA sequence
agccgtggaggttgaggctg

SEQ ID NO: 64203 - DNA, 20 bp, Artificial
  CRISPR gRNA sequence
aggctgcagtgaggtgtgaa

SEQ ID NO: 64204 - DNA, 20 bp, Artificial
  CRISPR gRNA sequence
cagtgaggtgtgaacacacc

SEQ ID NO: 64205 - DNA, 20 bp, Artificial
  CRISPR gRNA sequence
cactccagcctgagtagcag

SEQ ID NO: 64206 - DNA, 20 bp, Artificial
  CRISPR gRNA sequence
cagcctgagtagcagagtga

SEQ ID NO: 64207 - DNA, 20 bp, Artificial
  CRISPR gRNA sequence
agtagcagagtgagatctcc

SEQ ID NO: 64208 - DNA, 20 bp, Artificial
  CRISPR gRNA sequence
catctcaaatttaaaaagaa

SEQ ID NO: 64209 - DNA, 20 bp, Artificial
  CRISPR gRNA sequence
aaatttaaaaagaaaggaaa

SEQ ID NO: 64210 - DNA, 20 bp, Artificial
  CRISPR gRNA sequence
aaaaagaaaggaaaaaaaaa

SEQ ID NO: 64211 - DNA, 20 bp, Artificial
  CRISPR gRNA sequence
aaaagaaaggaaaaaaaaaa

SEQ ID NO: 64212 - DNA, 20 bp, Artificial
  CRISPR gRNA sequence
acaacattcttaatttttat

SEQ ID NO: 64213 - DNA, 20 bp, Artificial
  CRISPR gRNA sequence
ttaatttttattatatttct

SEQ ID NO: 64214 - DNA, 20 bp, Artificial
  CRISPR gRNA sequence
aatttttattatatttcttg

SEQ ID NO: 64215 - DNA, 20 bp, Artificial
  CRISPR gRNA sequence
atttttattatatttcttgt

SEQ ID NO: 64216 - DNA, 20 bp, Artificial
  CRISPR gRNA sequence
ttattatatttcttgtgaaa

SEQ ID NO: 64217 - DNA, 20 bp, Artificial
  CRISPR gRNA sequence
tattatatttcttgtgaaaa

SEQ ID NO: 64218 - DNA, 20 bp, Artificial
  CRISPR gRNA sequence
attatatttcttgtgaaaat

SEQ ID NO: 64219 - DNA, 20 bp, Artificial
  CRISPR gRNA sequence
ttatatttcttgtgaaaatt

SEQ ID NO: 64220 - DNA, 20 bp, Artificial
  CRISPR gRNA sequence
tatttcttgtgaaaattgtt

SEQ ID NO: 64221 - DNA, 20 bp, Artificial
  CRISPR gRNA sequence
cttgtgaaaattgtttttct

SEQ ID NO: 64222 - DNA, 20 bp, Artificial
  CRISPR gRNA sequence
ttgtgaaaattgtttttctg

SEQ ID NO: 64223 - DNA, 20 bp, Artificial
  CRISPR gRNA sequence
gtgaaaattgtttttctgac

SEQ ID NO: 64224 - DNA, 20 bp, Artificial
  CRISPR gRNA sequence
tgaaaattgtttttctgact

SEQ ID NO: 64225 - DNA, 20 bp, Artificial
  CRISPR gRNA sequence
tttttctgactttttaaaac

SEQ ID NO: 64226 - DNA, 20 bp, Artificial
  CRISPR gRNA sequence
ttctgactttttaaaacact

SEQ ID NO: 64227 - DNA, 20 bp, Artificial
  CRISPR gRNA sequence
tctgactttttaaaacactc

SEQ ID NO: 64228 - DNA, 20 bp, Artificial
  CRISPR gRNA sequence
ctgactttttaaaacactct

SEQ ID NO: 64229 - DNA, 20 bp, Artificial
  CRISPR gRNA sequence
tgactttttaaaacactctt

SEQ ID NO: 64230 - DNA, 20 bp, Artificial
  CRISPR gRNA sequence
actttttaaaacactcttgc

SEQ ID NO: 64231 - DNA, 20 bp, Artificial
  CRISPR gRNA sequence
tttaaaacactcttgcagga

SEQ ID NO: 64232 - DNA, 20 bp, Artificial
  CRISPR gRNA sequence
ttaaaacactcttgcaggat

SEQ ID NO: 64233 - DNA, 20 bp, Artificial
  CRISPR gRNA sequence
taaaacactcttgcaggatt

SEQ ID NO: 64234 - DNA, 20 bp, Artificial
  CRISPR gRNA sequence
aaaacactcttgcaggattc

SEQ ID NO: 64235 - DNA, 20 bp, Artificial
  CRISPR gRNA sequence
aaacactcttgcaggattca

SEQ ID NO: 64236 - DNA, 20 bp, Artificial
  CRISPR gRNA sequence
ttgcaggattcatcaagcaa

SEQ ID NO: 64237 - DNA, 20 bp, Artificial
  CRISPR gRNA sequence
gcaggattcatcaagcaaag

SEQ ID NO: 64238 - DNA, 20 bp, Artificial
  CRISPR gRNA sequence
caggattcatcaagcaaaga

SEQ ID NO: 64239 - DNA, 20 bp, Artificial
  CRISPR gRNA sequence
atcaagcaaagacataatca

SEQ ID NO: 64240 - DNA, 20 bp, Artificial
  CRISPR gRNA sequence
cacatgcctgatttaaaaca

SEQ ID NO: 64241 - DNA, 20 bp, Artificial
  CRISPR gRNA sequence
acatgcctgatttaaaacac

SEQ ID NO: 64242 - DNA, 20 bp, Artificial
  CRISPR gRNA sequence
atttaaaacacttttgctag

SEQ ID NO: 64243 - DNA, 20 bp, Artificial
  CRISPR gRNA sequence
aaaacacttttgctagttcc

SEQ ID NO: 64244 - DNA, 20 bp, Artificial
  CRISPR gRNA sequence
aaacacttttgctagttccg

SEQ ID NO: 64245 - DNA, 20 bp, Artificial
  CRISPR gRNA sequence
ttgctagttccgttatgttt

SEQ ID NO: 64246 - DNA, 20 bp, Artificial
  CRISPR gRNA sequence
tgctagttccgttatgtttc

SEQ ID NO: 64247 - DNA, 20 bp, Artificial
  CRISPR gRNA sequence
gctagttccgttatgtttcc

SEQ ID NO: 64248 - DNA, 20 bp, Artificial
  CRISPR gRNA sequence
ctagttccgttatgtttccc

SEQ ID NO: 64249 - DNA, 20 bp, Artificial
  CRISPR gRNA sequence
gttccgttatgtttccctgt

SEQ ID NO: 64250 - DNA, 20 bp, Artificial
  CRISPR gRNA sequence
cgttatgtttccctgtcaat

SEQ ID NO: 64251 - DNA, 20 bp, Artificial
  CRISPR gRNA sequence
tgtttccctgtcaattgcaa

SEQ ID NO: 64252 - DNA, 20 bp, Artificial
  CRISPR gRNA sequence
ccctgtcaattgcaaaatca

SEQ ID NO: 64253 - DNA, 20 bp, Artificial
  CRISPR gRNA sequence
cctgtcaattgcaaaatcag

SEQ ID NO: 64254 - DNA, 20 bp, Artificial
  CRISPR gRNA sequence
tcaattgcaaaatcagcttt

SEQ ID NO: 64255 - DNA, 20 bp, Artificial
  CRISPR gRNA sequence
caaaatcagctttatctgga

SEQ ID NO: 64256 - DNA, 20 bp, Artificial
  CRISPR gRNA sequence
tatctggatgtttgaacatt

SEQ ID NO: 64257 - DNA, 20 bp, Artificial
  CRISPR gRNA sequence
atctggatgtttgaacattt

SEQ ID NO: 64258 - DNA, 20 bp, Artificial
  CRISPR gRNA sequence
tctggatgtttgaacatttg

SEQ ID NO: 64259 - DNA, 20 bp, Artificial
  CRISPR gRNA sequence
gatgtttgaacatttggggc

SEQ ID NO: 64260 - DNA, 20 bp, Artificial
  CRISPR gRNA sequence
gaacatttggggcagaaaag

SEQ ID NO: 64261 - DNA, 20 bp, Artificial
  CRISPR gRNA sequence
aacatttggggcagaaaagg

SEQ ID NO: 64262 - DNA, 20 bp, Artificial
  CRISPR gRNA sequence
ggggcagaaaagggtgtgcc

SEQ ID NO: 64263 - DNA, 20 bp, Artificial
  CRISPR gRNA sequence
gggcagaaaagggtgtgcct

SEQ ID NO: 64264 - DNA, 20 bp, Artificial
  CRISPR gRNA sequence
tggtgggtgatgtgctggtt

SEQ ID NO: 64265 - DNA, 20 bp, Artificial
  CRISPR gRNA sequence
gtttccagtctctgggtttc

SEQ ID NO: 64266 - DNA, 20 bp, Artificial
  CRISPR gRNA sequence
ccagtctctgggtttcatgg

SEQ ID NO: 64267 - DNA, 20 bp, Artificial
  CRISPR gRNA sequence
cagtctctgggtttcatggc

SEQ ID NO: 64268 - DNA, 20 bp, Artificial
  CRISPR gRNA sequence
tgggtttcatggcttggtat

SEQ ID NO: 64269 - DNA, 20 bp, Artificial
  CRISPR gRNA sequence
ggtttcatggcttggtatct

SEQ ID NO: 64270 - DNA, 20 bp, Artificial
  CRISPR gRNA sequence
catggcttggtatctgatcc

SEQ ID NO: 64271 - DNA, 20 bp, Artificial
  CRISPR gRNA sequence
atggcttggtatctgatcct

SEQ ID NO: 64272 - DNA, 20 bp, Artificial
  CRISPR gRNA sequence
ggtatctgatcctgcaggga

SEQ ID NO: 64273 - DNA, 20 bp, Artificial
  CRISPR gRNA sequence
gtatctgatcctgcagggag

SEQ ID NO: 64274 - DNA, 20 bp, Artificial
  CRISPR gRNA sequence
atcctgcagggaggcggacc

SEQ ID NO: 64275 - DNA, 20 bp, Artificial
  CRISPR gRNA sequence
cagggaggcggacctcatct

SEQ ID NO: 64276 - DNA, 20 bp, Artificial
  CRISPR gRNA sequence
atcttccttctttccccgcc

SEQ ID NO: 64277 - DNA, 20 bp, Artificial
  CRISPR gRNA sequence
ccttctttccccgcccacag

SEQ ID NO: 64278 - DNA, 20 bp, Artificial
  CRISPR gRNA sequence
cttctttccccgcccacaga

SEQ ID NO: 64279 - DNA, 20 bp, Artificial
  CRISPR gRNA sequence
ctttccccgcccacagagac

SEQ ID NO: 64280 - DNA, 20 bp, Artificial
  CRISPR gRNA sequence
tttccccgcccacagagaca

SEQ ID NO: 64281 - DNA, 20 bp, Artificial
  CRISPR gRNA sequence
tccccgcccacagagacaac

SEQ ID NO: 64282 - DNA, 20 bp, Artificial
  CRISPR gRNA sequence
ccccgcccacagagacaact

SEQ ID NO: 64283 - DNA, 20 bp, Artificial
  CRISPR gRNA sequence
cccgcccacagagacaactg

SEQ ID NO: 64284 - DNA, 20 bp, Artificial
  CRISPR gRNA sequence
cagagctacaaaggtaagaa

SEQ ID NO: 64285 - DNA, 20 bp, Artificial
  CRISPR gRNA sequence
caaaggtaagaagccaagag

SEQ ID NO: 64286 - DNA, 20 bp, Artificial
  CRISPR gRNA sequence
gggccatccttagaagcaac

SEQ ID NO: 64287 - DNA, 20 bp, Artificial
  CRISPR gRNA sequence
agaagcaacttgggctcagg

SEQ ID NO: 64288 - DNA, 20 bp, Artificial
  CRISPR gRNA sequence
gaagcaacttgggctcaggc

SEQ ID NO: 64289 - DNA, 20 bp, Artificial
  CRISPR gRNA sequence
gggctcaggcagttgagggg

SEQ ID NO: 64290 - DNA, 20 bp, Artificial
  CRISPR gRNA sequence
ggctcaggcagttgagggga

SEQ ID NO: 64291 - DNA, 20 bp, Artificial
  CRISPR gRNA sequence
aggcagttgaggggaaaggt

SEQ ID NO: 64292 - DNA, 20 bp, Artificial
  CRISPR gRNA sequence
aggggaaaggtgaccaagag

SEQ ID NO: 64293 - DNA, 20 bp, Artificial
  CRISPR gRNA sequence
ggaagagctggggtatggga

SEQ ID NO: 64294 - DNA, 20 bp, Artificial
  CRISPR gRNA sequence
gggtatgggaattcttcctg

SEQ ID NO: 64295 - DNA, 20 bp, Artificial
  CRISPR gRNA sequence
ttcctgctactgctgcactg

SEQ ID NO: 64296 - DNA, 20 bp, Artificial
  CRISPR gRNA sequence
cctgctactgctgcactgag

SEQ ID NO: 64297 - DNA, 20 bp, Artificial
  CRISPR gRNA sequence
ctgctactgctgcactgagg

SEQ ID NO: 64298 - DNA, 20 bp, Artificial
  CRISPR gRNA sequence
ctactgctgcactgaggaat

SEQ ID NO: 64299 - DNA, 20 bp, Artificial
  CRISPR gRNA sequence
ctgctgcactgaggaatgaa

SEQ ID NO: 64300 - DNA, 20 bp, Artificial
  CRISPR gRNA sequence
ctgcactgaggaatgaatta

SEQ ID NO: 64301 - DNA, 20 bp, Artificial
  CRISPR gRNA sequence
cactgaggaatgaattactg

SEQ ID NO: 64302 - DNA, 20 bp, Artificial
  CRISPR gRNA sequence
aggaatgaattactgcttag

SEQ ID NO: 64303 - DNA, 20 bp, Artificial
  CRISPR gRNA sequence
ctgcttaggttggcaaagga

SEQ ID NO: 64304 - DNA, 20 bp, Artificial
  CRISPR gRNA sequence
cttaggttggcaaaggattt

SEQ ID NO: 64305 - DNA, 20 bp, Artificial
  CRISPR gRNA sequence
aggttggcaaaggattttaa

SEQ ID NO: 64306 - DNA, 20 bp, Artificial
  CRISPR gRNA sequence
ggttggcaaaggattttaac

SEQ ID NO: 64307 - DNA, 20 bp, Artificial
  CRISPR gRNA sequence
gcaaaggattttaacttcct

SEQ ID NO: 64308 - DNA, 20 bp, Artificial
  CRISPR gRNA sequence
taacttcctctagcgtgtcc

SEQ ID NO: 64309 - DNA, 20 bp, Artificial
  CRISPR gRNA sequence
aacttcctctagcgtgtcca

SEQ ID NO: 64310 - DNA, 20 bp, Artificial
  CRISPR gRNA sequence
acttcctctagcgtgtccag

SEQ ID NO: 64311 - DNA, 20 bp, Artificial
  CRISPR gRNA sequence
cctctagcgtgtccagacca

SEQ ID NO: 64312 - DNA, 20 bp, Artificial
  CRISPR gRNA sequence
ctctagcgtgtccagaccac

SEQ ID NO: 64313 - DNA, 20 bp, Artificial
  CRISPR gRNA sequence
tagcgtgtccagaccacatc

SEQ ID NO: 64314 - DNA, 20 bp, Artificial
  CRISPR gRNA sequence
gcgtgtccagaccacatctg

SEQ ID NO: 64315 - DNA, 20 bp, Artificial
  CRISPR gRNA sequence
gtccctgtggaaggaagcat

SEQ ID NO: 64316 - DNA, 20 bp, Artificial
  CRISPR gRNA sequence
tggaaggaagcatccccaga

SEQ ID NO: 64317 - DNA, 20 bp, Artificial
  CRISPR gRNA sequence
agaggaaggcaaacccttgg

SEQ ID NO: 64318 - DNA, 20 bp, Artificial
  CRISPR gRNA sequence
ggggagaacataaagatact

SEQ ID NO: 64319 - DNA, 20 bp, Artificial
  CRISPR gRNA sequence
gggagaacataaagatactg

SEQ ID NO: 64320 - DNA, 20 bp, Artificial
  CRISPR gRNA sequence
ttagactggcattactagat

SEQ ID NO: 64321 - DNA, 20 bp, Artificial
  CRISPR gRNA sequence
gactggcattactagatggt

SEQ ID NO: 64322 - DNA, 20 bp, Artificial
  CRISPR gRNA sequence
gcattactagatggtgaaaa

SEQ ID NO: 64323 - DNA, 20 bp, Artificial
  CRISPR gRNA sequence
ctagatggtgaaaactctgg

SEQ ID NO: 64324 - DNA, 20 bp, Artificial
  CRISPR gRNA sequence
gatggtgaaaactctggaaa

SEQ ID NO: 64325 - DNA, 20 bp, Artificial
  CRISPR gRNA sequence
tggaaaagcccttacaactg

SEQ ID NO: 64326 - DNA, 20 bp, Artificial
  CRISPR gRNA sequence
gaaaagcccttacaactgaa

SEQ ID NO: 64327 - DNA, 20 bp, Artificial
  CRISPR gRNA sequence
acaactgaaaaaagacaggg

SEQ ID NO: 64328 - DNA, 20 bp, Artificial
  CRISPR gRNA sequence
caactgaaaaaagacaggga

SEQ ID NO: 64329 - DNA, 20 bp, Artificial
  CRISPR gRNA sequence
aaaaaagacagggagggcaa

SEQ ID NO: 64330 - DNA, 20 bp, Artificial
  CRISPR gRNA sequence
tggtacctacatcttagggt

SEQ ID NO: 64331 - DNA, 20 bp, Artificial
  CRISPR gRNA sequence
catcttagggttgttctgag

SEQ ID NO: 64332 - DNA, 20 bp, Artificial
  CRISPR gRNA sequence
agggttgttctgagaattaa

SEQ ID NO: 64333 - DNA, 20 bp, Artificial
  CRISPR gRNA sequence
gggttgttctgagaattaaa

SEQ ID NO: 64334 - DNA, 20 bp, Artificial
  CRISPR gRNA sequence
ttctgagaattaaatgagtt

SEQ ID NO: 64335 - DNA, 20 bp, Artificial
  CRISPR gRNA sequence
tgagaattaaatgagttact

SEQ ID NO: 64336 - DNA, 20 bp, Artificial
  CRISPR gRNA sequence
agaattaaatgagttactac

SEQ ID NO: 64337 - DNA, 20 bp, Artificial
  CRISPR gRNA sequence
aatgagttactacacttaag

SEQ ID NO: 64338 - DNA, 20 bp, Artificial
  CRISPR gRNA sequence
ctacacttaaggagtttaga

SEQ ID NO: 64339 - DNA, 20 bp, Artificial
  CRISPR gRNA sequence
cacttaaggagtttagagca

SEQ ID NO: 64340 - DNA, 20 bp, Artificial
  CRISPR gRNA sequence
aaggagtttagagcactgtt

SEQ ID NO: 64341 - DNA, 20 bp, Artificial
  CRISPR gRNA sequence
aggagtttagagcactgttg

SEQ ID NO: 64342 - DNA, 20 bp, Artificial
  CRISPR gRNA sequence
agagcactgttggcatgcag

SEQ ID NO: 64343 - DNA, 20 bp, Artificial
  CRISPR gRNA sequence
gagcactgttggcatgcagt

SEQ ID NO: 64344 - DNA, 20 bp, Artificial
  CRISPR gRNA sequence
ttggcatgcagtgggcagtc

SEQ ID NO: 64345 - DNA, 20 bp, Artificial
  CRISPR gRNA sequence
gcatgcagtgggcagtcaaa

SEQ ID NO: 64346 - DNA, 20 bp, Artificial
  CRISPR gRNA sequence
gctattccagctgtgcatgg

SEQ ID NO: 64347 - DNA, 20 bp, Artificial
  CRISPR gRNA sequence
ttccagctgtgcatggattc

SEQ ID NO: 64348 - DNA, 20 bp, Artificial
  CRISPR gRNA sequence
cagctgtgcatggattccag

SEQ ID NO: 64349 - DNA, 20 bp, Artificial
  CRISPR gRNA sequence
tgcatggattccagcttggc

SEQ ID NO: 64350 - DNA, 20 bp, Artificial
  CRISPR gRNA sequence
cagcttggccagtcttggat

SEQ ID NO: 64351 - DNA, 20 bp, Artificial
  CRISPR gRNA sequence
ggccagtcttggatgggctg

SEQ ID NO: 64352 - DNA, 20 bp, Artificial
  CRISPR gRNA sequence
gccagtcttggatgggctga

SEQ ID NO: 64353 - DNA, 20 bp, Artificial
  CRISPR gRNA sequence
ggatgggctgagaaaaggga

SEQ ID NO: 64354 - DNA, 20 bp, Artificial
  CRISPR gRNA sequence
gatgggctgagaaaagggag

SEQ ID NO: 64355 - DNA, 20 bp, Artificial
  CRISPR gRNA sequence
agaaaagggagctgcttttc

SEQ ID NO: 64356 - DNA, 20 bp, Artificial
  CRISPR gRNA sequence
cttttccctaaaagaccatc

SEQ ID NO: 64357 - DNA, 20 bp, Artificial
  CRISPR gRNA sequence
ttccctaaaagaccatccca

SEQ ID NO: 64358 - DNA, 20 bp, Artificial
  CRISPR gRNA sequence
tccctaaaagaccatcccaa

SEQ ID NO: 64359 - DNA, 20 bp, Artificial
  CRISPR gRNA sequence
ccctaaaagaccatcccaac

SEQ ID NO: 64360 - DNA, 20 bp, Artificial
  CRISPR gRNA sequence
cctaaaagaccatcccaact

SEQ ID NO: 64361 - DNA, 20 bp, Artificial
  CRISPR gRNA sequence
aaagaccatcccaactgtgc

SEQ ID NO: 64362 - DNA, 20 bp, Artificial
  CRISPR gRNA sequence
tgctctaccacactttgctc

SEQ ID NO: 64363 - DNA, 20 bp, Artificial
  CRISPR gRNA sequence
taccacactttgctctcctg

SEQ ID NO: 64364 - DNA, 20 bp, Artificial
  CRISPR gRNA sequence
ccacactttgctctcctggc

SEQ ID NO: 64365 - DNA, 20 bp, Artificial
  CRISPR gRNA sequence
tgctctcctggctaagactc

SEQ ID NO: 64366 - DNA, 20 bp, Artificial
  CRISPR gRNA sequence
gctctcctggctaagactca

SEQ ID NO: 64367 - DNA, 20 bp, Artificial
  CRISPR gRNA sequence
ctctcctggctaagactcag

SEQ ID NO: 64368 - DNA, 20 bp, Artificial
  CRISPR gRNA sequence
tcctggctaagactcagaga

SEQ ID NO: 64369 - DNA, 20 bp, Artificial
  CRISPR gRNA sequence
ctggctaagactcagagaca

SEQ ID NO: 64370 - DNA, 20 bp, Artificial
  CRISPR gRNA sequence
gctaagactcagagacagat

SEQ ID NO: 64371 - DNA, 20 bp, Artificial
  CRISPR gRNA sequence
agactcagagacagatgtat

SEQ ID NO: 64372 - DNA, 20 bp, Artificial
  CRISPR gRNA sequence
agagacagatgtatgtatgc

SEQ ID NO: 64373 - DNA, 20 bp, Artificial
  CRISPR gRNA sequence
agcaatctctttcccttctc

SEQ ID NO: 64374 - DNA, 20 bp, Artificial
  CRISPR gRNA sequence
tttcccttctctggatctcg

SEQ ID NO: 64375 - DNA, 20 bp, Artificial
  CRISPR gRNA sequence
tcccttctctggatctcgat

SEQ ID NO: 64376 - DNA, 20 bp, Artificial
  CRISPR gRNA sequence
cccttctctggatctcgatt

SEQ ID NO: 64377 - DNA, 20 bp, Artificial
  CRISPR gRNA sequence
ccttctctggatctcgattc

SEQ ID NO: 64378 - DNA, 20 bp, Artificial
  CRISPR gRNA sequence
ctctggatctcgattccttg

SEQ ID NO: 64379 - DNA, 20 bp, Artificial
  CRISPR gRNA sequence
tctggatctcgattccttgc

SEQ ID NO: 64380 - DNA, 20 bp, Artificial
  CRISPR gRNA sequence
tggatctcgattccttgctt

SEQ ID NO: 64381 - DNA, 20 bp, Artificial
  CRISPR gRNA sequence
gatctcgattccttgcttgt

SEQ ID NO: 64382 - DNA, 20 bp, Artificial
  CRISPR gRNA sequence
gattccttgcttgtataatg

SEQ ID NO: 64383 - DNA, 20 bp, Artificial
  CRISPR gRNA sequence
cttgcttgtataatgacctg

SEQ ID NO: 64384 - DNA, 20 bp, Artificial
  CRISPR gRNA sequence
gcttgtataatgacctggta

SEQ ID NO: 64385 - DNA, 20 bp, Artificial
  CRISPR gRNA sequence
cttgtataatgacctggtag

SEQ ID NO: 64386 - DNA, 20 bp, Artificial
  CRISPR gRNA sequence
gtataatgacctggtagtgt

SEQ ID NO: 64387 - DNA, 20 bp, Artificial
  CRISPR gRNA sequence
tataatgacctggtagtgta

SEQ ID NO: 64388 - DNA, 20 bp, Artificial
  CRISPR gRNA sequence
gtagtgtaggaccaatgttg

SEQ ID NO: 64389 - DNA, 20 bp, Artificial
  CRISPR gRNA sequence
ctgggtgcggtggctcatgc

SEQ ID NO: 64390 - DNA, 20 bp, Artificial
  CRISPR gRNA sequence
ggtgcggtggctcatgcctg

SEQ ID NO: 64391 - DNA, 20 bp, Artificial
  CRISPR gRNA sequence
atgcctgtaatcctagcact

SEQ ID NO: 64392 - DNA, 20 bp, Artificial
  CRISPR gRNA sequence
taatcctagcactttggaac

SEQ ID NO: 64393 - DNA, 20 bp, Artificial
  CRISPR gRNA sequence
gcactttggaacgccaagca

SEQ ID NO: 64394 - DNA, 20 bp, Artificial
  CRISPR gRNA sequence
tggaacgccaagcacgagaa

SEQ ID NO: 64395 - DNA, 20 bp, Artificial
  CRISPR gRNA sequence
ggaacgccaagcacgagaat

SEQ ID NO: 64396 - DNA, 20 bp, Artificial
  CRISPR gRNA sequence
gaacgccaagcacgagaatc

SEQ ID NO: 64397 - DNA, 20 bp, Artificial
  CRISPR gRNA sequence
ttgattccaggtgttcaaga

SEQ ID NO: 64398 - DNA, 20 bp, Artificial
  CRISPR gRNA sequence
gattccaggtgttcaagacc

SEQ ID NO: 64399 - DNA, 20 bp, Artificial
  CRISPR gRNA sequence
attccaggtgttcaagacca

SEQ ID NO: 64400 - DNA, 20 bp, Artificial
  CRISPR gRNA sequence
caggtgttcaagaccagcct

SEQ ID NO: 64401 - DNA, 20 bp, Artificial
  CRISPR gRNA sequence
aagaccagcctgggcaacat

SEQ ID NO: 64402 - DNA, 20 bp, Artificial
  CRISPR gRNA sequence
ggcaacatagcaagacccca

SEQ ID NO: 64403 - DNA, 20 bp, Artificial
  CRISPR gRNA sequence
taaaaaaaaaaggcaggcgt

SEQ ID NO: 64404 - DNA, 20 bp, Artificial
  CRISPR gRNA sequence
aaaaaaaaaggcaggcgtgg

SEQ ID NO: 64405 - DNA, 20 bp, Artificial
  CRISPR gRNA sequence
tagtcccagctactcaagat

SEQ ID NO: 64406 - DNA, 20 bp, Artificial
  CRISPR gRNA sequence
ctcaagatgctgacgttggg

SEQ ID NO: 64407 - DNA, 20 bp, Artificial
  CRISPR gRNA sequence
aagatgctgacgttgggagg

SEQ ID NO: 64408 - DNA, 20 bp, Artificial
  CRISPR gRNA sequence
acgttgggaggatcgcttga

SEQ ID NO: 64409 - DNA, 20 bp, Artificial
  CRISPR gRNA sequence
ggaggatcgcttgagcctgg

SEQ ID NO: 64410 - DNA, 20 bp, Artificial
  CRISPR gRNA sequence
gagcctgggagcttgagcca

SEQ ID NO: 64411 - DNA, 20 bp, Artificial
  CRISPR gRNA sequence
agcctgggagcttgagccat

SEQ ID NO: 64412 - DNA, 20 bp, Artificial
  CRISPR gRNA sequence
ggagcttgagccatgatcac

SEQ ID NO: 64413 - DNA, 20 bp, Artificial
  CRISPR gRNA sequence
gagccatgatcacaccactg

SEQ ID NO: 64414 - DNA, 20 bp, Artificial
  CRISPR gRNA sequence
agccatgatcacaccactgt

SEQ ID NO: 64415 - DNA, 20 bp, Artificial
  CRISPR gRNA sequence
tactccagcctgggtgacag

SEQ ID NO: 64416 - DNA, 20 bp, Artificial
  CRISPR gRNA sequence
cagcctgggtgacagagagg

SEQ ID NO: 64417 - DNA, 20 bp, Artificial
  CRISPR gRNA sequence
ggtgacagagagggactctg

SEQ ID NO: 64418 - DNA, 20 bp, Artificial
  CRISPR gRNA sequence
tgtctcaaaaaatgacccac

SEQ ID NO: 64419 - DNA, 20 bp, Artificial
  CRISPR gRNA sequence
tctcaaaaaatgacccacta

SEQ ID NO: 64420 - DNA, 20 bp, Artificial
  CRISPR gRNA sequence
aaaaaatgacccactaggac

SEQ ID NO: 64421 - DNA, 20 bp, Artificial
  CRISPR gRNA sequence
ggaccagtgtcactttcttt

SEQ ID NO: 64422 - DNA, 20 bp, Artificial
  CRISPR gRNA sequence
tcttttccctctaactgctt

SEQ ID NO: 64423 - DNA, 20 bp, Artificial
  CRISPR gRNA sequence
cttttccctctaactgctta

SEQ ID NO: 64424 - DNA, 20 bp, Artificial
  CRISPR gRNA sequence
ttttccctctaactgcttaa

SEQ ID NO: 64425 - DNA, 20 bp, Artificial
  CRISPR gRNA sequence
ttccctctaactgcttaaag

SEQ ID NO: 64426 - DNA, 20 bp, Artificial
  CRISPR gRNA sequence
tccctctaactgcttaaagc

SEQ ID NO: 64427 - DNA, 20 bp, Artificial
  CRISPR gRNA sequence
ccctctaactgcttaaagct

SEQ ID NO: 64428 - DNA, 20 bp, Artificial
  CRISPR gRNA sequence
cctctaactgcttaaagctg

SEQ ID NO: 64429 - DNA, 20 bp, Artificial
  CRISPR gRNA sequence
taactgcttaaagctgtgat

SEQ ID NO: 64430 - DNA, 20 bp, Artificial
  CRISPR gRNA sequence
actgcttaaagctgtgatgc

SEQ ID NO: 64431 - DNA, 20 bp, Artificial
  CRISPR gRNA sequence
cttaaagctgtgatgctcag

SEQ ID NO: 64432 - DNA, 20 bp, Artificial
  CRISPR gRNA sequence
aaagctgtgatgctcagtag

SEQ ID NO: 64433 - DNA, 20 bp, Artificial
  CRISPR gRNA sequence
aagctgtgatgctcagtagg

SEQ ID NO: 64434 - DNA, 20 bp, Artificial
  CRISPR gRNA sequence
tgatgctcagtaggatagcc

SEQ ID NO: 64435 - DNA, 20 bp, Artificial
  CRISPR gRNA sequence
agtaggatagccactagccc

SEQ ID NO: 64436 - DNA, 20 bp, Artificial
  CRISPR gRNA sequence
gccccatatggctatttcaa

SEQ ID NO: 64437 - DNA, 20 bp, Artificial
  CRISPR gRNA sequence
tttcaatttaaataaattaa

SEQ ID NO: 64438 - DNA, 20 bp, Artificial
  CRISPR gRNA sequence
caatttaaataaattaaaat

SEQ ID NO: 64439 - DNA, 20 bp, Artificial
  CRISPR gRNA sequence
aatttaaataaattaaaatt

SEQ ID NO: 64440 - DNA, 20 bp, Artificial
  CRISPR gRNA sequence
aaataaattaaaattttaat

SEQ ID NO: 64441 - DNA, 20 bp, Artificial
  CRISPR gRNA sequence
aataaattaaaattttaatg

SEQ ID NO: 64442 - DNA, 20 bp, Artificial
  CRISPR gRNA sequence
aaattttaatgctatttcaa

SEQ ID NO: 64443 - DNA, 20 bp, Artificial
  CRISPR gRNA sequence
taatgctatttcaatttaaa

SEQ ID NO: 64444 - DNA, 20 bp, Artificial
  CRISPR gRNA sequence
aatgctatttcaatttaaat

SEQ ID NO: 64445 - DNA, 20 bp, Artificial
  CRISPR gRNA sequence
atgctatttcaatttaaata

SEQ ID NO: 64446 - DNA, 20 bp, Artificial
  CRISPR gRNA sequence
tttcaatttaaataaattaa

SEQ ID NO: 64447 - DNA, 20 bp, Artificial
  CRISPR gRNA sequence
caatttaaataaattaaaat

SEQ ID NO: 64448 - DNA, 20 bp, Artificial
  CRISPR gRNA sequence
aatttaaataaattaaaatt

SEQ ID NO: 64449 - DNA, 20 bp, Artificial
  CRISPR gRNA sequence
aaataaattaaaattttaat

SEQ ID NO: 64450 - DNA, 20 bp, Artificial
  CRISPR gRNA sequence
aataaattaaaattttaatg

SEQ ID NO: 64451 - DNA, 20 bp, Artificial
  CRISPR gRNA sequence
aaattttaatgctattttaa

SEQ ID NO: 64452 - DNA, 20 bp, Artificial
  CRISPR gRNA sequence
taatgctattttaatttaaa

SEQ ID NO: 64453 - DNA, 20 bp, Artificial
  CRISPR gRNA sequence
aatgctattttaatttaaat

SEQ ID NO: 64454 - DNA, 20 bp, Artificial
  CRISPR gRNA sequence
atgctattttaatttaaata

SEQ ID NO: 64455 - DNA, 20 bp, Artificial
  CRISPR gRNA sequence
ttttaatttaaataaattaa

SEQ ID NO: 64456 - DNA, 20 bp, Artificial
  CRISPR gRNA sequence
taatttaaataaattaaaat

SEQ ID NO: 64457 - DNA, 20 bp, Artificial
  CRISPR gRNA sequence
aatttaaataaattaaaatt

SEQ ID NO: 64458 - DNA, 20 bp, Artificial
  CRISPR gRNA sequence
atttaaataaattaaaatta

SEQ ID NO: 64459 - DNA, 20 bp, Artificial
  CRISPR gRNA sequence
aaataaattaaaattaagta

SEQ ID NO: 64460 - DNA, 20 bp, Artificial
  CRISPR gRNA sequence
aataaattaaaattaagtaa

SEQ ID NO: 64461 - DNA, 20 bp, Artificial
  CRISPR gRNA sequence
aaattaagtaaaatgaaatt

SEQ ID NO: 64462 - DNA, 20 bp, Artificial
  CRISPR gRNA sequence
agtaaaatgaaattttcagt

SEQ ID NO: 64463 - DNA, 20 bp, Artificial
  CRISPR gRNA sequence
tcagttcattagtcacatta

SEQ ID NO: 64464 - DNA, 20 bp, Artificial
  CRISPR gRNA sequence
cagttcattagtcacattag

SEQ ID NO: 64465 - DNA, 20 bp, Artificial
  CRISPR gRNA sequence
agttcattagtcacattagc

SEQ ID NO: 64466 - DNA, 20 bp, Artificial
  CRISPR gRNA sequence
attagtcacattagctatat

SEQ ID NO: 64467 - DNA, 20 bp, Artificial
  CRISPR gRNA sequence
gtcacattagctatatttca

SEQ ID NO: 64468 - DNA, 20 bp, Artificial
  CRISPR gRNA sequence
gctatatttcaactgctcag

SEQ ID NO: 64469 - DNA, 20 bp, Artificial
  CRISPR gRNA sequence
tatttcaactgctcagtggc

SEQ ID NO: 64470 - DNA, 20 bp, Artificial
  CRISPR gRNA sequence
caactgctcagtggccatag

SEQ ID NO: 64471 - DNA, 20 bp, Artificial
  CRISPR gRNA sequence
aactgctcagtggccatagg

SEQ ID NO: 64472 - DNA, 20 bp, Artificial
  CRISPR gRNA sequence
ctcagtggccataggtggct

SEQ ID NO: 64473 - DNA, 20 bp, Artificial
  CRISPR gRNA sequence
agtggccataggtggctagt

SEQ ID NO: 64474 - DNA, 20 bp, Artificial
  CRISPR gRNA sequence
gtggctcccatagcaagtgg

SEQ ID NO: 64475 - DNA, 20 bp, Artificial
  CRISPR gRNA sequence
ccatagcaagtggtacagat

SEQ ID NO: 64476 - DNA, 20 bp, Artificial
  CRISPR gRNA sequence
ccatcattgcagaaagttct

SEQ ID NO: 64477 - DNA, 20 bp, Artificial
  CRISPR gRNA sequence
catcattgcagaaagttcta

SEQ ID NO: 64478 - DNA, 20 bp, Artificial
  CRISPR gRNA sequence
cagaaagttctattaaacag

SEQ ID NO: 64479 - DNA, 20 bp, Artificial
  CRISPR gRNA sequence
tattaaacaggctggcatgg

SEQ ID NO: 64480 - DNA, 20 bp, Artificial
  CRISPR gRNA sequence
ttaaacaggctggcatggtg

SEQ ID NO: 64481 - DNA, 20 bp, Artificial
  CRISPR gRNA sequence
aacaggctggcatggtggct

SEQ ID NO: 64482 - DNA, 20 bp, Artificial
  CRISPR gRNA sequence
gcatggtggctcatgtctgt

SEQ ID NO: 64483 - DNA, 20 bp, Artificial
  CRISPR gRNA sequence
atgtctgtaaccccagcact

SEQ ID NO: 64484 - DNA, 20 bp, Artificial
  CRISPR gRNA sequence
taaccccagcactttgagag

SEQ ID NO: 64485 - DNA, 20 bp, Artificial
  CRISPR gRNA sequence
tgagaggctgagggggcagg

SEQ ID NO: 64486 - DNA, 20 bp, Artificial
  CRISPR gRNA sequence
gagaggctgagggggcagga

SEQ ID NO: 64487 - DNA, 20 bp, Artificial
  CRISPR gRNA sequence
agaggctgagggggcaggat

SEQ ID NO: 64488 - DNA, 20 bp, Artificial
  CRISPR gRNA sequence
agggggcaggatcgcttgaa

SEQ ID NO: 64489 - DNA, 20 bp, Artificial
  CRISPR gRNA sequence
gaagctaggagttcaagacc

SEQ ID NO: 64490 - DNA, 20 bp, Artificial
  CRISPR gRNA sequence
aagctaggagttcaagacca

SEQ ID NO: 64491 - DNA, 20 bp, Artificial
  CRISPR gRNA sequence
ggagttcaagaccagcctgg

SEQ ID NO: 64492 - DNA, 20 bp, Artificial
  CRISPR gRNA sequence
aagaccagcctgggcaacaa

SEQ ID NO: 64493 - DNA, 20 bp, Artificial
  CRISPR gRNA sequence
ggcaacaaagtgagaccccc

SEQ ID NO: 64494 - DNA, 20 bp, Artificial
  CRISPR gRNA sequence
tacaaaaaaaaaaaaaaaat

SEQ ID NO: 64495 - DNA, 20 bp, Artificial
  CRISPR gRNA sequence
caaaaaaaaaaaaaaaatag

SEQ ID NO: 64496 - DNA, 20 bp, Artificial
  CRISPR gRNA sequence
ggcatggtgattcactccta

SEQ ID NO: 64497 - DNA, 20 bp, Artificial
  CRISPR gRNA sequence
actcctatagtaccagttac

SEQ ID NO: 64498 - DNA, 20 bp, Artificial
  CRISPR gRNA sequence
ctatagtaccagttactcag

SEQ ID NO: 64499 - DNA, 20 bp, Artificial
  CRISPR gRNA sequence
tagtaccagttactcaggaa

SEQ ID NO: 64500 - DNA, 20 bp, Artificial
  CRISPR gRNA sequence
ctcaggaagccaaggtggga

SEQ ID NO: 64501 - DNA, 20 bp, Artificial
  CRISPR gRNA sequence
aggaagccaaggtgggagga

SEQ ID NO: 64502 - DNA, 20 bp, Artificial
  CRISPR gRNA sequence
gagcccaggagtttgaggct

SEQ ID NO: 64503 - DNA, 20 bp, Artificial
  CRISPR gRNA sequence
agcccaggagtttgaggctg

SEQ ID NO: 64504 - DNA, 20 bp, Artificial
  CRISPR gRNA sequence
gaggctgcagtgaactggga

SEQ ID NO: 64505 - DNA, 20 bp, Artificial
  CRISPR gRNA sequence
aggctgcagtgaactgggat

SEQ ID NO: 64506 - DNA, 20 bp, Artificial
  CRISPR gRNA sequence
cagtgaactgggatagagcc

SEQ ID NO: 64507 - DNA, 20 bp, Artificial
  CRISPR gRNA sequence
ggatagagccactgcactcc

SEQ ID NO: 64508 - DNA, 20 bp, Artificial
  CRISPR gRNA sequence
cactccagcttggggactga

SEQ ID NO: 64509 - DNA, 20 bp, Artificial
  CRISPR gRNA sequence
cagcttggggactgagtggg

SEQ ID NO: 64510 - DNA, 20 bp, Artificial
  CRISPR gRNA sequence
ggggactgagtgggaccctg

SEQ ID NO: 64511 - DNA, 20 bp, Artificial
  CRISPR gRNA sequence
gggactgagtgggaccctgt

SEQ ID NO: 64512 - DNA, 20 bp, Artificial
  CRISPR gRNA sequence
agtgggaccctgtctctaaa

SEQ ID NO: 64513 - DNA, 20 bp, Artificial
  CRISPR gRNA sequence
tctctaaaaaaaaaaaaatg

SEQ ID NO: 64514 - DNA, 20 bp, Artificial
  CRISPR gRNA sequence
taaaaaaaaaaaaatggtta

SEQ ID NO: 64515 - DNA, 20 bp, Artificial
  CRISPR gRNA sequence
aaaaaaaaaaaatggttagc

SEQ ID NO: 64516 - DNA, 20 bp, Artificial
  CRISPR gRNA sequence
gcaccaatccaaaaagtctg

SEQ ID NO: 64517 - DNA, 20 bp, Artificial
  CRISPR gRNA sequence
tgaaacctggctcatgatgt

SEQ ID NO: 64518 - DNA, 20 bp, Artificial
  CRISPR gRNA sequence
gctcatgatgtcctagcttc

SEQ ID NO: 64519 - DNA, 20 bp, Artificial
  CRISPR gRNA sequence
atgatgtcctagcttccctg

SEQ ID NO: 64520 - DNA, 20 bp, Artificial
  CRISPR gRNA sequence
gcttccctgcatcccctaac

SEQ ID NO: 64521 - DNA, 20 bp, Artificial
  CRISPR gRNA sequence
ccctgcatcccctaacgctc

SEQ ID NO: 64522 - DNA, 20 bp, Artificial
  CRISPR gRNA sequence
cctgcatcccctaacgctcc

SEQ ID NO: 64523 - DNA, 20 bp, Artificial
  CRISPR gRNA sequence
catcccctaacgctccctca

SEQ ID NO: 64524 - DNA, 20 bp, Artificial
  CRISPR gRNA sequence
acgctccctcagcccagtgg

SEQ ID NO: 64525 - DNA, 20 bp, Artificial
  CRISPR gRNA sequence
cctcagcccagtgggagaga

SEQ ID NO: 64526 - DNA, 20 bp, Artificial
  CRISPR gRNA sequence
agcccagtgggagagagtct

SEQ ID NO: 64527 - DNA, 20 bp, Artificial
  CRISPR gRNA sequence
tggtttaccatagcctggac

SEQ ID NO: 64528 - DNA, 20 bp, Artificial
  CRISPR gRNA sequence
accatagcctggactcactg

SEQ ID NO: 64529 - DNA, 20 bp, Artificial
  CRISPR gRNA sequence
ccatagcctggactcactgc

SEQ ID NO: 64530 - DNA, 20 bp, Artificial
  CRISPR gRNA sequence
gactcactgcatacagctca

SEQ ID NO: 64531 - DNA, 20 bp, Artificial
  CRISPR gRNA sequence
actgcatacagctcatgctc

SEQ ID NO: 64532 - DNA, 20 bp, Artificial
  CRISPR gRNA sequence
catacagctcatgctcctcg

SEQ ID NO: 64533 - DNA, 20 bp, Artificial
  CRISPR gRNA sequence
atgctcctcgccttctgaac

SEQ ID NO: 64534 - DNA, 20 bp, Artificial
  CRISPR gRNA sequence
ctcgccttctgaaccacaga

SEQ ID NO: 64535 - DNA, 20 bp, Artificial
  CRISPR gRNA sequence
gccttctgaaccacagacag

SEQ ID NO: 64536 - DNA, 20 bp, Artificial
  CRISPR gRNA sequence
ctgaaccacagacagcacat

SEQ ID NO: 64537 - DNA, 20 bp, Artificial
  CRISPR gRNA sequence
tgaaccacagacagcacatc

SEQ ID NO: 64538 - DNA, 20 bp, Artificial
  CRISPR gRNA sequence
aaccacagacagcacatcca

SEQ ID NO: 64539 - DNA, 20 bp, Artificial
  CRISPR gRNA sequence
ctgtttactaaccttcgatt

SEQ ID NO: 64540 - DNA, 20 bp, Artificial
  CRISPR gRNA sequence
tgtttactaaccttcgattt

SEQ ID NO: 64541 - DNA, 20 bp, Artificial
  CRISPR gRNA sequence
tttactaaccttcgatttta

SEQ ID NO: 64542 - DNA, 20 bp, Artificial
  CRISPR gRNA sequence
actaaccttcgattttacac

SEQ ID NO: 64543 - DNA, 20 bp, Artificial
  CRISPR gRNA sequence
ctaaccttcgattttacacc

SEQ ID NO: 64544 - DNA, 20 bp, Artificial
  CRISPR gRNA sequence
accttcgattttacacctat

SEQ ID NO: 64545 - DNA, 20 bp, Artificial
  CRISPR gRNA sequence
cgattttacacctatgctgg

SEQ ID NO: 64546 - DNA, 20 bp, Artificial
  CRISPR gRNA sequence
gattttacacctatgctggg

SEQ ID NO: 64547 - DNA, 20 bp, Artificial
  CRISPR gRNA sequence
tacacctatgctgggtactt

SEQ ID NO: 64548 - DNA, 20 bp, Artificial
  CRISPR gRNA sequence
acacctatgctgggtacttg

SEQ ID NO: 64549 - DNA, 20 bp, Artificial
  CRISPR gRNA sequence
cacctatgctgggtacttgg

SEQ ID NO: 64550 - DNA, 20 bp, Artificial
  CRISPR gRNA sequence
tgctgggtacttggacatac

SEQ ID NO: 64551 - DNA, 20 bp, Artificial
  CRISPR gRNA sequence
ggtacttggacatacattgt

SEQ ID NO: 64552 - DNA, 20 bp, Artificial
  CRISPR gRNA sequence
ggacatacattgtctcattc

SEQ ID NO: 64553 - DNA, 20 bp, Artificial
  CRISPR gRNA sequence
gacatacattgtctcattca

SEQ ID NO: 64554 - DNA, 20 bp, Artificial
  CRISPR gRNA sequence
tctcattcaatccttcaggt

SEQ ID NO: 64555 - DNA, 20 bp, Artificial
  CRISPR gRNA sequence
attcaatccttcaggtacct

SEQ ID NO: 64556 - DNA, 20 bp, Artificial
  CRISPR gRNA sequence
aatccttcaggtacctatgt

SEQ ID NO: 64557 - DNA, 20 bp, Artificial
  CRISPR gRNA sequence
caggtacctatgtgctagat

SEQ ID NO: 64558 - DNA, 20 bp, Artificial
  CRISPR gRNA sequence
aggtacctatgtgctagatg

SEQ ID NO: 64559 - DNA, 20 bp, Artificial
  CRISPR gRNA sequence
tgtgctagatgttgtcatcc

SEQ ID NO: 64560 - DNA, 20 bp, Artificial
  CRISPR gRNA sequence
gatgttgtcatccgttttag

SEQ ID NO: 64561 - DNA, 20 bp, Artificial
  CRISPR gRNA sequence
tcatccgttttagaaaagag

SEQ ID NO: 64562 - DNA, 20 bp, Artificial
  CRISPR gRNA sequence
tagaaaagagaaaagggagc

SEQ ID NO: 64563 - DNA, 20 bp, Artificial
  CRISPR gRNA sequence
agaaaagagaaaagggagcc

SEQ ID NO: 64564 - DNA, 20 bp, Artificial
  CRISPR gRNA sequence
gaaaagagaaaagggagccg

SEQ ID NO: 64565 - DNA, 20 bp, Artificial
  CRISPR gRNA sequence
cagtgatttgcccaaggcca

SEQ ID NO: 64566 - DNA, 20 bp, Artificial
  CRISPR gRNA sequence
gcccaaggccacatggctat

SEQ ID NO: 64567 - DNA, 20 bp, Artificial
  CRISPR gRNA sequence
cccaaggccacatggctata

SEQ ID NO: 64568 - DNA, 20 bp, Artificial
  CRISPR gRNA sequence
tacatggcagagccaaaatt

SEQ ID NO: 64569 - DNA, 20 bp, Artificial
  CRISPR gRNA sequence
gaataaaggttccatttgac

SEQ ID NO: 64570 - DNA, 20 bp, Artificial
  CRISPR gRNA sequence
aataaaggttccatttgacc

SEQ ID NO: 64571 - DNA, 20 bp, Artificial
  CRISPR gRNA sequence
catttgacctcaaacctgtt

SEQ ID NO: 64572 - DNA, 20 bp, Artificial
  CRISPR gRNA sequence
gacctcaaacctgttgcccc

SEQ ID NO: 64573 - DNA, 20 bp, Artificial
  CRISPR gRNA sequence
acctcaaacctgttgcccct

SEQ ID NO: 64574 - DNA, 20 bp, Artificial
  CRISPR gRNA sequence
aaacctgttgcccctcctgc

SEQ ID NO: 64575 - DNA, 20 bp, Artificial
  CRISPR gRNA sequence
ttgcccctcctgctctgctg

SEQ ID NO: 64576 - DNA, 20 bp, Artificial
  CRISPR gRNA sequence
cccctcctgctctgctgaat

SEQ ID NO: 64577 - DNA, 20 bp, Artificial
  CRISPR gRNA sequence
ctgctctgctgaatcacatc

SEQ ID NO: 64578 - DNA, 20 bp, Artificial
  CRISPR gRNA sequence
ctctgctgaatcacatcttg

SEQ ID NO: 64579 - DNA, 20 bp, Artificial
  CRISPR gRNA sequence
tgctgaatcacatcttgagc

SEQ ID NO: 64580 - DNA, 20 bp, Artificial
  CRISPR gRNA sequence
ctgaatcacatcttgagcat

SEQ ID NO: 64581 - DNA, 20 bp, Artificial
  CRISPR gRNA sequence
aatcacatcttgagcatctg

SEQ ID NO: 64582 - DNA, 20 bp, Artificial
  CRISPR gRNA sequence
gagcatctgcaagcagtctc

SEQ ID NO: 64583 - DNA, 20 bp, Artificial
  CRISPR gRNA sequence
agcatctgcaagcagtctcc

SEQ ID NO: 64584 - DNA, 20 bp, Artificial
  CRISPR gRNA sequence
caagcagtctcctttgttac

SEQ ID NO: 64585 - DNA, 20 bp, Artificial
  CRISPR gRNA sequence
ctttgttaccgactcacttt

SEQ ID NO: 64586 - DNA, 20 bp, Artificial
  CRISPR gRNA sequence
tgttaccgactcactttggg

SEQ ID NO: 64587 - DNA, 20 bp, Artificial
  CRISPR gRNA sequence
gttaccgactcactttgggt

SEQ ID NO: 64588 - DNA, 20 bp, Artificial
  CRISPR gRNA sequence
ttaccgactcactttgggtt

SEQ ID NO: 64589 - DNA, 20 bp, Artificial
  CRISPR gRNA sequence
ccgactcactttgggttgtg

SEQ ID NO: 64590 - DNA, 20 bp, Artificial
  CRISPR gRNA sequence
actttgggttgtgcttcagg

SEQ ID NO: 64591 - DNA, 20 bp, Artificial
  CRISPR gRNA sequence
tgggttgtgcttcagggtct

SEQ ID NO: 64592 - DNA, 20 bp, Artificial
  CRISPR gRNA sequence
gggttgtgcttcagggtctt

SEQ ID NO: 64593 - DNA, 20 bp, Artificial
  CRISPR gRNA sequence
ggttgtgcttcagggtcttc

SEQ ID NO: 64594 - DNA, 20 bp, Artificial
  CRISPR gRNA sequence
tgcttcagggtcttcagcct

SEQ ID NO: 64595 - DNA, 20 bp, Artificial
  CRISPR gRNA sequence
cagggtcttcagcctctaga

SEQ ID NO: 64596 - DNA, 20 bp, Artificial
  CRISPR gRNA sequence
agggtcttcagcctctagaa

SEQ ID NO: 64597 - DNA, 20 bp, Artificial
  CRISPR gRNA sequence
cagcctctagaagccaagga

SEQ ID NO: 64598 - DNA, 20 bp, Artificial
  CRISPR gRNA sequence
agcctctagaagccaaggaa

SEQ ID NO: 64599 - DNA, 20 bp, Artificial
  CRISPR gRNA sequence
tagaagccaaggaaagaggc

SEQ ID NO: 64600 - DNA, 20 bp, Artificial
  CRISPR gRNA sequence
gaagccaaggaaagaggctt

SEQ ID NO: 64601 - DNA, 20 bp, Artificial
  CRISPR gRNA sequence
gatccaccaggccctagatg

SEQ ID NO: 64602 - DNA, 20 bp, Artificial
  CRISPR gRNA sequence
atccaccaggccctagatgc

SEQ ID NO: 64603 - DNA, 20 bp, Artificial
  CRISPR gRNA sequence
gatgcctgagcccaggccaa

SEQ ID NO: 64604 - DNA, 20 bp, Artificial
  CRISPR gRNA sequence
agcccaggccaatgcttgat

SEQ ID NO: 64605 - DNA, 20 bp, Artificial
  CRISPR gRNA sequence
gatttgttcttgccagagct

SEQ ID NO: 64606 - DNA, 20 bp, Artificial
  CRISPR gRNA sequence
atttgttcttgccagagctc

SEQ ID NO: 64607 - DNA, 20 bp, Artificial
  CRISPR gRNA sequence
gttcttgccagagctccaga

SEQ ID NO: 64608 - DNA, 20 bp, Artificial
  CRISPR gRNA sequence
ttcttgccagagctccagac

SEQ ID NO: 64609 - DNA, 20 bp, Artificial
  CRISPR gRNA sequence
ttgccagagctccagacctg

SEQ ID NO: 64610 - DNA, 20 bp, Artificial
  CRISPR gRNA sequence
gccagagctccagacctgca

SEQ ID NO: 64611 - DNA, 20 bp, Artificial
  CRISPR gRNA sequence
ccagagctccagacctgcag

SEQ ID NO: 64612 - DNA, 20 bp, Artificial
  CRISPR gRNA sequence
cagacctgcaggaaagtgac

SEQ ID NO: 64613 - DNA, 20 bp, Artificial
  CRISPR gRNA sequence
caggaaagtgacggccagag

SEQ ID NO: 64614 - DNA, 20 bp, Artificial
  CRISPR gRNA sequence
agagcagaagcttgacgctc

SEQ ID NO: 64615 - DNA, 20 bp, Artificial
  CRISPR gRNA sequence
gacgctcaggtaccttggag

SEQ ID NO: 64616 - DNA, 20 bp, Artificial
  CRISPR gRNA sequence
acgctcaggtaccttggagg

SEQ ID NO: 64617 - DNA, 20 bp, Artificial
  CRISPR gRNA sequence
aggtaccttggagggatcta

SEQ ID NO: 64618 - DNA, 20 bp, Artificial
  CRISPR gRNA sequence
ggagggatctattgccttag

SEQ ID NO: 64619 - DNA, 20 bp, Artificial
  CRISPR gRNA sequence
gagggatctattgccttagg

SEQ ID NO: 64620 - DNA, 20 bp, Artificial
  CRISPR gRNA sequence
ttgccttaggagagggatat

SEQ ID NO: 64621 - DNA, 20 bp, Artificial
  CRISPR gRNA sequence
ccttaggagagggatatgat

SEQ ID NO: 64622 - DNA, 20 bp, Artificial
  CRISPR gRNA sequence
aggagagggatatgatatgg

SEQ ID NO: 64623 - DNA, 20 bp, Artificial
  CRISPR gRNA sequence
ggagagggatatgatatggg

SEQ ID NO: 64624 - DNA, 20 bp, Artificial
  CRISPR gRNA sequence
gccgggtgtggtgcccatcc

SEQ ID NO: 64625 - DNA, 20 bp, Artificial
  CRISPR gRNA sequence
gatagcccatcctggcttga

SEQ ID NO: 64626 - DNA, 20 bp, Artificial
  CRISPR gRNA sequence
gcttgaataaggagcatctg

SEQ ID NO: 64627 - DNA, 20 bp, Artificial
  CRISPR gRNA sequence
gaataaggagcatctgtcat

SEQ ID NO: 64628 - DNA, 20 bp, Artificial
  CRISPR gRNA sequence
aataaggagcatctgtcata

SEQ ID NO: 64629 - DNA, 20 bp, Artificial
  CRISPR gRNA sequence
tcataataacaatagctgca

SEQ ID NO: 64630 - DNA, 20 bp, Artificial
  CRISPR gRNA sequence
caacttaatggaaccggcta

SEQ ID NO: 64631 - DNA, 20 bp, Artificial
  CRISPR gRNA sequence
aatggaaccggctatctata

SEQ ID NO: 64632 - DNA, 20 bp, Artificial
  CRISPR gRNA sequence
atggaaccggctatctatat

SEQ ID NO: 64633 - DNA, 20 bp, Artificial
  CRISPR gRNA sequence
tctatatgccgggcattgca

SEQ ID NO: 64634 - DNA, 20 bp, Artificial
  CRISPR gRNA sequence
tatgccgggcattgcactag

SEQ ID NO: 64635 - DNA, 20 bp, Artificial
  CRISPR gRNA sequence
cactagatgttttacatcca

SEQ ID NO: 64636 - DNA, 20 bp, Artificial
  CRISPR gRNA sequence
gatgttttacatccattacc

SEQ ID NO: 64637 - DNA, 20 bp, Artificial
  CRISPR gRNA sequence
tacatccattacctcactgt

SEQ ID NO: 64638 - DNA, 20 bp, Artificial
  CRISPR gRNA sequence
acatccattacctcactgta

SEQ ID NO: 64639 - DNA, 20 bp, Artificial
  CRISPR gRNA sequence
catccattacctcactgtaa

SEQ ID NO: 64640 - DNA, 20 bp, Artificial
  CRISPR gRNA sequence
cctcactgtaattcctttag

SEQ ID NO: 64641 - DNA, 20 bp, Artificial
  CRISPR gRNA sequence
actgtaattcctttagaatc

SEQ ID NO: 64642 - DNA, 20 bp, Artificial
  CRISPR gRNA sequence
taattcctttagaatctctg

SEQ ID NO: 64643 - DNA, 20 bp, Artificial
  CRISPR gRNA sequence
ctttagaatctctgtgaagt

SEQ ID NO: 64644 - DNA, 20 bp, Artificial
  CRISPR gRNA sequence
tagaatctctgtgaagtaca

SEQ ID NO: 64645 - DNA, 20 bp, Artificial
  CRISPR gRNA sequence
agaatctctgtgaagtacac

SEQ ID NO: 64646 - DNA, 20 bp, Artificial
  CRISPR gRNA sequence
gaatctctgtgaagtacaca

SEQ ID NO: 64647 - DNA, 20 bp, Artificial
  CRISPR gRNA sequence
tgtgaagtacacattattat

SEQ ID NO: 64648 - DNA, 20 bp, Artificial
  CRISPR gRNA sequence
tgaagtacacattattattc

SEQ ID NO: 64649 - DNA, 20 bp, Artificial
  CRISPR gRNA sequence
ttattcccctttgagggagg

SEQ ID NO: 64650 - DNA, 20 bp, Artificial
  CRISPR gRNA sequence
ttcccctttgagggaggagg

SEQ ID NO: 64651 - DNA, 20 bp, Artificial
  CRISPR gRNA sequence
ccctttgagggaggaggaaa

SEQ ID NO: 64652 - DNA, 20 bp, Artificial
  CRISPR gRNA sequence
tgagggaggaggaaactgag

SEQ ID NO: 64653 - DNA, 20 bp, Artificial
  CRISPR gRNA sequence
gagggaggaggaaactgagt

SEQ ID NO: 64654 - DNA, 20 bp, Artificial
  CRISPR gRNA sequence
agggaggaggaaactgagtc

SEQ ID NO: 64655 - DNA, 20 bp, Artificial
  CRISPR gRNA sequence
agtctcagacaggttaagtc

SEQ ID NO: 64656 - DNA, 20 bp, Artificial
  CRISPR gRNA sequence
agacaggttaagtcccttgc

SEQ ID NO: 64657 - DNA, 20 bp, Artificial
  CRISPR gRNA sequence
agtcccttgctcaagatcac

SEQ ID NO: 64658 - DNA, 20 bp, Artificial
  CRISPR gRNA sequence
gctcaagatcacccagctac

SEQ ID NO: 64659 - DNA, 20 bp, Artificial
  CRISPR gRNA sequence
ctcaagatcacccagctact

SEQ ID NO: 64660 - DNA, 20 bp, Artificial
  CRISPR gRNA sequence
aagatcacccagctactaag

SEQ ID NO: 64661 - DNA, 20 bp, Artificial
  CRISPR gRNA sequence
ctaagaggtgtggctaggat

SEQ ID NO: 64662 - DNA, 20 bp, Artificial
  CRISPR gRNA sequence
agaggtgtggctaggattag

SEQ ID NO: 64663 - DNA, 20 bp, Artificial
  CRISPR gRNA sequence
ggattagacccaggtctgtg

SEQ ID NO: 64664 - DNA, 20 bp, Artificial
  CRISPR gRNA sequence
gacccaggtctgtgggcccc

SEQ ID NO: 64665 - DNA, 20 bp, Artificial
  CRISPR gRNA sequence
tgggccccctgactccccca

SEQ ID NO: 64666 - DNA, 20 bp, Artificial
  CRISPR gRNA sequence
actcccccagcattggaagc

SEQ ID NO: 64667 - DNA, 20 bp, Artificial
  CRISPR gRNA sequence
ccccagcattggaagctgga

SEQ ID NO: 64668 - DNA, 20 bp, Artificial
  CRISPR gRNA sequence
gaagctggaggggccatgga

SEQ ID NO: 64669 - DNA, 20 bp, Artificial
  CRISPR gRNA sequence
gaggggccatggagtagggg

SEQ ID NO: 64670 - DNA, 20 bp, Artificial
  CRISPR gRNA sequence
tttgccctgagcccttctgt

SEQ ID NO: 64671 - DNA, 20 bp, Artificial
  CRISPR gRNA sequence
gccctgagcccttctgtccc

SEQ ID NO: 64672 - DNA, 20 bp, Artificial
  CRISPR gRNA sequence
ccctgagcccttctgtcccc

SEQ ID NO: 64673 - DNA, 20 bp, Artificial
  CRISPR gRNA sequence
agcccttctgtcccccactc

SEQ ID NO: 64674 - DNA, 20 bp, Artificial
  CRISPR gRNA sequence
ctgtcccccactcctaccca

SEQ ID NO: 64675 - DNA, 20 bp, Artificial
  CRISPR gRNA sequence
tgtcccccactcctacccaa

SEQ ID NO: 64676 - DNA, 20 bp, Artificial
  CRISPR gRNA sequence
tcccccactcctacccaagg

SEQ ID NO: 64677 - DNA, 20 bp, Artificial
  CRISPR gRNA sequence
ctacccaaggctgcagaagt

SEQ ID NO: 64678 - DNA, 20 bp, Artificial
  CRISPR gRNA sequence
cccaaggctgcagaagtgtc

SEQ ID NO: 64679 - DNA, 20 bp, Artificial
  CRISPR gRNA sequence
cagaagtgtcagctccaggt

SEQ ID NO: 64680 - DNA, 20 bp, Artificial
  CRISPR gRNA sequence
caggtccacgatgcggaggc

SEQ ID NO: 64681 - DNA, 20 bp, Artificial
  CRISPR gRNA sequence
atagccctgctccaggaagg

SEQ ID NO: 64682 - DNA, 20 bp, Artificial
  CRISPR gRNA sequence
ctccaggaaggccctcacct

SEQ ID NO: 64683 - DNA, 20 bp, Artificial
  CRISPR gRNA sequence
caggaaggccctcacctgga

SEQ ID NO: 64684 - DNA, 20 bp, Artificial
  CRISPR gRNA sequence
acctggaggaagtggagtga

SEQ ID NO: 64685 - DNA, 20 bp, Artificial
  CRISPR gRNA sequence
gaggaagtggagtgagtatc

SEQ ID NO: 64686 - DNA, 20 bp, Artificial
  CRISPR gRNA sequence
gcgtaggagccaggaaagga

SEQ ID NO: 64687 - DNA, 20 bp, Artificial
  CRISPR gRNA sequence
gagagggtgggcagggcctc

SEQ ID NO: 64688 - DNA, 20 bp, Artificial
  CRISPR gRNA sequence
gcctttgggtgggtggtgtg

SEQ ID NO: 64689 - DNA, 20 bp, Artificial
  CRISPR gRNA sequence
tgggtgggtggtgtggggga

SEQ ID NO: 64690 - DNA, 20 bp, Artificial
  CRISPR gRNA sequence
gggtgggtggtgtgggggag

SEQ ID NO: 64691 - DNA, 20 bp, Artificial
  CRISPR gRNA sequence
ggtgggtggtgtgggggagg

SEQ ID NO: 64692 - DNA, 20 bp, Artificial
  CRISPR gRNA sequence
cctcatgaagaatttggggg

SEQ ID NO: 64693 - DNA, 20 bp, Artificial
  CRISPR gRNA sequence
atgaagaatttgggggaatc

SEQ ID NO: 64694 - DNA, 20 bp, Artificial
  CRISPR gRNA sequence
gggggaatcagatcattgta

SEQ ID NO: 64695 - DNA, 20 bp, Artificial
  CRISPR gRNA sequence
ggggaatcagatcattgtaa

SEQ ID NO: 64696 - DNA, 20 bp, Artificial
  CRISPR gRNA sequence
taacagctgctactattcag

SEQ ID NO: 64697 - DNA, 20 bp, Artificial
  CRISPR gRNA sequence
ctactattcagcacttgtcc

SEQ ID NO: 64698 - DNA, 20 bp, Artificial
  CRISPR gRNA sequence
ctattcagcacttgtcccgg

SEQ ID NO: 64699 - DNA, 20 bp, Artificial
  CRISPR gRNA sequence
ttcagcacttgtcccgggtc

SEQ ID NO: 64700 - DNA, 20 bp, Artificial
  CRISPR gRNA sequence
agcacttgtcccgggtcagg

SEQ ID NO: 64701 - DNA, 20 bp, Artificial
  CRISPR gRNA sequence
gtcccgggtcaggtgctgtg

SEQ ID NO: 64702 - DNA, 20 bp, Artificial
  CRISPR gRNA sequence
tcccgggtcaggtgctgtgc

SEQ ID NO: 64703 - DNA, 20 bp, Artificial
  CRISPR gRNA sequence
tgctagggactgtacatgcc

SEQ ID NO: 64704 - DNA, 20 bp, Artificial
  CRISPR gRNA sequence
gggactgtacatgcctcctc

SEQ ID NO: 64705 - DNA, 20 bp, Artificial
  CRISPR gRNA sequence
tacatgcctcctcgcattca

SEQ ID NO: 64706 - DNA, 20 bp, Artificial
  CRISPR gRNA sequence
ctcgcattcactcctcacat

SEQ ID NO: 64707 - DNA, 20 bp, Artificial
  CRISPR gRNA sequence
gcattcactcctcacatctc

SEQ ID NO: 64708 - DNA, 20 bp, Artificial
  CRISPR gRNA sequence
actcctcacatctctgtgat

SEQ ID NO: 64709 - DNA, 20 bp, Artificial
  CRISPR gRNA sequence
ctcacatctctgtgatgtaa

SEQ ID NO: 64710 - DNA, 20 bp, Artificial
  CRISPR gRNA sequence
acatctctgtgatgtaagca

SEQ ID NO: 64711 - DNA, 20 bp, Artificial
  CRISPR gRNA sequence
tgtgatgtaagcactgttac

SEQ ID NO: 64712 - DNA, 20 bp, Artificial
  CRISPR gRNA sequence
tgatgtaagcactgttactg

SEQ ID NO: 64713 - DNA, 20 bp, Artificial
  CRISPR gRNA sequence
ttactgtcctcattttatag

SEQ ID NO: 64714 - DNA, 20 bp, Artificial
  CRISPR gRNA sequence
ctgtcctcattttatagagg

SEQ ID NO: 64715 - DNA, 20 bp, Artificial
  CRISPR gRNA sequence
tcctcattttatagaggagg

SEQ ID NO: 64716 - DNA, 20 bp, Artificial
  CRISPR gRNA sequence
attttatagaggaggaagtt

SEQ ID NO: 64717 - DNA, 20 bp, Artificial
  CRISPR gRNA sequence
tatagaggaggaagttaagc

SEQ ID NO: 64718 - DNA, 20 bp, Artificial
  CRISPR gRNA sequence
atagaggaggaagttaagct

SEQ ID NO: 64719 - DNA, 20 bp, Artificial
  CRISPR gRNA sequence
tagaggaggaagttaagctg

SEQ ID NO: 64720 - DNA, 20 bp, Artificial
  CRISPR gRNA sequence
agctgcagaaagataaactt

SEQ ID NO: 64721 - DNA, 20 bp, Artificial
  CRISPR gRNA sequence
cagaaagataaacttgctca

SEQ ID NO: 64722 - DNA, 20 bp, Artificial
  CRISPR gRNA sequence
gctcaaggccacacaggtag

SEQ ID NO: 64723 - DNA, 20 bp, Artificial
  CRISPR gRNA sequence
ctcaaggccacacaggtagg

SEQ ID NO: 64724 - DNA, 20 bp, Artificial
  CRISPR gRNA sequence
aaggccacacaggtaggaag

SEQ ID NO: 64725 - DNA, 20 bp, Artificial
  CRISPR gRNA sequence
ggctagggttcaagcccaga

SEQ ID NO: 64726 - DNA, 20 bp, Artificial
  CRISPR gRNA sequence
gggttcaagcccagacagtc

SEQ ID NO: 64727 - DNA, 20 bp, Artificial
  CRISPR gRNA sequence
aagcccagacagtctggctc

SEQ ID NO: 64728 - DNA, 20 bp, Artificial
  CRISPR gRNA sequence
gctcgcagcctcatcctcat

SEQ ID NO: 64729 - DNA, 20 bp, Artificial
  CRISPR gRNA sequence
gcagcctcatcctcataacc

SEQ ID NO: 64730 - DNA, 20 bp, Artificial
  CRISPR gRNA sequence
atcctcataaccactgctac

SEQ ID NO: 64731 - DNA, 20 bp, Artificial
  CRISPR gRNA sequence
ataaccactgctacctctct

SEQ ID NO: 64732 - DNA, 20 bp, Artificial
  CRISPR gRNA sequence
ctacctctcttgctgagatc

SEQ ID NO: 64733 - DNA, 20 bp, Artificial
  CRISPR gRNA sequence
cctctcttgctgagatctgc

SEQ ID NO: 64734 - DNA, 20 bp, Artificial
  CRISPR gRNA sequence
tcttgctgagatctgccaag

SEQ ID NO: 64735 - DNA, 20 bp, Artificial
  CRISPR gRNA sequence
ttgctgagatctgccaagta

SEQ ID NO: 64736 - DNA, 20 bp, Artificial
  CRISPR gRNA sequence
gctgagatctgccaagtaga

SEQ ID NO: 64737 - DNA, 20 bp, Artificial
  CRISPR gRNA sequence
ctgagatctgccaagtagaa

SEQ ID NO: 64738 - DNA, 20 bp, Artificial
  CRISPR gRNA sequence
agatctgccaagtagaaacc

SEQ ID NO: 64739 - DNA, 20 bp, Artificial
  CRISPR gRNA sequence
ccaagtagaaaccccaccac

SEQ ID NO: 64740 - DNA, 20 bp, Artificial
  CRISPR gRNA sequence
ggtctgccttccaaaccaca

SEQ ID NO: 64741 - DNA, 20 bp, Artificial
  CRISPR gRNA sequence
ccttccaaaccacagtccct

SEQ ID NO: 64742 - DNA, 20 bp, Artificial
  CRISPR gRNA sequence
ccaaaccacagtccctcagg

SEQ ID NO: 64743 - DNA, 20 bp, Artificial
  CRISPR gRNA sequence
caaaccacagtccctcaggg

SEQ ID NO: 64744 - DNA, 20 bp, Artificial
  CRISPR gRNA sequence
agggctccccccaccccctt

SEQ ID NO: 64745 - DNA, 20 bp, Artificial
  CRISPR gRNA sequence
cccccacccccttcatcctt

SEQ ID NO: 64746 - DNA, 20 bp, Artificial
  CRISPR gRNA sequence
catccttctcccagagtaga

SEQ ID NO: 64747 - DNA, 20 bp, Artificial
  CRISPR gRNA sequence
atccttctcccagagtagag

SEQ ID NO: 64748 - DNA, 20 bp, Artificial
  CRISPR gRNA sequence
ctcccagagtagagtgggat

SEQ ID NO: 64749 - DNA, 20 bp, Artificial
  CRISPR gRNA sequence
tcccagagtagagtgggata

SEQ ID NO: 64750 - DNA, 20 bp, Artificial
  CRISPR gRNA sequence
ccagagtagagtgggataac

SEQ ID NO: 64751 - DNA, 20 bp, Artificial
  CRISPR gRNA sequence
ctcttttcgggatggagaaa

SEQ ID NO: 64752 - DNA, 20 bp, Artificial
  CRISPR gRNA sequence
tcttttcgggatggagaaat

SEQ ID NO: 64753 - DNA, 20 bp, Artificial
  CRISPR gRNA sequence
ttttcgggatggagaaattc

SEQ ID NO: 64754 - DNA, 20 bp, Artificial
  CRISPR gRNA sequence
ttcgggatggagaaattccc

SEQ ID NO: 64755 - DNA, 20 bp, Artificial
  CRISPR gRNA sequence
tcgggatggagaaattccca

SEQ ID NO: 64756 - DNA, 20 bp, Artificial
  CRISPR gRNA sequence
cgggatggagaaattcccat

SEQ ID NO: 64757 - DNA, 20 bp, Artificial
  CRISPR gRNA sequence
gggatggagaaattcccatg

SEQ ID NO: 64758 - DNA, 20 bp, Artificial
  CRISPR gRNA sequence
ccatggcgtccagcccctgg

SEQ ID NO: 64759 - DNA, 20 bp, Artificial
  CRISPR gRNA sequence
gctgaagccaataagagtag

SEQ ID NO: 64760 - DNA, 20 bp, Artificial
  CRISPR gRNA sequence
aagccaataagagtagtgct

SEQ ID NO: 64761 - DNA, 20 bp, Artificial
  CRISPR gRNA sequence
ggggatggacggaggctctg

SEQ ID NO: 64762 - DNA, 20 bp, Artificial
  CRISPR gRNA sequence
gggatggacggaggctctgt

SEQ ID NO: 64763 - DNA, 20 bp, Artificial
  CRISPR gRNA sequence
tgtcacgaccctaggagggg

SEQ ID NO: 64764 - DNA, 20 bp, Artificial
  CRISPR gRNA sequence
tcacgaccctaggaggggcg

SEQ ID NO: 64765 - DNA, 20 bp, Artificial
  CRISPR gRNA sequence
ggaggggcgcccctccagga

SEQ ID NO: 64766 - DNA, 20 bp, Artificial
  CRISPR gRNA sequence
caggaaacctccaagtgaac

SEQ ID NO: 64767 - DNA, 20 bp, Artificial
  CRISPR gRNA sequence
caagtgaacatgaaggcaga

SEQ ID NO: 64768 - DNA, 20 bp, Artificial
  CRISPR gRNA sequence
tgggtcgagtggccccacct

SEQ ID NO: 64769 - DNA, 20 bp, Artificial
  CRISPR gRNA sequence
ggtcgagtggccccacctca

SEQ ID NO: 64770 - DNA, 20 bp, Artificial
  CRISPR gRNA sequence
agggtaagacggataggggt

SEQ ID NO: 64771 - DNA, 20 bp, Artificial
  CRISPR gRNA sequence
tcgtggtgatcacctcttga

SEQ ID NO: 64772 - DNA, 20 bp, Artificial
  CRISPR gRNA sequence
ttgatcctggacctcgtccc

SEQ ID NO: 64773 - DNA, 20 bp, Artificial
  CRISPR gRNA sequence
gatcctggacctcgtcccat

SEQ ID NO: 64774 - DNA, 20 bp, Artificial
  CRISPR gRNA sequence
atcctggacctcgtcccatt

SEQ ID NO: 64775 - DNA, 20 bp, Artificial
  CRISPR gRNA sequence
gacctcgtcccattgggaga

SEQ ID NO: 64776 - DNA, 20 bp, Artificial
  CRISPR gRNA sequence
gtcccattgggagaaccagg

SEQ ID NO: 64777 - DNA, 20 bp, Artificial
  CRISPR gRNA sequence
ggagaaccaggacagaatta

SEQ ID NO: 64778 - DNA, 20 bp, Artificial
  CRISPR gRNA sequence
gaaggtggttttttaacaag

SEQ ID NO: 64779 - DNA, 20 bp, Artificial
  CRISPR gRNA sequence
tttaacaagctcacacactt

SEQ ID NO: 64780 - DNA, 20 bp, Artificial
  CRISPR gRNA sequence
ttaacaagctcacacacttc

SEQ ID NO: 64781 - DNA, 20 bp, Artificial
  CRISPR gRNA sequence
taacaagctcacacacttct

SEQ ID NO: 64782 - DNA, 20 bp, Artificial
  CRISPR gRNA sequence
aacaagctcacacacttcta

SEQ ID NO: 64783 - DNA, 20 bp, Artificial
  CRISPR gRNA sequence
acaagctcacacacttctac

SEQ ID NO: 64784 - DNA, 20 bp, Artificial
  CRISPR gRNA sequence
acacacttctacctgcctca

SEQ ID NO: 64785 - DNA, 20 bp, Artificial
  CRISPR gRNA sequence
ctacctgcctcaccagcact

SEQ ID NO: 64786 - DNA, 20 bp, Artificial
  CRISPR gRNA sequence
tacctgcctcaccagcactg

SEQ ID NO: 64787 - DNA, 20 bp, Artificial
  CRISPR gRNA sequence
cctgcctcaccagcactgag

SEQ ID NO: 64788 - DNA, 20 bp, Artificial
  CRISPR gRNA sequence
cctcaccagcactgagcatg

SEQ ID NO: 64789 - DNA, 20 bp, Artificial
  CRISPR gRNA sequence
accagcactgagcatgcccc

SEQ ID NO: 64790 - DNA, 20 bp, Artificial
  CRISPR gRNA sequence
agcatgcccctccccgagtg

SEQ ID NO: 64791 - DNA, 20 bp, Artificial
  CRISPR gRNA sequence
cccgagtgccatcacctgca

SEQ ID NO: 64792 - DNA, 20 bp, Artificial
  CRISPR gRNA sequence
cagaagcagccccatcaccc

SEQ ID NO: 64793 - DNA, 20 bp, Artificial
  CRISPR gRNA sequence
gttacgcagccacctcctag

SEQ ID NO: 64794 - DNA, 20 bp, Artificial
  CRISPR gRNA sequence
cgcagccacctcctagcccc

SEQ ID NO: 64795 - DNA, 20 bp, Artificial
  CRISPR gRNA sequence
ctagcccccttgcccttctc

SEQ ID NO: 64796 - DNA, 20 bp, Artificial
  CRISPR gRNA sequence
gcccccttgcccttctccca

SEQ ID NO: 64797 - DNA, 20 bp, Artificial
  CRISPR gRNA sequence
gcccttctcccacatttagt

SEQ ID NO: 64798 - DNA, 20 bp, Artificial
  CRISPR gRNA sequence
cccttctcccacatttagtc

SEQ ID NO: 64799 - DNA, 20 bp, Artificial
  CRISPR gRNA sequence
ctcccacatttagtccctcc

SEQ ID NO: 64800 - DNA, 20 bp, Artificial
  CRISPR gRNA sequence
tcccacatttagtccctcca

SEQ ID NO: 64801 - DNA, 20 bp, Artificial
  CRISPR gRNA sequence
ccacatttagtccctccaga

SEQ ID NO: 64802 - DNA, 20 bp, Artificial
  CRISPR gRNA sequence
agtccctccagatggaccta

SEQ ID NO: 64803 - DNA, 20 bp, Artificial
  CRISPR gRNA sequence
gtccctccagatggacctac

SEQ ID NO: 64804 - DNA, 20 bp, Artificial
  CRISPR gRNA sequence
cagatggacctactggtagc

SEQ ID NO: 64805 - DNA, 20 bp, Artificial
  CRISPR gRNA sequence
ctggtagcgctcaaaactat

SEQ ID NO: 64806 - DNA, 20 bp, Artificial
  CRISPR gRNA sequence
gtagcgctcaaaactatcct

SEQ ID NO: 64807 - DNA, 20 bp, Artificial
  CRISPR gRNA sequence
aaaactatcctcttttcctc

SEQ ID NO: 64808 - DNA, 20 bp, Artificial
  CRISPR gRNA sequence
tcctcttttcctccaccttt

SEQ ID NO: 64809 - DNA, 20 bp, Artificial
  CRISPR gRNA sequence
ttttcctccacctttctagt

SEQ ID NO: 64810 - DNA, 20 bp, Artificial
  CRISPR gRNA sequence
ttcctccacctttctagtcc

SEQ ID NO: 64811 - DNA, 20 bp, Artificial
  CRISPR gRNA sequence
tcctccacctttctagtcca

SEQ ID NO: 64812 - DNA, 20 bp, Artificial
  CRISPR gRNA sequence
cctccacctttctagtccaa

SEQ ID NO: 64813 - DNA, 20 bp, Artificial
  CRISPR gRNA sequence
ctccacctttctagtccaac

SEQ ID NO: 64814 - DNA, 20 bp, Artificial
  CRISPR gRNA sequence
cacctttctagtccaaccca

SEQ ID NO: 64815 - DNA, 20 bp, Artificial
  CRISPR gRNA sequence
tctagtccaacccaccctca

SEQ ID NO: 64816 - DNA, 20 bp, Artificial
  CRISPR gRNA sequence
ctagtccaacccaccctcat

SEQ ID NO: 64817 - DNA, 20 bp, Artificial
  CRISPR gRNA sequence
tagtccaacccaccctcatc

SEQ ID NO: 64818 - DNA, 20 bp, Artificial
  CRISPR gRNA sequence
gtccaacccaccctcatctc

SEQ ID NO: 64819 - DNA, 20 bp, Artificial
  CRISPR gRNA sequence
atctcttacctggatgaccc

SEQ ID NO: 64820 - DNA, 20 bp, Artificial
  CRISPR gRNA sequence
ttacctggatgaccccctcg

SEQ ID NO: 64821 - DNA, 20 bp, Artificial
  CRISPR gRNA sequence
acctggatgaccccctcgcc

SEQ ID NO: 64822 - DNA, 20 bp, Artificial
  CRISPR gRNA sequence
cctggatgaccccctcgcct

SEQ ID NO: 64823 - DNA, 20 bp, Artificial
  CRISPR gRNA sequence
gatgaccccctcgccttgcc

SEQ ID NO: 64824 - DNA, 20 bp, Artificial
  CRISPR gRNA sequence
gccttgccttccttgctggc

SEQ ID NO: 64825 - DNA, 20 bp, Artificial
  CRISPR gRNA sequence
gccttccttgctggcttccc

SEQ ID NO: 64826 - DNA, 20 bp, Artificial
  CRISPR gRNA sequence
ccttccttgctggcttccct

SEQ ID NO: 64827 - DNA, 20 bp, Artificial
  CRISPR gRNA sequence
ccttgctggcttccctgctt

SEQ ID NO: 64828 - DNA, 20 bp, Artificial
  CRISPR gRNA sequence
cttgctggcttccctgcttt

SEQ ID NO: 64829 - DNA, 20 bp, Artificial
  CRISPR gRNA sequence
gctggcttccctgctttcac

SEQ ID NO: 64830 - DNA, 20 bp, Artificial
  CRISPR gRNA sequence
ctggcttccctgctttcacc

SEQ ID NO: 64831 - DNA, 20 bp, Artificial
  CRISPR gRNA sequence
gcttccctgctttcaccctg

SEQ ID NO: 64832 - DNA, 20 bp, Artificial
  CRISPR gRNA sequence
ccctgctttcaccctggcca

SEQ ID NO: 64833 - DNA, 20 bp, Artificial
  CRISPR gRNA sequence
cctgctttcaccctggccac

SEQ ID NO: 64834 - DNA, 20 bp, Artificial
  CRISPR gRNA sequence
ctttcaccctggccacttcc

SEQ ID NO: 64835 - DNA, 20 bp, Artificial
  CRISPR gRNA sequence
tcaccctggccacttccacc

SEQ ID NO: 64836 - DNA, 20 bp, Artificial
  CRISPR gRNA sequence
caccctggccacttccacct

SEQ ID NO: 64837 - DNA, 20 bp, Artificial
  CRISPR gRNA sequence
accctggccacttccacctg

SEQ ID NO: 64838 - DNA, 20 bp, Artificial
  CRISPR gRNA sequence
gccacttccacctggcagag

SEQ ID NO: 64839 - DNA, 20 bp, Artificial
  CRISPR gRNA sequence
ccacctggcagagagtagat

SEQ ID NO: 64840 - DNA, 20 bp, Artificial
  CRISPR gRNA sequence
cacctggcagagagtagatc

SEQ ID NO: 64841 - DNA, 20 bp, Artificial
  CRISPR gRNA sequence
gcagagagtagatcactttt

SEQ ID NO: 64842 - DNA, 20 bp, Artificial
  CRISPR gRNA sequence
ttcactgatgcctgccccct

SEQ ID NO: 64843 - DNA, 20 bp, Artificial
  CRISPR gRNA sequence
tcactgatgcctgccccctt

SEQ ID NO: 64844 - DNA, 20 bp, Artificial
  CRISPR gRNA sequence
cactgatgcctgcccccttc

SEQ ID NO: 64845 - DNA, 20 bp, Artificial
  CRISPR gRNA sequence
actgatgcctgcccccttca

SEQ ID NO: 64846 - DNA, 20 bp, Artificial
  CRISPR gRNA sequence
atgcctgcccccttcactcc

SEQ ID NO: 64847 - DNA, 20 bp, Artificial
  CRISPR gRNA sequence
cccccttcactccttcccac

SEQ ID NO: 64848 - DNA, 20 bp, Artificial
  CRISPR gRNA sequence
cactccttcccactgctcag

SEQ ID NO: 64849 - DNA, 20 bp, Artificial
  CRISPR gRNA sequence
actccttcccactgctcagg

SEQ ID NO: 64850 - DNA, 20 bp, Artificial
  CRISPR gRNA sequence
cttcccactgctcaggataa

SEQ ID NO: 64851 - DNA, 20 bp, Artificial
  CRISPR gRNA sequence
cccactgctcaggataaaac

SEQ ID NO: 64852 - DNA, 20 bp, Artificial
  CRISPR gRNA sequence
ccactgctcaggataaaacc

SEQ ID NO: 64853 - DNA, 20 bp, Artificial
  CRISPR gRNA sequence
ctcaggataaaacccacatt

SEQ ID NO: 64854 - DNA, 20 bp, Artificial
  CRISPR gRNA sequence
aggataaaacccacattcta

SEQ ID NO: 64855 - DNA, 20 bp, Artificial
  CRISPR gRNA sequence
taaactcccaggtggtccag

SEQ ID NO: 64856 - DNA, 20 bp, Artificial
  CRISPR gRNA sequence
aactcccaggtggtccagaa

SEQ ID NO: 64857 - DNA, 20 bp, Artificial
  CRISPR gRNA sequence
ccaggtggtccagaaccctg

SEQ ID NO: 64858 - DNA, 20 bp, Artificial
  CRISPR gRNA sequence
cccccagcctcctaaacccc

SEQ ID NO: 64859 - DNA, 20 bp, Artificial
  CRISPR gRNA sequence
ctaaaccccatctgacccca

SEQ ID NO: 64860 - DNA, 20 bp, Artificial
  CRISPR gRNA sequence
aaccccatctgaccccatcc

SEQ ID NO: 64861 - DNA, 20 bp, Artificial
  CRISPR gRNA sequence
accccatccttccactcaat

SEQ ID NO: 64862 - DNA, 20 bp, Artificial
  CRISPR gRNA sequence
ccactcaatctccaatccag

SEQ ID NO: 64863 - DNA, 20 bp, Artificial
  CRISPR gRNA sequence
cactcaatctccaatccaga

SEQ ID NO: 64864 - DNA, 20 bp, Artificial
  CRISPR gRNA sequence
aatctccaatccagacacac

SEQ ID NO: 64865 - DNA, 20 bp, Artificial
  CRISPR gRNA sequence
caatccagacacactggctc

SEQ ID NO: 64866 - DNA, 20 bp, Artificial
  CRISPR gRNA sequence
gctctctttcaggtcctcat

SEQ ID NO: 64867 - DNA, 20 bp, Artificial
  CRISPR gRNA sequence
tctttcaggtcctcatatgt

SEQ ID NO: 64868 - DNA, 20 bp, Artificial
  CRISPR gRNA sequence
tttcaggtcctcatatgtgt

SEQ ID NO: 64869 - DNA, 20 bp, Artificial
  CRISPR gRNA sequence
tcaggtcctcatatgtgtta

SEQ ID NO: 64870 - DNA, 20 bp, Artificial
  CRISPR gRNA sequence
caggtcctcatatgtgttat

SEQ ID NO: 64871 - DNA, 20 bp, Artificial
  CRISPR gRNA sequence
aggtcctcatatgtgttatg

SEQ ID NO: 64872 - DNA, 20 bp, Artificial
  CRISPR gRNA sequence
atatgtgttatgccacaggg

SEQ ID NO: 64873 - DNA, 20 bp, Artificial
  CRISPR gRNA sequence
tgccacagggcctttgaatg

SEQ ID NO: 64874 - DNA, 20 bp, Artificial
  CRISPR gRNA sequence
tgaatgtactgcttctacca

SEQ ID NO: 64875 - DNA, 20 bp, Artificial
  CRISPR gRNA sequence
gaatgtactgcttctaccac

SEQ ID NO: 64876 - DNA, 20 bp, Artificial
  CRISPR gRNA sequence
aatgtactgcttctaccacc

SEQ ID NO: 64877 - DNA, 20 bp, Artificial
  CRISPR gRNA sequence
cttctaccaccaggaacacc

SEQ ID NO: 64878 - DNA, 20 bp, Artificial
  CRISPR gRNA sequence
ctaccaccaggaacaccctt

SEQ ID NO: 64879 - DNA, 20 bp, Artificial
  CRISPR gRNA sequence
taccaccaggaacacccttc

SEQ ID NO: 64880 - DNA, 20 bp, Artificial
  CRISPR gRNA sequence
ccaccaggaacacccttcct

SEQ ID NO: 64881 - DNA, 20 bp, Artificial
  CRISPR gRNA sequence
cctccatctctcccccaacc

SEQ ID NO: 64882 - DNA, 20 bp, Artificial
  CRISPR gRNA sequence
ctccatctctcccccaacct

SEQ ID NO: 64883 - DNA, 20 bp, Artificial
  CRISPR gRNA sequence
catctctcccccaacctttt

SEQ ID NO: 64884 - DNA, 20 bp, Artificial
  CRISPR gRNA sequence
tcccccaaccttttacctac

SEQ ID NO: 64885 - DNA, 20 bp, Artificial
  CRISPR gRNA sequence
ccccaaccttttacctactg

SEQ ID NO: 64886 - DNA, 20 bp, Artificial
  CRISPR gRNA sequence
ttacctactgaactcccagt

SEQ ID NO: 64887 - DNA, 20 bp, Artificial
  CRISPR gRNA sequence
tacctactgaactcccagtt

SEQ ID NO: 64888 - DNA, 20 bp, Artificial
  CRISPR gRNA sequence
acctactgaactcccagtta

SEQ ID NO: 64889 - DNA, 20 bp, Artificial
  CRISPR gRNA sequence
cctactgaactcccagttat

SEQ ID NO: 64890 - DNA, 20 bp, Artificial
  CRISPR gRNA sequence
ctgaactcccagttatttca

SEQ ID NO: 64891 - DNA, 20 bp, Artificial
  CRISPR gRNA sequence
aactcccagttatttcagca

SEQ ID NO: 64892 - DNA, 20 bp, Artificial
  CRISPR gRNA sequence
ccagttatttcagcaagtag

SEQ ID NO: 64893 - DNA, 20 bp, Artificial
  CRISPR gRNA sequence
tttcagcaagtagcttaagc

SEQ ID NO: 64894 - DNA, 20 bp, Artificial
  CRISPR gRNA sequence
cagcaagtagcttaagcaac

SEQ ID NO: 64895 - DNA, 20 bp, Artificial
  CRISPR gRNA sequence
agcaagtagcttaagcaaca

SEQ ID NO: 64896 - DNA, 20 bp, Artificial
  CRISPR gRNA sequence
aagcaacaaataagccatcc

SEQ ID NO: 64897 - DNA, 20 bp, Artificial
  CRISPR gRNA sequence
agcaacaaataagccatccc

SEQ ID NO: 64898 - DNA, 20 bp, Artificial
  CRISPR gRNA sequence
ccagactaggtcagatgccc

SEQ ID NO: 64899 - DNA, 20 bp, Artificial
  CRISPR gRNA sequence
ggtcagatgcccccataatc

SEQ ID NO: 64900 - DNA, 20 bp, Artificial
  CRISPR gRNA sequence
atcacaaaaagcaattatgt

SEQ ID NO: 64901 - DNA, 20 bp, Artificial
  CRISPR gRNA sequence
tcacaaaaagcaattatgta

SEQ ID NO: 64902 - DNA, 20 bp, Artificial
  CRISPR gRNA sequence
tgtaacttgcagcataaagg

SEQ ID NO: 64903 - DNA, 20 bp, Artificial
  CRISPR gRNA sequence
gcagcataaaggaagagttg

SEQ ID NO: 64904 - DNA, 20 bp, Artificial
  CRISPR gRNA sequence
cagcataaaggaagagttga

SEQ ID NO: 64905 - DNA, 20 bp, Artificial
  CRISPR gRNA sequence
agggtggggccttgaaggca

SEQ ID NO: 64906 - DNA, 20 bp, Artificial
  CRISPR gRNA sequence
gaaggcaggctgcctgggtt

SEQ ID NO: 64907 - DNA, 20 bp, Artificial
  CRISPR gRNA sequence
aaggcaggctgcctgggttc

SEQ ID NO: 64908 - DNA, 20 bp, Artificial
  CRISPR gRNA sequence
cctgggttcaaatccaggtt

SEQ ID NO: 64909 - DNA, 20 bp, Artificial
  CRISPR gRNA sequence
ggttcaaatccaggttctcc

SEQ ID NO: 64910 - DNA, 20 bp, Artificial
  CRISPR gRNA sequence
aaatccaggttctccctcga

SEQ ID NO: 64911 - DNA, 20 bp, Artificial
  CRISPR gRNA sequence
tccctcgagcaagtgcctta

SEQ ID NO: 64912 - DNA, 20 bp, Artificial
  CRISPR gRNA sequence
cctcgagcaagtgccttaac

SEQ ID NO: 64913 - DNA, 20 bp, Artificial
  CRISPR gRNA sequence
gagcaagtgccttaacttta

SEQ ID NO: 64914 - DNA, 20 bp, Artificial
  CRISPR gRNA sequence
aactttactctgcacttaac

SEQ ID NO: 64915 - DNA, 20 bp, Artificial
  CRISPR gRNA sequence
actttactctgcacttaacc

SEQ ID NO: 64916 - DNA, 20 bp, Artificial
  CRISPR gRNA sequence
tactctgcacttaaccactc

SEQ ID NO: 64917 - DNA, 20 bp, Artificial
  CRISPR gRNA sequence
actctgcacttaaccactct

SEQ ID NO: 64918 - DNA, 20 bp, Artificial
  CRISPR gRNA sequence
ctctgcacttaaccactctg

SEQ ID NO: 64919 - DNA, 20 bp, Artificial
  CRISPR gRNA sequence
tgcacttaaccactctgcac

SEQ ID NO: 64920 - DNA, 20 bp, Artificial
  CRISPR gRNA sequence
cacttaaccactctgcactt

SEQ ID NO: 64921 - DNA, 20 bp, Artificial
  CRISPR gRNA sequence
aaccactctgcacttgagtt

SEQ ID NO: 64922 - DNA, 20 bp, Artificial
  CRISPR gRNA sequence
accactctgcacttgagttt

SEQ ID NO: 64923 - DNA, 20 bp, Artificial
  CRISPR gRNA sequence
tgcacttgagtttactcatc

SEQ ID NO: 64924 - DNA, 20 bp, Artificial
  CRISPR gRNA sequence
cacttgagtttactcatcag

SEQ ID NO: 64925 - DNA, 20 bp, Artificial
  CRISPR gRNA sequence
gagtttactcatcagtaagg

SEQ ID NO: 64926 - DNA, 20 bp, Artificial
  CRISPR gRNA sequence
agtttactcatcagtaaggt

SEQ ID NO: 64927 - DNA, 20 bp, Artificial
  CRISPR gRNA sequence
actcatcagtaaggtgagga

SEQ ID NO: 64928 - DNA, 20 bp, Artificial
  CRISPR gRNA sequence
ctcatcagtaaggtgaggat

SEQ ID NO: 64929 - DNA, 20 bp, Artificial
  CRISPR gRNA sequence
atcagtaaggtgaggataat

SEQ ID NO: 64930 - DNA, 20 bp, Artificial
  CRISPR gRNA sequence
cagtgcccacgtcatcggca

SEQ ID NO: 64931 - DNA, 20 bp, Artificial
  CRISPR gRNA sequence
tgaggatgaaataggccaat

SEQ ID NO: 64932 - DNA, 20 bp, Artificial
  CRISPR gRNA sequence
ggatgttgccaggcatgtgg

SEQ ID NO: 64933 - DNA, 20 bp, Artificial
  CRISPR gRNA sequence
ccaggcatgtggtatggagt

SEQ ID NO: 64934 - DNA, 20 bp, Artificial
  CRISPR gRNA sequence
tcgatttcagttattatcaa

SEQ ID NO: 64935 - DNA, 20 bp, Artificial
  CRISPR gRNA sequence
cagttattatcaaggttcat

SEQ ID NO: 64936 - DNA, 20 bp, Artificial
  CRISPR gRNA sequence
agttattatcaaggttcatt

SEQ ID NO: 64937 - DNA, 20 bp, Artificial
  CRISPR gRNA sequence
ttatcaaggttcattcctga

SEQ ID NO: 64938 - DNA, 20 bp, Artificial
  CRISPR gRNA sequence
tcaaggttcattcctgagag

SEQ ID NO: 64939 - DNA, 20 bp, Artificial
  CRISPR gRNA sequence
attcctgagagtgacacttt

SEQ ID NO: 64940 - DNA, 20 bp, Artificial
  CRISPR gRNA sequence
ctgagagtgacactttgact

SEQ ID NO: 64941 - DNA, 20 bp, Artificial
  CRISPR gRNA sequence
agagtgacactttgactaaa

SEQ ID NO: 64942 - DNA, 20 bp, Artificial
  CRISPR gRNA sequence
tgactaaagttagcaaagga

SEQ ID NO: 64943 - DNA, 20 bp, Artificial
  CRISPR gRNA sequence
gactaaagttagcaaaggag

SEQ ID NO: 64944 - DNA, 20 bp, Artificial
  CRISPR gRNA sequence
actaaagttagcaaaggagg

SEQ ID NO: 64945 - DNA, 20 bp, Artificial
  CRISPR gRNA sequence
aagttagcaaaggaggagta

SEQ ID NO: 64946 - DNA, 20 bp, Artificial
  CRISPR gRNA sequence
gcaaaggaggagtaagtgat

SEQ ID NO: 64947 - DNA, 20 bp, Artificial
  CRISPR gRNA sequence
agggaggactccagccccac

SEQ ID NO: 64948 - DNA, 20 bp, Artificial
  CRISPR gRNA sequence
cagccccacaatacagtgca

SEQ ID NO: 64949 - DNA, 20 bp, Artificial
  CRISPR gRNA sequence
ggccccccgtctcagcctct

SEQ ID NO: 64950 - DNA, 20 bp, Artificial
  CRISPR gRNA sequence
agcctctcagggaaccagct

SEQ ID NO: 64951 - DNA, 20 bp, Artificial
  CRISPR gRNA sequence
tcagggaaccagctggaaga

SEQ ID NO: 64952 - DNA, 20 bp, Artificial
  CRISPR gRNA sequence
agggaaccagctggaagatg

SEQ ID NO: 64953 - DNA, 20 bp, Artificial
  CRISPR gRNA sequence
gaagatgaaggctgtcggct

SEQ ID NO: 64954 - DNA, 20 bp, Artificial
  CRISPR gRNA sequence
tcggctgatggcagaggctg

SEQ ID NO: 64955 - DNA, 20 bp, Artificial
  CRISPR gRNA sequence
atggcagaggctgcatccca

SEQ ID NO: 64956 - DNA, 20 bp, Artificial
  CRISPR gRNA sequence
catcccagctgcacatcgcc

SEQ ID NO: 64957 - DNA, 20 bp, Artificial
  CRISPR gRNA sequence
cacatcgccaggaagctgga

SEQ ID NO: 64958 - DNA, 20 bp, Artificial
  CRISPR gRNA sequence
gagtgagttgtccaccccac

SEQ ID NO: 64959 - DNA, 20 bp, Artificial
  CRISPR gRNA sequence
tccaccccaccgctgggtac

SEQ ID NO: 64960 - DNA, 20 bp, Artificial
  CRISPR gRNA sequence
ggtaccagggaaggccctgt

SEQ ID NO: 64961 - DNA, 20 bp, Artificial
  CRISPR gRNA sequence
tagagccccaggaggtcccc

SEQ ID NO: 64962 - DNA, 20 bp, Artificial
  CRISPR gRNA sequence
gtaatcagcagtaagggtgc

SEQ ID NO: 64963 - DNA, 20 bp, Artificial
  CRISPR gRNA sequence
atccactgccacccctgctt

SEQ ID NO: 64964 - DNA, 20 bp, Artificial
  CRISPR gRNA sequence
ccacccctgcttcctcccaa

SEQ ID NO: 64965 - DNA, 20 bp, Artificial
  CRISPR gRNA sequence
cttcctcccaactccagcaa

SEQ ID NO: 64966 - DNA, 20 bp, Artificial
  CRISPR gRNA sequence
cctcccaactccagcaaagt

SEQ ID NO: 64967 - DNA, 20 bp, Artificial
  CRISPR gRNA sequence
ctcccaactccagcaaagtc

SEQ ID NO: 64968 - DNA, 20 bp, Artificial
  CRISPR gRNA sequence
ccaactccagcaaagtcaag

SEQ ID NO: 64969 - DNA, 20 bp, Artificial
  CRISPR gRNA sequence
cagcaaagtcaagatggttt

SEQ ID NO: 64970 - DNA, 20 bp, Artificial
  CRISPR gRNA sequence
gaccatgccttgccttcacc

SEQ ID NO: 64971 - DNA, 20 bp, Artificial
  CRISPR gRNA sequence
accatgccttgccttcacct

SEQ ID NO: 64972 - DNA, 20 bp, Artificial
  CRISPR gRNA sequence
gccttcacctccggcatgag

SEQ ID NO: 64973 - DNA, 20 bp, Artificial
  CRISPR gRNA sequence
ccttcacctccggcatgagc

SEQ ID NO: 64974 - DNA, 20 bp, Artificial
  CRISPR gRNA sequence
cacctccggcatgagccact

SEQ ID NO: 64975 - DNA, 20 bp, Artificial
  CRISPR gRNA sequence
acctccggcatgagccactg

SEQ ID NO: 64976 - DNA, 20 bp, Artificial
  CRISPR gRNA sequence
cggcatgagccactgtctta

SEQ ID NO: 64977 - DNA, 20 bp, Artificial
  CRISPR gRNA sequence
tcttagtccaatcatctagc

SEQ ID NO: 64978 - DNA, 20 bp, Artificial
  CRISPR gRNA sequence
agtccaatcatctagcaccc

SEQ ID NO: 64979 - DNA, 20 bp, Artificial
  CRISPR gRNA sequence
gtccaatcatctagcaccct

SEQ ID NO: 64980 - DNA, 20 bp, Artificial
  CRISPR gRNA sequence
gcacccttacatgtgtaaaa

SEQ ID NO: 64981 - DNA, 20 bp, Artificial
  CRISPR gRNA sequence
acatgtgtaaaatgcgttca

SEQ ID NO: 64982 - DNA, 20 bp, Artificial
  CRISPR gRNA sequence
catgtgtaaaatgcgttcat

SEQ ID NO: 64983 - DNA, 20 bp, Artificial
  CRISPR gRNA sequence
attatacatcagtggcttgc

SEQ ID NO: 64984 - DNA, 20 bp, Artificial
  CRISPR gRNA sequence
tacatcagtggcttgcattc

SEQ ID NO: 64985 - DNA, 20 bp, Artificial
  CRISPR gRNA sequence
gcattccaattcatctttgt

SEQ ID NO: 64986 - DNA, 20 bp, Artificial
  CRISPR gRNA sequence
cattccaattcatctttgta

SEQ ID NO: 64987 - DNA, 20 bp, Artificial
  CRISPR gRNA sequence
caattcatctttgtagctgc

SEQ ID NO: 64988 - DNA, 20 bp, Artificial
  CRISPR gRNA sequence
atctttgtagctgccctgga

SEQ ID NO: 64989 - DNA, 20 bp, Artificial
  CRISPR gRNA sequence
tgtagctgccctggagcacg

SEQ ID NO: 64990 - DNA, 20 bp, Artificial
  CRISPR gRNA sequence
gtagctgccctggagcacgg

SEQ ID NO: 64991 - DNA, 20 bp, Artificial
  CRISPR gRNA sequence
tagctgccctggagcacggt

SEQ ID NO: 64992 - DNA, 20 bp, Artificial
  CRISPR gRNA sequence
ccctggagcacggtggggtg

SEQ ID NO: 64993 - DNA, 20 bp, Artificial
  CRISPR gRNA sequence
gagcacggtggggtggggtg

SEQ ID NO: 64994 - DNA, 20 bp, Artificial
  CRISPR gRNA sequence
cactggggaggtgtcagggt

SEQ ID NO: 64995 - DNA, 20 bp, Artificial
  CRISPR gRNA sequence
gggaggtgtcagggtgggtg

SEQ ID NO: 64996 - DNA, 20 bp, Artificial
  CRISPR gRNA sequence
cactgtggaggtgtcatgct

SEQ ID NO: 64997 - DNA, 20 bp, Artificial
  CRISPR gRNA sequence
tggaggtgtcatgctggggt

SEQ ID NO: 64998 - DNA, 20 bp, Artificial
  CRISPR gRNA sequence
gggtgctagggtagggagtg

SEQ ID NO: 64999 - DNA, 20 bp, Artificial
  CRISPR gRNA sequence
gggtagggagtggtgtgttc

SEQ ID NO: 65000 - DNA, 20 bp, Artificial
  CRISPR gRNA sequence
ctgtggggatacactgttgg

SEQ ID NO: 65001 - DNA, 20 bp, Artificial
  CRISPR gRNA sequence
tggggatacactgttggggt

SEQ ID NO: 65002 - DNA, 20 bp, Artificial
  CRISPR gRNA sequence
ttggggtgaggggtggtgag

SEQ ID NO: 65003 - DNA, 20 bp, Artificial
  CRISPR gRNA sequence
gggtgaggggtggtgagatg

SEQ ID NO: 65004 - DNA, 20 bp, Artificial
  CRISPR gRNA sequence
ttaggctgctgggtgtgctg

SEQ ID NO: 65005 - DNA, 20 bp, Artificial
  CRISPR gRNA sequence
ggctgctgggtgtgctgtgg

SEQ ID NO: 65006 - DNA, 20 bp, Artificial
  CRISPR gRNA sequence
ctgggtgtgctgtggtgttg

SEQ ID NO: 65007 - DNA, 20 bp, Artificial
  CRISPR gRNA sequence
ggtgtgctgtggtgttgcat

SEQ ID NO: 65008 - DNA, 20 bp, Artificial
  CRISPR gRNA sequence
tggtgttgcatggggtgagg

SEQ ID NO: 65009 - DNA, 20 bp, Artificial
  CRISPR gRNA sequence
catggggtgagggtgatgtt

SEQ ID NO: 65010 - DNA, 20 bp, Artificial
  CRISPR gRNA sequence
gggtgggggtgtcttggggg

SEQ ID NO: 65011 - DNA, 20 bp, Artificial
  CRISPR gRNA sequence
ggtgggggtgtcttgggggt

SEQ ID NO: 65012 - DNA, 20 bp, Artificial
  CRISPR gRNA sequence
gggggtcttaggatcaagtg

SEQ ID NO: 65013 - DNA, 20 bp, Artificial
  CRISPR gRNA sequence
ggggtcttaggatcaagtgt

SEQ ID NO: 65014 - DNA, 20 bp, Artificial
  CRISPR gRNA sequence
aggatcaagtgtgggtcggg

SEQ ID NO: 65015 - DNA, 20 bp, Artificial
  CRISPR gRNA sequence
ggatcaagtgtgggtcgggt

SEQ ID NO: 65016 - DNA, 20 bp, Artificial
  CRISPR gRNA sequence
ggggagtgttgagattgggt

SEQ ID NO: 65017 - DNA, 20 bp, Artificial
  CRISPR gRNA sequence
gggagtgttgagattgggta

SEQ ID NO: 65018 - DNA, 20 bp, Artificial
  CRISPR gRNA sequence
agattgggtagcagtggttt

SEQ ID NO: 65019 - DNA, 20 bp, Artificial
  CRISPR gRNA sequence
ggtagcagtggtttggggcc

SEQ ID NO: 65020 - DNA, 20 bp, Artificial
  CRISPR gRNA sequence
ggggcctcagctttggattt

SEQ ID NO: 65021 - DNA, 20 bp, Artificial
  CRISPR gRNA sequence
gggcctcagctttggatttc

SEQ ID NO: 65022 - DNA, 20 bp, Artificial
  CRISPR gRNA sequence
agctttggatttcaatcttc

SEQ ID NO: 65023 - DNA, 20 bp, Artificial
  CRISPR gRNA sequence
tggatttcaatcttcgctct

SEQ ID NO: 65024 - DNA, 20 bp, Artificial
  CRISPR gRNA sequence
ggatttcaatcttcgctctg

SEQ ID NO: 65025 - DNA, 20 bp, Artificial
  CRISPR gRNA sequence
gatttcaatcttcgctctgt

SEQ ID NO: 65026 - DNA, 20 bp, Artificial
  CRISPR gRNA sequence
caatcttcgctctgtcactt

SEQ ID NO: 65027 - DNA, 20 bp, Artificial
  CRISPR gRNA sequence
aatcttcgctctgtcactta

SEQ ID NO: 65028 - DNA, 20 bp, Artificial
  CRISPR gRNA sequence
cgctctgtcacttagtagca

SEQ ID NO: 65029 - DNA, 20 bp, Artificial
  CRISPR gRNA sequence
gctctgtcacttagtagcat

SEQ ID NO: 65030 - DNA, 20 bp, Artificial
  CRISPR gRNA sequence
tgtcacttagtagcattgtg

SEQ ID NO: 65031 - DNA, 20 bp, Artificial
  CRISPR gRNA sequence
tcacttagtagcattgtgaa

SEQ ID NO: 65032 - DNA, 20 bp, Artificial
  CRISPR gRNA sequence
agtagcattgtgaacctggg

SEQ ID NO: 65033 - DNA, 20 bp, Artificial
  CRISPR gRNA sequence
gtagcattgtgaacctggga

SEQ ID NO: 65034 - DNA, 20 bp, Artificial
  CRISPR gRNA sequence
tgaacctgggaaagtaattg

SEQ ID NO: 65035 - DNA, 20 bp, Artificial
  CRISPR gRNA sequence
ggaaagtaattgaatgtctc

SEQ ID NO: 65036 - DNA, 20 bp, Artificial
  CRISPR gRNA sequence
aatgtctctgggcctcggtt

SEQ ID NO: 65037 - DNA, 20 bp, Artificial
  CRISPR gRNA sequence
tgggcctcggtttcccctct

SEQ ID NO: 65038 - DNA, 20 bp, Artificial
  CRISPR gRNA sequence
ggcctcggtttcccctctgt

SEQ ID NO: 65039 - DNA, 20 bp, Artificial
  CRISPR gRNA sequence
ggtttcccctctgtaaaatg

SEQ ID NO: 65040 - DNA, 20 bp, Artificial
  CRISPR gRNA sequence
cccctctgtaaaatgggatc

SEQ ID NO: 65041 - DNA, 20 bp, Artificial
  CRISPR gRNA sequence
ccctctgtaaaatgggatca

SEQ ID NO: 65042 - DNA, 20 bp, Artificial
  CRISPR gRNA sequence
tgtaaaatgggatcacatga

SEQ ID NO: 65043 - DNA, 20 bp, Artificial
  CRISPR gRNA sequence
taaaatgggatcacatgaaa

SEQ ID NO: 65044 - DNA, 20 bp, Artificial
  CRISPR gRNA sequence
ttgtacagagtctggtatag

SEQ ID NO: 65045 - DNA, 20 bp, Artificial
  CRISPR gRNA sequence
tgtacagagtctggtatagt

SEQ ID NO: 65046 - DNA, 20 bp, Artificial
  CRISPR gRNA sequence
gtacagagtctggtatagtc

SEQ ID NO: 65047 - DNA, 20 bp, Artificial
  CRISPR gRNA sequence
tacagagtctggtatagtca

SEQ ID NO: 65048 - DNA, 20 bp, Artificial
  CRISPR gRNA sequence
gtatagtcagggctcagaaa

SEQ ID NO: 65049 - DNA, 20 bp, Artificial
  CRISPR gRNA sequence
agaaaatggtggttatttta

SEQ ID NO: 65050 - DNA, 20 bp, Artificial
  CRISPR gRNA sequence
ttttacagatgagaaaactg

SEQ ID NO: 65051 - DNA, 20 bp, Artificial
  CRISPR gRNA sequence
tacagatgagaaaactgggg

SEQ ID NO: 65052 - DNA, 20 bp, Artificial
  CRISPR gRNA sequence
acagatgagaaaactggggg

SEQ ID NO: 65053 - DNA, 20 bp, Artificial
  CRISPR gRNA sequence
cagatgagaaaactgggggt

SEQ ID NO: 65054 - DNA, 20 bp, Artificial
  CRISPR gRNA sequence
ggggtcagagaggtgaaaac

SEQ ID NO: 65055 - DNA, 20 bp, Artificial
  CRISPR gRNA sequence
agttcttgctgtcaagctgg

SEQ ID NO: 65056 - DNA, 20 bp, Artificial
  CRISPR gRNA sequence
ttgctgtcaagctggacaac

SEQ ID NO: 65057 - DNA, 20 bp, Artificial
  CRISPR gRNA sequence
gctgtcaagctggacaactt

SEQ ID NO: 65058 - DNA, 20 bp, Artificial
  CRISPR gRNA sequence
ctgtcaagctggacaacttt

SEQ ID NO: 65059 - DNA, 20 bp, Artificial
  CRISPR gRNA sequence
tcaagctggacaactttatt

SEQ ID NO: 65060 - DNA, 20 bp, Artificial
  CRISPR gRNA sequence
gacaactttattttccaaat

SEQ ID NO: 65061 - DNA, 20 bp, Artificial
  CRISPR gRNA sequence
tattttccaaatgggatggg

SEQ ID NO: 65062 - DNA, 20 bp, Artificial
  CRISPR gRNA sequence
attttccaaatgggatgggg

SEQ ID NO: 65063 - DNA, 20 bp, Artificial
  CRISPR gRNA sequence
ttttccaaatgggatggggg

SEQ ID NO: 65064 - DNA, 20 bp, Artificial
  CRISPR gRNA sequence
tccaaatgggatgggggtgt

SEQ ID NO: 65065 - DNA, 20 bp, Artificial
  CRISPR gRNA sequence
ccaaatgggatgggggtgtc

SEQ ID NO: 65066 - DNA, 20 bp, Artificial
  CRISPR gRNA sequence
caaatgggatgggggtgtca

SEQ ID NO: 65067 - DNA, 20 bp, Artificial
  CRISPR gRNA sequence
tttggcttactcacacgcac

SEQ ID NO: 65068 - DNA, 20 bp, Artificial
  CRISPR gRNA sequence
ttggcttactcacacgcacc

SEQ ID NO: 65069 - DNA, 20 bp, Artificial
  CRISPR gRNA sequence
tggcttactcacacgcacca

SEQ ID NO: 65070 - DNA, 20 bp, Artificial
  CRISPR gRNA sequence
ggcttactcacacgcaccag

SEQ ID NO: 65071 - DNA, 20 bp, Artificial
  CRISPR gRNA sequence
gcttactcacacgcaccaga

SEQ ID NO: 65072 - DNA, 20 bp, Artificial
  CRISPR gRNA sequence
actcacacgcaccagaatcc

SEQ ID NO: 65073 - DNA, 20 bp, Artificial
  CRISPR gRNA sequence
ctcacacgcaccagaatcct

SEQ ID NO: 65074 - DNA, 20 bp, Artificial
  CRISPR gRNA sequence
acacgcaccagaatcctttg

SEQ ID NO: 65075 - DNA, 20 bp, Artificial
  CRISPR gRNA sequence
tgagatcccctggcaaggga

SEQ ID NO: 65076 - DNA, 20 bp, Artificial
  CRISPR gRNA sequence
gagatcccctggcaagggac

SEQ ID NO: 65077 - DNA, 20 bp, Artificial
  CRISPR gRNA sequence
agatcccctggcaagggacc

SEQ ID NO: 65078 - DNA, 20 bp, Artificial
  CRISPR gRNA sequence
gcaagggacctaggacatcc

SEQ ID NO: 65079 - DNA, 20 bp, Artificial
  CRISPR gRNA sequence
ggacatccaggagtgacagc

SEQ ID NO: 65080 - DNA, 20 bp, Artificial
  CRISPR gRNA sequence
ctgagccacagggaggggct

SEQ ID NO: 65081 - DNA, 20 bp, Artificial
  CRISPR gRNA sequence
agccacagggaggggctaga

SEQ ID NO: 65082 - DNA, 20 bp, Artificial
  CRISPR gRNA sequence
gagctggctggggctgggta

SEQ ID NO: 65083 - DNA, 20 bp, Artificial
  CRISPR gRNA sequence
gctggggctgggtacctcag

SEQ ID NO: 65084 - DNA, 20 bp, Artificial
  CRISPR gRNA sequence
gggctgggtacctcagccac

SEQ ID NO: 65085 - DNA, 20 bp, Artificial
  CRISPR gRNA sequence
ggtacctcagccacatgcca

SEQ ID NO: 65086 - DNA, 20 bp, Artificial
  CRISPR gRNA sequence
agccacatgccaacggctgc

SEQ ID NO: 65087 - DNA, 20 bp, Artificial
  CRISPR gRNA sequence
ccttctcctgctctccacag

SEQ ID NO: 65088 - DNA, 20 bp, Artificial
  CRISPR gRNA sequence
ctcctgctctccacagcctc

SEQ ID NO: 65089 - DNA, 20 bp, Artificial
  CRISPR gRNA sequence
tcctgctctccacagcctca

SEQ ID NO: 65090 - DNA, 20 bp, Artificial
  CRISPR gRNA sequence
ctgctctccacagcctcagt

SEQ ID NO: 65091 - DNA, 20 bp, Artificial
  CRISPR gRNA sequence
ctctccacagcctcagtaac

SEQ ID NO: 65092 - DNA, 20 bp, Artificial
  CRISPR gRNA sequence
tccacagcctcagtaacaac

SEQ ID NO: 65093 - DNA, 20 bp, Artificial
  CRISPR gRNA sequence
cacagcctcagtaacaacgg

SEQ ID NO: 65094 - DNA, 20 bp, Artificial
  CRISPR gRNA sequence
agtaacaacgggctttctgt

SEQ ID NO: 65095 - DNA, 20 bp, Artificial
  CRISPR gRNA sequence
tctgtggccggggtgcattg

SEQ ID NO: 65096 - DNA, 20 bp, Artificial
  CRISPR gRNA sequence
ctgtggccggggtgcattgt

SEQ ID NO: 65097 - DNA, 20 bp, Artificial
  CRISPR gRNA sequence
tgtggccggggtgcattgtg

SEQ ID NO: 65098 - DNA, 20 bp, Artificial
  CRISPR gRNA sequence
tggccggggtgcattgtgtg

SEQ ID NO: 65099 - DNA, 20 bp, Artificial
  CRISPR gRNA sequence
tgtgctgagggccgtgagtg

SEQ ID NO: 65100 - DNA, 20 bp, Artificial
  CRISPR gRNA sequence
agggccgtgagtgcgtgctg

SEQ ID NO: 65101 - DNA, 20 bp, Artificial
  CRISPR gRNA sequence
gaccctggcagagctgcaca

SEQ ID NO: 65102 - DNA, 20 bp, Artificial
  CRISPR gRNA sequence
gcagagctgcacatcaggtg

SEQ ID NO: 65103 - DNA, 20 bp, Artificial
  CRISPR gRNA sequence
cacatcaggtgggagctccc

SEQ ID NO: 65104 - DNA, 20 bp, Artificial
  CRISPR gRNA sequence
cctcagaccacggtacccat

SEQ ID NO: 65105 - DNA, 20 bp, Artificial
  CRISPR gRNA sequence
agaccacggtacccatcccc

SEQ ID NO: 65106 - DNA, 20 bp, Artificial
  CRISPR gRNA sequence
tctctgaagcccttggaatt

SEQ ID NO: 65107 - DNA, 20 bp, Artificial
  CRISPR gRNA sequence
tctgaagcccttggaattcc

SEQ ID NO: 65108 - DNA, 20 bp, Artificial
  CRISPR gRNA sequence
tgaagcccttggaattcctt

SEQ ID NO: 65109 - DNA, 20 bp, Artificial
  CRISPR gRNA sequence
aagcccttggaattccttct

SEQ ID NO: 65110 - DNA, 20 bp, Artificial
  CRISPR gRNA sequence
ggaattccttctgggcccag

SEQ ID NO: 65111 - DNA, 20 bp, Artificial
  CRISPR gRNA sequence
gaattccttctgggcccagg

SEQ ID NO: 65112 - DNA, 20 bp, Artificial
  CRISPR gRNA sequence
cttctgggcccaggccttgg

SEQ ID NO: 65113 - DNA, 20 bp, Artificial
  CRISPR gRNA sequence
ctgggcccaggccttgggac

SEQ ID NO: 65114 - DNA, 20 bp, Artificial
  CRISPR gRNA sequence
tgggcccaggccttgggacg

SEQ ID NO: 65115 - DNA, 20 bp, Artificial
  CRISPR gRNA sequence
ggcccaggccttgggacggg

SEQ ID NO: 65116 - DNA, 20 bp, Artificial
  CRISPR gRNA sequence
gggacgggcagaagatgctg

SEQ ID NO: 65117 - DNA, 20 bp, Artificial
  CRISPR gRNA sequence
ggacgggcagaagatgctgc

SEQ ID NO: 65118 - DNA, 20 bp, Artificial
  CRISPR gRNA sequence
ctgctgtcccacccagaccc

SEQ ID NO: 65119 - DNA, 20 bp, Artificial
  CRISPR gRNA sequence
ctgtcccacccagaccccgt

SEQ ID NO: 65120 - DNA, 20 bp, Artificial
  CRISPR gRNA sequence
tcccacccagaccccgttac

SEQ ID NO: 65121 - DNA, 20 bp, Artificial
  CRISPR gRNA sequence
cagccggcacccctcttcct

SEQ ID NO: 65122 - DNA, 20 bp, Artificial
  CRISPR gRNA sequence
ttcctagctgctgtggatat

SEQ ID NO: 65123 - DNA, 20 bp, Artificial
  CRISPR gRNA sequence
cctagctgctgtggatatag

SEQ ID NO: 65124 - DNA, 20 bp, Artificial
  CRISPR gRNA sequence
ctagctgctgtggatatagg

SEQ ID NO: 65125 - DNA, 20 bp, Artificial
  CRISPR gRNA sequence
gctgctgtggatataggctg

SEQ ID NO: 65126 - DNA, 20 bp, Artificial
  CRISPR gRNA sequence
ctgtggatataggctgctca

SEQ ID NO: 65127 - DNA, 20 bp, Artificial
  CRISPR gRNA sequence
tggatataggctgctcatgg

SEQ ID NO: 65128 - DNA, 20 bp, Artificial
  CRISPR gRNA sequence
ctcatggtttatacctctgg

SEQ ID NO: 65129 - DNA, 20 bp, Artificial
  CRISPR gRNA sequence
atggtttatacctctggaga

SEQ ID NO: 65130 - DNA, 20 bp, Artificial
  CRISPR gRNA sequence
atacctctggagaactaccc

SEQ ID NO: 65131 - DNA, 20 bp, Artificial
  CRISPR gRNA sequence
tacctctggagaactaccct

SEQ ID NO: 65132 - DNA, 20 bp, Artificial
  CRISPR gRNA sequence
tggagaactacccttggctg

SEQ ID NO: 65133 - DNA, 20 bp, Artificial
  CRISPR gRNA sequence
gagaactacccttggctgat

SEQ ID NO: 65134 - DNA, 20 bp, Artificial
  CRISPR gRNA sequence
cccttggctgataagaacca

SEQ ID NO: 65135 - DNA, 20 bp, Artificial
  CRISPR gRNA sequence
ggctgataagaaccagagac

SEQ ID NO: 65136 - DNA, 20 bp, Artificial
  CRISPR gRNA sequence
gctgataagaaccagagacg

SEQ ID NO: 65137 - DNA, 20 bp, Artificial
  CRISPR gRNA sequence
ataagaaccagagacgcctg

SEQ ID NO: 65138 - DNA, 20 bp, Artificial
  CRISPR gRNA sequence
gcagggtacaacccccactt

SEQ ID NO: 65139 - DNA, 20 bp, Artificial
  CRISPR gRNA sequence
tcccctaacctagagtggcc

SEQ ID NO: 65140 - DNA, 20 bp, Artificial
  CRISPR gRNA sequence
cccctaacctagagtggcca

SEQ ID NO: 65141 - DNA, 20 bp, Artificial
  CRISPR gRNA sequence
ccctaacctagagtggccaa

SEQ ID NO: 65142 - DNA, 20 bp, Artificial
  CRISPR gRNA sequence
acctagagtggccaatgaca

SEQ ID NO: 65143 - DNA, 20 bp, Artificial
  CRISPR gRNA sequence
gagtggccaatgacagaggc

SEQ ID NO: 65144 - DNA, 20 bp, Artificial
  CRISPR gRNA sequence
tccagcccaaactctccagt

SEQ ID NO: 65145 - DNA, 20 bp, Artificial
  CRISPR gRNA sequence
cagcccaaactctccagtgg

SEQ ID NO: 65146 - DNA, 20 bp, Artificial
  CRISPR gRNA sequence
tccagtgggacaaagctccc

SEQ ID NO: 65147 - DNA, 20 bp, Artificial
  CRISPR gRNA sequence
cagtgggacaaagctccctg

SEQ ID NO: 65148 - DNA, 20 bp, Artificial
  CRISPR gRNA sequence
cctgggagactaggccaagg

SEQ ID NO: 65149 - DNA, 20 bp, Artificial
  CRISPR gRNA sequence
ggagactaggccaaggactt

SEQ ID NO: 65150 - DNA, 20 bp, Artificial
  CRISPR gRNA sequence
ggccaaggacttgctccgtt

SEQ ID NO: 65151 - DNA, 20 bp, Artificial
  CRISPR gRNA sequence
gctccgtttggcttccctca

SEQ ID NO: 65152 - DNA, 20 bp, Artificial
  CRISPR gRNA sequence
ctccgtttggcttccctcag

SEQ ID NO: 65153 - DNA, 20 bp, Artificial
  CRISPR gRNA sequence
cgtttggcttccctcagtcc

SEQ ID NO: 65154 - DNA, 20 bp, Artificial
  CRISPR gRNA sequence
ggcttccctcagtcccttac

SEQ ID NO: 65155 - DNA, 20 bp, Artificial
  CRISPR gRNA sequence
gcttccctcagtcccttact

SEQ ID NO: 65156 - DNA, 20 bp, Artificial
  CRISPR gRNA sequence
ccctcagtcccttactgttt

SEQ ID NO: 65157 - DNA, 20 bp, Artificial
  CRISPR gRNA sequence
cctcagtcccttactgtttc

SEQ ID NO: 65158 - DNA, 20 bp, Artificial
  CRISPR gRNA sequence
agtcccttactgtttctcct

SEQ ID NO: 65159 - DNA, 20 bp, Artificial
  CRISPR gRNA sequence
actgtttctcctgagagcag

SEQ ID NO: 65160 - DNA, 20 bp, Artificial
  CRISPR gRNA sequence
ctgtttctcctgagagcaga

SEQ ID NO: 65161 - DNA, 20 bp, Artificial
  CRISPR gRNA sequence
tttctcctgagagcagaccg

SEQ ID NO: 65162 - DNA, 20 bp, Artificial
  CRISPR gRNA sequence
ctcctgagagcagaccgtca

SEQ ID NO: 65163 - DNA, 20 bp, Artificial
  CRISPR gRNA sequence
tcctgagagcagaccgtcag

SEQ ID NO: 65164 - DNA, 20 bp, Artificial
  CRISPR gRNA sequence
ctgagagcagaccgtcagtt

SEQ ID NO: 65165 - DNA, 20 bp, Artificial
  CRISPR gRNA sequence
agagcagaccgtcagttcat

SEQ ID NO: 65166 - DNA, 20 bp, Artificial
  CRISPR gRNA sequence
atgatgtgcgcaactgacaa

SEQ ID NO: 65167 - DNA, 20 bp, Artificial
  CRISPR gRNA sequence
acaagtgacatgcgaccccc

SEQ ID NO: 65168 - DNA, 20 bp, Artificial
  CRISPR gRNA sequence
ccccactcacagacccaggc

SEQ ID NO: 65169 - DNA, 20 bp, Artificial
  CRISPR gRNA sequence
acagacccaggctctgccac

SEQ ID NO: 65170 - DNA, 20 bp, Artificial
  CRISPR gRNA sequence
tgccactagggaacccaatc

SEQ ID NO: 65171 - DNA, 20 bp, Artificial
  CRISPR gRNA sequence
ccactagggaacccaatcct

SEQ ID NO: 65172 - DNA, 20 bp, Artificial
  CRISPR gRNA sequence
gggaacccaatcctatttct

SEQ ID NO: 65173 - DNA, 20 bp, Artificial
  CRISPR gRNA sequence
tttctgtaagtctcgccgtt

SEQ ID NO: 65174 - DNA, 20 bp, Artificial
  CRISPR gRNA sequence
ctgtaagtctcgccgttgag

SEQ ID NO: 65175 - DNA, 20 bp, Artificial
  CRISPR gRNA sequence
tgtaagtctcgccgttgagt

SEQ ID NO: 65176 - DNA, 20 bp, Artificial
  CRISPR gRNA sequence
taagtctcgccgttgagtat

SEQ ID NO: 65177 - DNA, 20 bp, Artificial
  CRISPR gRNA sequence
gccgttgagtatggggaggt

SEQ ID NO: 65178 - DNA, 20 bp, Artificial
  CRISPR gRNA sequence
agtatggggaggtgaggaca

SEQ ID NO: 65179 - DNA, 20 bp, Artificial
  CRISPR gRNA sequence
atgtcaactcagttcccact

SEQ ID NO: 65180 - DNA, 20 bp, Artificial
  CRISPR gRNA sequence
agttcccactcggaggaaag

SEQ ID NO: 65181 - DNA, 20 bp, Artificial
  CRISPR gRNA sequence
ccactcggaggaaagcctca

SEQ ID NO: 65182 - DNA, 20 bp, Artificial
  CRISPR gRNA sequence
ggaggaaagcctcattctca

SEQ ID NO: 65183 - DNA, 20 bp, Artificial
  CRISPR gRNA sequence
attctcaacccagtagggtg

SEQ ID NO: 65184 - DNA, 20 bp, Artificial
  CRISPR gRNA sequence
tcaacccagtagggtggtcc

SEQ ID NO: 65185 - DNA, 20 bp, Artificial
  CRISPR gRNA sequence
aacccagtagggtggtccct

SEQ ID NO: 65186 - DNA, 20 bp, Artificial
  CRISPR gRNA sequence
ctttaaacacccctcaaggg

SEQ ID NO: 65187 - DNA, 20 bp, Artificial
  CRISPR gRNA sequence
taaacacccctcaagggagg

SEQ ID NO: 65188 - DNA, 20 bp, Artificial
  CRISPR gRNA sequence
aaacacccctcaagggagga

SEQ ID NO: 65189 - DNA, 20 bp, Artificial
  CRISPR gRNA sequence
aacacccctcaagggaggag

SEQ ID NO: 65190 - DNA, 20 bp, Artificial
  CRISPR gRNA sequence
aagggaggagagggaaaccg

SEQ ID NO: 65191 - DNA, 20 bp, Artificial
  CRISPR gRNA sequence
acccaaaaggtagattaggg

SEQ ID NO: 65192 - DNA, 20 bp, Artificial
  CRISPR gRNA sequence
ggggaccttggttcactgta

SEQ ID NO: 65193 - DNA, 20 bp, Artificial
  CRISPR gRNA sequence
ggttcactgtatatgatgat

SEQ ID NO: 65194 - DNA, 20 bp, Artificial
  CRISPR gRNA sequence
gttcactgtatatgatgatt

SEQ ID NO: 65195 - DNA, 20 bp, Artificial
  CRISPR gRNA sequence
actgtatatgatgattcaat

SEQ ID NO: 65196 - DNA, 20 bp, Artificial
  CRISPR gRNA sequence
tatatgatgattcaataaag

SEQ ID NO: 65197 - DNA, 20 bp, Artificial
  CRISPR gRNA sequence
aataaagggtccctagtgca

SEQ ID NO: 65198 - DNA, 20 bp, Artificial
  CRISPR gRNA sequence
gtgcattccaagcgatgccc

SEQ ID NO: 65199 - DNA, 20 bp, Artificial
  CRISPR gRNA sequence
caagcgatgccctgttcact

SEQ ID NO: 65200 - DNA, 20 bp, Artificial
  CRISPR gRNA sequence
ttcacttccaggaacttata

SEQ ID NO: 65201 - DNA, 20 bp, Artificial
  CRISPR gRNA sequence
acttccaggaacttatacta

SEQ ID NO: 65202 - DNA, 20 bp, Artificial
  CRISPR gRNA sequence
ccaggaacttatactaaata

SEQ ID NO: 65203 - DNA, 20 bp, Artificial
  CRISPR gRNA sequence
caggaacttatactaaataa

SEQ ID NO: 65204 - DNA, 20 bp, Artificial
  CRISPR gRNA sequence
atactaaataaattatcacg

SEQ ID NO: 65205 - DNA, 20 bp, Artificial
  CRISPR gRNA sequence
tactaaataaattatcacga

SEQ ID NO: 65206 - DNA, 20 bp, Artificial
  CRISPR gRNA sequence
aataaattatcacgattgtg

SEQ ID NO: 65207 - DNA, 20 bp, Artificial
  CRISPR gRNA sequence
tcacgattgtgcaaacacat

SEQ ID NO: 65208 - DNA, 20 bp, Artificial
  CRISPR gRNA sequence
tgcaaacacatttagctgta

SEQ ID NO: 65209 - DNA, 20 bp, Artificial
  CRISPR gRNA sequence
agctgtagggatgttcacct

SEQ ID NO: 65210 - DNA, 20 bp, Artificial
  CRISPR gRNA sequence
gctgtagggatgttcacctc

SEQ ID NO: 65211 - DNA, 20 bp, Artificial
  CRISPR gRNA sequence
tagggatgttcacctcagta

SEQ ID NO: 65212 - DNA, 20 bp, Artificial
  CRISPR gRNA sequence
acctcagtattggttataat

SEQ ID NO: 65213 - DNA, 20 bp, Artificial
  CRISPR gRNA sequence
agtattggttataataggaa

SEQ ID NO: 65214 - DNA, 20 bp, Artificial
  CRISPR gRNA sequence
gttataataggaaaaaaaaa

SEQ ID NO: 65215 - DNA, 20 bp, Artificial
  CRISPR gRNA sequence
taataggaaaaaaaaagaaa

SEQ ID NO: 65216 - DNA, 20 bp, Artificial
  CRISPR gRNA sequence
gaatgtttaaccgagggata

SEQ ID NO: 65217 - DNA, 20 bp, Artificial
  CRISPR gRNA sequence
aaccgagggatattagttag

SEQ ID NO: 65218 - DNA, 20 bp, Artificial
  CRISPR gRNA sequence
accgagggatattagttaga

SEQ ID NO: 65219 - DNA, 20 bp, Artificial
  CRISPR gRNA sequence
gttagactaagttacttcca

SEQ ID NO: 65220 - DNA, 20 bp, Artificial
  CRISPR gRNA sequence
gactaagttacttccagaga

SEQ ID NO: 65221 - DNA, 20 bp, Artificial
  CRISPR gRNA sequence
agttacttccagagagaact

SEQ ID NO: 65222 - DNA, 20 bp, Artificial
  CRISPR gRNA sequence
cttccagagagaactcagtg

SEQ ID NO: 65223 - DNA, 20 bp, Artificial
  CRISPR gRNA sequence
ccagagagaactcagtggaa

SEQ ID NO: 65224 - DNA, 20 bp, Artificial
  CRISPR gRNA sequence
cagagagaactcagtggaac

SEQ ID NO: 65225 - DNA, 20 bp, Artificial
  CRISPR gRNA sequence
agtggaaccatagaaaaaaa

SEQ ID NO: 65226 - DNA, 20 bp, Artificial
  CRISPR gRNA sequence
caatatggaggggtgacggg

SEQ ID NO: 65227 - DNA, 20 bp, Artificial
  CRISPR gRNA sequence
aatatggaggggtgacgggg

SEQ ID NO: 65228 - DNA, 20 bp, Artificial
  CRISPR gRNA sequence
ttaagtaaacataaagaaat

SEQ ID NO: 65229 - DNA, 20 bp, Artificial
  CRISPR gRNA sequence
agtaaacataaagaaatttc

SEQ ID NO: 65230 - DNA, 20 bp, Artificial
  CRISPR gRNA sequence
ctttagagacaggatcttgc

SEQ ID NO: 65231 - DNA, 20 bp, Artificial
  CRISPR gRNA sequence
tttagagacaggatcttgct

SEQ ID NO: 65232 - DNA, 20 bp, Artificial
  CRISPR gRNA sequence
tagagacaggatcttgctct

SEQ ID NO: 65233 - DNA, 20 bp, Artificial
  CRISPR gRNA sequence
agagacaggatcttgctctg

SEQ ID NO: 65234 - DNA, 20 bp, Artificial
  CRISPR gRNA sequence
gagacaggatcttgctctgt

SEQ ID NO: 65235 - DNA, 20 bp, Artificial
  CRISPR gRNA sequence
gctctgttaccaaggctgga

SEQ ID NO: 65236 - DNA, 20 bp, Artificial
  CRISPR gRNA sequence
ctctgttaccaaggctggag

SEQ ID NO: 65237 - DNA, 20 bp, Artificial
  CRISPR gRNA sequence
tgttaccaaggctggagtac

SEQ ID NO: 65238 - DNA, 20 bp, Artificial
  CRISPR gRNA sequence
ttaccaaggctggagtacag

SEQ ID NO: 65239 - DNA, 20 bp, Artificial
  CRISPR gRNA sequence
ccaaggctggagtacagtga

SEQ ID NO: 65240 - DNA, 20 bp, Artificial
  CRISPR gRNA sequence
gagtacagtgacacaatcac

SEQ ID NO: 65241 - DNA, 20 bp, Artificial
  CRISPR gRNA sequence
actgtaacctccaaatcctg

SEQ ID NO: 65242 - DNA, 20 bp, Artificial
  CRISPR gRNA sequence
taacctccaaatcctgggct

SEQ ID NO: 65243 - DNA, 20 bp, Artificial
  CRISPR gRNA sequence
caaatcctgggctcagcaat

SEQ ID NO: 65244 - DNA, 20 bp, Artificial
  CRISPR gRNA sequence
ggctcagcaatccatctctc

SEQ ID NO: 65245 - DNA, 20 bp, Artificial
  CRISPR gRNA sequence
agcaatccatctctcttagt

SEQ ID NO: 65246 - DNA, 20 bp, Artificial
  CRISPR gRNA sequence
tcttagtctcccaaagtgct

SEQ ID NO: 65247 - DNA, 20 bp, Artificial
  CRISPR gRNA sequence
ttagtctcccaaagtgctgg

SEQ ID NO: 65248 - DNA, 20 bp, Artificial
  CRISPR gRNA sequence
agtctcccaaagtgctggga

SEQ ID NO: 65249 - DNA, 20 bp, Artificial
  CRISPR gRNA sequence
gtctcccaaagtgctgggat

SEQ ID NO: 65250 - DNA, 20 bp, Artificial
  CRISPR gRNA sequence
ccaaagtgctgggattacag

SEQ ID NO: 65251 - DNA, 20 bp, Artificial
  CRISPR gRNA sequence
ggattacagtcatgagtcac

SEQ ID NO: 65252 - DNA, 20 bp, Artificial
  CRISPR gRNA sequence
cagtcatgagtcactatgcc

SEQ ID NO: 65253 - DNA, 20 bp, Artificial
  CRISPR gRNA sequence
tgcctggcaattttttttat

SEQ ID NO: 65254 - DNA, 20 bp, Artificial
  CRISPR gRNA sequence
gcaattttttttatttttag

SEQ ID NO: 65255 - DNA, 20 bp, Artificial
  CRISPR gRNA sequence
tttttatttttagtagagag

SEQ ID NO: 65256 - DNA, 20 bp, Artificial
  CRISPR gRNA sequence
ttttatttttagtagagaga

SEQ ID NO: 65257 - DNA, 20 bp, Artificial
  CRISPR gRNA sequence
tttatttttagtagagagag

SEQ ID NO: 65258 - DNA, 20 bp, Artificial
  CRISPR gRNA sequence
ttatttttagtagagagagg

SEQ ID NO: 65259 - DNA, 20 bp, Artificial
  CRISPR gRNA sequence
tatttttagtagagagaggg

SEQ ID NO: 65260 - DNA, 20 bp, Artificial
  CRISPR gRNA sequence
atttttagtagagagagggt

SEQ ID NO: 65261 - DNA, 20 bp, Artificial
  CRISPR gRNA sequence
tttttagtagagagagggtc

SEQ ID NO: 65262 - DNA, 20 bp, Artificial
  CRISPR gRNA sequence
ttagtagagagagggtcttg

SEQ ID NO: 65263 - DNA, 20 bp, Artificial
  CRISPR gRNA sequence
tagtagagagagggtcttgc

SEQ ID NO: 65264 - DNA, 20 bp, Artificial
  CRISPR gRNA sequence
agtagagagagggtcttgct

SEQ ID NO: 65265 - DNA, 20 bp, Artificial
  CRISPR gRNA sequence
gtagagagagggtcttgcta

SEQ ID NO: 65266 - DNA, 20 bp, Artificial
  CRISPR gRNA sequence
gctatattgaccaggctgtt

SEQ ID NO: 65267 - DNA, 20 bp, Artificial
  CRISPR gRNA sequence
ctatattgaccaggctgttc

SEQ ID NO: 65268 - DNA, 20 bp, Artificial
  CRISPR gRNA sequence
tattgaccaggctgttctca

SEQ ID NO: 65269 - DNA, 20 bp, Artificial
  CRISPR gRNA sequence
accaggctgttctcaaactc

SEQ ID NO: 65270 - DNA, 20 bp, Artificial
  CRISPR gRNA sequence
ttctcaaactcccgagctca

SEQ ID NO: 65271 - DNA, 20 bp, Artificial
  CRISPR gRNA sequence
tcaaactcccgagctcatgt

SEQ ID NO: 65272 - DNA, 20 bp, Artificial
  CRISPR gRNA sequence
aaactcccgagctcatgtga

SEQ ID NO: 65273 - DNA, 20 bp, Artificial
  CRISPR gRNA sequence
ccgagctcatgtgatcctcc

SEQ ID NO: 65274 - DNA, 20 bp, Artificial
  CRISPR gRNA sequence
atgtgatcctcctgccctgg

SEQ ID NO: 65275 - DNA, 20 bp, Artificial
  CRISPR gRNA sequence
ctgccctggcctcccaaaga

SEQ ID NO: 65276 - DNA, 20 bp, Artificial
  CRISPR gRNA sequence
ccctggcctcccaaagagca

SEQ ID NO: 65277 - DNA, 20 bp, Artificial
  CRISPR gRNA sequence
gcctcccaaagagcaaggat

SEQ ID NO: 65278 - DNA, 20 bp, Artificial
  CRISPR gRNA sequence
ccaaagagcaaggattatag

SEQ ID NO: 65279 - DNA, 20 bp, Artificial
  CRISPR gRNA sequence
taggtatgaaccactgcacc

SEQ ID NO: 65280 - DNA, 20 bp, Artificial
  CRISPR gRNA sequence
caccaggccaaacataaaaa

SEQ ID NO: 65281 - DNA, 20 bp, Artificial
  CRISPR gRNA sequence
taactcattatcttaaaaga

SEQ ID NO: 65282 - DNA, 20 bp, Artificial
  CRISPR gRNA sequence
aactcattatcttaaaagat

SEQ ID NO: 65283 - DNA, 20 bp, Artificial
  CRISPR gRNA sequence
actcattatcttaaaagatt

SEQ ID NO: 65284 - DNA, 20 bp, Artificial
  CRISPR gRNA sequence
attatcttaaaagattataa

SEQ ID NO: 65285 - DNA, 20 bp, Artificial
  CRISPR gRNA sequence
tcttaaaagattataaaaga

SEQ ID NO: 65286 - DNA, 20 bp, Artificial
  CRISPR gRNA sequence
aaaagattataaaagattat

SEQ ID NO: 65287 - DNA, 20 bp, Artificial
  CRISPR gRNA sequence
aaagattataaaagattata

SEQ ID NO: 65288 - DNA, 20 bp, Artificial
  CRISPR gRNA sequence
taaaagattataataaagct

SEQ ID NO: 65289 - DNA, 20 bp, Artificial
  CRISPR gRNA sequence
taataaagcttttcaagata

SEQ ID NO: 65290 - DNA, 20 bp, Artificial
  CRISPR gRNA sequence
ttcaagatatgcaatggcag

SEQ ID NO: 65291 - DNA, 20 bp, Artificial
  CRISPR gRNA sequence
tcaagatatgcaatggcaga

SEQ ID NO: 65292 - DNA, 20 bp, Artificial
  CRISPR gRNA sequence
caagatatgcaatggcagaa

SEQ ID NO: 65293 - DNA, 20 bp, Artificial
  CRISPR gRNA sequence
aagatatgcaatggcagaaa

SEQ ID NO: 65294 - DNA, 20 bp, Artificial
  CRISPR gRNA sequence
ggccaggtgctgtggctcat

SEQ ID NO: 65295 - DNA, 20 bp, Artificial
  CRISPR gRNA sequence
tggctcatgctgtaaaccca

SEQ ID NO: 65296 - DNA, 20 bp, Artificial
  CRISPR gRNA sequence
atgctgtaaacccagcactt

SEQ ID NO: 65297 - DNA, 20 bp, Artificial
  CRISPR gRNA sequence
taaacccagcactttgggag

SEQ ID NO: 65298 - DNA, 20 bp, Artificial
  CRISPR gRNA sequence
tgggaggctgaggcaggggg

SEQ ID NO: 65299 - DNA, 20 bp, Artificial
  CRISPR gRNA sequence
gggaggctgaggcaggggga

SEQ ID NO: 65300 - DNA, 20 bp, Artificial
  CRISPR gRNA sequence
ggaggctgaggcagggggat

SEQ ID NO: 65301 - DNA, 20 bp, Artificial
  CRISPR gRNA sequence
aggcagggggatcacctgag

SEQ ID NO: 65302 - DNA, 20 bp, Artificial
  CRISPR gRNA sequence
aggtcaggagttcaagacca

SEQ ID NO: 65303 - DNA, 20 bp, Artificial
  CRISPR gRNA sequence
aagaccagcctggccaatag

SEQ ID NO: 65304 - DNA, 20 bp, Artificial
  CRISPR gRNA sequence
gccaataggatgaaaccccg

SEQ ID NO: 65305 - DNA, 20 bp, Artificial
  CRISPR gRNA sequence
tactaaaaatacaaaaacta

SEQ ID NO: 65306 - DNA, 20 bp, Artificial
  CRISPR gRNA sequence
ctaaaaatacaaaaactagc

SEQ ID NO: 65307 - DNA, 20 bp, Artificial
  CRISPR gRNA sequence
aaaatacaaaaactagctgg

SEQ ID NO: 65308 - DNA, 20 bp, Artificial
  CRISPR gRNA sequence
gctgggcatggtggcgtgca

SEQ ID NO: 65309 - DNA, 20 bp, Artificial
  CRISPR gRNA sequence
ggcatggtggcgtgcacctg

SEQ ID NO: 65310 - DNA, 20 bp, Artificial
  CRISPR gRNA sequence
taattccagctactcaggag

SEQ ID NO: 65311 - DNA, 20 bp, Artificial
  CRISPR gRNA sequence
cagctactcaggaggctgag

SEQ ID NO: 65312 - DNA, 20 bp, Artificial
  CRISPR gRNA sequence
ctcaggaggctgaggcagga

SEQ ID NO: 65313 - DNA, 20 bp, Artificial
  CRISPR gRNA sequence
aggaggctgaggcaggagaa

SEQ ID NO: 65314 - DNA, 20 bp, Artificial
  CRISPR gRNA sequence
aggcaggagaatcgctggaa

SEQ ID NO: 65315 - DNA, 20 bp, Artificial
  CRISPR gRNA sequence
gaacctgggaggcggaggtt

SEQ ID NO: 65316 - DNA, 20 bp, Artificial
  CRISPR gRNA sequence
ggaggcggaggttgcagtga

SEQ ID NO: 65317 - DNA, 20 bp, Artificial
  CRISPR gRNA sequence
cagtgagccgagatcatgcc

SEQ ID NO: 65318 - DNA, 20 bp, Artificial
  CRISPR gRNA sequence
cactccagcctgggagacag

SEQ ID NO: 65319 - DNA, 20 bp, Artificial
  CRISPR gRNA sequence
cagcctgggagacagagcaa

SEQ ID NO: 65320 - DNA, 20 bp, Artificial
  CRISPR gRNA sequence
ggagacagagcaagactctg

SEQ ID NO: 65321 - DNA, 20 bp, Artificial
  CRISPR gRNA sequence
tgtctcaaattaaaaaaaaa

SEQ ID NO: 65322 - DNA, 20 bp, Artificial
  CRISPR gRNA sequence
tctcaaattaaaaaaaaaaa

SEQ ID NO: 65323 - DNA, 20 bp, Artificial
  CRISPR gRNA sequence
aaattaaaaaaaaaaaaaaa

SEQ ID NO: 65324 - DNA, 20 bp, Artificial
  CRISPR gRNA sequence
aaaaaaaaaaaaaaaaaaga

SEQ ID NO: 65325 - DNA, 20 bp, Artificial
  CRISPR gRNA sequence
ttcccatcaataatgatcaa

SEQ ID NO: 65326 - DNA, 20 bp, Artificial
  CRISPR gRNA sequence
ccatcaataatgatcaagta

SEQ ID NO: 65327 - DNA, 20 bp, Artificial
  CRISPR gRNA sequence
ataattatttgtcatccctg

SEQ ID NO: 65328 - DNA, 20 bp, Artificial
  CRISPR gRNA sequence
tttgtcatccctgcttctag

SEQ ID NO: 65329 - DNA, 20 bp, Artificial
  CRISPR gRNA sequence
gtcatccctgcttctagccc

SEQ ID NO: 65330 - DNA, 20 bp, Artificial
  CRISPR gRNA sequence
tcatccctgcttctagccct

SEQ ID NO: 65331 - DNA, 20 bp, Artificial
  CRISPR gRNA sequence
cttctagcccttaaaaaact

SEQ ID NO: 65332 - DNA, 20 bp, Artificial
  CRISPR gRNA sequence
ctagcccttaaaaaactaat

SEQ ID NO: 65333 - DNA, 20 bp, Artificial
  CRISPR gRNA sequence
tagcccttaaaaaactaatg

SEQ ID NO: 65334 - DNA, 20 bp, Artificial
  CRISPR gRNA sequence
gcccttaaaaaactaatgtt

SEQ ID NO: 65335 - DNA, 20 bp, Artificial
  CRISPR gRNA sequence
aaaaaactaatgtttaaaaa

SEQ ID NO: 65336 - DNA, 20 bp, Artificial
  CRISPR gRNA sequence
aaaaactaatgtttaaaaag

SEQ ID NO: 65337 - DNA, 20 bp, Artificial
  CRISPR gRNA sequence
atgtttaaaaagagaatcta

SEQ ID NO: 65338 - DNA, 20 bp, Artificial
  CRISPR gRNA sequence
aaaaagagaatctatagttt

SEQ ID NO: 65339 - DNA, 20 bp, Artificial
  CRISPR gRNA sequence
aaaagagaatctatagttta

SEQ ID NO: 65340 - DNA, 20 bp, Artificial
  CRISPR gRNA sequence
tagtttaatcccatgtttgt

SEQ ID NO: 65341 - DNA, 20 bp, Artificial
  CRISPR gRNA sequence
aatcccatgtttgtaaaaca

SEQ ID NO: 65342 - DNA, 20 bp, Artificial
  CRISPR gRNA sequence
atcccatgtttgtaaaacaa

SEQ ID NO: 65343 - DNA, 20 bp, Artificial
  CRISPR gRNA sequence
gtaaaacaaaaattattgca

SEQ ID NO: 65344 - DNA, 20 bp, Artificial
  CRISPR gRNA sequence
taaaacaaaaattattgcac

SEQ ID NO: 65345 - DNA, 20 bp, Artificial
  CRISPR gRNA sequence
ttgcactagaaaatggaagg

SEQ ID NO: 65346 - DNA, 20 bp, Artificial
  CRISPR gRNA sequence
cactagaaaatggaaggttt

SEQ ID NO: 65347 - DNA, 20 bp, Artificial
  CRISPR gRNA sequence
gaaaatggaaggtttgaagg

SEQ ID NO: 65348 - DNA, 20 bp, Artificial
  CRISPR gRNA sequence
gaaggactcactccaaaggt

SEQ ID NO: 65349 - DNA, 20 bp, Artificial
  CRISPR gRNA sequence
aaggactcactccaaaggtt

SEQ ID NO: 65350 - DNA, 20 bp, Artificial
  CRISPR gRNA sequence
actccaaaggttaccagggg

SEQ ID NO: 65351 - DNA, 20 bp, Artificial
  CRISPR gRNA sequence
caaaggttaccaggggtaat

SEQ ID NO: 65352 - DNA, 20 bp, Artificial
  CRISPR gRNA sequence
ccaggggtaatccacacata

SEQ ID NO: 65353 - DNA, 20 bp, Artificial
  CRISPR gRNA sequence
tgagcacagacagaacactg

SEQ ID NO: 65354 - DNA, 20 bp, Artificial
  CRISPR gRNA sequence
gagcacagacagaacactga

SEQ ID NO: 65355 - DNA, 20 bp, Artificial
  CRISPR gRNA sequence
agcacagacagaacactgac

SEQ ID NO: 65356 - DNA, 20 bp, Artificial
  CRISPR gRNA sequence
actagcagagagaggggttt

SEQ ID NO: 65357 - DNA, 20 bp, Artificial
  CRISPR gRNA sequence
gcagagagaggggtttcagt

SEQ ID NO: 65358 - DNA, 20 bp, Artificial
  CRISPR gRNA sequence
cagtctggggctaaaagaga

SEQ ID NO: 65359 - DNA, 20 bp, Artificial
  CRISPR gRNA sequence
agtctggggctaaaagagag

SEQ ID NO: 65360 - DNA, 20 bp, Artificial
  CRISPR gRNA sequence
gggctaaaagagagaacaca

SEQ ID NO: 65361 - DNA, 20 bp, Artificial
  CRISPR gRNA sequence
aaagagagaacacagaattt

SEQ ID NO: 65362 - DNA, 20 bp, Artificial
  CRISPR gRNA sequence
gttttcttttaagacttgcc

SEQ ID NO: 65363 - DNA, 20 bp, Artificial
  CRISPR gRNA sequence
ttttcttttaagacttgcca

SEQ ID NO: 65364 - DNA, 20 bp, Artificial
  CRISPR gRNA sequence
tcttttaagacttgccagga

SEQ ID NO: 65365 - DNA, 20 bp, Artificial
  CRISPR gRNA sequence
cttttaagacttgccaggaa

SEQ ID NO: 65366 - DNA, 20 bp, Artificial
  CRISPR gRNA sequence
ttttaagacttgccaggaaa

SEQ ID NO: 65367 - DNA, 20 bp, Artificial
  CRISPR gRNA sequence
ttaagacttgccaggaaatg

SEQ ID NO: 65368 - DNA, 20 bp, Artificial
  CRISPR gRNA sequence
taagacttgccaggaaatgg

SEQ ID NO: 65369 - DNA, 20 bp, Artificial
  CRISPR gRNA sequence
aagacttgccaggaaatggg

SEQ ID NO: 65370 - DNA, 20 bp, Artificial
  CRISPR gRNA sequence
agacttgccaggaaatgggg

SEQ ID NO: 65371 - DNA, 20 bp, Artificial
  CRISPR gRNA sequence
gccaggaaatggggcttact

SEQ ID NO: 65372 - DNA, 20 bp, Artificial
  CRISPR gRNA sequence
ccaggaaatggggcttactt

SEQ ID NO: 65373 - DNA, 20 bp, Artificial
  CRISPR gRNA sequence
acttaggcaatagatacatt

SEQ ID NO: 65374 - DNA, 20 bp, Artificial
  CRISPR gRNA sequence
cttaggcaatagatacattt

SEQ ID NO: 65375 - DNA, 20 bp, Artificial
  CRISPR gRNA sequence
aggcaatagatacatttgtg

SEQ ID NO: 65376 - DNA, 20 bp, Artificial
  CRISPR gRNA sequence
ggcaatagatacatttgtga

SEQ ID NO: 65377 - DNA, 20 bp, Artificial
  CRISPR gRNA sequence
gtgaaatatctgtggtagaa

SEQ ID NO: 65378 - DNA, 20 bp, Artificial
  CRISPR gRNA sequence
tgaaatatctgtggtagaaa

SEQ ID NO: 65379 - DNA, 20 bp, Artificial
  CRISPR gRNA sequence
tggtagaaagatttcagccc

SEQ ID NO: 65380 - DNA, 20 bp, Artificial
  CRISPR gRNA sequence
cagccctccaaaagctcaga

SEQ ID NO: 65381 - DNA, 20 bp, Artificial
  CRISPR gRNA sequence
agccctccaaaagctcagag

SEQ ID NO: 65382 - DNA, 20 bp, Artificial
  CRISPR gRNA sequence
caaaagctcagaggaagtca

SEQ ID NO: 65383 - DNA, 20 bp, Artificial
  CRISPR gRNA sequence
agaggaagtcagaggggagt

SEQ ID NO: 65384 - DNA, 20 bp, Artificial
  CRISPR gRNA sequence
cagctggaggcagggggatg

SEQ ID NO: 65385 - DNA, 20 bp, Artificial
  CRISPR gRNA sequence
gaggcagggggatggaactt

SEQ ID NO: 65386 - DNA, 20 bp, Artificial
  CRISPR gRNA sequence
gagaggtcctcccgggccag

SEQ ID NO: 65387 - DNA, 20 bp, Artificial
  CRISPR gRNA sequence
agaggtcctcccgggccagg

SEQ ID NO: 65388 - DNA, 20 bp, Artificial
  CRISPR gRNA sequence
ccgggccaggggtaaaaagt

SEQ ID NO: 65389 - DNA, 20 bp, Artificial
  CRISPR gRNA sequence
acacctatcatcccagcact

SEQ ID NO: 65390 - DNA, 20 bp, Artificial
  CRISPR gRNA sequence
tcatcccagcactttgggaa

SEQ ID NO: 65391 - DNA, 20 bp, Artificial
  CRISPR gRNA sequence
tgggaagcaaaggtgggagg

SEQ ID NO: 65392 - DNA, 20 bp, Artificial
  CRISPR gRNA sequence
gggaagcaaaggtgggagga

SEQ ID NO: 65393 - DNA, 20 bp, Artificial
  CRISPR gRNA sequence
ggaagcaaaggtgggaggat

SEQ ID NO: 65394 - DNA, 20 bp, Artificial
  CRISPR gRNA sequence
agcccagaagttcgagacca

SEQ ID NO: 65395 - DNA, 20 bp, Artificial
  CRISPR gRNA sequence
gagaccagagtagacaacat

SEQ ID NO: 65396 - DNA, 20 bp, Artificial
  CRISPR gRNA sequence
tctctacatacttttttttt

SEQ ID NO: 65397 - DNA, 20 bp, Artificial
  CRISPR gRNA sequence
tacatacttttttttttaat

SEQ ID NO: 65398 - DNA, 20 bp, Artificial
  CRISPR gRNA sequence
catacttttttttttaatta

SEQ ID NO: 65399 - DNA, 20 bp, Artificial
  CRISPR gRNA sequence
ttttttttaattagctgggc

SEQ ID NO: 65400 - DNA, 20 bp, Artificial
  CRISPR gRNA sequence
tttttttaattagctgggcc

SEQ ID NO: 65401 - DNA, 20 bp, Artificial
  CRISPR gRNA sequence
ttttttaattagctgggcct

SEQ ID NO: 65402 - DNA, 20 bp, Artificial
  CRISPR gRNA sequence
tttttaattagctgggcctg

SEQ ID NO: 65403 - DNA, 20 bp, Artificial
  CRISPR gRNA sequence
ttttaattagctgggcctga

SEQ ID NO: 65404 - DNA, 20 bp, Artificial
  CRISPR gRNA sequence
tttaattagctgggcctgat

SEQ ID NO: 65405 - DNA, 20 bp, Artificial
  CRISPR gRNA sequence
ttaattagctgggcctgatg

SEQ ID NO: 65406 - DNA, 20 bp, Artificial
  CRISPR gRNA sequence
taattagctgggcctgatgg

SEQ ID NO: 65407 - DNA, 20 bp, Artificial
  CRISPR gRNA sequence
aattagctgggcctgatggc

SEQ ID NO: 65408 - DNA, 20 bp, Artificial
  CRISPR gRNA sequence
attagctgggcctgatggca

SEQ ID NO: 65409 - DNA, 20 bp, Artificial
  CRISPR gRNA sequence
gctgggcctgatggcacaag

SEQ ID NO: 65410 - DNA, 20 bp, Artificial
  CRISPR gRNA sequence
ggcctgatggcacaagcctg

SEQ ID NO: 65411 - DNA, 20 bp, Artificial
  CRISPR gRNA sequence
atggcacaagcctgtaatcc

SEQ ID NO: 65412 - DNA, 20 bp, Artificial
  CRISPR gRNA sequence
taatcccagctactcaggag

SEQ ID NO: 65413 - DNA, 20 bp, Artificial
  CRISPR gRNA sequence
ctcaggaggctgaagtggga

SEQ ID NO: 65414 - DNA, 20 bp, Artificial
  CRISPR gRNA sequence
aggaggctgaagtgggagga

SEQ ID NO: 65415 - DNA, 20 bp, Artificial
  CRISPR gRNA sequence
aagtgggaggattgcttgag

SEQ ID NO: 65416 - DNA, 20 bp, Artificial
  CRISPR gRNA sequence
cttgagcccaggaggtggag

SEQ ID NO: 65417 - DNA, 20 bp, Artificial
  CRISPR gRNA sequence
gagcccaggaggtggaggct

SEQ ID NO: 65418 - DNA, 20 bp, Artificial
  CRISPR gRNA sequence
agcccaggaggtggaggctt

SEQ ID NO: 65419 - DNA, 20 bp, Artificial
  CRISPR gRNA sequence
cagtgagccatgattgcacc

SEQ ID NO: 65420 - DNA, 20 bp, Artificial
  CRISPR gRNA sequence
agtgagccatgattgcacca

SEQ ID NO: 65421 - DNA, 20 bp, Artificial
  CRISPR gRNA sequence
caccactgcacaccagcttg

SEQ ID NO: 65422 - DNA, 20 bp, Artificial
  CRISPR gRNA sequence
cacaccagcttgggcaacag

SEQ ID NO: 65423 - DNA, 20 bp, Artificial
  CRISPR gRNA sequence
gggcaacagactgagacctt

SEQ ID NO: 65424 - DNA, 20 bp, Artificial
  CRISPR gRNA sequence
ggcaacagactgagaccttc

SEQ ID NO: 65425 - DNA, 20 bp, Artificial
  CRISPR gRNA sequence
agaccttctctcaaaaagaa

SEQ ID NO: 65426 - DNA, 20 bp, Artificial
  CRISPR gRNA sequence
ctctcaaaaagaaatagtaa

SEQ ID NO: 65427 - DNA, 20 bp, Artificial
  CRISPR gRNA sequence
tctcaaaaagaaatagtaac

SEQ ID NO: 65428 - DNA, 20 bp, Artificial
  CRISPR gRNA sequence
tcaaaaagaaatagtaacag

SEQ ID NO: 65429 - DNA, 20 bp, Artificial
  CRISPR gRNA sequence
aaaaagaaatagtaacaggg

SEQ ID NO: 65430 - DNA, 20 bp, Artificial
  CRISPR gRNA sequence
tcgcttcctcacccctcttt

SEQ ID NO: 65431 - DNA, 20 bp, Artificial
  CRISPR gRNA sequence
gcttcctcacccctcttttg

SEQ ID NO: 65432 - DNA, 20 bp, Artificial
  CRISPR gRNA sequence
cctcacccctcttttgtctt

SEQ ID NO: 65433 - DNA, 20 bp, Artificial
  CRISPR gRNA sequence
ctcacccctcttttgtcttc

SEQ ID NO: 65434 - DNA, 20 bp, Artificial
  CRISPR gRNA sequence
acccctcttttgtcttcaca

SEQ ID NO: 65435 - DNA, 20 bp, Artificial
  CRISPR gRNA sequence
ttttgtcttcacagcctgca

SEQ ID NO: 65436 - DNA, 20 bp, Artificial
  CRISPR gRNA sequence
ttgtcttcacagcctgcagc

SEQ ID NO: 65437 - DNA, 20 bp, Artificial
  CRISPR gRNA sequence
tgtcttcacagcctgcagca

SEQ ID NO: 65438 - DNA, 20 bp, Artificial
  CRISPR gRNA sequence
gtcttcacagcctgcagcac

SEQ ID NO: 65439 - DNA, 20 bp, Artificial
  CRISPR gRNA sequence
tcttcacagcctgcagcaca

SEQ ID NO: 65440 - DNA, 20 bp, Artificial
  CRISPR gRNA sequence
cacagcctgcagcacaaaac

SEQ ID NO: 65441 - DNA, 20 bp, Artificial
  CRISPR gRNA sequence
acagcctgcagcacaaaact

SEQ ID NO: 65442 - DNA, 20 bp, Artificial
  CRISPR gRNA sequence
cagcacaaaactgtgatctt

SEQ ID NO: 65443 - DNA, 20 bp, Artificial
  CRISPR gRNA sequence
tgatcttcatgtttgcccag

SEQ ID NO: 65444 - DNA, 20 bp, Artificial
  CRISPR gRNA sequence
catgtttgcccaggagccag

SEQ ID NO: 65445 - DNA, 20 bp, Artificial
  CRISPR gRNA sequence
atgtttgcccaggagccaga

SEQ ID NO: 65446 - DNA, 20 bp, Artificial
  CRISPR gRNA sequence
gcccaggagccagaggagca

SEQ ID NO: 65447 - DNA, 20 bp, Artificial
  CRISPR gRNA sequence
cccaggagccagaggagcag

SEQ ID NO: 65448 - DNA, 20 bp, Artificial
  CRISPR gRNA sequence
caccccaactccatgctcag

SEQ ID NO: 65449 - DNA, 20 bp, Artificial
  CRISPR gRNA sequence
accccaactccatgctcagt

SEQ ID NO: 65450 - DNA, 20 bp, Artificial
  CRISPR gRNA sequence
catgctcagtcagggacatt

SEQ ID NO: 65451 - DNA, 20 bp, Artificial
  CRISPR gRNA sequence
agtcagggacattcccctct

SEQ ID NO: 65452 - DNA, 20 bp, Artificial
  CRISPR gRNA sequence
ccctctctaccctccacagc

SEQ ID NO: 65453 - DNA, 20 bp, Artificial
  CRISPR gRNA sequence
tctaccctccacagctgggc

SEQ ID NO: 65454 - DNA, 20 bp, Artificial
  CRISPR gRNA sequence
taccctccacagctgggcag

SEQ ID NO: 65455 - DNA, 20 bp, Artificial
  CRISPR gRNA sequence
ccctccacagctgggcagtg

SEQ ID NO: 65456 - DNA, 20 bp, Artificial
  CRISPR gRNA sequence
cacagctgggcagtgccagt

SEQ ID NO: 65457 - DNA, 20 bp, Artificial
  CRISPR gRNA sequence
ggcagtgccagtcagtcaac

SEQ ID NO: 65458 - DNA, 20 bp, Artificial
  CRISPR gRNA sequence
ccagggtgacctggacaaat

SEQ ID NO: 65459 - DNA, 20 bp, Artificial
  CRISPR gRNA sequence
gacaaattcacggaagagcg

SEQ ID NO: 65460 - DNA, 20 bp, Artificial
  CRISPR gRNA sequence
acggaagagcgggaagtgag

SEQ ID NO: 65461 - DNA, 20 bp, Artificial
  CRISPR gRNA sequence
ggcaaaggatgcagccccaa

SEQ ID NO: 65462 - DNA, 20 bp, Artificial
  CRISPR gRNA sequence
gcaaaggatgcagccccaaa

SEQ ID NO: 65463 - DNA, 20 bp, Artificial
  CRISPR gRNA sequence
cgcctctcatggtgcctgaa

SEQ ID NO: 65464 - DNA, 20 bp, Artificial
  CRISPR gRNA sequence
tcatggtgcctgaaaggagc

SEQ ID NO: 65465 - DNA, 20 bp, Artificial
  CRISPR gRNA sequence
atggtgcctgaaaggagccc

SEQ ID NO: 65466 - DNA, 20 bp, Artificial
  CRISPR gRNA sequence
aaaggagccccagtgtgtag

SEQ ID NO: 65467 - DNA, 20 bp, Artificial
  CRISPR gRNA sequence
ggtagccagagggggattcc

SEQ ID NO: 65468 - DNA, 20 bp, Artificial
  CRISPR gRNA sequence
cgggagactagagccctcca

SEQ ID NO: 65469 - DNA, 20 bp, Artificial
  CRISPR gRNA sequence
gagccctccagcttaaaccc

SEQ ID NO: 65470 - DNA, 20 bp, Artificial
  CRISPR gRNA sequence
cagcttaaacccaggggatt

SEQ ID NO: 65471 - DNA, 20 bp, Artificial
  CRISPR gRNA sequence
aaacccaggggattgcctgg

SEQ ID NO: 65472 - DNA, 20 bp, Artificial
  CRISPR gRNA sequence
aacccaggggattgcctggc

SEQ ID NO: 65473 - DNA, 20 bp, Artificial
  CRISPR gRNA sequence
cctggcctgtagctctggtc

SEQ ID NO: 65474 - DNA, 20 bp, Artificial
  CRISPR gRNA sequence
gcctgtagctctggtcctgg

SEQ ID NO: 65475 - DNA, 20 bp, Artificial
  CRISPR gRNA sequence
tagctctggtcctggtcgga

SEQ ID NO: 65476 - DNA, 20 bp, Artificial
  CRISPR gRNA sequence
tggtcctggtcggaacttct

SEQ ID NO: 65477 - DNA, 20 bp, Artificial
  CRISPR gRNA sequence
gtcctggtcggaacttctgt

SEQ ID NO: 65478 - DNA, 20 bp, Artificial
  CRISPR gRNA sequence
gtcggaacttctgtatccct

SEQ ID NO: 65479 - DNA, 20 bp, Artificial
  CRISPR gRNA sequence
ctgtatccctttcacacaag

SEQ ID NO: 65480 - DNA, 20 bp, Artificial
  CRISPR gRNA sequence
tgtatccctttcacacaagg

SEQ ID NO: 65481 - DNA, 20 bp, Artificial
  CRISPR gRNA sequence
tatccctttcacacaaggac

SEQ ID NO: 65482 - DNA, 20 bp, Artificial
  CRISPR gRNA sequence
tcacacaaggacccattagg

SEQ ID NO: 65483 - DNA, 20 bp, Artificial
  CRISPR gRNA sequence
cacacaaggacccattaggg

SEQ ID NO: 65484 - DNA, 20 bp, Artificial
  CRISPR gRNA sequence
acacaaggacccattagggt

SEQ ID NO: 65485 - DNA, 20 bp, Artificial
  CRISPR gRNA sequence
gggtcctggattgccccagc

SEQ ID NO: 65486 - DNA, 20 bp, Artificial
  CRISPR gRNA sequence
gattgccccagcctagcgca

SEQ ID NO: 65487 - DNA, 20 bp, Artificial
  CRISPR gRNA sequence
ccccagcctagcgcatgggt

SEQ ID NO: 65488 - DNA, 20 bp, Artificial
  CRISPR gRNA sequence
gcgcatgggtagagactcag

SEQ ID NO: 65489 - DNA, 20 bp, Artificial
  CRISPR gRNA sequence
agctctttgctcccggagcc

SEQ ID NO: 65490 - DNA, 20 bp, Artificial
  CRISPR gRNA sequence
tttgctcccggagcccaccc

SEQ ID NO: 65491 - DNA, 20 bp, Artificial
  CRISPR gRNA sequence
tgctcccggagcccacccac

SEQ ID NO: 65492 - DNA, 20 bp, Artificial
  CRISPR gRNA sequence
gctcccggagcccacccaca

SEQ ID NO: 65493 - DNA, 20 bp, Artificial
  CRISPR gRNA sequence
ctcccggagcccacccacaa

SEQ ID NO: 65494 - DNA, 20 bp, Artificial
  CRISPR gRNA sequence
ccggagcccacccacaatct

SEQ ID NO: 65495 - DNA, 20 bp, Artificial
  CRISPR gRNA sequence
ttctgtagagtctggactac

SEQ ID NO: 65496 - DNA, 20 bp, Artificial
  CRISPR gRNA sequence
ctgtagagtctggactactg

SEQ ID NO: 65497 - DNA, 20 bp, Artificial
  CRISPR gRNA sequence
tgtagagtctggactactga

SEQ ID NO: 65498 - DNA, 20 bp, Artificial
  CRISPR gRNA sequence
tagagtctggactactgaag

SEQ ID NO: 65499 - DNA, 20 bp, Artificial
  CRISPR gRNA sequence
gactactgaaggctcgattc

SEQ ID NO: 65500 - DNA, 20 bp, Artificial
  CRISPR gRNA sequence
ctgaaggctcgattccagct

SEQ ID NO: 65501 - DNA, 20 bp, Artificial
  CRISPR gRNA sequence
aaggctcgattccagctggg

SEQ ID NO: 65502 - DNA, 20 bp, Artificial
  CRISPR gRNA sequence
gattccagctggggctgaca

SEQ ID NO: 65503 - DNA, 20 bp, Artificial
  CRISPR gRNA sequence
cagctggggctgacatctct

SEQ ID NO: 65504 - DNA, 20 bp, Artificial
  CRISPR gRNA sequence
gggctgacatctctgaagca

SEQ ID NO: 65505 - DNA, 20 bp, Artificial
  CRISPR gRNA sequence
acatctctgaagcacagatg

SEQ ID NO: 65506 - DNA, 20 bp, Artificial
  CRISPR gRNA sequence
tgaagcacagatgaggagga

SEQ ID NO: 65507 - DNA, 20 bp, Artificial
  CRISPR gRNA sequence
aagcacagatgaggaggagg

SEQ ID NO: 65508 - DNA, 20 bp, Artificial
  CRISPR gRNA sequence
atgataatagcagtcaaggt

SEQ ID NO: 65509 - DNA, 20 bp, Artificial
  CRISPR gRNA sequence
agtacttgccatgtatgcac

SEQ ID NO: 65510 - DNA, 20 bp, Artificial
  CRISPR gRNA sequence
gccatgtatgcaccaagcac

SEQ ID NO: 65511 - DNA, 20 bp, Artificial
  CRISPR gRNA sequence
ccatgtatgcaccaagcacc

SEQ ID NO: 65512 - DNA, 20 bp, Artificial
  CRISPR gRNA sequence
aggcagttcacatacagtct

SEQ ID NO: 65513 - DNA, 20 bp, Artificial
  CRISPR gRNA sequence
acatacagtctcccattgag

SEQ ID NO: 65514 - DNA, 20 bp, Artificial
  CRISPR gRNA sequence
ccattgagaggctgtgattt

SEQ ID NO: 65515 - DNA, 20 bp, Artificial
  CRISPR gRNA sequence
agaggctgtgatttgtccag

SEQ ID NO: 65516 - DNA, 20 bp, Artificial
  CRISPR gRNA sequence
tgatttgtccagggtcacac

SEQ ID NO: 65517 - DNA, 20 bp, Artificial
  CRISPR gRNA sequence
gtccagggtcacacaaccag

SEQ ID NO: 65518 - DNA, 20 bp, Artificial
  CRISPR gRNA sequence
tccagggtcacacaaccagg

SEQ ID NO: 65519 - DNA, 20 bp, Artificial
  CRISPR gRNA sequence
gcaccaaggtctgattgact

SEQ ID NO: 65520 - DNA, 20 bp, Artificial
  CRISPR gRNA sequence
attgactctaggtggaggat

SEQ ID NO: 65521 - DNA, 20 bp, Artificial
  CRISPR gRNA sequence
actctaggtggaggataggg

SEQ ID NO: 65522 - DNA, 20 bp, Artificial
  CRISPR gRNA sequence
taggtggaggatagggctcg

SEQ ID NO: 65523 - DNA, 20 bp, Artificial
  CRISPR gRNA sequence
ggtggaggatagggctcgat

SEQ ID NO: 65524 - DNA, 20 bp, Artificial
  CRISPR gRNA sequence
gatggtggaaggccaggctg

SEQ ID NO: 65525 - DNA, 20 bp, Artificial
  CRISPR gRNA sequence
aggatggattctggagatgg

SEQ ID NO: 65526 - DNA, 20 bp, Artificial
  CRISPR gRNA sequence
tggagatggcggacatggcc

SEQ ID NO: 65527 - DNA, 20 bp, Artificial
  CRISPR gRNA sequence
gagatggcggacatggcctt

SEQ ID NO: 65528 - DNA, 20 bp, Artificial
  CRISPR gRNA sequence
tgctcagcctggccttggtg

SEQ ID NO: 65529 - DNA, 20 bp, Artificial
  CRISPR gRNA sequence
gctcagcctggccttggtga

SEQ ID NO: 65530 - DNA, 20 bp, Artificial
  CRISPR gRNA sequence
ctcagcctggccttggtgat

SEQ ID NO: 65531 - DNA, 20 bp, Artificial
  CRISPR gRNA sequence
agcctggccttggtgatgtc

SEQ ID NO: 65532 - DNA, 20 bp, Artificial
  CRISPR gRNA sequence
gccttggtgatgtccctcca

SEQ ID NO: 65533 - DNA, 20 bp, Artificial
  CRISPR gRNA sequence
ggtgatgtccctccagggct

SEQ ID NO: 65534 - DNA, 20 bp, Artificial
  CRISPR gRNA sequence
gtgatgtccctccagggctg

SEQ ID NO: 65535 - DNA, 20 bp, Artificial
  CRISPR gRNA sequence
cagggctgcatttcttgaca

SEQ ID NO: 65536 - DNA, 20 bp, Artificial
  CRISPR gRNA sequence
catttcttgacagcctcatg

SEQ ID NO: 65537 - DNA, 20 bp, Artificial
  CRISPR gRNA sequence
cttgacagcctcatgctcca

SEQ ID NO: 65538 - DNA, 20 bp, Artificial
  CRISPR gRNA sequence
ttgacagcctcatgctccag

SEQ ID NO: 65539 - DNA, 20 bp, Artificial
  CRISPR gRNA sequence
gacagcctcatgctccagat

SEQ ID NO: 65540 - DNA, 20 bp, Artificial
  CRISPR gRNA sequence
acagcctcatgctccagatg

SEQ ID NO: 65541 - DNA, 20 bp, Artificial
  CRISPR gRNA sequence
atgctccagatgccctctga

SEQ ID NO: 65542 - DNA, 20 bp, Artificial
  CRISPR gRNA sequence
cagatgccctctgagctgcc

SEQ ID NO: 65543 - DNA, 20 bp, Artificial
  CRISPR gRNA sequence
tgagctgcctctgagctccc

SEQ ID NO: 65544 - DNA, 20 bp, Artificial
  CRISPR gRNA sequence
agctgcctctgagctcccga

SEQ ID NO: 65545 - DNA, 20 bp, Artificial
  CRISPR gRNA sequence
cctctgagctcccgaaggat

SEQ ID NO: 65546 - DNA, 20 bp, Artificial
  CRISPR gRNA sequence
tgagctcccgaaggatgagg

SEQ ID NO: 65547 - DNA, 20 bp, Artificial
  CRISPR gRNA sequence
agctcccgaaggatgaggta

SEQ ID NO: 65548 - DNA, 20 bp, Artificial
  CRISPR gRNA sequence
ccgaaggatgaggtacagtg

SEQ ID NO: 65549 - DNA, 20 bp, Artificial
  CRISPR gRNA sequence
cagccctgtgtgtgattcca

SEQ ID NO: 65550 - DNA, 20 bp, Artificial
  CRISPR gRNA sequence
tgtgtgattccagccccctc

SEQ ID NO: 65551 - DNA, 20 bp, Artificial
  CRISPR gRNA sequence
cagccccctcccttcccctg

SEQ ID NO: 65552 - DNA, 20 bp, Artificial
  CRISPR gRNA sequence
ccttcccctgctcagagcct

SEQ ID NO: 65553 - DNA, 20 bp, Artificial
  CRISPR gRNA sequence
cccctgctcagagcctgctc

SEQ ID NO: 65554 - DNA, 20 bp, Artificial
  CRISPR gRNA sequence
ccctgctcagagcctgctcc

SEQ ID NO: 65555 - DNA, 20 bp, Artificial
  CRISPR gRNA sequence
ctcagagcctgctcccaaac

SEQ ID NO: 65556 - DNA, 20 bp, Artificial
  CRISPR gRNA sequence
agagcctgctcccaaacctg

SEQ ID NO: 65557 - DNA, 20 bp, Artificial
  CRISPR gRNA sequence
ctcccaaacctgtgcccagg

SEQ ID NO: 65558 - DNA, 20 bp, Artificial
  CRISPR gRNA sequence
ccaaacctgtgcccaggccc

SEQ ID NO: 65559 - DNA, 20 bp, Artificial
  CRISPR gRNA sequence
tgcccaggccccacatgctc

SEQ ID NO: 65560 - DNA, 20 bp, Artificial
  CRISPR gRNA sequence
cctgaaggacacctgacctg

SEQ ID NO: 65561 - DNA, 20 bp, Artificial
  CRISPR gRNA sequence
aaggacacctgacctgctgt

SEQ ID NO: 65562 - DNA, 20 bp, Artificial
  CRISPR gRNA sequence
acctgctgtgtccaggggtc

SEQ ID NO: 65563 - DNA, 20 bp, Artificial
  CRISPR gRNA sequence
ctgtgtccaggggtcatggc

SEQ ID NO: 65564 - DNA, 20 bp, Artificial
  CRISPR gRNA sequence
tgtccaggggtcatggcctg

SEQ ID NO: 65565 - DNA, 20 bp, Artificial
  CRISPR gRNA sequence
gcttccctacctcctacctc

SEQ ID NO: 65566 - DNA, 20 bp, Artificial
  CRISPR gRNA sequence
ccctacctcctacctcccct

SEQ ID NO: 65567 - DNA, 20 bp, Artificial
  CRISPR gRNA sequence
cctacctcctacctcccctg

SEQ ID NO: 65568 - DNA, 20 bp, Artificial
  CRISPR gRNA sequence
cctcctacctcccctgccca

SEQ ID NO: 65569 - DNA, 20 bp, Artificial
  CRISPR gRNA sequence
ctacctcccctgcccagccc

SEQ ID NO: 65570 - DNA, 20 bp, Artificial
  CRISPR gRNA sequence
cctcccctgcccagcccacc

SEQ ID NO: 65571 - DNA, 20 bp, Artificial
  CRISPR gRNA sequence
ccctgcccagcccaccccag

SEQ ID NO: 65572 - DNA, 20 bp, Artificial
  CRISPR gRNA sequence
cccagcccaccccagacagg

SEQ ID NO: 65573 - DNA, 20 bp, Artificial
  CRISPR gRNA sequence
acaaggcagccccgtcaacc

SEQ ID NO: 65574 - DNA, 20 bp, Artificial
  CRISPR gRNA sequence
cccaagcccaggagacccca

SEQ ID NO: 65575 - DNA, 20 bp, Artificial
  CRISPR gRNA sequence
ccaagcccaggagaccccac

SEQ ID NO: 65576 - DNA, 20 bp, Artificial
  CRISPR gRNA sequence
cccttagctccctgaccccc

SEQ ID NO: 65577 - DNA, 20 bp, Artificial
  CRISPR gRNA sequence
agctccctgacccccagcag

SEQ ID NO: 65578 - DNA, 20 bp, Artificial
  CRISPR gRNA sequence
gctccctgacccccagcagc

SEQ ID NO: 65579 - DNA, 20 bp, Artificial
  CRISPR gRNA sequence
cctgacccccagcagctgag

SEQ ID NO: 65580 - DNA, 20 bp, Artificial
  CRISPR gRNA sequence
acccccagcagctgaggggt

SEQ ID NO: 65581 - DNA, 20 bp, Artificial
  CRISPR gRNA sequence
aggggttgtggagactctga

SEQ ID NO: 65582 - DNA, 20 bp, Artificial
  CRISPR gRNA sequence
tggagactctgaaaagaggt

SEQ ID NO: 65583 - DNA, 20 bp, Artificial
  CRISPR gRNA sequence
tgaaaagaggtgaaggggag

SEQ ID NO: 65584 - DNA, 20 bp, Artificial
  CRISPR gRNA sequence
aaaagaggtgaaggggagca

SEQ ID NO: 65585 - DNA, 20 bp, Artificial
  CRISPR gRNA sequence
ggctccttctgtcatgatcc

SEQ ID NO: 65586 - DNA, 20 bp, Artificial
  CRISPR gRNA sequence
cttctgtcatgatcctggtg

SEQ ID NO: 65587 - DNA, 20 bp, Artificial
  CRISPR gRNA sequence
ctgtcatgatcctggtgcct

SEQ ID NO: 65588 - DNA, 20 bp, Artificial
  CRISPR gRNA sequence
tgtcatgatcctggtgcctg

SEQ ID NO: 65589 - DNA, 20 bp, Artificial
  CRISPR gRNA sequence
tcatgatcctggtgcctggg

SEQ ID NO: 65590 - DNA, 20 bp, Artificial
  CRISPR gRNA sequence
gtgcctgggcctgggggctc

SEQ ID NO: 65591 - DNA, 20 bp, Artificial
  CRISPR gRNA sequence
ggcctgggggctcccatcag

SEQ ID NO: 65592 - DNA, 20 bp, Artificial
  CRISPR gRNA sequence
ggggctcccatcagcactct

SEQ ID NO: 65593 - DNA, 20 bp, Artificial
  CRISPR gRNA sequence
ccatcagcactcttcccccc

SEQ ID NO: 65594 - DNA, 20 bp, Artificial
  CRISPR gRNA sequence
ttccccccttctctcttggt

SEQ ID NO: 65595 - DNA, 20 bp, Artificial
  CRISPR gRNA sequence
ccccccttctctcttggtct

SEQ ID NO: 65596 - DNA, 20 bp, Artificial
  CRISPR gRNA sequence
cccccttctctcttggtctt

SEQ ID NO: 65597 - DNA, 20 bp, Artificial
  CRISPR gRNA sequence
ctctcttggtctttgtctgt

SEQ ID NO: 65598 - DNA, 20 bp, Artificial
  CRISPR gRNA sequence
tctcttggtctttgtctgtc

SEQ ID NO: 65599 - DNA, 20 bp, Artificial
  CRISPR gRNA sequence
tcttggtctttgtctgtcct

SEQ ID NO: 65600 - DNA, 20 bp, Artificial
  CRISPR gRNA sequence
ttggtctttgtctgtcctaa

SEQ ID NO: 65601 - DNA, 20 bp, Artificial
  CRISPR gRNA sequence
ggtctttgtctgtcctaatc

SEQ ID NO: 65602 - DNA, 20 bp, Artificial
  CRISPR gRNA sequence
gtctttgtctgtcctaatct

SEQ ID NO: 65603 - DNA, 20 bp, Artificial
  CRISPR gRNA sequence
tgtctgtcctaatctccctc

SEQ ID NO: 65604 - DNA, 20 bp, Artificial
  CRISPR gRNA sequence
gtctgtcctaatctccctct

SEQ ID NO: 65605 - DNA, 20 bp, Artificial
  CRISPR gRNA sequence
tctgtcctaatctccctctg

SEQ ID NO: 65606 - DNA, 20 bp, Artificial
  CRISPR gRNA sequence
tcctaatctccctctgtccc

SEQ ID NO: 65607 - DNA, 20 bp, Artificial
  CRISPR gRNA sequence
atctccctctgtccctctgc

SEQ ID NO: 65608 - DNA, 20 bp, Artificial
  CRISPR gRNA sequence
cctctgtccctctgcctgtt

SEQ ID NO: 65609 - DNA, 20 bp, Artificial
  CRISPR gRNA sequence
tgtccctctgcctgtttctc

SEQ ID NO: 65610 - DNA, 20 bp, Artificial
  CRISPR gRNA sequence
tccctctgcctgtttctctc

SEQ ID NO: 65611 - DNA, 20 bp, Artificial
  CRISPR gRNA sequence
tgcctgtttctctcatttct

SEQ ID NO: 65612 - DNA, 20 bp, Artificial
  CRISPR gRNA sequence
cctgtttctctcatttcttc

SEQ ID NO: 65613 - DNA, 20 bp, Artificial
  CRISPR gRNA sequence
tttctctcatttcttccctc

SEQ ID NO: 65614 - DNA, 20 bp, Artificial
  CRISPR gRNA sequence
ctctcatttcttccctctct

SEQ ID NO: 65615 - DNA, 20 bp, Artificial
  CRISPR gRNA sequence
tctcatttcttccctctctc

SEQ ID NO: 65616 - DNA, 20 bp, Artificial
  CRISPR gRNA sequence
tcatttcttccctctctcat

SEQ ID NO: 65617 - DNA, 20 bp, Artificial
  CRISPR gRNA sequence
atttcttccctctctcatcg

SEQ ID NO: 65618 - DNA, 20 bp, Artificial
  CRISPR gRNA sequence
cttccctctctcatcgtgta

SEQ ID NO: 65619 - DNA, 20 bp, Artificial
  CRISPR gRNA sequence
ttccctctctcatcgtgtat

SEQ ID NO: 65620 - DNA, 20 bp, Artificial
  CRISPR gRNA sequence
ccctctctcatcgtgtattt

SEQ ID NO: 65621 - DNA, 20 bp, Artificial
  CRISPR gRNA sequence
cctctctcatcgtgtatttc

SEQ ID NO: 65622 - DNA, 20 bp, Artificial
  CRISPR gRNA sequence
tctcatcgtgtatttctgtt

SEQ ID NO: 65623 - DNA, 20 bp, Artificial
  CRISPR gRNA sequence
tcatcgtgtatttctgtttt

SEQ ID NO: 65624 - DNA, 20 bp, Artificial
  CRISPR gRNA sequence
atcgtgtatttctgttttat

SEQ ID NO: 65625 - DNA, 20 bp, Artificial
  CRISPR gRNA sequence
ctgttttatcagtttattta

SEQ ID NO: 65626 - DNA, 20 bp, Artificial
  CRISPR gRNA sequence
tgttttatcagtttatttaa

SEQ ID NO: 65627 - DNA, 20 bp, Artificial
  CRISPR gRNA sequence
ttttatcagtttatttaact

SEQ ID NO: 65628 - DNA, 20 bp, Artificial
  CRISPR gRNA sequence
tatcagtttatttaactgtt

SEQ ID NO: 65629 - DNA, 20 bp, Artificial
  CRISPR gRNA sequence
atcagtttatttaactgtta

SEQ ID NO: 65630 - DNA, 20 bp, Artificial
  CRISPR gRNA sequence
tcagtttatttaactgttat

SEQ ID NO: 65631 - DNA, 20 bp, Artificial
  CRISPR gRNA sequence
atttaactgttatttcagtc

SEQ ID NO: 65632 - DNA, 20 bp, Artificial
  CRISPR gRNA sequence
tttaactgttatttcagtct

SEQ ID NO: 65633 - DNA, 20 bp, Artificial
  CRISPR gRNA sequence
aactgttatttcagtcttat

SEQ ID NO: 65634 - DNA, 20 bp, Artificial
  CRISPR gRNA sequence
actgttatttcagtcttatc

SEQ ID NO: 65635 - DNA, 20 bp, Artificial
  CRISPR gRNA sequence
ttatttcagtcttatctgtc

SEQ ID NO: 65636 - DNA, 20 bp, Artificial
  CRISPR gRNA sequence
tttcagtcttatctgtcttc

SEQ ID NO: 65637 - DNA, 20 bp, Artificial
  CRISPR gRNA sequence
cagtcttatctgtcttcctc

SEQ ID NO: 65638 - DNA, 20 bp, Artificial
  CRISPR gRNA sequence
agtcttatctgtcttcctct

SEQ ID NO: 65639 - DNA, 20 bp, Artificial
  CRISPR gRNA sequence
atctgtcttcctctgatctg

SEQ ID NO: 65640 - DNA, 20 bp, Artificial
  CRISPR gRNA sequence
tctgtcttcctctgatctgc

SEQ ID NO: 65641 - DNA, 20 bp, Artificial
  CRISPR gRNA sequence
tcttcctctgatctgctctc

SEQ ID NO: 65642 - DNA, 20 bp, Artificial
  CRISPR gRNA sequence
cctctgatctgctctctctc

SEQ ID NO: 65643 - DNA, 20 bp, Artificial
  CRISPR gRNA sequence
ctctgatctgctctctctct

SEQ ID NO: 65644 - DNA, 20 bp, Artificial
  CRISPR gRNA sequence
tgatctgctctctctctctg

SEQ ID NO: 65645 - DNA, 20 bp, Artificial
  CRISPR gRNA sequence
atctgctctctctctctgag

SEQ ID NO: 65646 - DNA, 20 bp, Artificial
  CRISPR gRNA sequence
ctctctctctctgaggtctc

SEQ ID NO: 65647 - DNA, 20 bp, Artificial
  CRISPR gRNA sequence
tctctctctgaggtctctgt

SEQ ID NO: 65648 - DNA, 20 bp, Artificial
  CRISPR gRNA sequence
tctctctgaggtctctgtgc

SEQ ID NO: 65649 - DNA, 20 bp, Artificial
  CRISPR gRNA sequence
tctctgaggtctctgtgcct

SEQ ID NO: 65650 - DNA, 20 bp, Artificial
  CRISPR gRNA sequence
tctgaggtctctgtgccttg

SEQ ID NO: 65651 - DNA, 20 bp, Artificial
  CRISPR gRNA sequence
tgaggtctctgtgccttggt

SEQ ID NO: 65652 - DNA, 20 bp, Artificial
  CRISPR gRNA sequence
aggtctctgtgccttggttt

SEQ ID NO: 65653 - DNA, 20 bp, Artificial
  CRISPR gRNA sequence
tgtgccttggtttccttcca

SEQ ID NO: 65654 - DNA, 20 bp, Artificial
  CRISPR gRNA sequence
tgccttggtttccttccatc

SEQ ID NO: 65655 - DNA, 20 bp, Artificial
  CRISPR gRNA sequence
ggtttccttccatctgtgtc

SEQ ID NO: 65656 - DNA, 20 bp, Artificial
  CRISPR gRNA sequence
gtttccttccatctgtgtct

SEQ ID NO: 65657 - DNA, 20 bp, Artificial
  CRISPR gRNA sequence
ccttccatctgtgtctctgc

SEQ ID NO: 65658 - DNA, 20 bp, Artificial
  CRISPR gRNA sequence
cttccatctgtgtctctgcc

SEQ ID NO: 65659 - DNA, 20 bp, Artificial
  CRISPR gRNA sequence
ccatctgtgtctctgcccac

SEQ ID NO: 65660 - DNA, 20 bp, Artificial
  CRISPR gRNA sequence
catctgtgtctctgcccacc

SEQ ID NO: 65661 - DNA, 20 bp, Artificial
  CRISPR gRNA sequence
tgtctctgcccaccctctgc

SEQ ID NO: 65662 - DNA, 20 bp, Artificial
  CRISPR gRNA sequence
tgcccaccctctgcctatat

SEQ ID NO: 65663 - DNA, 20 bp, Artificial
  CRISPR gRNA sequence
cccaccctctgcctatatgt

SEQ ID NO: 65664 - DNA, 20 bp, Artificial
  CRISPR gRNA sequence
tgcctatatgtgacatcctg

SEQ ID NO: 65665 - DNA, 20 bp, Artificial
  CRISPR gRNA sequence
cctatatgtgacatcctgtg

SEQ ID NO: 65666 - DNA, 20 bp, Artificial
  CRISPR gRNA sequence
tatgtgacatcctgtgggtg

SEQ ID NO: 65667 - DNA, 20 bp, Artificial
  CRISPR gRNA sequence
tgggtgtcgtgtgtgttggt

SEQ ID NO: 65668 - DNA, 20 bp, Artificial
  CRISPR gRNA sequence
gtccctctttgtccgtctgt

SEQ ID NO: 65669 - DNA, 20 bp, Artificial
  CRISPR gRNA sequence
tttgtccgtctgtctaggtg

SEQ ID NO: 65670 - DNA, 20 bp, Artificial
  CRISPR gRNA sequence
tgtccgtctgtctaggtgcc

SEQ ID NO: 65671 - DNA, 20 bp, Artificial
  CRISPR gRNA sequence
gtccgtctgtctaggtgcca

SEQ ID NO: 65672 - DNA, 20 bp, Artificial
  CRISPR gRNA sequence
tccgtctgtctaggtgccag

SEQ ID NO: 65673 - DNA, 20 bp, Artificial
  CRISPR gRNA sequence
tctaggtgccagatacatcc

SEQ ID NO: 65674 - DNA, 20 bp, Artificial
  CRISPR gRNA sequence
ggtgccagatacatcccagt

SEQ ID NO: 65675 - DNA, 20 bp, Artificial
  CRISPR gRNA sequence
ctctcctgcaagcctcattc

SEQ ID NO: 65676 - DNA, 20 bp, Artificial
  CRISPR gRNA sequence
tcctgcaagcctcattctct

SEQ ID NO: 65677 - DNA, 20 bp, Artificial
  CRISPR gRNA sequence
ctgcaagcctcattctctgc

SEQ ID NO: 65678 - DNA, 20 bp, Artificial
  CRISPR gRNA sequence
caagcctcattctctgcctc

SEQ ID NO: 65679 - DNA, 20 bp, Artificial
  CRISPR gRNA sequence
attctctgcctctgtgtctg

SEQ ID NO: 65680 - DNA, 20 bp, Artificial
  CRISPR gRNA sequence
tctgcctctgtgtctggggg

SEQ ID NO: 65681 - DNA, 20 bp, Artificial
  CRISPR gRNA sequence
tgcctctgtgtctggggggt

SEQ ID NO: 65682 - DNA, 20 bp, Artificial
  CRISPR gRNA sequence
cctctgtgtctggggggtgg

SEQ ID NO: 65683 - DNA, 20 bp, Artificial
  CRISPR gRNA sequence
tgtgtctggggggtgggaaa

SEQ ID NO: 65684 - DNA, 20 bp, Artificial
  CRISPR gRNA sequence
tgtctggggggtgggaaagc

SEQ ID NO: 65685 - DNA, 20 bp, Artificial
  CRISPR gRNA sequence
gggggtgggaaagcggctcc

SEQ ID NO: 65686 - DNA, 20 bp, Artificial
  CRISPR gRNA sequence
cttcccgcctctgttcagtg

SEQ ID NO: 65687 - DNA, 20 bp, Artificial
  CRISPR gRNA sequence
cccgcctctgttcagtgggg

SEQ ID NO: 65688 - DNA, 20 bp, Artificial
  CRISPR gRNA sequence
ccgcctctgttcagtggggc

SEQ ID NO: 65689 - DNA, 20 bp, Artificial
  CRISPR gRNA sequence
tgttcagtggggcatgcagc

SEQ ID NO: 65690 - DNA, 20 bp, Artificial
  CRISPR gRNA sequence
ttcagtggggcatgcagcac

SEQ ID NO: 65691 - DNA, 20 bp, Artificial
  CRISPR gRNA sequence
agtggggcatgcagcactgt

SEQ ID NO: 65692 - DNA, 20 bp, Artificial
  CRISPR gRNA sequence
tgtttttgtccctgggcagg

SEQ ID NO: 65693 - DNA, 20 bp, Artificial
  CRISPR gRNA sequence
ttgtccctgggcaggctgac

SEQ ID NO: 65694 - DNA, 20 bp, Artificial
  CRISPR gRNA sequence
tgtccctgggcaggctgaca

SEQ ID NO: 65695 - DNA, 20 bp, Artificial
  CRISPR gRNA sequence
gtccctgggcaggctgacac

SEQ ID NO: 65696 - DNA, 20 bp, Artificial
  CRISPR gRNA sequence
tccctgggcaggctgacaca

SEQ ID NO: 65697 - DNA, 20 bp, Artificial
  CRISPR gRNA sequence
ggcaggctgacacattgtgg

SEQ ID NO: 65698 - DNA, 20 bp, Artificial
  CRISPR gRNA sequence
acacattgtggcctccaaga

SEQ ID NO: 65699 - DNA, 20 bp, Artificial
  CRISPR gRNA sequence
tggcctccaagaaaagcacc

SEQ ID NO: 65700 - DNA, 20 bp, Artificial
  CRISPR gRNA sequence
caagaaaagcacctagagca

SEQ ID NO: 65701 - DNA, 20 bp, Artificial
  CRISPR gRNA sequence
gagcagctctgcaaggctct

SEQ ID NO: 65702 - DNA, 20 bp, Artificial
  CRISPR gRNA sequence
tgcaaggctctgggaggaag

SEQ ID NO: 65703 - DNA, 20 bp, Artificial
  CRISPR gRNA sequence
caaggctctgggaggaagct

SEQ ID NO: 65704 - DNA, 20 bp, Artificial
  CRISPR gRNA sequence
tgggaggaagctgccacctc

SEQ ID NO: 65705 - DNA, 20 bp, Artificial
  CRISPR gRNA sequence
ggaggaagctgccacctcgg

SEQ ID NO: 65706 - DNA, 20 bp, Artificial
  CRISPR gRNA sequence
ccacctcggtcacctccacc

SEQ ID NO: 65707 - DNA, 20 bp, Artificial
  CRISPR gRNA sequence
ggtcacctccacctcgagtg

SEQ ID NO: 65708 - DNA, 20 bp, Artificial
  CRISPR gRNA sequence
cacctcgagtgagtggtttg

SEQ ID NO: 65709 - DNA, 20 bp, Artificial
  CRISPR gRNA sequence
gagtgagtggtttgtgtgtt

SEQ ID NO: 65710 - DNA, 20 bp, Artificial
  CRISPR gRNA sequence
gtgtgttggaaggtgggtgg

SEQ ID NO: 65711 - DNA, 20 bp, Artificial
  CRISPR gRNA sequence
tgtgttggaaggtgggtggg

SEQ ID NO: 65712 - DNA, 20 bp, Artificial
  CRISPR gRNA sequence
gaaggtgggtgggtggggcc

SEQ ID NO: 65713 - DNA, 20 bp, Artificial
  CRISPR gRNA sequence
cagtgagttagtgttggtgt

SEQ ID NO: 65714 - DNA, 20 bp, Artificial
  CRISPR gRNA sequence
gtgttggtgtttgggtttgg

SEQ ID NO: 65715 - DNA, 20 bp, Artificial
  CRISPR gRNA sequence
gtgtttgggtttggttttta

SEQ ID NO: 65716 - DNA, 20 bp, Artificial
  CRISPR gRNA sequence
gggtttggtttttaagattt

SEQ ID NO: 65717 - DNA, 20 bp, Artificial
  CRISPR gRNA sequence
ggtttggtttttaagattta

SEQ ID NO: 65718 - DNA, 20 bp, Artificial
  CRISPR gRNA sequence
ggtttttaagatttagatca

SEQ ID NO: 65719 - DNA, 20 bp, Artificial
  CRISPR gRNA sequence
gtttttaagatttagatcaa

SEQ ID NO: 65720 - DNA, 20 bp, Artificial
  CRISPR gRNA sequence
ttaagatttagatcaactgt

SEQ ID NO: 65721 - DNA, 20 bp, Artificial
  CRISPR gRNA sequence
taagatttagatcaactgtt

SEQ ID NO: 65722 - DNA, 20 bp, Artificial
  CRISPR gRNA sequence
aagatttagatcaactgttc

SEQ ID NO: 65723 - DNA, 20 bp, Artificial
  CRISPR gRNA sequence
agatttagatcaactgttct

SEQ ID NO: 65724 - DNA, 20 bp, Artificial
  CRISPR gRNA sequence
agatcaactgttctttccct

SEQ ID NO: 65725 - DNA, 20 bp, Artificial
  CRISPR gRNA sequence
gatcaactgttctttccctg

SEQ ID NO: 65726 - DNA, 20 bp, Artificial
  CRISPR gRNA sequence
ttctttccctgctgaagtca

SEQ ID NO: 65727 - DNA, 20 bp, Artificial
  CRISPR gRNA sequence
tttccctgctgaagtcagaa

SEQ ID NO: 65728 - DNA, 20 bp, Artificial
  CRISPR gRNA sequence
tccctgctgaagtcagaaac

SEQ ID NO: 65729 - DNA, 20 bp, Artificial
  CRISPR gRNA sequence
ccctgctgaagtcagaaacc

SEQ ID NO: 65730 - DNA, 20 bp, Artificial
  CRISPR gRNA sequence
cctgctgaagtcagaaaccc

SEQ ID NO: 65731 - DNA, 20 bp, Artificial
  CRISPR gRNA sequence
ctgaagtcagaaaccccttg

SEQ ID NO: 65732 - DNA, 20 bp, Artificial
  CRISPR gRNA sequence
aagtcagaaaccccttggag

SEQ ID NO: 65733 - DNA, 20 bp, Artificial
  CRISPR gRNA sequence
ggagaatctggtgaaagttg

SEQ ID NO: 65734 - DNA, 20 bp, Artificial
  CRISPR gRNA sequence
gagaatctggtgaaagttgt

SEQ ID NO: 65735 - DNA, 20 bp, Artificial
  CRISPR gRNA sequence
gtgaaagttgtgactcttcc

SEQ ID NO: 65736 - DNA, 20 bp, Artificial
  CRISPR gRNA sequence
tgactcttcctcccaagata

SEQ ID NO: 65737 - DNA, 20 bp, Artificial
  CRISPR gRNA sequence
ttcctcccaagatacagatc

SEQ ID NO: 65738 - DNA, 20 bp, Artificial
  CRISPR gRNA sequence
cctcccaagatacagatccc

SEQ ID NO: 65739 - DNA, 20 bp, Artificial
  CRISPR gRNA sequence
ctcccaagatacagatcccc

SEQ ID NO: 65740 - DNA, 20 bp, Artificial
  CRISPR gRNA sequence
ccaagatacagatcccccat

SEQ ID NO: 65741 - DNA, 20 bp, Artificial
  CRISPR gRNA sequence
acacgctcggaggctcaccc

SEQ ID NO: 65742 - DNA, 20 bp, Artificial
  CRISPR gRNA sequence
ggaggctcacccctggtccc

SEQ ID NO: 65743 - DNA, 20 bp, Artificial
  CRISPR gRNA sequence
acccctggtccctcagaggt

SEQ ID NO: 65744 - DNA, 20 bp, Artificial
  CRISPR gRNA sequence
gtccctcagaggtccacgaa

SEQ ID NO: 65745 - DNA, 20 bp, Artificial
  CRISPR gRNA sequence
agaggtccacgaacctcaga

SEQ ID NO: 65746 - DNA, 20 bp, Artificial
  CRISPR gRNA sequence
agaataagaacctgggggag

SEQ ID NO: 65747 - DNA, 20 bp, Artificial
  CRISPR gRNA sequence
ggggagaccccagctgcccg

SEQ ID NO: 65748 - DNA, 20 bp, Artificial
  CRISPR gRNA sequence
cccgtgccagatctgctgag

SEQ ID NO: 65749 - DNA, 20 bp, Artificial
  CRISPR gRNA sequence
ctgagatctggcctggcagc

SEQ ID NO: 65750 - DNA, 20 bp, Artificial
  CRISPR gRNA sequence
agatctggcctggcagccca

SEQ ID NO: 65751 - DNA, 20 bp, Artificial
  CRISPR gRNA sequence
gcctggcagcccagggctgt

SEQ ID NO: 65752 - DNA, 20 bp, Artificial
  CRISPR gRNA sequence
gcagcccagggctgtgtcca

SEQ ID NO: 65753 - DNA, 20 bp, Artificial
  CRISPR gRNA sequence
tgtccagtttcaggaagttg

SEQ ID NO: 65754 - DNA, 20 bp, Artificial
  CRISPR gRNA sequence
caggaagttgagtaactgga

SEQ ID NO: 65755 - DNA, 20 bp, Artificial
  CRISPR gRNA sequence
aggaagttgagtaactggaa

SEQ ID NO: 65756 - DNA, 20 bp, Artificial
  CRISPR gRNA sequence
agtaactggaatgcagggac

SEQ ID NO: 65757 - DNA, 20 bp, Artificial
  CRISPR gRNA sequence
gaatgcagggaccatgctgc

SEQ ID NO: 65758 - DNA, 20 bp, Artificial
  CRISPR gRNA sequence
ccagcaacccactccccacc

SEQ ID NO: 65759 - DNA, 20 bp, Artificial
  CRISPR gRNA sequence
cccacctgctaatgttctcc

SEQ ID NO: 65760 - DNA, 20 bp, Artificial
  CRISPR gRNA sequence
ctaatgttctcccctccctt

SEQ ID NO: 65761 - DNA, 20 bp, Artificial
  CRISPR gRNA sequence
atgttctcccctcccttctc

SEQ ID NO: 65762 - DNA, 20 bp, Artificial
  CRISPR gRNA sequence
tcccctcccttctccccacc

SEQ ID NO: 65763 - DNA, 20 bp, Artificial
  CRISPR gRNA sequence
ccctcccttctccccacccc

SEQ ID NO: 65764 - DNA, 20 bp, Artificial
  CRISPR gRNA sequence
ccttctccccacccccagct

SEQ ID NO: 65765 - DNA, 20 bp, Artificial
  CRISPR gRNA sequence
ctccccacccccagcttctc

SEQ ID NO: 65766 - DNA, 20 bp, Artificial
  CRISPR gRNA sequence
tccccacccccagcttctca

SEQ ID NO: 65767 - DNA, 20 bp, Artificial
  CRISPR gRNA sequence
cccacccccagcttctcagg

SEQ ID NO: 65768 - DNA, 20 bp, Artificial
  CRISPR gRNA sequence
ctcaggcaatgctctggggg

SEQ ID NO: 65769 - DNA, 20 bp, Artificial
  CRISPR gRNA sequence
tcaggcaatgctctggggga

SEQ ID NO: 65770 - DNA, 20 bp, Artificial
  CRISPR gRNA sequence
aggcaatgctctgggggatg

SEQ ID NO: 65771 - DNA, 20 bp, Artificial
  CRISPR gRNA sequence
tgggggatgaaggtgcagcc

SEQ ID NO: 65772 - DNA, 20 bp, Artificial
  CRISPR gRNA sequence
ggggatgaaggtgcagcccg

SEQ ID NO: 65773 - DNA, 20 bp, Artificial
  CRISPR gRNA sequence
gctcagctgctcccagggct

SEQ ID NO: 65774 - DNA, 20 bp, Artificial
  CRISPR gRNA sequence
agctgctcccagggctggga

SEQ ID NO: 65775 - DNA, 20 bp, Artificial
  CRISPR gRNA sequence
ctcccagggctgggagctct

SEQ ID NO: 65776 - DNA, 20 bp, Artificial
  CRISPR gRNA sequence
ccagggctgggagctctgca

SEQ ID NO: 65777 - DNA, 20 bp, Artificial
  CRISPR gRNA sequence
ggagctctgcagtccttgaa

SEQ ID NO: 65778 - DNA, 20 bp, Artificial
  CRISPR gRNA sequence
tgcagtccttgaagtgagta

SEQ ID NO: 65779 - DNA, 20 bp, Artificial
  CRISPR gRNA sequence
cagtccttgaagtgagtagc

SEQ ID NO: 65780 - DNA, 20 bp, Artificial
  CRISPR gRNA sequence
gaagtgagtagcccgctagg

SEQ ID NO: 65781 - DNA, 20 bp, Artificial
  CRISPR gRNA sequence
aagtgagtagcccgctaggc

SEQ ID NO: 65782 - DNA, 20 bp, Artificial
  CRISPR gRNA sequence
ggcagagcctctgaggctgg

SEQ ID NO: 65783 - DNA, 20 bp, Artificial
  CRISPR gRNA sequence
tgaggctggggcaggggggg

SEQ ID NO: 65784 - DNA, 20 bp, Artificial
  CRISPR gRNA sequence
aggctggggcagggggggag

SEQ ID NO: 65785 - DNA, 20 bp, Artificial
  CRISPR gRNA sequence
gggcagggggggagcattct

SEQ ID NO: 65786 - DNA, 20 bp, Artificial
  CRISPR gRNA sequence
tctgtcccatccccctcttt

SEQ ID NO: 65787 - DNA, 20 bp, Artificial
  CRISPR gRNA sequence
tgtcccatccccctctttcc

SEQ ID NO: 65788 - DNA, 20 bp, Artificial
  CRISPR gRNA sequence
tcccatccccctctttcctg

SEQ ID NO: 65789 - DNA, 20 bp, Artificial
  CRISPR gRNA sequence
tttcctggggttattgtaaa

SEQ ID NO: 65790 - DNA, 20 bp, Artificial
  CRISPR gRNA sequence
tcctggggttattgtaaaga

SEQ ID NO: 65791 - DNA, 20 bp, Artificial
  CRISPR gRNA sequence
cctggggttattgtaaagat

SEQ ID NO: 65792 - DNA, 20 bp, Artificial
  CRISPR gRNA sequence
ctggggttattgtaaagatt

SEQ ID NO: 65793 - DNA, 20 bp, Artificial
  CRISPR gRNA sequence
gggttattgtaaagattaaa

SEQ ID NO: 65794 - DNA, 20 bp, Artificial
  CRISPR gRNA sequence
ttgtaaagattaaatcggaa

SEQ ID NO: 65795 - DNA, 20 bp, Artificial
  CRISPR gRNA sequence
taaagattaaatcggaaaat

SEQ ID NO: 65796 - DNA, 20 bp, Artificial
  CRISPR gRNA sequence
aatcggaaaatgcatgaaaa

SEQ ID NO: 65797 - DNA, 20 bp, Artificial
  CRISPR gRNA sequence
cccctaatacaatgtaagtt

SEQ ID NO: 65798 - DNA, 20 bp, Artificial
  CRISPR gRNA sequence
atacaatgtaagttctcggt

SEQ ID NO: 65799 - DNA, 20 bp, Artificial
  CRISPR gRNA sequence
tcggtgaaggctagctaata

SEQ ID NO: 65800 - DNA, 20 bp, Artificial
  CRISPR gRNA sequence
ggtgaaggctagctaataga

SEQ ID NO: 65801 - DNA, 20 bp, Artificial
  CRISPR gRNA sequence
gctaatagatgattcttact

SEQ ID NO: 65802 - DNA, 20 bp, Artificial
  CRISPR gRNA sequence
atagatgattcttactcaga

SEQ ID NO: 65803 - DNA, 20 bp, Artificial
  CRISPR gRNA sequence
ttactcagagagtctgtgac

SEQ ID NO: 65804 - DNA, 20 bp, Artificial
  CRISPR gRNA sequence
actcagagagtctgtgactc

SEQ ID NO: 65805 - DNA, 20 bp, Artificial
  CRISPR gRNA sequence
ctcagagagtctgtgactca

SEQ ID NO: 65806 - DNA, 20 bp, Artificial
  CRISPR gRNA sequence
agagagtctgtgactcaata

SEQ ID NO: 65807 - DNA, 20 bp, Artificial
  CRISPR gRNA sequence
tgactcaataatcccacttc

SEQ ID NO: 65808 - DNA, 20 bp, Artificial
  CRISPR gRNA sequence
aataatcccacttctgattc

SEQ ID NO: 65809 - DNA, 20 bp, Artificial
  CRISPR gRNA sequence
ctgattcaaggtttcacttc

SEQ ID NO: 65810 - DNA, 20 bp, Artificial
  CRISPR gRNA sequence
tgattcaaggtttcacttct

SEQ ID NO: 65811 - DNA, 20 bp, Artificial
  CRISPR gRNA sequence
attcaaggtttcacttctgg

SEQ ID NO: 65812 - DNA, 20 bp, Artificial
  CRISPR gRNA sequence
aaggtttcacttctggaacc

SEQ ID NO: 65813 - DNA, 20 bp, Artificial
  CRISPR gRNA sequence
cacttctggaacctgtctcc

SEQ ID NO: 65814 - DNA, 20 bp, Artificial
  CRISPR gRNA sequence
acttctggaacctgtctccg

SEQ ID NO: 65815 - DNA, 20 bp, Artificial
  CRISPR gRNA sequence
ctggaacctgtctccgcatc

SEQ ID NO: 65816 - DNA, 20 bp, Artificial
  CRISPR gRNA sequence
tggaacctgtctccgcatct

SEQ ID NO: 65817 - DNA, 20 bp, Artificial
  CRISPR gRNA sequence
gaacctgtctccgcatctct

SEQ ID NO: 65818 - DNA, 20 bp, Artificial
  CRISPR gRNA sequence
tctccgcatctctgaacagg

SEQ ID NO: 65819 - DNA, 20 bp, Artificial
  CRISPR gRNA sequence
cgcatctctgaacaggcttc

SEQ ID NO: 65820 - DNA, 20 bp, Artificial
  CRISPR gRNA sequence
tgaacaggcttctgaggcca

SEQ ID NO: 65821 - DNA, 20 bp, Artificial
  CRISPR gRNA sequence
aacaggcttctgaggccacc

SEQ ID NO: 65822 - DNA, 20 bp, Artificial
  CRISPR gRNA sequence
ctgaggccaccctggggagg

SEQ ID NO: 65823 - DNA, 20 bp, Artificial
  CRISPR gRNA sequence
tgaggccaccctggggaggg

SEQ ID NO: 65824 - DNA, 20 bp, Artificial
  CRISPR gRNA sequence
aggccaccctggggagggca

SEQ ID NO: 65825 - DNA, 20 bp, Artificial
  CRISPR gRNA sequence
gggagggcaggtgtgggtgc

SEQ ID NO: 65826 - DNA, 20 bp, Artificial
  CRISPR gRNA sequence
acggctggcagttgttattc

SEQ ID NO: 65827 - DNA, 20 bp, Artificial
  CRISPR gRNA sequence
gcagttgttattctggccct

SEQ ID NO: 65828 - DNA, 20 bp, Artificial
  CRISPR gRNA sequence
ttattctggccctggggtgc

SEQ ID NO: 65829 - DNA, 20 bp, Artificial
  CRISPR gRNA sequence
ttctggccctggggtgccgg

SEQ ID NO: 65830 - DNA, 20 bp, Artificial
  CRISPR gRNA sequence
tggccctggggtgccgggag

SEQ ID NO: 65831 - DNA, 20 bp, Artificial
  CRISPR gRNA sequence
gccctggggtgccgggaggg

SEQ ID NO: 65832 - DNA, 20 bp, Artificial
  CRISPR gRNA sequence
gggtgccgggaggggctggg

SEQ ID NO: 65833 - DNA, 20 bp, Artificial
  CRISPR gRNA sequence
gggctgttagctggggtatg

SEQ ID NO: 65834 - DNA, 20 bp, Artificial
  CRISPR gRNA sequence
ttagctggggtatggtcagg

SEQ ID NO: 65835 - DNA, 20 bp, Artificial
  CRISPR gRNA sequence
gctggggtatggtcagggta

SEQ ID NO: 65836 - DNA, 20 bp, Artificial
  CRISPR gRNA sequence
gggtatggtcagggtagaca

SEQ ID NO: 65837 - DNA, 20 bp, Artificial
  CRISPR gRNA sequence
gtaccagagaggacactcaa

SEQ ID NO: 65838 - DNA, 20 bp, Artificial
  CRISPR gRNA sequence
taccagagaggacactcaag

SEQ ID NO: 65839 - DNA, 20 bp, Artificial
  CRISPR gRNA sequence
aagcagggtgcccagggctg

SEQ ID NO: 65840 - DNA, 20 bp, Artificial
  CRISPR gRNA sequence
ccaaggatccctgagtacct

SEQ ID NO: 65841 - DNA, 20 bp, Artificial
  CRISPR gRNA sequence
agtacctggcagagagtgtg

SEQ ID NO: 65842 - DNA, 20 bp, Artificial
  CRISPR gRNA sequence
gcagagagtgtgtaggagga

SEQ ID NO: 65843 - DNA, 20 bp, Artificial
  CRISPR gRNA sequence
gcctgcaatggaccagagtt

SEQ ID NO: 65844 - DNA, 20 bp, Artificial
  CRISPR gRNA sequence
cctgcaatggaccagagttc

SEQ ID NO: 65845 - DNA, 20 bp, Artificial
  CRISPR gRNA sequence
caatggaccagagttcttga

SEQ ID NO: 65846 - DNA, 20 bp, Artificial
  CRISPR gRNA sequence
ttgatccctaaatgcccttg

SEQ ID NO: 65847 - DNA, 20 bp, Artificial
  CRISPR gRNA sequence
gatccctaaatgcccttggt

SEQ ID NO: 65848 - DNA, 20 bp, Artificial
  CRISPR gRNA sequence
atccctaaatgcccttggtg

SEQ ID NO: 65849 - DNA, 20 bp, Artificial
  CRISPR gRNA sequence
aatgcccttggtgcttttgg

SEQ ID NO: 65850 - DNA, 20 bp, Artificial
  CRISPR gRNA sequence
ggtgcttttggctcacaaag

SEQ ID NO: 65851 - DNA, 20 bp, Artificial
  CRISPR gRNA sequence
gtgcttttggctcacaaagc

SEQ ID NO: 65852 - DNA, 20 bp, Artificial
  CRISPR gRNA sequence
ttggctcacaaagcaccccc

SEQ ID NO: 65853 - DNA, 20 bp, Artificial
  CRISPR gRNA sequence
tggctcacaaagcaccccct

SEQ ID NO: 65854 - DNA, 20 bp, Artificial
  CRISPR gRNA sequence
ggctcacaaagcaccccctc

SEQ ID NO: 65855 - DNA, 20 bp, Artificial
  CRISPR gRNA sequence
gctcacaaagcaccccctcc

SEQ ID NO: 65856 - DNA, 20 bp, Artificial
  CRISPR gRNA sequence
acaaagcaccccctcctccc

SEQ ID NO: 65857 - DNA, 20 bp, Artificial
  CRISPR gRNA sequence
ctcccaggcacttctgggcc

SEQ ID NO: 65858 - DNA, 20 bp, Artificial
  CRISPR gRNA sequence
ccaggcacttctgggccaaa

SEQ ID NO: 65859 - DNA, 20 bp, Artificial
  CRISPR gRNA sequence
ctgggccaaagccagaggag

SEQ ID NO: 65860 - DNA, 20 bp, Artificial
  CRISPR gRNA sequence
tgggccaaagccagaggagc

SEQ ID NO: 65861 - DNA, 20 bp, Artificial
  CRISPR gRNA sequence
ggccaaagccagaggagccc

SEQ ID NO: 65862 - DNA, 20 bp, Artificial
  CRISPR gRNA sequence
tattccaggctgtctctgtg

SEQ ID NO: 65863 - DNA, 20 bp, Artificial
  CRISPR gRNA sequence
caggctgtctctgtgaacac

SEQ ID NO: 65864 - DNA, 20 bp, Artificial
  CRISPR gRNA sequence
tctctgtgaacacgctttgc

SEQ ID NO: 65865 - DNA, 20 bp, Artificial
  CRISPR gRNA sequence
tgtgaacacgctttgctgtg

SEQ ID NO: 65866 - DNA, 20 bp, Artificial
  CRISPR gRNA sequence
tgaacacgctttgctgtgtg

SEQ ID NO: 65867 - DNA, 20 bp, Artificial
  CRISPR gRNA sequence
tgctgtgtgattctgggcaa

SEQ ID NO: 65868 - DNA, 20 bp, Artificial
  CRISPR gRNA sequence
gctgtgtgattctgggcaag

SEQ ID NO: 65869 - DNA, 20 bp, Artificial
  CRISPR gRNA sequence
ctgtgtgattctgggcaagt

SEQ ID NO: 65870 - DNA, 20 bp, Artificial
  CRISPR gRNA sequence
tgtgattctgggcaagttac

SEQ ID NO: 65871 - DNA, 20 bp, Artificial
  CRISPR gRNA sequence
tgggcaagttacatcccctc

SEQ ID NO: 65872 - DNA, 20 bp, Artificial
  CRISPR gRNA sequence
ggcaagttacatcccctctc

SEQ ID NO: 65873 - DNA, 20 bp, Artificial
  CRISPR gRNA sequence
catcccctctccgagtccct

SEQ ID NO: 65874 - DNA, 20 bp, Artificial
  CRISPR gRNA sequence
tccgagtccctggttcccag

SEQ ID NO: 65875 - DNA, 20 bp, Artificial
  CRISPR gRNA sequence
cgagtccctggttcccagtc

SEQ ID NO: 65876 - DNA, 20 bp, Artificial
  CRISPR gRNA sequence
gttcccagtcggtaaataca

SEQ ID NO: 65877 - DNA, 20 bp, Artificial
  CRISPR gRNA sequence
ccagtcggtaaatacataaa

SEQ ID NO: 65878 - DNA, 20 bp, Artificial
  CRISPR gRNA sequence
caggcgtggcctctgttggt

SEQ ID NO: 65879 - DNA, 20 bp, Artificial
  CRISPR gRNA sequence
tgttggtggctacgatctct

SEQ ID NO: 65880 - DNA, 20 bp, Artificial
  CRISPR gRNA sequence
ttggtggctacgatctctga

SEQ ID NO: 65881 - DNA, 20 bp, Artificial
  CRISPR gRNA sequence
gtggctacgatctctgaaat

SEQ ID NO: 65882 - DNA, 20 bp, Artificial
  CRISPR gRNA sequence
cgatctctgaaatgagtgct

SEQ ID NO: 65883 - DNA, 20 bp, Artificial
  CRISPR gRNA sequence
tgaaatgagtgctggggcct

SEQ ID NO: 65884 - DNA, 20 bp, Artificial
  CRISPR gRNA sequence
aaatgagtgctggggcctaa

SEQ ID NO: 65885 - DNA, 20 bp, Artificial
  CRISPR gRNA sequence
gggcctaaggaccccctgct

SEQ ID NO: 65886 - DNA, 20 bp, Artificial
  CRISPR gRNA sequence
aggaccccctgctcacaccc

SEQ ID NO: 65887 - DNA, 20 bp, Artificial
  CRISPR gRNA sequence
ctcacaccctgtttttgtgc

SEQ ID NO: 65888 - DNA, 20 bp, Artificial
  CRISPR gRNA sequence
acaccctgtttttgtgcaat

SEQ ID NO: 65889 - DNA, 20 bp, Artificial
  CRISPR gRNA sequence
tttttgtgcaatgctgggaa

SEQ ID NO: 65890 - DNA, 20 bp, Artificial
  CRISPR gRNA sequence
ttgtgcaatgctgggaagga

SEQ ID NO: 65891 - DNA, 20 bp, Artificial
  CRISPR gRNA sequence
tgtgcaatgctgggaaggaa

SEQ ID NO: 65892 - DNA, 20 bp, Artificial
  CRISPR gRNA sequence
gtgcaatgctgggaaggaag

SEQ ID NO: 65893 - DNA, 20 bp, Artificial
  CRISPR gRNA sequence
tgcaatgctgggaaggaagg

SEQ ID NO: 65894 - DNA, 20 bp, Artificial
  CRISPR gRNA sequence
ggaaggaagggagttgcctt

SEQ ID NO: 65895 - DNA, 20 bp, Artificial
  CRISPR gRNA sequence
ccttggttcctgttcagggc

SEQ ID NO: 65896 - DNA, 20 bp, Artificial
  CRISPR gRNA sequence
ggttcctgttcagggcctgc

SEQ ID NO: 65897 - DNA, 20 bp, Artificial
  CRISPR gRNA sequence
gttcctgttcagggcctgca

SEQ ID NO: 65898 - DNA, 20 bp, Artificial
  CRISPR gRNA sequence
ctgttcagggcctgcacctg

SEQ ID NO: 65899 - DNA, 20 bp, Artificial
  CRISPR gRNA sequence
ttcagggcctgcacctggga

SEQ ID NO: 65900 - DNA, 20 bp, Artificial
  CRISPR gRNA sequence
agggcctgcacctgggaagg

SEQ ID NO: 65901 - DNA, 20 bp, Artificial
  CRISPR gRNA sequence
cacctgggaaggaaggaagg

SEQ ID NO: 65902 - DNA, 20 bp, Artificial
  CRISPR gRNA sequence
ggaaggaaggaaggtctaac

SEQ ID NO: 65903 - DNA, 20 bp, Artificial
  CRISPR gRNA sequence
accattgcaggcaaattaca

SEQ ID NO: 65904 - DNA, 20 bp, Artificial
  CRISPR gRNA sequence
caggcaaattacatgaagac

SEQ ID NO: 65905 - DNA, 20 bp, Artificial
  CRISPR gRNA sequence
catgaagactggaggtttta

SEQ ID NO: 65906 - DNA, 20 bp, Artificial
  CRISPR gRNA sequence
gaggttttagtatgtcctca

SEQ ID NO: 65907 - DNA, 20 bp, Artificial
  CRISPR gRNA sequence
tagtatgtcctcatgtgacc

SEQ ID NO: 65908 - DNA, 20 bp, Artificial
  CRISPR gRNA sequence
agtatgtcctcatgtgacct

SEQ ID NO: 65909 - DNA, 20 bp, Artificial
  CRISPR gRNA sequence
gtatgtcctcatgtgacctt

SEQ ID NO: 65910 - DNA, 20 bp, Artificial
  CRISPR gRNA sequence
atgtgaccttcttattagtg

SEQ ID NO: 65911 - DNA, 20 bp, Artificial
  CRISPR gRNA sequence
cttattagtgtggactcgtg

SEQ ID NO: 65912 - DNA, 20 bp, Artificial
  CRISPR gRNA sequence
ttattagtgtggactcgtga

SEQ ID NO: 65913 - DNA, 20 bp, Artificial
  CRISPR gRNA sequence
attagtgtggactcgtgacc

SEQ ID NO: 65914 - DNA, 20 bp, Artificial
  CRISPR gRNA sequence
ttagtgtggactcgtgacct

SEQ ID NO: 65915 - DNA, 20 bp, Artificial
  CRISPR gRNA sequence
gtgtggactcgtgacctggt

SEQ ID NO: 65916 - DNA, 20 bp, Artificial
  CRISPR gRNA sequence
gtgacctggtgctgtgaggg

SEQ ID NO: 65917 - DNA, 20 bp, Artificial
  CRISPR gRNA sequence
gtgctgtgagggtccacact

SEQ ID NO: 65918 - DNA, 20 bp, Artificial
  CRISPR gRNA sequence
tgagggtccacactcgccct

SEQ ID NO: 65919 - DNA, 20 bp, Artificial
  CRISPR gRNA sequence
gccctaccagtgtccccgtg

SEQ ID NO: 65920 - DNA, 20 bp, Artificial
  CRISPR gRNA sequence
ccagtgtccccgtgggaggg

SEQ ID NO: 65921 - DNA, 20 bp, Artificial
  CRISPR gRNA sequence
aatagtaaatagaaaacaat

SEQ ID NO: 65922 - DNA, 20 bp, Artificial
  CRISPR gRNA sequence
acaggagaccctgaaagaaa

SEQ ID NO: 65923 - DNA, 20 bp, Artificial
  CRISPR gRNA sequence
aaagaaaggagacactttgt

SEQ ID NO: 65924 - DNA, 20 bp, Artificial
  CRISPR gRNA sequence
tgttcctgctttctgcacaa

SEQ ID NO: 65925 - DNA, 20 bp, Artificial
  CRISPR gRNA sequence
gttcctgctttctgcacaag

SEQ ID NO: 65926 - DNA, 20 bp, Artificial
  CRISPR gRNA sequence
ttcctgctttctgcacaaga

SEQ ID NO: 65927 - DNA, 20 bp, Artificial
  CRISPR gRNA sequence
ctgctttctgcacaagagac

SEQ ID NO: 65928 - DNA, 20 bp, Artificial
  CRISPR gRNA sequence
ctttctgcacaagagaccct

SEQ ID NO: 65929 - DNA, 20 bp, Artificial
  CRISPR gRNA sequence
tctgcacaagagaccctgca

SEQ ID NO: 65930 - DNA, 20 bp, Artificial
  CRISPR gRNA sequence
ctgcacaagagaccctgcat

SEQ ID NO: 65931 - DNA, 20 bp, Artificial
  CRISPR gRNA sequence
tgcacaagagaccctgcatt

SEQ ID NO: 65932 - DNA, 20 bp, Artificial
  CRISPR gRNA sequence
cacaagagaccctgcatttt

SEQ ID NO: 65933 - DNA, 20 bp, Artificial
  CRISPR gRNA sequence
cattttcattttgtcctggg

SEQ ID NO: 65934 - DNA, 20 bp, Artificial
  CRISPR gRNA sequence
tcattttgtcctgggtacca

SEQ ID NO: 65935 - DNA, 20 bp, Artificial
  CRISPR gRNA sequence
cattttgtcctgggtaccac

SEQ ID NO: 65936 - DNA, 20 bp, Artificial
  CRISPR gRNA sequence
attttgtcctgggtaccacc

SEQ ID NO: 65937 - DNA, 20 bp, Artificial
  CRISPR gRNA sequence
tgtcctgggtaccacccctc

SEQ ID NO: 65938 - DNA, 20 bp, Artificial
  CRISPR gRNA sequence
gtcctgggtaccacccctcc

SEQ ID NO: 65939 - DNA, 20 bp, Artificial
  CRISPR gRNA sequence
tcctgggtaccacccctccc

SEQ ID NO: 65940 - DNA, 20 bp, Artificial
  CRISPR gRNA sequence
ggtaccacccctcccttatc

SEQ ID NO: 65941 - DNA, 20 bp, Artificial
  CRISPR gRNA sequence
ccttatcaggtggagaaaag

SEQ ID NO: 65942 - DNA, 20 bp, Artificial
  CRISPR gRNA sequence
atcaggtggagaaaaggagg

SEQ ID NO: 65943 - DNA, 20 bp, Artificial
  CRISPR gRNA sequence
tcaggtggagaaaaggaggc

SEQ ID NO: 65944 - DNA, 20 bp, Artificial
  CRISPR gRNA sequence
cagccagaaagcactcctca

SEQ ID NO: 65945 - DNA, 20 bp, Artificial
  CRISPR gRNA sequence
ctcagatccatcacagaccg

SEQ ID NO: 65946 - DNA, 20 bp, Artificial
  CRISPR gRNA sequence
agatccatcacagaccgagg

SEQ ID NO: 65947 - DNA, 20 bp, Artificial
  CRISPR gRNA sequence
ggtgcccatctcagctctgt

SEQ ID NO: 65948 - DNA, 20 bp, Artificial
  CRISPR gRNA sequence
agctctgtcaccaacatgtc

SEQ ID NO: 65949 - DNA, 20 bp, Artificial
  CRISPR gRNA sequence
tgtcaccaacatgtctcata

SEQ ID NO: 65950 - DNA, 20 bp, Artificial
  CRISPR gRNA sequence
tcaccaacatgtctcataac

SEQ ID NO: 65951 - DNA, 20 bp, Artificial
  CRISPR gRNA sequence
ataaccttgggctagacctt

SEQ ID NO: 65952 - DNA, 20 bp, Artificial
  CRISPR gRNA sequence
gggctagaccttgattctct

SEQ ID NO: 65953 - DNA, 20 bp, Artificial
  CRISPR gRNA sequence
ggctagaccttgattctctc

SEQ ID NO: 65954 - DNA, 20 bp, Artificial
  CRISPR gRNA sequence
gaccttgattctctctagga

SEQ ID NO: 65955 - DNA, 20 bp, Artificial
  CRISPR gRNA sequence
gattctctctaggactctgt

SEQ ID NO: 65956 - DNA, 20 bp, Artificial
  CRISPR gRNA sequence
attctctctaggactctgtt

SEQ ID NO: 65957 - DNA, 20 bp, Artificial
  CRISPR gRNA sequence
tctctaggactctgtttccc

SEQ ID NO: 65958 - DNA, 20 bp, Artificial
  CRISPR gRNA sequence
tctaggactctgtttcccca

SEQ ID NO: 65959 - DNA, 20 bp, Artificial
  CRISPR gRNA sequence
taggactctgtttccccatc

SEQ ID NO: 65960 - DNA, 20 bp, Artificial
  CRISPR gRNA sequence
ggactctgtttccccatctc

SEQ ID NO: 65961 - DNA, 20 bp, Artificial
  CRISPR gRNA sequence
tgtttccccatctccaccat

SEQ ID NO: 65962 - DNA, 20 bp, Artificial
  CRISPR gRNA sequence
tttccccatctccaccatga

SEQ ID NO: 65963 - DNA, 20 bp, Artificial
  CRISPR gRNA sequence
ccccatctccaccatgagga

SEQ ID NO: 65964 - DNA, 20 bp, Artificial
  CRISPR gRNA sequence
cccatctccaccatgaggac

SEQ ID NO: 65965 - DNA, 20 bp, Artificial
  CRISPR gRNA sequence
caccatgaggacttgcaagg

SEQ ID NO: 65966 - DNA, 20 bp, Artificial
  CRISPR gRNA sequence
gcaaggggtgctctctgacc

SEQ ID NO: 65967 - DNA, 20 bp, Artificial
  CRISPR gRNA sequence
caaggggtgctctctgacca

SEQ ID NO: 65968 - DNA, 20 bp, Artificial
  CRISPR gRNA sequence
tctgaccatcttgggttcag

SEQ ID NO: 65969 - DNA, 20 bp, Artificial
  CRISPR gRNA sequence
tgaccatcttgggttcagtg

SEQ ID NO: 65970 - DNA, 20 bp, Artificial
  CRISPR gRNA sequence
accatcttgggttcagtggg

SEQ ID NO: 65971 - DNA, 20 bp, Artificial
  CRISPR gRNA sequence
gggttcagtgggttccgtca

SEQ ID NO: 65972 - DNA, 20 bp, Artificial
  CRISPR gRNA sequence
ggttcagtgggttccgtcat

SEQ ID NO: 65973 - DNA, 20 bp, Artificial
  CRISPR gRNA sequence
agtgggttccgtcatctgga

SEQ ID NO: 65974 - DNA, 20 bp, Artificial
  CRISPR gRNA sequence
cgtcatctggaaccagggat

SEQ ID NO: 65975 - DNA, 20 bp, Artificial
  CRISPR gRNA sequence
gaaccagggatccctccccc

SEQ ID NO: 65976 - DNA, 20 bp, Artificial
  CRISPR gRNA sequence
ccccgccctgtgccctgacc

SEQ ID NO: 65977 - DNA, 20 bp, Artificial
  CRISPR gRNA sequence
tgccctgaccacaaagagga

SEQ ID NO: 65978 - DNA, 20 bp, Artificial
  CRISPR gRNA sequence
accacaaagaggatgtgttt

SEQ ID NO: 65979 - DNA, 20 bp, Artificial
  CRISPR gRNA sequence
gggtcctgagtgacctccat

SEQ ID NO: 65980 - DNA, 20 bp, Artificial
  CRISPR gRNA sequence
ggtcctgagtgacctccatt

SEQ ID NO: 65981 - DNA, 20 bp, Artificial
  CRISPR gRNA sequence
agtgacctccattgtgccac

SEQ ID NO: 65982 - DNA, 20 bp, Artificial
  CRISPR gRNA sequence
cattgtgccacccctgtgat

SEQ ID NO: 65983 - DNA, 20 bp, Artificial
  CRISPR gRNA sequence
tgccacccctgtgatctcca

SEQ ID NO: 65984 - DNA, 20 bp, Artificial
  CRISPR gRNA sequence
tgatctccagcctcagtgag

SEQ ID NO: 65985 - DNA, 20 bp, Artificial
  CRISPR gRNA sequence
cagcctcagtgagaacggtt

SEQ ID NO: 65986 - DNA, 20 bp, Artificial
  CRISPR gRNA sequence
agtgagaacggtttgtccct

SEQ ID NO: 65987 - DNA, 20 bp, Artificial
  CRISPR gRNA sequence
gtccctggatgccgtgttgg

SEQ ID NO: 65988 - DNA, 20 bp, Artificial
  CRISPR gRNA sequence
tccctggatgccgtgttggg

SEQ ID NO: 65989 - DNA, 20 bp, Artificial
  CRISPR gRNA sequence
gatgccgtgttgggtttggt

SEQ ID NO: 65990 - DNA, 20 bp, Artificial
  CRISPR gRNA sequence
ggtttggttcggtgcttctc

SEQ ID NO: 65991 - DNA, 20 bp, Artificial
  CRISPR gRNA sequence
ggttcggtgcttctccactc

SEQ ID NO: 65992 - DNA, 20 bp, Artificial
  CRISPR gRNA sequence
gttcggtgcttctccactct

SEQ ID NO: 65993 - DNA, 20 bp, Artificial
  CRISPR gRNA sequence
ggtgcttctccactctgcag

SEQ ID NO: 65994 - DNA, 20 bp, Artificial
  CRISPR gRNA sequence
ctccactctgcagtggctct

SEQ ID NO: 65995 - DNA, 20 bp, Artificial
  CRISPR gRNA sequence
tccactctgcagtggctctt

SEQ ID NO: 65996 - DNA, 20 bp, Artificial
  CRISPR gRNA sequence
cactctgcagtggctcttcc

SEQ ID NO: 65997 - DNA, 20 bp, Artificial
  CRISPR gRNA sequence
tgcagtggctcttccgcttg

SEQ ID NO: 65998 - DNA, 20 bp, Artificial
  CRISPR gRNA sequence
cagtggctcttccgcttgga

SEQ ID NO: 65999 - DNA, 20 bp, Artificial
  CRISPR gRNA sequence
ttccgcttggacatcaggtg

SEQ ID NO: 66000 - DNA, 20 bp, Artificial
  CRISPR gRNA sequence
ccgcttggacatcaggtgag

SEQ ID NO: 66001 - DNA, 20 bp, Artificial
  CRISPR gRNA sequence
cgcttggacatcaggtgagc

SEQ ID NO: 66002 - DNA, 20 bp, Artificial
  CRISPR gRNA sequence
ggacatcaggtgagcgtgcc

SEQ ID NO: 66003 - DNA, 20 bp, Artificial
  CRISPR gRNA sequence
gacatcaggtgagcgtgcct

SEQ ID NO: 66004 - DNA, 20 bp, Artificial
  CRISPR gRNA sequence
tccgcccccagccctgcccc

SEQ ID NO: 66005 - DNA, 20 bp, Artificial
  CRISPR gRNA sequence
cgcccccagccctgcccctg

SEQ ID NO: 66006 - DNA, 20 bp, Artificial
  CRISPR gRNA sequence
cccctgtcccccatcccaca

SEQ ID NO: 66007 - DNA, 20 bp, Artificial
  CRISPR gRNA sequence
tcccccatcccacaggtcat

SEQ ID NO: 66008 - DNA, 20 bp, Artificial
  CRISPR gRNA sequence
ctcccacgtgggccccttgt

SEQ ID NO: 66009 - DNA, 20 bp, Artificial
  CRISPR gRNA sequence
ccacgtgggccccttgtcca

SEQ ID NO: 66010 - DNA, 20 bp, Artificial
  CRISPR gRNA sequence
gtccaccagtttcatgccaa

SEQ ID NO: 66011 - DNA, 20 bp, Artificial
  CRISPR gRNA sequence
tccaccagtttcatgccaac

SEQ ID NO: 66012 - DNA, 20 bp, Artificial
  CRISPR gRNA sequence
catgccaacctgtcatcctc

SEQ ID NO: 66013 - DNA, 20 bp, Artificial
  CRISPR gRNA sequence
atgccaacctgtcatcctca

SEQ ID NO: 66014 - DNA, 20 bp, Artificial
  CRISPR gRNA sequence
tcatcctcagcaccttgggc

SEQ ID NO: 66015 - DNA, 20 bp, Artificial
  CRISPR gRNA sequence
agcaccttgggcagtaccag

SEQ ID NO: 66016 - DNA, 20 bp, Artificial
  CRISPR gRNA sequence
gggcagtaccagatctgcag

SEQ ID NO: 66017 - DNA, 20 bp, Artificial
  CRISPR gRNA sequence
ggcagtaccagatctgcaga

SEQ ID NO: 66018 - DNA, 20 bp, Artificial
  CRISPR gRNA sequence
cagagcatgtgatgggcgtc

SEQ ID NO: 66019 - DNA, 20 bp, Artificial
  CRISPR gRNA sequence
aatgaatgaatgatcaaatg

SEQ ID NO: 66020 - DNA, 20 bp, Artificial
  CRISPR gRNA sequence
acggatgctcaaatttctcc

SEQ ID NO: 66021 - DNA, 20 bp, Artificial
  CRISPR gRNA sequence
aaatttctccaaattcacca

SEQ ID NO: 66022 - DNA, 20 bp, Artificial
  CRISPR gRNA sequence
ctccaaattcaccattagag

SEQ ID NO: 66023 - DNA, 20 bp, Artificial
  CRISPR gRNA sequence
tccaaattcaccattagaga

SEQ ID NO: 66024 - DNA, 20 bp, Artificial
  CRISPR gRNA sequence
caaattcaccattagagagt

SEQ ID NO: 66025 - DNA, 20 bp, Artificial
  CRISPR gRNA sequence
accattagagagttcattga

SEQ ID NO: 66026 - DNA, 20 bp, Artificial
  CRISPR gRNA sequence
gagagttcattgactctgcc

SEQ ID NO: 66027 - DNA, 20 bp, Artificial
  CRISPR gRNA sequence
attgactctgcctcactcgt

SEQ ID NO: 66028 - DNA, 20 bp, Artificial
  CRISPR gRNA sequence
actctgcctcactcgttctt

SEQ ID NO: 66029 - DNA, 20 bp, Artificial
  CRISPR gRNA sequence
tgcctcactcgttctttgga

SEQ ID NO: 66030 - DNA, 20 bp, Artificial
  CRISPR gRNA sequence
cctcactcgttctttggata

SEQ ID NO: 66031 - DNA, 20 bp, Artificial
  CRISPR gRNA sequence
actcgttctttggatagtcc

SEQ ID NO: 66032 - DNA, 20 bp, Artificial
  CRISPR gRNA sequence
gttctttggatagtccttag

SEQ ID NO: 66033 - DNA, 20 bp, Artificial
  CRISPR gRNA sequence
tttggatagtccttagagat

SEQ ID NO: 66034 - DNA, 20 bp, Artificial
  CRISPR gRNA sequence
tggatagtccttagagattt

SEQ ID NO: 66035 - DNA, 20 bp, Artificial
  CRISPR gRNA sequence
ggatagtccttagagatttt

SEQ ID NO: 66036 - DNA, 20 bp, Artificial
  CRISPR gRNA sequence
gatagtccttagagattttt

SEQ ID NO: 66037 - DNA, 20 bp, Artificial
  CRISPR gRNA sequence
agagatttttttttttagga

SEQ ID NO: 66038 - DNA, 20 bp, Artificial
  CRISPR gRNA sequence
gagatttttttttttaggat

SEQ ID NO: 66039 - DNA, 20 bp, Artificial
  CRISPR gRNA sequence
ttttttttaggatttttttt

SEQ ID NO: 66040 - DNA, 20 bp, Artificial
  CRISPR gRNA sequence
tttttttaggattttttttt

SEQ ID NO: 66041 - DNA, 20 bp, Artificial
  CRISPR gRNA sequence
ttttttaggatttttttttt

SEQ ID NO: 66042 - DNA, 20 bp, Artificial
  CRISPR gRNA sequence
tttttaggatttttttttta

SEQ ID NO: 66043 - DNA, 20 bp, Artificial
  CRISPR gRNA sequence
ttttaggattttttttttaa

SEQ ID NO: 66044 - DNA, 20 bp, Artificial
  CRISPR gRNA sequence
tttaggattttttttttaat

SEQ ID NO: 66045 - DNA, 20 bp, Artificial
  CRISPR gRNA sequence
ttaggattttttttttaatt

SEQ ID NO: 66046 - DNA, 20 bp, Artificial
  CRISPR gRNA sequence
taggattttttttttaatta

SEQ ID NO: 66047 - DNA, 20 bp, Artificial
  CRISPR gRNA sequence
aggattttttttttaattat

SEQ ID NO: 66048 - DNA, 20 bp, Artificial
  CRISPR gRNA sequence
ggattttttttttaattatt

SEQ ID NO: 66049 - DNA, 20 bp, Artificial
  CRISPR gRNA sequence
tttttttaattattatactt

SEQ ID NO: 66050 - DNA, 20 bp, Artificial
  CRISPR gRNA sequence
ttttttaattattatacttt

SEQ ID NO: 66051 - DNA, 20 bp, Artificial
  CRISPR gRNA sequence
tttttaattattatacttta

SEQ ID NO: 66052 - DNA, 20 bp, Artificial
  CRISPR gRNA sequence
ttttaattattatactttaa

SEQ ID NO: 66053 - DNA, 20 bp, Artificial
  CRISPR gRNA sequence
tttaattattatactttaag

SEQ ID NO: 66054 - DNA, 20 bp, Artificial
  CRISPR gRNA sequence
ttaattattatactttaagt

SEQ ID NO: 66055 - DNA, 20 bp, Artificial
  CRISPR gRNA sequence
taattattatactttaagtt

SEQ ID NO: 66056 - DNA, 20 bp, Artificial
  CRISPR gRNA sequence
aattattatactttaagttc

SEQ ID NO: 66057 - DNA, 20 bp, Artificial
  CRISPR gRNA sequence
attattatactttaagttct

SEQ ID NO: 66058 - DNA, 20 bp, Artificial
  CRISPR gRNA sequence
ttatactttaagttctaggg

SEQ ID NO: 66059 - DNA, 20 bp, Artificial
  CRISPR gRNA sequence
tactttaagttctagggtac

SEQ ID NO: 66060 - DNA, 20 bp, Artificial
  CRISPR gRNA sequence
taagttctagggtacatgtg

SEQ ID NO: 66061 - DNA, 20 bp, Artificial
  CRISPR gRNA sequence
aagttctagggtacatgtgc

SEQ ID NO: 66062 - DNA, 20 bp, Artificial
  CRISPR gRNA sequence
agttctagggtacatgtgca

SEQ ID NO: 66063 - DNA, 20 bp, Artificial
  CRISPR gRNA sequence
tagggtacatgtgcacaaca

SEQ ID NO: 66064 - DNA, 20 bp, Artificial
  CRISPR gRNA sequence
gggtacatgtgcacaacata

SEQ ID NO: 66065 - DNA, 20 bp, Artificial
  CRISPR gRNA sequence
gttacatatgtatacatgtg

SEQ ID NO: 66066 - DNA, 20 bp, Artificial
  CRISPR gRNA sequence
ttacatatgtatacatgtgc

SEQ ID NO: 66067 - DNA, 20 bp, Artificial
  CRISPR gRNA sequence
catatgtatacatgtgccat

SEQ ID NO: 66068 - DNA, 20 bp, Artificial
  CRISPR gRNA sequence
gtatgctgcagagactttta

SEQ ID NO: 66069 - DNA, 20 bp, Artificial
  CRISPR gRNA sequence
cagagacttttaagaaaact

SEQ ID NO: 66070 - DNA, 20 bp, Artificial
  CRISPR gRNA sequence
ttaagaaaactgggggccag

SEQ ID NO: 66071 - DNA, 20 bp, Artificial
  CRISPR gRNA sequence
taagaaaactgggggccagg

SEQ ID NO: 66072 - DNA, 20 bp, Artificial
  CRISPR gRNA sequence
aagaaaactgggggccaggc

SEQ ID NO: 66073 - DNA, 20 bp, Artificial
  CRISPR gRNA sequence
agaaaactgggggccaggcg

SEQ ID NO: 66074 - DNA, 20 bp, Artificial
  CRISPR gRNA sequence
ggggccaggcgcggtggctc

SEQ ID NO: 66075 - DNA, 20 bp, Artificial
  CRISPR gRNA sequence
acgcctgtaatcccagcatt

SEQ ID NO: 66076 - DNA, 20 bp, Artificial
  CRISPR gRNA sequence
taatcccagcattttgggag

SEQ ID NO: 66077 - DNA, 20 bp, Artificial
  CRISPR gRNA sequence
tgggaggccaaggtgggcgg

SEQ ID NO: 66078 - DNA, 20 bp, Artificial
  CRISPR gRNA sequence
gggaggccaaggtgggcgga

SEQ ID NO: 66079 - DNA, 20 bp, Artificial
  CRISPR gRNA sequence
ggaggccaaggtgggcggat

SEQ ID NO: 66080 - DNA, 20 bp, Artificial
  CRISPR gRNA sequence
gagaacagcctggccaacag

SEQ ID NO: 66081 - DNA, 20 bp, Artificial
  CRISPR gRNA sequence
agaacagcctggccaacagg

SEQ ID NO: 66082 - DNA, 20 bp, Artificial
  CRISPR gRNA sequence
gccaacagggtgaaaccctg

SEQ ID NO: 66083 - DNA, 20 bp, Artificial
  CRISPR gRNA sequence
tctctgctaaaaataccaaa

SEQ ID NO: 66084 - DNA, 20 bp, Artificial
  CRISPR gRNA sequence
tgctaaaaataccaaaaaaa

SEQ ID NO: 66085 - DNA, 20 bp, Artificial
  CRISPR gRNA sequence
ctaaaaataccaaaaaaaaa

SEQ ID NO: 66086 - DNA, 20 bp, Artificial
  CRISPR gRNA sequence
aaaataccaaaaaaaaaaaa

SEQ ID NO: 66087 - DNA, 20 bp, Artificial
  CRISPR gRNA sequence
ggcgtggttgtgagcccttg

SEQ ID NO: 66088 - DNA, 20 bp, Artificial
  CRISPR gRNA sequence
tgagcccttgtagtgccagc

SEQ ID NO: 66089 - DNA, 20 bp, Artificial
  CRISPR gRNA sequence
gtagtgccagccgctcagga

SEQ ID NO: 66090 - DNA, 20 bp, Artificial
  CRISPR gRNA sequence
tagtgccagccgctcaggag

SEQ ID NO: 66091 - DNA, 20 bp, Artificial
  CRISPR gRNA sequence
aggagtcaggagaatcactt

SEQ ID NO: 66092 - DNA, 20 bp, Artificial
  CRISPR gRNA sequence
gaacccaggaggcgaaggtt

SEQ ID NO: 66093 - DNA, 20 bp, Artificial
  CRISPR gRNA sequence
aacccaggaggcgaaggttg

SEQ ID NO: 66094 - DNA, 20 bp, Artificial
  CRISPR gRNA sequence
cagtgagctgagatcgtgcc

SEQ ID NO: 66095 - DNA, 20 bp, Artificial
  CRISPR gRNA sequence
agatcgtgccactgcactcc

SEQ ID NO: 66096 - DNA, 20 bp, Artificial
  CRISPR gRNA sequence
cactccagcctgggcgacag

SEQ ID NO: 66097 - DNA, 20 bp, Artificial
  CRISPR gRNA sequence
cagcctgggcgacagagtga

SEQ ID NO: 66098 - DNA, 20 bp, Artificial
  CRISPR gRNA sequence
ggcgacagagtgagactcca

SEQ ID NO: 66099 - DNA, 20 bp, Artificial
  CRISPR gRNA sequence
catctcaaaaaaaaaaagaa

SEQ ID NO: 66100 - DNA, 20 bp, Artificial
  CRISPR gRNA sequence
aaaaaaaaaaagaaaagaaa

SEQ ID NO: 66101 - DNA, 20 bp, Artificial
  CRISPR gRNA sequence
ggagcttcctagttgccact

SEQ ID NO: 66102 - DNA, 20 bp, Artificial
  CRISPR gRNA sequence
cctagttgccactggggact

SEQ ID NO: 66103 - DNA, 20 bp, Artificial
  CRISPR gRNA sequence
ctagttgccactggggactc

SEQ ID NO: 66104 - DNA, 20 bp, Artificial
  CRISPR gRNA sequence
gttgccactggggactcagg

SEQ ID NO: 66105 - DNA, 20 bp, Artificial
  CRISPR gRNA sequence
ccactggggactcagggacc

SEQ ID NO: 66106 - DNA, 20 bp, Artificial
  CRISPR gRNA sequence
gggactcagggacctgtctt

SEQ ID NO: 66107 - DNA, 20 bp, Artificial
  CRISPR gRNA sequence
agggacctgtcttaattgtg

SEQ ID NO: 66108 - DNA, 20 bp, Artificial
  CRISPR gRNA sequence
tcttaattgtgggagctgat

SEQ ID NO: 66109 - DNA, 20 bp, Artificial
  CRISPR gRNA sequence
aattgtgggagctgatgaga

SEQ ID NO: 66110 - DNA, 20 bp, Artificial
  CRISPR gRNA sequence
attgtgggagctgatgagaa

SEQ ID NO: 66111 - DNA, 20 bp, Artificial
  CRISPR gRNA sequence
tgggagctgatgagaatata

SEQ ID NO: 66112 - DNA, 20 bp, Artificial
  CRISPR gRNA sequence
atgagaatataaaaggggag

SEQ ID NO: 66113 - DNA, 20 bp, Artificial
  CRISPR gRNA sequence
agggcaccgcatccatgatt

SEQ ID NO: 66114 - DNA, 20 bp, Artificial
  CRISPR gRNA sequence
tcaggggaggtctgcttccc

SEQ ID NO: 66115 - DNA, 20 bp, Artificial
  CRISPR gRNA sequence
caggggaggtctgcttccct

SEQ ID NO: 66116 - DNA, 20 bp, Artificial
  CRISPR gRNA sequence
aggggaggtctgcttccctt

SEQ ID NO: 66117 - DNA, 20 bp, Artificial
  CRISPR gRNA sequence
cttccctttcccttccctaa

SEQ ID NO: 66118 - DNA, 20 bp, Artificial
  CRISPR gRNA sequence
ccctttcccttccctaagga

SEQ ID NO: 66119 - DNA, 20 bp, Artificial
  CRISPR gRNA sequence
cctttcccttccctaaggac

SEQ ID NO: 66120 - DNA, 20 bp, Artificial
  CRISPR gRNA sequence
tcccttccctaaggaccccc

SEQ ID NO: 66121 - DNA, 20 bp, Artificial
  CRISPR gRNA sequence
cccttccctaaggaccccca

SEQ ID NO: 66122 - DNA, 20 bp, Artificial
  CRISPR gRNA sequence
ccttccctaaggacccccaa

SEQ ID NO: 66123 - DNA, 20 bp, Artificial
  CRISPR gRNA sequence
ccctaaggacccccaagaat

SEQ ID NO: 66124 - DNA, 20 bp, Artificial
  CRISPR gRNA sequence
cctaaggacccccaagaatg

SEQ ID NO: 66125 - DNA, 20 bp, Artificial
  CRISPR gRNA sequence
aggacccccaagaatgggag

SEQ ID NO: 66126 - DNA, 20 bp, Artificial
  CRISPR gRNA sequence
agttacttaactgctgcgag

SEQ ID NO: 66127 - DNA, 20 bp, Artificial
  CRISPR gRNA sequence
cttaactgctgcgagctcag

SEQ ID NO: 66128 - DNA, 20 bp, Artificial
  CRISPR gRNA sequence
aactgctgcgagctcagagc

SEQ ID NO: 66129 - DNA, 20 bp, Artificial
  CRISPR gRNA sequence
actgctgcgagctcagagca

SEQ ID NO: 66130 - DNA, 20 bp, Artificial
  CRISPR gRNA sequence
ctgcgagctcagagcaggtc

SEQ ID NO: 66131 - DNA, 20 bp, Artificial
  CRISPR gRNA sequence
cgagctcagagcaggtccca

SEQ ID NO: 66132 - DNA, 20 bp, Artificial
  CRISPR gRNA sequence
agagcaggtcccagagcctc

SEQ ID NO: 66133 - DNA, 20 bp, Artificial
  CRISPR gRNA sequence
tccaggcctcagtttcctca

SEQ ID NO: 66134 - DNA, 20 bp, Artificial
  CRISPR gRNA sequence
caggcctcagtttcctcatc

SEQ ID NO: 66135 - DNA, 20 bp, Artificial
  CRISPR gRNA sequence
agtttcctcatctgtaaaat

SEQ ID NO: 66136 - DNA, 20 bp, Artificial
  CRISPR gRNA sequence
cctcatctgtaaaatggaga

SEQ ID NO: 66137 - DNA, 20 bp, Artificial
  CRISPR gRNA sequence
ctcatctgtaaaatggagat

SEQ ID NO: 66138 - DNA, 20 bp, Artificial
  CRISPR gRNA sequence
atctgtaaaatggagataag

SEQ ID NO: 66139 - DNA, 20 bp, Artificial
  CRISPR gRNA sequence
taaaatggagataagaataa

SEQ ID NO: 66140 - DNA, 20 bp, Artificial
  CRISPR gRNA sequence
ctggcctggcacagtggctc

SEQ ID NO: 66141 - DNA, 20 bp, Artificial
  CRISPR gRNA sequence
gcctggcacagtggctcaag

SEQ ID NO: 66142 - DNA, 20 bp, Artificial
  CRISPR gRNA sequence
gcacagtggctcaagcctgt

SEQ ID NO: 66143 - DNA, 20 bp, Artificial
  CRISPR gRNA sequence
aagcctgtaatcccagcact

SEQ ID NO: 66144 - DNA, 20 bp, Artificial
  CRISPR gRNA sequence
taatcccagcactttgggag

SEQ ID NO: 66145 - DNA, 20 bp, Artificial
  CRISPR gRNA sequence
tgggaggccaagacaggagg

SEQ ID NO: 66146 - DNA, 20 bp, Artificial
  CRISPR gRNA sequence
gggaggccaagacaggagga

SEQ ID NO: 66147 - DNA, 20 bp, Artificial
  CRISPR gRNA sequence
ggaggccaagacaggaggag

SEQ ID NO: 66148 - DNA, 20 bp, Artificial
  CRISPR gRNA sequence
agcctaggagtttgagacca

SEQ ID NO: 66149 - DNA, 20 bp, Artificial
  CRISPR gRNA sequence
ggagtttgagaccagcctgg

SEQ ID NO: 66150 - DNA, 20 bp, Artificial
  CRISPR gRNA sequence
gagaccagcctggacaacat

SEQ ID NO: 66151 - DNA, 20 bp, Artificial
  CRISPR gRNA sequence
agaccagcctggacaacatg

SEQ ID NO: 66152 - DNA, 20 bp, Artificial
  CRISPR gRNA sequence
gacaacatggtgagaccccc

SEQ ID NO: 66153 - DNA, 20 bp, Artificial
  CRISPR gRNA sequence
tacagaaactttaaaaatta

SEQ ID NO: 66154 - DNA, 20 bp, Artificial
  CRISPR gRNA sequence
cagaaactttaaaaattagc

SEQ ID NO: 66155 - DNA, 20 bp, Artificial
  CRISPR gRNA sequence
taaaaattagccaagcgtga

SEQ ID NO: 66156 - DNA, 20 bp, Artificial
  CRISPR gRNA sequence
aaaaattagccaagcgtgat

SEQ ID NO: 66157 - DNA, 20 bp, Artificial
  CRISPR gRNA sequence
aaaattagccaagcgtgatg

SEQ ID NO: 66158 - DNA, 20 bp, Artificial
  CRISPR gRNA sequence
gccaagcgtgatggcatgca

SEQ ID NO: 66159 - DNA, 20 bp, Artificial
  CRISPR gRNA sequence
cttgggaggctgaggtggga

SEQ ID NO: 66160 - DNA, 20 bp, Artificial
  CRISPR gRNA sequence
gggaggctgaggtgggagga

SEQ ID NO: 66161 - DNA, 20 bp, Artificial
  CRISPR gRNA sequence
ggaggctgaggtgggaggat

SEQ ID NO: 66162 - DNA, 20 bp, Artificial
  CRISPR gRNA sequence
aggtgggaggattgcttaga

SEQ ID NO: 66163 - DNA, 20 bp, Artificial
  CRISPR gRNA sequence
cttagactcaggagatcgag

SEQ ID NO: 66164 - DNA, 20 bp, Artificial
  CRISPR gRNA sequence
agactcaggagatcgaggct

SEQ ID NO: 66165 - DNA, 20 bp, Artificial
  CRISPR gRNA sequence
gactcaggagatcgaggcta

SEQ ID NO: 66166 - DNA, 20 bp, Artificial
  CRISPR gRNA sequence
aggagatcgaggctacagtg

SEQ ID NO: 66167 - DNA, 20 bp, Artificial
  CRISPR gRNA sequence
cagtgagttgtgatcacacc

SEQ ID NO: 66168 - DNA, 20 bp, Artificial
  CRISPR gRNA sequence
tgatcacaccattgcactcc

SEQ ID NO: 66169 - DNA, 20 bp, Artificial
  CRISPR gRNA sequence
cactccagcctgggcaacag

SEQ ID NO: 66170 - DNA, 20 bp, Artificial
  CRISPR gRNA sequence
cagcctgggcaacagagcaa

SEQ ID NO: 66171 - DNA, 20 bp, Artificial
  CRISPR gRNA sequence
ggcaacagagcaagactctg

SEQ ID NO: 66172 - DNA, 20 bp, Artificial
  CRISPR gRNA sequence
tgtctcaaagaaaaaaaaat

SEQ ID NO: 66173 - DNA, 20 bp, Artificial
  CRISPR gRNA sequence
tctcaaagaaaaaaaaatgt

SEQ ID NO: 66174 - DNA, 20 bp, Artificial
  CRISPR gRNA sequence
aaagaaaaaaaaatgtcagg

SEQ ID NO: 66175 - DNA, 20 bp, Artificial
  CRISPR gRNA sequence
acatctgtaattccagcact

SEQ ID NO: 66176 - DNA, 20 bp, Artificial
  CRISPR gRNA sequence
taattccagcactttgggag

SEQ ID NO: 66177 - DNA, 20 bp, Artificial
  CRISPR gRNA sequence
cagcactttgggaggctaag

SEQ ID NO: 66178 - DNA, 20 bp, Artificial
  CRISPR gRNA sequence
tgggaggctaaggcaggagg

SEQ ID NO: 66179 - DNA, 20 bp, Artificial
  CRISPR gRNA sequence
gggaggctaaggcaggagga

SEQ ID NO: 66180 - DNA, 20 bp, Artificial
  CRISPR gRNA sequence
ggaggctaaggcaggaggat

SEQ ID NO: 66181 - DNA, 20 bp, Artificial
  CRISPR gRNA sequence
aggcaggaggatcgtttgag

SEQ ID NO: 66182 - DNA, 20 bp, Artificial
  CRISPR gRNA sequence
gagccatggagtttgagacc

SEQ ID NO: 66183 - DNA, 20 bp, Artificial
  CRISPR gRNA sequence
agccatggagtttgagacca

SEQ ID NO: 66184 - DNA, 20 bp, Artificial
  CRISPR gRNA sequence
gagaccagcctgctcaacat

SEQ ID NO: 66185 - DNA, 20 bp, Artificial
  CRISPR gRNA sequence
agaccagcctgctcaacatg

SEQ ID NO: 66186 - DNA, 20 bp, Artificial
  CRISPR gRNA sequence
ctcaacatggcaaaacccca

SEQ ID NO: 66187 - DNA, 20 bp, Artificial
  CRISPR gRNA sequence
aacatggcaaaaccccatct

SEQ ID NO: 66188 - DNA, 20 bp, Artificial
  CRISPR gRNA sequence
tacaaaaaatacaaaaatta

SEQ ID NO: 66189 - DNA, 20 bp, Artificial
  CRISPR gRNA sequence
caaaaaatacaaaaattaga

SEQ ID NO: 66190 - DNA, 20 bp, Artificial
  CRISPR gRNA sequence
gacagtcatggtggggcgtt

SEQ ID NO: 66191 - DNA, 20 bp, Artificial
  CRISPR gRNA sequence
ctgtagtcccagctacttgg

SEQ ID NO: 66192 - DNA, 20 bp, Artificial
  CRISPR gRNA sequence
tagtcccagctacttgggag

SEQ ID NO: 66193 - DNA, 20 bp, Artificial
  CRISPR gRNA sequence
cttgggaggctgaggcagta

SEQ ID NO: 66194 - DNA, 20 bp, Artificial
  CRISPR gRNA sequence
gggaggctgaggcagtagga

SEQ ID NO: 66195 - DNA, 20 bp, Artificial
  CRISPR gRNA sequence
ggaggctgaggcagtaggat

SEQ ID NO: 66196 - DNA, 20 bp, Artificial
  CRISPR gRNA sequence
aggcagtaggatcagttgag

SEQ ID NO: 66197 - DNA, 20 bp, Artificial
  CRISPR gRNA sequence
agcccggggaaggttgaggc

SEQ ID NO: 66198 - DNA, 20 bp, Artificial
  CRISPR gRNA sequence
aggctgcagtgagccatgac

SEQ ID NO: 66199 - DNA, 20 bp, Artificial
  CRISPR gRNA sequence
cagtgagccatgactgcacc

SEQ ID NO: 66200 - DNA, 20 bp, Artificial
  CRISPR gRNA sequence
caccactgcacaccagcctg

SEQ ID NO: 66201 - DNA, 20 bp, Artificial
  CRISPR gRNA sequence
cacaccagcctgggcgacag

SEQ ID NO: 66202 - DNA, 20 bp, Artificial
  CRISPR gRNA sequence
ggcgacagagcaagaccctt

SEQ ID NO: 66203 - DNA, 20 bp, Artificial
  CRISPR gRNA sequence
tcttcgaaacaacaacaaag

SEQ ID NO: 66204 - DNA, 20 bp, Artificial
  CRISPR gRNA sequence
cttcgaaacaacaacaaaga

SEQ ID NO: 66205 - DNA, 20 bp, Artificial
  CRISPR gRNA sequence
ttcgaaacaacaacaaagaa

SEQ ID NO: 66206 - DNA, 20 bp, Artificial
  CRISPR gRNA sequence
cgaaacaacaacaaagaaga

SEQ ID NO: 66207 - DNA, 20 bp, Artificial
  CRISPR gRNA sequence
gaaacaacaacaaagaagaa

SEQ ID NO: 66208 - DNA, 20 bp, Artificial
  CRISPR gRNA sequence
cttacctcattgtttattgt

SEQ ID NO: 66209 - DNA, 20 bp, Artificial
  CRISPR gRNA sequence
ttacctcattgtttattgtg

SEQ ID NO: 66210 - DNA, 20 bp, Artificial
  CRISPR gRNA sequence
acctcattgtttattgtgag

SEQ ID NO: 66211 - DNA, 20 bp, Artificial
  CRISPR gRNA sequence
cctcattgtttattgtgaga

SEQ ID NO: 66212 - DNA, 20 bp, Artificial
  CRISPR gRNA sequence
attgtttattgtgagaatca

SEQ ID NO: 66213 - DNA, 20 bp, Artificial
  CRISPR gRNA sequence
tttattgtgagaatcaaatg

SEQ ID NO: 66214 - DNA, 20 bp, Artificial
  CRISPR gRNA sequence
attgtgagaatcaaatgaga

SEQ ID NO: 66215 - DNA, 20 bp, Artificial
  CRISPR gRNA sequence
ttgtgagaatcaaatgagaa

SEQ ID NO: 66216 - DNA, 20 bp, Artificial
  CRISPR gRNA sequence
tgagaatcaaatgagaaatg

SEQ ID NO: 66217 - DNA, 20 bp, Artificial
  CRISPR gRNA sequence
tgcatgtgacttgatacatg

SEQ ID NO: 66218 - DNA, 20 bp, Artificial
  CRISPR gRNA sequence
gcatgtgacttgatacatgt

SEQ ID NO: 66219 - DNA, 20 bp, Artificial
  CRISPR gRNA sequence
catgtgacttgatacatgta

SEQ ID NO: 66220 - DNA, 20 bp, Artificial
  CRISPR gRNA sequence
gatacatgtaattgttgctt

SEQ ID NO: 66221 - DNA, 20 bp, Artificial
  CRISPR gRNA sequence
atacatgtaattgttgctta

SEQ ID NO: 66222 - DNA, 20 bp, Artificial
  CRISPR gRNA sequence
ttgcttaatctattccttgt

SEQ ID NO: 66223 - DNA, 20 bp, Artificial
  CRISPR gRNA sequence
cttaatctattccttgtttg

SEQ ID NO: 66224 - DNA, 20 bp, Artificial
  CRISPR gRNA sequence
aatctattccttgtttgcta

SEQ ID NO: 66225 - DNA, 20 bp, Artificial
  CRISPR gRNA sequence
atctattccttgtttgctaa

SEQ ID NO: 66226 - DNA, 20 bp, Artificial
  CRISPR gRNA sequence
ttccttgtttgctaagaaag

SEQ ID NO: 66227 - DNA, 20 bp, Artificial
  CRISPR gRNA sequence
cttgtttgctaagaaagcag

SEQ ID NO: 66228 - DNA, 20 bp, Artificial
  CRISPR gRNA sequence
gtttgctaagaaagcaggcc

SEQ ID NO: 66229 - DNA, 20 bp, Artificial
  CRISPR gRNA sequence
tttgctaagaaagcaggcca

SEQ ID NO: 66230 - DNA, 20 bp, Artificial
  CRISPR gRNA sequence
gctaagaaagcaggccaccc

SEQ ID NO: 66231 - DNA, 20 bp, Artificial
  CRISPR gRNA sequence
ctaagaaagcaggccacccc

SEQ ID NO: 66232 - DNA, 20 bp, Artificial
  CRISPR gRNA sequence
agaaagcaggccaccccagg

SEQ ID NO: 66233 - DNA, 20 bp, Artificial
  CRISPR gRNA sequence
cttgccctgaccagtctggg

SEQ ID NO: 66234 - DNA, 20 bp, Artificial
  CRISPR gRNA sequence
gccctgaccagtctgggttc

SEQ ID NO: 66235 - DNA, 20 bp, Artificial
  CRISPR gRNA sequence
ccctgaccagtctgggttct

SEQ ID NO: 66236 - DNA, 20 bp, Artificial
  CRISPR gRNA sequence
accagtctgggttcttgcca

SEQ ID NO: 66237 - DNA, 20 bp, Artificial
  CRISPR gRNA sequence
ggttcttgccactgccaggg

SEQ ID NO: 66238 - DNA, 20 bp, Artificial
  CRISPR gRNA sequence
ttgccactgccagggaagtt

SEQ ID NO: 66239 - DNA, 20 bp, Artificial
  CRISPR gRNA sequence
gccactgccagggaagttgg

SEQ ID NO: 66240 - DNA, 20 bp, Artificial
  CRISPR gRNA sequence
ccactgccagggaagttggt

SEQ ID NO: 66241 - DNA, 20 bp, Artificial
  CRISPR gRNA sequence
ccagggaagttggtctttga

SEQ ID NO: 66242 - DNA, 20 bp, Artificial
  CRISPR gRNA sequence
gtctttgaccattttcaaac

SEQ ID NO: 66243 - DNA, 20 bp, Artificial
  CRISPR gRNA sequence
tgaccattttcaaactgctg

SEQ ID NO: 66244 - DNA, 20 bp, Artificial
  CRISPR gRNA sequence
gaccattttcaaactgctgc

SEQ ID NO: 66245 - DNA, 20 bp, Artificial
  CRISPR gRNA sequence
accattttcaaactgctgct

SEQ ID NO: 66246 - DNA, 20 bp, Artificial
  CRISPR gRNA sequence
tcaaactgctgcttcctctc

SEQ ID NO: 66247 - DNA, 20 bp, Artificial
  CRISPR gRNA sequence
caaactgctgcttcctctct

SEQ ID NO: 66248 - DNA, 20 bp, Artificial
  CRISPR gRNA sequence
aaactgctgcttcctctctg

SEQ ID NO: 66249 - DNA, 20 bp, Artificial
  CRISPR gRNA sequence
ctgcttcctctctgcttcca

SEQ ID NO: 66250 - DNA, 20 bp, Artificial
  CRISPR gRNA sequence
cttcctctctgcttccagct

SEQ ID NO: 66251 - DNA, 20 bp, Artificial
  CRISPR gRNA sequence
cctctctgcttccagctttg

SEQ ID NO: 66252 - DNA, 20 bp, Artificial
  CRISPR gRNA sequence
ctctctgcttccagctttga

SEQ ID NO: 66253 - DNA, 20 bp, Artificial
  CRISPR gRNA sequence
tctgcttccagctttgaaag

SEQ ID NO: 66254 - DNA, 20 bp, Artificial
  CRISPR gRNA sequence
tgcttccagctttgaaagcc

SEQ ID NO: 66255 - DNA, 20 bp, Artificial
  CRISPR gRNA sequence
cttccagctttgaaagccaa

SEQ ID NO: 66256 - DNA, 20 bp, Artificial
  CRISPR gRNA sequence
ccagctttgaaagccaacac

SEQ ID NO: 66257 - DNA, 20 bp, Artificial
  CRISPR gRNA sequence
cagctttgaaagccaacaca

SEQ ID NO: 66258 - DNA, 20 bp, Artificial
  CRISPR gRNA sequence
tgaaagccaacacatcctcc

SEQ ID NO: 66259 - DNA, 20 bp, Artificial
  CRISPR gRNA sequence
gaaagccaacacatcctcct

SEQ ID NO: 66260 - DNA, 20 bp, Artificial
  CRISPR gRNA sequence
aaagccaacacatcctcctg

SEQ ID NO: 66261 - DNA, 20 bp, Artificial
  CRISPR gRNA sequence
ctgagaggggacaagacaag

SEQ ID NO: 66262 - DNA, 20 bp, Artificial
  CRISPR gRNA sequence
agaggggacaagacaagcag

SEQ ID NO: 66263 - DNA, 20 bp, Artificial
  CRISPR gRNA sequence
ggggtgggggagtcccctcc

SEQ ID NO: 66264 - DNA, 20 bp, Artificial
  CRISPR gRNA sequence
ccgctctggtccccgtctgt

SEQ ID NO: 66265 - DNA, 20 bp, Artificial
  CRISPR gRNA sequence
tggtccccgtctgttggagg

SEQ ID NO: 66266 - DNA, 20 bp, Artificial
  CRISPR gRNA sequence
gtccccgtctgttggaggtc

SEQ ID NO: 66267 - DNA, 20 bp, Artificial
  CRISPR gRNA sequence
ttggaggtccccccaccccc

SEQ ID NO: 66268 - DNA, 20 bp, Artificial
  CRISPR gRNA sequence
gaggtccccccacccccaga

SEQ ID NO: 66269 - DNA, 20 bp, Artificial
  CRISPR gRNA sequence
accactcagctctcagttaa

SEQ ID NO: 66270 - DNA, 20 bp, Artificial
  CRISPR gRNA sequence
agctctcagttaaaccaccc

SEQ ID NO: 66271 - DNA, 20 bp, Artificial
  CRISPR gRNA sequence
tcagttaaaccacccaagtc

SEQ ID NO: 66272 - DNA, 20 bp, Artificial
  CRISPR gRNA sequence
agttaaaccacccaagtccg

SEQ ID NO: 66273 - DNA, 20 bp, Artificial
  CRISPR gRNA sequence
aaccacccaagtccggcaca

SEQ ID NO: 66274 - DNA, 20 bp, Artificial
  CRISPR gRNA sequence
ggtttaatcaccacttcagt

SEQ ID NO: 66275 - DNA, 20 bp, Artificial
  CRISPR gRNA sequence
aatcaccacttcagtaacca

SEQ ID NO: 66276 - DNA, 20 bp, Artificial
  CRISPR gRNA sequence
atcaccacttcagtaaccac

SEQ ID NO: 66277 - DNA, 20 bp, Artificial
  CRISPR gRNA sequence
cagtaaccaccgcccccccc

SEQ ID NO: 66278 - DNA, 20 bp, Artificial
  CRISPR gRNA sequence
agtaaccaccgcccccccca

SEQ ID NO: 66279 - DNA, 20 bp, Artificial
  CRISPR gRNA sequence
tcagtaatcaactgccctgt

SEQ ID NO: 66280 - DNA, 20 bp, Artificial
  CRISPR gRNA sequence
ccctgttttccccttggaag

SEQ ID NO: 66281 - DNA, 20 bp, Artificial
  CRISPR gRNA sequence
ttttccccttggaaggaggc

SEQ ID NO: 66282 - DNA, 20 bp, Artificial
  CRISPR gRNA sequence
tccccttggaaggaggcaat

SEQ ID NO: 66283 - DNA, 20 bp, Artificial
  CRISPR gRNA sequence
ccccttggaaggaggcaatg

SEQ ID NO: 66284 - DNA, 20 bp, Artificial
  CRISPR gRNA sequence
cccttggaaggaggcaatgc

SEQ ID NO: 66285 - DNA, 20 bp, Artificial
  CRISPR gRNA sequence
ggaaggaggcaatgcagatg

SEQ ID NO: 66286 - DNA, 20 bp, Artificial
  CRISPR gRNA sequence
gaaggaggcaatgcagatgg

SEQ ID NO: 66287 - DNA, 20 bp, Artificial
  CRISPR gRNA sequence
ggagaggtcccagagcaggg

SEQ ID NO: 66288 - DNA, 20 bp, Artificial
  CRISPR gRNA sequence
ctgctgtgtgggaggagaca

SEQ ID NO: 66289 - DNA, 20 bp, Artificial
  CRISPR gRNA sequence
ctgtgtgggaggagacagga

SEQ ID NO: 66290 - DNA, 20 bp, Artificial
  CRISPR gRNA sequence
tgtgggaggagacaggagaa

SEQ ID NO: 66291 - DNA, 20 bp, Artificial
  CRISPR gRNA sequence
gtgcttctgcgtttcgggga

SEQ ID NO: 66292 - DNA, 20 bp, Artificial
  CRISPR gRNA sequence
tgcttctgcgtttcggggaa

SEQ ID NO: 66293 - DNA, 20 bp, Artificial
  CRISPR gRNA sequence
ctgcgtttcggggaattttg

SEQ ID NO: 66294 - DNA, 20 bp, Artificial
  CRISPR gRNA sequence
tgcgtttcggggaattttgt

SEQ ID NO: 66295 - DNA, 20 bp, Artificial
  CRISPR gRNA sequence
cgtttcggggaattttgtag

SEQ ID NO: 66296 - DNA, 20 bp, Artificial
  CRISPR gRNA sequence
cggggaattttgtagaccca

SEQ ID NO: 66297 - DNA, 20 bp, Artificial
  CRISPR gRNA sequence
ggggaattttgtagacccac

SEQ ID NO: 66298 - DNA, 20 bp, Artificial
  CRISPR gRNA sequence
tgtagacccaccgctccata

SEQ ID NO: 66299 - DNA, 20 bp, Artificial
  CRISPR gRNA sequence
gtagacccaccgctccatac

SEQ ID NO: 66300 - DNA, 20 bp, Artificial
  CRISPR gRNA sequence
tagacccaccgctccataca

SEQ ID NO: 66301 - DNA, 20 bp, Artificial
  CRISPR gRNA sequence
catacatgtcactgcccttt

SEQ ID NO: 66302 - DNA, 20 bp, Artificial
  CRISPR gRNA sequence
ccctttcacgctctgaaggc

SEQ ID NO: 66303 - DNA, 20 bp, Artificial
  CRISPR gRNA sequence
tcacgctctgaaggcagggg

SEQ ID NO: 66304 - DNA, 20 bp, Artificial
  CRISPR gRNA sequence
cacgctctgaaggcaggggc

SEQ ID NO: 66305 - DNA, 20 bp, Artificial
  CRISPR gRNA sequence
acgctctgaaggcaggggcc

SEQ ID NO: 66306 - DNA, 20 bp, Artificial
  CRISPR gRNA sequence
tgaaggcaggggccgtgggt

SEQ ID NO: 66307 - DNA, 20 bp, Artificial
  CRISPR gRNA sequence
aaggcaggggccgtgggtgc

SEQ ID NO: 66308 - DNA, 20 bp, Artificial
  CRISPR gRNA sequence
tgaaaaaacattttccccgt

SEQ ID NO: 66309 - DNA, 20 bp, Artificial
  CRISPR gRNA sequence
aaaaaacattttccccgtct

SEQ ID NO: 66310 - DNA, 20 bp, Artificial
  CRISPR gRNA sequence
tccccgtcttcgcagtaaac

SEQ ID NO: 66311 - DNA, 20 bp, Artificial
  CRISPR gRNA sequence
ccccgtcttcgcagtaaaca

SEQ ID NO: 66312 - DNA, 20 bp, Artificial
  CRISPR gRNA sequence
cccgtcttcgcagtaaacaa

SEQ ID NO: 66313 - DNA, 20 bp, Artificial
  CRISPR gRNA sequence
cgcagtaaacaaccaatact

SEQ ID NO: 66314 - DNA, 20 bp, Artificial
  CRISPR gRNA sequence
gcagtaaacaaccaatacta

SEQ ID NO: 66315 - DNA, 20 bp, Artificial
  CRISPR gRNA sequence
gtttagctcttcatgatgtt

SEQ ID NO: 66316 - DNA, 20 bp, Artificial
  CRISPR gRNA sequence
agctcttcatgatgttcccg

SEQ ID NO: 66317 - DNA, 20 bp, Artificial
  CRISPR gRNA sequence
gctcttcatgatgttcccgg

SEQ ID NO: 66318 - DNA, 20 bp, Artificial
  CRISPR gRNA sequence
ttcatgatgttcccggctgc

SEQ ID NO: 66319 - DNA, 20 bp, Artificial
  CRISPR gRNA sequence
catgatgttcccggctgccc

SEQ ID NO: 66320 - DNA, 20 bp, Artificial
  CRISPR gRNA sequence
atgatgttcccggctgccct

SEQ ID NO: 66321 - DNA, 20 bp, Artificial
  CRISPR gRNA sequence
ccggctgccctctagtggga

SEQ ID NO: 66322 - DNA, 20 bp, Artificial
  CRISPR gRNA sequence
ccctctagtgggaccaggcc

SEQ ID NO: 66323 - DNA, 20 bp, Artificial
  CRISPR gRNA sequence
tagtgggaccaggcctcttg

SEQ ID NO: 66324 - DNA, 20 bp, Artificial
  CRISPR gRNA sequence
gtgggaccaggcctcttggc

SEQ ID NO: 66325 - DNA, 20 bp, Artificial
  CRISPR gRNA sequence
ttggcctcacttgggagcag

SEQ ID NO: 66326 - DNA, 20 bp, Artificial
  CRISPR gRNA sequence
ggcctcacttgggagcagtg

SEQ ID NO: 66327 - DNA, 20 bp, Artificial
  CRISPR gRNA sequence
gcctcacttgggagcagtgg

SEQ ID NO: 66328 - DNA, 20 bp, Artificial
  CRISPR gRNA sequence
acttgggagcagtggcagcg

SEQ ID NO: 66329 - DNA, 20 bp, Artificial
  CRISPR gRNA sequence
gggagcagtggcagcggaca

SEQ ID NO: 66330 - DNA, 20 bp, Artificial
  CRISPR gRNA sequence
ggagcagtggcagcggacag

SEQ ID NO: 66331 - DNA, 20 bp, Artificial
  CRISPR gRNA sequence
gctgggtggagagagtcaca

SEQ ID NO: 66332 - DNA, 20 bp, Artificial
  CRISPR gRNA sequence
ggtggagagagtcacagcta

SEQ ID NO: 66333 - DNA, 20 bp, Artificial
  CRISPR gRNA sequence
gtgtgtcaagaaaaggcact

SEQ ID NO: 66334 - DNA, 20 bp, Artificial
  CRISPR gRNA sequence
ccgtacagatgggctgtcag

SEQ ID NO: 66335 - DNA, 20 bp, Artificial
  CRISPR gRNA sequence
tcaggagtcaggggtggctc

SEQ ID NO: 66336 - DNA, 20 bp, Artificial
  CRISPR gRNA sequence
aagcctgggtggtcttgctt

SEQ ID NO: 66337 - DNA, 20 bp, Artificial
  CRISPR gRNA sequence
ggtggtcttgcttcccagga

SEQ ID NO: 66338 - DNA, 20 bp, Artificial
  CRISPR gRNA sequence
gcttcccaggataggatctc

SEQ ID NO: 66339 - DNA, 20 bp, Artificial
  CRISPR gRNA sequence
cttcccaggataggatctct

SEQ ID NO: 66340 - DNA, 20 bp, Artificial
  CRISPR gRNA sequence
cccaggataggatctctgtt

SEQ ID NO: 66341 - DNA, 20 bp, Artificial
  CRISPR gRNA sequence
ccaggataggatctctgttt

SEQ ID NO: 66342 - DNA, 20 bp, Artificial
  CRISPR gRNA sequence
tgtttctggggaacccccgg

SEQ ID NO: 66343 - DNA, 20 bp, Artificial
  CRISPR gRNA sequence
tttctggggaacccccgggt

SEQ ID NO: 66344 - DNA, 20 bp, Artificial
  CRISPR gRNA sequence
ctggggaacccccgggttct

SEQ ID NO: 66345 - DNA, 20 bp, Artificial
  CRISPR gRNA sequence
tggggaacccccgggttctt

SEQ ID NO: 66346 - DNA, 20 bp, Artificial
  CRISPR gRNA sequence
gggaacccccgggttcttga

SEQ ID NO: 66347 - DNA, 20 bp, Artificial
  CRISPR gRNA sequence
ttgaggcccaaagaactgac

SEQ ID NO: 66348 - DNA, 20 bp, Artificial
  CRISPR gRNA sequence
gaggcccaaagaactgacgt

SEQ ID NO: 66349 - DNA, 20 bp, Artificial
  CRISPR gRNA sequence
aggcccaaagaactgacgta

SEQ ID NO: 66350 - DNA, 20 bp, Artificial
  CRISPR gRNA sequence
acgtacagggaggcagaagt

SEQ ID NO: 66351 - DNA, 20 bp, Artificial
  CRISPR gRNA sequence
tgtcttgggtcctcctgcct

SEQ ID NO: 66352 - DNA, 20 bp, Artificial
  CRISPR gRNA sequence
tcttgggtcctcctgcctgc

SEQ ID NO: 66353 - DNA, 20 bp, Artificial
  CRISPR gRNA sequence
gggtcctcctgcctgctcac

SEQ ID NO: 66354 - DNA, 20 bp, Artificial
  CRISPR gRNA sequence
ggtcctcctgcctgctcacc

SEQ ID NO: 66355 - DNA, 20 bp, Artificial
  CRISPR gRNA sequence
ctgcctgctcacctggacag

SEQ ID NO: 66356 - DNA, 20 bp, Artificial
  CRISPR gRNA sequence
cctgctcacctggacaggaa

SEQ ID NO: 66357 - DNA, 20 bp, Artificial
  CRISPR gRNA sequence
ctcacctggacaggaacaag

SEQ ID NO: 66358 - DNA, 20 bp, Artificial
  CRISPR gRNA sequence
acctggacaggaacaagctg

SEQ ID NO: 66359 - DNA, 20 bp, Artificial
  CRISPR gRNA sequence
gacaggaacaagctgctggc

SEQ ID NO: 66360 - DNA, 20 bp, Artificial
  CRISPR gRNA sequence
ctggcttttctaactcaggc

SEQ ID NO: 66361 - DNA, 20 bp, Artificial
  CRISPR gRNA sequence
gcttttctaactcaggcttc

SEQ ID NO: 66362 - DNA, 20 bp, Artificial
  CRISPR gRNA sequence
ttctaactcaggcttccctt

SEQ ID NO: 66363 - DNA, 20 bp, Artificial
  CRISPR gRNA sequence
tctaactcaggcttcccttc

SEQ ID NO: 66364 - DNA, 20 bp, Artificial
  CRISPR gRNA sequence
ctaactcaggcttcccttcc

SEQ ID NO: 66365 - DNA, 20 bp, Artificial
  CRISPR gRNA sequence
taactcaggcttcccttccc

SEQ ID NO: 66366 - DNA, 20 bp, Artificial
  CRISPR gRNA sequence
actcaggcttcccttccctg

SEQ ID NO: 66367 - DNA, 20 bp, Artificial
  CRISPR gRNA sequence
aggcttcccttccctgagcc

SEQ ID NO: 66368 - DNA, 20 bp, Artificial
  CRISPR gRNA sequence
cccttccctgagcctcagtt

SEQ ID NO: 66369 - DNA, 20 bp, Artificial
  CRISPR gRNA sequence
ccttccctgagcctcagttt

SEQ ID NO: 66370 - DNA, 20 bp, Artificial
  CRISPR gRNA sequence
ccctgagcctcagtttcccc

SEQ ID NO: 66371 - DNA, 20 bp, Artificial
  CRISPR gRNA sequence
cctgagcctcagtttcccca

SEQ ID NO: 66372 - DNA, 20 bp, Artificial
  CRISPR gRNA sequence
agcctcagtttccccatctg

SEQ ID NO: 66373 - DNA, 20 bp, Artificial
  CRISPR gRNA sequence
agtttccccatctgaacaat

SEQ ID NO: 66374 - DNA, 20 bp, Artificial
  CRISPR gRNA sequence
ccccatctgaacaatgaggg

SEQ ID NO: 66375 - DNA, 20 bp, Artificial
  CRISPR gRNA sequence
cccatctgaacaatgaggga

SEQ ID NO: 66376 - DNA, 20 bp, Artificial
  CRISPR gRNA sequence
aacaatgagggactgagcta

SEQ ID NO: 66377 - DNA, 20 bp, Artificial
  CRISPR gRNA sequence
agctaggatctagtgactgc

SEQ ID NO: 66378 - DNA, 20 bp, Artificial
  CRISPR gRNA sequence
ggatctagtgactgcattgt

SEQ ID NO: 66379 - DNA, 20 bp, Artificial
  CRISPR gRNA sequence
gtgactgcattgtctctgag

SEQ ID NO: 66380 - DNA, 20 bp, Artificial
  CRISPR gRNA sequence
cattgtctctgagatgcctt

SEQ ID NO: 66381 - DNA, 20 bp, Artificial
  CRISPR gRNA sequence
tctctgagatgccttccagc

SEQ ID NO: 66382 - DNA, 20 bp, Artificial
  CRISPR gRNA sequence
tgagatgccttccagccctg

SEQ ID NO: 66383 - DNA, 20 bp, Artificial
  CRISPR gRNA sequence
agatgccttccagccctgac

SEQ ID NO: 66384 - DNA, 20 bp, Artificial
  CRISPR gRNA sequence
ccagccctgactttccaagt

SEQ ID NO: 66385 - DNA, 20 bp, Artificial
  CRISPR gRNA sequence
cagccctgactttccaagtc

SEQ ID NO: 66386 - DNA, 20 bp, Artificial
  CRISPR gRNA sequence
actttccaagtctgggagtc

SEQ ID NO: 66387 - DNA, 20 bp, Artificial
  CRISPR gRNA sequence
tccaagtctgggagtccaat

SEQ ID NO: 66388 - DNA, 20 bp, Artificial
  CRISPR gRNA sequence
ccaagtctgggagtccaatg

SEQ ID NO: 66389 - DNA, 20 bp, Artificial
  CRISPR gRNA sequence
caagtctgggagtccaatgt

SEQ ID NO: 66390 - DNA, 20 bp, Artificial
  CRISPR gRNA sequence
ggagtccaatgtgggtgatc

SEQ ID NO: 66391 - DNA, 20 bp, Artificial
  CRISPR gRNA sequence
aactttcctttctaaacgat

SEQ ID NO: 66392 - DNA, 20 bp, Artificial
  CRISPR gRNA sequence
tcctttctaaacgatccccc

SEQ ID NO: 66393 - DNA, 20 bp, Artificial
  CRISPR gRNA sequence
cctttctaaacgatccccct

SEQ ID NO: 66394 - DNA, 20 bp, Artificial
  CRISPR gRNA sequence
ctttctaaacgatccccctc

SEQ ID NO: 66395 - DNA, 20 bp, Artificial
  CRISPR gRNA sequence
tctaaacgatccccctccta

SEQ ID NO: 66396 - DNA, 20 bp, Artificial
  CRISPR gRNA sequence
ctaaacgatccccctcctag

SEQ ID NO: 66397 - DNA, 20 bp, Artificial
  CRISPR gRNA sequence
taaacgatccccctcctagg

SEQ ID NO: 66398 - DNA, 20 bp, Artificial
  CRISPR gRNA sequence
aacgatccccctcctagggg

SEQ ID NO: 66399 - DNA, 20 bp, Artificial
  CRISPR gRNA sequence
ctaggggtatatgggctggg

SEQ ID NO: 66400 - DNA, 20 bp, Artificial
  CRISPR gRNA sequence
ggggtatatgggctgggctg

SEQ ID NO: 66401 - DNA, 20 bp, Artificial
  CRISPR gRNA sequence
ggctgggagtccgagggggt

SEQ ID NO: 66402 - DNA, 20 bp, Artificial
  CRISPR gRNA sequence
ggagtccgagggggtgatct

SEQ ID NO: 66403 - DNA, 20 bp, Artificial
  CRISPR gRNA sequence
aactttcctttctaaatgat

SEQ ID NO: 66404 - DNA, 20 bp, Artificial
  CRISPR gRNA sequence
tcctttctaaatgatccccc

SEQ ID NO: 66405 - DNA, 20 bp, Artificial
  CRISPR gRNA sequence
cctttctaaatgatccccct

SEQ ID NO: 66406 - DNA, 20 bp, Artificial
  CRISPR gRNA sequence
ctttctaaatgatccccctc

SEQ ID NO: 66407 - DNA, 20 bp, Artificial
  CRISPR gRNA sequence
tctaaatgatccccctccta

SEQ ID NO: 66408 - DNA, 20 bp, Artificial
  CRISPR gRNA sequence
ctaaatgatccccctcctag

SEQ ID NO: 66409 - DNA, 20 bp, Artificial
  CRISPR gRNA sequence
taaatgatccccctcctagg

SEQ ID NO: 66410 - DNA, 20 bp, Artificial
  CRISPR gRNA sequence
aatgatccccctcctaggga

SEQ ID NO: 66411 - DNA, 20 bp, Artificial
  CRISPR gRNA sequence
ctagggatatgtgggccact

SEQ ID NO: 66412 - DNA, 20 bp, Artificial
  CRISPR gRNA sequence
gggatatgtgggccactgga

SEQ ID NO: 66413 - DNA, 20 bp, Artificial
  CRISPR gRNA sequence
gatctttgccagacttccca

SEQ ID NO: 66414 - DNA, 20 bp, Artificial
  CRISPR gRNA sequence
tgccagacttcccagctgca

SEQ ID NO: 66415 - DNA, 20 bp, Artificial
  CRISPR gRNA sequence
gccagacttcccagctgcag

SEQ ID NO: 66416 - DNA, 20 bp, Artificial
  CRISPR gRNA sequence
ccagacttcccagctgcagc

SEQ ID NO: 66417 - DNA, 20 bp, Artificial
  CRISPR gRNA sequence
cccagctgcagccaagttct

SEQ ID NO: 66418 - DNA, 20 bp, Artificial
  CRISPR gRNA sequence
ccagctgcagccaagttctt

SEQ ID NO: 66419 - DNA, 20 bp, Artificial
  CRISPR gRNA sequence
cagccaagttcttagggttc

SEQ ID NO: 66420 - DNA, 20 bp, Artificial
  CRISPR gRNA sequence
ttagggttccgtcagcgctg

SEQ ID NO: 66421 - DNA, 20 bp, Artificial
  CRISPR gRNA sequence
agggttccgtcagcgctgca

SEQ ID NO: 66422 - DNA, 20 bp, Artificial
  CRISPR gRNA sequence
gggttccgtcagcgctgcat

SEQ ID NO: 66423 - DNA, 20 bp, Artificial
  CRISPR gRNA sequence
cgtcagcgctgcatccccag

SEQ ID NO: 66424 - DNA, 20 bp, Artificial
  CRISPR gRNA sequence
catccccaggagcctctggt

SEQ ID NO: 66425 - DNA, 20 bp, Artificial
  CRISPR gRNA sequence
tggtactgtcccagcccttc

SEQ ID NO: 66426 - DNA, 20 bp, Artificial
  CRISPR gRNA sequence
gtactgtcccagcccttctt

SEQ ID NO: 66427 - DNA, 20 bp, Artificial
  CRISPR gRNA sequence
tcccagcccttcttgtttgg

SEQ ID NO: 66428 - DNA, 20 bp, Artificial
  CRISPR gRNA sequence
cttgtttgggggtaaccata

SEQ ID NO: 66429 - DNA, 20 bp, Artificial
  CRISPR gRNA sequence
ttgtttgggggtaaccataa

SEQ ID NO: 66430 - DNA, 20 bp, Artificial
  CRISPR gRNA sequence
gtttgggggtaaccataata

SEQ ID NO: 66431 - DNA, 20 bp, Artificial
  CRISPR gRNA sequence
tttgggggtaaccataatag

SEQ ID NO: 66432 - DNA, 20 bp, Artificial
  CRISPR gRNA sequence
gggggtaaccataataggga

SEQ ID NO: 66433 - DNA, 20 bp, Artificial
  CRISPR gRNA sequence
ggggtaaccataatagggat

SEQ ID NO: 66434 - DNA, 20 bp, Artificial
  CRISPR gRNA sequence
gcagggggctagggctgggg

SEQ ID NO: 66435 - DNA, 20 bp, Artificial
  CRISPR gRNA sequence
gggctggggattgggataga

SEQ ID NO: 66436 - DNA, 20 bp, Artificial
  CRISPR gRNA sequence
gggattgggatagagggaag

SEQ ID NO: 66437 - DNA, 20 bp, Artificial
  CRISPR gRNA sequence
ggatagagggaagagaggga

SEQ ID NO: 66438 - DNA, 20 bp, Artificial
  CRISPR gRNA sequence
aagagaaaaggaaaagaaag

SEQ ID NO: 66439 - DNA, 20 bp, Artificial
  CRISPR gRNA sequence
agagaaaaggaaaagaaaga

SEQ ID NO: 66440 - DNA, 20 bp, Artificial
  CRISPR gRNA sequence
ggagttggggagctctggcc

SEQ ID NO: 66441 - DNA, 20 bp, Artificial
  CRISPR gRNA sequence
gggagctctggcccctgacg

SEQ ID NO: 66442 - DNA, 20 bp, Artificial
  CRISPR gRNA sequence
tggcccctgacgggcagctc

SEQ ID NO: 66443 - DNA, 20 bp, Artificial
  CRISPR gRNA sequence
gcccctgacgggcagctcag

SEQ ID NO: 66444 - DNA, 20 bp, Artificial
  CRISPR gRNA sequence
acgggcagctcagctggccc

SEQ ID NO: 66445 - DNA, 20 bp, Artificial
  CRISPR gRNA sequence
agctggcccatgccccgcat

SEQ ID NO: 66446 - DNA, 20 bp, Artificial
  CRISPR gRNA sequence
gcccatgccccgcattctcc

SEQ ID NO: 66447 - DNA, 20 bp, Artificial
  CRISPR gRNA sequence
tccttggagagaagattcca

SEQ ID NO: 66448 - DNA, 20 bp, Artificial
  CRISPR gRNA sequence
cttggagagaagattccaca

SEQ ID NO: 66449 - DNA, 20 bp, Artificial
  CRISPR gRNA sequence
ggagagaagattccacattt

SEQ ID NO: 66450 - DNA, 20 bp, Artificial
  CRISPR gRNA sequence
gagagaagattccacatttc

SEQ ID NO: 66451 - DNA, 20 bp, Artificial
  CRISPR gRNA sequence
cacatttctgtgaagcaaac

SEQ ID NO: 66452 - DNA, 20 bp, Artificial
  CRISPR gRNA sequence
ctgtgaagcaaacagagcag

SEQ ID NO: 66453 - DNA, 20 bp, Artificial
  CRISPR gRNA sequence
tgtgaagcaaacagagcagc

SEQ ID NO: 66454 - DNA, 20 bp, Artificial
  CRISPR gRNA sequence
tgaagcaaacagagcagctc

SEQ ID NO: 66455 - DNA, 20 bp, Artificial
  CRISPR gRNA sequence
agccactccctgcctggggt

SEQ ID NO: 66456 - DNA, 20 bp, Artificial
  CRISPR gRNA sequence
cctgcctggggtctccatct

SEQ ID NO: 66457 - DNA, 20 bp, Artificial
  CRISPR gRNA sequence
cctggggtctccatctgctc

SEQ ID NO: 66458 - DNA, 20 bp, Artificial
  CRISPR gRNA sequence
gggtctccatctgctctggg

SEQ ID NO: 66459 - DNA, 20 bp, Artificial
  CRISPR gRNA sequence
catctgctctgggggacacc

SEQ ID NO: 66460 - DNA, 20 bp, Artificial
  CRISPR gRNA sequence
ctctgggggacacccacttt

SEQ ID NO: 66461 - DNA, 20 bp, Artificial
  CRISPR gRNA sequence
tgggggacacccactttcca

SEQ ID NO: 66462 - DNA, 20 bp, Artificial
  CRISPR gRNA sequence
ggggacacccactttccaga

SEQ ID NO: 66463 - DNA, 20 bp, Artificial
  CRISPR gRNA sequence
tccagaaagaaaggggttgg

SEQ ID NO: 66464 - DNA, 20 bp, Artificial
  CRISPR gRNA sequence
ccagaaagaaaggggttggc

SEQ ID NO: 66465 - DNA, 20 bp, Artificial
  CRISPR gRNA sequence
cagaaagaaaggggttggcc

SEQ ID NO: 66466 - DNA, 20 bp, Artificial
  CRISPR gRNA sequence
gcctgtctccccactaatac

SEQ ID NO: 66467 - DNA, 20 bp, Artificial
  CRISPR gRNA sequence
tctccccactaatacactcc

SEQ ID NO: 66468 - DNA, 20 bp, Artificial
  CRISPR gRNA sequence
cccactaatacactccccat

SEQ ID NO: 66469 - DNA, 20 bp, Artificial
  CRISPR gRNA sequence
atacactccccatctgcaag

SEQ ID NO: 66470 - DNA, 20 bp, Artificial
  CRISPR gRNA sequence
cccatctgcaagctctgcca

SEQ ID NO: 66471 - DNA, 20 bp, Artificial
  CRISPR gRNA sequence
caagctctgccatgagaggc

SEQ ID NO: 66472 - DNA, 20 bp, Artificial
  CRISPR gRNA sequence
tgccatgagaggctgtgaga

SEQ ID NO: 66473 - DNA, 20 bp, Artificial
  CRISPR gRNA sequence
ccatgagaggctgtgagacc

SEQ ID NO: 66474 - DNA, 20 bp, Artificial
  CRISPR gRNA sequence
tgagaccctgacttggcccc

SEQ ID NO: 66475 - DNA, 20 bp, Artificial
  CRISPR gRNA sequence
acttggccccacctctctct

SEQ ID NO: 66476 - DNA, 20 bp, Artificial
  CRISPR gRNA sequence
ggccccacctctctctaggc

SEQ ID NO: 66477 - DNA, 20 bp, Artificial
  CRISPR gRNA sequence
gccccacctctctctaggcc

SEQ ID NO: 66478 - DNA, 20 bp, Artificial
  CRISPR gRNA sequence
tctctaggcctccagggaag

SEQ ID NO: 66479 - DNA, 20 bp, Artificial
  CRISPR gRNA sequence
tctaggcctccagggaagtg

SEQ ID NO: 66480 - DNA, 20 bp, Artificial
  CRISPR gRNA sequence
taggcctccagggaagtgga

SEQ ID NO: 66481 - DNA, 20 bp, Artificial
  CRISPR gRNA sequence
ggcctccagggaagtggagg

SEQ ID NO: 66482 - DNA, 20 bp, Artificial
  CRISPR gRNA sequence
cagggaagtggaggcaagtg

SEQ ID NO: 66483 - DNA, 20 bp, Artificial
  CRISPR gRNA sequence
ggaaggacatttcaatttca

SEQ ID NO: 66484 - DNA, 20 bp, Artificial
  CRISPR gRNA sequence
caatttcactgttagcccca

SEQ ID NO: 66485 - DNA, 20 bp, Artificial
  CRISPR gRNA sequence
aatttcactgttagccccag

SEQ ID NO: 66486 - DNA, 20 bp, Artificial
  CRISPR gRNA sequence
cactgttagccccagggcaa

SEQ ID NO: 66487 - DNA, 20 bp, Artificial
  CRISPR gRNA sequence
actgttagccccagggcaat

SEQ ID NO: 66488 - DNA, 20 bp, Artificial
  CRISPR gRNA sequence
ttagccccagggcaatgggg

SEQ ID NO: 66489 - DNA, 20 bp, Artificial
  CRISPR gRNA sequence
gccccagggcaatggggagc

SEQ ID NO: 66490 - DNA, 20 bp, Artificial
  CRISPR gRNA sequence
gtcagatgtgcagtgttaaa

SEQ ID NO: 66491 - DNA, 20 bp, Artificial
  CRISPR gRNA sequence
aaatgtgagacacttgtggg

SEQ ID NO: 66492 - DNA, 20 bp, Artificial
  CRISPR gRNA sequence
gtggggcagagagggattaa

SEQ ID NO: 66493 - DNA, 20 bp, Artificial
  CRISPR gRNA sequence
tggggcagagagggattaaa

SEQ ID NO: 66494 - DNA, 20 bp, Artificial
  CRISPR gRNA sequence
aagggaggcaagagtggaag

SEQ ID NO: 66495 - DNA, 20 bp, Artificial
  CRISPR gRNA sequence
aatggtcaaggtgagtgagg

SEQ ID NO: 66496 - DNA, 20 bp, Artificial
  CRISPR gRNA sequence
ggctctggagggggcggtgg

SEQ ID NO: 66497 - DNA, 20 bp, Artificial
  CRISPR gRNA sequence
tggagggggcggtggggagg

SEQ ID NO: 66498 - DNA, 20 bp, Artificial
  CRISPR gRNA sequence
gagggggcggtggggaggac

SEQ ID NO: 66499 - DNA, 20 bp, Artificial
  CRISPR gRNA sequence
ggagagtcactgacaagggc

SEQ ID NO: 66500 - DNA, 20 bp, Artificial
  CRISPR gRNA sequence
gagagtcactgacaagggca

SEQ ID NO: 66501 - DNA, 20 bp, Artificial
  CRISPR gRNA sequence
acaagggcagctgggaactc

SEQ ID NO: 66502 - DNA, 20 bp, Artificial
  CRISPR gRNA sequence
ggaactcagggtcctgcact

SEQ ID NO: 66503 - DNA, 20 bp, Artificial
  CRISPR gRNA sequence
agggtcctgcactgtcactg

SEQ ID NO: 66504 - DNA, 20 bp, Artificial
  CRISPR gRNA sequence
cactgtcactgtcagggcag

SEQ ID NO: 66505 - DNA, 20 bp, Artificial
  CRISPR gRNA sequence
tcactgtcagggcaggagga

SEQ ID NO: 66506 - DNA, 20 bp, Artificial
  CRISPR gRNA sequence
tcagggcaggaggattgggg

SEQ ID NO: 66507 - DNA, 20 bp, Artificial
  CRISPR gRNA sequence
ggggctgcaggggagactcg

SEQ ID NO: 66508 - DNA, 20 bp, Artificial
  CRISPR gRNA sequence
caggggagactcgagaggga

SEQ ID NO: 66509 - DNA, 20 bp, Artificial
  CRISPR gRNA sequence
gagagggaagcgagtgcccc

SEQ ID NO: 66510 - DNA, 20 bp, Artificial
  CRISPR gRNA sequence
tggcctcccacttagagtga

SEQ ID NO: 66511 - DNA, 20 bp, Artificial
  CRISPR gRNA sequence
ccacttagagtgagggatgc

SEQ ID NO: 66512 - DNA, 20 bp, Artificial
  CRISPR gRNA sequence
agagtgagggatgctgggag

SEQ ID NO: 66513 - DNA, 20 bp, Artificial
  CRISPR gRNA sequence
gagtgagggatgctgggaga

SEQ ID NO: 66514 - DNA, 20 bp, Artificial
  CRISPR gRNA sequence
ggagaaggatagagcccctg

SEQ ID NO: 66515 - DNA, 20 bp, Artificial
  CRISPR gRNA sequence
gggctagccagggaccctgg

SEQ ID NO: 66516 - DNA, 20 bp, Artificial
  CRISPR gRNA sequence
gccagggaccctgggctttc

SEQ ID NO: 66517 - DNA, 20 bp, Artificial
  CRISPR gRNA sequence
ggctttctctgattccctgc

SEQ ID NO: 66518 - DNA, 20 bp, Artificial
  CRISPR gRNA sequence
tctctgattccctgccctgc

SEQ ID NO: 66519 - DNA, 20 bp, Artificial
  CRISPR gRNA sequence
ctctgattccctgccctgcc

SEQ ID NO: 66520 - DNA, 20 bp, Artificial
  CRISPR gRNA sequence
tctgattccctgccctgccc

SEQ ID NO: 66521 - DNA, 20 bp, Artificial
  CRISPR gRNA sequence
tgattccctgccctgcccat

SEQ ID NO: 66522 - DNA, 20 bp, Artificial
  CRISPR gRNA sequence
attccctgccctgcccattg

SEQ ID NO: 66523 - DNA, 20 bp, Artificial
  CRISPR gRNA sequence
cctgccctgcccattgcccc

SEQ ID NO: 66524 - DNA, 20 bp, Artificial
  CRISPR gRNA sequence
ccctgcccattgcccctttg

SEQ ID NO: 66525 - DNA, 20 bp, Artificial
  CRISPR gRNA sequence
cccattgcccctttgcagcc

SEQ ID NO: 66526 - DNA, 20 bp, Artificial
  CRISPR gRNA sequence
cccctttgcagcctcagtga

SEQ ID NO: 66527 - DNA, 20 bp, Artificial
  CRISPR gRNA sequence
tgcagcctcagtgagtgtcc

SEQ ID NO: 66528 - DNA, 20 bp, Artificial
  CRISPR gRNA sequence
gcagcctcagtgagtgtcct

SEQ ID NO: 66529 - DNA, 20 bp, Artificial
  CRISPR gRNA sequence
cagcctcagtgagtgtcctc

SEQ ID NO: 66530 - DNA, 20 bp, Artificial
  CRISPR gRNA sequence
agtgagtgtcctctggagcc

SEQ ID NO: 66531 - DNA, 20 bp, Artificial
  CRISPR gRNA sequence
tggagcccccaagcctcacc

SEQ ID NO: 66532 - DNA, 20 bp, Artificial
  CRISPR gRNA sequence
gagcccccaagcctcacccg

SEQ ID NO: 66533 - DNA, 20 bp, Artificial
  CRISPR gRNA sequence
acccgcctctgtgccactct

SEQ ID NO: 66534 - DNA, 20 bp, Artificial
  CRISPR gRNA sequence
tgtgccactctgaaggactg

SEQ ID NO: 66535 - DNA, 20 bp, Artificial
  CRISPR gRNA sequence
tgccactctgaaggactgcc

SEQ ID NO: 66536 - DNA, 20 bp, Artificial
  CRISPR gRNA sequence
tgaaggactgcccgggaccc

SEQ ID NO: 66537 - DNA, 20 bp, Artificial
  CRISPR gRNA sequence
aaggactgcccgggacccct

SEQ ID NO: 66538 - DNA, 20 bp, Artificial
  CRISPR gRNA sequence
cccgggacccctggaactgc

SEQ ID NO: 66539 - DNA, 20 bp, Artificial
  CRISPR gRNA sequence
gaactgcagtaagtaacgag

SEQ ID NO: 66540 - DNA, 20 bp, Artificial
  CRISPR gRNA sequence
cagtaagtaacgaggacaca

SEQ ID NO: 66541 - DNA, 20 bp, Artificial
  CRISPR gRNA sequence
cccagtgacctgggaggggg

SEQ ID NO: 66542 - DNA, 20 bp, Artificial
  CRISPR gRNA sequence
ggagggggcttcttggttag

SEQ ID NO: 66543 - DNA, 20 bp, Artificial
  CRISPR gRNA sequence
cttggttagaagacaggtga

SEQ ID NO: 66544 - DNA, 20 bp, Artificial
  CRISPR gRNA sequence
ttggttagaagacaggtgag

SEQ ID NO: 66545 - DNA, 20 bp, Artificial
  CRISPR gRNA sequence
ggttagaagacaggtgagtc

SEQ ID NO: 66546 - DNA, 20 bp, Artificial
  CRISPR gRNA sequence
gttagaagacaggtgagtct

SEQ ID NO: 66547 - DNA, 20 bp, Artificial
  CRISPR gRNA sequence
gaagacaggtgagtctttct

SEQ ID NO: 66548 - DNA, 20 bp, Artificial
  CRISPR gRNA sequence
tctcgatttcttcccaccag

SEQ ID NO: 66549 - DNA, 20 bp, Artificial
  CRISPR gRNA sequence
ctcgatttcttcccaccagc

SEQ ID NO: 66550 - DNA, 20 bp, Artificial
  CRISPR gRNA sequence
tcgatttcttcccaccagcc

SEQ ID NO: 66551 - DNA, 20 bp, Artificial
  CRISPR gRNA sequence
gatttcttcccaccagccct

SEQ ID NO: 66552 - DNA, 20 bp, Artificial
  CRISPR gRNA sequence
cttcccaccagccctgcccc

SEQ ID NO: 66553 - DNA, 20 bp, Artificial
  CRISPR gRNA sequence
ttcccaccagccctgcccca

SEQ ID NO: 66554 - DNA, 20 bp, Artificial
  CRISPR gRNA sequence
cccaccagccctgccccatg

SEQ ID NO: 66555 - DNA, 20 bp, Artificial
  CRISPR gRNA sequence
ccaccagccctgccccatga

SEQ ID NO: 66556 - DNA, 20 bp, Artificial
  CRISPR gRNA sequence
ccccatgagagtcccctggc

SEQ ID NO: 66557 - DNA, 20 bp, Artificial
  CRISPR gRNA sequence
gcctttggtagaaacttggc

SEQ ID NO: 66558 - DNA, 20 bp, Artificial
  CRISPR gRNA sequence
tggtagaaacttggctgtct

SEQ ID NO: 66559 - DNA, 20 bp, Artificial
  CRISPR gRNA sequence
ggtagaaacttggctgtctc

SEQ ID NO: 66560 - DNA, 20 bp, Artificial
  CRISPR gRNA sequence
gtagaaacttggctgtctct

SEQ ID NO: 66561 - DNA, 20 bp, Artificial
  CRISPR gRNA sequence
ggctgtctctcggcagcccc

SEQ ID NO: 66562 - DNA, 20 bp, Artificial
  CRISPR gRNA sequence
gctgtctctcggcagccccc

SEQ ID NO: 66563 - DNA, 20 bp, Artificial
  CRISPR gRNA sequence
tctctcggcagcccccagcc

SEQ ID NO: 66564 - DNA, 20 bp, Artificial
  CRISPR gRNA sequence
tcggcagcccccagccttag

SEQ ID NO: 66565 - DNA, 20 bp, Artificial
  CRISPR gRNA sequence
ggcagcccccagccttaggc

SEQ ID NO: 66566 - DNA, 20 bp, Artificial
  CRISPR gRNA sequence
aggcagcgcatgtctcccac

SEQ ID NO: 66567 - DNA, 20 bp, Artificial
  CRISPR gRNA sequence
ggcagcgcatgtctcccact

SEQ ID NO: 66568 - DNA, 20 bp, Artificial
  CRISPR gRNA sequence
ccactgggagatgctgtgct

SEQ ID NO: 66569 - DNA, 20 bp, Artificial
  CRISPR gRNA sequence
ggagatgctgtgctggactg

SEQ ID NO: 66570 - DNA, 20 bp, Artificial
  CRISPR gRNA sequence
tgctggactggggaagcctt

SEQ ID NO: 66571 - DNA, 20 bp, Artificial
  CRISPR gRNA sequence
gactggggaagccttcacct

SEQ ID NO: 66572 - DNA, 20 bp, Artificial
  CRISPR gRNA sequence
gggaagccttcacctgcacc

SEQ ID NO: 66573 - DNA, 20 bp, Artificial
  CRISPR gRNA sequence
cacctgcaccatccactcaa

SEQ ID NO: 66574 - DNA, 20 bp, Artificial
  CRISPR gRNA sequence
acctgcaccatccactcaac

SEQ ID NO: 66575 - DNA, 20 bp, Artificial
  CRISPR gRNA sequence
caccatccactcaactcagg

SEQ ID NO: 66576 - DNA, 20 bp, Artificial
  CRISPR gRNA sequence
aactcagggcacctgggagc

SEQ ID NO: 66577 - DNA, 20 bp, Artificial
  CRISPR gRNA sequence
agggcacctgggagccctgt

SEQ ID NO: 66578 - DNA, 20 bp, Artificial
  CRISPR gRNA sequence
ggagccctgtccacctccaa

SEQ ID NO: 66579 - DNA, 20 bp, Artificial
  CRISPR gRNA sequence
tccacctccaaccccacccc

SEQ ID NO: 66580 - DNA, 20 bp, Artificial
  CRISPR gRNA sequence
caaccccacccctggagcct

SEQ ID NO: 66581 - DNA, 20 bp, Artificial
  CRISPR gRNA sequence
gagcctcaccagggcaccca

SEQ ID NO: 66582 - DNA, 20 bp, Artificial
  CRISPR gRNA sequence
accagggcacccacttgaac

SEQ ID NO: 66583 - DNA, 20 bp, Artificial
  CRISPR gRNA sequence
gaacctgcctgcatggctgg

SEQ ID NO: 66584 - DNA, 20 bp, Artificial
  CRISPR gRNA sequence
aacctgcctgcatggctgga

SEQ ID NO: 66585 - DNA, 20 bp, Artificial
  CRISPR gRNA sequence
cctgcatggctggagcgtag

SEQ ID NO: 66586 - DNA, 20 bp, Artificial
  CRISPR gRNA sequence
catggctggagcgtagcact

SEQ ID NO: 66587 - DNA, 20 bp, Artificial
  CRISPR gRNA sequence
gagcgtagcacttctgaaag

SEQ ID NO: 66588 - DNA, 20 bp, Artificial
  CRISPR gRNA sequence
ctgaaagcccttcctcaagg

SEQ ID NO: 66589 - DNA, 20 bp, Artificial
  CRISPR gRNA sequence
tgaaagcccttcctcaaggc

SEQ ID NO: 66590 - DNA, 20 bp, Artificial
  CRISPR gRNA sequence
aaagcccttcctcaaggcac

SEQ ID NO: 66591 - DNA, 20 bp, Artificial
  CRISPR gRNA sequence
cctcaaggcacccccactct

SEQ ID NO: 66592 - DNA, 20 bp, Artificial
  CRISPR gRNA sequence
ctcaaggcacccccactctc

SEQ ID NO: 66593 - DNA, 20 bp, Artificial
  CRISPR gRNA sequence
aaggcacccccactctcctt

SEQ ID NO: 66594 - DNA, 20 bp, Artificial
  CRISPR gRNA sequence
tccttggggttaccacctca

SEQ ID NO: 66595 - DNA, 20 bp, Artificial
  CRISPR gRNA sequence
cttggggttaccacctcact

SEQ ID NO: 66596 - DNA, 20 bp, Artificial
  CRISPR gRNA sequence
ggggttaccacctcactcgc

SEQ ID NO: 66597 - DNA, 20 bp, Artificial
  CRISPR gRNA sequence
gggttaccacctcactcgcc

SEQ ID NO: 66598 - DNA, 20 bp, Artificial
  CRISPR gRNA sequence
ccacctcactcgccccagaa

SEQ ID NO: 66599 - DNA, 20 bp, Artificial
  CRISPR gRNA sequence
actcgccccagaacatctgg

SEQ ID NO: 66600 - DNA, 20 bp, Artificial
  CRISPR gRNA sequence
gccccagaacatctgggtct

SEQ ID NO: 66601 - DNA, 20 bp, Artificial
  CRISPR gRNA sequence
ggtctgtaaccagagactgg

SEQ ID NO: 66602 - DNA, 20 bp, Artificial
  CRISPR gRNA sequence
taaccagagactggacctgg

SEQ ID NO: 66603 - DNA, 20 bp, Artificial
  CRISPR gRNA sequence
gacctggaatcaggactctt

SEQ ID NO: 66604 - DNA, 20 bp, Artificial
  CRISPR gRNA sequence
gaatcaggactcttggctca

SEQ ID NO: 66605 - DNA, 20 bp, Artificial
  CRISPR gRNA sequence
ttggctcaaaagggatttaa

SEQ ID NO: 66606 - DNA, 20 bp, Artificial
  CRISPR gRNA sequence
ggctcaaaagggatttaact

SEQ ID NO: 66607 - DNA, 20 bp, Artificial
  CRISPR gRNA sequence
gctcaaaagggatttaactc

SEQ ID NO: 66608 - DNA, 20 bp, Artificial
  CRISPR gRNA sequence
aaaagggatttaactccccg

SEQ ID NO: 66609 - DNA, 20 bp, Artificial
  CRISPR gRNA sequence
aactccccgggcctcagctt

SEQ ID NO: 66610 - DNA, 20 bp, Artificial
  CRISPR gRNA sequence
actccccgggcctcagcttc

SEQ ID NO: 66611 - DNA, 20 bp, Artificial
  CRISPR gRNA sequence
cccgggcctcagcttcttca

SEQ ID NO: 66612 - DNA, 20 bp, Artificial
  CRISPR gRNA sequence
agcttcttcatctgcacagt

SEQ ID NO: 66613 - DNA, 20 bp, Artificial
  CRISPR gRNA sequence
cttcatctgcacagtggatg

SEQ ID NO: 66614 - DNA, 20 bp, Artificial
  CRISPR gRNA sequence
ttcatctgcacagtggatgg

SEQ ID NO: 66615 - DNA, 20 bp, Artificial
  CRISPR gRNA sequence
catctgcacagtggatggtc

SEQ ID NO: 66616 - DNA, 20 bp, Artificial
  CRISPR gRNA sequence
atctgcacagtggatggtca

SEQ ID NO: 66617 - DNA, 20 bp, Artificial
  CRISPR gRNA sequence
cacagtggatggtcagcctt

SEQ ID NO: 66618 - DNA, 20 bp, Artificial
  CRISPR gRNA sequence
tccttttattgtcattgtgg

SEQ ID NO: 66619 - DNA, 20 bp, Artificial
  CRISPR gRNA sequence
ccttttattgtcattgtggt

SEQ ID NO: 66620 - DNA, 20 bp, Artificial
  CRISPR gRNA sequence
cttttattgtcattgtggtg

SEQ ID NO: 66621 - DNA, 20 bp, Artificial
  CRISPR gRNA sequence
ttattgtcattgtggtgatt

SEQ ID NO: 66622 - DNA, 20 bp, Artificial
  CRISPR gRNA sequence
tattgtcattgtggtgattc

SEQ ID NO: 66623 - DNA, 20 bp, Artificial
  CRISPR gRNA sequence
attgtcattgtggtgattct

SEQ ID NO: 66624 - DNA, 20 bp, Artificial
  CRISPR gRNA sequence
ttgtcattgtggtgattcta

SEQ ID NO: 66625 - DNA, 20 bp, Artificial
  CRISPR gRNA sequence
tcattgtggtgattctatta

SEQ ID NO: 66626 - DNA, 20 bp, Artificial
  CRISPR gRNA sequence
tggtgattctattatagtaa

SEQ ID NO: 66627 - DNA, 20 bp, Artificial
  CRISPR gRNA sequence
tattatagtaattaccttaa

SEQ ID NO: 66628 - DNA, 20 bp, Artificial
  CRISPR gRNA sequence
ttatagtaattaccttaaaa

SEQ ID NO: 66629 - DNA, 20 bp, Artificial
  CRISPR gRNA sequence
tagtaattaccttaaaataa

SEQ ID NO: 66630 - DNA, 20 bp, Artificial
  CRISPR gRNA sequence
ccttaaaataaagaaatcca

SEQ ID NO: 66631 - DNA, 20 bp, Artificial
  CRISPR gRNA sequence
aaaataaagaaatccaagac

SEQ ID NO: 66632 - DNA, 20 bp, Artificial
  CRISPR gRNA sequence
aaataaagaaatccaagaca

SEQ ID NO: 66633 - DNA, 20 bp, Artificial
  CRISPR gRNA sequence
cctcacctaaacaacctctt

SEQ ID NO: 66634 - DNA, 20 bp, Artificial
  CRISPR gRNA sequence
acctaaacaacctcttctct

SEQ ID NO: 66635 - DNA, 20 bp, Artificial
  CRISPR gRNA sequence
aacaacctcttctctcatca

SEQ ID NO: 66636 - DNA, 20 bp, Artificial
  CRISPR gRNA sequence
ttctctcatcaaatccatgt

SEQ ID NO: 66637 - DNA, 20 bp, Artificial
  CRISPR gRNA sequence
ctctcatcaaatccatgttg

SEQ ID NO: 66638 - DNA, 20 bp, Artificial
  CRISPR gRNA sequence
tctcatcaaatccatgttgt

SEQ ID NO: 66639 - DNA, 20 bp, Artificial
  CRISPR gRNA sequence
tcatcaaatccatgttgtca

SEQ ID NO: 66640 - DNA, 20 bp, Artificial
  CRISPR gRNA sequence
atcaaatccatgttgtcatg

SEQ ID NO: 66641 - DNA, 20 bp, Artificial
  CRISPR gRNA sequence
tcatgtgtccacaggactgt

SEQ ID NO: 66642 - DNA, 20 bp, Artificial
  CRISPR gRNA sequence
tctactccttgcctatttgc

SEQ ID NO: 66643 - DNA, 20 bp, Artificial
  CRISPR gRNA sequence
ctccttgcctatttgcatat

SEQ ID NO: 66644 - DNA, 20 bp, Artificial
  CRISPR gRNA sequence
cttgcctatttgcatattca

SEQ ID NO: 66645 - DNA, 20 bp, Artificial
  CRISPR gRNA sequence
gcctatttgcatattcagtt

SEQ ID NO: 66646 - DNA, 20 bp, Artificial
  CRISPR gRNA sequence
cctatttgcatattcagttt

SEQ ID NO: 66647 - DNA, 20 bp, Artificial
  CRISPR gRNA sequence
tttgcatattcagtttctac

SEQ ID NO: 66648 - DNA, 20 bp, Artificial
  CRISPR gRNA sequence
gcatattcagtttctacctg

SEQ ID NO: 66649 - DNA, 20 bp, Artificial
  CRISPR gRNA sequence
catattcagtttctacctgt

SEQ ID NO: 66650 - DNA, 20 bp, Artificial
  CRISPR gRNA sequence
agtttctacctgtttgcagt

SEQ ID NO: 66651 - DNA, 20 bp, Artificial
  CRISPR gRNA sequence
ctacctgtttgcagtcataa

SEQ ID NO: 66652 - DNA, 20 bp, Artificial
  CRISPR gRNA sequence
tacctgtttgcagtcataaa

SEQ ID NO: 66653 - DNA, 20 bp, Artificial
  CRISPR gRNA sequence
cctgtttgcagtcataaact

SEQ ID NO: 66654 - DNA, 20 bp, Artificial
  CRISPR gRNA sequence
tttgcagtcataaactagtt

SEQ ID NO: 66655 - DNA, 20 bp, Artificial
  CRISPR gRNA sequence
gcagtcataaactagtttca

SEQ ID NO: 66656 - DNA, 20 bp, Artificial
  CRISPR gRNA sequence
cagtcataaactagtttcat

SEQ ID NO: 66657 - DNA, 20 bp, Artificial
  CRISPR gRNA sequence
gtttcatgcactgtgttttc

SEQ ID NO: 66658 - DNA, 20 bp, Artificial
  CRISPR gRNA sequence
catgcactgtgttttcatag

SEQ ID NO: 66659 - DNA, 20 bp, Artificial
  CRISPR gRNA sequence
atgcactgtgttttcatagc

SEQ ID NO: 66660 - DNA, 20 bp, Artificial
  CRISPR gRNA sequence
tgttttcatagcatctgtgt

SEQ ID NO: 66661 - DNA, 20 bp, Artificial
  CRISPR gRNA sequence
tcatagcatctgtgttttcc

SEQ ID NO: 66662 - DNA, 20 bp, Artificial
  CRISPR gRNA sequence
catagcatctgtgttttcca

SEQ ID NO: 66663 - DNA, 20 bp, Artificial
  CRISPR gRNA sequence
atagcatctgtgttttccat

SEQ ID NO: 66664 - DNA, 20 bp, Artificial
  CRISPR gRNA sequence
tgttttccattttgcttcag

SEQ ID NO: 66665 - DNA, 20 bp, Artificial
  CRISPR gRNA sequence
tccattttgcttcagtcttt

SEQ ID NO: 66666 - DNA, 20 bp, Artificial
  CRISPR gRNA sequence
ccattttgcttcagtctttt

SEQ ID NO: 66667 - DNA, 20 bp, Artificial
  CRISPR gRNA sequence
cattttgcttcagtcttttt

SEQ ID NO: 66668 - DNA, 20 bp, Artificial
  CRISPR gRNA sequence
tgcttcagtcttttttcttg

SEQ ID NO: 66669 - DNA, 20 bp, Artificial
  CRISPR gRNA sequence
gcttcagtcttttttcttgc

SEQ ID NO: 66670 - DNA, 20 bp, Artificial
  CRISPR gRNA sequence
cttcagtcttttttcttgct

SEQ ID NO: 66671 - DNA, 20 bp, Artificial
  CRISPR gRNA sequence
cagtcttttttcttgctttc

SEQ ID NO: 66672 - DNA, 20 bp, Artificial
  CRISPR gRNA sequence
agtcttttttcttgctttct

SEQ ID NO: 66673 - DNA, 20 bp, Artificial
  CRISPR gRNA sequence
ttttcttgctttctagcccc

SEQ ID NO: 66674 - DNA, 20 bp, Artificial
  CRISPR gRNA sequence
tttcttgctttctagccccc

SEQ ID NO: 66675 - DNA, 20 bp, Artificial
  CRISPR gRNA sequence
ttcttgctttctagccccca

SEQ ID NO: 66676 - DNA, 20 bp, Artificial
  CRISPR gRNA sequence
tcttgctttctagcccccat

SEQ ID NO: 66677 - DNA, 20 bp, Artificial
  CRISPR gRNA sequence
cttgctttctagcccccatc

SEQ ID NO: 66678 - DNA, 20 bp, Artificial
  CRISPR gRNA sequence
ttgctttctagcccccatct

SEQ ID NO: 66679 - DNA, 20 bp, Artificial
  CRISPR gRNA sequence
gctttctagcccccatctca

SEQ ID NO: 66680 - DNA, 20 bp, Artificial
  CRISPR gRNA sequence
ctttctagcccccatctcaa

SEQ ID NO: 66681 - DNA, 20 bp, Artificial
  CRISPR gRNA sequence
tctagcccccatctcaaatg

SEQ ID NO: 66682 - DNA, 20 bp, Artificial
  CRISPR gRNA sequence
ctagcccccatctcaaatgc

SEQ ID NO: 66683 - DNA, 20 bp, Artificial
  CRISPR gRNA sequence
tagcccccatctcaaatgcc

SEQ ID NO: 66684 - DNA, 20 bp, Artificial
  CRISPR gRNA sequence
gcccccatctcaaatgccct

SEQ ID NO: 66685 - DNA, 20 bp, Artificial
  CRISPR gRNA sequence
aaatgcccttccagcccttc

SEQ ID NO: 66686 - DNA, 20 bp, Artificial
  CRISPR gRNA sequence
ccagcccttccaaccagata

SEQ ID NO: 66687 - DNA, 20 bp, Artificial
  CRISPR gRNA sequence
cagcccttccaaccagataa

SEQ ID NO: 66688 - DNA, 20 bp, Artificial
  CRISPR gRNA sequence
ccaaccagataatccggttt

SEQ ID NO: 66689 - DNA, 20 bp, Artificial
  CRISPR gRNA sequence
caaccagataatccggtttg

SEQ ID NO: 66690 - DNA, 20 bp, Artificial
  CRISPR gRNA sequence
gaccccctggagtgtggcct

SEQ ID NO: 66691 - DNA, 20 bp, Artificial
  CRISPR gRNA sequence
accccctggagtgtggcctt

SEQ ID NO: 66692 - DNA, 20 bp, Artificial
  CRISPR gRNA sequence
gagtgtggccttcccatgtc

SEQ ID NO: 66693 - DNA, 20 bp, Artificial
  CRISPR gRNA sequence
cccatgtccttctccaggtt

SEQ ID NO: 66694 - DNA, 20 bp, Artificial
  CRISPR gRNA sequence
ccatgtccttctccaggttc

SEQ ID NO: 66695 - DNA, 20 bp, Artificial
  CRISPR gRNA sequence
ctccaggttcaaacatataa

SEQ ID NO: 66696 - DNA, 20 bp, Artificial
  CRISPR gRNA sequence
tccaggttcaaacatataac

SEQ ID NO: 66697 - DNA, 20 bp, Artificial
  CRISPR gRNA sequence
caggttcaaacatataacca

SEQ ID NO: 66698 - DNA, 20 bp, Artificial
  CRISPR gRNA sequence
aaacatataaccacaaaacc

SEQ ID NO: 66699 - DNA, 20 bp, Artificial
  CRISPR gRNA sequence
tcagacctacactatttttt

SEQ ID NO: 66700 - DNA, 20 bp, Artificial
  CRISPR gRNA sequence
cactattttttttttctgag

SEQ ID NO: 66701 - DNA, 20 bp, Artificial
  CRISPR gRNA sequence
ttttttttttctgagacaga

SEQ ID NO: 66702 - DNA, 20 bp, Artificial
  CRISPR gRNA sequence
tttttttctgagacagagtt

SEQ ID NO: 66703 - DNA, 20 bp, Artificial
  CRISPR gRNA sequence
ttttttctgagacagagttt

SEQ ID NO: 66704 - DNA, 20 bp, Artificial
  CRISPR gRNA sequence
tttttctgagacagagtttt

SEQ ID NO: 66705 - DNA, 20 bp, Artificial
  CRISPR gRNA sequence
ttttctgagacagagttttg

SEQ ID NO: 66706 - DNA, 20 bp, Artificial
  CRISPR gRNA sequence
tttctgagacagagttttgc

SEQ ID NO: 66707 - DNA, 20 bp, Artificial
  CRISPR gRNA sequence
ttctgagacagagttttgct

SEQ ID NO: 66708 - DNA, 20 bp, Artificial
  CRISPR gRNA sequence
tctgagacagagttttgctc

SEQ ID NO: 66709 - DNA, 20 bp, Artificial
  CRISPR gRNA sequence
ctgagacagagttttgctct

SEQ ID NO: 66710 - DNA, 20 bp, Artificial
  CRISPR gRNA sequence
tgagacagagttttgctctt

SEQ ID NO: 66711 - DNA, 20 bp, Artificial
  CRISPR gRNA sequence
agacagagttttgctcttgt

SEQ ID NO: 66712 - DNA, 20 bp, Artificial
  CRISPR gRNA sequence
tgctcttgttgcccaggctg

SEQ ID NO: 66713 - DNA, 20 bp, Artificial
  CRISPR gRNA sequence
gctcttgttgcccaggctgg

SEQ ID NO: 66714 - DNA, 20 bp, Artificial
  CRISPR gRNA sequence
ctcttgttgcccaggctgga

SEQ ID NO: 66715 - DNA, 20 bp, Artificial
  CRISPR gRNA sequence
ttgttgcccaggctggagtg

SEQ ID NO: 66716 - DNA, 20 bp, Artificial
  CRISPR gRNA sequence
gttgcccaggctggagtgca

SEQ ID NO: 66717 - DNA, 20 bp, Artificial
  CRISPR gRNA sequence
ttgcccaggctggagtgcaa

SEQ ID NO: 66718 - DNA, 20 bp, Artificial
  CRISPR gRNA sequence
cccaggctggagtgcaatgg

SEQ ID NO: 66719 - DNA, 20 bp, Artificial
  CRISPR gRNA sequence
gagtgcaatggcgtgatctc

SEQ ID NO: 66720 - DNA, 20 bp, Artificial
  CRISPR gRNA sequence
ggcttgctgccacctctgcc

SEQ ID NO: 66721 - DNA, 20 bp, Artificial
  CRISPR gRNA sequence
gctgccacctctgcctcctg

SEQ ID NO: 66722 - DNA, 20 bp, Artificial
  CRISPR gRNA sequence
ctgccacctctgcctcctgg

SEQ ID NO: 66723 - DNA, 20 bp, Artificial
  CRISPR gRNA sequence
ccacctctgcctcctgggtt

SEQ ID NO: 66724 - DNA, 20 bp, Artificial
  CRISPR gRNA sequence
tgcctcctgggttcaagcaa

SEQ ID NO: 66725 - DNA, 20 bp, Artificial
  CRISPR gRNA sequence
cctcctgggttcaagcaatt

SEQ ID NO: 66726 - DNA, 20 bp, Artificial
  CRISPR gRNA sequence
ctgggttcaagcaattctcc

SEQ ID NO: 66727 - DNA, 20 bp, Artificial
  CRISPR gRNA sequence
ggttcaagcaattctcctgc

SEQ ID NO: 66728 - DNA, 20 bp, Artificial
  CRISPR gRNA sequence
aagcaattctcctgcctcag

SEQ ID NO: 66729 - DNA, 20 bp, Artificial
  CRISPR gRNA sequence
tcctgcctcagcctcctgag

SEQ ID NO: 66730 - DNA, 20 bp, Artificial
  CRISPR gRNA sequence
ctgcctcagcctcctgagta

SEQ ID NO: 66731 - DNA, 20 bp, Artificial
  CRISPR gRNA sequence
cctcagcctcctgagtagct

SEQ ID NO: 66732 - DNA, 20 bp, Artificial
  CRISPR gRNA sequence
agcctcctgagtagctggga

SEQ ID NO: 66733 - DNA, 20 bp, Artificial
  CRISPR gRNA sequence
ctgagtagctgggattacag

SEQ ID NO: 66734 - DNA, 20 bp, Artificial
  CRISPR gRNA sequence
agtagctgggattacaggcg

SEQ ID NO: 66735 - DNA, 20 bp, Artificial
  CRISPR gRNA sequence
ggattacaggcgcccgccat

SEQ ID NO: 66736 - DNA, 20 bp, Artificial
  CRISPR gRNA sequence
caggcgcccgccatcatgcc

SEQ ID NO: 66737 - DNA, 20 bp, Artificial
  CRISPR gRNA sequence
gctaatttttgtatttttag

SEQ ID NO: 66738 - DNA, 20 bp, Artificial
  CRISPR gRNA sequence
atttttgtatttttagtaga

SEQ ID NO: 66739 - DNA, 20 bp, Artificial
  CRISPR gRNA sequence
ttgtatttttagtagaggca

SEQ ID NO: 66740 - DNA, 20 bp, Artificial
  CRISPR gRNA sequence
tgtatttttagtagaggcag

SEQ ID NO: 66741 - DNA, 20 bp, Artificial
  CRISPR gRNA sequence
gtatttttagtagaggcagg

SEQ ID NO: 66742 - DNA, 20 bp, Artificial
  CRISPR gRNA sequence
tatttttagtagaggcaggg

SEQ ID NO: 66743 - DNA, 20 bp, Artificial
  CRISPR gRNA sequence
ttagtagaggcagggtttca

SEQ ID NO: 66744 - DNA, 20 bp, Artificial
  CRISPR gRNA sequence
tagtagaggcagggtttcac

SEQ ID NO: 66745 - DNA, 20 bp, Artificial
  CRISPR gRNA sequence
agtagaggcagggtttcacc

SEQ ID NO: 66746 - DNA, 20 bp, Artificial
  CRISPR gRNA sequence
gtagaggcagggtttcacca

SEQ ID NO: 66747 - DNA, 20 bp, Artificial
  CRISPR gRNA sequence
caccatgttggccaggctgg

SEQ ID NO: 66748 - DNA, 20 bp, Artificial
  CRISPR gRNA sequence
accatgttggccaggctggt

SEQ ID NO: 66749 - DNA, 20 bp, Artificial
  CRISPR gRNA sequence
gccaggctggtctcgaactc

SEQ ID NO: 66750 - DNA, 20 bp, Artificial
  CRISPR gRNA sequence
gtctcgaactcctgacctca

SEQ ID NO: 66751 - DNA, 20 bp, Artificial
  CRISPR gRNA sequence
gaactcctgacctcaagtga

SEQ ID NO: 66752 - DNA, 20 bp, Artificial
  CRISPR gRNA sequence
ctgacctcaagtgatccacc

SEQ ID NO: 66753 - DNA, 20 bp, Artificial
  CRISPR gRNA sequence
acctcaagtgatccaccttc

SEQ ID NO: 66754 - DNA, 20 bp, Artificial
  CRISPR gRNA sequence
aagtgatccaccttcctcag

SEQ ID NO: 66755 - DNA, 20 bp, Artificial
  CRISPR gRNA sequence
cctcagcctcccaaagtgtt

SEQ ID NO: 66756 - DNA, 20 bp, Artificial
  CRISPR gRNA sequence
ctcagcctcccaaagtgttg

SEQ ID NO: 66757 - DNA, 20 bp, Artificial
  CRISPR gRNA sequence
agcctcccaaagtgttggga

SEQ ID NO: 66758 - DNA, 20 bp, Artificial
  CRISPR gRNA sequence
ccaaagtgttgggattacag

SEQ ID NO: 66759 - DNA, 20 bp, Artificial
  CRISPR gRNA sequence
ggattacaggcttgagccac

SEQ ID NO: 66760 - DNA, 20 bp, Artificial
  CRISPR gRNA sequence
caggcttgagccactgcacc

SEQ ID NO: 66761 - DNA, 20 bp, Artificial
  CRISPR gRNA sequence
gagccactgcacctggccca

SEQ ID NO: 66762 - DNA, 20 bp, Artificial
  CRISPR gRNA sequence
agccactgcacctggcccag

SEQ ID NO: 66763 - DNA, 20 bp, Artificial
  CRISPR gRNA sequence
cacctggcccagacctaccc

SEQ ID NO: 66764 - DNA, 20 bp, Artificial
  CRISPR gRNA sequence
gcccagacctaccctattaa

SEQ ID NO: 66765 - DNA, 20 bp, Artificial
  CRISPR gRNA sequence
ccctattaatggcaattcct

SEQ ID NO: 66766 - DNA, 20 bp, Artificial
  CRISPR gRNA sequence
ttaatggcaattccttaaag

SEQ ID NO: 66767 - DNA, 20 bp, Artificial
  CRISPR gRNA sequence
atggcaattccttaaagtca

SEQ ID NO: 66768 - DNA, 20 bp, Artificial
  CRISPR gRNA sequence
cttaaagtcaaccaatggtc

SEQ ID NO: 66769 - DNA, 20 bp, Artificial
  CRISPR gRNA sequence
aaagtcaaccaatggtcagt

SEQ ID NO: 66770 - DNA, 20 bp, Artificial
  CRISPR gRNA sequence
aagtcaaccaatggtcagtg

SEQ ID NO: 66771 - DNA, 20 bp, Artificial
  CRISPR gRNA sequence
attgtctcttacctgttttc

SEQ ID NO: 66772 - DNA, 20 bp, Artificial
  CRISPR gRNA sequence
tctcttacctgttttcacag

SEQ ID NO: 66773 - DNA, 20 bp, Artificial
  CRISPR gRNA sequence
ttacctgttttcacagagta

SEQ ID NO: 66774 - DNA, 20 bp, Artificial
  CRISPR gRNA sequence
acctgttttcacagagtata

SEQ ID NO: 66775 - DNA, 20 bp, Artificial
  CRISPR gRNA sequence
cctgttttcacagagtatat

SEQ ID NO: 66776 - DNA, 20 bp, Artificial
  CRISPR gRNA sequence
ttttcacagagtatatactg

SEQ ID NO: 66777 - DNA, 20 bp, Artificial
  CRISPR gRNA sequence
tcacagagtatatactgatg

SEQ ID NO: 66778 - DNA, 20 bp, Artificial
  CRISPR gRNA sequence
cacagagtatatactgatgc

SEQ ID NO: 66779 - DNA, 20 bp, Artificial
  CRISPR gRNA sequence
acagagtatatactgatgcc

SEQ ID NO: 66780 - DNA, 20 bp, Artificial
  CRISPR gRNA sequence
atgccttttaatactaaatt

SEQ ID NO: 66781 - DNA, 20 bp, Artificial
  CRISPR gRNA sequence
ttaatactaaattgccacag

SEQ ID NO: 66782 - DNA, 20 bp, Artificial
  CRISPR gRNA sequence
taatactaaattgccacagt

SEQ ID NO: 66783 - DNA, 20 bp, Artificial
  CRISPR gRNA sequence
aatactaaattgccacagta

SEQ ID NO: 66784 - DNA, 20 bp, Artificial
  CRISPR gRNA sequence
atactaaattgccacagtac

SEQ ID NO: 66785 - DNA, 20 bp, Artificial
  CRISPR gRNA sequence
aattgccacagtacgggacg

SEQ ID NO: 66786 - DNA, 20 bp, Artificial
  CRISPR gRNA sequence
ccacagtacgggacgagctg

SEQ ID NO: 66787 - DNA, 20 bp, Artificial
  CRISPR gRNA sequence
caagttactccaccacaccc

SEQ ID NO: 66788 - DNA, 20 bp, Artificial
  CRISPR gRNA sequence
ctccaccacacccttctaga

SEQ ID NO: 66789 - DNA, 20 bp, Artificial
  CRISPR gRNA sequence
caccacacccttctagagtc

SEQ ID NO: 66790 - DNA, 20 bp, Artificial
  CRISPR gRNA sequence
ctagagtctagatcaagggt

SEQ ID NO: 66791 - DNA, 20 bp, Artificial
  CRISPR gRNA sequence
tagagtctagatcaagggtg

SEQ ID NO: 66792 - DNA, 20 bp, Artificial
  CRISPR gRNA sequence
gagtctagatcaagggtgtc

SEQ ID NO: 66793 - DNA, 20 bp, Artificial
  CRISPR gRNA sequence
gatcaagggtgtccaatctt

SEQ ID NO: 66794 - DNA, 20 bp, Artificial
  CRISPR gRNA sequence
ttggcttccctgggccacat

SEQ ID NO: 66795 - DNA, 20 bp, Artificial
  CRISPR gRNA sequence
tggcttccctgggccacatt

SEQ ID NO: 66796 - DNA, 20 bp, Artificial
  CRISPR gRNA sequence
ggcttccctgggccacattg

SEQ ID NO: 66797 - DNA, 20 bp, Artificial
  CRISPR gRNA sequence
gcttccctgggccacattgg

SEQ ID NO: 66798 - DNA, 20 bp, Artificial
  CRISPR gRNA sequence
ccctgggccacattggaaga

SEQ ID NO: 66799 - DNA, 20 bp, Artificial
  CRISPR gRNA sequence
cctgggccacattggaagaa

SEQ ID NO: 66800 - DNA, 20 bp, Artificial
  CRISPR gRNA sequence
ggccacattggaagaagaaa

SEQ ID NO: 66801 - DNA, 20 bp, Artificial
  CRISPR gRNA sequence
gaagaagaaaaagaattgtc

SEQ ID NO: 66802 - DNA, 20 bp, Artificial
  CRISPR gRNA sequence
tcttgggccacacataaaat

SEQ ID NO: 66803 - DNA, 20 bp, Artificial
  CRISPR gRNA sequence
gggccacacataaaatacac

SEQ ID NO: 66804 - DNA, 20 bp, Artificial
  CRISPR gRNA sequence
ggccacacataaaatacact

SEQ ID NO: 66805 - DNA, 20 bp, Artificial
  CRISPR gRNA sequence
acactagcgatagctgatgt

SEQ ID NO: 66806 - DNA, 20 bp, Artificial
  CRISPR gRNA sequence
gcgatagctgatgtgctaaa

SEQ ID NO: 66807 - DNA, 20 bp, Artificial
  CRISPR gRNA sequence
atgtgctaaaaaaaaaaaac

SEQ ID NO: 66808 - DNA, 20 bp, Artificial
  CRISPR gRNA sequence
aaaaaaaaaaacaaaactcc

SEQ ID NO: 66809 - DNA, 20 bp, Artificial
  CRISPR gRNA sequence
caaagaaaaatctcatagtg

SEQ ID NO: 66810 - DNA, 20 bp, Artificial
  CRISPR gRNA sequence
atagtgttttaagaaagttt

SEQ ID NO: 66811 - DNA, 20 bp, Artificial
  CRISPR gRNA sequence
taagaaagtttacgaatttt

SEQ ID NO: 66812 - DNA, 20 bp, Artificial
  CRISPR gRNA sequence
aagaaagtttacgaattttt

SEQ ID NO: 66813 - DNA, 20 bp, Artificial
  CRISPR gRNA sequence
agaaagtttacgaatttttg

SEQ ID NO: 66814 - DNA, 20 bp, Artificial
  CRISPR gRNA sequence
acgaatttttgttaggccgt

SEQ ID NO: 66815 - DNA, 20 bp, Artificial
  CRISPR gRNA sequence
cgaatttttgttaggccgta

SEQ ID NO: 66816 - DNA, 20 bp, Artificial
  CRISPR gRNA sequence
ttgttaggccgtattcaaag

SEQ ID NO: 66817 - DNA, 20 bp, Artificial
  CRISPR gRNA sequence
tgttaggccgtattcaaagc

SEQ ID NO: 66818 - DNA, 20 bp, Artificial
  CRISPR gRNA sequence
gttaggccgtattcaaagcc

SEQ ID NO: 66819 - DNA, 20 bp, Artificial
  CRISPR gRNA sequence
ttaggccgtattcaaagcca

SEQ ID NO: 66820 - DNA, 20 bp, Artificial
  CRISPR gRNA sequence
ggccgtattcaaagccatcc

SEQ ID NO: 66821 - DNA, 20 bp, Artificial
  CRISPR gRNA sequence
aaagccatcctaggctgcat

SEQ ID NO: 66822 - DNA, 20 bp, Artificial
  CRISPR gRNA sequence
ggctgcatgcagcaggccat

SEQ ID NO: 66823 - DNA, 20 bp, Artificial
  CRISPR gRNA sequence
catgcagcaggccatgtggc

SEQ ID NO: 66824 - DNA, 20 bp, Artificial
  CRISPR gRNA sequence
ggacaacttggtctagattg

SEQ ID NO: 66825 - DNA, 20 bp, Artificial
  CRISPR gRNA sequence
gacaacttggtctagattga

SEQ ID NO: 66826 - DNA, 20 bp, Artificial
  CRISPR gRNA sequence
ggtctagattgaaatccaaa

SEQ ID NO: 66827 - DNA, 20 bp, Artificial
  CRISPR gRNA sequence
gtctagattgaaatccaaac

SEQ ID NO: 66828 - DNA, 20 bp, Artificial
  CRISPR gRNA sequence
gattgaaatccaaactgctt

SEQ ID NO: 66829 - DNA, 20 bp, Artificial
  CRISPR gRNA sequence
aaatccaaactgcttctagg

SEQ ID NO: 66830 - DNA, 20 bp, Artificial
  CRISPR gRNA sequence
cttctaggtgttgtgttttg

SEQ ID NO: 66831 - DNA, 20 bp, Artificial
  CRISPR gRNA sequence
ctaggtgttgtgttttgttt

SEQ ID NO: 66832 - DNA, 20 bp, Artificial
  CRISPR gRNA sequence
taggtgttgtgttttgtttt

SEQ ID NO: 66833 - DNA, 20 bp, Artificial
  CRISPR gRNA sequence
ggtgttgtgttttgttttgt

SEQ ID NO: 66834 - DNA, 20 bp, Artificial
  CRISPR gRNA sequence
tgttttgttttgtgtagcac

SEQ ID NO: 66835 - DNA, 20 bp, Artificial
  CRISPR gRNA sequence
tgttttgtgtagcactgcag

SEQ ID NO: 66836 - DNA, 20 bp, Artificial
  CRISPR gRNA sequence
gttttgtgtagcactgcagt

SEQ ID NO: 66837 - DNA, 20 bp, Artificial
  CRISPR gRNA sequence
ttttgtgtagcactgcagtc

SEQ ID NO: 66838 - DNA, 20 bp, Artificial
  CRISPR gRNA sequence
tgtgtagcactgcagtcagt

SEQ ID NO: 66839 - DNA, 20 bp, Artificial
  CRISPR gRNA sequence
gtgtagcactgcagtcagtg

SEQ ID NO: 66840 - DNA, 20 bp, Artificial
  CRISPR gRNA sequence
tgtagcactgcagtcagtgc

SEQ ID NO: 66841 - DNA, 20 bp, Artificial
  CRISPR gRNA sequence
cagtcagtgctacaaaaagc

SEQ ID NO: 66842 - DNA, 20 bp, Artificial
  CRISPR gRNA sequence
caaaaagcactcttacgtga

SEQ ID NO: 66843 - DNA, 20 bp, Artificial
  CRISPR gRNA sequence
ttacgtgatttgactgttaa

SEQ ID NO: 66844 - DNA, 20 bp, Artificial
  CRISPR gRNA sequence
acgtgatttgactgttaagt

SEQ ID NO: 66845 - DNA, 20 bp, Artificial
  CRISPR gRNA sequence
cgtgatttgactgttaagta

SEQ ID NO: 66846 - DNA, 20 bp, Artificial
  CRISPR gRNA sequence
gactgttaagtacctattgt

SEQ ID NO: 66847 - DNA, 20 bp, Artificial
  CRISPR gRNA sequence
actgttaagtacctattgta

SEQ ID NO: 66848 - DNA, 20 bp, Artificial
  CRISPR gRNA sequence
ttaagtacctattgtatacc

SEQ ID NO: 66849 - DNA, 20 bp, Artificial
  CRISPR gRNA sequence
agtacctattgtataccatg

SEQ ID NO: 66850 - DNA, 20 bp, Artificial
  CRISPR gRNA sequence
ttgtataccatgcactgggc

SEQ ID NO: 66851 - DNA, 20 bp, Artificial
  CRISPR gRNA sequence
tataccatgcactgggccag

SEQ ID NO: 66852 - DNA, 20 bp, Artificial
  CRISPR gRNA sequence
ggccagatcctgggaacaca

SEQ ID NO: 66853 - DNA, 20 bp, Artificial
  CRISPR gRNA sequence
ggaacacaaggagactggga

SEQ ID NO: 66854 - DNA, 20 bp, Artificial
  CRISPR gRNA sequence
ggatgcgggctctgctggcc

SEQ ID NO: 66855 - DNA, 20 bp, Artificial
  CRISPR gRNA sequence
tgctggccaaggcaaatcat

SEQ ID NO: 66856 - DNA, 20 bp, Artificial
  CRISPR gRNA sequence
ctggccaaggcaaatcatct

SEQ ID NO: 66857 - DNA, 20 bp, Artificial
  CRISPR gRNA sequence
gccaaggcaaatcatctgca

SEQ ID NO: 66858 - DNA, 20 bp, Artificial
  CRISPR gRNA sequence
cagaggaagcttaatataaa

SEQ ID NO: 66859 - DNA, 20 bp, Artificial
  CRISPR gRNA sequence
aatataaaaagcccactggc

SEQ ID NO: 66860 - DNA, 20 bp, Artificial
  CRISPR gRNA sequence
atataaaaagcccactggcg

SEQ ID NO: 66861 - DNA, 20 bp, Artificial
  CRISPR gRNA sequence
gcggcccggcacggtgactc

SEQ ID NO: 66862 - DNA, 20 bp, Artificial
  CRISPR gRNA sequence
acgcctataatcccagcact

SEQ ID NO: 66863 - DNA, 20 bp, Artificial
  CRISPR gRNA sequence
taatcccagcactttgggag

SEQ ID NO: 66864 - DNA, 20 bp, Artificial
  CRISPR gRNA sequence
tgggaggccgaggtggctgg

SEQ ID NO: 66865 - DNA, 20 bp, Artificial
  CRISPR gRNA sequence
gggaggccgaggtggctgga

SEQ ID NO: 66866 - DNA, 20 bp, Artificial
  CRISPR gRNA sequence
ggaggccgaggtggctggat

SEQ ID NO: 66867 - DNA, 20 bp, Artificial
  CRISPR gRNA sequence
gatcatgaggtcaggagttc

SEQ ID NO: 66868 - DNA, 20 bp, Artificial
  CRISPR gRNA sequence
gagactagcctggccaacat

SEQ ID NO: 66869 - DNA, 20 bp, Artificial
  CRISPR gRNA sequence
gcctggccaacatagtgaaa

SEQ ID NO: 66870 - DNA, 20 bp, Artificial
  CRISPR gRNA sequence
gccaacatagtgaaacccca

SEQ ID NO: 66871 - DNA, 20 bp, Artificial
  CRISPR gRNA sequence
tactaaaaatacaaaaatta

SEQ ID NO: 66872 - DNA, 20 bp, Artificial
  CRISPR gRNA sequence
ctaaaaatacaaaaattagc

SEQ ID NO: 66873 - DNA, 20 bp, Artificial
  CRISPR gRNA sequence
aaaatacaaaaattagccag

SEQ ID NO: 66874 - DNA, 20 bp, Artificial
  CRISPR gRNA sequence
gccaggcatggtggtgcacc

SEQ ID NO: 66875 - DNA, 20 bp, Artificial
  CRISPR gRNA sequence
taatcccagctactctggag

SEQ ID NO: 66876 - DNA, 20 bp, Artificial
  CRISPR gRNA sequence
ctctggaggcaggcaggaga

SEQ ID NO: 66877 - DNA, 20 bp, Artificial
  CRISPR gRNA sequence
tggaggcaggcaggagactt

SEQ ID NO: 66878 - DNA, 20 bp, Artificial
  CRISPR gRNA sequence
gaggcaggcaggagacttgc

SEQ ID NO: 66879 - DNA, 20 bp, Artificial
  CRISPR gRNA sequence
gcttgaacccgggaggcaga

SEQ ID NO: 66880 - DNA, 20 bp, Artificial
  CRISPR gRNA sequence
cttgaacccgggaggcagag

SEQ ID NO: 66881 - DNA, 20 bp, Artificial
  CRISPR gRNA sequence
gaacccgggaggcagagatt

SEQ ID NO: 66882 - DNA, 20 bp, Artificial
  CRISPR gRNA sequence
aacccgggaggcagagattg

SEQ ID NO: 66883 - DNA, 20 bp, Artificial
  CRISPR gRNA sequence
tggtgagccaagactgcgcc

SEQ ID NO: 66884 - DNA, 20 bp, Artificial
  CRISPR gRNA sequence
cgccactgtcctccagcctg

SEQ ID NO: 66885 - DNA, 20 bp, Artificial
  CRISPR gRNA sequence
tcctccagcctgggcaacag

SEQ ID NO: 66886 - DNA, 20 bp, Artificial
  CRISPR gRNA sequence
cagcctgggcaacagagcaa

SEQ ID NO: 66887 - DNA, 20 bp, Artificial
  CRISPR gRNA sequence
ggcaacagagcaagactctg

SEQ ID NO: 66888 - DNA, 20 bp, Artificial
  CRISPR gRNA sequence
tgtctcaaataaataaataa

SEQ ID NO: 66889 - DNA, 20 bp, Artificial
  CRISPR gRNA sequence
tctcaaataaataaataaat

SEQ ID NO: 66890 - DNA, 20 bp, Artificial
  CRISPR gRNA sequence
aaataaataaataaataaat

SEQ ID NO: 66891 - DNA, 20 bp, Artificial
  CRISPR gRNA sequence
gcagcactgggcggtctgag

SEQ ID NO: 66892 - DNA, 20 bp, Artificial
  CRISPR gRNA sequence
ggcggtctgagcacaggtgg

SEQ ID NO: 66893 - DNA, 20 bp, Artificial
  CRISPR gRNA sequence
agcacaggtgggagtttcag

SEQ ID NO: 66894 - DNA, 20 bp, Artificial
  CRISPR gRNA sequence
caggtccccctccattacct

SEQ ID NO: 66895 - DNA, 20 bp, Artificial
  CRISPR gRNA sequence
aggtccccctccattacctg

SEQ ID NO: 66896 - DNA, 20 bp, Artificial
  CRISPR gRNA sequence
cattacctgtggttggggaa

SEQ ID NO: 66897 - DNA, 20 bp, Artificial
  CRISPR gRNA sequence
cctgtggttggggaaagtgc

SEQ ID NO: 66898 - DNA, 20 bp, Artificial
  CRISPR gRNA sequence
tggttggggaaagtgcaata

SEQ ID NO: 66899 - DNA, 20 bp, Artificial
  CRISPR gRNA sequence
gggaaagtgcaatagtgaat

SEQ ID NO: 66900 - DNA, 20 bp, Artificial
  CRISPR gRNA sequence
tgtcaactgtagagtactgt

SEQ ID NO: 66901 - DNA, 20 bp, Artificial
  CRISPR gRNA sequence
gtcaactgtagagtactgtg

SEQ ID NO: 66902 - DNA, 20 bp, Artificial
  CRISPR gRNA sequence
tcaactgtagagtactgtga

SEQ ID NO: 66903 - DNA, 20 bp, Artificial
  CRISPR gRNA sequence
tagagtactgtgatcacttg

SEQ ID NO: 66904 - DNA, 20 bp, Artificial
  CRISPR gRNA sequence
tgatcacttgcaggattatt

SEQ ID NO: 66905 - DNA, 20 bp, Artificial
  CRISPR gRNA sequence
gcaggattattgctataaat

SEQ ID NO: 66906 - DNA, 20 bp, Artificial
  CRISPR gRNA sequence
caggattattgctataaata

SEQ ID NO: 66907 - DNA, 20 bp, Artificial
  CRISPR gRNA sequence
ttgctataaatagtcatcaa

SEQ ID NO: 66908 - DNA, 20 bp, Artificial
  CRISPR gRNA sequence
ctataaatagtcatcaaggt

SEQ ID NO: 66909 - DNA, 20 bp, Artificial
  CRISPR gRNA sequence
taaatagtcatcaaggtact

SEQ ID NO: 66910 - DNA, 20 bp, Artificial
  CRISPR gRNA sequence
aatgctgaagtccagtgatt

SEQ ID NO: 66911 - DNA, 20 bp, Artificial
  CRISPR gRNA sequence
aagtccagtgattccccggg

SEQ ID NO: 66912 - DNA, 20 bp, Artificial
  CRISPR gRNA sequence
cccggggttccaccggggaa

SEQ ID NO: 66913 - DNA, 20 bp, Artificial
  CRISPR gRNA sequence
caccggggaagccagggaag

SEQ ID NO: 66914 - DNA, 20 bp, Artificial
  CRISPR gRNA sequence
tggggctccatcccccctcc

SEQ ID NO: 66915 - DNA, 20 bp, Artificial
  CRISPR gRNA sequence
catcccccctccctgaattc

SEQ ID NO: 66916 - DNA, 20 bp, Artificial
  CRISPR gRNA sequence
cctgaattcaagcactgcag

SEQ ID NO: 66917 - DNA, 20 bp, Artificial
  CRISPR gRNA sequence
aattcaagcactgcaggtct

SEQ ID NO: 66918 - DNA, 20 bp, Artificial
  CRISPR gRNA sequence
aagcactgcaggtctacttt

SEQ ID NO: 66919 - DNA, 20 bp, Artificial
  CRISPR gRNA sequence
caggtctactttgcctgtgt

SEQ ID NO: 66920 - DNA, 20 bp, Artificial
  CRISPR gRNA sequence
ctttgcctgtgtacacatgg

SEQ ID NO: 66921 - DNA, 20 bp, Artificial
  CRISPR gRNA sequence
tgcctgtgtacacatgggca

SEQ ID NO: 66922 - DNA, 20 bp, Artificial
  CRISPR gRNA sequence
gcctgtgtacacatgggcat

SEQ ID NO: 66923 - DNA, 20 bp, Artificial
  CRISPR gRNA sequence
cctgtgtacacatgggcata

SEQ ID NO: 66924 - DNA, 20 bp, Artificial
  CRISPR gRNA sequence
tgtacacatgggcataccat

SEQ ID NO: 66925 - DNA, 20 bp, Artificial
  CRISPR gRNA sequence
cattgctttaaaaaaaaaaa

SEQ ID NO: 66926 - DNA, 20 bp, Artificial
  CRISPR gRNA sequence
ctttaaaaaaaaaaaaaagg

SEQ ID NO: 66927 - DNA, 20 bp, Artificial
  CRISPR gRNA sequence
taaaaaaaaaaaaaaggagg

SEQ ID NO: 66928 - DNA, 20 bp, Artificial
  CRISPR gRNA sequence
aaaaaaaaaaaaaaggaggg

SEQ ID NO: 66929 - DNA, 20 bp, Artificial
  CRISPR gRNA sequence
aaaaaaaaaaaaaggagggt

SEQ ID NO: 66930 - DNA, 20 bp, Artificial
  CRISPR gRNA sequence
ctttgccaaccagagcccat

SEQ ID NO: 66931 - DNA, 20 bp, Artificial
  CRISPR gRNA sequence
tgccaaccagagcccatggt

SEQ ID NO: 66932 - DNA, 20 bp, Artificial
  CRISPR gRNA sequence
gccaaccagagcccatggtg

SEQ ID NO: 66933 - DNA, 20 bp, Artificial
  CRISPR gRNA sequence
ccaaccagagcccatggtgt

SEQ ID NO: 66934 - DNA, 20 bp, Artificial
  CRISPR gRNA sequence
gggggtctggtgggacacca

SEQ ID NO: 66935 - DNA, 20 bp, Artificial
  CRISPR gRNA sequence
ggggtctggtgggacaccat

SEQ ID NO: 66936 - DNA, 20 bp, Artificial
  CRISPR gRNA sequence
gtgggacaccatacgggatg

SEQ ID NO: 66937 - DNA, 20 bp, Artificial
  CRISPR gRNA sequence
ctggaaagaccaccctcaat

SEQ ID NO: 66938 - DNA, 20 bp, Artificial
  CRISPR gRNA sequence
tggaaagaccaccctcaata

SEQ ID NO: 66939 - DNA, 20 bp, Artificial
  CRISPR gRNA sequence
gaaagaccaccctcaataaa

SEQ ID NO: 66940 - DNA, 20 bp, Artificial
  CRISPR gRNA sequence
aataaaggccccagtcctga

SEQ ID NO: 66941 - DNA, 20 bp, Artificial
  CRISPR gRNA sequence
actgtgcctcaggggcccat

SEQ ID NO: 66942 - DNA, 20 bp, Artificial
  CRISPR gRNA sequence
tgcctcaggggcccatgccc

SEQ ID NO: 66943 - DNA, 20 bp, Artificial
  CRISPR gRNA sequence
aggggcccatgcccagtccc

SEQ ID NO: 66944 - DNA, 20 bp, Artificial
  CRISPR gRNA sequence
gggcagaaagggtagagttg

SEQ ID NO: 66945 - DNA, 20 bp, Artificial
  CRISPR gRNA sequence
ggcctccagcctgggccctg

SEQ ID NO: 66946 - DNA, 20 bp, Artificial
  CRISPR gRNA sequence
cagcctgggccctggcagag

SEQ ID NO: 66947 - DNA, 20 bp, Artificial
  CRISPR gRNA sequence
ggccctggcagaggctccaa

SEQ ID NO: 66948 - DNA, 20 bp, Artificial
  CRISPR gRNA sequence
gcagaggctccaacatgagg

SEQ ID NO: 66949 - DNA, 20 bp, Artificial
  CRISPR gRNA sequence
caacatgaggctgctcctcc

SEQ ID NO: 66950 - DNA, 20 bp, Artificial
  CRISPR gRNA sequence
ctcctcccgccctaccctgc

SEQ ID NO: 66951 - DNA, 20 bp, Artificial
  CRISPR gRNA sequence
ctcccgccctaccctgcccc

SEQ ID NO: 66952 - DNA, 20 bp, Artificial
  CRISPR gRNA sequence
ccgccctaccctgcccccca

SEQ ID NO: 66953 - DNA, 20 bp, Artificial
  CRISPR gRNA sequence
ccctgccccccagctcactg

SEQ ID NO: 66954 - DNA, 20 bp, Artificial
  CRISPR gRNA sequence
ccccccagctcactgagcca

SEQ ID NO: 66955 - DNA, 20 bp, Artificial
  CRISPR gRNA sequence
actgagccagttgatgtagg

SEQ ID NO: 66956 - DNA, 20 bp, Artificial
  CRISPR gRNA sequence
agccagttgatgtagggccc

SEQ ID NO: 66957 - DNA, 20 bp, Artificial
  CRISPR gRNA sequence
atgtagggcccctgtactcc

SEQ ID NO: 66958 - DNA, 20 bp, Artificial
  CRISPR gRNA sequence
tactccatgcctcccctcca

SEQ ID NO: 66959 - DNA, 20 bp, Artificial
  CRISPR gRNA sequence
catgcctcccctccaaacag

SEQ ID NO: 66960 - DNA, 20 bp, Artificial
  CRISPR gRNA sequence
ccctccaaacagccagagga

SEQ ID NO: 66961 - DNA, 20 bp, Artificial
  CRISPR gRNA sequence
caaacagccagaggagaaag

SEQ ID NO: 66962 - DNA, 20 bp, Artificial
  CRISPR gRNA sequence
ggaggccccggagaggggag

SEQ ID NO: 66963 - DNA, 20 bp, Artificial
  CRISPR gRNA sequence
gaggccccggagaggggaga

SEQ ID NO: 66964 - DNA, 20 bp, Artificial
  CRISPR gRNA sequence
cagaggatgaaggaacagaa

SEQ ID NO: 66965 - DNA, 20 bp, Artificial
  CRISPR gRNA sequence
cgggggttgggaagtggctc

SEQ ID NO: 66966 - DNA, 20 bp, Artificial
  CRISPR gRNA sequence
ggaagtggctccaggccccc

SEQ ID NO: 66967 - DNA, 20 bp, Artificial
  CRISPR gRNA sequence
caggccccccaggaaggggc

SEQ ID NO: 66968 - DNA, 20 bp, Artificial
  CRISPR gRNA sequence
taggtaaaccccagggaact

SEQ ID NO: 66969 - DNA, 20 bp, Artificial
  CRISPR gRNA sequence
agtgtcttgagttgtcctgg

SEQ ID NO: 66970 - DNA, 20 bp, Artificial
  CRISPR gRNA sequence
gagttgtcctggtcctccat

SEQ ID NO: 66971 - DNA, 20 bp, Artificial
  CRISPR gRNA sequence
agttgtcctggtcctccatc

SEQ ID NO: 66972 - DNA, 20 bp, Artificial
  CRISPR gRNA sequence
tcctggtcctccatctagag

SEQ ID NO: 66973 - DNA, 20 bp, Artificial
  CRISPR gRNA sequence
gtcctccatctagagcagag

SEQ ID NO: 66974 - DNA, 20 bp, Artificial
  CRISPR gRNA sequence
catctagagcagagacagca

SEQ ID NO: 66975 - DNA, 20 bp, Artificial
  CRISPR gRNA sequence
gagcagagacagcaaggcag

SEQ ID NO: 66976 - DNA, 20 bp, Artificial
  CRISPR gRNA sequence
gagtttctcctaaatgcact

SEQ ID NO: 66977 - DNA, 20 bp, Artificial
  CRISPR gRNA sequence
ctcctaaatgcactgggttc

SEQ ID NO: 66978 - DNA, 20 bp, Artificial
  CRISPR gRNA sequence
tcctaaatgcactgggttct

SEQ ID NO: 66979 - DNA, 20 bp, Artificial
  CRISPR gRNA sequence
ctaaatgcactgggttctga

SEQ ID NO: 66980 - DNA, 20 bp, Artificial
  CRISPR gRNA sequence
aatgcactgggttctgacga

SEQ ID NO: 66981 - DNA, 20 bp, Artificial
  CRISPR gRNA sequence
ggttctgacgaattatctga

SEQ ID NO: 66982 - DNA, 20 bp, Artificial
  CRISPR gRNA sequence
tgacgaattatctgaacaat

SEQ ID NO: 66983 - DNA, 20 bp, Artificial
  CRISPR gRNA sequence
acgaattatctgaacaatga

SEQ ID NO: 66984 - DNA, 20 bp, Artificial
  CRISPR gRNA sequence
tctgaacaatgatgagctgg

SEQ ID NO: 66985 - DNA, 20 bp, Artificial
  CRISPR gRNA sequence
aacaatgatgagctggttgg

SEQ ID NO: 66986 - DNA, 20 bp, Artificial
  CRISPR gRNA sequence
gttggtctggtgttaatggg

SEQ ID NO: 66987 - DNA, 20 bp, Artificial
  CRISPR gRNA sequence
gtctggtgttaatgggcaac

SEQ ID NO: 66988 - DNA, 20 bp, Artificial
  CRISPR gRNA sequence
gtgttaatgggcaactagag

SEQ ID NO: 66989 - DNA, 20 bp, Artificial
  CRISPR gRNA sequence
atgggcaactagagacccaa

SEQ ID NO: 66990 - DNA, 20 bp, Artificial
  CRISPR gRNA sequence
gagacccaagccagtccctg

SEQ ID NO: 66991 - DNA, 20 bp, Artificial
  CRISPR gRNA sequence
tctccttcgctgacctgttg

SEQ ID NO: 66992 - DNA, 20 bp, Artificial
  CRISPR gRNA sequence
cttcgctgacctgttgtatg

SEQ ID NO: 66993 - DNA, 20 bp, Artificial
  CRISPR gRNA sequence
cgctgacctgttgtatgctg

SEQ ID NO: 66994 - DNA, 20 bp, Artificial
  CRISPR gRNA sequence
gctgacctgttgtatgctga

SEQ ID NO: 66995 - DNA, 20 bp, Artificial
  CRISPR gRNA sequence
acctgttgtatgctgaattt

SEQ ID NO: 66996 - DNA, 20 bp, Artificial
  CRISPR gRNA sequence
ttgtatgctgaatttccact

SEQ ID NO: 66997 - DNA, 20 bp, Artificial
  CRISPR gRNA sequence
tatgctgaatttccactgtc

SEQ ID NO: 66998 - DNA, 20 bp, Artificial
  CRISPR gRNA sequence
aatttccactgtcatatcca

SEQ ID NO: 66999 - DNA, 20 bp, Artificial
  CRISPR gRNA sequence
ccactgtcatatccactcct

SEQ ID NO: 67000 - DNA, 20 bp, Artificial
  CRISPR gRNA sequence
cactgtcatatccactcctc

SEQ ID NO: 67001 - DNA, 20 bp, Artificial
  CRISPR gRNA sequence
tcatatccactcctctgggt

SEQ ID NO: 67002 - DNA, 20 bp, Artificial
  CRISPR gRNA sequence
ctctgggttaaggcagcatt

SEQ ID NO: 67003 - DNA, 20 bp, Artificial
  CRISPR gRNA sequence
tgggttaaggcagcattgtt

SEQ ID NO: 67004 - DNA, 20 bp, Artificial
  CRISPR gRNA sequence
ggttaaggcagcattgtttt

SEQ ID NO: 67005 - DNA, 20 bp, Artificial
  CRISPR gRNA sequence
aggcagcattgttttctttt

SEQ ID NO: 67006 - DNA, 20 bp, Artificial
  CRISPR gRNA sequence
ttttcttttcttttttattt

SEQ ID NO: 67007 - DNA, 20 bp, Artificial
  CRISPR gRNA sequence
tcttttcttttttatttttt

SEQ ID NO: 67008 - DNA, 20 bp, Artificial
  CRISPR gRNA sequence
cttttcttttttattttttt

SEQ ID NO: 67009 - DNA, 20 bp, Artificial
  CRISPR gRNA sequence
ttttcttttttatttttttg

SEQ ID NO: 67010 - DNA, 20 bp, Artificial
  CRISPR gRNA sequence
ttcttttttatttttttgag

SEQ ID NO: 67011 - DNA, 20 bp, Artificial
  CRISPR gRNA sequence
tcttttttatttttttgaga

SEQ ID NO: 67012 - DNA, 20 bp, Artificial
  CRISPR gRNA sequence
cttttttatttttttgagat

SEQ ID NO: 67013 - DNA, 20 bp, Artificial
  CRISPR gRNA sequence
ttttttatttttttgagata

SEQ ID NO: 67014 - DNA, 20 bp, Artificial
  CRISPR gRNA sequence
ttttatttttttgagataga

SEQ ID NO: 67015 - DNA, 20 bp, Artificial
  CRISPR gRNA sequence
tttatttttttgagatagag

SEQ ID NO: 67016 - DNA, 20 bp, Artificial
  CRISPR gRNA sequence
ttatttttttgagatagaga

SEQ ID NO: 67017 - DNA, 20 bp, Artificial
  CRISPR gRNA sequence
tatttttttgagatagagac

SEQ ID NO: 67018 - DNA, 20 bp, Artificial
  CRISPR gRNA sequence
atttttttgagatagagact

SEQ ID NO: 67019 - DNA, 20 bp, Artificial
  CRISPR gRNA sequence
tttttttgagatagagactc

SEQ ID NO: 67020 - DNA, 20 bp, Artificial
  CRISPR gRNA sequence
ttttgagatagagactcgct

SEQ ID NO: 67021 - DNA, 20 bp, Artificial
  CRISPR gRNA sequence
tttgagatagagactcgctc

SEQ ID NO: 67022 - DNA, 20 bp, Artificial
  CRISPR gRNA sequence
ttgagatagagactcgctct

SEQ ID NO: 67023 - DNA, 20 bp, Artificial
  CRISPR gRNA sequence
tgagatagagactcgctctg

SEQ ID NO: 67024 - DNA, 20 bp, Artificial
  CRISPR gRNA sequence
gagatagagactcgctctgt

SEQ ID NO: 67025 - DNA, 20 bp, Artificial
  CRISPR gRNA sequence
agatagagactcgctctgtc

SEQ ID NO: 67026 - DNA, 20 bp, Artificial
  CRISPR gRNA sequence
gctctgtcacccaggctgga

SEQ ID NO: 67027 - DNA, 20 bp, Artificial
  CRISPR gRNA sequence
tgtcacccaggctggagtgc

SEQ ID NO: 67028 - DNA, 20 bp, Artificial
  CRISPR gRNA sequence
tcacccaggctggagtgcag

SEQ ID NO: 67029 - DNA, 20 bp, Artificial
  CRISPR gRNA sequence
gagtgcagtggtacgatctt

SEQ ID NO: 67030 - DNA, 20 bp, Artificial
  CRISPR gRNA sequence
ggctcactgcaacctctgcc

SEQ ID NO: 67031 - DNA, 20 bp, Artificial
  CRISPR gRNA sequence
gctcactgcaacctctgcct

SEQ ID NO: 67032 - DNA, 20 bp, Artificial
  CRISPR gRNA sequence
actgcaacctctgcctccca

SEQ ID NO: 67033 - DNA, 20 bp, Artificial
  CRISPR gRNA sequence
caacctctgcctcccaggtt

SEQ ID NO: 67034 - DNA, 20 bp, Artificial
  CRISPR gRNA sequence
tgcctcccaggttcaagtga

SEQ ID NO: 67035 - DNA, 20 bp, Artificial
  CRISPR gRNA sequence
cctcccaggttcaagtgatt

SEQ ID NO: 67036 - DNA, 20 bp, Artificial
  CRISPR gRNA sequence
ccaggttcaagtgattccca

SEQ ID NO: 67037 - DNA, 20 bp, Artificial
  CRISPR gRNA sequence
aagtgattcccatgcctcag

SEQ ID NO: 67038 - DNA, 20 bp, Artificial
  CRISPR gRNA sequence
ccatgcctcagcctcctgag

SEQ ID NO: 67039 - DNA, 20 bp, Artificial
  CRISPR gRNA sequence
agcctcctgagtagctatta

SEQ ID NO: 67040 - DNA, 20 bp, Artificial
  CRISPR gRNA sequence
ctgagtagctattactacag

SEQ ID NO: 67041 - DNA, 20 bp, Artificial
  CRISPR gRNA sequence
agtagctattactacaggtg

SEQ ID NO: 67042 - DNA, 20 bp, Artificial
  CRISPR gRNA sequence
ttactacaggtgtgcaccac

SEQ ID NO: 67043 - DNA, 20 bp, Artificial
  CRISPR gRNA sequence
ctacaggtgtgcaccaccac

SEQ ID NO: 67044 - DNA, 20 bp, Artificial
  CRISPR gRNA sequence
caggtgtgcaccaccacgcc

SEQ ID NO: 67045 - DNA, 20 bp, Artificial
  CRISPR gRNA sequence
gctaatttttttttcgtttt

SEQ ID NO: 67046 - DNA, 20 bp, Artificial
  CRISPR gRNA sequence
atttttttttcgttttttgt

SEQ ID NO: 67047 - DNA, 20 bp, Artificial
  CRISPR gRNA sequence
ttttttcgttttttgtagta

SEQ ID NO: 67048 - DNA, 20 bp, Artificial
  CRISPR gRNA sequence
tttttcgttttttgtagtag

SEQ ID NO: 67049 - DNA, 20 bp, Artificial
  CRISPR gRNA sequence
ttttcgttttttgtagtaga

SEQ ID NO: 67050 - DNA, 20 bp, Artificial
  CRISPR gRNA sequence
tttcgttttttgtagtagag

SEQ ID NO: 67051 - DNA, 20 bp, Artificial
  CRISPR gRNA sequence
ttcgttttttgtagtagagg

SEQ ID NO: 67052 - DNA, 20 bp, Artificial
  CRISPR gRNA sequence
tcgttttttgtagtagaggt

SEQ ID NO: 67053 - DNA, 20 bp, Artificial
  CRISPR gRNA sequence
cgttttttgtagtagaggtg

SEQ ID NO: 67054 - DNA, 20 bp, Artificial
  CRISPR gRNA sequence
gttttttgtagtagaggtgg

SEQ ID NO: 67055 - DNA, 20 bp, Artificial
  CRISPR gRNA sequence
tttgtagtagaggtggaatt

SEQ ID NO: 67056 - DNA, 20 bp, Artificial
  CRISPR gRNA sequence
ttgtagtagaggtggaattt

SEQ ID NO: 67057 - DNA, 20 bp, Artificial
  CRISPR gRNA sequence
tgtagtagaggtggaatttc

SEQ ID NO: 67058 - DNA, 20 bp, Artificial
  CRISPR gRNA sequence
gtagtagaggtggaatttca

SEQ ID NO: 67059 - DNA, 20 bp, Artificial
  CRISPR gRNA sequence
tagtagaggtggaatttcac

SEQ ID NO: 67060 - DNA, 20 bp, Artificial
  CRISPR gRNA sequence
caccatgttgcccaggctgg

SEQ ID NO: 67061 - DNA, 20 bp, Artificial
  CRISPR gRNA sequence
accatgttgcccaggctggt

SEQ ID NO: 67062 - DNA, 20 bp, Artificial
  CRISPR gRNA sequence
cccaggctggtcccagactc

SEQ ID NO: 67063 - DNA, 20 bp, Artificial
  CRISPR gRNA sequence
gtcccagactcctgacctca

SEQ ID NO: 67064 - DNA, 20 bp, Artificial
  CRISPR gRNA sequence
ctgacctcagatgatccacc

SEQ ID NO: 67065 - DNA, 20 bp, Artificial
  CRISPR gRNA sequence
acctcagatgatccacccac

SEQ ID NO: 67066 - DNA, 20 bp, Artificial
  CRISPR gRNA sequence
agatgatccacccacctcag

SEQ ID NO: 67067 - DNA, 20 bp, Artificial
  CRISPR gRNA sequence
agcctcccaaagtgctgcga

SEQ ID NO: 67068 - DNA, 20 bp, Artificial
  CRISPR gRNA sequence
ccaaagtgctgcgattacag

SEQ ID NO: 67069 - DNA, 20 bp, Artificial
  CRISPR gRNA sequence
cgattacaggcatgagccac

SEQ ID NO: 67070 - DNA, 20 bp, Artificial
  CRISPR gRNA sequence
caggcatgagccaccatgcc

SEQ ID NO: 67071 - DNA, 20 bp, Artificial
  CRISPR gRNA sequence
cattcttttcttaacaaaca

SEQ ID NO: 67072 - DNA, 20 bp, Artificial
  CRISPR gRNA sequence
ttttcttaacaaacatgttt

SEQ ID NO: 67073 - DNA, 20 bp, Artificial
  CRISPR gRNA sequence
ttcttaacaaacatgttttg

SEQ ID NO: 67074 - DNA, 20 bp, Artificial
  CRISPR gRNA sequence
tcttaacaaacatgttttgc

SEQ ID NO: 67075 - DNA, 20 bp, Artificial
  CRISPR gRNA sequence
cttaacaaacatgttttgcg

SEQ ID NO: 67076 - DNA, 20 bp, Artificial
  CRISPR gRNA sequence
ttaacaaacatgttttgcgg

SEQ ID NO: 67077 - DNA, 20 bp, Artificial
  CRISPR gRNA sequence
aacaaacatgttttgcggaa

SEQ ID NO: 67078 - DNA, 20 bp, Artificial
  CRISPR gRNA sequence
acaaacatgttttgcggaac

SEQ ID NO: 67079 - DNA, 20 bp, Artificial
  CRISPR gRNA sequence
tgcggaacactaaccttcat

SEQ ID NO: 67080 - DNA, 20 bp, Artificial
  CRISPR gRNA sequence
gcggaacactaaccttcatg

SEQ ID NO: 67081 - DNA, 20 bp, Artificial
  CRISPR gRNA sequence
cggaacactaaccttcatgg

SEQ ID NO: 67082 - DNA, 20 bp, Artificial
  CRISPR gRNA sequence
accttcatggcccttaaaaa

SEQ ID NO: 67083 - DNA, 20 bp, Artificial
  CRISPR gRNA sequence
catggcccttaaaaattaat

SEQ ID NO: 67084 - DNA, 20 bp, Artificial
  CRISPR gRNA sequence
atggcccttaaaaattaatt

SEQ ID NO: 67085 - DNA, 20 bp, Artificial
  CRISPR gRNA sequence
aaaaattaattctgctagtc

SEQ ID NO: 67086 - DNA, 20 bp, Artificial
  CRISPR gRNA sequence
aaaattaattctgctagtcc

SEQ ID NO: 67087 - DNA, 20 bp, Artificial
  CRISPR gRNA sequence
attctgctagtccatttagt

SEQ ID NO: 67088 - DNA, 20 bp, Artificial
  CRISPR gRNA sequence
tgctagtccatttagtttgg

SEQ ID NO: 67089 - DNA, 20 bp, Artificial
  CRISPR gRNA sequence
ctagtccatttagtttgggg

SEQ ID NO: 67090 - DNA, 20 bp, Artificial
  CRISPR gRNA sequence
gtccatttagtttggggaaa

SEQ ID NO: 67091 - DNA, 20 bp, Artificial
  CRISPR gRNA sequence
agtttggggaaaagtctgct

SEQ ID NO: 67092 - DNA, 20 bp, Artificial
  CRISPR gRNA sequence
gtttggggaaaagtctgctg

SEQ ID NO: 67093 - DNA, 20 bp, Artificial
  CRISPR gRNA sequence
ggggaaaagtctgctgtagc

SEQ ID NO: 67094 - DNA, 20 bp, Artificial
  CRISPR gRNA sequence
gggaaaagtctgctgtagct

SEQ ID NO: 67095 - DNA, 20 bp, Artificial
  CRISPR gRNA sequence
ctgtagctccttggaaattc

SEQ ID NO: 67096 - DNA, 20 bp, Artificial
  CRISPR gRNA sequence
tagctccttggaaattcata

SEQ ID NO: 67097 - DNA, 20 bp, Artificial
  CRISPR gRNA sequence
cttggaaattcataatgcac

SEQ ID NO: 67098 - DNA, 20 bp, Artificial
  CRISPR gRNA sequence
ggaaattcataatgcacagc

SEQ ID NO: 67099 - DNA, 20 bp, Artificial
  CRISPR gRNA sequence
gaaattcataatgcacagca

SEQ ID NO: 67100 - DNA, 20 bp, Artificial
  CRISPR gRNA sequence
ataatgcacagcagcctatc

SEQ ID NO: 67101 - DNA, 20 bp, Artificial
  CRISPR gRNA sequence
tcgcagcctcagagaagccc

SEQ ID NO: 67102 - DNA, 20 bp, Artificial
  CRISPR gRNA sequence
agagaagccctgcagcaaac

SEQ ID NO: 67103 - DNA, 20 bp, Artificial
  CRISPR gRNA sequence
cagcaaacaaaaccatttaa

SEQ ID NO: 67104 - DNA, 20 bp, Artificial
  CRISPR gRNA sequence
aatttggcttaaccccgtat

SEQ ID NO: 67105 - DNA, 20 bp, Artificial
  CRISPR gRNA sequence
atttggcttaaccccgtatt

SEQ ID NO: 67106 - DNA, 20 bp, Artificial
  CRISPR gRNA sequence
ggcttaaccccgtatttccc

SEQ ID NO: 67107 - DNA, 20 bp, Artificial
  CRISPR gRNA sequence
gcttaaccccgtatttccca

SEQ ID NO: 67108 - DNA, 20 bp, Artificial
  CRISPR gRNA sequence
aaccccgtatttcccaaact

SEQ ID NO: 67109 - DNA, 20 bp, Artificial
  CRISPR gRNA sequence
accccgtatttcccaaactt

SEQ ID NO: 67110 - DNA, 20 bp, Artificial
  CRISPR gRNA sequence
cccaaacttaaaagaccttc

SEQ ID NO: 67111 - DNA, 20 bp, Artificial
  CRISPR gRNA sequence
ccaaacttaaaagaccttcc

SEQ ID NO: 67112 - DNA, 20 bp, Artificial
  CRISPR gRNA sequence
aaaagaccttcctcttcttc

SEQ ID NO: 67113 - DNA, 20 bp, Artificial
  CRISPR gRNA sequence
aaagaccttcctcttcttcc

SEQ ID NO: 67114 - DNA, 20 bp, Artificial
  CRISPR gRNA sequence
cctcttcttccagcctcacg

SEQ ID NO: 67115 - DNA, 20 bp, Artificial
  CRISPR gRNA sequence
ctcttcttccagcctcacgg

SEQ ID NO: 67116 - DNA, 20 bp, Artificial
  CRISPR gRNA sequence
ttcttccagcctcacggata

SEQ ID NO: 67117 - DNA, 20 bp, Artificial
  CRISPR gRNA sequence
cttccagcctcacggataac

SEQ ID NO: 67118 - DNA, 20 bp, Artificial
  CRISPR gRNA sequence
ttccagcctcacggataacc

SEQ ID NO: 67119 - DNA, 20 bp, Artificial
  CRISPR gRNA sequence
ccagcctcacggataaccca

SEQ ID NO: 67120 - DNA, 20 bp, Artificial
  CRISPR gRNA sequence
cagcctcacggataacccat

SEQ ID NO: 67121 - DNA, 20 bp, Artificial
  CRISPR gRNA sequence
acggataacccatggaccca

SEQ ID NO: 67122 - DNA, 20 bp, Artificial
  CRISPR gRNA sequence
ggagggaatgtttcaggtga

SEQ ID NO: 67123 - DNA, 20 bp, Artificial
  CRISPR gRNA sequence
caggtgaccctggttaggtc

SEQ ID NO: 67124 - DNA, 20 bp, Artificial
  CRISPR gRNA sequence
aggtgaccctggttaggtcc

SEQ ID NO: 67125 - DNA, 20 bp, Artificial
  CRISPR gRNA sequence
gttaggtcccatctccagaa

SEQ ID NO: 67126 - DNA, 20 bp, Artificial
  CRISPR gRNA sequence
ggtcccatctccagaaggct

SEQ ID NO: 67127 - DNA, 20 bp, Artificial
  CRISPR gRNA sequence
cagaaggctctggctatgag

SEQ ID NO: 67128 - DNA, 20 bp, Artificial
  CRISPR gRNA sequence
tggctatgaggccgtgctcc

SEQ ID NO: 67129 - DNA, 20 bp, Artificial
  CRISPR gRNA sequence
gctatgaggccgtgctccct

SEQ ID NO: 67130 - DNA, 20 bp, Artificial
  CRISPR gRNA sequence
tgaggccgtgctccctgctt

SEQ ID NO: 67131 - DNA, 20 bp, Artificial
  CRISPR gRNA sequence
cctgctttcctggaaggttt

SEQ ID NO: 67132 - DNA, 20 bp, Artificial
  CRISPR gRNA sequence
ctttcctggaaggtttcccc

SEQ ID NO: 67133 - DNA, 20 bp, Artificial
  CRISPR gRNA sequence
tcctggaaggtttcccccac

SEQ ID NO: 67134 - DNA, 20 bp, Artificial
  CRISPR gRNA sequence
cctggaaggtttcccccacc

SEQ ID NO: 67135 - DNA, 20 bp, Artificial
  CRISPR gRNA sequence
ctggaaggtttcccccacct

SEQ ID NO: 67136 - DNA, 20 bp, Artificial
  CRISPR gRNA sequence
gaaggtttcccccacctcat

SEQ ID NO: 67137 - DNA, 20 bp, Artificial
  CRISPR gRNA sequence
cccccacctcatccacctgc

SEQ ID NO: 67138 - DNA, 20 bp, Artificial
  CRISPR gRNA sequence
ccccacctcatccacctgct

SEQ ID NO: 67139 - DNA, 20 bp, Artificial
  CRISPR gRNA sequence
atccacctgctttgtttcac

SEQ ID NO: 67140 - DNA, 20 bp, Artificial
  CRISPR gRNA sequence
ctttgtttcacagattgtcc

SEQ ID NO: 67141 - DNA, 20 bp, Artificial
  CRISPR gRNA sequence
tgtttcacagattgtcctgt

SEQ ID NO: 67142 - DNA, 20 bp, Artificial
  CRISPR gRNA sequence
gtttcacagattgtcctgtg

SEQ ID NO: 67143 - DNA, 20 bp, Artificial
  CRISPR gRNA sequence
tttcacagattgtcctgtga

SEQ ID NO: 67144 - DNA, 20 bp, Artificial
  CRISPR gRNA sequence
cacagattgtcctgtgagtt

SEQ ID NO: 67145 - DNA, 20 bp, Artificial
  CRISPR gRNA sequence
acagattgtcctgtgagttc

SEQ ID NO: 67146 - DNA, 20 bp, Artificial
  CRISPR gRNA sequence
tcctgtgagttcctgagtga

SEQ ID NO: 67147 - DNA, 20 bp, Artificial
  CRISPR gRNA sequence
tgagttcctgagtgaccaga

SEQ ID NO: 67148 - DNA, 20 bp, Artificial
  CRISPR gRNA sequence
ctgagtgaccagagcctgga

SEQ ID NO: 67149 - DNA, 20 bp, Artificial
  CRISPR gRNA sequence
agtgaccagagcctggagac

SEQ ID NO: 67150 - DNA, 20 bp, Artificial
  CRISPR gRNA sequence
gagactctactggactgctt

SEQ ID NO: 67151 - DNA, 20 bp, Artificial
  CRISPR gRNA sequence
tactggactgcttacctcaa

SEQ ID NO: 67152 - DNA, 20 bp, Artificial
  CRISPR gRNA sequence
ctggactgcttacctcaact

SEQ ID NO: 67153 - DNA, 20 bp, Artificial
  CRISPR gRNA sequence
gactgcttacctcaactccc

SEQ ID NO: 67154 - DNA, 20 bp, Artificial
  CRISPR gRNA sequence
cttacctcaactccctcagc

SEQ ID NO: 67155 - DNA, 20 bp, Artificial
  CRISPR gRNA sequence
acctcaactccctcagctga

SEQ ID NO: 67156 - DNA, 20 bp, Artificial
  CRISPR gRNA sequence
cctcaactccctcagctgag

SEQ ID NO: 67157 - DNA, 20 bp, Artificial
  CRISPR gRNA sequence
aactccctcagctgagcctg

SEQ ID NO: 67158 - DNA, 20 bp, Artificial
  CRISPR gRNA sequence
cctcagctgagcctgctgca

SEQ ID NO: 67159 - DNA, 20 bp, Artificial
  CRISPR gRNA sequence
agctgagcctgctgcagtaa

SEQ ID NO: 67160 - DNA, 20 bp, Artificial
  CRISPR gRNA sequence
agcctgctgcagtaagacga

SEQ ID NO: 67161 - DNA, 20 bp, Artificial
  CRISPR gRNA sequence
ctgcagtaagacgagagttt

SEQ ID NO: 67162 - DNA, 20 bp, Artificial
  CRISPR gRNA sequence
cagtaagacgagagtttttc

SEQ ID NO: 67163 - DNA, 20 bp, Artificial
  CRISPR gRNA sequence
ttcctatttcccggttcctt

SEQ ID NO: 67164 - DNA, 20 bp, Artificial
  CRISPR gRNA sequence
tcctatttcccggttccttg

SEQ ID NO: 67165 - DNA, 20 bp, Artificial
  CRISPR gRNA sequence
cctatttcccggttccttgt

SEQ ID NO: 67166 - DNA, 20 bp, Artificial
  CRISPR gRNA sequence
ctatttcccggttccttgtg

SEQ ID NO: 67167 - DNA, 20 bp, Artificial
  CRISPR gRNA sequence
tttcccggttccttgtgctc

SEQ ID NO: 67168 - DNA, 20 bp, Artificial
  CRISPR gRNA sequence
cccggttccttgtgctcgtg

SEQ ID NO: 67169 - DNA, 20 bp, Artificial
  CRISPR gRNA sequence
ccggttccttgtgctcgtgt

SEQ ID NO: 67170 - DNA, 20 bp, Artificial
  CRISPR gRNA sequence
cttgtgctcgtgtttctaag

SEQ ID NO: 67171 - DNA, 20 bp, Artificial
  CRISPR gRNA sequence
gtgctcgtgtttctaaggct

SEQ ID NO: 67172 - DNA, 20 bp, Artificial
  CRISPR gRNA sequence
tgctcgtgtttctaaggctc

SEQ ID NO: 67173 - DNA, 20 bp, Artificial
  CRISPR gRNA sequence
gtgtttctaaggctcctcca

SEQ ID NO: 67174 - DNA, 20 bp, Artificial
  CRISPR gRNA sequence
ctaaggctcctccatggcaa

SEQ ID NO: 67175 - DNA, 20 bp, Artificial
  CRISPR gRNA sequence
taaggctcctccatggcaaa

SEQ ID NO: 67176 - DNA, 20 bp, Artificial
  CRISPR gRNA sequence
aggctcctccatggcaaagc

SEQ ID NO: 67177 - DNA, 20 bp, Artificial
  CRISPR gRNA sequence
ctccatggcaaagctgtacc

SEQ ID NO: 67178 - DNA, 20 bp, Artificial
  CRISPR gRNA sequence
catggcaaagctgtacctgc

SEQ ID NO: 67179 - DNA, 20 bp, Artificial
  CRISPR gRNA sequence
tacctgccctctaacccctc

SEQ ID NO: 67180 - DNA, 20 bp, Artificial
  CRISPR gRNA sequence
ccctctaacccctcaacccc

SEQ ID NO: 67181 - DNA, 20 bp, Artificial
  CRISPR gRNA sequence
taacccctcaaccccccgcc

SEQ ID NO: 67182 - DNA, 20 bp, Artificial
  CRISPR gRNA sequence
acccctcaaccccccgcctt

SEQ ID NO: 67183 - DNA, 20 bp, Artificial
  CRISPR gRNA sequence
aaccccccgcctttaccccc

SEQ ID NO: 67184 - DNA, 20 bp, Artificial
  CRISPR gRNA sequence
taccccctccaaccccctct

SEQ ID NO: 67185 - DNA, 20 bp, Artificial
  CRISPR gRNA sequence
accccctccaaccccctcta

SEQ ID NO: 67186 - DNA, 20 bp, Artificial
  CRISPR gRNA sequence
ccccctccaaccccctctac

SEQ ID NO: 67187 - DNA, 20 bp, Artificial
  CRISPR gRNA sequence
caaccccctctacccgctcc

SEQ ID NO: 67188 - DNA, 20 bp, Artificial
  CRISPR gRNA sequence
tacccgctccattctttcct

SEQ ID NO: 67189 - DNA, 20 bp, Artificial
  CRISPR gRNA sequence
cccgctccattctttcctta

SEQ ID NO: 67190 - DNA, 20 bp, Artificial
  CRISPR gRNA sequence
cattctttccttaggttgtt

SEQ ID NO: 67191 - DNA, 20 bp, Artificial
  CRISPR gRNA sequence
tttccttaggttgttttatc

SEQ ID NO: 67192 - DNA, 20 bp, Artificial
  CRISPR gRNA sequence
tccttaggttgttttatcat

SEQ ID NO: 67193 - DNA, 20 bp, Artificial
  CRISPR gRNA sequence
ccttaggttgttttatcatt

SEQ ID NO: 67194 - DNA, 20 bp, Artificial
  CRISPR gRNA sequence
cttaggttgttttatcattt

SEQ ID NO: 67195 - DNA, 20 bp, Artificial
  CRISPR gRNA sequence
aggttgttttatcattttac

SEQ ID NO: 67196 - DNA, 20 bp, Artificial
  CRISPR gRNA sequence
ggttgttttatcattttacc

SEQ ID NO: 67197 - DNA, 20 bp, Artificial
  CRISPR gRNA sequence
ttttatcattttacctggca

SEQ ID NO: 67198 - DNA, 20 bp, Artificial
  CRISPR gRNA sequence
tatcattttacctggcacaa

SEQ ID NO: 67199 - DNA, 20 bp, Artificial
  CRISPR gRNA sequence
atcattttacctggcacaac

SEQ ID NO: 67200 - DNA, 20 bp, Artificial
  CRISPR gRNA sequence
tcattttacctggcacaact

SEQ ID NO: 67201 - DNA, 20 bp, Artificial
  CRISPR gRNA sequence
tacctggcacaactggggac

SEQ ID NO: 67202 - DNA, 20 bp, Artificial
  CRISPR gRNA sequence
acctggcacaactggggact

SEQ ID NO: 67203 - DNA, 20 bp, Artificial
  CRISPR gRNA sequence
cctggcacaactggggactc

SEQ ID NO: 67204 - DNA, 20 bp, Artificial
  CRISPR gRNA sequence
gcacaactggggactccaat

SEQ ID NO: 67205 - DNA, 20 bp, Artificial
  CRISPR gRNA sequence
gggactccaatctgcttcca

SEQ ID NO: 67206 - DNA, 20 bp, Artificial
  CRISPR gRNA sequence
caatctgcttccagctccac

SEQ ID NO: 67207 - DNA, 20 bp, Artificial
  CRISPR gRNA sequence
cttccagctccaccctaata

SEQ ID NO: 67208 - DNA, 20 bp, Artificial
  CRISPR gRNA sequence
ccagctccaccctaatactt

SEQ ID NO: 67209 - DNA, 20 bp, Artificial
  CRISPR gRNA sequence
cagctccaccctaatacttt

SEQ ID NO: 67210 - DNA, 20 bp, Artificial
  CRISPR gRNA sequence
caccctaatactttgtcaac

SEQ ID NO: 67211 - DNA, 20 bp, Artificial
  CRISPR gRNA sequence
atactttgtcaacctcaggg

SEQ ID NO: 67212 - DNA, 20 bp, Artificial
  CRISPR gRNA sequence
tgtcaacctcagggggcgtc

SEQ ID NO: 67213 - DNA, 20 bp, Artificial
  CRISPR gRNA sequence
gtcaacctcagggggcgtcg

SEQ ID NO: 67214 - DNA, 20 bp, Artificial
  CRISPR gRNA sequence
tcaacctcagggggcgtcgt

SEQ ID NO: 67215 - DNA, 20 bp, Artificial
  CRISPR gRNA sequence
agggggcgtcgtttgcctcc

SEQ ID NO: 67216 - DNA, 20 bp, Artificial
  CRISPR gRNA sequence
gcctcctctgcgtctcagtt

SEQ ID NO: 67217 - DNA, 20 bp, Artificial
  CRISPR gRNA sequence
cctcctctgcgtctcagttt

SEQ ID NO: 67218 - DNA, 20 bp, Artificial
  CRISPR gRNA sequence
ctctgcgtctcagtttcctc

SEQ ID NO: 67219 - DNA, 20 bp, Artificial
  CRISPR gRNA sequence
tgcgtctcagtttcctcatc

SEQ ID NO: 67220 - DNA, 20 bp, Artificial
  CRISPR gRNA sequence
cgtctcagtttcctcatctg

SEQ ID NO: 67221 - DNA, 20 bp, Artificial
  CRISPR gRNA sequence
agtttcctcatctgacaaat

SEQ ID NO: 67222 - DNA, 20 bp, Artificial
  CRISPR gRNA sequence
cctcatctgacaaatgggat

SEQ ID NO: 67223 - DNA, 20 bp, Artificial
  CRISPR gRNA sequence
ctcatctgacaaatgggatt

SEQ ID NO: 67224 - DNA, 20 bp, Artificial
  CRISPR gRNA sequence
atctgacaaatgggattaat

SEQ ID NO: 67225 - DNA, 20 bp, Artificial
  CRISPR gRNA sequence
acaaatgggattaatattcc

SEQ ID NO: 67226 - DNA, 20 bp, Artificial
  CRISPR gRNA sequence
atattccccgcccattcccc

SEQ ID NO: 67227 - DNA, 20 bp, Artificial
  CRISPR gRNA sequence
cccgcccattcccccagagt

SEQ ID NO: 67228 - DNA, 20 bp, Artificial
  CRISPR gRNA sequence
ccccagagttgggactcaaa

SEQ ID NO: 67229 - DNA, 20 bp, Artificial
  CRISPR gRNA sequence
ggactcaaataagttattct

SEQ ID NO: 67230 - DNA, 20 bp, Artificial
  CRISPR gRNA sequence
aaataagttattctaaaatc

SEQ ID NO: 67231 - DNA, 20 bp, Artificial
  CRISPR gRNA sequence
ttctaaaatcaccttaagaa

SEQ ID NO: 67232 - DNA, 20 bp, Artificial
  CRISPR gRNA sequence
taaaatcaccttaagaaatg

SEQ ID NO: 67233 - DNA, 20 bp, Artificial
  CRISPR gRNA sequence
aaatcaccttaagaaatgga

SEQ ID NO: 67234 - DNA, 20 bp, Artificial
  CRISPR gRNA sequence
aagaaatggaagatctgtga

SEQ ID NO: 67235 - DNA, 20 bp, Artificial
  CRISPR gRNA sequence
agaaatggaagatctgtgac

SEQ ID NO: 67236 - DNA, 20 bp, Artificial
  CRISPR gRNA sequence
tgacaaatgagctgtccaac

SEQ ID NO: 67237 - DNA, 20 bp, Artificial
  CRISPR gRNA sequence
tccaacttctccccacccac

SEQ ID NO: 67238 - DNA, 20 bp, Artificial
  CRISPR gRNA sequence
ctccccacccacggagggtc

SEQ ID NO: 67239 - DNA, 20 bp, Artificial
  CRISPR gRNA sequence
tccccacccacggagggtca

SEQ ID NO: 67240 - DNA, 20 bp, Artificial
  CRISPR gRNA sequence
cccacccacggagggtcacc

SEQ ID NO: 67241 - DNA, 20 bp, Artificial
  CRISPR gRNA sequence
gtagaaaggggctgtacaga

SEQ ID NO: 67242 - DNA, 20 bp, Artificial
  CRISPR gRNA sequence
tacagatgtaggtcctgtac

SEQ ID NO: 67243 - DNA, 20 bp, Artificial
  CRISPR gRNA sequence
tacttatcacatgctgcttt

SEQ ID NO: 67244 - DNA, 20 bp, Artificial
  CRISPR gRNA sequence
atcacatgctgctttttaaa

SEQ ID NO: 67245 - DNA, 20 bp, Artificial
  CRISPR gRNA sequence
tcacatgctgctttttaaag

SEQ ID NO: 67246 - DNA, 20 bp, Artificial
  CRISPR gRNA sequence
ctttttaaaggtcaccgtca

SEQ ID NO: 67247 - DNA, 20 bp, Artificial
  CRISPR gRNA sequence
tttaaaggtcaccgtcaaac

SEQ ID NO: 67248 - DNA, 20 bp, Artificial
  CRISPR gRNA sequence
ttaaaggtcaccgtcaaact

SEQ ID NO: 67249 - DNA, 20 bp, Artificial
  CRISPR gRNA sequence
taaaggtcaccgtcaaactc

SEQ ID NO: 67250 - DNA, 20 bp, Artificial
  CRISPR gRNA sequence
aaaggtcaccgtcaaactcg

SEQ ID NO: 67251 - DNA, 20 bp, Artificial
  CRISPR gRNA sequence
aaggtcaccgtcaaactcgc

SEQ ID NO: 67252 - DNA, 20 bp, Artificial
  CRISPR gRNA sequence
gcaaaaagggaatttaagca

SEQ ID NO: 67253 - DNA, 20 bp, Artificial
  CRISPR gRNA sequence
aagcagaattcccccaaagt

SEQ ID NO: 67254 - DNA, 20 bp, Artificial
  CRISPR gRNA sequence
agcagaattcccccaaagta

SEQ ID NO: 67255 - DNA, 20 bp, Artificial
  CRISPR gRNA sequence
ccccaaagtattaaaactat

SEQ ID NO: 67256 - DNA, 20 bp, Artificial
  CRISPR gRNA sequence
aaactattttctaatttcag

SEQ ID NO: 67257 - DNA, 20 bp, Artificial
  CRISPR gRNA sequence
ttttctaatttcagctcaga

SEQ ID NO: 67258 - DNA, 20 bp, Artificial
  CRISPR gRNA sequence
tctaatttcagctcagactg

SEQ ID NO: 67259 - DNA, 20 bp, Artificial
  CRISPR gRNA sequence
ctaatttcagctcagactgg

SEQ ID NO: 67260 - DNA, 20 bp, Artificial
  CRISPR gRNA sequence
taatttcagctcagactggt

SEQ ID NO: 67261 - DNA, 20 bp, Artificial
  CRISPR gRNA sequence
atttcagctcagactggtta

SEQ ID NO: 67262 - DNA, 20 bp, Artificial
  CRISPR gRNA sequence
cagctcagactggttagaat

SEQ ID NO: 67263 - DNA, 20 bp, Artificial
  CRISPR gRNA sequence
agctcagactggttagaatt

SEQ ID NO: 67264 - DNA, 20 bp, Artificial
  CRISPR gRNA sequence
agactggttagaattttaaa

SEQ ID NO: 67265 - DNA, 20 bp, Artificial
  CRISPR gRNA sequence
gttagaattttaaaagtatt

SEQ ID NO: 67266 - DNA, 20 bp, Artificial
  CRISPR gRNA sequence
gaattttaaaagtatttagg

SEQ ID NO: 67267 - DNA, 20 bp, Artificial
  CRISPR gRNA sequence
taaaagtatttaggccatgt

SEQ ID NO: 67268 - DNA, 20 bp, Artificial
  CRISPR gRNA sequence
aaaagtatttaggccatgtg

SEQ ID NO: 67269 - DNA, 20 bp, Artificial
  CRISPR gRNA sequence
aaagtatttaggccatgtgt

SEQ ID NO: 67270 - DNA, 20 bp, Artificial
  CRISPR gRNA sequence
aggccatgtgtggtggctca

SEQ ID NO: 67271 - DNA, 20 bp, Artificial
  CRISPR gRNA sequence
ggccatgtgtggtggctcat

SEQ ID NO: 67272 - DNA, 20 bp, Artificial
  CRISPR gRNA sequence
atgcctgtaatcccggcact

SEQ ID NO: 67273 - DNA, 20 bp, Artificial
  CRISPR gRNA sequence
taatcccggcactttgggag

SEQ ID NO: 67274 - DNA, 20 bp, Artificial
  CRISPR gRNA sequence
tgggaggccgaggcgggcag

SEQ ID NO: 67275 - DNA, 20 bp, Artificial
  CRISPR gRNA sequence
gggaggccgaggcgggcaga

SEQ ID NO: 67276 - DNA, 20 bp, Artificial
  CRISPR gRNA sequence
ggaggccgaggcgggcagat

SEQ ID NO: 67277 - DNA, 20 bp, Artificial
  CRISPR gRNA sequence
aggtcaggagtttgagacca

SEQ ID NO: 67278 - DNA, 20 bp, Artificial
  CRISPR gRNA sequence
gagaccagcctggccaatgt

SEQ ID NO: 67279 - DNA, 20 bp, Artificial
  CRISPR gRNA sequence
agaccagcctggccaatgtg

SEQ ID NO: 67280 - DNA, 20 bp, Artificial
  CRISPR gRNA sequence
gccaatgtggtgaaaccccg

SEQ ID NO: 67281 - DNA, 20 bp, Artificial
  CRISPR gRNA sequence
tactaaaaatacaaaaatta

SEQ ID NO: 67282 - DNA, 20 bp, Artificial
  CRISPR gRNA sequence
ctaaaaatacaaaaattagc

SEQ ID NO: 67283 - DNA, 20 bp, Artificial
  CRISPR gRNA sequence
aaaatacaaaaattagcccg

SEQ ID NO: 67284 - DNA, 20 bp, Artificial
  CRISPR gRNA sequence
gcccggtgtggtggtgggtg

SEQ ID NO: 67285 - DNA, 20 bp, Artificial
  CRISPR gRNA sequence
taattccagctacttgggag

SEQ ID NO: 67286 - DNA, 20 bp, Artificial
  CRISPR gRNA sequence
cagctacttgggaggctgag

SEQ ID NO: 67287 - DNA, 20 bp, Artificial
  CRISPR gRNA sequence
cttgggaggctgaggcagga

SEQ ID NO: 67288 - DNA, 20 bp, Artificial
  CRISPR gRNA sequence
gggaggctgaggcaggagaa

SEQ ID NO: 67289 - DNA, 20 bp, Artificial
  CRISPR gRNA sequence
ggaggctgaggcaggagaat

SEQ ID NO: 67290 - DNA, 20 bp, Artificial
  CRISPR gRNA sequence
aggcaggagaattgcttgaa

SEQ ID NO: 67291 - DNA, 20 bp, Artificial
  CRISPR gRNA sequence
cttgaacttgggaggcggag

SEQ ID NO: 67292 - DNA, 20 bp, Artificial
  CRISPR gRNA sequence
gaacttgggaggcggaggtt

SEQ ID NO: 67293 - DNA, 20 bp, Artificial
  CRISPR gRNA sequence
aacttgggaggcggaggttg

SEQ ID NO: 67294 - DNA, 20 bp, Artificial
  CRISPR gRNA sequence
gggaggcggaggttgcagtg

SEQ ID NO: 67295 - DNA, 20 bp, Artificial
  CRISPR gRNA sequence
ggaggcggaggttgcagtga

SEQ ID NO: 67296 - DNA, 20 bp, Artificial
  CRISPR gRNA sequence
cagtgagccgagatcgcgcc

SEQ ID NO: 67297 - DNA, 20 bp, Artificial
  CRISPR gRNA sequence
cactccagcttgggcgacaa

SEQ ID NO: 67298 - DNA, 20 bp, Artificial
  CRISPR gRNA sequence
cagcttgggcgacaagagtg

SEQ ID NO: 67299 - DNA, 20 bp, Artificial
  CRISPR gRNA sequence
gggcgacaagagtgaaactc

SEQ ID NO: 67300 - DNA, 20 bp, Artificial
  CRISPR gRNA sequence
ggcgacaagagtgaaactcc

SEQ ID NO: 67301 - DNA, 20 bp, Artificial
  CRISPR gRNA sequence
catctcagaaaaaaaaaaag

SEQ ID NO: 67302 - DNA, 20 bp, Artificial
  CRISPR gRNA sequence
agaaaaaaaaaaagaaaaaa

SEQ ID NO: 67303 - DNA, 20 bp, Artificial
  CRISPR gRNA sequence
tagaaggatttactttaaac

SEQ ID NO: 67304 - DNA, 20 bp, Artificial
  CRISPR gRNA sequence
agaaggatttactttaaaca

SEQ ID NO: 67305 - DNA, 20 bp, Artificial
  CRISPR gRNA sequence
gaaggatttactttaaacag

SEQ ID NO: 67306 - DNA, 20 bp, Artificial
  CRISPR gRNA sequence
actttaaacagtcttctagt

SEQ ID NO: 67307 - DNA, 20 bp, Artificial
  CRISPR gRNA sequence
ctttaaacagtcttctagtg

SEQ ID NO: 67308 - DNA, 20 bp, Artificial
  CRISPR gRNA sequence
taaacagtcttctagtggtg

SEQ ID NO: 67309 - DNA, 20 bp, Artificial
  CRISPR gRNA sequence
aaacagtcttctagtggtgg

SEQ ID NO: 67310 - DNA, 20 bp, Artificial
  CRISPR gRNA sequence
aacagtcttctagtggtggg

SEQ ID NO: 67311 - DNA, 20 bp, Artificial
  CRISPR gRNA sequence
ctagtggtgggaggcggggt

SEQ ID NO: 67312 - DNA, 20 bp, Artificial
  CRISPR gRNA sequence
tagtggtgggaggcggggtg

SEQ ID NO: 67313 - DNA, 20 bp, Artificial
  CRISPR gRNA sequence
gtggtgggaggcggggtggg

SEQ ID NO: 67314 - DNA, 20 bp, Artificial
  CRISPR gRNA sequence
cagctaagatgaaaaaatac

SEQ ID NO: 67315 - DNA, 20 bp, Artificial
  CRISPR gRNA sequence
agatgaaaaaatacagcagg

SEQ ID NO: 67316 - DNA, 20 bp, Artificial
  CRISPR gRNA sequence
ataacatcggtgcaaaggct

SEQ ID NO: 67317 - DNA, 20 bp, Artificial
  CRISPR gRNA sequence
gggctctctgggatgtctaa

SEQ ID NO: 67318 - DNA, 20 bp, Artificial
  CRISPR gRNA sequence
tctgggatgtctaagatggc

SEQ ID NO: 67319 - DNA, 20 bp, Artificial
  CRISPR gRNA sequence
tgggatgtctaagatggctc

SEQ ID NO: 67320 - DNA, 20 bp, Artificial
  CRISPR gRNA sequence
ggatgtctaagatggctcgc

SEQ ID NO: 67321 - DNA, 20 bp, Artificial
  CRISPR gRNA sequence
agatggctcgcatcacctcc

SEQ ID NO: 67322 - DNA, 20 bp, Artificial
  CRISPR gRNA sequence
gcatcacctccaggatctcg

SEQ ID NO: 67323 - DNA, 20 bp, Artificial
  CRISPR gRNA sequence
caggatctcgcttatgcttg

SEQ ID NO: 67324 - DNA, 20 bp, Artificial
  CRISPR gRNA sequence
gcttatgcttgggttttatc

SEQ ID NO: 67325 - DNA, 20 bp, Artificial
  CRISPR gRNA sequence
atgcttgggttttatctggg

SEQ ID NO: 67326 - DNA, 20 bp, Artificial
  CRISPR gRNA sequence
tgcttgggttttatctggga

SEQ ID NO: 67327 - DNA, 20 bp, Artificial
  CRISPR gRNA sequence
gggttttatctgggagggag

SEQ ID NO: 67328 - DNA, 20 bp, Artificial
  CRISPR gRNA sequence
ggttttatctgggagggagg

SEQ ID NO: 67329 - DNA, 20 bp, Artificial
  CRISPR gRNA sequence
tatctgggagggagggagga

SEQ ID NO: 67330 - DNA, 20 bp, Artificial
  CRISPR gRNA sequence
atctgggagggagggaggag

SEQ ID NO: 67331 - DNA, 20 bp, Artificial
  CRISPR gRNA sequence
tctgggagggagggaggaga

SEQ ID NO: 67332 - DNA, 20 bp, Artificial
  CRISPR gRNA sequence
ggagggagggaggagacgtg

SEQ ID NO: 67333 - DNA, 20 bp, Artificial
  CRISPR gRNA sequence
caggggcaagtacagcccag

SEQ ID NO: 67334 - DNA, 20 bp, Artificial
  CRISPR gRNA sequence
acagcaccccatggcaccct

SEQ ID NO: 67335 - DNA, 20 bp, Artificial
  CRISPR gRNA sequence
taatagtcccaccctgcccg

SEQ ID NO: 67336 - DNA, 20 bp, Artificial
  CRISPR gRNA sequence
cccggagataatgagtcaga

SEQ ID NO: 67337 - DNA, 20 bp, Artificial
  CRISPR gRNA sequence
ctttggacataaaaggtggc

SEQ ID NO: 67338 - DNA, 20 bp, Artificial
  CRISPR gRNA sequence
tggacataaaaggtggcagg

SEQ ID NO: 67339 - DNA, 20 bp, Artificial
  CRISPR gRNA sequence
ggacataaaaggtggcaggt

SEQ ID NO: 67340 - DNA, 20 bp, Artificial
  CRISPR gRNA sequence
gacataaaaggtggcaggtt

SEQ ID NO: 67341 - DNA, 20 bp, Artificial
  CRISPR gRNA sequence
aaattgaacaggttggaaac

SEQ ID NO: 67342 - DNA, 20 bp, Artificial
  CRISPR gRNA sequence
aacaggttggaaacctcaga

SEQ ID NO: 67343 - DNA, 20 bp, Artificial
  CRISPR gRNA sequence
gaaacctcagaccggagagg

SEQ ID NO: 67344 - DNA, 20 bp, Artificial
  CRISPR gRNA sequence
agaccggagaggaacttctc

SEQ ID NO: 67345 - DNA, 20 bp, Artificial
  CRISPR gRNA sequence
ctctttgcctaaatcacaca

SEQ ID NO: 67346 - DNA, 20 bp, Artificial
  CRISPR gRNA sequence
tctttgcctaaatcacacag

SEQ ID NO: 67347 - DNA, 20 bp, Artificial
  CRISPR gRNA sequence
tttgcctaaatcacacagct

SEQ ID NO: 67348 - DNA, 20 bp, Artificial
  CRISPR gRNA sequence
tgcctaaatcacacagcttc

SEQ ID NO: 67349 - DNA, 20 bp, Artificial
  CRISPR gRNA sequence
gcctaaatcacacagcttca

SEQ ID NO: 67350 - DNA, 20 bp, Artificial
  CRISPR gRNA sequence
cctaaatcacacagcttcac

SEQ ID NO: 67351 - DNA, 20 bp, Artificial
  CRISPR gRNA sequence
aatcacacagcttcacccct

SEQ ID NO: 67352 - DNA, 20 bp, Artificial
  CRISPR gRNA sequence
cacccctgactcctcgtccg

SEQ ID NO: 67353 - DNA, 20 bp, Artificial
  CRISPR gRNA sequence
acccctgactcctcgtccgc

SEQ ID NO: 67354 - DNA, 20 bp, Artificial
  CRISPR gRNA sequence
actcctcgtccgcctttgga

SEQ ID NO: 67355 - DNA, 20 bp, Artificial
  CRISPR gRNA sequence
ctcgtccgcctttggagtgg

SEQ ID NO: 67356 - DNA, 20 bp, Artificial
  CRISPR gRNA sequence
gtccgcctttggagtggcgt

SEQ ID NO: 67357 - DNA, 20 bp, Artificial
  CRISPR gRNA sequence
tggagtggcgtggccagcct

SEQ ID NO: 67358 - DNA, 20 bp, Artificial
  CRISPR gRNA sequence
ggagtggcgtggccagcctg

SEQ ID NO: 67359 - DNA, 20 bp, Artificial
  CRISPR gRNA sequence
gagtggcgtggccagcctga

SEQ ID NO: 67360 - DNA, 20 bp, Artificial
  CRISPR gRNA sequence
accccttgccagggtttaaa

SEQ ID NO: 67361 - DNA, 20 bp, Artificial
  CRISPR gRNA sequence
gccagggtttaaactttgta

SEQ ID NO: 67362 - DNA, 20 bp, Artificial
  CRISPR gRNA sequence
ccagggtttaaactttgtag

SEQ ID NO: 67363 - DNA, 20 bp, Artificial
  CRISPR gRNA sequence
aaactttgtagtactcaacg

SEQ ID NO: 67364 - DNA, 20 bp, Artificial
  CRISPR gRNA sequence
aactttgtagtactcaacgt

SEQ ID NO: 67365 - DNA, 20 bp, Artificial
  CRISPR gRNA sequence
tgtagtactcaacgtgtagt

SEQ ID NO: 67366 - DNA, 20 bp, Artificial
  CRISPR gRNA sequence
gtagtactcaacgtgtagtg

SEQ ID NO: 67367 - DNA, 20 bp, Artificial
  CRISPR gRNA sequence
tagtactcaacgtgtagtgc

SEQ ID NO: 67368 - DNA, 20 bp, Artificial
  CRISPR gRNA sequence
aacgtgtagtgcttgtggcc

SEQ ID NO: 67369 - DNA, 20 bp, Artificial
  CRISPR gRNA sequence
gtggccctactgtgggccag

SEQ ID NO: 67370 - DNA, 20 bp, Artificial
  CRISPR gRNA sequence
tggccctactgtgggccagg

SEQ ID NO: 67371 - DNA, 20 bp, Artificial
  CRISPR gRNA sequence
ctgtgggccaggcattgtgt

SEQ ID NO: 67372 - DNA, 20 bp, Artificial
  CRISPR gRNA sequence
tgggccaggcattgtgtgac

SEQ ID NO: 67373 - DNA, 20 bp, Artificial
  CRISPR gRNA sequence
tgtgacgacacagcagaaaa

SEQ ID NO: 67374 - DNA, 20 bp, Artificial
  CRISPR gRNA sequence
accatgtccttatcttcttg

SEQ ID NO: 67375 - DNA, 20 bp, Artificial
  CRISPR gRNA sequence
atcttcttggagctcctctt

SEQ ID NO: 67376 - DNA, 20 bp, Artificial
  CRISPR gRNA sequence
tcttcttggagctcctctta

SEQ ID NO: 67377 - DNA, 20 bp, Artificial
  CRISPR gRNA sequence
cttggagctcctcttacaat

SEQ ID NO: 67378 - DNA, 20 bp, Artificial
  CRISPR gRNA sequence
ttggagctcctcttacaata

SEQ ID NO: 67379 - DNA, 20 bp, Artificial
  CRISPR gRNA sequence
ggagctcctcttacaatagt

SEQ ID NO: 67380 - DNA, 20 bp, Artificial
  CRISPR gRNA sequence
gagctcctcttacaatagtg

SEQ ID NO: 67381 - DNA, 20 bp, Artificial
  CRISPR gRNA sequence
ctcttacaatagtgggagct

SEQ ID NO: 67382 - DNA, 20 bp, Artificial
  CRISPR gRNA sequence
ttacaatagtgggagctgaa

SEQ ID NO: 67383 - DNA, 20 bp, Artificial
  CRISPR gRNA sequence
acaatagtgggagctgaaaa

SEQ ID NO: 67384 - DNA, 20 bp, Artificial
  CRISPR gRNA sequence
caatagtgggagctgaaaaa

SEQ ID NO: 67385 - DNA, 20 bp, Artificial
  CRISPR gRNA sequence
aaaaataagtaaagtaaaat

SEQ ID NO: 67386 - DNA, 20 bp, Artificial
  CRISPR gRNA sequence
agccagtgataagagaattt

SEQ ID NO: 67387 - DNA, 20 bp, Artificial
  CRISPR gRNA sequence
gccagtgataagagaatttt

SEQ ID NO: 67388 - DNA, 20 bp, Artificial
  CRISPR gRNA sequence
tctcgggatgtggtgaagag

SEQ ID NO: 67389 - DNA, 20 bp, Artificial
  CRISPR gRNA sequence
ctcgggatgtggtgaagagt

SEQ ID NO: 67390 - DNA, 20 bp, Artificial
  CRISPR gRNA sequence
tcgggatgtggtgaagagtg

SEQ ID NO: 67391 - DNA, 20 bp, Artificial
  CRISPR gRNA sequence
gggatgtggtgaagagtggc

SEQ ID NO: 67392 - DNA, 20 bp, Artificial
  CRISPR gRNA sequence
gagaggtgatttagatgtgg

SEQ ID NO: 67393 - DNA, 20 bp, Artificial
  CRISPR gRNA sequence
agatgtggcagaagccatca

SEQ ID NO: 67394 - DNA, 20 bp, Artificial
  CRISPR gRNA sequence
gatgtggcagaagccatcag

SEQ ID NO: 67395 - DNA, 20 bp, Artificial
  CRISPR gRNA sequence
tgaggagggatgctgagctg

SEQ ID NO: 67396 - DNA, 20 bp, Artificial
  CRISPR gRNA sequence
aggagggatgctgagctggg

SEQ ID NO: 67397 - DNA, 20 bp, Artificial
  CRISPR gRNA sequence
agctgggacctaaaggaaga

SEQ ID NO: 67398 - DNA, 20 bp, Artificial
  CRISPR gRNA sequence
ggacctaaaggaagagagag

SEQ ID NO: 67399 - DNA, 20 bp, Artificial
  CRISPR gRNA sequence
aaggaagagagagagctcgc

SEQ ID NO: 67400 - DNA, 20 bp, Artificial
  CRISPR gRNA sequence
gccttgtgaagagcagggaa

SEQ ID NO: 67401 - DNA, 20 bp, Artificial
  CRISPR gRNA sequence
gtgaagagcagggaactgca

SEQ ID NO: 67402 - DNA, 20 bp, Artificial
  CRISPR gRNA sequence
tgaagagcagggaactgcat

SEQ ID NO: 67403 - DNA, 20 bp, Artificial
  CRISPR gRNA sequence
cattccaggcagagggaacg

SEQ ID NO: 67404 - DNA, 20 bp, Artificial
  CRISPR gRNA sequence
caggcagagggaacggcatg

SEQ ID NO: 67405 - DNA, 20 bp, Artificial
  CRISPR gRNA sequence
aggcatgattaagcttggtg

SEQ ID NO: 67406 - DNA, 20 bp, Artificial
  CRISPR gRNA sequence
agcttggtgggctccaggaa

SEQ ID NO: 67407 - DNA, 20 bp, Artificial
  CRISPR gRNA sequence
ggtgggctccaggaacagcg

SEQ ID NO: 67408 - DNA, 20 bp, Artificial
  CRISPR gRNA sequence
gtgggctccaggaacagcgc

SEQ ID NO: 67409 - DNA, 20 bp, Artificial
  CRISPR gRNA sequence
caggaacagcgcggaaccga

SEQ ID NO: 67410 - DNA, 20 bp, Artificial
  CRISPR gRNA sequence
gcagggacagtcctaggaga

SEQ ID NO: 67411 - DNA, 20 bp, Artificial
  CRISPR gRNA sequence
ggagaggaggaagagagaga

SEQ ID NO: 67412 - DNA, 20 bp, Artificial
  CRISPR gRNA sequence
gggttgggttgcatggggcc

SEQ ID NO: 67413 - DNA, 20 bp, Artificial
  CRISPR gRNA sequence
ggttgcatggggcctggcac

SEQ ID NO: 67414 - DNA, 20 bp, Artificial
  CRISPR gRNA sequence
catggggcctggcacccatg

SEQ ID NO: 67415 - DNA, 20 bp, Artificial
  CRISPR gRNA sequence
gcacccatggggagagttta

SEQ ID NO: 67416 - DNA, 20 bp, Artificial
  CRISPR gRNA sequence
agacttttgttcctgggaac

SEQ ID NO: 67417 - DNA, 20 bp, Artificial
  CRISPR gRNA sequence
gacttttgttcctgggaaca

SEQ ID NO: 67418 - DNA, 20 bp, Artificial
  CRISPR gRNA sequence
ttgttcctgggaacatgaaa

SEQ ID NO: 67419 - DNA, 20 bp, Artificial
  CRISPR gRNA sequence
tgttcctgggaacatgaaag

SEQ ID NO: 67420 - DNA, 20 bp, Artificial
  CRISPR gRNA sequence
gttcctgggaacatgaaagg

SEQ ID NO: 67421 - DNA, 20 bp, Artificial
  CRISPR gRNA sequence
ttcctgggaacatgaaaggg

SEQ ID NO: 67422 - DNA, 20 bp, Artificial
  CRISPR gRNA sequence
ctgggaacatgaaagggaga

SEQ ID NO: 67423 - DNA, 20 bp, Artificial
  CRISPR gRNA sequence
ggaacatgaaagggagagga

SEQ ID NO: 67424 - DNA, 20 bp, Artificial
  CRISPR gRNA sequence
gggttttctttctttctttt

SEQ ID NO: 67425 - DNA, 20 bp, Artificial
  CRISPR gRNA sequence
ggttttctttctttcttttt

SEQ ID NO: 67426 - DNA, 20 bp, Artificial
  CRISPR gRNA sequence
tctttctttcttttttgtgg

SEQ ID NO: 67427 - DNA, 20 bp, Artificial
  CRISPR gRNA sequence
ctttctttcttttttgtggg

SEQ ID NO: 67428 - DNA, 20 bp, Artificial
  CRISPR gRNA sequence
tttctttcttttttgtgggg

SEQ ID NO: 67429 - DNA, 20 bp, Artificial
  CRISPR gRNA sequence
tctttcttttttgtggggga

SEQ ID NO: 67430 - DNA, 20 bp, Artificial
  CRISPR gRNA sequence
ctttcttttttgtgggggag

SEQ ID NO: 67431 - DNA, 20 bp, Artificial
  CRISPR gRNA sequence
tttcttttttgtgggggagg

SEQ ID NO: 67432 - DNA, 20 bp, Artificial
  CRISPR gRNA sequence
tcttttttgtgggggagggt

SEQ ID NO: 67433 - DNA, 20 bp, Artificial
  CRISPR gRNA sequence
cttttttgtgggggagggtc

SEQ ID NO: 67434 - DNA, 20 bp, Artificial
  CRISPR gRNA sequence
ttttttgtgggggagggtct

SEQ ID NO: 67435 - DNA, 20 bp, Artificial
  CRISPR gRNA sequence
ttttgtgggggagggtctcg

SEQ ID NO: 67436 - DNA, 20 bp, Artificial
  CRISPR gRNA sequence
tttgtgggggagggtctcgc

SEQ ID NO: 67437 - DNA, 20 bp, Artificial
  CRISPR gRNA sequence
ttgtgggggagggtctcgct

SEQ ID NO: 67438 - DNA, 20 bp, Artificial
  CRISPR gRNA sequence
tgtgggggagggtctcgctc

SEQ ID NO: 67439 - DNA, 20 bp, Artificial
  CRISPR gRNA sequence
gtgggggagggtctcgctct

SEQ ID NO: 67440 - DNA, 20 bp, Artificial
  CRISPR gRNA sequence
tgggggagggtctcgctctg

SEQ ID NO: 67441 - DNA, 20 bp, Artificial
  CRISPR gRNA sequence
gctctgtcacacaggctgga

SEQ ID NO: 67442 - DNA, 20 bp, Artificial
  CRISPR gRNA sequence
tgtcacacaggctggagtgc

SEQ ID NO: 67443 - DNA, 20 bp, Artificial
  CRISPR gRNA sequence
tcacacaggctggagtgcaa

SEQ ID NO: 67444 - DNA, 20 bp, Artificial
  CRISPR gRNA sequence
gagtgcaatggcgcaatctc

SEQ ID NO: 67445 - DNA, 20 bp, Artificial
  CRISPR gRNA sequence
ggctcactgcaacctccgcc

SEQ ID NO: 67446 - DNA, 20 bp, Artificial
  CRISPR gRNA sequence
actgcaacctccgcctccca

SEQ ID NO: 67447 - DNA, 20 bp, Artificial
  CRISPR gRNA sequence
caacctccgcctcccaggtt

SEQ ID NO: 67448 - DNA, 20 bp, Artificial
  CRISPR gRNA sequence
cgcctcccaggttcaggcaa

SEQ ID NO: 67449 - DNA, 20 bp, Artificial
  CRISPR gRNA sequence
ccaggttcaggcaattcttg

SEQ ID NO: 67450 - DNA, 20 bp, Artificial
  CRISPR gRNA sequence
aggcaattcttgtgcctcag

SEQ ID NO: 67451 - DNA, 20 bp, Artificial
  CRISPR gRNA sequence
ttgtgcctcagcctcccaag

SEQ ID NO: 67452 - DNA, 20 bp, Artificial
  CRISPR gRNA sequence
gtgcctcagcctcccaagta

SEQ ID NO: 67453 - DNA, 20 bp, Artificial
  CRISPR gRNA sequence
tgcctcagcctcccaagtag

SEQ ID NO: 67454 - DNA, 20 bp, Artificial
  CRISPR gRNA sequence
agcctcccaagtagctggga

SEQ ID NO: 67455 - DNA, 20 bp, Artificial
  CRISPR gRNA sequence
ccaagtagctgggattacag

SEQ ID NO: 67456 - DNA, 20 bp, Artificial
  CRISPR gRNA sequence
ggattacaggcgtgcaccat

SEQ ID NO: 67457 - DNA, 20 bp, Artificial
  CRISPR gRNA sequence
caggcgtgcaccatcatgcc

SEQ ID NO: 67458 - DNA, 20 bp, Artificial
  CRISPR gRNA sequence
atttttgtatttttagtaga

SEQ ID NO: 67459 - DNA, 20 bp, Artificial
  CRISPR gRNA sequence
ttgtatttttagtagagaca

SEQ ID NO: 67460 - DNA, 20 bp, Artificial
  CRISPR gRNA sequence
tgtatttttagtagagacag

SEQ ID NO: 67461 - DNA, 20 bp, Artificial
  CRISPR gRNA sequence
gtatttttagtagagacaga

SEQ ID NO: 67462 - DNA, 20 bp, Artificial
  CRISPR gRNA sequence
tatttttagtagagacagag

SEQ ID NO: 67463 - DNA, 20 bp, Artificial
  CRISPR gRNA sequence
ttagtagagacagagtttaa

SEQ ID NO: 67464 - DNA, 20 bp, Artificial
  CRISPR gRNA sequence
tagtagagacagagtttaac

SEQ ID NO: 67465 - DNA, 20 bp, Artificial
  CRISPR gRNA sequence
agtagagacagagtttaacc

SEQ ID NO: 67466 - DNA, 20 bp, Artificial
  CRISPR gRNA sequence
gtagagacagagtttaacca

SEQ ID NO: 67467 - DNA, 20 bp, Artificial
  CRISPR gRNA sequence
aaccatgttgaccatgctgg

SEQ ID NO: 67468 - DNA, 20 bp, Artificial
  CRISPR gRNA sequence
accatgttgaccatgctggt

SEQ ID NO: 67469 - DNA, 20 bp, Artificial
  CRISPR gRNA sequence
accatgctggtctcaaactc

SEQ ID NO: 67470 - DNA, 20 bp, Artificial
  CRISPR gRNA sequence
gtctcaaactcccgacctca

SEQ ID NO: 67471 - DNA, 20 bp, Artificial
  CRISPR gRNA sequence
aaactcccgacctcaagtga

SEQ ID NO: 67472 - DNA, 20 bp, Artificial
  CRISPR gRNA sequence
ccgacctcaagtgatccgcc

SEQ ID NO: 67473 - DNA, 20 bp, Artificial
  CRISPR gRNA sequence
aagtgatccgcccgcctcgg

SEQ ID NO: 67474 - DNA, 20 bp, Artificial
  CRISPR gRNA sequence
ggcttcccaaagtactgaga

SEQ ID NO: 67475 - DNA, 20 bp, Artificial
  CRISPR gRNA sequence
cccaaagtactgagattaca

SEQ ID NO: 67476 - DNA, 20 bp, Artificial
  CRISPR gRNA sequence
ccaaagtactgagattacag

SEQ ID NO: 67477 - DNA, 20 bp, Artificial
  CRISPR gRNA sequence
agattacaggcaggagccac

SEQ ID NO: 67478 - DNA, 20 bp, Artificial
  CRISPR gRNA sequence
caggcaggagccactgcacc

SEQ ID NO: 67479 - DNA, 20 bp, Artificial
  CRISPR gRNA sequence
cacccgttcctcatttgggt

SEQ ID NO: 67480 - DNA, 20 bp, Artificial
  CRISPR gRNA sequence
ctcatttgggttttcaaaag

SEQ ID NO: 67481 - DNA, 20 bp, Artificial
  CRISPR gRNA sequence
atttgggttttcaaaagttc

SEQ ID NO: 67482 - DNA, 20 bp, Artificial
  CRISPR gRNA sequence
gggttttcaaaagttcagac

SEQ ID NO: 67483 - DNA, 20 bp, Artificial
  CRISPR gRNA sequence
ggttttcaaaagttcagact

SEQ ID NO: 67484 - DNA, 20 bp, Artificial
  CRISPR gRNA sequence
tcaaaagttcagactgagtg

SEQ ID NO: 67485 - DNA, 20 bp, Artificial
  CRISPR gRNA sequence
caaaagttcagactgagtgc

SEQ ID NO: 67486 - DNA, 20 bp, Artificial
  CRISPR gRNA sequence
aaaagttcagactgagtgct

SEQ ID NO: 67487 - DNA, 20 bp, Artificial
  CRISPR gRNA sequence
agactgagtgctgggtagag

SEQ ID NO: 67488 - DNA, 20 bp, Artificial
  CRISPR gRNA sequence
agtgctgggtagagaatgga

SEQ ID NO: 67489 - DNA, 20 bp, Artificial
  CRISPR gRNA sequence
ggtagagaatggattgggag

SEQ ID NO: 67490 - DNA, 20 bp, Artificial
  CRISPR gRNA sequence
ggagatacgagtggaaatga

SEQ ID NO: 67491 - DNA, 20 bp, Artificial
  CRISPR gRNA sequence
ggggctgatcactgctgggg

SEQ ID NO: 67492 - DNA, 20 bp, Artificial
  CRISPR gRNA sequence
atcactgctggggtgggata

SEQ ID NO: 67493 - DNA, 20 bp, Artificial
  CRISPR gRNA sequence
ctggggtgggatagaagttg

SEQ ID NO: 67494 - DNA, 20 bp, Artificial
  CRISPR gRNA sequence
gggtgggatagaagttggta

SEQ ID NO: 67495 - DNA, 20 bp, Artificial
  CRISPR gRNA sequence
gtagactcagggtggatctt

SEQ ID NO: 67496 - DNA, 20 bp, Artificial
  CRISPR gRNA sequence
agggtggatcttgagagtgg

SEQ ID NO: 67497 - DNA, 20 bp, Artificial
  CRISPR gRNA sequence
gagagtggaatttacagaca

SEQ ID NO: 67498 - DNA, 20 bp, Artificial
  CRISPR gRNA sequence
agagtggaatttacagacaa

SEQ ID NO: 67499 - DNA, 20 bp, Artificial
  CRISPR gRNA sequence
acagacaagctgataggggg

SEQ ID NO: 67500 - DNA, 20 bp, Artificial
  CRISPR gRNA sequence
cagacaagctgataggggga

SEQ ID NO: 67501 - DNA, 20 bp, Artificial
  CRISPR gRNA sequence
atagggggattactggatga

SEQ ID NO: 67502 - DNA, 20 bp, Artificial
  CRISPR gRNA sequence
ctggatgaggcaaatggagg

SEQ ID NO: 67503 - DNA, 20 bp, Artificial
  CRISPR gRNA sequence
gatgaggcaaatggaggtgc

SEQ ID NO: 67504 - DNA, 20 bp, Artificial
  CRISPR gRNA sequence
aggctgcctctgagggcaga

SEQ ID NO: 67505 - DNA, 20 bp, Artificial
  CRISPR gRNA sequence
cctctgagggcagagtggac

SEQ ID NO: 67506 - DNA, 20 bp, Artificial
  CRISPR gRNA sequence
tgagggcagagtggacccat

SEQ ID NO: 67507 - DNA, 20 bp, Artificial
  CRISPR gRNA sequence
agggcagagtggacccatct

SEQ ID NO: 67508 - DNA, 20 bp, Artificial
  CRISPR gRNA sequence
actttctctaaggcagtggt

SEQ ID NO: 67509 - DNA, 20 bp, Artificial
  CRISPR gRNA sequence
tctctaaggcagtggtttcc

SEQ ID NO: 67510 - DNA, 20 bp, Artificial
  CRISPR gRNA sequence
ctctaaggcagtggtttcca

SEQ ID NO: 67511 - DNA, 20 bp, Artificial
  CRISPR gRNA sequence
tctaaggcagtggtttccaa

SEQ ID NO: 67512 - DNA, 20 bp, Artificial
  CRISPR gRNA sequence
taaggcagtggtttccaact

SEQ ID NO: 67513 - DNA, 20 bp, Artificial
  CRISPR gRNA sequence
aggcagtggtttccaactgg

SEQ ID NO: 67514 - DNA, 20 bp, Artificial
  CRISPR gRNA sequence
ccaactgggggtgattttca

SEQ ID NO: 67515 - DNA, 20 bp, Artificial
  CRISPR gRNA sequence
caactgggggtgattttcac

SEQ ID NO: 67516 - DNA, 20 bp, Artificial
  CRISPR gRNA sequence
ggggtgattttcacccttgg

SEQ ID NO: 67517 - DNA, 20 bp, Artificial
  CRISPR gRNA sequence
tcacccttgggagtcatttg

SEQ ID NO: 67518 - DNA, 20 bp, Artificial
  CRISPR gRNA sequence
cacccttgggagtcatttgg

SEQ ID NO: 67519 - DNA, 20 bp, Artificial
  CRISPR gRNA sequence
acccttgggagtcatttgga

SEQ ID NO: 67520 - DNA, 20 bp, Artificial
  CRISPR gRNA sequence
gggagtcatttggaaatatc

SEQ ID NO: 67521 - DNA, 20 bp, Artificial
  CRISPR gRNA sequence
ggagtcatttggaaatatct

SEQ ID NO: 67522 - DNA, 20 bp, Artificial
  CRISPR gRNA sequence
ggaaatatctggagatattt

SEQ ID NO: 67523 - DNA, 20 bp, Artificial
  CRISPR gRNA sequence
gaaatatctggagatatttt

SEQ ID NO: 67524 - DNA, 20 bp, Artificial
  CRISPR gRNA sequence
gagatatttttggtggtcat

SEQ ID NO: 67525 - DNA, 20 bp, Artificial
  CRISPR gRNA sequence
ttggtggtcatgactgcggg

SEQ ID NO: 67526 - DNA, 20 bp, Artificial
  CRISPR gRNA sequence
tggtggtcatgactgcgggt

SEQ ID NO: 67527 - DNA, 20 bp, Artificial
  CRISPR gRNA sequence
ggtggtcatgactgcgggtg

SEQ ID NO: 67528 - DNA, 20 bp, Artificial
  CRISPR gRNA sequence
gtggtcatgactgcgggtga

SEQ ID NO: 67529 - DNA, 20 bp, Artificial
  CRISPR gRNA sequence
cgggtgaggggtgctgctac

SEQ ID NO: 67530 - DNA, 20 bp, Artificial
  CRISPR gRNA sequence
ctactggcatcgaatgaata

SEQ ID NO: 67531 - DNA, 20 bp, Artificial
  CRISPR gRNA sequence
ctggcatcgaatgaatagag

SEQ ID NO: 67532 - DNA, 20 bp, Artificial
  CRISPR gRNA sequence
gcatcgaatgaatagagatc

SEQ ID NO: 67533 - DNA, 20 bp, Artificial
  CRISPR gRNA sequence
ggatgctgctgaacatccta

SEQ ID NO: 67534 - DNA, 20 bp, Artificial
  CRISPR gRNA sequence
ctgaacatcctatagggcac

SEQ ID NO: 67535 - DNA, 20 bp, Artificial
  CRISPR gRNA sequence
aacatcctatagggcacagg

SEQ ID NO: 67536 - DNA, 20 bp, Artificial
  CRISPR gRNA sequence
tagggcacaggagagcccac

SEQ ID NO: 67537 - DNA, 20 bp, Artificial
  CRISPR gRNA sequence
ttggacctcacatctcaata

SEQ ID NO: 67538 - DNA, 20 bp, Artificial
  CRISPR gRNA sequence
gacctcacatctcaatagtg

SEQ ID NO: 67539 - DNA, 20 bp, Artificial
  CRISPR gRNA sequence
acatctcaatagtgctaagg

SEQ ID NO: 67540 - DNA, 20 bp, Artificial
  CRISPR gRNA sequence
aatagtgctaaggtttaaaa

SEQ ID NO: 67541 - DNA, 20 bp, Artificial
  CRISPR gRNA sequence
aggtttaaaaactgtgtctg

SEQ ID NO: 67542 - DNA, 20 bp, Artificial
  CRISPR gRNA sequence
aaaaactgtgtctgaagggc

SEQ ID NO: 67543 - DNA, 20 bp, Artificial
  CRISPR gRNA sequence
aaaactgtgtctgaagggcc

SEQ ID NO: 67544 - DNA, 20 bp, Artificial
  CRISPR gRNA sequence
tgtctgaagggcctgaagct

SEQ ID NO: 67545 - DNA, 20 bp, Artificial
  CRISPR gRNA sequence
aagggcctgaagcttcccac

SEQ ID NO: 67546 - DNA, 20 bp, Artificial
  CRISPR gRNA sequence
aagcttcccactctctgtga

SEQ ID NO: 67547 - DNA, 20 bp, Artificial
  CRISPR gRNA sequence
cccactctctgtgagcaagg

SEQ ID NO: 67548 - DNA, 20 bp, Artificial
  CRISPR gRNA sequence
ccactctctgtgagcaagga

SEQ ID NO: 67549 - DNA, 20 bp, Artificial
  CRISPR gRNA sequence
tctgtgagcaaggactcgcc

SEQ ID NO: 67550 - DNA, 20 bp, Artificial
  CRISPR gRNA sequence
tgtgagcaaggactcgcctg

SEQ ID NO: 67551 - DNA, 20 bp, Artificial
  CRISPR gRNA sequence
tgagcaaggactcgcctgtg

SEQ ID NO: 67552 - DNA, 20 bp, Artificial
  CRISPR gRNA sequence
gcctgtgaaatctgtgcttg

SEQ ID NO: 67553 - DNA, 20 bp, Artificial
  CRISPR gRNA sequence
tgaaatctgtgcttgcaggt

SEQ ID NO: 67554 - DNA, 20 bp, Artificial
  CRISPR gRNA sequence
tgcttgcaggtaaaaacaat

SEQ ID NO: 67555 - DNA, 20 bp, Artificial
  CRISPR gRNA sequence
gcaggtaaaaacaatagtaa

SEQ ID NO: 67556 - DNA, 20 bp, Artificial
  CRISPR gRNA sequence
caggtaaaaacaatagtaat

SEQ ID NO: 67557 - DNA, 20 bp, Artificial
  CRISPR gRNA sequence
catgatgtaattaaatcctc

SEQ ID NO: 67558 - DNA, 20 bp, Artificial
  CRISPR gRNA sequence
aatcctcatatacctcgaga

SEQ ID NO: 67559 - DNA, 20 bp, Artificial
  CRISPR gRNA sequence
atatacctcgagagtcatac

SEQ ID NO: 67560 - DNA, 20 bp, Artificial
  CRISPR gRNA sequence
gagagtcatacatgacgagt

SEQ ID NO: 67561 - DNA, 20 bp, Artificial
  CRISPR gRNA sequence
gatttccagataaggaaact

SEQ ID NO: 67562 - DNA, 20 bp, Artificial
  CRISPR gRNA sequence
atttccagataaggaaactg

SEQ ID NO: 67563 - DNA, 20 bp, Artificial
  CRISPR gRNA sequence
ccagataaggaaactgaagc

SEQ ID NO: 67564 - DNA, 20 bp, Artificial
  CRISPR gRNA sequence
cagataaggaaactgaagct

SEQ ID NO: 67565 - DNA, 20 bp, Artificial
  CRISPR gRNA sequence
aagctcagagaggtgaagtc

SEQ ID NO: 67566 - DNA, 20 bp, Artificial
  CRISPR gRNA sequence
agagaggtgaagtcacttct

SEQ ID NO: 67567 - DNA, 20 bp, Artificial
  CRISPR gRNA sequence
ctccaaggtcacacagccaa

SEQ ID NO: 67568 - DNA, 20 bp, Artificial
  CRISPR gRNA sequence
tccaaggtcacacagccaat

SEQ ID NO: 67569 - DNA, 20 bp, Artificial
  CRISPR gRNA sequence
caaggtcacacagccaataa

SEQ ID NO: 67570 - DNA, 20 bp, Artificial
  CRISPR gRNA sequence
ggactcaaatccaaatctgc

SEQ ID NO: 67571 - DNA, 20 bp, Artificial
  CRISPR gRNA sequence
aaatccaaatctgcctgtcc

SEQ ID NO: 67572 - DNA, 20 bp, Artificial
  CRISPR gRNA sequence
cctgtccctcagccctattt

SEQ ID NO: 67573 - DNA, 20 bp, Artificial
  CRISPR gRNA sequence
tccctcagccctatttgtgc

SEQ ID NO: 67574 - DNA, 20 bp, Artificial
  CRISPR gRNA sequence
agccctatttgtgcctcttg

SEQ ID NO: 67575 - DNA, 20 bp, Artificial
  CRISPR gRNA sequence
tttgtgcctcttgatcccct

SEQ ID NO: 67576 - DNA, 20 bp, Artificial
  CRISPR gRNA sequence
gtgcctcttgatcccctgcc

SEQ ID NO: 67577 - DNA, 20 bp, Artificial
  CRISPR gRNA sequence
tgcctcttgatcccctgcct

SEQ ID NO: 67578 - DNA, 20 bp, Artificial
  CRISPR gRNA sequence
ttgatcccctgcctgcttcc

SEQ ID NO: 67579 - DNA, 20 bp, Artificial
  CRISPR gRNA sequence
gatcccctgcctgcttccct

SEQ ID NO: 67580 - DNA, 20 bp, Artificial
  CRISPR gRNA sequence
atcccctgcctgcttcccta

SEQ ID NO: 67581 - DNA, 20 bp, Artificial
  CRISPR gRNA sequence
cctgcttccctattgccttg

SEQ ID NO: 67582 - DNA, 20 bp, Artificial
  CRISPR gRNA sequence
cttccctattgccttgctga

SEQ ID NO: 67583 - DNA, 20 bp, Artificial
  CRISPR gRNA sequence
ccctattgccttgctgagct

SEQ ID NO: 67584 - DNA, 20 bp, Artificial
  CRISPR gRNA sequence
cctattgccttgctgagctg

SEQ ID NO: 67585 - DNA, 20 bp, Artificial
  CRISPR gRNA sequence
ttgccttgctgagctgctag

SEQ ID NO: 67586 - DNA, 20 bp, Artificial
  CRISPR gRNA sequence
ccttgctgagctgctagccc

SEQ ID NO: 67587 - DNA, 20 bp, Artificial
  CRISPR gRNA sequence
gctgagctgctagccctccc

SEQ ID NO: 67588 - DNA, 20 bp, Artificial
  CRISPR gRNA sequence
ctgagctgctagccctcccc

SEQ ID NO: 67589 - DNA, 20 bp, Artificial
  CRISPR gRNA sequence
agctgctagccctccccacc

SEQ ID NO: 67590 - DNA, 20 bp, Artificial
  CRISPR gRNA sequence
ctagccctccccaccctccc

SEQ ID NO: 67591 - DNA, 20 bp, Artificial
  CRISPR gRNA sequence
gccctccccaccctcccttt

SEQ ID NO: 67592 - DNA, 20 bp, Artificial
  CRISPR gRNA sequence
cccaccctccctttccttac

SEQ ID NO: 67593 - DNA, 20 bp, Artificial
  CRISPR gRNA sequence
cctttccttaccctccaggc

SEQ ID NO: 67594 - DNA, 20 bp, Artificial
  CRISPR gRNA sequence
tccttaccctccaggctagc

SEQ ID NO: 67595 - DNA, 20 bp, Artificial
  CRISPR gRNA sequence
ccttaccctccaggctagcc

SEQ ID NO: 67596 - DNA, 20 bp, Artificial
  CRISPR gRNA sequence
cttaccctccaggctagcca

SEQ ID NO: 67597 - DNA, 20 bp, Artificial
  CRISPR gRNA sequence
accctccaggctagccaggt

SEQ ID NO: 67598 - DNA, 20 bp, Artificial
  CRISPR gRNA sequence
ccctccaggctagccaggtt

SEQ ID NO: 67599 - DNA, 20 bp, Artificial
  CRISPR gRNA sequence
caggctagccaggttccttg

SEQ ID NO: 67600 - DNA, 20 bp, Artificial
  CRISPR gRNA sequence
gccaggttccttgtccactc

SEQ ID NO: 67601 - DNA, 20 bp, Artificial
  CRISPR gRNA sequence
cttgtccactcatcttgccg

SEQ ID NO: 67602 - DNA, 20 bp, Artificial
  CRISPR gRNA sequence
gtccactcatcttgccggat

SEQ ID NO: 67603 - DNA, 20 bp, Artificial
  CRISPR gRNA sequence
tccactcatcttgccggatc

SEQ ID NO: 67604 - DNA, 20 bp, Artificial
  CRISPR gRNA sequence
atcttgccggatctaccccc

SEQ ID NO: 67605 - DNA, 20 bp, Artificial
  CRISPR gRNA sequence
gccggatctaccccctttcc

SEQ ID NO: 67606 - DNA, 20 bp, Artificial
  CRISPR gRNA sequence
ccggatctaccccctttcct

SEQ ID NO: 67607 - DNA, 20 bp, Artificial
  CRISPR gRNA sequence
ccccctttccttttcaggct

SEQ ID NO: 67608 - DNA, 20 bp, Artificial
  CRISPR gRNA sequence
tccttttcaggctgagccag

SEQ ID NO: 67609 - DNA, 20 bp, Artificial
  CRISPR gRNA sequence
ccttttcaggctgagccaga

SEQ ID NO: 67610 - DNA, 20 bp, Artificial
  CRISPR gRNA sequence
cttttcaggctgagccagac

SEQ ID NO: 67611 - DNA, 20 bp, Artificial
  CRISPR gRNA sequence
ttcaggctgagccagacggg

SEQ ID NO: 67612 - DNA, 20 bp, Artificial
  CRISPR gRNA sequence
tcaggctgagccagacggga

SEQ ID NO: 67613 - DNA, 20 bp, Artificial
  CRISPR gRNA sequence
caggctgagccagacgggac

SEQ ID NO: 67614 - DNA, 20 bp, Artificial
  CRISPR gRNA sequence
aggctgagccagacgggact

SEQ ID NO: 67615 - DNA, 20 bp, Artificial
  CRISPR gRNA sequence
agccagacgggactgtcccc

SEQ ID NO: 67616 - DNA, 20 bp, Artificial
  CRISPR gRNA sequence
tccccgaaaagccccttcct

SEQ ID NO: 67617 - DNA, 20 bp, Artificial
  CRISPR gRNA sequence
cctgctggccaacaccttaa

SEQ ID NO: 67618 - DNA, 20 bp, Artificial
  CRISPR gRNA sequence
ctgctggccaacaccttaag

SEQ ID NO: 67619 - DNA, 20 bp, Artificial
  CRISPR gRNA sequence
ctggccaacaccttaagcct

SEQ ID NO: 67620 - DNA, 20 bp, Artificial
  CRISPR gRNA sequence
gccaacaccttaagcctgtg

SEQ ID NO: 67621 - DNA, 20 bp, Artificial
  CRISPR gRNA sequence
aagcctgtgtccacgggtta

SEQ ID NO: 67622 - DNA, 20 bp, Artificial
  CRISPR gRNA sequence
agcctgtgtccacgggttaa

SEQ ID NO: 67623 - DNA, 20 bp, Artificial
  CRISPR gRNA sequence
tgtccacgggttaaaaaggt

SEQ ID NO: 67624 - DNA, 20 bp, Artificial
  CRISPR gRNA sequence
aaaaggtggatctcaggtgg

SEQ ID NO: 67625 - DNA, 20 bp, Artificial
  CRISPR gRNA sequence
aggtgggcattcccctggga

SEQ ID NO: 67626 - DNA, 20 bp, Artificial
  CRISPR gRNA sequence
ccctgggacagccaggactc

SEQ ID NO: 67627 - DNA, 20 bp, Artificial
  CRISPR gRNA sequence
ggacagccaggactcgtcct

SEQ ID NO: 67628 - DNA, 20 bp, Artificial
  CRISPR gRNA sequence
gtcctgaagggttgtgcctg

SEQ ID NO: 67629 - DNA, 20 bp, Artificial
  CRISPR gRNA sequence
aagggttgtgcctggagtct

SEQ ID NO: 67630 - DNA, 20 bp, Artificial
  CRISPR gRNA sequence
tgcctggagtctggtgggta

SEQ ID NO: 67631 - DNA, 20 bp, Artificial
  CRISPR gRNA sequence
gagtctggtgggtatgaggg

SEQ ID NO: 67632 - DNA, 20 bp, Artificial
  CRISPR gRNA sequence
gtgggtatgagggggtagga

SEQ ID NO: 67633 - DNA, 20 bp, Artificial
  CRISPR gRNA sequence
gaggctgggcttccggagga

SEQ ID NO: 67634 - DNA, 20 bp, Artificial
  CRISPR gRNA sequence
ggcttccggaggaggggtgc

SEQ ID NO: 67635 - DNA, 20 bp, Artificial
  CRISPR gRNA sequence
ccggaggaggggtgctggcc

SEQ ID NO: 67636 - DNA, 20 bp, Artificial
  CRISPR gRNA sequence
cggaggaggggtgctggccc

SEQ ID NO: 67637 - DNA, 20 bp, Artificial
  CRISPR gRNA sequence
gccccgtgggggcatcctga

SEQ ID NO: 67638 - DNA, 20 bp, Artificial
  CRISPR gRNA sequence
aggctgtggccacagctgtc

SEQ ID NO: 67639 - DNA, 20 bp, Artificial
  CRISPR gRNA sequence
tggccacagctgtctgaccc

SEQ ID NO: 67640 - DNA, 20 bp, Artificial
  CRISPR gRNA sequence
tctgacccaggtcctgtctg

SEQ ID NO: 67641 - DNA, 20 bp, Artificial
  CRISPR gRNA sequence
acccaggtcctgtctgatcc

SEQ ID NO: 67642 - DNA, 20 bp, Artificial
  CRISPR gRNA sequence
tctgatccaggtccctgcac

SEQ ID NO: 67643 - DNA, 20 bp, Artificial
  CRISPR gRNA sequence
atccaggtccctgcaccatg

SEQ ID NO: 67644 - DNA, 20 bp, Artificial
  CRISPR gRNA sequence
caccatgcaactttgcactt

SEQ ID NO: 67645 - DNA, 20 bp, Artificial
  CRISPR gRNA sequence
tgcacttcagatccaacgag

SEQ ID NO: 67646 - DNA, 20 bp, Artificial
  CRISPR gRNA sequence
gcacttcagatccaacgagg

SEQ ID NO: 67647 - DNA, 20 bp, Artificial
  CRISPR gRNA sequence
cacttcagatccaacgagga

SEQ ID NO: 67648 - DNA, 20 bp, Artificial
  CRISPR gRNA sequence
cagatccaacgaggaggagg

SEQ ID NO: 67649 - DNA, 20 bp, Artificial
  CRISPR gRNA sequence
agatccaacgaggaggagga

SEQ ID NO: 67650 - DNA, 20 bp, Artificial
  CRISPR gRNA sequence
tgggtaagcccccttgaacc

SEQ ID NO: 67651 - DNA, 20 bp, Artificial
  CRISPR gRNA sequence
gaaccatgcctaggcagcta

SEQ ID NO: 67652 - DNA, 20 bp, Artificial
  CRISPR gRNA sequence
aaccatgcctaggcagctag

SEQ ID NO: 67653 - DNA, 20 bp, Artificial
  CRISPR gRNA sequence
ggcagctagttgatgttggg

SEQ ID NO: 67654 - DNA, 20 bp, Artificial
  CRISPR gRNA sequence
gttgatgttggggaccagta

SEQ ID NO: 67655 - DNA, 20 bp, Artificial
  CRISPR gRNA sequence
atgttggggaccagtagatc

SEQ ID NO: 67656 - DNA, 20 bp, Artificial
  CRISPR gRNA sequence
gggaccagtagatctgcctc

SEQ ID NO: 67657 - DNA, 20 bp, Artificial
  CRISPR gRNA sequence
cctcctgggtggccagagca

SEQ ID NO: 67658 - DNA, 20 bp, Artificial
  CRISPR gRNA sequence
ctgggtggccagagcagtat

SEQ ID NO: 67659 - DNA, 20 bp, Artificial
  CRISPR gRNA sequence
ggtggccagagcagtatgca

SEQ ID NO: 67660 - DNA, 20 bp, Artificial
  CRISPR gRNA sequence
cctaccacaaaacattcccc

SEQ ID NO: 67661 - DNA, 20 bp, Artificial
  CRISPR gRNA sequence
ccacaaaacattcccctgga

SEQ ID NO: 67662 - DNA, 20 bp, Artificial
  CRISPR gRNA sequence
ccctggaacaaccctgcaga

SEQ ID NO: 67663 - DNA, 20 bp, Artificial
  CRISPR gRNA sequence
gaacaaccctgcagagggac

SEQ ID NO: 67664 - DNA, 20 bp, Artificial
  CRISPR gRNA sequence
cagagggacttgtttcaccc

SEQ ID NO: 67665 - DNA, 20 bp, Artificial
  CRISPR gRNA sequence
gtttcacccagcatgaagaa

SEQ ID NO: 67666 - DNA, 20 bp, Artificial
  CRISPR gRNA sequence
tttcacccagcatgaagaaa

SEQ ID NO: 67667 - DNA, 20 bp, Artificial
  CRISPR gRNA sequence
cacccagcatgaagaaacac

SEQ ID NO: 67668 - DNA, 20 bp, Artificial
  CRISPR gRNA sequence
acccagcatgaagaaacaca

SEQ ID NO: 67669 - DNA, 20 bp, Artificial
  CRISPR gRNA sequence
ctgtgggggtgggagcagtg

SEQ ID NO: 67670 - DNA, 20 bp, Artificial
  CRISPR gRNA sequence
tgggggtgggagcagtggat

SEQ ID NO: 67671 - DNA, 20 bp, Artificial
  CRISPR gRNA sequence
tggacacttccagagggtcc

SEQ ID NO: 67672 - DNA, 20 bp, Artificial
  CRISPR gRNA sequence
gacacttccagagggtccaa

SEQ ID NO: 67673 - DNA, 20 bp, Artificial
  CRISPR gRNA sequence
ccagagggtccaagcttgag

SEQ ID NO: 67674 - DNA, 20 bp, Artificial
  CRISPR gRNA sequence
cagagggtccaagcttgagt

SEQ ID NO: 67675 - DNA, 20 bp, Artificial
  CRISPR gRNA sequence
gagtggagacccacctggag

SEQ ID NO: 67676 - DNA, 20 bp, Artificial
  CRISPR gRNA sequence
agtggagacccacctggagc

SEQ ID NO: 67677 - DNA, 20 bp, Artificial
  CRISPR gRNA sequence
gagcccagaggctgtgccct

SEQ ID NO: 67678 - DNA, 20 bp, Artificial
  CRISPR gRNA sequence
tgccctgggctagccaggcc

SEQ ID NO: 67679 - DNA, 20 bp, Artificial
  CRISPR gRNA sequence
ggctagccaggccggagggg

SEQ ID NO: 67680 - DNA, 20 bp, Artificial
  CRISPR gRNA sequence
gccaggccggagggggtctc

SEQ ID NO: 67681 - DNA, 20 bp, Artificial
  CRISPR gRNA sequence
agtggccaaacgccccatcc

SEQ ID NO: 67682 - DNA, 20 bp, Artificial
  CRISPR gRNA sequence
cttgtcccctttacctccgt

SEQ ID NO: 67683 - DNA, 20 bp, Artificial
  CRISPR gRNA sequence
gtcccctttacctccgtcca

SEQ ID NO: 67684 - DNA, 20 bp, Artificial
  CRISPR gRNA sequence
tcccctttacctccgtccag

SEQ ID NO: 67685 - DNA, 20 bp, Artificial
  CRISPR gRNA sequence
tacctccgtccagcaggttc

SEQ ID NO: 67686 - DNA, 20 bp, Artificial
  CRISPR gRNA sequence
acctccgtccagcaggttca

SEQ ID NO: 67687 - DNA, 20 bp, Artificial
  CRISPR gRNA sequence
cctccgtccagcaggttcac

SEQ ID NO: 67688 - DNA, 20 bp, Artificial
  CRISPR gRNA sequence
cgtccagcaggttcacaggc

SEQ ID NO: 67689 - DNA, 20 bp, Artificial
  CRISPR gRNA sequence
acaggctgcagcctcagcca

SEQ ID NO: 67690 - DNA, 20 bp, Artificial
  CRISPR gRNA sequence
cagcctcagccaggagcacg

SEQ ID NO: 67691 - DNA, 20 bp, Artificial
  CRISPR gRNA sequence
agccaggagcacgtagagtc

SEQ ID NO: 67692 - DNA, 20 bp, Artificial
  CRISPR gRNA sequence
tgctggttgctgagcaagtg

SEQ ID NO: 67693 - DNA, 20 bp, Artificial
  CRISPR gRNA sequence
ctggttgctgagcaagtgta

SEQ ID NO: 67694 - DNA, 20 bp, Artificial
  CRISPR gRNA sequence
gttgctgagcaagtgtaaag

SEQ ID NO: 67695 - DNA, 20 bp, Artificial
  CRISPR gRNA sequence
ctgagcaagtgtaaagacct

SEQ ID NO: 67696 - DNA, 20 bp, Artificial
  CRISPR gRNA sequence
agcaagtgtaaagacctcag

SEQ ID NO: 67697 - DNA, 20 bp, Artificial
  CRISPR gRNA sequence
agccaggtggagtaagttga

SEQ ID NO: 67698 - DNA, 20 bp, Artificial
  CRISPR gRNA sequence
agggaggaggaggaaggaga

SEQ ID NO: 67699 - DNA, 20 bp, Artificial
  CRISPR gRNA sequence
aggggcactgaagggggtat

SEQ ID NO: 67700 - DNA, 20 bp, Artificial
  CRISPR gRNA sequence
aagggggtatgagggtccgt

SEQ ID NO: 67701 - DNA, 20 bp, Artificial
  CRISPR gRNA sequence
atgtgtgcctgcctacacct

SEQ ID NO: 67702 - DNA, 20 bp, Artificial
  CRISPR gRNA sequence
cctacacctctcaggaccag

SEQ ID NO: 67703 - DNA, 20 bp, Artificial
  CRISPR gRNA sequence
cacctctcaggaccagctgt

SEQ ID NO: 67704 - DNA, 20 bp, Artificial
  CRISPR gRNA sequence
tcaggaccagctgtcaggga

SEQ ID NO: 67705 - DNA, 20 bp, Artificial
  CRISPR gRNA sequence
aggaccagctgtcagggatg

SEQ ID NO: 67706 - DNA, 20 bp, Artificial
  CRISPR gRNA sequence
tcagggatgcctgggtcaca

SEQ ID NO: 67707 - DNA, 20 bp, Artificial
  CRISPR gRNA sequence
ggtcacatacccaaagcttc

SEQ ID NO: 67708 - DNA, 20 bp, Artificial
  CRISPR gRNA sequence
ccctgaatcaattttctctc

SEQ ID NO: 67709 - DNA, 20 bp, Artificial
  CRISPR gRNA sequence
cctgaatcaattttctctct

SEQ ID NO: 67710 - DNA, 20 bp, Artificial
  CRISPR gRNA sequence
aatcaattttctctctcccg

SEQ ID NO: 67711 - DNA, 20 bp, Artificial
  CRISPR gRNA sequence
tctctctcccgcccccactc

SEQ ID NO: 67712 - DNA, 20 bp, Artificial
  CRISPR gRNA sequence
ctctctcccgcccccactct

SEQ ID NO: 67713 - DNA, 20 bp, Artificial
  CRISPR gRNA sequence
tctctcccgcccccactctc

SEQ ID NO: 67714 - DNA, 20 bp, Artificial
  CRISPR gRNA sequence
tctcccgcccccactctcgc

SEQ ID NO: 67715 - DNA, 20 bp, Artificial
  CRISPR gRNA sequence
tcccgcccccactctcgcca

SEQ ID NO: 67716 - DNA, 20 bp, Artificial
  CRISPR gRNA sequence
ccgcccccactctcgccatg

SEQ ID NO: 67717 - DNA, 20 bp, Artificial
  CRISPR gRNA sequence
tcgccatggtggagctagtt

SEQ ID NO: 67718 - DNA, 20 bp, Artificial
  CRISPR gRNA sequence
gccatggtggagctagttcc

SEQ ID NO: 67719 - DNA, 20 bp, Artificial
  CRISPR gRNA sequence
gttccatggtgtgccctctg

SEQ ID NO: 67720 - DNA, 20 bp, Artificial
  CRISPR gRNA sequence
catggtgtgccctctgactt

SEQ ID NO: 67721 - DNA, 20 bp, Artificial
  CRISPR gRNA sequence
tgacttgggcagccctcagc

SEQ ID NO: 67722 - DNA, 20 bp, Artificial
  CRISPR gRNA sequence
acttgggcagccctcagcct

SEQ ID NO: 67723 - DNA, 20 bp, Artificial
  CRISPR gRNA sequence
gggcagccctcagcctcaag

SEQ ID NO: 67724 - DNA, 20 bp, Artificial
  CRISPR gRNA sequence
ggcagccctcagcctcaagt

SEQ ID NO: 67725 - DNA, 20 bp, Artificial
  CRISPR gRNA sequence
agcctcaagtatgtgcaagc

SEQ ID NO: 67726 - DNA, 20 bp, Artificial
  CRISPR gRNA sequence
aagtatgtgcaagctctgct

SEQ ID NO: 67727 - DNA, 20 bp, Artificial
  CRISPR gRNA sequence
tgctggcagatgggggctaa

SEQ ID NO: 67728 - DNA, 20 bp, Artificial
  CRISPR gRNA sequence
ctggcagatgggggctaaaa

SEQ ID NO: 67729 - DNA, 20 bp, Artificial
  CRISPR gRNA sequence
gcagatgggggctaaaacgc

SEQ ID NO: 67730 - DNA, 20 bp, Artificial
  CRISPR gRNA sequence
aaacgcaggattcattgttg

SEQ ID NO: 67731 - DNA, 20 bp, Artificial
  CRISPR gRNA sequence
attgttggcccagcaggtgg

SEQ ID NO: 67732 - DNA, 20 bp, Artificial
  CRISPR gRNA sequence
ttggcccagcaggtggttaa

SEQ ID NO: 67733 - DNA, 20 bp, Artificial
  CRISPR gRNA sequence
gcccagcaggtggttaaaag

SEQ ID NO: 67734 - DNA, 20 bp, Artificial
  CRISPR gRNA sequence
aaagtaccggatgactctgc

SEQ ID NO: 67735 - DNA, 20 bp, Artificial
  CRISPR gRNA sequence
tgcctgaggagggacgcaga

SEQ ID NO: 67736 - DNA, 20 bp, Artificial
  CRISPR gRNA sequence
cctgaggagggacgcagagc

SEQ ID NO: 67737 - DNA, 20 bp, Artificial
  CRISPR gRNA sequence
aggagggacgcagagccagc

SEQ ID NO: 67738 - DNA, 20 bp, Artificial
  CRISPR gRNA sequence
gcagtctcttgtattgttga

SEQ ID NO: 67739 - DNA, 20 bp, Artificial
  CRISPR gRNA sequence
cagtctcttgtattgttgag

SEQ ID NO: 67740 - DNA, 20 bp, Artificial
  CRISPR gRNA sequence
ttgtattgttgagatgtggt

SEQ ID NO: 67741 - DNA, 20 bp, Artificial
  CRISPR gRNA sequence
gtattgttgagatgtggtat

SEQ ID NO: 67742 - DNA, 20 bp, Artificial
  CRISPR gRNA sequence
tattgttgagatgtggtatc

SEQ ID NO: 67743 - DNA, 20 bp, Artificial
  CRISPR gRNA sequence
ttgagatgtggtatctgcgt

SEQ ID NO: 67744 - DNA, 20 bp, Artificial
  CRISPR gRNA sequence
agatgtggtatctgcgtggc

SEQ ID NO: 67745 - DNA, 20 bp, Artificial
  CRISPR gRNA sequence
cgtggcctgtcttggatatt

SEQ ID NO: 67746 - DNA, 20 bp, Artificial
  CRISPR gRNA sequence
tcttggatattcaaatagtc

SEQ ID NO: 67747 - DNA, 20 bp, Artificial
  CRISPR gRNA sequence
ggatattcaaatagtcagcc

SEQ ID NO: 67748 - DNA, 20 bp, Artificial
  CRISPR gRNA sequence
gatattcaaatagtcagccc

SEQ ID NO: 67749 - DNA, 20 bp, Artificial
  CRISPR gRNA sequence
aaatagtcagcccctgcatg

SEQ ID NO: 67750 - DNA, 20 bp, Artificial
  CRISPR gRNA sequence
catgggtggaataataatag

SEQ ID NO: 67751 - DNA, 20 bp, Artificial
  CRISPR gRNA sequence
acagctactgagcactttct

SEQ ID NO: 67752 - DNA, 20 bp, Artificial
  CRISPR gRNA sequence
ctgagcactttctccactgt

SEQ ID NO: 67753 - DNA, 20 bp, Artificial
  CRISPR gRNA sequence
agcactttctccactgttct

SEQ ID NO: 67754 - DNA, 20 bp, Artificial
  CRISPR gRNA sequence
tctccactgttctaagtgct

SEQ ID NO: 67755 - DNA, 20 bp, Artificial
  CRISPR gRNA sequence
ctccactgttctaagtgctt

SEQ ID NO: 67756 - DNA, 20 bp, Artificial
  CRISPR gRNA sequence
tccactgttctaagtgcttg

SEQ ID NO: 67757 - DNA, 20 bp, Artificial
  CRISPR gRNA sequence
cactgttctaagtgcttgac

SEQ ID NO: 67758 - DNA, 20 bp, Artificial
  CRISPR gRNA sequence
ttctaagtgcttgacatgtt

SEQ ID NO: 67759 - DNA, 20 bp, Artificial
  CRISPR gRNA sequence
taagtgcttgacatgttctt

SEQ ID NO: 67760 - DNA, 20 bp, Artificial
  CRISPR gRNA sequence
agtgcttgacatgttctttt

SEQ ID NO: 67761 - DNA, 20 bp, Artificial
  CRISPR gRNA sequence
gacatgttctttttatgttt

SEQ ID NO: 67762 - DNA, 20 bp, Artificial
  CRISPR gRNA sequence
acatgttctttttatgtttc

SEQ ID NO: 67763 - DNA, 20 bp, Artificial
  CRISPR gRNA sequence
tttttatgtttcccatatcc

SEQ ID NO: 67764 - DNA, 20 bp, Artificial
  CRISPR gRNA sequence
tttatgtttcccatatccct

SEQ ID NO: 67765 - DNA, 20 bp, Artificial
  CRISPR gRNA sequence
ttatgtttcccatatccctg

SEQ ID NO: 67766 - DNA, 20 bp, Artificial
  CRISPR gRNA sequence
tatgtttcccatatccctgg

SEQ ID NO: 67767 - DNA, 20 bp, Artificial
  CRISPR gRNA sequence
atgtttcccatatccctgga

SEQ ID NO: 67768 - DNA, 20 bp, Artificial
  CRISPR gRNA sequence
tgtttcccatatccctggat

SEQ ID NO: 67769 - DNA, 20 bp, Artificial
  CRISPR gRNA sequence
cccatatccctggatactag

SEQ ID NO: 67770 - DNA, 20 bp, Artificial
  CRISPR gRNA sequence
ccatatccctggatactagt

SEQ ID NO: 67771 - DNA, 20 bp, Artificial
  CRISPR gRNA sequence
gatactagtattgttctcat

SEQ ID NO: 67772 - DNA, 20 bp, Artificial
  CRISPR gRNA sequence
gtattgttctcattttacag

SEQ ID NO: 67773 - DNA, 20 bp, Artificial
  CRISPR gRNA sequence
ttctcattttacagatgagg

SEQ ID NO: 67774 - DNA, 20 bp, Artificial
  CRISPR gRNA sequence
tcattttacagatgagggaa

SEQ ID NO: 67775 - DNA, 20 bp, Artificial
  CRISPR gRNA sequence
attttacagatgagggaact

SEQ ID NO: 67776 - DNA, 20 bp, Artificial
  CRISPR gRNA sequence
tacagatgagggaactgaga

SEQ ID NO: 67777 - DNA, 20 bp, Artificial
  CRISPR gRNA sequence
acagatgagggaactgagac

SEQ ID NO: 67778 - DNA, 20 bp, Artificial
  CRISPR gRNA sequence
cagatgagggaactgagaca

SEQ ID NO: 67779 - DNA, 20 bp, Artificial
  CRISPR gRNA sequence
agacacagagggtgtaagaa

SEQ ID NO: 67780 - DNA, 20 bp, Artificial
  CRISPR gRNA sequence
gcccaaggtcacacagctag

SEQ ID NO: 67781 - DNA, 20 bp, Artificial
  CRISPR gRNA sequence
cccaaggtcacacagctagt

SEQ ID NO: 67782 - DNA, 20 bp, Artificial
  CRISPR gRNA sequence
gtaaaatgcagagtccctgc

SEQ ID NO: 67783 - DNA, 20 bp, Artificial
  CRISPR gRNA sequence
ctcagacgcattgggaatcc

SEQ ID NO: 67784 - DNA, 20 bp, Artificial
  CRISPR gRNA sequence
agacgcattgggaatccagc

SEQ ID NO: 67785 - DNA, 20 bp, Artificial
  CRISPR gRNA sequence
ggaatccagcctaggaccag

SEQ ID NO: 67786 - DNA, 20 bp, Artificial
  CRISPR gRNA sequence
ggaccagtgggaaatagaga

SEQ ID NO: 67787 - DNA, 20 bp, Artificial
  CRISPR gRNA sequence
tcatttctgttgtgatgtgg

SEQ ID NO: 67788 - DNA, 20 bp, Artificial
  CRISPR gRNA sequence
catttctgttgtgatgtggc

SEQ ID NO: 67789 - DNA, 20 bp, Artificial
  CRISPR gRNA sequence
atttctgttgtgatgtggca

SEQ ID NO: 67790 - DNA, 20 bp, Artificial
  CRISPR gRNA sequence
ctgttgtgatgtggcagaga

SEQ ID NO: 67791 - DNA, 20 bp, Artificial
  CRISPR gRNA sequence
tgttgtgatgtggcagagaa

SEQ ID NO: 67792 - DNA, 20 bp, Artificial
  CRISPR gRNA sequence
ttgtgatgtggcagagaaga

SEQ ID NO: 67793 - DNA, 20 bp, Artificial
  CRISPR gRNA sequence
tgatgtggcagagaagaaaa

SEQ ID NO: 67794 - DNA, 20 bp, Artificial
  CRISPR gRNA sequence
ataaaatcatggatttcttt

SEQ ID NO: 67795 - DNA, 20 bp, Artificial
  CRISPR gRNA sequence
cttttttttttaagacctgg

SEQ ID NO: 67796 - DNA, 20 bp, Artificial
  CRISPR gRNA sequence
ttttttttttaagacctggg

SEQ ID NO: 67797 - DNA, 20 bp, Artificial
  CRISPR gRNA sequence
ttttttttaagacctggggt

SEQ ID NO: 67798 - DNA, 20 bp, Artificial
  CRISPR gRNA sequence
tttttttaagacctggggtc

SEQ ID NO: 67799 - DNA, 20 bp, Artificial
  CRISPR gRNA sequence
ttttttaagacctggggtct

SEQ ID NO: 67800 - DNA, 20 bp, Artificial
  CRISPR gRNA sequence
tttttaagacctggggtctc

SEQ ID NO: 67801 - DNA, 20 bp, Artificial
  CRISPR gRNA sequence
ttttaagacctggggtctca

SEQ ID NO: 67802 - DNA, 20 bp, Artificial
  CRISPR gRNA sequence
tttaagacctggggtctcac

SEQ ID NO: 67803 - DNA, 20 bp, Artificial
  CRISPR gRNA sequence
ttaagacctggggtctcact

SEQ ID NO: 67804 - DNA, 20 bp, Artificial
  CRISPR gRNA sequence
taagacctggggtctcactc

SEQ ID NO: 67805 - DNA, 20 bp, Artificial
  CRISPR gRNA sequence
aagacctggggtctcactct

SEQ ID NO: 67806 - DNA, 20 bp, Artificial
  CRISPR gRNA sequence
agacctggggtctcactctg

SEQ ID NO: 67807 - DNA, 20 bp, Artificial
  CRISPR gRNA sequence
gggtctcactctgttgccca

SEQ ID NO: 67808 - DNA, 20 bp, Artificial
  CRISPR gRNA sequence
actctgttgcccaggctgga

SEQ ID NO: 67809 - DNA, 20 bp, Artificial
  CRISPR gRNA sequence
tgttgcccaggctggagtgc

SEQ ID NO: 67810 - DNA, 20 bp, Artificial
  CRISPR gRNA sequence
ttgcccaggctggagtgcag

SEQ ID NO: 67811 - DNA, 20 bp, Artificial
  CRISPR gRNA sequence
cccaggctggagtgcagtgg

SEQ ID NO: 67812 - DNA, 20 bp, Artificial
  CRISPR gRNA sequence
gagtgcagtggtgcaatgat

SEQ ID NO: 67813 - DNA, 20 bp, Artificial
  CRISPR gRNA sequence
cagcctccaactcctgggct

SEQ ID NO: 67814 - DNA, 20 bp, Artificial
  CRISPR gRNA sequence
caactcctgggctcaagcga

SEQ ID NO: 67815 - DNA, 20 bp, Artificial
  CRISPR gRNA sequence
ctgggctcaagcgatcctcc

SEQ ID NO: 67816 - DNA, 20 bp, Artificial
  CRISPR gRNA sequence
ggctcaagcgatcctcccac

SEQ ID NO: 67817 - DNA, 20 bp, Artificial
  CRISPR gRNA sequence
aagcgatcctcccacctcag

SEQ ID NO: 67818 - DNA, 20 bp, Artificial
  CRISPR gRNA sequence
ccacctcagcctctggagta

SEQ ID NO: 67819 - DNA, 20 bp, Artificial
  CRISPR gRNA sequence
agcctctggagtagctggga

SEQ ID NO: 67820 - DNA, 20 bp, Artificial
  CRISPR gRNA sequence
tggagtagctgggactacag

SEQ ID NO: 67821 - DNA, 20 bp, Artificial
  CRISPR gRNA sequence
gagtagctgggactacaggc

SEQ ID NO: 67822 - DNA, 20 bp, Artificial
  CRISPR gRNA sequence
ggactacaggcacacaccaa

SEQ ID NO: 67823 - DNA, 20 bp, Artificial
  CRISPR gRNA sequence
caggcacacaccaacatgcc

SEQ ID NO: 67824 - DNA, 20 bp, Artificial
  CRISPR gRNA sequence
gctaatagtttagttttgta

SEQ ID NO: 67825 - DNA, 20 bp, Artificial
  CRISPR gRNA sequence
atagtttagttttgtaagag

SEQ ID NO: 67826 - DNA, 20 bp, Artificial
  CRISPR gRNA sequence
agttttgtaagagatgaagt

SEQ ID NO: 67827 - DNA, 20 bp, Artificial
  CRISPR gRNA sequence
gttttgtaagagatgaagtc

SEQ ID NO: 67828 - DNA, 20 bp, Artificial
  CRISPR gRNA sequence
tgtaagagatgaagtctcac

SEQ ID NO: 67829 - DNA, 20 bp, Artificial
  CRISPR gRNA sequence
gtaagagatgaagtctcacc

SEQ ID NO: 67830 - DNA, 20 bp, Artificial
  CRISPR gRNA sequence
taagagatgaagtctcacca

SEQ ID NO: 67831 - DNA, 20 bp, Artificial
  CRISPR gRNA sequence
accatgttccccaggttggt

SEQ ID NO: 67832 - DNA, 20 bp, Artificial
  CRISPR gRNA sequence
cccaggttggtctcaaactt

SEQ ID NO: 67833 - DNA, 20 bp, Artificial
  CRISPR gRNA sequence
gtctcaaacttctgagctca

SEQ ID NO: 67834 - DNA, 20 bp, Artificial
  CRISPR gRNA sequence
aaacttctgagctcaggtga

SEQ ID NO: 67835 - DNA, 20 bp, Artificial
  CRISPR gRNA sequence
ctgagctcaggtgatcctca

SEQ ID NO: 67836 - DNA, 20 bp, Artificial
  CRISPR gRNA sequence
tgagctcaggtgatcctcag

SEQ ID NO: 67837 - DNA, 20 bp, Artificial
  CRISPR gRNA sequence
agctcaggtgatcctcagcc

SEQ ID NO: 67838 - DNA, 20 bp, Artificial
  CRISPR gRNA sequence
aggtgatcctcagcctccca

SEQ ID NO: 67839 - DNA, 20 bp, Artificial
  CRISPR gRNA sequence
agcctcccaggttgctgaga

SEQ ID NO: 67840 - DNA, 20 bp, Artificial
  CRISPR gRNA sequence
ccaggttgctgagattacag

SEQ ID NO: 67841 - DNA, 20 bp, Artificial
  CRISPR gRNA sequence
ctgagattacaggcatgagc

SEQ ID NO: 67842 - DNA, 20 bp, Artificial
  CRISPR gRNA sequence
agattacaggcatgagccgc

SEQ ID NO: 67843 - DNA, 20 bp, Artificial
  CRISPR gRNA sequence
caggcatgagccgctgtgct

SEQ ID NO: 67844 - DNA, 20 bp, Artificial
  CRISPR gRNA sequence
tgcttggaatgtattttaaa

SEQ ID NO: 67845 - DNA, 20 bp, Artificial
  CRISPR gRNA sequence
ggaatgtattttaaacagat

SEQ ID NO: 67846 - DNA, 20 bp, Artificial
  CRISPR gRNA sequence
gaatgtattttaaacagata

SEQ ID NO: 67847 - DNA, 20 bp, Artificial
  CRISPR gRNA sequence
taaacagatatgaataagaa

SEQ ID NO: 67848 - DNA, 20 bp, Artificial
  CRISPR gRNA sequence
aaacagatatgaataagaaa

SEQ ID NO: 67849 - DNA, 20 bp, Artificial
  CRISPR gRNA sequence
aacagatatgaataagaaat

SEQ ID NO: 67850 - DNA, 20 bp, Artificial
  CRISPR gRNA sequence
tgagttttttgtttttcatt

SEQ ID NO: 67851 - DNA, 20 bp, Artificial
  CRISPR gRNA sequence
gagttttttgtttttcatta

SEQ ID NO: 67852 - DNA, 20 bp, Artificial
  CRISPR gRNA sequence
agttttttgtttttcattat

SEQ ID NO: 67853 - DNA, 20 bp, Artificial
  CRISPR gRNA sequence
tttgtttttcattatagagg

SEQ ID NO: 67854 - DNA, 20 bp, Artificial
  CRISPR gRNA sequence
ttgtttttcattatagaggg

SEQ ID NO: 67855 - DNA, 20 bp, Artificial
  CRISPR gRNA sequence
tgtttttcattatagaggga

SEQ ID NO: 67856 - DNA, 20 bp, Artificial
  CRISPR gRNA sequence
gtttttcattatagagggaa

SEQ ID NO: 67857 - DNA, 20 bp, Artificial
  CRISPR gRNA sequence
tttttcattatagagggaaa

SEQ ID NO: 67858 - DNA, 20 bp, Artificial
  CRISPR gRNA sequence
ttcattatagagggaaattt

SEQ ID NO: 67859 - DNA, 20 bp, Artificial
  CRISPR gRNA sequence
tcattatagagggaaatttt

SEQ ID NO: 67860 - DNA, 20 bp, Artificial
  CRISPR gRNA sequence
cattatagagggaaattttt

SEQ ID NO: 67861 - DNA, 20 bp, Artificial
  CRISPR gRNA sequence
attatagagggaaatttttc

SEQ ID NO: 67862 - DNA, 20 bp, Artificial
  CRISPR gRNA sequence
tagagggaaatttttctttt

SEQ ID NO: 67863 - DNA, 20 bp, Artificial
  CRISPR gRNA sequence
ttcttttctttctttctttt

SEQ ID NO: 67864 - DNA, 20 bp, Artificial
  CRISPR gRNA sequence
tcttttctttctttcttttt

SEQ ID NO: 67865 - DNA, 20 bp, Artificial
  CRISPR gRNA sequence
cttttctttctttctttttt

SEQ ID NO: 67866 - DNA, 20 bp, Artificial
  CRISPR gRNA sequence
ttttctttctttcttttttt

SEQ ID NO: 67867 - DNA, 20 bp, Artificial
  CRISPR gRNA sequence
ttctttctttcttttttttt

SEQ ID NO: 67868 - DNA, 20 bp, Artificial
  CRISPR gRNA sequence
tctttctttcttttttttta

SEQ ID NO: 67869 - DNA, 20 bp, Artificial
  CRISPR gRNA sequence
ctttctttctttttttttag

SEQ ID NO: 67870 - DNA, 20 bp, Artificial
  CRISPR gRNA sequence
tttctttctttttttttaga

SEQ ID NO: 67871 - DNA, 20 bp, Artificial
  CRISPR gRNA sequence
tctttctttttttttagatg

SEQ ID NO: 67872 - DNA, 20 bp, Artificial
  CRISPR gRNA sequence
ctttctttttttttagatgg

SEQ ID NO: 67873 - DNA, 20 bp, Artificial
  CRISPR gRNA sequence
tttctttttttttagatgga

SEQ ID NO: 67874 - DNA, 20 bp, Artificial
  CRISPR gRNA sequence
tctttttttttagatggagt

SEQ ID NO: 67875 - DNA, 20 bp, Artificial
  CRISPR gRNA sequence
ctttttttttagatggagtc

SEQ ID NO: 67876 - DNA, 20 bp, Artificial
  CRISPR gRNA sequence
tttttttttagatggagtct

SEQ ID NO: 67877 - DNA, 20 bp, Artificial
  CRISPR gRNA sequence
tttttttagatggagtcttt

SEQ ID NO: 67878 - DNA, 20 bp, Artificial
  CRISPR gRNA sequence
ttttttagatggagtctttc

SEQ ID NO: 67879 - DNA, 20 bp, Artificial
  CRISPR gRNA sequence
tttttagatggagtctttct

SEQ ID NO: 67880 - DNA, 20 bp, Artificial
  CRISPR gRNA sequence
ttttagatggagtctttctc

SEQ ID NO: 67881 - DNA, 20 bp, Artificial
  CRISPR gRNA sequence
tttagatggagtctttctct

SEQ ID NO: 67882 - DNA, 20 bp, Artificial
  CRISPR gRNA sequence
ttagatggagtctttctctg

SEQ ID NO: 67883 - DNA, 20 bp, Artificial
  CRISPR gRNA sequence
tagatggagtctttctctgc

SEQ ID NO: 67884 - DNA, 20 bp, Artificial
  CRISPR gRNA sequence
agatggagtctttctctgct

SEQ ID NO: 67885 - DNA, 20 bp, Artificial
  CRISPR gRNA sequence
gatggagtctttctctgctg

SEQ ID NO: 67886 - DNA, 20 bp, Artificial
  CRISPR gRNA sequence
tctctgctgcccaggctgga

SEQ ID NO: 67887 - DNA, 20 bp, Artificial
  CRISPR gRNA sequence
ctctgctgcccaggctggaa

SEQ ID NO: 67888 - DNA, 20 bp, Artificial
  CRISPR gRNA sequence
tctgctgcccaggctggaat

SEQ ID NO: 67889 - DNA, 20 bp, Artificial
  CRISPR gRNA sequence
tgctgcccaggctggaatgc

SEQ ID NO: 67890 - DNA, 20 bp, Artificial
  CRISPR gRNA sequence
ctgcccaggctggaatgcag

SEQ ID NO: 67891 - DNA, 20 bp, Artificial
  CRISPR gRNA sequence
cccaggctggaatgcagtgg

SEQ ID NO: 67892 - DNA, 20 bp, Artificial
  CRISPR gRNA sequence
gaatgcagtggcgcaatttc

SEQ ID NO: 67893 - DNA, 20 bp, Artificial
  CRISPR gRNA sequence
cggctcactgcaacttccgc

SEQ ID NO: 67894 - DNA, 20 bp, Artificial
  CRISPR gRNA sequence
ggctcactgcaacttccgcc

SEQ ID NO: 67895 - DNA, 20 bp, Artificial
  CRISPR gRNA sequence
actgcaacttccgcctccca

SEQ ID NO: 67896 - DNA, 20 bp, Artificial
  CRISPR gRNA sequence
caacttccgcctcccaggtt

SEQ ID NO: 67897 - DNA, 20 bp, Artificial
  CRISPR gRNA sequence
ccgcctcccaggttcaagca

SEQ ID NO: 67898 - DNA, 20 bp, Artificial
  CRISPR gRNA sequence
cgcctcccaggttcaagcaa

SEQ ID NO: 67899 - DNA, 20 bp, Artificial
  CRISPR gRNA sequence
ccaggttcaagcaattctcc

SEQ ID NO: 67900 - DNA, 20 bp, Artificial
  CRISPR gRNA sequence
aagcaattctcctgcctcag

SEQ ID NO: 67901 - DNA, 20 bp, Artificial
  CRISPR gRNA sequence
tcctgcctcagcctcccaag

SEQ ID NO: 67902 - DNA, 20 bp, Artificial
  CRISPR gRNA sequence
ctgcctcagcctcccaagga

SEQ ID NO: 67903 - DNA, 20 bp, Artificial
  CRISPR gRNA sequence
cctcagcctcccaaggagct

SEQ ID NO: 67904 - DNA, 20 bp, Artificial
  CRISPR gRNA sequence
agcctcccaaggagctgaga

SEQ ID NO: 67905 - DNA, 20 bp, Artificial
  CRISPR gRNA sequence
ccaaggagctgagattacag

SEQ ID NO: 67906 - DNA, 20 bp, Artificial
  CRISPR gRNA sequence
agattacaggcatgagccac

SEQ ID NO: 67907 - DNA, 20 bp, Artificial
  CRISPR gRNA sequence
caggcatgagccaccatgcc

SEQ ID NO: 67908 - DNA, 20 bp, Artificial
  CRISPR gRNA sequence
gctaattttggtatttttag

SEQ ID NO: 67909 - DNA, 20 bp, Artificial
  CRISPR gRNA sequence
attttggtatttttagtaga

SEQ ID NO: 67910 - DNA, 20 bp, Artificial
  CRISPR gRNA sequence
tggtatttttagtagagacg

SEQ ID NO: 67911 - DNA, 20 bp, Artificial
  CRISPR gRNA sequence
ggtatttttagtagagacgg

SEQ ID NO: 67912 - DNA, 20 bp, Artificial
  CRISPR gRNA sequence
gtatttttagtagagacggg

SEQ ID NO: 67913 - DNA, 20 bp, Artificial
  CRISPR gRNA sequence
ttagtagagacggggtttca

SEQ ID NO: 67914 - DNA, 20 bp, Artificial
  CRISPR gRNA sequence
tagtagagacggggtttcac

SEQ ID NO: 67915 - DNA, 20 bp, Artificial
  CRISPR gRNA sequence
agtagagacggggtttcacc

SEQ ID NO: 67916 - DNA, 20 bp, Artificial
  CRISPR gRNA sequence
gtagagacggggtttcacca

SEQ ID NO: 67917 - DNA, 20 bp, Artificial
  CRISPR gRNA sequence
caccatgttggccaggctgg

SEQ ID NO: 67918 - DNA, 20 bp, Artificial
  CRISPR gRNA sequence
accatgttggccaggctggt

SEQ ID NO: 67919 - DNA, 20 bp, Artificial
  CRISPR gRNA sequence
gccaggctggtcttgaactc

SEQ ID NO: 67920 - DNA, 20 bp, Artificial
  CRISPR gRNA sequence
gtcttgaactcctgacctca

SEQ ID NO: 67921 - DNA, 20 bp, Artificial
  CRISPR gRNA sequence
gaactcctgacctcaggcga

SEQ ID NO: 67922 - DNA, 20 bp, Artificial
  CRISPR gRNA sequence
aactcctgacctcaggcgat

SEQ ID NO: 67923 - DNA, 20 bp, Artificial
  CRISPR gRNA sequence
ctgacctcaggcgatccgcc

SEQ ID NO: 67924 - DNA, 20 bp, Artificial
  CRISPR gRNA sequence
acctcaggcgatccgcctgc

SEQ ID NO: 67925 - DNA, 20 bp, Artificial
  CRISPR gRNA sequence
aggcgatccgcctgcctcgc

SEQ ID NO: 67926 - DNA, 20 bp, Artificial
  CRISPR gRNA sequence
cctcgccctcccaaagtgct

SEQ ID NO: 67927 - DNA, 20 bp, Artificial
  CRISPR gRNA sequence
gccctcccaaagtgctggga

SEQ ID NO: 67928 - DNA, 20 bp, Artificial
  CRISPR gRNA sequence
ccaaagtgctgggattacag

SEQ ID NO: 67929 - DNA, 20 bp, Artificial
  CRISPR gRNA sequence
ggattacagccttgagccac

SEQ ID NO: 67930 - DNA, 20 bp, Artificial
  CRISPR gRNA sequence
cagccttgagccaccgcacc

SEQ ID NO: 67931 - DNA, 20 bp, Artificial
  CRISPR gRNA sequence
gagccaccgcacccagccaa

SEQ ID NO: 67932 - DNA, 20 bp, Artificial
  CRISPR gRNA sequence
agccaccgcacccagccaat

SEQ ID NO: 67933 - DNA, 20 bp, Artificial
  CRISPR gRNA sequence
ttcttattttaaagactatt

SEQ ID NO: 67934 - DNA, 20 bp, Artificial
  CRISPR gRNA sequence
tcttattttaaagactattt

SEQ ID NO: 67935 - DNA, 20 bp, Artificial
  CRISPR gRNA sequence
cttattttaaagactatttt

SEQ ID NO: 67936 - DNA, 20 bp, Artificial
  CRISPR gRNA sequence
ttattttaaagactatttta

SEQ ID NO: 67937 - DNA, 20 bp, Artificial
  CRISPR gRNA sequence
attttaaagactattttatt

SEQ ID NO: 67938 - DNA, 20 bp, Artificial
  CRISPR gRNA sequence
ttttaaagactattttatta

SEQ ID NO: 67939 - DNA, 20 bp, Artificial
  CRISPR gRNA sequence
taaagactattttattaagt

SEQ ID NO: 67940 - DNA, 20 bp, Artificial
  CRISPR gRNA sequence
aaagactattttattaagtg

SEQ ID NO: 67941 - DNA, 20 bp, Artificial
  CRISPR gRNA sequence
aagactattttattaagtgg

SEQ ID NO: 67942 - DNA, 20 bp, Artificial
  CRISPR gRNA sequence
ttttattaagtggcttcata

SEQ ID NO: 67943 - DNA, 20 bp, Artificial
  CRISPR gRNA sequence
tattaagtggcttcataaga

SEQ ID NO: 67944 - DNA, 20 bp, Artificial
  CRISPR gRNA sequence
attaagtggcttcataagac

SEQ ID NO: 67945 - DNA, 20 bp, Artificial
  CRISPR gRNA sequence
ttaagtggcttcataagaca

SEQ ID NO: 67946 - DNA, 20 bp, Artificial
  CRISPR gRNA sequence
agtggcttcataagacagac

SEQ ID NO: 67947 - DNA, 20 bp, Artificial
  CRISPR gRNA sequence
cataagacagaccaattttt

SEQ ID NO: 67948 - DNA, 20 bp, Artificial
  CRISPR gRNA sequence
ataagacagaccaattttta

SEQ ID NO: 67949 - DNA, 20 bp, Artificial
  CRISPR gRNA sequence
ttaaatgacgtttctcagga

SEQ ID NO: 67950 - DNA, 20 bp, Artificial
  CRISPR gRNA sequence
taaatgacgtttctcaggaa

SEQ ID NO: 67951 - DNA, 20 bp, Artificial
  CRISPR gRNA sequence
aaatgacgtttctcaggaaa

SEQ ID NO: 67952 - DNA, 20 bp, Artificial
  CRISPR gRNA sequence
aatgacgtttctcaggaaaa

SEQ ID NO: 67953 - DNA, 20 bp, Artificial
  CRISPR gRNA sequence
ctcaggaaaagatgaaatta

SEQ ID NO: 67954 - DNA, 20 bp, Artificial
  CRISPR gRNA sequence
tcaggaaaagatgaaattaa

SEQ ID NO: 67955 - DNA, 20 bp, Artificial
  CRISPR gRNA sequence
aggaaaagatgaaattaaca

SEQ ID NO: 67956 - DNA, 20 bp, Artificial
  CRISPR gRNA sequence
acaaacatcaaaaatgtcac

SEQ ID NO: 67957 - DNA, 20 bp, Artificial
  CRISPR gRNA sequence
ggaggaaaatcagatgttcc

SEQ ID NO: 67958 - DNA, 20 bp, Artificial
  CRISPR gRNA sequence
cgggacacactggttatatt

SEQ ID NO: 67959 - DNA, 20 bp, Artificial
  CRISPR gRNA sequence
gttatattatttctgaaact

SEQ ID NO: 67960 - DNA, 20 bp, Artificial
  CRISPR gRNA sequence
tattatttctgaaactgtag

SEQ ID NO: 67961 - DNA, 20 bp, Artificial
  CRISPR gRNA sequence
tttctgaaactgtagttaaa

SEQ ID NO: 67962 - DNA, 20 bp, Artificial
  CRISPR gRNA sequence
ctgaaactgtagttaaaact

SEQ ID NO: 67963 - DNA, 20 bp, Artificial
  CRISPR gRNA sequence
tgaaactgtagttaaaacta

SEQ ID NO: 67964 - DNA, 20 bp, Artificial
  CRISPR gRNA sequence
aaactgtagttaaaactagc

SEQ ID NO: 67965 - DNA, 20 bp, Artificial
  CRISPR gRNA sequence
tagttaaaactagctgggcg

SEQ ID NO: 67966 - DNA, 20 bp, Artificial
  CRISPR gRNA sequence
aaactagctgggcgtggtgg

SEQ ID NO: 67967 - DNA, 20 bp, Artificial
  CRISPR gRNA sequence
gctgggcgtggtggctcacg

SEQ ID NO: 67968 - DNA, 20 bp, Artificial
  CRISPR gRNA sequence
ggcgtggtggctcacgcctg

SEQ ID NO: 67969 - DNA, 20 bp, Artificial
  CRISPR gRNA sequence
acgcctgtaatcccagcact

SEQ ID NO: 67970 - DNA, 20 bp, Artificial
  CRISPR gRNA sequence
taatcccagcactttgggag

SEQ ID NO: 67971 - DNA, 20 bp, Artificial
  CRISPR gRNA sequence
tgggaggccaaagcgggtgg

SEQ ID NO: 67972 - DNA, 20 bp, Artificial
  CRISPR gRNA sequence
gggaggccaaagcgggtgga

SEQ ID NO: 67973 - DNA, 20 bp, Artificial
  CRISPR gRNA sequence
ggaggccaaagcgggtggat

SEQ ID NO: 67974 - DNA, 20 bp, Artificial
  CRISPR gRNA sequence
aggtcaggagtttgagacca

SEQ ID NO: 67975 - DNA, 20 bp, Artificial
  CRISPR gRNA sequence
gagaccagcctgatcaacat

SEQ ID NO: 67976 - DNA, 20 bp, Artificial
  CRISPR gRNA sequence
agaccagcctgatcaacatg

SEQ ID NO: 67977 - DNA, 20 bp, Artificial
  CRISPR gRNA sequence
atcaacatggtgaaaacccg

SEQ ID NO: 67978 - DNA, 20 bp, Artificial
  CRISPR gRNA sequence
tactaaaaatacaaaaataa

SEQ ID NO: 67979 - DNA, 20 bp, Artificial
  CRISPR gRNA sequence
ctaaaaatacaaaaataatt

SEQ ID NO: 67980 - DNA, 20 bp, Artificial
  CRISPR gRNA sequence
aaaatacaaaaataattagc

SEQ ID NO: 67981 - DNA, 20 bp, Artificial
  CRISPR gRNA sequence
gccaggcatagtggcacatg

SEQ ID NO: 67982 - DNA, 20 bp, Artificial
  CRISPR gRNA sequence
taatcccagctacttgggag

SEQ ID NO: 67983 - DNA, 20 bp, Artificial
  CRISPR gRNA sequence
cttgggaggctgaggcagga

SEQ ID NO: 67984 - DNA, 20 bp, Artificial
  CRISPR gRNA sequence
gggaggctgaggcaggagaa

SEQ ID NO: 67985 - DNA, 20 bp, Artificial
  CRISPR gRNA sequence
ggaggctgaggcaggagaat

SEQ ID NO: 67986 - DNA, 20 bp, Artificial
  CRISPR gRNA sequence
aggcaggagaatctcttgaa

SEQ ID NO: 67987 - DNA, 20 bp, Artificial
  CRISPR gRNA sequence
ttgaacctgggagacagagg

SEQ ID NO: 67988 - DNA, 20 bp, Artificial
  CRISPR gRNA sequence
gaacctgggagacagaggtc

SEQ ID NO: 67989 - DNA, 20 bp, Artificial
  CRISPR gRNA sequence
aacctgggagacagaggtcg

SEQ ID NO: 67990 - DNA, 20 bp, Artificial
  CRISPR gRNA sequence
ggagacagaggtcgcagtga

SEQ ID NO: 67991 - DNA, 20 bp, Artificial
  CRISPR gRNA sequence
cactccagcctgggcaacag

SEQ ID NO: 67992 - DNA, 20 bp, Artificial
  CRISPR gRNA sequence
cagcctgggcaacagagcaa

SEQ ID NO: 67993 - DNA, 20 bp, Artificial
  CRISPR gRNA sequence
ggcaacagagcaagactcca

SEQ ID NO: 67994 - DNA, 20 bp, Artificial
  CRISPR gRNA sequence
catctcaaaataaataaata

SEQ ID NO: 67995 - DNA, 20 bp, Artificial
  CRISPR gRNA sequence
aaaataaataaataaataaa

SEQ ID NO: 67996 - DNA, 20 bp, Artificial
  CRISPR gRNA sequence
caatgaagggaagtaagaaa

SEQ ID NO: 67997 - DNA, 20 bp, Artificial
  CRISPR gRNA sequence
caggtgaggtttccaatatt

SEQ ID NO: 67998 - DNA, 20 bp, Artificial
  CRISPR gRNA sequence
aggtgaggtttccaatattg

SEQ ID NO: 67999 - DNA, 20 bp, Artificial
  CRISPR gRNA sequence
ccaatattgatattgcattc

SEQ ID NO: 68000 - DNA, 20 bp, Artificial
  CRISPR gRNA sequence
caatattgatattgcattcc

SEQ ID NO: 68001 - DNA, 20 bp, Artificial
  CRISPR gRNA sequence
atattgcattcccagattaa

SEQ ID NO: 68002 - DNA, 20 bp, Artificial
  CRISPR gRNA sequence
cattcccagattaaaagaag

SEQ ID NO: 68003 - DNA, 20 bp, Artificial
  CRISPR gRNA sequence
ccagattaaaagaagaaatc

SEQ ID NO: 68004 - DNA, 20 bp, Artificial
  CRISPR gRNA sequence
aaagaagaaatctatgggtt

SEQ ID NO: 68005 - DNA, 20 bp, Artificial
  CRISPR gRNA sequence
tgggtttaatgcatcctgca

SEQ ID NO: 68006 - DNA, 20 bp, Artificial
  CRISPR gRNA sequence
aatgcatcctgcaaacattt

SEQ ID NO: 68007 - DNA, 20 bp, Artificial
  CRISPR gRNA sequence
atgcatcctgcaaacatttt

SEQ ID NO: 68008 - DNA, 20 bp, Artificial
  CRISPR gRNA sequence
caaacatttttttttcctga

SEQ ID NO: 68009 - DNA, 20 bp, Artificial
  CRISPR gRNA sequence
ttttttcctgaatttcctct

SEQ ID NO: 68010 - DNA, 20 bp, Artificial
  CRISPR gRNA sequence
tttttcctgaatttcctctc

SEQ ID NO: 68011 - DNA, 20 bp, Artificial
  CRISPR gRNA sequence
ttttcctgaatttcctctca

SEQ ID NO: 68012 - DNA, 20 bp, Artificial
  CRISPR gRNA sequence
tttcctgaatttcctctcat

SEQ ID NO: 68013 - DNA, 20 bp, Artificial
  CRISPR gRNA sequence
ttcctgaatttcctctcatt

SEQ ID NO: 68014 - DNA, 20 bp, Artificial
  CRISPR gRNA sequence
tcctgaatttcctctcattc

SEQ ID NO: 68015 - DNA, 20 bp, Artificial
  CRISPR gRNA sequence
cctgaatttcctctcattca

SEQ ID NO: 68016 - DNA, 20 bp, Artificial
  CRISPR gRNA sequence
ctgaatttcctctcattcaa

SEQ ID NO: 68017 - DNA, 20 bp, Artificial
  CRISPR gRNA sequence
aatttcctctcattcaaaaa

SEQ ID NO: 68018 - DNA, 20 bp, Artificial
  CRISPR gRNA sequence
cctctcattcaaaaactgtg

SEQ ID NO: 68019 - DNA, 20 bp, Artificial
  CRISPR gRNA sequence
ctctcattcaaaaactgtgg

SEQ ID NO: 68020 - DNA, 20 bp, Artificial
  CRISPR gRNA sequence
tcattcaaaaactgtggatc

SEQ ID NO: 68021 - DNA, 20 bp, Artificial
  CRISPR gRNA sequence
attcaaaaactgtggatccc

SEQ ID NO: 68022 - DNA, 20 bp, Artificial
  CRISPR gRNA sequence
aaaaactgtggatcccaaat

SEQ ID NO: 68023 - DNA, 20 bp, Artificial
  CRISPR gRNA sequence
tggatcccaaatgatgccgg

SEQ ID NO: 68024 - DNA, 20 bp, Artificial
  CRISPR gRNA sequence
gtttttctttaacccttgaa

SEQ ID NO: 68025 - DNA, 20 bp, Artificial
  CRISPR gRNA sequence
ttctttaacccttgaaagcc

SEQ ID NO: 68026 - DNA, 20 bp, Artificial
  CRISPR gRNA sequence
tctttaacccttgaaagcct

SEQ ID NO: 68027 - DNA, 20 bp, Artificial
  CRISPR gRNA sequence
ctttaacccttgaaagcctg

SEQ ID NO: 68028 - DNA, 20 bp, Artificial
  CRISPR gRNA sequence
tttaacccttgaaagcctgc

SEQ ID NO: 68029 - DNA, 20 bp, Artificial
  CRISPR gRNA sequence
taacccttgaaagcctgctg

SEQ ID NO: 68030 - DNA, 20 bp, Artificial
  CRISPR gRNA sequence
aacccttgaaagcctgctgg

SEQ ID NO: 68031 - DNA, 20 bp, Artificial
  CRISPR gRNA sequence
acccttgaaagcctgctgga

SEQ ID NO: 68032 - DNA, 20 bp, Artificial
  CRISPR gRNA sequence
gaaagcctgctggaggcacc

SEQ ID NO: 68033 - DNA, 20 bp, Artificial
  CRISPR gRNA sequence
aaagcctgctggaggcacct

SEQ ID NO: 68034 - DNA, 20 bp, Artificial
  CRISPR gRNA sequence
ctggaggcacctgagctatg

SEQ ID NO: 68035 - DNA, 20 bp, Artificial
  CRISPR gRNA sequence
gaggcacctgagctatgagt

SEQ ID NO: 68036 - DNA, 20 bp, Artificial
  CRISPR gRNA sequence
agctatgagtggtcacccga

SEQ ID NO: 68037 - DNA, 20 bp, Artificial
  CRISPR gRNA sequence
tgagtggtcacccgatatgg

SEQ ID NO: 68038 - DNA, 20 bp, Artificial
  CRISPR gRNA sequence
actgtggtgctggggagggg

SEQ ID NO: 68039 - DNA, 20 bp, Artificial
  CRISPR gRNA sequence
ctgtggtgctggggagggga

SEQ ID NO: 68040 - DNA, 20 bp, Artificial
  CRISPR gRNA sequence
tggtgctggggaggggatag

SEQ ID NO: 68041 - DNA, 20 bp, Artificial
  CRISPR gRNA sequence
gggaggggatagtagcagag

SEQ ID NO: 68042 - DNA, 20 bp, Artificial
  CRISPR gRNA sequence
ctggtcattctagtggtgat

SEQ ID NO: 68043 - DNA, 20 bp, Artificial
  CRISPR gRNA sequence
gtcattctagtggtgatgga

SEQ ID NO: 68044 - DNA, 20 bp, Artificial
  CRISPR gRNA sequence
tagtggtgatggaagggatg

SEQ ID NO: 68045 - DNA, 20 bp, Artificial
  CRISPR gRNA sequence
gtggtgatggaagggatggt

SEQ ID NO: 68046 - DNA, 20 bp, Artificial
  CRISPR gRNA sequence
ggcttggtggtgtagaattg

SEQ ID NO: 68047 - DNA, 20 bp, Artificial
  CRISPR gRNA sequence
ggtggtgtagaattgtggtg

SEQ ID NO: 68048 - DNA, 20 bp, Artificial
  CRISPR gRNA sequence
gtggtgtagaattgtggtga

SEQ ID NO: 68049 - DNA, 20 bp, Artificial
  CRISPR gRNA sequence
tggtgataatgaaagtggtg

SEQ ID NO: 68050 - DNA, 20 bp, Artificial
  CRISPR gRNA sequence
gtggtggtgacattggtggt

SEQ ID NO: 68051 - DNA, 20 bp, Artificial
  CRISPR gRNA sequence
gtggtggtggtgatggtggt

SEQ ID NO: 68052 - DNA, 20 bp, Artificial
  CRISPR gRNA sequence
gtgatggtggtgatggtggt

SEQ ID NO: 68053 - DNA, 20 bp, Artificial
  CRISPR gRNA sequence
gtgaccctgacatggggtcc

SEQ ID NO: 68054 - DNA, 20 bp, Artificial
  CRISPR gRNA sequence
acatggggtccagtagcagt

SEQ ID NO: 68055 - DNA, 20 bp, Artificial
  CRISPR gRNA sequence
ctggtgactgaggagcatct

SEQ ID NO: 68056 - DNA, 20 bp, Artificial
  CRISPR gRNA sequence
gtgactgaggagcatctcag

SEQ ID NO: 68057 - DNA, 20 bp, Artificial
  CRISPR gRNA sequence
aggagcatctcaggctgagg

SEQ ID NO: 68058 - DNA, 20 bp, Artificial
  CRISPR gRNA sequence
aggctgaggaggcacctctg

SEQ ID NO: 68059 - DNA, 20 bp, Artificial
  CRISPR gRNA sequence
aggaggcacctctgatcccc

SEQ ID NO: 68060 - DNA, 20 bp, Artificial
  CRISPR gRNA sequence
tgatccccgccactgctcct

SEQ ID NO: 68061 - DNA, 20 bp, Artificial
  CRISPR gRNA sequence
atccccgccactgctcctta

SEQ ID NO: 68062 - DNA, 20 bp, Artificial
  CRISPR gRNA sequence
ctccttaccccctacagtct

SEQ ID NO: 68063 - DNA, 20 bp, Artificial
  CRISPR gRNA sequence
cttaccccctacagtctctc

SEQ ID NO: 68064 - DNA, 20 bp, Artificial
  CRISPR gRNA sequence
accccctacagtctctcagc

SEQ ID NO: 68065 - DNA, 20 bp, Artificial
  CRISPR gRNA sequence
ccccctacagtctctcagca

SEQ ID NO: 68066 - DNA, 20 bp, Artificial
  CRISPR gRNA sequence
cagtctctcagcaaacctgc

SEQ ID NO: 68067 - DNA, 20 bp, Artificial
  CRISPR gRNA sequence
tcagcaaacctgctgggcga

SEQ ID NO: 68068 - DNA, 20 bp, Artificial
  CRISPR gRNA sequence
agcaaacctgctgggcgaca

SEQ ID NO: 68069 - DNA, 20 bp, Artificial
  CRISPR gRNA sequence
ctgggcgacagcggactcag

SEQ ID NO: 68070 - DNA, 20 bp, Artificial
  CRISPR gRNA sequence
ggcgacagcggactcagatg

SEQ ID NO: 68071 - DNA, 20 bp, Artificial
  CRISPR gRNA sequence
agatgccttctggaatgtct

SEQ ID NO: 68072 - DNA, 20 bp, Artificial
  CRISPR gRNA sequence
ctggaatgtctgccgcaggt

SEQ ID NO: 68073 - DNA, 20 bp, Artificial
  CRISPR gRNA sequence
tggaatgtctgccgcaggtg

SEQ ID NO: 68074 - DNA, 20 bp, Artificial
  CRISPR gRNA sequence
gaatgtctgccgcaggtgcc

SEQ ID NO: 68075 - DNA, 20 bp, Artificial
  CRISPR gRNA sequence
ccgcaggtgcccatctccgg

SEQ ID NO: 68076 - DNA, 20 bp, Artificial
  CRISPR gRNA sequence
cggtttgcttgagtaagtgg

SEQ ID NO: 68077 - DNA, 20 bp, Artificial
  CRISPR gRNA sequence
gcttgagtaagtggaaagca

SEQ ID NO: 68078 - DNA, 20 bp, Artificial
  CRISPR gRNA sequence
cttgagtaagtggaaagcag

SEQ ID NO: 68079 - DNA, 20 bp, Artificial
  CRISPR gRNA sequence
gagtaagtggaaagcagcat

SEQ ID NO: 68080 - DNA, 20 bp, Artificial
  CRISPR gRNA sequence
agtaagtggaaagcagcata

SEQ ID NO: 68081 - DNA, 20 bp, Artificial
  CRISPR gRNA sequence
ccctaggccaaaagcatgat

SEQ ID NO: 68082 - DNA, 20 bp, Artificial
  CRISPR gRNA sequence
ggccaaaagcatgatggggg

SEQ ID NO: 68083 - DNA, 20 bp, Artificial
  CRISPR gRNA sequence
cttctgagggcatcccccag

SEQ ID NO: 68084 - DNA, 20 bp, Artificial
  CRISPR gRNA sequence
ctgagggcatcccccagagc

SEQ ID NO: 68085 - DNA, 20 bp, Artificial
  CRISPR gRNA sequence
tgagggcatcccccagagca

SEQ ID NO: 68086 - DNA, 20 bp, Artificial
  CRISPR gRNA sequence
agggcatcccccagagcacc

SEQ ID NO: 68087 - DNA, 20 bp, Artificial
  CRISPR gRNA sequence
tggagggcaaggggcaattc

SEQ ID NO: 68088 - DNA, 20 bp, Artificial
  CRISPR gRNA sequence
ttcccttgccttcactcccc

SEQ ID NO: 68089 - DNA, 20 bp, Artificial
  CRISPR gRNA sequence
cccttgccttcactcccctg

SEQ ID NO: 68090 - DNA, 20 bp, Artificial
  CRISPR gRNA sequence
ccttgccttcactcccctgg

SEQ ID NO: 68091 - DNA, 20 bp, Artificial
  CRISPR gRNA sequence
gccttcactcccctggcctt

SEQ ID NO: 68092 - DNA, 20 bp, Artificial
  CRISPR gRNA sequence
ccttcactcccctggccttg

SEQ ID NO: 68093 - DNA, 20 bp, Artificial
  CRISPR gRNA sequence
cactcccctggccttgggtc

SEQ ID NO: 68094 - DNA, 20 bp, Artificial
  CRISPR gRNA sequence
actcccctggccttgggtcc

SEQ ID NO: 68095 - DNA, 20 bp, Artificial
  CRISPR gRNA sequence
ccctggccttgggtcctttc

SEQ ID NO: 68096 - DNA, 20 bp, Artificial
  CRISPR gRNA sequence
gccttgggtcctttcctctg

SEQ ID NO: 68097 - DNA, 20 bp, Artificial
  CRISPR gRNA sequence
gggtcctttcctctgtccct

SEQ ID NO: 68098 - DNA, 20 bp, Artificial
  CRISPR gRNA sequence
ggtcctttcctctgtccctc

SEQ ID NO: 68099 - DNA, 20 bp, Artificial
  CRISPR gRNA sequence
tcctctgtccctcacaccca

SEQ ID NO: 68100 - DNA, 20 bp, Artificial
  CRISPR gRNA sequence
cctctgtccctcacacccac

SEQ ID NO: 68101 - DNA, 20 bp, Artificial
  CRISPR gRNA sequence
ctctgtccctcacacccacc

SEQ ID NO: 68102 - DNA, 20 bp, Artificial
  CRISPR gRNA sequence
tgtccctcacacccaccatg

SEQ ID NO: 68103 - DNA, 20 bp, Artificial
  CRISPR gRNA sequence
tccctcacacccaccatggg

SEQ ID NO: 68104 - DNA, 20 bp, Artificial
  CRISPR gRNA sequence
acacccaccatgggcagatc

SEQ ID NO: 68105 - DNA, 20 bp, Artificial
  CRISPR gRNA sequence
caccaaacacccaagagagg

SEQ ID NO: 68106 - DNA, 20 bp, Artificial
  CRISPR gRNA sequence
tgattcgtggcagggtgaca

SEQ ID NO: 68107 - DNA, 20 bp, Artificial
  CRISPR gRNA sequence
gtggcagggtgacacacccc

SEQ ID NO: 68108 - DNA, 20 bp, Artificial
  CRISPR gRNA sequence
cagccaaactgacctgggga

SEQ ID NO: 68109 - DNA, 20 bp, Artificial
  CRISPR gRNA sequence
acctggggacagggaagcaa

SEQ ID NO: 68110 - DNA, 20 bp, Artificial
  CRISPR gRNA sequence
gggacagggaagcaacattc

SEQ ID NO: 68111 - DNA, 20 bp, Artificial
  CRISPR gRNA sequence
catccccaaccagctgatgc

SEQ ID NO: 68112 - DNA, 20 bp, Artificial
  CRISPR gRNA sequence
atgcgggattgcagctgcct

SEQ ID NO: 68113 - DNA, 20 bp, Artificial
  CRISPR gRNA sequence
cagctgcctggctcctggtc

SEQ ID NO: 68114 - DNA, 20 bp, Artificial
  CRISPR gRNA sequence
cctggctcctggtccatccc

SEQ ID NO: 68115 - DNA, 20 bp, Artificial
  CRISPR gRNA sequence
gctcctggtccatcccgtcc

SEQ ID NO: 68116 - DNA, 20 bp, Artificial
  CRISPR gRNA sequence
ctggtccatcccgtccctga

SEQ ID NO: 68117 - DNA, 20 bp, Artificial
  CRISPR gRNA sequence
gtccatcccgtccctgaaat

SEQ ID NO: 68118 - DNA, 20 bp, Artificial
  CRISPR gRNA sequence
aaattcttctgacccaatct

SEQ ID NO: 68119 - DNA, 20 bp, Artificial
  CRISPR gRNA sequence
ttctgacccaatctgtggaa

SEQ ID NO: 68120 - DNA, 20 bp, Artificial
  CRISPR gRNA sequence
ctgacccaatctgtggaaca

SEQ ID NO: 68121 - DNA, 20 bp, Artificial
  CRISPR gRNA sequence
tgacccaatctgtggaacat

SEQ ID NO: 68122 - DNA, 20 bp, Artificial
  CRISPR gRNA sequence
acccaatctgtggaacataa

SEQ ID NO: 68123 - DNA, 20 bp, Artificial
  CRISPR gRNA sequence
tggaacataaatgtggagat

SEQ ID NO: 68124 - DNA, 20 bp, Artificial
  CRISPR gRNA sequence
tggcaggcaaggggccttag

SEQ ID NO: 68125 - DNA, 20 bp, Artificial
  CRISPR gRNA sequence
aggaagtcatccacatggtt

SEQ ID NO: 68126 - DNA, 20 bp, Artificial
  CRISPR gRNA sequence
ggaagtcatccacatggttg

SEQ ID NO: 68127 - DNA, 20 bp, Artificial
  CRISPR gRNA sequence
ccccatctctcccgtgacct

SEQ ID NO: 68128 - DNA, 20 bp, Artificial
  CRISPR gRNA sequence
tcccgtgacctgctggagtg

SEQ ID NO: 68129 - DNA, 20 bp, Artificial
  CRISPR gRNA sequence
ccgtgacctgctggagtgac

SEQ ID NO: 68130 - DNA, 20 bp, Artificial
  CRISPR gRNA sequence
ctggagtgacagccagctcc

SEQ ID NO: 68131 - DNA, 20 bp, Artificial
  CRISPR gRNA sequence
gagtgacagccagctccagg

SEQ ID NO: 68132 - DNA, 20 bp, Artificial
  CRISPR gRNA sequence
caggacaccacttgttgcta

SEQ ID NO: 68133 - DNA, 20 bp, Artificial
  CRISPR gRNA sequence
gttgctaggcaactgagctt

SEQ ID NO: 68134 - DNA, 20 bp, Artificial
  CRISPR gRNA sequence
ttgctaggcaactgagcttc

SEQ ID NO: 68135 - DNA, 20 bp, Artificial
  CRISPR gRNA sequence
ctaggcaactgagcttcgtg

SEQ ID NO: 68136 - DNA, 20 bp, Artificial
  CRISPR gRNA sequence
ggcaactgagcttcgtgctc

SEQ ID NO: 68137 - DNA, 20 bp, Artificial
  CRISPR gRNA sequence
agcttcgtgctcgggagtcc

SEQ ID NO: 68138 - DNA, 20 bp, Artificial
  CRISPR gRNA sequence
cgtgctcgggagtccttgac

SEQ ID NO: 68139 - DNA, 20 bp, Artificial
  CRISPR gRNA sequence
gtgctcgggagtccttgacc

SEQ ID NO: 68140 - DNA, 20 bp, Artificial
  CRISPR gRNA sequence
gggagtccttgacccatgcg

SEQ ID NO: 68141 - DNA, 20 bp, Artificial
  CRISPR gRNA sequence
gacccatgcggggctagagc

SEQ ID NO: 68142 - DNA, 20 bp, Artificial
  CRISPR gRNA sequence
acccatgcggggctagagct

SEQ ID NO: 68143 - DNA, 20 bp, Artificial
  CRISPR gRNA sequence
gagctgccagcctggccttg

SEQ ID NO: 68144 - DNA, 20 bp, Artificial
  CRISPR gRNA sequence
ccagcctggccttgccagtg

SEQ ID NO: 68145 - DNA, 20 bp, Artificial
  CRISPR gRNA sequence
gccttgccagtgcccagacc

SEQ ID NO: 68146 - DNA, 20 bp, Artificial
  CRISPR gRNA sequence
gccagtgcccagaccccaga

SEQ ID NO: 68147 - DNA, 20 bp, Artificial
  CRISPR gRNA sequence
ccagtgcccagaccccagac

SEQ ID NO: 68148 - DNA, 20 bp, Artificial
  CRISPR gRNA sequence
aaggactcagggtctggtgc

SEQ ID NO: 68149 - DNA, 20 bp, Artificial
  CRISPR gRNA sequence
agggtctggtgccagttctg

SEQ ID NO: 68150 - DNA, 20 bp, Artificial
  CRISPR gRNA sequence
gtgccagttctgcctgtgtg

SEQ ID NO: 68151 - DNA, 20 bp, Artificial
  CRISPR gRNA sequence
tgcctgtgtggggatggtat

SEQ ID NO: 68152 - DNA, 20 bp, Artificial
  CRISPR gRNA sequence
cctgtgtggggatggtatcc

SEQ ID NO: 68153 - DNA, 20 bp, Artificial
  CRISPR gRNA sequence
tgtggggatggtatccttct

SEQ ID NO: 68154 - DNA, 20 bp, Artificial
  CRISPR gRNA sequence
ctgggcctcagtgtgtccat

SEQ ID NO: 68155 - DNA, 20 bp, Artificial
  CRISPR gRNA sequence
tgggcctcagtgtgtccatc

SEQ ID NO: 68156 - DNA, 20 bp, Artificial
  CRISPR gRNA sequence
ggcctcagtgtgtccatctg

SEQ ID NO: 68157 - DNA, 20 bp, Artificial
  CRISPR gRNA sequence
agtgtgtccatctggagaat

SEQ ID NO: 68158 - DNA, 20 bp, Artificial
  CRISPR gRNA sequence
gagaatagatgcttagacat

SEQ ID NO: 68159 - DNA, 20 bp, Artificial
  CRISPR gRNA sequence
agacatggaggcttctcttc

SEQ ID NO: 68160 - DNA, 20 bp, Artificial
  CRISPR gRNA sequence
gacatggaggcttctcttct

SEQ ID NO: 68161 - DNA, 20 bp, Artificial
  CRISPR gRNA sequence
ctcttcttggaaatgacagc

SEQ ID NO: 68162 - DNA, 20 bp, Artificial
  CRISPR gRNA sequence
tcttcttggaaatgacagct

SEQ ID NO: 68163 - DNA, 20 bp, Artificial
  CRISPR gRNA sequence
ttcttggaaatgacagctgg

SEQ ID NO: 68164 - DNA, 20 bp, Artificial
  CRISPR gRNA sequence
cttggaaatgacagctggaa

SEQ ID NO: 68165 - DNA, 20 bp, Artificial
  CRISPR gRNA sequence
ttggaaatgacagctggaag

SEQ ID NO: 68166 - DNA, 20 bp, Artificial
  CRISPR gRNA sequence
ggaaatgacagctggaaggg

SEQ ID NO: 68167 - DNA, 20 bp, Artificial
  CRISPR gRNA sequence
gaaatgacagctggaaggga

SEQ ID NO: 68168 - DNA, 20 bp, Artificial
  CRISPR gRNA sequence
gaagggagatggagggggct

SEQ ID NO: 68169 - DNA, 20 bp, Artificial
  CRISPR gRNA sequence
ggcagggctccaaggaggtc

SEQ ID NO: 68170 - DNA, 20 bp, Artificial
  CRISPR gRNA sequence
caaggaggtcctgccctcac

SEQ ID NO: 68171 - DNA, 20 bp, Artificial
  CRISPR gRNA sequence
ccctcactcccattctcatc

SEQ ID NO: 68172 - DNA, 20 bp, Artificial
  CRISPR gRNA sequence
actcccattctcatctccat

SEQ ID NO: 68173 - DNA, 20 bp, Artificial
  CRISPR gRNA sequence
ccattctcatctccatttcc

SEQ ID NO: 68174 - DNA, 20 bp, Artificial
  CRISPR gRNA sequence
tcatctccatttcccttcta

SEQ ID NO: 68175 - DNA, 20 bp, Artificial
  CRISPR gRNA sequence
atctccatttcccttctagt

SEQ ID NO: 68176 - DNA, 20 bp, Artificial
  CRISPR gRNA sequence
catttcccttctagtctgag

SEQ ID NO: 68177 - DNA, 20 bp, Artificial
  CRISPR gRNA sequence
cccttctagtctgagtcaca

SEQ ID NO: 68178 - DNA, 20 bp, Artificial
  CRISPR gRNA sequence
ccttctagtctgagtcacaa

SEQ ID NO: 68179 - DNA, 20 bp, Artificial
  CRISPR gRNA sequence
ctagtctgagtcacaacagc

SEQ ID NO: 68180 - DNA, 20 bp, Artificial
  CRISPR gRNA sequence
tagtctgagtcacaacagca

SEQ ID NO: 68181 - DNA, 20 bp, Artificial
  CRISPR gRNA sequence
gtctgagtcacaacagcatt

SEQ ID NO: 68182 - DNA, 20 bp, Artificial
  CRISPR gRNA sequence
agtcacaacagcatttctca

SEQ ID NO: 68183 - DNA, 20 bp, Artificial
  CRISPR gRNA sequence
ctcaggaaagtgccctgtac

SEQ ID NO: 68184 - DNA, 20 bp, Artificial
  CRISPR gRNA sequence
tcaggaaagtgccctgtacc

SEQ ID NO: 68185 - DNA, 20 bp, Artificial
  CRISPR gRNA sequence
aggaaagtgccctgtacctg

SEQ ID NO: 68186 - DNA, 20 bp, Artificial
  CRISPR gRNA sequence
tacctgctggagacactgcc

SEQ ID NO: 68187 - DNA, 20 bp, Artificial
  CRISPR gRNA sequence
ctggagacactgccctcctg

SEQ ID NO: 68188 - DNA, 20 bp, Artificial
  CRISPR gRNA sequence
gagacactgccctcctgccc

SEQ ID NO: 68189 - DNA, 20 bp, Artificial
  CRISPR gRNA sequence
ccctcctgcccacgtgtccg

SEQ ID NO: 68190 - DNA, 20 bp, Artificial
  CRISPR gRNA sequence
ctgcccacgtgtccgggagg

SEQ ID NO: 68191 - DNA, 20 bp, Artificial
  CRISPR gRNA sequence
cccacgtgtccgggaggcct

SEQ ID NO: 68192 - DNA, 20 bp, Artificial
  CRISPR gRNA sequence
agtgaagtaaggggatgttg

SEQ ID NO: 68193 - DNA, 20 bp, Artificial
  CRISPR gRNA sequence
gtccccgaaaagcccctttc

SEQ ID NO: 68194 - DNA, 20 bp, Artificial
  CRISPR gRNA sequence
tctgctggccaacaggtgcc

SEQ ID NO: 68195 - DNA, 20 bp, Artificial
  CRISPR gRNA sequence
ctgctggccaacaggtgccc

SEQ ID NO: 68196 - DNA, 20 bp, Artificial
  CRISPR gRNA sequence
tgctggccaacaggtgcccc

SEQ ID NO: 68197 - DNA, 20 bp, Artificial
  CRISPR gRNA sequence
ctggccaacaggtgcccctg

SEQ ID NO: 68198 - DNA, 20 bp, Artificial
  CRISPR gRNA sequence
gccaacaggtgcccctggct

SEQ ID NO: 68199 - DNA, 20 bp, Artificial
  CRISPR gRNA sequence
gctgatgatgggagaagcaa

SEQ ID NO: 68200 - DNA, 20 bp, Artificial
  CRISPR gRNA sequence
atgatgggagaagcaaggca

SEQ ID NO: 68201 - DNA, 20 bp, Artificial
  CRISPR gRNA sequence
tgtggccttccatctgggtg

SEQ ID NO: 68202 - DNA, 20 bp, Artificial
  CRISPR gRNA sequence
gtggccttccatctgggtgg

SEQ ID NO: 68203 - DNA, 20 bp, Artificial
  CRISPR gRNA sequence
tggccttccatctgggtggc

SEQ ID NO: 68204 - DNA, 20 bp, Artificial
  CRISPR gRNA sequence
ccatctgggtggcttggagc

SEQ ID NO: 68205 - DNA, 20 bp, Artificial
  CRISPR gRNA sequence
catctgggtggcttggagca

SEQ ID NO: 68206 - DNA, 20 bp, Artificial
  CRISPR gRNA sequence
ggtggcttggagcaacctct

SEQ ID NO: 68207 - DNA, 20 bp, Artificial
  CRISPR gRNA sequence
ggagcaacctctgcctttct

SEQ ID NO: 68208 - DNA, 20 bp, Artificial
  CRISPR gRNA sequence
gagcaacctctgcctttctc

SEQ ID NO: 68209 - DNA, 20 bp, Artificial
  CRISPR gRNA sequence
tgcctttctctgaatctcag

SEQ ID NO: 68210 - DNA, 20 bp, Artificial
  CRISPR gRNA sequence
cctttctctgaatctcaggg

SEQ ID NO: 68211 - DNA, 20 bp, Artificial
  CRISPR gRNA sequence
tctctgaatctcagggtttc

SEQ ID NO: 68212 - DNA, 20 bp, Artificial
  CRISPR gRNA sequence
ctctgaatctcagggtttcc

SEQ ID NO: 68213 - DNA, 20 bp, Artificial
  CRISPR gRNA sequence
tctgaatctcagggtttcct

SEQ ID NO: 68214 - DNA, 20 bp, Artificial
  CRISPR gRNA sequence
tgaatctcagggtttcctgg

SEQ ID NO: 68215 - DNA, 20 bp, Artificial
  CRISPR gRNA sequence
aatctcagggtttcctgggc

SEQ ID NO: 68216 - DNA, 20 bp, Artificial
  CRISPR gRNA sequence
agggtttcctgggcatggga

SEQ ID NO: 68217 - DNA, 20 bp, Artificial
  CRISPR gRNA sequence
cctgggcatgggatcataat

SEQ ID NO: 68218 - DNA, 20 bp, Artificial
  CRISPR gRNA sequence
ctgggcatgggatcataatt

SEQ ID NO: 68219 - DNA, 20 bp, Artificial
  CRISPR gRNA sequence
ggcatgggatcataatttct

SEQ ID NO: 68220 - DNA, 20 bp, Artificial
  CRISPR gRNA sequence
ctatcccctgatgcccgggt

SEQ ID NO: 68221 - DNA, 20 bp, Artificial
  CRISPR gRNA sequence
tatcccctgatgcccgggtg

SEQ ID NO: 68222 - DNA, 20 bp, Artificial
  CRISPR gRNA sequence
tcccctgatgcccgggtgcc

SEQ ID NO: 68223 - DNA, 20 bp, Artificial
  CRISPR gRNA sequence
atgcccgggtgccatgggga

SEQ ID NO: 68224 - DNA, 20 bp, Artificial
  CRISPR gRNA sequence
ccatgctcacagaatgagtt

SEQ ID NO: 68225 - DNA, 20 bp, Artificial
  CRISPR gRNA sequence
acagaatgagtttgggggtc

SEQ ID NO: 68226 - DNA, 20 bp, Artificial
  CRISPR gRNA sequence
gggggtctcctctggttctg

SEQ ID NO: 68227 - DNA, 20 bp, Artificial
  CRISPR gRNA sequence
ggggtctcctctggttctga

SEQ ID NO: 68228 - DNA, 20 bp, Artificial
  CRISPR gRNA sequence
ctctggttctgaggcctcca

SEQ ID NO: 68229 - DNA, 20 bp, Artificial
  CRISPR gRNA sequence
tggttctgaggcctccatcc

SEQ ID NO: 68230 - DNA, 20 bp, Artificial
  CRISPR gRNA sequence
gttctgaggcctccatcctc

SEQ ID NO: 68231 - DNA, 20 bp, Artificial
  CRISPR gRNA sequence
tgaggcctccatcctccctt

SEQ ID NO: 68232 - DNA, 20 bp, Artificial
  CRISPR gRNA sequence
aggcctccatcctcccttgt

SEQ ID NO: 68233 - DNA, 20 bp, Artificial
  CRISPR gRNA sequence
catcctcccttgtccttgtg

SEQ ID NO: 68234 - DNA, 20 bp, Artificial
  CRISPR gRNA sequence
ccttgtccttgtgggtgcag

SEQ ID NO: 68235 - DNA, 20 bp, Artificial
  CRISPR gRNA sequence
gtccttgtgggtgcagcccc

SEQ ID NO: 68236 - DNA, 20 bp, Artificial
  CRISPR gRNA sequence
tccttgtgggtgcagccccg

SEQ ID NO: 68237 - DNA, 20 bp, Artificial
  CRISPR gRNA sequence
gtgggtgcagccccgcttcc

SEQ ID NO: 68238 - DNA, 20 bp, Artificial
  CRISPR gRNA sequence
tgggtgcagccccgcttccc

SEQ ID NO: 68239 - DNA, 20 bp, Artificial
  CRISPR gRNA sequence
ccctctctgtgccctgtggg

SEQ ID NO: 68240 - DNA, 20 bp, Artificial
  CRISPR gRNA sequence
cctctctgtgccctgtgggt

SEQ ID NO: 68241 - DNA, 20 bp, Artificial
  CRISPR gRNA sequence
tctgtgccctgtgggtgccc

SEQ ID NO: 68242 - DNA, 20 bp, Artificial
  CRISPR gRNA sequence
tgtgccctgtgggtgcccta

SEQ ID NO: 68243 - DNA, 20 bp, Artificial
  CRISPR gRNA sequence
tgccctgtgggtgccctagg

SEQ ID NO: 68244 - DNA, 20 bp, Artificial
  CRISPR gRNA sequence
tgggtgccctaggtgcctag

SEQ ID NO: 68245 - DNA, 20 bp, Artificial
  CRISPR gRNA sequence
ggtgcctaggaagctggcat

SEQ ID NO: 68246 - DNA, 20 bp, Artificial
  CRISPR gRNA sequence
ggaagctggcatgtctgggc

SEQ ID NO: 68247 - DNA, 20 bp, Artificial
  CRISPR gRNA sequence
gcatgtctgggcaccgtgct

SEQ ID NO: 68248 - DNA, 20 bp, Artificial
  CRISPR gRNA sequence
ggcaccgtgcttccccaggc

SEQ ID NO: 68249 - DNA, 20 bp, Artificial
  CRISPR gRNA sequence
ccccaggcccttctctctgc

SEQ ID NO: 68250 - DNA, 20 bp, Artificial
  CRISPR gRNA sequence
cccaggcccttctctctgca

SEQ ID NO: 68251 - DNA, 20 bp, Artificial
  CRISPR gRNA sequence
ctctctgcagcctgggctct

SEQ ID NO: 68252 - DNA, 20 bp, Artificial
  CRISPR gRNA sequence
tctctgcagcctgggctctg

SEQ ID NO: 68253 - DNA, 20 bp, Artificial
  CRISPR gRNA sequence
tctgcagcctgggctctgag

SEQ ID NO: 68254 - DNA, 20 bp, Artificial
  CRISPR gRNA sequence
tgcagcctgggctctgagca

SEQ ID NO: 68255 - DNA, 20 bp, Artificial
  CRISPR gRNA sequence
cagcctgggctctgagcaga

SEQ ID NO: 68256 - DNA, 20 bp, Artificial
  CRISPR gRNA sequence
ggctctgagcagagcttccg

SEQ ID NO: 68257 - DNA, 20 bp, Artificial
  CRISPR gRNA sequence
tgagcagagcttccggattc

SEQ ID NO: 68258 - DNA, 20 bp, Artificial
  CRISPR gRNA sequence
agcagagcttccggattcac

SEQ ID NO: 68259 - DNA, 20 bp, Artificial
  CRISPR gRNA sequence
ccggattcacttctccagag

SEQ ID NO: 68260 - DNA, 20 bp, Artificial
  CRISPR gRNA sequence
cggattcacttctccagaga

SEQ ID NO: 68261 - DNA, 20 bp, Artificial
  CRISPR gRNA sequence
acttctccagagaggaccag

SEQ ID NO: 68262 - DNA, 20 bp, Artificial
  CRISPR gRNA sequence
ctccagagaggaccaggctg

SEQ ID NO: 68263 - DNA, 20 bp, Artificial
  CRISPR gRNA sequence
tccagagaggaccaggctgg

SEQ ID NO: 68264 - DNA, 20 bp, Artificial
  CRISPR gRNA sequence
cagagaggaccaggctggga

SEQ ID NO: 68265 - DNA, 20 bp, Artificial
  CRISPR gRNA sequence
ggaagacactcaggtaatcc

SEQ ID NO: 68266 - DNA, 20 bp, Artificial
  CRISPR gRNA sequence
aggtaatccctgcagggtga

SEQ ID NO: 68267 - DNA, 20 bp, Artificial
  CRISPR gRNA sequence
cagggtgatgggacagggga

SEQ ID NO: 68268 - DNA, 20 bp, Artificial
  CRISPR gRNA sequence
accctatggcggcctccatg

SEQ ID NO: 68269 - DNA, 20 bp, Artificial
  CRISPR gRNA sequence
tggcggcctccatggccccc

SEQ ID NO: 68270 - DNA, 20 bp, Artificial
  CRISPR gRNA sequence
catggccccctcttccctgg

SEQ ID NO: 68271 - DNA, 20 bp, Artificial
  CRISPR gRNA sequence
ttccctgggccctctcctcc

SEQ ID NO: 68272 - DNA, 20 bp, Artificial
  CRISPR gRNA sequence
ccctgggccctctcctcctt

SEQ ID NO: 68273 - DNA, 20 bp, Artificial
  CRISPR gRNA sequence
cctgggccctctcctccttt

SEQ ID NO: 68274 - DNA, 20 bp, Artificial
  CRISPR gRNA sequence
ggccctctcctcctttagag

SEQ ID NO: 68275 - DNA, 20 bp, Artificial
  CRISPR gRNA sequence
tcctcctttagagagcagct

SEQ ID NO: 68276 - DNA, 20 bp, Artificial
  CRISPR gRNA sequence
ctcctttagagagcagcttc

SEQ ID NO: 68277 - DNA, 20 bp, Artificial
  CRISPR gRNA sequence
ctttagagagcagcttcaag

SEQ ID NO: 68278 - DNA, 20 bp, Artificial
  CRISPR gRNA sequence
tagagagcagcttcaagctc

SEQ ID NO: 68279 - DNA, 20 bp, Artificial
  CRISPR gRNA sequence
agagagcagcttcaagctca

SEQ ID NO: 68280 - DNA, 20 bp, Artificial
  CRISPR gRNA sequence
gagagcagcttcaagctcac

SEQ ID NO: 68281 - DNA, 20 bp, Artificial
  CRISPR gRNA sequence
caagctcactgcctgggtct

SEQ ID NO: 68282 - DNA, 20 bp, Artificial
  CRISPR gRNA sequence
aagctcactgcctgggtctg

SEQ ID NO: 68283 - DNA, 20 bp, Artificial
  CRISPR gRNA sequence
actgcctgggtctgttcctc

SEQ ID NO: 68284 - DNA, 20 bp, Artificial
  CRISPR gRNA sequence
cctgggtctgttcctccaga

SEQ ID NO: 68285 - DNA, 20 bp, Artificial
  CRISPR gRNA sequence
ggtctgttcctccagatctg

SEQ ID NO: 68286 - DNA, 20 bp, Artificial
  CRISPR gRNA sequence
ttcctccagatctgcccccg

SEQ ID NO: 68287 - DNA, 20 bp, Artificial
  CRISPR gRNA sequence
ctccagatctgcccccgatg

SEQ ID NO: 68288 - DNA, 20 bp, Artificial
  CRISPR gRNA sequence
cagatctgcccccgatgccc

SEQ ID NO: 68289 - DNA, 20 bp, Artificial
  CRISPR gRNA sequence
cccccgatgccctggtaact

SEQ ID NO: 68290 - DNA, 20 bp, Artificial
  CRISPR gRNA sequence
gtaactccagtctcagccag

SEQ ID NO: 68291 - DNA, 20 bp, Artificial
  CRISPR gRNA sequence
cagtctcagccagggccttg

SEQ ID NO: 68292 - DNA, 20 bp, Artificial
  CRISPR gRNA sequence
agccagggccttggcattga

SEQ ID NO: 68293 - DNA, 20 bp, Artificial
  CRISPR gRNA sequence
ggcattgaacttgtgcctct

SEQ ID NO: 68294 - DNA, 20 bp, Artificial
  CRISPR gRNA sequence
gcattgaacttgtgcctctt

SEQ ID NO: 68295 - DNA, 20 bp, Artificial
  CRISPR gRNA sequence
aacttgtgcctcttagccca

SEQ ID NO: 68296 - DNA, 20 bp, Artificial
  CRISPR gRNA sequence
gtgcctcttagcccaccatc

SEQ ID NO: 68297 - DNA, 20 bp, Artificial
  CRISPR gRNA sequence
tgcctcttagcccaccatcc

SEQ ID NO: 68298 - DNA, 20 bp, Artificial
  CRISPR gRNA sequence
ttagcccaccatcctaagcc

SEQ ID NO: 68299 - DNA, 20 bp, Artificial
  CRISPR gRNA sequence
agcccaccatcctaagccca

SEQ ID NO: 68300 - DNA, 20 bp, Artificial
  CRISPR gRNA sequence
gcccaccatcctaagcccaa

SEQ ID NO: 68301 - DNA, 20 bp, Artificial
  CRISPR gRNA sequence
agcccaactcagcccaacat

SEQ ID NO: 68302 - DNA, 20 bp, Artificial
  CRISPR gRNA sequence
agcccaacattctcttcctt

SEQ ID NO: 68303 - DNA, 20 bp, Artificial
  CRISPR gRNA sequence
tcttccttgccatgtcctga

SEQ ID NO: 68304 - DNA, 20 bp, Artificial
  CRISPR gRNA sequence
ttccttgccatgtcctgact

SEQ ID NO: 68305 - DNA, 20 bp, Artificial
  CRISPR gRNA sequence
ccttgccatgtcctgactac

SEQ ID NO: 68306 - DNA, 20 bp, Artificial
  CRISPR gRNA sequence
cttgccatgtcctgactaca

SEQ ID NO: 68307 - DNA, 20 bp, Artificial
  CRISPR gRNA sequence
gccatgtcctgactacaggc

SEQ ID NO: 68308 - DNA, 20 bp, Artificial
  CRISPR gRNA sequence
ccatgtcctgactacaggcc

SEQ ID NO: 68309 - DNA, 20 bp, Artificial
  CRISPR gRNA sequence
actacaggccttgaggcttc

SEQ ID NO: 68310 - DNA, 20 bp, Artificial
  CRISPR gRNA sequence
caggccttgaggcttctgag

SEQ ID NO: 68311 - DNA, 20 bp, Artificial
  CRISPR gRNA sequence
gaggcttctgagtgtcacgg

SEQ ID NO: 68312 - DNA, 20 bp, Artificial
  CRISPR gRNA sequence
aggcttctgagtgtcacggt

SEQ ID NO: 68313 - DNA, 20 bp, Artificial
  CRISPR gRNA sequence
ctgagtgtcacggttaaaga

SEQ ID NO: 68314 - DNA, 20 bp, Artificial
  CRISPR gRNA sequence
tgagtgtcacggttaaagat

SEQ ID NO: 68315 - DNA, 20 bp, Artificial
  CRISPR gRNA sequence
agtgtcacggttaaagattt

SEQ ID NO: 68316 - DNA, 20 bp, Artificial
  CRISPR gRNA sequence
aagattttgaagccaactga

SEQ ID NO: 68317 - DNA, 20 bp, Artificial
  CRISPR gRNA sequence
tgaagccaactgaaaataaa

SEQ ID NO: 68318 - DNA, 20 bp, Artificial
  CRISPR gRNA sequence
gaagccaactgaaaataaat

SEQ ID NO: 68319 - DNA, 20 bp, Artificial
  CRISPR gRNA sequence
aagccaactgaaaataaatc

SEQ ID NO: 68320 - DNA, 20 bp, Artificial
  CRISPR gRNA sequence
aaaataaatccctgatctgc

SEQ ID NO: 68321 - DNA, 20 bp, Artificial
  CRISPR gRNA sequence
atctgccacttaccagctat

SEQ ID NO: 68322 - DNA, 20 bp, Artificial
  CRISPR gRNA sequence
ccacttaccagctatgtggc

SEQ ID NO: 68323 - DNA, 20 bp, Artificial
  CRISPR gRNA sequence
accagctatgtggccctgga

SEQ ID NO: 68324 - DNA, 20 bp, Artificial
  CRISPR gRNA sequence
ccagctatgtggccctggac

SEQ ID NO: 68325 - DNA, 20 bp, Artificial
  CRISPR gRNA sequence
tgtggccctggacaagtaaa

SEQ ID NO: 68326 - DNA, 20 bp, Artificial
  CRISPR gRNA sequence
gacaagtaaaatggggataa

SEQ ID NO: 68327 - DNA, 20 bp, Artificial
  CRISPR gRNA sequence
ccccttagggttattgtgag

SEQ ID NO: 68328 - DNA, 20 bp, Artificial
  CRISPR gRNA sequence
agggttattgtgaggattaa

SEQ ID NO: 68329 - DNA, 20 bp, Artificial
  CRISPR gRNA sequence
gggttattgtgaggattaaa

SEQ ID NO: 68330 - DNA, 20 bp, Artificial
  CRISPR gRNA sequence
ttgtgaggattaaatgagtt

SEQ ID NO: 68331 - DNA, 20 bp, Artificial
  CRISPR gRNA sequence
tgaggattaaatgagttaat

SEQ ID NO: 68332 - DNA, 20 bp, Artificial
  CRISPR gRNA sequence
aatgagttaataagtataaa

SEQ ID NO: 68333 - DNA, 20 bp, Artificial
  CRISPR gRNA sequence
ataagtataaagtgccagga

SEQ ID NO: 68334 - DNA, 20 bp, Artificial
  CRISPR gRNA sequence
gctcatgggagtgctgtcag

SEQ ID NO: 68335 - DNA, 20 bp, Artificial
  CRISPR gRNA sequence
atgggagtgctgtcagcagt

SEQ ID NO: 68336 - DNA, 20 bp, Artificial
  CRISPR gRNA sequence
tcagcagttattgtaactgt

SEQ ID NO: 68337 - DNA, 20 bp, Artificial
  CRISPR gRNA sequence
ttgtaactgttattattatt

SEQ ID NO: 68338 - DNA, 20 bp, Artificial
  CRISPR gRNA sequence
taactgttattattattatt

SEQ ID NO: 68339 - DNA, 20 bp, Artificial
  CRISPR gRNA sequence
ttattattattattattatt

SEQ ID NO: 68340 - DNA, 20 bp, Artificial
  CRISPR gRNA sequence
ttattattattattattatt

SEQ ID NO: 68341 - DNA, 20 bp, Artificial
  CRISPR gRNA sequence
ttattattattattattatt

SEQ ID NO: 68342 - DNA, 20 bp, Artificial
  CRISPR gRNA sequence
ttattattattattattatt

SEQ ID NO: 68343 - DNA, 20 bp, Artificial
  CRISPR gRNA sequence
ttattattattattattatt

SEQ ID NO: 68344 - DNA, 20 bp, Artificial
  CRISPR gRNA sequence
ttattattattattattatc

SEQ ID NO: 68345 - DNA, 20 bp, Artificial
  CRISPR gRNA sequence
ttattattattattatcatt

SEQ ID NO: 68346 - DNA, 20 bp, Artificial
  CRISPR gRNA sequence
ttattattattatcattatc

SEQ ID NO: 68347 - DNA, 20 bp, Artificial
  CRISPR gRNA sequence
ttattattatcattatcatt

SEQ ID NO: 68348 - DNA, 20 bp, Artificial
  CRISPR gRNA sequence
ttattatcattatcattacc

SEQ ID NO: 68349 - DNA, 20 bp, Artificial
  CRISPR gRNA sequence
ttatcattatcattacccct

SEQ ID NO: 68350 - DNA, 20 bp, Artificial
  CRISPR gRNA sequence
tcattatcattacccctggt

SEQ ID NO: 68351 - DNA, 20 bp, Artificial
  CRISPR gRNA sequence
tcattacccctggtagccct

SEQ ID NO: 68352 - DNA, 20 bp, Artificial
  CRISPR gRNA sequence
cccctggtagccctgactca

SEQ ID NO: 68353 - DNA, 20 bp, Artificial
  CRISPR gRNA sequence
gtagccctgactcactgcca

SEQ ID NO: 68354 - DNA, 20 bp, Artificial
  CRISPR gRNA sequence
actcactgccacggccagtt

SEQ ID NO: 68355 - DNA, 20 bp, Artificial
  CRISPR gRNA sequence
actgccacggccagttcctt

SEQ ID NO: 68356 - DNA, 20 bp, Artificial
  CRISPR gRNA sequence
ccacggccagttcctttaca

SEQ ID NO: 68357 - DNA, 20 bp, Artificial
  CRISPR gRNA sequence
ctttacatgtcttacttcag

SEQ ID NO: 68358 - DNA, 20 bp, Artificial
  CRISPR gRNA sequence
tacatgtcttacttcagctg

SEQ ID NO: 68359 - DNA, 20 bp, Artificial
  CRISPR gRNA sequence
acatgtcttacttcagctgt

SEQ ID NO: 68360 - DNA, 20 bp, Artificial
  CRISPR gRNA sequence
catgtcttacttcagctgtg

SEQ ID NO: 68361 - DNA, 20 bp, Artificial
  CRISPR gRNA sequence
acttcagctgtgaacagggc

SEQ ID NO: 68362 - DNA, 20 bp, Artificial
  CRISPR gRNA sequence
cttcagctgtgaacagggcc

SEQ ID NO: 68363 - DNA, 20 bp, Artificial
  CRISPR gRNA sequence
cagctgtgaacagggcctcc

SEQ ID NO: 68364 - DNA, 20 bp, Artificial
  CRISPR gRNA sequence
agctgtgaacagggcctcca

SEQ ID NO: 68365 - DNA, 20 bp, Artificial
  CRISPR gRNA sequence
tgaacagggcctccaaactg

SEQ ID NO: 68366 - DNA, 20 bp, Artificial
  CRISPR gRNA sequence
caaactgatccctgcatctt

SEQ ID NO: 68367 - DNA, 20 bp, Artificial
  CRISPR gRNA sequence
atccctgcatcttatcaggc

SEQ ID NO: 68368 - DNA, 20 bp, Artificial
  CRISPR gRNA sequence
catcttatcaggcctcctcc

SEQ ID NO: 68369 - DNA, 20 bp, Artificial
  CRISPR gRNA sequence
atcaggcctcctcccctcca

SEQ ID NO: 68370 - DNA, 20 bp, Artificial
  CRISPR gRNA sequence
tcaggcctcctcccctccat

SEQ ID NO: 68371 - DNA, 20 bp, Artificial
  CRISPR gRNA sequence
ctcccctccattcactccac

SEQ ID NO: 68372 - DNA, 20 bp, Artificial
  CRISPR gRNA sequence
ccctccattcactccacagc

SEQ ID NO: 68373 - DNA, 20 bp, Artificial
  CRISPR gRNA sequence
cattcactccacagccccca

SEQ ID NO: 68374 - DNA, 20 bp, Artificial
  CRISPR gRNA sequence
actccacagcccccagaggg

SEQ ID NO: 68375 - DNA, 20 bp, Artificial
  CRISPR gRNA sequence
cacagcccccagagggatct

SEQ ID NO: 68376 - DNA, 20 bp, Artificial
  CRISPR gRNA sequence
cacaacacacatctgacagt

SEQ ID NO: 68377 - DNA, 20 bp, Artificial
  CRISPR gRNA sequence
acaacacacatctgacagtg

SEQ ID NO: 68378 - DNA, 20 bp, Artificial
  CRISPR gRNA sequence
acagtgcccctctgctactc

SEQ ID NO: 68379 - DNA, 20 bp, Artificial
  CRISPR gRNA sequence
tgctactctgtgcccctcag

SEQ ID NO: 68380 - DNA, 20 bp, Artificial
  CRISPR gRNA sequence
ctactctgtgcccctcagtg

SEQ ID NO: 68381 - DNA, 20 bp, Artificial
  CRISPR gRNA sequence
ctctgtgcccctcagtggct

SEQ ID NO: 68382 - DNA, 20 bp, Artificial
  CRISPR gRNA sequence
tgtgcccctcagtggctccc

SEQ ID NO: 68383 - DNA, 20 bp, Artificial
  CRISPR gRNA sequence
tgcccctcagtggctcccca

SEQ ID NO: 68384 - DNA, 20 bp, Artificial
  CRISPR gRNA sequence
agtggctccccattaacccc

SEQ ID NO: 68385 - DNA, 20 bp, Artificial
  CRISPR gRNA sequence
cccattaaccccagggtgaa

SEQ ID NO: 68386 - DNA, 20 bp, Artificial
  CRISPR gRNA sequence
accccagggtgaagttcaaa

SEQ ID NO: 68387 - DNA, 20 bp, Artificial
  CRISPR gRNA sequence
aaagtccctagcatcttctc

SEQ ID NO: 68388 - DNA, 20 bp, Artificial
  CRISPR gRNA sequence
gcatcttctccctcacagtc

SEQ ID NO: 68389 - DNA, 20 bp, Artificial
  CRISPR gRNA sequence
ctccctcacagtctgatcca

SEQ ID NO: 68390 - DNA, 20 bp, Artificial
  CRISPR gRNA sequence
tccctcacagtctgatccaa

SEQ ID NO: 68391 - DNA, 20 bp, Artificial
  CRISPR gRNA sequence
cctcacagtctgatccaact

SEQ ID NO: 68392 - DNA, 20 bp, Artificial
  CRISPR gRNA sequence
acagtctgatccaactgtca

SEQ ID NO: 68393 - DNA, 20 bp, Artificial
  CRISPR gRNA sequence
atccaactgtcaccttccac

SEQ ID NO: 68394 - DNA, 20 bp, Artificial
  CRISPR gRNA sequence
tcaccttccaccatgttcct

SEQ ID NO: 68395 - DNA, 20 bp, Artificial
  CRISPR gRNA sequence
ccaccatgttccttcccacc

SEQ ID NO: 68396 - DNA, 20 bp, Artificial
  CRISPR gRNA sequence
caccatgttccttcccacct

SEQ ID NO: 68397 - DNA, 20 bp, Artificial
  CRISPR gRNA sequence
cttcccacctcccccacacc

SEQ ID NO: 68398 - DNA, 20 bp, Artificial
  CRISPR gRNA sequence
cccacctcccccacaccaca

SEQ ID NO: 68399 - DNA, 20 bp, Artificial
  CRISPR gRNA sequence
ccacctcccccacaccacac

SEQ ID NO: 68400 - DNA, 20 bp, Artificial
  CRISPR gRNA sequence
ccccacaccacacacacgcc

SEQ ID NO: 68401 - DNA, 20 bp, Artificial
  CRISPR gRNA sequence
cacaccaacccatataccac

SEQ ID NO: 68402 - DNA, 20 bp, Artificial
  CRISPR gRNA sequence
gcacattacaaatacagcac

SEQ ID NO: 68403 - DNA, 20 bp, Artificial
  CRISPR gRNA sequence
caaatacagcacacacacca

SEQ ID NO: 68404 - DNA, 20 bp, Artificial
  CRISPR gRNA sequence
caaataccacatacacaaca

SEQ ID NO: 68405 - DNA, 20 bp, Artificial
  CRISPR gRNA sequence
agccataaccttcactattt

SEQ ID NO: 68406 - DNA, 20 bp, Artificial
  CRISPR gRNA sequence
cactatttgctcctagatca

SEQ ID NO: 68407 - DNA, 20 bp, Artificial
  CRISPR gRNA sequence
actatttgctcctagatcaa

SEQ ID NO: 68408 - DNA, 20 bp, Artificial
  CRISPR gRNA sequence
tttgctcctagatcaagccc

SEQ ID NO: 68409 - DNA, 20 bp, Artificial
  CRISPR gRNA sequence
gctcctagatcaagccctgc

SEQ ID NO: 68410 - DNA, 20 bp, Artificial
  CRISPR gRNA sequence
ctcctagatcaagccctgcc

SEQ ID NO: 68411 - DNA, 20 bp, Artificial
  CRISPR gRNA sequence
ctagatcaagccctgcctga

SEQ ID NO: 68412 - DNA, 20 bp, Artificial
  CRISPR gRNA sequence
gatcaagccctgcctgaaga

SEQ ID NO: 68413 - DNA, 20 bp, Artificial
  CRISPR gRNA sequence
cctgaagattctctgcctct

SEQ ID NO: 68414 - DNA, 20 bp, Artificial
  CRISPR gRNA sequence
aagattctctgcctctgctc

SEQ ID NO: 68415 - DNA, 20 bp, Artificial
  CRISPR gRNA sequence
tctgcctctgctcacaccgc

SEQ ID NO: 68416 - DNA, 20 bp, Artificial
  CRISPR gRNA sequence
tgcctctgctcacaccgcac

SEQ ID NO: 68417 - DNA, 20 bp, Artificial
  CRISPR gRNA sequence
cctctgctcacaccgcactc

SEQ ID NO: 68418 - DNA, 20 bp, Artificial
  CRISPR gRNA sequence
tgctcacaccgcactcagct

SEQ ID NO: 68419 - DNA, 20 bp, Artificial
  CRISPR gRNA sequence
ctcacaccgcactcagctca

SEQ ID NO: 68420 - DNA, 20 bp, Artificial
  CRISPR gRNA sequence
acaccgcactcagctcaaca

SEQ ID NO: 68421 - DNA, 20 bp, Artificial
  CRISPR gRNA sequence
agctcaacattctcttcctt

SEQ ID NO: 68422 - DNA, 20 bp, Artificial
  CRISPR gRNA sequence
aacattctcttccttgcctt

SEQ ID NO: 68423 - DNA, 20 bp, Artificial
  CRISPR gRNA sequence
tcttccttgccttttctgag

SEQ ID NO: 68424 - DNA, 20 bp, Artificial
  CRISPR gRNA sequence
ttccttgccttttctgagat

SEQ ID NO: 68425 - DNA, 20 bp, Artificial
  CRISPR gRNA sequence
ccttgccttttctgagataa

SEQ ID NO: 68426 - DNA, 20 bp, Artificial
  CRISPR gRNA sequence
cttgccttttctgagataaa

SEQ ID NO: 68427 - DNA, 20 bp, Artificial
  CRISPR gRNA sequence
gccttttctgagataaaatt

SEQ ID NO: 68428 - DNA, 20 bp, Artificial
  CRISPR gRNA sequence
ccttttctgagataaaattc

SEQ ID NO: 68429 - DNA, 20 bp, Artificial
  CRISPR gRNA sequence
ttctgagataaaattctccc

SEQ ID NO: 68430 - DNA, 20 bp, Artificial
  CRISPR gRNA sequence
tctgagataaaattctccca

SEQ ID NO: 68431 - DNA, 20 bp, Artificial
  CRISPR gRNA sequence
ctgagataaaattctcccaa

SEQ ID NO: 68432 - DNA, 20 bp, Artificial
  CRISPR gRNA sequence
tgagataaaattctcccaat

SEQ ID NO: 68433 - DNA, 20 bp, Artificial
  CRISPR gRNA sequence
agataaaattctcccaatcc

SEQ ID NO: 68434 - DNA, 20 bp, Artificial
  CRISPR gRNA sequence
tcccaatcctttaacaccca

SEQ ID NO: 68435 - DNA, 20 bp, Artificial
  CRISPR gRNA sequence
ccaatcctttaacacccagc

SEQ ID NO: 68436 - DNA, 20 bp, Artificial
  CRISPR gRNA sequence
taacacccagctcaaacatc

SEQ ID NO: 68437 - DNA, 20 bp, Artificial
  CRISPR gRNA sequence
aacacccagctcaaacatca

SEQ ID NO: 68438 - DNA, 20 bp, Artificial
  CRISPR gRNA sequence
acacccagctcaaacatcag

SEQ ID NO: 68439 - DNA, 20 bp, Artificial
  CRISPR gRNA sequence
aaacatcagcccctcctgga

SEQ ID NO: 68440 - DNA, 20 bp, Artificial
  CRISPR gRNA sequence
ctggaagtatcccagcagcc

SEQ ID NO: 68441 - DNA, 20 bp, Artificial
  CRISPR gRNA sequence
gaagtatcccagcagccctg

SEQ ID NO: 68442 - DNA, 20 bp, Artificial
  CRISPR gRNA sequence
cctcatcagagtgaactgcc

SEQ ID NO: 68443 - DNA, 20 bp, Artificial
  CRISPR gRNA sequence
atcagagtgaactgccccga

SEQ ID NO: 68444 - DNA, 20 bp, Artificial
  CRISPR gRNA sequence
ccccgaggttcactgggccc

SEQ ID NO: 68445 - DNA, 20 bp, Artificial
  CRISPR gRNA sequence
actgggccctttcacttggc

SEQ ID NO: 68446 - DNA, 20 bp, Artificial
  CRISPR gRNA sequence
ggccctttcacttggctggg

SEQ ID NO: 68447 - DNA, 20 bp, Artificial
  CRISPR gRNA sequence
tcacttggctgggcccgtct

SEQ ID NO: 68448 - DNA, 20 bp, Artificial
  CRISPR gRNA sequence
cacttggctgggcccgtctg

SEQ ID NO: 68449 - DNA, 20 bp, Artificial
  CRISPR gRNA sequence
acttggctgggcccgtctgc

SEQ ID NO: 68450 - DNA, 20 bp, Artificial
  CRISPR gRNA sequence
ggctgggcccgtctgctggc

SEQ ID NO: 68451 - DNA, 20 bp, Artificial
  CRISPR gRNA sequence
gctgggcccgtctgctggcc

SEQ ID NO: 68452 - DNA, 20 bp, Artificial
  CRISPR gRNA sequence
ggcccgtctgctggccaccc

SEQ ID NO: 68453 - DNA, 20 bp, Artificial
  CRISPR gRNA sequence
ctggccacccagggctgaga

SEQ ID NO: 68454 - DNA, 20 bp, Artificial
  CRISPR gRNA sequence
gccacccagggctgagatgc

SEQ ID NO: 68455 - DNA, 20 bp, Artificial
  CRISPR gRNA sequence
agatgcctggacagcagagc

SEQ ID NO: 68456 - DNA, 20 bp, Artificial
  CRISPR gRNA sequence
gacagcagagccccacggag

SEQ ID NO: 68457 - DNA, 20 bp, Artificial
  CRISPR gRNA sequence
cctccccagggagctcagcc

SEQ ID NO: 68458 - DNA, 20 bp, Artificial
  CRISPR gRNA sequence
cccagggagctcagccagtg

SEQ ID NO: 68459 - DNA, 20 bp, Artificial
  CRISPR gRNA sequence
agccagtgctggtccgggag

SEQ ID NO: 68460 - DNA, 20 bp, Artificial
  CRISPR gRNA sequence
gtccgggagagtaaggcagt

SEQ ID NO: 68461 - DNA, 20 bp, Artificial
  CRISPR gRNA sequence
agagcttggggtctgcagtc

SEQ ID NO: 68462 - DNA, 20 bp, Artificial
  CRISPR gRNA sequence
ggggtctgcagtcagactga

SEQ ID NO: 68463 - DNA, 20 bp, Artificial
  CRISPR gRNA sequence
gggtctgcagtcagactgac

SEQ ID NO: 68464 - DNA, 20 bp, Artificial
  CRISPR gRNA sequence
cagtcagactgacctggatg

SEQ ID NO: 68465 - DNA, 20 bp, Artificial
  CRISPR gRNA sequence
acctggatggaaaccagatt

SEQ ID NO: 68466 - DNA, 20 bp, Artificial
  CRISPR gRNA sequence
gatggaaaccagattctgcc

SEQ ID NO: 68467 - DNA, 20 bp, Artificial
  CRISPR gRNA sequence
tgcccttctttcttatctgc

SEQ ID NO: 68468 - DNA, 20 bp, Artificial
  CRISPR gRNA sequence
cccttctttcttatctgctg

SEQ ID NO: 68469 - DNA, 20 bp, Artificial
  CRISPR gRNA sequence
ctttcttatctgctgtgtgt

SEQ ID NO: 68470 - DNA, 20 bp, Artificial
  CRISPR gRNA sequence
tttcttatctgctgtgtgtc

SEQ ID NO: 68471 - DNA, 20 bp, Artificial
  CRISPR gRNA sequence
tcttatctgctgtgtgtcct

SEQ ID NO: 68472 - DNA, 20 bp, Artificial
  CRISPR gRNA sequence
cttatctgctgtgtgtcctt

SEQ ID NO: 68473 - DNA, 20 bp, Artificial
  CRISPR gRNA sequence
ttatctgctgtgtgtccttg

SEQ ID NO: 68474 - DNA, 20 bp, Artificial
  CRISPR gRNA sequence
atctgctgtgtgtccttggg

SEQ ID NO: 68475 - DNA, 20 bp, Artificial
  CRISPR gRNA sequence
tctgctgtgtgtccttgggt

SEQ ID NO: 68476 - DNA, 20 bp, Artificial
  CRISPR gRNA sequence
ctgtgtgtccttgggttagt

SEQ ID NO: 68477 - DNA, 20 bp, Artificial
  CRISPR gRNA sequence
tgtgtccttgggttagtcag

SEQ ID NO: 68478 - DNA, 20 bp, Artificial
  CRISPR gRNA sequence
gggttagtcagtttccccac

SEQ ID NO: 68479 - DNA, 20 bp, Artificial
  CRISPR gRNA sequence
ggttagtcagtttccccacc

SEQ ID NO: 68480 - DNA, 20 bp, Artificial
  CRISPR gRNA sequence
gtcagtttccccacctctaa

SEQ ID NO: 68481 - DNA, 20 bp, Artificial
  CRISPR gRNA sequence
ccccacctctaattggtgct

SEQ ID NO: 68482 - DNA, 20 bp, Artificial
  CRISPR gRNA sequence
cccacctctaattggtgcta

SEQ ID NO: 68483 - DNA, 20 bp, Artificial
  CRISPR gRNA sequence
taattggtgctatgagaatt

SEQ ID NO: 68484 - DNA, 20 bp, Artificial
  CRISPR gRNA sequence
attggtgctatgagaattaa

SEQ ID NO: 68485 - DNA, 20 bp, Artificial
  CRISPR gRNA sequence
gtgctatgagaattaaagga

SEQ ID NO: 68486 - DNA, 20 bp, Artificial
  CRISPR gRNA sequence
tgagaattaaaggagaccct

SEQ ID NO: 68487 - DNA, 20 bp, Artificial
  CRISPR gRNA sequence
aaggagaccctgcgggtaag

SEQ ID NO: 68488 - DNA, 20 bp, Artificial
  CRISPR gRNA sequence
cgggtaaggcaggaagtccc

SEQ ID NO: 68489 - DNA, 20 bp, Artificial
  CRISPR gRNA sequence
gcacagtgcctgacctagag

SEQ ID NO: 68490 - DNA, 20 bp, Artificial
  CRISPR gRNA sequence
acctagagtcagcctcccta

SEQ ID NO: 68491 - DNA, 20 bp, Artificial
  CRISPR gRNA sequence
gagtcagcctccctaaataa

SEQ ID NO: 68492 - DNA, 20 bp, Artificial
  CRISPR gRNA sequence
cctaaataacttactcctaa

SEQ ID NO: 68493 - DNA, 20 bp, Artificial
  CRISPR gRNA sequence
aataacttactcctaatact

SEQ ID NO: 68494 - DNA, 20 bp, Artificial
  CRISPR gRNA sequence
actcctaatactttcttaca

SEQ ID NO: 68495 - DNA, 20 bp, Artificial
  CRISPR gRNA sequence
ctcctaatactttcttacag

SEQ ID NO: 68496 - DNA, 20 bp, Artificial
  CRISPR gRNA sequence
ctaatactttcttacagggg

SEQ ID NO: 68497 - DNA, 20 bp, Artificial
  CRISPR gRNA sequence
atactttcttacagggggtg

SEQ ID NO: 68498 - DNA, 20 bp, Artificial
  CRISPR gRNA sequence
tcttacagggggtgtgggag

SEQ ID NO: 68499 - DNA, 20 bp, Artificial
  CRISPR gRNA sequence
cttacagggggtgtgggagg

SEQ ID NO: 68500 - DNA, 20 bp, Artificial
  CRISPR gRNA sequence
ttacagggggtgtgggaggt

SEQ ID NO: 68501 - DNA, 20 bp, Artificial
  CRISPR gRNA sequence
acagggggtgtgggaggttc

SEQ ID NO: 68502 - DNA, 20 bp, Artificial
  CRISPR gRNA sequence
cagggggtgtgggaggttcc

SEQ ID NO: 68503 - DNA, 20 bp, Artificial
  CRISPR gRNA sequence
ctccccaaagagacaggaag

SEQ ID NO: 68504 - DNA, 20 bp, Artificial
  CRISPR gRNA sequence
cccaaagagacaggaagctc

SEQ ID NO: 68505 - DNA, 20 bp, Artificial
  CRISPR gRNA sequence
ccagagcaggagctgcatat

SEQ ID NO: 68506 - DNA, 20 bp, Artificial
  CRISPR gRNA sequence
catatttggcctctcaggcc

SEQ ID NO: 68507 - DNA, 20 bp, Artificial
  CRISPR gRNA sequence
ggcctctcaggccctgctcc

SEQ ID NO: 68508 - DNA, 20 bp, Artificial
  CRISPR gRNA sequence
gcctctcaggccctgctcca

SEQ ID NO: 68509 - DNA, 20 bp, Artificial
  CRISPR gRNA sequence
tcaggccctgctccaggcct

SEQ ID NO: 68510 - DNA, 20 bp, Artificial
  CRISPR gRNA sequence
aggccctgctccaggccttt

SEQ ID NO: 68511 - DNA, 20 bp, Artificial
  CRISPR gRNA sequence
ctccaggcctttgccctcag

SEQ ID NO: 68512 - DNA, 20 bp, Artificial
  CRISPR gRNA sequence
caggcctttgccctcagagg

SEQ ID NO: 68513 - DNA, 20 bp, Artificial
  CRISPR gRNA sequence
tgccctcagaggtgggatgc

SEQ ID NO: 68514 - DNA, 20 bp, Artificial
  CRISPR gRNA sequence
gccctcagaggtgggatgct

SEQ ID NO: 68515 - DNA, 20 bp, Artificial
  CRISPR gRNA sequence
ccctcagaggtgggatgctc

SEQ ID NO: 68516 - DNA, 20 bp, Artificial
  CRISPR gRNA sequence
agaggtgggatgctccccca

SEQ ID NO: 68517 - DNA, 20 bp, Artificial
  CRISPR gRNA sequence
ccccaataggccctcaggga

SEQ ID NO: 68518 - DNA, 20 bp, Artificial
  CRISPR gRNA sequence
agggaggctgagatgaagct

SEQ ID NO: 68519 - DNA, 20 bp, Artificial
  CRISPR gRNA sequence
agatgaagctgagcagcagt

SEQ ID NO: 68520 - DNA, 20 bp, Artificial
  CRISPR gRNA sequence
agcagcagtgcccacaggcc

SEQ ID NO: 68521 - DNA, 20 bp, Artificial
  CRISPR gRNA sequence
acccaggctctgccctggct

SEQ ID NO: 68522 - DNA, 20 bp, Artificial
  CRISPR gRNA sequence
tgccctggctttctgccctc

SEQ ID NO: 68523 - DNA, 20 bp, Artificial
  CRISPR gRNA sequence
ccctggctttctgccctcag

SEQ ID NO: 68524 - DNA, 20 bp, Artificial
  CRISPR gRNA sequence
gctttctgccctcaggctaa

SEQ ID NO: 68525 - DNA, 20 bp, Artificial
  CRISPR gRNA sequence
tctgccctcaggctaagtga

SEQ ID NO: 68526 - DNA, 20 bp, Artificial
  CRISPR gRNA sequence
ctgccctcaggctaagtgag

SEQ ID NO: 68527 - DNA, 20 bp, Artificial
  CRISPR gRNA sequence
tgccctcaggctaagtgagt

SEQ ID NO: 68528 - DNA, 20 bp, Artificial
  CRISPR gRNA sequence
ccctcaggctaagtgagtgc

SEQ ID NO: 68529 - DNA, 20 bp, Artificial
  CRISPR gRNA sequence
aggctaagtgagtgcagctt

SEQ ID NO: 68530 - DNA, 20 bp, Artificial
  CRISPR gRNA sequence
agtgagtgcagcttccggcc

SEQ ID NO: 68531 - DNA, 20 bp, Artificial
  CRISPR gRNA sequence
ccggccagagcacgtgtcca

SEQ ID NO: 68532 - DNA, 20 bp, Artificial
  CRISPR gRNA sequence
cggccagagcacgtgtccag

SEQ ID NO: 68533 - DNA, 20 bp, Artificial
  CRISPR gRNA sequence
gccaccggcttgagcaagtc

SEQ ID NO: 68534 - DNA, 20 bp, Artificial
  CRISPR gRNA sequence
gagcaagtccctgcagctga

SEQ ID NO: 68535 - DNA, 20 bp, Artificial
  CRISPR gRNA sequence
agcaagtccctgcagctgac

SEQ ID NO: 68536 - DNA, 20 bp, Artificial
  CRISPR gRNA sequence
cagctgacggagctcacgtg

SEQ ID NO: 68537 - DNA, 20 bp, Artificial
  CRISPR gRNA sequence
acggagctcacgtgagtgac

SEQ ID NO: 68538 - DNA, 20 bp, Artificial
  CRISPR gRNA sequence
acgtgagtgacccacccagc

SEQ ID NO: 68539 - DNA, 20 bp, Artificial
  CRISPR gRNA sequence
ccagagccacctcagtgact

SEQ ID NO: 68540 - DNA, 20 bp, Artificial
  CRISPR gRNA sequence
agtgactgacctctgtctcc

SEQ ID NO: 68541 - DNA, 20 bp, Artificial
  CRISPR gRNA sequence
acctctgtctccaggctgac

SEQ ID NO: 68542 - DNA, 20 bp, Artificial
  CRISPR gRNA sequence
tgtctccaggctgacccagt

SEQ ID NO: 68543 - DNA, 20 bp, Artificial
  CRISPR gRNA sequence
tctccaggctgacccagtgc

SEQ ID NO: 68544 - DNA, 20 bp, Artificial
  CRISPR gRNA sequence
caggctgacccagtgctgcc

SEQ ID NO: 68545 - DNA, 20 bp, Artificial
  CRISPR gRNA sequence
acccagtgctgcctgggcca

SEQ ID NO: 68546 - DNA, 20 bp, Artificial
  CRISPR gRNA sequence
cctgggccagaagcagctgg

SEQ ID NO: 68547 - DNA, 20 bp, Artificial
  CRISPR gRNA sequence
ggccagaagcagctggccat

SEQ ID NO: 68548 - DNA, 20 bp, Artificial
  CRISPR gRNA sequence
gccatcctcctgagcttggt

SEQ ID NO: 68549 - DNA, 20 bp, Artificial
  CRISPR gRNA sequence
ctgagcttggtggggcgacc

SEQ ID NO: 68550 - DNA, 20 bp, Artificial
  CRISPR gRNA sequence
agcttggtggggcgacccgc

SEQ ID NO: 68551 - DNA, 20 bp, Artificial
  CRISPR gRNA sequence
ggtggggcgacccgcagggc

SEQ ID NO: 68552 - DNA, 20 bp, Artificial
  CRISPR gRNA sequence
gtggggcgacccgcagggct

SEQ ID NO: 68553 - DNA, 20 bp, Artificial
  CRISPR gRNA sequence
ttcagcctcaggtacctcct

SEQ ID NO: 68554 - DNA, 20 bp, Artificial
  CRISPR gRNA sequence
agcctcaggtacctcctccc

SEQ ID NO: 68555 - DNA, 20 bp, Artificial
  CRISPR gRNA sequence
aggtacctcctcccccgctg

SEQ ID NO: 68556 - DNA, 20 bp, Artificial
  CRISPR gRNA sequence
ctcccccgctgcctccggga

SEQ ID NO: 68557 - DNA, 20 bp, Artificial
  CRISPR gRNA sequence
ccccgctgcctccgggaggg

SEQ ID NO: 68558 - DNA, 20 bp, Artificial
  CRISPR gRNA sequence
cctccgggaggggccatggc

SEQ ID NO: 68559 - DNA, 20 bp, Artificial
  CRISPR gRNA sequence
cgggaggggccatggcatga

SEQ ID NO: 68560 - DNA, 20 bp, Artificial
  CRISPR gRNA sequence
gagtaagaggcccccaggat

SEQ ID NO: 68561 - DNA, 20 bp, Artificial
  CRISPR gRNA sequence
cctgtacccacaaccctgcc

SEQ ID NO: 68562 - DNA, 20 bp, Artificial
  CRISPR gRNA sequence
ctgtacccacaaccctgcca

SEQ ID NO: 68563 - DNA, 20 bp, Artificial
  CRISPR gRNA sequence
tacccacaaccctgccatct

SEQ ID NO: 68564 - DNA, 20 bp, Artificial
  CRISPR gRNA sequence
ccatctggaccctgagcaaa

SEQ ID NO: 68565 - DNA, 20 bp, Artificial
  CRISPR gRNA sequence
gaccctgagcaaaccctgtc

SEQ ID NO: 68566 - DNA, 20 bp, Artificial
  CRISPR gRNA sequence
agcaaaccctgtccatctgt

SEQ ID NO: 68567 - DNA, 20 bp, Artificial
  CRISPR gRNA sequence
tccatctgtcccagagactc

SEQ ID NO: 68568 - DNA, 20 bp, Artificial
  CRISPR gRNA sequence
tcccagagactccacaaggc

SEQ ID NO: 68569 - DNA, 20 bp, Artificial
  CRISPR gRNA sequence
cacaaggcacacagagaaac

SEQ ID NO: 68570 - DNA, 20 bp, Artificial
  CRISPR gRNA sequence
tccttccccacactggaggc

SEQ ID NO: 68571 - DNA, 20 bp, Artificial
  CRISPR gRNA sequence
ccccacactggaggcctgtg

SEQ ID NO: 68572 - DNA, 20 bp, Artificial
  CRISPR gRNA sequence
cccacactggaggcctgtgc

SEQ ID NO: 68573 - DNA, 20 bp, Artificial
  CRISPR gRNA sequence
gaggcctgtgctttgggatt

SEQ ID NO: 68574 - DNA, 20 bp, Artificial
  CRISPR gRNA sequence
tgctttgggatttaagaaaa

SEQ ID NO: 68575 - DNA, 20 bp, Artificial
  CRISPR gRNA sequence
tgggatttaagaaaaaaaga

SEQ ID NO: 68576 - DNA, 20 bp, Artificial
  CRISPR gRNA sequence
gggatttaagaaaaaaagaa

SEQ ID NO: 68577 - DNA, 20 bp, Artificial
  CRISPR gRNA sequence
ggatttaagaaaaaaagaaa

SEQ ID NO: 68578 - DNA, 20 bp, Artificial
  CRISPR gRNA sequence
aagaaaaaaagaaagaaaga

SEQ ID NO: 68579 - DNA, 20 bp, Artificial
  CRISPR gRNA sequence
agaaaaaaagaaagaaagaa

SEQ ID NO: 68580 - DNA, 20 bp, Artificial
  CRISPR gRNA sequence
cagaggatactgaactgagg

SEQ ID NO: 68581 - DNA, 20 bp, Artificial
  CRISPR gRNA sequence
agaggatactgaactgagga

SEQ ID NO: 68582 - DNA, 20 bp, Artificial
  CRISPR gRNA sequence
aactgaggacaaaaataaac

SEQ ID NO: 68583 - DNA, 20 bp, Artificial
  CRISPR gRNA sequence
aggacaaaaataaactgaaa

SEQ ID NO: 68584 - DNA, 20 bp, Artificial
  CRISPR gRNA sequence
aaacgaagttcttgtctgtc

SEQ ID NO: 68585 - DNA, 20 bp, Artificial
  CRISPR gRNA sequence
ttgtctgtctgttcactatg

SEQ ID NO: 68586 - DNA, 20 bp, Artificial
  CRISPR gRNA sequence
gtctgtctgttcactatgat

SEQ ID NO: 68587 - DNA, 20 bp, Artificial
  CRISPR gRNA sequence
tctgtctgttcactatgatc

SEQ ID NO: 68588 - DNA, 20 bp, Artificial
  CRISPR gRNA sequence
tctgttcactatgatcattt

SEQ ID NO: 68589 - DNA, 20 bp, Artificial
  CRISPR gRNA sequence
ttcactatgatcattttaaa

SEQ ID NO: 68590 - DNA, 20 bp, Artificial
  CRISPR gRNA sequence
actatgatcattttaaaaca

SEQ ID NO: 68591 - DNA, 20 bp, Artificial
  CRISPR gRNA sequence
tgatcattttaaaacactca

SEQ ID NO: 68592 - DNA, 20 bp, Artificial
  CRISPR gRNA sequence
taaaacactcagaaaaagaa

SEQ ID NO: 68593 - DNA, 20 bp, Artificial
  CRISPR gRNA sequence
aaaacactcagaaaaagaag

SEQ ID NO: 68594 - DNA, 20 bp, Artificial
  CRISPR gRNA sequence
aaacactcagaaaaagaaga

SEQ ID NO: 68595 - DNA, 20 bp, Artificial
  CRISPR gRNA sequence
agaaaaagaagataccgaag

SEQ ID NO: 68596 - DNA, 20 bp, Artificial
  CRISPR gRNA sequence
tttaaaactcctattcccag

SEQ ID NO: 68597 - DNA, 20 bp, Artificial
  CRISPR gRNA sequence
ttaaaactcctattcccaga

SEQ ID NO: 68598 - DNA, 20 bp, Artificial
  CRISPR gRNA sequence
taaaactcctattcccagaa

SEQ ID NO: 68599 - DNA, 20 bp, Artificial
  CRISPR gRNA sequence
aaaactcctattcccagaac

SEQ ID NO: 68600 - DNA, 20 bp, Artificial
  CRISPR gRNA sequence
aaactcctattcccagaacc

SEQ ID NO: 68601 - DNA, 20 bp, Artificial
  CRISPR gRNA sequence
ctattcccagaacctaggtt

SEQ ID NO: 68602 - DNA, 20 bp, Artificial
  CRISPR gRNA sequence
ttcccagaacctaggtttga

SEQ ID NO: 68603 - DNA, 20 bp, Artificial
  CRISPR gRNA sequence
ccagaacctaggtttgacag

SEQ ID NO: 68604 - DNA, 20 bp, Artificial
  CRISPR gRNA sequence
ggtttgacagttgttcatac

SEQ ID NO: 68605 - DNA, 20 bp, Artificial
  CRISPR gRNA sequence
gacagttgttcatacttttt

SEQ ID NO: 68606 - DNA, 20 bp, Artificial
  CRISPR gRNA sequence
acagttgttcatactttttt

SEQ ID NO: 68607 - DNA, 20 bp, Artificial
  CRISPR gRNA sequence
ttcatactttttttatattt

SEQ ID NO: 68608 - DNA, 20 bp, Artificial
  CRISPR gRNA sequence
atactttttttatatttgct

SEQ ID NO: 68609 - DNA, 20 bp, Artificial
  CRISPR gRNA sequence
tttttatatttgcttctatt

SEQ ID NO: 68610 - DNA, 20 bp, Artificial
  CRISPR gRNA sequence
ttttatatttgcttctattt

SEQ ID NO: 68611 - DNA, 20 bp, Artificial
  CRISPR gRNA sequence
tttatatttgcttctatttt

SEQ ID NO: 68612 - DNA, 20 bp, Artificial
  CRISPR gRNA sequence
ttatatttgcttctattttt

SEQ ID NO: 68613 - DNA, 20 bp, Artificial
  CRISPR gRNA sequence
tatatttgcttctattttta

SEQ ID NO: 68614 - DNA, 20 bp, Artificial
  CRISPR gRNA sequence
atatttgcttctatttttat

SEQ ID NO: 68615 - DNA, 20 bp, Artificial
  CRISPR gRNA sequence
tatttgcttctatttttatt

SEQ ID NO: 68616 - DNA, 20 bp, Artificial
  CRISPR gRNA sequence
gcttctatttttatttttat

SEQ ID NO: 68617 - DNA, 20 bp, Artificial
  CRISPR gRNA sequence
cttctatttttatttttatt

SEQ ID NO: 68618 - DNA, 20 bp, Artificial
  CRISPR gRNA sequence
ctatttttatttttatttca

SEQ ID NO: 68619 - DNA, 20 bp, Artificial
  CRISPR gRNA sequence
tatttttatttttatttcag

SEQ ID NO: 68620 - DNA, 20 bp, Artificial
  CRISPR gRNA sequence
tttttatttttatttcagct

SEQ ID NO: 68621 - DNA, 20 bp, Artificial
  CRISPR gRNA sequence
ttatttttatttcagctgaa

SEQ ID NO: 68622 - DNA, 20 bp, Artificial
  CRISPR gRNA sequence
tatttttatttcagctgaag

SEQ ID NO: 68623 - DNA, 20 bp, Artificial
  CRISPR gRNA sequence
atttttatttcagctgaagc

SEQ ID NO: 68624 - DNA, 20 bp, Artificial
  CRISPR gRNA sequence
tttttatttcagctgaagcg

SEQ ID NO: 68625 - DNA, 20 bp, Artificial
  CRISPR gRNA sequence
ttatttcagctgaagcggtt

SEQ ID NO: 68626 - DNA, 20 bp, Artificial
  CRISPR gRNA sequence
tatttcagctgaagcggttt

SEQ ID NO: 68627 - DNA, 20 bp, Artificial
  CRISPR gRNA sequence
atttcagctgaagcggtttc

SEQ ID NO: 68628 - DNA, 20 bp, Artificial
  CRISPR gRNA sequence
tttcagctgaagcggtttca

SEQ ID NO: 68629 - DNA, 20 bp, Artificial
  CRISPR gRNA sequence
cagctgaagcggtttcaagt

SEQ ID NO: 68630 - DNA, 20 bp, Artificial
  CRISPR gRNA sequence
agctgaagcggtttcaagta

SEQ ID NO: 68631 - DNA, 20 bp, Artificial
  CRISPR gRNA sequence
aagcggtttcaagtaagtta

SEQ ID NO: 68632 - DNA, 20 bp, Artificial
  CRISPR gRNA sequence
caagtaagttatagacctca

SEQ ID NO: 68633 - DNA, 20 bp, Artificial
  CRISPR gRNA sequence
aagtaagttatagacctcat

SEQ ID NO: 68634 - DNA, 20 bp, Artificial
  CRISPR gRNA sequence
tagacctcataatccatcac

SEQ ID NO: 68635 - DNA, 20 bp, Artificial
  CRISPR gRNA sequence
ataatccatcactcctaaat

SEQ ID NO: 68636 - DNA, 20 bp, Artificial
  CRISPR gRNA sequence
ctaaatatttcaccgtgaag

SEQ ID NO: 68637 - DNA, 20 bp, Artificial
  CRISPR gRNA sequence
aatatttcaccgtgaagctc

SEQ ID NO: 68638 - DNA, 20 bp, Artificial
  CRISPR gRNA sequence
caccgtgaagctccaaaaaa

SEQ ID NO: 68639 - DNA, 20 bp, Artificial
  CRISPR gRNA sequence
accgtgaagctccaaaaaat

SEQ ID NO: 68640 - DNA, 20 bp, Artificial
  CRISPR gRNA sequence
caaaaaataaggacattttt

SEQ ID NO: 68641 - DNA, 20 bp, Artificial
  CRISPR gRNA sequence
ttttcagtaatcacagttcc

SEQ ID NO: 68642 - DNA, 20 bp, Artificial
  CRISPR gRNA sequence
tttcagtaatcacagttcca

SEQ ID NO: 68643 - DNA, 20 bp, Artificial
  CRISPR gRNA sequence
ttcagtaatcacagttccat

SEQ ID NO: 68644 - DNA, 20 bp, Artificial
  CRISPR gRNA sequence
tcagtaatcacagttccatc

SEQ ID NO: 68645 - DNA, 20 bp, Artificial
  CRISPR gRNA sequence
cagtaatcacagttccatca

SEQ ID NO: 68646 - DNA, 20 bp, Artificial
  CRISPR gRNA sequence
agtaatcacagttccatcag

SEQ ID NO: 68647 - DNA, 20 bp, Artificial
  CRISPR gRNA sequence
catcaggacacctaagaaac

SEQ ID NO: 68648 - DNA, 20 bp, Artificial
  CRISPR gRNA sequence
agaaactcagttagcgattc

SEQ ID NO: 68649 - DNA, 20 bp, Artificial
  CRISPR gRNA sequence
agttagcgattccttagtgt

SEQ ID NO: 68650 - DNA, 20 bp, Artificial
  CRISPR gRNA sequence
gcgattccttagtgtcgggt

SEQ ID NO: 68651 - DNA, 20 bp, Artificial
  CRISPR gRNA sequence
cttagtgtcgggtactacct

SEQ ID NO: 68652 - DNA, 20 bp, Artificial
  CRISPR gRNA sequence
agtgtcgggtactacctagt

SEQ ID NO: 68653 - DNA, 20 bp, Artificial
  CRISPR gRNA sequence
gtgtcgggtactacctagtc

SEQ ID NO: 68654 - DNA, 20 bp, Artificial
  CRISPR gRNA sequence
cctagtctaatctaaaatgt

SEQ ID NO: 68655 - DNA, 20 bp, Artificial
  CRISPR gRNA sequence
gtctaatctaaaatgtcccc

SEQ ID NO: 68656 - DNA, 20 bp, Artificial
  CRISPR gRNA sequence
atctaaaatgtccccattgt

SEQ ID NO: 68657 - DNA, 20 bp, Artificial
  CRISPR gRNA sequence
aaatgtccccattgtccccc

SEQ ID NO: 68658 - DNA, 20 bp, Artificial
  CRISPR gRNA sequence
tcccccagataagacagctg

SEQ ID NO: 68659 - DNA, 20 bp, Artificial
  CRISPR gRNA sequence
gcttttgggatccaggatct

SEQ ID NO: 68660 - DNA, 20 bp, Artificial
  CRISPR gRNA sequence
ttgggatccaggatctgtca

SEQ ID NO: 68661 - DNA, 20 bp, Artificial
  CRISPR gRNA sequence
tgggatccaggatctgtcac

SEQ ID NO: 68662 - DNA, 20 bp, Artificial
  CRISPR gRNA sequence
gggatccaggatctgtcaca

SEQ ID NO: 68663 - DNA, 20 bp, Artificial
  CRISPR gRNA sequence
ggatccaggatctgtcacat

SEQ ID NO: 68664 - DNA, 20 bp, Artificial
  CRISPR gRNA sequence
tcacatctggtctgcatttg

SEQ ID NO: 68665 - DNA, 20 bp, Artificial
  CRISPR gRNA sequence
gtctgcatttgcacgggatg

SEQ ID NO: 68666 - DNA, 20 bp, Artificial
  CRISPR gRNA sequence
catttgcacgggatggcgat

SEQ ID NO: 68667 - DNA, 20 bp, Artificial
  CRISPR gRNA sequence
gcacgggatggcgatggtct

SEQ ID NO: 68668 - DNA, 20 bp, Artificial
  CRISPR gRNA sequence
cacgggatggcgatggtctt

SEQ ID NO: 68669 - DNA, 20 bp, Artificial
  CRISPR gRNA sequence
ctgactcttctaacctgcgg

SEQ ID NO: 68670 - DNA, 20 bp, Artificial
  CRISPR gRNA sequence
tgactcttctaacctgcggc

SEQ ID NO: 68671 - DNA, 20 bp, Artificial
  CRISPR gRNA sequence
actcttctaacctgcggcat

SEQ ID NO: 68672 - DNA, 20 bp, Artificial
  CRISPR gRNA sequence
ttctaacctgcggcatcact

SEQ ID NO: 68673 - DNA, 20 bp, Artificial
  CRISPR gRNA sequence
ctaacctgcggcatcactgc

SEQ ID NO: 68674 - DNA, 20 bp, Artificial
  CRISPR gRNA sequence
taacctgcggcatcactgcc

SEQ ID NO: 68675 - DNA, 20 bp, Artificial
  CRISPR gRNA sequence
acctgcggcatcactgcccc

SEQ ID NO: 68676 - DNA, 20 bp, Artificial
  CRISPR gRNA sequence
cggcatcactgcccccatcc

SEQ ID NO: 68677 - DNA, 20 bp, Artificial
  CRISPR gRNA sequence
cccccatcccctcaccacag

SEQ ID NO: 68678 - DNA, 20 bp, Artificial
  CRISPR gRNA sequence
accacagctttctgtttcat

SEQ ID NO: 68679 - DNA, 20 bp, Artificial
  CRISPR gRNA sequence
tctgtttcatgtcagtgtct

SEQ ID NO: 68680 - DNA, 20 bp, Artificial
  CRISPR gRNA sequence
ctgtttcatgtcagtgtctg

SEQ ID NO: 68681 - DNA, 20 bp, Artificial
  CRISPR gRNA sequence
tgtttcatgtcagtgtctgt

SEQ ID NO: 68682 - DNA, 20 bp, Artificial
  CRISPR gRNA sequence
tttcatgtcagtgtctgttg

SEQ ID NO: 68683 - DNA, 20 bp, Artificial
  CRISPR gRNA sequence
catgtcagtgtctgttgaca

SEQ ID NO: 68684 - DNA, 20 bp, Artificial
  CRISPR gRNA sequence
atgtcagtgtctgttgacaa

SEQ ID NO: 68685 - DNA, 20 bp, Artificial
  CRISPR gRNA sequence
ttgacaaaatcagcaactgt

SEQ ID NO: 68686 - DNA, 20 bp, Artificial
  CRISPR gRNA sequence
acaaaatcagcaactgtgtg

SEQ ID NO: 68687 - DNA, 20 bp, Artificial
  CRISPR gRNA sequence
tgtgtactgcagactgtcct

SEQ ID NO: 68688 - DNA, 20 bp, Artificial
  CRISPR gRNA sequence
cagactgtcctgctcctgac

SEQ ID NO: 68689 - DNA, 20 bp, Artificial
  CRISPR gRNA sequence
tcctgctcctgactctggtg

SEQ ID NO: 68690 - DNA, 20 bp, Artificial
  CRISPR gRNA sequence
ctcctgactctggtggcttt

SEQ ID NO: 68691 - DNA, 20 bp, Artificial
  CRISPR gRNA sequence
ctgactctggtggctttctc

SEQ ID NO: 68692 - DNA, 20 bp, Artificial
  CRISPR gRNA sequence
actctggtggctttctcatg

SEQ ID NO: 68693 - DNA, 20 bp, Artificial
  CRISPR gRNA sequence
tggtggctttctcatgatgt

SEQ ID NO: 68694 - DNA, 20 bp, Artificial
  CRISPR gRNA sequence
gtggctttctcatgatgtca

SEQ ID NO: 68695 - DNA, 20 bp, Artificial
  CRISPR gRNA sequence
tctcatgatgtcatggcacg

SEQ ID NO: 68696 - DNA, 20 bp, Artificial
  CRISPR gRNA sequence
ctcatgatgtcatggcacgt

SEQ ID NO: 68697 - DNA, 20 bp, Artificial
  CRISPR gRNA sequence
tcatgatgtcatggcacgtg

SEQ ID NO: 68698 - DNA, 20 bp, Artificial
  CRISPR gRNA sequence
atgatgtcatggcacgtgtt

SEQ ID NO: 68699 - DNA, 20 bp, Artificial
  CRISPR gRNA sequence
ctctaaccccgactttcctg

SEQ ID NO: 68700 - DNA, 20 bp, Artificial
  CRISPR gRNA sequence
taaccccgactttcctggaa

SEQ ID NO: 68701 - DNA, 20 bp, Artificial
  CRISPR gRNA sequence
accccgactttcctggaaac

SEQ ID NO: 68702 - DNA, 20 bp, Artificial
  CRISPR gRNA sequence
tcctggaaactggacgttag

SEQ ID NO: 68703 - DNA, 20 bp, Artificial
  CRISPR gRNA sequence
cctggaaactggacgttaga

SEQ ID NO: 68704 - DNA, 20 bp, Artificial
  CRISPR gRNA sequence
ctggaaactggacgttagat

SEQ ID NO: 68705 - DNA, 20 bp, Artificial
  CRISPR gRNA sequence
gaaactggacgttagatcaa

SEQ ID NO: 68706 - DNA, 20 bp, Artificial
  CRISPR gRNA sequence
gacgttagatcaaaaggctc

SEQ ID NO: 68707 - DNA, 20 bp, Artificial
  CRISPR gRNA sequence
gatcaaaaggctccatgaca

SEQ ID NO: 68708 - DNA, 20 bp, Artificial
  CRISPR gRNA sequence
catgacattcagtttcatgt

SEQ ID NO: 68709 - DNA, 20 bp, Artificial
  CRISPR gRNA sequence
agtttcatgtttgtgcccaa

SEQ ID NO: 68710 - DNA, 20 bp, Artificial
  CRISPR gRNA sequence
catgtttgtgcccaaaaaac

SEQ ID NO: 68711 - DNA, 20 bp, Artificial
  CRISPR gRNA sequence
atgtttgtgcccaaaaaact

SEQ ID NO: 68712 - DNA, 20 bp, Artificial
  CRISPR gRNA sequence
gtgcccaaaaaacttacgtc

SEQ ID NO: 68713 - DNA, 20 bp, Artificial
  CRISPR gRNA sequence
tgcccaaaaaacttacgtca

SEQ ID NO: 68714 - DNA, 20 bp, Artificial
  CRISPR gRNA sequence
acgtcaccgacagagctgtg

SEQ ID NO: 68715 - DNA, 20 bp, Artificial
  CRISPR gRNA sequence
cgtcaccgacagagctgtgc

SEQ ID NO: 68716 - DNA, 20 bp, Artificial
  CRISPR gRNA sequence
tgcacttctcattgcagcct

SEQ ID NO: 68717 - DNA, 20 bp, Artificial
  CRISPR gRNA sequence
ctcattgcagcctgtgacaa

SEQ ID NO: 68718 - DNA, 20 bp, Artificial
  CRISPR gRNA sequence
tcattgcagcctgtgacaag

SEQ ID NO: 68719 - DNA, 20 bp, Artificial
  CRISPR gRNA sequence
attgcagcctgtgacaaggc

SEQ ID NO: 68720 - DNA, 20 bp, Artificial
  CRISPR gRNA sequence
cagcctgtgacaaggcacct

SEQ ID NO: 68721 - DNA, 20 bp, Artificial
  CRISPR gRNA sequence
tgacaaggcacctaagaact

SEQ ID NO: 68722 - DNA, 20 bp, Artificial
  CRISPR gRNA sequence
agaactgactgttccccaaa

SEQ ID NO: 68723 - DNA, 20 bp, Artificial
  CRISPR gRNA sequence
actgttccccaaaataacct

SEQ ID NO: 68724 - DNA, 20 bp, Artificial
  CRISPR gRNA sequence
ttccccaaaataacctgtaa

SEQ ID NO: 68725 - DNA, 20 bp, Artificial
  CRISPR gRNA sequence
cccaaaataacctgtaaaaa

SEQ ID NO: 68726 - DNA, 20 bp, Artificial
  CRISPR gRNA sequence
taaaaattattataaaatac

SEQ ID NO: 68727 - DNA, 20 bp, Artificial
  CRISPR gRNA sequence
ttataaaatacacataacaa

SEQ ID NO: 68728 - DNA, 20 bp, Artificial
  CRISPR gRNA sequence
taaaatacacataacaaaat

SEQ ID NO: 68729 - DNA, 20 bp, Artificial
  CRISPR gRNA sequence
gccatcttaatcatttctaa

SEQ ID NO: 68730 - DNA, 20 bp, Artificial
  CRISPR gRNA sequence
ccatcttaatcatttctaag

SEQ ID NO: 68731 - DNA, 20 bp, Artificial
  CRISPR gRNA sequence
aatcatttctaagtgtacca

SEQ ID NO: 68732 - DNA, 20 bp, Artificial
  CRISPR gRNA sequence
atcatttctaagtgtaccat

SEQ ID NO: 68733 - DNA, 20 bp, Artificial
  CRISPR gRNA sequence
ctaagtgtaccattcaggag

SEQ ID NO: 68734 - DNA, 20 bp, Artificial
  CRISPR gRNA sequence
taagtgtaccattcaggagt

SEQ ID NO: 68735 - DNA, 20 bp, Artificial
  CRISPR gRNA sequence
agtgtaccattcaggagtgt

SEQ ID NO: 68736 - DNA, 20 bp, Artificial
  CRISPR gRNA sequence
aggagtgttaagtacatcca

SEQ ID NO: 68737 - DNA, 20 bp, Artificial
  CRISPR gRNA sequence
agtacatccacttttttgta

SEQ ID NO: 68738 - DNA, 20 bp, Artificial
  CRISPR gRNA sequence
ttttgtacggccaatctccg

SEQ ID NO: 68739 - DNA, 20 bp, Artificial
  CRISPR gRNA sequence
tttgtacggccaatctccgg

SEQ ID NO: 68740 - DNA, 20 bp, Artificial
  CRISPR gRNA sequence
ttgtacggccaatctccgga

SEQ ID NO: 68741 - DNA, 20 bp, Artificial
  CRISPR gRNA sequence
tgtacggccaatctccggaa

SEQ ID NO: 68742 - DNA, 20 bp, Artificial
  CRISPR gRNA sequence
gtacggccaatctccggaac

SEQ ID NO: 68743 - DNA, 20 bp, Artificial
  CRISPR gRNA sequence
tacggccaatctccggaact

SEQ ID NO: 68744 - DNA, 20 bp, Artificial
  CRISPR gRNA sequence
cggaactcttttcctcttgc

SEQ ID NO: 68745 - DNA, 20 bp, Artificial
  CRISPR gRNA sequence
ttttcctcttgcaaaactga

SEQ ID NO: 68746 - DNA, 20 bp, Artificial
  CRISPR gRNA sequence
ttcctcttgcaaaactgaat

SEQ ID NO: 68747 - DNA, 20 bp, Artificial
  CRISPR gRNA sequence
tcctcttgcaaaactgaatc

SEQ ID NO: 68748 - DNA, 20 bp, Artificial
  CRISPR gRNA sequence
cctcttgcaaaactgaatct

SEQ ID NO: 68749 - DNA, 20 bp, Artificial
  CRISPR gRNA sequence
ctcttgcaaaactgaatctc

SEQ ID NO: 68750 - DNA, 20 bp, Artificial
  CRISPR gRNA sequence
ttgcaaaactgaatctctat

SEQ ID NO: 68751 - DNA, 20 bp, Artificial
  CRISPR gRNA sequence
gcaaaactgaatctctatcc

SEQ ID NO: 68752 - DNA, 20 bp, Artificial
  CRISPR gRNA sequence
caaaactgaatctctatccc

SEQ ID NO: 68753 - DNA, 20 bp, Artificial
  CRISPR gRNA sequence
aatctctatccccattaaac

SEQ ID NO: 68754 - DNA, 20 bp, Artificial
  CRISPR gRNA sequence
tatccccattaaacaacacc

SEQ ID NO: 68755 - DNA, 20 bp, Artificial
  CRISPR gRNA sequence
tccccattaaacaacacccc

SEQ ID NO: 68756 - DNA, 20 bp, Artificial
  CRISPR gRNA sequence
aacaacaccccatttccccc

SEQ ID NO: 68757 - DNA, 20 bp, Artificial
  CRISPR gRNA sequence
cccccctaccccagcccctg

SEQ ID NO: 68758 - DNA, 20 bp, Artificial
  CRISPR gRNA sequence
ccccctaccccagcccctgg

SEQ ID NO: 68759 - DNA, 20 bp, Artificial
  CRISPR gRNA sequence
ccccagcccctggcaaccac

SEQ ID NO: 68760 - DNA, 20 bp, Artificial
  CRISPR gRNA sequence
gcaaccaccattctgctttc

SEQ ID NO: 68761 - DNA, 20 bp, Artificial
  CRISPR gRNA sequence
tgctttctgtctctatgaat

SEQ ID NO: 68762 - DNA, 20 bp, Artificial
  CRISPR gRNA sequence
ctttctgtctctatgaattg

SEQ ID NO: 68763 - DNA, 20 bp, Artificial
  CRISPR gRNA sequence
tctgtctctatgaattggac

SEQ ID NO: 68764 - DNA, 20 bp, Artificial
  CRISPR gRNA sequence
ctgtctctatgaattggact

SEQ ID NO: 68765 - DNA, 20 bp, Artificial
  CRISPR gRNA sequence
tgtctctatgaattggactg

SEQ ID NO: 68766 - DNA, 20 bp, Artificial
  CRISPR gRNA sequence
tctctatgaattggactgct

SEQ ID NO: 68767 - DNA, 20 bp, Artificial
  CRISPR gRNA sequence
tatgaattggactgctctaa

SEQ ID NO: 68768 - DNA, 20 bp, Artificial
  CRISPR gRNA sequence
tgaattggactgctctaaat

SEQ ID NO: 68769 - DNA, 20 bp, Artificial
  CRISPR gRNA sequence
gactgctctaaatagtttat

SEQ ID NO: 68770 - DNA, 20 bp, Artificial
  CRISPR gRNA sequence
ctctaaatagtttatatgag

SEQ ID NO: 68771 - DNA, 20 bp, Artificial
  CRISPR gRNA sequence
taaatagtttatatgagtgg

SEQ ID NO: 68772 - DNA, 20 bp, Artificial
  CRISPR gRNA sequence
aatagtttatatgagtggag

SEQ ID NO: 68773 - DNA, 20 bp, Artificial
  CRISPR gRNA sequence
atatgagtggagtcatttgt

SEQ ID NO: 68774 - DNA, 20 bp, Artificial
  CRISPR gRNA sequence
tatgagtggagtcatttgta

SEQ ID NO: 68775 - DNA, 20 bp, Artificial
  CRISPR gRNA sequence
gtatttgtctgtatttgtct

SEQ ID NO: 68776 - DNA, 20 bp, Artificial
  CRISPR gRNA sequence
tatttgtctgtatttgtctt

SEQ ID NO: 68777 - DNA, 20 bp, Artificial
  CRISPR gRNA sequence
gtctgtatttgtctttttgt

SEQ ID NO: 68778 - DNA, 20 bp, Artificial
  CRISPR gRNA sequence
tctgtatttgtctttttgtg

SEQ ID NO: 68779 - DNA, 20 bp, Artificial
  CRISPR gRNA sequence
tatttgtctttttgtgactg

SEQ ID NO: 68780 - DNA, 20 bp, Artificial
  CRISPR gRNA sequence
gtctttttgtgactggctca

SEQ ID NO: 68781 - DNA, 20 bp, Artificial
  CRISPR gRNA sequence
tctttttgtgactggctcat

SEQ ID NO: 68782 - DNA, 20 bp, Artificial
  CRISPR gRNA sequence
tttgtgactggctcatttca

SEQ ID NO: 68783 - DNA, 20 bp, Artificial
  CRISPR gRNA sequence
ttgtgactggctcatttcat

SEQ ID NO: 68784 - DNA, 20 bp, Artificial
  CRISPR gRNA sequence
tgtgactggctcatttcatt

SEQ ID NO: 68785 - DNA, 20 bp, Artificial
  CRISPR gRNA sequence
gtgactggctcatttcattg

SEQ ID NO: 68786 - DNA, 20 bp, Artificial
  CRISPR gRNA sequence
tgactggctcatttcattgg

SEQ ID NO: 68787 - DNA, 20 bp, Artificial
  CRISPR gRNA sequence
gctcatttcattgggcataa

SEQ ID NO: 68788 - DNA, 20 bp, Artificial
  CRISPR gRNA sequence
atttcattgggcataatgtc

SEQ ID NO: 68789 - DNA, 20 bp, Artificial
  CRISPR gRNA sequence
cattgggcataatgtcctct

SEQ ID NO: 68790 - DNA, 20 bp, Artificial
  CRISPR gRNA sequence
attgggcataatgtcctctg

SEQ ID NO: 68791 - DNA, 20 bp, Artificial
  CRISPR gRNA sequence
ggcataatgtcctctggttc

SEQ ID NO: 68792 - DNA, 20 bp, Artificial
  CRISPR gRNA sequence
tggttcattcatgttgcagc

SEQ ID NO: 68793 - DNA, 20 bp, Artificial
  CRISPR gRNA sequence
gttcattcatgttgcagcgt

SEQ ID NO: 68794 - DNA, 20 bp, Artificial
  CRISPR gRNA sequence
attcatgttgcagcgtgtgt

SEQ ID NO: 68795 - DNA, 20 bp, Artificial
  CRISPR gRNA sequence
atgttgcagcgtgtgtcact

SEQ ID NO: 68796 - DNA, 20 bp, Artificial
  CRISPR gRNA sequence
cagcgtgtgtcactgtgtca

SEQ ID NO: 68797 - DNA, 20 bp, Artificial
  CRISPR gRNA sequence
tgtcagactttccttccttt

SEQ ID NO: 68798 - DNA, 20 bp, Artificial
  CRISPR gRNA sequence
tccttccttttttttttttt

SEQ ID NO: 68799 - DNA, 20 bp, Artificial
  CRISPR gRNA sequence
ccttcctttttttttttttt

SEQ ID NO: 68800 - DNA, 20 bp, Artificial
  CRISPR gRNA sequence
cttccttttttttttttttt

SEQ ID NO: 68801 - DNA, 20 bp, Artificial
  CRISPR gRNA sequence
cctttttttttttttttttt

SEQ ID NO: 68802 - DNA, 20 bp, Artificial
  CRISPR gRNA sequence
cttttttttttttttttttt

SEQ ID NO: 68803 - DNA, 20 bp, Artificial
  CRISPR gRNA sequence
tttttttttttttttttttt

SEQ ID NO: 68804 - DNA, 20 bp, Artificial
  CRISPR gRNA sequence
tttttttttttttttttttt

SEQ ID NO: 68805 - DNA, 20 bp, Artificial
  CRISPR gRNA sequence
tttttttttttttttttttg

SEQ ID NO: 68806 - DNA, 20 bp, Artificial
  CRISPR gRNA sequence
ttttttttttttttttttga

SEQ ID NO: 68807 - DNA, 20 bp, Artificial
  CRISPR gRNA sequence
tttttttttttttttttgag

SEQ ID NO: 68808 - DNA, 20 bp, Artificial
  CRISPR gRNA sequence
ttttttttttttttttgaga

SEQ ID NO: 68809 - DNA, 20 bp, Artificial
  CRISPR gRNA sequence
tttttttttttttttgagac

SEQ ID NO: 68810 - DNA, 20 bp, Artificial
  CRISPR gRNA sequence
ttttttttttttttgagaca

SEQ ID NO: 68811 - DNA, 20 bp, Artificial
  CRISPR gRNA sequence
tttttttttttttgagacag

SEQ ID NO: 68812 - DNA, 20 bp, Artificial
  CRISPR gRNA sequence
ttttttttttttgagacaga

SEQ ID NO: 68813 - DNA, 20 bp, Artificial
  CRISPR gRNA sequence
tttttttttttgagacagag

SEQ ID NO: 68814 - DNA, 20 bp, Artificial
  CRISPR gRNA sequence
ttttttttttgagacagagt

SEQ ID NO: 68815 - DNA, 20 bp, Artificial
  CRISPR gRNA sequence
tttttttttgagacagagtc

SEQ ID NO: 68816 - DNA, 20 bp, Artificial
  CRISPR gRNA sequence
ttttttttgagacagagtct

SEQ ID NO: 68817 - DNA, 20 bp, Artificial
  CRISPR gRNA sequence
tttttttgagacagagtctc

SEQ ID NO: 68818 - DNA, 20 bp, Artificial
  CRISPR gRNA sequence
ttttttgagacagagtctca

SEQ ID NO: 68819 - DNA, 20 bp, Artificial
  CRISPR gRNA sequence
tttttgagacagagtctcac

SEQ ID NO: 68820 - DNA, 20 bp, Artificial
  CRISPR gRNA sequence
ttttgagacagagtctcact

SEQ ID NO: 68821 - DNA, 20 bp, Artificial
  CRISPR gRNA sequence
tttgagacagagtctcactc

SEQ ID NO: 68822 - DNA, 20 bp, Artificial
  CRISPR gRNA sequence
ttgagacagagtctcactct

SEQ ID NO: 68823 - DNA, 20 bp, Artificial
  CRISPR gRNA sequence
tgagacagagtctcactctt

SEQ ID NO: 68824 - DNA, 20 bp, Artificial
  CRISPR gRNA sequence
gagacagagtctcactcttg

SEQ ID NO: 68825 - DNA, 20 bp, Artificial
  CRISPR gRNA sequence
agacagagtctcactcttgt

SEQ ID NO: 68826 - DNA, 20 bp, Artificial
  CRISPR gRNA sequence
actcttgtcacctgggctgg

SEQ ID NO: 68827 - DNA, 20 bp, Artificial
  CRISPR gRNA sequence
ttgtcacctgggctggagtg

SEQ ID NO: 68828 - DNA, 20 bp, Artificial
  CRISPR gRNA sequence
gtcacctgggctggagtgca

SEQ ID NO: 68829 - DNA, 20 bp, Artificial
  CRISPR gRNA sequence
tcacctgggctggagtgcac

SEQ ID NO: 68830 - DNA, 20 bp, Artificial
  CRISPR gRNA sequence
ggctggagtgcactggctcg

SEQ ID NO: 68831 - DNA, 20 bp, Artificial
  CRISPR gRNA sequence
gagtgcactggctcgatctc

SEQ ID NO: 68832 - DNA, 20 bp, Artificial
  CRISPR gRNA sequence
gctcgatctcagctcactgc

SEQ ID NO: 68833 - DNA, 20 bp, Artificial
  CRISPR gRNA sequence
gatctcagctcactgcaccc

SEQ ID NO: 68834 - DNA, 20 bp, Artificial
  CRISPR gRNA sequence
agctcactgcaccctccacc

SEQ ID NO: 68835 - DNA, 20 bp, Artificial
  CRISPR gRNA sequence
actgcaccctccacctcttg

SEQ ID NO: 68836 - DNA, 20 bp, Artificial
  CRISPR gRNA sequence
caccctccacctcttgggtt

SEQ ID NO: 68837 - DNA, 20 bp, Artificial
  CRISPR gRNA sequence
cacctcttgggttcaagcga

SEQ ID NO: 68838 - DNA, 20 bp, Artificial
  CRISPR gRNA sequence
ttgggttcaagcgattctcc

SEQ ID NO: 68839 - DNA, 20 bp, Artificial
  CRISPR gRNA sequence
gggttcaagcgattctcctg

SEQ ID NO: 68840 - DNA, 20 bp, Artificial
  CRISPR gRNA sequence
ggttcaagcgattctcctgc

SEQ ID NO: 68841 - DNA, 20 bp, Artificial
  CRISPR gRNA sequence
aagcgattctcctgcctcag

SEQ ID NO: 68842 - DNA, 20 bp, Artificial
  CRISPR gRNA sequence
tcctgcctcagcctccggag

SEQ ID NO: 68843 - DNA, 20 bp, Artificial
  CRISPR gRNA sequence
ctgcctcagcctccggagta

SEQ ID NO: 68844 - DNA, 20 bp, Artificial
  CRISPR gRNA sequence
cctcagcctccggagtagct

SEQ ID NO: 68845 - DNA, 20 bp, Artificial
  CRISPR gRNA sequence
agcctccggagtagctggga

SEQ ID NO: 68846 - DNA, 20 bp, Artificial
  CRISPR gRNA sequence
cggagtagctgggattacag

SEQ ID NO: 68847 - DNA, 20 bp, Artificial
  CRISPR gRNA sequence
ggattacaggcgcccgccac

SEQ ID NO: 68848 - DNA, 20 bp, Artificial
  CRISPR gRNA sequence
caggcgcccgccaccacacc

SEQ ID NO: 68849 - DNA, 20 bp, Artificial
  CRISPR gRNA sequence
atttttttttgtatttttgt

SEQ ID NO: 68850 - DNA, 20 bp, Artificial
  CRISPR gRNA sequence
ttttttgtatttttgtagag

SEQ ID NO: 68851 - DNA, 20 bp, Artificial
  CRISPR gRNA sequence
tttttgtatttttgtagaga

SEQ ID NO: 68852 - DNA, 20 bp, Artificial
  CRISPR gRNA sequence
ttttgtatttttgtagagac

SEQ ID NO: 68853 - DNA, 20 bp, Artificial
  CRISPR gRNA sequence
tttgtatttttgtagagaca

SEQ ID NO: 68854 - DNA, 20 bp, Artificial
  CRISPR gRNA sequence
ttgtatttttgtagagacag

SEQ ID NO: 68855 - DNA, 20 bp, Artificial
  CRISPR gRNA sequence
tgtatttttgtagagacagg

SEQ ID NO: 68856 - DNA, 20 bp, Artificial
  CRISPR gRNA sequence
gtatttttgtagagacaggg

SEQ ID NO: 68857 - DNA, 20 bp, Artificial
  CRISPR gRNA sequence
tatttttgtagagacagggt

SEQ ID NO: 68858 - DNA, 20 bp, Artificial
  CRISPR gRNA sequence
ttgtagagacagggtttcac

SEQ ID NO: 68859 - DNA, 20 bp, Artificial
  CRISPR gRNA sequence
tgtagagacagggtttcacc

SEQ ID NO: 68860 - DNA, 20 bp, Artificial
  CRISPR gRNA sequence
gtagagacagggtttcacca

SEQ ID NO: 68861 - DNA, 20 bp, Artificial
  CRISPR gRNA sequence
tagagacagggtttcaccat

SEQ ID NO: 68862 - DNA, 20 bp, Artificial
  CRISPR gRNA sequence
caccatgttggcgaggctgg

SEQ ID NO: 68863 - DNA, 20 bp, Artificial
  CRISPR gRNA sequence
accatgttggcgaggctggt

SEQ ID NO: 68864 - DNA, 20 bp, Artificial
  CRISPR gRNA sequence
gcgaggctggtctcgaactc

SEQ ID NO: 68865 - DNA, 20 bp, Artificial
  CRISPR gRNA sequence
gtctcgaactcctgacctca

SEQ ID NO: 68866 - DNA, 20 bp, Artificial
  CRISPR gRNA sequence
gaactcctgacctcagatga

SEQ ID NO: 68867 - DNA, 20 bp, Artificial
  CRISPR gRNA sequence
ctgacctcagatgatctgcc

SEQ ID NO: 68868 - DNA, 20 bp, Artificial
  CRISPR gRNA sequence
acctcagatgatctgcccgt

SEQ ID NO: 68869 - DNA, 20 bp, Artificial
  CRISPR gRNA sequence
agatgatctgcccgtttcgg

SEQ ID NO: 68870 - DNA, 20 bp, Artificial
  CRISPR gRNA sequence
cccgtttcggccttccaaag

SEQ ID NO: 68871 - DNA, 20 bp, Artificial
  CRISPR gRNA sequence
cggccttccaaagtgctggg

SEQ ID NO: 68872 - DNA, 20 bp, Artificial
  CRISPR gRNA sequence
ggccttccaaagtgctggga

SEQ ID NO: 68873 - DNA, 20 bp, Artificial
  CRISPR gRNA sequence
ccaaagtgctgggattacag

SEQ ID NO: 68874 - DNA, 20 bp, Artificial
  CRISPR gRNA sequence
caaagtgctgggattacagg

SEQ ID NO: 68875 - DNA, 20 bp, Artificial
  CRISPR gRNA sequence
ggattacaggcatgagccac

SEQ ID NO: 68876 - DNA, 20 bp, Artificial
  CRISPR gRNA sequence
caggcatgagccaccacacc

SEQ ID NO: 68877 - DNA, 20 bp, Artificial
  CRISPR gRNA sequence
tccttttttaaggctgcata

SEQ ID NO: 68878 - DNA, 20 bp, Artificial
  CRISPR gRNA sequence
ccttttttaaggctgcataa

SEQ ID NO: 68879 - DNA, 20 bp, Artificial
  CRISPR gRNA sequence
cttttttaaggctgcataat

SEQ ID NO: 68880 - DNA, 20 bp, Artificial
  CRISPR gRNA sequence
ttttaaggctgcataatatt

SEQ ID NO: 68881 - DNA, 20 bp, Artificial
  CRISPR gRNA sequence
tttaaggctgcataatattc

SEQ ID NO: 68882 - DNA, 20 bp, Artificial
  CRISPR gRNA sequence
ttaaggctgcataatattcc

SEQ ID NO: 68883 - DNA, 20 bp, Artificial
  CRISPR gRNA sequence
taaggctgcataatattcca

SEQ ID NO: 68884 - DNA, 20 bp, Artificial
  CRISPR gRNA sequence
aaggctgcataatattccat

SEQ ID NO: 68885 - DNA, 20 bp, Artificial
  CRISPR gRNA sequence
aggctgcataatattccatt

SEQ ID NO: 68886 - DNA, 20 bp, Artificial
  CRISPR gRNA sequence
cataatattccattgtgtgg

SEQ ID NO: 68887 - DNA, 20 bp, Artificial
  CRISPR gRNA sequence
cattgtgtggatggaccaca

SEQ ID NO: 68888 - DNA, 20 bp, Artificial
  CRISPR gRNA sequence
tgtggatggaccacattttg

SEQ ID NO: 68889 - DNA, 20 bp, Artificial
  CRISPR gRNA sequence
tgtgtatccacttatccatc

SEQ ID NO: 68890 - DNA, 20 bp, Artificial
  CRISPR gRNA sequence
gtgtatccacttatccatca

SEQ ID NO: 68891 - DNA, 20 bp, Artificial
  CRISPR gRNA sequence
tgtatccacttatccatcaa

SEQ ID NO: 68892 - DNA, 20 bp, Artificial
  CRISPR gRNA sequence
atccatcaattgacacttgg

SEQ ID NO: 68893 - DNA, 20 bp, Artificial
  CRISPR gRNA sequence
tccatcaattgacacttggg

SEQ ID NO: 68894 - DNA, 20 bp, Artificial
  CRISPR gRNA sequence
acacttgggttgtccattca

SEQ ID NO: 68895 - DNA, 20 bp, Artificial
  CRISPR gRNA sequence
gggttgtccattcaagtgcc

SEQ ID NO: 68896 - DNA, 20 bp, Artificial
  CRISPR gRNA sequence
ggttgtccattcaagtgccc

SEQ ID NO: 68897 - DNA, 20 bp, Artificial
  CRISPR gRNA sequence
tccattcaagtgcccaattg

SEQ ID NO: 68898 - DNA, 20 bp, Artificial
  CRISPR gRNA sequence
aagtgcccaattgacagtcc

SEQ ID NO: 68899 - DNA, 20 bp, Artificial
  CRISPR gRNA sequence
acagtccctgctttcttttt

SEQ ID NO: 68900 - DNA, 20 bp, Artificial
  CRISPR gRNA sequence
ctttctttttttaaatatta

SEQ ID NO: 68901 - DNA, 20 bp, Artificial
  CRISPR gRNA sequence
tctttttttaaatattattt

SEQ ID NO: 68902 - DNA, 20 bp, Artificial
  CRISPR gRNA sequence
ctttttttaaatattatttt

SEQ ID NO: 68903 - DNA, 20 bp, Artificial
  CRISPR gRNA sequence
tttttttaaatattatttta

SEQ ID NO: 68904 - DNA, 20 bp, Artificial
  CRISPR gRNA sequence
tttttaaatattattttatt

SEQ ID NO: 68905 - DNA, 20 bp, Artificial
  CRISPR gRNA sequence
ttttaaatattattttattt

SEQ ID NO: 68906 - DNA, 20 bp, Artificial
  CRISPR gRNA sequence
tttaaatattattttatttc

SEQ ID NO: 68907 - DNA, 20 bp, Artificial
  CRISPR gRNA sequence
ttaaatattattttatttca

SEQ ID NO: 68908 - DNA, 20 bp, Artificial
  CRISPR gRNA sequence
taaatattattttatttcaa

SEQ ID NO: 68909 - DNA, 20 bp, Artificial
  CRISPR gRNA sequence
aaatattattttatttcaaa

SEQ ID NO: 68910 - DNA, 20 bp, Artificial
  CRISPR gRNA sequence
aatattattttatttcaaaa

SEQ ID NO: 68911 - DNA, 20 bp, Artificial
  CRISPR gRNA sequence
ttttatttcaaaaacaatag

SEQ ID NO: 68912 - DNA, 20 bp, Artificial
  CRISPR gRNA sequence
tatttcaaaaacaatagaga

SEQ ID NO: 68913 - DNA, 20 bp, Artificial
  CRISPR gRNA sequence
atttcaaaaacaatagagat

SEQ ID NO: 68914 - DNA, 20 bp, Artificial
  CRISPR gRNA sequence
tttcaaaaacaatagagatg

SEQ ID NO: 68915 - DNA, 20 bp, Artificial
  CRISPR gRNA sequence
caaaaacaatagagatgagg

SEQ ID NO: 68916 - DNA, 20 bp, Artificial
  CRISPR gRNA sequence
aaaaacaatagagatgaggt

SEQ ID NO: 68917 - DNA, 20 bp, Artificial
  CRISPR gRNA sequence
actgttttgcccaggatgat

SEQ ID NO: 68918 - DNA, 20 bp, Artificial
  CRISPR gRNA sequence
ttttgcccaggatgatcttg

SEQ ID NO: 68919 - DNA, 20 bp, Artificial
  CRISPR gRNA sequence
tgcccaggatgatcttgatc

SEQ ID NO: 68920 - DNA, 20 bp, Artificial
  CRISPR gRNA sequence
gcccaggatgatcttgatct

SEQ ID NO: 68921 - DNA, 20 bp, Artificial
  CRISPR gRNA sequence
cccaggatgatcttgatctc

SEQ ID NO: 68922 - DNA, 20 bp, Artificial
  CRISPR gRNA sequence
gatctcctgagctcaagtga

SEQ ID NO: 68923 - DNA, 20 bp, Artificial
  CRISPR gRNA sequence
atctcctgagctcaagtgat

SEQ ID NO: 68924 - DNA, 20 bp, Artificial
  CRISPR gRNA sequence
ctgagctcaagtgatcctcc

SEQ ID NO: 68925 - DNA, 20 bp, Artificial
  CRISPR gRNA sequence
agctcaagtgatcctcccac

SEQ ID NO: 68926 - DNA, 20 bp, Artificial
  CRISPR gRNA sequence
aagtgatcctcccacctcag

SEQ ID NO: 68927 - DNA, 20 bp, Artificial
  CRISPR gRNA sequence
ccacctcagcctcccaaagt

SEQ ID NO: 68928 - DNA, 20 bp, Artificial
  CRISPR gRNA sequence
agcctcccaaagtgctaggc

SEQ ID NO: 68929 - DNA, 20 bp, Artificial
  CRISPR gRNA sequence
ccaaagtgctaggcgtgagc

SEQ ID NO: 68930 - DNA, 20 bp, Artificial
  CRISPR gRNA sequence
ggcgtgagccaccatgccca

SEQ ID NO: 68931 - DNA, 20 bp, Artificial
  CRISPR gRNA sequence
tcaattattttggttatata

SEQ ID NO: 68932 - DNA, 20 bp, Artificial
  CRISPR gRNA sequence
caattattttggttatatat

SEQ ID NO: 68933 - DNA, 20 bp, Artificial
  CRISPR gRNA sequence
aattattttggttatatatc

SEQ ID NO: 68934 - DNA, 20 bp, Artificial
  CRISPR gRNA sequence
ttttggttatatatccagaa

SEQ ID NO: 68935 - DNA, 20 bp, Artificial
  CRISPR gRNA sequence
tggttatatatccagaattg

SEQ ID NO: 68936 - DNA, 20 bp, Artificial
  CRISPR gRNA sequence
ggttatatatccagaattgc

SEQ ID NO: 68937 - DNA, 20 bp, Artificial
  CRISPR gRNA sequence
gttatatatccagaattgct

SEQ ID NO: 68938 - DNA, 20 bp, Artificial
  CRISPR gRNA sequence
tatatccagaattgctagag

SEQ ID NO: 68939 - DNA, 20 bp, Artificial
  CRISPR gRNA sequence
ctagagcacccaaaataact

SEQ ID NO: 68940 - DNA, 20 bp, Artificial
  CRISPR gRNA sequence
gagcacccaaaataactttt

SEQ ID NO: 68941 - DNA, 20 bp, Artificial
  CRISPR gRNA sequence
tttttttttgagacggagtc

SEQ ID NO: 68942 - DNA, 20 bp, Artificial
  CRISPR gRNA sequence
ttttttttgagacggagtct

SEQ ID NO: 68943 - DNA, 20 bp, Artificial
  CRISPR gRNA sequence
tttttttgagacggagtctc

SEQ ID NO: 68944 - DNA, 20 bp, Artificial
  CRISPR gRNA sequence
ttttttgagacggagtctcg

SEQ ID NO: 68945 - DNA, 20 bp, Artificial
  CRISPR gRNA sequence
tttttgagacggagtctcgc

SEQ ID NO: 68946 - DNA, 20 bp, Artificial
  CRISPR gRNA sequence
ttttgagacggagtctcgct

SEQ ID NO: 68947 - DNA, 20 bp, Artificial
  CRISPR gRNA sequence
tttgagacggagtctcgctc

SEQ ID NO: 68948 - DNA, 20 bp, Artificial
  CRISPR gRNA sequence
ttgagacggagtctcgctct

SEQ ID NO: 68949 - DNA, 20 bp, Artificial
  CRISPR gRNA sequence
tgagacggagtctcgctctg

SEQ ID NO: 68950 - DNA, 20 bp, Artificial
  CRISPR gRNA sequence
gagacggagtctcgctctgt

SEQ ID NO: 68951 - DNA, 20 bp, Artificial
  CRISPR gRNA sequence
agacggagtctcgctctgtt

SEQ ID NO: 68952 - DNA, 20 bp, Artificial
  CRISPR gRNA sequence
gctctgttgcccaggttgga

SEQ ID NO: 68953 - DNA, 20 bp, Artificial
  CRISPR gRNA sequence
tgttgcccaggttggagtgc

SEQ ID NO: 68954 - DNA, 20 bp, Artificial
  CRISPR gRNA sequence
ttgcccaggttggagtgcag

SEQ ID NO: 68955 - DNA, 20 bp, Artificial
  CRISPR gRNA sequence
cccaggttggagtgcagtgg

SEQ ID NO: 68956 - DNA, 20 bp, Artificial
  CRISPR gRNA sequence
gagtgcagtggtgcgatctc

SEQ ID NO: 68957 - DNA, 20 bp, Artificial
  CRISPR gRNA sequence
ggctcactgcaagctccgcc

SEQ ID NO: 68958 - DNA, 20 bp, Artificial
  CRISPR gRNA sequence
actgcaagctccgcctcctg

SEQ ID NO: 68959 - DNA, 20 bp, Artificial
  CRISPR gRNA sequence
caagctccgcctcctgggtt

SEQ ID NO: 68960 - DNA, 20 bp, Artificial
  CRISPR gRNA sequence
cgcctcctgggttcacgcca

SEQ ID NO: 68961 - DNA, 20 bp, Artificial
  CRISPR gRNA sequence
ctgggttcacgccattctcc

SEQ ID NO: 68962 - DNA, 20 bp, Artificial
  CRISPR gRNA sequence
ggttcacgccattctcctgc

SEQ ID NO: 68963 - DNA, 20 bp, Artificial
  CRISPR gRNA sequence
acgccattctcctgcctcag

SEQ ID NO: 68964 - DNA, 20 bp, Artificial
  CRISPR gRNA sequence
tcctgcctcagcctccagag

SEQ ID NO: 68965 - DNA, 20 bp, Artificial
  CRISPR gRNA sequence
ctgcctcagcctccagagta

SEQ ID NO: 68966 - DNA, 20 bp, Artificial
  CRISPR gRNA sequence
cctcagcctccagagtagct

SEQ ID NO: 68967 - DNA, 20 bp, Artificial
  CRISPR gRNA sequence
agcctccagagtagctggga

SEQ ID NO: 68968 - DNA, 20 bp, Artificial
  CRISPR gRNA sequence
cagagtagctgggactacag

SEQ ID NO: 68969 - DNA, 20 bp, Artificial
  CRISPR gRNA sequence
ggactacaggtgcccgccac

SEQ ID NO: 68970 - DNA, 20 bp, Artificial
  CRISPR gRNA sequence
caggtgcccgccaccacgcc

SEQ ID NO: 68971 - DNA, 20 bp, Artificial
  CRISPR gRNA sequence
actaatgttttgtattttta

SEQ ID NO: 68972 - DNA, 20 bp, Artificial
  CRISPR gRNA sequence
atgttttgtatttttagtag

SEQ ID NO: 68973 - DNA, 20 bp, Artificial
  CRISPR gRNA sequence
tgtatttttagtagagacgg

SEQ ID NO: 68974 - DNA, 20 bp, Artificial
  CRISPR gRNA sequence
gtatttttagtagagacggg

SEQ ID NO: 68975 - DNA, 20 bp, Artificial
  CRISPR gRNA sequence
tatttttagtagagacgggg

SEQ ID NO: 68976 - DNA, 20 bp, Artificial
  CRISPR gRNA sequence
ttagtagagacggggtttca

SEQ ID NO: 68977 - DNA, 20 bp, Artificial
  CRISPR gRNA sequence
tagtagagacggggtttcac

SEQ ID NO: 68978 - DNA, 20 bp, Artificial
  CRISPR gRNA sequence
agtagagacggggtttcacc

SEQ ID NO: 68979 - DNA, 20 bp, Artificial
  CRISPR gRNA sequence
gtagagacggggtttcacca

SEQ ID NO: 68980 - DNA, 20 bp, Artificial
  CRISPR gRNA sequence
caccatgttagccaggatgg

SEQ ID NO: 68981 - DNA, 20 bp, Artificial
  CRISPR gRNA sequence
accatgttagccaggatggt

SEQ ID NO: 68982 - DNA, 20 bp, Artificial
  CRISPR gRNA sequence
gccaggatggtctcgatctc

SEQ ID NO: 68983 - DNA, 20 bp, Artificial
  CRISPR gRNA sequence
gatctcctgacctcgtgatc

SEQ ID NO: 68984 - DNA, 20 bp, Artificial
  CRISPR gRNA sequence
ctgacctcgtgatcccccca

SEQ ID NO: 68985 - DNA, 20 bp, Artificial
  CRISPR gRNA sequence
acctcgtgatccccccacct

SEQ ID NO: 68986 - DNA, 20 bp, Artificial
  CRISPR gRNA sequence
gtgatccccccacctcagcc

SEQ ID NO: 68987 - DNA, 20 bp, Artificial
  CRISPR gRNA sequence
agcctcccaaagtgctggga

SEQ ID NO: 68988 - DNA, 20 bp, Artificial
  CRISPR gRNA sequence
ccaaagtgctgggattacag

SEQ ID NO: 68989 - DNA, 20 bp, Artificial
  CRISPR gRNA sequence
ggattacaggtgtgagccac

SEQ ID NO: 68990 - DNA, 20 bp, Artificial
  CRISPR gRNA sequence
caggtgtgagccactgcacc

SEQ ID NO: 68991 - DNA, 20 bp, Artificial
  CRISPR gRNA sequence
cacccagccaaaataacatt

SEQ ID NO: 68992 - DNA, 20 bp, Artificial
  CRISPR gRNA sequence
tcaaataaaacttttcttag

SEQ ID NO: 68993 - DNA, 20 bp, Artificial
  CRISPR gRNA sequence
caaataaaacttttcttagt

SEQ ID NO: 68994 - DNA, 20 bp, Artificial
  CRISPR gRNA sequence
aaataaaacttttcttagtc

SEQ ID NO: 68995 - DNA, 20 bp, Artificial
  CRISPR gRNA sequence
ttcttagtctaaaaataata

SEQ ID NO: 68996 - DNA, 20 bp, Artificial
  CRISPR gRNA sequence
tcttagtctaaaaataatat

SEQ ID NO: 68997 - DNA, 20 bp, Artificial
  CRISPR gRNA sequence
cttagtctaaaaataatatt

SEQ ID NO: 68998 - DNA, 20 bp, Artificial
  CRISPR gRNA sequence
ttagtctaaaaataatattg

SEQ ID NO: 68999 - DNA, 20 bp, Artificial
  CRISPR gRNA sequence
agtctaaaaataatattggt

SEQ ID NO: 69000 - DNA, 20 bp, Artificial
  CRISPR gRNA sequence
gtctaaaaataatattggtt

SEQ ID NO: 69001 - DNA, 20 bp, Artificial
  CRISPR gRNA sequence
aaaataatattggttggggg

SEQ ID NO: 69002 - DNA, 20 bp, Artificial
  CRISPR gRNA sequence
gttgggggaagtggcacacg

SEQ ID NO: 69003 - DNA, 20 bp, Artificial
  CRISPR gRNA sequence
ggggaagtggcacacgcctg

SEQ ID NO: 69004 - DNA, 20 bp, Artificial
  CRISPR gRNA sequence
taatcccaacactttgggag

SEQ ID NO: 69005 - DNA, 20 bp, Artificial
  CRISPR gRNA sequence
tgggaggctgaggtgggcag

SEQ ID NO: 69006 - DNA, 20 bp, Artificial
  CRISPR gRNA sequence
gggaggctgaggtgggcaga

SEQ ID NO: 69007 - DNA, 20 bp, Artificial
  CRISPR gRNA sequence
ggaggctgaggtgggcagat

SEQ ID NO: 69008 - DNA, 20 bp, Artificial
  CRISPR gRNA sequence
aggtgggcagattgtttgag

SEQ ID NO: 69009 - DNA, 20 bp, Artificial
  CRISPR gRNA sequence
tttgagctcaggcgttcaag

SEQ ID NO: 69010 - DNA, 20 bp, Artificial
  CRISPR gRNA sequence
gagctcaggcgttcaagacc

SEQ ID NO: 69011 - DNA, 20 bp, Artificial
  CRISPR gRNA sequence
agctcaggcgttcaagacca

SEQ ID NO: 69012 - DNA, 20 bp, Artificial
  CRISPR gRNA sequence
aggcgttcaagaccagcctg

SEQ ID NO: 69013 - DNA, 20 bp, Artificial
  CRISPR gRNA sequence
aagaccagcctggacaacat

SEQ ID NO: 69014 - DNA, 20 bp, Artificial
  CRISPR gRNA sequence
gacaacatggcaaaacccca

SEQ ID NO: 69015 - DNA, 20 bp, Artificial
  CRISPR gRNA sequence
caaaaaataaaaataaaaaa

SEQ ID NO: 69016 - DNA, 20 bp, Artificial
  CRISPR gRNA sequence
aatcattgttgaaatgtgca

SEQ ID NO: 69017 - DNA, 20 bp, Artificial
  CRISPR gRNA sequence
atcattgttgaaatgtgcag

SEQ ID NO: 69018 - DNA, 20 bp, Artificial
  CRISPR gRNA sequence
ttgaaatgtgcagaaaatcc

SEQ ID NO: 69019 - DNA, 20 bp, Artificial
  CRISPR gRNA sequence
aaatgtgcagaaaatccaga

SEQ ID NO: 69020 - DNA, 20 bp, Artificial
  CRISPR gRNA sequence
taaaaattcagcataacttt

SEQ ID NO: 69021 - DNA, 20 bp, Artificial
  CRISPR gRNA sequence
aaaaattcagcataacttta

SEQ ID NO: 69022 - DNA, 20 bp, Artificial
  CRISPR gRNA sequence
aaaattcagcataactttaa

SEQ ID NO: 69023 - DNA, 20 bp, Artificial
  CRISPR gRNA sequence
agcataactttaaagcagta

SEQ ID NO: 69024 - DNA, 20 bp, Artificial
  CRISPR gRNA sequence
taaagcagtaatatttgact

SEQ ID NO: 69025 - DNA, 20 bp, Artificial
  CRISPR gRNA sequence
aaagcagtaatatttgactt

SEQ ID NO: 69026 - DNA, 20 bp, Artificial
  CRISPR gRNA sequence
aagcagtaatatttgactta

SEQ ID NO: 69027 - DNA, 20 bp, Artificial
  CRISPR gRNA sequence
gacttaattctcttttttcc

SEQ ID NO: 69028 - DNA, 20 bp, Artificial
  CRISPR gRNA sequence
acttaattctcttttttcct

SEQ ID NO: 69029 - DNA, 20 bp, Artificial
  CRISPR gRNA sequence
aattctcttttttcctactt

SEQ ID NO: 69030 - DNA, 20 bp, Artificial
  CRISPR gRNA sequence
attctcttttttcctacttt

SEQ ID NO: 69031 - DNA, 20 bp, Artificial
  CRISPR gRNA sequence
tcttttttcctactttcaaa

SEQ ID NO: 69032 - DNA, 20 bp, Artificial
  CRISPR gRNA sequence
ttttttcctactttcaaatt

SEQ ID NO: 69033 - DNA, 20 bp, Artificial
  CRISPR gRNA sequence
ttttcctactttcaaattaa

SEQ ID NO: 69034 - DNA, 20 bp, Artificial
  CRISPR gRNA sequence
tttcctactttcaaattaat

SEQ ID NO: 69035 - DNA, 20 bp, Artificial
  CRISPR gRNA sequence
ttcctactttcaaattaatg

SEQ ID NO: 69036 - DNA, 20 bp, Artificial
  CRISPR gRNA sequence
tcctactttcaaattaatgc

SEQ ID NO: 69037 - DNA, 20 bp, Artificial
  CRISPR gRNA sequence
cctactttcaaattaatgca

SEQ ID NO: 69038 - DNA, 20 bp, Artificial
  CRISPR gRNA sequence
ctactttcaaattaatgcac

SEQ ID NO: 69039 - DNA, 20 bp, Artificial
  CRISPR gRNA sequence
ctttcaaattaatgcacatg

SEQ ID NO: 69040 - DNA, 20 bp, Artificial
  CRISPR gRNA sequence
tcaaattaatgcacatgcat

SEQ ID NO: 69041 - DNA, 20 bp, Artificial
  CRISPR gRNA sequence
caaattaatgcacatgcatt

SEQ ID NO: 69042 - DNA, 20 bp, Artificial
  CRISPR gRNA sequence
aaattaatgcacatgcattg

SEQ ID NO: 69043 - DNA, 20 bp, Artificial
  CRISPR gRNA sequence
atgcacatgcattgtagaaa

SEQ ID NO: 69044 - DNA, 20 bp, Artificial
  CRISPR gRNA sequence
tagaaagtttagaaaatata

SEQ ID NO: 69045 - DNA, 20 bp, Artificial
  CRISPR gRNA sequence
agaaaatatagaaaattaaa

SEQ ID NO: 69046 - DNA, 20 bp, Artificial
  CRISPR gRNA sequence
gaaaatatagaaaattaaag

SEQ ID NO: 69047 - DNA, 20 bp, Artificial
  CRISPR gRNA sequence
aagaagacataaaataaaaa

SEQ ID NO: 69048 - DNA, 20 bp, Artificial
  CRISPR gRNA sequence
atgagaattctatcatctta

SEQ ID NO: 69049 - DNA, 20 bp, Artificial
  CRISPR gRNA sequence
tatcatcttaaacaaccacc

SEQ ID NO: 69050 - DNA, 20 bp, Artificial
  CRISPR gRNA sequence
tcatcttaaacaaccaccat

SEQ ID NO: 69051 - DNA, 20 bp, Artificial
  CRISPR gRNA sequence
aaacaaccaccatgaacatt

SEQ ID NO: 69052 - DNA, 20 bp, Artificial
  CRISPR gRNA sequence
aacaaccaccatgaacattt

SEQ ID NO: 69053 - DNA, 20 bp, Artificial
  CRISPR gRNA sequence
aatatattttcctatgtttt

SEQ ID NO: 69054 - DNA, 20 bp, Artificial
  CRISPR gRNA sequence
atatattttcctatgttttc

SEQ ID NO: 69055 - DNA, 20 bp, Artificial
  CRISPR gRNA sequence
tcctatgttttccacacatc

SEQ ID NO: 69056 - DNA, 20 bp, Artificial
  CRISPR gRNA sequence
cctatgttttccacacatct

SEQ ID NO: 69057 - DNA, 20 bp, Artificial
  CRISPR gRNA sequence
ctatgttttccacacatctc

SEQ ID NO: 69058 - DNA, 20 bp, Artificial
  CRISPR gRNA sequence
tgttttccacacatctctct

SEQ ID NO: 69059 - DNA, 20 bp, Artificial
  CRISPR gRNA sequence
tccacacatctctctccctg

SEQ ID NO: 69060 - DNA, 20 bp, Artificial
  CRISPR gRNA sequence
ccacacatctctctccctgt

SEQ ID NO: 69061 - DNA, 20 bp, Artificial
  CRISPR gRNA sequence
cacacatctctctccctgtt

SEQ ID NO: 69062 - DNA, 20 bp, Artificial
  CRISPR gRNA sequence
tctccctgtttctttccaca

SEQ ID NO: 69063 - DNA, 20 bp, Artificial
  CRISPR gRNA sequence
tccctgtttctttccacact

SEQ ID NO: 69064 - DNA, 20 bp, Artificial
  CRISPR gRNA sequence
cctgtttctttccacacttt

SEQ ID NO: 69065 - DNA, 20 bp, Artificial
  CRISPR gRNA sequence
tttctttccacacttttttt

SEQ ID NO: 69066 - DNA, 20 bp, Artificial
  CRISPR gRNA sequence
ctttccacactttttttctc

SEQ ID NO: 69067 - DNA, 20 bp, Artificial
  CRISPR gRNA sequence
tttccacactttttttctcc

SEQ ID NO: 69068 - DNA, 20 bp, Artificial
  CRISPR gRNA sequence
tccacactttttttctccaa

SEQ ID NO: 69069 - DNA, 20 bp, Artificial
  CRISPR gRNA sequence
ccacactttttttctccaaa

SEQ ID NO: 69070 - DNA, 20 bp, Artificial
  CRISPR gRNA sequence
cacactttttttctccaaat

SEQ ID NO: 69071 - DNA, 20 bp, Artificial
  CRISPR gRNA sequence
tttttctccaaatactttcc

SEQ ID NO: 69072 - DNA, 20 bp, Artificial
  CRISPR gRNA sequence
ttttctccaaatactttcct

SEQ ID NO: 69073 - DNA, 20 bp, Artificial
  CRISPR gRNA sequence
tttctccaaatactttcctt

SEQ ID NO: 69074 - DNA, 20 bp, Artificial
  CRISPR gRNA sequence
ttctccaaatactttccttt

SEQ ID NO: 69075 - DNA, 20 bp, Artificial
  CRISPR gRNA sequence
tctccaaatactttcctttt

SEQ ID NO: 69076 - DNA, 20 bp, Artificial
  CRISPR gRNA sequence
ctccaaatactttccttttt

SEQ ID NO: 69077 - DNA, 20 bp, Artificial
  CRISPR gRNA sequence
tccaaatactttcctttttt

SEQ ID NO: 69078 - DNA, 20 bp, Artificial
  CRISPR gRNA sequence
caaatactttcctttttttg

SEQ ID NO: 69079 - DNA, 20 bp, Artificial
  CRISPR gRNA sequence
tcctttttttgaaatgcaaa

SEQ ID NO: 69080 - DNA, 20 bp, Artificial
  CRISPR gRNA sequence
cctttttttgaaatgcaaaa

SEQ ID NO: 69081 - DNA, 20 bp, Artificial
  CRISPR gRNA sequence
ctttttttgaaatgcaaaat

SEQ ID NO: 69082 - DNA, 20 bp, Artificial
  CRISPR gRNA sequence
tttttgaaatgcaaaattgg

SEQ ID NO: 69083 - DNA, 20 bp, Artificial
  CRISPR gRNA sequence
ttttgaaatgcaaaattggg

SEQ ID NO: 69084 - DNA, 20 bp, Artificial
  CRISPR gRNA sequence
tttgaaatgcaaaattggga

SEQ ID NO: 69085 - DNA, 20 bp, Artificial
  CRISPR gRNA sequence
ttgaaatgcaaaattgggat

SEQ ID NO: 69086 - DNA, 20 bp, Artificial
  CRISPR gRNA sequence
tgaaatgcaaaattgggatc

SEQ ID NO: 69087 - DNA, 20 bp, Artificial
  CRISPR gRNA sequence
gaaatgcaaaattgggatca

SEQ ID NO: 69088 - DNA, 20 bp, Artificial
  CRISPR gRNA sequence
aaatgcaaaattgggatcat

SEQ ID NO: 69089 - DNA, 20 bp, Artificial
  CRISPR gRNA sequence
ggatcatgttttatatacag

SEQ ID NO: 69090 - DNA, 20 bp, Artificial
  CRISPR gRNA sequence
tatatacagtttggtttcct

SEQ ID NO: 69091 - DNA, 20 bp, Artificial
  CRISPR gRNA sequence
atatacagtttggtttcctt

SEQ ID NO: 69092 - DNA, 20 bp, Artificial
  CRISPR gRNA sequence
tatacagtttggtttcctta

SEQ ID NO: 69093 - DNA, 20 bp, Artificial
  CRISPR gRNA sequence
ggtttccttacctttgtgat

SEQ ID NO: 69094 - DNA, 20 bp, Artificial
  CRISPR gRNA sequence
gtttccttacctttgtgatg

SEQ ID NO: 69095 - DNA, 20 bp, Artificial
  CRISPR gRNA sequence
ccttacctttgtgatgtaac

SEQ ID NO: 69096 - DNA, 20 bp, Artificial
  CRISPR gRNA sequence
cttacctttgtgatgtaaca

SEQ ID NO: 69097 - DNA, 20 bp, Artificial
  CRISPR gRNA sequence
acctttgtgatgtaacatta

SEQ ID NO: 69098 - DNA, 20 bp, Artificial
  CRISPR gRNA sequence
cctttgtgatgtaacattat

SEQ ID NO: 69099 - DNA, 20 bp, Artificial
  CRISPR gRNA sequence
tgtgatgtaacattatgtga

SEQ ID NO: 69100 - DNA, 20 bp, Artificial
  CRISPR gRNA sequence
gtgatgtaacattatgtgaa

SEQ ID NO: 69101 - DNA, 20 bp, Artificial
  CRISPR gRNA sequence
tgatgtaacattatgtgaat

SEQ ID NO: 69102 - DNA, 20 bp, Artificial
  CRISPR gRNA sequence
tgtgaatcttttcttaaatc

SEQ ID NO: 69103 - DNA, 20 bp, Artificial
  CRISPR gRNA sequence
ttcttaaatctaaaaatatc

SEQ ID NO: 69104 - DNA, 20 bp, Artificial
  CRISPR gRNA sequence
tcttaaatctaaaaatatca

SEQ ID NO: 69105 - DNA, 20 bp, Artificial
  CRISPR gRNA sequence
cttaaatctaaaaatatcag

SEQ ID NO: 69106 - DNA, 20 bp, Artificial
  CRISPR gRNA sequence
ttaaatctaaaaatatcagt

SEQ ID NO: 69107 - DNA, 20 bp, Artificial
  CRISPR gRNA sequence
aaatctaaaaatatcagtgg

SEQ ID NO: 69108 - DNA, 20 bp, Artificial
  CRISPR gRNA sequence
aatctaaaaatatcagtggc

SEQ ID NO: 69109 - DNA, 20 bp, Artificial
  CRISPR gRNA sequence
aaaatatcagtggcccagtg

SEQ ID NO: 69110 - DNA, 20 bp, Artificial
  CRISPR gRNA sequence
acgcctgtaatcccagcact

SEQ ID NO: 69111 - DNA, 20 bp, Artificial
  CRISPR gRNA sequence
taatcccagcactttgggag

SEQ ID NO: 69112 - DNA, 20 bp, Artificial
  CRISPR gRNA sequence
tgggaggccgaggcaggtgg

SEQ ID NO: 69113 - DNA, 20 bp, Artificial
  CRISPR gRNA sequence
gggaggccgaggcaggtgga

SEQ ID NO: 69114 - DNA, 20 bp, Artificial
  CRISPR gRNA sequence
ggaggccgaggcaggtggat

SEQ ID NO: 69115 - DNA, 20 bp, Artificial
  CRISPR gRNA sequence
gaggtcaggagttcaagacc

SEQ ID NO: 69116 - DNA, 20 bp, Artificial
  CRISPR gRNA sequence
aggtcaggagttcaagacca

SEQ ID NO: 69117 - DNA, 20 bp, Artificial
  CRISPR gRNA sequence
aagaccagcctgaccaacat

SEQ ID NO: 69118 - DNA, 20 bp, Artificial
  CRISPR gRNA sequence
accaacatggtgaaacccca

SEQ ID NO: 69119 - DNA, 20 bp, Artificial
  CRISPR gRNA sequence
tactaaaaatacaaaaatta

SEQ ID NO: 69120 - DNA, 20 bp, Artificial
  CRISPR gRNA sequence
ctaaaaatacaaaaattagc

SEQ ID NO: 69121 - DNA, 20 bp, Artificial
  CRISPR gRNA sequence
aaaatacaaaaattagccag

SEQ ID NO: 69122 - DNA, 20 bp, Artificial
  CRISPR gRNA sequence
gccaggcgtggtggcgcatg

SEQ ID NO: 69123 - DNA, 20 bp, Artificial
  CRISPR gRNA sequence
taatcccagctacttgggag

SEQ ID NO: 69124 - DNA, 20 bp, Artificial
  CRISPR gRNA sequence
cttgggaggctgaggcagga

SEQ ID NO: 69125 - DNA, 20 bp, Artificial
  CRISPR gRNA sequence
gggaggctgaggcaggagaa

SEQ ID NO: 69126 - DNA, 20 bp, Artificial
  CRISPR gRNA sequence
ggaggctgaggcaggagaat

SEQ ID NO: 69127 - DNA, 20 bp, Artificial
  CRISPR gRNA sequence
aggcaggagaatcgcttgaa

SEQ ID NO: 69128 - DNA, 20 bp, Artificial
  CRISPR gRNA sequence
gaacccaggaggcagaggtt

SEQ ID NO: 69129 - DNA, 20 bp, Artificial
  CRISPR gRNA sequence
aacccaggaggcagaggttg

SEQ ID NO: 69130 - DNA, 20 bp, Artificial
  CRISPR gRNA sequence
cagtgatctgagatcatgcc

SEQ ID NO: 69131 - DNA, 20 bp, Artificial
  CRISPR gRNA sequence
agatcatgccattgcactcc

SEQ ID NO: 69132 - DNA, 20 bp, Artificial
  CRISPR gRNA sequence
cactccagtctgggcaacaa

SEQ ID NO: 69133 - DNA, 20 bp, Artificial
  CRISPR gRNA sequence
cagtctgggcaacaagagca

SEQ ID NO: 69134 - DNA, 20 bp, Artificial
  CRISPR gRNA sequence
ggcaacaagagcaaaactct

SEQ ID NO: 69135 - DNA, 20 bp, Artificial
  CRISPR gRNA sequence
tgtctcaaaaataaaataag

SEQ ID NO: 69136 - DNA, 20 bp, Artificial
  CRISPR gRNA sequence
tctcaaaaataaaataagat

SEQ ID NO: 69137 - DNA, 20 bp, Artificial
  CRISPR gRNA sequence
aaaaataaaataagataaga

SEQ ID NO: 69138 - DNA, 20 bp, Artificial
  CRISPR gRNA sequence
aaaaaataatattttctgtt

SEQ ID NO: 69139 - DNA, 20 bp, Artificial
  CRISPR gRNA sequence
aaaaataatattttctgttt

SEQ ID NO: 69140 - DNA, 20 bp, Artificial
  CRISPR gRNA sequence
tctgtttggattgtcacaac

SEQ ID NO: 69141 - DNA, 20 bp, Artificial
  CRISPR gRNA sequence
ctgtttggattgtcacaaca

SEQ ID NO: 69142 - DNA, 20 bp, Artificial
  CRISPR gRNA sequence
tgtttggattgtcacaacaa

SEQ ID NO: 69143 - DNA, 20 bp, Artificial
  CRISPR gRNA sequence
tttggattgtcacaacaata

SEQ ID NO: 69144 - DNA, 20 bp, Artificial
  CRISPR gRNA sequence
ggattgtcacaacaatagtt

SEQ ID NO: 69145 - DNA, 20 bp, Artificial
  CRISPR gRNA sequence
gattgtcacaacaatagttg

SEQ ID NO: 69146 - DNA, 20 bp, Artificial
  CRISPR gRNA sequence
tcacaacaatagttgttgga

SEQ ID NO: 69147 - DNA, 20 bp, Artificial
  CRISPR gRNA sequence
ttggaataagggtgatgtta

SEQ ID NO: 69148 - DNA, 20 bp, Artificial
  CRISPR gRNA sequence
gaataagggtgatgttaatt

SEQ ID NO: 69149 - DNA, 20 bp, Artificial
  CRISPR gRNA sequence
atttccttttttagattgat

SEQ ID NO: 69150 - DNA, 20 bp, Artificial
  CRISPR gRNA sequence
ccttttttagattgatgcct

SEQ ID NO: 69151 - DNA, 20 bp, Artificial
  CRISPR gRNA sequence
cttttttagattgatgccta

SEQ ID NO: 69152 - DNA, 20 bp, Artificial
  CRISPR gRNA sequence
ttttagattgatgcctactt

SEQ ID NO: 69153 - DNA, 20 bp, Artificial
  CRISPR gRNA sequence
tttagattgatgcctacttg

SEQ ID NO: 69154 - DNA, 20 bp, Artificial
  CRISPR gRNA sequence
ttagattgatgcctacttgt

SEQ ID NO: 69155 - DNA, 20 bp, Artificial
  CRISPR gRNA sequence
tagattgatgcctacttgta

SEQ ID NO: 69156 - DNA, 20 bp, Artificial
  CRISPR gRNA sequence
agattgatgcctacttgtat

SEQ ID NO: 69157 - DNA, 20 bp, Artificial
  CRISPR gRNA sequence
gattgatgcctacttgtata

SEQ ID NO: 69158 - DNA, 20 bp, Artificial
  CRISPR gRNA sequence
atgcctacttgtataatttt

SEQ ID NO: 69159 - DNA, 20 bp, Artificial
  CRISPR gRNA sequence
cttgtataattttatagttt

SEQ ID NO: 69160 - DNA, 20 bp, Artificial
  CRISPR gRNA sequence
gtataattttatagttttaa

SEQ ID NO: 69161 - DNA, 20 bp, Artificial
  CRISPR gRNA sequence
tataattttatagttttaaa

SEQ ID NO: 69162 - DNA, 20 bp, Artificial
  CRISPR gRNA sequence
tatagttttaaaatgagcaa

SEQ ID NO: 69163 - DNA, 20 bp, Artificial
  CRISPR gRNA sequence
atagttttaaaatgagcaaa

SEQ ID NO: 69164 - DNA, 20 bp, Artificial
  CRISPR gRNA sequence
tagttttaaaatgagcaaaa

SEQ ID NO: 69165 - DNA, 20 bp, Artificial
  CRISPR gRNA sequence
taaaatgagcaaaaaaaact

SEQ ID NO: 69166 - DNA, 20 bp, Artificial
  CRISPR gRNA sequence
aaaatgagcaaaaaaaactc

SEQ ID NO: 69167 - DNA, 20 bp, Artificial
  CRISPR gRNA sequence
aaatgagcaaaaaaaactca

SEQ ID NO: 69168 - DNA, 20 bp, Artificial
  CRISPR gRNA sequence
aaaaagcctctaggtccccc

SEQ ID NO: 69169 - DNA, 20 bp, Artificial
  CRISPR gRNA sequence
taggtcccccccttgacact

SEQ ID NO: 69170 - DNA, 20 bp, Artificial
  CRISPR gRNA sequence
ggtcccccccttgacactcc

SEQ ID NO: 69171 - DNA, 20 bp, Artificial
  CRISPR gRNA sequence
gacactcctcccccggcccc

SEQ ID NO: 69172 - DNA, 20 bp, Artificial
  CRISPR gRNA sequence
acactcctcccccggccccg

SEQ ID NO: 69173 - DNA, 20 bp, Artificial
  CRISPR gRNA sequence
ctcccccggccccgtcatgt

SEQ ID NO: 69174 - DNA, 20 bp, Artificial
  CRISPR gRNA sequence
ccccggccccgtcatgtgtg

SEQ ID NO: 69175 - DNA, 20 bp, Artificial
  CRISPR gRNA sequence
attgtctgctgctcaccttg

SEQ ID NO: 69176 - DNA, 20 bp, Artificial
  CRISPR gRNA sequence
tctgctgctcaccttggggg

SEQ ID NO: 69177 - DNA, 20 bp, Artificial
  CRISPR gRNA sequence
ctgctcaccttgggggggcc

SEQ ID NO: 69178 - DNA, 20 bp, Artificial
  CRISPR gRNA sequence
ctcaccttgggggggcctta

SEQ ID NO: 69179 - DNA, 20 bp, Artificial
  CRISPR gRNA sequence
accttgggggggccttatct

SEQ ID NO: 69180 - DNA, 20 bp, Artificial
  CRISPR gRNA sequence
gggggggccttatctgtgtc

SEQ ID NO: 69181 - DNA, 20 bp, Artificial
  CRISPR gRNA sequence
ggggggccttatctgtgtcc

SEQ ID NO: 69182 - DNA, 20 bp, Artificial
  CRISPR gRNA sequence
atctgtgtccccttctgtga

SEQ ID NO: 69183 - DNA, 20 bp, Artificial
  CRISPR gRNA sequence
tctgtgtccccttctgtgac

SEQ ID NO: 69184 - DNA, 20 bp, Artificial
  CRISPR gRNA sequence
tgtccccttctgtgacaggg

SEQ ID NO: 69185 - DNA, 20 bp, Artificial
  CRISPR gRNA sequence
ctgtgacagggtgcaggagc

SEQ ID NO: 69186 - DNA, 20 bp, Artificial
  CRISPR gRNA sequence
tgtgacagggtgcaggagcc

SEQ ID NO: 69187 - DNA, 20 bp, Artificial
  CRISPR gRNA sequence
tgacagggtgcaggagccgt

SEQ ID NO: 69188 - DNA, 20 bp, Artificial
  CRISPR gRNA sequence
tctccctgttagaagtctgc

SEQ ID NO: 69189 - DNA, 20 bp, Artificial
  CRISPR gRNA sequence
tccctgttagaagtctgcgc

SEQ ID NO: 69190 - DNA, 20 bp, Artificial
  CRISPR gRNA sequence
cctgttagaagtctgcgccc

SEQ ID NO: 69191 - DNA, 20 bp, Artificial
  CRISPR gRNA sequence
ttagaagtctgcgcccaggc

SEQ ID NO: 69192 - DNA, 20 bp, Artificial
  CRISPR gRNA sequence
gaagtctgcgcccaggcctc

SEQ ID NO: 69193 - DNA, 20 bp, Artificial
  CRISPR gRNA sequence
cgcccaggcctcaggcagtg

SEQ ID NO: 69194 - DNA, 20 bp, Artificial
  CRISPR gRNA sequence
aggcagtgtcactgaaatca

SEQ ID NO: 69195 - DNA, 20 bp, Artificial
  CRISPR gRNA sequence
aaatcaggtgagtccagaga

SEQ ID NO: 69196 - DNA, 20 bp, Artificial
  CRISPR gRNA sequence
tggaattcttcatctttcat

SEQ ID NO: 69197 - DNA, 20 bp, Artificial
  CRISPR gRNA sequence
ggaattcttcatctttcata

SEQ ID NO: 69198 - DNA, 20 bp, Artificial
  CRISPR gRNA sequence
gaattcttcatctttcataa

SEQ ID NO: 69199 - DNA, 20 bp, Artificial
  CRISPR gRNA sequence
ttcatctttcataagcattg

SEQ ID NO: 69200 - DNA, 20 bp, Artificial
  CRISPR gRNA sequence
catctttcataagcattggg

SEQ ID NO: 69201 - DNA, 20 bp, Artificial
  CRISPR gRNA sequence
atctttcataagcattggga

SEQ ID NO: 69202 - DNA, 20 bp, Artificial
  CRISPR gRNA sequence
tcataagcattgggactttt

SEQ ID NO: 69203 - DNA, 20 bp, Artificial
  CRISPR gRNA sequence
cataagcattgggacttttc

SEQ ID NO: 69204 - DNA, 20 bp, Artificial
  CRISPR gRNA sequence
ataagcattgggacttttcc

SEQ ID NO: 69205 - DNA, 20 bp, Artificial
  CRISPR gRNA sequence
ggacttttccttgaccttcc

SEQ ID NO: 69206 - DNA, 20 bp, Artificial
  CRISPR gRNA sequence
ttccttgaccttccctcatc

SEQ ID NO: 69207 - DNA, 20 bp, Artificial
  CRISPR gRNA sequence
tccttgaccttccctcatcc

SEQ ID NO: 69208 - DNA, 20 bp, Artificial
  CRISPR gRNA sequence
ccttgaccttccctcatcct

SEQ ID NO: 69209 - DNA, 20 bp, Artificial
  CRISPR gRNA sequence
cttgaccttccctcatcctg

SEQ ID NO: 69210 - DNA, 20 bp, Artificial
  CRISPR gRNA sequence
gaccttccctcatcctgtgg

SEQ ID NO: 69211 - DNA, 20 bp, Artificial
  CRISPR gRNA sequence
accttccctcatcctgtggg

SEQ ID NO: 69212 - DNA, 20 bp, Artificial
  CRISPR gRNA sequence
ccctcatcctgtggggtaat

SEQ ID NO: 69213 - DNA, 20 bp, Artificial
  CRISPR gRNA sequence
cctcatcctgtggggtaata

SEQ ID NO: 69214 - DNA, 20 bp, Artificial
  CRISPR gRNA sequence
atcctgtggggtaatagctg

SEQ ID NO: 69215 - DNA, 20 bp, Artificial
  CRISPR gRNA sequence
tggggtaatagctgtgtcac

SEQ ID NO: 69216 - DNA, 20 bp, Artificial
  CRISPR gRNA sequence
tgtcaccagctagttttcca

SEQ ID NO: 69217 - DNA, 20 bp, Artificial
  CRISPR gRNA sequence
gttttccatgtccccagggt

SEQ ID NO: 69218 - DNA, 20 bp, Artificial
  CRISPR gRNA sequence
tccatgtccccagggtagca

SEQ ID NO: 69219 - DNA, 20 bp, Artificial
  CRISPR gRNA sequence
ccatgtccccagggtagcag

SEQ ID NO: 69220 - DNA, 20 bp, Artificial
  CRISPR gRNA sequence
catgtccccagggtagcagg

SEQ ID NO: 69221 - DNA, 20 bp, Artificial
  CRISPR gRNA sequence
ctggggcatatgtgaggggc

SEQ ID NO: 69222 - DNA, 20 bp, Artificial
  CRISPR gRNA sequence
gggcatatgtgaggggctac

SEQ ID NO: 69223 - DNA, 20 bp, Artificial
  CRISPR gRNA sequence
cacatttgttgggactagtg

SEQ ID NO: 69224 - DNA, 20 bp, Artificial
  CRISPR gRNA sequence
gttgggactagtgcagtagt

SEQ ID NO: 69225 - DNA, 20 bp, Artificial
  CRISPR gRNA sequence
ttgggactagtgcagtagtc

SEQ ID NO: 69226 - DNA, 20 bp, Artificial
  CRISPR gRNA sequence
ggactagtgcagtagtcaag

SEQ ID NO: 69227 - DNA, 20 bp, Artificial
  CRISPR gRNA sequence
gtgcagtagtcaagccacag

SEQ ID NO: 69228 - DNA, 20 bp, Artificial
  CRISPR gRNA sequence
ttggatccaggcagacatgg

SEQ ID NO: 69229 - DNA, 20 bp, Artificial
  CRISPR gRNA sequence
gatccaggcagacatggctg

SEQ ID NO: 69230 - DNA, 20 bp, Artificial
  CRISPR gRNA sequence
ggagtccacgctggttgctt

SEQ ID NO: 69231 - DNA, 20 bp, Artificial
  CRISPR gRNA sequence
gttgcttggaagtggccccc

SEQ ID NO: 69232 - DNA, 20 bp, Artificial
  CRISPR gRNA sequence
cttggaagtggccccccaga

SEQ ID NO: 69233 - DNA, 20 bp, Artificial
  CRISPR gRNA sequence
ggaagtggccccccagatgc

SEQ ID NO: 69234 - DNA, 20 bp, Artificial
  CRISPR gRNA sequence
gaagtggccccccagatgca

SEQ ID NO: 69235 - DNA, 20 bp, Artificial
  CRISPR gRNA sequence
tggctcttcaaccagaaata

SEQ ID NO: 69236 - DNA, 20 bp, Artificial
  CRISPR gRNA sequence
ttcaaccagaaataacacaa

SEQ ID NO: 69237 - DNA, 20 bp, Artificial
  CRISPR gRNA sequence
caaccagaaataacacaatg

SEQ ID NO: 69238 - DNA, 20 bp, Artificial
  CRISPR gRNA sequence
aaccagaaataacacaatga

SEQ ID NO: 69239 - DNA, 20 bp, Artificial
  CRISPR gRNA sequence
atagcaaaggttttagcatc

SEQ ID NO: 69240 - DNA, 20 bp, Artificial
  CRISPR gRNA sequence
tagcaaaggttttagcatcc

SEQ ID NO: 69241 - DNA, 20 bp, Artificial
  CRISPR gRNA sequence
tagcatcccactcagctatg

SEQ ID NO: 69242 - DNA, 20 bp, Artificial
  CRISPR gRNA sequence
agcatcccactcagctatgt

SEQ ID NO: 69243 - DNA, 20 bp, Artificial
  CRISPR gRNA sequence
gcatcccactcagctatgtt

SEQ ID NO: 69244 - DNA, 20 bp, Artificial
  CRISPR gRNA sequence
agctatgttcagatcccaac

SEQ ID NO: 69245 - DNA, 20 bp, Artificial
  CRISPR gRNA sequence
tgttcagatcccaactcagt

SEQ ID NO: 69246 - DNA, 20 bp, Artificial
  CRISPR gRNA sequence
agatcccaactcagtcactt

SEQ ID NO: 69247 - DNA, 20 bp, Artificial
  CRISPR gRNA sequence
agtcacttactggttggagc

SEQ ID NO: 69248 - DNA, 20 bp, Artificial
  CRISPR gRNA sequence
actggttggagcccattact

SEQ ID NO: 69249 - DNA, 20 bp, Artificial
  CRISPR gRNA sequence
ctggttggagcccattactg

SEQ ID NO: 69250 - DNA, 20 bp, Artificial
  CRISPR gRNA sequence
gttggagcccattactgtgt

SEQ ID NO: 69251 - DNA, 20 bp, Artificial
  CRISPR gRNA sequence
gagcccattactgtgtctct

SEQ ID NO: 69252 - DNA, 20 bp, Artificial
  CRISPR gRNA sequence
ctgtgtctctctgacctcaa

SEQ ID NO: 69253 - DNA, 20 bp, Artificial
  CRISPR gRNA sequence
tgtctctctgacctcaacct

SEQ ID NO: 69254 - DNA, 20 bp, Artificial
  CRISPR gRNA sequence
tctgacctcaacctcctgct

SEQ ID NO: 69255 - DNA, 20 bp, Artificial
  CRISPR gRNA sequence
tgacctcaacctcctgctct

SEQ ID NO: 69256 - DNA, 20 bp, Artificial
  CRISPR gRNA sequence
acctcaacctcctgctctta

SEQ ID NO: 69257 - DNA, 20 bp, Artificial
  CRISPR gRNA sequence
aacctcctgctcttaaaaga

SEQ ID NO: 69258 - DNA, 20 bp, Artificial
  CRISPR gRNA sequence
ctgctcttaaaagagtctaa

SEQ ID NO: 69259 - DNA, 20 bp, Artificial
  CRISPR gRNA sequence
ctcttaaaagagtctaatta

SEQ ID NO: 69260 - DNA, 20 bp, Artificial
  CRISPR gRNA sequence
ttaaaagagtctaattacgg

SEQ ID NO: 69261 - DNA, 20 bp, Artificial
  CRISPR gRNA sequence
aaaagagtctaattacggcc

SEQ ID NO: 69262 - DNA, 20 bp, Artificial
  CRISPR gRNA sequence
aaagagtctaattacggccc

SEQ ID NO: 69263 - DNA, 20 bp, Artificial
  CRISPR gRNA sequence
attacggccctttgcagggc

SEQ ID NO: 69264 - DNA, 20 bp, Artificial
  CRISPR gRNA sequence
cggccctttgcagggctggg

SEQ ID NO: 69265 - DNA, 20 bp, Artificial
  CRISPR gRNA sequence
tgcagggctgggaggattac

SEQ ID NO: 69266 - DNA, 20 bp, Artificial
  CRISPR gRNA sequence
gcagggctgggaggattaca

SEQ ID NO: 69267 - DNA, 20 bp, Artificial
  CRISPR gRNA sequence
cagggctgggaggattacaa

SEQ ID NO: 69268 - DNA, 20 bp, Artificial
  CRISPR gRNA sequence
ggaggattacaagaactgga

SEQ ID NO: 69269 - DNA, 20 bp, Artificial
  CRISPR gRNA sequence
caagaactggagcctgtaaa

SEQ ID NO: 69270 - DNA, 20 bp, Artificial
  CRISPR gRNA sequence
gagcctgtaaagatgtctgc

SEQ ID NO: 69271 - DNA, 20 bp, Artificial
  CRISPR gRNA sequence
taaagatgtctgctgtactg

SEQ ID NO: 69272 - DNA, 20 bp, Artificial
  CRISPR gRNA sequence
ctgtactgtcaccagccaca

SEQ ID NO: 69273 - DNA, 20 bp, Artificial
  CRISPR gRNA sequence
tactgtcaccagccacacag

SEQ ID NO: 69274 - DNA, 20 bp, Artificial
  CRISPR gRNA sequence
tcaccagccacacagcctgc

SEQ ID NO: 69275 - DNA, 20 bp, Artificial
  CRISPR gRNA sequence
ccctgcttcttccttctctc

SEQ ID NO: 69276 - DNA, 20 bp, Artificial
  CRISPR gRNA sequence
cttcttccttctctcctcca

SEQ ID NO: 69277 - DNA, 20 bp, Artificial
  CRISPR gRNA sequence
cttccttctctcctccagga

SEQ ID NO: 69278 - DNA, 20 bp, Artificial
  CRISPR gRNA sequence
ttccttctctcctccaggag

SEQ ID NO: 69279 - DNA, 20 bp, Artificial
  CRISPR gRNA sequence
ccttctctcctccaggagtg

SEQ ID NO: 69280 - DNA, 20 bp, Artificial
  CRISPR gRNA sequence
cttctctcctccaggagtga

SEQ ID NO: 69281 - DNA, 20 bp, Artificial
  CRISPR gRNA sequence
ctctcctccaggagtgagca

SEQ ID NO: 69282 - DNA, 20 bp, Artificial
  CRISPR gRNA sequence
tctcctccaggagtgagcaa

SEQ ID NO: 69283 - DNA, 20 bp, Artificial
  CRISPR gRNA sequence
tcctccaggagtgagcaagg

SEQ ID NO: 69284 - DNA, 20 bp, Artificial
  CRISPR gRNA sequence
ctccaggagtgagcaagggg

SEQ ID NO: 69285 - DNA, 20 bp, Artificial
  CRISPR gRNA sequence
caggagtgagcaaggggatg

SEQ ID NO: 69286 - DNA, 20 bp, Artificial
  CRISPR gRNA sequence
tggggactttataatctccc

SEQ ID NO: 69287 - DNA, 20 bp, Artificial
  CRISPR gRNA sequence
gggactttataatctcccat

SEQ ID NO: 69288 - DNA, 20 bp, Artificial
  CRISPR gRNA sequence
tataatctcccatagccctc

SEQ ID NO: 69289 - DNA, 20 bp, Artificial
  CRISPR gRNA sequence
ataatctcccatagccctct

SEQ ID NO: 69290 - DNA, 20 bp, Artificial
  CRISPR gRNA sequence
taatctcccatagccctctc

SEQ ID NO: 69291 - DNA, 20 bp, Artificial
  CRISPR gRNA sequence
ccatagccctctccccataa

SEQ ID NO: 69292 - DNA, 20 bp, Artificial
  CRISPR gRNA sequence
tccccataagcaccccatga

SEQ ID NO: 69293 - DNA, 20 bp, Artificial
  CRISPR gRNA sequence
cccataagcaccccatgaac

SEQ ID NO: 69294 - DNA, 20 bp, Artificial
  CRISPR gRNA sequence
aagtgaaggcagtgagctta

SEQ ID NO: 69295 - DNA, 20 bp, Artificial
  CRISPR gRNA sequence
agagcgcaaatgcagactcc

SEQ ID NO: 69296 - DNA, 20 bp, Artificial
  CRISPR gRNA sequence
gagcgcaaatgcagactcca

SEQ ID NO: 69297 - DNA, 20 bp, Artificial
  CRISPR gRNA sequence
cagacacatcccctacccca

SEQ ID NO: 69298 - DNA, 20 bp, Artificial
  CRISPR gRNA sequence
ccccacccttccaccacact

SEQ ID NO: 69299 - DNA, 20 bp, Artificial
  CRISPR gRNA sequence
ccaccacactgtggtccttg

SEQ ID NO: 69300 - DNA, 20 bp, Artificial
  CRISPR gRNA sequence
caccacactgtggtccttgt

SEQ ID NO: 69301 - DNA, 20 bp, Artificial
  CRISPR gRNA sequence
tggtccttgtgcccctccct

SEQ ID NO: 69302 - DNA, 20 bp, Artificial
  CRISPR gRNA sequence
gtgcccctccctcagaaaat

SEQ ID NO: 69303 - DNA, 20 bp, Artificial
  CRISPR gRNA sequence
tgcccctccctcagaaaatt

SEQ ID NO: 69304 - DNA, 20 bp, Artificial
  CRISPR gRNA sequence
cctcagaaaattctggaact

SEQ ID NO: 69305 - DNA, 20 bp, Artificial
  CRISPR gRNA sequence
agaaaattctggaactgccc

SEQ ID NO: 69306 - DNA, 20 bp, Artificial
  CRISPR gRNA sequence
tggaactgcccttggatccc

SEQ ID NO: 69307 - DNA, 20 bp, Artificial
  CRISPR gRNA sequence
gaactgcccttggatccctc

SEQ ID NO: 69308 - DNA, 20 bp, Artificial
  CRISPR gRNA sequence
cccttggatccctctaatgg

SEQ ID NO: 69309 - DNA, 20 bp, Artificial
  CRISPR gRNA sequence
ggatccctctaatggctttc

SEQ ID NO: 69310 - DNA, 20 bp, Artificial
  CRISPR gRNA sequence
gatccctctaatggctttct

SEQ ID NO: 69311 - DNA, 20 bp, Artificial
  CRISPR gRNA sequence
taatggctttctgtcatggt

SEQ ID NO: 69312 - DNA, 20 bp, Artificial
  CRISPR gRNA sequence
atggctttctgtcatggtct

SEQ ID NO: 69313 - DNA, 20 bp, Artificial
  CRISPR gRNA sequence
tctgtcatggtctgaaaagg

SEQ ID NO: 69314 - DNA, 20 bp, Artificial
  CRISPR gRNA sequence
ctgtcatggtctgaaaaggc

SEQ ID NO: 69315 - DNA, 20 bp, Artificial
  CRISPR gRNA sequence
tgtcatggtctgaaaaggct

SEQ ID NO: 69316 - DNA, 20 bp, Artificial
  CRISPR gRNA sequence
tcatggtctgaaaaggctta

SEQ ID NO: 69317 - DNA, 20 bp, Artificial
  CRISPR gRNA sequence
aaaaggcttatcaacttatt

SEQ ID NO: 69318 - DNA, 20 bp, Artificial
  CRISPR gRNA sequence
atcaacttattaactttaaa

SEQ ID NO: 69319 - DNA, 20 bp, Artificial
  CRISPR gRNA sequence
tcaacttattaactttaaat

SEQ ID NO: 69320 - DNA, 20 bp, Artificial
  CRISPR gRNA sequence
attaactttaaattgttgaa

SEQ ID NO: 69321 - DNA, 20 bp, Artificial
  CRISPR gRNA sequence
ttaactttaaattgttgaaa

SEQ ID NO: 69322 - DNA, 20 bp, Artificial
  CRISPR gRNA sequence
actttaaattgttgaaaagg

SEQ ID NO: 69323 - DNA, 20 bp, Artificial
  CRISPR gRNA sequence
taaattgttgaaaagggcca

SEQ ID NO: 69324 - DNA, 20 bp, Artificial
  CRISPR gRNA sequence
aaattgttgaaaagggccag

SEQ ID NO: 69325 - DNA, 20 bp, Artificial
  CRISPR gRNA sequence
aattgttgaaaagggccagg

SEQ ID NO: 69326 - DNA, 20 bp, Artificial
  CRISPR gRNA sequence
ttgaaaagggccaggcgcgg

SEQ ID NO: 69327 - DNA, 20 bp, Artificial
  CRISPR gRNA sequence
aaaagggccaggcgcggtgg

SEQ ID NO: 69328 - DNA, 20 bp, Artificial
  CRISPR gRNA sequence
acgcctgtaaccccagcact

SEQ ID NO: 69329 - DNA, 20 bp, Artificial
  CRISPR gRNA sequence
taaccccagcactttgggag

SEQ ID NO: 69330 - DNA, 20 bp, Artificial
  CRISPR gRNA sequence
tgggaggccgaggcaggagg

SEQ ID NO: 69331 - DNA, 20 bp, Artificial
  CRISPR gRNA sequence
gggaggccgaggcaggagga

SEQ ID NO: 69332 - DNA, 20 bp, Artificial
  CRISPR gRNA sequence
ggaggccgaggcaggaggat

SEQ ID NO: 69333 - DNA, 20 bp, Artificial
  CRISPR gRNA sequence
aagcccagagttcaaggctg

SEQ ID NO: 69334 - DNA, 20 bp, Artificial
  CRISPR gRNA sequence
aaggctgcagtgagctatga

SEQ ID NO: 69335 - DNA, 20 bp, Artificial
  CRISPR gRNA sequence
cagtgagctatgatcgtgcc

SEQ ID NO: 69336 - DNA, 20 bp, Artificial
  CRISPR gRNA sequence
tgatcgtgcccaccactgca

SEQ ID NO: 69337 - DNA, 20 bp, Artificial
  CRISPR gRNA sequence
cacttcagcctgggctacag

SEQ ID NO: 69338 - DNA, 20 bp, Artificial
  CRISPR gRNA sequence
cagcctgggctacagagcaa

SEQ ID NO: 69339 - DNA, 20 bp, Artificial
  CRISPR gRNA sequence
agcctgggctacagagcaag

SEQ ID NO: 69340 - DNA, 20 bp, Artificial
  CRISPR gRNA sequence
ggctacagagcaagaccctg

SEQ ID NO: 69341 - DNA, 20 bp, Artificial
  CRISPR gRNA sequence
cagagcaagaccctgtctct

SEQ ID NO: 69342 - DNA, 20 bp, Artificial
  CRISPR gRNA sequence
tctctttaaaaaaaaaaaaa

SEQ ID NO: 69343 - DNA, 20 bp, Artificial
  CRISPR gRNA sequence
tttaaaaaaaaaaaaaaaga

SEQ ID NO: 69344 - DNA, 20 bp, Artificial
  CRISPR gRNA sequence
taaaaaaaaaaaaaaagaaa

SEQ ID NO: 69345 - DNA, 20 bp, Artificial
  CRISPR gRNA sequence
aaaaaaaaaaaaaaagaaag

SEQ ID NO: 69346 - DNA, 20 bp, Artificial
  CRISPR gRNA sequence
aaaaaaaaaaaaaagaaaga

SEQ ID NO: 69347 - DNA, 20 bp, Artificial
  CRISPR gRNA sequence
ttgaaaaggcactacttggg

SEQ ID NO: 69348 - DNA, 20 bp, Artificial
  CRISPR gRNA sequence
aaaaggcactacttggggta

SEQ ID NO: 69349 - DNA, 20 bp, Artificial
  CRISPR gRNA sequence
cttggggtattgtgtgtgac

SEQ ID NO: 69350 - DNA, 20 bp, Artificial
  CRISPR gRNA sequence
ggggtattgtgtgtgactca

SEQ ID NO: 69351 - DNA, 20 bp, Artificial
  CRISPR gRNA sequence
gggtattgtgtgtgactcac

SEQ ID NO: 69352 - DNA, 20 bp, Artificial
  CRISPR gRNA sequence
tgtgtgactcacggaagcac

SEQ ID NO: 69353 - DNA, 20 bp, Artificial
  CRISPR gRNA sequence
acggaagcacctactttcca

SEQ ID NO: 69354 - DNA, 20 bp, Artificial
  CRISPR gRNA sequence
ctttccagtcctaagctggt

SEQ ID NO: 69355 - DNA, 20 bp, Artificial
  CRISPR gRNA sequence
tccagtcctaagctggtccc

SEQ ID NO: 69356 - DNA, 20 bp, Artificial
  CRISPR gRNA sequence
ccagtcctaagctggtccct

SEQ ID NO: 69357 - DNA, 20 bp, Artificial
  CRISPR gRNA sequence
cagtcctaagctggtccctg

SEQ ID NO: 69358 - DNA, 20 bp, Artificial
  CRISPR gRNA sequence
agctggtccctggcagggga

SEQ ID NO: 69359 - DNA, 20 bp, Artificial
  CRISPR gRNA sequence
gtccctggcaggggagaagg

SEQ ID NO: 69360 - DNA, 20 bp, Artificial
  CRISPR gRNA sequence
gcaggggagaaggggaccca

SEQ ID NO: 69361 - DNA, 20 bp, Artificial
  CRISPR gRNA sequence
agagttggagccgggcagcc

SEQ ID NO: 69362 - DNA, 20 bp, Artificial
  CRISPR gRNA sequence
gagccgggcagcccaggtgc

SEQ ID NO: 69363 - DNA, 20 bp, Artificial
  CRISPR gRNA sequence
ggccctccggggaaggctgc

SEQ ID NO: 69364 - DNA, 20 bp, Artificial
  CRISPR gRNA sequence
cggggaaggctgcccgacct

SEQ ID NO: 69365 - DNA, 20 bp, Artificial
  CRISPR gRNA sequence
cccgacctcacgttggttac

SEQ ID NO: 69366 - DNA, 20 bp, Artificial
  CRISPR gRNA sequence
acgttggttactgctcactc

SEQ ID NO: 69367 - DNA, 20 bp, Artificial
  CRISPR gRNA sequence
gttactgctcactcctcagc

SEQ ID NO: 69368 - DNA, 20 bp, Artificial
  CRISPR gRNA sequence
ctgctcactcctcagcatct

SEQ ID NO: 69369 - DNA, 20 bp, Artificial
  CRISPR gRNA sequence
ctcactcctcagcatctccg

SEQ ID NO: 69370 - DNA, 20 bp, Artificial
  CRISPR gRNA sequence
actcctcagcatctccgaga

SEQ ID NO: 69371 - DNA, 20 bp, Artificial
  CRISPR gRNA sequence
ctcagcatctccgagaccca

SEQ ID NO: 69372 - DNA, 20 bp, Artificial
  CRISPR gRNA sequence
agcatctccgagacccagca

SEQ ID NO: 69373 - DNA, 20 bp, Artificial
  CRISPR gRNA sequence
cgagacccagcagcagctct

SEQ ID NO: 69374 - DNA, 20 bp, Artificial
  CRISPR gRNA sequence
tgtgtccagctggaatttcc

SEQ ID NO: 69375 - DNA, 20 bp, Artificial
  CRISPR gRNA sequence
tgtccagctggaatttcctc

SEQ ID NO: 69376 - DNA, 20 bp, Artificial
  CRISPR gRNA sequence
gaatttcctcgccaggaaga

SEQ ID NO: 69377 - DNA, 20 bp, Artificial
  CRISPR gRNA sequence
cctcgccaggaagagaatcc

SEQ ID NO: 69378 - DNA, 20 bp, Artificial
  CRISPR gRNA sequence
ctcgccaggaagagaatcca

SEQ ID NO: 69379 - DNA, 20 bp, Artificial
  CRISPR gRNA sequence
gccaggaagagaatccagaa

SEQ ID NO: 69380 - DNA, 20 bp, Artificial
  CRISPR gRNA sequence
tggcactcaggtgggaccca

SEQ ID NO: 69381 - DNA, 20 bp, Artificial
  CRISPR gRNA sequence
aggtgggacccagcaccagg

SEQ ID NO: 69382 - DNA, 20 bp, Artificial
  CRISPR gRNA sequence
gtgttggggagggggcaggg

SEQ ID NO: 69383 - DNA, 20 bp, Artificial
  CRISPR gRNA sequence
gggagggggcagggctgctt

SEQ ID NO: 69384 - DNA, 20 bp, Artificial
  CRISPR gRNA sequence
cttctgaccaatattcacca

SEQ ID NO: 69385 - DNA, 20 bp, Artificial
  CRISPR gRNA sequence
ctgaccaatattcaccaccc

SEQ ID NO: 69386 - DNA, 20 bp, Artificial
  CRISPR gRNA sequence
tgaccaatattcaccaccct

SEQ ID NO: 69387 - DNA, 20 bp, Artificial
  CRISPR gRNA sequence
accaatattcaccaccctgc

SEQ ID NO: 69388 - DNA, 20 bp, Artificial
  CRISPR gRNA sequence
accaccctgcccagagacct

SEQ ID NO: 69389 - DNA, 20 bp, Artificial
  CRISPR gRNA sequence
cccagagaccttaggggttc

SEQ ID NO: 69390 - DNA, 20 bp, Artificial
  CRISPR gRNA sequence
aggggttcgaagtctttaca

SEQ ID NO: 69391 - DNA, 20 bp, Artificial
  CRISPR gRNA sequence
ggggttcgaagtctttacac

SEQ ID NO: 69392 - DNA, 20 bp, Artificial
  CRISPR gRNA sequence
gaagtctttacacaggctac

SEQ ID NO: 69393 - DNA, 20 bp, Artificial
  CRISPR gRNA sequence
tacacaggctacagaggtct

SEQ ID NO: 69394 - DNA, 20 bp, Artificial
  CRISPR gRNA sequence
acacaggctacagaggtctg

SEQ ID NO: 69395 - DNA, 20 bp, Artificial
  CRISPR gRNA sequence
cacaggctacagaggtctga

SEQ ID NO: 69396 - DNA, 20 bp, Artificial
  CRISPR gRNA sequence
cagaggtctgaccaacccac

SEQ ID NO: 69397 - DNA, 20 bp, Artificial
  CRISPR gRNA sequence
accaacccacttctgaggcg

SEQ ID NO: 69398 - DNA, 20 bp, Artificial
  CRISPR gRNA sequence
ctgaggcgtttcagccccac

SEQ ID NO: 69399 - DNA, 20 bp, Artificial
  CRISPR gRNA sequence
tgaggcgtttcagccccact

SEQ ID NO: 69400 - DNA, 20 bp, Artificial
  CRISPR gRNA sequence
aggcgtttcagccccactcc

SEQ ID NO: 69401 - DNA, 20 bp, Artificial
  CRISPR gRNA sequence
cagccccactccaggcccca

SEQ ID NO: 69402 - DNA, 20 bp, Artificial
  CRISPR gRNA sequence
agccccactccaggccccag

SEQ ID NO: 69403 - DNA, 20 bp, Artificial
  CRISPR gRNA sequence
caggccccagtctcagctcc

SEQ ID NO: 69404 - DNA, 20 bp, Artificial
  CRISPR gRNA sequence
agctccagtcacccccatga

SEQ ID NO: 69405 - DNA, 20 bp, Artificial
  CRISPR gRNA sequence
cagtcacccccatgaacttt

SEQ ID NO: 69406 - DNA, 20 bp, Artificial
  CRISPR gRNA sequence
tcagttccccgaacaccatc

SEQ ID NO: 69407 - DNA, 20 bp, Artificial
  CRISPR gRNA sequence
cagttccccgaacaccatct

SEQ ID NO: 69408 - DNA, 20 bp, Artificial
  CRISPR gRNA sequence
agttccccgaacaccatctt

SEQ ID NO: 69409 - DNA, 20 bp, Artificial
  CRISPR gRNA sequence
cccgaacaccatcttgctta

SEQ ID NO: 69410 - DNA, 20 bp, Artificial
  CRISPR gRNA sequence
gcttagaccttagggcattt

SEQ ID NO: 69411 - DNA, 20 bp, Artificial
  CRISPR gRNA sequence
cttagaccttagggcatttg

SEQ ID NO: 69412 - DNA, 20 bp, Artificial
  CRISPR gRNA sequence
agaccttagggcatttgcac

SEQ ID NO: 69413 - DNA, 20 bp, Artificial
  CRISPR gRNA sequence
gaccttagggcatttgcaca

SEQ ID NO: 69414 - DNA, 20 bp, Artificial
  CRISPR gRNA sequence
agggcatttgcacaggctgt

SEQ ID NO: 69415 - DNA, 20 bp, Artificial
  CRISPR gRNA sequence
gggcatttgcacaggctgtg

SEQ ID NO: 69416 - DNA, 20 bp, Artificial
  CRISPR gRNA sequence
gcacaggctgtgctctctgc

SEQ ID NO: 69417 - DNA, 20 bp, Artificial
  CRISPR gRNA sequence
cacaggctgtgctctctgcc

SEQ ID NO: 69418 - DNA, 20 bp, Artificial
  CRISPR gRNA sequence
tgctctctgcccagaatgtt

SEQ ID NO: 69419 - DNA, 20 bp, Artificial
  CRISPR gRNA sequence
tctgcccagaatgttctctt

SEQ ID NO: 69420 - DNA, 20 bp, Artificial
  CRISPR gRNA sequence
tgcccagaatgttctcttca

SEQ ID NO: 69421 - DNA, 20 bp, Artificial
  CRISPR gRNA sequence
cccagaatgttctcttcacg

SEQ ID NO: 69422 - DNA, 20 bp, Artificial
  CRISPR gRNA sequence
tcttcacgcctacctgcttc

SEQ ID NO: 69423 - DNA, 20 bp, Artificial
  CRISPR gRNA sequence
ttcacgcctacctgcttcac

SEQ ID NO: 69424 - DNA, 20 bp, Artificial
  CRISPR gRNA sequence
cacgcctacctgcttcacct

SEQ ID NO: 69425 - DNA, 20 bp, Artificial
  CRISPR gRNA sequence
acgcctacctgcttcacctg

SEQ ID NO: 69426 - DNA, 20 bp, Artificial
  CRISPR gRNA sequence
cctgcttcacctgcctaact

SEQ ID NO: 69427 - DNA, 20 bp, Artificial
  CRISPR gRNA sequence
cttcacctgcctaactcctc

SEQ ID NO: 69428 - DNA, 20 bp, Artificial
  CRISPR gRNA sequence
cacctgcctaactcctcctc

SEQ ID NO: 69429 - DNA, 20 bp, Artificial
  CRISPR gRNA sequence
acctgcctaactcctcctca

SEQ ID NO: 69430 - DNA, 20 bp, Artificial
  CRISPR gRNA sequence
cctaactcctcctcatccct

SEQ ID NO: 69431 - DNA, 20 bp, Artificial
  CRISPR gRNA sequence
actcctcctcatccctcagg

SEQ ID NO: 69432 - DNA, 20 bp, Artificial
  CRISPR gRNA sequence
ctcctcatccctcaggtctc

SEQ ID NO: 69433 - DNA, 20 bp, Artificial
  CRISPR gRNA sequence
ctcatccctcaggtctcagc

SEQ ID NO: 69434 - DNA, 20 bp, Artificial
  CRISPR gRNA sequence
atccctcaggtctcagctta

SEQ ID NO: 69435 - DNA, 20 bp, Artificial
  CRISPR gRNA sequence
aggtctcagcttaaatgcca

SEQ ID NO: 69436 - DNA, 20 bp, Artificial
  CRISPR gRNA sequence
agcttaaatgccaccacctc

SEQ ID NO: 69437 - DNA, 20 bp, Artificial
  CRISPR gRNA sequence
aaatgccaccacctcaggga

SEQ ID NO: 69438 - DNA, 20 bp, Artificial
  CRISPR gRNA sequence
aatgccaccacctcagggag

SEQ ID NO: 69439 - DNA, 20 bp, Artificial
  CRISPR gRNA sequence
agggaggccccctggacccc

SEQ ID NO: 69440 - DNA, 20 bp, Artificial
  CRISPR gRNA sequence
gaccccaaggcttagtcaaa

SEQ ID NO: 69441 - DNA, 20 bp, Artificial
  CRISPR gRNA sequence
agtcaaacacttccattatc

SEQ ID NO: 69442 - DNA, 20 bp, Artificial
  CRISPR gRNA sequence
gtcaaacacttccattatcc

SEQ ID NO: 69443 - DNA, 20 bp, Artificial
  CRISPR gRNA sequence
ccattatccactcttataga

SEQ ID NO: 69444 - DNA, 20 bp, Artificial
  CRISPR gRNA sequence
cattatccactcttatagat

SEQ ID NO: 69445 - DNA, 20 bp, Artificial
  CRISPR gRNA sequence
tccactcttatagatccctg

SEQ ID NO: 69446 - DNA, 20 bp, Artificial
  CRISPR gRNA sequence
ttatagatccctggattcac

SEQ ID NO: 69447 - DNA, 20 bp, Artificial
  CRISPR gRNA sequence
atagatccctggattcacag

SEQ ID NO: 69448 - DNA, 20 bp, Artificial
  CRISPR gRNA sequence
tagatccctggattcacagc

SEQ ID NO: 69449 - DNA, 20 bp, Artificial
  CRISPR gRNA sequence
gattcacagcacctctaaat

SEQ ID NO: 69450 - DNA, 20 bp, Artificial
  CRISPR gRNA sequence
acagcacctctaaatccata

SEQ ID NO: 69451 - DNA, 20 bp, Artificial
  CRISPR gRNA sequence
taaatccatatggcacagtt

SEQ ID NO: 69452 - DNA, 20 bp, Artificial
  CRISPR gRNA sequence
aatccatatggcacagtttg

SEQ ID NO: 69453 - DNA, 20 bp, Artificial
  CRISPR gRNA sequence
gggaaattaaaatgtcaccc

SEQ ID NO: 69454 - DNA, 20 bp, Artificial
  CRISPR gRNA sequence
ggaaattaaaatgtcaccct

SEQ ID NO: 69455 - DNA, 20 bp, Artificial
  CRISPR gRNA sequence
aaatgtcacccttttgagtg

SEQ ID NO: 69456 - DNA, 20 bp, Artificial
  CRISPR gRNA sequence
ttgagtggatgcagccctgc

SEQ ID NO: 69457 - DNA, 20 bp, Artificial
  CRISPR gRNA sequence
tgagtggatgcagccctgca

SEQ ID NO: 69458 - DNA, 20 bp, Artificial
  CRISPR gRNA sequence
gagtggatgcagccctgcat

SEQ ID NO: 69459 - DNA, 20 bp, Artificial
  CRISPR gRNA sequence
agtggatgcagccctgcatg

SEQ ID NO: 69460 - DNA, 20 bp, Artificial
  CRISPR gRNA sequence
catgtgtacattctgggaaa

SEQ ID NO: 69461 - DNA, 20 bp, Artificial
  CRISPR gRNA sequence
tgggaaatagagcatggtag

SEQ ID NO: 69462 - DNA, 20 bp, Artificial
  CRISPR gRNA sequence
ggaaatagagcatggtagga

SEQ ID NO: 69463 - DNA, 20 bp, Artificial
  CRISPR gRNA sequence
agcctcacctcacctcctcg

SEQ ID NO: 69464 - DNA, 20 bp, Artificial
  CRISPR gRNA sequence
acctcacctcctcggctgtg

SEQ ID NO: 69465 - DNA, 20 bp, Artificial
  CRISPR gRNA sequence
acctcctcggctgtgtgtcc

SEQ ID NO: 69466 - DNA, 20 bp, Artificial
  CRISPR gRNA sequence
ctcggctgtgtgtccttgtg

SEQ ID NO: 69467 - DNA, 20 bp, Artificial
  CRISPR gRNA sequence
ggctgtgtgtccttgtgcgg

SEQ ID NO: 69468 - DNA, 20 bp, Artificial
  CRISPR gRNA sequence
tgtgtccttgtgcggtgaac

SEQ ID NO: 69469 - DNA, 20 bp, Artificial
  CRISPR gRNA sequence
gtgcggtgaacaacctgcac

SEQ ID NO: 69470 - DNA, 20 bp, Artificial
  CRISPR gRNA sequence
tgcggtgaacaacctgcaca

SEQ ID NO: 69471 - DNA, 20 bp, Artificial
  CRISPR gRNA sequence
cacaaccataccagctgccc

SEQ ID NO: 69472 - DNA, 20 bp, Artificial
  CRISPR gRNA sequence
ccccatctggactcctgctt

SEQ ID NO: 69473 - DNA, 20 bp, Artificial
  CRISPR gRNA sequence
gactcctgcttcctagcact

SEQ ID NO: 69474 - DNA, 20 bp, Artificial
  CRISPR gRNA sequence
ctgcttcctagcacttctca

SEQ ID NO: 69475 - DNA, 20 bp, Artificial
  CRISPR gRNA sequence
cttcctagcacttctcataa

SEQ ID NO: 69476 - DNA, 20 bp, Artificial
  CRISPR gRNA sequence
cctagcacttctcataagtg

SEQ ID NO: 69477 - DNA, 20 bp, Artificial
  CRISPR gRNA sequence
ctagcacttctcataagtga

SEQ ID NO: 69478 - DNA, 20 bp, Artificial
  CRISPR gRNA sequence
gcacttctcataagtgaata

SEQ ID NO: 69479 - DNA, 20 bp, Artificial
  CRISPR gRNA sequence
ctcataagtgaatagcaaac

SEQ ID NO: 69480 - DNA, 20 bp, Artificial
  CRISPR gRNA sequence
tcataagtgaatagcaaact

SEQ ID NO: 69481 - DNA, 20 bp, Artificial
  CRISPR gRNA sequence
ataagtgaatagcaaactgt

SEQ ID NO: 69482 - DNA, 20 bp, Artificial
  CRISPR gRNA sequence
taggacttcatttgatcagc

SEQ ID NO: 69483 - DNA, 20 bp, Artificial
  CRISPR gRNA sequence
catttgatcagcatttattt

SEQ ID NO: 69484 - DNA, 20 bp, Artificial
  CRISPR gRNA sequence
atttgatcagcatttattta

SEQ ID NO: 69485 - DNA, 20 bp, Artificial
  CRISPR gRNA sequence
gatcagcatttatttacccc

SEQ ID NO: 69486 - DNA, 20 bp, Artificial
  CRISPR gRNA sequence
atcagcatttatttacccct

SEQ ID NO: 69487 - DNA, 20 bp, Artificial
  CRISPR gRNA sequence
atttacccctacaccataag

SEQ ID NO: 69488 - DNA, 20 bp, Artificial
  CRISPR gRNA sequence
tttacccctacaccataagc

SEQ ID NO: 69489 - DNA, 20 bp, Artificial
  CRISPR gRNA sequence
acccctacaccataagctcc

SEQ ID NO: 69490 - DNA, 20 bp, Artificial
  CRISPR gRNA sequence
cccctacaccataagctcct

SEQ ID NO: 69491 - DNA, 20 bp, Artificial
  CRISPR gRNA sequence
caccataagctccttgcagg

SEQ ID NO: 69492 - DNA, 20 bp, Artificial
  CRISPR gRNA sequence
cttgcaggcagatactgaat

SEQ ID NO: 69493 - DNA, 20 bp, Artificial
  CRISPR gRNA sequence
gcaggcagatactgaatccc

SEQ ID NO: 69494 - DNA, 20 bp, Artificial
  CRISPR gRNA sequence
caggcagatactgaatccca

SEQ ID NO: 69495 - DNA, 20 bp, Artificial
  CRISPR gRNA sequence
aatcccacatactggactag

SEQ ID NO: 69496 - DNA, 20 bp, Artificial
  CRISPR gRNA sequence
gactagatgttccaaaactg

SEQ ID NO: 69497 - DNA, 20 bp, Artificial
  CRISPR gRNA sequence
gatgttccaaaactgtcgtc

SEQ ID NO: 69498 - DNA, 20 bp, Artificial
  CRISPR gRNA sequence
caaaactgtcgtctccctgt

SEQ ID NO: 69499 - DNA, 20 bp, Artificial
  CRISPR gRNA sequence
tcgtctccctgtctgtgtcc

SEQ ID NO: 69500 - DNA, 20 bp, Artificial
  CRISPR gRNA sequence
cctgtctgtgtccaggttgg

SEQ ID NO: 69501 - DNA, 20 bp, Artificial
  CRISPR gRNA sequence
tctgtgtccaggttggctca

SEQ ID NO: 69502 - DNA, 20 bp, Artificial
  CRISPR gRNA sequence
tgtccaggttggctcactgt

SEQ ID NO: 69503 - DNA, 20 bp, Artificial
  CRISPR gRNA sequence
gctcactgtgaccttggagc

SEQ ID NO: 69504 - DNA, 20 bp, Artificial
  CRISPR gRNA sequence
actgtgaccttggagcccac

SEQ ID NO: 69505 - DNA, 20 bp, Artificial
  CRISPR gRNA sequence
tgaccttggagcccaccaca

SEQ ID NO: 69506 - DNA, 20 bp, Artificial
  CRISPR gRNA sequence
ggagcccaccacagccttct

SEQ ID NO: 69507 - DNA, 20 bp, Artificial
  CRISPR gRNA sequence
gagcccaccacagccttctt

SEQ ID NO: 69508 - DNA, 20 bp, Artificial
  CRISPR gRNA sequence
cttgtcgggcagctgatgga

SEQ ID NO: 69509 - DNA, 20 bp, Artificial
  CRISPR gRNA sequence
ttgtcgggcagctgatggag

SEQ ID NO: 69510 - DNA, 20 bp, Artificial
  CRISPR gRNA sequence
gtcgggcagctgatggagac

SEQ ID NO: 69511 - DNA, 20 bp, Artificial
  CRISPR gRNA sequence
tcgggcagctgatggagaca

SEQ ID NO: 69512 - DNA, 20 bp, Artificial
  CRISPR gRNA sequence
atggagacatgtgccaggct

SEQ ID NO: 69513 - DNA, 20 bp, Artificial
  CRISPR gRNA sequence
cagcagctcaggtcagcgcc

SEQ ID NO: 69514 - DNA, 20 bp, Artificial
  CRISPR gRNA sequence
aggtcagcgcctggaaactc

SEQ ID NO: 69515 - DNA, 20 bp, Artificial
  CRISPR gRNA sequence
gaaactctgtgtggggccct

SEQ ID NO: 69516 - DNA, 20 bp, Artificial
  CRISPR gRNA sequence
tgtgtggggccctgagttct

SEQ ID NO: 69517 - DNA, 20 bp, Artificial
  CRISPR gRNA sequence
tgtggggccctgagttctct

SEQ ID NO: 69518 - DNA, 20 bp, Artificial
  CRISPR gRNA sequence
agttctctggttgaccctgg

SEQ ID NO: 69519 - DNA, 20 bp, Artificial
  CRISPR gRNA sequence
tctggttgaccctggtacct

SEQ ID NO: 69520 - DNA, 20 bp, Artificial
  CRISPR gRNA sequence
tggttgaccctggtacctac

SEQ ID NO: 69521 - DNA, 20 bp, Artificial
  CRISPR gRNA sequence
gttgaccctggtacctactc

SEQ ID NO: 69522 - DNA, 20 bp, Artificial
  CRISPR gRNA sequence
accctggtacctactccagg

SEQ ID NO: 69523 - DNA, 20 bp, Artificial
  CRISPR gRNA sequence
gtacctactccaggccatgt

SEQ ID NO: 69524 - DNA, 20 bp, Artificial
  CRISPR gRNA sequence
ctccaggccatgtgtgaccc

SEQ ID NO: 69525 - DNA, 20 bp, Artificial
  CRISPR gRNA sequence
caggccatgtgtgaccctgg

SEQ ID NO: 69526 - DNA, 20 bp, Artificial
  CRISPR gRNA sequence
gcattctcacttccttgtgc

SEQ ID NO: 69527 - DNA, 20 bp, Artificial
  CRISPR gRNA sequence
tcacttccttgtgcaggaga

SEQ ID NO: 69528 - DNA, 20 bp, Artificial
  CRISPR gRNA sequence
acttccttgtgcaggagaaa

SEQ ID NO: 69529 - DNA, 20 bp, Artificial
  CRISPR gRNA sequence
ccttgtgcaggagaaaatca

SEQ ID NO: 69530 - DNA, 20 bp, Artificial
  CRISPR gRNA sequence
cttgtgcaggagaaaatcac

SEQ ID NO: 69531 - DNA, 20 bp, Artificial
  CRISPR gRNA sequence
gtgcaggagaaaatcacact

SEQ ID NO: 69532 - DNA, 20 bp, Artificial
  CRISPR gRNA sequence
tgcaggagaaaatcacactt

SEQ ID NO: 69533 - DNA, 20 bp, Artificial
  CRISPR gRNA sequence
ggccagtggaggggagggag

SEQ ID NO: 69534 - DNA, 20 bp, Artificial
  CRISPR gRNA sequence
gccagtggaggggagggaga

SEQ ID NO: 69535 - DNA, 20 bp, Artificial
  CRISPR gRNA sequence
aggggagctcttgggtggcc

SEQ ID NO: 69536 - DNA, 20 bp, Artificial
  CRISPR gRNA sequence
ttgggtggccccttctcctc

SEQ ID NO: 69537 - DNA, 20 bp, Artificial
  CRISPR gRNA sequence
gggtggccccttctcctctc

SEQ ID NO: 69538 - DNA, 20 bp, Artificial
  CRISPR gRNA sequence
ggtggccccttctcctctct

SEQ ID NO: 69539 - DNA, 20 bp, Artificial
  CRISPR gRNA sequence
ctcctctcttggcaccccct

SEQ ID NO: 69540 - DNA, 20 bp, Artificial
  CRISPR gRNA sequence
tcctctcttggcaccccctt

SEQ ID NO: 69541 - DNA, 20 bp, Artificial
  CRISPR gRNA sequence
ctctcttggcacccccttct

SEQ ID NO: 69542 - DNA, 20 bp, Artificial
  CRISPR gRNA sequence
tcttggcacccccttctgga

SEQ ID NO: 69543 - DNA, 20 bp, Artificial
  CRISPR gRNA sequence
ttggcacccccttctggatg

SEQ ID NO: 69544 - DNA, 20 bp, Artificial
  CRISPR gRNA sequence
ggcacccccttctggatgtg

SEQ ID NO: 69545 - DNA, 20 bp, Artificial
  CRISPR gRNA sequence
gcacccccttctggatgtga

SEQ ID NO: 69546 - DNA, 20 bp, Artificial
  CRISPR gRNA sequence
ctggatgtgatgacctctga

SEQ ID NO: 69547 - DNA, 20 bp, Artificial
  CRISPR gRNA sequence
tggatgtgatgacctctgag

SEQ ID NO: 69548 - DNA, 20 bp, Artificial
  CRISPR gRNA sequence
gatgtgatgacctctgaggt

SEQ ID NO: 69549 - DNA, 20 bp, Artificial
  CRISPR gRNA sequence
tgaggtgtgtccagcctgaa

SEQ ID NO: 69550 - DNA, 20 bp, Artificial
  CRISPR gRNA sequence
aggtgtgtccagcctgaaat

SEQ ID NO: 69551 - DNA, 20 bp, Artificial
  CRISPR gRNA sequence
aaatcctctagaatatcctt

SEQ ID NO: 69552 - DNA, 20 bp, Artificial
  CRISPR gRNA sequence
tagaatatccttggaccttt

SEQ ID NO: 69553 - DNA, 20 bp, Artificial
  CRISPR gRNA sequence
gaatatccttggaccttttc

SEQ ID NO: 69554 - DNA, 20 bp, Artificial
  CRISPR gRNA sequence
ggaccttttcagcttgtctc

SEQ ID NO: 69555 - DNA, 20 bp, Artificial
  CRISPR gRNA sequence
gaccttttcagcttgtctca

SEQ ID NO: 69556 - DNA, 20 bp, Artificial
  CRISPR gRNA sequence
ttcagcttgtctcaggttaa

SEQ ID NO: 69557 - DNA, 20 bp, Artificial
  CRISPR gRNA sequence
tcagcttgtctcaggttaac

SEQ ID NO: 69558 - DNA, 20 bp, Artificial
  CRISPR gRNA sequence
cagcttgtctcaggttaacc

SEQ ID NO: 69559 - DNA, 20 bp, Artificial
  CRISPR gRNA sequence
agcttgtctcaggttaacct

SEQ ID NO: 69560 - DNA, 20 bp, Artificial
  CRISPR gRNA sequence
gtctcaggttaacctctgtg

SEQ ID NO: 69561 - DNA, 20 bp, Artificial
  CRISPR gRNA sequence
tctcaggttaacctctgtga

SEQ ID NO: 69562 - DNA, 20 bp, Artificial
  CRISPR gRNA sequence
aggttaacctctgtgaggac

SEQ ID NO: 69563 - DNA, 20 bp, Artificial
  CRISPR gRNA sequence
acctctgtgaggacgatgat

SEQ ID NO: 69564 - DNA, 20 bp, Artificial
  CRISPR gRNA sequence
tgtgaggacgatgatgccag

SEQ ID NO: 69565 - DNA, 20 bp, Artificial
  CRISPR gRNA sequence
tgaggacgatgatgccagtt

SEQ ID NO: 69566 - DNA, 20 bp, Artificial
  CRISPR gRNA sequence
cctgctgctgcagagcctcc

SEQ ID NO: 69567 - DNA, 20 bp, Artificial
  CRISPR gRNA sequence
ctgctgcagagcctcctgct

SEQ ID NO: 69568 - DNA, 20 bp, Artificial
  CRISPR gRNA sequence
ctgcagagcctcctgctgtc

SEQ ID NO: 69569 - DNA, 20 bp, Artificial
  CRISPR gRNA sequence
cagagcctcctgctgtccct

SEQ ID NO: 69570 - DNA, 20 bp, Artificial
  CRISPR gRNA sequence
ctgctgtccctctctgagct

SEQ ID NO: 69571 - DNA, 20 bp, Artificial
  CRISPR gRNA sequence
ctgtccctctctgagctgaa

SEQ ID NO: 69572 - DNA, 20 bp, Artificial
  CRISPR gRNA sequence
tccctctctgagctgaagac

SEQ ID NO: 69573 - DNA, 20 bp, Artificial
  CRISPR gRNA sequence
tctgagctgaagacatttcg

SEQ ID NO: 69574 - DNA, 20 bp, Artificial
  CRISPR gRNA sequence
tgagctgaagacatttcggt

SEQ ID NO: 69575 - DNA, 20 bp, Artificial
  CRISPR gRNA sequence
agctgaagacatttcggtat

SEQ ID NO: 69576 - DNA, 20 bp, Artificial
  CRISPR gRNA sequence
aagacatttcggtatgtaga

SEQ ID NO: 69577 - DNA, 20 bp, Artificial
  CRISPR gRNA sequence
cggtatgtagacaagacatt

SEQ ID NO: 69578 - DNA, 20 bp, Artificial
  CRISPR gRNA sequence
ggtatgtagacaagacattc

SEQ ID NO: 69579 - DNA, 20 bp, Artificial
  CRISPR gRNA sequence
actcagtcccctttgcagct

SEQ ID NO: 69580 - DNA, 20 bp, Artificial
  CRISPR gRNA sequence
agtcccctttgcagctctgc

SEQ ID NO: 69581 - DNA, 20 bp, Artificial
  CRISPR gRNA sequence
tgcagctctgccctgccctg

SEQ ID NO: 69582 - DNA, 20 bp, Artificial
  CRISPR gRNA sequence
gcagctctgccctgccctga

SEQ ID NO: 69583 - DNA, 20 bp, Artificial
  CRISPR gRNA sequence
cagctctgccctgccctgac

SEQ ID NO: 69584 - DNA, 20 bp, Artificial
  CRISPR gRNA sequence
tgccctgccctgacacctcc

SEQ ID NO: 69585 - DNA, 20 bp, Artificial
  CRISPR gRNA sequence
ccctgccctgacacctcccg

SEQ ID NO: 69586 - DNA, 20 bp, Artificial
  CRISPR gRNA sequence
ccctgacacctcccgttatt

SEQ ID NO: 69587 - DNA, 20 bp, Artificial
  CRISPR gRNA sequence
acacctcccgttattcccag

SEQ ID NO: 69588 - DNA, 20 bp, Artificial
  CRISPR gRNA sequence
ccgttattcccagccctggg

SEQ ID NO: 69589 - DNA, 20 bp, Artificial
  CRISPR gRNA sequence
ttcccagccctgggctcaga

SEQ ID NO: 69590 - DNA, 20 bp, Artificial
  CRISPR gRNA sequence
ccagccctgggctcagagga

SEQ ID NO: 69591 - DNA, 20 bp, Artificial
  CRISPR gRNA sequence
ggctcagaggactcttactc

SEQ ID NO: 69592 - DNA, 20 bp, Artificial
  CRISPR gRNA sequence
agaggactcttactctgtgt

SEQ ID NO: 69593 - DNA, 20 bp, Artificial
  CRISPR gRNA sequence
ttactctgtgtcttactctg

SEQ ID NO: 69594 - DNA, 20 bp, Artificial
  CRISPR gRNA sequence
actctgtgtcttactctgtg

SEQ ID NO: 69595 - DNA, 20 bp, Artificial
  CRISPR gRNA sequence
ctctgtgtcttactctgtgg

SEQ ID NO: 69596 - DNA, 20 bp, Artificial
  CRISPR gRNA sequence
tgtgtcttactctgtggaca

SEQ ID NO: 69597 - DNA, 20 bp, Artificial
  CRISPR gRNA sequence
tgtcttactctgtggacaca

SEQ ID NO: 69598 - DNA, 20 bp, Artificial
  CRISPR gRNA sequence
actctgtggacacaaaccac

SEQ ID NO: 69599 - DNA, 20 bp, Artificial
  CRISPR gRNA sequence
ctctgtggacacaaaccaca

SEQ ID NO: 69600 - DNA, 20 bp, Artificial
  CRISPR gRNA sequence
tgtggacacaaaccacaggt

SEQ ID NO: 69601 - DNA, 20 bp, Artificial
  CRISPR gRNA sequence
tggacacaaaccacaggtgg

SEQ ID NO: 69602 - DNA, 20 bp, Artificial
  CRISPR gRNA sequence
gagatgatttttaggggtac

SEQ ID NO: 69603 - DNA, 20 bp, Artificial
  CRISPR gRNA sequence
ttaggggtacctagtcgtaa

SEQ ID NO: 69604 - DNA, 20 bp, Artificial
  CRISPR gRNA sequence
taggggtacctagtcgtaaa

SEQ ID NO: 69605 - DNA, 20 bp, Artificial
  CRISPR gRNA sequence
aggggtacctagtcgtaaac

SEQ ID NO: 69606 - DNA, 20 bp, Artificial
  CRISPR gRNA sequence
ggggtacctagtcgtaaaca

SEQ ID NO: 69607 - DNA, 20 bp, Artificial
  CRISPR gRNA sequence
gtcgtaaacatgaccttagg

SEQ ID NO: 69608 - DNA, 20 bp, Artificial
  CRISPR gRNA sequence
aggaacattgagccacatgg

SEQ ID NO: 69609 - DNA, 20 bp, Artificial
  CRISPR gRNA sequence
ggaacattgagccacatggc

SEQ ID NO: 69610 - DNA, 20 bp, Artificial
  CRISPR gRNA sequence
agccacatggcaagaaagtt

SEQ ID NO: 69611 - DNA, 20 bp, Artificial
  CRISPR gRNA sequence
ttccctttttaacactcttt

SEQ ID NO: 69612 - DNA, 20 bp, Artificial
  CRISPR gRNA sequence
cctttttaacactctttcat

SEQ ID NO: 69613 - DNA, 20 bp, Artificial
  CRISPR gRNA sequence
tttaacactctttcattgtt

SEQ ID NO: 69614 - DNA, 20 bp, Artificial
  CRISPR gRNA sequence
ttaacactctttcattgttt

SEQ ID NO: 69615 - DNA, 20 bp, Artificial
  CRISPR gRNA sequence
taacactctttcattgtttt

SEQ ID NO: 69616 - DNA, 20 bp, Artificial
  CRISPR gRNA sequence
aacactctttcattgttttt

SEQ ID NO: 69617 - DNA, 20 bp, Artificial
  CRISPR gRNA sequence
acactctttcattgtttttc

SEQ ID NO: 69618 - DNA, 20 bp, Artificial
  CRISPR gRNA sequence
tttcattgtttttcttttaa

SEQ ID NO: 69619 - DNA, 20 bp, Artificial
  CRISPR gRNA sequence
tcattgtttttcttttaaaa

SEQ ID NO: 69620 - DNA, 20 bp, Artificial
  CRISPR gRNA sequence
cattgtttttcttttaaaat

SEQ ID NO: 69621 - DNA, 20 bp, Artificial
  CRISPR gRNA sequence
attgtttttcttttaaaata

SEQ ID NO: 69622 - DNA, 20 bp, Artificial
  CRISPR gRNA sequence
tttttcttttaaaataactg

SEQ ID NO: 69623 - DNA, 20 bp, Artificial
  CRISPR gRNA sequence
ttcttttaaaataactgcga

SEQ ID NO: 69624 - DNA, 20 bp, Artificial
  CRISPR gRNA sequence
tcttttaaaataactgcgaa

SEQ ID NO: 69625 - DNA, 20 bp, Artificial
  CRISPR gRNA sequence
cttttaaaataactgcgaac

SEQ ID NO: 69626 - DNA, 20 bp, Artificial
  CRISPR gRNA sequence
ttttaaaataactgcgaact

SEQ ID NO: 69627 - DNA, 20 bp, Artificial
  CRISPR gRNA sequence
ttaaaataactgcgaactaa

SEQ ID NO: 69628 - DNA, 20 bp, Artificial
  CRISPR gRNA sequence
taaaataactgcgaactaac

SEQ ID NO: 69629 - DNA, 20 bp, Artificial
  CRISPR gRNA sequence
aaaataactgcgaactaaca

SEQ ID NO: 69630 - DNA, 20 bp, Artificial
  CRISPR gRNA sequence
aaataactgcgaactaacac

SEQ ID NO: 69631 - DNA, 20 bp, Artificial
  CRISPR gRNA sequence
cgaactaacacaaagtttca

SEQ ID NO: 69632 - DNA, 20 bp, Artificial
  CRISPR gRNA sequence
acacaaagtttcaagaagac

SEQ ID NO: 69633 - DNA, 20 bp, Artificial
  CRISPR gRNA sequence
caagaagactgagaactgct

SEQ ID NO: 69634 - DNA, 20 bp, Artificial
  CRISPR gRNA sequence
aagaagactgagaactgctg

SEQ ID NO: 69635 - DNA, 20 bp, Artificial
  CRISPR gRNA sequence
agaactgctgtgtgccattt

SEQ ID NO: 69636 - DNA, 20 bp, Artificial
  CRISPR gRNA sequence
ctgtgtgccatttacccaaa

SEQ ID NO: 69637 - DNA, 20 bp, Artificial
  CRISPR gRNA sequence
tgtgccatttacccaaattc

SEQ ID NO: 69638 - DNA, 20 bp, Artificial
  CRISPR gRNA sequence
acccaaattcacccttagag

SEQ ID NO: 69639 - DNA, 20 bp, Artificial
  CRISPR gRNA sequence
cccaaattcacccttagagc

SEQ ID NO: 69640 - DNA, 20 bp, Artificial
  CRISPR gRNA sequence
acccttagagctgggcgtgg

SEQ ID NO: 69641 - DNA, 20 bp, Artificial
  CRISPR gRNA sequence
agagctgggcgtggtggctc

SEQ ID NO: 69642 - DNA, 20 bp, Artificial
  CRISPR gRNA sequence
gagctgggcgtggtggctca

SEQ ID NO: 69643 - DNA, 20 bp, Artificial
  CRISPR gRNA sequence
ggcgtggtggctcatgtctg

SEQ ID NO: 69644 - DNA, 20 bp, Artificial
  CRISPR gRNA sequence
atgtctgtaatcctagcact

SEQ ID NO: 69645 - DNA, 20 bp, Artificial
  CRISPR gRNA sequence
taatcctagcactttgggag

SEQ ID NO: 69646 - DNA, 20 bp, Artificial
  CRISPR gRNA sequence
gcactttgggaggccgaggc

SEQ ID NO: 69647 - DNA, 20 bp, Artificial
  CRISPR gRNA sequence
tgggaggccgaggcaggtgg

SEQ ID NO: 69648 - DNA, 20 bp, Artificial
  CRISPR gRNA sequence
gggaggccgaggcaggtgga

SEQ ID NO: 69649 - DNA, 20 bp, Artificial
  CRISPR gRNA sequence
ggaggccgaggcaggtggat

SEQ ID NO: 69650 - DNA, 20 bp, Artificial
  CRISPR gRNA sequence
cctgagctcaggaattcgag

SEQ ID NO: 69651 - DNA, 20 bp, Artificial
  CRISPR gRNA sequence
agctcaggaattcgagacca

SEQ ID NO: 69652 - DNA, 20 bp, Artificial
  CRISPR gRNA sequence
aggaattcgagaccaccctg

SEQ ID NO: 69653 - DNA, 20 bp, Artificial
  CRISPR gRNA sequence
gagaccaccctggacaacac

SEQ ID NO: 69654 - DNA, 20 bp, Artificial
  CRISPR gRNA sequence
gacaacacggtgaaaccccg

SEQ ID NO: 69655 - DNA, 20 bp, Artificial
  CRISPR gRNA sequence
tactaaaatacaaaaaaatt

SEQ ID NO: 69656 - DNA, 20 bp, Artificial
  CRISPR gRNA sequence
ctaaaatacaaaaaaattag

SEQ ID NO: 69657 - DNA, 20 bp, Artificial
  CRISPR gRNA sequence
aaatacaaaaaaattagctg

SEQ ID NO: 69658 - DNA, 20 bp, Artificial
  CRISPR gRNA sequence
gctgggcatggtggtgcatg

SEQ ID NO: 69659 - DNA, 20 bp, Artificial
  CRISPR gRNA sequence
ggcatggtggtgcatgcctg

SEQ ID NO: 69660 - DNA, 20 bp, Artificial
  CRISPR gRNA sequence
taatcccagctaattgggag

SEQ ID NO: 69661 - DNA, 20 bp, Artificial
  CRISPR gRNA sequence
attgggaggctgaggcacaa

SEQ ID NO: 69662 - DNA, 20 bp, Artificial
  CRISPR gRNA sequence
ggaggctgaggcacaagaat

SEQ ID NO: 69663 - DNA, 20 bp, Artificial
  CRISPR gRNA sequence
aggcacaagaattgcttgaa

SEQ ID NO: 69664 - DNA, 20 bp, Artificial
  CRISPR gRNA sequence
cttgaacccgggaggctgag

SEQ ID NO: 69665 - DNA, 20 bp, Artificial
  CRISPR gRNA sequence
gaacccgggaggctgaggtt

SEQ ID NO: 69666 - DNA, 20 bp, Artificial
  CRISPR gRNA sequence
aacccgggaggctgaggtta

SEQ ID NO: 69667 - DNA, 20 bp, Artificial
  CRISPR gRNA sequence
aggttacagtgagccaagat

SEQ ID NO: 69668 - DNA, 20 bp, Artificial
  CRISPR gRNA sequence
cagtgagccaagattgtgcc

SEQ ID NO: 69669 - DNA, 20 bp, Artificial
  CRISPR gRNA sequence
tgccactgcactctagccta

SEQ ID NO: 69670 - DNA, 20 bp, Artificial
  CRISPR gRNA sequence
cactctagcctaggtgacag

SEQ ID NO: 69671 - DNA, 20 bp, Artificial
  CRISPR gRNA sequence
tagcctaggtgacagagcga

SEQ ID NO: 69672 - DNA, 20 bp, Artificial
  CRISPR gRNA sequence
gcctaggtgacagagcgagg

SEQ ID NO: 69673 - DNA, 20 bp, Artificial
  CRISPR gRNA sequence
ggtgacagagcgaggctcgg

SEQ ID NO: 69674 - DNA, 20 bp, Artificial
  CRISPR gRNA sequence
ggtttccgaaaaaaaaaaaa

SEQ ID NO: 69675 - DNA, 20 bp, Artificial
  CRISPR gRNA sequence
ccgaaaaaaaaaaaaaagaa

SEQ ID NO: 69676 - DNA, 20 bp, Artificial
  CRISPR gRNA sequence
cgaaaaaaaaaaaaaagaac

SEQ ID NO: 69677 - DNA, 20 bp, Artificial
  CRISPR gRNA sequence
accctttgccaatctttttc

SEQ ID NO: 69678 - DNA, 20 bp, Artificial
  CRISPR gRNA sequence
tgccaatctttttccacatt

SEQ ID NO: 69679 - DNA, 20 bp, Artificial
  CRISPR gRNA sequence
gccaatctttttccacattt

SEQ ID NO: 69680 - DNA, 20 bp, Artificial
  CRISPR gRNA sequence
ccaatctttttccacatttg

SEQ ID NO: 69681 - DNA, 20 bp, Artificial
  CRISPR gRNA sequence
tttccacatttgctcatttc

SEQ ID NO: 69682 - DNA, 20 bp, Artificial
  CRISPR gRNA sequence
ttccacatttgctcatttct

SEQ ID NO: 69683 - DNA, 20 bp, Artificial
  CRISPR gRNA sequence
tccacatttgctcatttctt

SEQ ID NO: 69684 - DNA, 20 bp, Artificial
  CRISPR gRNA sequence
ccacatttgctcatttcttc

SEQ ID NO: 69685 - DNA, 20 bp, Artificial
  CRISPR gRNA sequence
cacatttgctcatttcttcc

SEQ ID NO: 69686 - DNA, 20 bp, Artificial
  CRISPR gRNA sequence
gctcatttcttccctccctc

SEQ ID NO: 69687 - DNA, 20 bp, Artificial
  CRISPR gRNA sequence
ctcatttcttccctccctcc

SEQ ID NO: 69688 - DNA, 20 bp, Artificial
  CRISPR gRNA sequence
atttcttccctccctccttc

SEQ ID NO: 69689 - DNA, 20 bp, Artificial
  CRISPR gRNA sequence
cttccctccctccttctttc

SEQ ID NO: 69690 - DNA, 20 bp, Artificial
  CRISPR gRNA sequence
ttccctccctccttctttcc

SEQ ID NO: 69691 - DNA, 20 bp, Artificial
  CRISPR gRNA sequence
ccctccctccttctttccca

SEQ ID NO: 69692 - DNA, 20 bp, Artificial
  CRISPR gRNA sequence
cctccctccttctttcccac

SEQ ID NO: 69693 - DNA, 20 bp, Artificial
  CRISPR gRNA sequence
cctccttctttcccacctcc

SEQ ID NO: 69694 - DNA, 20 bp, Artificial
  CRISPR gRNA sequence
cttctttcccacctcccttt

SEQ ID NO: 69695 - DNA, 20 bp, Artificial
  CRISPR gRNA sequence
ctttcccacctcccttttct

SEQ ID NO: 69696 - DNA, 20 bp, Artificial
  CRISPR gRNA sequence
tttcccacctcccttttctt

SEQ ID NO: 69697 - DNA, 20 bp, Artificial
  CRISPR gRNA sequence
tcccacctcccttttctttc

SEQ ID NO: 69698 - DNA, 20 bp, Artificial
  CRISPR gRNA sequence
cccacctcccttttctttca

SEQ ID NO: 69699 - DNA, 20 bp, Artificial
  CRISPR gRNA sequence
ccacctcccttttctttcac

SEQ ID NO: 69700 - DNA, 20 bp, Artificial
  CRISPR gRNA sequence
ccttttctttcactctctcc

SEQ ID NO: 69701 - DNA, 20 bp, Artificial
  CRISPR gRNA sequence
ttctttcactctctccctct

SEQ ID NO: 69702 - DNA, 20 bp, Artificial
  CRISPR gRNA sequence
tctttcactctctccctctc

SEQ ID NO: 69703 - DNA, 20 bp, Artificial
  CRISPR gRNA sequence
ctttcactctctccctctct

SEQ ID NO: 69704 - DNA, 20 bp, Artificial
  CRISPR gRNA sequence
tttcactctctccctctctc

SEQ ID NO: 69705 - DNA, 20 bp, Artificial
  CRISPR gRNA sequence
tcactctctccctctctcct

SEQ ID NO: 69706 - DNA, 20 bp, Artificial
  CRISPR gRNA sequence
cactctctccctctctcctt

SEQ ID NO: 69707 - DNA, 20 bp, Artificial
  CRISPR gRNA sequence
actctctccctctctccttt

SEQ ID NO: 69708 - DNA, 20 bp, Artificial
  CRISPR gRNA sequence
tctccctctctccttttctg

SEQ ID NO: 69709 - DNA, 20 bp, Artificial
  CRISPR gRNA sequence
tccctctctccttttctgaa

SEQ ID NO: 69710 - DNA, 20 bp, Artificial
  CRISPR gRNA sequence
cctctctccttttctgaacc

SEQ ID NO: 69711 - DNA, 20 bp, Artificial
  CRISPR gRNA sequence
tctccttttctgaaccattt

SEQ ID NO: 69712 - DNA, 20 bp, Artificial
  CRISPR gRNA sequence
tccttttctgaaccatttag

SEQ ID NO: 69713 - DNA, 20 bp, Artificial
  CRISPR gRNA sequence
cttttctgaaccatttagaa

SEQ ID NO: 69714 - DNA, 20 bp, Artificial
  CRISPR gRNA sequence
ttctgaaccatttagaagta

SEQ ID NO: 69715 - DNA, 20 bp, Artificial
  CRISPR gRNA sequence
tctgaaccatttagaagtaa

SEQ ID NO: 69716 - DNA, 20 bp, Artificial
  CRISPR gRNA sequence
ctgaaccatttagaagtaag

SEQ ID NO: 69717 - DNA, 20 bp, Artificial
  CRISPR gRNA sequence
tgaaccatttagaagtaagt

SEQ ID NO: 69718 - DNA, 20 bp, Artificial
  CRISPR gRNA sequence
aaccatttagaagtaagttg

SEQ ID NO: 69719 - DNA, 20 bp, Artificial
  CRISPR gRNA sequence
agaagtaagttgtaatcatg

SEQ ID NO: 69720 - DNA, 20 bp, Artificial
  CRISPR gRNA sequence
gaagtaagttgtaatcatgt

SEQ ID NO: 69721 - DNA, 20 bp, Artificial
  CRISPR gRNA sequence
taatcatgtccctttacccg

SEQ ID NO: 69722 - DNA, 20 bp, Artificial
  CRISPR gRNA sequence
tacccgttaacatttcagcg

SEQ ID NO: 69723 - DNA, 20 bp, Artificial
  CRISPR gRNA sequence
acccgttaacatttcagcga

SEQ ID NO: 69724 - DNA, 20 bp, Artificial
  CRISPR gRNA sequence
cccgttaacatttcagcgaa

SEQ ID NO: 69725 - DNA, 20 bp, Artificial
  CRISPR gRNA sequence
acatttcagcgaatttgcta

SEQ ID NO: 69726 - DNA, 20 bp, Artificial
  CRISPR gRNA sequence
cagcgaatttgctagaaata

SEQ ID NO: 69727 - DNA, 20 bp, Artificial
  CRISPR gRNA sequence
agcgaatttgctagaaataa

SEQ ID NO: 69728 - DNA, 20 bp, Artificial
  CRISPR gRNA sequence
gctagaaataaggacattct

SEQ ID NO: 69729 - DNA, 20 bp, Artificial
  CRISPR gRNA sequence
ctagaaataaggacattctc

SEQ ID NO: 69730 - DNA, 20 bp, Artificial
  CRISPR gRNA sequence
gaaataaggacattctcttc

SEQ ID NO: 69731 - DNA, 20 bp, Artificial
  CRISPR gRNA sequence
tcttccataatccagtaaaa

SEQ ID NO: 69732 - DNA, 20 bp, Artificial
  CRISPR gRNA sequence
ttccataatccagtaaaatt

SEQ ID NO: 69733 - DNA, 20 bp, Artificial
  CRISPR gRNA sequence
ccataatccagtaaaattat

SEQ ID NO: 69734 - DNA, 20 bp, Artificial
  CRISPR gRNA sequence
cataatccagtaaaattata

SEQ ID NO: 69735 - DNA, 20 bp, Artificial
  CRISPR gRNA sequence
taaaatccaggaaatgtgac

SEQ ID NO: 69736 - DNA, 20 bp, Artificial
  CRISPR gRNA sequence
atacactactattatctcaa

SEQ ID NO: 69737 - DNA, 20 bp, Artificial
  CRISPR gRNA sequence
ctattatctcaactacagtt

SEQ ID NO: 69738 - DNA, 20 bp, Artificial
  CRISPR gRNA sequence
ttatctcaactacagtttat

SEQ ID NO: 69739 - DNA, 20 bp, Artificial
  CRISPR gRNA sequence
tctcaactacagtttatact

SEQ ID NO: 69740 - DNA, 20 bp, Artificial
  CRISPR gRNA sequence
aactacagtttatactccaa

SEQ ID NO: 69741 - DNA, 20 bp, Artificial
  CRISPR gRNA sequence
cagtttatactccaatctca

SEQ ID NO: 69742 - DNA, 20 bp, Artificial
  CRISPR gRNA sequence
atactccaatctcaccagtt

SEQ ID NO: 69743 - DNA, 20 bp, Artificial
  CRISPR gRNA sequence
tactccaatctcaccagttc

SEQ ID NO: 69744 - DNA, 20 bp, Artificial
  CRISPR gRNA sequence
caatctcaccagttctccca

SEQ ID NO: 69745 - DNA, 20 bp, Artificial
  CRISPR gRNA sequence
accagttctcccaataatgt

SEQ ID NO: 69746 - DNA, 20 bp, Artificial
  CRISPR gRNA sequence
tcccaataatgttgcttatt

SEQ ID NO: 69747 - DNA, 20 bp, Artificial
  CRISPR gRNA sequence
ccaataatgttgcttattgc

SEQ ID NO: 69748 - DNA, 20 bp, Artificial
  CRISPR gRNA sequence
cttattgcatttttttccca

SEQ ID NO: 69749 - DNA, 20 bp, Artificial
  CRISPR gRNA sequence
attgcatttttttcccagtt

SEQ ID NO: 69750 - DNA, 20 bp, Artificial
  CRISPR gRNA sequence
ttgcatttttttcccagttg

SEQ ID NO: 69751 - DNA, 20 bp, Artificial
  CRISPR gRNA sequence
catttttttcccagttgtgg

SEQ ID NO: 69752 - DNA, 20 bp, Artificial
  CRISPR gRNA sequence
ttttcccagttgtggatcca

SEQ ID NO: 69753 - DNA, 20 bp, Artificial
  CRISPR gRNA sequence
tttcccagttgtggatccaa

SEQ ID NO: 69754 - DNA, 20 bp, Artificial
  CRISPR gRNA sequence
ttcccagttgtggatccaat

SEQ ID NO: 69755 - DNA, 20 bp, Artificial
  CRISPR gRNA sequence
tcccagttgtggatccaatc

SEQ ID NO: 69756 - DNA, 20 bp, Artificial
  CRISPR gRNA sequence
cccagttgtggatccaatcc

SEQ ID NO: 69757 - DNA, 20 bp, Artificial
  CRISPR gRNA sequence
ccagttgtggatccaatcca

SEQ ID NO: 69758 - DNA, 20 bp, Artificial
  CRISPR gRNA sequence
tggatccaatccaggatcac

SEQ ID NO: 69759 - DNA, 20 bp, Artificial
  CRISPR gRNA sequence
atttagtgtcatctctttag

SEQ ID NO: 69760 - DNA, 20 bp, Artificial
  CRISPR gRNA sequence
agtgtcatctctttagtgtc

SEQ ID NO: 69761 - DNA, 20 bp, Artificial
  CRISPR gRNA sequence
gtgtcatctctttagtgtct

SEQ ID NO: 69762 - DNA, 20 bp, Artificial
  CRISPR gRNA sequence
tttagtgtctccttcaatct

SEQ ID NO: 69763 - DNA, 20 bp, Artificial
  CRISPR gRNA sequence
tagtgtctccttcaatctgg

SEQ ID NO: 69764 - DNA, 20 bp, Artificial
  CRISPR gRNA sequence
agtgtctccttcaatctgga

SEQ ID NO: 69765 - DNA, 20 bp, Artificial
  CRISPR gRNA sequence
gtgtctccttcaatctggaa

SEQ ID NO: 69766 - DNA, 20 bp, Artificial
  CRISPR gRNA sequence
cttcaatctggaacacgtcc

SEQ ID NO: 69767 - DNA, 20 bp, Artificial
  CRISPR gRNA sequence
caatctggaacacgtccttg

SEQ ID NO: 69768 - DNA, 20 bp, Artificial
  CRISPR gRNA sequence
aatctggaacacgtccttgg

SEQ ID NO: 69769 - DNA, 20 bp, Artificial
  CRISPR gRNA sequence
gaacacgtccttggcccttc

SEQ ID NO: 69770 - DNA, 20 bp, Artificial
  CRISPR gRNA sequence
ggcccttctttgtctttcat

SEQ ID NO: 69771 - DNA, 20 bp, Artificial
  CRISPR gRNA sequence
gcccttctttgtctttcata

SEQ ID NO: 69772 - DNA, 20 bp, Artificial
  CRISPR gRNA sequence
ctttgtctttcatagcattg

SEQ ID NO: 69773 - DNA, 20 bp, Artificial
  CRISPR gRNA sequence
tttgtctttcatagcattgt

SEQ ID NO: 69774 - DNA, 20 bp, Artificial
  CRISPR gRNA sequence
tgtctttcatagcattgtct

SEQ ID NO: 69775 - DNA, 20 bp, Artificial
  CRISPR gRNA sequence
gtctttcatagcattgtctc

SEQ ID NO: 69776 - DNA, 20 bp, Artificial
  CRISPR gRNA sequence
tctttcatagcattgtctct

SEQ ID NO: 69777 - DNA, 20 bp, Artificial
  CRISPR gRNA sequence
tcatagcattgtctctgaca

SEQ ID NO: 69778 - DNA, 20 bp, Artificial
  CRISPR gRNA sequence
catagcattgtctctgacat

SEQ ID NO: 69779 - DNA, 20 bp, Artificial
  CRISPR gRNA sequence
atagcattgtctctgacatt

SEQ ID NO: 69780 - DNA, 20 bp, Artificial
  CRISPR gRNA sequence
tctctgacatttacaggcca

SEQ ID NO: 69781 - DNA, 20 bp, Artificial
  CRISPR gRNA sequence
tgacatttacaggccagtta

SEQ ID NO: 69782 - DNA, 20 bp, Artificial
  CRISPR gRNA sequence
acatttacaggccagttatt

SEQ ID NO: 69783 - DNA, 20 bp, Artificial
  CRISPR gRNA sequence
acaggccagttattttatag

SEQ ID NO: 69784 - DNA, 20 bp, Artificial
  CRISPR gRNA sequence
caggccagttattttataga

SEQ ID NO: 69785 - DNA, 20 bp, Artificial
  CRISPR gRNA sequence
ttttatagaatgtccttcca

SEQ ID NO: 69786 - DNA, 20 bp, Artificial
  CRISPR gRNA sequence
tatagaatgtccttccactt

SEQ ID NO: 69787 - DNA, 20 bp, Artificial
  CRISPR gRNA sequence
atagaatgtccttccacttg

SEQ ID NO: 69788 - DNA, 20 bp, Artificial
  CRISPR gRNA sequence
tagaatgtccttccacttgg

SEQ ID NO: 69789 - DNA, 20 bp, Artificial
  CRISPR gRNA sequence
ccacttgggtttgtccaatg

SEQ ID NO: 69790 - DNA, 20 bp, Artificial
  CRISPR gRNA sequence
cacttgggtttgtccaatgt

SEQ ID NO: 69791 - DNA, 20 bp, Artificial
  CRISPR gRNA sequence
gggtttgtccaatgtttcct

SEQ ID NO: 69792 - DNA, 20 bp, Artificial
  CRISPR gRNA sequence
ggtttgtccaatgtttcctc

SEQ ID NO: 69793 - DNA, 20 bp, Artificial
  CRISPR gRNA sequence
gtccaatgtttcctcatgtt

SEQ ID NO: 69794 - DNA, 20 bp, Artificial
  CRISPR gRNA sequence
tccaatgtttcctcatgttt

SEQ ID NO: 69795 - DNA, 20 bp, Artificial
  CRISPR gRNA sequence
cctcatgtttagagttagag

SEQ ID NO: 69796 - DNA, 20 bp, Artificial
  CRISPR gRNA sequence
ctcatgtttagagttagagt

SEQ ID NO: 69797 - DNA, 20 bp, Artificial
  CRISPR gRNA sequence
atgtttagagttagagtctg

SEQ ID NO: 69798 - DNA, 20 bp, Artificial
  CRISPR gRNA sequence
agagttagagtctgcccttt

SEQ ID NO: 69799 - DNA, 20 bp, Artificial
  CRISPR gRNA sequence
gagttagagtctgccctttg

SEQ ID NO: 69800 - DNA, 20 bp, Artificial
  CRISPR gRNA sequence
gagtctgccctttgggcagg

SEQ ID NO: 69801 - DNA, 20 bp, Artificial
  CRISPR gRNA sequence
ccctttgggcaggaatatca

SEQ ID NO: 69802 - DNA, 20 bp, Artificial
  CRISPR gRNA sequence
tgggcaggaatatcacacag

SEQ ID NO: 69803 - DNA, 20 bp, Artificial
  CRISPR gRNA sequence
gggcaggaatatcacacagg

SEQ ID NO: 69804 - DNA, 20 bp, Artificial
  CRISPR gRNA sequence
ggcaggaatatcacacaggt

SEQ ID NO: 69805 - DNA, 20 bp, Artificial
  CRISPR gRNA sequence
tgttatcgtgccttccatcg

SEQ ID NO: 69806 - DNA, 20 bp, Artificial
  CRISPR gRNA sequence
tcgtgccttccatcggggca

SEQ ID NO: 69807 - DNA, 20 bp, Artificial
  CRISPR gRNA sequence
ccatcggggcacatgatgtg

SEQ ID NO: 69808 - DNA, 20 bp, Artificial
  CRISPR gRNA sequence
catcggggcacatgatgtgt

SEQ ID NO: 69809 - DNA, 20 bp, Artificial
  CRISPR gRNA sequence
gggctagtgatgttaactgt

SEQ ID NO: 69810 - DNA, 20 bp, Artificial
  CRISPR gRNA sequence
gtgatgttaactgtgatcac

SEQ ID NO: 69811 - DNA, 20 bp, Artificial
  CRISPR gRNA sequence
actgtgatcacctgtgacag

SEQ ID NO: 69812 - DNA, 20 bp, Artificial
  CRISPR gRNA sequence
tgatcacctgtgacagtggt

SEQ ID NO: 69813 - DNA, 20 bp, Artificial
  CRISPR gRNA sequence
tgacagtggtgtctgccagg

SEQ ID NO: 69814 - DNA, 20 bp, Artificial
  CRISPR gRNA sequence
ccaggtctctccacttgcaa

SEQ ID NO: 69815 - DNA, 20 bp, Artificial
  CRISPR gRNA sequence
tccacttgcaaatttactaa

SEQ ID NO: 69816 - DNA, 20 bp, Artificial
  CRISPR gRNA sequence
cacttgcaaatttactaact

SEQ ID NO: 69817 - DNA, 20 bp, Artificial
  CRISPR gRNA sequence
gcaaatttactaactttccc

SEQ ID NO: 69818 - DNA, 20 bp, Artificial
  CRISPR gRNA sequence
caaatttactaactttccct

SEQ ID NO: 69819 - DNA, 20 bp, Artificial
  CRISPR gRNA sequence
actaactttccctttgtaat

SEQ ID NO: 69820 - DNA, 20 bp, Artificial
  CRISPR gRNA sequence
ctaactttccctttgtaatc

SEQ ID NO: 69821 - DNA, 20 bp, Artificial
  CRISPR gRNA sequence
actttccctttgtaatcaac

SEQ ID NO: 69822 - DNA, 20 bp, Artificial
  CRISPR gRNA sequence
tccctttgtaatcaacatag

SEQ ID NO: 69823 - DNA, 20 bp, Artificial
  CRISPR gRNA sequence
ccctttgtaatcaacataga

SEQ ID NO: 69824 - DNA, 20 bp, Artificial
  CRISPR gRNA sequence
cctttgtaatcaacatagat

SEQ ID NO: 69825 - DNA, 20 bp, Artificial
  CRISPR gRNA sequence
tgtaatcaacatagattatg

SEQ ID NO: 69826 - DNA, 20 bp, Artificial
  CRISPR gRNA sequence
gtaatcaacatagattatgt

SEQ ID NO: 69827 - DNA, 20 bp, Artificial
  CRISPR gRNA sequence
taatcaacatagattatgtg

SEQ ID NO: 69828 - DNA, 20 bp, Artificial
  CRISPR gRNA sequence
tgtggggagatactttaaga

SEQ ID NO: 69829 - DNA, 20 bp, Artificial
  CRISPR gRNA sequence
taagattatgtattaagtct

SEQ ID NO: 69830 - DNA, 20 bp, Artificial
  CRISPR gRNA sequence
aagattatgtattaagtctt

SEQ ID NO: 69831 - DNA, 20 bp, Artificial
  CRISPR gRNA sequence
agattatgtattaagtcttc

SEQ ID NO: 69832 - DNA, 20 bp, Artificial
  CRISPR gRNA sequence
tgtattaagtcttcctcaaa

SEQ ID NO: 69833 - DNA, 20 bp, Artificial
  CRISPR gRNA sequence
agtcttcctcaaactctcat

SEQ ID NO: 69834 - DNA, 20 bp, Artificial
  CRISPR gRNA sequence
cctcaaactctcattggcaa

SEQ ID NO: 69835 - DNA, 20 bp, Artificial
  CRISPR gRNA sequence
ctcaaactctcattggcaaa

SEQ ID NO: 69836 - DNA, 20 bp, Artificial
  CRISPR gRNA sequence
aaactctcattggcaaattt

SEQ ID NO: 69837 - DNA, 20 bp, Artificial
  CRISPR gRNA sequence
tcattggcaaattttagcag

SEQ ID NO: 69838 - DNA, 20 bp, Artificial
  CRISPR gRNA sequence
attggcaaattttagcagcc

SEQ ID NO: 69839 - DNA, 20 bp, Artificial
  CRISPR gRNA sequence
gcaaattttagcagccgtta

SEQ ID NO: 69840 - DNA, 20 bp, Artificial
  CRISPR gRNA sequence
tagcagccgttaataaatct

SEQ ID NO: 69841 - DNA, 20 bp, Artificial
  CRISPR gRNA sequence
agcagccgttaataaatctt

SEQ ID NO: 69842 - DNA, 20 bp, Artificial
  CRISPR gRNA sequence
gcagccgttaataaatctta

SEQ ID NO: 69843 - DNA, 20 bp, Artificial
  CRISPR gRNA sequence
ataaatcttacttaaatcga

SEQ ID NO: 69844 - DNA, 20 bp, Artificial
  CRISPR gRNA sequence
acttaaatcgatgaatcagc

SEQ ID NO: 69845 - DNA, 20 bp, Artificial
  CRISPR gRNA sequence
cttaaatcgatgaatcagca

SEQ ID NO: 69846 - DNA, 20 bp, Artificial
  CRISPR gRNA sequence
aaatcgatgaatcagcatga

SEQ ID NO: 69847 - DNA, 20 bp, Artificial
  CRISPR gRNA sequence
aatcgatgaatcagcatgac

SEQ ID NO: 69848 - DNA, 20 bp, Artificial
  CRISPR gRNA sequence
caaaatgtagctttcctaac

SEQ ID NO: 69849 - DNA, 20 bp, Artificial
  CRISPR gRNA sequence
tcctaactttacattttatt

SEQ ID NO: 69850 - DNA, 20 bp, Artificial
  CRISPR gRNA sequence
cctaactttacattttattt

SEQ ID NO: 69851 - DNA, 20 bp, Artificial
  CRISPR gRNA sequence
ctaactttacattttatttc

SEQ ID NO: 69852 - DNA, 20 bp, Artificial
  CRISPR gRNA sequence
actttacattttatttccat

SEQ ID NO: 69853 - DNA, 20 bp, Artificial
  CRISPR gRNA sequence
tacattttatttccatctaa

SEQ ID NO: 69854 - DNA, 20 bp, Artificial
  CRISPR gRNA sequence
acattttatttccatctaac

SEQ ID NO: 69855 - DNA, 20 bp, Artificial
  CRISPR gRNA sequence
cattttatttccatctaact

SEQ ID NO: 69856 - DNA, 20 bp, Artificial
  CRISPR gRNA sequence
tatttccatctaactgatta

SEQ ID NO: 69857 - DNA, 20 bp, Artificial
  CRISPR gRNA sequence
atttccatctaactgattac

SEQ ID NO: 69858 - DNA, 20 bp, Artificial
  CRISPR gRNA sequence
tttccatctaactgattaca

SEQ ID NO: 69859 - DNA, 20 bp, Artificial
  CRISPR gRNA sequence
ccatctaactgattacacca

SEQ ID NO: 69860 - DNA, 20 bp, Artificial
  CRISPR gRNA sequence
catctaactgattacaccaa

SEQ ID NO: 69861 - DNA, 20 bp, Artificial
  CRISPR gRNA sequence
actgattacaccaagaagaa

SEQ ID NO: 69862 - DNA, 20 bp, Artificial
  CRISPR gRNA sequence
attacaccaagaagaaactc

SEQ ID NO: 69863 - DNA, 20 bp, Artificial
  CRISPR gRNA sequence
caccaagaagaaactcttgg

SEQ ID NO: 69864 - DNA, 20 bp, Artificial
  CRISPR gRNA sequence
ttgggctgggaacagtggct

SEQ ID NO: 69865 - DNA, 20 bp, Artificial
  CRISPR gRNA sequence
gggctgggaacagtggctca

SEQ ID NO: 69866 - DNA, 20 bp, Artificial
  CRISPR gRNA sequence
ggctgggaacagtggctcaa

SEQ ID NO: 69867 - DNA, 20 bp, Artificial
  CRISPR gRNA sequence
ggaacagtggctcaagcttg

SEQ ID NO: 69868 - DNA, 20 bp, Artificial
  CRISPR gRNA sequence
aagcttgtaatcccagcact

SEQ ID NO: 69869 - DNA, 20 bp, Artificial
  CRISPR gRNA sequence
gtaatcccagcactctggga

SEQ ID NO: 69870 - DNA, 20 bp, Artificial
  CRISPR gRNA sequence
taatcccagcactctgggag

SEQ ID NO: 69871 - DNA, 20 bp, Artificial
  CRISPR gRNA sequence
tgggaggccgaggaggaaaa

SEQ ID NO: 69872 - DNA, 20 bp, Artificial
  CRISPR gRNA sequence
ggaggccgaggaggaaaaat

SEQ ID NO: 69873 - DNA, 20 bp, Artificial
  CRISPR gRNA sequence
gagcccgggagttcgacacc

SEQ ID NO: 69874 - DNA, 20 bp, Artificial
  CRISPR gRNA sequence
agcccgggagttcgacacca

SEQ ID NO: 69875 - DNA, 20 bp, Artificial
  CRISPR gRNA sequence
gacaccagcctgagcaacat

SEQ ID NO: 69876 - DNA, 20 bp, Artificial
  CRISPR gRNA sequence
agcaacatagcgagaccacc

SEQ ID NO: 69877 - DNA, 20 bp, Artificial
  CRISPR gRNA sequence
tacaaaaaataaataaataa

SEQ ID NO: 69878 - DNA, 20 bp, Artificial
  CRISPR gRNA sequence
caaaaaataaataaataaaa

SEQ ID NO: 69879 - DNA, 20 bp, Artificial
  CRISPR gRNA sequence
aaaaaggaagaaactcttta

SEQ ID NO: 69880 - DNA, 20 bp, Artificial
  CRISPR gRNA sequence
aaaaggaagaaactctttag

SEQ ID NO: 69881 - DNA, 20 bp, Artificial
  CRISPR gRNA sequence
tttaggacagagagatcttt

SEQ ID NO: 69882 - DNA, 20 bp, Artificial
  CRISPR gRNA sequence
taggacagagagatctttga

SEQ ID NO: 69883 - DNA, 20 bp, Artificial
  CRISPR gRNA sequence
aggacagagagatctttgac

SEQ ID NO: 69884 - DNA, 20 bp, Artificial
  CRISPR gRNA sequence
ggacagagagatctttgaca

SEQ ID NO: 69885 - DNA, 20 bp, Artificial
  CRISPR gRNA sequence
tgacacttcttcagtatttg

SEQ ID NO: 69886 - DNA, 20 bp, Artificial
  CRISPR gRNA sequence
gacacttcttcagtatttgc

SEQ ID NO: 69887 - DNA, 20 bp, Artificial
  CRISPR gRNA sequence
acacttcttcagtatttgct

SEQ ID NO: 69888 - DNA, 20 bp, Artificial
  CRISPR gRNA sequence
cttcagtatttgctttaaag

SEQ ID NO: 69889 - DNA, 20 bp, Artificial
  CRISPR gRNA sequence
ttcagtatttgctttaaaga

SEQ ID NO: 69890 - DNA, 20 bp, Artificial
  CRISPR gRNA sequence
cagtatttgctttaaagatg

SEQ ID NO: 69891 - DNA, 20 bp, Artificial
  CRISPR gRNA sequence
agtatttgctttaaagatgc

SEQ ID NO: 69892 - DNA, 20 bp, Artificial
  CRISPR gRNA sequence
gctttaaagatgcagagttt

SEQ ID NO: 69893 - DNA, 20 bp, Artificial
  CRISPR gRNA sequence
ctttaaagatgcagagtttg

SEQ ID NO: 69894 - DNA, 20 bp, Artificial
  CRISPR gRNA sequence
taaagatgcagagtttgtaa

SEQ ID NO: 69895 - DNA, 20 bp, Artificial
  CRISPR gRNA sequence
aaagatgcagagtttgtaat

SEQ ID NO: 69896 - DNA, 20 bp, Artificial
  CRISPR gRNA sequence
aagatgcagagtttgtaata

SEQ ID NO: 69897 - DNA, 20 bp, Artificial
  CRISPR gRNA sequence
gtaataaacaacagtaacta

SEQ ID NO: 69898 - DNA, 20 bp, Artificial
  CRISPR gRNA sequence
taataaacaacagtaactag

SEQ ID NO: 69899 - DNA, 20 bp, Artificial
  CRISPR gRNA sequence
gctaaactacagtgatacct

SEQ ID NO: 69900 - DNA, 20 bp, Artificial
  CRISPR gRNA sequence
aactacagtgatacctaatc

SEQ ID NO: 69901 - DNA, 20 bp, Artificial
  CRISPR gRNA sequence
cagtgatacctaatcctggc

SEQ ID NO: 69902 - DNA, 20 bp, Artificial
  CRISPR gRNA sequence
atcctggcttaagttgtgaa

SEQ ID NO: 69903 - DNA, 20 bp, Artificial
  CRISPR gRNA sequence
gcttaagttgtgaagttgct

SEQ ID NO: 69904 - DNA, 20 bp, Artificial
  CRISPR gRNA sequence
aagttgtgaagttgctacct

SEQ ID NO: 69905 - DNA, 20 bp, Artificial
  CRISPR gRNA sequence
agttgtgaagttgctacctg

SEQ ID NO: 69906 - DNA, 20 bp, Artificial
  CRISPR gRNA sequence
tgaagttgctacctgaatga

SEQ ID NO: 69907 - DNA, 20 bp, Artificial
  CRISPR gRNA sequence
ctacctgaatgactgcggtt

SEQ ID NO: 69908 - DNA, 20 bp, Artificial
  CRISPR gRNA sequence
cctgaatgactgcggtttag

SEQ ID NO: 69909 - DNA, 20 bp, Artificial
  CRISPR gRNA sequence
aatgactgcggtttaggaaa

SEQ ID NO: 69910 - DNA, 20 bp, Artificial
  CRISPR gRNA sequence
cggtttaggaaatactgaac

SEQ ID NO: 69911 - DNA, 20 bp, Artificial
  CRISPR gRNA sequence
aggaaatactgaactagtcc

SEQ ID NO: 69912 - DNA, 20 bp, Artificial
  CRISPR gRNA sequence
ggaaatactgaactagtcca

SEQ ID NO: 69913 - DNA, 20 bp, Artificial
  CRISPR gRNA sequence
aactagtccatgcttctgct

SEQ ID NO: 69914 - DNA, 20 bp, Artificial
  CRISPR gRNA sequence
gtccatgcttctgcttccaa

SEQ ID NO: 69915 - DNA, 20 bp, Artificial
  CRISPR gRNA sequence
ctgcttccaagctctgtggt

SEQ ID NO: 69916 - DNA, 20 bp, Artificial
  CRISPR gRNA sequence
tgcttccaagctctgtggtg

SEQ ID NO: 69917 - DNA, 20 bp, Artificial
  CRISPR gRNA sequence
cttccaagctctgtggtggc

SEQ ID NO: 69918 - DNA, 20 bp, Artificial
  CRISPR gRNA sequence
ccaagctctgtggtggctta

SEQ ID NO: 69919 - DNA, 20 bp, Artificial
  CRISPR gRNA sequence
caagctctgtggtggcttaa

SEQ ID NO: 69920 - DNA, 20 bp, Artificial
  CRISPR gRNA sequence
tgtggtggcttaatgagttc

SEQ ID NO: 69921 - DNA, 20 bp, Artificial
  CRISPR gRNA sequence
tggtggcttaatgagttcat

SEQ ID NO: 69922 - DNA, 20 bp, Artificial
  CRISPR gRNA sequence
aatgagttcatggtggaaga

SEQ ID NO: 69923 - DNA, 20 bp, Artificial
  CRISPR gRNA sequence
atgagttcatggtggaagag

SEQ ID NO: 69924 - DNA, 20 bp, Artificial
  CRISPR gRNA sequence
atggtggaagagatttacga

SEQ ID NO: 69925 - DNA, 20 bp, Artificial
  CRISPR gRNA sequence
acgaagggaaggaggtctcc

SEQ ID NO: 69926 - DNA, 20 bp, Artificial
  CRISPR gRNA sequence
cgaagggaaggaggtctcct

SEQ ID NO: 69927 - DNA, 20 bp, Artificial
  CRISPR gRNA sequence
ctcacattgcccgccacatc

SEQ ID NO: 69928 - DNA, 20 bp, Artificial
  CRISPR gRNA sequence
acattgcccgccacatccct

SEQ ID NO: 69929 - DNA, 20 bp, Artificial
  CRISPR gRNA sequence
cccgccacatccctacccca

SEQ ID NO: 69930 - DNA, 20 bp, Artificial
  CRISPR gRNA sequence
ccccacatccttgccctctg

SEQ ID NO: 69931 - DNA, 20 bp, Artificial
  CRISPR gRNA sequence
gccctctgccaccagcattc

SEQ ID NO: 69932 - DNA, 20 bp, Artificial
  CRISPR gRNA sequence
ccctctgccaccagcattca

SEQ ID NO: 69933 - DNA, 20 bp, Artificial
  CRISPR gRNA sequence
tgccaccagcattcagagct

SEQ ID NO: 69934 - DNA, 20 bp, Artificial
  CRISPR gRNA sequence
ccaccagcattcagagctcc

SEQ ID NO: 69935 - DNA, 20 bp, Artificial
  CRISPR gRNA sequence
agagctcccaagacccaggg

SEQ ID NO: 69936 - DNA, 20 bp, Artificial
  CRISPR gRNA sequence
ccaagacccagggcggctcc

SEQ ID NO: 69937 - DNA, 20 bp, Artificial
  CRISPR gRNA sequence
ctgcctgacctgttgccctt

SEQ ID NO: 69938 - DNA, 20 bp, Artificial
  CRISPR gRNA sequence
cctgacctgttgccctttga

SEQ ID NO: 69939 - DNA, 20 bp, Artificial
  CRISPR gRNA sequence
acctgttgccctttgacccc

SEQ ID NO: 69940 - DNA, 20 bp, Artificial
  CRISPR gRNA sequence
ttgccctttgacccccacca

SEQ ID NO: 69941 - DNA, 20 bp, Artificial
  CRISPR gRNA sequence
ccctttgacccccaccaggc

SEQ ID NO: 69942 - DNA, 20 bp, Artificial
  CRISPR gRNA sequence
tgacccccaccaggctgacc

SEQ ID NO: 69943 - DNA, 20 bp, Artificial
  CRISPR gRNA sequence
gacccccaccaggctgacct

SEQ ID NO: 69944 - DNA, 20 bp, Artificial
  CRISPR gRNA sequence
acccccaccaggctgacctc

SEQ ID NO: 69945 - DNA, 20 bp, Artificial
  CRISPR gRNA sequence
acctccagctgtgtgagcac

SEQ ID NO: 69946 - DNA, 20 bp, Artificial
  CRISPR gRNA sequence
cagctgtgtgagcaccgagg

SEQ ID NO: 69947 - DNA, 20 bp, Artificial
  CRISPR gRNA sequence
tgtgagcaccgagggcctcg

SEQ ID NO: 69948 - DNA, 20 bp, Artificial
  CRISPR gRNA sequence
gcccacctggcatctggtct

SEQ ID NO: 69949 - DNA, 20 bp, Artificial
  CRISPR gRNA sequence
gcatctggtctgggccactg

SEQ ID NO: 69950 - DNA, 20 bp, Artificial
  CRISPR gRNA sequence
gtctgggccactgccaccac

SEQ ID NO: 69951 - DNA, 20 bp, Artificial
  CRISPR gRNA sequence
ggccactgccaccacttgga

SEQ ID NO: 69952 - DNA, 20 bp, Artificial
  CRISPR gRNA sequence
ccaccacttggaggagctgg

SEQ ID NO: 69953 - DNA, 20 bp, Artificial
  CRISPR gRNA sequence
ggaggagctggagtgagttg

SEQ ID NO: 69954 - DNA, 20 bp, Artificial
  CRISPR gRNA sequence
gaggagctggagtgagttgc

SEQ ID NO: 69955 - DNA, 20 bp, Artificial
  CRISPR gRNA sequence
gagtgagttgcagagtggag

SEQ ID NO: 69956 - DNA, 20 bp, Artificial
  CRISPR gRNA sequence
cagagtggagggattgggga

SEQ ID NO: 69957 - DNA, 20 bp, Artificial
  CRISPR gRNA sequence
gggacaagtggcccagctga

SEQ ID NO: 69958 - DNA, 20 bp, Artificial
  CRISPR gRNA sequence
agggtgaggggtggagaaga

SEQ ID NO: 69959 - DNA, 20 bp, Artificial
  CRISPR gRNA sequence
gggagggcaggcaatgagac

SEQ ID NO: 69960 - DNA, 20 bp, Artificial
  CRISPR gRNA sequence
ggagggcaggcaatgagact

SEQ ID NO: 69961 - DNA, 20 bp, Artificial
  CRISPR gRNA sequence
caaccaatgacccttcccct

SEQ ID NO: 69962 - DNA, 20 bp, Artificial
  CRISPR gRNA sequence
aaccaatgacccttcccctg

SEQ ID NO: 69963 - DNA, 20 bp, Artificial
  CRISPR gRNA sequence
cccctgatgaagtgcagcag

SEQ ID NO: 69964 - DNA, 20 bp, Artificial
  CRISPR gRNA sequence
ccctgatgaagtgcagcagt

SEQ ID NO: 69965 - DNA, 20 bp, Artificial
  CRISPR gRNA sequence
atgaagtgcagcagttctgg

SEQ ID NO: 69966 - DNA, 20 bp, Artificial
  CRISPR gRNA sequence
tgggtgtggcctggggaagg

SEQ ID NO: 69967 - DNA, 20 bp, Artificial
  CRISPR gRNA sequence
ggtgtggcctggggaaggaa

SEQ ID NO: 69968 - DNA, 20 bp, Artificial
  CRISPR gRNA sequence
gggaaggaagagcaccacag

SEQ ID NO: 69969 - DNA, 20 bp, Artificial
  CRISPR gRNA sequence
tggtctgaatttcgccactg

SEQ ID NO: 69970 - DNA, 20 bp, Artificial
  CRISPR gRNA sequence
ggtctgaatttcgccactga

SEQ ID NO: 69971 - DNA, 20 bp, Artificial
  CRISPR gRNA sequence
gtctgaatttcgccactgac

SEQ ID NO: 69972 - DNA, 20 bp, Artificial
  CRISPR gRNA sequence
aatttcgccactgactcaca

SEQ ID NO: 69973 - DNA, 20 bp, Artificial
  CRISPR gRNA sequence
cgccactgactcacagaggg

SEQ ID NO: 69974 - DNA, 20 bp, Artificial
  CRISPR gRNA sequence
gccactgactcacagagggg

SEQ ID NO: 69975 - DNA, 20 bp, Artificial
  CRISPR gRNA sequence
actcacagaggggctgtggg

SEQ ID NO: 69976 - DNA, 20 bp, Artificial
  CRISPR gRNA sequence
acagaggggctgtgggcatg

SEQ ID NO: 69977 - DNA, 20 bp, Artificial
  CRISPR gRNA sequence
tgggcatggctgttccactc

SEQ ID NO: 69978 - DNA, 20 bp, Artificial
  CRISPR gRNA sequence
ttccactctgggctttgatt

SEQ ID NO: 69979 - DNA, 20 bp, Artificial
  CRISPR gRNA sequence
cactctgggctttgattgcc

SEQ ID NO: 69980 - DNA, 20 bp, Artificial
  CRISPR gRNA sequence
tgggctttgattgccttatc

SEQ ID NO: 69981 - DNA, 20 bp, Artificial
  CRISPR gRNA sequence
ggctttgattgccttatcta

SEQ ID NO: 69982 - DNA, 20 bp, Artificial
  CRISPR gRNA sequence
tgattgccttatctatgaaa

SEQ ID NO: 69983 - DNA, 20 bp, Artificial
  CRISPR gRNA sequence
gattgccttatctatgaaaa

SEQ ID NO: 69984 - DNA, 20 bp, Artificial
  CRISPR gRNA sequence
attgccttatctatgaaaat

SEQ ID NO: 69985 - DNA, 20 bp, Artificial
  CRISPR gRNA sequence
ccttatctatgaaaatgggg

SEQ ID NO: 69986 - DNA, 20 bp, Artificial
  CRISPR gRNA sequence
atctatgaaaatggggctca

SEQ ID NO: 69987 - DNA, 20 bp, Artificial
  CRISPR gRNA sequence
tctatgaaaatggggctcat

SEQ ID NO: 69988 - DNA, 20 bp, Artificial
  CRISPR gRNA sequence
tgaaaatggggctcatgagc

SEQ ID NO: 69989 - DNA, 20 bp, Artificial
  CRISPR gRNA sequence
atgagccttgctctgctggg

SEQ ID NO: 69990 - DNA, 20 bp, Artificial
  CRISPR gRNA sequence
gctctgctgggctggctgtg

SEQ ID NO: 69991 - DNA, 20 bp, Artificial
  CRISPR gRNA sequence
ctctgctgggctggctgtgg

SEQ ID NO: 69992 - DNA, 20 bp, Artificial
  CRISPR gRNA sequence
tgctgggctggctgtgggag

SEQ ID NO: 69993 - DNA, 20 bp, Artificial
  CRISPR gRNA sequence
ctgggctggctgtgggagtc

SEQ ID NO: 69994 - DNA, 20 bp, Artificial
  CRISPR gRNA sequence
ggctggctgtgggagtcagg

SEQ ID NO: 69995 - DNA, 20 bp, Artificial
  CRISPR gRNA sequence
gctgtgggagtcaggctacg

SEQ ID NO: 69996 - DNA, 20 bp, Artificial
  CRISPR gRNA sequence
tgggagtcaggctacggaga

SEQ ID NO: 69997 - DNA, 20 bp, Artificial
  CRISPR gRNA sequence
cggagagggctgaagaacaa

SEQ ID NO: 69998 - DNA, 20 bp, Artificial
  CRISPR gRNA sequence
aagaacaagagggtgtgtgt

SEQ ID NO: 69999 - DNA, 20 bp, Artificial
  CRISPR gRNA sequence
gtcccccagcttcctctctg

SEQ ID NO: 70000 - DNA, 20 bp, Artificial
  CRISPR gRNA sequence
cctctctgcagccttcatcc

SEQ ID NO: 70001 - DNA, 20 bp, Artificial
  CRISPR gRNA sequence
ctctctgcagccttcatcca

SEQ ID NO: 70002 - DNA, 20 bp, Artificial
  CRISPR gRNA sequence
tctgcagccttcatccaggg

SEQ ID NO: 70003 - DNA, 20 bp, Artificial
  CRISPR gRNA sequence
tgcagccttcatccagggca

SEQ ID NO: 70004 - DNA, 20 bp, Artificial
  CRISPR gRNA sequence
cagccttcatccagggcata

SEQ ID NO: 70005 - DNA, 20 bp, Artificial
  CRISPR gRNA sequence
catccagggcatagtttctc

SEQ ID NO: 70006 - DNA, 20 bp, Artificial
  CRISPR gRNA sequence
atccagggcatagtttctca

SEQ ID NO: 70007 - DNA, 20 bp, Artificial
  CRISPR gRNA sequence
ctcagctgggccagctgtga

SEQ ID NO: 70008 - DNA, 20 bp, Artificial
  CRISPR gRNA sequence
tcagctgggccagctgtgac

SEQ ID NO: 70009 - DNA, 20 bp, Artificial
  CRISPR gRNA sequence
agctgggccagctgtgacta

SEQ ID NO: 70010 - DNA, 20 bp, Artificial
  CRISPR gRNA sequence
ggccagctgtgactatcatg

SEQ ID NO: 70011 - DNA, 20 bp, Artificial
  CRISPR gRNA sequence
tgactatcatgcctacccag

SEQ ID NO: 70012 - DNA, 20 bp, Artificial
  CRISPR gRNA sequence
tcatgcctacccagagcctg

SEQ ID NO: 70013 - DNA, 20 bp, Artificial
  CRISPR gRNA sequence
cccagagcctgagccctgga

SEQ ID NO: 70014 - DNA, 20 bp, Artificial
  CRISPR gRNA sequence
agccctggagctagggatac

SEQ ID NO: 70015 - DNA, 20 bp, Artificial
  CRISPR gRNA sequence
gagctagggatacccatggg

SEQ ID NO: 70016 - DNA, 20 bp, Artificial
  CRISPR gRNA sequence
gggatacccatggggaacct

SEQ ID NO: 70017 - DNA, 20 bp, Artificial
  CRISPR gRNA sequence
gacagcgagggtggcccagg

SEQ ID NO: 70018 - DNA, 20 bp, Artificial
  CRISPR gRNA sequence
gcctcccaggggacagagca

SEQ ID NO: 70019 - DNA, 20 bp, Artificial
  CRISPR gRNA sequence
ccaggggacagagcaggaga

SEQ ID NO: 70020 - DNA, 20 bp, Artificial
  CRISPR gRNA sequence
acaggacagctcagctccag

SEQ ID NO: 70021 - DNA, 20 bp, Artificial
  CRISPR gRNA sequence
agctccagggctgggcaggc

SEQ ID NO: 70022 - DNA, 20 bp, Artificial
  CRISPR gRNA sequence
cagggctgggcaggctgcgc

SEQ ID NO: 70023 - DNA, 20 bp, Artificial
  CRISPR gRNA sequence
ggcaggctgcgctaaccctt

SEQ ID NO: 70024 - DNA, 20 bp, Artificial
  CRISPR gRNA sequence
cgctaacccttgcctctgcc

SEQ ID NO: 70025 - DNA, 20 bp, Artificial
  CRISPR gRNA sequence
acccttgcctctgcctggtc

SEQ ID NO: 70026 - DNA, 20 bp, Artificial
  CRISPR gRNA sequence
gcctctgcctggtcttctgc

SEQ ID NO: 70027 - DNA, 20 bp, Artificial
  CRISPR gRNA sequence
cctctgcctggtcttctgca

SEQ ID NO: 70028 - DNA, 20 bp, Artificial
  CRISPR gRNA sequence
tgcctggtcttctgcagctt

SEQ ID NO: 70029 - DNA, 20 bp, Artificial
  CRISPR gRNA sequence
cctggtcttctgcagcttgt

SEQ ID NO: 70030 - DNA, 20 bp, Artificial
  CRISPR gRNA sequence
gtcttctgcagcttgtctaa

SEQ ID NO: 70031 - DNA, 20 bp, Artificial
  CRISPR gRNA sequence
ctgcagcttgtctaacaatc

SEQ ID NO: 70032 - DNA, 20 bp, Artificial
  CRISPR gRNA sequence
tgcagcttgtctaacaatca

SEQ ID NO: 70033 - DNA, 20 bp, Artificial
  CRISPR gRNA sequence
cagcttgtctaacaatcaat

SEQ ID NO: 70034 - DNA, 20 bp, Artificial
  CRISPR gRNA sequence
gtctaacaatcaatttgatg

SEQ ID NO: 70035 - DNA, 20 bp, Artificial
  CRISPR gRNA sequence
tctaacaatcaatttgatga

SEQ ID NO: 70036 - DNA, 20 bp, Artificial
  CRISPR gRNA sequence
acaatcaatttgatgaggag

SEQ ID NO: 70037 - DNA, 20 bp, Artificial
  CRISPR gRNA sequence
gatgaggagggcaccaaggc

SEQ ID NO: 70038 - DNA, 20 bp, Artificial
  CRISPR gRNA sequence
atgaggagggcaccaaggcg

SEQ ID NO: 70039 - DNA, 20 bp, Artificial
  CRISPR gRNA sequence
atgagggcccttgaggggaa

SEQ ID NO: 70040 - DNA, 20 bp, Artificial
  CRISPR gRNA sequence
gaggggaaatggatgctaaa

SEQ ID NO: 70041 - DNA, 20 bp, Artificial
  CRISPR gRNA sequence
aggggaaatggatgctaaag

SEQ ID NO: 70042 - DNA, 20 bp, Artificial
  CRISPR gRNA sequence
aagaggctggagtaagtagt

SEQ ID NO: 70043 - DNA, 20 bp, Artificial
  CRISPR gRNA sequence
gagtaagtagtgatggtggt

SEQ ID NO: 70044 - DNA, 20 bp, Artificial
  CRISPR gRNA sequence
tgggtgagtgagtggtgggg

SEQ ID NO: 70045 - DNA, 20 bp, Artificial
  CRISPR gRNA sequence
atggatggtggaagtgggtg

SEQ ID NO: 70046 - DNA, 20 bp, Artificial
  CRISPR gRNA sequence
gttaatggatggtggaagtg

SEQ ID NO: 70047 - DNA, 20 bp, Artificial
  CRISPR gRNA sequence
atggatggtggaagtgggtg

SEQ ID NO: 70048 - DNA, 20 bp, Artificial
  CRISPR gRNA sequence
gttaatggggaatggggtga

SEQ ID NO: 70049 - DNA, 20 bp, Artificial
  CRISPR gRNA sequence
atggggaatggggtgagtga

SEQ ID NO: 70050 - DNA, 20 bp, Artificial
  CRISPR gRNA sequence
atggggaatgggctgagtga

SEQ ID NO: 70051 - DNA, 20 bp, Artificial
  CRISPR gRNA sequence
agtgagtggtgggagtggtt

SEQ ID NO: 70052 - DNA, 20 bp, Artificial
  CRISPR gRNA sequence
atggggaatggggtgagtga

SEQ ID NO: 70053 - DNA, 20 bp, Artificial
  CRISPR gRNA sequence
atggggaagggtgtgagagt

SEQ ID NO: 70054 - DNA, 20 bp, Artificial
  CRISPR gRNA sequence
atggggaagggggtgagtga

SEQ ID NO: 70055 - DNA, 20 bp, Artificial
  CRISPR gRNA sequence
atggggaagtgttgtgagtg

SEQ ID NO: 70056 - DNA, 20 bp, Artificial
  CRISPR gRNA sequence
tgagtgagttgtgttggtgg

SEQ ID NO: 70057 - DNA, 20 bp, Artificial
  CRISPR gRNA sequence
tgttggtggttaatggggaa

SEQ ID NO: 70058 - DNA, 20 bp, Artificial
  CRISPR gRNA sequence
gtggttaatggggaaggaga

SEQ ID NO: 70059 - DNA, 20 bp, Artificial
  CRISPR gRNA sequence
atggggaaggagatgagtga

SEQ ID NO: 70060 - DNA, 20 bp, Artificial
  CRISPR gRNA sequence
gtggttaatggggaagggtt

SEQ ID NO: 70061 - DNA, 20 bp, Artificial
  CRISPR gRNA sequence
atggggaagggttgtgagtg

SEQ ID NO: 70062 - DNA, 20 bp, Artificial
  CRISPR gRNA sequence
tgagtgagtggtggcgttgg

SEQ ID NO: 70063 - DNA, 20 bp, Artificial
  CRISPR gRNA sequence
gttaatggggaagggggtga

SEQ ID NO: 70064 - DNA, 20 bp, Artificial
  CRISPR gRNA sequence
atggggaagggggtgagtga

SEQ ID NO: 70065 - DNA, 20 bp, Artificial
  CRISPR gRNA sequence
atggggaagagttgtgagtg

SEQ ID NO: 70066 - DNA, 20 bp, Artificial
  CRISPR gRNA sequence
tgagtgagtggtgttggtgg

SEQ ID NO: 70067 - DNA, 20 bp, Artificial
  CRISPR gRNA sequence
gtggttaatggggaaggggg

SEQ ID NO: 70068 - DNA, 20 bp, Artificial
  CRISPR gRNA sequence
atggggaagggggtgagtga

SEQ ID NO: 70069 - DNA, 20 bp, Artificial
  CRISPR gRNA sequence
gttaatggggaagtgttgtg

SEQ ID NO: 70070 - DNA, 20 bp, Artificial
  CRISPR gRNA sequence
atggggaagtgttgtgagtg

SEQ ID NO: 70071 - DNA, 20 bp, Artificial
  CRISPR gRNA sequence
tgagtgagtggtgatggtga

SEQ ID NO: 70072 - DNA, 20 bp, Artificial
  CRISPR gRNA sequence
atggggaagggttgtgagtg

SEQ ID NO: 70073 - DNA, 20 bp, Artificial
  CRISPR gRNA sequence
tgagtgagtggcgttggtgg

SEQ ID NO: 70074 - DNA, 20 bp, Artificial
  CRISPR gRNA sequence
gtggttaatggggaagggag

SEQ ID NO: 70075 - DNA, 20 bp, Artificial
  CRISPR gRNA sequence
atggggaagggagggagtga

SEQ ID NO: 70076 - DNA, 20 bp, Artificial
  CRISPR gRNA sequence
atggggaagggttgtgagtg

SEQ ID NO: 70077 - DNA, 20 bp, Artificial
  CRISPR gRNA sequence
tgagtgagttgtggggttgg

SEQ ID NO: 70078 - DNA, 20 bp, Artificial
  CRISPR gRNA sequence
tggggttggttaatggggaa

SEQ ID NO: 70079 - DNA, 20 bp, Artificial
  CRISPR gRNA sequence
gttaatggggaagcgttgtg

SEQ ID NO: 70080 - DNA, 20 bp, Artificial
  CRISPR gRNA sequence
atggggaagcgttgtgagtg

SEQ ID NO: 70081 - DNA, 20 bp, Artificial
  CRISPR gRNA sequence
tgagtgagtggtgatggttg

SEQ ID NO: 70082 - DNA, 20 bp, Artificial
  CRISPR gRNA sequence
gttaatggggaagggttgtg

SEQ ID NO: 70083 - DNA, 20 bp, Artificial
  CRISPR gRNA sequence
atggggaagggttgtgagtg

SEQ ID NO: 70084 - DNA, 20 bp, Artificial
  CRISPR gRNA sequence
tgagtgagtggtgatggtgg

SEQ ID NO: 70085 - DNA, 20 bp, Artificial
  CRISPR gRNA sequence
atggggaagggggtgagtga

SEQ ID NO: 70086 - DNA, 20 bp, Artificial
  CRISPR gRNA sequence
gtggttaatggggaagtgtt

SEQ ID NO: 70087 - DNA, 20 bp, Artificial
  CRISPR gRNA sequence
atggggaagtgttgtgagtg

SEQ ID NO: 70088 - DNA, 20 bp, Artificial
  CRISPR gRNA sequence
tgagtgagtggtgatggtgg

SEQ ID NO: 70089 - DNA, 20 bp, Artificial
  CRISPR gRNA sequence
atggggaagggttgtgagtg

SEQ ID NO: 70090 - DNA, 20 bp, Artificial
  CRISPR gRNA sequence
tgagtgagtggtgttggtgg

SEQ ID NO: 70091 - DNA, 20 bp, Artificial
  CRISPR gRNA sequence
gtggttaatggggaaggggg

SEQ ID NO: 70092 - DNA, 20 bp, Artificial
  CRISPR gRNA sequence
atggggaagggggtgagtga

SEQ ID NO: 70093 - DNA, 20 bp, Artificial
  CRISPR gRNA sequence
atggggaagggttgtgagtg

SEQ ID NO: 70094 - DNA, 20 bp, Artificial
  CRISPR gRNA sequence
tgagtgagtggtggggttgg

SEQ ID NO: 70095 - DNA, 20 bp, Artificial
  CRISPR gRNA sequence
gttaacggggaagggggtga

SEQ ID NO: 70096 - DNA, 20 bp, Artificial
  CRISPR gRNA sequence
acggggaagggggtgagtga

SEQ ID NO: 70097 - DNA, 20 bp, Artificial
  CRISPR gRNA sequence
atggggaagggggtgagtga

SEQ ID NO: 70098 - DNA, 20 bp, Artificial
  CRISPR gRNA sequence
gtggttaatggggaaggggg

SEQ ID NO: 70099 - DNA, 20 bp, Artificial
  CRISPR gRNA sequence
atggggaagggggtgggtga

SEQ ID NO: 70100 - DNA, 20 bp, Artificial
  CRISPR gRNA sequence
atgggaagggagtgagtggt

SEQ ID NO: 70101 - DNA, 20 bp, Artificial
  CRISPR gRNA sequence
atggggaagggttgtgagtg

SEQ ID NO: 70102 - DNA, 20 bp, Artificial
  CRISPR gRNA sequence
tgagtgagtggtgatggtgg

SEQ ID NO: 70103 - DNA, 20 bp, Artificial
  CRISPR gRNA sequence
atggggaagggggtgagtaa

SEQ ID NO: 70104 - DNA, 20 bp, Artificial
  CRISPR gRNA sequence
atagggaagagttgtgagtg

SEQ ID NO: 70105 - DNA, 20 bp, Artificial
  CRISPR gRNA sequence
tgagtgagtggtggggttgg

SEQ ID NO: 70106 - DNA, 20 bp, Artificial
  CRISPR gRNA sequence
gttaatggggaagggggtga

SEQ ID NO: 70107 - DNA, 20 bp, Artificial
  CRISPR gRNA sequence
atggggaagggggtgagtga

SEQ ID NO: 70108 - DNA, 20 bp, Artificial
  CRISPR gRNA sequence
atggggaaaggagtgagtga

SEQ ID NO: 70109 - DNA, 20 bp, Artificial
  CRISPR gRNA sequence
agtgctgcatggtcagtgag

SEQ ID NO: 70110 - DNA, 20 bp, Artificial
  CRISPR gRNA sequence
gtgctgcatggtcagtgagt

SEQ ID NO: 70111 - DNA, 20 bp, Artificial
  CRISPR gRNA sequence
catggtcagtgagtagcatg

SEQ ID NO: 70112 - DNA, 20 bp, Artificial
  CRISPR gRNA sequence
ggaacctttgcatgttttgt

SEQ ID NO: 70113 - DNA, 20 bp, Artificial
  CRISPR gRNA sequence
tgcatgttttgtgaacacaa

SEQ ID NO: 70114 - DNA, 20 bp, Artificial
  CRISPR gRNA sequence
gcatgttttgtgaacacaaa

SEQ ID NO: 70115 - DNA, 20 bp, Artificial
  CRISPR gRNA sequence
catgttttgtgaacacaaac

SEQ ID NO: 70116 - DNA, 20 bp, Artificial
  CRISPR gRNA sequence
tgtgaacacaaaccgccatg

SEQ ID NO: 70117 - DNA, 20 bp, Artificial
  CRISPR gRNA sequence
gtgaacacaaaccgccatgt

SEQ ID NO: 70118 - DNA, 20 bp, Artificial
  CRISPR gRNA sequence
tgaacacaaaccgccatgtt

SEQ ID NO: 70119 - DNA, 20 bp, Artificial
  CRISPR gRNA sequence
ctggatggacccaggtgagc

SEQ ID NO: 70120 - DNA, 20 bp, Artificial
  CRISPR gRNA sequence
tggatggacccaggtgagct

SEQ ID NO: 70121 - DNA, 20 bp, Artificial
  CRISPR gRNA sequence
gatggacccaggtgagctga

SEQ ID NO: 70122 - DNA, 20 bp, Artificial
  CRISPR gRNA sequence
aatgcccttacatgaccttt

SEQ ID NO: 70123 - DNA, 20 bp, Artificial
  CRISPR gRNA sequence
acatgaccttttactttcta

SEQ ID NO: 70124 - DNA, 20 bp, Artificial
  CRISPR gRNA sequence
catgaccttttactttctat

SEQ ID NO: 70125 - DNA, 20 bp, Artificial
  CRISPR gRNA sequence
ttactttctattctggatct

SEQ ID NO: 70126 - DNA, 20 bp, Artificial
  CRISPR gRNA sequence
tactttctattctggatctc

SEQ ID NO: 70127 - DNA, 20 bp, Artificial
  CRISPR gRNA sequence
actttctattctggatctca

SEQ ID NO: 70128 - DNA, 20 bp, Artificial
  CRISPR gRNA sequence
ctttctattctggatctcag

SEQ ID NO: 70129 - DNA, 20 bp, Artificial
  CRISPR gRNA sequence
tctattctggatctcagtgc

SEQ ID NO: 70130 - DNA, 20 bp, Artificial
  CRISPR gRNA sequence
ctattctggatctcagtgcc

SEQ ID NO: 70131 - DNA, 20 bp, Artificial
  CRISPR gRNA sequence
tattctggatctcagtgcca

SEQ ID NO: 70132 - DNA, 20 bp, Artificial
  CRISPR gRNA sequence
ttctggatctcagtgccagc

SEQ ID NO: 70133 - DNA, 20 bp, Artificial
  CRISPR gRNA sequence
tggatctcagtgccagcaag

SEQ ID NO: 70134 - DNA, 20 bp, Artificial
  CRISPR gRNA sequence
gatctcagtgccagcaagaa

SEQ ID NO: 70135 - DNA, 20 bp, Artificial
  CRISPR gRNA sequence
agtgccagcaagaaccttgg

SEQ ID NO: 70136 - DNA, 20 bp, Artificial
  CRISPR gRNA sequence
ggtcataggaaacagaatac

SEQ ID NO: 70137 - DNA, 20 bp, Artificial
  CRISPR gRNA sequence
gtcataggaaacagaataca

SEQ ID NO: 70138 - DNA, 20 bp, Artificial
  CRISPR gRNA sequence
aaagcaatccaagacagaaa

SEQ ID NO: 70139 - DNA, 20 bp, Artificial
  CRISPR gRNA sequence
gcttatgtcatggaaaatta

SEQ ID NO: 70140 - DNA, 20 bp, Artificial
  CRISPR gRNA sequence
atgtcatggaaaattacgag

SEQ ID NO: 70141 - DNA, 20 bp, Artificial
  CRISPR gRNA sequence
tgtcatggaaaattacgagg

SEQ ID NO: 70142 - DNA, 20 bp, Artificial
  CRISPR gRNA sequence
cgaggccaatgacttcaggc

SEQ ID NO: 70143 - DNA, 20 bp, Artificial
  CRISPR gRNA sequence
caggcacagctggatccagg

SEQ ID NO: 70144 - DNA, 20 bp, Artificial
  CRISPR gRNA sequence
aggcacagctggatccaggg

SEQ ID NO: 70145 - DNA, 20 bp, Artificial
  CRISPR gRNA sequence
gatccaggggttctatattt

SEQ ID NO: 70146 - DNA, 20 bp, Artificial
  CRISPR gRNA sequence
tatatttgtcaggcttctct

SEQ ID NO: 70147 - DNA, 20 bp, Artificial
  CRISPR gRNA sequence
tatttgtcaggcttctctct

SEQ ID NO: 70148 - DNA, 20 bp, Artificial
  CRISPR gRNA sequence
gtcaggcttctctctcacac

SEQ ID NO: 70149 - DNA, 20 bp, Artificial
  CRISPR gRNA sequence
tcaggcttctctctcacaca

SEQ ID NO: 70150 - DNA, 20 bp, Artificial
  CRISPR gRNA sequence
ctctctcacacacttcactc

SEQ ID NO: 70151 - DNA, 20 bp, Artificial
  CRISPR gRNA sequence
tctctcacacacttcactct

SEQ ID NO: 70152 - DNA, 20 bp, Artificial
  CRISPR gRNA sequence
tctcacacacttcactctgg

SEQ ID NO: 70153 - DNA, 20 bp, Artificial
  CRISPR gRNA sequence
tcacacacttcactctggcc

SEQ ID NO: 70154 - DNA, 20 bp, Artificial
  CRISPR gRNA sequence
acacacttcactctggccct

SEQ ID NO: 70155 - DNA, 20 bp, Artificial
  CRISPR gRNA sequence
cactctggcccttactcttt

SEQ ID NO: 70156 - DNA, 20 bp, Artificial
  CRISPR gRNA sequence
actctggcccttactctttc

SEQ ID NO: 70157 - DNA, 20 bp, Artificial
  CRISPR gRNA sequence
tggcccttactctttctctg

SEQ ID NO: 70158 - DNA, 20 bp, Artificial
  CRISPR gRNA sequence
gcccttactctttctctgtc

SEQ ID NO: 70159 - DNA, 20 bp, Artificial
  CRISPR gRNA sequence
actctttctctgtccacctt

SEQ ID NO: 70160 - DNA, 20 bp, Artificial
  CRISPR gRNA sequence
ctctttctctgtccaccttg

SEQ ID NO: 70161 - DNA, 20 bp, Artificial
  CRISPR gRNA sequence
tttctctgtccaccttggct

SEQ ID NO: 70162 - DNA, 20 bp, Artificial
  CRISPR gRNA sequence
tctctgtccaccttggcttc

SEQ ID NO: 70163 - DNA, 20 bp, Artificial
  CRISPR gRNA sequence
ctctgtccaccttggcttcc

SEQ ID NO: 70164 - DNA, 20 bp, Artificial
  CRISPR gRNA sequence
tctgtccaccttggcttcct

SEQ ID NO: 70165 - DNA, 20 bp, Artificial
  CRISPR gRNA sequence
tgtccaccttggcttccttc

SEQ ID NO: 70166 - DNA, 20 bp, Artificial
  CRISPR gRNA sequence
tccaccttggcttccttctc

SEQ ID NO: 70167 - DNA, 20 bp, Artificial
  CRISPR gRNA sequence
ggcttccttctcaggcaggc

SEQ ID NO: 70168 - DNA, 20 bp, Artificial
  CRISPR gRNA sequence
gcttccttctcaggcaggcc

SEQ ID NO: 70169 - DNA, 20 bp, Artificial
  CRISPR gRNA sequence
ccttctcaggcaggccatcc

SEQ ID NO: 70170 - DNA, 20 bp, Artificial
  CRISPR gRNA sequence
cttctcaggcaggccatccc

SEQ ID NO: 70171 - DNA, 20 bp, Artificial
  CRISPR gRNA sequence
ctcaggcaggccatccctgc

SEQ ID NO: 70172 - DNA, 20 bp, Artificial
  CRISPR gRNA sequence
tcaggcaggccatccctgca

SEQ ID NO: 70173 - DNA, 20 bp, Artificial
  CRISPR gRNA sequence
aggcaggccatccctgcacc

SEQ ID NO: 70174 - DNA, 20 bp, Artificial
  CRISPR gRNA sequence
cacctgcaggcttactttct

SEQ ID NO: 70175 - DNA, 20 bp, Artificial
  CRISPR gRNA sequence
caggcttactttctctcagc

SEQ ID NO: 70176 - DNA, 20 bp, Artificial
  CRISPR gRNA sequence
actttctctcagcttagtgg

SEQ ID NO: 70177 - DNA, 20 bp, Artificial
  CRISPR gRNA sequence
ctttctctcagcttagtgga

SEQ ID NO: 70178 - DNA, 20 bp, Artificial
  CRISPR gRNA sequence
tctctcagcttagtggaaag

SEQ ID NO: 70179 - DNA, 20 bp, Artificial
  CRISPR gRNA sequence
ctctcagcttagtggaaagg

SEQ ID NO: 70180 - DNA, 20 bp, Artificial
  CRISPR gRNA sequence
tctcagcttagtggaaaggg

SEQ ID NO: 70181 - DNA, 20 bp, Artificial
  CRISPR gRNA sequence
tcagcttagtggaaagggag

SEQ ID NO: 70182 - DNA, 20 bp, Artificial
  CRISPR gRNA sequence
agcttagtggaaagggagta

SEQ ID NO: 70183 - DNA, 20 bp, Artificial
  CRISPR gRNA sequence
agtggaaagggagtaccatt

SEQ ID NO: 70184 - DNA, 20 bp, Artificial
  CRISPR gRNA sequence
gtggaaagggagtaccattc

SEQ ID NO: 70185 - DNA, 20 bp, Artificial
  CRISPR gRNA sequence
tctctgtggttacaacaaaa

SEQ ID NO: 70186 - DNA, 20 bp, Artificial
  CRISPR gRNA sequence
tctgtggttacaacaaaagg

SEQ ID NO: 70187 - DNA, 20 bp, Artificial
  CRISPR gRNA sequence
tgtggttacaacaaaaggtc

SEQ ID NO: 70188 - DNA, 20 bp, Artificial
  CRISPR gRNA sequence
tggttacaacaaaaggtcct

SEQ ID NO: 70189 - DNA, 20 bp, Artificial
  CRISPR gRNA sequence
caacaaaaggtcctagactg

SEQ ID NO: 70190 - DNA, 20 bp, Artificial
  CRISPR gRNA sequence
gactgagtctcactggacta

SEQ ID NO: 70191 - DNA, 20 bp, Artificial
  CRISPR gRNA sequence
agtctcactggactagcttg

SEQ ID NO: 70192 - DNA, 20 bp, Artificial
  CRISPR gRNA sequence
actggactagcttgagtcac

SEQ ID NO: 70193 - DNA, 20 bp, Artificial
  CRISPR gRNA sequence
gactagcttgagtcacctgc

SEQ ID NO: 70194 - DNA, 20 bp, Artificial
  CRISPR gRNA sequence
gcttgagtcacctgccccac

SEQ ID NO: 70195 - DNA, 20 bp, Artificial
  CRISPR gRNA sequence
gagtcacctgccccacccta

SEQ ID NO: 70196 - DNA, 20 bp, Artificial
  CRISPR gRNA sequence
agtcacctgccccaccctaa

SEQ ID NO: 70197 - DNA, 20 bp, Artificial
  CRISPR gRNA sequence
ccccaccctaaagcaatcac

SEQ ID NO: 70198 - DNA, 20 bp, Artificial
  CRISPR gRNA sequence
aagcaatcactgtggctgtg

SEQ ID NO: 70199 - DNA, 20 bp, Artificial
  CRISPR gRNA sequence
tggctgtgagcacaaaatat

SEQ ID NO: 70200 - DNA, 20 bp, Artificial
  CRISPR gRNA sequence
tgagcacaaaatattctcct

SEQ ID NO: 70201 - DNA, 20 bp, Artificial
  CRISPR gRNA sequence
tcctcactggccagacctgg

SEQ ID NO: 70202 - DNA, 20 bp, Artificial
  CRISPR gRNA sequence
ctcactggccagacctgggc

SEQ ID NO: 70203 - DNA, 20 bp, Artificial
  CRISPR gRNA sequence
actggccagacctgggcgca

SEQ ID NO: 70204 - DNA, 20 bp, Artificial
  CRISPR gRNA sequence
gccagacctgggcgcatgca

SEQ ID NO: 70205 - DNA, 20 bp, Artificial
  CRISPR gRNA sequence
ggcgcatgcacaccctatct

SEQ ID NO: 70206 - DNA, 20 bp, Artificial
  CRISPR gRNA sequence
tcttctggacttagaggggt

SEQ ID NO: 70207 - DNA, 20 bp, Artificial
  CRISPR gRNA sequence
ctggacttagaggggtggta

SEQ ID NO: 70208 - DNA, 20 bp, Artificial
  CRISPR gRNA sequence
tggacttagaggggtggtat

SEQ ID NO: 70209 - DNA, 20 bp, Artificial
  CRISPR gRNA sequence
gacttagaggggtggtattt

SEQ ID NO: 70210 - DNA, 20 bp, Artificial
  CRISPR gRNA sequence
agaggggtggtatttcagga

SEQ ID NO: 70211 - DNA, 20 bp, Artificial
  CRISPR gRNA sequence
gaggggtggtatttcaggat

SEQ ID NO: 70212 - DNA, 20 bp, Artificial
  CRISPR gRNA sequence
caggatgtgagtaacagaag

SEQ ID NO: 70213 - DNA, 20 bp, Artificial
  CRISPR gRNA sequence
aggatgtgagtaacagaaga

SEQ ID NO: 70214 - DNA, 20 bp, Artificial
  CRISPR gRNA sequence
tgggcagaaaaaaatctaca

SEQ ID NO: 70215 - DNA, 20 bp, Artificial
  CRISPR gRNA sequence
ggcagaaaaaaatctacaga

SEQ ID NO: 70216 - DNA, 20 bp, Artificial
  CRISPR gRNA sequence
cagatgtccactacatttgt

SEQ ID NO: 70217 - DNA, 20 bp, Artificial
  CRISPR gRNA sequence
catttgtctacagttgtttc

SEQ ID NO: 70218 - DNA, 20 bp, Artificial
  CRISPR gRNA sequence
gtctacagttgtttccttgg

SEQ ID NO: 70219 - DNA, 20 bp, Artificial
  CRISPR gRNA sequence
tctacagttgtttccttggt

SEQ ID NO: 70220 - DNA, 20 bp, Artificial
  CRISPR gRNA sequence
cagttgtttccttggtaact

SEQ ID NO: 70221 - DNA, 20 bp, Artificial
  CRISPR gRNA sequence
tttccttggtaactggcagc

SEQ ID NO: 70222 - DNA, 20 bp, Artificial
  CRISPR gRNA sequence
ccttggtaactggcagcttt

SEQ ID NO: 70223 - DNA, 20 bp, Artificial
  CRISPR gRNA sequence
cttggtaactggcagctttt

SEQ ID NO: 70224 - DNA, 20 bp, Artificial
  CRISPR gRNA sequence
ggtaactggcagcttttact

SEQ ID NO: 70225 - DNA, 20 bp, Artificial
  CRISPR gRNA sequence
gtaactggcagcttttacta

SEQ ID NO: 70226 - DNA, 20 bp, Artificial
  CRISPR gRNA sequence
gcagcttttactactctccc

SEQ ID NO: 70227 - DNA, 20 bp, Artificial
  CRISPR gRNA sequence
ttactactctcccccataat

SEQ ID NO: 70228 - DNA, 20 bp, Artificial
  CRISPR gRNA sequence
tactactctcccccataatt

SEQ ID NO: 70229 - DNA, 20 bp, Artificial
  CRISPR gRNA sequence
actactctcccccataattt

SEQ ID NO: 70230 - DNA, 20 bp, Artificial
  CRISPR gRNA sequence
ctactctcccccataatttg

SEQ ID NO: 70231 - DNA, 20 bp, Artificial
  CRISPR gRNA sequence
ctctcccccataatttgaag

SEQ ID NO: 70232 - DNA, 20 bp, Artificial
  CRISPR gRNA sequence
tcccccataatttgaagtca

SEQ ID NO: 70233 - DNA, 20 bp, Artificial
  CRISPR gRNA sequence
ccccataatttgaagtcatc

SEQ ID NO: 70234 - DNA, 20 bp, Artificial
  CRISPR gRNA sequence
gaagtcatcaaattcttaga

SEQ ID NO: 70235 - DNA, 20 bp, Artificial
  CRISPR gRNA sequence
aagtcatcaaattcttagaa

SEQ ID NO: 70236 - DNA, 20 bp, Artificial
  CRISPR gRNA sequence
ttagaaatgccagaaacagc

SEQ ID NO: 70237 - DNA, 20 bp, Artificial
  CRISPR gRNA sequence
agaaatgccagaaacagcct

SEQ ID NO: 70238 - DNA, 20 bp, Artificial
  CRISPR gRNA sequence
gaaatgccagaaacagcctc

SEQ ID NO: 70239 - DNA, 20 bp, Artificial
  CRISPR gRNA sequence
agtctaaaagacaggtcccc

SEQ ID NO: 70240 - DNA, 20 bp, Artificial
  CRISPR gRNA sequence
aaagacaggtccccgtcctg

SEQ ID NO: 70241 - DNA, 20 bp, Artificial
  CRISPR gRNA sequence
cacagattcctgtttagaca

SEQ ID NO: 70242 - DNA, 20 bp, Artificial
  CRISPR gRNA sequence
ctgtttagacagtatctgga

SEQ ID NO: 70243 - DNA, 20 bp, Artificial
  CRISPR gRNA sequence
tttagacagtatctggacag

SEQ ID NO: 70244 - DNA, 20 bp, Artificial
  CRISPR gRNA sequence
agacagtatctggacagaaa

SEQ ID NO: 70245 - DNA, 20 bp, Artificial
  CRISPR gRNA sequence
gacagtatctggacagaaaa

SEQ ID NO: 70246 - DNA, 20 bp, Artificial
  CRISPR gRNA sequence
gacagaaaatttaacagaat

SEQ ID NO: 70247 - DNA, 20 bp, Artificial
  CRISPR gRNA sequence
aacagaatatcttctgcttt

SEQ ID NO: 70248 - DNA, 20 bp, Artificial
  CRISPR gRNA sequence
acagaatatcttctgctttt

SEQ ID NO: 70249 - DNA, 20 bp, Artificial
  CRISPR gRNA sequence
ctgcttttcatctcttaact

SEQ ID NO: 70250 - DNA, 20 bp, Artificial
  CRISPR gRNA sequence
tgcttttcatctcttaactt

SEQ ID NO: 70251 - DNA, 20 bp, Artificial
  CRISPR gRNA sequence
cttttcatctcttaactttt

SEQ ID NO: 70252 - DNA, 20 bp, Artificial
  CRISPR gRNA sequence
ttcatctcttaactttttct

SEQ ID NO: 70253 - DNA, 20 bp, Artificial
  CRISPR gRNA sequence
tcatctcttaactttttctg

SEQ ID NO: 70254 - DNA, 20 bp, Artificial
  CRISPR gRNA sequence
catctcttaactttttctga

SEQ ID NO: 70255 - DNA, 20 bp, Artificial
  CRISPR gRNA sequence
atctcttaactttttctgat

SEQ ID NO: 70256 - DNA, 20 bp, Artificial
  CRISPR gRNA sequence
ttaactttttctgatgacca

SEQ ID NO: 70257 - DNA, 20 bp, Artificial
  CRISPR gRNA sequence
aactttttctgatgaccaaa

SEQ ID NO: 70258 - DNA, 20 bp, Artificial
  CRISPR gRNA sequence
actttttctgatgaccaaaa

SEQ ID NO: 70259 - DNA, 20 bp, Artificial
  CRISPR gRNA sequence
tttctgatgaccaaaaaagt

SEQ ID NO: 70260 - DNA, 20 bp, Artificial
  CRISPR gRNA sequence
ttctgatgaccaaaaaagtt

SEQ ID NO: 70261 - DNA, 20 bp, Artificial
  CRISPR gRNA sequence
tctgatgaccaaaaaagttc

SEQ ID NO: 70262 - DNA, 20 bp, Artificial
  CRISPR gRNA sequence
ctgatgaccaaaaaagttcc

SEQ ID NO: 70263 - DNA, 20 bp, Artificial
  CRISPR gRNA sequence
tgatgaccaaaaaagttcca

SEQ ID NO: 70264 - DNA, 20 bp, Artificial
  CRISPR gRNA sequence
atgaccaaaaaagttccatc

SEQ ID NO: 70265 - DNA, 20 bp, Artificial
  CRISPR gRNA sequence
catctttctagaaatatgta

SEQ ID NO: 70266 - DNA, 20 bp, Artificial
  CRISPR gRNA sequence
tctagaaatatgtaacaaat

SEQ ID NO: 70267 - DNA, 20 bp, Artificial
  CRISPR gRNA sequence
ctagaaatatgtaacaaata

SEQ ID NO: 70268 - DNA, 20 bp, Artificial
  CRISPR gRNA sequence
tagaaatatgtaacaaataa

SEQ ID NO: 70269 - DNA, 20 bp, Artificial
  CRISPR gRNA sequence
gaaatatgtaacaaataaca

SEQ ID NO: 70270 - DNA, 20 bp, Artificial
  CRISPR gRNA sequence
agaaaacttctgttgaacgg

SEQ ID NO: 70271 - DNA, 20 bp, Artificial
  CRISPR gRNA sequence
ctgttgaacggtttgtgaat

SEQ ID NO: 70272 - DNA, 20 bp, Artificial
  CRISPR gRNA sequence
tgttgaacggtttgtgaatt

SEQ ID NO: 70273 - DNA, 20 bp, Artificial
  CRISPR gRNA sequence
ttgaacggtttgtgaatttt

SEQ ID NO: 70274 - DNA, 20 bp, Artificial
  CRISPR gRNA sequence
aacggtttgtgaatttttct

SEQ ID NO: 70275 - DNA, 20 bp, Artificial
  CRISPR gRNA sequence
gtgaatttttctccagattt

SEQ ID NO: 70276 - DNA, 20 bp, Artificial
  CRISPR gRNA sequence
tgaatttttctccagatttt

SEQ ID NO: 70277 - DNA, 20 bp, Artificial
  CRISPR gRNA sequence
ttctccagatttttttttct

SEQ ID NO: 70278 - DNA, 20 bp, Artificial
  CRISPR gRNA sequence
tctccagatttttttttcta

SEQ ID NO: 70279 - DNA, 20 bp, Artificial
  CRISPR gRNA sequence
ctccagatttttttttctac

SEQ ID NO: 70280 - DNA, 20 bp, Artificial
  CRISPR gRNA sequence
tccagatttttttttctaca

SEQ ID NO: 70281 - DNA, 20 bp, Artificial
  CRISPR gRNA sequence
cagatttttttttctacata

SEQ ID NO: 70282 - DNA, 20 bp, Artificial
  CRISPR gRNA sequence
ttttttctacatatgttttg

SEQ ID NO: 70283 - DNA, 20 bp, Artificial
  CRISPR gRNA sequence
tttttctacatatgttttga

SEQ ID NO: 70284 - DNA, 20 bp, Artificial
  CRISPR gRNA sequence
ttttctacatatgttttgaa

SEQ ID NO: 70285 - DNA, 20 bp, Artificial
  CRISPR gRNA sequence
tttctacatatgttttgaat

SEQ ID NO: 70286 - DNA, 20 bp, Artificial
  CRISPR gRNA sequence
ttctacatatgttttgaatt

SEQ ID NO: 70287 - DNA, 20 bp, Artificial
  CRISPR gRNA sequence
tctacatatgttttgaattc

SEQ ID NO: 70288 - DNA, 20 bp, Artificial
  CRISPR gRNA sequence
ctacatatgttttgaattca

SEQ ID NO: 70289 - DNA, 20 bp, Artificial
  CRISPR gRNA sequence
tacatatgttttgaattcag

SEQ ID NO: 70290 - DNA, 20 bp, Artificial
  CRISPR gRNA sequence
catatgttttgaattcagct

SEQ ID NO: 70291 - DNA, 20 bp, Artificial
  CRISPR gRNA sequence
tgaattcagcttgaaagtag

SEQ ID NO: 70292 - DNA, 20 bp, Artificial
  CRISPR gRNA sequence
gaattcagcttgaaagtagc

SEQ ID NO: 70293 - DNA, 20 bp, Artificial
  CRISPR gRNA sequence
aattcagcttgaaagtagcc

SEQ ID NO: 70294 - DNA, 20 bp, Artificial
  CRISPR gRNA sequence
agcttgaaagtagccttttg

SEQ ID NO: 70295 - DNA, 20 bp, Artificial
  CRISPR gRNA sequence
gaaagtagccttttgacttt

SEQ ID NO: 70296 - DNA, 20 bp, Artificial
  CRISPR gRNA sequence
aaagtagccttttgactttt

SEQ ID NO: 70297 - DNA, 20 bp, Artificial
  CRISPR gRNA sequence
ttgactttttgccccttaac

SEQ ID NO: 70298 - DNA, 20 bp, Artificial
  CRISPR gRNA sequence
tgactttttgccccttaaca

SEQ ID NO: 70299 - DNA, 20 bp, Artificial
  CRISPR gRNA sequence
gactttttgccccttaacat

SEQ ID NO: 70300 - DNA, 20 bp, Artificial
  CRISPR gRNA sequence
actttttgccccttaacatt

SEQ ID NO: 70301 - DNA, 20 bp, Artificial
  CRISPR gRNA sequence
tttgccccttaacattgaaa

SEQ ID NO: 70302 - DNA, 20 bp, Artificial
  CRISPR gRNA sequence
ttgccccttaacattgaaat

SEQ ID NO: 70303 - DNA, 20 bp, Artificial
  CRISPR gRNA sequence
tgccccttaacattgaaatt

SEQ ID NO: 70304 - DNA, 20 bp, Artificial
  CRISPR gRNA sequence
gccccttaacattgaaattc

SEQ ID NO: 70305 - DNA, 20 bp, Artificial
  CRISPR gRNA sequence
ccccttaacattgaaattct

SEQ ID NO: 70306 - DNA, 20 bp, Artificial
  CRISPR gRNA sequence
aacattgaaattcttccgct

SEQ ID NO: 70307 - DNA, 20 bp, Artificial
  CRISPR gRNA sequence
acattgaaattcttccgctt

SEQ ID NO: 70308 - DNA, 20 bp, Artificial
  CRISPR gRNA sequence
aaattcttccgcttgtccct

SEQ ID NO: 70309 - DNA, 20 bp, Artificial
  CRISPR gRNA sequence
ttccgcttgtccctctttgc

SEQ ID NO: 70310 - DNA, 20 bp, Artificial
  CRISPR gRNA sequence
ccgcttgtccctctttgctt

SEQ ID NO: 70311 - DNA, 20 bp, Artificial
  CRISPR gRNA sequence
cgcttgtccctctttgcttg

SEQ ID NO: 70312 - DNA, 20 bp, Artificial
  CRISPR gRNA sequence
gtccctctttgcttgtcctg

SEQ ID NO: 70313 - DNA, 20 bp, Artificial
  CRISPR gRNA sequence
tccctctttgcttgtcctgg

SEQ ID NO: 70314 - DNA, 20 bp, Artificial
  CRISPR gRNA sequence
tttgcttgtcctggggagag

SEQ ID NO: 70315 - DNA, 20 bp, Artificial
  CRISPR gRNA sequence
tgcttgtcctggggagagga

SEQ ID NO: 70316 - DNA, 20 bp, Artificial
  CRISPR gRNA sequence
gcttgtcctggggagaggat

SEQ ID NO: 70317 - DNA, 20 bp, Artificial
  CRISPR gRNA sequence
cttgtcctggggagaggatc

SEQ ID NO: 70318 - DNA, 20 bp, Artificial
  CRISPR gRNA sequence
gtcctggggagaggatcagg

SEQ ID NO: 70319 - DNA, 20 bp, Artificial
  CRISPR gRNA sequence
tcctggggagaggatcaggt

SEQ ID NO: 70320 - DNA, 20 bp, Artificial
  CRISPR gRNA sequence
gggagaggatcaggtaaaag

SEQ ID NO: 70321 - DNA, 20 bp, Artificial
  CRISPR gRNA sequence
cagagacctttgaccacagg

SEQ ID NO: 70322 - DNA, 20 bp, Artificial
  CRISPR gRNA sequence
tgaccacagggccctcctgt

SEQ ID NO: 70323 - DNA, 20 bp, Artificial
  CRISPR gRNA sequence
gaccacagggccctcctgtc

SEQ ID NO: 70324 - DNA, 20 bp, Artificial
  CRISPR gRNA sequence
accacagggccctcctgtcg

SEQ ID NO: 70325 - DNA, 20 bp, Artificial
  CRISPR gRNA sequence
ctgtcgtctcactggtctgt

SEQ ID NO: 70326 - DNA, 20 bp, Artificial
  CRISPR gRNA sequence
tcgtctcactggtctgtttc

SEQ ID NO: 70327 - DNA, 20 bp, Artificial
  CRISPR gRNA sequence
actggtctgtttctttgccc

SEQ ID NO: 70328 - DNA, 20 bp, Artificial
  CRISPR gRNA sequence
gtctgtttctttgcccactg

SEQ ID NO: 70329 - DNA, 20 bp, Artificial
  CRISPR gRNA sequence
tttctttgcccactgtccat

SEQ ID NO: 70330 - DNA, 20 bp, Artificial
  CRISPR gRNA sequence
ctttgcccactgtccatgta

SEQ ID NO: 70331 - DNA, 20 bp, Artificial
  CRISPR gRNA sequence
tttgcccactgtccatgtac

SEQ ID NO: 70332 - DNA, 20 bp, Artificial
  CRISPR gRNA sequence
tgcccactgtccatgtacct

SEQ ID NO: 70333 - DNA, 20 bp, Artificial
  CRISPR gRNA sequence
gcccactgtccatgtacctg

SEQ ID NO: 70334 - DNA, 20 bp, Artificial
  CRISPR gRNA sequence
cccactgtccatgtacctgc

SEQ ID NO: 70335 - DNA, 20 bp, Artificial
  CRISPR gRNA sequence
tccatgtacctgcatctcgg

SEQ ID NO: 70336 - DNA, 20 bp, Artificial
  CRISPR gRNA sequence
catctcggctcagccttctg

SEQ ID NO: 70337 - DNA, 20 bp, Artificial
  CRISPR gRNA sequence
ggctcagccttctggaagct

SEQ ID NO: 70338 - DNA, 20 bp, Artificial
  CRISPR gRNA sequence
agccttctggaagcttttat

SEQ ID NO: 70339 - DNA, 20 bp, Artificial
  CRISPR gRNA sequence
ctggaagcttttatttaggg

SEQ ID NO: 70340 - DNA, 20 bp, Artificial
  CRISPR gRNA sequence
tggaagcttttatttagggg

SEQ ID NO: 70341 - DNA, 20 bp, Artificial
  CRISPR gRNA sequence
gaagcttttatttaggggat

SEQ ID NO: 70342 - DNA, 20 bp, Artificial
  CRISPR gRNA sequence
ttatttaggggattggaggc

SEQ ID NO: 70343 - DNA, 20 bp, Artificial
  CRISPR gRNA sequence
tatttaggggattggaggcc

SEQ ID NO: 70344 - DNA, 20 bp, Artificial
  CRISPR gRNA sequence
atttaggggattggaggccc

SEQ ID NO: 70345 - DNA, 20 bp, Artificial
  CRISPR gRNA sequence
tttaggggattggaggccca

SEQ ID NO: 70346 - DNA, 20 bp, Artificial
  CRISPR gRNA sequence
aggggattggaggcccagtg

SEQ ID NO: 70347 - DNA, 20 bp, Artificial
  CRISPR gRNA sequence
ggggattggaggcccagtga

SEQ ID NO: 70348 - DNA, 20 bp, Artificial
  CRISPR gRNA sequence
gaggcccagtgaggtcattc

SEQ ID NO: 70349 - DNA, 20 bp, Artificial
  CRISPR gRNA sequence
attggctcattcatgcattc

SEQ ID NO: 70350 - DNA, 20 bp, Artificial
  CRISPR gRNA sequence
gctcattcatgcattcgaca

SEQ ID NO: 70351 - DNA, 20 bp, Artificial
  CRISPR gRNA sequence
attcatgcattcgacaaata

SEQ ID NO: 70352 - DNA, 20 bp, Artificial
  CRISPR gRNA sequence
atgcattcgacaaatatgta

SEQ ID NO: 70353 - DNA, 20 bp, Artificial
  CRISPR gRNA sequence
gacaaatatgtactgagctg

SEQ ID NO: 70354 - DNA, 20 bp, Artificial
  CRISPR gRNA sequence
agctgggcacctgggccggg

SEQ ID NO: 70355 - DNA, 20 bp, Artificial
  CRISPR gRNA sequence
ggcacctgggccggggacag

SEQ ID NO: 70356 - DNA, 20 bp, Artificial
  CRISPR gRNA sequence
ggccggggacaggacagatt

SEQ ID NO: 70357 - DNA, 20 bp, Artificial
  CRISPR gRNA sequence
atccatgcccctgggggcct

SEQ ID NO: 70358 - DNA, 20 bp, Artificial
  CRISPR gRNA sequence
ggggcctttttcttcctcct

SEQ ID NO: 70359 - DNA, 20 bp, Artificial
  CRISPR gRNA sequence
tttcttcctcctgatttccc

SEQ ID NO: 70360 - DNA, 20 bp, Artificial
  CRISPR gRNA sequence
ttcttcctcctgatttccca

SEQ ID NO: 70361 - DNA, 20 bp, Artificial
  CRISPR gRNA sequence
tcttcctcctgatttcccag

SEQ ID NO: 70362 - DNA, 20 bp, Artificial
  CRISPR gRNA sequence
cttcctcctgatttcccagg

SEQ ID NO: 70363 - DNA, 20 bp, Artificial
  CRISPR gRNA sequence
ttcctcctgatttcccaggc

SEQ ID NO: 70364 - DNA, 20 bp, Artificial
  CRISPR gRNA sequence
cctcctgatttcccaggcac

SEQ ID NO: 70365 - DNA, 20 bp, Artificial
  CRISPR gRNA sequence
ctcctgatttcccaggcacc

SEQ ID NO: 70366 - DNA, 20 bp, Artificial
  CRISPR gRNA sequence
ctgatttcccaggcaccatg

SEQ ID NO: 70367 - DNA, 20 bp, Artificial
  CRISPR gRNA sequence
atttcccaggcaccatgtgc

SEQ ID NO: 70368 - DNA, 20 bp, Artificial
  CRISPR gRNA sequence
cccaggcaccatgtgctgct

SEQ ID NO: 70369 - DNA, 20 bp, Artificial
  CRISPR gRNA sequence
ccaggcaccatgtgctgctc

SEQ ID NO: 70370 - DNA, 20 bp, Artificial
  CRISPR gRNA sequence
ctccttacctcctgctgcct

SEQ ID NO: 70371 - DNA, 20 bp, Artificial
  CRISPR gRNA sequence
cttacctcctgctgccttag

SEQ ID NO: 70372 - DNA, 20 bp, Artificial
  CRISPR gRNA sequence
acctcctgctgccttagttg

SEQ ID NO: 70373 - DNA, 20 bp, Artificial
  CRISPR gRNA sequence
cctcctgctgccttagttgc

SEQ ID NO: 70374 - DNA, 20 bp, Artificial
  CRISPR gRNA sequence
ctgctgccttagttgcccta

SEQ ID NO: 70375 - DNA, 20 bp, Artificial
  CRISPR gRNA sequence
ctgccttagttgccctatct

SEQ ID NO: 70376 - DNA, 20 bp, Artificial
  CRISPR gRNA sequence
ccttagttgccctatctgta

SEQ ID NO: 70377 - DNA, 20 bp, Artificial
  CRISPR gRNA sequence
agttgccctatctgtaaact

SEQ ID NO: 70378 - DNA, 20 bp, Artificial
  CRISPR gRNA sequence
gttgccctatctgtaaactg

SEQ ID NO: 70379 - DNA, 20 bp, Artificial
  CRISPR gRNA sequence
ccctatctgtaaactgggca

SEQ ID NO: 70380 - DNA, 20 bp, Artificial
  CRISPR gRNA sequence
tctgtaaactgggcataata

SEQ ID NO: 70381 - DNA, 20 bp, Artificial
  CRISPR gRNA sequence
taaactgggcataatatctt

SEQ ID NO: 70382 - DNA, 20 bp, Artificial
  CRISPR gRNA sequence
ggcataatatcttccctgtc

SEQ ID NO: 70383 - DNA, 20 bp, Artificial
  CRISPR gRNA sequence
ccctgtccgaaggaagggga

SEQ ID NO: 70384 - DNA, 20 bp, Artificial
  CRISPR gRNA sequence
cctgtccgaaggaaggggat

SEQ ID NO: 70385 - DNA, 20 bp, Artificial
  CRISPR gRNA sequence
tccgaaggaaggggatggat

SEQ ID NO: 70386 - DNA, 20 bp, Artificial
  CRISPR gRNA sequence
ttcccatctcagatctgtca

SEQ ID NO: 70387 - DNA, 20 bp, Artificial
  CRISPR gRNA sequence
cccatctcagatctgtcatt

SEQ ID NO: 70388 - DNA, 20 bp, Artificial
  CRISPR gRNA sequence
ccatctcagatctgtcattt

SEQ ID NO: 70389 - DNA, 20 bp, Artificial
  CRISPR gRNA sequence
agatctgtcatttccaagtg

SEQ ID NO: 70390 - DNA, 20 bp, Artificial
  CRISPR gRNA sequence
tcatttccaagtgtaactcc

SEQ ID NO: 70391 - DNA, 20 bp, Artificial
  CRISPR gRNA sequence
ccaagtgtaactccccacag

SEQ ID NO: 70392 - DNA, 20 bp, Artificial
  CRISPR gRNA sequence
caagtgtaactccccacagg

SEQ ID NO: 70393 - DNA, 20 bp, Artificial
  CRISPR gRNA sequence
cccacaggcagttaccctca

SEQ ID NO: 70394 - DNA, 20 bp, Artificial
  CRISPR gRNA sequence
ccctcaaatccagtcagctt

SEQ ID NO: 70395 - DNA, 20 bp, Artificial
  CRISPR gRNA sequence
aaatccagtcagcttcttcc

SEQ ID NO: 70396 - DNA, 20 bp, Artificial
  CRISPR gRNA sequence
cttccagctgtatacctgtg

SEQ ID NO: 70397 - DNA, 20 bp, Artificial
  CRISPR gRNA sequence
ttccagctgtatacctgtga

SEQ ID NO: 70398 - DNA, 20 bp, Artificial
  CRISPR gRNA sequence
ccagctgtatacctgtgatg

SEQ ID NO: 70399 - DNA, 20 bp, Artificial
  CRISPR gRNA sequence
cagctgtatacctgtgatgg

SEQ ID NO: 70400 - DNA, 20 bp, Artificial
  CRISPR gRNA sequence
tatacctgtgatggagtggg

SEQ ID NO: 70401 - DNA, 20 bp, Artificial
  CRISPR gRNA sequence
tgatggagtgggtaggagca

SEQ ID NO: 70402 - DNA, 20 bp, Artificial
  CRISPR gRNA sequence
gttaggagcctcactgcctg

SEQ ID NO: 70403 - DNA, 20 bp, Artificial
  CRISPR gRNA sequence
ggagcctcactgcctgggtt

SEQ ID NO: 70404 - DNA, 20 bp, Artificial
  CRISPR gRNA sequence
actgcctgggttcaactctg

SEQ ID NO: 70405 - DNA, 20 bp, Artificial
  CRISPR gRNA sequence
cctgggttcaactctgggtg

SEQ ID NO: 70406 - DNA, 20 bp, Artificial
  CRISPR gRNA sequence
ggttcaactctgggtggggt

SEQ ID NO: 70407 - DNA, 20 bp, Artificial
  CRISPR gRNA sequence
aactctgggtggggtaactg

SEQ ID NO: 70408 - DNA, 20 bp, Artificial
  CRISPR gRNA sequence
tgggtggggtaactgacact

SEQ ID NO: 70409 - DNA, 20 bp, Artificial
  CRISPR gRNA sequence
ggtggggtaactgacacttc

SEQ ID NO: 70410 - DNA, 20 bp, Artificial
  CRISPR gRNA sequence
acacttccagtttgcttgga

SEQ ID NO: 70411 - DNA, 20 bp, Artificial
  CRISPR gRNA sequence
ccagtttgcttggagctttc

SEQ ID NO: 70412 - DNA, 20 bp, Artificial
  CRISPR gRNA sequence
cagtttgcttggagctttcc

SEQ ID NO: 70413 - DNA, 20 bp, Artificial
  CRISPR gRNA sequence
gcttggagctttccccattt

SEQ ID NO: 70414 - DNA, 20 bp, Artificial
  CRISPR gRNA sequence
cttggagctttccccatttt

SEQ ID NO: 70415 - DNA, 20 bp, Artificial
  CRISPR gRNA sequence
ggagctttccccattttggc

SEQ ID NO: 70416 - DNA, 20 bp, Artificial
  CRISPR gRNA sequence
gagctttccccattttggca

SEQ ID NO: 70417 - DNA, 20 bp, Artificial
  CRISPR gRNA sequence
tccccattttggcacccaaa

SEQ ID NO: 70418 - DNA, 20 bp, Artificial
  CRISPR gRNA sequence
ccccattttggcacccaaag

SEQ ID NO: 70419 - DNA, 20 bp, Artificial
  CRISPR gRNA sequence
cccattttggcacccaaagt

SEQ ID NO: 70420 - DNA, 20 bp, Artificial
  CRISPR gRNA sequence
tggcacccaaagtcccacat

SEQ ID NO: 70421 - DNA, 20 bp, Artificial
  CRISPR gRNA sequence
ggcacccaaagtcccacatc

SEQ ID NO: 70422 - DNA, 20 bp, Artificial
  CRISPR gRNA sequence
gcacccaaagtcccacatcc

SEQ ID NO: 70423 - DNA, 20 bp, Artificial
  CRISPR gRNA sequence
ttctgttctgagccaaccaa

SEQ ID NO: 70424 - DNA, 20 bp, Artificial
  CRISPR gRNA sequence
ctgttctgagccaaccaaga

SEQ ID NO: 70425 - DNA, 20 bp, Artificial
  CRISPR gRNA sequence
tgttctgagccaaccaagac

SEQ ID NO: 70426 - DNA, 20 bp, Artificial
  CRISPR gRNA sequence
ttctgagccaaccaagacag

SEQ ID NO: 70427 - DNA, 20 bp, Artificial
  CRISPR gRNA sequence
tgagccaaccaagacagttg

SEQ ID NO: 70428 - DNA, 20 bp, Artificial
  CRISPR gRNA sequence
agccaaccaagacagttgac

SEQ ID NO: 70429 - DNA, 20 bp, Artificial
  CRISPR gRNA sequence
accatcttttgcttctgcct

SEQ ID NO: 70430 - DNA, 20 bp, Artificial
  CRISPR gRNA sequence
ttgcttctgcctcttatttt

SEQ ID NO: 70431 - DNA, 20 bp, Artificial
  CRISPR gRNA sequence
tgcttctgcctcttatttta

SEQ ID NO: 70432 - DNA, 20 bp, Artificial
  CRISPR gRNA sequence
gcttctgcctcttattttat

SEQ ID NO: 70433 - DNA, 20 bp, Artificial
  CRISPR gRNA sequence
cttctgcctcttattttatt

SEQ ID NO: 70434 - DNA, 20 bp, Artificial
  CRISPR gRNA sequence
ctgcctcttattttattatt

SEQ ID NO: 70435 - DNA, 20 bp, Artificial
  CRISPR gRNA sequence
tgcctcttattttattattt

SEQ ID NO: 70436 - DNA, 20 bp, Artificial
  CRISPR gRNA sequence
cctcttattttattatttat

SEQ ID NO: 70437 - DNA, 20 bp, Artificial
  CRISPR gRNA sequence
ttattttattatttatttat

SEQ ID NO: 70438 - DNA, 20 bp, Artificial
  CRISPR gRNA sequence
attttattatttatttattt

SEQ ID NO: 70439 - DNA, 20 bp, Artificial
  CRISPR gRNA sequence
ttttattatttatttatttg

SEQ ID NO: 70440 - DNA, 20 bp, Artificial
  CRISPR gRNA sequence
tattatttatttatttgaga

SEQ ID NO: 70441 - DNA, 20 bp, Artificial
  CRISPR gRNA sequence
attatttatttatttgagac

SEQ ID NO: 70442 - DNA, 20 bp, Artificial
  CRISPR gRNA sequence
ttatttatttatttgagacc

SEQ ID NO: 70443 - DNA, 20 bp, Artificial
  CRISPR gRNA sequence
tttatttatttgagacccag

SEQ ID NO: 70444 - DNA, 20 bp, Artificial
  CRISPR gRNA sequence
atttatttgagacccagtct

SEQ ID NO: 70445 - DNA, 20 bp, Artificial
  CRISPR gRNA sequence
tttatttgagacccagtctc

SEQ ID NO: 70446 - DNA, 20 bp, Artificial
  CRISPR gRNA sequence
atttgagacccagtctctct

SEQ ID NO: 70447 - DNA, 20 bp, Artificial
  CRISPR gRNA sequence
tttgagacccagtctctctc

SEQ ID NO: 70448 - DNA, 20 bp, Artificial
  CRISPR gRNA sequence
gagacccagtctctctccgt

SEQ ID NO: 70449 - DNA, 20 bp, Artificial
  CRISPR gRNA sequence
agacccagtctctctccgtt

SEQ ID NO: 70450 - DNA, 20 bp, Artificial
  CRISPR gRNA sequence
tctccgttgcccaggctgga

SEQ ID NO: 70451 - DNA, 20 bp, Artificial
  CRISPR gRNA sequence
tccgttgcccaggctggagt

SEQ ID NO: 70452 - DNA, 20 bp, Artificial
  CRISPR gRNA sequence
cgttgcccaggctggagtgc

SEQ ID NO: 70453 - DNA, 20 bp, Artificial
  CRISPR gRNA sequence
cccaggctggagtgcagtgg

SEQ ID NO: 70454 - DNA, 20 bp, Artificial
  CRISPR gRNA sequence
gagtgcagtggcacagtctt

SEQ ID NO: 70455 - DNA, 20 bp, Artificial
  CRISPR gRNA sequence
ggctcactgcaacctccgcc

SEQ ID NO: 70456 - DNA, 20 bp, Artificial
  CRISPR gRNA sequence
gctcactgcaacctccgcct

SEQ ID NO: 70457 - DNA, 20 bp, Artificial
  CRISPR gRNA sequence
actgcaacctccgcctcccg

SEQ ID NO: 70458 - DNA, 20 bp, Artificial
  CRISPR gRNA sequence
caacctccgcctcccgggtt

SEQ ID NO: 70459 - DNA, 20 bp, Artificial
  CRISPR gRNA sequence
cgcctcccgggttcaagcaa

SEQ ID NO: 70460 - DNA, 20 bp, Artificial
  CRISPR gRNA sequence
ccgggttcaagcaaccctcc

SEQ ID NO: 70461 - DNA, 20 bp, Artificial
  CRISPR gRNA sequence
aagcaaccctcctgcctcag

SEQ ID NO: 70462 - DNA, 20 bp, Artificial
  CRISPR gRNA sequence
ctgcctcagcctcccaagta

SEQ ID NO: 70463 - DNA, 20 bp, Artificial
  CRISPR gRNA sequence
cctcagcctcccaagtagct

SEQ ID NO: 70464 - DNA, 20 bp, Artificial
  CRISPR gRNA sequence
agcctcccaagtagctggca

SEQ ID NO: 70465 - DNA, 20 bp, Artificial
  CRISPR gRNA sequence
ccaagtagctggcattacag

SEQ ID NO: 70466 - DNA, 20 bp, Artificial
  CRISPR gRNA sequence
gcattacaggcacatgccac

SEQ ID NO: 70467 - DNA, 20 bp, Artificial
  CRISPR gRNA sequence
caggcacatgccaccaggcc

SEQ ID NO: 70468 - DNA, 20 bp, Artificial
  CRISPR gRNA sequence
atttttctatttttagtgga

SEQ ID NO: 70469 - DNA, 20 bp, Artificial
  CRISPR gRNA sequence
ttctatttttagtggagatg

SEQ ID NO: 70470 - DNA, 20 bp, Artificial
  CRISPR gRNA sequence
tctatttttagtggagatgg

SEQ ID NO: 70471 - DNA, 20 bp, Artificial
  CRISPR gRNA sequence
ctatttttagtggagatggg

SEQ ID NO: 70472 - DNA, 20 bp, Artificial
  CRISPR gRNA sequence
tatttttagtggagatgggg

SEQ ID NO: 70473 - DNA, 20 bp, Artificial
  CRISPR gRNA sequence
tttttagtggagatggggtt

SEQ ID NO: 70474 - DNA, 20 bp, Artificial
  CRISPR gRNA sequence
ttagtggagatggggtttca

SEQ ID NO: 70475 - DNA, 20 bp, Artificial
  CRISPR gRNA sequence
tagtggagatggggtttcac

SEQ ID NO: 70476 - DNA, 20 bp, Artificial
  CRISPR gRNA sequence
agtggagatggggtttcact

SEQ ID NO: 70477 - DNA, 20 bp, Artificial
  CRISPR gRNA sequence
gtggagatggggtttcactt

SEQ ID NO: 70478 - DNA, 20 bp, Artificial
  CRISPR gRNA sequence
cactttgttggccaggctgg

SEQ ID NO: 70479 - DNA, 20 bp, Artificial
  CRISPR gRNA sequence
actttgttggccaggctggt

SEQ ID NO: 70480 - DNA, 20 bp, Artificial
  CRISPR gRNA sequence
tgttggccaggctggtctcg

SEQ ID NO: 70481 - DNA, 20 bp, Artificial
  CRISPR gRNA sequence
gttggccaggctggtctcga

SEQ ID NO: 70482 - DNA, 20 bp, Artificial
  CRISPR gRNA sequence
ttggccaggctggtctcgaa

SEQ ID NO: 70483 - DNA, 20 bp, Artificial
  CRISPR gRNA sequence
gccaggctggtctcgaactc

SEQ ID NO: 70484 - DNA, 20 bp, Artificial
  CRISPR gRNA sequence
gtctcgaactcctgacctca

SEQ ID NO: 70485 - DNA, 20 bp, Artificial
  CRISPR gRNA sequence
gaactcctgacctcaggtga

SEQ ID NO: 70486 - DNA, 20 bp, Artificial
  CRISPR gRNA sequence
ctgacctcaggtgattcacc

SEQ ID NO: 70487 - DNA, 20 bp, Artificial
  CRISPR gRNA sequence
acctcaggtgattcacccgc

SEQ ID NO: 70488 - DNA, 20 bp, Artificial
  CRISPR gRNA sequence
aggtgattcacccgccttgg

SEQ ID NO: 70489 - DNA, 20 bp, Artificial
  CRISPR gRNA sequence
acccgccttggcctcacaaa

SEQ ID NO: 70490 - DNA, 20 bp, Artificial
  CRISPR gRNA sequence
ggcctcacaaagtcctggga

SEQ ID NO: 70491 - DNA, 20 bp, Artificial
  CRISPR gRNA sequence
gcctcacaaagtcctgggat

SEQ ID NO: 70492 - DNA, 20 bp, Artificial
  CRISPR gRNA sequence
acaaagtcctgggattacag

SEQ ID NO: 70493 - DNA, 20 bp, Artificial
  CRISPR gRNA sequence
ggattacaggcatgagccat

SEQ ID NO: 70494 - DNA, 20 bp, Artificial
  CRISPR gRNA sequence
caggcatgagccattgcgcc

SEQ ID NO: 70495 - DNA, 20 bp, Artificial
  CRISPR gRNA sequence
cgcccagccagttctgtttc

SEQ ID NO: 70496 - DNA, 20 bp, Artificial
  CRISPR gRNA sequence
tgtttcttaatgtgtgaact

SEQ ID NO: 70497 - DNA, 20 bp, Artificial
  CRISPR gRNA sequence
tttcttaatgtgtgaactcg

SEQ ID NO: 70498 - DNA, 20 bp, Artificial
  CRISPR gRNA sequence
cttaatgtgtgaactcgtgc

SEQ ID NO: 70499 - DNA, 20 bp, Artificial
  CRISPR gRNA sequence
ttaatgtgtgaactcgtgcc

SEQ ID NO: 70500 - DNA, 20 bp, Artificial
  CRISPR gRNA sequence
aatgtgtgaactcgtgccag

SEQ ID NO: 70501 - DNA, 20 bp, Artificial
  CRISPR gRNA sequence
atgtgtgaactcgtgccagt

SEQ ID NO: 70502 - DNA, 20 bp, Artificial
  CRISPR gRNA sequence
gtgccagtccctcagcctct

SEQ ID NO: 70503 - DNA, 20 bp, Artificial
  CRISPR gRNA sequence
agcctctctgttctttggcc

SEQ ID NO: 70504 - DNA, 20 bp, Artificial
  CRISPR gRNA sequence
tctgttctttggcctcctca

SEQ ID NO: 70505 - DNA, 20 bp, Artificial
  CRISPR gRNA sequence
tgttctttggcctcctcatc

SEQ ID NO: 70506 - DNA, 20 bp, Artificial
  CRISPR gRNA sequence
ttctttggcctcctcatctt

SEQ ID NO: 70507 - DNA, 20 bp, Artificial
  CRISPR gRNA sequence
tttggcctcctcatcttaac

SEQ ID NO: 70508 - DNA, 20 bp, Artificial
  CRISPR gRNA sequence
tggcctcctcatcttaactt

SEQ ID NO: 70509 - DNA, 20 bp, Artificial
  CRISPR gRNA sequence
ggcctcctcatcttaacttt

SEQ ID NO: 70510 - DNA, 20 bp, Artificial
  CRISPR gRNA sequence
gcctcctcatcttaactttg

SEQ ID NO: 70511 - DNA, 20 bp, Artificial
  CRISPR gRNA sequence
ctcatcttaactttgaggat

SEQ ID NO: 70512 - DNA, 20 bp, Artificial
  CRISPR gRNA sequence
atcttaactttgaggataag

SEQ ID NO: 70513 - DNA, 20 bp, Artificial
  CRISPR gRNA sequence
aactttgaggataagagcaa

SEQ ID NO: 70514 - DNA, 20 bp, Artificial
  CRISPR gRNA sequence
actttgaggataagagcaat

SEQ ID NO: 70515 - DNA, 20 bp, Artificial
  CRISPR gRNA sequence
tgaggataagagcaatctcc

SEQ ID NO: 70516 - DNA, 20 bp, Artificial
  CRISPR gRNA sequence
gaggataagagcaatctccc

SEQ ID NO: 70517 - DNA, 20 bp, Artificial
  CRISPR gRNA sequence
aggataagagcaatctcccc

SEQ ID NO: 70518 - DNA, 20 bp, Artificial
  CRISPR gRNA sequence
ccctgctacggttgttgtga

SEQ ID NO: 70519 - DNA, 20 bp, Artificial
  CRISPR gRNA sequence
ctacggttgttgtgagtatt

SEQ ID NO: 70520 - DNA, 20 bp, Artificial
  CRISPR gRNA sequence
cggttgttgtgagtattaaa

SEQ ID NO: 70521 - DNA, 20 bp, Artificial
  CRISPR gRNA sequence
ttgtgagtattaaatgagat

SEQ ID NO: 70522 - DNA, 20 bp, Artificial
  CRISPR gRNA sequence
tgagtattaaatgagataat

SEQ ID NO: 70523 - DNA, 20 bp, Artificial
  CRISPR gRNA sequence
aatgagataatatgtgttac

SEQ ID NO: 70524 - DNA, 20 bp, Artificial
  CRISPR gRNA sequence
cagtcttagagtctggtcag

SEQ ID NO: 70525 - DNA, 20 bp, Artificial
  CRISPR gRNA sequence
agagtctggtcagagttcac

SEQ ID NO: 70526 - DNA, 20 bp, Artificial
  CRISPR gRNA sequence
gagtctggtcagagttcaca

SEQ ID NO: 70527 - DNA, 20 bp, Artificial
  CRISPR gRNA sequence
gtcagagttcacactctaca

SEQ ID NO: 70528 - DNA, 20 bp, Artificial
  CRISPR gRNA sequence
acactctacaagtgctagct

SEQ ID NO: 70529 - DNA, 20 bp, Artificial
  CRISPR gRNA sequence
tacaagtgctagctattgtt

SEQ ID NO: 70530 - DNA, 20 bp, Artificial
  CRISPR gRNA sequence
caagtgctagctattgttat

SEQ ID NO: 70531 - DNA, 20 bp, Artificial
  CRISPR gRNA sequence
gctattgttattctcctctc

SEQ ID NO: 70532 - DNA, 20 bp, Artificial
  CRISPR gRNA sequence
ttgttattctcctctcctgc

SEQ ID NO: 70533 - DNA, 20 bp, Artificial
  CRISPR gRNA sequence
ttattctcctctcctgccta

SEQ ID NO: 70534 - DNA, 20 bp, Artificial
  CRISPR gRNA sequence
ttctcctctcctgcctaggc

SEQ ID NO: 70535 - DNA, 20 bp, Artificial
  CRISPR gRNA sequence
tcctctcctgcctaggctgg

SEQ ID NO: 70536 - DNA, 20 bp, Artificial
  CRISPR gRNA sequence
ctctcctgcctaggctgggg

SEQ ID NO: 70537 - DNA, 20 bp, Artificial
  CRISPR gRNA sequence
tcctgcctaggctgggggcc

SEQ ID NO: 70538 - DNA, 20 bp, Artificial
  CRISPR gRNA sequence
ctgcctaggctgggggcctc

SEQ ID NO: 70539 - DNA, 20 bp, Artificial
  CRISPR gRNA sequence
cctaggctgggggcctctag

SEQ ID NO: 70540 - DNA, 20 bp, Artificial
  CRISPR gRNA sequence
ggctgggggcctctagaagt

SEQ ID NO: 70541 - DNA, 20 bp, Artificial
  CRISPR gRNA sequence
ggggcctctagaagtacaat

SEQ ID NO: 70542 - DNA, 20 bp, Artificial
  CRISPR gRNA sequence
tagaagtacaatcgcctggg

SEQ ID NO: 70543 - DNA, 20 bp, Artificial
  CRISPR gRNA sequence
gaagtacaatcgcctgggtc

SEQ ID NO: 70544 - DNA, 20 bp, Artificial
  CRISPR gRNA sequence
ggtcacatatggttggggct

SEQ ID NO: 70545 - DNA, 20 bp, Artificial
  CRISPR gRNA sequence
gggctcaggaatgggagttc

SEQ ID NO: 70546 - DNA, 20 bp, Artificial
  CRISPR gRNA sequence
aggaatgggagttctatagt

SEQ ID NO: 70547 - DNA, 20 bp, Artificial
  CRISPR gRNA sequence
tatagtttttggttctgttc

SEQ ID NO: 70548 - DNA, 20 bp, Artificial
  CRISPR gRNA sequence
tagtttttggttctgttcct

SEQ ID NO: 70549 - DNA, 20 bp, Artificial
  CRISPR gRNA sequence
ttggttctgttcctgaagca

SEQ ID NO: 70550 - DNA, 20 bp, Artificial
  CRISPR gRNA sequence
tggttctgttcctgaagcag

SEQ ID NO: 70551 - DNA, 20 bp, Artificial
  CRISPR gRNA sequence
ggttctgttcctgaagcagc

SEQ ID NO: 70552 - DNA, 20 bp, Artificial
  CRISPR gRNA sequence
gttctgttcctgaagcagcc

SEQ ID NO: 70553 - DNA, 20 bp, Artificial
  CRISPR gRNA sequence
tgttcctgaagcagccactt

SEQ ID NO: 70554 - DNA, 20 bp, Artificial
  CRISPR gRNA sequence
ttcctgaagcagccactttg

SEQ ID NO: 70555 - DNA, 20 bp, Artificial
  CRISPR gRNA sequence
ctgaagcagccactttgtgt

SEQ ID NO: 70556 - DNA, 20 bp, Artificial
  CRISPR gRNA sequence
aagcagccactttgtgtatg

SEQ ID NO: 70557 - DNA, 20 bp, Artificial
  CRISPR gRNA sequence
tgtgtatgaccttaagcaag

SEQ ID NO: 70558 - DNA, 20 bp, Artificial
  CRISPR gRNA sequence
gtgtatgaccttaagcaagt

SEQ ID NO: 70559 - DNA, 20 bp, Artificial
  CRISPR gRNA sequence
tgtatgaccttaagcaagtt

SEQ ID NO: 70560 - DNA, 20 bp, Artificial
  CRISPR gRNA sequence
aagcaagttctctaactctc

SEQ ID NO: 70561 - DNA, 20 bp, Artificial
  CRISPR gRNA sequence
agcaagttctctaactctct

SEQ ID NO: 70562 - DNA, 20 bp, Artificial
  CRISPR gRNA sequence
tctaactctctgaaccttgg

SEQ ID NO: 70563 - DNA, 20 bp, Artificial
  CRISPR gRNA sequence
taactctctgaaccttggtg

SEQ ID NO: 70564 - DNA, 20 bp, Artificial
  CRISPR gRNA sequence
actctctgaaccttggtgtt

SEQ ID NO: 70565 - DNA, 20 bp, Artificial
  CRISPR gRNA sequence
tctgaaccttggtgttcctc

SEQ ID NO: 70566 - DNA, 20 bp, Artificial
  CRISPR gRNA sequence
tgaaccttggtgttcctcac

SEQ ID NO: 70567 - DNA, 20 bp, Artificial
  CRISPR gRNA sequence
aaccttggtgttcctcacct

SEQ ID NO: 70568 - DNA, 20 bp, Artificial
  CRISPR gRNA sequence
ggtgttcctcacctgtaaaa

SEQ ID NO: 70569 - DNA, 20 bp, Artificial
  CRISPR gRNA sequence
gtgttcctcacctgtaaaat

SEQ ID NO: 70570 - DNA, 20 bp, Artificial
  CRISPR gRNA sequence
ctcacctgtaaaatggggac

SEQ ID NO: 70571 - DNA, 20 bp, Artificial
  CRISPR gRNA sequence
acctgtaaaatggggacgat

SEQ ID NO: 70572 - DNA, 20 bp, Artificial
  CRISPR gRNA sequence
taaaatggggacgataataa

SEQ ID NO: 70573 - DNA, 20 bp, Artificial
  CRISPR gRNA sequence
tccagatggccccaagccct

SEQ ID NO: 70574 - DNA, 20 bp, Artificial
  CRISPR gRNA sequence
ccagatggccccaagccctg

SEQ ID NO: 70575 - DNA, 20 bp, Artificial
  CRISPR gRNA sequence
cagatggccccaagccctga

SEQ ID NO: 70576 - DNA, 20 bp, Artificial
  CRISPR gRNA sequence
agtttggcccacattttatg

SEQ ID NO: 70577 - DNA, 20 bp, Artificial
  CRISPR gRNA sequence
ggcccacattttatgatcaa

SEQ ID NO: 70578 - DNA, 20 bp, Artificial
  CRISPR gRNA sequence
gcccacattttatgatcaat

SEQ ID NO: 70579 - DNA, 20 bp, Artificial
  CRISPR gRNA sequence
tatgatcaatgtgtgaccgc

SEQ ID NO: 70580 - DNA, 20 bp, Artificial
  CRISPR gRNA sequence
atgatcaatgtgtgaccgcc

SEQ ID NO: 70581 - DNA, 20 bp, Artificial
  CRISPR gRNA sequence
tgatcaatgtgtgaccgcca

SEQ ID NO: 70582 - DNA, 20 bp, Artificial
  CRISPR gRNA sequence
ttacggatcattagtcttgg

SEQ ID NO: 70583 - DNA, 20 bp, Artificial
  CRISPR gRNA sequence
cggatcattagtcttggtcc

SEQ ID NO: 70584 - DNA, 20 bp, Artificial
  CRISPR gRNA sequence
gtcttggtccatgtggttca

SEQ ID NO: 70585 - DNA, 20 bp, Artificial
  CRISPR gRNA sequence
ggtccatgtggttcagaaca

SEQ ID NO: 70586 - DNA, 20 bp, Artificial
  CRISPR gRNA sequence
gtccatgtggttcagaacat

SEQ ID NO: 70587 - DNA, 20 bp, Artificial
  CRISPR gRNA sequence
agaacatagaactgctgcct

SEQ ID NO: 70588 - DNA, 20 bp, Artificial
  CRISPR gRNA sequence
ctgcctgcctgacctcagta

SEQ ID NO: 70589 - DNA, 20 bp, Artificial
  CRISPR gRNA sequence
cctgcctgacctcagtaatt

SEQ ID NO: 70590 - DNA, 20 bp, Artificial
  CRISPR gRNA sequence
cctgacctcagtaattcatg

SEQ ID NO: 70591 - DNA, 20 bp, Artificial
  CRISPR gRNA sequence
acctcagtaattcatgcaga

SEQ ID NO: 70592 - DNA, 20 bp, Artificial
  CRISPR gRNA sequence
agtaattcatgcagagaaac

SEQ ID NO: 70593 - DNA, 20 bp, Artificial
  CRISPR gRNA sequence
atgcagagaaacagcatttg

SEQ ID NO: 70594 - DNA, 20 bp, Artificial
  CRISPR gRNA sequence
ggacctcccagtacagttca

SEQ ID NO: 70595 - DNA, 20 bp, Artificial
  CRISPR gRNA sequence
gacctcccagtacagttcat

SEQ ID NO: 70596 - DNA, 20 bp, Artificial
  CRISPR gRNA sequence
ccagtacagttcattttgta

SEQ ID NO: 70597 - DNA, 20 bp, Artificial
  CRISPR gRNA sequence
attttgtagaatttttacac

SEQ ID NO: 70598 - DNA, 20 bp, Artificial
  CRISPR gRNA sequence
tgtagaatttttacactgtg

SEQ ID NO: 70599 - DNA, 20 bp, Artificial
  CRISPR gRNA sequence
gtagaatttttacactgtgt

SEQ ID NO: 70600 - DNA, 20 bp, Artificial
  CRISPR gRNA sequence
tagaatttttacactgtgtg

SEQ ID NO: 70601 - DNA, 20 bp, Artificial
  CRISPR gRNA sequence
ttacactgtgtggatataag

SEQ ID NO: 70602 - DNA, 20 bp, Artificial
  CRISPR gRNA sequence
tacactgtgtggatataagt

SEQ ID NO: 70603 - DNA, 20 bp, Artificial
  CRISPR gRNA sequence
acactgtgtggatataagtg

SEQ ID NO: 70604 - DNA, 20 bp, Artificial
  CRISPR gRNA sequence
cactgtgtggatataagtgg

SEQ ID NO: 70605 - DNA, 20 bp, Artificial
  CRISPR gRNA sequence
tgtggatataagtggctgtc

SEQ ID NO: 70606 - DNA, 20 bp, Artificial
  CRISPR gRNA sequence
tcttggaggtccctaggctt

SEQ ID NO: 70607 - DNA, 20 bp, Artificial
  CRISPR gRNA sequence
ggaggtccctaggcttgcta

SEQ ID NO: 70608 - DNA, 20 bp, Artificial
  CRISPR gRNA sequence
gaggtccctaggcttgctaa

SEQ ID NO: 70609 - DNA, 20 bp, Artificial
  CRISPR gRNA sequence
ggcttgctaagcacagaggc

SEQ ID NO: 70610 - DNA, 20 bp, Artificial
  CRISPR gRNA sequence
gctaagcacagaggcctcag

SEQ ID NO: 70611 - DNA, 20 bp, Artificial
  CRISPR gRNA sequence
ctaagcacagaggcctcaga

SEQ ID NO: 70612 - DNA, 20 bp, Artificial
  CRISPR gRNA sequence
agcacagaggcctcagaccc

SEQ ID NO: 70613 - DNA, 20 bp, Artificial
  CRISPR gRNA sequence
agacccccagactggacagt

SEQ ID NO: 70614 - DNA, 20 bp, Artificial
  CRISPR gRNA sequence
gacagtgccccacccccaga

SEQ ID NO: 70615 - DNA, 20 bp, Artificial
  CRISPR gRNA sequence
acctggcctcctcttctcca

SEQ ID NO: 70616 - DNA, 20 bp, Artificial
  CRISPR gRNA sequence
gcctcctcttctccagcctc

SEQ ID NO: 70617 - DNA, 20 bp, Artificial
  CRISPR gRNA sequence
ctcttctccagcctcagtca

SEQ ID NO: 70618 - DNA, 20 bp, Artificial
  CRISPR gRNA sequence
ttctccagcctcagtcacct

SEQ ID NO: 70619 - DNA, 20 bp, Artificial
  CRISPR gRNA sequence
ctccagcctcagtcaccttc

SEQ ID NO: 70620 - DNA, 20 bp, Artificial
  CRISPR gRNA sequence
tccagcctcagtcaccttct

SEQ ID NO: 70621 - DNA, 20 bp, Artificial
  CRISPR gRNA sequence
cagcctcagtcaccttctgc

SEQ ID NO: 70622 - DNA, 20 bp, Artificial
  CRISPR gRNA sequence
agtcaccttctgctgaacag

SEQ ID NO: 70623 - DNA, 20 bp, Artificial
  CRISPR gRNA sequence
ctgctgaacagctccacctt

SEQ ID NO: 70624 - DNA, 20 bp, Artificial
  CRISPR gRNA sequence
tgctgaacagctccaccttg

SEQ ID NO: 70625 - DNA, 20 bp, Artificial
  CRISPR gRNA sequence
ctgaacagctccaccttggc

SEQ ID NO: 70626 - DNA, 20 bp, Artificial
  CRISPR gRNA sequence
aacagctccaccttggcctt

SEQ ID NO: 70627 - DNA, 20 bp, Artificial
  CRISPR gRNA sequence
caccttggccttgcttactc

SEQ ID NO: 70628 - DNA, 20 bp, Artificial
  CRISPR gRNA sequence
ggccttgcttactcacagac

SEQ ID NO: 70629 - DNA, 20 bp, Artificial
  CRISPR gRNA sequence
gccttgcttactcacagact

SEQ ID NO: 70630 - DNA, 20 bp, Artificial
  CRISPR gRNA sequence
gcttactcacagactaagcc

SEQ ID NO: 70631 - DNA, 20 bp, Artificial
  CRISPR gRNA sequence
cttactcacagactaagcca

SEQ ID NO: 70632 - DNA, 20 bp, Artificial
  CRISPR gRNA sequence
actcacagactaagccagat

SEQ ID NO: 70633 - DNA, 20 bp, Artificial
  CRISPR gRNA sequence
ctcacagactaagccagatg

SEQ ID NO: 70634 - DNA, 20 bp, Artificial
  CRISPR gRNA sequence
acagactaagccagatgacc

SEQ ID NO: 70635 - DNA, 20 bp, Artificial
  CRISPR gRNA sequence
agccagatgacctgcctgca

SEQ ID NO: 70636 - DNA, 20 bp, Artificial
  CRISPR gRNA sequence
cctgcagagcctcaggtgag

SEQ ID NO: 70637 - DNA, 20 bp, Artificial
  CRISPR gRNA sequence
cagagcctcaggtgagtgac

SEQ ID NO: 70638 - DNA, 20 bp, Artificial
  CRISPR gRNA sequence
aggtgagtgaccgagcggcc

SEQ ID NO: 70639 - DNA, 20 bp, Artificial
  CRISPR gRNA sequence
cccactcagttgggaccaca

SEQ ID NO: 70640 - DNA, 20 bp, Artificial
  CRISPR gRNA sequence
ccactcagttgggaccacat

SEQ ID NO: 70641 - DNA, 20 bp, Artificial
  CRISPR gRNA sequence
agttgggaccacatccaggg

SEQ ID NO: 70642 - DNA, 20 bp, Artificial
  CRISPR gRNA sequence
ggaccacatccagggaagca

SEQ ID NO: 70643 - DNA, 20 bp, Artificial
  CRISPR gRNA sequence
aggccacctcccaggggatc

SEQ ID NO: 70644 - DNA, 20 bp, Artificial
  CRISPR gRNA sequence
ccaggggatcctttgcggat

SEQ ID NO: 70645 - DNA, 20 bp, Artificial
  CRISPR gRNA sequence
tgcggatccctcccaggccc

SEQ ID NO: 70646 - DNA, 20 bp, Artificial
  CRISPR gRNA sequence
gcggatccctcccaggccca

SEQ ID NO: 70647 - DNA, 20 bp, Artificial
  CRISPR gRNA sequence
cggatccctcccaggcccat

SEQ ID NO: 70648 - DNA, 20 bp, Artificial
  CRISPR gRNA sequence
ccaggcccatccctgtgccc

SEQ ID NO: 70649 - DNA, 20 bp, Artificial
  CRISPR gRNA sequence
tgccctcccaggtgggtgcc

SEQ ID NO: 70650 - DNA, 20 bp, Artificial
  CRISPR gRNA sequence
ccaggtgggtgcccactgct

SEQ ID NO: 70651 - DNA, 20 bp, Artificial
  CRISPR gRNA sequence
ctcttgccttctaatgccat

SEQ ID NO: 70652 - DNA, 20 bp, Artificial
  CRISPR gRNA sequence
ttgccttctaatgccatcag

SEQ ID NO: 70653 - DNA, 20 bp, Artificial
  CRISPR gRNA sequence
gccttctaatgccatcagct

SEQ ID NO: 70654 - DNA, 20 bp, Artificial
  CRISPR gRNA sequence
ccttctaatgccatcagctt

SEQ ID NO: 70655 - DNA, 20 bp, Artificial
  CRISPR gRNA sequence
ctaatgccatcagcttcctc

SEQ ID NO: 70656 - DNA, 20 bp, Artificial
  CRISPR gRNA sequence
taatgccatcagcttcctcc

SEQ ID NO: 70657 - DNA, 20 bp, Artificial
  CRISPR gRNA sequence
atgccatcagcttcctcctg

SEQ ID NO: 70658 - DNA, 20 bp, Artificial
  CRISPR gRNA sequence
cctcctggttacaaaagtgg

SEQ ID NO: 70659 - DNA, 20 bp, Artificial
  CRISPR gRNA sequence
ctcctggttacaaaagtggc

SEQ ID NO: 70660 - DNA, 20 bp, Artificial
  CRISPR gRNA sequence
ctggttacaaaagtggccta

SEQ ID NO: 70661 - DNA, 20 bp, Artificial
  CRISPR gRNA sequence
gttacaaaagtggcctaaag

SEQ ID NO: 70662 - DNA, 20 bp, Artificial
  CRISPR gRNA sequence
caaaagtggcctaaagggct

SEQ ID NO: 70663 - DNA, 20 bp, Artificial
  CRISPR gRNA sequence
aagggcttaggcccacgtcg

SEQ ID NO: 70664 - DNA, 20 bp, Artificial
  CRISPR gRNA sequence
aggcccacgtcgtagaacaa

SEQ ID NO: 70665 - DNA, 20 bp, Artificial
  CRISPR gRNA sequence
ggcccacgtcgtagaacaac

SEQ ID NO: 70666 - DNA, 20 bp, Artificial
  CRISPR gRNA sequence
gaggcacacacacagttcac

SEQ ID NO: 70667 - DNA, 20 bp, Artificial
  CRISPR gRNA sequence
aggcacacacacagttcacc

SEQ ID NO: 70668 - DNA, 20 bp, Artificial
  CRISPR gRNA sequence
accctgggctcttgttaaaa

SEQ ID NO: 70669 - DNA, 20 bp, Artificial
  CRISPR gRNA sequence
ggctcttgttaaaatgctca

SEQ ID NO: 70670 - DNA, 20 bp, Artificial
  CRISPR gRNA sequence
ttgttaaaatgctcattctg

SEQ ID NO: 70671 - DNA, 20 bp, Artificial
  CRISPR gRNA sequence
gttaaaatgctcattctgat

SEQ ID NO: 70672 - DNA, 20 bp, Artificial
  CRISPR gRNA sequence
ttaaaatgctcattctgatt

SEQ ID NO: 70673 - DNA, 20 bp, Artificial
  CRISPR gRNA sequence
aaatgctcattctgattccc

SEQ ID NO: 70674 - DNA, 20 bp, Artificial
  CRISPR gRNA sequence
attctgattccccaggtctg

SEQ ID NO: 70675 - DNA, 20 bp, Artificial
  CRISPR gRNA sequence
tgattccccaggtctggaat

SEQ ID NO: 70676 - DNA, 20 bp, Artificial
  CRISPR gRNA sequence
attccccaggtctggaattc

SEQ ID NO: 70677 - DNA, 20 bp, Artificial
  CRISPR gRNA sequence
cccaggtctggaattctgcc

SEQ ID NO: 70678 - DNA, 20 bp, Artificial
  CRISPR gRNA sequence
gaattctgcctagactgtgc

SEQ ID NO: 70679 - DNA, 20 bp, Artificial
  CRISPR gRNA sequence
tgcctagactgtgctttttt

SEQ ID NO: 70680 - DNA, 20 bp, Artificial
  CRISPR gRNA sequence
cctagactgtgctttttttt

SEQ ID NO: 70681 - DNA, 20 bp, Artificial
  CRISPR gRNA sequence
gactgtgctttttttttttt

SEQ ID NO: 70682 - DNA, 20 bp, Artificial
  CRISPR gRNA sequence
tgcttttttttttttttttt

SEQ ID NO: 70683 - DNA, 20 bp, Artificial
  CRISPR gRNA sequence
tttttttttttttttttttt

SEQ ID NO: 70684 - DNA, 20 bp, Artificial
  CRISPR gRNA sequence
tttttttttttttttttttt

SEQ ID NO: 70685 - DNA, 20 bp, Artificial
  CRISPR gRNA sequence
tttttttttttttttttttt

SEQ ID NO: 70686 - DNA, 20 bp, Artificial
  CRISPR gRNA sequence
tttttttttttttttttttt

SEQ ID NO: 70687 - DNA, 20 bp, Artificial
  CRISPR gRNA sequence
tttttttttttttttttttt

SEQ ID NO: 70688 - DNA, 20 bp, Artificial
  CRISPR gRNA sequence
tttttttttttttttttttt

SEQ ID NO: 70689 - DNA, 20 bp, Artificial
  CRISPR gRNA sequence
tttttttttttttttttttt

SEQ ID NO: 70690 - DNA, 20 bp, Artificial
  CRISPR gRNA sequence
tttttttttttttttttttt

SEQ ID NO: 70691 - DNA, 20 bp, Artificial
  CRISPR gRNA sequence
tttttttttttttttttttt

SEQ ID NO: 70692 - DNA, 20 bp, Artificial
  CRISPR gRNA sequence
tttttttttttttttttttt

SEQ ID NO: 70693 - DNA, 20 bp, Artificial
  CRISPR gRNA sequence
tttttttttttttttttttt

SEQ ID NO: 70694 - DNA, 20 bp, Artificial
  CRISPR gRNA sequence
tttttttttttttttttttt

SEQ ID NO: 70695 - DNA, 20 bp, Artificial
  CRISPR gRNA sequence
tttttttttttttttttttt

SEQ ID NO: 70696 - DNA, 20 bp, Artificial
  CRISPR gRNA sequence
tttttttttttttttttttt

SEQ ID NO: 70697 - DNA, 20 bp, Artificial
  CRISPR gRNA sequence
tttttttttttttttttttt

SEQ ID NO: 70698 - DNA, 20 bp, Artificial
  CRISPR gRNA sequence
tttttttttttttttttttt

SEQ ID NO: 70699 - DNA, 20 bp, Artificial
  CRISPR gRNA sequence
tttttttttttttttttttt

SEQ ID NO: 70700 - DNA, 20 bp, Artificial
  CRISPR gRNA sequence
tttttttttttttttttttt

SEQ ID NO: 70701 - DNA, 20 bp, Artificial
  CRISPR gRNA sequence
tttttttttttttttttttt

SEQ ID NO: 70702 - DNA, 20 bp, Artificial
  CRISPR gRNA sequence
tttttttttttttttttttt

SEQ ID NO: 70703 - DNA, 20 bp, Artificial
  CRISPR gRNA sequence
tttttttttttttttttttt

SEQ ID NO: 70704 - DNA, 20 bp, Artificial
  CRISPR gRNA sequence
tttttttttttttttttttg

SEQ ID NO: 70705 - DNA, 20 bp, Artificial
  CRISPR gRNA sequence
ttttttttttttttttttga

SEQ ID NO: 70706 - DNA, 20 bp, Artificial
  CRISPR gRNA sequence
tttttttttttttttttgag

SEQ ID NO: 70707 - DNA, 20 bp, Artificial
  CRISPR gRNA sequence
ttttttttttttttttgagt

SEQ ID NO: 70708 - DNA, 20 bp, Artificial
  CRISPR gRNA sequence
tttttttttttttttgagtt

SEQ ID NO: 70709 - DNA, 20 bp, Artificial
  CRISPR gRNA sequence
ttttttttttttttgagttg

SEQ ID NO: 70710 - DNA, 20 bp, Artificial
  CRISPR gRNA sequence
tttttttttttttgagttgg

SEQ ID NO: 70711 - DNA, 20 bp, Artificial
  CRISPR gRNA sequence
ttttttttttttgagttggg

SEQ ID NO: 70712 - DNA, 20 bp, Artificial
  CRISPR gRNA sequence
tttttttttttgagttgggg

SEQ ID NO: 70713 - DNA, 20 bp, Artificial
  CRISPR gRNA sequence
ttttttttttgagttggggc

SEQ ID NO: 70714 - DNA, 20 bp, Artificial
  CRISPR gRNA sequence
tttttttttgagttggggcc

SEQ ID NO: 70715 - DNA, 20 bp, Artificial
  CRISPR gRNA sequence
ttttttttgagttggggcct

SEQ ID NO: 70716 - DNA, 20 bp, Artificial
  CRISPR gRNA sequence
tttttttgagttggggcctc

SEQ ID NO: 70717 - DNA, 20 bp, Artificial
  CRISPR gRNA sequence
ttttttgagttggggcctca

SEQ ID NO: 70718 - DNA, 20 bp, Artificial
  CRISPR gRNA sequence
tttttgagttggggcctcac

SEQ ID NO: 70719 - DNA, 20 bp, Artificial
  CRISPR gRNA sequence
ttttgagttggggcctcact

SEQ ID NO: 70720 - DNA, 20 bp, Artificial
  CRISPR gRNA sequence
tttgagttggggcctcactg

SEQ ID NO: 70721 - DNA, 20 bp, Artificial
  CRISPR gRNA sequence
ttgagttggggcctcactgt

SEQ ID NO: 70722 - DNA, 20 bp, Artificial
  CRISPR gRNA sequence
tgagttggggcctcactgtg

SEQ ID NO: 70723 - DNA, 20 bp, Artificial
  CRISPR gRNA sequence
gagttggggcctcactgtgt

SEQ ID NO: 70724 - DNA, 20 bp, Artificial
  CRISPR gRNA sequence
agttggggcctcactgtgtg

SEQ ID NO: 70725 - DNA, 20 bp, Artificial
  CRISPR gRNA sequence
gggcctcactgtgtggccca

SEQ ID NO: 70726 - DNA, 20 bp, Artificial
  CRISPR gRNA sequence
actgtgtggcccaggctgga

SEQ ID NO: 70727 - DNA, 20 bp, Artificial
  CRISPR gRNA sequence
tgtggcccaggctggagtgc

SEQ ID NO: 70728 - DNA, 20 bp, Artificial
  CRISPR gRNA sequence
gagtgcagtggcaatgcaca

SEQ ID NO: 70729 - DNA, 20 bp, Artificial
  CRISPR gRNA sequence
cactgcagcctcaaactcct

SEQ ID NO: 70730 - DNA, 20 bp, Artificial
  CRISPR gRNA sequence
cagcctcaaactcctgggcg

SEQ ID NO: 70731 - DNA, 20 bp, Artificial
  CRISPR gRNA sequence
aaactcctgggcgaacgtga

SEQ ID NO: 70732 - DNA, 20 bp, Artificial
  CRISPR gRNA sequence
ctgggcgaacgtgatcctcc

SEQ ID NO: 70733 - DNA, 20 bp, Artificial
  CRISPR gRNA sequence
ggcgaacgtgatcctcctgc

SEQ ID NO: 70734 - DNA, 20 bp, Artificial
  CRISPR gRNA sequence
ctgcctcaccctcctaagca

SEQ ID NO: 70735 - DNA, 20 bp, Artificial
  CRISPR gRNA sequence
cctcaccctcctaagcagct

SEQ ID NO: 70736 - DNA, 20 bp, Artificial
  CRISPR gRNA sequence
accctcctaagcagctggga

SEQ ID NO: 70737 - DNA, 20 bp, Artificial
  CRISPR gRNA sequence
ctaagcagctgggactacag

SEQ ID NO: 70738 - DNA, 20 bp, Artificial
  CRISPR gRNA sequence
agcagctgggactacaggcc

SEQ ID NO: 70739 - DNA, 20 bp, Artificial
  CRISPR gRNA sequence
ggactacaggcctaaggcgt

SEQ ID NO: 70740 - DNA, 20 bp, Artificial
  CRISPR gRNA sequence
caggcctaaggcgttgcacc

SEQ ID NO: 70741 - DNA, 20 bp, Artificial
  CRISPR gRNA sequence
aggcgttgcacccaaactta

SEQ ID NO: 70742 - DNA, 20 bp, Artificial
  CRISPR gRNA sequence
cacccaaacttagcatttct

SEQ ID NO: 70743 - DNA, 20 bp, Artificial
  CRISPR gRNA sequence
agcatttctttttttgtttg

SEQ ID NO: 70744 - DNA, 20 bp, Artificial
  CRISPR gRNA sequence
gcatttctttttttgtttgt

SEQ ID NO: 70745 - DNA, 20 bp, Artificial
  CRISPR gRNA sequence
ctttttttgtttgtttgttt

SEQ ID NO: 70746 - DNA, 20 bp, Artificial
  CRISPR gRNA sequence
tttttttgtttgtttgtttt

SEQ ID NO: 70747 - DNA, 20 bp, Artificial
  CRISPR gRNA sequence
tttttgtttgtttgtttttg

SEQ ID NO: 70748 - DNA, 20 bp, Artificial
  CRISPR gRNA sequence
ttttgtttgtttgtttttga

SEQ ID NO: 70749 - DNA, 20 bp, Artificial
  CRISPR gRNA sequence
tttgtttgtttgtttttgag

SEQ ID NO: 70750 - DNA, 20 bp, Artificial
  CRISPR gRNA sequence
ttgtttgtttgtttttgaga

SEQ ID NO: 70751 - DNA, 20 bp, Artificial
  CRISPR gRNA sequence
tgtttgtttgtttttgagac

SEQ ID NO: 70752 - DNA, 20 bp, Artificial
  CRISPR gRNA sequence
gtttgtttgtttttgagaca

SEQ ID NO: 70753 - DNA, 20 bp, Artificial
  CRISPR gRNA sequence
tttgtttgtttttgagacag

SEQ ID NO: 70754 - DNA, 20 bp, Artificial
  CRISPR gRNA sequence
gtttgtttttgagacagagt

SEQ ID NO: 70755 - DNA, 20 bp, Artificial
  CRISPR gRNA sequence
tttgtttttgagacagagtt

SEQ ID NO: 70756 - DNA, 20 bp, Artificial
  CRISPR gRNA sequence
gtttttgagacagagtttcg

SEQ ID NO: 70757 - DNA, 20 bp, Artificial
  CRISPR gRNA sequence
tttttgagacagagtttcgc

SEQ ID NO: 70758 - DNA, 20 bp, Artificial
  CRISPR gRNA sequence
ttgagacagagtttcgctct

SEQ ID NO: 70759 - DNA, 20 bp, Artificial
  CRISPR gRNA sequence
tgagacagagtttcgctctt

SEQ ID NO: 70760 - DNA, 20 bp, Artificial
  CRISPR gRNA sequence
gagacagagtttcgctcttg

SEQ ID NO: 70761 - DNA, 20 bp, Artificial
  CRISPR gRNA sequence
agacagagtttcgctcttgt

SEQ ID NO: 70762 - DNA, 20 bp, Artificial
  CRISPR gRNA sequence
cgctcttgttgcccaggctg

SEQ ID NO: 70763 - DNA, 20 bp, Artificial
  CRISPR gRNA sequence
gctcttgttgcccaggctgg

SEQ ID NO: 70764 - DNA, 20 bp, Artificial
  CRISPR gRNA sequence
ttgttgcccaggctggagtg

SEQ ID NO: 70765 - DNA, 20 bp, Artificial
  CRISPR gRNA sequence
gttgcccaggctggagtgca

SEQ ID NO: 70766 - DNA, 20 bp, Artificial
  CRISPR gRNA sequence
ttgcccaggctggagtgcaa

SEQ ID NO: 70767 - DNA, 20 bp, Artificial
  CRISPR gRNA sequence
cccaggctggagtgcaatgg

SEQ ID NO: 70768 - DNA, 20 bp, Artificial
  CRISPR gRNA sequence
gagtgcaatggcacaatctc

SEQ ID NO: 70769 - DNA, 20 bp, Artificial
  CRISPR gRNA sequence
agctcactgcaacctccgcc

SEQ ID NO: 70770 - DNA, 20 bp, Artificial
  CRISPR gRNA sequence
actgcaacctccgcctcccg

SEQ ID NO: 70771 - DNA, 20 bp, Artificial
  CRISPR gRNA sequence
caacctccgcctcccgggtt

SEQ ID NO: 70772 - DNA, 20 bp, Artificial
  CRISPR gRNA sequence
cgcctcccgggttcaagcga

SEQ ID NO: 70773 - DNA, 20 bp, Artificial
  CRISPR gRNA sequence
ccgggttcaagcgattctcc

SEQ ID NO: 70774 - DNA, 20 bp, Artificial
  CRISPR gRNA sequence
aagcgattctcctgcctcag

SEQ ID NO: 70775 - DNA, 20 bp, Artificial
  CRISPR gRNA sequence
tcctgcctcagcctcccgag

SEQ ID NO: 70776 - DNA, 20 bp, Artificial
  CRISPR gRNA sequence
ctgcctcagcctcccgagta

SEQ ID NO: 70777 - DNA, 20 bp, Artificial
  CRISPR gRNA sequence
cctcagcctcccgagtagcc

SEQ ID NO: 70778 - DNA, 20 bp, Artificial
  CRISPR gRNA sequence
agcctcccgagtagccggga

SEQ ID NO: 70779 - DNA, 20 bp, Artificial
  CRISPR gRNA sequence
ccgagtagccgggattatag

SEQ ID NO: 70780 - DNA, 20 bp, Artificial
  CRISPR gRNA sequence
taggcatgtgccaccacgcc

SEQ ID NO: 70781 - DNA, 20 bp, Artificial
  CRISPR gRNA sequence
atttttgtatttttggtaga

SEQ ID NO: 70782 - DNA, 20 bp, Artificial
  CRISPR gRNA sequence
ttgtatttttggtagagaca

SEQ ID NO: 70783 - DNA, 20 bp, Artificial
  CRISPR gRNA sequence
tgtatttttggtagagacag

SEQ ID NO: 70784 - DNA, 20 bp, Artificial
  CRISPR gRNA sequence
gtatttttggtagagacagt

SEQ ID NO: 70785 - DNA, 20 bp, Artificial
  CRISPR gRNA sequence
tatttttggtagagacagtg

SEQ ID NO: 70786 - DNA, 20 bp, Artificial
  CRISPR gRNA sequence
ttggtagagacagtgtttct

SEQ ID NO: 70787 - DNA, 20 bp, Artificial
  CRISPR gRNA sequence
tggtagagacagtgtttctc

SEQ ID NO: 70788 - DNA, 20 bp, Artificial
  CRISPR gRNA sequence
ggtagagacagtgtttctcc

SEQ ID NO: 70789 - DNA, 20 bp, Artificial
  CRISPR gRNA sequence
gtagagacagtgtttctcca

SEQ ID NO: 70790 - DNA, 20 bp, Artificial
  CRISPR gRNA sequence
ctccatgttggtcaggctgg

SEQ ID NO: 70791 - DNA, 20 bp, Artificial
  CRISPR gRNA sequence
tccatgttggtcaggctggt

SEQ ID NO: 70792 - DNA, 20 bp, Artificial
  CRISPR gRNA sequence
catgttggtcaggctggtct

SEQ ID NO: 70793 - DNA, 20 bp, Artificial
  CRISPR gRNA sequence
gtcaggctggtcttgaacgt

SEQ ID NO: 70794 - DNA, 20 bp, Artificial
  CRISPR gRNA sequence
gtcttgaacgtccaacctca

SEQ ID NO: 70795 - DNA, 20 bp, Artificial
  CRISPR gRNA sequence
gaacgtccaacctcaggtga

SEQ ID NO: 70796 - DNA, 20 bp, Artificial
  CRISPR gRNA sequence
aacgtccaacctcaggtgat

SEQ ID NO: 70797 - DNA, 20 bp, Artificial
  CRISPR gRNA sequence
aggtgatctgcccacctcgg

SEQ ID NO: 70798 - DNA, 20 bp, Artificial
  CRISPR gRNA sequence
cccacctcggcctcccaaag

SEQ ID NO: 70799 - DNA, 20 bp, Artificial
  CRISPR gRNA sequence
ggcctcccaaagtgctggga

SEQ ID NO: 70800 - DNA, 20 bp, Artificial
  CRISPR gRNA sequence
ccaaagtgctgggattacag

SEQ ID NO: 70801 - DNA, 20 bp, Artificial
  CRISPR gRNA sequence
ggattacaggcgtgagccac

SEQ ID NO: 70802 - DNA, 20 bp, Artificial
  CRISPR gRNA sequence
caggcgtgagccaccacgcc

SEQ ID NO: 70803 - DNA, 20 bp, Artificial
  CRISPR gRNA sequence
gcttcagactctgcattttc

SEQ ID NO: 70804 - DNA, 20 bp, Artificial
  CRISPR gRNA sequence
cagactctgcattttctaac

SEQ ID NO: 70805 - DNA, 20 bp, Artificial
  CRISPR gRNA sequence
agactctgcattttctaaca

SEQ ID NO: 70806 - DNA, 20 bp, Artificial
  CRISPR gRNA sequence
tgcattttctaacaagcttc

SEQ ID NO: 70807 - DNA, 20 bp, Artificial
  CRISPR gRNA sequence
cattttctaacaagcttccg

SEQ ID NO: 70808 - DNA, 20 bp, Artificial
  CRISPR gRNA sequence
tctaacaagcttccgggtgg

SEQ ID NO: 70809 - DNA, 20 bp, Artificial
  CRISPR gRNA sequence
ctaacaagcttccgggtggt

SEQ ID NO: 70810 - DNA, 20 bp, Artificial
  CRISPR gRNA sequence
taacaagcttccgggtggta

SEQ ID NO: 70811 - DNA, 20 bp, Artificial
  CRISPR gRNA sequence
acaagcttccgggtggtatc

SEQ ID NO: 70812 - DNA, 20 bp, Artificial
  CRISPR gRNA sequence
ccgggtggtatcaattctgg

SEQ ID NO: 70813 - DNA, 20 bp, Artificial
  CRISPR gRNA sequence
cgggtggtatcaattctggg

SEQ ID NO: 70814 - DNA, 20 bp, Artificial
  CRISPR gRNA sequence
tgggggccacggtcagcact

SEQ ID NO: 70815 - DNA, 20 bp, Artificial
  CRISPR gRNA sequence
ggggccacggtcagcacttt

SEQ ID NO: 70816 - DNA, 20 bp, Artificial
  CRISPR gRNA sequence
tgagtagtgtgggtctagac

SEQ ID NO: 70817 - DNA, 20 bp, Artificial
  CRISPR gRNA sequence
gagtagtgtgggtctagact

SEQ ID NO: 70818 - DNA, 20 bp, Artificial
  CRISPR gRNA sequence
agtagtgtgggtctagactc

SEQ ID NO: 70819 - DNA, 20 bp, Artificial
  CRISPR gRNA sequence
gactcagatggggtggcctt

SEQ ID NO: 70820 - DNA, 20 bp, Artificial
  CRISPR gRNA sequence
agatggggtggccttcctac

SEQ ID NO: 70821 - DNA, 20 bp, Artificial
  CRISPR gRNA sequence
cctacactccctttgtgatt

SEQ ID NO: 70822 - DNA, 20 bp, Artificial
  CRISPR gRNA sequence
ctacactccctttgtgattt

SEQ ID NO: 70823 - DNA, 20 bp, Artificial
  CRISPR gRNA sequence
cactccctttgtgatttcac

SEQ ID NO: 70824 - DNA, 20 bp, Artificial
  CRISPR gRNA sequence
cctttgtgatttcactccct

SEQ ID NO: 70825 - DNA, 20 bp, Artificial
  CRISPR gRNA sequence
tgtgatttcactccctgctg

SEQ ID NO: 70826 - DNA, 20 bp, Artificial
  CRISPR gRNA sequence
gtgatttcactccctgctgc

SEQ ID NO: 70827 - DNA, 20 bp, Artificial
  CRISPR gRNA sequence
tgatttcactccctgctgct

SEQ ID NO: 70828 - DNA, 20 bp, Artificial
  CRISPR gRNA sequence
cactccctgctgctaggata

SEQ ID NO: 70829 - DNA, 20 bp, Artificial
  CRISPR gRNA sequence
actccctgctgctaggataa

SEQ ID NO: 70830 - DNA, 20 bp, Artificial
  CRISPR gRNA sequence
cctgctgctaggataaataa

SEQ ID NO: 70831 - DNA, 20 bp, Artificial
  CRISPR gRNA sequence
ctgctaggataaataaacat

SEQ ID NO: 70832 - DNA, 20 bp, Artificial
  CRISPR gRNA sequence
ctaggataaataaacatgac

SEQ ID NO: 70833 - DNA, 20 bp, Artificial
  CRISPR gRNA sequence
ggataaataaacatgacact

SEQ ID NO: 70834 - DNA, 20 bp, Artificial
  CRISPR gRNA sequence
actttcaatgtgatttttca

SEQ ID NO: 70835 - DNA, 20 bp, Artificial
  CRISPR gRNA sequence
ctttcaatgtgatttttcaa

SEQ ID NO: 70836 - DNA, 20 bp, Artificial
  CRISPR gRNA sequence
tcaatgtgatttttcaaaac

SEQ ID NO: 70837 - DNA, 20 bp, Artificial
  CRISPR gRNA sequence
caatgtgatttttcaaaaca

SEQ ID NO: 70838 - DNA, 20 bp, Artificial
  CRISPR gRNA sequence
aatgtgatttttcaaaacat

SEQ ID NO: 70839 - DNA, 20 bp, Artificial
  CRISPR gRNA sequence
ttcaaaacatgaaatcttgt

SEQ ID NO: 70840 - DNA, 20 bp, Artificial
  CRISPR gRNA sequence
tcaaaacatgaaatcttgtg

SEQ ID NO: 70841 - DNA, 20 bp, Artificial
  CRISPR gRNA sequence
caaaacatgaaatcttgtga

SEQ ID NO: 70842 - DNA, 20 bp, Artificial
  CRISPR gRNA sequence
aaaacatgaaatcttgtgac

SEQ ID NO: 70843 - DNA, 20 bp, Artificial
  CRISPR gRNA sequence
gtgactaaaaacaaatccaa

SEQ ID NO: 70844 - DNA, 20 bp, Artificial
  CRISPR gRNA sequence
tgactaaaaacaaatccaag

SEQ ID NO: 70845 - DNA, 20 bp, Artificial
  CRISPR gRNA sequence
aaaacaaatccaagcagtga

SEQ ID NO: 70846 - DNA, 20 bp, Artificial
  CRISPR gRNA sequence
ctttgtttatatccaagtac

SEQ ID NO: 70847 - DNA, 20 bp, Artificial
  CRISPR gRNA sequence
tgtttatatccaagtacacc

SEQ ID NO: 70848 - DNA, 20 bp, Artificial
  CRISPR gRNA sequence
gtttatatccaagtacacct

SEQ ID NO: 70849 - DNA, 20 bp, Artificial
  CRISPR gRNA sequence
tttatatccaagtacacctc

SEQ ID NO: 70850 - DNA, 20 bp, Artificial
  CRISPR gRNA sequence
atatccaagtacacctccta

SEQ ID NO: 70851 - DNA, 20 bp, Artificial
  CRISPR gRNA sequence
tatccaagtacacctcctac

SEQ ID NO: 70852 - DNA, 20 bp, Artificial
  CRISPR gRNA sequence
ctaccccctacctcgggcag

SEQ ID NO: 70853 - DNA, 20 bp, Artificial
  CRISPR gRNA sequence
ccccctacctcgggcagagc

SEQ ID NO: 70854 - DNA, 20 bp, Artificial
  CRISPR gRNA sequence
cctcgggcagagcagagtag

SEQ ID NO: 70855 - DNA, 20 bp, Artificial
  CRISPR gRNA sequence
gggcagagcagagtaggtag

SEQ ID NO: 70856 - DNA, 20 bp, Artificial
  CRISPR gRNA sequence
gagagttccaggaggttata

SEQ ID NO: 70857 - DNA, 20 bp, Artificial
  CRISPR gRNA sequence
caggaggttatatcatattg

SEQ ID NO: 70858 - DNA, 20 bp, Artificial
  CRISPR gRNA sequence
tatcatattggaccatttca

SEQ ID NO: 70859 - DNA, 20 bp, Artificial
  CRISPR gRNA sequence
gaccatttcacccaaaatta

SEQ ID NO: 70860 - DNA, 20 bp, Artificial
  CRISPR gRNA sequence
cacccaaaattaatttactg

SEQ ID NO: 70861 - DNA, 20 bp, Artificial
  CRISPR gRNA sequence
acccaaaattaatttactga

SEQ ID NO: 70862 - DNA, 20 bp, Artificial
  CRISPR gRNA sequence
atttactgaaaggtgatcca

SEQ ID NO: 70863 - DNA, 20 bp, Artificial
  CRISPR gRNA sequence
actgaaaggtgatccattaa

SEQ ID NO: 70864 - DNA, 20 bp, Artificial
  CRISPR gRNA sequence
ctgaaaggtgatccattaaa

SEQ ID NO: 70865 - DNA, 20 bp, Artificial
  CRISPR gRNA sequence
aaaggtgatccattaaagtg

SEQ ID NO: 70866 - DNA, 20 bp, Artificial
  CRISPR gRNA sequence
aagtgtatttatttatttct

SEQ ID NO: 70867 - DNA, 20 bp, Artificial
  CRISPR gRNA sequence
atttatttctattttatttt

SEQ ID NO: 70868 - DNA, 20 bp, Artificial
  CRISPR gRNA sequence
tttatttctattttattttt

SEQ ID NO: 70869 - DNA, 20 bp, Artificial
  CRISPR gRNA sequence
atttctattttatttttatt

SEQ ID NO: 70870 - DNA, 20 bp, Artificial
  CRISPR gRNA sequence
tttctattttatttttattt

SEQ ID NO: 70871 - DNA, 20 bp, Artificial
  CRISPR gRNA sequence
ctattttatttttatttttt

SEQ ID NO: 70872 - DNA, 20 bp, Artificial
  CRISPR gRNA sequence
tattttatttttattttttg

SEQ ID NO: 70873 - DNA, 20 bp, Artificial
  CRISPR gRNA sequence
ttttatttttattttttgag

SEQ ID NO: 70874 - DNA, 20 bp, Artificial
  CRISPR gRNA sequence
tatttttattttttgagaca

SEQ ID NO: 70875 - DNA, 20 bp, Artificial
  CRISPR gRNA sequence
atttttattttttgagacac

SEQ ID NO: 70876 - DNA, 20 bp, Artificial
  CRISPR gRNA sequence
tttttattttttgagacaca

SEQ ID NO: 70877 - DNA, 20 bp, Artificial
  CRISPR gRNA sequence
ttattttttgagacacagtc

SEQ ID NO: 70878 - DNA, 20 bp, Artificial
  CRISPR gRNA sequence
tattttttgagacacagtct

SEQ ID NO: 70879 - DNA, 20 bp, Artificial
  CRISPR gRNA sequence
attttttgagacacagtctc

SEQ ID NO: 70880 - DNA, 20 bp, Artificial
  CRISPR gRNA sequence
ttttttgagacacagtctca

SEQ ID NO: 70881 - DNA, 20 bp, Artificial
  CRISPR gRNA sequence
tttgagacacagtctcactc

SEQ ID NO: 70882 - DNA, 20 bp, Artificial
  CRISPR gRNA sequence
ttgagacacagtctcactct

SEQ ID NO: 70883 - DNA, 20 bp, Artificial
  CRISPR gRNA sequence
tgagacacagtctcactctg

SEQ ID NO: 70884 - DNA, 20 bp, Artificial
  CRISPR gRNA sequence
gagacacagtctcactctgt

SEQ ID NO: 70885 - DNA, 20 bp, Artificial
  CRISPR gRNA sequence
agacacagtctcactctgtc

SEQ ID NO: 70886 - DNA, 20 bp, Artificial
  CRISPR gRNA sequence
actctgtcgcccaggctgga

SEQ ID NO: 70887 - DNA, 20 bp, Artificial
  CRISPR gRNA sequence
tgtcgcccaggctggagtgc

SEQ ID NO: 70888 - DNA, 20 bp, Artificial
  CRISPR gRNA sequence
tcgcccaggctggagtgcag

SEQ ID NO: 70889 - DNA, 20 bp, Artificial
  CRISPR gRNA sequence
gagtgcagtggcatgatctc

SEQ ID NO: 70890 - DNA, 20 bp, Artificial
  CRISPR gRNA sequence
acttcactgcaacctctgcc

SEQ ID NO: 70891 - DNA, 20 bp, Artificial
  CRISPR gRNA sequence
cactgcaacctctgcctcct

SEQ ID NO: 70892 - DNA, 20 bp, Artificial
  CRISPR gRNA sequence
actgcaacctctgcctcctg

SEQ ID NO: 70893 - DNA, 20 bp, Artificial
  CRISPR gRNA sequence
caacctctgcctcctgggtt

SEQ ID NO: 70894 - DNA, 20 bp, Artificial
  CRISPR gRNA sequence
tgcctcctgggttcaagcga

SEQ ID NO: 70895 - DNA, 20 bp, Artificial
  CRISPR gRNA sequence
cctcctgggttcaagcgatt

SEQ ID NO: 70896 - DNA, 20 bp, Artificial
  CRISPR gRNA sequence
ctgggttcaagcgattctgg

SEQ ID NO: 70897 - DNA, 20 bp, Artificial
  CRISPR gRNA sequence
ggttcaagcgattctggtgc

SEQ ID NO: 70898 - DNA, 20 bp, Artificial
  CRISPR gRNA sequence
aagcgattctggtgcctcag

SEQ ID NO: 70899 - DNA, 20 bp, Artificial
  CRISPR gRNA sequence
tggtgcctcagccgcccaag

SEQ ID NO: 70900 - DNA, 20 bp, Artificial
  CRISPR gRNA sequence
gtgcctcagccgcccaagta

SEQ ID NO: 70901 - DNA, 20 bp, Artificial
  CRISPR gRNA sequence
agccgcccaagtagctggga

SEQ ID NO: 70902 - DNA, 20 bp, Artificial
  CRISPR gRNA sequence
ggattacaggtatgcaccac

SEQ ID NO: 70903 - DNA, 20 bp, Artificial
  CRISPR gRNA sequence
caggtatgcaccaccacgcc

SEQ ID NO: 70904 - DNA, 20 bp, Artificial
  CRISPR gRNA sequence
ttgtatatttttagtacaaa

SEQ ID NO: 70905 - DNA, 20 bp, Artificial
  CRISPR gRNA sequence
tgtatatttttagtacaaat

SEQ ID NO: 70906 - DNA, 20 bp, Artificial
  CRISPR gRNA sequence
gtatatttttagtacaaatg

SEQ ID NO: 70907 - DNA, 20 bp, Artificial
  CRISPR gRNA sequence
tatatttttagtacaaatgg

SEQ ID NO: 70908 - DNA, 20 bp, Artificial
  CRISPR gRNA sequence
ttagtacaaatggggtttca

SEQ ID NO: 70909 - DNA, 20 bp, Artificial
  CRISPR gRNA sequence
tagtacaaatggggtttcac

SEQ ID NO: 70910 - DNA, 20 bp, Artificial
  CRISPR gRNA sequence
agtacaaatggggtttcacc

SEQ ID NO: 70911 - DNA, 20 bp, Artificial
  CRISPR gRNA sequence
gtacaaatggggtttcacca

SEQ ID NO: 70912 - DNA, 20 bp, Artificial
  CRISPR gRNA sequence
caccatgttggccgggctgg

SEQ ID NO: 70913 - DNA, 20 bp, Artificial
  CRISPR gRNA sequence
accatgttggccgggctggt

SEQ ID NO: 70914 - DNA, 20 bp, Artificial
  CRISPR gRNA sequence
gccgggctggtctcgaaccc

SEQ ID NO: 70915 - DNA, 20 bp, Artificial
  CRISPR gRNA sequence
gtctcgaacccctgacctca

SEQ ID NO: 70916 - DNA, 20 bp, Artificial
  CRISPR gRNA sequence
gaacccctgacctcaaatga

SEQ ID NO: 70917 - DNA, 20 bp, Artificial
  CRISPR gRNA sequence
acctcaaatgatccacctgc

SEQ ID NO: 70918 - DNA, 20 bp, Artificial
  CRISPR gRNA sequence
aaatgatccacctgcctaga

SEQ ID NO: 70919 - DNA, 20 bp, Artificial
  CRISPR gRNA sequence
cctagactccgaaagtgctg

SEQ ID NO: 70920 - DNA, 20 bp, Artificial
  CRISPR gRNA sequence
gactccgaaagtgctgggaa

SEQ ID NO: 70921 - DNA, 20 bp, Artificial
  CRISPR gRNA sequence
cgaaagtgctgggaatacag

SEQ ID NO: 70922 - DNA, 20 bp, Artificial
  CRISPR gRNA sequence
ggaatacaggtgtgaaccac

SEQ ID NO: 70923 - DNA, 20 bp, Artificial
  CRISPR gRNA sequence
ctcccagccccattaaaatt

SEQ ID NO: 70924 - DNA, 20 bp, Artificial
  CRISPR gRNA sequence
ccagccccattaaaatttaa

SEQ ID NO: 70925 - DNA, 20 bp, Artificial
  CRISPR gRNA sequence
aaatttaatttgcaaaataa

SEQ ID NO: 70926 - DNA, 20 bp, Artificial
  CRISPR gRNA sequence
aatttgcaaaataaaagaaa

SEQ ID NO: 70927 - DNA, 20 bp, Artificial
  CRISPR gRNA sequence
atttgcaaaataaaagaaag

SEQ ID NO: 70928 - DNA, 20 bp, Artificial
  CRISPR gRNA sequence
gcaaaataaaagaaagtaaa

SEQ ID NO: 70929 - DNA, 20 bp, Artificial
  CRISPR gRNA sequence
caaaataaaagaaagtaaaa

SEQ ID NO: 70930 - DNA, 20 bp, Artificial
  CRISPR gRNA sequence
cccaaggggctaagaccatt

SEQ ID NO: 70931 - DNA, 20 bp, Artificial
  CRISPR gRNA sequence
ccaaggggctaagaccattt

SEQ ID NO: 70932 - DNA, 20 bp, Artificial
  CRISPR gRNA sequence
agaccatttgcctcagctat

SEQ ID NO: 70933 - DNA, 20 bp, Artificial
  CRISPR gRNA sequence
gcctcagctatttattgttt

SEQ ID NO: 70934 - DNA, 20 bp, Artificial
  CRISPR gRNA sequence
cctcagctatttattgtttt

SEQ ID NO: 70935 - DNA, 20 bp, Artificial
  CRISPR gRNA sequence
agctatttattgttttttcc

SEQ ID NO: 70936 - DNA, 20 bp, Artificial
  CRISPR gRNA sequence
tttattgttttttcctaccc

SEQ ID NO: 70937 - DNA, 20 bp, Artificial
  CRISPR gRNA sequence
attgttttttcctacccagg

SEQ ID NO: 70938 - DNA, 20 bp, Artificial
  CRISPR gRNA sequence
ttgttttttcctacccaggc

SEQ ID NO: 70939 - DNA, 20 bp, Artificial
  CRISPR gRNA sequence
ttttttcctacccaggcaga

SEQ ID NO: 70940 - DNA, 20 bp, Artificial
  CRISPR gRNA sequence
tttcctacccaggcagagca

SEQ ID NO: 70941 - DNA, 20 bp, Artificial
  CRISPR gRNA sequence
ttcctacccaggcagagcaa

SEQ ID NO: 70942 - DNA, 20 bp, Artificial
  CRISPR gRNA sequence
tcctacccaggcagagcaag

SEQ ID NO: 70943 - DNA, 20 bp, Artificial
  CRISPR gRNA sequence
cctacccaggcagagcaagg

SEQ ID NO: 70944 - DNA, 20 bp, Artificial
  CRISPR gRNA sequence
ctacccaggcagagcaaggt

SEQ ID NO: 70945 - DNA, 20 bp, Artificial
  CRISPR gRNA sequence
cccaggcagagcaaggtcag

SEQ ID NO: 70946 - DNA, 20 bp, Artificial
  CRISPR gRNA sequence
agtaaagacaataccctggg

SEQ ID NO: 70947 - DNA, 20 bp, Artificial
  CRISPR gRNA sequence
ggtttaaggaaaaacctacc

SEQ ID NO: 70948 - DNA, 20 bp, Artificial
  CRISPR gRNA sequence
aaggaaaaacctaccatttg

SEQ ID NO: 70949 - DNA, 20 bp, Artificial
  CRISPR gRNA sequence
aggaaaaacctaccatttgc

SEQ ID NO: 70950 - DNA, 20 bp, Artificial
  CRISPR gRNA sequence
ccatttgcatggatgagaac

SEQ ID NO: 70951 - DNA, 20 bp, Artificial
  CRISPR gRNA sequence
gcatggatgagaacacatat

SEQ ID NO: 70952 - DNA, 20 bp, Artificial
  CRISPR gRNA sequence
catggatgagaacacatatg

SEQ ID NO: 70953 - DNA, 20 bp, Artificial
  CRISPR gRNA sequence
agaactgatctgcgtgaatc

SEQ ID NO: 70954 - DNA, 20 bp, Artificial
  CRISPR gRNA sequence
atctgcgtgaatcagagaat

SEQ ID NO: 70955 - DNA, 20 bp, Artificial
  CRISPR gRNA sequence
cgtgaatcagagaatcccac

SEQ ID NO: 70956 - DNA, 20 bp, Artificial
  CRISPR gRNA sequence
agccgggccagcccggagat

SEQ ID NO: 70957 - DNA, 20 bp, Artificial
  CRISPR gRNA sequence
acacagaggctgaggtgaag

SEQ ID NO: 70958 - DNA, 20 bp, Artificial
  CRISPR gRNA sequence
aggtgaagcttggcaaagaa

SEQ ID NO: 70959 - DNA, 20 bp, Artificial
  CRISPR gRNA sequence
ggcaaagaaatgtagagact

SEQ ID NO: 70960 - DNA, 20 bp, Artificial
  CRISPR gRNA sequence
gcaaagaaatgtagagactc

SEQ ID NO: 70961 - DNA, 20 bp, Artificial
  CRISPR gRNA sequence
ctcctgggccaggggctctg

SEQ ID NO: 70962 - DNA, 20 bp, Artificial
  CRISPR gRNA sequence
ctgggccaggggctctggat

SEQ ID NO: 70963 - DNA, 20 bp, Artificial
  CRISPR gRNA sequence
ggccaggggctctggatttg

SEQ ID NO: 70964 - DNA, 20 bp, Artificial
  CRISPR gRNA sequence
tggatttgtttccacccagc

SEQ ID NO: 70965 - DNA, 20 bp, Artificial
  CRISPR gRNA sequence
gatttgtttccacccagcct

SEQ ID NO: 70966 - DNA, 20 bp, Artificial
  CRISPR gRNA sequence
gtttccacccagcctgcaag

SEQ ID NO: 70967 - DNA, 20 bp, Artificial
  CRISPR gRNA sequence
tttccacccagcctgcaagt

SEQ ID NO: 70968 - DNA, 20 bp, Artificial
  CRISPR gRNA sequence
ccacccagcctgcaagtccc

SEQ ID NO: 70969 - DNA, 20 bp, Artificial
  CRISPR gRNA sequence
cacccagcctgcaagtccct

SEQ ID NO: 70970 - DNA, 20 bp, Artificial
  CRISPR gRNA sequence
caagtccctaagtctctggc

SEQ ID NO: 70971 - DNA, 20 bp, Artificial
  CRISPR gRNA sequence
agtctctggccagtcacagc

SEQ ID NO: 70972 - DNA, 20 bp, Artificial
  CRISPR gRNA sequence
tggccagtcacagctcactg

SEQ ID NO: 70973 - DNA, 20 bp, Artificial
  CRISPR gRNA sequence
gccagtcacagctcactgct

SEQ ID NO: 70974 - DNA, 20 bp, Artificial
  CRISPR gRNA sequence
actgctggctctcaagtttt

SEQ ID NO: 70975 - DNA, 20 bp, Artificial
  CRISPR gRNA sequence
ctggctctcaagttttctca

SEQ ID NO: 70976 - DNA, 20 bp, Artificial
  CRISPR gRNA sequence
gctctcaagttttctcacct

SEQ ID NO: 70977 - DNA, 20 bp, Artificial
  CRISPR gRNA sequence
tcaagttttctcacctggac

SEQ ID NO: 70978 - DNA, 20 bp, Artificial
  CRISPR gRNA sequence
aagttttctcacctggacac

SEQ ID NO: 70979 - DNA, 20 bp, Artificial
  CRISPR gRNA sequence
tctcacctggacactgggga

SEQ ID NO: 70980 - DNA, 20 bp, Artificial
  CRISPR gRNA sequence
ctcacctggacactggggac

SEQ ID NO: 70981 - DNA, 20 bp, Artificial
  CRISPR gRNA sequence
tcacctggacactggggaca

SEQ ID NO: 70982 - DNA, 20 bp, Artificial
  CRISPR gRNA sequence
acctggacactggggacaat

SEQ ID NO: 70983 - DNA, 20 bp, Artificial
  CRISPR gRNA sequence
gacactggggacaataattc

SEQ ID NO: 70984 - DNA, 20 bp, Artificial
  CRISPR gRNA sequence
gggacaataattcccacctt

SEQ ID NO: 70985 - DNA, 20 bp, Artificial
  CRISPR gRNA sequence
ccaccttgctcaccactccc

SEQ ID NO: 70986 - DNA, 20 bp, Artificial
  CRISPR gRNA sequence
gctcaccactccccacctgc

SEQ ID NO: 70987 - DNA, 20 bp, Artificial
  CRISPR gRNA sequence
ctcaccactccccacctgcc

SEQ ID NO: 70988 - DNA, 20 bp, Artificial
  CRISPR gRNA sequence
accactccccacctgccatg

SEQ ID NO: 70989 - DNA, 20 bp, Artificial
  CRISPR gRNA sequence
cccacctgccatgaccccca

SEQ ID NO: 70990 - DNA, 20 bp, Artificial
  CRISPR gRNA sequence
ccatgacccccagaagtttt

SEQ ID NO: 70991 - DNA, 20 bp, Artificial
  CRISPR gRNA sequence
tgctaccagcatatgaattc

SEQ ID NO: 70992 - DNA, 20 bp, Artificial
  CRISPR gRNA sequence
gctaccagcatatgaattcc

SEQ ID NO: 70993 - DNA, 20 bp, Artificial
  CRISPR gRNA sequence
ctaccagcatatgaattcct

SEQ ID NO: 70994 - DNA, 20 bp, Artificial
  CRISPR gRNA sequence
ccagcatatgaattcctggg

SEQ ID NO: 70995 - DNA, 20 bp, Artificial
  CRISPR gRNA sequence
ctgggcgtgtaaggctttgc

SEQ ID NO: 70996 - DNA, 20 bp, Artificial
  CRISPR gRNA sequence
ggcgtgtaaggctttgcaaa

SEQ ID NO: 70997 - DNA, 20 bp, Artificial
  CRISPR gRNA sequence
tgcaaactgtagagttctta

SEQ ID NO: 70998 - DNA, 20 bp, Artificial
  CRISPR gRNA sequence
gcaaactgtagagttcttag

SEQ ID NO: 70999 - DNA, 20 bp, Artificial
  CRISPR gRNA sequence
caaactgtagagttcttagc

SEQ ID NO: 71000 - DNA, 20 bp, Artificial
  CRISPR gRNA sequence
tagagttcttagcacagcac

SEQ ID NO: 71001 - DNA, 20 bp, Artificial
  CRISPR gRNA sequence
ttagcacagcacctgcaaag

SEQ ID NO: 71002 - DNA, 20 bp, Artificial
  CRISPR gRNA sequence
agcacagcacctgcaaaggc

SEQ ID NO: 71003 - DNA, 20 bp, Artificial
  CRISPR gRNA sequence
gcacagcacctgcaaaggcc

SEQ ID NO: 71004 - DNA, 20 bp, Artificial
  CRISPR gRNA sequence
caaaggcctttaagctcctg

SEQ ID NO: 71005 - DNA, 20 bp, Artificial
  CRISPR gRNA sequence
taagctcctgaaagcctctt

SEQ ID NO: 71006 - DNA, 20 bp, Artificial
  CRISPR gRNA sequence
aagctcctgaaagcctcttg

SEQ ID NO: 71007 - DNA, 20 bp, Artificial
  CRISPR gRNA sequence
agctcctgaaagcctcttgg

SEQ ID NO: 71008 - DNA, 20 bp, Artificial
  CRISPR gRNA sequence
ctgaaagcctcttggtctat

SEQ ID NO: 71009 - DNA, 20 bp, Artificial
  CRISPR gRNA sequence
aaagcctcttggtctattcc

SEQ ID NO: 71010 - DNA, 20 bp, Artificial
  CRISPR gRNA sequence
ttggtctattccctgctttt

SEQ ID NO: 71011 - DNA, 20 bp, Artificial
  CRISPR gRNA sequence
ggtctattccctgcttttcc

SEQ ID NO: 71012 - DNA, 20 bp, Artificial
  CRISPR gRNA sequence
gtctattccctgcttttcca

SEQ ID NO: 71013 - DNA, 20 bp, Artificial
  CRISPR gRNA sequence
ttccctgcttttccagactg

SEQ ID NO: 71014 - DNA, 20 bp, Artificial
  CRISPR gRNA sequence
cctgcttttccagactgaac

SEQ ID NO: 71015 - DNA, 20 bp, Artificial
  CRISPR gRNA sequence
cttttccagactgaacagga

SEQ ID NO: 71016 - DNA, 20 bp, Artificial
  CRISPR gRNA sequence
ttccagactgaacaggaaca

SEQ ID NO: 71017 - DNA, 20 bp, Artificial
  CRISPR gRNA sequence
tccagactgaacaggaacag

SEQ ID NO: 71018 - DNA, 20 bp, Artificial
  CRISPR gRNA sequence
ccagactgaacaggaacagt

SEQ ID NO: 71019 - DNA, 20 bp, Artificial
  CRISPR gRNA sequence
cagactgaacaggaacagta

SEQ ID NO: 71020 - DNA, 20 bp, Artificial
  CRISPR gRNA sequence
aacaggaacagtatcggtga

SEQ ID NO: 71021 - DNA, 20 bp, Artificial
  CRISPR gRNA sequence
ctgccacctttctgaggctc

SEQ ID NO: 71022 - DNA, 20 bp, Artificial
  CRISPR gRNA sequence
ccacctttctgaggctctca

SEQ ID NO: 71023 - DNA, 20 bp, Artificial
  CRISPR gRNA sequence
tctgaggctctcagggctgc

SEQ ID NO: 71024 - DNA, 20 bp, Artificial
  CRISPR gRNA sequence
ctgaggctctcagggctgcc

SEQ ID NO: 71025 - DNA, 20 bp, Artificial
  CRISPR gRNA sequence
tgaggctctcagggctgcca

SEQ ID NO: 71026 - DNA, 20 bp, Artificial
  CRISPR gRNA sequence
aggctctcagggctgccacc

SEQ ID NO: 71027 - DNA, 20 bp, Artificial
  CRISPR gRNA sequence
tcagggctgccaccagccta

SEQ ID NO: 71028 - DNA, 20 bp, Artificial
  CRISPR gRNA sequence
agggctgccaccagcctaga

SEQ ID NO: 71029 - DNA, 20 bp, Artificial
  CRISPR gRNA sequence
ccaccagcctagaggagctg

SEQ ID NO: 71030 - DNA, 20 bp, Artificial
  CRISPR gRNA sequence
gaggagctggagtgagttgc

SEQ ID NO: 71031 - DNA, 20 bp, Artificial
  CRISPR gRNA sequence
gagtgagttgcccattctgc

SEQ ID NO: 71032 - DNA, 20 bp, Artificial
  CRISPR gRNA sequence
cccattctgcccccagaccc

SEQ ID NO: 71033 - DNA, 20 bp, Artificial
  CRISPR gRNA sequence
tgcccccagacccaggacaa

SEQ ID NO: 71034 - DNA, 20 bp, Artificial
  CRISPR gRNA sequence
cccccagacccaggacaatt

SEQ ID NO: 71035 - DNA, 20 bp, Artificial
  CRISPR gRNA sequence
tggccgggaaagatgacaag

SEQ ID NO: 71036 - DNA, 20 bp, Artificial
  CRISPR gRNA sequence
ggccgggaaagatgacaagg

SEQ ID NO: 71037 - DNA, 20 bp, Artificial
  CRISPR gRNA sequence
gccgggaaagatgacaaggg

SEQ ID NO: 71038 - DNA, 20 bp, Artificial
  CRISPR gRNA sequence
cctgagcacgccctttgctt

SEQ ID NO: 71039 - DNA, 20 bp, Artificial
  CRISPR gRNA sequence
agcacgccctttgcttcttc

SEQ ID NO: 71040 - DNA, 20 bp, Artificial
  CRISPR gRNA sequence
tgcttcttcatctcatctcc

SEQ ID NO: 71041 - DNA, 20 bp, Artificial
  CRISPR gRNA sequence
gcttcttcatctcatctcct

SEQ ID NO: 71042 - DNA, 20 bp, Artificial
  CRISPR gRNA sequence
cttcttcatctcatctcctt

SEQ ID NO: 71043 - DNA, 20 bp, Artificial
  CRISPR gRNA sequence
cttcatctcatctccttcac

SEQ ID NO: 71044 - DNA, 20 bp, Artificial
  CRISPR gRNA sequence
ttcatctcatctccttcacc

SEQ ID NO: 71045 - DNA, 20 bp, Artificial
  CRISPR gRNA sequence
catctcatctccttcaccca

SEQ ID NO: 71046 - DNA, 20 bp, Artificial
  CRISPR gRNA sequence
atctcatctccttcacccac

SEQ ID NO: 71047 - DNA, 20 bp, Artificial
  CRISPR gRNA sequence
atctccttcacccacttcta

SEQ ID NO: 71048 - DNA, 20 bp, Artificial
  CRISPR gRNA sequence
cttcacccacttctacactg

SEQ ID NO: 71049 - DNA, 20 bp, Artificial
  CRISPR gRNA sequence
cacccacttctacactgtgt

SEQ ID NO: 71050 - DNA, 20 bp, Artificial
  CRISPR gRNA sequence
acccacttctacactgtgta

SEQ ID NO: 71051 - DNA, 20 bp, Artificial
  CRISPR gRNA sequence
ctacactgtgtaaacaacct

SEQ ID NO: 71052 - DNA, 20 bp, Artificial
  CRISPR gRNA sequence
tacactgtgtaaacaacctg

SEQ ID NO: 71053 - DNA, 20 bp, Artificial
  CRISPR gRNA sequence
cactgtgtaaacaacctggg

SEQ ID NO: 71054 - DNA, 20 bp, Artificial
  CRISPR gRNA sequence
tgtaaacaacctggggccta

SEQ ID NO: 71055 - DNA, 20 bp, Artificial
  CRISPR gRNA sequence
gggcctagaagcttggggga

SEQ ID NO: 71056 - DNA, 20 bp, Artificial
  CRISPR gRNA sequence
gaagcttgggggacccaaag

SEQ ID NO: 71057 - DNA, 20 bp, Artificial
  CRISPR gRNA sequence
gggggacccaaagacaggat

SEQ ID NO: 71058 - DNA, 20 bp, Artificial
  CRISPR gRNA sequence
ggggacccaaagacaggatg

SEQ ID NO: 71059 - DNA, 20 bp, Artificial
  CRISPR gRNA sequence
tagcaagagggatttaggtc

SEQ ID NO: 71060 - DNA, 20 bp, Artificial
  CRISPR gRNA sequence
aggtcagacaatggggagaa

SEQ ID NO: 71061 - DNA, 20 bp, Artificial
  CRISPR gRNA sequence
ggtcagacaatggggagaac

SEQ ID NO: 71062 - DNA, 20 bp, Artificial
  CRISPR gRNA sequence
aacagaagccaagggttagg

SEQ ID NO: 71063 - DNA, 20 bp, Artificial
  CRISPR gRNA sequence
ggagctgtcactcaacatgg

SEQ ID NO: 71064 - DNA, 20 bp, Artificial
  CRISPR gRNA sequence
tcactcaacatggggtgatg

SEQ ID NO: 71065 - DNA, 20 bp, Artificial
  CRISPR gRNA sequence
aacatggggtgatggggctc

SEQ ID NO: 71066 - DNA, 20 bp, Artificial
  CRISPR gRNA sequence
tctgtgtgagtcgaggccct

SEQ ID NO: 71067 - DNA, 20 bp, Artificial
  CRISPR gRNA sequence
tgtgtgagtcgaggcccttc

SEQ ID NO: 71068 - DNA, 20 bp, Artificial
  CRISPR gRNA sequence
tgtgagtcgaggcccttcct

SEQ ID NO: 71069 - DNA, 20 bp, Artificial
  CRISPR gRNA sequence
cctgggacttcagcctcccc

SEQ ID NO: 71070 - DNA, 20 bp, Artificial
  CRISPR gRNA sequence
ctgggacttcagcctcccct

SEQ ID NO: 71071 - DNA, 20 bp, Artificial
  CRISPR gRNA sequence
ggacttcagcctccccttct

SEQ ID NO: 71072 - DNA, 20 bp, Artificial
  CRISPR gRNA sequence
cagcctccccttctttttct

SEQ ID NO: 71073 - DNA, 20 bp, Artificial
  CRISPR gRNA sequence
agcctccccttctttttctg

SEQ ID NO: 71074 - DNA, 20 bp, Artificial
  CRISPR gRNA sequence
cccttctttttctgggagtg

SEQ ID NO: 71075 - DNA, 20 bp, Artificial
  CRISPR gRNA sequence
ctttttctgggagtggggtg

SEQ ID NO: 71076 - DNA, 20 bp, Artificial
  CRISPR gRNA sequence
tttttctgggagtggggtgt

SEQ ID NO: 71077 - DNA, 20 bp, Artificial
  CRISPR gRNA sequence
tttctgggagtggggtgtgg

SEQ ID NO: 71078 - DNA, 20 bp, Artificial
  CRISPR gRNA sequence
ttctgggagtggggtgtgga

SEQ ID NO: 71079 - DNA, 20 bp, Artificial
  CRISPR gRNA sequence
tctgggagtggggtgtggac

SEQ ID NO: 71080 - DNA, 20 bp, Artificial
  CRISPR gRNA sequence
ctgggagtggggtgtggaca

SEQ ID NO: 71081 - DNA, 20 bp, Artificial
  CRISPR gRNA sequence
tgggagtggggtgtggacaa

SEQ ID NO: 71082 - DNA, 20 bp, Artificial
  CRISPR gRNA sequence
ggagtggggtgtggacaaga

SEQ ID NO: 71083 - DNA, 20 bp, Artificial
  CRISPR gRNA sequence
atgaagctgttttctccccc

SEQ ID NO: 71084 - DNA, 20 bp, Artificial
  CRISPR gRNA sequence
ttttctcccccaagcttgag

SEQ ID NO: 71085 - DNA, 20 bp, Artificial
  CRISPR gRNA sequence
tctcccccaagcttgagcca

SEQ ID NO: 71086 - DNA, 20 bp, Artificial
  CRISPR gRNA sequence
ctcccccaagcttgagccac

SEQ ID NO: 71087 - DNA, 20 bp, Artificial
  CRISPR gRNA sequence
tcccccaagcttgagccaca

SEQ ID NO: 71088 - DNA, 20 bp, Artificial
  CRISPR gRNA sequence
ccccaagcttgagccacaac

SEQ ID NO: 71089 - DNA, 20 bp, Artificial
  CRISPR gRNA sequence
gagccacaaccagattggag

SEQ ID NO: 71090 - DNA, 20 bp, Artificial
  CRISPR gRNA sequence
agccacaaccagattggaga

SEQ ID NO: 71091 - DNA, 20 bp, Artificial
  CRISPR gRNA sequence
gagacgctggtgtccagcac

SEQ ID NO: 71092 - DNA, 20 bp, Artificial
  CRISPR gRNA sequence
gtgtccagcacttagctacc

SEQ ID NO: 71093 - DNA, 20 bp, Artificial
  CRISPR gRNA sequence
agctaccatcctgcctgggc

SEQ ID NO: 71094 - DNA, 20 bp, Artificial
  CRISPR gRNA sequence
gctaccatcctgcctgggct

SEQ ID NO: 71095 - DNA, 20 bp, Artificial
  CRISPR gRNA sequence
ccatcctgcctgggctgcca

SEQ ID NO: 71096 - DNA, 20 bp, Artificial
  CRISPR gRNA sequence
cctgggctgccagagctcag

SEQ ID NO: 71097 - DNA, 20 bp, Artificial
  CRISPR gRNA sequence
ggctgccagagctcaggaag

SEQ ID NO: 71098 - DNA, 20 bp, Artificial
  CRISPR gRNA sequence
ccagagctcaggaagataga

SEQ ID NO: 71099 - DNA, 20 bp, Artificial
  CRISPR gRNA sequence
aggaagatagagtgagtagc

SEQ ID NO: 71100 - DNA, 20 bp, Artificial
  CRISPR gRNA sequence
cagaggagggccacaggggt

SEQ ID NO: 71101 - DNA, 20 bp, Artificial
  CRISPR gRNA sequence
ggagatactggcccctagct

SEQ ID NO: 71102 - DNA, 20 bp, Artificial
  CRISPR gRNA sequence
gcccctagctgaggccagca

SEQ ID NO: 71103 - DNA, 20 bp, Artificial
  CRISPR gRNA sequence
gctgaggccagcatggtaaa

SEQ ID NO: 71104 - DNA, 20 bp, Artificial
  CRISPR gRNA sequence
aggccagcatggtaaaatct

SEQ ID NO: 71105 - DNA, 20 bp, Artificial
  CRISPR gRNA sequence
ccctgcgccaacctcagtgt

SEQ ID NO: 71106 - DNA, 20 bp, Artificial
  CRISPR gRNA sequence
cgccaacctcagtgtccagg

SEQ ID NO: 71107 - DNA, 20 bp, Artificial
  CRISPR gRNA sequence
agtgtccaggcagtggggct

SEQ ID NO: 71108 - DNA, 20 bp, Artificial
  CRISPR gRNA sequence
ggtgacctcctggccctcac

SEQ ID NO: 71109 - DNA, 20 bp, Artificial
  CRISPR gRNA sequence
ctggccctcactgcgggacc

SEQ ID NO: 71110 - DNA, 20 bp, Artificial
  CRISPR gRNA sequence
gccctcactgcgggacctta

SEQ ID NO: 71111 - DNA, 20 bp, Artificial
  CRISPR gRNA sequence
actgcgggaccttaagccac

SEQ ID NO: 71112 - DNA, 20 bp, Artificial
  CRISPR gRNA sequence
cgggaccttaagccacccca

SEQ ID NO: 71113 - DNA, 20 bp, Artificial
  CRISPR gRNA sequence
aagccaccccagcccctgct

SEQ ID NO: 71114 - DNA, 20 bp, Artificial
  CRISPR gRNA sequence
agccaccccagcccctgctc

SEQ ID NO: 71115 - DNA, 20 bp, Artificial
  CRISPR gRNA sequence
ctcttctctgggcctttctg

SEQ ID NO: 71116 - DNA, 20 bp, Artificial
  CRISPR gRNA sequence
ttctctgggcctttctgcct

SEQ ID NO: 71117 - DNA, 20 bp, Artificial
  CRISPR gRNA sequence
ctctgggcctttctgcctca

SEQ ID NO: 71118 - DNA, 20 bp, Artificial
  CRISPR gRNA sequence
tctgggcctttctgcctcat

SEQ ID NO: 71119 - DNA, 20 bp, Artificial
  CRISPR gRNA sequence
tgggcctttctgcctcattg

SEQ ID NO: 71120 - DNA, 20 bp, Artificial
  CRISPR gRNA sequence
ggcctttctgcctcattgtc

SEQ ID NO: 71121 - DNA, 20 bp, Artificial
  CRISPR gRNA sequence
tctgcctcattgtctgggta

SEQ ID NO: 71122 - DNA, 20 bp, Artificial
  CRISPR gRNA sequence
ctgcctcattgtctgggtag

SEQ ID NO: 71123 - DNA, 20 bp, Artificial
  CRISPR gRNA sequence
tgcctcattgtctgggtagg

SEQ ID NO: 71124 - DNA, 20 bp, Artificial
  CRISPR gRNA sequence
cctcattgtctgggtaggtg

SEQ ID NO: 71125 - DNA, 20 bp, Artificial
  CRISPR gRNA sequence
attgtctgggtaggtgtgtg

SEQ ID NO: 71126 - DNA, 20 bp, Artificial
  CRISPR gRNA sequence
tctgggtaggtgtgtggtgt

SEQ ID NO: 71127 - DNA, 20 bp, Artificial
  CRISPR gRNA sequence
ggtaggtgtgtggtgtcggg

SEQ ID NO: 71128 - DNA, 20 bp, Artificial
  CRISPR gRNA sequence
tctcttaggccccctgaagc

SEQ ID NO: 71129 - DNA, 20 bp, Artificial
  CRISPR gRNA sequence
ttaggccccctgaagcaggg

SEQ ID NO: 71130 - DNA, 20 bp, Artificial
  CRISPR gRNA sequence
aggccccctgaagcaggggt

SEQ ID NO: 71131 - DNA, 20 bp, Artificial
  CRISPR gRNA sequence
ggccccctgaagcaggggtg

SEQ ID NO: 71132 - DNA, 20 bp, Artificial
  CRISPR gRNA sequence
aagcaggggtggcagaccca

SEQ ID NO: 71133 - DNA, 20 bp, Artificial
  CRISPR gRNA sequence
gggtgtcggggagagggggc

SEQ ID NO: 71134 - DNA, 20 bp, Artificial
  CRISPR gRNA sequence
atggctgcccccctcccaca

SEQ ID NO: 71135 - DNA, 20 bp, Artificial
  CRISPR gRNA sequence
cccccctcccacagcctctc

SEQ ID NO: 71136 - DNA, 20 bp, Artificial
  CRISPR gRNA sequence
ccacagcctctcagggaata

SEQ ID NO: 71137 - DNA, 20 bp, Artificial
  CRISPR gRNA sequence
tcagggaatagcatcagctc

SEQ ID NO: 71138 - DNA, 20 bp, Artificial
  CRISPR gRNA sequence
agggaatagcatcagctcag

SEQ ID NO: 71139 - DNA, 20 bp, Artificial
  CRISPR gRNA sequence
agccgggggagtgcagttgg

SEQ ID NO: 71140 - DNA, 20 bp, Artificial
  CRISPR gRNA sequence
gcagagtctctcgttctttg

SEQ ID NO: 71141 - DNA, 20 bp, Artificial
  CRISPR gRNA sequence
tcgttctttgcaggcgcctg

SEQ ID NO: 71142 - DNA, 20 bp, Artificial
  CRISPR gRNA sequence
gttctttgcaggcgcctgga

SEQ ID NO: 71143 - DNA, 20 bp, Artificial
  CRISPR gRNA sequence
tttgcaggcgcctggaggag

SEQ ID NO: 71144 - DNA, 20 bp, Artificial
  CRISPR gRNA sequence
tgcaggcgcctggaggagtt

SEQ ID NO: 71145 - DNA, 20 bp, Artificial
  CRISPR gRNA sequence
gcaggcgcctggaggagttg

SEQ ID NO: 71146 - DNA, 20 bp, Artificial
  CRISPR gRNA sequence
caggcgcctggaggagttga

SEQ ID NO: 71147 - DNA, 20 bp, Artificial
  CRISPR gRNA sequence
gaggagttgatgtgagtgtc

SEQ ID NO: 71148 - DNA, 20 bp, Artificial
  CRISPR gRNA sequence
atgtgagtgtctgcccaggt

SEQ ID NO: 71149 - DNA, 20 bp, Artificial
  CRISPR gRNA sequence
cccaggtggcctctgccctc

SEQ ID NO: 71150 - DNA, 20 bp, Artificial
  CRISPR gRNA sequence
tgccctctgtgccccccagg

SEQ ID NO: 71151 - DNA, 20 bp, Artificial
  CRISPR gRNA sequence
ccctctgtgccccccaggtc

SEQ ID NO: 71152 - DNA, 20 bp, Artificial
  CRISPR gRNA sequence
tgtgccccccaggtccacct

SEQ ID NO: 71153 - DNA, 20 bp, Artificial
  CRISPR gRNA sequence
tgccccccaggtccacctgg

SEQ ID NO: 71154 - DNA, 20 bp, Artificial
  CRISPR gRNA sequence
gcctcctctcccgcagtggg

SEQ ID NO: 71155 - DNA, 20 bp, Artificial
  CRISPR gRNA sequence
ctctcccgcagtgggcacag

SEQ ID NO: 71156 - DNA, 20 bp, Artificial
  CRISPR gRNA sequence
tcccgcagtgggcacagggc

SEQ ID NO: 71157 - DNA, 20 bp, Artificial
  CRISPR gRNA sequence
ccgcagtgggcacagggcag

SEQ ID NO: 71158 - DNA, 20 bp, Artificial
  CRISPR gRNA sequence
aatgctcattcctctcctct

SEQ ID NO: 71159 - DNA, 20 bp, Artificial
  CRISPR gRNA sequence
attcctctcctcttccaggc

SEQ ID NO: 71160 - DNA, 20 bp, Artificial
  CRISPR gRNA sequence
ctctcctcttccaggcttgg

SEQ ID NO: 71161 - DNA, 20 bp, Artificial
  CRISPR gRNA sequence
tcctcttccaggcttggctg

SEQ ID NO: 71162 - DNA, 20 bp, Artificial
  CRISPR gRNA sequence
ctcttccaggcttggctgca

SEQ ID NO: 71163 - DNA, 20 bp, Artificial
  CRISPR gRNA sequence
ttccaggcttggctgcaatg

SEQ ID NO: 71164 - DNA, 20 bp, Artificial
  CRISPR gRNA sequence
ccaggcttggctgcaatgcc

SEQ ID NO: 71165 - DNA, 20 bp, Artificial
  CRISPR gRNA sequence
caggcttggctgcaatgccc

SEQ ID NO: 71166 - DNA, 20 bp, Artificial
  CRISPR gRNA sequence
ggctgcaatgccctggggga

SEQ ID NO: 71167 - DNA, 20 bp, Artificial
  CRISPR gRNA sequence
gctgcaatgccctgggggat

SEQ ID NO: 71168 - DNA, 20 bp, Artificial
  CRISPR gRNA sequence
caatgccctgggggatccca

SEQ ID NO: 71169 - DNA, 20 bp, Artificial
  CRISPR gRNA sequence
ggggatcccacagccctggg

SEQ ID NO: 71170 - DNA, 20 bp, Artificial
  CRISPR gRNA sequence
gggctggctcaggagctgcc

SEQ ID NO: 71171 - DNA, 20 bp, Artificial
  CRISPR gRNA sequence
gctcaggagctgccccagca

SEQ ID NO: 71172 - DNA, 20 bp, Artificial
  CRISPR gRNA sequence
aggagctgccccagcacctg

SEQ ID NO: 71173 - DNA, 20 bp, Artificial
  CRISPR gRNA sequence
ccccagcacctgagggtcct

SEQ ID NO: 71174 - DNA, 20 bp, Artificial
  CRISPR gRNA sequence
agggtcctacagtgagtggc

SEQ ID NO: 71175 - DNA, 20 bp, Artificial
  CRISPR gRNA sequence
cagtgagtggccccctgccc

SEQ ID NO: 71176 - DNA, 20 bp, Artificial
  CRISPR gRNA sequence
cccataccatgcagggctgg

SEQ ID NO: 71177 - DNA, 20 bp, Artificial
  CRISPR gRNA sequence
gtggggaggagggtcctcgg

SEQ ID NO: 71178 - DNA, 20 bp, Artificial
  CRISPR gRNA sequence
gggagcagtgggggggtcca

SEQ ID NO: 71179 - DNA, 20 bp, Artificial
  CRISPR gRNA sequence
agctgccctgccccaagtca

SEQ ID NO: 71180 - DNA, 20 bp, Artificial
  CRISPR gRNA sequence
ccctgccccaagtcaagctt

SEQ ID NO: 71181 - DNA, 20 bp, Artificial
  CRISPR gRNA sequence
ccccaagtcaagcttggcat

SEQ ID NO: 71182 - DNA, 20 bp, Artificial
  CRISPR gRNA sequence
ggcatatacccactctcctg

SEQ ID NO: 71183 - DNA, 20 bp, Artificial
  CRISPR gRNA sequence
gcatatacccactctcctgc

SEQ ID NO: 71184 - DNA, 20 bp, Artificial
  CRISPR gRNA sequence
tcctgcctgttccttccctg

SEQ ID NO: 71185 - DNA, 20 bp, Artificial
  CRISPR gRNA sequence
ctgcctgttccttccctgcc

SEQ ID NO: 71186 - DNA, 20 bp, Artificial
  CRISPR gRNA sequence
cctgttccttccctgcctct

SEQ ID NO: 71187 - DNA, 20 bp, Artificial
  CRISPR gRNA sequence
ttccttccctgcctctgatg

SEQ ID NO: 71188 - DNA, 20 bp, Artificial
  CRISPR gRNA sequence
cttccctgcctctgatgtct

SEQ ID NO: 71189 - DNA, 20 bp, Artificial
  CRISPR gRNA sequence
ccctgcctctgatgtctgca

SEQ ID NO: 71190 - DNA, 20 bp, Artificial
  CRISPR gRNA sequence
cctgcctctgatgtctgcag

SEQ ID NO: 71191 - DNA, 20 bp, Artificial
  CRISPR gRNA sequence
cctctgatgtctgcagcaag

SEQ ID NO: 71192 - DNA, 20 bp, Artificial
  CRISPR gRNA sequence
tgatgtctgcagcaagaaaa

SEQ ID NO: 71193 - DNA, 20 bp, Artificial
  CRISPR gRNA sequence
atgtctgcagcaagaaaatc

SEQ ID NO: 71194 - DNA, 20 bp, Artificial
  CRISPR gRNA sequence
cagcaagaaaatcaggaggc

SEQ ID NO: 71195 - DNA, 20 bp, Artificial
  CRISPR gRNA sequence
gtcctggctctgccactggc

SEQ ID NO: 71196 - DNA, 20 bp, Artificial
  CRISPR gRNA sequence
gctctgccactggcccctgc

SEQ ID NO: 71197 - DNA, 20 bp, Artificial
  CRISPR gRNA sequence
tgccactggcccctgcctga

SEQ ID NO: 71198 - DNA, 20 bp, Artificial
  CRISPR gRNA sequence
ccactggcccctgcctgacc

SEQ ID NO: 71199 - DNA, 20 bp, Artificial
  CRISPR gRNA sequence
gcccctgcctgaccttggcc

SEQ ID NO: 71200 - DNA, 20 bp, Artificial
  CRISPR gRNA sequence
cctgaccttggccaaacccc

SEQ ID NO: 71201 - DNA, 20 bp, Artificial
  CRISPR gRNA sequence
accttggccaaacccctgcc

SEQ ID NO: 71202 - DNA, 20 bp, Artificial
  CRISPR gRNA sequence
ggccaaacccctgccccttc

SEQ ID NO: 71203 - DNA, 20 bp, Artificial
  CRISPR gRNA sequence
gccaaacccctgccccttct

SEQ ID NO: 71204 - DNA, 20 bp, Artificial
  CRISPR gRNA sequence
ccccttctcagcctcagttt

SEQ ID NO: 71205 - DNA, 20 bp, Artificial
  CRISPR gRNA sequence
ctcagcctcagtttcttcac

SEQ ID NO: 71206 - DNA, 20 bp, Artificial
  CRISPR gRNA sequence
tcagcctcagtttcttcaca

SEQ ID NO: 71207 - DNA, 20 bp, Artificial
  CRISPR gRNA sequence
agcctcagtttcttcacatg

SEQ ID NO: 71208 - DNA, 20 bp, Artificial
  CRISPR gRNA sequence
agtttcttcacatgcaaaag

SEQ ID NO: 71209 - DNA, 20 bp, Artificial
  CRISPR gRNA sequence
cttcacatgcaaaagaagta

SEQ ID NO: 71210 - DNA, 20 bp, Artificial
  CRISPR gRNA sequence
ttcacatgcaaaagaagtac

SEQ ID NO: 71211 - DNA, 20 bp, Artificial
  CRISPR gRNA sequence
cacatgcaaaagaagtacaa

SEQ ID NO: 71212 - DNA, 20 bp, Artificial
  CRISPR gRNA sequence
acatgcaaaagaagtacaat

SEQ ID NO: 71213 - DNA, 20 bp, Artificial
  CRISPR gRNA sequence
attgtgccctgtgagcgggt

SEQ ID NO: 71214 - DNA, 20 bp, Artificial
  CRISPR gRNA sequence
tgccctgtgagcgggtccct

SEQ ID NO: 71215 - DNA, 20 bp, Artificial
  CRISPR gRNA sequence
tgagcgggtccctgagggcg

SEQ ID NO: 71216 - DNA, 20 bp, Artificial
  CRISPR gRNA sequence
agggcgaatgagaaatcctg

SEQ ID NO: 71217 - DNA, 20 bp, Artificial
  CRISPR gRNA sequence
gcagagggcttcgcaggagc

SEQ ID NO: 71218 - DNA, 20 bp, Artificial
  CRISPR gRNA sequence
cgcaggagcacggtgccaat

SEQ ID NO: 71219 - DNA, 20 bp, Artificial
  CRISPR gRNA sequence
gcaggagcacggtgccaatc

SEQ ID NO: 71220 - DNA, 20 bp, Artificial
  CRISPR gRNA sequence
agcacttcacaaatgacctc

SEQ ID NO: 71221 - DNA, 20 bp, Artificial
  CRISPR gRNA sequence
cacaaatgacctcattgcag

SEQ ID NO: 71222 - DNA, 20 bp, Artificial
  CRISPR gRNA sequence
acaaatgacctcattgcagc

SEQ ID NO: 71223 - DNA, 20 bp, Artificial
  CRISPR gRNA sequence
attgcagccccatggcagcc

SEQ ID NO: 71224 - DNA, 20 bp, Artificial
  CRISPR gRNA sequence
cagccccatggcagccccca

SEQ ID NO: 71225 - DNA, 20 bp, Artificial
  CRISPR gRNA sequence
ggaccttgtttttttttttt

SEQ ID NO: 71226 - DNA, 20 bp, Artificial
  CRISPR gRNA sequence
gttttttttttttttttttt

SEQ ID NO: 71227 - DNA, 20 bp, Artificial
  CRISPR gRNA sequence
tttttttttttttttttttt

SEQ ID NO: 71228 - DNA, 20 bp, Artificial
  CRISPR gRNA sequence
tttttttttttttttttttt

SEQ ID NO: 71229 - DNA, 20 bp, Artificial
  CRISPR gRNA sequence
tttttttttttttttttttt

SEQ ID NO: 71230 - DNA, 20 bp, Artificial
  CRISPR gRNA sequence
ttttttttttttttttttta

SEQ ID NO: 71231 - DNA, 20 bp, Artificial
  CRISPR gRNA sequence
ttttttttttttttttttag

SEQ ID NO: 71232 - DNA, 20 bp, Artificial
  CRISPR gRNA sequence
tttttttttttttttttaga

SEQ ID NO: 71233 - DNA, 20 bp, Artificial
  CRISPR gRNA sequence
ttttttttttttttttagat

SEQ ID NO: 71234 - DNA, 20 bp, Artificial
  CRISPR gRNA sequence
tttttttttttttttagatg

SEQ ID NO: 71235 - DNA, 20 bp, Artificial
  CRISPR gRNA sequence
ttttttttttttttagatgg

SEQ ID NO: 71236 - DNA, 20 bp, Artificial
  CRISPR gRNA sequence
tttttttttttttagatgga

SEQ ID NO: 71237 - DNA, 20 bp, Artificial
  CRISPR gRNA sequence
ttttttttttttagatggag

SEQ ID NO: 71238 - DNA, 20 bp, Artificial
  CRISPR gRNA sequence
tttttttttttagatggagt

SEQ ID NO: 71239 - DNA, 20 bp, Artificial
  CRISPR gRNA sequence
ttttttttttagatggagtc

SEQ ID NO: 71240 - DNA, 20 bp, Artificial
  CRISPR gRNA sequence
tttttttttagatggagtct

SEQ ID NO: 71241 - DNA, 20 bp, Artificial
  CRISPR gRNA sequence
ttttttttagatggagtctc

SEQ ID NO: 71242 - DNA, 20 bp, Artificial
  CRISPR gRNA sequence
tttttttagatggagtctct

SEQ ID NO: 71243 - DNA, 20 bp, Artificial
  CRISPR gRNA sequence
ttttttagatggagtctctc

SEQ ID NO: 71244 - DNA, 20 bp, Artificial
  CRISPR gRNA sequence
tttttagatggagtctctct

SEQ ID NO: 71245 - DNA, 20 bp, Artificial
  CRISPR gRNA sequence
ttttagatggagtctctctc

SEQ ID NO: 71246 - DNA, 20 bp, Artificial
  CRISPR gRNA sequence
tttagatggagtctctctct

SEQ ID NO: 71247 - DNA, 20 bp, Artificial
  CRISPR gRNA sequence
ttagatggagtctctctctg

SEQ ID NO: 71248 - DNA, 20 bp, Artificial
  CRISPR gRNA sequence
tagatggagtctctctctgt

SEQ ID NO: 71249 - DNA, 20 bp, Artificial
  CRISPR gRNA sequence
agatggagtctctctctgtc

SEQ ID NO: 71250 - DNA, 20 bp, Artificial
  CRISPR gRNA sequence
gatggagtctctctctgtca

SEQ ID NO: 71251 - DNA, 20 bp, Artificial
  CRISPR gRNA sequence
tctctgtcacccaggctgga

SEQ ID NO: 71252 - DNA, 20 bp, Artificial
  CRISPR gRNA sequence
tctgtcacccaggctggagt

SEQ ID NO: 71253 - DNA, 20 bp, Artificial
  CRISPR gRNA sequence
tgtcacccaggctggagtgc

SEQ ID NO: 71254 - DNA, 20 bp, Artificial
  CRISPR gRNA sequence
tcacccaggctggagtgcag

SEQ ID NO: 71255 - DNA, 20 bp, Artificial
  CRISPR gRNA sequence
gagtgcagtggtgcaacctc

SEQ ID NO: 71256 - DNA, 20 bp, Artificial
  CRISPR gRNA sequence
ggctcactgcaacctccacc

SEQ ID NO: 71257 - DNA, 20 bp, Artificial
  CRISPR gRNA sequence
actgcaacctccacctcccg

SEQ ID NO: 71258 - DNA, 20 bp, Artificial
  CRISPR gRNA sequence
caacctccacctcccgggtt

SEQ ID NO: 71259 - DNA, 20 bp, Artificial
  CRISPR gRNA sequence
cacctcccgggttcaagcaa

SEQ ID NO: 71260 - DNA, 20 bp, Artificial
  CRISPR gRNA sequence
ccgggttcaagcaattcttg

SEQ ID NO: 71261 - DNA, 20 bp, Artificial
  CRISPR gRNA sequence
aagcaattcttgtgcctcag

SEQ ID NO: 71262 - DNA, 20 bp, Artificial
  CRISPR gRNA sequence
ttgtgcctcagctaccagag

SEQ ID NO: 71263 - DNA, 20 bp, Artificial
  CRISPR gRNA sequence
gtgcctcagctaccagagta

SEQ ID NO: 71264 - DNA, 20 bp, Artificial
  CRISPR gRNA sequence
tgcctcagctaccagagtag

SEQ ID NO: 71265 - DNA, 20 bp, Artificial
  CRISPR gRNA sequence
agctaccagagtagctggga

SEQ ID NO: 71266 - DNA, 20 bp, Artificial
  CRISPR gRNA sequence
ccagagtagctgggattacg

SEQ ID NO: 71267 - DNA, 20 bp, Artificial
  CRISPR gRNA sequence
ggattacgagcatgcccacc

SEQ ID NO: 71268 - DNA, 20 bp, Artificial
  CRISPR gRNA sequence
cgagcatgcccaccatgccc

SEQ ID NO: 71269 - DNA, 20 bp, Artificial
  CRISPR gRNA sequence
atttttgtatttttagtaga

SEQ ID NO: 71270 - DNA, 20 bp, Artificial
  CRISPR gRNA sequence
ttgtatttttagtagagacg

SEQ ID NO: 71271 - DNA, 20 bp, Artificial
  CRISPR gRNA sequence
tgtatttttagtagagacgg

SEQ ID NO: 71272 - DNA, 20 bp, Artificial
  CRISPR gRNA sequence
gtatttttagtagagacggc

SEQ ID NO: 71273 - DNA, 20 bp, Artificial
  CRISPR gRNA sequence
tatttttagtagagacggca

SEQ ID NO: 71274 - DNA, 20 bp, Artificial
  CRISPR gRNA sequence
ttagtagagacggcatttca

SEQ ID NO: 71275 - DNA, 20 bp, Artificial
  CRISPR gRNA sequence
tagtagagacggcatttcac

SEQ ID NO: 71276 - DNA, 20 bp, Artificial
  CRISPR gRNA sequence
agtagagacggcatttcacc

SEQ ID NO: 71277 - DNA, 20 bp, Artificial
  CRISPR gRNA sequence
gtagagacggcatttcacca

SEQ ID NO: 71278 - DNA, 20 bp, Artificial
  CRISPR gRNA sequence
caccatattgcccaggctgg

SEQ ID NO: 71279 - DNA, 20 bp, Artificial
  CRISPR gRNA sequence
accatattgcccaggctggt

SEQ ID NO: 71280 - DNA, 20 bp, Artificial
  CRISPR gRNA sequence
cccaggctggtcttggactc

SEQ ID NO: 71281 - DNA, 20 bp, Artificial
  CRISPR gRNA sequence
gtcttggactcctggcctca

SEQ ID NO: 71282 - DNA, 20 bp, Artificial
  CRISPR gRNA sequence
ggactcctggcctcaagtga

SEQ ID NO: 71283 - DNA, 20 bp, Artificial
  CRISPR gRNA sequence
gactcctggcctcaagtgat

SEQ ID NO: 71284 - DNA, 20 bp, Artificial
  CRISPR gRNA sequence
ctggcctcaagtgatccacc

SEQ ID NO: 71285 - DNA, 20 bp, Artificial
  CRISPR gRNA sequence
gcctcaagtgatccacccac

SEQ ID NO: 71286 - DNA, 20 bp, Artificial
  CRISPR gRNA sequence
aagtgatccacccacctcag

SEQ ID NO: 71287 - DNA, 20 bp, Artificial
  CRISPR gRNA sequence
agcctccaaaagtgctggga

SEQ ID NO: 71288 - DNA, 20 bp, Artificial
  CRISPR gRNA sequence
caaaagtgctgggattacag

SEQ ID NO: 71289 - DNA, 20 bp, Artificial
  CRISPR gRNA sequence
ggattacaggcgtgagccac

SEQ ID NO: 71290 - DNA, 20 bp, Artificial
  CRISPR gRNA sequence
caggcgtgagccaccatggc

SEQ ID NO: 71291 - DNA, 20 bp, Artificial
  CRISPR gRNA sequence
gctggtgctgggacttttat

SEQ ID NO: 71292 - DNA, 20 bp, Artificial
  CRISPR gRNA sequence
gtgctgggacttttatgtgc

SEQ ID NO: 71293 - DNA, 20 bp, Artificial
  CRISPR gRNA sequence
ggacttttatgtgctccctt

SEQ ID NO: 71294 - DNA, 20 bp, Artificial
  CRISPR gRNA sequence
ttatgtgctcccttttccag

SEQ ID NO: 71295 - DNA, 20 bp, Artificial
  CRISPR gRNA sequence
tatgtgctcccttttccagg

SEQ ID NO: 71296 - DNA, 20 bp, Artificial
  CRISPR gRNA sequence
atgtgctcccttttccaggc

SEQ ID NO: 71297 - DNA, 20 bp, Artificial
  CRISPR gRNA sequence
tgtgctcccttttccaggca

SEQ ID NO: 71298 - DNA, 20 bp, Artificial
  CRISPR gRNA sequence
ccttttccaggcaagggaat

SEQ ID NO: 71299 - DNA, 20 bp, Artificial
  CRISPR gRNA sequence
ttccaggcaagggaatgaag

SEQ ID NO: 71300 - DNA, 20 bp, Artificial
  CRISPR gRNA sequence
tccaggcaagggaatgaagg

SEQ ID NO: 71301 - DNA, 20 bp, Artificial
  CRISPR gRNA sequence
ccaggcaagggaatgaaggc

SEQ ID NO: 71302 - DNA, 20 bp, Artificial
  CRISPR gRNA sequence
caggcaagggaatgaaggcc

SEQ ID NO: 71303 - DNA, 20 bp, Artificial
  CRISPR gRNA sequence
tccttactcatacacgaagg

SEQ ID NO: 71304 - DNA, 20 bp, Artificial
  CRISPR gRNA sequence
ccttactcatacacgaagga

SEQ ID NO: 71305 - DNA, 20 bp, Artificial
  CRISPR gRNA sequence
cttactcatacacgaaggac

SEQ ID NO: 71306 - DNA, 20 bp, Artificial
  CRISPR gRNA sequence
actcatacacgaaggaccca

SEQ ID NO: 71307 - DNA, 20 bp, Artificial
  CRISPR gRNA sequence
ctcatacacgaaggacccag

SEQ ID NO: 71308 - DNA, 20 bp, Artificial
  CRISPR gRNA sequence
atacacgaaggacccaggtg

SEQ ID NO: 71309 - DNA, 20 bp, Artificial
  CRISPR gRNA sequence
aatttgggatctcagacccc

SEQ ID NO: 71310 - DNA, 20 bp, Artificial
  CRISPR gRNA sequence
gggatctcagaccccaaagc

SEQ ID NO: 71311 - DNA, 20 bp, Artificial
  CRISPR gRNA sequence
ggatctcagaccccaaagcc

SEQ ID NO: 71312 - DNA, 20 bp, Artificial
  CRISPR gRNA sequence
agaccccaaagccagggtcc

SEQ ID NO: 71313 - DNA, 20 bp, Artificial
  CRISPR gRNA sequence
gatacctacccaggtcctgt

SEQ ID NO: 71314 - DNA, 20 bp, Artificial
  CRISPR gRNA sequence
atacctacccaggtcctgtg

SEQ ID NO: 71315 - DNA, 20 bp, Artificial
  CRISPR gRNA sequence
cccaggtcctgtgtggatgg

SEQ ID NO: 71316 - DNA, 20 bp, Artificial
  CRISPR gRNA sequence
tgtggatggggaattagcca

SEQ ID NO: 71317 - DNA, 20 bp, Artificial
  CRISPR gRNA sequence
gccagagactgtctacgggc

SEQ ID NO: 71318 - DNA, 20 bp, Artificial
  CRISPR gRNA sequence
tctacgggctggcactgcag

SEQ ID NO: 71319 - DNA, 20 bp, Artificial
  CRISPR gRNA sequence
cgggctggcactgcagcctg

SEQ ID NO: 71320 - DNA, 20 bp, Artificial
  CRISPR gRNA sequence
gcactgcagcctgagacaag

SEQ ID NO: 71321 - DNA, 20 bp, Artificial
  CRISPR gRNA sequence
cagcctgagacaaggctgag

SEQ ID NO: 71322 - DNA, 20 bp, Artificial
  CRISPR gRNA sequence
agacaaggctgagggtgggg

SEQ ID NO: 71323 - DNA, 20 bp, Artificial
  CRISPR gRNA sequence
agggtggggctctggaaacg

SEQ ID NO: 71324 - DNA, 20 bp, Artificial
  CRISPR gRNA sequence
tggaaacgccagtccctcag

SEQ ID NO: 71325 - DNA, 20 bp, Artificial
  CRISPR gRNA sequence
gaaacgccagtccctcaggc

SEQ ID NO: 71326 - DNA, 20 bp, Artificial
  CRISPR gRNA sequence
aggctcctctcaccctctcc

SEQ ID NO: 71327 - DNA, 20 bp, Artificial
  CRISPR gRNA sequence
ctctcaccctctcctctttc

SEQ ID NO: 71328 - DNA, 20 bp, Artificial
  CRISPR gRNA sequence
tcaccctctcctctttcccc

SEQ ID NO: 71329 - DNA, 20 bp, Artificial
  CRISPR gRNA sequence
accctctcctctttccccag

SEQ ID NO: 71330 - DNA, 20 bp, Artificial
  CRISPR gRNA sequence
tcctctttccccagcctacc

SEQ ID NO: 71331 - DNA, 20 bp, Artificial
  CRISPR gRNA sequence
ctctttccccagcctaccat

SEQ ID NO: 71332 - DNA, 20 bp, Artificial
  CRISPR gRNA sequence
tttccccagcctaccattca

SEQ ID NO: 71333 - DNA, 20 bp, Artificial
  CRISPR gRNA sequence
tccccagcctaccattcagc

SEQ ID NO: 71334 - DNA, 20 bp, Artificial
  CRISPR gRNA sequence
ccccagcctaccattcagcc

SEQ ID NO: 71335 - DNA, 20 bp, Artificial
  CRISPR gRNA sequence
cccagcctaccattcagcca

SEQ ID NO: 71336 - DNA, 20 bp, Artificial
  CRISPR gRNA sequence
ccattcagccatctgggccc

SEQ ID NO: 71337 - DNA, 20 bp, Artificial
  CRISPR gRNA sequence
agccatctgggcccaggtgg

SEQ ID NO: 71338 - DNA, 20 bp, Artificial
  CRISPR gRNA sequence
ggcccaggtggggccctgag

SEQ ID NO: 71339 - DNA, 20 bp, Artificial
  CRISPR gRNA sequence
agcctggcccaggccctgga

SEQ ID NO: 71340 - DNA, 20 bp, Artificial
  CRISPR gRNA sequence
gcccaggccctggatggatc

SEQ ID NO: 71341 - DNA, 20 bp, Artificial
  CRISPR gRNA sequence
gatggatccccccatttgga

SEQ ID NO: 71342 - DNA, 20 bp, Artificial
  CRISPR gRNA sequence
ggaagagatcaggtaagtag

SEQ ID NO: 71343 - DNA, 20 bp, Artificial
  CRISPR gRNA sequence
gaagagatcaggtaagtagg

SEQ ID NO: 71344 - DNA, 20 bp, Artificial
  CRISPR gRNA sequence
cccagcccaggcacggggac

SEQ ID NO: 71345 - DNA, 20 bp, Artificial
  CRISPR gRNA sequence
ggcgggtctgggggttcctc

SEQ ID NO: 71346 - DNA, 20 bp, Artificial
  CRISPR gRNA sequence
ggggttcctctcacaggtat

SEQ ID NO: 71347 - DNA, 20 bp, Artificial
  CRISPR gRNA sequence
ctctcacaggtatctcccct

SEQ ID NO: 71348 - DNA, 20 bp, Artificial
  CRISPR gRNA sequence
tcacaggtatctcccctacc

SEQ ID NO: 71349 - DNA, 20 bp, Artificial
  CRISPR gRNA sequence
acaggtatctcccctaccct

SEQ ID NO: 71350 - DNA, 20 bp, Artificial
  CRISPR gRNA sequence
ccctaccctgcagcttggcg

SEQ ID NO: 71351 - DNA, 20 bp, Artificial
  CRISPR gRNA sequence
ccctgcagcttggcggaaaa

SEQ ID NO: 71352 - DNA, 20 bp, Artificial
  CRISPR gRNA sequence
cagcttggcggaaaacaacc

SEQ ID NO: 71353 - DNA, 20 bp, Artificial
  CRISPR gRNA sequence
ggcggaaaacaacctggctg

SEQ ID NO: 71354 - DNA, 20 bp, Artificial
  CRISPR gRNA sequence
gcggaaaacaacctggctgg

SEQ ID NO: 71355 - DNA, 20 bp, Artificial
  CRISPR gRNA sequence
gctggaggggtcctgcgttt

SEQ ID NO: 71356 - DNA, 20 bp, Artificial
  CRISPR gRNA sequence
gaggggtcctgcgtttctgt

SEQ ID NO: 71357 - DNA, 20 bp, Artificial
  CRISPR gRNA sequence
cgtttctgtatggagctccc

SEQ ID NO: 71358 - DNA, 20 bp, Artificial
  CRISPR gRNA sequence
ctgtatggagctcccgctgc

SEQ ID NO: 71359 - DNA, 20 bp, Artificial
  CRISPR gRNA sequence
tgtatggagctcccgctgct

SEQ ID NO: 71360 - DNA, 20 bp, Artificial
  CRISPR gRNA sequence
tatggagctcccgctgctca

SEQ ID NO: 71361 - DNA, 20 bp, Artificial
  CRISPR gRNA sequence
ccgctgctcagacagataga

SEQ ID NO: 71362 - DNA, 20 bp, Artificial
  CRISPR gRNA sequence
ctcagacagatagagtaagt

SEQ ID NO: 71363 - DNA, 20 bp, Artificial
  CRISPR gRNA sequence
agacagatagagtaagtagc

SEQ ID NO: 71364 - DNA, 20 bp, Artificial
  CRISPR gRNA sequence
ccctgcctgcctaggggacc

SEQ ID NO: 71365 - DNA, 20 bp, Artificial
  CRISPR gRNA sequence
cctgcctaggggaccagtgg

SEQ ID NO: 71366 - DNA, 20 bp, Artificial
  CRISPR gRNA sequence
cctaggggaccagtggcagg

SEQ ID NO: 71367 - DNA, 20 bp, Artificial
  CRISPR gRNA sequence
ggggaccagtggcaggctga

SEQ ID NO: 71368 - DNA, 20 bp, Artificial
  CRISPR gRNA sequence
agggcagcccttctctgact

SEQ ID NO: 71369 - DNA, 20 bp, Artificial
  CRISPR gRNA sequence
ctctgactgagcctaacacc

SEQ ID NO: 71370 - DNA, 20 bp, Artificial
  CRISPR gRNA sequence
tctgactgagcctaacacct

SEQ ID NO: 71371 - DNA, 20 bp, Artificial
  CRISPR gRNA sequence
tgactgagcctaacacctgg

SEQ ID NO: 71372 - DNA, 20 bp, Artificial
  CRISPR gRNA sequence
actgagcctaacacctgggg

SEQ ID NO: 71373 - DNA, 20 bp, Artificial
  CRISPR gRNA sequence
agcctaacacctggggaggc

SEQ ID NO: 71374 - DNA, 20 bp, Artificial
  CRISPR gRNA sequence
acacctggggaggcctttga

SEQ ID NO: 71375 - DNA, 20 bp, Artificial
  CRISPR gRNA sequence
gggaggcctttgaagtgata

SEQ ID NO: 71376 - DNA, 20 bp, Artificial
  CRISPR gRNA sequence
tgaagtgatagaagccccag

SEQ ID NO: 71377 - DNA, 20 bp, Artificial
  CRISPR gRNA sequence
gaagtgatagaagccccagg

SEQ ID NO: 71378 - DNA, 20 bp, Artificial
  CRISPR gRNA sequence
aagtgatagaagccccaggg

SEQ ID NO: 71379 - DNA, 20 bp, Artificial
  CRISPR gRNA sequence
gctcaagaaaggaagtcttt

SEQ ID NO: 71380 - DNA, 20 bp, Artificial
  CRISPR gRNA sequence
aagaaaggaagtctttccta

SEQ ID NO: 71381 - DNA, 20 bp, Artificial
  CRISPR gRNA sequence
tcctaaaacgcctagcttac

SEQ ID NO: 71382 - DNA, 20 bp, Artificial
  CRISPR gRNA sequence
cctaaaacgcctagcttacc

SEQ ID NO: 71383 - DNA, 20 bp, Artificial
  CRISPR gRNA sequence
ctaaaacgcctagcttaccc

SEQ ID NO: 71384 - DNA, 20 bp, Artificial
  CRISPR gRNA sequence
aaacgcctagcttaccccag

SEQ ID NO: 71385 - DNA, 20 bp, Artificial
  CRISPR gRNA sequence
gcttaccccagaccctggtg

SEQ ID NO: 71386 - DNA, 20 bp, Artificial
  CRISPR gRNA sequence
accccagaccctggtggctc

SEQ ID NO: 71387 - DNA, 20 bp, Artificial
  CRISPR gRNA sequence
ccccagaccctggtggctct

SEQ ID NO: 71388 - DNA, 20 bp, Artificial
  CRISPR gRNA sequence
gtggctctggaggcaggacc

SEQ ID NO: 71389 - DNA, 20 bp, Artificial
  CRISPR gRNA sequence
tggaggcaggacctgctaga

SEQ ID NO: 71390 - DNA, 20 bp, Artificial
  CRISPR gRNA sequence
gaggcaggacctgctagatc

SEQ ID NO: 71391 - DNA, 20 bp, Artificial
  CRISPR gRNA sequence
ctagatcccctgactcaaac

SEQ ID NO: 71392 - DNA, 20 bp, Artificial
  CRISPR gRNA sequence
gatcccctgactcaaacaac

SEQ ID NO: 71393 - DNA, 20 bp, Artificial
  CRISPR gRNA sequence
actcaaacaacccccatccc

SEQ ID NO: 71394 - DNA, 20 bp, Artificial
  CRISPR gRNA sequence
aaacaacccccatcccatcc

SEQ ID NO: 71395 - DNA, 20 bp, Artificial
  CRISPR gRNA sequence
ctccatccccagcctggttt

SEQ ID NO: 71396 - DNA, 20 bp, Artificial
  CRISPR gRNA sequence
tccatccccagcctggtttc

SEQ ID NO: 71397 - DNA, 20 bp, Artificial
  CRISPR gRNA sequence
catccccagcctggtttcct

SEQ ID NO: 71398 - DNA, 20 bp, Artificial
  CRISPR gRNA sequence
gtttcctgtaagattgacaa

SEQ ID NO: 71399 - DNA, 20 bp, Artificial
  CRISPR gRNA sequence
cctgtaagattgacaaccag

SEQ ID NO: 71400 - DNA, 20 bp, Artificial
  CRISPR gRNA sequence
ctgtaagattgacaaccaga

SEQ ID NO: 71401 - DNA, 20 bp, Artificial
  CRISPR gRNA sequence
taagattgacaaccagactg

SEQ ID NO: 71402 - DNA, 20 bp, Artificial
  CRISPR gRNA sequence
acaaccagactgccaagctc

SEQ ID NO: 71403 - DNA, 20 bp, Artificial
  CRISPR gRNA sequence
ccaagctcctcacctccagc

SEQ ID NO: 71404 - DNA, 20 bp, Artificial
  CRISPR gRNA sequence
ctcacctccagcttcacgag

SEQ ID NO: 71405 - DNA, 20 bp, Artificial
  CRISPR gRNA sequence
acctccagcttcacgagctg

SEQ ID NO: 71406 - DNA, 20 bp, Artificial
  CRISPR gRNA sequence
cagcttcacgagctgccctg

SEQ ID NO: 71407 - DNA, 20 bp, Artificial
  CRISPR gRNA sequence
cacgagctgccctgccctgg

SEQ ID NO: 71408 - DNA, 20 bp, Artificial
  CRISPR gRNA sequence
acgagctgccctgccctgga

SEQ ID NO: 71409 - DNA, 20 bp, Artificial
  CRISPR gRNA sequence
ccctgccctggaagtaatct

SEQ ID NO: 71410 - DNA, 20 bp, Artificial
  CRISPR gRNA sequence
ccctggaagtaatcttgtga

SEQ ID NO: 71411 - DNA, 20 bp, Artificial
  CRISPR gRNA sequence
gaagtaatcttgtgagtgat

SEQ ID NO: 71412 - DNA, 20 bp, Artificial
  CRISPR gRNA sequence
gtgagtgattggaagagccc

SEQ ID NO: 71413 - DNA, 20 bp, Artificial
  CRISPR gRNA sequence
tgagtgattggaagagccct

SEQ ID NO: 71414 - DNA, 20 bp, Artificial
  CRISPR gRNA sequence
gaagagccctgagctggctg

SEQ ID NO: 71415 - DNA, 20 bp, Artificial
  CRISPR gRNA sequence
agctggctgggaaaaggaaa

SEQ ID NO: 71416 - DNA, 20 bp, Artificial
  CRISPR gRNA sequence
gctgggaaaaggaaaagtcg

SEQ ID NO: 71417 - DNA, 20 bp, Artificial
  CRISPR gRNA sequence
ggaaaaggaaaagtcgggag

SEQ ID NO: 71418 - DNA, 20 bp, Artificial
  CRISPR gRNA sequence
gctccagcctgctgtgtggc

SEQ ID NO: 71419 - DNA, 20 bp, Artificial
  CRISPR gRNA sequence
cagcctgctgtgtggcctgg

SEQ ID NO: 71420 - DNA, 20 bp, Artificial
  CRISPR gRNA sequence
ctgtgtggcctggagctgct

SEQ ID NO: 71421 - DNA, 20 bp, Artificial
  CRISPR gRNA sequence
tgtggcctggagctgctccc

SEQ ID NO: 71422 - DNA, 20 bp, Artificial
  CRISPR gRNA sequence
gagctgctcccatcctctct

SEQ ID NO: 71423 - DNA, 20 bp, Artificial
  CRISPR gRNA sequence
ctcccatcctctctggccag

SEQ ID NO: 71424 - DNA, 20 bp, Artificial
  CRISPR gRNA sequence
ccatcctctctggccagtcc

SEQ ID NO: 71425 - DNA, 20 bp, Artificial
  CRISPR gRNA sequence
tctggccagtcctcccattt

SEQ ID NO: 71426 - DNA, 20 bp, Artificial
  CRISPR gRNA sequence
tggccagtcctcccatttgt

SEQ ID NO: 71427 - DNA, 20 bp, Artificial
  CRISPR gRNA sequence
gccagtcctcccatttgtaa

SEQ ID NO: 71428 - DNA, 20 bp, Artificial
  CRISPR gRNA sequence
ccatttgtaaatggggaaga

SEQ ID NO: 71429 - DNA, 20 bp, Artificial
  CRISPR gRNA sequence
gtaaatggggaagatcatcc

SEQ ID NO: 71430 - DNA, 20 bp, Artificial
  CRISPR gRNA sequence
taaatggggaagatcatcct

SEQ ID NO: 71431 - DNA, 20 bp, Artificial
  CRISPR gRNA sequence
actcagacatcctctcaaag

SEQ ID NO: 71432 - DNA, 20 bp, Artificial
  CRISPR gRNA sequence
ctcagacatcctctcaaaga

SEQ ID NO: 71433 - DNA, 20 bp, Artificial
  CRISPR gRNA sequence
agacatcctctcaaagacat

SEQ ID NO: 71434 - DNA, 20 bp, Artificial
  CRISPR gRNA sequence
tcaaagacattttaacactt

SEQ ID NO: 71435 - DNA, 20 bp, Artificial
  CRISPR gRNA sequence
aaagacattttaacacttga

SEQ ID NO: 71436 - DNA, 20 bp, Artificial
  CRISPR gRNA sequence
taacacttgagctgcaggta

SEQ ID NO: 71437 - DNA, 20 bp, Artificial
  CRISPR gRNA sequence
aacacttgagctgcaggtaa

SEQ ID NO: 71438 - DNA, 20 bp, Artificial
  CRISPR gRNA sequence
acacttgagctgcaggtaat

SEQ ID NO: 71439 - DNA, 20 bp, Artificial
  CRISPR gRNA sequence
gagctgcaggtaatgttggg

SEQ ID NO: 71440 - DNA, 20 bp, Artificial
  CRISPR gRNA sequence
agctgcaggtaatgttgggt

SEQ ID NO: 71441 - DNA, 20 bp, Artificial
  CRISPR gRNA sequence
caggtaatgttgggtaaaac

SEQ ID NO: 71442 - DNA, 20 bp, Artificial
  CRISPR gRNA sequence
ggtaaaacagtttaccttct

SEQ ID NO: 71443 - DNA, 20 bp, Artificial
  CRISPR gRNA sequence
accttcttctgcctttttcc

SEQ ID NO: 71444 - DNA, 20 bp, Artificial
  CRISPR gRNA sequence
ccttcttctgcctttttccc

SEQ ID NO: 71445 - DNA, 20 bp, Artificial
  CRISPR gRNA sequence
cttctgcctttttccccatt

SEQ ID NO: 71446 - DNA, 20 bp, Artificial
  CRISPR gRNA sequence
ttctgcctttttccccattt

SEQ ID NO: 71447 - DNA, 20 bp, Artificial
  CRISPR gRNA sequence
ctgcctttttccccatttgt

SEQ ID NO: 71448 - DNA, 20 bp, Artificial
  CRISPR gRNA sequence
tgcctttttccccatttgta

SEQ ID NO: 71449 - DNA, 20 bp, Artificial
  CRISPR gRNA sequence
cctttttccccatttgtaga

SEQ ID NO: 71450 - DNA, 20 bp, Artificial
  CRISPR gRNA sequence
tttccccatttgtagattgg

SEQ ID NO: 71451 - DNA, 20 bp, Artificial
  CRISPR gRNA sequence
ttccccatttgtagattggt

SEQ ID NO: 71452 - DNA, 20 bp, Artificial
  CRISPR gRNA sequence
tccccatttgtagattggtg

SEQ ID NO: 71453 - DNA, 20 bp, Artificial
  CRISPR gRNA sequence
ccccatttgtagattggtgg

SEQ ID NO: 71454 - DNA, 20 bp, Artificial
  CRISPR gRNA sequence
cccatttgtagattggtggg

SEQ ID NO: 71455 - DNA, 20 bp, Artificial
  CRISPR gRNA sequence
gtagattggtgggaggggag

SEQ ID NO: 71456 - DNA, 20 bp, Artificial
  CRISPR gRNA sequence
tagattggtgggaggggagg

SEQ ID NO: 71457 - DNA, 20 bp, Artificial
  CRISPR gRNA sequence
gtgggaggggaggtggacca

SEQ ID NO: 71458 - DNA, 20 bp, Artificial
  CRISPR gRNA sequence
taaaggtttttggtccaacc

SEQ ID NO: 71459 - DNA, 20 bp, Artificial
  CRISPR gRNA sequence
aaaggtttttggtccaacct

SEQ ID NO: 71460 - DNA, 20 bp, Artificial
  CRISPR gRNA sequence
aaggtttttggtccaacctt

SEQ ID NO: 71461 - DNA, 20 bp, Artificial
  CRISPR gRNA sequence
ttggtccaaccttccttttg

SEQ ID NO: 71462 - DNA, 20 bp, Artificial
  CRISPR gRNA sequence
tggtccaaccttccttttgg

SEQ ID NO: 71463 - DNA, 20 bp, Artificial
  CRISPR gRNA sequence
ggtccaaccttccttttggg

SEQ ID NO: 71464 - DNA, 20 bp, Artificial
  CRISPR gRNA sequence
gtccaaccttccttttggga

SEQ ID NO: 71465 - DNA, 20 bp, Artificial
  CRISPR gRNA sequence
ccttttgggaggcaactgga

SEQ ID NO: 71466 - DNA, 20 bp, Artificial
  CRISPR gRNA sequence
cttttgggaggcaactggat

SEQ ID NO: 71467 - DNA, 20 bp, Artificial
  CRISPR gRNA sequence
ttgggaggcaactggataga

SEQ ID NO: 71468 - DNA, 20 bp, Artificial
  CRISPR gRNA sequence
tgggaggcaactggatagac

SEQ ID NO: 71469 - DNA, 20 bp, Artificial
  CRISPR gRNA sequence
gggaggcaactggatagacc

SEQ ID NO: 71470 - DNA, 20 bp, Artificial
  CRISPR gRNA sequence
ggaggcaactggatagacca

SEQ ID NO: 71471 - DNA, 20 bp, Artificial
  CRISPR gRNA sequence
gatagaccaccttgcctgct

SEQ ID NO: 71472 - DNA, 20 bp, Artificial
  CRISPR gRNA sequence
gcctgcttgatgaaacctcc

SEQ ID NO: 71473 - DNA, 20 bp, Artificial
  CRISPR gRNA sequence
cctgcttgatgaaacctcca

SEQ ID NO: 71474 - DNA, 20 bp, Artificial
  CRISPR gRNA sequence
cttgatgaaacctccattta

SEQ ID NO: 71475 - DNA, 20 bp, Artificial
  CRISPR gRNA sequence
gatgaaacctccatttatga

SEQ ID NO: 71476 - DNA, 20 bp, Artificial
  CRISPR gRNA sequence
atgaaacctccatttatgaa

SEQ ID NO: 71477 - DNA, 20 bp, Artificial
  CRISPR gRNA sequence
catttatgaaccacagttgg

SEQ ID NO: 71478 - DNA, 20 bp, Artificial
  CRISPR gRNA sequence
atgaaccacagttggtagaa

SEQ ID NO: 71479 - DNA, 20 bp, Artificial
  CRISPR gRNA sequence
tgaaccacagttggtagaaa

SEQ ID NO: 71480 - DNA, 20 bp, Artificial
  CRISPR gRNA sequence
gtagaaacagtggctaaagc

SEQ ID NO: 71481 - DNA, 20 bp, Artificial
  CRISPR gRNA sequence
aagccaggagaaagccaccc

SEQ ID NO: 71482 - DNA, 20 bp, Artificial
  CRISPR gRNA sequence
ctggctggccgtgcttggct

SEQ ID NO: 71483 - DNA, 20 bp, Artificial
  CRISPR gRNA sequence
gctggccgtgcttggctgtc

SEQ ID NO: 71484 - DNA, 20 bp, Artificial
  CRISPR gRNA sequence
gccgtgcttggctgtctctt

SEQ ID NO: 71485 - DNA, 20 bp, Artificial
  CRISPR gRNA sequence
ggctgtctcttagcaatcag

SEQ ID NO: 71486 - DNA, 20 bp, Artificial
  CRISPR gRNA sequence
gctgtctcttagcaatcaga

SEQ ID NO: 71487 - DNA, 20 bp, Artificial
  CRISPR gRNA sequence
tctcttagcaatcagaatcc

SEQ ID NO: 71488 - DNA, 20 bp, Artificial
  CRISPR gRNA sequence
ttagcaatcagaatccccca

SEQ ID NO: 71489 - DNA, 20 bp, Artificial
  CRISPR gRNA sequence
agcaatcagaatcccccaga

SEQ ID NO: 71490 - DNA, 20 bp, Artificial
  CRISPR gRNA sequence
gcaatcagaatcccccagac

SEQ ID NO: 71491 - DNA, 20 bp, Artificial
  CRISPR gRNA sequence
ggggctttgcagtgctgcct

SEQ ID NO: 71492 - DNA, 20 bp, Artificial
  CRISPR gRNA sequence
gggctttgcagtgctgcctc

SEQ ID NO: 71493 - DNA, 20 bp, Artificial
  CRISPR gRNA sequence
tgcagtgctgcctcatgagt

SEQ ID NO: 71494 - DNA, 20 bp, Artificial
  CRISPR gRNA sequence
gcagtgctgcctcatgagta

SEQ ID NO: 71495 - DNA, 20 bp, Artificial
  CRISPR gRNA sequence
cagtgctgcctcatgagtaa

SEQ ID NO: 71496 - DNA, 20 bp, Artificial
  CRISPR gRNA sequence
cctcatgagtaaactagaat

SEQ ID NO: 71497 - DNA, 20 bp, Artificial
  CRISPR gRNA sequence
atgagtaaactagaattcta

SEQ ID NO: 71498 - DNA, 20 bp, Artificial
  CRISPR gRNA sequence
gaattctaggactagcctgg

SEQ ID NO: 71499 - DNA, 20 bp, Artificial
  CRISPR gRNA sequence
taggactagcctgggaccct

SEQ ID NO: 71500 - DNA, 20 bp, Artificial
  CRISPR gRNA sequence
ggactagcctgggaccctaa

SEQ ID NO: 71501 - DNA, 20 bp, Artificial
  CRISPR gRNA sequence
gcctgggaccctaaccatgg

SEQ ID NO: 71502 - DNA, 20 bp, Artificial
  CRISPR gRNA sequence
ggaccctaaccatggtatgg

SEQ ID NO: 71503 - DNA, 20 bp, Artificial
  CRISPR gRNA sequence
accatggtatggaggacaaa

SEQ ID NO: 71504 - DNA, 20 bp, Artificial
  CRISPR gRNA sequence
tttcctaaagaacaggacac

SEQ ID NO: 71505 - DNA, 20 bp, Artificial
  CRISPR gRNA sequence
cctaaagaacaggacacaag

SEQ ID NO: 71506 - DNA, 20 bp, Artificial
  CRISPR gRNA sequence
ctaaagaacaggacacaagt

SEQ ID NO: 71507 - DNA, 20 bp, Artificial
  CRISPR gRNA sequence
aagaacaggacacaagtgat

SEQ ID NO: 71508 - DNA, 20 bp, Artificial
  CRISPR gRNA sequence
cgagaagattttagtttgca

SEQ ID NO: 71509 - DNA, 20 bp, Artificial
  CRISPR gRNA sequence
tagtttgcatcctaaaggtc

SEQ ID NO: 71510 - DNA, 20 bp, Artificial
  CRISPR gRNA sequence
agtttgcatcctaaaggtct

SEQ ID NO: 71511 - DNA, 20 bp, Artificial
  CRISPR gRNA sequence
gtttgcatcctaaaggtctt

SEQ ID NO: 71512 - DNA, 20 bp, Artificial
  CRISPR gRNA sequence
gcatcctaaaggtcttaacc

SEQ ID NO: 71513 - DNA, 20 bp, Artificial
  CRISPR gRNA sequence
catcctaaaggtcttaaccc

SEQ ID NO: 71514 - DNA, 20 bp, Artificial
  CRISPR gRNA sequence
aaggtcttaacccttctcat

SEQ ID NO: 71515 - DNA, 20 bp, Artificial
  CRISPR gRNA sequence
aacccttctcattacaccaa

SEQ ID NO: 71516 - DNA, 20 bp, Artificial
  CRISPR gRNA sequence
acccttctcattacaccaaa

SEQ ID NO: 71517 - DNA, 20 bp, Artificial
  CRISPR gRNA sequence
ctcattacaccaaagcgaaa

SEQ ID NO: 71518 - DNA, 20 bp, Artificial
  CRISPR gRNA sequence
tcattacaccaaagcgaaag

SEQ ID NO: 71519 - DNA, 20 bp, Artificial
  CRISPR gRNA sequence
attacaccaaagcgaaagtc

SEQ ID NO: 71520 - DNA, 20 bp, Artificial
  CRISPR gRNA sequence
caccaaagcgaaagtctcag

SEQ ID NO: 71521 - DNA, 20 bp, Artificial
  CRISPR gRNA sequence
agatcagtggtaattcatct

SEQ ID NO: 71522 - DNA, 20 bp, Artificial
  CRISPR gRNA sequence
atctttaacacctaacactg

SEQ ID NO: 71523 - DNA, 20 bp, Artificial
  CRISPR gRNA sequence
taacacctaacactggattc

SEQ ID NO: 71524 - DNA, 20 bp, Artificial
  CRISPR gRNA sequence
aacacctaacactggattct

SEQ ID NO: 71525 - DNA, 20 bp, Artificial
  CRISPR gRNA sequence
acacctaacactggattctc

SEQ ID NO: 71526 - DNA, 20 bp, Artificial
  CRISPR gRNA sequence
acactggattctcccttttt

SEQ ID NO: 71527 - DNA, 20 bp, Artificial
  CRISPR gRNA sequence
gattctccctttttaaccaa

SEQ ID NO: 71528 - DNA, 20 bp, Artificial
  CRISPR gRNA sequence
tccctttttaaccaaaaggg

SEQ ID NO: 71529 - DNA, 20 bp, Artificial
  CRISPR gRNA sequence
cctttttaaccaaaagggtt

SEQ ID NO: 71530 - DNA, 20 bp, Artificial
  CRISPR gRNA sequence
tttaaccaaaagggttaaaa

SEQ ID NO: 71531 - DNA, 20 bp, Artificial
  CRISPR gRNA sequence
ttaaccaaaagggttaaaaa

SEQ ID NO: 71532 - DNA, 20 bp, Artificial
  CRISPR gRNA sequence
taaccaaaagggttaaaaac

SEQ ID NO: 71533 - DNA, 20 bp, Artificial
  CRISPR gRNA sequence
aaccaaaagggttaaaaacc

SEQ ID NO: 71534 - DNA, 20 bp, Artificial
  CRISPR gRNA sequence
accaaaagggttaaaaaccc

SEQ ID NO: 71535 - DNA, 20 bp, Artificial
  CRISPR gRNA sequence
aaaacccaacatcttaggaa

SEQ ID NO: 71536 - DNA, 20 bp, Artificial
  CRISPR gRNA sequence
aggaagggcatatgttccaa

SEQ ID NO: 71537 - DNA, 20 bp, Artificial
  CRISPR gRNA sequence
ggaagggcatatgttccaac

SEQ ID NO: 71538 - DNA, 20 bp, Artificial
  CRISPR gRNA sequence
caactagaagttaataccat

SEQ ID NO: 71539 - DNA, 20 bp, Artificial
  CRISPR gRNA sequence
gaagttaataccattgtttg

SEQ ID NO: 71540 - DNA, 20 bp, Artificial
  CRISPR gRNA sequence
ataccattgtttgtactata

SEQ ID NO: 71541 - DNA, 20 bp, Artificial
  CRISPR gRNA sequence
tttgtactatatttattttt

SEQ ID NO: 71542 - DNA, 20 bp, Artificial
  CRISPR gRNA sequence
gtactatatttatttttgta

SEQ ID NO: 71543 - DNA, 20 bp, Artificial
  CRISPR gRNA sequence
tactatatttatttttgtaa

SEQ ID NO: 71544 - DNA, 20 bp, Artificial
  CRISPR gRNA sequence
tatttatttttgtaactacc

SEQ ID NO: 71545 - DNA, 20 bp, Artificial
  CRISPR gRNA sequence
atttttgtaactaccttcta

SEQ ID NO: 71546 - DNA, 20 bp, Artificial
  CRISPR gRNA sequence
tttttgtaactaccttctat

SEQ ID NO: 71547 - DNA, 20 bp, Artificial
  CRISPR gRNA sequence
ttgtaactaccttctatatg

SEQ ID NO: 71548 - DNA, 20 bp, Artificial
  CRISPR gRNA sequence
tgtaactaccttctatatgg

SEQ ID NO: 71549 - DNA, 20 bp, Artificial
  CRISPR gRNA sequence
gtaactaccttctatatgga

SEQ ID NO: 71550 - DNA, 20 bp, Artificial
  CRISPR gRNA sequence
taactaccttctatatggag

SEQ ID NO: 71551 - DNA, 20 bp, Artificial
  CRISPR gRNA sequence
ccttctatatggagtctgta

SEQ ID NO: 71552 - DNA, 20 bp, Artificial
  CRISPR gRNA sequence
ctatatggagtctgtaacac

SEQ ID NO: 71553 - DNA, 20 bp, Artificial
  CRISPR gRNA sequence
tatatggagtctgtaacaca

SEQ ID NO: 71554 - DNA, 20 bp, Artificial
  CRISPR gRNA sequence
tatggagtctgtaacacaag

SEQ ID NO: 71555 - DNA, 20 bp, Artificial
  CRISPR gRNA sequence
taacacaagttttccattga

SEQ ID NO: 71556 - DNA, 20 bp, Artificial
  CRISPR gRNA sequence
tccattgatagtagcaataa

SEQ ID NO: 71557 - DNA, 20 bp, Artificial
  CRISPR gRNA sequence
ccattgatagtagcaataaa

SEQ ID NO: 71558 - DNA, 20 bp, Artificial
  CRISPR gRNA sequence
cattgatagtagcaataaaa

SEQ ID NO: 71559 - DNA, 20 bp, Artificial
  CRISPR gRNA sequence
atagtagcaataaaagtttc

SEQ ID NO: 71560 - DNA, 20 bp, Artificial
  CRISPR gRNA sequence
cctttcaagatttttttttt

SEQ ID NO: 71561 - DNA, 20 bp, Artificial
  CRISPR gRNA sequence
ctttcaagattttttttttt

SEQ ID NO: 71562 - DNA, 20 bp, Artificial
  CRISPR gRNA sequence
tcaagatttttttttttttt

SEQ ID NO: 71563 - DNA, 20 bp, Artificial
  CRISPR gRNA sequence
caagattttttttttttttt

SEQ ID NO: 71564 - DNA, 20 bp, Artificial
  CRISPR gRNA sequence
aagatttttttttttttttt

SEQ ID NO: 71565 - DNA, 20 bp, Artificial
  CRISPR gRNA sequence
ttttttttttttttttttga

SEQ ID NO: 71566 - DNA, 20 bp, Artificial
  CRISPR gRNA sequence
tttttttttttttttttgag

SEQ ID NO: 71567 - DNA, 20 bp, Artificial
  CRISPR gRNA sequence
ttttttttttttttttgaga

SEQ ID NO: 71568 - DNA, 20 bp, Artificial
  CRISPR gRNA sequence
tttttttttttttttgagat

SEQ ID NO: 71569 - DNA, 20 bp, Artificial
  CRISPR gRNA sequence
ttttttttttttttgagatg

SEQ ID NO: 71570 - DNA, 20 bp, Artificial
  CRISPR gRNA sequence
tttttttttttttgagatgg

SEQ ID NO: 71571 - DNA, 20 bp, Artificial
  CRISPR gRNA sequence
ttttttttttttgagatgga

SEQ ID NO: 71572 - DNA, 20 bp, Artificial
  CRISPR gRNA sequence
tttttttttttgagatggag

SEQ ID NO: 71573 - DNA, 20 bp, Artificial
  CRISPR gRNA sequence
ttttttttttgagatggagt

SEQ ID NO: 71574 - DNA, 20 bp, Artificial
  CRISPR gRNA sequence
tttttttttgagatggagtc

SEQ ID NO: 71575 - DNA, 20 bp, Artificial
  CRISPR gRNA sequence
ttttttttgagatggagtct

SEQ ID NO: 71576 - DNA, 20 bp, Artificial
  CRISPR gRNA sequence
tttttttgagatggagtctc

SEQ ID NO: 71577 - DNA, 20 bp, Artificial
  CRISPR gRNA sequence
ttttttgagatggagtctcc

SEQ ID NO: 71578 - DNA, 20 bp, Artificial
  CRISPR gRNA sequence
tttttgagatggagtctccc

SEQ ID NO: 71579 - DNA, 20 bp, Artificial
  CRISPR gRNA sequence
ttttgagatggagtctccct

SEQ ID NO: 71580 - DNA, 20 bp, Artificial
  CRISPR gRNA sequence
tttgagatggagtctccctc

SEQ ID NO: 71581 - DNA, 20 bp, Artificial
  CRISPR gRNA sequence
ttgagatggagtctccctct

SEQ ID NO: 71582 - DNA, 20 bp, Artificial
  CRISPR gRNA sequence
tgagatggagtctccctctg

SEQ ID NO: 71583 - DNA, 20 bp, Artificial
  CRISPR gRNA sequence
gagatggagtctccctctgt

SEQ ID NO: 71584 - DNA, 20 bp, Artificial
  CRISPR gRNA sequence
agatggagtctccctctgtt

SEQ ID NO: 71585 - DNA, 20 bp, Artificial
  CRISPR gRNA sequence
cctctgttacccaggctgga

SEQ ID NO: 71586 - DNA, 20 bp, Artificial
  CRISPR gRNA sequence
tgttacccaggctggagtgc

SEQ ID NO: 71587 - DNA, 20 bp, Artificial
  CRISPR gRNA sequence
ttacccaggctggagtgcag

SEQ ID NO: 71588 - DNA, 20 bp, Artificial
  CRISPR gRNA sequence
cccaggctggagtgcagtgg

SEQ ID NO: 71589 - DNA, 20 bp, Artificial
  CRISPR gRNA sequence
gagtgcagtggtgcaatctc

SEQ ID NO: 71590 - DNA, 20 bp, Artificial
  CRISPR gRNA sequence
ggctcactgcaacctccacc

SEQ ID NO: 71591 - DNA, 20 bp, Artificial
  CRISPR gRNA sequence
actgcaacctccacctgccg

SEQ ID NO: 71592 - DNA, 20 bp, Artificial
  CRISPR gRNA sequence
caacctccacctgccgggtt

SEQ ID NO: 71593 - DNA, 20 bp, Artificial
  CRISPR gRNA sequence
cacctgccgggttcaagaga

SEQ ID NO: 71594 - DNA, 20 bp, Artificial
  CRISPR gRNA sequence
ccgggttcaagagattctcc

SEQ ID NO: 71595 - DNA, 20 bp, Artificial
  CRISPR gRNA sequence
aagagattctcctgcctcag

SEQ ID NO: 71596 - DNA, 20 bp, Artificial
  CRISPR gRNA sequence
tcctgcctcagcctcctgag

SEQ ID NO: 71597 - DNA, 20 bp, Artificial
  CRISPR gRNA sequence
ctgcctcagcctcctgagta

SEQ ID NO: 71598 - DNA, 20 bp, Artificial
  CRISPR gRNA sequence
cctcagcctcctgagtagct

SEQ ID NO: 71599 - DNA, 20 bp, Artificial
  CRISPR gRNA sequence
agcctcctgagtagctggga

SEQ ID NO: 71600 - DNA, 20 bp, Artificial
  CRISPR gRNA sequence
ctgagtagctgggattacaa

SEQ ID NO: 71601 - DNA, 20 bp, Artificial
  CRISPR gRNA sequence
agtagctgggattacaagtg

SEQ ID NO: 71602 - DNA, 20 bp, Artificial
  CRISPR gRNA sequence
ggattacaagtgcccaccac

SEQ ID NO: 71603 - DNA, 20 bp, Artificial
  CRISPR gRNA sequence
caagtgcccaccaccacacc

SEQ ID NO: 71604 - DNA, 20 bp, Artificial
  CRISPR gRNA sequence
atttttgtatttttagtaga

SEQ ID NO: 71605 - DNA, 20 bp, Artificial
  CRISPR gRNA sequence
ttgtatttttagtagagaca

SEQ ID NO: 71606 - DNA, 20 bp, Artificial
  CRISPR gRNA sequence
tgtatttttagtagagacag

SEQ ID NO: 71607 - DNA, 20 bp, Artificial
  CRISPR gRNA sequence
gtatttttagtagagacagg

SEQ ID NO: 71608 - DNA, 20 bp, Artificial
  CRISPR gRNA sequence
tatttttagtagagacagga

SEQ ID NO: 71609 - DNA, 20 bp, Artificial
  CRISPR gRNA sequence
ttagtagagacaggatttca

SEQ ID NO: 71610 - DNA, 20 bp, Artificial
  CRISPR gRNA sequence
tagtagagacaggatttcac

SEQ ID NO: 71611 - DNA, 20 bp, Artificial
  CRISPR gRNA sequence
agtagagacaggatttcacc

SEQ ID NO: 71612 - DNA, 20 bp, Artificial
  CRISPR gRNA sequence
gtagagacaggatttcacca

SEQ ID NO: 71613 - DNA, 20 bp, Artificial
  CRISPR gRNA sequence
caccatgttggttaggctcg

SEQ ID NO: 71614 - DNA, 20 bp, Artificial
  CRISPR gRNA sequence
accatgttggttaggctcgt

SEQ ID NO: 71615 - DNA, 20 bp, Artificial
  CRISPR gRNA sequence
gttaggctcgtctcaaacac

SEQ ID NO: 71616 - DNA, 20 bp, Artificial
  CRISPR gRNA sequence
ggctcgtctcaaacacctga

SEQ ID NO: 71617 - DNA, 20 bp, Artificial
  CRISPR gRNA sequence
gtctcaaacacctgaccttg

SEQ ID NO: 71618 - DNA, 20 bp, Artificial
  CRISPR gRNA sequence
aaacacctgaccttggcctc

SEQ ID NO: 71619 - DNA, 20 bp, Artificial
  CRISPR gRNA sequence
accttggcctcccaaagtgc

SEQ ID NO: 71620 - DNA, 20 bp, Artificial
  CRISPR gRNA sequence
ggcctcccaaagtgctggga

SEQ ID NO: 71621 - DNA, 20 bp, Artificial
  CRISPR gRNA sequence
gcctcccaaagtgctgggat

SEQ ID NO: 71622 - DNA, 20 bp, Artificial
  CRISPR gRNA sequence
ccaaagtgctgggattacag

SEQ ID NO: 71623 - DNA, 20 bp, Artificial
  CRISPR gRNA sequence
ggattacaggcgtgagcaac

SEQ ID NO: 71624 - DNA, 20 bp, Artificial
  CRISPR gRNA sequence
caggcgtgagcaaccacgcc

SEQ ID NO: 71625 - DNA, 20 bp, Artificial
  CRISPR gRNA sequence
attttttaaagtaagaaaaa

SEQ ID NO: 71626 - DNA, 20 bp, Artificial
  CRISPR gRNA sequence
tttaaagtaagaaaaaagag

SEQ ID NO: 71627 - DNA, 20 bp, Artificial
  CRISPR gRNA sequence
ttaaagtaagaaaaaagagg

SEQ ID NO: 71628 - DNA, 20 bp, Artificial
  CRISPR gRNA sequence
taaagtaagaaaaaagaggg

SEQ ID NO: 71629 - DNA, 20 bp, Artificial
  CRISPR gRNA sequence
aaagtaagaaaaaagagggg

SEQ ID NO: 71630 - DNA, 20 bp, Artificial
  CRISPR gRNA sequence
aagtaagaaaaaagaggggg

SEQ ID NO: 71631 - DNA, 20 bp, Artificial
  CRISPR gRNA sequence
aaagaaaaatatgatgcatc

SEQ ID NO: 71632 - DNA, 20 bp, Artificial
  CRISPR gRNA sequence
aagaaaaatatgatgcatct

SEQ ID NO: 71633 - DNA, 20 bp, Artificial
  CRISPR gRNA sequence
aaatacaggaggtacatgta

SEQ ID NO: 71634 - DNA, 20 bp, Artificial
  CRISPR gRNA sequence
aatacaggaggtacatgtat

SEQ ID NO: 71635 - DNA, 20 bp, Artificial
  CRISPR gRNA sequence
gtgaacaacgtcatgattca

SEQ ID NO: 71636 - DNA, 20 bp, Artificial
  CRISPR gRNA sequence
tgaacaacgtcatgattcaa

SEQ ID NO: 71637 - DNA, 20 bp, Artificial
  CRISPR gRNA sequence
aaacttgacggggaggggag

SEQ ID NO: 71638 - DNA, 20 bp, Artificial
  CRISPR gRNA sequence
gacggggaggggagcaggga

SEQ ID NO: 71639 - DNA, 20 bp, Artificial
  CRISPR gRNA sequence
acggggaggggagcagggag

SEQ ID NO: 71640 - DNA, 20 bp, Artificial
  CRISPR gRNA sequence
caccctgacgtcttcagggg

SEQ ID NO: 71641 - DNA, 20 bp, Artificial
  CRISPR gRNA sequence
acgtcttcaggggaggacac

SEQ ID NO: 71642 - DNA, 20 bp, Artificial
  CRISPR gRNA sequence
caggggaggacacacaagca

SEQ ID NO: 71643 - DNA, 20 bp, Artificial
  CRISPR gRNA sequence
aggggaggacacacaagcac

SEQ ID NO: 71644 - DNA, 20 bp, Artificial
  CRISPR gRNA sequence
tcaggtggcctctcttgaaa

SEQ ID NO: 71645 - DNA, 20 bp, Artificial
  CRISPR gRNA sequence
tcttgaaaacccttgccccc

SEQ ID NO: 71646 - DNA, 20 bp, Artificial
  CRISPR gRNA sequence
ttgaaaacccttgcccccac

SEQ ID NO: 71647 - DNA, 20 bp, Artificial
  CRISPR gRNA sequence
gaaaacccttgcccccacga

SEQ ID NO: 71648 - DNA, 20 bp, Artificial
  CRISPR gRNA sequence
aaaacccttgcccccacgac

SEQ ID NO: 71649 - DNA, 20 bp, Artificial
  CRISPR gRNA sequence
gcccccacgactggcaccct

SEQ ID NO: 71650 - DNA, 20 bp, Artificial
  CRISPR gRNA sequence
cccccacgactggcaccctg

SEQ ID NO: 71651 - DNA, 20 bp, Artificial
  CRISPR gRNA sequence
gcaccctgctttccccattc

SEQ ID NO: 71652 - DNA, 20 bp, Artificial
  CRISPR gRNA sequence
ctttccccattcactgcctt

SEQ ID NO: 71653 - DNA, 20 bp, Artificial
  CRISPR gRNA sequence
tccccattcactgccttgtc

SEQ ID NO: 71654 - DNA, 20 bp, Artificial
  CRISPR gRNA sequence
ccccattcactgccttgtct

SEQ ID NO: 71655 - DNA, 20 bp, Artificial
  CRISPR gRNA sequence
cccattcactgccttgtctc

SEQ ID NO: 71656 - DNA, 20 bp, Artificial
  CRISPR gRNA sequence
actgccttgtctccacccct

SEQ ID NO: 71657 - DNA, 20 bp, Artificial
  CRISPR gRNA sequence
ccttgtctccacccctcgac

SEQ ID NO: 71658 - DNA, 20 bp, Artificial
  CRISPR gRNA sequence
gtctccacccctcgacctcc

SEQ ID NO: 71659 - DNA, 20 bp, Artificial
  CRISPR gRNA sequence
tctccacccctcgacctcct

SEQ ID NO: 71660 - DNA, 20 bp, Artificial
  CRISPR gRNA sequence
cacccctcgacctccttgct

SEQ ID NO: 71661 - DNA, 20 bp, Artificial
  CRISPR gRNA sequence
gacctccttgctctcctgcc

SEQ ID NO: 71662 - DNA, 20 bp, Artificial
  CRISPR gRNA sequence
cttgctctcctgccgctgac

SEQ ID NO: 71663 - DNA, 20 bp, Artificial
  CRISPR gRNA sequence
gctctcctgccgctgacttt

SEQ ID NO: 71664 - DNA, 20 bp, Artificial
  CRISPR gRNA sequence
ctctcctgccgctgactttg

SEQ ID NO: 71665 - DNA, 20 bp, Artificial
  CRISPR gRNA sequence
tcctgccgctgactttggga

SEQ ID NO: 71666 - DNA, 20 bp, Artificial
  CRISPR gRNA sequence
ctgccgctgactttgggacc

SEQ ID NO: 71667 - DNA, 20 bp, Artificial
  CRISPR gRNA sequence
ccgctgactttgggacccct

SEQ ID NO: 71668 - DNA, 20 bp, Artificial
  CRISPR gRNA sequence
actttgggacccctaccctg

SEQ ID NO: 71669 - DNA, 20 bp, Artificial
  CRISPR gRNA sequence
tgggacccctaccctgcagg

SEQ ID NO: 71670 - DNA, 20 bp, Artificial
  CRISPR gRNA sequence
gggacccctaccctgcaggc

SEQ ID NO: 71671 - DNA, 20 bp, Artificial
  CRISPR gRNA sequence
ggacccctaccctgcaggct

SEQ ID NO: 71672 - DNA, 20 bp, Artificial
  CRISPR gRNA sequence
ccctgcaggctgtcctggaa

SEQ ID NO: 71673 - DNA, 20 bp, Artificial
  CRISPR gRNA sequence
caggctgtcctggaatctcc

SEQ ID NO: 71674 - DNA, 20 bp, Artificial
  CRISPR gRNA sequence
tcctggaatctcctcgggga

SEQ ID NO: 71675 - DNA, 20 bp, Artificial
  CRISPR gRNA sequence
gaatctcctcggggatgagg

SEQ ID NO: 71676 - DNA, 20 bp, Artificial
  CRISPR gRNA sequence
ctcggggatgaggcagctgc

SEQ ID NO: 71677 - DNA, 20 bp, Artificial
  CRISPR gRNA sequence
ggggatgaggcagctgccga

SEQ ID NO: 71678 - DNA, 20 bp, Artificial
  CRISPR gRNA sequence
ccgagctggcccaggtgctg

SEQ ID NO: 71679 - DNA, 20 bp, Artificial
  CRISPR gRNA sequence
gcccaggtgctgccgcagat

SEQ ID NO: 71680 - DNA, 20 bp, Artificial
  CRISPR gRNA sequence
ccgcagatgggccggctgaa

SEQ ID NO: 71681 - DNA, 20 bp, Artificial
  CRISPR gRNA sequence
aagagagtggagtatgaggg

SEQ ID NO: 71682 - DNA, 20 bp, Artificial
  CRISPR gRNA sequence
aagggggacctacatcccgg

SEQ ID NO: 71683 - DNA, 20 bp, Artificial
  CRISPR gRNA sequence
catcccgggaacaccaagag

SEQ ID NO: 71684 - DNA, 20 bp, Artificial
  CRISPR gRNA sequence
ggtcagtcccctgcctccca

SEQ ID NO: 71685 - DNA, 20 bp, Artificial
  CRISPR gRNA sequence
cctcccagaaagcccttcct

SEQ ID NO: 71686 - DNA, 20 bp, Artificial
  CRISPR gRNA sequence
ccagaaagcccttccttgag

SEQ ID NO: 71687 - DNA, 20 bp, Artificial
  CRISPR gRNA sequence
ccttgagttgcacactctgg

SEQ ID NO: 71688 - DNA, 20 bp, Artificial
  CRISPR gRNA sequence
cttgagttgcacactctggc

SEQ ID NO: 71689 - DNA, 20 bp, Artificial
  CRISPR gRNA sequence
gagttgcacactctggcctg

SEQ ID NO: 71690 - DNA, 20 bp, Artificial
  CRISPR gRNA sequence
agttgcacactctggcctgt

SEQ ID NO: 71691 - DNA, 20 bp, Artificial
  CRISPR gRNA sequence
cacactctggcctgttccaa

SEQ ID NO: 71692 - DNA, 20 bp, Artificial
  CRISPR gRNA sequence
tggcctgttccaagcccctg

SEQ ID NO: 71693 - DNA, 20 bp, Artificial
  CRISPR gRNA sequence
gcctgttccaagcccctgcc

SEQ ID NO: 71694 - DNA, 20 bp, Artificial
  CRISPR gRNA sequence
ttccaagcccctgccaggct

SEQ ID NO: 71695 - DNA, 20 bp, Artificial
  CRISPR gRNA sequence
caagcccctgccaggcttag

SEQ ID NO: 71696 - DNA, 20 bp, Artificial
  CRISPR gRNA sequence
ccaggcttagttccccctgg

SEQ ID NO: 71697 - DNA, 20 bp, Artificial
  CRISPR gRNA sequence
agttccccctgggttctagc

SEQ ID NO: 71698 - DNA, 20 bp, Artificial
  CRISPR gRNA sequence
gttccccctgggttctagcc

SEQ ID NO: 71699 - DNA, 20 bp, Artificial
  CRISPR gRNA sequence
cccctgggttctagccttca

SEQ ID NO: 71700 - DNA, 20 bp, Artificial
  CRISPR gRNA sequence
ggttctagccttcagccttc

SEQ ID NO: 71701 - DNA, 20 bp, Artificial
  CRISPR gRNA sequence
tagccttcagccttcctgct

SEQ ID NO: 71702 - DNA, 20 bp, Artificial
  CRISPR gRNA sequence
gccttcagccttcctgctgc

SEQ ID NO: 71703 - DNA, 20 bp, Artificial
  CRISPR gRNA sequence
cagccttcctgctgcacctg

SEQ ID NO: 71704 - DNA, 20 bp, Artificial
  CRISPR gRNA sequence
agccttcctgctgcacctgc

SEQ ID NO: 71705 - DNA, 20 bp, Artificial
  CRISPR gRNA sequence
cctgctgcacctgccaccag

SEQ ID NO: 71706 - DNA, 20 bp, Artificial
  CRISPR gRNA sequence
ctgctgcacctgccaccagt

SEQ ID NO: 71707 - DNA, 20 bp, Artificial
  CRISPR gRNA sequence
ctgcacctgccaccagtccc

SEQ ID NO: 71708 - DNA, 20 bp, Artificial
  CRISPR gRNA sequence
cacctgccaccagtcccctg

SEQ ID NO: 71709 - DNA, 20 bp, Artificial
  CRISPR gRNA sequence
ccaccagtcccctgttgtct

SEQ ID NO: 71710 - DNA, 20 bp, Artificial
  CRISPR gRNA sequence
ttgtcttttgggttccctga

SEQ ID NO: 71711 - DNA, 20 bp, Artificial
  CRISPR gRNA sequence
tcttttgggttccctgagaa

SEQ ID NO: 71712 - DNA, 20 bp, Artificial
  CRISPR gRNA sequence
ttgggttccctgagaaggta

SEQ ID NO: 71713 - DNA, 20 bp, Artificial
  CRISPR gRNA sequence
tgggttccctgagaaggtag

SEQ ID NO: 71714 - DNA, 20 bp, Artificial
  CRISPR gRNA sequence
gggttccctgagaaggtagt

SEQ ID NO: 71715 - DNA, 20 bp, Artificial
  CRISPR gRNA sequence
ggttccctgagaaggtagtg

SEQ ID NO: 71716 - DNA, 20 bp, Artificial
  CRISPR gRNA sequence
cctgagaaggtagtgtggga

SEQ ID NO: 71717 - DNA, 20 bp, Artificial
  CRISPR gRNA sequence
agaaggtagtgtgggagact

SEQ ID NO: 71718 - DNA, 20 bp, Artificial
  CRISPR gRNA sequence
tgtcccctgaccttggcctg

SEQ ID NO: 71719 - DNA, 20 bp, Artificial
  CRISPR gRNA sequence
accttggcctgaggaaggga

SEQ ID NO: 71720 - DNA, 20 bp, Artificial
  CRISPR gRNA sequence
ggcctgaggaagggacctag

SEQ ID NO: 71721 - DNA, 20 bp, Artificial
  CRISPR gRNA sequence
gcctgaggaagggacctagg

SEQ ID NO: 71722 - DNA, 20 bp, Artificial
  CRISPR gRNA sequence
aggaagggacctaggaaact

SEQ ID NO: 71723 - DNA, 20 bp, Artificial
  CRISPR gRNA sequence
ggaaactctcacacccattc

SEQ ID NO: 71724 - DNA, 20 bp, Artificial
  CRISPR gRNA sequence
tcacacccattctcatggcc

SEQ ID NO: 71725 - DNA, 20 bp, Artificial
  CRISPR gRNA sequence
acacccattctcatggccgt

SEQ ID NO: 71726 - DNA, 20 bp, Artificial
  CRISPR gRNA sequence
tcatggccgtgtttctcttt

SEQ ID NO: 71727 - DNA, 20 bp, Artificial
  CRISPR gRNA sequence
atggccgtgtttctctttcc

SEQ ID NO: 71728 - DNA, 20 bp, Artificial
  CRISPR gRNA sequence
ctctttcccctcccctcact

SEQ ID NO: 71729 - DNA, 20 bp, Artificial
  CRISPR gRNA sequence
tctttcccctcccctcactg

SEQ ID NO: 71730 - DNA, 20 bp, Artificial
  CRISPR gRNA sequence
tttcccctcccctcactgtc

SEQ ID NO: 71731 - DNA, 20 bp, Artificial
  CRISPR gRNA sequence
tcccctcccctcactgtcca

SEQ ID NO: 71732 - DNA, 20 bp, Artificial
  CRISPR gRNA sequence
cccctcccctcactgtccac

SEQ ID NO: 71733 - DNA, 20 bp, Artificial
  CRISPR gRNA sequence
ccctcccctcactgtccact

SEQ ID NO: 71734 - DNA, 20 bp, Artificial
  CRISPR gRNA sequence
ccctcactgtccactgagaa

SEQ ID NO: 71735 - DNA, 20 bp, Artificial
  CRISPR gRNA sequence
actgtccactgagaagcctg

SEQ ID NO: 71736 - DNA, 20 bp, Artificial
  CRISPR gRNA sequence
tccactgagaagcctggaga

SEQ ID NO: 71737 - DNA, 20 bp, Artificial
  CRISPR gRNA sequence
agaagcctggagaagaatca

SEQ ID NO: 71738 - DNA, 20 bp, Artificial
  CRISPR gRNA sequence
gagaagaatcagatcacagc

SEQ ID NO: 71739 - DNA, 20 bp, Artificial
  CRISPR gRNA sequence
tgggggcctggctcctggct

SEQ ID NO: 71740 - DNA, 20 bp, Artificial
  CRISPR gRNA sequence
gggggcctggctcctggctg

SEQ ID NO: 71741 - DNA, 20 bp, Artificial
  CRISPR gRNA sequence
ggggcctggctcctggctga

SEQ ID NO: 71742 - DNA, 20 bp, Artificial
  CRISPR gRNA sequence
gctcctggctgaaggactgg

SEQ ID NO: 71743 - DNA, 20 bp, Artificial
  CRISPR gRNA sequence
ctggctgaaggactggccca

SEQ ID NO: 71744 - DNA, 20 bp, Artificial
  CRISPR gRNA sequence
gctgaaggactggcccaggg

SEQ ID NO: 71745 - DNA, 20 bp, Artificial
  CRISPR gRNA sequence
aaggactggcccaggggtct

SEQ ID NO: 71746 - DNA, 20 bp, Artificial
  CRISPR gRNA sequence
gcccaggggtctagcatcca

SEQ ID NO: 71747 - DNA, 20 bp, Artificial
  CRISPR gRNA sequence
gcatccaagtcatccggtaa

SEQ ID NO: 71748 - DNA, 20 bp, Artificial
  CRISPR gRNA sequence
caggggcagggatggtgggt

SEQ ID NO: 71749 - DNA, 20 bp, Artificial
  CRISPR gRNA sequence
caccaacccccagatctaat

SEQ ID NO: 71750 - DNA, 20 bp, Artificial
  CRISPR gRNA sequence
atgggactccctggaggagg

SEQ ID NO: 71751 - DNA, 20 bp, Artificial
  CRISPR gRNA sequence
cctggaggaggcggcagggc

SEQ ID NO: 71752 - DNA, 20 bp, Artificial
  CRISPR gRNA sequence
gaggaggcggcagggcctgg

SEQ ID NO: 71753 - DNA, 20 bp, Artificial
  CRISPR gRNA sequence
ggctggggattatcaaagga

SEQ ID NO: 71754 - DNA, 20 bp, Artificial
  CRISPR gRNA sequence
gggattatcaaaggagactt

SEQ ID NO: 71755 - DNA, 20 bp, Artificial
  CRISPR gRNA sequence
tcaaaggagacttggaccac

SEQ ID NO: 71756 - DNA, 20 bp, Artificial
  CRISPR gRNA sequence
ggaccactccaccaagaatt

SEQ ID NO: 71757 - DNA, 20 bp, Artificial
  CRISPR gRNA sequence
gaccactccaccaagaattt

SEQ ID NO: 71758 - DNA, 20 bp, Artificial
  CRISPR gRNA sequence
caccaagaatttggcagcaa

SEQ ID NO: 71759 - DNA, 20 bp, Artificial
  CRISPR gRNA sequence
ggcagcaagcagacttggat

SEQ ID NO: 71760 - DNA, 20 bp, Artificial
  CRISPR gRNA sequence
gcagcaagcagacttggatc

SEQ ID NO: 71761 - DNA, 20 bp, Artificial
  CRISPR gRNA sequence
ggatcaaaccccagctctgc

SEQ ID NO: 71762 - DNA, 20 bp, Artificial
  CRISPR gRNA sequence
gatcaaaccccagctctgcc

SEQ ID NO: 71763 - DNA, 20 bp, Artificial
  CRISPR gRNA sequence
tgccacttgccaactgtgta

SEQ ID NO: 71764 - DNA, 20 bp, Artificial
  CRISPR gRNA sequence
ccacttgccaactgtgtaac

SEQ ID NO: 71765 - DNA, 20 bp, Artificial
  CRISPR gRNA sequence
gccaactgtgtaactttgta

SEQ ID NO: 71766 - DNA, 20 bp, Artificial
  CRISPR gRNA sequence
ccaactgtgtaactttgtag

SEQ ID NO: 71767 - DNA, 20 bp, Artificial
  CRISPR gRNA sequence
tgtaactttgtagccataac

SEQ ID NO: 71768 - DNA, 20 bp, Artificial
  CRISPR gRNA sequence
tgtagccataactcaacctc

SEQ ID NO: 71769 - DNA, 20 bp, Artificial
  CRISPR gRNA sequence
gtagccataactcaacctct

SEQ ID NO: 71770 - DNA, 20 bp, Artificial
  CRISPR gRNA sequence
tagccataactcaacctctc

SEQ ID NO: 71771 - DNA, 20 bp, Artificial
  CRISPR gRNA sequence
aacctctctgaaccccaatt

SEQ ID NO: 71772 - DNA, 20 bp, Artificial
  CRISPR gRNA sequence
tctgaaccccaattttctca

SEQ ID NO: 71773 - DNA, 20 bp, Artificial
  CRISPR gRNA sequence
tgaaccccaattttctcatc

SEQ ID NO: 71774 - DNA, 20 bp, Artificial
  CRISPR gRNA sequence
aaccccaattttctcatctg

SEQ ID NO: 71775 - DNA, 20 bp, Artificial
  CRISPR gRNA sequence
tctcatctgtgaaatgggga

SEQ ID NO: 71776 - DNA, 20 bp, Artificial
  CRISPR gRNA sequence
ctcatctgtgaaatggggat

SEQ ID NO: 71777 - DNA, 20 bp, Artificial
  CRISPR gRNA sequence
tcatctgtgaaatggggata

SEQ ID NO: 71778 - DNA, 20 bp, Artificial
  CRISPR gRNA sequence
atctgtgaaatggggatact

SEQ ID NO: 71779 - DNA, 20 bp, Artificial
  CRISPR gRNA sequence
tgaaatggggatactgatag

SEQ ID NO: 71780 - DNA, 20 bp, Artificial
  CRISPR gRNA sequence
atagtatctacctcagagag

SEQ ID NO: 71781 - DNA, 20 bp, Artificial
  CRISPR gRNA sequence
cctcagagagttgtgaagac

SEQ ID NO: 71782 - DNA, 20 bp, Artificial
  CRISPR gRNA sequence
agagagttgtgaagactaaa

SEQ ID NO: 71783 - DNA, 20 bp, Artificial
  CRISPR gRNA sequence
tgaagactaaatgagcatat

SEQ ID NO: 71784 - DNA, 20 bp, Artificial
  CRISPR gRNA sequence
aatgagcatataaagcactg

SEQ ID NO: 71785 - DNA, 20 bp, Artificial
  CRISPR gRNA sequence
aacccaatgcctggcacata

SEQ ID NO: 71786 - DNA, 20 bp, Artificial
  CRISPR gRNA sequence
gcacatagtaagcacttaaa

SEQ ID NO: 71787 - DNA, 20 bp, Artificial
  CRISPR gRNA sequence
aaaatggcagctataatcag

SEQ ID NO: 71788 - DNA, 20 bp, Artificial
  CRISPR gRNA sequence
aaatggcagctataatcaga

SEQ ID NO: 71789 - DNA, 20 bp, Artificial
  CRISPR gRNA sequence
taatcagagccatcacatac

SEQ ID NO: 71790 - DNA, 20 bp, Artificial
  CRISPR gRNA sequence
tataggttgtgcactgcaca

SEQ ID NO: 71791 - DNA, 20 bp, Artificial
  CRISPR gRNA sequence
tgcactgcacaagggcatta

SEQ ID NO: 71792 - DNA, 20 bp, Artificial
  CRISPR gRNA sequence
cacaagggcattaaacctaa

SEQ ID NO: 71793 - DNA, 20 bp, Artificial
  CRISPR gRNA sequence
aacctaaggggcaccattca

SEQ ID NO: 71794 - DNA, 20 bp, Artificial
  CRISPR gRNA sequence
aggggcaccattcacattgt

SEQ ID NO: 71795 - DNA, 20 bp, Artificial
  CRISPR gRNA sequence
acattgtcaacctgctagat

SEQ ID NO: 71796 - DNA, 20 bp, Artificial
  CRISPR gRNA sequence
tcaacctgctagatttctag

SEQ ID NO: 71797 - DNA, 20 bp, Artificial
  CRISPR gRNA sequence
ctagatttctagcagatgag

SEQ ID NO: 71798 - DNA, 20 bp, Artificial
  CRISPR gRNA sequence
gatttctagcagatgagagt

SEQ ID NO: 71799 - DNA, 20 bp, Artificial
  CRISPR gRNA sequence
ctagcagatgagagtaaagt

SEQ ID NO: 71800 - DNA, 20 bp, Artificial
  CRISPR gRNA sequence
tagcagatgagagtaaagta

SEQ ID NO: 71801 - DNA, 20 bp, Artificial
  CRISPR gRNA sequence
gcagatgagagtaaagtacc

SEQ ID NO: 71802 - DNA, 20 bp, Artificial
  CRISPR gRNA sequence
gttctaccaaaatcatatat

SEQ ID NO: 71803 - DNA, 20 bp, Artificial
  CRISPR gRNA sequence
ttctaccaaaatcatatatt

SEQ ID NO: 71804 - DNA, 20 bp, Artificial
  CRISPR gRNA sequence
taccaaaatcatatattatg

SEQ ID NO: 71805 - DNA, 20 bp, Artificial
  CRISPR gRNA sequence
ccaaaatcatatattatgac

SEQ ID NO: 71806 - DNA, 20 bp, Artificial
  CRISPR gRNA sequence
tgacaatttcagacagatgg

SEQ ID NO: 71807 - DNA, 20 bp, Artificial
  CRISPR gRNA sequence
cagacagatggaagtaaaac

SEQ ID NO: 71808 - DNA, 20 bp, Artificial
  CRISPR gRNA sequence
agacagatggaagtaaaaca

SEQ ID NO: 71809 - DNA, 20 bp, Artificial
  CRISPR gRNA sequence
gaagaaagagggtcttttcc

SEQ ID NO: 71810 - DNA, 20 bp, Artificial
  CRISPR gRNA sequence
aagaaagagggtcttttcct

SEQ ID NO: 71811 - DNA, 20 bp, Artificial
  CRISPR gRNA sequence
ttccttatttgcacaaatgt

SEQ ID NO: 71812 - DNA, 20 bp, Artificial
  CRISPR gRNA sequence
tccttatttgcacaaatgtg

SEQ ID NO: 71813 - DNA, 20 bp, Artificial
  CRISPR gRNA sequence
ccttatttgcacaaatgtgt

SEQ ID NO: 71814 - DNA, 20 bp, Artificial
  CRISPR gRNA sequence
cttatttgcacaaatgtgtc

SEQ ID NO: 71815 - DNA, 20 bp, Artificial
  CRISPR gRNA sequence
atttgcacaaatgtgtcata

SEQ ID NO: 71816 - DNA, 20 bp, Artificial
  CRISPR gRNA sequence
tttgcacaaatgtgtcatat

SEQ ID NO: 71817 - DNA, 20 bp, Artificial
  CRISPR gRNA sequence
gcacaaatgtgtcatatgag

SEQ ID NO: 71818 - DNA, 20 bp, Artificial
  CRISPR gRNA sequence
cacaaatgtgtcatatgagt

SEQ ID NO: 71819 - DNA, 20 bp, Artificial
  CRISPR gRNA sequence
agctggcatcactatctccc

SEQ ID NO: 71820 - DNA, 20 bp, Artificial
  CRISPR gRNA sequence
gctggcatcactatctccca

SEQ ID NO: 71821 - DNA, 20 bp, Artificial
  CRISPR gRNA sequence
gcatcactatctcccaggga

SEQ ID NO: 71822 - DNA, 20 bp, Artificial
  CRISPR gRNA sequence
tctcccagggaggaaggttg

SEQ ID NO: 71823 - DNA, 20 bp, Artificial
  CRISPR gRNA sequence
ccagggaggaaggttgagtt

SEQ ID NO: 71824 - DNA, 20 bp, Artificial
  CRISPR gRNA sequence
agttggaggactcaggaggc

SEQ ID NO: 71825 - DNA, 20 bp, Artificial
  CRISPR gRNA sequence
gaggactcaggaggcaggtg

SEQ ID NO: 71826 - DNA, 20 bp, Artificial
  CRISPR gRNA sequence
aggaggcaggtgtggggtac

SEQ ID NO: 71827 - DNA, 20 bp, Artificial
  CRISPR gRNA sequence
tccctaggtcagctatgctg

SEQ ID NO: 71828 - DNA, 20 bp, Artificial
  CRISPR gRNA sequence
cctaggtcagctatgctggt

SEQ ID NO: 71829 - DNA, 20 bp, Artificial
  CRISPR gRNA sequence
ggtcagctatgctggtctaa

SEQ ID NO: 71830 - DNA, 20 bp, Artificial
  CRISPR gRNA sequence
tgctggtctaacacctgcct

SEQ ID NO: 71831 - DNA, 20 bp, Artificial
  CRISPR gRNA sequence
gtctaacacctgcctctgcc

SEQ ID NO: 71832 - DNA, 20 bp, Artificial
  CRISPR gRNA sequence
acacctgcctctgccaggta

SEQ ID NO: 71833 - DNA, 20 bp, Artificial
  CRISPR gRNA sequence
cctctgccaggtaactctag

SEQ ID NO: 71834 - DNA, 20 bp, Artificial
  CRISPR gRNA sequence
tgccaggtaactctaggcac

SEQ ID NO: 71835 - DNA, 20 bp, Artificial
  CRISPR gRNA sequence
ccaggtaactctaggcacag

SEQ ID NO: 71836 - DNA, 20 bp, Artificial
  CRISPR gRNA sequence
taggcacagctctacctttt

SEQ ID NO: 71837 - DNA, 20 bp, Artificial
  CRISPR gRNA sequence
ggcacagctctacctttttg

SEQ ID NO: 71838 - DNA, 20 bp, Artificial
  CRISPR gRNA sequence
tacctttttgggcctcagcc

SEQ ID NO: 71839 - DNA, 20 bp, Artificial
  CRISPR gRNA sequence
cctttttgggcctcagcctc

SEQ ID NO: 71840 - DNA, 20 bp, Artificial
  CRISPR gRNA sequence
tttgggcctcagcctcccaa

SEQ ID NO: 71841 - DNA, 20 bp, Artificial
  CRISPR gRNA sequence
ttgggcctcagcctcccaat

SEQ ID NO: 71842 - DNA, 20 bp, Artificial
  CRISPR gRNA sequence
tgggcctcagcctcccaatc

SEQ ID NO: 71843 - DNA, 20 bp, Artificial
  CRISPR gRNA sequence
gggcctcagcctcccaatct

SEQ ID NO: 71844 - DNA, 20 bp, Artificial
  CRISPR gRNA sequence
ggcctcagcctcccaatctg

SEQ ID NO: 71845 - DNA, 20 bp, Artificial
  CRISPR gRNA sequence
agcctcccaatctgcagata

SEQ ID NO: 71846 - DNA, 20 bp, Artificial
  CRISPR gRNA sequence
ccaatctgcagatacgacag

SEQ ID NO: 71847 - DNA, 20 bp, Artificial
  CRISPR gRNA sequence
cagatacgacagatggcaaa

SEQ ID NO: 71848 - DNA, 20 bp, Artificial
  CRISPR gRNA sequence
tatctgtgccccacagcctc

SEQ ID NO: 71849 - DNA, 20 bp, Artificial
  CRISPR gRNA sequence
tgccccacagcctctggaat

SEQ ID NO: 71850 - DNA, 20 bp, Artificial
  CRISPR gRNA sequence
tggaataaccccattccctg

SEQ ID NO: 71851 - DNA, 20 bp, Artificial
  CRISPR gRNA sequence
gaataaccccattccctgcg

SEQ ID NO: 71852 - DNA, 20 bp, Artificial
  CRISPR gRNA sequence
cctgcgacatggcccagcac

SEQ ID NO: 71853 - DNA, 20 bp, Artificial
  CRISPR gRNA sequence
cgacatggcccagcacctga

SEQ ID NO: 71854 - DNA, 20 bp, Artificial
  CRISPR gRNA sequence
aagagccaggagcccaggct

SEQ ID NO: 71855 - DNA, 20 bp, Artificial
  CRISPR gRNA sequence
gactttgccttctttgacaa

SEQ ID NO: 71856 - DNA, 20 bp, Artificial
  CRISPR gRNA sequence
tgccttctttgacaaccagc

SEQ ID NO: 71857 - DNA, 20 bp, Artificial
  CRISPR gRNA sequence
gccttctttgacaaccagcc

SEQ ID NO: 71858 - DNA, 20 bp, Artificial
  CRISPR gRNA sequence
ccttctttgacaaccagccc

SEQ ID NO: 71859 - DNA, 20 bp, Artificial
  CRISPR gRNA sequence
ctttgacaaccagccccagg

SEQ ID NO: 71860 - DNA, 20 bp, Artificial
  CRISPR gRNA sequence
tttgacaaccagccccaggc

SEQ ID NO: 71861 - DNA, 20 bp, Artificial
  CRISPR gRNA sequence
tgacaaccagccccaggccc

SEQ ID NO: 71862 - DNA, 20 bp, Artificial
  CRISPR gRNA sequence
gacaaccagccccaggcccc

SEQ ID NO: 71863 - DNA, 20 bp, Artificial
  CRISPR gRNA sequence
acaaccagccccaggcccct

SEQ ID NO: 71864 - DNA, 20 bp, Artificial
  CRISPR gRNA sequence
ggggtacttgatggccccct

SEQ ID NO: 71865 - DNA, 20 bp, Artificial
  CRISPR gRNA sequence
gggtacttgatggccccctc

SEQ ID NO: 71866 - DNA, 20 bp, Artificial
  CRISPR gRNA sequence
gatggccccctcaagacctt

SEQ ID NO: 71867 - DNA, 20 bp, Artificial
  CRISPR gRNA sequence
atggccccctcaagaccttt

SEQ ID NO: 71868 - DNA, 20 bp, Artificial
  CRISPR gRNA sequence
aagacctttggaatccagcc

SEQ ID NO: 71869 - DNA, 20 bp, Artificial
  CRISPR gRNA sequence
tggaatccagccaagtgatg

SEQ ID NO: 71870 - DNA, 20 bp, Artificial
  CRISPR gRNA sequence
ggaatccagccaagtgatgc

SEQ ID NO: 71871 - DNA, 20 bp, Artificial
  CRISPR gRNA sequence
gaatccagccaagtgatgca

SEQ ID NO: 71872 - DNA, 20 bp, Artificial
  CRISPR gRNA sequence
tcgcccactgggataattga

SEQ ID NO: 71873 - DNA, 20 bp, Artificial
  CRISPR gRNA sequence
cgcccactgggataattgac

SEQ ID NO: 71874 - DNA, 20 bp, Artificial
  CRISPR gRNA sequence
gcccactgggataattgact

SEQ ID NO: 71875 - DNA, 20 bp, Artificial
  CRISPR gRNA sequence
ggataattgactcaggaaag

SEQ ID NO: 71876 - DNA, 20 bp, Artificial
  CRISPR gRNA sequence
actcaggaaagaagagcctc

SEQ ID NO: 71877 - DNA, 20 bp, Artificial
  CRISPR gRNA sequence
aggaaagaagagcctcggca

SEQ ID NO: 71878 - DNA, 20 bp, Artificial
  CRISPR gRNA sequence
ggcagggcgctctgcactcc

SEQ ID NO: 71879 - DNA, 20 bp, Artificial
  CRISPR gRNA sequence
tgcactccacccaggaggaa

SEQ ID NO: 71880 - DNA, 20 bp, Artificial
  CRISPR gRNA sequence
cactccacccaggaggaagg

SEQ ID NO: 71881 - DNA, 20 bp, Artificial
  CRISPR gRNA sequence
cacccaggaggaaggatacg

SEQ ID NO: 71882 - DNA, 20 bp, Artificial
  CRISPR gRNA sequence
ctgcagtcctcagggagaac

SEQ ID NO: 71883 - DNA, 20 bp, Artificial
  CRISPR gRNA sequence
cagtcctcagggagaacttt

SEQ ID NO: 71884 - DNA, 20 bp, Artificial
  CRISPR gRNA sequence
agggagaacttttttgggaa

SEQ ID NO: 71885 - DNA, 20 bp, Artificial
  CRISPR gRNA sequence
ttttgggaaccaggagctgg

SEQ ID NO: 71886 - DNA, 20 bp, Artificial
  CRISPR gRNA sequence
tttgggaaccaggagctggg

SEQ ID NO: 71887 - DNA, 20 bp, Artificial
  CRISPR gRNA sequence
ttgggaaccaggagctgggt

SEQ ID NO: 71888 - DNA, 20 bp, Artificial
  CRISPR gRNA sequence
tgggaaccaggagctgggtc

SEQ ID NO: 71889 - DNA, 20 bp, Artificial
  CRISPR gRNA sequence
gggaaccaggagctgggtct

SEQ ID NO: 71890 - DNA, 20 bp, Artificial
  CRISPR gRNA sequence
ggaaccaggagctgggtctg

SEQ ID NO: 71891 - DNA, 20 bp, Artificial
  CRISPR gRNA sequence
ggtctggacaaaggagtacc

SEQ ID NO: 71892 - DNA, 20 bp, Artificial
  CRISPR gRNA sequence
gacaaaggagtaccctgcat

SEQ ID NO: 71893 - DNA, 20 bp, Artificial
  CRISPR gRNA sequence
cattacgtgggatatgtgtg

SEQ ID NO: 71894 - DNA, 20 bp, Artificial
  CRISPR gRNA sequence
cgtgggatatgtgtgatcaa

SEQ ID NO: 71895 - DNA, 20 bp, Artificial
  CRISPR gRNA sequence
gggacatgcgacacacaatg

SEQ ID NO: 71896 - DNA, 20 bp, Artificial
  CRISPR gRNA sequence
tatgtggcagtgtgacccct

SEQ ID NO: 71897 - DNA, 20 bp, Artificial
  CRISPR gRNA sequence
gacatgtggcgttacatgaa

SEQ ID NO: 71898 - DNA, 20 bp, Artificial
  CRISPR gRNA sequence
acatgtggcgttacatgaaa

SEQ ID NO: 71899 - DNA, 20 bp, Artificial
  CRISPR gRNA sequence
catgaaagtcagtgtggcac

SEQ ID NO: 71900 - DNA, 20 bp, Artificial
  CRISPR gRNA sequence
tgtggcatgggtgctggcat

SEQ ID NO: 71901 - DNA, 20 bp, Artificial
  CRISPR gRNA sequence
tggcatgggtgctggcatcc

SEQ ID NO: 71902 - DNA, 20 bp, Artificial
  CRISPR gRNA sequence
gcatcccaagtagcaggata

SEQ ID NO: 71903 - DNA, 20 bp, Artificial
  CRISPR gRNA sequence
ttggtctatatatgacacat

SEQ ID NO: 71904 - DNA, 20 bp, Artificial
  CRISPR gRNA sequence
gtctatatatgacacatgac

SEQ ID NO: 71905 - DNA, 20 bp, Artificial
  CRISPR gRNA sequence
tatatgacacatgacaaatg

SEQ ID NO: 71906 - DNA, 20 bp, Artificial
  CRISPR gRNA sequence
atggctggccagatgacctc

SEQ ID NO: 71907 - DNA, 20 bp, Artificial
  CRISPR gRNA sequence
gccagatgacctcaggctgg

SEQ ID NO: 71908 - DNA, 20 bp, Artificial
  CRISPR gRNA sequence
aggctggcccaagatctaat

SEQ ID NO: 71909 - DNA, 20 bp, Artificial
  CRISPR gRNA sequence
gcccaagatctaatttatta

SEQ ID NO: 71910 - DNA, 20 bp, Artificial
  CRISPR gRNA sequence
atttattaatttttaaagca

SEQ ID NO: 71911 - DNA, 20 bp, Artificial
  CRISPR gRNA sequence
attaatttttaaagcaaata

SEQ ID NO: 71912 - DNA, 20 bp, Artificial
  CRISPR gRNA sequence
ttaatttttaaagcaaatac

SEQ ID NO: 71913 - DNA, 20 bp, Artificial
  CRISPR gRNA sequence
atttttaaagcaaatacata

SEQ ID NO: 71914 - DNA, 20 bp, Artificial
  CRISPR gRNA sequence
ttaaagcaaatacatattta

SEQ ID NO: 71915 - DNA, 20 bp, Artificial
  CRISPR gRNA sequence
taaagcaaatacatatttat

SEQ ID NO: 71916 - DNA, 20 bp, Artificial
  CRISPR gRNA sequence
aaagcaaatacatatttata

SEQ ID NO: 71917 - DNA, 20 bp, Artificial
  CRISPR gRNA sequence
aagcaaatacatatttatag

SEQ ID NO: 71918 - DNA, 20 bp, Artificial
  CRISPR gRNA sequence
atagattgtgtgtatggagc

SEQ ID NO: 71919 - DNA, 20 bp, Artificial
  CRISPR gRNA sequence
tagattgtgtgtatggagca

SEQ ID NO: 71920 - DNA, 20 bp, Artificial
  CRISPR gRNA sequence
tgtgtatggagcagctaagt

SEQ ID NO: 71921 - DNA, 20 bp, Artificial
  CRISPR gRNA sequence
agtcaggaaaagtcttccgc

SEQ ID NO: 71922 - DNA, 20 bp, Artificial
  CRISPR gRNA sequence
ccgcccgagctgggagggga

SEQ ID NO: 71923 - DNA, 20 bp, Artificial
  CRISPR gRNA sequence
cgcccgagctgggaggggag

SEQ ID NO: 71924 - DNA, 20 bp, Artificial
  CRISPR gRNA sequence
ggaggggagagtgtccatgc

SEQ ID NO: 71925 - DNA, 20 bp, Artificial
  CRISPR gRNA sequence
accagtccaggggctcaagg

SEQ ID NO: 71926 - DNA, 20 bp, Artificial
  CRISPR gRNA sequence
aagggccagggctctggaac

SEQ ID NO: 71927 - DNA, 20 bp, Artificial
  CRISPR gRNA sequence
tggaacaagccagggactca

SEQ ID NO: 71928 - DNA, 20 bp, Artificial
  CRISPR gRNA sequence
gaacaagccagggactcagc

SEQ ID NO: 71929 - DNA, 20 bp, Artificial
  CRISPR gRNA sequence
agccattaagtcccctcctg

SEQ ID NO: 71930 - DNA, 20 bp, Artificial
  CRISPR gRNA sequence
agtcccctcctgcctcaatc

SEQ ID NO: 71931 - DNA, 20 bp, Artificial
  CRISPR gRNA sequence
ctgcctcaatcctcagccta

SEQ ID NO: 71932 - DNA, 20 bp, Artificial
  CRISPR gRNA sequence
cctcaatcctcagcctaccc

SEQ ID NO: 71933 - DNA, 20 bp, Artificial
  CRISPR gRNA sequence
aatcctcagcctacccatct

SEQ ID NO: 71934 - DNA, 20 bp, Artificial
  CRISPR gRNA sequence
agcctacccatctataaact

SEQ ID NO: 71935 - DNA, 20 bp, Artificial
  CRISPR gRNA sequence
cccatctataaacttgatga

SEQ ID NO: 71936 - DNA, 20 bp, Artificial
  CRISPR gRNA sequence
taaacttgatgactcctccc

SEQ ID NO: 71937 - DNA, 20 bp, Artificial
  CRISPR gRNA sequence
gatgactcctcccttactta

SEQ ID NO: 71938 - DNA, 20 bp, Artificial
  CRISPR gRNA sequence
atgactcctcccttacttac

SEQ ID NO: 71939 - DNA, 20 bp, Artificial
  CRISPR gRNA sequence
ctcccttacttacatactag

SEQ ID NO: 71940 - DNA, 20 bp, Artificial
  CRISPR gRNA sequence
ccttacttacatactagctt

SEQ ID NO: 71941 - DNA, 20 bp, Artificial
  CRISPR gRNA sequence
acttacatactagcttccaa

SEQ ID NO: 71942 - DNA, 20 bp, Artificial
  CRISPR gRNA sequence
cttacatactagcttccaag

SEQ ID NO: 71943 - DNA, 20 bp, Artificial
  CRISPR gRNA sequence
acatactagcttccaaggac

SEQ ID NO: 71944 - DNA, 20 bp, Artificial
  CRISPR gRNA sequence
catactagcttccaaggaca

SEQ ID NO: 71945 - DNA, 20 bp, Artificial
  CRISPR gRNA sequence
gcttccaaggacaggtggag

SEQ ID NO: 71946 - DNA, 20 bp, Artificial
  CRISPR gRNA sequence
ccaaggacaggtggaggtag

SEQ ID NO: 71947 - DNA, 20 bp, Artificial
  CRISPR gRNA sequence
caaggacaggtggaggtagg

SEQ ID NO: 71948 - DNA, 20 bp, Artificial
  CRISPR gRNA sequence
gcgggagtggagaagcccag

SEQ ID NO: 71949 - DNA, 20 bp, Artificial
  CRISPR gRNA sequence
tcctatgtaagggacaaagc

SEQ ID NO: 71950 - DNA, 20 bp, Artificial
  CRISPR gRNA sequence
tgtaagggacaaagccaggt

SEQ ID NO: 71951 - DNA, 20 bp, Artificial
  CRISPR gRNA sequence
atggtactgggtagggggca

SEQ ID NO: 71952 - DNA, 20 bp, Artificial
  CRISPR gRNA sequence
ggtagggggcactgccaaga

SEQ ID NO: 71953 - DNA, 20 bp, Artificial
  CRISPR gRNA sequence
ccaagacaataagctaggct

SEQ ID NO: 71954 - DNA, 20 bp, Artificial
  CRISPR gRNA sequence
ggctactgggtccagctact

SEQ ID NO: 71955 - DNA, 20 bp, Artificial
  CRISPR gRNA sequence
ctgggtccagctactacttt

SEQ ID NO: 71956 - DNA, 20 bp, Artificial
  CRISPR gRNA sequence
ggtccagctactactttggt

SEQ ID NO: 71957 - DNA, 20 bp, Artificial
  CRISPR gRNA sequence
ctactttggtgggattcagg

SEQ ID NO: 71958 - DNA, 20 bp, Artificial
  CRISPR gRNA sequence
ctttggtgggattcaggtga

SEQ ID NO: 71959 - DNA, 20 bp, Artificial
  CRISPR gRNA sequence
tggtgggattcaggtgagtc

SEQ ID NO: 71960 - DNA, 20 bp, Artificial
  CRISPR gRNA sequence
ggtgggattcaggtgagtct

SEQ ID NO: 71961 - DNA, 20 bp, Artificial
  CRISPR gRNA sequence
gtgggattcaggtgagtctc

SEQ ID NO: 71962 - DNA, 20 bp, Artificial
  CRISPR gRNA sequence
aggtgagtctccatgcactt

SEQ ID NO: 71963 - DNA, 20 bp, Artificial
  CRISPR gRNA sequence
catgcacttcacatgttacc

SEQ ID NO: 71964 - DNA, 20 bp, Artificial
  CRISPR gRNA sequence
cacatgttacccagtgttct

SEQ ID NO: 71965 - DNA, 20 bp, Artificial
  CRISPR gRNA sequence
acatgttacccagtgttctt

SEQ ID NO: 71966 - DNA, 20 bp, Artificial
  CRISPR gRNA sequence
cccagtgttcttgttacttc

SEQ ID NO: 71967 - DNA, 20 bp, Artificial
  CRISPR gRNA sequence
ttgttacttccaaggagaac

SEQ ID NO: 71968 - DNA, 20 bp, Artificial
  CRISPR gRNA sequence
gttacttccaaggagaacca

SEQ ID NO: 71969 - DNA, 20 bp, Artificial
  CRISPR gRNA sequence
ttacttccaaggagaaccaa

SEQ ID NO: 71970 - DNA, 20 bp, Artificial
  CRISPR gRNA sequence
cttccaaggagaaccaagaa

SEQ ID NO: 71971 - DNA, 20 bp, Artificial
  CRISPR gRNA sequence
ccaaggagaaccaagaatgg

SEQ ID NO: 71972 - DNA, 20 bp, Artificial
  CRISPR gRNA sequence
caaggagaaccaagaatggc

SEQ ID NO: 71973 - DNA, 20 bp, Artificial
  CRISPR gRNA sequence
tgtcacactcgaagccaggc

SEQ ID NO: 71974 - DNA, 20 bp, Artificial
  CRISPR gRNA sequence
tcacactcgaagccaggctt

SEQ ID NO: 71975 - DNA, 20 bp, Artificial
  CRISPR gRNA sequence
gaagccaggcttgatcaata

SEQ ID NO: 71976 - DNA, 20 bp, Artificial
  CRISPR gRNA sequence
gatcaataaacacaatggta

SEQ ID NO: 71977 - DNA, 20 bp, Artificial
  CRISPR gRNA sequence
atcaataaacacaatggtat

SEQ ID NO: 71978 - DNA, 20 bp, Artificial
  CRISPR gRNA sequence
cacgtctagcgtgaatccaa

SEQ ID NO: 71979 - DNA, 20 bp, Artificial
  CRISPR gRNA sequence
gcgtgaatccaatgtttcct

SEQ ID NO: 71980 - DNA, 20 bp, Artificial
  CRISPR gRNA sequence
cctcttaccccactgaagtc

SEQ ID NO: 71981 - DNA, 20 bp, Artificial
  CRISPR gRNA sequence
ctcttaccccactgaagtca

SEQ ID NO: 71982 - DNA, 20 bp, Artificial
  CRISPR gRNA sequence
ttaccccactgaagtcagag

SEQ ID NO: 71983 - DNA, 20 bp, Artificial
  CRISPR gRNA sequence
accccactgaagtcagaggt

SEQ ID NO: 71984 - DNA, 20 bp, Artificial
  CRISPR gRNA sequence
ccccactgaagtcagaggtg

SEQ ID NO: 71985 - DNA, 20 bp, Artificial
  CRISPR gRNA sequence
aagtcagaggtggttcaccc

SEQ ID NO: 71986 - DNA, 20 bp, Artificial
  CRISPR gRNA sequence
accccctgccgtaaggactg

SEQ ID NO: 71987 - DNA, 20 bp, Artificial
  CRISPR gRNA sequence
ccgtaaggactggacagcag

SEQ ID NO: 71988 - DNA, 20 bp, Artificial
  CRISPR gRNA sequence
gacagcagcgcaaacaacag

SEQ ID NO: 71989 - DNA, 20 bp, Artificial
  CRISPR gRNA sequence
tctgttgtttgcgctgctgt

SEQ ID NO: 71990 - DNA, 20 bp, Artificial
  CRISPR gRNA sequence
tgttgtttgcgctgctgtcc

SEQ ID NO: 71991 - DNA, 20 bp, Artificial
  CRISPR gRNA sequence
ttgtttgcgctgctgtccag

SEQ ID NO: 71992 - DNA, 20 bp, Artificial
  CRISPR gRNA sequence
tttgcgctgctgtccagtcc

SEQ ID NO: 71993 - DNA, 20 bp, Artificial
  CRISPR gRNA sequence
gcgctgctgtccagtcctta

SEQ ID NO: 71994 - DNA, 20 bp, Artificial
  CRISPR gRNA sequence
cgctgctgtccagtccttac

SEQ ID NO: 71995 - DNA, 20 bp, Artificial
  CRISPR gRNA sequence
ctgtccagtccttacggcag

SEQ ID NO: 71996 - DNA, 20 bp, Artificial
  CRISPR gRNA sequence
tccagtccttacggcagggg

SEQ ID NO: 71997 - DNA, 20 bp, Artificial
  CRISPR gRNA sequence
acggcagggggtgaaccacc

SEQ ID NO: 71998 - DNA, 20 bp, Artificial
  CRISPR gRNA sequence
cggcagggggtgaaccacct

SEQ ID NO: 71999 - DNA, 20 bp, Artificial
  CRISPR gRNA sequence
tgacttcagtggggtaagag

SEQ ID NO: 72000 - DNA, 20 bp, Artificial
  CRISPR gRNA sequence
acttcagtggggtaagagga

SEQ ID NO: 72001 - DNA, 20 bp, Artificial
  CRISPR gRNA sequence
cagtggggtaagaggaaaca

SEQ ID NO: 72002 - DNA, 20 bp, Artificial
  CRISPR gRNA sequence
agtggggtaagaggaaacat

SEQ ID NO: 72003 - DNA, 20 bp, Artificial
  CRISPR gRNA sequence
gattcacgctagacgtggaa

SEQ ID NO: 72004 - DNA, 20 bp, Artificial
  CRISPR gRNA sequence
acgctagacgtggaatacca

SEQ ID NO: 72005 - DNA, 20 bp, Artificial
  CRISPR gRNA sequence
gacgtggaataccattgtgt

SEQ ID NO: 72006 - DNA, 20 bp, Artificial
  CRISPR gRNA sequence
tgtttattgatcaagcctgg

SEQ ID NO: 72007 - DNA, 20 bp, Artificial
  CRISPR gRNA sequence
attgatcaagcctggcttcg

SEQ ID NO: 72008 - DNA, 20 bp, Artificial
  CRISPR gRNA sequence
ttgatcaagcctggcttcga

SEQ ID NO: 72009 - DNA, 20 bp, Artificial
  CRISPR gRNA sequence
atcaagcctggcttcgagtg

SEQ ID NO: 72010 - DNA, 20 bp, Artificial
  CRISPR gRNA sequence
gcttcgagtgtgacagagcc

SEQ ID NO: 72011 - DNA, 20 bp, Artificial
  CRISPR gRNA sequence
cgagtgtgacagagccattc

SEQ ID NO: 72012 - DNA, 20 bp, Artificial
  CRISPR gRNA sequence
gagtgtgacagagccattct

SEQ ID NO: 72013 - DNA, 20 bp, Artificial
  CRISPR gRNA sequence
ttggttctccttggaagtaa

SEQ ID NO: 72014 - DNA, 20 bp, Artificial
  CRISPR gRNA sequence
ggttctccttggaagtaaca

SEQ ID NO: 72015 - DNA, 20 bp, Artificial
  CRISPR gRNA sequence
gttctccttggaagtaacaa

SEQ ID NO: 72016 - DNA, 20 bp, Artificial
  CRISPR gRNA sequence
tccttggaagtaacaagaac

SEQ ID NO: 72017 - DNA, 20 bp, Artificial
  CRISPR gRNA sequence
cttggaagtaacaagaacac

SEQ ID NO: 72018 - DNA, 20 bp, Artificial
  CRISPR gRNA sequence
ggaagtaacaagaacactgg

SEQ ID NO: 72019 - DNA, 20 bp, Artificial
  CRISPR gRNA sequence
gaagtaacaagaacactggg

SEQ ID NO: 72020 - DNA, 20 bp, Artificial
  CRISPR gRNA sequence
ggtaacatgtgaagtgcatg

SEQ ID NO: 72021 - DNA, 20 bp, Artificial
  CRISPR gRNA sequence
acctgaatcccaccaaagta

SEQ ID NO: 72022 - DNA, 20 bp, Artificial
  CRISPR gRNA sequence
aatcccaccaaagtagtagc

SEQ ID NO: 72023 - DNA, 20 bp, Artificial
  CRISPR gRNA sequence
gacccagtagcctagcttat

SEQ ID NO: 72024 - DNA, 20 bp, Artificial
  CRISPR gRNA sequence
gcttattgtcttggcagtgc

SEQ ID NO: 72025 - DNA, 20 bp, Artificial
  CRISPR gRNA sequence
attgtcttggcagtgccccc

SEQ ID NO: 72026 - DNA, 20 bp, Artificial
  CRISPR gRNA sequence
ttgtcttggcagtgccccct

SEQ ID NO: 72027 - DNA, 20 bp, Artificial
  CRISPR gRNA sequence
tcttggcagtgccccctacc

SEQ ID NO: 72028 - DNA, 20 bp, Artificial
  CRISPR gRNA sequence
ggcagtgccccctacccagt

SEQ ID NO: 72029 - DNA, 20 bp, Artificial
  CRISPR gRNA sequence
gcagtgccccctacccagta

SEQ ID NO: 72030 - DNA, 20 bp, Artificial
  CRISPR gRNA sequence
cccagtaccattagacctgg

SEQ ID NO: 72031 - DNA, 20 bp, Artificial
  CRISPR gRNA sequence
gacctggctttgtcccttac

SEQ ID NO: 72032 - DNA, 20 bp, Artificial
  CRISPR gRNA sequence
gctttgtcccttacatagga

SEQ ID NO: 72033 - DNA, 20 bp, Artificial
  CRISPR gRNA sequence
tgtcccttacataggacaga

SEQ ID NO: 72034 - DNA, 20 bp, Artificial
  CRISPR gRNA sequence
gtcccttacataggacagac

SEQ ID NO: 72035 - DNA, 20 bp, Artificial
  CRISPR gRNA sequence
tcccttacataggacagact

SEQ ID NO: 72036 - DNA, 20 bp, Artificial
  CRISPR gRNA sequence
acataggacagactgggctt

SEQ ID NO: 72037 - DNA, 20 bp, Artificial
  CRISPR gRNA sequence
cataggacagactgggcttc

SEQ ID NO: 72038 - DNA, 20 bp, Artificial
  CRISPR gRNA sequence
ggcttctccactcccgccag

SEQ ID NO: 72039 - DNA, 20 bp, Artificial
  CRISPR gRNA sequence
ctccactcccgccaggctgg

SEQ ID NO: 72040 - DNA, 20 bp, Artificial
  CRISPR gRNA sequence
tccactcccgccaggctggc

SEQ ID NO: 72041 - DNA, 20 bp, Artificial
  CRISPR gRNA sequence
cactcccgccaggctggccc

SEQ ID NO: 72042 - DNA, 20 bp, Artificial
  CRISPR gRNA sequence
ccgccaggctggccctacct

SEQ ID NO: 72043 - DNA, 20 bp, Artificial
  CRISPR gRNA sequence
gccctacctccacctgtcct

SEQ ID NO: 72044 - DNA, 20 bp, Artificial
  CRISPR gRNA sequence
cctccacctgtccttggaag

SEQ ID NO: 72045 - DNA, 20 bp, Artificial
  CRISPR gRNA sequence
cacctgtccttggaagctag

SEQ ID NO: 72046 - DNA, 20 bp, Artificial
  CRISPR gRNA sequence
tccttggaagctagtatgta

SEQ ID NO: 72047 - DNA, 20 bp, Artificial
  CRISPR gRNA sequence
ggaagctagtatgtaagtaa

SEQ ID NO: 72048 - DNA, 20 bp, Artificial
  CRISPR gRNA sequence
gaagctagtatgtaagtaag

SEQ ID NO: 72049 - DNA, 20 bp, Artificial
  CRISPR gRNA sequence
gtatgtaagtaagggaggag

SEQ ID NO: 72050 - DNA, 20 bp, Artificial
  CRISPR gRNA sequence
atagatgggtaggctgagga

SEQ ID NO: 72051 - DNA, 20 bp, Artificial
  CRISPR gRNA sequence
tagatgggtaggctgaggat

SEQ ID NO: 72052 - DNA, 20 bp, Artificial
  CRISPR gRNA sequence
aggattgaggcaggagggga

SEQ ID NO: 72053 - DNA, 20 bp, Artificial
  CRISPR gRNA sequence
aggcaggaggggacttaatg

SEQ ID NO: 72054 - DNA, 20 bp, Artificial
  CRISPR gRNA sequence
aatggctgagtccctggctt

SEQ ID NO: 72055 - DNA, 20 bp, Artificial
  CRISPR gRNA sequence
atggctgagtccctggcttg

SEQ ID NO: 72056 - DNA, 20 bp, Artificial
  CRISPR gRNA sequence
agtccctggcttgttccaga

SEQ ID NO: 72057 - DNA, 20 bp, Artificial
  CRISPR gRNA sequence
gcttgttccagagccctggc

SEQ ID NO: 72058 - DNA, 20 bp, Artificial
  CRISPR gRNA sequence
gttccagagccctggccctt

SEQ ID NO: 72059 - DNA, 20 bp, Artificial
  CRISPR gRNA sequence
ttccagagccctggcccttg

SEQ ID NO: 72060 - DNA, 20 bp, Artificial
  CRISPR gRNA sequence
cagagccctggcccttgagc

SEQ ID NO: 72061 - DNA, 20 bp, Artificial
  CRISPR gRNA sequence
gcccttgagcccctggactg

SEQ ID NO: 72062 - DNA, 20 bp, Artificial
  CRISPR gRNA sequence
gagcccctggactggtcagt

SEQ ID NO: 72063 - DNA, 20 bp, Artificial
  CRISPR gRNA sequence
agcccctggactggtcagtg

SEQ ID NO: 72064 - DNA, 20 bp, Artificial
  CRISPR gRNA sequence
gactggtcagtgcatggaca

SEQ ID NO: 72065 - DNA, 20 bp, Artificial
  CRISPR gRNA sequence
gtcagtgcatggacactctc

SEQ ID NO: 72066 - DNA, 20 bp, Artificial
  CRISPR gRNA sequence
tcccctcccagctcgggcgg

SEQ ID NO: 72067 - DNA, 20 bp, Artificial
  CRISPR gRNA sequence
ccctcccagctcgggcggaa

SEQ ID NO: 72068 - DNA, 20 bp, Artificial
  CRISPR gRNA sequence
ccagctcgggcggaagactt

SEQ ID NO: 72069 - DNA, 20 bp, Artificial
  CRISPR gRNA sequence
gggcggaagacttttcctga

SEQ ID NO: 72070 - DNA, 20 bp, Artificial
  CRISPR gRNA sequence
ttcctgacttagctgctcca

SEQ ID NO: 72071 - DNA, 20 bp, Artificial
  CRISPR gRNA sequence
tcctgacttagctgctccat

SEQ ID NO: 72072 - DNA, 20 bp, Artificial
  CRISPR gRNA sequence
cctgacttagctgctccata

SEQ ID NO: 72073 - DNA, 20 bp, Artificial
  CRISPR gRNA sequence
ctgacttagctgctccatac

SEQ ID NO: 72074 - DNA, 20 bp, Artificial
  CRISPR gRNA sequence
acttagctgctccatacaca

SEQ ID NO: 72075 - DNA, 20 bp, Artificial
  CRISPR gRNA sequence
agctgctccatacacacaat

SEQ ID NO: 72076 - DNA, 20 bp, Artificial
  CRISPR gRNA sequence
gctgctccatacacacaatc

SEQ ID NO: 72077 - DNA, 20 bp, Artificial
  CRISPR gRNA sequence
ctccatacacacaatctata

SEQ ID NO: 72078 - DNA, 20 bp, Artificial
  CRISPR gRNA sequence
catacacacaatctataaat

SEQ ID NO: 72079 - DNA, 20 bp, Artificial
  CRISPR gRNA sequence
taaatatgtatttgctttaa

SEQ ID NO: 72080 - DNA, 20 bp, Artificial
  CRISPR gRNA sequence
gctttaaaaattaataaatt

SEQ ID NO: 72081 - DNA, 20 bp, Artificial
  CRISPR gRNA sequence
ctttaaaaattaataaatta

SEQ ID NO: 72082 - DNA, 20 bp, Artificial
  CRISPR gRNA sequence
taaaaattaataaattagat

SEQ ID NO: 72083 - DNA, 20 bp, Artificial
  CRISPR gRNA sequence
aaaaattaataaattagatc

SEQ ID NO: 72084 - DNA, 20 bp, Artificial
  CRISPR gRNA sequence
aaaattaataaattagatct

SEQ ID NO: 72085 - DNA, 20 bp, Artificial
  CRISPR gRNA sequence
ataaattagatcttgggcca

SEQ ID NO: 72086 - DNA, 20 bp, Artificial
  CRISPR gRNA sequence
gatcttgggccagcctgagg

SEQ ID NO: 72087 - DNA, 20 bp, Artificial
  CRISPR gRNA sequence
gggccagcctgaggtcatct

SEQ ID NO: 72088 - DNA, 20 bp, Artificial
  CRISPR gRNA sequence
ggccagcctgaggtcatctg

SEQ ID NO: 72089 - DNA, 20 bp, Artificial
  CRISPR gRNA sequence
aggtcatctggccagccatg

SEQ ID NO: 72090 - DNA, 20 bp, Artificial
  CRISPR gRNA sequence
gccagccatgagtcctgtga

SEQ ID NO: 72091 - DNA, 20 bp, Artificial
  CRISPR gRNA sequence
tgacatggacatttgtcatg

SEQ ID NO: 72092 - DNA, 20 bp, Artificial
  CRISPR gRNA sequence
gtcatgtgtcatatatagac

SEQ ID NO: 72093 - DNA, 20 bp, Artificial
  CRISPR gRNA sequence
tcatgtgtcatatatagacc

SEQ ID NO: 72094 - DNA, 20 bp, Artificial
  CRISPR gRNA sequence
ctacttgggatgccagcacc

SEQ ID NO: 72095 - DNA, 20 bp, Artificial
  CRISPR gRNA sequence
cttgggatgccagcacccat

SEQ ID NO: 72096 - DNA, 20 bp, Artificial
  CRISPR gRNA sequence
gggatgccagcacccatgcc

SEQ ID NO: 72097 - DNA, 20 bp, Artificial
  CRISPR gRNA sequence
ggatgccagcacccatgcca

SEQ ID NO: 72098 - DNA, 20 bp, Artificial
  CRISPR gRNA sequence
actttcatgtaacgccacat

SEQ ID NO: 72099 - DNA, 20 bp, Artificial
  CRISPR gRNA sequence
tcatgtaacgccacatgtca

SEQ ID NO: 72100 - DNA, 20 bp, Artificial
  CRISPR gRNA sequence
catgtaacgccacatgtcaa

SEQ ID NO: 72101 - DNA, 20 bp, Artificial
  CRISPR gRNA sequence
atgtaacgccacatgtcaag

SEQ ID NO: 72102 - DNA, 20 bp, Artificial
  CRISPR gRNA sequence
ccacatataaccgtacgtgt

SEQ ID NO: 72103 - DNA, 20 bp, Artificial
  CRISPR gRNA sequence
tcatgacaccctcattgtgt

SEQ ID NO: 72104 - DNA, 20 bp, Artificial
  CRISPR gRNA sequence
attgtgtgtcgcatgtcccc

SEQ ID NO: 72105 - DNA, 20 bp, Artificial
  CRISPR gRNA sequence
tgtgtcgcatgtccccaatt

SEQ ID NO: 72106 - DNA, 20 bp, Artificial
  CRISPR gRNA sequence
atcacacatatcccacgtaa

SEQ ID NO: 72107 - DNA, 20 bp, Artificial
  CRISPR gRNA sequence
ctttgtccagacccagctcc

SEQ ID NO: 72108 - DNA, 20 bp, Artificial
  CRISPR gRNA sequence
tgtccagacccagctcctgg

SEQ ID NO: 72109 - DNA, 20 bp, Artificial
  CRISPR gRNA sequence
gtccagacccagctcctggt

SEQ ID NO: 72110 - DNA, 20 bp, Artificial
  CRISPR gRNA sequence
tccagacccagctcctggtt

SEQ ID NO: 72111 - DNA, 20 bp, Artificial
  CRISPR gRNA sequence
ctggttcccaaaaaagttct

SEQ ID NO: 72112 - DNA, 20 bp, Artificial
  CRISPR gRNA sequence
gttcccaaaaaagttctccc

SEQ ID NO: 72113 - DNA, 20 bp, Artificial
  CRISPR gRNA sequence
ccaaaaaagttctccctgag

SEQ ID NO: 72114 - DNA, 20 bp, Artificial
  CRISPR gRNA sequence
tccctgaggactgcagcagg

SEQ ID NO: 72115 - DNA, 20 bp, Artificial
  CRISPR gRNA sequence
cctgaggactgcagcaggac

SEQ ID NO: 72116 - DNA, 20 bp, Artificial
  CRISPR gRNA sequence
aggactgcagcaggacacac

SEQ ID NO: 72117 - DNA, 20 bp, Artificial
  CRISPR gRNA sequence
cagcaggacacacgtatcct

SEQ ID NO: 72118 - DNA, 20 bp, Artificial
  CRISPR gRNA sequence
cctcctgggtggagtgcaga

SEQ ID NO: 72119 - DNA, 20 bp, Artificial
  CRISPR gRNA sequence
ctcctgggtggagtgcagag

SEQ ID NO: 72120 - DNA, 20 bp, Artificial
  CRISPR gRNA sequence
ctgggtggagtgcagagcgc

SEQ ID NO: 72121 - DNA, 20 bp, Artificial
  CRISPR gRNA sequence
ggtggagtgcagagcgccct

SEQ ID NO: 72122 - DNA, 20 bp, Artificial
  CRISPR gRNA sequence
ccgaggctcttctttcctga

SEQ ID NO: 72123 - DNA, 20 bp, Artificial
  CRISPR gRNA sequence
ttctttcctgagtcaattat

SEQ ID NO: 72124 - DNA, 20 bp, Artificial
  CRISPR gRNA sequence
ctttcctgagtcaattatcc

SEQ ID NO: 72125 - DNA, 20 bp, Artificial
  CRISPR gRNA sequence
tttcctgagtcaattatccc

SEQ ID NO: 72126 - DNA, 20 bp, Artificial
  CRISPR gRNA sequence
tcctgagtcaattatcccag

SEQ ID NO: 72127 - DNA, 20 bp, Artificial
  CRISPR gRNA sequence
cctgagtcaattatcccagt

SEQ ID NO: 72128 - DNA, 20 bp, Artificial
  CRISPR gRNA sequence
ctgagtcaattatcccagtg

SEQ ID NO: 72129 - DNA, 20 bp, Artificial
  CRISPR gRNA sequence
agtcaattatcccagtgggc

SEQ ID NO: 72130 - DNA, 20 bp, Artificial
  CRISPR gRNA sequence
tcccagtgggcgaaaggtgg

SEQ ID NO: 72131 - DNA, 20 bp, Artificial
  CRISPR gRNA sequence
gggtgcatcacttggctgga

SEQ ID NO: 72132 - DNA, 20 bp, Artificial
  CRISPR gRNA sequence
ggtgcatcacttggctggat

SEQ ID NO: 72133 - DNA, 20 bp, Artificial
  CRISPR gRNA sequence
ggctggattccaaaggtctt

SEQ ID NO: 72134 - DNA, 20 bp, Artificial
  CRISPR gRNA sequence
gctggattccaaaggtcttg

SEQ ID NO: 72135 - DNA, 20 bp, Artificial
  CRISPR gRNA sequence
gattccaaaggtcttgaggg

SEQ ID NO: 72136 - DNA, 20 bp, Artificial
  CRISPR gRNA sequence
caaaggtcttgagggggcca

SEQ ID NO: 72137 - DNA, 20 bp, Artificial
  CRISPR gRNA sequence
gagggggccatcaagtaccc

SEQ ID NO: 72138 - DNA, 20 bp, Artificial
  CRISPR gRNA sequence
agggggccatcaagtacccc

SEQ ID NO: 72139 - DNA, 20 bp, Artificial
  CRISPR gRNA sequence
gggctggttgtcaaagaagg

SEQ ID NO: 72140 - DNA, 20 bp, Artificial
  CRISPR gRNA sequence
gttgtcaaagaaggcaaagt

SEQ ID NO: 72141 - DNA, 20 bp, Artificial
  CRISPR gRNA sequence
tcaaagaaggcaaagtccag

SEQ ID NO: 72142 - DNA, 20 bp, Artificial
  CRISPR gRNA sequence
ggctcctggctcttcaggtg

SEQ ID NO: 72143 - DNA, 20 bp, Artificial
  CRISPR gRNA sequence
ctggctcttcaggtgctggg

SEQ ID NO: 72144 - DNA, 20 bp, Artificial
  CRISPR gRNA sequence
gctcttcaggtgctgggcca

SEQ ID NO: 72145 - DNA, 20 bp, Artificial
  CRISPR gRNA sequence
ttcaggtgctgggccatgtc

SEQ ID NO: 72146 - DNA, 20 bp, Artificial
  CRISPR gRNA sequence
caggtgctgggccatgtcgc

SEQ ID NO: 72147 - DNA, 20 bp, Artificial
  CRISPR gRNA sequence
aggtgctgggccatgtcgca

SEQ ID NO: 72148 - DNA, 20 bp, Artificial
  CRISPR gRNA sequence
ggccatgtcgcagggaatgg

SEQ ID NO: 72149 - DNA, 20 bp, Artificial
  CRISPR gRNA sequence
ttccagaggctgtggggcac

SEQ ID NO: 72150 - DNA, 20 bp, Artificial
  CRISPR gRNA sequence
cagaggctgtggggcacaga

SEQ ID NO: 72151 - DNA, 20 bp, Artificial
  CRISPR gRNA sequence
tggggcacagatataggcac

SEQ ID NO: 72152 - DNA, 20 bp, Artificial
  CRISPR gRNA sequence
attcatcctcccatctttgc

SEQ ID NO: 72153 - DNA, 20 bp, Artificial
  CRISPR gRNA sequence
atcctcccatctttgccatc

SEQ ID NO: 72154 - DNA, 20 bp, Artificial
  CRISPR gRNA sequence
ccatctttgccatctgtcgt

SEQ ID NO: 72155 - DNA, 20 bp, Artificial
  CRISPR gRNA sequence
tgccatctgtcgtatctgca

SEQ ID NO: 72156 - DNA, 20 bp, Artificial
  CRISPR gRNA sequence
gccatctgtcgtatctgcag

SEQ ID NO: 72157 - DNA, 20 bp, Artificial
  CRISPR gRNA sequence
ccatctgtcgtatctgcaga

SEQ ID NO: 72158 - DNA, 20 bp, Artificial
  CRISPR gRNA sequence
tcgtatctgcagattgggag

SEQ ID NO: 72159 - DNA, 20 bp, Artificial
  CRISPR gRNA sequence
cagattgggaggctgaggcc

SEQ ID NO: 72160 - DNA, 20 bp, Artificial
  CRISPR gRNA sequence
ggaggctgaggcccaaaaag

SEQ ID NO: 72161 - DNA, 20 bp, Artificial
  CRISPR gRNA sequence
aggcccaaaaaggtagagct

SEQ ID NO: 72162 - DNA, 20 bp, Artificial
  CRISPR gRNA sequence
tgcctagagttacctggcag

SEQ ID NO: 72163 - DNA, 20 bp, Artificial
  CRISPR gRNA sequence
gagttacctggcagaggcag

SEQ ID NO: 72164 - DNA, 20 bp, Artificial
  CRISPR gRNA sequence
cctggcagaggcaggtgtta

SEQ ID NO: 72165 - DNA, 20 bp, Artificial
  CRISPR gRNA sequence
gcagaggcaggtgttagacc

SEQ ID NO: 72166 - DNA, 20 bp, Artificial
  CRISPR gRNA sequence
gaccagcatagctgacctag

SEQ ID NO: 72167 - DNA, 20 bp, Artificial
  CRISPR gRNA sequence
acctagggagagggtgtacc

SEQ ID NO: 72168 - DNA, 20 bp, Artificial
  CRISPR gRNA sequence
gggagagggtgtaccccaca

SEQ ID NO: 72169 - DNA, 20 bp, Artificial
  CRISPR gRNA sequence
cctcctgagtcctccaactc

SEQ ID NO: 72170 - DNA, 20 bp, Artificial
  CRISPR gRNA sequence
ctgagtcctccaactcaacc

SEQ ID NO: 72171 - DNA, 20 bp, Artificial
  CRISPR gRNA sequence
agtcctccaactcaaccttc

SEQ ID NO: 72172 - DNA, 20 bp, Artificial
  CRISPR gRNA sequence
caactcaaccttcctccctg

SEQ ID NO: 72173 - DNA, 20 bp, Artificial
  CRISPR gRNA sequence
aaccttcctccctgggagat

SEQ ID NO: 72174 - DNA, 20 bp, Artificial
  CRISPR gRNA sequence
cctccctgggagatagtgat

SEQ ID NO: 72175 - DNA, 20 bp, Artificial
  CRISPR gRNA sequence
ctccctgggagatagtgatg

SEQ ID NO: 72176 - DNA, 20 bp, Artificial
  CRISPR gRNA sequence
cctgggagatagtgatgcca

SEQ ID NO: 72177 - DNA, 20 bp, Artificial
  CRISPR gRNA sequence
ggagatagtgatgccagcta

SEQ ID NO: 72178 - DNA, 20 bp, Artificial
  CRISPR gRNA sequence
aggccacactcatatgacac

SEQ ID NO: 72179 - DNA, 20 bp, Artificial
  CRISPR gRNA sequence
atatgacacatttgtgcaaa

SEQ ID NO: 72180 - DNA, 20 bp, Artificial
  CRISPR gRNA sequence
gtgcaaataaggaaaagacc

SEQ ID NO: 72181 - DNA, 20 bp, Artificial
  CRISPR gRNA sequence
tgcaaataaggaaaagaccc

SEQ ID NO: 72182 - DNA, 20 bp, Artificial
  CRISPR gRNA sequence
tttcttcaagatgttttact

SEQ ID NO: 72183 - DNA, 20 bp, Artificial
  CRISPR gRNA sequence
tcttcaagatgttttacttc

SEQ ID NO: 72184 - DNA, 20 bp, Artificial
  CRISPR gRNA sequence
cttcaagatgttttacttcc

SEQ ID NO: 72185 - DNA, 20 bp, Artificial
  CRISPR gRNA sequence
ttcaagatgttttacttcca

SEQ ID NO: 72186 - DNA, 20 bp, Artificial
  CRISPR gRNA sequence
caagatgttttacttccatc

SEQ ID NO: 72187 - DNA, 20 bp, Artificial
  CRISPR gRNA sequence
aagatgttttacttccatct

SEQ ID NO: 72188 - DNA, 20 bp, Artificial
  CRISPR gRNA sequence
tacttccatctgtctgaaat

SEQ ID NO: 72189 - DNA, 20 bp, Artificial
  CRISPR gRNA sequence
acttccatctgtctgaaatt

SEQ ID NO: 72190 - DNA, 20 bp, Artificial
  CRISPR gRNA sequence
cttccatctgtctgaaattg

SEQ ID NO: 72191 - DNA, 20 bp, Artificial
  CRISPR gRNA sequence
ccatctgtctgaaattgtca

SEQ ID NO: 72192 - DNA, 20 bp, Artificial
  CRISPR gRNA sequence
catctgtctgaaattgtcat

SEQ ID NO: 72193 - DNA, 20 bp, Artificial
  CRISPR gRNA sequence
tctgaaattgtcataatata

SEQ ID NO: 72194 - DNA, 20 bp, Artificial
  CRISPR gRNA sequence
aaattgtcataatatatgat

SEQ ID NO: 72195 - DNA, 20 bp, Artificial
  CRISPR gRNA sequence
tcataatatatgattttggt

SEQ ID NO: 72196 - DNA, 20 bp, Artificial
  CRISPR gRNA sequence
tggtagaacaaggtacttta

SEQ ID NO: 72197 - DNA, 20 bp, Artificial
  CRISPR gRNA sequence
ggtagaacaaggtactttac

SEQ ID NO: 72198 - DNA, 20 bp, Artificial
  CRISPR gRNA sequence
gtagaacaaggtactttact

SEQ ID NO: 72199 - DNA, 20 bp, Artificial
  CRISPR gRNA sequence
tactctcatctgctagaaat

SEQ ID NO: 72200 - DNA, 20 bp, Artificial
  CRISPR gRNA sequence
actctcatctgctagaaatc

SEQ ID NO: 72201 - DNA, 20 bp, Artificial
  CRISPR gRNA sequence
ctctcatctgctagaaatct

SEQ ID NO: 72202 - DNA, 20 bp, Artificial
  CRISPR gRNA sequence
tcatctgctagaaatctagc

SEQ ID NO: 72203 - DNA, 20 bp, Artificial
  CRISPR gRNA sequence
atctgctagaaatctagcag

SEQ ID NO: 72204 - DNA, 20 bp, Artificial
  CRISPR gRNA sequence
ctagaaatctagcaggttga

SEQ ID NO: 72205 - DNA, 20 bp, Artificial
  CRISPR gRNA sequence
gaaatctagcaggttgacaa

SEQ ID NO: 72206 - DNA, 20 bp, Artificial
  CRISPR gRNA sequence
gcaggttgacaatgtgaatg

SEQ ID NO: 72207 - DNA, 20 bp, Artificial
  CRISPR gRNA sequence
acaatgtgaatggtgcccct

SEQ ID NO: 72208 - DNA, 20 bp, Artificial
  CRISPR gRNA sequence
aggtttaatgcccttgtgca

SEQ ID NO: 72209 - DNA, 20 bp, Artificial
  CRISPR gRNA sequence
ggtttaatgcccttgtgcag

SEQ ID NO: 72210 - DNA, 20 bp, Artificial
  CRISPR gRNA sequence
aatgcccttgtgcagtgcac

SEQ ID NO: 72211 - DNA, 20 bp, Artificial
  CRISPR gRNA sequence
atgcccttgtgcagtgcaca

SEQ ID NO: 72212 - DNA, 20 bp, Artificial
  CRISPR gRNA sequence
gtgcagtgcacaacctatac

SEQ ID NO: 72213 - DNA, 20 bp, Artificial
  CRISPR gRNA sequence
tgcagtgcacaacctataca

SEQ ID NO: 72214 - DNA, 20 bp, Artificial
  CRISPR gRNA sequence
tacaactgtatgtgatggct

SEQ ID NO: 72215 - DNA, 20 bp, Artificial
  CRISPR gRNA sequence
tatgtgatggctctgattat

SEQ ID NO: 72216 - DNA, 20 bp, Artificial
  CRISPR gRNA sequence
tgattatagctgccatttta

SEQ ID NO: 72217 - DNA, 20 bp, Artificial
  CRISPR gRNA sequence
attatagctgccattttaag

SEQ ID NO: 72218 - DNA, 20 bp, Artificial
  CRISPR gRNA sequence
tagctgccattttaagtgct

SEQ ID NO: 72219 - DNA, 20 bp, Artificial
  CRISPR gRNA sequence
ccattttaagtgcttactat

SEQ ID NO: 72220 - DNA, 20 bp, Artificial
  CRISPR gRNA sequence
taagtgcttactatgtgcca

SEQ ID NO: 72221 - DNA, 20 bp, Artificial
  CRISPR gRNA sequence
aagtgcttactatgtgccag

SEQ ID NO: 72222 - DNA, 20 bp, Artificial
  CRISPR gRNA sequence
agtgcttactatgtgccagg

SEQ ID NO: 72223 - DNA, 20 bp, Artificial
  CRISPR gRNA sequence
actatgtgccaggcattggg

SEQ ID NO: 72224 - DNA, 20 bp, Artificial
  CRISPR gRNA sequence
ctatgtgccaggcattgggt

SEQ ID NO: 72225 - DNA, 20 bp, Artificial
  CRISPR gRNA sequence
tgtgccaggcattgggttca

SEQ ID NO: 72226 - DNA, 20 bp, Artificial
  CRISPR gRNA sequence
ggttcagtgctttatatgct

SEQ ID NO: 72227 - DNA, 20 bp, Artificial
  CRISPR gRNA sequence
agtgctttatatgctcattt

SEQ ID NO: 72228 - DNA, 20 bp, Artificial
  CRISPR gRNA sequence
tatatgctcatttagtcttc

SEQ ID NO: 72229 - DNA, 20 bp, Artificial
  CRISPR gRNA sequence
atatgctcatttagtcttca

SEQ ID NO: 72230 - DNA, 20 bp, Artificial
  CRISPR gRNA sequence
tatgctcatttagtcttcac

SEQ ID NO: 72231 - DNA, 20 bp, Artificial
  CRISPR gRNA sequence
atttagtcttcacaactctc

SEQ ID NO: 72232 - DNA, 20 bp, Artificial
  CRISPR gRNA sequence
agtcttcacaactctctgag

SEQ ID NO: 72233 - DNA, 20 bp, Artificial
  CRISPR gRNA sequence
gtcttcacaactctctgagg

SEQ ID NO: 72234 - DNA, 20 bp, Artificial
  CRISPR gRNA sequence
cacaactctctgaggtagat

SEQ ID NO: 72235 - DNA, 20 bp, Artificial
  CRISPR gRNA sequence
acaactctctgaggtagata

SEQ ID NO: 72236 - DNA, 20 bp, Artificial
  CRISPR gRNA sequence
tctgaggtagatactatcag

SEQ ID NO: 72237 - DNA, 20 bp, Artificial
  CRISPR gRNA sequence
tgaggtagatactatcagta

SEQ ID NO: 72238 - DNA, 20 bp, Artificial
  CRISPR gRNA sequence
aggtagatactatcagtatc

SEQ ID NO: 72239 - DNA, 20 bp, Artificial
  CRISPR gRNA sequence
tcagtatccccatttcacag

SEQ ID NO: 72240 - DNA, 20 bp, Artificial
  CRISPR gRNA sequence
cacagatgagaaaattgggg

SEQ ID NO: 72241 - DNA, 20 bp, Artificial
  CRISPR gRNA sequence
acagatgagaaaattggggt

SEQ ID NO: 72242 - DNA, 20 bp, Artificial
  CRISPR gRNA sequence
gggttcagagaggttgagtt

SEQ ID NO: 72243 - DNA, 20 bp, Artificial
  CRISPR gRNA sequence
agagaggttgagttatggct

SEQ ID NO: 72244 - DNA, 20 bp, Artificial
  CRISPR gRNA sequence
agttatggctacaaagttac

SEQ ID NO: 72245 - DNA, 20 bp, Artificial
  CRISPR gRNA sequence
tggctacaaagttacacagt

SEQ ID NO: 72246 - DNA, 20 bp, Artificial
  CRISPR gRNA sequence
caaagttacacagttggcaa

SEQ ID NO: 72247 - DNA, 20 bp, Artificial
  CRISPR gRNA sequence
cacagttggcaagtggcaga

SEQ ID NO: 72248 - DNA, 20 bp, Artificial
  CRISPR gRNA sequence
gcaagtggcagagctggggt

SEQ ID NO: 72249 - DNA, 20 bp, Artificial
  CRISPR gRNA sequence
gggtttgatccaagtctgct

SEQ ID NO: 72250 - DNA, 20 bp, Artificial
  CRISPR gRNA sequence
gatccaagtctgcttgctgc

SEQ ID NO: 72251 - DNA, 20 bp, Artificial
  CRISPR gRNA sequence
atccaagtctgcttgctgcc

SEQ ID NO: 72252 - DNA, 20 bp, Artificial
  CRISPR gRNA sequence
cttgctgccaaattcttggt

SEQ ID NO: 72253 - DNA, 20 bp, Artificial
  CRISPR gRNA sequence
gctgccaaattcttggtgga

SEQ ID NO: 72254 - DNA, 20 bp, Artificial
  CRISPR gRNA sequence
ctgccaaattcttggtggag

SEQ ID NO: 72255 - DNA, 20 bp, Artificial
  CRISPR gRNA sequence
ccaaattcttggtggagtgg

SEQ ID NO: 72256 - DNA, 20 bp, Artificial
  CRISPR gRNA sequence
ttggtggagtggtccaagtc

SEQ ID NO: 72257 - DNA, 20 bp, Artificial
  CRISPR gRNA sequence
ggtggagtggtccaagtctc

SEQ ID NO: 72258 - DNA, 20 bp, Artificial
  CRISPR gRNA sequence
gtggagtggtccaagtctcc

SEQ ID NO: 72259 - DNA, 20 bp, Artificial
  CRISPR gRNA sequence
ctttgataatccccagccca

SEQ ID NO: 72260 - DNA, 20 bp, Artificial
  CRISPR gRNA sequence
tgataatccccagcccaggc

SEQ ID NO: 72261 - DNA, 20 bp, Artificial
  CRISPR gRNA sequence
gataatccccagcccaggcc

SEQ ID NO: 72262 - DNA, 20 bp, Artificial
  CRISPR gRNA sequence
ataatccccagcccaggccc

SEQ ID NO: 72263 - DNA, 20 bp, Artificial
  CRISPR gRNA sequence
ccgcctcctccagggagtcc

SEQ ID NO: 72264 - DNA, 20 bp, Artificial
  CRISPR gRNA sequence
ctccagggagtcccattaga

SEQ ID NO: 72265 - DNA, 20 bp, Artificial
  CRISPR gRNA sequence
cagggagtcccattagatct

SEQ ID NO: 72266 - DNA, 20 bp, Artificial
  CRISPR gRNA sequence
gatctgggggttggtgtagc

SEQ ID NO: 72267 - DNA, 20 bp, Artificial
  CRISPR gRNA sequence
ggggttggtgtagcctccca

SEQ ID NO: 72268 - DNA, 20 bp, Artificial
  CRISPR gRNA sequence
gtgtagcctcccacccacca

SEQ ID NO: 72269 - DNA, 20 bp, Artificial
  CRISPR gRNA sequence
ccacccaccatccctgcccc

SEQ ID NO: 72270 - DNA, 20 bp, Artificial
  CRISPR gRNA sequence
cccctgcaggcctctgttac

SEQ ID NO: 72271 - DNA, 20 bp, Artificial
  CRISPR gRNA sequence
caggcctctgttaccggatg

SEQ ID NO: 72272 - DNA, 20 bp, Artificial
  CRISPR gRNA sequence
tgttaccggatgacttggat

SEQ ID NO: 72273 - DNA, 20 bp, Artificial
  CRISPR gRNA sequence
ttaccggatgacttggatgc

SEQ ID NO: 72274 - DNA, 20 bp, Artificial
  CRISPR gRNA sequence
ccggatgacttggatgctag

SEQ ID NO: 72275 - DNA, 20 bp, Artificial
  CRISPR gRNA sequence
ggatgctagacccctgggcc

SEQ ID NO: 72276 - DNA, 20 bp, Artificial
  CRISPR gRNA sequence
gatgctagacccctgggcca

SEQ ID NO: 72277 - DNA, 20 bp, Artificial
  CRISPR gRNA sequence
gacccctgggccagtccttc

SEQ ID NO: 72278 - DNA, 20 bp, Artificial
  CRISPR gRNA sequence
ggccagtccttcagccagga

SEQ ID NO: 72279 - DNA, 20 bp, Artificial
  CRISPR gRNA sequence
cagccaggagccaggccccc

SEQ ID NO: 72280 - DNA, 20 bp, Artificial
  CRISPR gRNA sequence
agccaggagccaggccccca

SEQ ID NO: 72281 - DNA, 20 bp, Artificial
  CRISPR gRNA sequence
tgatctgattcttctccagg

SEQ ID NO: 72282 - DNA, 20 bp, Artificial
  CRISPR gRNA sequence
attcttctccaggcttctca

SEQ ID NO: 72283 - DNA, 20 bp, Artificial
  CRISPR gRNA sequence
ttctccaggcttctcagtgg

SEQ ID NO: 72284 - DNA, 20 bp, Artificial
  CRISPR gRNA sequence
ctccaggcttctcagtggac

SEQ ID NO: 72285 - DNA, 20 bp, Artificial
  CRISPR gRNA sequence
tccaggcttctcagtggaca

SEQ ID NO: 72286 - DNA, 20 bp, Artificial
  CRISPR gRNA sequence
caggcttctcagtggacagt

SEQ ID NO: 72287 - DNA, 20 bp, Artificial
  CRISPR gRNA sequence
ctcagtggacagtgagggga

SEQ ID NO: 72288 - DNA, 20 bp, Artificial
  CRISPR gRNA sequence
tcagtggacagtgaggggag

SEQ ID NO: 72289 - DNA, 20 bp, Artificial
  CRISPR gRNA sequence
agtggacagtgaggggaggg

SEQ ID NO: 72290 - DNA, 20 bp, Artificial
  CRISPR gRNA sequence
cctaggtcccttcctcaggc

SEQ ID NO: 72291 - DNA, 20 bp, Artificial
  CRISPR gRNA sequence
ctaggtcccttcctcaggcc

SEQ ID NO: 72292 - DNA, 20 bp, Artificial
  CRISPR gRNA sequence
ggtcccttcctcaggccaag

SEQ ID NO: 72293 - DNA, 20 bp, Artificial
  CRISPR gRNA sequence
cctcaggccaaggtcagggg

SEQ ID NO: 72294 - DNA, 20 bp, Artificial
  CRISPR gRNA sequence
ctcaggccaaggtcagggga

SEQ ID NO: 72295 - DNA, 20 bp, Artificial
  CRISPR gRNA sequence
aggccaaggtcaggggacac

SEQ ID NO: 72296 - DNA, 20 bp, Artificial
  CRISPR gRNA sequence
ccacactaccttctcaggga

SEQ ID NO: 72297 - DNA, 20 bp, Artificial
  CRISPR gRNA sequence
ccttctcagggaacccaaaa

SEQ ID NO: 72298 - DNA, 20 bp, Artificial
  CRISPR gRNA sequence
ctcagggaacccaaaagaca

SEQ ID NO: 72299 - DNA, 20 bp, Artificial
  CRISPR gRNA sequence
tcagggaacccaaaagacaa

SEQ ID NO: 72300 - DNA, 20 bp, Artificial
  CRISPR gRNA sequence
agggaacccaaaagacaaca

SEQ ID NO: 72301 - DNA, 20 bp, Artificial
  CRISPR gRNA sequence
gtggcaggtgcagcaggaag

SEQ ID NO: 72302 - DNA, 20 bp, Artificial
  CRISPR gRNA sequence
aaggctagaacccaggggga

SEQ ID NO: 72303 - DNA, 20 bp, Artificial
  CRISPR gRNA sequence
gaacccagggggaactaagc

SEQ ID NO: 72304 - DNA, 20 bp, Artificial
  CRISPR gRNA sequence
agcctggcaggggcttggaa

SEQ ID NO: 72305 - DNA, 20 bp, Artificial
  CRISPR gRNA sequence
gcaggggcttggaacaggcc

SEQ ID NO: 72306 - DNA, 20 bp, Artificial
  CRISPR gRNA sequence
ggaacaggccagagtgtgca

SEQ ID NO: 72307 - DNA, 20 bp, Artificial
  CRISPR gRNA sequence
gaacaggccagagtgtgcaa

SEQ ID NO: 72308 - DNA, 20 bp, Artificial
  CRISPR gRNA sequence
aaggaagggctttctgggag

SEQ ID NO: 72309 - DNA, 20 bp, Artificial
  CRISPR gRNA sequence
tctgggaggcaggggactga

SEQ ID NO: 72310 - DNA, 20 bp, Artificial
  CRISPR gRNA sequence
ctgggaggcaggggactgac

SEQ ID NO: 72311 - DNA, 20 bp, Artificial
  CRISPR gRNA sequence
tgggaggcaggggactgacc

SEQ ID NO: 72312 - DNA, 20 bp, Artificial
  CRISPR gRNA sequence
ggaggcaggggactgaccca

SEQ ID NO: 72313 - DNA, 20 bp, Artificial
  CRISPR gRNA sequence
acccagtggcctcttggtgt

SEQ ID NO: 72314 - DNA, 20 bp, Artificial
  CRISPR gRNA sequence
ttggtgttcccgggatgtag

SEQ ID NO: 72315 - DNA, 20 bp, Artificial
  CRISPR gRNA sequence
ggtgttcccgggatgtaggt

SEQ ID NO: 72316 - DNA, 20 bp, Artificial
  CRISPR gRNA sequence
gtgttcccgggatgtaggtc

SEQ ID NO: 72317 - DNA, 20 bp, Artificial
  CRISPR gRNA sequence
ccgggatgtaggtccccctt

SEQ ID NO: 72318 - DNA, 20 bp, Artificial
  CRISPR gRNA sequence
tagcccgtcccattcctccc

SEQ ID NO: 72319 - DNA, 20 bp, Artificial
  CRISPR gRNA sequence
agcccgtcccattcctcccc

SEQ ID NO: 72320 - DNA, 20 bp, Artificial
  CRISPR gRNA sequence
gcccgtcccattcctccccc

SEQ ID NO: 72321 - DNA, 20 bp, Artificial
  CRISPR gRNA sequence
ctcccccggcccctcatact

SEQ ID NO: 72322 - DNA, 20 bp, Artificial
  CRISPR gRNA sequence
ccccggcccctcatactcca

SEQ ID NO: 72323 - DNA, 20 bp, Artificial
  CRISPR gRNA sequence
atactccactctcttcagcc

SEQ ID NO: 72324 - DNA, 20 bp, Artificial
  CRISPR gRNA sequence
cactctcttcagccggccca

SEQ ID NO: 72325 - DNA, 20 bp, Artificial
  CRISPR gRNA sequence
tcttcagccggcccatctgc

SEQ ID NO: 72326 - DNA, 20 bp, Artificial
  CRISPR gRNA sequence
ttcagccggcccatctgcgg

SEQ ID NO: 72327 - DNA, 20 bp, Artificial
  CRISPR gRNA sequence
cagccggcccatctgcggca

SEQ ID NO: 72328 - DNA, 20 bp, Artificial
  CRISPR gRNA sequence
agccggcccatctgcggcag

SEQ ID NO: 72329 - DNA, 20 bp, Artificial
  CRISPR gRNA sequence
cggcagcacctgggccagct

SEQ ID NO: 72330 - DNA, 20 bp, Artificial
  CRISPR gRNA sequence
ggccagctcggcagctgcct

SEQ ID NO: 72331 - DNA, 20 bp, Artificial
  CRISPR gRNA sequence
ggcagctgcctcatccccga

SEQ ID NO: 72332 - DNA, 20 bp, Artificial
  CRISPR gRNA sequence
cctcatccccgaggagattc

SEQ ID NO: 72333 - DNA, 20 bp, Artificial
  CRISPR gRNA sequence
atccccgaggagattccagg

SEQ ID NO: 72334 - DNA, 20 bp, Artificial
  CRISPR gRNA sequence
caggacagcctgcagggtag

SEQ ID NO: 72335 - DNA, 20 bp, Artificial
  CRISPR gRNA sequence
cagggtaggggtcccaaagt

SEQ ID NO: 72336 - DNA, 20 bp, Artificial
  CRISPR gRNA sequence
tcaagagaggccacctgata

SEQ ID NO: 72337 - DNA, 20 bp, Artificial
  CRISPR gRNA sequence
caagagaggccacctgatag

SEQ ID NO: 72338 - DNA, 20 bp, Artificial
  CRISPR gRNA sequence
aagagaggccacctgatagg

SEQ ID NO: 72339 - DNA, 20 bp, Artificial
  CRISPR gRNA sequence
atagggtgcttgtgtgtcct

SEQ ID NO: 72340 - DNA, 20 bp, Artificial
  CRISPR gRNA sequence
gtgtgtcctcccctgaagac

SEQ ID NO: 72341 - DNA, 20 bp, Artificial
  CRISPR gRNA sequence
tgtgtcctcccctgaagacg

SEQ ID NO: 72342 - DNA, 20 bp, Artificial
  CRISPR gRNA sequence
ccctgaagacgtcagggtgc

SEQ ID NO: 72343 - DNA, 20 bp, Artificial
  CRISPR gRNA sequence
aagacgtcagggtgcaggtt

SEQ ID NO: 72344 - DNA, 20 bp, Artificial
  CRISPR gRNA sequence
ccttcctccctgctcccctc

SEQ ID NO: 72345 - DNA, 20 bp, Artificial
  CRISPR gRNA sequence
cctccctgctcccctccccg

SEQ ID NO: 72346 - DNA, 20 bp, Artificial
  CRISPR gRNA sequence
ctccctgctcccctccccgt

SEQ ID NO: 72347 - DNA, 20 bp, Artificial
  CRISPR gRNA sequence
cctgctcccctccccgtcaa

SEQ ID NO: 72348 - DNA, 20 bp, Artificial
  CRISPR gRNA sequence
ctcccctccccgtcaagttt

SEQ ID NO: 72349 - DNA, 20 bp, Artificial
  CRISPR gRNA sequence
ccctccccgtcaagtttgaa

SEQ ID NO: 72350 - DNA, 20 bp, Artificial
  CRISPR gRNA sequence
cccgtcaagtttgaatcatg

SEQ ID NO: 72351 - DNA, 20 bp, Artificial
  CRISPR gRNA sequence
gaatcatgacgttgttcaca

SEQ ID NO: 72352 - DNA, 20 bp, Artificial
  CRISPR gRNA sequence
aatcatgacgttgttcacaa

SEQ ID NO: 72353 - DNA, 20 bp, Artificial
  CRISPR gRNA sequence
ttcacaagatgttgccattt

SEQ ID NO: 72354 - DNA, 20 bp, Artificial
  CRISPR gRNA sequence
acaagatgttgccatttttg

SEQ ID NO: 72355 - DNA, 20 bp, Artificial
  CRISPR gRNA sequence
ccatttttgccacatacatg

SEQ ID NO: 72356 - DNA, 20 bp, Artificial
  CRISPR gRNA sequence
ttgccacatacatgtacctc

SEQ ID NO: 72357 - DNA, 20 bp, Artificial
  CRISPR gRNA sequence
tgccacatacatgtacctcc

SEQ ID NO: 72358 - DNA, 20 bp, Artificial
  CRISPR gRNA sequence
gccacatacatgtacctcct

SEQ ID NO: 72359 - DNA, 20 bp, Artificial
  CRISPR gRNA sequence
ccacatacatgtacctcctg

SEQ ID NO: 72360 - DNA, 20 bp, Artificial
  CRISPR gRNA sequence
ctgtatttaagatgcatcat

SEQ ID NO: 72361 - DNA, 20 bp, Artificial
  CRISPR gRNA sequence
tatttaagatgcatcatatt

SEQ ID NO: 72362 - DNA, 20 bp, Artificial
  CRISPR gRNA sequence
aagatgcatcatatttttct

SEQ ID NO: 72363 - DNA, 20 bp, Artificial
  CRISPR gRNA sequence
agatgcatcatatttttctt

SEQ ID NO: 72364 - DNA, 20 bp, Artificial
  CRISPR gRNA sequence
ttctttaaattggccccctc

SEQ ID NO: 72365 - DNA, 20 bp, Artificial
  CRISPR gRNA sequence
tctttaaattggccccctct

SEQ ID NO: 72366 - DNA, 20 bp, Artificial
  CRISPR gRNA sequence
ctttaaattggccccctctt

SEQ ID NO: 72367 - DNA, 20 bp, Artificial
  CRISPR gRNA sequence
tttaaattggccccctcttt

SEQ ID NO: 72368 - DNA, 20 bp, Artificial
  CRISPR gRNA sequence
taaattggccccctcttttt

SEQ ID NO: 72369 - DNA, 20 bp, Artificial
  CRISPR gRNA sequence
aaattggccccctctttttt

SEQ ID NO: 72370 - DNA, 20 bp, Artificial
  CRISPR gRNA sequence
aattggccccctcttttttc

SEQ ID NO: 72371 - DNA, 20 bp, Artificial
  CRISPR gRNA sequence
gccccctcttttttcttact

SEQ ID NO: 72372 - DNA, 20 bp, Artificial
  CRISPR gRNA sequence
ttttttcttactttaaaaaa

SEQ ID NO: 72373 - DNA, 20 bp, Artificial
  CRISPR gRNA sequence
ttttcttactttaaaaaatt

SEQ ID NO: 72374 - DNA, 20 bp, Artificial
  CRISPR gRNA sequence
tttcttactttaaaaaatta

SEQ ID NO: 72375 - DNA, 20 bp, Artificial
  CRISPR gRNA sequence
ttcttactttaaaaaattaa

SEQ ID NO: 72376 - DNA, 20 bp, Artificial
  CRISPR gRNA sequence
tcttactttaaaaaattaat

SEQ ID NO: 72377 - DNA, 20 bp, Artificial
  CRISPR gRNA sequence
cttactttaaaaaattaatc

SEQ ID NO: 72378 - DNA, 20 bp, Artificial
  CRISPR gRNA sequence
ttactttaaaaaattaatct

SEQ ID NO: 72379 - DNA, 20 bp, Artificial
  CRISPR gRNA sequence
actttaaaaaattaatcttg

SEQ ID NO: 72380 - DNA, 20 bp, Artificial
  CRISPR gRNA sequence
ctttaaaaaattaatcttgg

SEQ ID NO: 72381 - DNA, 20 bp, Artificial
  CRISPR gRNA sequence
taaaaaattaatcttggctg

SEQ ID NO: 72382 - DNA, 20 bp, Artificial
  CRISPR gRNA sequence
aaaaaattaatcttggctgg

SEQ ID NO: 72383 - DNA, 20 bp, Artificial
  CRISPR gRNA sequence
aaaaattaatcttggctggg

SEQ ID NO: 72384 - DNA, 20 bp, Artificial
  CRISPR gRNA sequence
atcttggctgggcgtggttg

SEQ ID NO: 72385 - DNA, 20 bp, Artificial
  CRISPR gRNA sequence
ggctgggcgtggttgctcac

SEQ ID NO: 72386 - DNA, 20 bp, Artificial
  CRISPR gRNA sequence
gctgggcgtggttgctcacg

SEQ ID NO: 72387 - DNA, 20 bp, Artificial
  CRISPR gRNA sequence
ggcgtggttgctcacgcctg

SEQ ID NO: 72388 - DNA, 20 bp, Artificial
  CRISPR gRNA sequence
ctcacgcctgtaatcccagc

SEQ ID NO: 72389 - DNA, 20 bp, Artificial
  CRISPR gRNA sequence
acgcctgtaatcccagcact

SEQ ID NO: 72390 - DNA, 20 bp, Artificial
  CRISPR gRNA sequence
taatcccagcactttgggag

SEQ ID NO: 72391 - DNA, 20 bp, Artificial
  CRISPR gRNA sequence
tgggaggccaaggtcaggtg

SEQ ID NO: 72392 - DNA, 20 bp, Artificial
  CRISPR gRNA sequence
gggaggccaaggtcaggtgt

SEQ ID NO: 72393 - DNA, 20 bp, Artificial
  CRISPR gRNA sequence
ggaggccaaggtcaggtgtt

SEQ ID NO: 72394 - DNA, 20 bp, Artificial
  CRISPR gRNA sequence
gagacgagcctaaccaacat

SEQ ID NO: 72395 - DNA, 20 bp, Artificial
  CRISPR gRNA sequence
agacgagcctaaccaacatg

SEQ ID NO: 72396 - DNA, 20 bp, Artificial
  CRISPR gRNA sequence
accaacatggtgaaatcctg

SEQ ID NO: 72397 - DNA, 20 bp, Artificial
  CRISPR gRNA sequence
tctctactaaaaatacaaaa

SEQ ID NO: 72398 - DNA, 20 bp, Artificial
  CRISPR gRNA sequence
tactaaaaatacaaaaatta

SEQ ID NO: 72399 - DNA, 20 bp, Artificial
  CRISPR gRNA sequence
ctaaaaatacaaaaattagc

SEQ ID NO: 72400 - DNA, 20 bp, Artificial
  CRISPR gRNA sequence
aaaatacaaaaattagctgg

SEQ ID NO: 72401 - DNA, 20 bp, Artificial
  CRISPR gRNA sequence
gctgggtgtggtggtgggca

SEQ ID NO: 72402 - DNA, 20 bp, Artificial
  CRISPR gRNA sequence
ggtgtggtggtgggcacttg

SEQ ID NO: 72403 - DNA, 20 bp, Artificial
  CRISPR gRNA sequence
gtaatcccagctactcagga

SEQ ID NO: 72404 - DNA, 20 bp, Artificial
  CRISPR gRNA sequence
taatcccagctactcaggag

SEQ ID NO: 72405 - DNA, 20 bp, Artificial
  CRISPR gRNA sequence
ctcaggaggctgaggcagga

SEQ ID NO: 72406 - DNA, 20 bp, Artificial
  CRISPR gRNA sequence
aggaggctgaggcaggagaa

SEQ ID NO: 72407 - DNA, 20 bp, Artificial
  CRISPR gRNA sequence
aggcaggagaatctcttgaa

SEQ ID NO: 72408 - DNA, 20 bp, Artificial
  CRISPR gRNA sequence
ttgaacccggcaggtggagg

SEQ ID NO: 72409 - DNA, 20 bp, Artificial
  CRISPR gRNA sequence
gaacccggcaggtggaggtt

SEQ ID NO: 72410 - DNA, 20 bp, Artificial
  CRISPR gRNA sequence
aacccggcaggtggaggttg

SEQ ID NO: 72411 - DNA, 20 bp, Artificial
  CRISPR gRNA sequence
cagtgagccgagattgcacc

SEQ ID NO: 72412 - DNA, 20 bp, Artificial
  CRISPR gRNA sequence
caccactgcactccagcctg

SEQ ID NO: 72413 - DNA, 20 bp, Artificial
  CRISPR gRNA sequence
cactccagcctgggtaacag

SEQ ID NO: 72414 - DNA, 20 bp, Artificial
  CRISPR gRNA sequence
cagcctgggtaacagaggga

SEQ ID NO: 72415 - DNA, 20 bp, Artificial
  CRISPR gRNA sequence
ggtaacagagggagactcca

SEQ ID NO: 72416 - DNA, 20 bp, Artificial
  CRISPR gRNA sequence
catctcaaaaaaaaaaaaaa

SEQ ID NO: 72417 - DNA, 20 bp, Artificial
  CRISPR gRNA sequence
aaaaaaaaaaaaaaaaaaaa

SEQ ID NO: 72418 - DNA, 20 bp, Artificial
  CRISPR gRNA sequence
gaaaggaaacttttattgct

SEQ ID NO: 72419 - DNA, 20 bp, Artificial
  CRISPR gRNA sequence
aaaggaaacttttattgcta

SEQ ID NO: 72420 - DNA, 20 bp, Artificial
  CRISPR gRNA sequence
ttattgctactatcaatgga

SEQ ID NO: 72421 - DNA, 20 bp, Artificial
  CRISPR gRNA sequence
tattgctactatcaatggaa

SEQ ID NO: 72422 - DNA, 20 bp, Artificial
  CRISPR gRNA sequence
attgctactatcaatggaaa

SEQ ID NO: 72423 - DNA, 20 bp, Artificial
  CRISPR gRNA sequence
ttgctactatcaatggaaaa

SEQ ID NO: 72424 - DNA, 20 bp, Artificial
  CRISPR gRNA sequence
ctactatcaatggaaaactt

SEQ ID NO: 72425 - DNA, 20 bp, Artificial
  CRISPR gRNA sequence
ctatcaatggaaaacttgtg

SEQ ID NO: 72426 - DNA, 20 bp, Artificial
  CRISPR gRNA sequence
tcaatggaaaacttgtgtta

SEQ ID NO: 72427 - DNA, 20 bp, Artificial
  CRISPR gRNA sequence
gtgttacagactccatatag

SEQ ID NO: 72428 - DNA, 20 bp, Artificial
  CRISPR gRNA sequence
tgttacagactccatataga

SEQ ID NO: 72429 - DNA, 20 bp, Artificial
  CRISPR gRNA sequence
cagactccatatagaaggta

SEQ ID NO: 72430 - DNA, 20 bp, Artificial
  CRISPR gRNA sequence
catatagaaggtagttacaa

SEQ ID NO: 72431 - DNA, 20 bp, Artificial
  CRISPR gRNA sequence
caaaaataaatatagtacaa

SEQ ID NO: 72432 - DNA, 20 bp, Artificial
  CRISPR gRNA sequence
acttctagttggaacatatg

SEQ ID NO: 72433 - DNA, 20 bp, Artificial
  CRISPR gRNA sequence
ctagttggaacatatgccct

SEQ ID NO: 72434 - DNA, 20 bp, Artificial
  CRISPR gRNA sequence
tagttggaacatatgccctt

SEQ ID NO: 72435 - DNA, 20 bp, Artificial
  CRISPR gRNA sequence
gttggaacatatgcccttcc

SEQ ID NO: 72436 - DNA, 20 bp, Artificial
  CRISPR gRNA sequence
gaacatatgcccttcctaag

SEQ ID NO: 72437 - DNA, 20 bp, Artificial
  CRISPR gRNA sequence
cctaagatgttgggttttta

SEQ ID NO: 72438 - DNA, 20 bp, Artificial
  CRISPR gRNA sequence
ctaagatgttgggtttttaa

SEQ ID NO: 72439 - DNA, 20 bp, Artificial
  CRISPR gRNA sequence
agatgttgggtttttaaccc

SEQ ID NO: 72440 - DNA, 20 bp, Artificial
  CRISPR gRNA sequence
ggtttttaacccttttggtt

SEQ ID NO: 72441 - DNA, 20 bp, Artificial
  CRISPR gRNA sequence
ttaacccttttggttaaaaa

SEQ ID NO: 72442 - DNA, 20 bp, Artificial
  CRISPR gRNA sequence
taacccttttggttaaaaag

SEQ ID NO: 72443 - DNA, 20 bp, Artificial
  CRISPR gRNA sequence
aacccttttggttaaaaagg

SEQ ID NO: 72444 - DNA, 20 bp, Artificial
  CRISPR gRNA sequence
acccttttggttaaaaaggg

SEQ ID NO: 72445 - DNA, 20 bp, Artificial
  CRISPR gRNA sequence
ttggttaaaaagggagaatc

SEQ ID NO: 72446 - DNA, 20 bp, Artificial
  CRISPR gRNA sequence
tggttaaaaagggagaatcc

SEQ ID NO: 72447 - DNA, 20 bp, Artificial
  CRISPR gRNA sequence
ggttaaaaagggagaatcca

SEQ ID NO: 72448 - DNA, 20 bp, Artificial
  CRISPR gRNA sequence
gttaaaaagggagaatccag

SEQ ID NO: 72449 - DNA, 20 bp, Artificial
  CRISPR gRNA sequence
aaaagggagaatccagtgtt

SEQ ID NO: 72450 - DNA, 20 bp, Artificial
  CRISPR gRNA sequence
ggtgttaaagatgaattacc

SEQ ID NO: 72451 - DNA, 20 bp, Artificial
  CRISPR gRNA sequence
aagatgaattaccactgatc

SEQ ID NO: 72452 - DNA, 20 bp, Artificial
  CRISPR gRNA sequence
ccactgatctgagactttcg

SEQ ID NO: 72453 - DNA, 20 bp, Artificial
  CRISPR gRNA sequence
atctgagactttcgctttgg

SEQ ID NO: 72454 - DNA, 20 bp, Artificial
  CRISPR gRNA sequence
agactttcgctttggtgtaa

SEQ ID NO: 72455 - DNA, 20 bp, Artificial
  CRISPR gRNA sequence
tcgctttggtgtaatgagaa

SEQ ID NO: 72456 - DNA, 20 bp, Artificial
  CRISPR gRNA sequence
cgctttggtgtaatgagaag

SEQ ID NO: 72457 - DNA, 20 bp, Artificial
  CRISPR gRNA sequence
gctttggtgtaatgagaagg

SEQ ID NO: 72458 - DNA, 20 bp, Artificial
  CRISPR gRNA sequence
tggtgtaatgagaagggtta

SEQ ID NO: 72459 - DNA, 20 bp, Artificial
  CRISPR gRNA sequence
ggtgtaatgagaagggttaa

SEQ ID NO: 72460 - DNA, 20 bp, Artificial
  CRISPR gRNA sequence
gtgtaatgagaagggttaag

SEQ ID NO: 72461 - DNA, 20 bp, Artificial
  CRISPR gRNA sequence
agacctttaggatgcaaact

SEQ ID NO: 72462 - DNA, 20 bp, Artificial
  CRISPR gRNA sequence
taggatgcaaactaaaatct

SEQ ID NO: 72463 - DNA, 20 bp, Artificial
  CRISPR gRNA sequence
aggatgcaaactaaaatctt

SEQ ID NO: 72464 - DNA, 20 bp, Artificial
  CRISPR gRNA sequence
ggatgcaaactaaaatcttc

SEQ ID NO: 72465 - DNA, 20 bp, Artificial
  CRISPR gRNA sequence
aaatcttctcgtaatcactt

SEQ ID NO: 72466 - DNA, 20 bp, Artificial
  CRISPR gRNA sequence
ctcgtaatcacttgtgtcct

SEQ ID NO: 72467 - DNA, 20 bp, Artificial
  CRISPR gRNA sequence
tcgtaatcacttgtgtcctg

SEQ ID NO: 72468 - DNA, 20 bp, Artificial
  CRISPR gRNA sequence
gtaatcacttgtgtcctgtt

SEQ ID NO: 72469 - DNA, 20 bp, Artificial
  CRISPR gRNA sequence
gtgtcctgttctttaggaaa

SEQ ID NO: 72470 - DNA, 20 bp, Artificial
  CRISPR gRNA sequence
tgtcctgttctttaggaaac

SEQ ID NO: 72471 - DNA, 20 bp, Artificial
  CRISPR gRNA sequence
ttctttaggaaacagctttg

SEQ ID NO: 72472 - DNA, 20 bp, Artificial
  CRISPR gRNA sequence
tttaggaaacagctttgtcc

SEQ ID NO: 72473 - DNA, 20 bp, Artificial
  CRISPR gRNA sequence
taggaaacagctttgtcctc

SEQ ID NO: 72474 - DNA, 20 bp, Artificial
  CRISPR gRNA sequence
aggaaacagctttgtcctcc

SEQ ID NO: 72475 - DNA, 20 bp, Artificial
  CRISPR gRNA sequence
ggaaacagctttgtcctcca

SEQ ID NO: 72476 - DNA, 20 bp, Artificial
  CRISPR gRNA sequence
tgtcctccataccatggtta

SEQ ID NO: 72477 - DNA, 20 bp, Artificial
  CRISPR gRNA sequence
gtcctccataccatggttag

SEQ ID NO: 72478 - DNA, 20 bp, Artificial
  CRISPR gRNA sequence
tcctccataccatggttagg

SEQ ID NO: 72479 - DNA, 20 bp, Artificial
  CRISPR gRNA sequence
cataccatggttagggtccc

SEQ ID NO: 72480 - DNA, 20 bp, Artificial
  CRISPR gRNA sequence
gggtcccaggctagtcctag

SEQ ID NO: 72481 - DNA, 20 bp, Artificial
  CRISPR gRNA sequence
gtcctagaattctagtttac

SEQ ID NO: 72482 - DNA, 20 bp, Artificial
  CRISPR gRNA sequence
gaattctagtttactcatga

SEQ ID NO: 72483 - DNA, 20 bp, Artificial
  CRISPR gRNA sequence
tagtttactcatgaggcagc

SEQ ID NO: 72484 - DNA, 20 bp, Artificial
  CRISPR gRNA sequence
gtttactcatgaggcagcac

SEQ ID NO: 72485 - DNA, 20 bp, Artificial
  CRISPR gRNA sequence
actcatgaggcagcactgca

SEQ ID NO: 72486 - DNA, 20 bp, Artificial
  CRISPR gRNA sequence
ctcatgaggcagcactgcaa

SEQ ID NO: 72487 - DNA, 20 bp, Artificial
  CRISPR gRNA sequence
atgaggcagcactgcaaagc

SEQ ID NO: 72488 - DNA, 20 bp, Artificial
  CRISPR gRNA sequence
caaagccccaaggtctgggg

SEQ ID NO: 72489 - DNA, 20 bp, Artificial
  CRISPR gRNA sequence
ggggattctgattgctaaga

SEQ ID NO: 72490 - DNA, 20 bp, Artificial
  CRISPR gRNA sequence
tgattgctaagagacagcca

SEQ ID NO: 72491 - DNA, 20 bp, Artificial
  CRISPR gRNA sequence
attgctaagagacagccaag

SEQ ID NO: 72492 - DNA, 20 bp, Artificial
  CRISPR gRNA sequence
ctaagagacagccaagcacg

SEQ ID NO: 72493 - DNA, 20 bp, Artificial
  CRISPR gRNA sequence
agagacagccaagcacggcc

SEQ ID NO: 72494 - DNA, 20 bp, Artificial
  CRISPR gRNA sequence
ggggtggctttctcctggct

SEQ ID NO: 72495 - DNA, 20 bp, Artificial
  CRISPR gRNA sequence
tctcctggctttagccactg

SEQ ID NO: 72496 - DNA, 20 bp, Artificial
  CRISPR gRNA sequence
ctcctggctttagccactgt

SEQ ID NO: 72497 - DNA, 20 bp, Artificial
  CRISPR gRNA sequence
tcctggctttagccactgtt

SEQ ID NO: 72498 - DNA, 20 bp, Artificial
  CRISPR gRNA sequence
ctggctttagccactgtttc

SEQ ID NO: 72499 - DNA, 20 bp, Artificial
  CRISPR gRNA sequence
gctttagccactgtttctac

SEQ ID NO: 72500 - DNA, 20 bp, Artificial
  CRISPR gRNA sequence
tagccactgtttctaccaac

SEQ ID NO: 72501 - DNA, 20 bp, Artificial
  CRISPR gRNA sequence
agccactgtttctaccaact

SEQ ID NO: 72502 - DNA, 20 bp, Artificial
  CRISPR gRNA sequence
gccactgtttctaccaactg

SEQ ID NO: 72503 - DNA, 20 bp, Artificial
  CRISPR gRNA sequence
tttctaccaactgtggttca

SEQ ID NO: 72504 - DNA, 20 bp, Artificial
  CRISPR gRNA sequence
ctaccaactgtggttcataa

SEQ ID NO: 72505 - DNA, 20 bp, Artificial
  CRISPR gRNA sequence
taccaactgtggttcataaa

SEQ ID NO: 72506 - DNA, 20 bp, Artificial
  CRISPR gRNA sequence
ccaactgtggttcataaatg

SEQ ID NO: 72507 - DNA, 20 bp, Artificial
  CRISPR gRNA sequence
tggttcataaatggaggttt

SEQ ID NO: 72508 - DNA, 20 bp, Artificial
  CRISPR gRNA sequence
ataaatggaggtttcatcaa

SEQ ID NO: 72509 - DNA, 20 bp, Artificial
  CRISPR gRNA sequence
catcaagcaggcaaggtggt

SEQ ID NO: 72510 - DNA, 20 bp, Artificial
  CRISPR gRNA sequence
atcaagcaggcaaggtggtc

SEQ ID NO: 72511 - DNA, 20 bp, Artificial
  CRISPR gRNA sequence
tccagttgcctcccaaaagg

SEQ ID NO: 72512 - DNA, 20 bp, Artificial
  CRISPR gRNA sequence
cctcccaaaaggaaggttgg

SEQ ID NO: 72513 - DNA, 20 bp, Artificial
  CRISPR gRNA sequence
ccaaaaggaaggttggacca

SEQ ID NO: 72514 - DNA, 20 bp, Artificial
  CRISPR gRNA sequence
gaccaaaaacctttaaagac

SEQ ID NO: 72515 - DNA, 20 bp, Artificial
  CRISPR gRNA sequence
taaagaccatctggtccacc

SEQ ID NO: 72516 - DNA, 20 bp, Artificial
  CRISPR gRNA sequence
aaagaccatctggtccacct

SEQ ID NO: 72517 - DNA, 20 bp, Artificial
  CRISPR gRNA sequence
aagaccatctggtccacctc

SEQ ID NO: 72518 - DNA, 20 bp, Artificial
  CRISPR gRNA sequence
gtccacctcccctcccacca

SEQ ID NO: 72519 - DNA, 20 bp, Artificial
  CRISPR gRNA sequence
ccctcccaccaatctacaaa

SEQ ID NO: 72520 - DNA, 20 bp, Artificial
  CRISPR gRNA sequence
ccaccaatctacaaatgggg

SEQ ID NO: 72521 - DNA, 20 bp, Artificial
  CRISPR gRNA sequence
caaatggggaaaaaggcaga

SEQ ID NO: 72522 - DNA, 20 bp, Artificial
  CRISPR gRNA sequence
ttttacccaacattacctgc

SEQ ID NO: 72523 - DNA, 20 bp, Artificial
  CRISPR gRNA sequence
tacccaacattacctgcagc

SEQ ID NO: 72524 - DNA, 20 bp, Artificial
  CRISPR gRNA sequence
acccaacattacctgcagct

SEQ ID NO: 72525 - DNA, 20 bp, Artificial
  CRISPR gRNA sequence
cccaacattacctgcagctc

SEQ ID NO: 72526 - DNA, 20 bp, Artificial
  CRISPR gRNA sequence
cctgcagctcaagtgttaaa

SEQ ID NO: 72527 - DNA, 20 bp, Artificial
  CRISPR gRNA sequence
cagctcaagtgttaaaatgt

SEQ ID NO: 72528 - DNA, 20 bp, Artificial
  CRISPR gRNA sequence
aagtgttaaaatgtctttga

SEQ ID NO: 72529 - DNA, 20 bp, Artificial
  CRISPR gRNA sequence
aaatgtctttgagaggatgt

SEQ ID NO: 72530 - DNA, 20 bp, Artificial
  CRISPR gRNA sequence
tgagaggatgtctgagtaag

SEQ ID NO: 72531 - DNA, 20 bp, Artificial
  CRISPR gRNA sequence
gagaggatgtctgagtaagg

SEQ ID NO: 72532 - DNA, 20 bp, Artificial
  CRISPR gRNA sequence
agaggatgtctgagtaagga

SEQ ID NO: 72533 - DNA, 20 bp, Artificial
  CRISPR gRNA sequence
agtaaggatgatcttcccca

SEQ ID NO: 72534 - DNA, 20 bp, Artificial
  CRISPR gRNA sequence
ccccatttacaaatgggagg

SEQ ID NO: 72535 - DNA, 20 bp, Artificial
  CRISPR gRNA sequence
cccatttacaaatgggagga

SEQ ID NO: 72536 - DNA, 20 bp, Artificial
  CRISPR gRNA sequence
acaaatgggaggactggcca

SEQ ID NO: 72537 - DNA, 20 bp, Artificial
  CRISPR gRNA sequence
caaatgggaggactggccag

SEQ ID NO: 72538 - DNA, 20 bp, Artificial
  CRISPR gRNA sequence
gccagagaggatgggagcag

SEQ ID NO: 72539 - DNA, 20 bp, Artificial
  CRISPR gRNA sequence
caggccacacagcaggctgg

SEQ ID NO: 72540 - DNA, 20 bp, Artificial
  CRISPR gRNA sequence
gagccaactcccccgacccc

SEQ ID NO: 72541 - DNA, 20 bp, Artificial
  CRISPR gRNA sequence
ccccgacccctcccgacttt

SEQ ID NO: 72542 - DNA, 20 bp, Artificial
  CRISPR gRNA sequence
ccgacttttccttttcccag

SEQ ID NO: 72543 - DNA, 20 bp, Artificial
  CRISPR gRNA sequence
ttccttttcccagccagctc

SEQ ID NO: 72544 - DNA, 20 bp, Artificial
  CRISPR gRNA sequence
tccttttcccagccagctca

SEQ ID NO: 72545 - DNA, 20 bp, Artificial
  CRISPR gRNA sequence
ccttttcccagccagctcag

SEQ ID NO: 72546 - DNA, 20 bp, Artificial
  CRISPR gRNA sequence
cttttcccagccagctcagg

SEQ ID NO: 72547 - DNA, 20 bp, Artificial
  CRISPR gRNA sequence
ttcccagccagctcagggct

SEQ ID NO: 72548 - DNA, 20 bp, Artificial
  CRISPR gRNA sequence
tcccagccagctcagggctc

SEQ ID NO: 72549 - DNA, 20 bp, Artificial
  CRISPR gRNA sequence
cccagccagctcagggctct

SEQ ID NO: 72550 - DNA, 20 bp, Artificial
  CRISPR gRNA sequence
ccagccagctcagggctctt

SEQ ID NO: 72551 - DNA, 20 bp, Artificial
  CRISPR gRNA sequence
agggctcttccaatcactca

SEQ ID NO: 72552 - DNA, 20 bp, Artificial
  CRISPR gRNA sequence
ttccaatcactcacaagatt

SEQ ID NO: 72553 - DNA, 20 bp, Artificial
  CRISPR gRNA sequence
ccaatcactcacaagattac

SEQ ID NO: 72554 - DNA, 20 bp, Artificial
  CRISPR gRNA sequence
caatcactcacaagattact

SEQ ID NO: 72555 - DNA, 20 bp, Artificial
  CRISPR gRNA sequence
acaagattacttccagggca

SEQ ID NO: 72556 - DNA, 20 bp, Artificial
  CRISPR gRNA sequence
cttccagggcagggcagctc

SEQ ID NO: 72557 - DNA, 20 bp, Artificial
  CRISPR gRNA sequence
ccagggcagggcagctcgtg

SEQ ID NO: 72558 - DNA, 20 bp, Artificial
  CRISPR gRNA sequence
cagggcagggcagctcgtga

SEQ ID NO: 72559 - DNA, 20 bp, Artificial
  CRISPR gRNA sequence
gtgaagctggaggtgaggag

SEQ ID NO: 72560 - DNA, 20 bp, Artificial
  CRISPR gRNA sequence
gaggtgaggagcttggcagt

SEQ ID NO: 72561 - DNA, 20 bp, Artificial
  CRISPR gRNA sequence
ggcagtctggttgtcaatct

SEQ ID NO: 72562 - DNA, 20 bp, Artificial
  CRISPR gRNA sequence
gcagtctggttgtcaatctt

SEQ ID NO: 72563 - DNA, 20 bp, Artificial
  CRISPR gRNA sequence
gttgtcaatcttacaggaaa

SEQ ID NO: 72564 - DNA, 20 bp, Artificial
  CRISPR gRNA sequence
tcaatcttacaggaaaccag

SEQ ID NO: 72565 - DNA, 20 bp, Artificial
  CRISPR gRNA sequence
acaggaaaccaggctgggga

SEQ ID NO: 72566 - DNA, 20 bp, Artificial
  CRISPR gRNA sequence
caggaaaccaggctggggat

SEQ ID NO: 72567 - DNA, 20 bp, Artificial
  CRISPR gRNA sequence
gggatggagaagggcatggg

SEQ ID NO: 72568 - DNA, 20 bp, Artificial
  CRISPR gRNA sequence
tttgagtcaggggatctagc

SEQ ID NO: 72569 - DNA, 20 bp, Artificial
  CRISPR gRNA sequence
gagtcaggggatctagcagg

SEQ ID NO: 72570 - DNA, 20 bp, Artificial
  CRISPR gRNA sequence
agtcaggggatctagcaggt

SEQ ID NO: 72571 - DNA, 20 bp, Artificial
  CRISPR gRNA sequence
gcaggtcctgcctccagagc

SEQ ID NO: 72572 - DNA, 20 bp, Artificial
  CRISPR gRNA sequence
cctccagagccaccagggtc

SEQ ID NO: 72573 - DNA, 20 bp, Artificial
  CRISPR gRNA sequence
cagagccaccagggtctggg

SEQ ID NO: 72574 - DNA, 20 bp, Artificial
  CRISPR gRNA sequence
gggtaagctaggcgttttag

SEQ ID NO: 72575 - DNA, 20 bp, Artificial
  CRISPR gRNA sequence
ggcgttttaggaaagacttc

SEQ ID NO: 72576 - DNA, 20 bp, Artificial
  CRISPR gRNA sequence
taggaaagacttcctttctt

SEQ ID NO: 72577 - DNA, 20 bp, Artificial
  CRISPR gRNA sequence
aggaaagacttcctttcttg

SEQ ID NO: 72578 - DNA, 20 bp, Artificial
  CRISPR gRNA sequence
ggaaagacttcctttcttga

SEQ ID NO: 72579 - DNA, 20 bp, Artificial
  CRISPR gRNA sequence
cctttcttgagccaggcccc

SEQ ID NO: 72580 - DNA, 20 bp, Artificial
  CRISPR gRNA sequence
ctttcttgagccaggccccc

SEQ ID NO: 72581 - DNA, 20 bp, Artificial
  CRISPR gRNA sequence
tcttgagccaggcccccacc

SEQ ID NO: 72582 - DNA, 20 bp, Artificial
  CRISPR gRNA sequence
cttgagccaggcccccacca

SEQ ID NO: 72583 - DNA, 20 bp, Artificial
  CRISPR gRNA sequence
ttgagccaggcccccaccat

SEQ ID NO: 72584 - DNA, 20 bp, Artificial
  CRISPR gRNA sequence
gagccaggcccccaccatcc

SEQ ID NO: 72585 - DNA, 20 bp, Artificial
  CRISPR gRNA sequence
agccaggcccccaccatccc

SEQ ID NO: 72586 - DNA, 20 bp, Artificial
  CRISPR gRNA sequence
gggcttctatcacttcaaag

SEQ ID NO: 72587 - DNA, 20 bp, Artificial
  CRISPR gRNA sequence
ctatcacttcaaaggcctcc

SEQ ID NO: 72588 - DNA, 20 bp, Artificial
  CRISPR gRNA sequence
tatcacttcaaaggcctccc

SEQ ID NO: 72589 - DNA, 20 bp, Artificial
  CRISPR gRNA sequence
tcacttcaaaggcctcccca

SEQ ID NO: 72590 - DNA, 20 bp, Artificial
  CRISPR gRNA sequence
caaaggcctccccaggtgtt

SEQ ID NO: 72591 - DNA, 20 bp, Artificial
  CRISPR gRNA sequence
aaaggcctccccaggtgtta

SEQ ID NO: 72592 - DNA, 20 bp, Artificial
  CRISPR gRNA sequence
cccaggtgttaggctcagtc

SEQ ID NO: 72593 - DNA, 20 bp, Artificial
  CRISPR gRNA sequence
ggctcagtcagagaagggct

SEQ ID NO: 72594 - DNA, 20 bp, Artificial
  CRISPR gRNA sequence
agtcagagaagggctgccct

SEQ ID NO: 72595 - DNA, 20 bp, Artificial
  CRISPR gRNA sequence
ccctcagcctgccactggtc

SEQ ID NO: 72596 - DNA, 20 bp, Artificial
  CRISPR gRNA sequence
agcctgccactggtccccta

SEQ ID NO: 72597 - DNA, 20 bp, Artificial
  CRISPR gRNA sequence
ccactggtcccctaggcagg

SEQ ID NO: 72598 - DNA, 20 bp, Artificial
  CRISPR gRNA sequence
gtcccctaggcaggcagggg

SEQ ID NO: 72599 - DNA, 20 bp, Artificial
  CRISPR gRNA sequence
ggcaggcaggggaggctact

SEQ ID NO: 72600 - DNA, 20 bp, Artificial
  CRISPR gRNA sequence
cttactctatctgtctgagc

SEQ ID NO: 72601 - DNA, 20 bp, Artificial
  CRISPR gRNA sequence
actctatctgtctgagcagc

SEQ ID NO: 72602 - DNA, 20 bp, Artificial
  CRISPR gRNA sequence
ctctatctgtctgagcagcg

SEQ ID NO: 72603 - DNA, 20 bp, Artificial
  CRISPR gRNA sequence
tatctgtctgagcagcggga

SEQ ID NO: 72604 - DNA, 20 bp, Artificial
  CRISPR gRNA sequence
tctgtctgagcagcgggagc

SEQ ID NO: 72605 - DNA, 20 bp, Artificial
  CRISPR gRNA sequence
tctgagcagcgggagctcca

SEQ ID NO: 72606 - DNA, 20 bp, Artificial
  CRISPR gRNA sequence
agcagcgggagctccataca

SEQ ID NO: 72607 - DNA, 20 bp, Artificial
  CRISPR gRNA sequence
catacagaaacgcaggaccc

SEQ ID NO: 72608 - DNA, 20 bp, Artificial
  CRISPR gRNA sequence
cagccaggttgttttccgcc

SEQ ID NO: 72609 - DNA, 20 bp, Artificial
  CRISPR gRNA sequence
ttttccgccaagctgcaggg

SEQ ID NO: 72610 - DNA, 20 bp, Artificial
  CRISPR gRNA sequence
tccgccaagctgcagggtag

SEQ ID NO: 72611 - DNA, 20 bp, Artificial
  CRISPR gRNA sequence
ccgccaagctgcagggtagg

SEQ ID NO: 72612 - DNA, 20 bp, Artificial
  CRISPR gRNA sequence
cgccaagctgcagggtaggg

SEQ ID NO: 72613 - DNA, 20 bp, Artificial
  CRISPR gRNA sequence
cagggtaggggagatacctg

SEQ ID NO: 72614 - DNA, 20 bp, Artificial
  CRISPR gRNA sequence
tgagaggaacccccagaccc

SEQ ID NO: 72615 - DNA, 20 bp, Artificial
  CRISPR gRNA sequence
tccccgtgcctgggctgggc

SEQ ID NO: 72616 - DNA, 20 bp, Artificial
  CRISPR gRNA sequence
ggctgggcagcccctactta

SEQ ID NO: 72617 - DNA, 20 bp, Artificial
  CRISPR gRNA sequence
ggcagcccctacttacctga

SEQ ID NO: 72618 - DNA, 20 bp, Artificial
  CRISPR gRNA sequence
cttacctgatctcttccaaa

SEQ ID NO: 72619 - DNA, 20 bp, Artificial
  CRISPR gRNA sequence
acctgatctcttccaaatgg

SEQ ID NO: 72620 - DNA, 20 bp, Artificial
  CRISPR gRNA sequence
cctgatctcttccaaatggg

SEQ ID NO: 72621 - DNA, 20 bp, Artificial
  CRISPR gRNA sequence
atctcttccaaatgggggga

SEQ ID NO: 72622 - DNA, 20 bp, Artificial
  CRISPR gRNA sequence
ttccaaatggggggatccat

SEQ ID NO: 72623 - DNA, 20 bp, Artificial
  CRISPR gRNA sequence
ccaaatggggggatccatcc

SEQ ID NO: 72624 - DNA, 20 bp, Artificial
  CRISPR gRNA sequence
caaatggggggatccatcca

SEQ ID NO: 72625 - DNA, 20 bp, Artificial
  CRISPR gRNA sequence
ggccaggctcagggccccac

SEQ ID NO: 72626 - DNA, 20 bp, Artificial
  CRISPR gRNA sequence
agggccccacctgggcccag

SEQ ID NO: 72627 - DNA, 20 bp, Artificial
  CRISPR gRNA sequence
ggcccagatggctgaatggt

SEQ ID NO: 72628 - DNA, 20 bp, Artificial
  CRISPR gRNA sequence
aatggtaggctggggaaaga

SEQ ID NO: 72629 - DNA, 20 bp, Artificial
  CRISPR gRNA sequence
gggaaagaggagagggtgag

SEQ ID NO: 72630 - DNA, 20 bp, Artificial
  CRISPR gRNA sequence
agggactggcgtttccagag

SEQ ID NO: 72631 - DNA, 20 bp, Artificial
  CRISPR gRNA sequence
gcgtttccagagccccaccc

SEQ ID NO: 72632 - DNA, 20 bp, Artificial
  CRISPR gRNA sequence
ccagagccccaccctcagcc

SEQ ID NO: 72633 - DNA, 20 bp, Artificial
  CRISPR gRNA sequence
cagagccccaccctcagcct

SEQ ID NO: 72634 - DNA, 20 bp, Artificial
  CRISPR gRNA sequence
agccttgtctcaggctgcag

SEQ ID NO: 72635 - DNA, 20 bp, Artificial
  CRISPR gRNA sequence
gtctcaggctgcagtgccag

SEQ ID NO: 72636 - DNA, 20 bp, Artificial
  CRISPR gRNA sequence
tctcaggctgcagtgccagc

SEQ ID NO: 72637 - DNA, 20 bp, Artificial
  CRISPR gRNA sequence
aggctgcagtgccagcccgt

SEQ ID NO: 72638 - DNA, 20 bp, Artificial
  CRISPR gRNA sequence
cagtgccagcccgtagacag

SEQ ID NO: 72639 - DNA, 20 bp, Artificial
  CRISPR gRNA sequence
tggctaattccccatccaca

SEQ ID NO: 72640 - DNA, 20 bp, Artificial
  CRISPR gRNA sequence
gctaattccccatccacaca

SEQ ID NO: 72641 - DNA, 20 bp, Artificial
  CRISPR gRNA sequence
attccccatccacacaggac

SEQ ID NO: 72642 - DNA, 20 bp, Artificial
  CRISPR gRNA sequence
cccatccacacaggacctgg

SEQ ID NO: 72643 - DNA, 20 bp, Artificial
  CRISPR gRNA sequence
ggtaggtatcaaggaccctg

SEQ ID NO: 72644 - DNA, 20 bp, Artificial
  CRISPR gRNA sequence
gctttggggtctgagatccc

SEQ ID NO: 72645 - DNA, 20 bp, Artificial
  CRISPR gRNA sequence
tggggtctgagatcccaaat

SEQ ID NO: 72646 - DNA, 20 bp, Artificial
  CRISPR gRNA sequence
ggggtctgagatcccaaatt

SEQ ID NO: 72647 - DNA, 20 bp, Artificial
  CRISPR gRNA sequence
gggtctgagatcccaaattc

SEQ ID NO: 72648 - DNA, 20 bp, Artificial
  CRISPR gRNA sequence
agatcccaaattcaacacct

SEQ ID NO: 72649 - DNA, 20 bp, Artificial
  CRISPR gRNA sequence
aacacctgggtccttcgtgt

SEQ ID NO: 72650 - DNA, 20 bp, Artificial
  CRISPR gRNA sequence
ggtccttcgtgtatgagtaa

SEQ ID NO: 72651 - DNA, 20 bp, Artificial
  CRISPR gRNA sequence
cgtgtatgagtaaggaaaat

SEQ ID NO: 72652 - DNA, 20 bp, Artificial
  CRISPR gRNA sequence
gtgtatgagtaaggaaaatt

SEQ ID NO: 72653 - DNA, 20 bp, Artificial
  CRISPR gRNA sequence
tccacacctctcctggcctt

SEQ ID NO: 72654 - DNA, 20 bp, Artificial
  CRISPR gRNA sequence
cacacctctcctggccttca

SEQ ID NO: 72655 - DNA, 20 bp, Artificial
  CRISPR gRNA sequence
tcctggccttcattcccttg

SEQ ID NO: 72656 - DNA, 20 bp, Artificial
  CRISPR gRNA sequence
ctggccttcattcccttgcc

SEQ ID NO: 72657 - DNA, 20 bp, Artificial
  CRISPR gRNA sequence
gccttcattcccttgcctgg

SEQ ID NO: 72658 - DNA, 20 bp, Artificial
  CRISPR gRNA sequence
cattcccttgcctggaaaag

SEQ ID NO: 72659 - DNA, 20 bp, Artificial
  CRISPR gRNA sequence
attcccttgcctggaaaagg

SEQ ID NO: 72660 - DNA, 20 bp, Artificial
  CRISPR gRNA sequence
ccttgcctggaaaagggagc

SEQ ID NO: 72661 - DNA, 20 bp, Artificial
  CRISPR gRNA sequence
gcctggaaaagggagcacat

SEQ ID NO: 72662 - DNA, 20 bp, Artificial
  CRISPR gRNA sequence
cctggaaaagggagcacata

SEQ ID NO: 72663 - DNA, 20 bp, Artificial
  CRISPR gRNA sequence
gaaaagggagcacataaaag

SEQ ID NO: 72664 - DNA, 20 bp, Artificial
  CRISPR gRNA sequence
acgcctgtaatcccagcact

SEQ ID NO: 72665 - DNA, 20 bp, Artificial
  CRISPR gRNA sequence
taatcccagcacttttggag

SEQ ID NO: 72666 - DNA, 20 bp, Artificial
  CRISPR gRNA sequence
ttggaggctgaggtgggtgg

SEQ ID NO: 72667 - DNA, 20 bp, Artificial
  CRISPR gRNA sequence
tggaggctgaggtgggtgga

SEQ ID NO: 72668 - DNA, 20 bp, Artificial
  CRISPR gRNA sequence
ggaggctgaggtgggtggat

SEQ ID NO: 72669 - DNA, 20 bp, Artificial
  CRISPR gRNA sequence
gaggctgaggtgggtggatc

SEQ ID NO: 72670 - DNA, 20 bp, Artificial
  CRISPR gRNA sequence
aggtgggtggatcacttgag

SEQ ID NO: 72671 - DNA, 20 bp, Artificial
  CRISPR gRNA sequence
gaggccaggagtccaagacc

SEQ ID NO: 72672 - DNA, 20 bp, Artificial
  CRISPR gRNA sequence
aggccaggagtccaagacca

SEQ ID NO: 72673 - DNA, 20 bp, Artificial
  CRISPR gRNA sequence
ggcaatatggtgaaatgccg

SEQ ID NO: 72674 - DNA, 20 bp, Artificial
  CRISPR gRNA sequence
tactaaaaatacaaaaatta

SEQ ID NO: 72675 - DNA, 20 bp, Artificial
  CRISPR gRNA sequence
ctaaaaatacaaaaattagc

SEQ ID NO: 72676 - DNA, 20 bp, Artificial
  CRISPR gRNA sequence
aaaatacaaaaattagctgg

SEQ ID NO: 72677 - DNA, 20 bp, Artificial
  CRISPR gRNA sequence
gctgggcatggtgggcatgc

SEQ ID NO: 72678 - DNA, 20 bp, Artificial
  CRISPR gRNA sequence
ggcatggtgggcatgctcgt

SEQ ID NO: 72679 - DNA, 20 bp, Artificial
  CRISPR gRNA sequence
gtaatcccagctactctggt

SEQ ID NO: 72680 - DNA, 20 bp, Artificial
  CRISPR gRNA sequence
ctctggtagctgaggcacaa

SEQ ID NO: 72681 - DNA, 20 bp, Artificial
  CRISPR gRNA sequence
tggtagctgaggcacaagaa

SEQ ID NO: 72682 - DNA, 20 bp, Artificial
  CRISPR gRNA sequence
gtagctgaggcacaagaatt

SEQ ID NO: 72683 - DNA, 20 bp, Artificial
  CRISPR gRNA sequence
aggcacaagaattgcttgaa

SEQ ID NO: 72684 - DNA, 20 bp, Artificial
  CRISPR gRNA sequence
cttgaacccgggaggtggag

SEQ ID NO: 72685 - DNA, 20 bp, Artificial
  CRISPR gRNA sequence
gaacccgggaggtggaggtt

SEQ ID NO: 72686 - DNA, 20 bp, Artificial
  CRISPR gRNA sequence
aacccgggaggtggaggttg

SEQ ID NO: 72687 - DNA, 20 bp, Artificial
  CRISPR gRNA sequence
cagtgagccgaggttgcacc

SEQ ID NO: 72688 - DNA, 20 bp, Artificial
  CRISPR gRNA sequence
caccactgcactccagcctg

SEQ ID NO: 72689 - DNA, 20 bp, Artificial
  CRISPR gRNA sequence
cactccagcctgggtgacag

SEQ ID NO: 72690 - DNA, 20 bp, Artificial
  CRISPR gRNA sequence
cagcctgggtgacagagaga

SEQ ID NO: 72691 - DNA, 20 bp, Artificial
  CRISPR gRNA sequence
ggtgacagagagagactcca

SEQ ID NO: 72692 - DNA, 20 bp, Artificial
  CRISPR gRNA sequence
catctaaaaaaaaaaaaaaa

SEQ ID NO: 72693 - DNA, 20 bp, Artificial
  CRISPR gRNA sequence
aaaaaaaaaaaaaaaaaaaa

SEQ ID NO: 72694 - DNA, 20 bp, Artificial
  CRISPR gRNA sequence
tgggactctgggggctgcca

SEQ ID NO: 72695 - DNA, 20 bp, Artificial
  CRISPR gRNA sequence
ggactctgggggctgccatg

SEQ ID NO: 72696 - DNA, 20 bp, Artificial
  CRISPR gRNA sequence
tgggggctgccatggggctg

SEQ ID NO: 72697 - DNA, 20 bp, Artificial
  CRISPR gRNA sequence
ggggctgccatggggctgca

SEQ ID NO: 72698 - DNA, 20 bp, Artificial
  CRISPR gRNA sequence
ccatggggctgcaatgaggt

SEQ ID NO: 72699 - DNA, 20 bp, Artificial
  CRISPR gRNA sequence
caatgaggtcatttgtgaag

SEQ ID NO: 72700 - DNA, 20 bp, Artificial
  CRISPR gRNA sequence
gtgaagtgctgaggccacgt

SEQ ID NO: 72701 - DNA, 20 bp, Artificial
  CRISPR gRNA sequence
tgaagtgctgaggccacgtt

SEQ ID NO: 72702 - DNA, 20 bp, Artificial
  CRISPR gRNA sequence
aggccacgttgattggcacc

SEQ ID NO: 72703 - DNA, 20 bp, Artificial
  CRISPR gRNA sequence
attggcaccgtgctcctgcg

SEQ ID NO: 72704 - DNA, 20 bp, Artificial
  CRISPR gRNA sequence
gcaccgtgctcctgcgaagc

SEQ ID NO: 72705 - DNA, 20 bp, Artificial
  CRISPR gRNA sequence
ctgcgaagccctctgccagg

SEQ ID NO: 72706 - DNA, 20 bp, Artificial
  CRISPR gRNA sequence
cgaagccctctgccaggatt

SEQ ID NO: 72707 - DNA, 20 bp, Artificial
  CRISPR gRNA sequence
tgccaggatttctcattcgc

SEQ ID NO: 72708 - DNA, 20 bp, Artificial
  CRISPR gRNA sequence
ccaggatttctcattcgccc

SEQ ID NO: 72709 - DNA, 20 bp, Artificial
  CRISPR gRNA sequence
ctcattcgccctcagggacc

SEQ ID NO: 72710 - DNA, 20 bp, Artificial
  CRISPR gRNA sequence
tcattcgccctcagggaccc

SEQ ID NO: 72711 - DNA, 20 bp, Artificial
  CRISPR gRNA sequence
attcgccctcagggacccgc

SEQ ID NO: 72712 - DNA, 20 bp, Artificial
  CRISPR gRNA sequence
gccctcagggacccgctcac

SEQ ID NO: 72713 - DNA, 20 bp, Artificial
  CRISPR gRNA sequence
agggacccgctcacagggca

SEQ ID NO: 72714 - DNA, 20 bp, Artificial
  CRISPR gRNA sequence
acagggcacaatgaactggg

SEQ ID NO: 72715 - DNA, 20 bp, Artificial
  CRISPR gRNA sequence
ggatcattgtacttcttttg

SEQ ID NO: 72716 - DNA, 20 bp, Artificial
  CRISPR gRNA sequence
tacttcttttgcatgtgaag

SEQ ID NO: 72717 - DNA, 20 bp, Artificial
  CRISPR gRNA sequence
cttttgcatgtgaagaaact

SEQ ID NO: 72718 - DNA, 20 bp, Artificial
  CRISPR gRNA sequence
ttttgcatgtgaagaaactg

SEQ ID NO: 72719 - DNA, 20 bp, Artificial
  CRISPR gRNA sequence
ttgcatgtgaagaaactgag

SEQ ID NO: 72720 - DNA, 20 bp, Artificial
  CRISPR gRNA sequence
tgcatgtgaagaaactgagg

SEQ ID NO: 72721 - DNA, 20 bp, Artificial
  CRISPR gRNA sequence
gcatgtgaagaaactgaggc

SEQ ID NO: 72722 - DNA, 20 bp, Artificial
  CRISPR gRNA sequence
catgtgaagaaactgaggct

SEQ ID NO: 72723 - DNA, 20 bp, Artificial
  CRISPR gRNA sequence
aggctgagaaggggcagggg

SEQ ID NO: 72724 - DNA, 20 bp, Artificial
  CRISPR gRNA sequence
agaaggggcaggggtttggc

SEQ ID NO: 72725 - DNA, 20 bp, Artificial
  CRISPR gRNA sequence
ggccaaggtcaggcaggggc

SEQ ID NO: 72726 - DNA, 20 bp, Artificial
  CRISPR gRNA sequence
gccaaggtcaggcaggggcc

SEQ ID NO: 72727 - DNA, 20 bp, Artificial
  CRISPR gRNA sequence
ggctgggcctcctgattttc

SEQ ID NO: 72728 - DNA, 20 bp, Artificial
  CRISPR gRNA sequence
ggcctcctgattttcttgct

SEQ ID NO: 72729 - DNA, 20 bp, Artificial
  CRISPR gRNA sequence
ctgattttcttgctgcagac

SEQ ID NO: 72730 - DNA, 20 bp, Artificial
  CRISPR gRNA sequence
attttcttgctgcagacatc

SEQ ID NO: 72731 - DNA, 20 bp, Artificial
  CRISPR gRNA sequence
tcttgctgcagacatcagag

SEQ ID NO: 72732 - DNA, 20 bp, Artificial
  CRISPR gRNA sequence
cttgctgcagacatcagagg

SEQ ID NO: 72733 - DNA, 20 bp, Artificial
  CRISPR gRNA sequence
ttgctgcagacatcagaggc

SEQ ID NO: 72734 - DNA, 20 bp, Artificial
  CRISPR gRNA sequence
gctgcagacatcagaggcag

SEQ ID NO: 72735 - DNA, 20 bp, Artificial
  CRISPR gRNA sequence
ctgcagacatcagaggcagg

SEQ ID NO: 72736 - DNA, 20 bp, Artificial
  CRISPR gRNA sequence
cagacatcagaggcagggaa

SEQ ID NO: 72737 - DNA, 20 bp, Artificial
  CRISPR gRNA sequence
gacttggggcagggcagctc

SEQ ID NO: 72738 - DNA, 20 bp, Artificial
  CRISPR gRNA sequence
acttggggcagggcagctca

SEQ ID NO: 72739 - DNA, 20 bp, Artificial
  CRISPR gRNA sequence
ggggcagggcagctcaactg

SEQ ID NO: 72740 - DNA, 20 bp, Artificial
  CRISPR gRNA sequence
gggcagggcagctcaactga

SEQ ID NO: 72741 - DNA, 20 bp, Artificial
  CRISPR gRNA sequence
aactgatgggggcctggacc

SEQ ID NO: 72742 - DNA, 20 bp, Artificial
  CRISPR gRNA sequence
atgggggcctggaccccccc

SEQ ID NO: 72743 - DNA, 20 bp, Artificial
  CRISPR gRNA sequence
gacccccccactgctcccga

SEQ ID NO: 72744 - DNA, 20 bp, Artificial
  CRISPR gRNA sequence
ctcccgaggaccctcctccc

SEQ ID NO: 72745 - DNA, 20 bp, Artificial
  CRISPR gRNA sequence
ccgaggaccctcctccccac

SEQ ID NO: 72746 - DNA, 20 bp, Artificial
  CRISPR gRNA sequence
ctccccaccagccctgcatg

SEQ ID NO: 72747 - DNA, 20 bp, Artificial
  CRISPR gRNA sequence
cccaccagccctgcatggta

SEQ ID NO: 72748 - DNA, 20 bp, Artificial
  CRISPR gRNA sequence
catggtatgggcagggggcc

SEQ ID NO: 72749 - DNA, 20 bp, Artificial
  CRISPR gRNA sequence
actgtaggaccctcaggtgc

SEQ ID NO: 72750 - DNA, 20 bp, Artificial
  CRISPR gRNA sequence
taggaccctcaggtgctggg

SEQ ID NO: 72751 - DNA, 20 bp, Artificial
  CRISPR gRNA sequence
aggtgctggggcagctcctg

SEQ ID NO: 72752 - DNA, 20 bp, Artificial
  CRISPR gRNA sequence
gggcagctcctgagccagcc

SEQ ID NO: 72753 - DNA, 20 bp, Artificial
  CRISPR gRNA sequence
ctgagccagccccagggctg

SEQ ID NO: 72754 - DNA, 20 bp, Artificial
  CRISPR gRNA sequence
agccagccccagggctgtgg

SEQ ID NO: 72755 - DNA, 20 bp, Artificial
  CRISPR gRNA sequence
tgggatcccccagggcattg

SEQ ID NO: 72756 - DNA, 20 bp, Artificial
  CRISPR gRNA sequence
cagccaagcctggaagagga

SEQ ID NO: 72757 - DNA, 20 bp, Artificial
  CRISPR gRNA sequence
gaagaggagaggaatgagca

SEQ ID NO: 72758 - DNA, 20 bp, Artificial
  CRISPR gRNA sequence
agtactgggcctgcccactc

SEQ ID NO: 72759 - DNA, 20 bp, Artificial
  CRISPR gRNA sequence
ggcctgcccactcgggaccc

SEQ ID NO: 72760 - DNA, 20 bp, Artificial
  CRISPR gRNA sequence
cccactcgggacccccgccc

SEQ ID NO: 72761 - DNA, 20 bp, Artificial
  CRISPR gRNA sequence
gggacccccgccctgccctg

SEQ ID NO: 72762 - DNA, 20 bp, Artificial
  CRISPR gRNA sequence
ccctgtgcccactgcgggag

SEQ ID NO: 72763 - DNA, 20 bp, Artificial
  CRISPR gRNA sequence
tgcccactgcgggagaggag

SEQ ID NO: 72764 - DNA, 20 bp, Artificial
  CRISPR gRNA sequence
cgggagaggaggccaggtgg

SEQ ID NO: 72765 - DNA, 20 bp, Artificial
  CRISPR gRNA sequence
gggggcacagagggcagagg

SEQ ID NO: 72766 - DNA, 20 bp, Artificial
  CRISPR gRNA sequence
ggcagacactcacatcaact

SEQ ID NO: 72767 - DNA, 20 bp, Artificial
  CRISPR gRNA sequence
acatcaactcctccaggcgc

SEQ ID NO: 72768 - DNA, 20 bp, Artificial
  CRISPR gRNA sequence
ctccaggcgcctgcaaagaa

SEQ ID NO: 72769 - DNA, 20 bp, Artificial
  CRISPR gRNA sequence
caggcgcctgcaaagaacga

SEQ ID NO: 72770 - DNA, 20 bp, Artificial
  CRISPR gRNA sequence
caaagaacgagagactctgc

SEQ ID NO: 72771 - DNA, 20 bp, Artificial
  CRISPR gRNA sequence
tgccaactgcactcccccgg

SEQ ID NO: 72772 - DNA, 20 bp, Artificial
  CRISPR gRNA sequence
ccaactgcactcccccggct

SEQ ID NO: 72773 - DNA, 20 bp, Artificial
  CRISPR gRNA sequence
cactcccccggctgagctga

SEQ ID NO: 72774 - DNA, 20 bp, Artificial
  CRISPR gRNA sequence
ccccggctgagctgatgcta

SEQ ID NO: 72775 - DNA, 20 bp, Artificial
  CRISPR gRNA sequence
agctgatgctattccctgag

SEQ ID NO: 72776 - DNA, 20 bp, Artificial
  CRISPR gRNA sequence
atgctattccctgagaggct

SEQ ID NO: 72777 - DNA, 20 bp, Artificial
  CRISPR gRNA sequence
ttccctgagaggctgtggga

SEQ ID NO: 72778 - DNA, 20 bp, Artificial
  CRISPR gRNA sequence
cctgagaggctgtgggaggg

SEQ ID NO: 72779 - DNA, 20 bp, Artificial
  CRISPR gRNA sequence
agaggctgtgggaggggggc

SEQ ID NO: 72780 - DNA, 20 bp, Artificial
  CRISPR gRNA sequence
tgggaggggggcagccatca

SEQ ID NO: 72781 - DNA, 20 bp, Artificial
  CRISPR gRNA sequence
tgatgccccctctccccgac

SEQ ID NO: 72782 - DNA, 20 bp, Artificial
  CRISPR gRNA sequence
atgccccctctccccgacac

SEQ ID NO: 72783 - DNA, 20 bp, Artificial
  CRISPR gRNA sequence
tccccgacaccccagcacat

SEQ ID NO: 72784 - DNA, 20 bp, Artificial
  CRISPR gRNA sequence
cccgacaccccagcacatct

SEQ ID NO: 72785 - DNA, 20 bp, Artificial
  CRISPR gRNA sequence
ctgggtctgccacccctgct

SEQ ID NO: 72786 - DNA, 20 bp, Artificial
  CRISPR gRNA sequence
ggtctgccacccctgcttca

SEQ ID NO: 72787 - DNA, 20 bp, Artificial
  CRISPR gRNA sequence
ccacccctgcttcagggggc

SEQ ID NO: 72788 - DNA, 20 bp, Artificial
  CRISPR gRNA sequence
cttcagggggcctaagagac

SEQ ID NO: 72789 - DNA, 20 bp, Artificial
  CRISPR gRNA sequence
cagggggcctaagagacaac

SEQ ID NO: 72790 - DNA, 20 bp, Artificial
  CRISPR gRNA sequence
agggggcctaagagacaacc

SEQ ID NO: 72791 - DNA, 20 bp, Artificial
  CRISPR gRNA sequence
agagacaaccccccgacacc

SEQ ID NO: 72792 - DNA, 20 bp, Artificial
  CRISPR gRNA sequence
cccagacaatgaggcagaaa

SEQ ID NO: 72793 - DNA, 20 bp, Artificial
  CRISPR gRNA sequence
gggtggcttaaggtcccgca

SEQ ID NO: 72794 - DNA, 20 bp, Artificial
  CRISPR gRNA sequence
aaggtcccgcagtgagggcc

SEQ ID NO: 72795 - DNA, 20 bp, Artificial
  CRISPR gRNA sequence
aggtcccgcagtgagggcca

SEQ ID NO: 72796 - DNA, 20 bp, Artificial
  CRISPR gRNA sequence
cctggacactgaggttggcg

SEQ ID NO: 72797 - DNA, 20 bp, Artificial
  CRISPR gRNA sequence
gacactgaggttggcgcagg

SEQ ID NO: 72798 - DNA, 20 bp, Artificial
  CRISPR gRNA sequence
aggttggcgcaggggagatt

SEQ ID NO: 72799 - DNA, 20 bp, Artificial
  CRISPR gRNA sequence
gcgcaggggagattttacca

SEQ ID NO: 72800 - DNA, 20 bp, Artificial
  CRISPR gRNA sequence
taccatgctggcctcagcta

SEQ ID NO: 72801 - DNA, 20 bp, Artificial
  CRISPR gRNA sequence
accatgctggcctcagctag

SEQ ID NO: 72802 - DNA, 20 bp, Artificial
  CRISPR gRNA sequence
ccatgctggcctcagctagg

SEQ ID NO: 72803 - DNA, 20 bp, Artificial
  CRISPR gRNA sequence
gcctcagctaggggccagta

SEQ ID NO: 72804 - DNA, 20 bp, Artificial
  CRISPR gRNA sequence
agctaggggccagtatctcc

SEQ ID NO: 72805 - DNA, 20 bp, Artificial
  CRISPR gRNA sequence
ggggccagtatctcctagga

SEQ ID NO: 72806 - DNA, 20 bp, Artificial
  CRISPR gRNA sequence
ctaggaccatcgtgtgaccc

SEQ ID NO: 72807 - DNA, 20 bp, Artificial
  CRISPR gRNA sequence
ggaccatcgtgtgacccctg

SEQ ID NO: 72808 - DNA, 20 bp, Artificial
  CRISPR gRNA sequence
tggccctcctctgtagggct

SEQ ID NO: 72809 - DNA, 20 bp, Artificial
  CRISPR gRNA sequence
ctctgtagggctggctactc

SEQ ID NO: 72810 - DNA, 20 bp, Artificial
  CRISPR gRNA sequence
tgtagggctggctactcact

SEQ ID NO: 72811 - DNA, 20 bp, Artificial
  CRISPR gRNA sequence
tagggctggctactcactct

SEQ ID NO: 72812 - DNA, 20 bp, Artificial
  CRISPR gRNA sequence
gctactcactctatcttcct

SEQ ID NO: 72813 - DNA, 20 bp, Artificial
  CRISPR gRNA sequence
ctcactctatcttcctgagc

SEQ ID NO: 72814 - DNA, 20 bp, Artificial
  CRISPR gRNA sequence
actctatcttcctgagctct

SEQ ID NO: 72815 - DNA, 20 bp, Artificial
  CRISPR gRNA sequence
tatcttcctgagctctggca

SEQ ID NO: 72816 - DNA, 20 bp, Artificial
  CRISPR gRNA sequence
tcttcctgagctctggcagc

SEQ ID NO: 72817 - DNA, 20 bp, Artificial
  CRISPR gRNA sequence
cctgagctctggcagcccag

SEQ ID NO: 72818 - DNA, 20 bp, Artificial
  CRISPR gRNA sequence
ctgagctctggcagcccagg

SEQ ID NO: 72819 - DNA, 20 bp, Artificial
  CRISPR gRNA sequence
agctctggcagcccaggcag

SEQ ID NO: 72820 - DNA, 20 bp, Artificial
  CRISPR gRNA sequence
tggcagcccaggcaggatgg

SEQ ID NO: 72821 - DNA, 20 bp, Artificial
  CRISPR gRNA sequence
gcagcccaggcaggatggta

SEQ ID NO: 72822 - DNA, 20 bp, Artificial
  CRISPR gRNA sequence
agtgctggacaccagcgtct

SEQ ID NO: 72823 - DNA, 20 bp, Artificial
  CRISPR gRNA sequence
gacaccagcgtctccaatct

SEQ ID NO: 72824 - DNA, 20 bp, Artificial
  CRISPR gRNA sequence
caatctggttgtggctcaag

SEQ ID NO: 72825 - DNA, 20 bp, Artificial
  CRISPR gRNA sequence
gttgtggctcaagcttgggg

SEQ ID NO: 72826 - DNA, 20 bp, Artificial
  CRISPR gRNA sequence
tggctcaagcttgggggaga

SEQ ID NO: 72827 - DNA, 20 bp, Artificial
  CRISPR gRNA sequence
aagcttgggggagaaaacag

SEQ ID NO: 72828 - DNA, 20 bp, Artificial
  CRISPR gRNA sequence
gggggagaaaacagcttcat

SEQ ID NO: 72829 - DNA, 20 bp, Artificial
  CRISPR gRNA sequence
ggggagaaaacagcttcatc

SEQ ID NO: 72830 - DNA, 20 bp, Artificial
  CRISPR gRNA sequence
catcagccttctgccgtctc

SEQ ID NO: 72831 - DNA, 20 bp, Artificial
  CRISPR gRNA sequence
atcagccttctgccgtctca

SEQ ID NO: 72832 - DNA, 20 bp, Artificial
  CRISPR gRNA sequence
ctgccgtctcatcttgtcca

SEQ ID NO: 72833 - DNA, 20 bp, Artificial
  CRISPR gRNA sequence
tgccgtctcatcttgtccac

SEQ ID NO: 72834 - DNA, 20 bp, Artificial
  CRISPR gRNA sequence
ccgtctcatcttgtccacac

SEQ ID NO: 72835 - DNA, 20 bp, Artificial
  CRISPR gRNA sequence
atcttgtccacaccccactc

SEQ ID NO: 72836 - DNA, 20 bp, Artificial
  CRISPR gRNA sequence
gtccacaccccactcccaga

SEQ ID NO: 72837 - DNA, 20 bp, Artificial
  CRISPR gRNA sequence
tccacaccccactcccagaa

SEQ ID NO: 72838 - DNA, 20 bp, Artificial
  CRISPR gRNA sequence
ccagaaaaagaaggggaggc

SEQ ID NO: 72839 - DNA, 20 bp, Artificial
  CRISPR gRNA sequence
aagtcccaggaagggcctcg

SEQ ID NO: 72840 - DNA, 20 bp, Artificial
  CRISPR gRNA sequence
gactcacacagagagcccca

SEQ ID NO: 72841 - DNA, 20 bp, Artificial
  CRISPR gRNA sequence
acacagagagccccatcacc

SEQ ID NO: 72842 - DNA, 20 bp, Artificial
  CRISPR gRNA sequence
agtgacagctcctaaccctt

SEQ ID NO: 72843 - DNA, 20 bp, Artificial
  CRISPR gRNA sequence
ctaacccttggcttctgttt

SEQ ID NO: 72844 - DNA, 20 bp, Artificial
  CRISPR gRNA sequence
acccttggcttctgtttagg

SEQ ID NO: 72845 - DNA, 20 bp, Artificial
  CRISPR gRNA sequence
ggcttctgtttaggatgttc

SEQ ID NO: 72846 - DNA, 20 bp, Artificial
  CRISPR gRNA sequence
gcttctgtttaggatgttct

SEQ ID NO: 72847 - DNA, 20 bp, Artificial
  CRISPR gRNA sequence
ctgtttaggatgttctcccc

SEQ ID NO: 72848 - DNA, 20 bp, Artificial
  CRISPR gRNA sequence
tgtttaggatgttctcccca

SEQ ID NO: 72849 - DNA, 20 bp, Artificial
  CRISPR gRNA sequence
tttaggatgttctccccatt

SEQ ID NO: 72850 - DNA, 20 bp, Artificial
  CRISPR gRNA sequence
aggatgttctccccattgtc

SEQ ID NO: 72851 - DNA, 20 bp, Artificial
  CRISPR gRNA sequence
ggatgttctccccattgtct

SEQ ID NO: 72852 - DNA, 20 bp, Artificial
  CRISPR gRNA sequence
tccccattgtctgacctaaa

SEQ ID NO: 72853 - DNA, 20 bp, Artificial
  CRISPR gRNA sequence
cccattgtctgacctaaatc

SEQ ID NO: 72854 - DNA, 20 bp, Artificial
  CRISPR gRNA sequence
tctgacctaaatccctcttg

SEQ ID NO: 72855 - DNA, 20 bp, Artificial
  CRISPR gRNA sequence
acctaaatccctcttgctac

SEQ ID NO: 72856 - DNA, 20 bp, Artificial
  CRISPR gRNA sequence
aatccctcttgctacaattg

SEQ ID NO: 72857 - DNA, 20 bp, Artificial
  CRISPR gRNA sequence
ttgctacaattgacactctt

SEQ ID NO: 72858 - DNA, 20 bp, Artificial
  CRISPR gRNA sequence
gctacaattgacactcttac

SEQ ID NO: 72859 - DNA, 20 bp, Artificial
  CRISPR gRNA sequence
ctacaattgacactcttaca

SEQ ID NO: 72860 - DNA, 20 bp, Artificial
  CRISPR gRNA sequence
caattgacactcttacatcc

SEQ ID NO: 72861 - DNA, 20 bp, Artificial
  CRISPR gRNA sequence
acactcttacatcctgtctt

SEQ ID NO: 72862 - DNA, 20 bp, Artificial
  CRISPR gRNA sequence
ttacatcctgtctttgggtc

SEQ ID NO: 72863 - DNA, 20 bp, Artificial
  CRISPR gRNA sequence
acatcctgtctttgggtccc

SEQ ID NO: 72864 - DNA, 20 bp, Artificial
  CRISPR gRNA sequence
catcctgtctttgggtcccc

SEQ ID NO: 72865 - DNA, 20 bp, Artificial
  CRISPR gRNA sequence
tctttgggtcccccaagctt

SEQ ID NO: 72866 - DNA, 20 bp, Artificial
  CRISPR gRNA sequence
tgggtcccccaagcttctag

SEQ ID NO: 72867 - DNA, 20 bp, Artificial
  CRISPR gRNA sequence
gggtcccccaagcttctagg

SEQ ID NO: 72868 - DNA, 20 bp, Artificial
  CRISPR gRNA sequence
ggtcccccaagcttctaggc

SEQ ID NO: 72869 - DNA, 20 bp, Artificial
  CRISPR gRNA sequence
ctaggccccaggttgtttac

SEQ ID NO: 72870 - DNA, 20 bp, Artificial
  CRISPR gRNA sequence
taggccccaggttgtttaca

SEQ ID NO: 72871 - DNA, 20 bp, Artificial
  CRISPR gRNA sequence
ggccccaggttgtttacaca

SEQ ID NO: 72872 - DNA, 20 bp, Artificial
  CRISPR gRNA sequence
tttacacagtgtagaagtgg

SEQ ID NO: 72873 - DNA, 20 bp, Artificial
  CRISPR gRNA sequence
acacagtgtagaagtgggtg

SEQ ID NO: 72874 - DNA, 20 bp, Artificial
  CRISPR gRNA sequence
cacagtgtagaagtgggtga

SEQ ID NO: 72875 - DNA, 20 bp, Artificial
  CRISPR gRNA sequence
aggtagccccttgcccttgt

SEQ ID NO: 72876 - DNA, 20 bp, Artificial
  CRISPR gRNA sequence
gcccttgtcatctttcccgg

SEQ ID NO: 72877 - DNA, 20 bp, Artificial
  CRISPR gRNA sequence
cccttgtcatctttcccggc

SEQ ID NO: 72878 - DNA, 20 bp, Artificial
  CRISPR gRNA sequence
gtcatctttcccggccaaaa

SEQ ID NO: 72879 - DNA, 20 bp, Artificial
  CRISPR gRNA sequence
tcatctttcccggccaaaat

SEQ ID NO: 72880 - DNA, 20 bp, Artificial
  CRISPR gRNA sequence
tcccggccaaaattgtcctg

SEQ ID NO: 72881 - DNA, 20 bp, Artificial
  CRISPR gRNA sequence
cccggccaaaattgtcctgg

SEQ ID NO: 72882 - DNA, 20 bp, Artificial
  CRISPR gRNA sequence
ccggccaaaattgtcctggg

SEQ ID NO: 72883 - DNA, 20 bp, Artificial
  CRISPR gRNA sequence
tcctgggtctgggggcagaa

SEQ ID NO: 72884 - DNA, 20 bp, Artificial
  CRISPR gRNA sequence
ggtctgggggcagaatgggc

SEQ ID NO: 72885 - DNA, 20 bp, Artificial
  CRISPR gRNA sequence
ggggcagaatgggcaactca

SEQ ID NO: 72886 - DNA, 20 bp, Artificial
  CRISPR gRNA sequence
actccagctcctctaggctg

SEQ ID NO: 72887 - DNA, 20 bp, Artificial
  CRISPR gRNA sequence
cagctcctctaggctggtgg

SEQ ID NO: 72888 - DNA, 20 bp, Artificial
  CRISPR gRNA sequence
ctctaggctggtggcagccc

SEQ ID NO: 72889 - DNA, 20 bp, Artificial
  CRISPR gRNA sequence
taggctggtggcagccctga

SEQ ID NO: 72890 - DNA, 20 bp, Artificial
  CRISPR gRNA sequence
ggctggtggcagccctgaga

SEQ ID NO: 72891 - DNA, 20 bp, Artificial
  CRISPR gRNA sequence
gtggcagccctgagagcctc

SEQ ID NO: 72892 - DNA, 20 bp, Artificial
  CRISPR gRNA sequence
agagcctcagaaaggtggca

SEQ ID NO: 72893 - DNA, 20 bp, Artificial
  CRISPR gRNA sequence
agaaaggtggcagcaaccga

SEQ ID NO: 72894 - DNA, 20 bp, Artificial
  CRISPR gRNA sequence
ttcctgttcagtctggaaaa

SEQ ID NO: 72895 - DNA, 20 bp, Artificial
  CRISPR gRNA sequence
ctgttcagtctggaaaagca

SEQ ID NO: 72896 - DNA, 20 bp, Artificial
  CRISPR gRNA sequence
ttcagtctggaaaagcaggg

SEQ ID NO: 72897 - DNA, 20 bp, Artificial
  CRISPR gRNA sequence
agtctggaaaagcagggaat

SEQ ID NO: 72898 - DNA, 20 bp, Artificial
  CRISPR gRNA sequence
gaaaagcagggaatagacca

SEQ ID NO: 72899 - DNA, 20 bp, Artificial
  CRISPR gRNA sequence
tcaggagcttaaaggccttt

SEQ ID NO: 72900 - DNA, 20 bp, Artificial
  CRISPR gRNA sequence
caggagcttaaaggcctttg

SEQ ID NO: 72901 - DNA, 20 bp, Artificial
  CRISPR gRNA sequence
aggagcttaaaggcctttgc

SEQ ID NO: 72902 - DNA, 20 bp, Artificial
  CRISPR gRNA sequence
aaaggcctttgcaggtgctg

SEQ ID NO: 72903 - DNA, 20 bp, Artificial
  CRISPR gRNA sequence
aaggcctttgcaggtgctgt

SEQ ID NO: 72904 - DNA, 20 bp, Artificial
  CRISPR gRNA sequence
tgcaggtgctgtgctaagaa

SEQ ID NO: 72905 - DNA, 20 bp, Artificial
  CRISPR gRNA sequence
gcaggtgctgtgctaagaac

SEQ ID NO: 72906 - DNA, 20 bp, Artificial
  CRISPR gRNA sequence
caggtgctgtgctaagaact

SEQ ID NO: 72907 - DNA, 20 bp, Artificial
  CRISPR gRNA sequence
tgctaagaactctacagttt

SEQ ID NO: 72908 - DNA, 20 bp, Artificial
  CRISPR gRNA sequence
agaactctacagtttgcaaa

SEQ ID NO: 72909 - DNA, 20 bp, Artificial
  CRISPR gRNA sequence
tacagtttgcaaagccttac

SEQ ID NO: 72910 - DNA, 20 bp, Artificial
  CRISPR gRNA sequence
cagtttgcaaagccttacac

SEQ ID NO: 72911 - DNA, 20 bp, Artificial
  CRISPR gRNA sequence
gcaaagccttacacgcccag

SEQ ID NO: 72912 - DNA, 20 bp, Artificial
  CRISPR gRNA sequence
caaagccttacacgcccagg

SEQ ID NO: 72913 - DNA, 20 bp, Artificial
  CRISPR gRNA sequence
acacgcccaggaattcatat

SEQ ID NO: 72914 - DNA, 20 bp, Artificial
  CRISPR gRNA sequence
cacgcccaggaattcatatg

SEQ ID NO: 72915 - DNA, 20 bp, Artificial
  CRISPR gRNA sequence
atatgctggtagcaaaactt

SEQ ID NO: 72916 - DNA, 20 bp, Artificial
  CRISPR gRNA sequence
gtagcaaaacttctgggggt

SEQ ID NO: 72917 - DNA, 20 bp, Artificial
  CRISPR gRNA sequence
ctgggggtcatggcaggtgg

SEQ ID NO: 72918 - DNA, 20 bp, Artificial
  CRISPR gRNA sequence
tgggggtcatggcaggtggg

SEQ ID NO: 72919 - DNA, 20 bp, Artificial
  CRISPR gRNA sequence
ggggtcatggcaggtgggga

SEQ ID NO: 72920 - DNA, 20 bp, Artificial
  CRISPR gRNA sequence
ttgtccccagtgtccaggtg

SEQ ID NO: 72921 - DNA, 20 bp, Artificial
  CRISPR gRNA sequence
tccccagtgtccaggtgaga

SEQ ID NO: 72922 - DNA, 20 bp, Artificial
  CRISPR gRNA sequence
gagagccagcagtgagctgt

SEQ ID NO: 72923 - DNA, 20 bp, Artificial
  CRISPR gRNA sequence
agagccagcagtgagctgtg

SEQ ID NO: 72924 - DNA, 20 bp, Artificial
  CRISPR gRNA sequence
tgactggccagagacttagg

SEQ ID NO: 72925 - DNA, 20 bp, Artificial
  CRISPR gRNA sequence
gccagagacttagggacttg

SEQ ID NO: 72926 - DNA, 20 bp, Artificial
  CRISPR gRNA sequence
agggacttgcaggctgggtg

SEQ ID NO: 72927 - DNA, 20 bp, Artificial
  CRISPR gRNA sequence
gggacttgcaggctgggtgg

SEQ ID NO: 72928 - DNA, 20 bp, Artificial
  CRISPR gRNA sequence
gcaggctgggtggaaacaaa

SEQ ID NO: 72929 - DNA, 20 bp, Artificial
  CRISPR gRNA sequence
caggctgggtggaaacaaat

SEQ ID NO: 72930 - DNA, 20 bp, Artificial
  CRISPR gRNA sequence
ggtggaaacaaatccagagc

SEQ ID NO: 72931 - DNA, 20 bp, Artificial
  CRISPR gRNA sequence
gcccaggaggagtctctaca

SEQ ID NO: 72932 - DNA, 20 bp, Artificial
  CRISPR gRNA sequence
tacatttctttgccaagctt

SEQ ID NO: 72933 - DNA, 20 bp, Artificial
  CRISPR gRNA sequence
catttctttgccaagcttca

SEQ ID NO: 72934 - DNA, 20 bp, Artificial
  CRISPR gRNA sequence
ctttgccaagcttcacctca

SEQ ID NO: 72935 - DNA, 20 bp, Artificial
  CRISPR gRNA sequence
tttgccaagcttcacctcag

SEQ ID NO: 72936 - DNA, 20 bp, Artificial
  CRISPR gRNA sequence
tgccaagcttcacctcagcc

SEQ ID NO: 72937 - DNA, 20 bp, Artificial
  CRISPR gRNA sequence
gccaagcttcacctcagcct

SEQ ID NO: 72938 - DNA, 20 bp, Artificial
  CRISPR gRNA sequence
ccaagcttcacctcagcctc

SEQ ID NO: 72939 - DNA, 20 bp, Artificial
  CRISPR gRNA sequence
cacctcagcctctgtgtcag

SEQ ID NO: 72940 - DNA, 20 bp, Artificial
  CRISPR gRNA sequence
acctcagcctctgtgtcagg

SEQ ID NO: 72941 - DNA, 20 bp, Artificial
  CRISPR gRNA sequence
agcctctgtgtcagggatct

SEQ ID NO: 72942 - DNA, 20 bp, Artificial
  CRISPR gRNA sequence
tgtgtcagggatctccgggc

SEQ ID NO: 72943 - DNA, 20 bp, Artificial
  CRISPR gRNA sequence
tgtcagggatctccgggctg

SEQ ID NO: 72944 - DNA, 20 bp, Artificial
  CRISPR gRNA sequence
cgggctggcccggctgaatg

SEQ ID NO: 72945 - DNA, 20 bp, Artificial
  CRISPR gRNA sequence
gcccggctgaatgccacttt

SEQ ID NO: 72946 - DNA, 20 bp, Artificial
  CRISPR gRNA sequence
aatgccactttcacgtggga

SEQ ID NO: 72947 - DNA, 20 bp, Artificial
  CRISPR gRNA sequence
tcacgtgggattctctgatt

SEQ ID NO: 72948 - DNA, 20 bp, Artificial
  CRISPR gRNA sequence
cacgtgggattctctgattc

SEQ ID NO: 72949 - DNA, 20 bp, Artificial
  CRISPR gRNA sequence
acgtgggattctctgattca

SEQ ID NO: 72950 - DNA, 20 bp, Artificial
  CRISPR gRNA sequence
tctgattcacgcagatcagt

SEQ ID NO: 72951 - DNA, 20 bp, Artificial
  CRISPR gRNA sequence
tgattcacgcagatcagttc

SEQ ID NO: 72952 - DNA, 20 bp, Artificial
  CRISPR gRNA sequence
attcacgcagatcagttctc

SEQ ID NO: 72953 - DNA, 20 bp, Artificial
  CRISPR gRNA sequence
acgcagatcagttctcaggg

SEQ ID NO: 72954 - DNA, 20 bp, Artificial
  CRISPR gRNA sequence
tcaggggcatatgtgttctc

SEQ ID NO: 72955 - DNA, 20 bp, Artificial
  CRISPR gRNA sequence
aggggcatatgtgttctcat

SEQ ID NO: 72956 - DNA, 20 bp, Artificial
  CRISPR gRNA sequence
tcatccatgcaaatggtagg

SEQ ID NO: 72957 - DNA, 20 bp, Artificial
  CRISPR gRNA sequence
atccatgcaaatggtaggtt

SEQ ID NO: 72958 - DNA, 20 bp, Artificial
  CRISPR gRNA sequence
ttccttaaacccagggtatt

SEQ ID NO: 72959 - DNA, 20 bp, Artificial
  CRISPR gRNA sequence
tccttaaacccagggtattg

SEQ ID NO: 72960 - DNA, 20 bp, Artificial
  CRISPR gRNA sequence
ccttaaacccagggtattgt

SEQ ID NO: 72961 - DNA, 20 bp, Artificial
  CRISPR gRNA sequence
cttaaacccagggtattgtc

SEQ ID NO: 72962 - DNA, 20 bp, Artificial
  CRISPR gRNA sequence
aaacccagggtattgtcttt

SEQ ID NO: 72963 - DNA, 20 bp, Artificial
  CRISPR gRNA sequence
aacccagggtattgtcttta

SEQ ID NO: 72964 - DNA, 20 bp, Artificial
  CRISPR gRNA sequence
tctttactgagccctgacct

SEQ ID NO: 72965 - DNA, 20 bp, Artificial
  CRISPR gRNA sequence
tactgagccctgaccttgct

SEQ ID NO: 72966 - DNA, 20 bp, Artificial
  CRISPR gRNA sequence
actgagccctgaccttgctc

SEQ ID NO: 72967 - DNA, 20 bp, Artificial
  CRISPR gRNA sequence
ctgagccctgaccttgctct

SEQ ID NO: 72968 - DNA, 20 bp, Artificial
  CRISPR gRNA sequence
agccctgaccttgctctgcc

SEQ ID NO: 72969 - DNA, 20 bp, Artificial
  CRISPR gRNA sequence
accttgctctgcctgggtag

SEQ ID NO: 72970 - DNA, 20 bp, Artificial
  CRISPR gRNA sequence
gctctgcctgggtaggaaaa

SEQ ID NO: 72971 - DNA, 20 bp, Artificial
  CRISPR gRNA sequence
ctctgcctgggtaggaaaaa

SEQ ID NO: 72972 - DNA, 20 bp, Artificial
  CRISPR gRNA sequence
tgcctgggtaggaaaaaaca

SEQ ID NO: 72973 - DNA, 20 bp, Artificial
  CRISPR gRNA sequence
cctgggtaggaaaaaacaat

SEQ ID NO: 72974 - DNA, 20 bp, Artificial
  CRISPR gRNA sequence
ggtaggaaaaaacaataaat

SEQ ID NO: 72975 - DNA, 20 bp, Artificial
  CRISPR gRNA sequence
aggcaaatggtcttagcccc

SEQ ID NO: 72976 - DNA, 20 bp, Artificial
  CRISPR gRNA sequence
agccccttgggaagtatttg

SEQ ID NO: 72977 - DNA, 20 bp, Artificial
  CRISPR gRNA sequence
gccccttgggaagtatttgt

SEQ ID NO: 72978 - DNA, 20 bp, Artificial
  CRISPR gRNA sequence
gggaagtatttgtttgcatg

SEQ ID NO: 72979 - DNA, 20 bp, Artificial
  CRISPR gRNA sequence
ggaagtatttgtttgcatgt

SEQ ID NO: 72980 - DNA, 20 bp, Artificial
  CRISPR gRNA sequence
gtttgcatgttgtttttact

SEQ ID NO: 72981 - DNA, 20 bp, Artificial
  CRISPR gRNA sequence
tttgcatgttgtttttactt

SEQ ID NO: 72982 - DNA, 20 bp, Artificial
  CRISPR gRNA sequence
gcatgttgtttttactttct

SEQ ID NO: 72983 - DNA, 20 bp, Artificial
  CRISPR gRNA sequence
catgttgtttttactttctt

SEQ ID NO: 72984 - DNA, 20 bp, Artificial
  CRISPR gRNA sequence
tttttactttcttttatttt

SEQ ID NO: 72985 - DNA, 20 bp, Artificial
  CRISPR gRNA sequence
ttactttcttttattttgca

SEQ ID NO: 72986 - DNA, 20 bp, Artificial
  CRISPR gRNA sequence
tactttcttttattttgcaa

SEQ ID NO: 72987 - DNA, 20 bp, Artificial
  CRISPR gRNA sequence
actttcttttattttgcaaa

SEQ ID NO: 72988 - DNA, 20 bp, Artificial
  CRISPR gRNA sequence
ctttcttttattttgcaaat

SEQ ID NO: 72989 - DNA, 20 bp, Artificial
  CRISPR gRNA sequence
tcttttattttgcaaattaa

SEQ ID NO: 72990 - DNA, 20 bp, Artificial
  CRISPR gRNA sequence
cttttattttgcaaattaaa

SEQ ID NO: 72991 - DNA, 20 bp, Artificial
  CRISPR gRNA sequence
ttttattttgcaaattaaat

SEQ ID NO: 72992 - DNA, 20 bp, Artificial
  CRISPR gRNA sequence
ttattttgcaaattaaattt

SEQ ID NO: 72993 - DNA, 20 bp, Artificial
  CRISPR gRNA sequence
tattttgcaaattaaatttt

SEQ ID NO: 72994 - DNA, 20 bp, Artificial
  CRISPR gRNA sequence
attttgcaaattaaatttta

SEQ ID NO: 72995 - DNA, 20 bp, Artificial
  CRISPR gRNA sequence
ttttgcaaattaaattttaa

SEQ ID NO: 72996 - DNA, 20 bp, Artificial
  CRISPR gRNA sequence
tgcaaattaaattttaatgg

SEQ ID NO: 72997 - DNA, 20 bp, Artificial
  CRISPR gRNA sequence
gcaaattaaattttaatggg

SEQ ID NO: 72998 - DNA, 20 bp, Artificial
  CRISPR gRNA sequence
caaattaaattttaatgggg

SEQ ID NO: 72999 - DNA, 20 bp, Artificial
  CRISPR gRNA sequence
aattttaatggggctgggag

SEQ ID NO: 73000 - DNA, 20 bp, Artificial
  CRISPR gRNA sequence
taatggggctgggagcagtg

SEQ ID NO: 73001 - DNA, 20 bp, Artificial
  CRISPR gRNA sequence
aatggggctgggagcagtgg

SEQ ID NO: 73002 - DNA, 20 bp, Artificial
  CRISPR gRNA sequence
atggggctgggagcagtggt

SEQ ID NO: 73003 - DNA, 20 bp, Artificial
  CRISPR gRNA sequence
ggagcagtggttcacacctg

SEQ ID NO: 73004 - DNA, 20 bp, Artificial
  CRISPR gRNA sequence
acacctgtattcccagcact

SEQ ID NO: 73005 - DNA, 20 bp, Artificial
  CRISPR gRNA sequence
tattcccagcactttcggag

SEQ ID NO: 73006 - DNA, 20 bp, Artificial
  CRISPR gRNA sequence
ccagcactttcggagtctag

SEQ ID NO: 73007 - DNA, 20 bp, Artificial
  CRISPR gRNA sequence
tcggagtctaggcaggtgga

SEQ ID NO: 73008 - DNA, 20 bp, Artificial
  CRISPR gRNA sequence
cggagtctaggcaggtggat

SEQ ID NO: 73009 - DNA, 20 bp, Artificial
  CRISPR gRNA sequence
ggagtctaggcaggtggatc

SEQ ID NO: 73010 - DNA, 20 bp, Artificial
  CRISPR gRNA sequence
ggcaggtggatcatttgagg

SEQ ID NO: 73011 - DNA, 20 bp, Artificial
  CRISPR gRNA sequence
gaggtcaggggttcgagacc

SEQ ID NO: 73012 - DNA, 20 bp, Artificial
  CRISPR gRNA sequence
aggtcaggggttcgagacca

SEQ ID NO: 73013 - DNA, 20 bp, Artificial
  CRISPR gRNA sequence
gagaccagcccggccaacat

SEQ ID NO: 73014 - DNA, 20 bp, Artificial
  CRISPR gRNA sequence
gtactaaaaatatacaaaaa

SEQ ID NO: 73015 - DNA, 20 bp, Artificial
  CRISPR gRNA sequence
tactaaaaatatacaaaaat

SEQ ID NO: 73016 - DNA, 20 bp, Artificial
  CRISPR gRNA sequence
aaaatatacaaaaattatct

SEQ ID NO: 73017 - DNA, 20 bp, Artificial
  CRISPR gRNA sequence
tctgggcgtggtggtgcata

SEQ ID NO: 73018 - DNA, 20 bp, Artificial
  CRISPR gRNA sequence
ggcgtggtggtgcatacctg

SEQ ID NO: 73019 - DNA, 20 bp, Artificial
  CRISPR gRNA sequence
taatcccagctacttgggcg

SEQ ID NO: 73020 - DNA, 20 bp, Artificial
  CRISPR gRNA sequence
cttgggcggctgaggcacca

SEQ ID NO: 73021 - DNA, 20 bp, Artificial
  CRISPR gRNA sequence
gggcggctgaggcaccagaa

SEQ ID NO: 73022 - DNA, 20 bp, Artificial
  CRISPR gRNA sequence
ggcggctgaggcaccagaat

SEQ ID NO: 73023 - DNA, 20 bp, Artificial
  CRISPR gRNA sequence
aggcaccagaatcgcttgaa

SEQ ID NO: 73024 - DNA, 20 bp, Artificial
  CRISPR gRNA sequence
gaacccaggaggcagaggtt

SEQ ID NO: 73025 - DNA, 20 bp, Artificial
  CRISPR gRNA sequence
aacccaggaggcagaggttg

SEQ ID NO: 73026 - DNA, 20 bp, Artificial
  CRISPR gRNA sequence
cagtgaagtgagatcatgcc

SEQ ID NO: 73027 - DNA, 20 bp, Artificial
  CRISPR gRNA sequence
cactccagcctgggcgacag

SEQ ID NO: 73028 - DNA, 20 bp, Artificial
  CRISPR gRNA sequence
cagcctgggcgacagagtga

SEQ ID NO: 73029 - DNA, 20 bp, Artificial
  CRISPR gRNA sequence
ggcgacagagtgagactgtg

SEQ ID NO: 73030 - DNA, 20 bp, Artificial
  CRISPR gRNA sequence
tgtctcaaaaaataaaaata

SEQ ID NO: 73031 - DNA, 20 bp, Artificial
  CRISPR gRNA sequence
aaaaaataaaaataaaatag

SEQ ID NO: 73032 - DNA, 20 bp, Artificial
  CRISPR gRNA sequence
taatggatcacctttcagta

SEQ ID NO: 73033 - DNA, 20 bp, Artificial
  CRISPR gRNA sequence
aatggatcacctttcagtaa

SEQ ID NO: 73034 - DNA, 20 bp, Artificial
  CRISPR gRNA sequence
atggatcacctttcagtaaa

SEQ ID NO: 73035 - DNA, 20 bp, Artificial
  CRISPR gRNA sequence
tcagtaaattaattttgggt

SEQ ID NO: 73036 - DNA, 20 bp, Artificial
  CRISPR gRNA sequence
cagtaaattaattttgggtg

SEQ ID NO: 73037 - DNA, 20 bp, Artificial
  CRISPR gRNA sequence
agtaaattaattttgggtga

SEQ ID NO: 73038 - DNA, 20 bp, Artificial
  CRISPR gRNA sequence
attttgggtgaaatggtcca

SEQ ID NO: 73039 - DNA, 20 bp, Artificial
  CRISPR gRNA sequence
tgggtgaaatggtccaatat

SEQ ID NO: 73040 - DNA, 20 bp, Artificial
  CRISPR gRNA sequence
gggtgaaatggtccaatatg

SEQ ID NO: 73041 - DNA, 20 bp, Artificial
  CRISPR gRNA sequence
ggtgaaatggtccaatatga

SEQ ID NO: 73042 - DNA, 20 bp, Artificial
  CRISPR gRNA sequence
ctggaactctctaacctcat

SEQ ID NO: 73043 - DNA, 20 bp, Artificial
  CRISPR gRNA sequence
gaactctctaacctcatttc

SEQ ID NO: 73044 - DNA, 20 bp, Artificial
  CRISPR gRNA sequence
tctaacctcatttcctacct

SEQ ID NO: 73045 - DNA, 20 bp, Artificial
  CRISPR gRNA sequence
taacctcatttcctacctac

SEQ ID NO: 73046 - DNA, 20 bp, Artificial
  CRISPR gRNA sequence
acctcatttcctacctactc

SEQ ID NO: 73047 - DNA, 20 bp, Artificial
  CRISPR gRNA sequence
atttcctacctactctgctc

SEQ ID NO: 73048 - DNA, 20 bp, Artificial
  CRISPR gRNA sequence
cctacctactctgctctgcc

SEQ ID NO: 73049 - DNA, 20 bp, Artificial
  CRISPR gRNA sequence
ctacctactctgctctgccc

SEQ ID NO: 73050 - DNA, 20 bp, Artificial
  CRISPR gRNA sequence
cctactctgctctgcccgag

SEQ ID NO: 73051 - DNA, 20 bp, Artificial
  CRISPR gRNA sequence
ctctgctctgcccgaggtag

SEQ ID NO: 73052 - DNA, 20 bp, Artificial
  CRISPR gRNA sequence
tgctctgcccgaggtagggg

SEQ ID NO: 73053 - DNA, 20 bp, Artificial
  CRISPR gRNA sequence
ctctgcccgaggtagggggt

SEQ ID NO: 73054 - DNA, 20 bp, Artificial
  CRISPR gRNA sequence
tgcccgaggtagggggtagg

SEQ ID NO: 73055 - DNA, 20 bp, Artificial
  CRISPR gRNA sequence
cccgaggtagggggtaggag

SEQ ID NO: 73056 - DNA, 20 bp, Artificial
  CRISPR gRNA sequence
ggatataaacaaagcaatgc

SEQ ID NO: 73057 - DNA, 20 bp, Artificial
  CRISPR gRNA sequence
gatataaacaaagcaatgct

SEQ ID NO: 73058 - DNA, 20 bp, Artificial
  CRISPR gRNA sequence
tgtgtcactgcttggatttg

SEQ ID NO: 73059 - DNA, 20 bp, Artificial
  CRISPR gRNA sequence
gtgtcactgcttggatttgt

SEQ ID NO: 73060 - DNA, 20 bp, Artificial
  CRISPR gRNA sequence
tgtcactgcttggatttgtt

SEQ ID NO: 73061 - DNA, 20 bp, Artificial
  CRISPR gRNA sequence
cttggatttgtttttagtca

SEQ ID NO: 73062 - DNA, 20 bp, Artificial
  CRISPR gRNA sequence
ggatttgtttttagtcacaa

SEQ ID NO: 73063 - DNA, 20 bp, Artificial
  CRISPR gRNA sequence
gatttgtttttagtcacaag

SEQ ID NO: 73064 - DNA, 20 bp, Artificial
  CRISPR gRNA sequence
gtttttagtcacaagatttc

SEQ ID NO: 73065 - DNA, 20 bp, Artificial
  CRISPR gRNA sequence
tttttagtcacaagatttca

SEQ ID NO: 73066 - DNA, 20 bp, Artificial
  CRISPR gRNA sequence
ttagtcacaagatttcatgt

SEQ ID NO: 73067 - DNA, 20 bp, Artificial
  CRISPR gRNA sequence
tagtcacaagatttcatgtt

SEQ ID NO: 73068 - DNA, 20 bp, Artificial
  CRISPR gRNA sequence
agtcacaagatttcatgttt

SEQ ID NO: 73069 - DNA, 20 bp, Artificial
  CRISPR gRNA sequence
gtcacaagatttcatgtttt

SEQ ID NO: 73070 - DNA, 20 bp, Artificial
  CRISPR gRNA sequence
catgttttgaaaaatcacat

SEQ ID NO: 73071 - DNA, 20 bp, Artificial
  CRISPR gRNA sequence
atgttttgaaaaatcacatt

SEQ ID NO: 73072 - DNA, 20 bp, Artificial
  CRISPR gRNA sequence
tgaaaaatcacattgaaagt

SEQ ID NO: 73073 - DNA, 20 bp, Artificial
  CRISPR gRNA sequence
gaaaaatcacattgaaagta

SEQ ID NO: 73074 - DNA, 20 bp, Artificial
  CRISPR gRNA sequence
aaaaatcacattgaaagtaa

SEQ ID NO: 73075 - DNA, 20 bp, Artificial
  CRISPR gRNA sequence
aaagtaagtgtcatgtttat

SEQ ID NO: 73076 - DNA, 20 bp, Artificial
  CRISPR gRNA sequence
atttatcctagcagcaggga

SEQ ID NO: 73077 - DNA, 20 bp, Artificial
  CRISPR gRNA sequence
tttatcctagcagcagggag

SEQ ID NO: 73078 - DNA, 20 bp, Artificial
  CRISPR gRNA sequence
atcctagcagcagggagtga

SEQ ID NO: 73079 - DNA, 20 bp, Artificial
  CRISPR gRNA sequence
tcctagcagcagggagtgaa

SEQ ID NO: 73080 - DNA, 20 bp, Artificial
  CRISPR gRNA sequence
gcagcagggagtgaaatcac

SEQ ID NO: 73081 - DNA, 20 bp, Artificial
  CRISPR gRNA sequence
agtctagacccacactactc

SEQ ID NO: 73082 - DNA, 20 bp, Artificial
  CRISPR gRNA sequence
gacccacactactcaaagtg

SEQ ID NO: 73083 - DNA, 20 bp, Artificial
  CRISPR gRNA sequence
ctcaaagtgctgaccgtggc

SEQ ID NO: 73084 - DNA, 20 bp, Artificial
  CRISPR gRNA sequence
aaagtgctgaccgtggcccc

SEQ ID NO: 73085 - DNA, 20 bp, Artificial
  CRISPR gRNA sequence
accgtggcccccagaattga

SEQ ID NO: 73086 - DNA, 20 bp, Artificial
  CRISPR gRNA sequence
ataccacccggaagcttgtt

SEQ ID NO: 73087 - DNA, 20 bp, Artificial
  CRISPR gRNA sequence
gttagaaaatgcagagtctg

SEQ ID NO: 73088 - DNA, 20 bp, Artificial
  CRISPR gRNA sequence
ttagaaaatgcagagtctga

SEQ ID NO: 73089 - DNA, 20 bp, Artificial
  CRISPR gRNA sequence
gaaaatgcagagtctgaagc

SEQ ID NO: 73090 - DNA, 20 bp, Artificial
  CRISPR gRNA sequence
aagccaggcgtggtggctca

SEQ ID NO: 73091 - DNA, 20 bp, Artificial
  CRISPR gRNA sequence
acgcctgtaatcccagcact

SEQ ID NO: 73092 - DNA, 20 bp, Artificial
  CRISPR gRNA sequence
taatcccagcactttgggag

SEQ ID NO: 73093 - DNA, 20 bp, Artificial
  CRISPR gRNA sequence
tgggaggccgaggtgggcag

SEQ ID NO: 73094 - DNA, 20 bp, Artificial
  CRISPR gRNA sequence
gggaggccgaggtgggcaga

SEQ ID NO: 73095 - DNA, 20 bp, Artificial
  CRISPR gRNA sequence
ggaggccgaggtgggcagat

SEQ ID NO: 73096 - DNA, 20 bp, Artificial
  CRISPR gRNA sequence
aggttggacgttcaagacca

SEQ ID NO: 73097 - DNA, 20 bp, Artificial
  CRISPR gRNA sequence
gacgttcaagaccagcctga

SEQ ID NO: 73098 - DNA, 20 bp, Artificial
  CRISPR gRNA sequence
aagaccagcctgaccaacat

SEQ ID NO: 73099 - DNA, 20 bp, Artificial
  CRISPR gRNA sequence
accaacatggagaaacactg

SEQ ID NO: 73100 - DNA, 20 bp, Artificial
  CRISPR gRNA sequence
tctctaccaaaaatacaaaa

SEQ ID NO: 73101 - DNA, 20 bp, Artificial
  CRISPR gRNA sequence
taccaaaaatacaaaaatta

SEQ ID NO: 73102 - DNA, 20 bp, Artificial
  CRISPR gRNA sequence
ccaaaaatacaaaaattagc

SEQ ID NO: 73103 - DNA, 20 bp, Artificial
  CRISPR gRNA sequence
gccgggcgtggtggcacatg

SEQ ID NO: 73104 - DNA, 20 bp, Artificial
  CRISPR gRNA sequence
taatcccggctactcgggag

SEQ ID NO: 73105 - DNA, 20 bp, Artificial
  CRISPR gRNA sequence
ctcgggaggctgaggcagga

SEQ ID NO: 73106 - DNA, 20 bp, Artificial
  CRISPR gRNA sequence
gggaggctgaggcaggagaa

SEQ ID NO: 73107 - DNA, 20 bp, Artificial
  CRISPR gRNA sequence
aggcaggagaatcgcttgaa

SEQ ID NO: 73108 - DNA, 20 bp, Artificial
  CRISPR gRNA sequence
gaacccgggaggcggaggtt

SEQ ID NO: 73109 - DNA, 20 bp, Artificial
  CRISPR gRNA sequence
aacccgggaggcggaggttg

SEQ ID NO: 73110 - DNA, 20 bp, Artificial
  CRISPR gRNA sequence
cagtgagctgagattgtgcc

SEQ ID NO: 73111 - DNA, 20 bp, Artificial
  CRISPR gRNA sequence
agattgtgccattgcactcc

SEQ ID NO: 73112 - DNA, 20 bp, Artificial
  CRISPR gRNA sequence
tgccattgcactccagcctg

SEQ ID NO: 73113 - DNA, 20 bp, Artificial
  CRISPR gRNA sequence
cactccagcctgggcaacaa

SEQ ID NO: 73114 - DNA, 20 bp, Artificial
  CRISPR gRNA sequence
cagcctgggcaacaagagcg

SEQ ID NO: 73115 - DNA, 20 bp, Artificial
  CRISPR gRNA sequence
ggcaacaagagcgaaactct

SEQ ID NO: 73116 - DNA, 20 bp, Artificial
  CRISPR gRNA sequence
tgtctcaaaaacaaacaaac

SEQ ID NO: 73117 - DNA, 20 bp, Artificial
  CRISPR gRNA sequence
tctcaaaaacaaacaaacaa

SEQ ID NO: 73118 - DNA, 20 bp, Artificial
  CRISPR gRNA sequence
aaaaacaaacaaacaaaaaa

SEQ ID NO: 73119 - DNA, 20 bp, Artificial
  CRISPR gRNA sequence
agtttgggtgcaacgcctta

SEQ ID NO: 73120 - DNA, 20 bp, Artificial
  CRISPR gRNA sequence
gggtgcaacgccttaggcct

SEQ ID NO: 73121 - DNA, 20 bp, Artificial
  CRISPR gRNA sequence
ggtgcaacgccttaggcctg

SEQ ID NO: 73122 - DNA, 20 bp, Artificial
  CRISPR gRNA sequence
aggcctgtagtcccagctgc

SEQ ID NO: 73123 - DNA, 20 bp, Artificial
  CRISPR gRNA sequence
ggcctgtagtcccagctgct

SEQ ID NO: 73124 - DNA, 20 bp, Artificial
  CRISPR gRNA sequence
tagtcccagctgcttaggag

SEQ ID NO: 73125 - DNA, 20 bp, Artificial
  CRISPR gRNA sequence
cttaggagggtgaggcagga

SEQ ID NO: 73126 - DNA, 20 bp, Artificial
  CRISPR gRNA sequence
aggagggtgaggcaggagga

SEQ ID NO: 73127 - DNA, 20 bp, Artificial
  CRISPR gRNA sequence
ggagggtgaggcaggaggat

SEQ ID NO: 73128 - DNA, 20 bp, Artificial
  CRISPR gRNA sequence
gcccaggagtttgaggctgc

SEQ ID NO: 73129 - DNA, 20 bp, Artificial
  CRISPR gRNA sequence
gaggctgcagtgcaacacga

SEQ ID NO: 73130 - DNA, 20 bp, Artificial
  CRISPR gRNA sequence
aggctgcagtgcaacacgat

SEQ ID NO: 73131 - DNA, 20 bp, Artificial
  CRISPR gRNA sequence
cagtgcaacacgattgcacc

SEQ ID NO: 73132 - DNA, 20 bp, Artificial
  CRISPR gRNA sequence
cacctgtgcattgccactgc

SEQ ID NO: 73133 - DNA, 20 bp, Artificial
  CRISPR gRNA sequence
tgcattgccactgcactcca

SEQ ID NO: 73134 - DNA, 20 bp, Artificial
  CRISPR gRNA sequence
ccactgcactccagcctggg

SEQ ID NO: 73135 - DNA, 20 bp, Artificial
  CRISPR gRNA sequence
cactccagcctgggccacac

SEQ ID NO: 73136 - DNA, 20 bp, Artificial
  CRISPR gRNA sequence
cagcctgggccacacagtga

SEQ ID NO: 73137 - DNA, 20 bp, Artificial
  CRISPR gRNA sequence
ggccacacagtgaggcccca

SEQ ID NO: 73138 - DNA, 20 bp, Artificial
  CRISPR gRNA sequence
aaaaaaaaaaaaaaaaaaaa

SEQ ID NO: 73139 - DNA, 20 bp, Artificial
  CRISPR gRNA sequence
ggcagaattccagacctggg

SEQ ID NO: 73140 - DNA, 20 bp, Artificial
  CRISPR gRNA sequence
cagacctggggaatcagaat

SEQ ID NO: 73141 - DNA, 20 bp, Artificial
  CRISPR gRNA sequence
gggaatcagaatgagcattt

SEQ ID NO: 73142 - DNA, 20 bp, Artificial
  CRISPR gRNA sequence
taacaagagcccagggtgaa

SEQ ID NO: 73143 - DNA, 20 bp, Artificial
  CRISPR gRNA sequence
aacaagagcccagggtgaac

SEQ ID NO: 73144 - DNA, 20 bp, Artificial
  CRISPR gRNA sequence
acaagagcccagggtgaact

SEQ ID NO: 73145 - DNA, 20 bp, Artificial
  CRISPR gRNA sequence
tgtgtgtgcctcaagggttg

SEQ ID NO: 73146 - DNA, 20 bp, Artificial
  CRISPR gRNA sequence
aagggttgttctacgacgtg

SEQ ID NO: 73147 - DNA, 20 bp, Artificial
  CRISPR gRNA sequence
ttctacgacgtgggcctaag

SEQ ID NO: 73148 - DNA, 20 bp, Artificial
  CRISPR gRNA sequence
tacgacgtgggcctaagccc

SEQ ID NO: 73149 - DNA, 20 bp, Artificial
  CRISPR gRNA sequence
cgacgtgggcctaagccctt

SEQ ID NO: 73150 - DNA, 20 bp, Artificial
  CRISPR gRNA sequence
agccctttaggccacttttg

SEQ ID NO: 73151 - DNA, 20 bp, Artificial
  CRISPR gRNA sequence
taggccacttttgtaaccag

SEQ ID NO: 73152 - DNA, 20 bp, Artificial
  CRISPR gRNA sequence
aggccacttttgtaaccagg

SEQ ID NO: 73153 - DNA, 20 bp, Artificial
  CRISPR gRNA sequence
ggccacttttgtaaccagga

SEQ ID NO: 73154 - DNA, 20 bp, Artificial
  CRISPR gRNA sequence
ttgtaaccaggaggaagctg

SEQ ID NO: 73155 - DNA, 20 bp, Artificial
  CRISPR gRNA sequence
tgtaaccaggaggaagctga

SEQ ID NO: 73156 - DNA, 20 bp, Artificial
  CRISPR gRNA sequence
gtaaccaggaggaagctgat

SEQ ID NO: 73157 - DNA, 20 bp, Artificial
  CRISPR gRNA sequence
taaccaggaggaagctgatg

SEQ ID NO: 73158 - DNA, 20 bp, Artificial
  CRISPR gRNA sequence
atggcattagaaggcaagag

SEQ ID NO: 73159 - DNA, 20 bp, Artificial
  CRISPR gRNA sequence
gaaggcaagagcagtgggca

SEQ ID NO: 73160 - DNA, 20 bp, Artificial
  CRISPR gRNA sequence
ggagggcacagggatgggcc

SEQ ID NO: 73161 - DNA, 20 bp, Artificial
  CRISPR gRNA sequence
ggagggatccgcaaaggatc

SEQ ID NO: 73162 - DNA, 20 bp, Artificial
  CRISPR gRNA sequence
ggaggtggcctcagtgcttc

SEQ ID NO: 73163 - DNA, 20 bp, Artificial
  CRISPR gRNA sequence
agtgcttccctggatgtggt

SEQ ID NO: 73164 - DNA, 20 bp, Artificial
  CRISPR gRNA sequence
ccctggatgtggtcccaact

SEQ ID NO: 73165 - DNA, 20 bp, Artificial
  CRISPR gRNA sequence
cctggatgtggtcccaactg

SEQ ID NO: 73166 - DNA, 20 bp, Artificial
  CRISPR gRNA sequence
gatgtggtcccaactgagtg

SEQ ID NO: 73167 - DNA, 20 bp, Artificial
  CRISPR gRNA sequence
agtgggaagtgtttcttccc

SEQ ID NO: 73168 - DNA, 20 bp, Artificial
  CRISPR gRNA sequence
cttcccactcattcccatgg

SEQ ID NO: 73169 - DNA, 20 bp, Artificial
  CRISPR gRNA sequence
ttcccactcattcccatggg

SEQ ID NO: 73170 - DNA, 20 bp, Artificial
  CRISPR gRNA sequence
cccactcattcccatggggc

SEQ ID NO: 73171 - DNA, 20 bp, Artificial
  CRISPR gRNA sequence
ccactcattcccatggggcc

SEQ ID NO: 73172 - DNA, 20 bp, Artificial
  CRISPR gRNA sequence
attcccatggggccgctcgg

SEQ ID NO: 73173 - DNA, 20 bp, Artificial
  CRISPR gRNA sequence
ccatggggccgctcggtcac

SEQ ID NO: 73174 - DNA, 20 bp, Artificial
  CRISPR gRNA sequence
ggtcactcacctgaggctct

SEQ ID NO: 73175 - DNA, 20 bp, Artificial
  CRISPR gRNA sequence
acctgaggctctgcaggcag

SEQ ID NO: 73176 - DNA, 20 bp, Artificial
  CRISPR gRNA sequence
aggctctgcaggcaggtcat

SEQ ID NO: 73177 - DNA, 20 bp, Artificial
  CRISPR gRNA sequence
tgcaggcaggtcatctggct

SEQ ID NO: 73178 - DNA, 20 bp, Artificial
  CRISPR gRNA sequence
caggcaggtcatctggctta

SEQ ID NO: 73179 - DNA, 20 bp, Artificial
  CRISPR gRNA sequence
gcttagtctgtgagtaagca

SEQ ID NO: 73180 - DNA, 20 bp, Artificial
  CRISPR gRNA sequence
agtctgtgagtaagcaaggc

SEQ ID NO: 73181 - DNA, 20 bp, Artificial
  CRISPR gRNA sequence
gtctgtgagtaagcaaggcc

SEQ ID NO: 73182 - DNA, 20 bp, Artificial
  CRISPR gRNA sequence
tgagtaagcaaggccaaggt

SEQ ID NO: 73183 - DNA, 20 bp, Artificial
  CRISPR gRNA sequence
ttcagcagaaggtgactgag

SEQ ID NO: 73184 - DNA, 20 bp, Artificial
  CRISPR gRNA sequence
agcagaaggtgactgaggct

SEQ ID NO: 73185 - DNA, 20 bp, Artificial
  CRISPR gRNA sequence
aggctggagaagaggaggcc

SEQ ID NO: 73186 - DNA, 20 bp, Artificial
  CRISPR gRNA sequence
gagaagaggaggccaggtga

SEQ ID NO: 73187 - DNA, 20 bp, Artificial
  CRISPR gRNA sequence
gacatctgggggtggggcac

SEQ ID NO: 73188 - DNA, 20 bp, Artificial
  CRISPR gRNA sequence
acatctgggggtggggcact

SEQ ID NO: 73189 - DNA, 20 bp, Artificial
  CRISPR gRNA sequence
ggggtggggcactgtccagt

SEQ ID NO: 73190 - DNA, 20 bp, Artificial
  CRISPR gRNA sequence
tccagtctgggggtctgagg

SEQ ID NO: 73191 - DNA, 20 bp, Artificial
  CRISPR gRNA sequence
ggggtctgaggcctctgtgc

SEQ ID NO: 73192 - DNA, 20 bp, Artificial
  CRISPR gRNA sequence
aggcctctgtgcttagcaag

SEQ ID NO: 73193 - DNA, 20 bp, Artificial
  CRISPR gRNA sequence
tgtgcttagcaagcctaggg

SEQ ID NO: 73194 - DNA, 20 bp, Artificial
  CRISPR gRNA sequence
tgcttagcaagcctagggac

SEQ ID NO: 73195 - DNA, 20 bp, Artificial
  CRISPR gRNA sequence
agcaagcctagggacctcca

SEQ ID NO: 73196 - DNA, 20 bp, Artificial
  CRISPR gRNA sequence
gcaagcctagggacctccaa

SEQ ID NO: 73197 - DNA, 20 bp, Artificial
  CRISPR gRNA sequence
gggacctccaagacagccac

SEQ ID NO: 73198 - DNA, 20 bp, Artificial
  CRISPR gRNA sequence
caagacagccacttatatcc

SEQ ID NO: 73199 - DNA, 20 bp, Artificial
  CRISPR gRNA sequence
atatccacacagtgtaaaaa

SEQ ID NO: 73200 - DNA, 20 bp, Artificial
  CRISPR gRNA sequence
tatccacacagtgtaaaaat

SEQ ID NO: 73201 - DNA, 20 bp, Artificial
  CRISPR gRNA sequence
tacaaaatgaactgtactgg

SEQ ID NO: 73202 - DNA, 20 bp, Artificial
  CRISPR gRNA sequence
caaaatgaactgtactggga

SEQ ID NO: 73203 - DNA, 20 bp, Artificial
  CRISPR gRNA sequence
tactgggaggtccaaatgct

SEQ ID NO: 73204 - DNA, 20 bp, Artificial
  CRISPR gRNA sequence
ggaggtccaaatgctgtttc

SEQ ID NO: 73205 - DNA, 20 bp, Artificial
  CRISPR gRNA sequence
tttctctgcatgaattactg

SEQ ID NO: 73206 - DNA, 20 bp, Artificial
  CRISPR gRNA sequence
ctctgcatgaattactgagg

SEQ ID NO: 73207 - DNA, 20 bp, Artificial
  CRISPR gRNA sequence
tctgcatgaattactgaggt

SEQ ID NO: 73208 - DNA, 20 bp, Artificial
  CRISPR gRNA sequence
tgcatgaattactgaggtca

SEQ ID NO: 73209 - DNA, 20 bp, Artificial
  CRISPR gRNA sequence
catgaattactgaggtcagg

SEQ ID NO: 73210 - DNA, 20 bp, Artificial
  CRISPR gRNA sequence
ctgaggtcaggcaggcagca

SEQ ID NO: 73211 - DNA, 20 bp, Artificial
  CRISPR gRNA sequence
aggtcaggcaggcagcagtt

SEQ ID NO: 73212 - DNA, 20 bp, Artificial
  CRISPR gRNA sequence
tatgttctgaaccacatgga

SEQ ID NO: 73213 - DNA, 20 bp, Artificial
  CRISPR gRNA sequence
tgttctgaaccacatggacc

SEQ ID NO: 73214 - DNA, 20 bp, Artificial
  CRISPR gRNA sequence
tgaaccacatggaccaagac

SEQ ID NO: 73215 - DNA, 20 bp, Artificial
  CRISPR gRNA sequence
aaccacatggaccaagacta

SEQ ID NO: 73216 - DNA, 20 bp, Artificial
  CRISPR gRNA sequence
atgatccgtaataatggcgg

SEQ ID NO: 73217 - DNA, 20 bp, Artificial
  CRISPR gRNA sequence
atcataaaatgtgggccaaa

SEQ ID NO: 73218 - DNA, 20 bp, Artificial
  CRISPR gRNA sequence
agggcttggggccatctgga

SEQ ID NO: 73219 - DNA, 20 bp, Artificial
  CRISPR gRNA sequence
ggggccatctggaaaggtgg

SEQ ID NO: 73220 - DNA, 20 bp, Artificial
  CRISPR gRNA sequence
gggccatctggaaaggtggg

SEQ ID NO: 73221 - DNA, 20 bp, Artificial
  CRISPR gRNA sequence
gaaaggtgggtttattatcg

SEQ ID NO: 73222 - DNA, 20 bp, Artificial
  CRISPR gRNA sequence
attatcgtccccattttaca

SEQ ID NO: 73223 - DNA, 20 bp, Artificial
  CRISPR gRNA sequence
ttatcgtccccattttacag

SEQ ID NO: 73224 - DNA, 20 bp, Artificial
  CRISPR gRNA sequence
tcgtccccattttacaggtg

SEQ ID NO: 73225 - DNA, 20 bp, Artificial
  CRISPR gRNA sequence
tacaggtgaggaacaccaag

SEQ ID NO: 73226 - DNA, 20 bp, Artificial
  CRISPR gRNA sequence
acaggtgaggaacaccaagg

SEQ ID NO: 73227 - DNA, 20 bp, Artificial
  CRISPR gRNA sequence
caggtgaggaacaccaaggt

SEQ ID NO: 73228 - DNA, 20 bp, Artificial
  CRISPR gRNA sequence
agagagttagagaacttgct

SEQ ID NO: 73229 - DNA, 20 bp, Artificial
  CRISPR gRNA sequence
gagaacttgcttaaggtcat

SEQ ID NO: 73230 - DNA, 20 bp, Artificial
  CRISPR gRNA sequence
gcttaaggtcatacacaaag

SEQ ID NO: 73231 - DNA, 20 bp, Artificial
  CRISPR gRNA sequence
cttaaggtcatacacaaagt

SEQ ID NO: 73232 - DNA, 20 bp, Artificial
  CRISPR gRNA sequence
aaggtcatacacaaagtggc

SEQ ID NO: 73233 - DNA, 20 bp, Artificial
  CRISPR gRNA sequence
aggtcatacacaaagtggct

SEQ ID NO: 73234 - DNA, 20 bp, Artificial
  CRISPR gRNA sequence
cttcaggaacagaaccaaaa

SEQ ID NO: 73235 - DNA, 20 bp, Artificial
  CRISPR gRNA sequence
caggaacagaaccaaaaact

SEQ ID NO: 73236 - DNA, 20 bp, Artificial
  CRISPR gRNA sequence
aggaacagaaccaaaaacta

SEQ ID NO: 73237 - DNA, 20 bp, Artificial
  CRISPR gRNA sequence
tagaactcccattcctgagc

SEQ ID NO: 73238 - DNA, 20 bp, Artificial
  CRISPR gRNA sequence
ccattcctgagccccaacca

SEQ ID NO: 73239 - DNA, 20 bp, Artificial
  CRISPR gRNA sequence
ctgagccccaaccatatgtg

SEQ ID NO: 73240 - DNA, 20 bp, Artificial
  CRISPR gRNA sequence
agccccaaccatatgtgacc

SEQ ID NO: 73241 - DNA, 20 bp, Artificial
  CRISPR gRNA sequence
tacttctagaggcccccagc

SEQ ID NO: 73242 - DNA, 20 bp, Artificial
  CRISPR gRNA sequence
ctagaggcccccagcctagg

SEQ ID NO: 73243 - DNA, 20 bp, Artificial
  CRISPR gRNA sequence
tagaggcccccagcctaggc

SEQ ID NO: 73244 - DNA, 20 bp, Artificial
  CRISPR gRNA sequence
gaggcccccagcctaggcag

SEQ ID NO: 73245 - DNA, 20 bp, Artificial
  CRISPR gRNA sequence
ggcaggagaggagaataaca

SEQ ID NO: 73246 - DNA, 20 bp, Artificial
  CRISPR gRNA sequence
gcacttgtagagtgtgaact

SEQ ID NO: 73247 - DNA, 20 bp, Artificial
  CRISPR gRNA sequence
gtagagtgtgaactctgacc

SEQ ID NO: 73248 - DNA, 20 bp, Artificial
  CRISPR gRNA sequence
tagagtgtgaactctgacca

SEQ ID NO: 73249 - DNA, 20 bp, Artificial
  CRISPR gRNA sequence
tgaccagactctaagactgt

SEQ ID NO: 73250 - DNA, 20 bp, Artificial
  CRISPR gRNA sequence
accagactctaagactgtaa

SEQ ID NO: 73251 - DNA, 20 bp, Artificial
  CRISPR gRNA sequence
taagactgtaacacatatta

SEQ ID NO: 73252 - DNA, 20 bp, Artificial
  CRISPR gRNA sequence
agactgtaacacatattatc

SEQ ID NO: 73253 - DNA, 20 bp, Artificial
  CRISPR gRNA sequence
taacacatattatctcattt

SEQ ID NO: 73254 - DNA, 20 bp, Artificial
  CRISPR gRNA sequence
tctcatttaatactcacaac

SEQ ID NO: 73255 - DNA, 20 bp, Artificial
  CRISPR gRNA sequence
atttaatactcacaacaacc

SEQ ID NO: 73256 - DNA, 20 bp, Artificial
  CRISPR gRNA sequence
aatactcacaacaaccgtag

SEQ ID NO: 73257 - DNA, 20 bp, Artificial
  CRISPR gRNA sequence
atactcacaacaaccgtagc

SEQ ID NO: 73258 - DNA, 20 bp, Artificial
  CRISPR gRNA sequence
acaacaaccgtagcagggga

SEQ ID NO: 73259 - DNA, 20 bp, Artificial
  CRISPR gRNA sequence
ctcttatcctcaaagttaag

SEQ ID NO: 73260 - DNA, 20 bp, Artificial
  CRISPR gRNA sequence
ttatcctcaaagttaagatg

SEQ ID NO: 73261 - DNA, 20 bp, Artificial
  CRISPR gRNA sequence
atcctcaaagttaagatgag

SEQ ID NO: 73262 - DNA, 20 bp, Artificial
  CRISPR gRNA sequence
tcctcaaagttaagatgagg

SEQ ID NO: 73263 - DNA, 20 bp, Artificial
  CRISPR gRNA sequence
aaagttaagatgaggaggcc

SEQ ID NO: 73264 - DNA, 20 bp, Artificial
  CRISPR gRNA sequence
agatgaggaggccaaagaac

SEQ ID NO: 73265 - DNA, 20 bp, Artificial
  CRISPR gRNA sequence
agggactggcacgagttcac

SEQ ID NO: 73266 - DNA, 20 bp, Artificial
  CRISPR gRNA sequence
gcacgagttcacacattaag

SEQ ID NO: 73267 - DNA, 20 bp, Artificial
  CRISPR gRNA sequence
acacattaagaaacagaact

SEQ ID NO: 73268 - DNA, 20 bp, Artificial
  CRISPR gRNA sequence
agaaacagaactggctgggc

SEQ ID NO: 73269 - DNA, 20 bp, Artificial
  CRISPR gRNA sequence
gctgggcgcaatggctcatg

SEQ ID NO: 73270 - DNA, 20 bp, Artificial
  CRISPR gRNA sequence
ggcgcaatggctcatgcctg

SEQ ID NO: 73271 - DNA, 20 bp, Artificial
  CRISPR gRNA sequence
atgcctgtaatcccaggact

SEQ ID NO: 73272 - DNA, 20 bp, Artificial
  CRISPR gRNA sequence
taatcccaggactttgtgag

SEQ ID NO: 73273 - DNA, 20 bp, Artificial
  CRISPR gRNA sequence
tgtgaggccaaggcgggtga

SEQ ID NO: 73274 - DNA, 20 bp, Artificial
  CRISPR gRNA sequence
gtgaggccaaggcgggtgaa

SEQ ID NO: 73275 - DNA, 20 bp, Artificial
  CRISPR gRNA sequence
tgaggccaaggcgggtgaat

SEQ ID NO: 73276 - DNA, 20 bp, Artificial
  CRISPR gRNA sequence
aggtcaggagttcgagacca

SEQ ID NO: 73277 - DNA, 20 bp, Artificial
  CRISPR gRNA sequence
gagaccagcctggccaacaa

SEQ ID NO: 73278 - DNA, 20 bp, Artificial
  CRISPR gRNA sequence
gccaacaaagtgaaacccca

SEQ ID NO: 73279 - DNA, 20 bp, Artificial
  CRISPR gRNA sequence
cactaaaaatagaaaaatta

SEQ ID NO: 73280 - DNA, 20 bp, Artificial
  CRISPR gRNA sequence
aaaatagaaaaattagctgg

SEQ ID NO: 73281 - DNA, 20 bp, Artificial
  CRISPR gRNA sequence
gctgggcctggtggcatgtg

SEQ ID NO: 73282 - DNA, 20 bp, Artificial
  CRISPR gRNA sequence
ggcctggtggcatgtgcctg

SEQ ID NO: 73283 - DNA, 20 bp, Artificial
  CRISPR gRNA sequence
gtggcatgtgcctgtaatgc

SEQ ID NO: 73284 - DNA, 20 bp, Artificial
  CRISPR gRNA sequence
taatgccagctacttgggag

SEQ ID NO: 73285 - DNA, 20 bp, Artificial
  CRISPR gRNA sequence
cttgggaggctgaggcagga

SEQ ID NO: 73286 - DNA, 20 bp, Artificial
  CRISPR gRNA sequence
gggaggctgaggcaggaggg

SEQ ID NO: 73287 - DNA, 20 bp, Artificial
  CRISPR gRNA sequence
ggaggctgaggcaggagggt

SEQ ID NO: 73288 - DNA, 20 bp, Artificial
  CRISPR gRNA sequence
aggcaggagggttgcttgaa

SEQ ID NO: 73289 - DNA, 20 bp, Artificial
  CRISPR gRNA sequence
cttgaacccgggaggcggag

SEQ ID NO: 73290 - DNA, 20 bp, Artificial
  CRISPR gRNA sequence
gaacccgggaggcggaggtt

SEQ ID NO: 73291 - DNA, 20 bp, Artificial
  CRISPR gRNA sequence
aacccgggaggcggaggttg

SEQ ID NO: 73292 - DNA, 20 bp, Artificial
  CRISPR gRNA sequence
cagtgagccaagactgtgcc

SEQ ID NO: 73293 - DNA, 20 bp, Artificial
  CRISPR gRNA sequence
tgccactgcactccagcctg

SEQ ID NO: 73294 - DNA, 20 bp, Artificial
  CRISPR gRNA sequence
cactccagcctgggcaacgg

SEQ ID NO: 73295 - DNA, 20 bp, Artificial
  CRISPR gRNA sequence
cagcctgggcaacggagaga

SEQ ID NO: 73296 - DNA, 20 bp, Artificial
  CRISPR gRNA sequence
ggcaacggagagagactggg

SEQ ID NO: 73297 - DNA, 20 bp, Artificial
  CRISPR gRNA sequence
ggtctcaaataaataaataa

SEQ ID NO: 73298 - DNA, 20 bp, Artificial
  CRISPR gRNA sequence
aaataaataaataataaaat

SEQ ID NO: 73299 - DNA, 20 bp, Artificial
  CRISPR gRNA sequence
tcttggttggctcagaacag

SEQ ID NO: 73300 - DNA, 20 bp, Artificial
  CRISPR gRNA sequence
ggttggctcagaacagaaga

SEQ ID NO: 73301 - DNA, 20 bp, Artificial
  CRISPR gRNA sequence
gttggctcagaacagaagag

SEQ ID NO: 73302 - DNA, 20 bp, Artificial
  CRISPR gRNA sequence
gctcagaacagaagagtttt

SEQ ID NO: 73303 - DNA, 20 bp, Artificial
  CRISPR gRNA sequence
agaacagaagagtttttcct

SEQ ID NO: 73304 - DNA, 20 bp, Artificial
  CRISPR gRNA sequence
ttcctggatgtgggactttg

SEQ ID NO: 73305 - DNA, 20 bp, Artificial
  CRISPR gRNA sequence
tcctggatgtgggactttgg

SEQ ID NO: 73306 - DNA, 20 bp, Artificial
  CRISPR gRNA sequence
cctggatgtgggactttggg

SEQ ID NO: 73307 - DNA, 20 bp, Artificial
  CRISPR gRNA sequence
ctggatgtgggactttgggt

SEQ ID NO: 73308 - DNA, 20 bp, Artificial
  CRISPR gRNA sequence
gatgtgggactttgggtgcc

SEQ ID NO: 73309 - DNA, 20 bp, Artificial
  CRISPR gRNA sequence
tgggtgccaaaatggggaaa

SEQ ID NO: 73310 - DNA, 20 bp, Artificial
  CRISPR gRNA sequence
gggtgccaaaatggggaaag

SEQ ID NO: 73311 - DNA, 20 bp, Artificial
  CRISPR gRNA sequence
ggtgccaaaatggggaaagc

SEQ ID NO: 73312 - DNA, 20 bp, Artificial
  CRISPR gRNA sequence
caagcaaactggaagtgtca

SEQ ID NO: 73313 - DNA, 20 bp, Artificial
  CRISPR gRNA sequence
gaagtgtcagttaccccacc

SEQ ID NO: 73314 - DNA, 20 bp, Artificial
  CRISPR gRNA sequence
ccccacccagagttgaaccc

SEQ ID NO: 73315 - DNA, 20 bp, Artificial
  CRISPR gRNA sequence
aacccaggcagtgaggctcc

SEQ ID NO: 73316 - DNA, 20 bp, Artificial
  CRISPR gRNA sequence
ctaactagggtccatgctcc

SEQ ID NO: 73317 - DNA, 20 bp, Artificial
  CRISPR gRNA sequence
actagggtccatgctcctac

SEQ ID NO: 73318 - DNA, 20 bp, Artificial
  CRISPR gRNA sequence
gggtccatgctcctacccac

SEQ ID NO: 73319 - DNA, 20 bp, Artificial
  CRISPR gRNA sequence
ctacccactccatcacaggt

SEQ ID NO: 73320 - DNA, 20 bp, Artificial
  CRISPR gRNA sequence
cccactccatcacaggtata

SEQ ID NO: 73321 - DNA, 20 bp, Artificial
  CRISPR gRNA sequence
catcacaggtatacagctgg

SEQ ID NO: 73322 - DNA, 20 bp, Artificial
  CRISPR gRNA sequence
gaagaagctgactggatttg

SEQ ID NO: 73323 - DNA, 20 bp, Artificial
  CRISPR gRNA sequence
actggatttgagggtaactg

SEQ ID NO: 73324 - DNA, 20 bp, Artificial
  CRISPR gRNA sequence
gatttgagggtaactgcctg

SEQ ID NO: 73325 - DNA, 20 bp, Artificial
  CRISPR gRNA sequence
gagggtaactgcctgtgggg

SEQ ID NO: 73326 - DNA, 20 bp, Artificial
  CRISPR gRNA sequence
agggtaactgcctgtgggga

SEQ ID NO: 73327 - DNA, 20 bp, Artificial
  CRISPR gRNA sequence
cctgtggggagttacacttg

SEQ ID NO: 73328 - DNA, 20 bp, Artificial
  CRISPR gRNA sequence
tggggagttacacttggaaa

SEQ ID NO: 73329 - DNA, 20 bp, Artificial
  CRISPR gRNA sequence
cacttggaaatgacagatct

SEQ ID NO: 73330 - DNA, 20 bp, Artificial
  CRISPR gRNA sequence
ggaaatgacagatctgagat

SEQ ID NO: 73331 - DNA, 20 bp, Artificial
  CRISPR gRNA sequence
gaaatgacagatctgagatg

SEQ ID NO: 73332 - DNA, 20 bp, Artificial
  CRISPR gRNA sequence
agatgggaagagacctccgg

SEQ ID NO: 73333 - DNA, 20 bp, Artificial
  CRISPR gRNA sequence
cgggcactgacgatccatcc

SEQ ID NO: 73334 - DNA, 20 bp, Artificial
  CRISPR gRNA sequence
acgatccatccccttccttc

SEQ ID NO: 73335 - DNA, 20 bp, Artificial
  CRISPR gRNA sequence
ccttcggacagggaagatat

SEQ ID NO: 73336 - DNA, 20 bp, Artificial
  CRISPR gRNA sequence
cttcggacagggaagatatt

SEQ ID NO: 73337 - DNA, 20 bp, Artificial
  CRISPR gRNA sequence
cggacagggaagatattatg

SEQ ID NO: 73338 - DNA, 20 bp, Artificial
  CRISPR gRNA sequence
ggacagggaagatattatgc

SEQ ID NO: 73339 - DNA, 20 bp, Artificial
  CRISPR gRNA sequence
tgcccagtttacagataggg

SEQ ID NO: 73340 - DNA, 20 bp, Artificial
  CRISPR gRNA sequence
acagatagggcaactaaggc

SEQ ID NO: 73341 - DNA, 20 bp, Artificial
  CRISPR gRNA sequence
cagatagggcaactaaggca

SEQ ID NO: 73342 - DNA, 20 bp, Artificial
  CRISPR gRNA sequence
aggcagcaggaggtaaggag

SEQ ID NO: 73343 - DNA, 20 bp, Artificial
  CRISPR gRNA sequence
ggaaatcaggaggaagaaaa

SEQ ID NO: 73344 - DNA, 20 bp, Artificial
  CRISPR gRNA sequence
tcctgtccccggcccaggtg

SEQ ID NO: 73345 - DNA, 20 bp, Artificial
  CRISPR gRNA sequence
tccccggcccaggtgcccag

SEQ ID NO: 73346 - DNA, 20 bp, Artificial
  CRISPR gRNA sequence
agtacatatttgtcgaatgc

SEQ ID NO: 73347 - DNA, 20 bp, Artificial
  CRISPR gRNA sequence
gtcgaatgcatgaatgagcc

SEQ ID NO: 73348 - DNA, 20 bp, Artificial
  CRISPR gRNA sequence
tcgaatgcatgaatgagcca

SEQ ID NO: 73349 - DNA, 20 bp, Artificial
  CRISPR gRNA sequence
actgggcctccaatccccta

SEQ ID NO: 73350 - DNA, 20 bp, Artificial
  CRISPR gRNA sequence
ggcctccaatcccctaaata

SEQ ID NO: 73351 - DNA, 20 bp, Artificial
  CRISPR gRNA sequence
caatcccctaaataaaagct

SEQ ID NO: 73352 - DNA, 20 bp, Artificial
  CRISPR gRNA sequence
aataaaagcttccagaaggc

SEQ ID NO: 73353 - DNA, 20 bp, Artificial
  CRISPR gRNA sequence
ccagaaggctgagccgagat

SEQ ID NO: 73354 - DNA, 20 bp, Artificial
  CRISPR gRNA sequence
cagaaggctgagccgagatg

SEQ ID NO: 73355 - DNA, 20 bp, Artificial
  CRISPR gRNA sequence
agccgagatgcaggtacatg

SEQ ID NO: 73356 - DNA, 20 bp, Artificial
  CRISPR gRNA sequence
tggtcaaaggtctctgtaat

SEQ ID NO: 73357 - DNA, 20 bp, Artificial
  CRISPR gRNA sequence
tgtaatccctcttctccttt

SEQ ID NO: 73358 - DNA, 20 bp, Artificial
  CRISPR gRNA sequence
taatccctcttctcctttta

SEQ ID NO: 73359 - DNA, 20 bp, Artificial
  CRISPR gRNA sequence
ttctccttttacctgatcct

SEQ ID NO: 73360 - DNA, 20 bp, Artificial
  CRISPR gRNA sequence
ctccttttacctgatcctct

SEQ ID NO: 73361 - DNA, 20 bp, Artificial
  CRISPR gRNA sequence
tccttttacctgatcctctc

SEQ ID NO: 73362 - DNA, 20 bp, Artificial
  CRISPR gRNA sequence
cttttacctgatcctctccc

SEQ ID NO: 73363 - DNA, 20 bp, Artificial
  CRISPR gRNA sequence
ttacctgatcctctccccag

SEQ ID NO: 73364 - DNA, 20 bp, Artificial
  CRISPR gRNA sequence
tacctgatcctctccccagg

SEQ ID NO: 73365 - DNA, 20 bp, Artificial
  CRISPR gRNA sequence
acctgatcctctccccagga

SEQ ID NO: 73366 - DNA, 20 bp, Artificial
  CRISPR gRNA sequence
cctgatcctctccccaggac

SEQ ID NO: 73367 - DNA, 20 bp, Artificial
  CRISPR gRNA sequence
atcctctccccaggacaagc

SEQ ID NO: 73368 - DNA, 20 bp, Artificial
  CRISPR gRNA sequence
tccccaggacaagcaaagag

SEQ ID NO: 73369 - DNA, 20 bp, Artificial
  CRISPR gRNA sequence
cccaggacaagcaaagaggg

SEQ ID NO: 73370 - DNA, 20 bp, Artificial
  CRISPR gRNA sequence
caatgttaaggggcaaaaag

SEQ ID NO: 73371 - DNA, 20 bp, Artificial
  CRISPR gRNA sequence
aatgttaaggggcaaaaagt

SEQ ID NO: 73372 - DNA, 20 bp, Artificial
  CRISPR gRNA sequence
aggggcaaaaagtcaaaagg

SEQ ID NO: 73373 - DNA, 20 bp, Artificial
  CRISPR gRNA sequence
ctttcaagctgaattcaaaa

SEQ ID NO: 73374 - DNA, 20 bp, Artificial
  CRISPR gRNA sequence
tcaagctgaattcaaaacat

SEQ ID NO: 73375 - DNA, 20 bp, Artificial
  CRISPR gRNA sequence
caagctgaattcaaaacata

SEQ ID NO: 73376 - DNA, 20 bp, Artificial
  CRISPR gRNA sequence
aagctgaattcaaaacatat

SEQ ID NO: 73377 - DNA, 20 bp, Artificial
  CRISPR gRNA sequence
aattcaaaacatatgtagaa

SEQ ID NO: 73378 - DNA, 20 bp, Artificial
  CRISPR gRNA sequence
aaaacatatgtagaaaaaaa

SEQ ID NO: 73379 - DNA, 20 bp, Artificial
  CRISPR gRNA sequence
gagaaaaattcacaaaccgt

SEQ ID NO: 73380 - DNA, 20 bp, Artificial
  CRISPR gRNA sequence
acaaaccgttcaacagaagt

SEQ ID NO: 73381 - DNA, 20 bp, Artificial
  CRISPR gRNA sequence
aacagaagttttctcagggg

SEQ ID NO: 73382 - DNA, 20 bp, Artificial
  CRISPR gRNA sequence
tctcagggggtgtcatcccc

SEQ ID NO: 73383 - DNA, 20 bp, Artificial
  CRISPR gRNA sequence
ctcagggggtgtcatccccg

SEQ ID NO: 73384 - DNA, 20 bp, Artificial
  CRISPR gRNA sequence
tcagggggtgtcatccccgg

SEQ ID NO: 73385 - DNA, 20 bp, Artificial
  CRISPR gRNA sequence
agggggtgtcatccccgggg

SEQ ID NO: 73386 - DNA, 20 bp, Artificial
  CRISPR gRNA sequence
catgttatttgttacatatt

SEQ ID NO: 73387 - DNA, 20 bp, Artificial
  CRISPR gRNA sequence
atgttatttgttacatattt

SEQ ID NO: 73388 - DNA, 20 bp, Artificial
  CRISPR gRNA sequence
tttgttacatatttctagaa

SEQ ID NO: 73389 - DNA, 20 bp, Artificial
  CRISPR gRNA sequence
gttacatatttctagaaaga

SEQ ID NO: 73390 - DNA, 20 bp, Artificial
  CRISPR gRNA sequence
ttacatatttctagaaagat

SEQ ID NO: 73391 - DNA, 20 bp, Artificial
  CRISPR gRNA sequence
catatttctagaaagatgga

SEQ ID NO: 73392 - DNA, 20 bp, Artificial
  CRISPR gRNA sequence
ctagaaagatggaacttttt

SEQ ID NO: 73393 - DNA, 20 bp, Artificial
  CRISPR gRNA sequence
tagaaagatggaactttttt

SEQ ID NO: 73394 - DNA, 20 bp, Artificial
  CRISPR gRNA sequence
gaaagatggaacttttttgg

SEQ ID NO: 73395 - DNA, 20 bp, Artificial
  CRISPR gRNA sequence
ttttggtcatcagaaaaagt

SEQ ID NO: 73396 - DNA, 20 bp, Artificial
  CRISPR gRNA sequence
tttggtcatcagaaaaagtt

SEQ ID NO: 73397 - DNA, 20 bp, Artificial
  CRISPR gRNA sequence
ttggtcatcagaaaaagtta

SEQ ID NO: 73398 - DNA, 20 bp, Artificial
  CRISPR gRNA sequence
tggtcatcagaaaaagttaa

SEQ ID NO: 73399 - DNA, 20 bp, Artificial
  CRISPR gRNA sequence
ggtcatcagaaaaagttaag

SEQ ID NO: 73400 - DNA, 20 bp, Artificial
  CRISPR gRNA sequence
gtcatcagaaaaagttaaga

SEQ ID NO: 73401 - DNA, 20 bp, Artificial
  CRISPR gRNA sequence
agagatgaaaagcagaagat

SEQ ID NO: 73402 - DNA, 20 bp, Artificial
  CRISPR gRNA sequence
tgttaaattttctgtccaga

SEQ ID NO: 73403 - DNA, 20 bp, Artificial
  CRISPR gRNA sequence
ttaaattttctgtccagata

SEQ ID NO: 73404 - DNA, 20 bp, Artificial
  CRISPR gRNA sequence
aattttctgtccagatactg

SEQ ID NO: 73405 - DNA, 20 bp, Artificial
  CRISPR gRNA sequence
tctgtccagatactgtctaa

SEQ ID NO: 73406 - DNA, 20 bp, Artificial
  CRISPR gRNA sequence
ctgtccagatactgtctaaa

SEQ ID NO: 73407 - DNA, 20 bp, Artificial
  CRISPR gRNA sequence
tgtccagatactgtctaaac

SEQ ID NO: 73408 - DNA, 20 bp, Artificial
  CRISPR gRNA sequence
tccagatactgtctaaacag

SEQ ID NO: 73409 - DNA, 20 bp, Artificial
  CRISPR gRNA sequence
tctaaacaggaatctgtgca

SEQ ID NO: 73410 - DNA, 20 bp, Artificial
  CRISPR gRNA sequence
aacaggaatctgtgcaggac

SEQ ID NO: 73411 - DNA, 20 bp, Artificial
  CRISPR gRNA sequence
tgcaggacggggacctgtct

SEQ ID NO: 73412 - DNA, 20 bp, Artificial
  CRISPR gRNA sequence
tcttttagactgaggctgtt

SEQ ID NO: 73413 - DNA, 20 bp, Artificial
  CRISPR gRNA sequence
ttagactgaggctgtttctg

SEQ ID NO: 73414 - DNA, 20 bp, Artificial
  CRISPR gRNA sequence
tagactgaggctgtttctgg

SEQ ID NO: 73415 - DNA, 20 bp, Artificial
  CRISPR gRNA sequence
agactgaggctgtttctggc

SEQ ID NO: 73416 - DNA, 20 bp, Artificial
  CRISPR gRNA sequence
gactgaggctgtttctggca

SEQ ID NO: 73417 - DNA, 20 bp, Artificial
  CRISPR gRNA sequence
aggctgtttctggcatttct

SEQ ID NO: 73418 - DNA, 20 bp, Artificial
  CRISPR gRNA sequence
tttctggcatttctaagaat

SEQ ID NO: 73419 - DNA, 20 bp, Artificial
  CRISPR gRNA sequence
ctggcatttctaagaatttg

SEQ ID NO: 73420 - DNA, 20 bp, Artificial
  CRISPR gRNA sequence
tggcatttctaagaatttga

SEQ ID NO: 73421 - DNA, 20 bp, Artificial
  CRISPR gRNA sequence
gcatttctaagaatttgatg

SEQ ID NO: 73422 - DNA, 20 bp, Artificial
  CRISPR gRNA sequence
ctaagaatttgatgacttca

SEQ ID NO: 73423 - DNA, 20 bp, Artificial
  CRISPR gRNA sequence
taagaatttgatgacttcaa

SEQ ID NO: 73424 - DNA, 20 bp, Artificial
  CRISPR gRNA sequence
agaatttgatgacttcaaat

SEQ ID NO: 73425 - DNA, 20 bp, Artificial
  CRISPR gRNA sequence
gatgacttcaaattatgggg

SEQ ID NO: 73426 - DNA, 20 bp, Artificial
  CRISPR gRNA sequence
atgacttcaaattatggggg

SEQ ID NO: 73427 - DNA, 20 bp, Artificial
  CRISPR gRNA sequence
caaattatgggggagagtag

SEQ ID NO: 73428 - DNA, 20 bp, Artificial
  CRISPR gRNA sequence
aaattatgggggagagtagt

SEQ ID NO: 73429 - DNA, 20 bp, Artificial
  CRISPR gRNA sequence
tgggggagagtagtaaaagc

SEQ ID NO: 73430 - DNA, 20 bp, Artificial
  CRISPR gRNA sequence
ccagttaccaaggaaacaac

SEQ ID NO: 73431 - DNA, 20 bp, Artificial
  CRISPR gRNA sequence
ccaaggaaacaactgtagac

SEQ ID NO: 73432 - DNA, 20 bp, Artificial
  CRISPR gRNA sequence
tagacaaatgtagtggacat

SEQ ID NO: 73433 - DNA, 20 bp, Artificial
  CRISPR gRNA sequence
tagatttttttctgcccaga

SEQ ID NO: 73434 - DNA, 20 bp, Artificial
  CRISPR gRNA sequence
ttttctgcccagagtttctt

SEQ ID NO: 73435 - DNA, 20 bp, Artificial
  CRISPR gRNA sequence
tttctgcccagagtttcttt

SEQ ID NO: 73436 - DNA, 20 bp, Artificial
  CRISPR gRNA sequence
ttctgcccagagtttctttc

SEQ ID NO: 73437 - DNA, 20 bp, Artificial
  CRISPR gRNA sequence
tctgcccagagtttctttcc

SEQ ID NO: 73438 - DNA, 20 bp, Artificial
  CRISPR gRNA sequence
ctgcccagagtttctttcct

SEQ ID NO: 73439 - DNA, 20 bp, Artificial
  CRISPR gRNA sequence
tgcccagagtttctttcctc

SEQ ID NO: 73440 - DNA, 20 bp, Artificial
  CRISPR gRNA sequence
cccagagtttctttcctctt

SEQ ID NO: 73441 - DNA, 20 bp, Artificial
  CRISPR gRNA sequence
ctttcctcttctgttactca

SEQ ID NO: 73442 - DNA, 20 bp, Artificial
  CRISPR gRNA sequence
tttcctcttctgttactcac

SEQ ID NO: 73443 - DNA, 20 bp, Artificial
  CRISPR gRNA sequence
tcctcttctgttactcacat

SEQ ID NO: 73444 - DNA, 20 bp, Artificial
  CRISPR gRNA sequence
cctcttctgttactcacatc

SEQ ID NO: 73445 - DNA, 20 bp, Artificial
  CRISPR gRNA sequence
ctcttctgttactcacatcc

SEQ ID NO: 73446 - DNA, 20 bp, Artificial
  CRISPR gRNA sequence
ttctgttactcacatcctga

SEQ ID NO: 73447 - DNA, 20 bp, Artificial
  CRISPR gRNA sequence
ctgttactcacatcctgaaa

SEQ ID NO: 73448 - DNA, 20 bp, Artificial
  CRISPR gRNA sequence
tgttactcacatcctgaaat

SEQ ID NO: 73449 - DNA, 20 bp, Artificial
  CRISPR gRNA sequence
ttactcacatcctgaaatac

SEQ ID NO: 73450 - DNA, 20 bp, Artificial
  CRISPR gRNA sequence
ctcacatcctgaaataccac

SEQ ID NO: 73451 - DNA, 20 bp, Artificial
  CRISPR gRNA sequence
acatcctgaaataccacccc

SEQ ID NO: 73452 - DNA, 20 bp, Artificial
  CRISPR gRNA sequence
aaataccacccctctaagtc

SEQ ID NO: 73453 - DNA, 20 bp, Artificial
  CRISPR gRNA sequence
taagtccagaagatagggtg

SEQ ID NO: 73454 - DNA, 20 bp, Artificial
  CRISPR gRNA sequence
agtccagaagatagggtgtg

SEQ ID NO: 73455 - DNA, 20 bp, Artificial
  CRISPR gRNA sequence
gccagtgaggagaatatttt

SEQ ID NO: 73456 - DNA, 20 bp, Artificial
  CRISPR gRNA sequence
tgtgctcacagccacagtga

SEQ ID NO: 73457 - DNA, 20 bp, Artificial
  CRISPR gRNA sequence
gtgctcacagccacagtgat

SEQ ID NO: 73458 - DNA, 20 bp, Artificial
  CRISPR gRNA sequence
tgctcacagccacagtgatt

SEQ ID NO: 73459 - DNA, 20 bp, Artificial
  CRISPR gRNA sequence
acagccacagtgattgcttt

SEQ ID NO: 73460 - DNA, 20 bp, Artificial
  CRISPR gRNA sequence
ctttagggtggggcaggtga

SEQ ID NO: 73461 - DNA, 20 bp, Artificial
  CRISPR gRNA sequence
tagggtggggcaggtgactc

SEQ ID NO: 73462 - DNA, 20 bp, Artificial
  CRISPR gRNA sequence
agggtggggcaggtgactca

SEQ ID NO: 73463 - DNA, 20 bp, Artificial
  CRISPR gRNA sequence
gggtggggcaggtgactcaa

SEQ ID NO: 73464 - DNA, 20 bp, Artificial
  CRISPR gRNA sequence
aagctagtccagtgagactc

SEQ ID NO: 73465 - DNA, 20 bp, Artificial
  CRISPR gRNA sequence
gtccagtgagactcagtcta

SEQ ID NO: 73466 - DNA, 20 bp, Artificial
  CRISPR gRNA sequence
agtctaggaccttttgttgt

SEQ ID NO: 73467 - DNA, 20 bp, Artificial
  CRISPR gRNA sequence
ggaccttttgttgtaaccac

SEQ ID NO: 73468 - DNA, 20 bp, Artificial
  CRISPR gRNA sequence
ttgttgtaaccacagagaga

SEQ ID NO: 73469 - DNA, 20 bp, Artificial
  CRISPR gRNA sequence
tgttgtaaccacagagagaa

SEQ ID NO: 73470 - DNA, 20 bp, Artificial
  CRISPR gRNA sequence
gttgtaaccacagagagaat

SEQ ID NO: 73471 - DNA, 20 bp, Artificial
  CRISPR gRNA sequence
ttgtaaccacagagagaatg

SEQ ID NO: 73472 - DNA, 20 bp, Artificial
  CRISPR gRNA sequence
taaccacagagagaatggta

SEQ ID NO: 73473 - DNA, 20 bp, Artificial
  CRISPR gRNA sequence
cctttccactaagctgagag

SEQ ID NO: 73474 - DNA, 20 bp, Artificial
  CRISPR gRNA sequence
tccactaagctgagagaaag

SEQ ID NO: 73475 - DNA, 20 bp, Artificial
  CRISPR gRNA sequence
ccactaagctgagagaaagt

SEQ ID NO: 73476 - DNA, 20 bp, Artificial
  CRISPR gRNA sequence
cactaagctgagagaaagta

SEQ ID NO: 73477 - DNA, 20 bp, Artificial
  CRISPR gRNA sequence
agctgagagaaagtaagcct

SEQ ID NO: 73478 - DNA, 20 bp, Artificial
  CRISPR gRNA sequence
agagaaagtaagcctgcagg

SEQ ID NO: 73479 - DNA, 20 bp, Artificial
  CRISPR gRNA sequence
caggtgcagggatggcctgc

SEQ ID NO: 73480 - DNA, 20 bp, Artificial
  CRISPR gRNA sequence
cctgagaaggaagccaaggt

SEQ ID NO: 73481 - DNA, 20 bp, Artificial
  CRISPR gRNA sequence
agaaggaagccaaggtggac

SEQ ID NO: 73482 - DNA, 20 bp, Artificial
  CRISPR gRNA sequence
acaaatatagaacccctgga

SEQ ID NO: 73483 - DNA, 20 bp, Artificial
  CRISPR gRNA sequence
gatccagctgtgcctgaagt

SEQ ID NO: 73484 - DNA, 20 bp, Artificial
  CRISPR gRNA sequence
tgcctgaagtcattggcctc

SEQ ID NO: 73485 - DNA, 20 bp, Artificial
  CRISPR gRNA sequence
aagtcattggcctcgtaatt

SEQ ID NO: 73486 - DNA, 20 bp, Artificial
  CRISPR gRNA sequence
gcctcgtaattttccatgac

SEQ ID NO: 73487 - DNA, 20 bp, Artificial
  CRISPR gRNA sequence
gtaattttccatgacataag

SEQ ID NO: 73488 - DNA, 20 bp, Artificial
  CRISPR gRNA sequence
tccatgacataagccaatat

SEQ ID NO: 73489 - DNA, 20 bp, Artificial
  CRISPR gRNA sequence
ccatgacataagccaatata

SEQ ID NO: 73490 - DNA, 20 bp, Artificial
  CRISPR gRNA sequence
catgacataagccaatatat

SEQ ID NO: 73491 - DNA, 20 bp, Artificial
  CRISPR gRNA sequence
ctgtcttggattgctttgag

SEQ ID NO: 73492 - DNA, 20 bp, Artificial
  CRISPR gRNA sequence
tgtcttggattgctttgagt

SEQ ID NO: 73493 - DNA, 20 bp, Artificial
  CRISPR gRNA sequence
tcttggattgctttgagttg

SEQ ID NO: 73494 - DNA, 20 bp, Artificial
  CRISPR gRNA sequence
ggattgctttgagttgtgta

SEQ ID NO: 73495 - DNA, 20 bp, Artificial
  CRISPR gRNA sequence
gattgctttgagttgtgtat

SEQ ID NO: 73496 - DNA, 20 bp, Artificial
  CRISPR gRNA sequence
ctttgagttgtgtattctgt

SEQ ID NO: 73497 - DNA, 20 bp, Artificial
  CRISPR gRNA sequence
tgagttgtgtattctgtttc

SEQ ID NO: 73498 - DNA, 20 bp, Artificial
  CRISPR gRNA sequence
gagttgtgtattctgtttcc

SEQ ID NO: 73499 - DNA, 20 bp, Artificial
  CRISPR gRNA sequence
agttgtgtattctgtttcct

SEQ ID NO: 73500 - DNA, 20 bp, Artificial
  CRISPR gRNA sequence
tgtattctgtttcctatgac

SEQ ID NO: 73501 - DNA, 20 bp, Artificial
  CRISPR gRNA sequence
tgtttcctatgaccaaggtt

SEQ ID NO: 73502 - DNA, 20 bp, Artificial
  CRISPR gRNA sequence
tttcctatgaccaaggttct

SEQ ID NO: 73503 - DNA, 20 bp, Artificial
  CRISPR gRNA sequence
cctatgaccaaggttcttgc

SEQ ID NO: 73504 - DNA, 20 bp, Artificial
  CRISPR gRNA sequence
ctatgaccaaggttcttgct

SEQ ID NO: 73505 - DNA, 20 bp, Artificial
  CRISPR gRNA sequence
tgaccaaggttcttgctggc

SEQ ID NO: 73506 - DNA, 20 bp, Artificial
  CRISPR gRNA sequence
ttgctggcactgagatccag

SEQ ID NO: 73507 - DNA, 20 bp, Artificial
  CRISPR gRNA sequence
gctggcactgagatccagaa

SEQ ID NO: 73508 - DNA, 20 bp, Artificial
  CRISPR gRNA sequence
ctggcactgagatccagaat

SEQ ID NO: 73509 - DNA, 20 bp, Artificial
  CRISPR gRNA sequence
gcactgagatccagaataga

SEQ ID NO: 73510 - DNA, 20 bp, Artificial
  CRISPR gRNA sequence
agatccagaatagaaagtaa

SEQ ID NO: 73511 - DNA, 20 bp, Artificial
  CRISPR gRNA sequence
agctcacctgggtccatcca

SEQ ID NO: 73512 - DNA, 20 bp, Artificial
  CRISPR gRNA sequence
acctgggtccatccagaaac

SEQ ID NO: 73513 - DNA, 20 bp, Artificial
  CRISPR gRNA sequence
ggtccatccagaaacatggc

SEQ ID NO: 73514 - DNA, 20 bp, Artificial
  CRISPR gRNA sequence
gtgttcacaaaacatgcaaa

SEQ ID NO: 73515 - DNA, 20 bp, Artificial
  CRISPR gRNA sequence
tgttcacaaaacatgcaaag

SEQ ID NO: 73516 - DNA, 20 bp, Artificial
  CRISPR gRNA sequence
acaaaacatgcaaaggttcc

SEQ ID NO: 73517 - DNA, 20 bp, Artificial
  CRISPR gRNA sequence
ctaggcatgctactcactga

SEQ ID NO: 73518 - DNA, 20 bp, Artificial
  CRISPR gRNA sequence
ggcatgctactcactgacca

SEQ ID NO: 73519 - DNA, 20 bp, Artificial
  CRISPR gRNA sequence
ctcactgaccatgcagcact

SEQ ID NO: 73520 - DNA, 20 bp, Artificial
  CRISPR gRNA sequence
actgaccatgcagcactaag

SEQ ID NO: 73521 - DNA, 20 bp, Artificial
  CRISPR gRNA sequence
accatgcagcactaagcacc

SEQ ID NO: 73522 - DNA, 20 bp, Artificial
  CRISPR gRNA sequence
agcaccatcacccctcactc

SEQ ID NO: 73523 - DNA, 20 bp, Artificial
  CRISPR gRNA sequence
actcactcctttccccatta

SEQ ID NO: 73524 - DNA, 20 bp, Artificial
  CRISPR gRNA sequence
actcctttccccattaacca

SEQ ID NO: 73525 - DNA, 20 bp, Artificial
  CRISPR gRNA sequence
ctttccccattaaccactgt

SEQ ID NO: 73526 - DNA, 20 bp, Artificial
  CRISPR gRNA sequence
tccccattaaccactgtcat

SEQ ID NO: 73527 - DNA, 20 bp, Artificial
  CRISPR gRNA sequence
ccccattaaccactgtcatc

SEQ ID NO: 73528 - DNA, 20 bp, Artificial
  CRISPR gRNA sequence
cccattaaccactgtcatcc

SEQ ID NO: 73529 - DNA, 20 bp, Artificial
  CRISPR gRNA sequence
accactgtcatccctcactc

SEQ ID NO: 73530 - DNA, 20 bp, Artificial
  CRISPR gRNA sequence
tcatccctcactcaccccct

SEQ ID NO: 73531 - DNA, 20 bp, Artificial
  CRISPR gRNA sequence
actcacccccttccccatta

SEQ ID NO: 73532 - DNA, 20 bp, Artificial
  CRISPR gRNA sequence
acccccttccccattaacca

SEQ ID NO: 73533 - DNA, 20 bp, Artificial
  CRISPR gRNA sequence
ccccattaaccaaccccacc

SEQ ID NO: 73534 - DNA, 20 bp, Artificial
  CRISPR gRNA sequence
cccattaaccaaccccacca

SEQ ID NO: 73535 - DNA, 20 bp, Artificial
  CRISPR gRNA sequence
accaaccccaccactcactc

SEQ ID NO: 73536 - DNA, 20 bp, Artificial
  CRISPR gRNA sequence
actcacaactcttccctatt

SEQ ID NO: 73537 - DNA, 20 bp, Artificial
  CRISPR gRNA sequence
acaactcttccctattaacc

SEQ ID NO: 73538 - DNA, 20 bp, Artificial
  CRISPR gRNA sequence
ttccctattaaccaccccca

SEQ ID NO: 73539 - DNA, 20 bp, Artificial
  CRISPR gRNA sequence
ccctattaaccacccccacc

SEQ ID NO: 73540 - DNA, 20 bp, Artificial
  CRISPR gRNA sequence
cctattaaccacccccaccc

SEQ ID NO: 73541 - DNA, 20 bp, Artificial
  CRISPR gRNA sequence
ttaaccacccccacccctta

SEQ ID NO: 73542 - DNA, 20 bp, Artificial
  CRISPR gRNA sequence
accacccccaccccttactc

SEQ ID NO: 73543 - DNA, 20 bp, Artificial
  CRISPR gRNA sequence
actcacccccttccccatta

SEQ ID NO: 73544 - DNA, 20 bp, Artificial
  CRISPR gRNA sequence
ctcacccccttccccattaa

SEQ ID NO: 73545 - DNA, 20 bp, Artificial
  CRISPR gRNA sequence
acccccttccccattaacca

SEQ ID NO: 73546 - DNA, 20 bp, Artificial
  CRISPR gRNA sequence
ccccattaaccaccatcacc

SEQ ID NO: 73547 - DNA, 20 bp, Artificial
  CRISPR gRNA sequence
cccattaaccaccatcacca

SEQ ID NO: 73548 - DNA, 20 bp, Artificial
  CRISPR gRNA sequence
accaccatcaccactcactc

SEQ ID NO: 73549 - DNA, 20 bp, Artificial
  CRISPR gRNA sequence
actcacaacccttccccatt

SEQ ID NO: 73550 - DNA, 20 bp, Artificial
  CRISPR gRNA sequence
acaacccttccccattaacc

SEQ ID NO: 73551 - DNA, 20 bp, Artificial
  CRISPR gRNA sequence
ccccattaaccaccatcacc

SEQ ID NO: 73552 - DNA, 20 bp, Artificial
  CRISPR gRNA sequence
cccattaaccaccatcacca

SEQ ID NO: 73553 - DNA, 20 bp, Artificial
  CRISPR gRNA sequence
accaccatcaccactcactc

SEQ ID NO: 73554 - DNA, 20 bp, Artificial
  CRISPR gRNA sequence
actcccttcccattaaccac

SEQ ID NO: 73555 - DNA, 20 bp, Artificial
  CRISPR gRNA sequence
ccttcccattaaccaccatc

SEQ ID NO: 73556 - DNA, 20 bp, Artificial
  CRISPR gRNA sequence
cccattaaccaccatcacca

SEQ ID NO: 73557 - DNA, 20 bp, Artificial
  CRISPR gRNA sequence
ccattaaccaccatcaccac

SEQ ID NO: 73558 - DNA, 20 bp, Artificial
  CRISPR gRNA sequence
accaccatcaccactcaccc

SEQ ID NO: 73559 - DNA, 20 bp, Artificial
  CRISPR gRNA sequence
acccacccccttccccatta

SEQ ID NO: 73560 - DNA, 20 bp, Artificial
  CRISPR gRNA sequence
ccccattaaccaccaacacc

SEQ ID NO: 73561 - DNA, 20 bp, Artificial
  CRISPR gRNA sequence
cccattaaccaccaacacca

SEQ ID NO: 73562 - DNA, 20 bp, Artificial
  CRISPR gRNA sequence
accaccaacaccactcactc

SEQ ID NO: 73563 - DNA, 20 bp, Artificial
  CRISPR gRNA sequence
actcacccccttccccatta

SEQ ID NO: 73564 - DNA, 20 bp, Artificial
  CRISPR gRNA sequence
acccccttccccattaacca

SEQ ID NO: 73565 - DNA, 20 bp, Artificial
  CRISPR gRNA sequence
ccccattaaccaccaccacc

SEQ ID NO: 73566 - DNA, 20 bp, Artificial
  CRISPR gRNA sequence
cccattaaccaccaccacca

SEQ ID NO: 73567 - DNA, 20 bp, Artificial
  CRISPR gRNA sequence
accaccaccaccactcactc

SEQ ID NO: 73568 - DNA, 20 bp, Artificial
  CRISPR gRNA sequence
actcacccccttccccgtta

SEQ ID NO: 73569 - DNA, 20 bp, Artificial
  CRISPR gRNA sequence
acccccttccccgttaacca

SEQ ID NO: 73570 - DNA, 20 bp, Artificial
  CRISPR gRNA sequence
ccccgttaaccaaccccacc

SEQ ID NO: 73571 - DNA, 20 bp, Artificial
  CRISPR gRNA sequence
cccgttaaccaaccccacca

SEQ ID NO: 73572 - DNA, 20 bp, Artificial
  CRISPR gRNA sequence
accaaccccaccactcactc

SEQ ID NO: 73573 - DNA, 20 bp, Artificial
  CRISPR gRNA sequence
actcacaacccttccccatt

SEQ ID NO: 73574 - DNA, 20 bp, Artificial
  CRISPR gRNA sequence
acaacccttccccattaacc

SEQ ID NO: 73575 - DNA, 20 bp, Artificial
  CRISPR gRNA sequence
ccccattaaccaccatcatc

SEQ ID NO: 73576 - DNA, 20 bp, Artificial
  CRISPR gRNA sequence
cccattaaccaccatcatcg

SEQ ID NO: 73577 - DNA, 20 bp, Artificial
  CRISPR gRNA sequence
accaccatcatcgctcactc

SEQ ID NO: 73578 - DNA, 20 bp, Artificial
  CRISPR gRNA sequence
actcacccccttccccatta

SEQ ID NO: 73579 - DNA, 20 bp, Artificial
  CRISPR gRNA sequence
acccccttccccattaacca

SEQ ID NO: 73580 - DNA, 20 bp, Artificial
  CRISPR gRNA sequence
ccccattaaccaccaacacc

SEQ ID NO: 73581 - DNA, 20 bp, Artificial
  CRISPR gRNA sequence
cccattaaccaccaacacca

SEQ ID NO: 73582 - DNA, 20 bp, Artificial
  CRISPR gRNA sequence
accaccaacaccactcactc

SEQ ID NO: 73583 - DNA, 20 bp, Artificial
  CRISPR gRNA sequence
actcacaacccttccccatt

SEQ ID NO: 73584 - DNA, 20 bp, Artificial
  CRISPR gRNA sequence
acaacccttccccattaacc

SEQ ID NO: 73585 - DNA, 20 bp, Artificial
  CRISPR gRNA sequence
ccccattaaccaccatcacc

SEQ ID NO: 73586 - DNA, 20 bp, Artificial
  CRISPR gRNA sequence
cccattaaccaccatcacca

SEQ ID NO: 73587 - DNA, 20 bp, Artificial
  CRISPR gRNA sequence
accaccatcaccactcactc

SEQ ID NO: 73588 - DNA, 20 bp, Artificial
  CRISPR gRNA sequence
actcacaacacttccccatt

SEQ ID NO: 73589 - DNA, 20 bp, Artificial
  CRISPR gRNA sequence
acaacacttccccattaacc

SEQ ID NO: 73590 - DNA, 20 bp, Artificial
  CRISPR gRNA sequence
ccccattaaccaccaacacc

SEQ ID NO: 73591 - DNA, 20 bp, Artificial
  CRISPR gRNA sequence
cccattaaccaccaacacca

SEQ ID NO: 73592 - DNA, 20 bp, Artificial
  CRISPR gRNA sequence
accaccaacaccactcactc

SEQ ID NO: 73593 - DNA, 20 bp, Artificial
  CRISPR gRNA sequence
actcacccccttccccatta

SEQ ID NO: 73594 - DNA, 20 bp, Artificial
  CRISPR gRNA sequence
acccccttccccattaacca

SEQ ID NO: 73595 - DNA, 20 bp, Artificial
  CRISPR gRNA sequence
ccccattaaccaccatcacc

SEQ ID NO: 73596 - DNA, 20 bp, Artificial
  CRISPR gRNA sequence
cccattaaccaccatcacca

SEQ ID NO: 73597 - DNA, 20 bp, Artificial
  CRISPR gRNA sequence
accaccatcaccactcactc

SEQ ID NO: 73598 - DNA, 20 bp, Artificial
  CRISPR gRNA sequence
actcacaacccttccccatt

SEQ ID NO: 73599 - DNA, 20 bp, Artificial
  CRISPR gRNA sequence
acaacccttccccattaacc

SEQ ID NO: 73600 - DNA, 20 bp, Artificial
  CRISPR gRNA sequence
ccccattaaccaaccatcac

SEQ ID NO: 73601 - DNA, 20 bp, Artificial
  CRISPR gRNA sequence
cccattaaccaaccatcacc

SEQ ID NO: 73602 - DNA, 20 bp, Artificial
  CRISPR gRNA sequence
accaaccatcaccactcact

SEQ ID NO: 73603 - DNA, 20 bp, Artificial
  CRISPR gRNA sequence
actcacaacgcttccccatt

SEQ ID NO: 73604 - DNA, 20 bp, Artificial
  CRISPR gRNA sequence
acaacgcttccccattaacc

SEQ ID NO: 73605 - DNA, 20 bp, Artificial
  CRISPR gRNA sequence
ccccattaaccaaccccaca

SEQ ID NO: 73606 - DNA, 20 bp, Artificial
  CRISPR gRNA sequence
cccattaaccaaccccacaa

SEQ ID NO: 73607 - DNA, 20 bp, Artificial
  CRISPR gRNA sequence
accaaccccacaactcactc

SEQ ID NO: 73608 - DNA, 20 bp, Artificial
  CRISPR gRNA sequence
actcacaacccttccccatt

SEQ ID NO: 73609 - DNA, 20 bp, Artificial
  CRISPR gRNA sequence
acaacccttccccattaacc

SEQ ID NO: 73610 - DNA, 20 bp, Artificial
  CRISPR gRNA sequence
ccccattaaccaccatcatc

SEQ ID NO: 73611 - DNA, 20 bp, Artificial
  CRISPR gRNA sequence
cccattaaccaccatcatca

SEQ ID NO: 73612 - DNA, 20 bp, Artificial
  CRISPR gRNA sequence
accaccatcatcactcactc

SEQ ID NO: 73613 - DNA, 20 bp, Artificial
  CRISPR gRNA sequence
actccctcccttccccatta

SEQ ID NO: 73614 - DNA, 20 bp, Artificial
  CRISPR gRNA sequence
cctcccttccccattaacca

SEQ ID NO: 73615 - DNA, 20 bp, Artificial
  CRISPR gRNA sequence
ccttccccattaaccaccaa

SEQ ID NO: 73616 - DNA, 20 bp, Artificial
  CRISPR gRNA sequence
ccccattaaccaccaacgcc

SEQ ID NO: 73617 - DNA, 20 bp, Artificial
  CRISPR gRNA sequence
cccattaaccaccaacgcca

SEQ ID NO: 73618 - DNA, 20 bp, Artificial
  CRISPR gRNA sequence
accaccaacgccactcactc

SEQ ID NO: 73619 - DNA, 20 bp, Artificial
  CRISPR gRNA sequence
actcacaacccttccccatt

SEQ ID NO: 73620 - DNA, 20 bp, Artificial
  CRISPR gRNA sequence
acaacccttccccattaatc

SEQ ID NO: 73621 - DNA, 20 bp, Artificial
  CRISPR gRNA sequence
ccccattaatcaccatcacc

SEQ ID NO: 73622 - DNA, 20 bp, Artificial
  CRISPR gRNA sequence
cccattaatcaccatcacca

SEQ ID NO: 73623 - DNA, 20 bp, Artificial
  CRISPR gRNA sequence
atcaccatcaccactcactc

SEQ ID NO: 73624 - DNA, 20 bp, Artificial
  CRISPR gRNA sequence
actcacaacacttccccatt

SEQ ID NO: 73625 - DNA, 20 bp, Artificial
  CRISPR gRNA sequence
acaacacttccccattaacc

SEQ ID NO: 73626 - DNA, 20 bp, Artificial
  CRISPR gRNA sequence
ccccattaaccaaccccacc

SEQ ID NO: 73627 - DNA, 20 bp, Artificial
  CRISPR gRNA sequence
cccattaaccaaccccacca

SEQ ID NO: 73628 - DNA, 20 bp, Artificial
  CRISPR gRNA sequence
accaaccccaccactcactc

SEQ ID NO: 73629 - DNA, 20 bp, Artificial
  CRISPR gRNA sequence
actcacccccttccccatta

SEQ ID NO: 73630 - DNA, 20 bp, Artificial
  CRISPR gRNA sequence
acccccttccccattaacca

SEQ ID NO: 73631 - DNA, 20 bp, Artificial
  CRISPR gRNA sequence
ccccattaaccaccaacacc

SEQ ID NO: 73632 - DNA, 20 bp, Artificial
  CRISPR gRNA sequence
cccattaaccaccaacacca

SEQ ID NO: 73633 - DNA, 20 bp, Artificial
  CRISPR gRNA sequence
accaccaacaccactcactc

SEQ ID NO: 73634 - DNA, 20 bp, Artificial
  CRISPR gRNA sequence
actcacaactcttccccatt

SEQ ID NO: 73635 - DNA, 20 bp, Artificial
  CRISPR gRNA sequence
acaactcttccccattaacc

SEQ ID NO: 73636 - DNA, 20 bp, Artificial
  CRISPR gRNA sequence
ttccccattaaccaccatca

SEQ ID NO: 73637 - DNA, 20 bp, Artificial
  CRISPR gRNA sequence
ccccattaaccaccatcacc

SEQ ID NO: 73638 - DNA, 20 bp, Artificial
  CRISPR gRNA sequence
cccattaaccaccatcacca

SEQ ID NO: 73639 - DNA, 20 bp, Artificial
  CRISPR gRNA sequence
accaccatcaccactcactc

SEQ ID NO: 73640 - DNA, 20 bp, Artificial
  CRISPR gRNA sequence
actcacccccttccccatta

SEQ ID NO: 73641 - DNA, 20 bp, Artificial
  CRISPR gRNA sequence
acccccttccccattaacca

SEQ ID NO: 73642 - DNA, 20 bp, Artificial
  CRISPR gRNA sequence
ccccattaaccaacgccacc

SEQ ID NO: 73643 - DNA, 20 bp, Artificial
  CRISPR gRNA sequence
cccattaaccaacgccacca

SEQ ID NO: 73644 - DNA, 20 bp, Artificial
  CRISPR gRNA sequence
accaacgccaccactcactc

SEQ ID NO: 73645 - DNA, 20 bp, Artificial
  CRISPR gRNA sequence
actcacaacccttccccatt

SEQ ID NO: 73646 - DNA, 20 bp, Artificial
  CRISPR gRNA sequence
acaacccttccccattaacc

SEQ ID NO: 73647 - DNA, 20 bp, Artificial
  CRISPR gRNA sequence
ccccattaaccaccaacacc

SEQ ID NO: 73648 - DNA, 20 bp, Artificial
  CRISPR gRNA sequence
cccattaaccaccaacacca

SEQ ID NO: 73649 - DNA, 20 bp, Artificial
  CRISPR gRNA sequence
accaccaacaccactcactc

SEQ ID NO: 73650 - DNA, 20 bp, Artificial
  CRISPR gRNA sequence
actcatctccttccccatta

SEQ ID NO: 73651 - DNA, 20 bp, Artificial
  CRISPR gRNA sequence
atctccttccccattaacca

SEQ ID NO: 73652 - DNA, 20 bp, Artificial
  CRISPR gRNA sequence
cttccccattaaccaccaac

SEQ ID NO: 73653 - DNA, 20 bp, Artificial
  CRISPR gRNA sequence
ccccattaaccaccaacaca

SEQ ID NO: 73654 - DNA, 20 bp, Artificial
  CRISPR gRNA sequence
cccattaaccaccaacacaa

SEQ ID NO: 73655 - DNA, 20 bp, Artificial
  CRISPR gRNA sequence
accaccaacacaactcactc

SEQ ID NO: 73656 - DNA, 20 bp, Artificial
  CRISPR gRNA sequence
actcacaacacttccccatt

SEQ ID NO: 73657 - DNA, 20 bp, Artificial
  CRISPR gRNA sequence
acaacacttccccattaacc

SEQ ID NO: 73658 - DNA, 20 bp, Artificial
  CRISPR gRNA sequence
ccccattaaccaccatcacc

SEQ ID NO: 73659 - DNA, 20 bp, Artificial
  CRISPR gRNA sequence
cccattaaccaccatcacca

SEQ ID NO: 73660 - DNA, 20 bp, Artificial
  CRISPR gRNA sequence
accaccatcaccactcactc

SEQ ID NO: 73661 - DNA, 20 bp, Artificial
  CRISPR gRNA sequence
actcacccccttccccatta

SEQ ID NO: 73662 - DNA, 20 bp, Artificial
  CRISPR gRNA sequence
acccccttccccattaacca

SEQ ID NO: 73663 - DNA, 20 bp, Artificial
  CRISPR gRNA sequence
ccccattaaccaccatcacc

SEQ ID NO: 73664 - DNA, 20 bp, Artificial
  CRISPR gRNA sequence
cccattaaccaccatcacca

SEQ ID NO: 73665 - DNA, 20 bp, Artificial
  CRISPR gRNA sequence
accaccatcaccactctcac

SEQ ID NO: 73666 - DNA, 20 bp, Artificial
  CRISPR gRNA sequence
tcacacccttccccattaac

SEQ ID NO: 73667 - DNA, 20 bp, Artificial
  CRISPR gRNA sequence
acacccttccccattaacca

SEQ ID NO: 73668 - DNA, 20 bp, Artificial
  CRISPR gRNA sequence
ccccattaaccaccatcacc

SEQ ID NO: 73669 - DNA, 20 bp, Artificial
  CRISPR gRNA sequence
cccattaaccaccatcacca

SEQ ID NO: 73670 - DNA, 20 bp, Artificial
  CRISPR gRNA sequence
accaccatcaccactcactc

SEQ ID NO: 73671 - DNA, 20 bp, Artificial
  CRISPR gRNA sequence
actcaccccattccccatta

SEQ ID NO: 73672 - DNA, 20 bp, Artificial
  CRISPR gRNA sequence
accccattccccattaacca

SEQ ID NO: 73673 - DNA, 20 bp, Artificial
  CRISPR gRNA sequence
cccattaaccactcccacca

SEQ ID NO: 73674 - DNA, 20 bp, Artificial
  CRISPR gRNA sequence
accactcccaccactcactc

SEQ ID NO: 73675 - DNA, 20 bp, Artificial
  CRISPR gRNA sequence
ccaccactcactcagcccat

SEQ ID NO: 73676 - DNA, 20 bp, Artificial
  CRISPR gRNA sequence
actcagcccattccccatta

SEQ ID NO: 73677 - DNA, 20 bp, Artificial
  CRISPR gRNA sequence
agcccattccccattaacca

SEQ ID NO: 73678 - DNA, 20 bp, Artificial
  CRISPR gRNA sequence
cccattaaccactcccacca

SEQ ID NO: 73679 - DNA, 20 bp, Artificial
  CRISPR gRNA sequence
accactcccaccactcactc

SEQ ID NO: 73680 - DNA, 20 bp, Artificial
  CRISPR gRNA sequence
ccaccactcactcaccccat

SEQ ID NO: 73681 - DNA, 20 bp, Artificial
  CRISPR gRNA sequence
actcaccccattccccatta

SEQ ID NO: 73682 - DNA, 20 bp, Artificial
  CRISPR gRNA sequence
accccattccccattaacca

SEQ ID NO: 73683 - DNA, 20 bp, Artificial
  CRISPR gRNA sequence
cccattaaccaaccccacca

SEQ ID NO: 73684 - DNA, 20 bp, Artificial
  CRISPR gRNA sequence
accaaccccaccactcaccc

SEQ ID NO: 73685 - DNA, 20 bp, Artificial
  CRISPR gRNA sequence
acccacttccaccatccatt

SEQ ID NO: 73686 - DNA, 20 bp, Artificial
  CRISPR gRNA sequence
ccaccatccattaaccaacc

SEQ ID NO: 73687 - DNA, 20 bp, Artificial
  CRISPR gRNA sequence
caccatccattaaccaaccc

SEQ ID NO: 73688 - DNA, 20 bp, Artificial
  CRISPR gRNA sequence
accaaccccaccactcaccc

SEQ ID NO: 73689 - DNA, 20 bp, Artificial
  CRISPR gRNA sequence
acccacttccaccatccatt

SEQ ID NO: 73690 - DNA, 20 bp, Artificial
  CRISPR gRNA sequence
ccaccatccattaaccaccc

SEQ ID NO: 73691 - DNA, 20 bp, Artificial
  CRISPR gRNA sequence
caccatccattaaccacccc

SEQ ID NO: 73692 - DNA, 20 bp, Artificial
  CRISPR gRNA sequence
accacccccaccactcactc

SEQ ID NO: 73693 - DNA, 20 bp, Artificial
  CRISPR gRNA sequence
actcacccacaaccaccatc

SEQ ID NO: 73694 - DNA, 20 bp, Artificial
  CRISPR gRNA sequence
acccacaaccaccatcacta

SEQ ID NO: 73695 - DNA, 20 bp, Artificial
  CRISPR gRNA sequence
cttactccagcctctttagc

SEQ ID NO: 73696 - DNA, 20 bp, Artificial
  CRISPR gRNA sequence
actccagcctctttagcatc

SEQ ID NO: 73697 - DNA, 20 bp, Artificial
  CRISPR gRNA sequence
ctccagcctctttagcatcc

SEQ ID NO: 73698 - DNA, 20 bp, Artificial
  CRISPR gRNA sequence
cagcctctttagcatccatt

SEQ ID NO: 73699 - DNA, 20 bp, Artificial
  CRISPR gRNA sequence
tttagcatccatttcccctc

SEQ ID NO: 73700 - DNA, 20 bp, Artificial
  CRISPR gRNA sequence
tagcatccatttcccctcaa

SEQ ID NO: 73701 - DNA, 20 bp, Artificial
  CRISPR gRNA sequence
agcatccatttcccctcaag

SEQ ID NO: 73702 - DNA, 20 bp, Artificial
  CRISPR gRNA sequence
gcatccatttcccctcaagg

SEQ ID NO: 73703 - DNA, 20 bp, Artificial
  CRISPR gRNA sequence
cccctcaagggccctcatca

SEQ ID NO: 73704 - DNA, 20 bp, Artificial
  CRISPR gRNA sequence
ccctcaagggccctcatcag

SEQ ID NO: 73705 - DNA, 20 bp, Artificial
  CRISPR gRNA sequence
aagggccctcatcagcgcct

SEQ ID NO: 73706 - DNA, 20 bp, Artificial
  CRISPR gRNA sequence
atcagcgccttggtgccctc

SEQ ID NO: 73707 - DNA, 20 bp, Artificial
  CRISPR gRNA sequence
ggtgccctcctcatcaaatt

SEQ ID NO: 73708 - DNA, 20 bp, Artificial
  CRISPR gRNA sequence
gtgccctcctcatcaaattg

SEQ ID NO: 73709 - DNA, 20 bp, Artificial
  CRISPR gRNA sequence
ctcatcaaattgattgttag

SEQ ID NO: 73710 - DNA, 20 bp, Artificial
  CRISPR gRNA sequence
atcaaattgattgttagaca

SEQ ID NO: 73711 - DNA, 20 bp, Artificial
  CRISPR gRNA sequence
attgttagacaagctgcaga

SEQ ID NO: 73712 - DNA, 20 bp, Artificial
  CRISPR gRNA sequence
ttagacaagctgcagaagac

SEQ ID NO: 73713 - DNA, 20 bp, Artificial
  CRISPR gRNA sequence
gacaagctgcagaagaccag

SEQ ID NO: 73714 - DNA, 20 bp, Artificial
  CRISPR gRNA sequence
cagaagaccaggcagaggca

SEQ ID NO: 73715 - DNA, 20 bp, Artificial
  CRISPR gRNA sequence
gcgcagcctgcccagccctg

SEQ ID NO: 73716 - DNA, 20 bp, Artificial
  CRISPR gRNA sequence
cccagccctggagctgagct

SEQ ID NO: 73717 - DNA, 20 bp, Artificial
  CRISPR gRNA sequence
gagctgagctgtcctgtcag

SEQ ID NO: 73718 - DNA, 20 bp, Artificial
  CRISPR gRNA sequence
agctgtcctgtcagctcccc

SEQ ID NO: 73719 - DNA, 20 bp, Artificial
  CRISPR gRNA sequence
tcctgtcagctcccctctcc

SEQ ID NO: 73720 - DNA, 20 bp, Artificial
  CRISPR gRNA sequence
tcagctcccctctcctgctc

SEQ ID NO: 73721 - DNA, 20 bp, Artificial
  CRISPR gRNA sequence
ccctctcctgctctgtcccc

SEQ ID NO: 73722 - DNA, 20 bp, Artificial
  CRISPR gRNA sequence
tcctgctctgtcccctggga

SEQ ID NO: 73723 - DNA, 20 bp, Artificial
  CRISPR gRNA sequence
ctgctctgtcccctgggagg

SEQ ID NO: 73724 - DNA, 20 bp, Artificial
  CRISPR gRNA sequence
ctctgtcccctgggaggcca

SEQ ID NO: 73725 - DNA, 20 bp, Artificial
  CRISPR gRNA sequence
tgtcccctgggaggccaact

SEQ ID NO: 73726 - DNA, 20 bp, Artificial
  CRISPR gRNA sequence
tcccctgggaggccaactct

SEQ ID NO: 73727 - DNA, 20 bp, Artificial
  CRISPR gRNA sequence
ggaggccaactctgcatctg

SEQ ID NO: 73728 - DNA, 20 bp, Artificial
  CRISPR gRNA sequence
tgcatctgcatgccctgggc

SEQ ID NO: 73729 - DNA, 20 bp, Artificial
  CRISPR gRNA sequence
catctgcatgccctgggcca

SEQ ID NO: 73730 - DNA, 20 bp, Artificial
  CRISPR gRNA sequence
catgccctgggccaccctcg

SEQ ID NO: 73731 - DNA, 20 bp, Artificial
  CRISPR gRNA sequence
ggccaccctcgctgtccagg

SEQ ID NO: 73732 - DNA, 20 bp, Artificial
  CRISPR gRNA sequence
gctgtccaggttccccatgg

SEQ ID NO: 73733 - DNA, 20 bp, Artificial
  CRISPR gRNA sequence
tccaggttccccatgggtat

SEQ ID NO: 73734 - DNA, 20 bp, Artificial
  CRISPR gRNA sequence
cccatgggtatccctagctc

SEQ ID NO: 73735 - DNA, 20 bp, Artificial
  CRISPR gRNA sequence
gctccagggctcaggctctg

SEQ ID NO: 73736 - DNA, 20 bp, Artificial
  CRISPR gRNA sequence
cagggctcaggctctgggta

SEQ ID NO: 73737 - DNA, 20 bp, Artificial
  CRISPR gRNA sequence
aggctctgggtaggcatgat

SEQ ID NO: 73738 - DNA, 20 bp, Artificial
  CRISPR gRNA sequence
tgggtaggcatgatagtcac

SEQ ID NO: 73739 - DNA, 20 bp, Artificial
  CRISPR gRNA sequence
ggtaggcatgatagtcacag

SEQ ID NO: 73740 - DNA, 20 bp, Artificial
  CRISPR gRNA sequence
gcccagctgagaaactatgc

SEQ ID NO: 73741 - DNA, 20 bp, Artificial
  CRISPR gRNA sequence
agaaactatgccctggatga

SEQ ID NO: 73742 - DNA, 20 bp, Artificial
  CRISPR gRNA sequence
tgccctggatgaaggctgca

SEQ ID NO: 73743 - DNA, 20 bp, Artificial
  CRISPR gRNA sequence
gatgaaggctgcagagagga

SEQ ID NO: 73744 - DNA, 20 bp, Artificial
  CRISPR gRNA sequence
cagagaggaagctgggggac

SEQ ID NO: 73745 - DNA, 20 bp, Artificial
  CRISPR gRNA sequence
ggggactagggacacacaca

SEQ ID NO: 73746 - DNA, 20 bp, Artificial
  CRISPR gRNA sequence
gggacacacacacacacaca

SEQ ID NO: 73747 - DNA, 20 bp, Artificial
  CRISPR gRNA sequence
ttgttcttcagccctctccg

SEQ ID NO: 73748 - DNA, 20 bp, Artificial
  CRISPR gRNA sequence
gttcttcagccctctccgta

SEQ ID NO: 73749 - DNA, 20 bp, Artificial
  CRISPR gRNA sequence
ttcttcagccctctccgtag

SEQ ID NO: 73750 - DNA, 20 bp, Artificial
  CRISPR gRNA sequence
ttcagccctctccgtagcct

SEQ ID NO: 73751 - DNA, 20 bp, Artificial
  CRISPR gRNA sequence
cagccctctccgtagcctga

SEQ ID NO: 73752 - DNA, 20 bp, Artificial
  CRISPR gRNA sequence
agccctctccgtagcctgac

SEQ ID NO: 73753 - DNA, 20 bp, Artificial
  CRISPR gRNA sequence
tccgtagcctgactcccaca

SEQ ID NO: 73754 - DNA, 20 bp, Artificial
  CRISPR gRNA sequence
cgtagcctgactcccacagc

SEQ ID NO: 73755 - DNA, 20 bp, Artificial
  CRISPR gRNA sequence
actcccacagccagcccagc

SEQ ID NO: 73756 - DNA, 20 bp, Artificial
  CRISPR gRNA sequence
ccacagccagcccagcagag

SEQ ID NO: 73757 - DNA, 20 bp, Artificial
  CRISPR gRNA sequence
atgagccccattttcataga

SEQ ID NO: 73758 - DNA, 20 bp, Artificial
  CRISPR gRNA sequence
tcatagataaggcaatcaaa

SEQ ID NO: 73759 - DNA, 20 bp, Artificial
  CRISPR gRNA sequence
catagataaggcaatcaaag

SEQ ID NO: 73760 - DNA, 20 bp, Artificial
  CRISPR gRNA sequence
atagataaggcaatcaaagc

SEQ ID NO: 73761 - DNA, 20 bp, Artificial
  CRISPR gRNA sequence
tgtgagtcagtggcgaaatt

SEQ ID NO: 73762 - DNA, 20 bp, Artificial
  CRISPR gRNA sequence
tgagtcagtggcgaaattca

SEQ ID NO: 73763 - DNA, 20 bp, Artificial
  CRISPR gRNA sequence
agaccaaaactgtggtgctc

SEQ ID NO: 73764 - DNA, 20 bp, Artificial
  CRISPR gRNA sequence
tggtgctcttccttccccag

SEQ ID NO: 73765 - DNA, 20 bp, Artificial
  CRISPR gRNA sequence
ttccttccccaggccacacc

SEQ ID NO: 73766 - DNA, 20 bp, Artificial
  CRISPR gRNA sequence
ccttccccaggccacaccca

SEQ ID NO: 73767 - DNA, 20 bp, Artificial
  CRISPR gRNA sequence
cttccccaggccacacccag

SEQ ID NO: 73768 - DNA, 20 bp, Artificial
  CRISPR gRNA sequence
ccccaggccacacccagaac

SEQ ID NO: 73769 - DNA, 20 bp, Artificial
  CRISPR gRNA sequence
cccaggccacacccagaact

SEQ ID NO: 73770 - DNA, 20 bp, Artificial
  CRISPR gRNA sequence
ctgcacttcatcaggggaag

SEQ ID NO: 73771 - DNA, 20 bp, Artificial
  CRISPR gRNA sequence
cacttcatcaggggaagggt

SEQ ID NO: 73772 - DNA, 20 bp, Artificial
  CRISPR gRNA sequence
catcaggggaagggtcattg

SEQ ID NO: 73773 - DNA, 20 bp, Artificial
  CRISPR gRNA sequence
atcaggggaagggtcattgg

SEQ ID NO: 73774 - DNA, 20 bp, Artificial
  CRISPR gRNA sequence
gttgaagtctcattgcctgc

SEQ ID NO: 73775 - DNA, 20 bp, Artificial
  CRISPR gRNA sequence
aagtctcattgcctgccctc

SEQ ID NO: 73776 - DNA, 20 bp, Artificial
  CRISPR gRNA sequence
attgcctgccctcccaaacg

SEQ ID NO: 73777 - DNA, 20 bp, Artificial
  CRISPR gRNA sequence
cctgccctcccaaacgccct

SEQ ID NO: 73778 - DNA, 20 bp, Artificial
  CRISPR gRNA sequence
ccctcccaaacgccctgctc

SEQ ID NO: 73779 - DNA, 20 bp, Artificial
  CRISPR gRNA sequence
ccaaacgccctgctctcttc

SEQ ID NO: 73780 - DNA, 20 bp, Artificial
  CRISPR gRNA sequence
ctctcttctccacccctcac

SEQ ID NO: 73781 - DNA, 20 bp, Artificial
  CRISPR gRNA sequence
tcttctccacccctcaccct

SEQ ID NO: 73782 - DNA, 20 bp, Artificial
  CRISPR gRNA sequence
ttctccacccctcaccctca

SEQ ID NO: 73783 - DNA, 20 bp, Artificial
  CRISPR gRNA sequence
ctccacccctcaccctcagc

SEQ ID NO: 73784 - DNA, 20 bp, Artificial
  CRISPR gRNA sequence
tccacccctcaccctcagct

SEQ ID NO: 73785 - DNA, 20 bp, Artificial
  CRISPR gRNA sequence
cacccctcaccctcagctgg

SEQ ID NO: 73786 - DNA, 20 bp, Artificial
  CRISPR gRNA sequence
accctcagctgggccacttg

SEQ ID NO: 73787 - DNA, 20 bp, Artificial
  CRISPR gRNA sequence
agctgggccacttgtcccca

SEQ ID NO: 73788 - DNA, 20 bp, Artificial
  CRISPR gRNA sequence
ggccacttgtccccaatccc

SEQ ID NO: 73789 - DNA, 20 bp, Artificial
  CRISPR gRNA sequence
gtccccaatccctccactct

SEQ ID NO: 73790 - DNA, 20 bp, Artificial
  CRISPR gRNA sequence
tccccaatccctccactctg

SEQ ID NO: 73791 - DNA, 20 bp, Artificial
  CRISPR gRNA sequence
cactctgcaactcactccag

SEQ ID NO: 73792 - DNA, 20 bp, Artificial
  CRISPR gRNA sequence
tgcaactcactccagctcct

SEQ ID NO: 73793 - DNA, 20 bp, Artificial
  CRISPR gRNA sequence
caactcactccagctcctcc

SEQ ID NO: 73794 - DNA, 20 bp, Artificial
  CRISPR gRNA sequence
actccagctcctccaagtgg

SEQ ID NO: 73795 - DNA, 20 bp, Artificial
  CRISPR gRNA sequence
cagctcctccaagtggtggc

SEQ ID NO: 73796 - DNA, 20 bp, Artificial
  CRISPR gRNA sequence
ctccaagtggtggcagtggc

SEQ ID NO: 73797 - DNA, 20 bp, Artificial
  CRISPR gRNA sequence
caagtggtggcagtggccca

SEQ ID NO: 73798 - DNA, 20 bp, Artificial
  CRISPR gRNA sequence
ggtgctcacacagctggagg

SEQ ID NO: 73799 - DNA, 20 bp, Artificial
  CRISPR gRNA sequence
acacagctggaggtcagcct

SEQ ID NO: 73800 - DNA, 20 bp, Artificial
  CRISPR gRNA sequence
gaggtcagcctggtgggggt

SEQ ID NO: 73801 - DNA, 20 bp, Artificial
  CRISPR gRNA sequence
gtgggggtcaaagggcaaca

SEQ ID NO: 73802 - DNA, 20 bp, Artificial
  CRISPR gRNA sequence
ggtcttgggagctctgaatg

SEQ ID NO: 73803 - DNA, 20 bp, Artificial
  CRISPR gRNA sequence
gggagctctgaatgctggtg

SEQ ID NO: 73804 - DNA, 20 bp, Artificial
  CRISPR gRNA sequence
ggagctctgaatgctggtgg

SEQ ID NO: 73805 - DNA, 20 bp, Artificial
  CRISPR gRNA sequence
tgaatgctggtggcagaggg

SEQ ID NO: 73806 - DNA, 20 bp, Artificial
  CRISPR gRNA sequence
aatgctggtggcagagggca

SEQ ID NO: 73807 - DNA, 20 bp, Artificial
  CRISPR gRNA sequence
gtggcagagggcaaggatgt

SEQ ID NO: 73808 - DNA, 20 bp, Artificial
  CRISPR gRNA sequence
cttcccttcgtaaatctctt

SEQ ID NO: 73809 - DNA, 20 bp, Artificial
  CRISPR gRNA sequence
cccttcgtaaatctcttcca

SEQ ID NO: 73810 - DNA, 20 bp, Artificial
  CRISPR gRNA sequence
ccttcgtaaatctcttccac

SEQ ID NO: 73811 - DNA, 20 bp, Artificial
  CRISPR gRNA sequence
cgtaaatctcttccaccatg

SEQ ID NO: 73812 - DNA, 20 bp, Artificial
  CRISPR gRNA sequence
gtaaatctcttccaccatga

SEQ ID NO: 73813 - DNA, 20 bp, Artificial
  CRISPR gRNA sequence
ttccaccatgaactcattaa

SEQ ID NO: 73814 - DNA, 20 bp, Artificial
  CRISPR gRNA sequence
ccaccatgaactcattaagc

SEQ ID NO: 73815 - DNA, 20 bp, Artificial
  CRISPR gRNA sequence
caccatgaactcattaagcc

SEQ ID NO: 73816 - DNA, 20 bp, Artificial
  CRISPR gRNA sequence
attaagccaccacagagctt

SEQ ID NO: 73817 - DNA, 20 bp, Artificial
  CRISPR gRNA sequence
agccaccacagagcttggaa

SEQ ID NO: 73818 - DNA, 20 bp, Artificial
  CRISPR gRNA sequence
ggaagcagaagcatggacta

SEQ ID NO: 73819 - DNA, 20 bp, Artificial
  CRISPR gRNA sequence
gaagcagaagcatggactag

SEQ ID NO: 73820 - DNA, 20 bp, Artificial
  CRISPR gRNA sequence
gttcagtatttcctaaaccg

SEQ ID NO: 73821 - DNA, 20 bp, Artificial
  CRISPR gRNA sequence
agtatttcctaaaccgcagt

SEQ ID NO: 73822 - DNA, 20 bp, Artificial
  CRISPR gRNA sequence
cctaaaccgcagtcattcag

SEQ ID NO: 73823 - DNA, 20 bp, Artificial
  CRISPR gRNA sequence
ctaaaccgcagtcattcagg

SEQ ID NO: 73824 - DNA, 20 bp, Artificial
  CRISPR gRNA sequence
aaccgcagtcattcaggtag

SEQ ID NO: 73825 - DNA, 20 bp, Artificial
  CRISPR gRNA sequence
aggtagcaacttcacaactt

SEQ ID NO: 73826 - DNA, 20 bp, Artificial
  CRISPR gRNA sequence
cacaacttaagccaggatta

SEQ ID NO: 73827 - DNA, 20 bp, Artificial
  CRISPR gRNA sequence
acaacttaagccaggattag

SEQ ID NO: 73828 - DNA, 20 bp, Artificial
  CRISPR gRNA sequence
aagccaggattaggtatcac

SEQ ID NO: 73829 - DNA, 20 bp, Artificial
  CRISPR gRNA sequence
agccaggattaggtatcact

SEQ ID NO: 73830 - DNA, 20 bp, Artificial
  CRISPR gRNA sequence
ggtatcactgtagtttagct

SEQ ID NO: 73831 - DNA, 20 bp, Artificial
  CRISPR gRNA sequence
tagtttagctagttactgtt

SEQ ID NO: 73832 - DNA, 20 bp, Artificial
  CRISPR gRNA sequence
agctagttactgttgtttat

SEQ ID NO: 73833 - DNA, 20 bp, Artificial
  CRISPR gRNA sequence
gctagttactgttgtttatt

SEQ ID NO: 73834 - DNA, 20 bp, Artificial
  CRISPR gRNA sequence
gttactgttgtttattacaa

SEQ ID NO: 73835 - DNA, 20 bp, Artificial
  CRISPR gRNA sequence
ctgttgtttattacaaactc

SEQ ID NO: 73836 - DNA, 20 bp, Artificial
  CRISPR gRNA sequence
ttgtttattacaaactctgc

SEQ ID NO: 73837 - DNA, 20 bp, Artificial
  CRISPR gRNA sequence
tttattacaaactctgcatc

SEQ ID NO: 73838 - DNA, 20 bp, Artificial
  CRISPR gRNA sequence
attacaaactctgcatcttt

SEQ ID NO: 73839 - DNA, 20 bp, Artificial
  CRISPR gRNA sequence
ttacaaactctgcatcttta

SEQ ID NO: 73840 - DNA, 20 bp, Artificial
  CRISPR gRNA sequence
caaactctgcatctttaaag

SEQ ID NO: 73841 - DNA, 20 bp, Artificial
  CRISPR gRNA sequence
tgcatctttaaagcaaatac

SEQ ID NO: 73842 - DNA, 20 bp, Artificial
  CRISPR gRNA sequence
catctttaaagcaaatactg

SEQ ID NO: 73843 - DNA, 20 bp, Artificial
  CRISPR gRNA sequence
taaagcaaatactgaagaag

SEQ ID NO: 73844 - DNA, 20 bp, Artificial
  CRISPR gRNA sequence
aaagcaaatactgaagaagt

SEQ ID NO: 73845 - DNA, 20 bp, Artificial
  CRISPR gRNA sequence
aagcaaatactgaagaagtg

SEQ ID NO: 73846 - DNA, 20 bp, Artificial
  CRISPR gRNA sequence
aagaagtgtcaaagatctct

SEQ ID NO: 73847 - DNA, 20 bp, Artificial
  CRISPR gRNA sequence
tctgtcctaaagagtttctt

SEQ ID NO: 73848 - DNA, 20 bp, Artificial
  CRISPR gRNA sequence
tgtcctaaagagtttcttcc

SEQ ID NO: 73849 - DNA, 20 bp, Artificial
  CRISPR gRNA sequence
tcctaaagagtttcttcctt

SEQ ID NO: 73850 - DNA, 20 bp, Artificial
  CRISPR gRNA sequence
aagagtttcttcctttttaa

SEQ ID NO: 73851 - DNA, 20 bp, Artificial
  CRISPR gRNA sequence
cttcctttttaaacatttat

SEQ ID NO: 73852 - DNA, 20 bp, Artificial
  CRISPR gRNA sequence
ttcctttttaaacatttatt

SEQ ID NO: 73853 - DNA, 20 bp, Artificial
  CRISPR gRNA sequence
cctttttaaacatttatttt

SEQ ID NO: 73854 - DNA, 20 bp, Artificial
  CRISPR gRNA sequence
ctttttaaacatttatttta

SEQ ID NO: 73855 - DNA, 20 bp, Artificial
  CRISPR gRNA sequence
tttaaacatttattttattt

SEQ ID NO: 73856 - DNA, 20 bp, Artificial
  CRISPR gRNA sequence
ttaaacatttattttattta

SEQ ID NO: 73857 - DNA, 20 bp, Artificial
  CRISPR gRNA sequence
taaacatttattttatttat

SEQ ID NO: 73858 - DNA, 20 bp, Artificial
  CRISPR gRNA sequence
aaacatttattttatttatt

SEQ ID NO: 73859 - DNA, 20 bp, Artificial
  CRISPR gRNA sequence
aacatttattttatttattt

SEQ ID NO: 73860 - DNA, 20 bp, Artificial
  CRISPR gRNA sequence
attttatttatttatttttt

SEQ ID NO: 73861 - DNA, 20 bp, Artificial
  CRISPR gRNA sequence
ttttatttatttattttttg

SEQ ID NO: 73862 - DNA, 20 bp, Artificial
  CRISPR gRNA sequence
tatttatttattttttgtag

SEQ ID NO: 73863 - DNA, 20 bp, Artificial
  CRISPR gRNA sequence
atttatttattttttgtaga

SEQ ID NO: 73864 - DNA, 20 bp, Artificial
  CRISPR gRNA sequence
tttatttattttttgtagag

SEQ ID NO: 73865 - DNA, 20 bp, Artificial
  CRISPR gRNA sequence
atttattttttgtagagatg

SEQ ID NO: 73866 - DNA, 20 bp, Artificial
  CRISPR gRNA sequence
tttattttttgtagagatgg

SEQ ID NO: 73867 - DNA, 20 bp, Artificial
  CRISPR gRNA sequence
attttttgtagagatggggg

SEQ ID NO: 73868 - DNA, 20 bp, Artificial
  CRISPR gRNA sequence
ttttttgtagagatgggggt

SEQ ID NO: 73869 - DNA, 20 bp, Artificial
  CRISPR gRNA sequence
tttgtagagatgggggtggt

SEQ ID NO: 73870 - DNA, 20 bp, Artificial
  CRISPR gRNA sequence
ttgtagagatgggggtggtc

SEQ ID NO: 73871 - DNA, 20 bp, Artificial
  CRISPR gRNA sequence
tgtagagatgggggtggtct

SEQ ID NO: 73872 - DNA, 20 bp, Artificial
  CRISPR gRNA sequence
gtagagatgggggtggtctc

SEQ ID NO: 73873 - DNA, 20 bp, Artificial
  CRISPR gRNA sequence
tagagatgggggtggtctcg

SEQ ID NO: 73874 - DNA, 20 bp, Artificial
  CRISPR gRNA sequence
gctatgttgctcaggctggt

SEQ ID NO: 73875 - DNA, 20 bp, Artificial
  CRISPR gRNA sequence
tgttgctcaggctggtgtcg

SEQ ID NO: 73876 - DNA, 20 bp, Artificial
  CRISPR gRNA sequence
ctcaggctggtgtcgaactc

SEQ ID NO: 73877 - DNA, 20 bp, Artificial
  CRISPR gRNA sequence
aggctggtgtcgaactcccg

SEQ ID NO: 73878 - DNA, 20 bp, Artificial
  CRISPR gRNA sequence
gtgtcgaactcccgggctca

SEQ ID NO: 73879 - DNA, 20 bp, Artificial
  CRISPR gRNA sequence
ccgggctcaagcgatttttc

SEQ ID NO: 73880 - DNA, 20 bp, Artificial
  CRISPR gRNA sequence
aagcgatttttcctcctcgg

SEQ ID NO: 73881 - DNA, 20 bp, Artificial
  CRISPR gRNA sequence
ttcctcctcggcctcccaga

SEQ ID NO: 73882 - DNA, 20 bp, Artificial
  CRISPR gRNA sequence
tcctcctcggcctcccagag

SEQ ID NO: 73883 - DNA, 20 bp, Artificial
  CRISPR gRNA sequence
cctcctcggcctcccagagt

SEQ ID NO: 73884 - DNA, 20 bp, Artificial
  CRISPR gRNA sequence
ctcctcggcctcccagagtg

SEQ ID NO: 73885 - DNA, 20 bp, Artificial
  CRISPR gRNA sequence
ctcggcctcccagagtgctg

SEQ ID NO: 73886 - DNA, 20 bp, Artificial
  CRISPR gRNA sequence
ggcctcccagagtgctggga

SEQ ID NO: 73887 - DNA, 20 bp, Artificial
  CRISPR gRNA sequence
ccagagtgctgggattacaa

SEQ ID NO: 73888 - DNA, 20 bp, Artificial
  CRISPR gRNA sequence
ggattacaagcttgagccac

SEQ ID NO: 73889 - DNA, 20 bp, Artificial
  CRISPR gRNA sequence
caagcttgagccactgttcc

SEQ ID NO: 73890 - DNA, 20 bp, Artificial
  CRISPR gRNA sequence
gagccactgttcccagccca

SEQ ID NO: 73891 - DNA, 20 bp, Artificial
  CRISPR gRNA sequence
agccactgttcccagcccaa

SEQ ID NO: 73892 - DNA, 20 bp, Artificial
  CRISPR gRNA sequence
ttcccagcccaagagtttct

SEQ ID NO: 73893 - DNA, 20 bp, Artificial
  CRISPR gRNA sequence
ccagcccaagagtttcttct

SEQ ID NO: 73894 - DNA, 20 bp, Artificial
  CRISPR gRNA sequence
cttcttggtgtaatcagtta

SEQ ID NO: 73895 - DNA, 20 bp, Artificial
  CRISPR gRNA sequence
ttcttggtgtaatcagttag

SEQ ID NO: 73896 - DNA, 20 bp, Artificial
  CRISPR gRNA sequence
cttggtgtaatcagttagat

SEQ ID NO: 73897 - DNA, 20 bp, Artificial
  CRISPR gRNA sequence
ttggtgtaatcagttagatg

SEQ ID NO: 73898 - DNA, 20 bp, Artificial
  CRISPR gRNA sequence
ggtgtaatcagttagatgga

SEQ ID NO: 73899 - DNA, 20 bp, Artificial
  CRISPR gRNA sequence
gtgtaatcagttagatggaa

SEQ ID NO: 73900 - DNA, 20 bp, Artificial
  CRISPR gRNA sequence
gatggaaataaaatgtaaag

SEQ ID NO: 73901 - DNA, 20 bp, Artificial
  CRISPR gRNA sequence
ggaaagctacattttgcaac

SEQ ID NO: 73902 - DNA, 20 bp, Artificial
  CRISPR gRNA sequence
cattttgcaactgtcatgct

SEQ ID NO: 73903 - DNA, 20 bp, Artificial
  CRISPR gRNA sequence
tgcaactgtcatgctgattc

SEQ ID NO: 73904 - DNA, 20 bp, Artificial
  CRISPR gRNA sequence
gcaactgtcatgctgattca

SEQ ID NO: 73905 - DNA, 20 bp, Artificial
  CRISPR gRNA sequence
caactgtcatgctgattcat

SEQ ID NO: 73906 - DNA, 20 bp, Artificial
  CRISPR gRNA sequence
tcatgctgattcatcgattt

SEQ ID NO: 73907 - DNA, 20 bp, Artificial
  CRISPR gRNA sequence
attcatcgatttaagtaaga

SEQ ID NO: 73908 - DNA, 20 bp, Artificial
  CRISPR gRNA sequence
atcgatttaagtaagattta

SEQ ID NO: 73909 - DNA, 20 bp, Artificial
  CRISPR gRNA sequence
aagtaagatttattaacggc

SEQ ID NO: 73910 - DNA, 20 bp, Artificial
  CRISPR gRNA sequence
agtaagatttattaacggct

SEQ ID NO: 73911 - DNA, 20 bp, Artificial
  CRISPR gRNA sequence
attaacggctgctaaaattt

SEQ ID NO: 73912 - DNA, 20 bp, Artificial
  CRISPR gRNA sequence
ttaacggctgctaaaatttg

SEQ ID NO: 73913 - DNA, 20 bp, Artificial
  CRISPR gRNA sequence
acggctgctaaaatttgcca

SEQ ID NO: 73914 - DNA, 20 bp, Artificial
  CRISPR gRNA sequence
ctaaaatttgccaatgagag

SEQ ID NO: 73915 - DNA, 20 bp, Artificial
  CRISPR gRNA sequence
aaatttgccaatgagagttt

SEQ ID NO: 73916 - DNA, 20 bp, Artificial
  CRISPR gRNA sequence
gccaatgagagtttgaggaa

SEQ ID NO: 73917 - DNA, 20 bp, Artificial
  CRISPR gRNA sequence
ccaatgagagtttgaggaag

SEQ ID NO: 73918 - DNA, 20 bp, Artificial
  CRISPR gRNA sequence
gaggaagacttaatacataa

SEQ ID NO: 73919 - DNA, 20 bp, Artificial
  CRISPR gRNA sequence
aggaagacttaatacataat

SEQ ID NO: 73920 - DNA, 20 bp, Artificial
  CRISPR gRNA sequence
aatacataatcttaaagtat

SEQ ID NO: 73921 - DNA, 20 bp, Artificial
  CRISPR gRNA sequence
atacataatcttaaagtatc

SEQ ID NO: 73922 - DNA, 20 bp, Artificial
  CRISPR gRNA sequence
aaagtatctccccacataat

SEQ ID NO: 73923 - DNA, 20 bp, Artificial
  CRISPR gRNA sequence
aagtatctccccacataatc

SEQ ID NO: 73924 - DNA, 20 bp, Artificial
  CRISPR gRNA sequence
cccacataatctatgttgat

SEQ ID NO: 73925 - DNA, 20 bp, Artificial
  CRISPR gRNA sequence
tgttgattacaaagggaaag

SEQ ID NO: 73926 - DNA, 20 bp, Artificial
  CRISPR gRNA sequence
attacaaagggaaagttagt

SEQ ID NO: 73927 - DNA, 20 bp, Artificial
  CRISPR gRNA sequence
caaagggaaagttagtaaat

SEQ ID NO: 73928 - DNA, 20 bp, Artificial
  CRISPR gRNA sequence
gtaaatttgcaagtggagag

SEQ ID NO: 73929 - DNA, 20 bp, Artificial
  CRISPR gRNA sequence
gcaagtggagagacctggca

SEQ ID NO: 73930 - DNA, 20 bp, Artificial
  CRISPR gRNA sequence
caagtggagagacctggcag

SEQ ID NO: 73931 - DNA, 20 bp, Artificial
  CRISPR gRNA sequence
gcagacaccactgtcacagg

SEQ ID NO: 73932 - DNA, 20 bp, Artificial
  CRISPR gRNA sequence
tcacaggtgatcacagttaa

SEQ ID NO: 73933 - DNA, 20 bp, Artificial
  CRISPR gRNA sequence
acatcactagcccgaggact

SEQ ID NO: 73934 - DNA, 20 bp, Artificial
  CRISPR gRNA sequence
gcccgaggactctgacacat

SEQ ID NO: 73935 - DNA, 20 bp, Artificial
  CRISPR gRNA sequence
tgacacatcatgtgccccga

SEQ ID NO: 73936 - DNA, 20 bp, Artificial
  CRISPR gRNA sequence
acacatcatgtgccccgatg

SEQ ID NO: 73937 - DNA, 20 bp, Artificial
  CRISPR gRNA sequence
tgtgatattcctgcccaaag

SEQ ID NO: 73938 - DNA, 20 bp, Artificial
  CRISPR gRNA sequence
ctgcccaaagggcagactct

SEQ ID NO: 73939 - DNA, 20 bp, Artificial
  CRISPR gRNA sequence
cccaaagggcagactctaac

SEQ ID NO: 73940 - DNA, 20 bp, Artificial
  CRISPR gRNA sequence
taactctaaacatgaggaaa

SEQ ID NO: 73941 - DNA, 20 bp, Artificial
  CRISPR gRNA sequence
actctaaacatgaggaaaca

SEQ ID NO: 73942 - DNA, 20 bp, Artificial
  CRISPR gRNA sequence
taaacatgaggaaacattgg

SEQ ID NO: 73943 - DNA, 20 bp, Artificial
  CRISPR gRNA sequence
aacatgaggaaacattggac

SEQ ID NO: 73944 - DNA, 20 bp, Artificial
  CRISPR gRNA sequence
gacaaacccaagtggaagga

SEQ ID NO: 73945 - DNA, 20 bp, Artificial
  CRISPR gRNA sequence
tataaaataactggcctgta

SEQ ID NO: 73946 - DNA, 20 bp, Artificial
  CRISPR gRNA sequence
taaaataactggcctgtaaa

SEQ ID NO: 73947 - DNA, 20 bp, Artificial
  CRISPR gRNA sequence
gcctgtaaatgtcagagaca

SEQ ID NO: 73948 - DNA, 20 bp, Artificial
  CRISPR gRNA sequence
taaatgtcagagacaatgct

SEQ ID NO: 73949 - DNA, 20 bp, Artificial
  CRISPR gRNA sequence
tgaaagacaaagaagggcca

SEQ ID NO: 73950 - DNA, 20 bp, Artificial
  CRISPR gRNA sequence
cagattgaaggagacactaa

SEQ ID NO: 73951 - DNA, 20 bp, Artificial
  CRISPR gRNA sequence
aaggagacactaaagagatg

SEQ ID NO: 73952 - DNA, 20 bp, Artificial
  CRISPR gRNA sequence
aagagatgacactaaatgag

SEQ ID NO: 73953 - DNA, 20 bp, Artificial
  CRISPR gRNA sequence
aatgagacgtgtgatcctgg

SEQ ID NO: 73954 - DNA, 20 bp, Artificial
  CRISPR gRNA sequence
gattggatccacaactggga

SEQ ID NO: 73955 - DNA, 20 bp, Artificial
  CRISPR gRNA sequence
gatccacaactgggaaaaaa

SEQ ID NO: 73956 - DNA, 20 bp, Artificial
  CRISPR gRNA sequence
ggaaaaaaatgcaataagca

SEQ ID NO: 73957 - DNA, 20 bp, Artificial
  CRISPR gRNA sequence
ttgggagaactggtgagatt

SEQ ID NO: 73958 - DNA, 20 bp, Artificial
  CRISPR gRNA sequence
ggagaactggtgagattgga

SEQ ID NO: 73959 - DNA, 20 bp, Artificial
  CRISPR gRNA sequence
gtgagattggagtataaact

SEQ ID NO: 73960 - DNA, 20 bp, Artificial
  CRISPR gRNA sequence
gagtataaactgtagttgag

SEQ ID NO: 73961 - DNA, 20 bp, Artificial
  CRISPR gRNA sequence
tagttgagataatagtagtg

SEQ ID NO: 73962 - DNA, 20 bp, Artificial
  CRISPR gRNA sequence
agataatagtagtgtatcaa

SEQ ID NO: 73963 - DNA, 20 bp, Artificial
  CRISPR gRNA sequence
cctggattttataattttac

SEQ ID NO: 73964 - DNA, 20 bp, Artificial
  CRISPR gRNA sequence
ctggattttataattttact

SEQ ID NO: 73965 - DNA, 20 bp, Artificial
  CRISPR gRNA sequence
gattttataattttactgga

SEQ ID NO: 73966 - DNA, 20 bp, Artificial
  CRISPR gRNA sequence
tataattttactggattatg

SEQ ID NO: 73967 - DNA, 20 bp, Artificial
  CRISPR gRNA sequence
ataattttactggattatgg

SEQ ID NO: 73968 - DNA, 20 bp, Artificial
  CRISPR gRNA sequence
taattttactggattatgga

SEQ ID NO: 73969 - DNA, 20 bp, Artificial
  CRISPR gRNA sequence
tactggattatggaagagaa

SEQ ID NO: 73970 - DNA, 20 bp, Artificial
  CRISPR gRNA sequence
actggattatggaagagaat

SEQ ID NO: 73971 - DNA, 20 bp, Artificial
  CRISPR gRNA sequence
ctggattatggaagagaatg

SEQ ID NO: 73972 - DNA, 20 bp, Artificial
  CRISPR gRNA sequence
gattatggaagagaatgtcc

SEQ ID NO: 73973 - DNA, 20 bp, Artificial
  CRISPR gRNA sequence
tggaagagaatgtccttatt

SEQ ID NO: 73974 - DNA, 20 bp, Artificial
  CRISPR gRNA sequence
atttctagcaaattcgctga

SEQ ID NO: 73975 - DNA, 20 bp, Artificial
  CRISPR gRNA sequence
tttctagcaaattcgctgaa

SEQ ID NO: 73976 - DNA, 20 bp, Artificial
  CRISPR gRNA sequence
ctagcaaattcgctgaaatg

SEQ ID NO: 73977 - DNA, 20 bp, Artificial
  CRISPR gRNA sequence
tagcaaattcgctgaaatgt

SEQ ID NO: 73978 - DNA, 20 bp, Artificial
  CRISPR gRNA sequence
gcaaattcgctgaaatgtta

SEQ ID NO: 73979 - DNA, 20 bp, Artificial
  CRISPR gRNA sequence
gctgaaatgttaacgggtaa

SEQ ID NO: 73980 - DNA, 20 bp, Artificial
  CRISPR gRNA sequence
aaatgttaacgggtaaaggg

SEQ ID NO: 73981 - DNA, 20 bp, Artificial
  CRISPR gRNA sequence
acgggtaaagggacatgatt

SEQ ID NO: 73982 - DNA, 20 bp, Artificial
  CRISPR gRNA sequence
caacttacttctaaatggtt

SEQ ID NO: 73983 - DNA, 20 bp, Artificial
  CRISPR gRNA sequence
acttctaaatggttcagaaa

SEQ ID NO: 73984 - DNA, 20 bp, Artificial
  CRISPR gRNA sequence
cttctaaatggttcagaaaa

SEQ ID NO: 73985 - DNA, 20 bp, Artificial
  CRISPR gRNA sequence
ctaaatggttcagaaaagga

SEQ ID NO: 73986 - DNA, 20 bp, Artificial
  CRISPR gRNA sequence
taaatggttcagaaaaggag

SEQ ID NO: 73987 - DNA, 20 bp, Artificial
  CRISPR gRNA sequence
aatggttcagaaaaggagag

SEQ ID NO: 73988 - DNA, 20 bp, Artificial
  CRISPR gRNA sequence
agaaaaggagagagggagag

SEQ ID NO: 73989 - DNA, 20 bp, Artificial
  CRISPR gRNA sequence
gcaaagggtgaatttgttct

SEQ ID NO: 73990 - DNA, 20 bp, Artificial
  CRISPR gRNA sequence
gttcttttttttttttttcg

SEQ ID NO: 73991 - DNA, 20 bp, Artificial
  CRISPR gRNA sequence
ttcttttttttttttttcgg

SEQ ID NO: 73992 - DNA, 20 bp, Artificial
  CRISPR gRNA sequence
ttttttttttttttcggaaa

SEQ ID NO: 73993 - DNA, 20 bp, Artificial
  CRISPR gRNA sequence
ttttttttttttcggaaacc

SEQ ID NO: 73994 - DNA, 20 bp, Artificial
  CRISPR gRNA sequence
tttttttttttcggaaaccg

SEQ ID NO: 73995 - DNA, 20 bp, Artificial
  CRISPR gRNA sequence
ttttttttttcggaaaccga

SEQ ID NO: 73996 - DNA, 20 bp, Artificial
  CRISPR gRNA sequence
tttttttttcggaaaccgag

SEQ ID NO: 73997 - DNA, 20 bp, Artificial
  CRISPR gRNA sequence
ttttttttcggaaaccgagc

SEQ ID NO: 73998 - DNA, 20 bp, Artificial
  CRISPR gRNA sequence
tttttttcggaaaccgagcc

SEQ ID NO: 73999 - DNA, 20 bp, Artificial
  CRISPR gRNA sequence
ttttttcggaaaccgagcct

SEQ ID NO: 74000 - DNA, 20 bp, Artificial
  CRISPR gRNA sequence
tttttcggaaaccgagcctc

SEQ ID NO: 74001 - DNA, 20 bp, Artificial
  CRISPR gRNA sequence
ttttcggaaaccgagcctcg

SEQ ID NO: 74002 - DNA, 20 bp, Artificial
  CRISPR gRNA sequence
tttcggaaaccgagcctcgc

SEQ ID NO: 74003 - DNA, 20 bp, Artificial
  CRISPR gRNA sequence
ttcggaaaccgagcctcgct

SEQ ID NO: 74004 - DNA, 20 bp, Artificial
  CRISPR gRNA sequence
tcggaaaccgagcctcgctc

SEQ ID NO: 74005 - DNA, 20 bp, Artificial
  CRISPR gRNA sequence
cggaaaccgagcctcgctct

SEQ ID NO: 74006 - DNA, 20 bp, Artificial
  CRISPR gRNA sequence
ggaaaccgagcctcgctctg

SEQ ID NO: 74007 - DNA, 20 bp, Artificial
  CRISPR gRNA sequence
gctctgtcacctaggctaga

SEQ ID NO: 74008 - DNA, 20 bp, Artificial
  CRISPR gRNA sequence
tgtcacctaggctagagtgc

SEQ ID NO: 74009 - DNA, 20 bp, Artificial
  CRISPR gRNA sequence
tcacctaggctagagtgcag

SEQ ID NO: 74010 - DNA, 20 bp, Artificial
  CRISPR gRNA sequence
ggctagagtgcagtggcaca

SEQ ID NO: 74011 - DNA, 20 bp, Artificial
  CRISPR gRNA sequence
gagtgcagtggcacaatctt

SEQ ID NO: 74012 - DNA, 20 bp, Artificial
  CRISPR gRNA sequence
ggctcactgtaacctcagcc

SEQ ID NO: 74013 - DNA, 20 bp, Artificial
  CRISPR gRNA sequence
gctcactgtaacctcagcct

SEQ ID NO: 74014 - DNA, 20 bp, Artificial
  CRISPR gRNA sequence
actgtaacctcagcctcccg

SEQ ID NO: 74015 - DNA, 20 bp, Artificial
  CRISPR gRNA sequence
taacctcagcctcccgggtt

SEQ ID NO: 74016 - DNA, 20 bp, Artificial
  CRISPR gRNA sequence
agcctcccgggttcaagcaa

SEQ ID NO: 74017 - DNA, 20 bp, Artificial
  CRISPR gRNA sequence
ccgggttcaagcaattcttg

SEQ ID NO: 74018 - DNA, 20 bp, Artificial
  CRISPR gRNA sequence
aagcaattcttgtgcctcag

SEQ ID NO: 74019 - DNA, 20 bp, Artificial
  CRISPR gRNA sequence
ttgtgcctcagcctcccaat

SEQ ID NO: 74020 - DNA, 20 bp, Artificial
  CRISPR gRNA sequence
gtgcctcagcctcccaatta

SEQ ID NO: 74021 - DNA, 20 bp, Artificial
  CRISPR gRNA sequence
tgcctcagcctcccaattag

SEQ ID NO: 74022 - DNA, 20 bp, Artificial
  CRISPR gRNA sequence
agcctcccaattagctggga

SEQ ID NO: 74023 - DNA, 20 bp, Artificial
  CRISPR gRNA sequence
ccaattagctgggattacag

SEQ ID NO: 74024 - DNA, 20 bp, Artificial
  CRISPR gRNA sequence
gctgggattacaggcatgca

SEQ ID NO: 74025 - DNA, 20 bp, Artificial
  CRISPR gRNA sequence
ggattacaggcatgcaccac

SEQ ID NO: 74026 - DNA, 20 bp, Artificial
  CRISPR gRNA sequence
caggcatgcaccaccatgcc

SEQ ID NO: 74027 - DNA, 20 bp, Artificial
  CRISPR gRNA sequence
atttttttgtattttagtag

SEQ ID NO: 74028 - DNA, 20 bp, Artificial
  CRISPR gRNA sequence
ttttgtattttagtagagac

SEQ ID NO: 74029 - DNA, 20 bp, Artificial
  CRISPR gRNA sequence
tttgtattttagtagagacg

SEQ ID NO: 74030 - DNA, 20 bp, Artificial
  CRISPR gRNA sequence
ttgtattttagtagagacgg

SEQ ID NO: 74031 - DNA, 20 bp, Artificial
  CRISPR gRNA sequence
tgtattttagtagagacggg

SEQ ID NO: 74032 - DNA, 20 bp, Artificial
  CRISPR gRNA sequence
gtattttagtagagacgggg

SEQ ID NO: 74033 - DNA, 20 bp, Artificial
  CRISPR gRNA sequence
tattttagtagagacggggt

SEQ ID NO: 74034 - DNA, 20 bp, Artificial
  CRISPR gRNA sequence
tagtagagacggggtttcac

SEQ ID NO: 74035 - DNA, 20 bp, Artificial
  CRISPR gRNA sequence
agtagagacggggtttcacc

SEQ ID NO: 74036 - DNA, 20 bp, Artificial
  CRISPR gRNA sequence
gtagagacggggtttcaccg

SEQ ID NO: 74037 - DNA, 20 bp, Artificial
  CRISPR gRNA sequence
caccgtgttgtccagggtgg

SEQ ID NO: 74038 - DNA, 20 bp, Artificial
  CRISPR gRNA sequence
accgtgttgtccagggtggt

SEQ ID NO: 74039 - DNA, 20 bp, Artificial
  CRISPR gRNA sequence
tccagggtggtctcgaattc

SEQ ID NO: 74040 - DNA, 20 bp, Artificial
  CRISPR gRNA sequence
gaattcctgagctcaggcaa

SEQ ID NO: 74041 - DNA, 20 bp, Artificial
  CRISPR gRNA sequence
ctgagctcaggcaatccacc

SEQ ID NO: 74042 - DNA, 20 bp, Artificial
  CRISPR gRNA sequence
agctcaggcaatccacctgc

SEQ ID NO: 74043 - DNA, 20 bp, Artificial
  CRISPR gRNA sequence
aggcaatccacctgcctcgg

SEQ ID NO: 74044 - DNA, 20 bp, Artificial
  CRISPR gRNA sequence
cctcggcctcccaaagtgct

SEQ ID NO: 74045 - DNA, 20 bp, Artificial
  CRISPR gRNA sequence
ggcctcccaaagtgctagga

SEQ ID NO: 74046 - DNA, 20 bp, Artificial
  CRISPR gRNA sequence
ccaaagtgctaggattacag

SEQ ID NO: 74047 - DNA, 20 bp, Artificial
  CRISPR gRNA sequence
ggattacagacatgagccac

SEQ ID NO: 74048 - DNA, 20 bp, Artificial
  CRISPR gRNA sequence
cagacatgagccaccacgcc

SEQ ID NO: 74049 - DNA, 20 bp, Artificial
  CRISPR gRNA sequence
taagggtgaatttgggtaaa

SEQ ID NO: 74050 - DNA, 20 bp, Artificial
  CRISPR gRNA sequence
agggtgaatttgggtaaatg

SEQ ID NO: 74051 - DNA, 20 bp, Artificial
  CRISPR gRNA sequence
gggtaaatggcacacagcag

SEQ ID NO: 74052 - DNA, 20 bp, Artificial
  CRISPR gRNA sequence
ggtaaatggcacacagcagt

SEQ ID NO: 74053 - DNA, 20 bp, Artificial
  CRISPR gRNA sequence
tcagtcttcttgaaactttg

SEQ ID NO: 74054 - DNA, 20 bp, Artificial
  CRISPR gRNA sequence
agtcttcttgaaactttgtg

SEQ ID NO: 74055 - DNA, 20 bp, Artificial
  CRISPR gRNA sequence
cttgaaactttgtgttagtt

SEQ ID NO: 74056 - DNA, 20 bp, Artificial
  CRISPR gRNA sequence
ttgaaactttgtgttagttc

SEQ ID NO: 74057 - DNA, 20 bp, Artificial
  CRISPR gRNA sequence
gaaactttgtgttagttcgc

SEQ ID NO: 74058 - DNA, 20 bp, Artificial
  CRISPR gRNA sequence
aaactttgtgttagttcgca

SEQ ID NO: 74059 - DNA, 20 bp, Artificial
  CRISPR gRNA sequence
tgtgttagttcgcagttatt

SEQ ID NO: 74060 - DNA, 20 bp, Artificial
  CRISPR gRNA sequence
gtgttagttcgcagttattt

SEQ ID NO: 74061 - DNA, 20 bp, Artificial
  CRISPR gRNA sequence
tgttagttcgcagttatttt

SEQ ID NO: 74062 - DNA, 20 bp, Artificial
  CRISPR gRNA sequence
gttcgcagttattttaaaag

SEQ ID NO: 74063 - DNA, 20 bp, Artificial
  CRISPR gRNA sequence
gcagttattttaaaagaaaa

SEQ ID NO: 74064 - DNA, 20 bp, Artificial
  CRISPR gRNA sequence
ttttaaaagaaaaacaatga

SEQ ID NO: 74065 - DNA, 20 bp, Artificial
  CRISPR gRNA sequence
taaaagaaaaacaatgaaag

SEQ ID NO: 74066 - DNA, 20 bp, Artificial
  CRISPR gRNA sequence
aaaagaaaaacaatgaaaga

SEQ ID NO: 74067 - DNA, 20 bp, Artificial
  CRISPR gRNA sequence
aaagaaaaacaatgaaagag

SEQ ID NO: 74068 - DNA, 20 bp, Artificial
  CRISPR gRNA sequence
aaaagggaacaactttcttg

SEQ ID NO: 74069 - DNA, 20 bp, Artificial
  CRISPR gRNA sequence
tcttgccatgtggctcaatg

SEQ ID NO: 74070 - DNA, 20 bp, Artificial
  CRISPR gRNA sequence
cttgccatgtggctcaatgt

SEQ ID NO: 74071 - DNA, 20 bp, Artificial
  CRISPR gRNA sequence
ttgccatgtggctcaatgtt

SEQ ID NO: 74072 - DNA, 20 bp, Artificial
  CRISPR gRNA sequence
gccatgtggctcaatgttcc

SEQ ID NO: 74073 - DNA, 20 bp, Artificial
  CRISPR gRNA sequence
ccatgtggctcaatgttcct

SEQ ID NO: 74074 - DNA, 20 bp, Artificial
  CRISPR gRNA sequence
aatgttcctaaggtcatgtt

SEQ ID NO: 74075 - DNA, 20 bp, Artificial
  CRISPR gRNA sequence
ctaaggtcatgtttacgact

SEQ ID NO: 74076 - DNA, 20 bp, Artificial
  CRISPR gRNA sequence
aggtcatgtttacgactagg

SEQ ID NO: 74077 - DNA, 20 bp, Artificial
  CRISPR gRNA sequence
acgactaggtacccctaaaa

SEQ ID NO: 74078 - DNA, 20 bp, Artificial
  CRISPR gRNA sequence
cgactaggtacccctaaaaa

SEQ ID NO: 74079 - DNA, 20 bp, Artificial
  CRISPR gRNA sequence
ggtacccctaaaaatcatct

SEQ ID NO: 74080 - DNA, 20 bp, Artificial
  CRISPR gRNA sequence
aaaatcatctccagggccac

SEQ ID NO: 74081 - DNA, 20 bp, Artificial
  CRISPR gRNA sequence
cagggccacctgtggtttgt

SEQ ID NO: 74082 - DNA, 20 bp, Artificial
  CRISPR gRNA sequence
tggtttgtgtccacagagta

SEQ ID NO: 74083 - DNA, 20 bp, Artificial
  CRISPR gRNA sequence
gtgtccacagagtaagacac

SEQ ID NO: 74084 - DNA, 20 bp, Artificial
  CRISPR gRNA sequence
tgtccacagagtaagacaca

SEQ ID NO: 74085 - DNA, 20 bp, Artificial
  CRISPR gRNA sequence
tgagcccagggctgggaata

SEQ ID NO: 74086 - DNA, 20 bp, Artificial
  CRISPR gRNA sequence
agcccagggctgggaataac

SEQ ID NO: 74087 - DNA, 20 bp, Artificial
  CRISPR gRNA sequence
ggaataacgggaggtgtcag

SEQ ID NO: 74088 - DNA, 20 bp, Artificial
  CRISPR gRNA sequence
caaaggggactgagtgaatg

SEQ ID NO: 74089 - DNA, 20 bp, Artificial
  CRISPR gRNA sequence
agtgaatgtcttgtctacat

SEQ ID NO: 74090 - DNA, 20 bp, Artificial
  CRISPR gRNA sequence
gtctacataccgaaatgtct

SEQ ID NO: 74091 - DNA, 20 bp, Artificial
  CRISPR gRNA sequence
tctacataccgaaatgtctt

SEQ ID NO: 74092 - DNA, 20 bp, Artificial
  CRISPR gRNA sequence
cataccgaaatgtcttcagc

SEQ ID NO: 74093 - DNA, 20 bp, Artificial
  CRISPR gRNA sequence
cagctcagagagggacagca

SEQ ID NO: 74094 - DNA, 20 bp, Artificial
  CRISPR gRNA sequence
agctcagagagggacagcag

SEQ ID NO: 74095 - DNA, 20 bp, Artificial
  CRISPR gRNA sequence
agagagggacagcaggaggc

SEQ ID NO: 74096 - DNA, 20 bp, Artificial
  CRISPR gRNA sequence
tgcagcagcagggaactggc

SEQ ID NO: 74097 - DNA, 20 bp, Artificial
  CRISPR gRNA sequence
cagcagcagggaactggcat

SEQ ID NO: 74098 - DNA, 20 bp, Artificial
  CRISPR gRNA sequence
gcatcatcgtcctcacagag

SEQ ID NO: 74099 - DNA, 20 bp, Artificial
  CRISPR gRNA sequence
acagaggttaacctgagaca

SEQ ID NO: 74100 - DNA, 20 bp, Artificial
  CRISPR gRNA sequence
acctgagacaagctgaaaag

SEQ ID NO: 74101 - DNA, 20 bp, Artificial
  CRISPR gRNA sequence
agacaagctgaaaaggtcca

SEQ ID NO: 74102 - DNA, 20 bp, Artificial
  CRISPR gRNA sequence
aaaaggtccaaggatattct

SEQ ID NO: 74103 - DNA, 20 bp, Artificial
  CRISPR gRNA sequence
tagaggatttcaggctggac

SEQ ID NO: 74104 - DNA, 20 bp, Artificial
  CRISPR gRNA sequence
gaggatttcaggctggacac

SEQ ID NO: 74105 - DNA, 20 bp, Artificial
  CRISPR gRNA sequence
caggctggacacacctcaga

SEQ ID NO: 74106 - DNA, 20 bp, Artificial
  CRISPR gRNA sequence
aggctggacacacctcagag

SEQ ID NO: 74107 - DNA, 20 bp, Artificial
  CRISPR gRNA sequence
gacacacctcagaggtcatc

SEQ ID NO: 74108 - DNA, 20 bp, Artificial
  CRISPR gRNA sequence
agaggtcatcacatccagaa

SEQ ID NO: 74109 - DNA, 20 bp, Artificial
  CRISPR gRNA sequence
ccctgagccaccctggggct

SEQ ID NO: 74110 - DNA, 20 bp, Artificial
  CRISPR gRNA sequence
agccaccctggggctctccc

SEQ ID NO: 74111 - DNA, 20 bp, Artificial
  CRISPR gRNA sequence
gggctctccctcccctccac

SEQ ID NO: 74112 - DNA, 20 bp, Artificial
  CRISPR gRNA sequence
tccctcccctccactggcca

SEQ ID NO: 74113 - DNA, 20 bp, Artificial
  CRISPR gRNA sequence
cctcccctccactggccaag

SEQ ID NO: 74114 - DNA, 20 bp, Artificial
  CRISPR gRNA sequence
ccctccactggccaagtgtg

SEQ ID NO: 74115 - DNA, 20 bp, Artificial
  CRISPR gRNA sequence
cactggccaagtgtgatttt

SEQ ID NO: 74116 - DNA, 20 bp, Artificial
  CRISPR gRNA sequence
gccaagtgtgattttctcct

SEQ ID NO: 74117 - DNA, 20 bp, Artificial
  CRISPR gRNA sequence
tctcctgcacaaggaagtga

SEQ ID NO: 74118 - DNA, 20 bp, Artificial
  CRISPR gRNA sequence
ctcctgcacaaggaagtgag

SEQ ID NO: 74119 - DNA, 20 bp, Artificial
  CRISPR gRNA sequence
tcctgcacaaggaagtgaga

SEQ ID NO: 74120 - DNA, 20 bp, Artificial
  CRISPR gRNA sequence
ctgcacaaggaagtgagaat

SEQ ID NO: 74121 - DNA, 20 bp, Artificial
  CRISPR gRNA sequence
cacaaggaagtgagaatgcc

SEQ ID NO: 74122 - DNA, 20 bp, Artificial
  CRISPR gRNA sequence
gagtaggtaccagggtcaac

SEQ ID NO: 74123 - DNA, 20 bp, Artificial
  CRISPR gRNA sequence
agggccccacacagagtttc

SEQ ID NO: 74124 - DNA, 20 bp, Artificial
  CRISPR gRNA sequence
ccaggcgctgacctgagctg

SEQ ID NO: 74125 - DNA, 20 bp, Artificial
  CRISPR gRNA sequence
caggcgctgacctgagctgc

SEQ ID NO: 74126 - DNA, 20 bp, Artificial
  CRISPR gRNA sequence
acctgagctgctgcagcctg

SEQ ID NO: 74127 - DNA, 20 bp, Artificial
  CRISPR gRNA sequence
agctgctgcagcctggcaca

SEQ ID NO: 74128 - DNA, 20 bp, Artificial
  CRISPR gRNA sequence
ctgcagcctggcacatgtct

SEQ ID NO: 74129 - DNA, 20 bp, Artificial
  CRISPR gRNA sequence
cagcctggcacatgtctcca

SEQ ID NO: 74130 - DNA, 20 bp, Artificial
  CRISPR gRNA sequence
gcacatgtctccatcagctg

SEQ ID NO: 74131 - DNA, 20 bp, Artificial
  CRISPR gRNA sequence
catcagctgcccgacaagaa

SEQ ID NO: 74132 - DNA, 20 bp, Artificial
  CRISPR gRNA sequence
cccgacaagaaggctgtggt

SEQ ID NO: 74133 - DNA, 20 bp, Artificial
  CRISPR gRNA sequence
tggtgggctccaaggtcaca

SEQ ID NO: 74134 - DNA, 20 bp, Artificial
  CRISPR gRNA sequence
caaggtcacagtgagccaac

SEQ ID NO: 74135 - DNA, 20 bp, Artificial
  CRISPR gRNA sequence
gacacagacagggagacgac

SEQ ID NO: 74136 - DNA, 20 bp, Artificial
  CRISPR gRNA sequence
tggaacatctagtccagtat

SEQ ID NO: 74137 - DNA, 20 bp, Artificial
  CRISPR gRNA sequence
ggaacatctagtccagtatg

SEQ ID NO: 74138 - DNA, 20 bp, Artificial
  CRISPR gRNA sequence
gaacatctagtccagtatgt

SEQ ID NO: 74139 - DNA, 20 bp, Artificial
  CRISPR gRNA sequence
gtccagtatgtgggattcag

SEQ ID NO: 74140 - DNA, 20 bp, Artificial
  CRISPR gRNA sequence
agtatctgcctgcaaggagc

SEQ ID NO: 74141 - DNA, 20 bp, Artificial
  CRISPR gRNA sequence
cctgcaaggagcttatggtg

SEQ ID NO: 74142 - DNA, 20 bp, Artificial
  CRISPR gRNA sequence
caaggagcttatggtgtagg

SEQ ID NO: 74143 - DNA, 20 bp, Artificial
  CRISPR gRNA sequence
atggtgtaggggtaaataaa

SEQ ID NO: 74144 - DNA, 20 bp, Artificial
  CRISPR gRNA sequence
tggtgtaggggtaaataaat

SEQ ID NO: 74145 - DNA, 20 bp, Artificial
  CRISPR gRNA sequence
atcaaatgaagtcctacagt

SEQ ID NO: 74146 - DNA, 20 bp, Artificial
  CRISPR gRNA sequence
cagtttgctattcacttatg

SEQ ID NO: 74147 - DNA, 20 bp, Artificial
  CRISPR gRNA sequence
gctattcacttatgagaagt

SEQ ID NO: 74148 - DNA, 20 bp, Artificial
  CRISPR gRNA sequence
ctattcacttatgagaagtg

SEQ ID NO: 74149 - DNA, 20 bp, Artificial
  CRISPR gRNA sequence
ttcacttatgagaagtgcta

SEQ ID NO: 74150 - DNA, 20 bp, Artificial
  CRISPR gRNA sequence
acttatgagaagtgctagga

SEQ ID NO: 74151 - DNA, 20 bp, Artificial
  CRISPR gRNA sequence
atgagaagtgctaggaagca

SEQ ID NO: 74152 - DNA, 20 bp, Artificial
  CRISPR gRNA sequence
tgagaagtgctaggaagcag

SEQ ID NO: 74153 - DNA, 20 bp, Artificial
  CRISPR gRNA sequence
ggaagcaggagtccagatgg

SEQ ID NO: 74154 - DNA, 20 bp, Artificial
  CRISPR gRNA sequence
gtatggttgtgcaggttgtt

SEQ ID NO: 74155 - DNA, 20 bp, Artificial
  CRISPR gRNA sequence
tgcaggttgttcaccgcaca

SEQ ID NO: 74156 - DNA, 20 bp, Artificial
  CRISPR gRNA sequence
ttcaccgcacaaggacacac

SEQ ID NO: 74157 - DNA, 20 bp, Artificial
  CRISPR gRNA sequence
accgcacaaggacacacagc

SEQ ID NO: 74158 - DNA, 20 bp, Artificial
  CRISPR gRNA sequence
agatcctaccatgctctatt

SEQ ID NO: 74159 - DNA, 20 bp, Artificial
  CRISPR gRNA sequence
ccatgctctatttcccagaa

SEQ ID NO: 74160 - DNA, 20 bp, Artificial
  CRISPR gRNA sequence
tatttcccagaatgtacaca

SEQ ID NO: 74161 - DNA, 20 bp, Artificial
  CRISPR gRNA sequence
tttcccagaatgtacacatg

SEQ ID NO: 74162 - DNA, 20 bp, Artificial
  CRISPR gRNA sequence
cccagaatgtacacatgcag

SEQ ID NO: 74163 - DNA, 20 bp, Artificial
  CRISPR gRNA sequence
ccagaatgtacacatgcagg

SEQ ID NO: 74164 - DNA, 20 bp, Artificial
  CRISPR gRNA sequence
catccactcaaaagggtgac

SEQ ID NO: 74165 - DNA, 20 bp, Artificial
  CRISPR gRNA sequence
aaaagggtgacattttaatt

SEQ ID NO: 74166 - DNA, 20 bp, Artificial
  CRISPR gRNA sequence
taatttcccaaactgtgcca

SEQ ID NO: 74167 - DNA, 20 bp, Artificial
  CRISPR gRNA sequence
aatttcccaaactgtgccat

SEQ ID NO: 74168 - DNA, 20 bp, Artificial
  CRISPR gRNA sequence
atttcccaaactgtgccata

SEQ ID NO: 74169 - DNA, 20 bp, Artificial
  CRISPR gRNA sequence
cccaaactgtgccatatgga

SEQ ID NO: 74170 - DNA, 20 bp, Artificial
  CRISPR gRNA sequence
ccaaactgtgccatatggat

SEQ ID NO: 74171 - DNA, 20 bp, Artificial
  CRISPR gRNA sequence
tgccatatggatttagaggt

SEQ ID NO: 74172 - DNA, 20 bp, Artificial
  CRISPR gRNA sequence
agaggtgctgtgaatccagg

SEQ ID NO: 74173 - DNA, 20 bp, Artificial
  CRISPR gRNA sequence
gaggtgctgtgaatccaggg

SEQ ID NO: 74174 - DNA, 20 bp, Artificial
  CRISPR gRNA sequence
tgaatccagggatctataag

SEQ ID NO: 74175 - DNA, 20 bp, Artificial
  CRISPR gRNA sequence
taagagtggataatggaagt

SEQ ID NO: 74176 - DNA, 20 bp, Artificial
  CRISPR gRNA sequence
gactaagccttggggtccag

SEQ ID NO: 74177 - DNA, 20 bp, Artificial
  CRISPR gRNA sequence
actaagccttggggtccagg

SEQ ID NO: 74178 - DNA, 20 bp, Artificial
  CRISPR gRNA sequence
agccttggggtccagggggc

SEQ ID NO: 74179 - DNA, 20 bp, Artificial
  CRISPR gRNA sequence
ggggtccagggggcctccct

SEQ ID NO: 74180 - DNA, 20 bp, Artificial
  CRISPR gRNA sequence
gggtccagggggcctccctg

SEQ ID NO: 74181 - DNA, 20 bp, Artificial
  CRISPR gRNA sequence
cctgaggtggtggcatttaa

SEQ ID NO: 74182 - DNA, 20 bp, Artificial
  CRISPR gRNA sequence
aggtggtggcatttaagctg

SEQ ID NO: 74183 - DNA, 20 bp, Artificial
  CRISPR gRNA sequence
aagctgagacctgagggatg

SEQ ID NO: 74184 - DNA, 20 bp, Artificial
  CRISPR gRNA sequence
agctgagacctgagggatga

SEQ ID NO: 74185 - DNA, 20 bp, Artificial
  CRISPR gRNA sequence
agacctgagggatgaggagg

SEQ ID NO: 74186 - DNA, 20 bp, Artificial
  CRISPR gRNA sequence
agggatgaggaggagttagg

SEQ ID NO: 74187 - DNA, 20 bp, Artificial
  CRISPR gRNA sequence
ggcaggtgaagcaggtaggc

SEQ ID NO: 74188 - DNA, 20 bp, Artificial
  CRISPR gRNA sequence
tgggcagagagcacagcctg

SEQ ID NO: 74189 - DNA, 20 bp, Artificial
  CRISPR gRNA sequence
ggcagagagcacagcctgtg

SEQ ID NO: 74190 - DNA, 20 bp, Artificial
  CRISPR gRNA sequence
tgcaaatgccctaaggtcta

SEQ ID NO: 74191 - DNA, 20 bp, Artificial
  CRISPR gRNA sequence
aggtctaagcaagatggtgt

SEQ ID NO: 74192 - DNA, 20 bp, Artificial
  CRISPR gRNA sequence
agcaagatggtgttcgggga

SEQ ID NO: 74193 - DNA, 20 bp, Artificial
  CRISPR gRNA sequence
ggggaactgaaagttcatgg

SEQ ID NO: 74194 - DNA, 20 bp, Artificial
  CRISPR gRNA sequence
aaagttcatgggggtgactg

SEQ ID NO: 74195 - DNA, 20 bp, Artificial
  CRISPR gRNA sequence
atgggggtgactggagctga

SEQ ID NO: 74196 - DNA, 20 bp, Artificial
  CRISPR gRNA sequence
gagctgagactggggcctgg

SEQ ID NO: 74197 - DNA, 20 bp, Artificial
  CRISPR gRNA sequence
agactggggcctggagtggg

SEQ ID NO: 74198 - DNA, 20 bp, Artificial
  CRISPR gRNA sequence
gggcctggagtggggctgaa

SEQ ID NO: 74199 - DNA, 20 bp, Artificial
  CRISPR gRNA sequence
gagtggggctgaaacgcctc

SEQ ID NO: 74200 - DNA, 20 bp, Artificial
  CRISPR gRNA sequence
aaacgcctcagaagtgggtt

SEQ ID NO: 74201 - DNA, 20 bp, Artificial
  CRISPR gRNA sequence
agaagtgggttggtcagacc

SEQ ID NO: 74202 - DNA, 20 bp, Artificial
  CRISPR gRNA sequence
gtcagacctctgtagcctgt

SEQ ID NO: 74203 - DNA, 20 bp, Artificial
  CRISPR gRNA sequence
tgtagcctgtgtaaagactt

SEQ ID NO: 74204 - DNA, 20 bp, Artificial
  CRISPR gRNA sequence
tagcctgtgtaaagacttcg

SEQ ID NO: 74205 - DNA, 20 bp, Artificial
  CRISPR gRNA sequence
tgtaaagacttcgaacccct

SEQ ID NO: 74206 - DNA, 20 bp, Artificial
  CRISPR gRNA sequence
cgaacccctaaggtctctgg

SEQ ID NO: 74207 - DNA, 20 bp, Artificial
  CRISPR gRNA sequence
gaacccctaaggtctctggg

SEQ ID NO: 74208 - DNA, 20 bp, Artificial
  CRISPR gRNA sequence
aggtctctgggcagggtggt

SEQ ID NO: 74209 - DNA, 20 bp, Artificial
  CRISPR gRNA sequence
tgggcagggtggtgaatatt

SEQ ID NO: 74210 - DNA, 20 bp, Artificial
  CRISPR gRNA sequence
ggcagggtggtgaatattgg

SEQ ID NO: 74211 - DNA, 20 bp, Artificial
  CRISPR gRNA sequence
gtcagaagcagccctgcccc

SEQ ID NO: 74212 - DNA, 20 bp, Artificial
  CRISPR gRNA sequence
ccccctccccaacaccagcc

SEQ ID NO: 74213 - DNA, 20 bp, Artificial
  CRISPR gRNA sequence
cccaacaccagcccctgcct

SEQ ID NO: 74214 - DNA, 20 bp, Artificial
  CRISPR gRNA sequence
ccttggggtccctggtgctg

SEQ ID NO: 74215 - DNA, 20 bp, Artificial
  CRISPR gRNA sequence
ggggtccctggtgctgggtc

SEQ ID NO: 74216 - DNA, 20 bp, Artificial
  CRISPR gRNA sequence
gggtccctggtgctgggtcc

SEQ ID NO: 74217 - DNA, 20 bp, Artificial
  CRISPR gRNA sequence
gtgctgggtcccacctgagt

SEQ ID NO: 74218 - DNA, 20 bp, Artificial
  CRISPR gRNA sequence
ggtcccacctgagtgccaca

SEQ ID NO: 74219 - DNA, 20 bp, Artificial
  CRISPR gRNA sequence
agtgccacagcttctggatt

SEQ ID NO: 74220 - DNA, 20 bp, Artificial
  CRISPR gRNA sequence
ctggattctcttcctggcga

SEQ ID NO: 74221 - DNA, 20 bp, Artificial
  CRISPR gRNA sequence
tggattctcttcctggcgag

SEQ ID NO: 74222 - DNA, 20 bp, Artificial
  CRISPR gRNA sequence
gattctcttcctggcgagga

SEQ ID NO: 74223 - DNA, 20 bp, Artificial
  CRISPR gRNA sequence
tcttcctggcgaggaaattc

SEQ ID NO: 74224 - DNA, 20 bp, Artificial
  CRISPR gRNA sequence
ttcctggcgaggaaattcca

SEQ ID NO: 74225 - DNA, 20 bp, Artificial
  CRISPR gRNA sequence
cctggcgaggaaattccagc

SEQ ID NO: 74226 - DNA, 20 bp, Artificial
  CRISPR gRNA sequence
ctggcgaggaaattccagct

SEQ ID NO: 74227 - DNA, 20 bp, Artificial
  CRISPR gRNA sequence
gcgaggaaattccagctgga

SEQ ID NO: 74228 - DNA, 20 bp, Artificial
  CRISPR gRNA sequence
cagctggacacagagctgct

SEQ ID NO: 74229 - DNA, 20 bp, Artificial
  CRISPR gRNA sequence
gacacagagctgctgctggg

SEQ ID NO: 74230 - DNA, 20 bp, Artificial
  CRISPR gRNA sequence
ctgctgggtctcggagatgc

SEQ ID NO: 74231 - DNA, 20 bp, Artificial
  CRISPR gRNA sequence
ctgggtctcggagatgctga

SEQ ID NO: 74232 - DNA, 20 bp, Artificial
  CRISPR gRNA sequence
ggtctcggagatgctgagga

SEQ ID NO: 74233 - DNA, 20 bp, Artificial
  CRISPR gRNA sequence
ggagatgctgaggagtgagc

SEQ ID NO: 74234 - DNA, 20 bp, Artificial
  CRISPR gRNA sequence
aggagtgagcagtaaccaac

SEQ ID NO: 74235 - DNA, 20 bp, Artificial
  CRISPR gRNA sequence
ccccggagggcctagctggc

SEQ ID NO: 74236 - DNA, 20 bp, Artificial
  CRISPR gRNA sequence
cccggagggcctagctggca

SEQ ID NO: 74237 - DNA, 20 bp, Artificial
  CRISPR gRNA sequence
gctggcacctgggctgcccg

SEQ ID NO: 74238 - DNA, 20 bp, Artificial
  CRISPR gRNA sequence
gcacctgggctgcccggctc

SEQ ID NO: 74239 - DNA, 20 bp, Artificial
  CRISPR gRNA sequence
ggctgcccggctccaactct

SEQ ID NO: 74240 - DNA, 20 bp, Artificial
  CRISPR gRNA sequence
cccggctccaactctgaact

SEQ ID NO: 74241 - DNA, 20 bp, Artificial
  CRISPR gRNA sequence
caactctgaactctcacttt

SEQ ID NO: 74242 - DNA, 20 bp, Artificial
  CRISPR gRNA sequence
tgaactctcactttgcctgg

SEQ ID NO: 74243 - DNA, 20 bp, Artificial
  CRISPR gRNA sequence
aactctcactttgcctgggt

SEQ ID NO: 74244 - DNA, 20 bp, Artificial
  CRISPR gRNA sequence
tcactttgcctgggtcccct

SEQ ID NO: 74245 - DNA, 20 bp, Artificial
  CRISPR gRNA sequence
actttgcctgggtccccttc

SEQ ID NO: 74246 - DNA, 20 bp, Artificial
  CRISPR gRNA sequence
tgcctgggtccccttctccc

SEQ ID NO: 74247 - DNA, 20 bp, Artificial
  CRISPR gRNA sequence
gcctgggtccccttctcccc

SEQ ID NO: 74248 - DNA, 20 bp, Artificial
  CRISPR gRNA sequence
cctgggtccccttctcccct

SEQ ID NO: 74249 - DNA, 20 bp, Artificial
  CRISPR gRNA sequence
ggtccccttctcccctgcca

SEQ ID NO: 74250 - DNA, 20 bp, Artificial
  CRISPR gRNA sequence
ctcccctgccagggaccagc

SEQ ID NO: 74251 - DNA, 20 bp, Artificial
  CRISPR gRNA sequence
tcccctgccagggaccagct

SEQ ID NO: 74252 - DNA, 20 bp, Artificial
  CRISPR gRNA sequence
ccctgccagggaccagctta

SEQ ID NO: 74253 - DNA, 20 bp, Artificial
  CRISPR gRNA sequence
ccagggaccagcttaggact

SEQ ID NO: 74254 - DNA, 20 bp, Artificial
  CRISPR gRNA sequence
aggactggaaagtaggtgct

SEQ ID NO: 74255 - DNA, 20 bp, Artificial
  CRISPR gRNA sequence
ggactggaaagtaggtgctt

SEQ ID NO: 74256 - DNA, 20 bp, Artificial
  CRISPR gRNA sequence
gaaagtaggtgcttccgtga

SEQ ID NO: 74257 - DNA, 20 bp, Artificial
  CRISPR gRNA sequence
ccgtgagtcacacacaatac

SEQ ID NO: 74258 - DNA, 20 bp, Artificial
  CRISPR gRNA sequence
cgtgagtcacacacaatacc

SEQ ID NO: 74259 - DNA, 20 bp, Artificial
  CRISPR gRNA sequence
ttcaacaatttttctctttc

SEQ ID NO: 74260 - DNA, 20 bp, Artificial
  CRISPR gRNA sequence
tcaacaatttttctctttct

SEQ ID NO: 74261 - DNA, 20 bp, Artificial
  CRISPR gRNA sequence
caacaatttttctctttctt

SEQ ID NO: 74262 - DNA, 20 bp, Artificial
  CRISPR gRNA sequence
aacaatttttctctttcttt

SEQ ID NO: 74263 - DNA, 20 bp, Artificial
  CRISPR gRNA sequence
ttctctttcttttttttttt

SEQ ID NO: 74264 - DNA, 20 bp, Artificial
  CRISPR gRNA sequence
tctctttctttttttttttt

SEQ ID NO: 74265 - DNA, 20 bp, Artificial
  CRISPR gRNA sequence
ctctttcttttttttttttt

SEQ ID NO: 74266 - DNA, 20 bp, Artificial
  CRISPR gRNA sequence
tctttctttttttttttttt

SEQ ID NO: 74267 - DNA, 20 bp, Artificial
  CRISPR gRNA sequence
tttcttttttttttttttta

SEQ ID NO: 74268 - DNA, 20 bp, Artificial
  CRISPR gRNA sequence
tctttttttttttttttaaa

SEQ ID NO: 74269 - DNA, 20 bp, Artificial
  CRISPR gRNA sequence
ctttttttttttttttaaag

SEQ ID NO: 74270 - DNA, 20 bp, Artificial
  CRISPR gRNA sequence
tttttttttttttttaaaga

SEQ ID NO: 74271 - DNA, 20 bp, Artificial
  CRISPR gRNA sequence
tttttttttttttaaagaga

SEQ ID NO: 74272 - DNA, 20 bp, Artificial
  CRISPR gRNA sequence
ttttttttttttaaagagac

SEQ ID NO: 74273 - DNA, 20 bp, Artificial
  CRISPR gRNA sequence
tttttttttttaaagagaca

SEQ ID NO: 74274 - DNA, 20 bp, Artificial
  CRISPR gRNA sequence
ttttttttttaaagagacag

SEQ ID NO: 74275 - DNA, 20 bp, Artificial
  CRISPR gRNA sequence
tttttttttaaagagacagg

SEQ ID NO: 74276 - DNA, 20 bp, Artificial
  CRISPR gRNA sequence
ttttttttaaagagacaggg

SEQ ID NO: 74277 - DNA, 20 bp, Artificial
  CRISPR gRNA sequence
tttttttaaagagacagggt

SEQ ID NO: 74278 - DNA, 20 bp, Artificial
  CRISPR gRNA sequence
ttttttaaagagacagggtc

SEQ ID NO: 74279 - DNA, 20 bp, Artificial
  CRISPR gRNA sequence
tttttaaagagacagggtct

SEQ ID NO: 74280 - DNA, 20 bp, Artificial
  CRISPR gRNA sequence
ttttaaagagacagggtctt

SEQ ID NO: 74281 - DNA, 20 bp, Artificial
  CRISPR gRNA sequence
tttaaagagacagggtcttg

SEQ ID NO: 74282 - DNA, 20 bp, Artificial
  CRISPR gRNA sequence
ttaaagagacagggtcttgc

SEQ ID NO: 74283 - DNA, 20 bp, Artificial
  CRISPR gRNA sequence
taaagagacagggtcttgct

SEQ ID NO: 74284 - DNA, 20 bp, Artificial
  CRISPR gRNA sequence
aaagagacagggtcttgctc

SEQ ID NO: 74285 - DNA, 20 bp, Artificial
  CRISPR gRNA sequence
aagagacagggtcttgctct

SEQ ID NO: 74286 - DNA, 20 bp, Artificial
  CRISPR gRNA sequence
gctctgtagcccaggctgaa

SEQ ID NO: 74287 - DNA, 20 bp, Artificial
  CRISPR gRNA sequence
ctctgtagcccaggctgaag

SEQ ID NO: 74288 - DNA, 20 bp, Artificial
  CRISPR gRNA sequence
tgtagcccaggctgaagtgc

SEQ ID NO: 74289 - DNA, 20 bp, Artificial
  CRISPR gRNA sequence
tagcccaggctgaagtgcag

SEQ ID NO: 74290 - DNA, 20 bp, Artificial
  CRISPR gRNA sequence
aagtgcagtggtgggcacga

SEQ ID NO: 74291 - DNA, 20 bp, Artificial
  CRISPR gRNA sequence
actgcagccttgaactctgg

SEQ ID NO: 74292 - DNA, 20 bp, Artificial
  CRISPR gRNA sequence
cagccttgaactctgggctt

SEQ ID NO: 74293 - DNA, 20 bp, Artificial
  CRISPR gRNA sequence
gaactctgggcttcagtgat

SEQ ID NO: 74294 - DNA, 20 bp, Artificial
  CRISPR gRNA sequence
aactctgggcttcagtgatc

SEQ ID NO: 74295 - DNA, 20 bp, Artificial
  CRISPR gRNA sequence
tgggcttcagtgatcctcct

SEQ ID NO: 74296 - DNA, 20 bp, Artificial
  CRISPR gRNA sequence
ggcttcagtgatcctcctgc

SEQ ID NO: 74297 - DNA, 20 bp, Artificial
  CRISPR gRNA sequence
cagtgatcctcctgcctcgg

SEQ ID NO: 74298 - DNA, 20 bp, Artificial
  CRISPR gRNA sequence
agtgatcctcctgcctcggc

SEQ ID NO: 74299 - DNA, 20 bp, Artificial
  CRISPR gRNA sequence
ctgcctcggcctcccaaagt

SEQ ID NO: 74300 - DNA, 20 bp, Artificial
  CRISPR gRNA sequence
cctcggcctcccaaagtgct

SEQ ID NO: 74301 - DNA, 20 bp, Artificial
  CRISPR gRNA sequence
ggcctcccaaagtgctgggg

SEQ ID NO: 74302 - DNA, 20 bp, Artificial
  CRISPR gRNA sequence
ccaaagtgctggggttacag

SEQ ID NO: 74303 - DNA, 20 bp, Artificial
  CRISPR gRNA sequence
gggttacaggcgtgagccac

SEQ ID NO: 74304 - DNA, 20 bp, Artificial
  CRISPR gRNA sequence
caggcgtgagccaccgcgcc

SEQ ID NO: 74305 - DNA, 20 bp, Artificial
  CRISPR gRNA sequence
gcccttttcaacaatttaaa

SEQ ID NO: 74306 - DNA, 20 bp, Artificial
  CRISPR gRNA sequence
ttcaacaatttaaagttaat

SEQ ID NO: 74307 - DNA, 20 bp, Artificial
  CRISPR gRNA sequence
tcaacaatttaaagttaata

SEQ ID NO: 74308 - DNA, 20 bp, Artificial
  CRISPR gRNA sequence
caacaatttaaagttaataa

SEQ ID NO: 74309 - DNA, 20 bp, Artificial
  CRISPR gRNA sequence
aacaatttaaagttaataag

SEQ ID NO: 74310 - DNA, 20 bp, Artificial
  CRISPR gRNA sequence
aaagttaataagttgataag

SEQ ID NO: 74311 - DNA, 20 bp, Artificial
  CRISPR gRNA sequence
aagttaataagttgataagc

SEQ ID NO: 74312 - DNA, 20 bp, Artificial
  CRISPR gRNA sequence
ataagttgataagccttttc

SEQ ID NO: 74313 - DNA, 20 bp, Artificial
  CRISPR gRNA sequence
ataagccttttcagaccatg

SEQ ID NO: 74314 - DNA, 20 bp, Artificial
  CRISPR gRNA sequence
ttcagaccatgacagaaagc

SEQ ID NO: 74315 - DNA, 20 bp, Artificial
  CRISPR gRNA sequence
tcagaccatgacagaaagcc

SEQ ID NO: 74316 - DNA, 20 bp, Artificial
  CRISPR gRNA sequence
cagaccatgacagaaagcca

SEQ ID NO: 74317 - DNA, 20 bp, Artificial
  CRISPR gRNA sequence
agaccatgacagaaagccat

SEQ ID NO: 74318 - DNA, 20 bp, Artificial
  CRISPR gRNA sequence
gagggatccaagggcagttc

SEQ ID NO: 74319 - DNA, 20 bp, Artificial
  CRISPR gRNA sequence
cagaattttctgagggaggg

SEQ ID NO: 74320 - DNA, 20 bp, Artificial
  CRISPR gRNA sequence
tctgagggaggggcacaagg

SEQ ID NO: 74321 - DNA, 20 bp, Artificial
  CRISPR gRNA sequence
ctgagggaggggcacaagga

SEQ ID NO: 74322 - DNA, 20 bp, Artificial
  CRISPR gRNA sequence
tgagggaggggcacaaggac

SEQ ID NO: 74323 - DNA, 20 bp, Artificial
  CRISPR gRNA sequence
agggaggggcacaaggacca

SEQ ID NO: 74324 - DNA, 20 bp, Artificial
  CRISPR gRNA sequence
gagtctgcatttgcgctcta

SEQ ID NO: 74325 - DNA, 20 bp, Artificial
  CRISPR gRNA sequence
catttgcgctctaagctcac

SEQ ID NO: 74326 - DNA, 20 bp, Artificial
  CRISPR gRNA sequence
gcgctctaagctcactgcct

SEQ ID NO: 74327 - DNA, 20 bp, Artificial
  CRISPR gRNA sequence
cgctctaagctcactgcctt

SEQ ID NO: 74328 - DNA, 20 bp, Artificial
  CRISPR gRNA sequence
taagctcactgccttcactt

SEQ ID NO: 74329 - DNA, 20 bp, Artificial
  CRISPR gRNA sequence
agctcactgccttcacttga

SEQ ID NO: 74330 - DNA, 20 bp, Artificial
  CRISPR gRNA sequence
actgccttcacttgaatgtt

SEQ ID NO: 74331 - DNA, 20 bp, Artificial
  CRISPR gRNA sequence
ccttcacttgaatgttatgt

SEQ ID NO: 74332 - DNA, 20 bp, Artificial
  CRISPR gRNA sequence
cacttgaatgttatgttcat

SEQ ID NO: 74333 - DNA, 20 bp, Artificial
  CRISPR gRNA sequence
acttgaatgttatgttcatg

SEQ ID NO: 74334 - DNA, 20 bp, Artificial
  CRISPR gRNA sequence
gaatgttatgttcatggggt

SEQ ID NO: 74335 - DNA, 20 bp, Artificial
  CRISPR gRNA sequence
aatgttatgttcatggggtg

SEQ ID NO: 74336 - DNA, 20 bp, Artificial
  CRISPR gRNA sequence
tgttcatggggtgcttatgg

SEQ ID NO: 74337 - DNA, 20 bp, Artificial
  CRISPR gRNA sequence
atggggtgcttatggggaga

SEQ ID NO: 74338 - DNA, 20 bp, Artificial
  CRISPR gRNA sequence
atggggagagggctatggga

SEQ ID NO: 74339 - DNA, 20 bp, Artificial
  CRISPR gRNA sequence
tggggagagggctatgggag

SEQ ID NO: 74340 - DNA, 20 bp, Artificial
  CRISPR gRNA sequence
tgggagattataaagtcccc

SEQ ID NO: 74341 - DNA, 20 bp, Artificial
  CRISPR gRNA sequence
taaagtccccagagcatccc

SEQ ID NO: 74342 - DNA, 20 bp, Artificial
  CRISPR gRNA sequence
gctcactcctggaggagaga

SEQ ID NO: 74343 - DNA, 20 bp, Artificial
  CRISPR gRNA sequence
ctcactcctggaggagagaa

SEQ ID NO: 74344 - DNA, 20 bp, Artificial
  CRISPR gRNA sequence
actcctggaggagagaagga

SEQ ID NO: 74345 - DNA, 20 bp, Artificial
  CRISPR gRNA sequence
ctggaggagagaaggaagaa

SEQ ID NO: 74346 - DNA, 20 bp, Artificial
  CRISPR gRNA sequence
gaggagagaaggaagaagca

SEQ ID NO: 74347 - DNA, 20 bp, Artificial
  CRISPR gRNA sequence
tgtggctggtgacagtacag

SEQ ID NO: 74348 - DNA, 20 bp, Artificial
  CRISPR gRNA sequence
gtgacagtacagcagacatc

SEQ ID NO: 74349 - DNA, 20 bp, Artificial
  CRISPR gRNA sequence
tacaggctccagttcttgta

SEQ ID NO: 74350 - DNA, 20 bp, Artificial
  CRISPR gRNA sequence
acaggctccagttcttgtaa

SEQ ID NO: 74351 - DNA, 20 bp, Artificial
  CRISPR gRNA sequence
caggctccagttcttgtaat

SEQ ID NO: 74352 - DNA, 20 bp, Artificial
  CRISPR gRNA sequence
cagttcttgtaatcctccca

SEQ ID NO: 74353 - DNA, 20 bp, Artificial
  CRISPR gRNA sequence
ttgtaatcctcccagccctg

SEQ ID NO: 74354 - DNA, 20 bp, Artificial
  CRISPR gRNA sequence
gtaatcctcccagccctgca

SEQ ID NO: 74355 - DNA, 20 bp, Artificial
  CRISPR gRNA sequence
taatcctcccagccctgcaa

SEQ ID NO: 74356 - DNA, 20 bp, Artificial
  CRISPR gRNA sequence
ccagccctgcaaagggccgt

SEQ ID NO: 74357 - DNA, 20 bp, Artificial
  CRISPR gRNA sequence
caaagggccgtaattagact

SEQ ID NO: 74358 - DNA, 20 bp, Artificial
  CRISPR gRNA sequence
gactcttttaagagcaggag

SEQ ID NO: 74359 - DNA, 20 bp, Artificial
  CRISPR gRNA sequence
ttttaagagcaggaggttga

SEQ ID NO: 74360 - DNA, 20 bp, Artificial
  CRISPR gRNA sequence
ttaagagcaggaggttgagg

SEQ ID NO: 74361 - DNA, 20 bp, Artificial
  CRISPR gRNA sequence
taagagcaggaggttgaggt

SEQ ID NO: 74362 - DNA, 20 bp, Artificial
  CRISPR gRNA sequence
aagagcaggaggttgaggtc

SEQ ID NO: 74363 - DNA, 20 bp, Artificial
  CRISPR gRNA sequence
agagcaggaggttgaggtca

SEQ ID NO: 74364 - DNA, 20 bp, Artificial
  CRISPR gRNA sequence
aggtcagagagacacagtaa

SEQ ID NO: 74365 - DNA, 20 bp, Artificial
  CRISPR gRNA sequence
caaccagtaagtgactgagt

SEQ ID NO: 74366 - DNA, 20 bp, Artificial
  CRISPR gRNA sequence
agttgggatctgaacatagc

SEQ ID NO: 74367 - DNA, 20 bp, Artificial
  CRISPR gRNA sequence
ggatctgaacatagctgagt

SEQ ID NO: 74368 - DNA, 20 bp, Artificial
  CRISPR gRNA sequence
aacatagctgagtgggatgc

SEQ ID NO: 74369 - DNA, 20 bp, Artificial
  CRISPR gRNA sequence
agtgggatgctaaaaccttt

SEQ ID NO: 74370 - DNA, 20 bp, Artificial
  CRISPR gRNA sequence
aaacctttgctataagctac

SEQ ID NO: 74371 - DNA, 20 bp, Artificial
  CRISPR gRNA sequence
tgctataagctactctgtgt

SEQ ID NO: 74372 - DNA, 20 bp, Artificial
  CRISPR gRNA sequence
gctataagctactctgtgtg

SEQ ID NO: 74373 - DNA, 20 bp, Artificial
  CRISPR gRNA sequence
ctataagctactctgtgtgt

SEQ ID NO: 74374 - DNA, 20 bp, Artificial
  CRISPR gRNA sequence
taagctactctgtgtgtcat

SEQ ID NO: 74375 - DNA, 20 bp, Artificial
  CRISPR gRNA sequence
ctctgtgtgtcattgtgtta

SEQ ID NO: 74376 - DNA, 20 bp, Artificial
  CRISPR gRNA sequence
tgtgtgtcattgtgttattt

SEQ ID NO: 74377 - DNA, 20 bp, Artificial
  CRISPR gRNA sequence
tgtgtcattgtgttatttct

SEQ ID NO: 74378 - DNA, 20 bp, Artificial
  CRISPR gRNA sequence
tgttatttctggttgaagag

SEQ ID NO: 74379 - DNA, 20 bp, Artificial
  CRISPR gRNA sequence
tttctggttgaagagccata

SEQ ID NO: 74380 - DNA, 20 bp, Artificial
  CRISPR gRNA sequence
ctggttgaagagccataatg

SEQ ID NO: 74381 - DNA, 20 bp, Artificial
  CRISPR gRNA sequence
tggttgaagagccataatgt

SEQ ID NO: 74382 - DNA, 20 bp, Artificial
  CRISPR gRNA sequence
gttgaagagccataatgtgt

SEQ ID NO: 74383 - DNA, 20 bp, Artificial
  CRISPR gRNA sequence
aagagccataatgtgtgtta

SEQ ID NO: 74384 - DNA, 20 bp, Artificial
  CRISPR gRNA sequence
ctgcatctggggggccactt

SEQ ID NO: 74385 - DNA, 20 bp, Artificial
  CRISPR gRNA sequence
catctggggggccacttcca

SEQ ID NO: 74386 - DNA, 20 bp, Artificial
  CRISPR gRNA sequence
gggggccacttccaagcaac

SEQ ID NO: 74387 - DNA, 20 bp, Artificial
  CRISPR gRNA sequence
ccaagcaaccagcgtggact

SEQ ID NO: 74388 - DNA, 20 bp, Artificial
  CRISPR gRNA sequence
caagcaaccagcgtggactc

SEQ ID NO: 74389 - DNA, 20 bp, Artificial
  CRISPR gRNA sequence
ccagccatgtctgcctggat

SEQ ID NO: 74390 - DNA, 20 bp, Artificial
  CRISPR gRNA sequence
cctggatccaatagcccttt

SEQ ID NO: 74391 - DNA, 20 bp, Artificial
  CRISPR gRNA sequence
gatccaatagccctttgttt

SEQ ID NO: 74392 - DNA, 20 bp, Artificial
  CRISPR gRNA sequence
tgttttgattctggggatgt

SEQ ID NO: 74393 - DNA, 20 bp, Artificial
  CRISPR gRNA sequence
gttttgattctggggatgtc

SEQ ID NO: 74394 - DNA, 20 bp, Artificial
  CRISPR gRNA sequence
ttttgattctggggatgtct

SEQ ID NO: 74395 - DNA, 20 bp, Artificial
  CRISPR gRNA sequence
tgattctggggatgtcttcc

SEQ ID NO: 74396 - DNA, 20 bp, Artificial
  CRISPR gRNA sequence
gattctggggatgtcttcct

SEQ ID NO: 74397 - DNA, 20 bp, Artificial
  CRISPR gRNA sequence
attctggggatgtcttcctc

SEQ ID NO: 74398 - DNA, 20 bp, Artificial
  CRISPR gRNA sequence
tggggatgtcttcctctgac

SEQ ID NO: 74399 - DNA, 20 bp, Artificial
  CRISPR gRNA sequence
gggatgtcttcctctgacac

SEQ ID NO: 74400 - DNA, 20 bp, Artificial
  CRISPR gRNA sequence
cctctgacactgtggcttga

SEQ ID NO: 74401 - DNA, 20 bp, Artificial
  CRISPR gRNA sequence
ctctgacactgtggcttgac

SEQ ID NO: 74402 - DNA, 20 bp, Artificial
  CRISPR gRNA sequence
tgacactgtggcttgactac

SEQ ID NO: 74403 - DNA, 20 bp, Artificial
  CRISPR gRNA sequence
acactgtggcttgactactg

SEQ ID NO: 74404 - DNA, 20 bp, Artificial
  CRISPR gRNA sequence
tggcttgactactgcactag

SEQ ID NO: 74405 - DNA, 20 bp, Artificial
  CRISPR gRNA sequence
gactactgcactagtcccaa

SEQ ID NO: 74406 - DNA, 20 bp, Artificial
  CRISPR gRNA sequence
actactgcactagtcccaac

SEQ ID NO: 74407 - DNA, 20 bp, Artificial
  CRISPR gRNA sequence
ctgcactagtcccaacaaat

SEQ ID NO: 74408 - DNA, 20 bp, Artificial
  CRISPR gRNA sequence
cactagtcccaacaaatgtg

SEQ ID NO: 74409 - DNA, 20 bp, Artificial
  CRISPR gRNA sequence
gtcccaacaaatgtgtagcc

SEQ ID NO: 74410 - DNA, 20 bp, Artificial
  CRISPR gRNA sequence
acatatgccccaggagctcc

SEQ ID NO: 74411 - DNA, 20 bp, Artificial
  CRISPR gRNA sequence
ctgctaccctggggacatgg

SEQ ID NO: 74412 - DNA, 20 bp, Artificial
  CRISPR gRNA sequence
ctaccctggggacatggaaa

SEQ ID NO: 74413 - DNA, 20 bp, Artificial
  CRISPR gRNA sequence
ccctggggacatggaaaact

SEQ ID NO: 74414 - DNA, 20 bp, Artificial
  CRISPR gRNA sequence
gggacatggaaaactagctg

SEQ ID NO: 74415 - DNA, 20 bp, Artificial
  CRISPR gRNA sequence
gctggtgacacagctattac

SEQ ID NO: 74416 - DNA, 20 bp, Artificial
  CRISPR gRNA sequence
gtgacacagctattacccca

SEQ ID NO: 74417 - DNA, 20 bp, Artificial
  CRISPR gRNA sequence
ttaccccacaggatgaggga

SEQ ID NO: 74418 - DNA, 20 bp, Artificial
  CRISPR gRNA sequence
ccccacaggatgagggaagg

SEQ ID NO: 74419 - DNA, 20 bp, Artificial
  CRISPR gRNA sequence
atgaaagatgaagaattcca

SEQ ID NO: 74420 - DNA, 20 bp, Artificial
  CRISPR gRNA sequence
tgaaagatgaagaattccaa

SEQ ID NO: 74421 - DNA, 20 bp, Artificial
  CRISPR gRNA sequence
caaaggggcctcttctctgg

SEQ ID NO: 74422 - DNA, 20 bp, Artificial
  CRISPR gRNA sequence
ttctctggactcacctgatt

SEQ ID NO: 74423 - DNA, 20 bp, Artificial
  CRISPR gRNA sequence
ctctggactcacctgatttc

SEQ ID NO: 74424 - DNA, 20 bp, Artificial
  CRISPR gRNA sequence
tctggactcacctgatttca

SEQ ID NO: 74425 - DNA, 20 bp, Artificial
  CRISPR gRNA sequence
tggactcacctgatttcagt

SEQ ID NO: 74426 - DNA, 20 bp, Artificial
  CRISPR gRNA sequence
gactcacctgatttcagtga

SEQ ID NO: 74427 - DNA, 20 bp, Artificial
  CRISPR gRNA sequence
acctgatttcagtgacactg

SEQ ID NO: 74428 - DNA, 20 bp, Artificial
  CRISPR gRNA sequence
atttcagtgacactgcctga

SEQ ID NO: 74429 - DNA, 20 bp, Artificial
  CRISPR gRNA sequence
cagtgacactgcctgaggcc

SEQ ID NO: 74430 - DNA, 20 bp, Artificial
  CRISPR gRNA sequence
agtgacactgcctgaggcct

SEQ ID NO: 74431 - DNA, 20 bp, Artificial
  CRISPR gRNA sequence
cctgaggcctgggcgcagac

SEQ ID NO: 74432 - DNA, 20 bp, Artificial
  CRISPR gRNA sequence
aggcctgggcgcagacttct

SEQ ID NO: 74433 - DNA, 20 bp, Artificial
  CRISPR gRNA sequence
ggcgcagacttctaacaggg

SEQ ID NO: 74434 - DNA, 20 bp, Artificial
  CRISPR gRNA sequence
ctaacagggagagaaccctg

SEQ ID NO: 74435 - DNA, 20 bp, Artificial
  CRISPR gRNA sequence
taacagggagagaaccctgg

SEQ ID NO: 74436 - DNA, 20 bp, Artificial
  CRISPR gRNA sequence
acagggagagaaccctggct

SEQ ID NO: 74437 - DNA, 20 bp, Artificial
  CRISPR gRNA sequence
gctctgtccgcccacggctc

SEQ ID NO: 74438 - DNA, 20 bp, Artificial
  CRISPR gRNA sequence
tgtccgcccacggctcctgc

SEQ ID NO: 74439 - DNA, 20 bp, Artificial
  CRISPR gRNA sequence
tccgcccacggctcctgcac

SEQ ID NO: 74440 - DNA, 20 bp, Artificial
  CRISPR gRNA sequence
ctgcaccctgtcacagaagg

SEQ ID NO: 74441 - DNA, 20 bp, Artificial
  CRISPR gRNA sequence
caccctgtcacagaagggga

SEQ ID NO: 74442 - DNA, 20 bp, Artificial
  CRISPR gRNA sequence
tcacagaaggggacacagat

SEQ ID NO: 74443 - DNA, 20 bp, Artificial
  CRISPR gRNA sequence
gaggctttttgagttttttt

SEQ ID NO: 74444 - DNA, 20 bp, Artificial
  CRISPR gRNA sequence
tttgagttttttttgctcat

SEQ ID NO: 74445 - DNA, 20 bp, Artificial
  CRISPR gRNA sequence
ttgagttttttttgctcatt

SEQ ID NO: 74446 - DNA, 20 bp, Artificial
  CRISPR gRNA sequence
tgagttttttttgctcattt

SEQ ID NO: 74447 - DNA, 20 bp, Artificial
  CRISPR gRNA sequence
gagttttttttgctcatttt

SEQ ID NO: 74448 - DNA, 20 bp, Artificial
  CRISPR gRNA sequence
agttttttttgctcatttta

SEQ ID NO: 74449 - DNA, 20 bp, Artificial
  CRISPR gRNA sequence
tttttgctcattttaaaact

SEQ ID NO: 74450 - DNA, 20 bp, Artificial
  CRISPR gRNA sequence
ttttgctcattttaaaacta

SEQ ID NO: 74451 - DNA, 20 bp, Artificial
  CRISPR gRNA sequence
tttgctcattttaaaactat

SEQ ID NO: 74452 - DNA, 20 bp, Artificial
  CRISPR gRNA sequence
ttgctcattttaaaactata

SEQ ID NO: 74453 - DNA, 20 bp, Artificial
  CRISPR gRNA sequence
tgctcattttaaaactataa

SEQ ID NO: 74454 - DNA, 20 bp, Artificial
  CRISPR gRNA sequence
gctcattttaaaactataaa

SEQ ID NO: 74455 - DNA, 20 bp, Artificial
  CRISPR gRNA sequence
ctcattttaaaactataaaa

SEQ ID NO: 74456 - DNA, 20 bp, Artificial
  CRISPR gRNA sequence
attttaaaactataaaatta

SEQ ID NO: 74457 - DNA, 20 bp, Artificial
  CRISPR gRNA sequence
taaaactataaaattataca

SEQ ID NO: 74458 - DNA, 20 bp, Artificial
  CRISPR gRNA sequence
aaaactataaaattatacaa

SEQ ID NO: 74459 - DNA, 20 bp, Artificial
  CRISPR gRNA sequence
aaactataaaattatacaag

SEQ ID NO: 74460 - DNA, 20 bp, Artificial
  CRISPR gRNA sequence
taaaattatacaagtaggca

SEQ ID NO: 74461 - DNA, 20 bp, Artificial
  CRISPR gRNA sequence
tacaagtaggcatcaatcta

SEQ ID NO: 74462 - DNA, 20 bp, Artificial
  CRISPR gRNA sequence
aaaaaggaaattaacatcac

SEQ ID NO: 74463 - DNA, 20 bp, Artificial
  CRISPR gRNA sequence
acatcacccttattccaaca

SEQ ID NO: 74464 - DNA, 20 bp, Artificial
  CRISPR gRNA sequence
attccaacaactattgttgt

SEQ ID NO: 74465 - DNA, 20 bp, Artificial
  CRISPR gRNA sequence
ttccaacaactattgttgtg

SEQ ID NO: 74466 - DNA, 20 bp, Artificial
  CRISPR gRNA sequence
caacaactattgttgtgaca

SEQ ID NO: 74467 - DNA, 20 bp, Artificial
  CRISPR gRNA sequence
ttgttgtgacaatccaaaca

SEQ ID NO: 74468 - DNA, 20 bp, Artificial
  CRISPR gRNA sequence
ttgtgacaatccaaacagaa

SEQ ID NO: 74469 - DNA, 20 bp, Artificial
  CRISPR gRNA sequence
tgacaatccaaacagaaaat

SEQ ID NO: 74470 - DNA, 20 bp, Artificial
  CRISPR gRNA sequence
ttttttaaatgatattttta

SEQ ID NO: 74471 - DNA, 20 bp, Artificial
  CRISPR gRNA sequence
tttaaatgatatttttatat

SEQ ID NO: 74472 - DNA, 20 bp, Artificial
  CRISPR gRNA sequence
ttaaatgatatttttatatt

SEQ ID NO: 74473 - DNA, 20 bp, Artificial
  CRISPR gRNA sequence
taaatgatatttttatattt

SEQ ID NO: 74474 - DNA, 20 bp, Artificial
  CRISPR gRNA sequence
aaatgatatttttatatttt

SEQ ID NO: 74475 - DNA, 20 bp, Artificial
  CRISPR gRNA sequence
aatgatatttttatatttta

SEQ ID NO: 74476 - DNA, 20 bp, Artificial
  CRISPR gRNA sequence
ttatattttatttttttatc

SEQ ID NO: 74477 - DNA, 20 bp, Artificial
  CRISPR gRNA sequence
tatattttatttttttatct

SEQ ID NO: 74478 - DNA, 20 bp, Artificial
  CRISPR gRNA sequence
atattttatttttttatctt

SEQ ID NO: 74479 - DNA, 20 bp, Artificial
  CRISPR gRNA sequence
tattttatttttttatctta

SEQ ID NO: 74480 - DNA, 20 bp, Artificial
  CRISPR gRNA sequence
tatttttttatcttatctta

SEQ ID NO: 74481 - DNA, 20 bp, Artificial
  CRISPR gRNA sequence
atttttttatcttatcttat

SEQ ID NO: 74482 - DNA, 20 bp, Artificial
  CRISPR gRNA sequence
tttttttatcttatcttatt

SEQ ID NO: 74483 - DNA, 20 bp, Artificial
  CRISPR gRNA sequence
ttttatcttatcttatttta

SEQ ID NO: 74484 - DNA, 20 bp, Artificial
  CRISPR gRNA sequence
tttatcttatcttattttat

SEQ ID NO: 74485 - DNA, 20 bp, Artificial
  CRISPR gRNA sequence
ttatcttatcttattttatt

SEQ ID NO: 74486 - DNA, 20 bp, Artificial
  CRISPR gRNA sequence
tatcttatcttattttattt

SEQ ID NO: 74487 - DNA, 20 bp, Artificial
  CRISPR gRNA sequence
atcttatcttattttatttt

SEQ ID NO: 74488 - DNA, 20 bp, Artificial
  CRISPR gRNA sequence
tcttatcttattttattttt

SEQ ID NO: 74489 - DNA, 20 bp, Artificial
  CRISPR gRNA sequence
atcttattttatttttgaga

SEQ ID NO: 74490 - DNA, 20 bp, Artificial
  CRISPR gRNA sequence
tcttattttatttttgagac

SEQ ID NO: 74491 - DNA, 20 bp, Artificial
  CRISPR gRNA sequence
attttatttttgagacagag

SEQ ID NO: 74492 - DNA, 20 bp, Artificial
  CRISPR gRNA sequence
ttttatttttgagacagagt

SEQ ID NO: 74493 - DNA, 20 bp, Artificial
  CRISPR gRNA sequence
tatttttgagacagagtttt

SEQ ID NO: 74494 - DNA, 20 bp, Artificial
  CRISPR gRNA sequence
atttttgagacagagttttg

SEQ ID NO: 74495 - DNA, 20 bp, Artificial
  CRISPR gRNA sequence
tttttgagacagagttttgc

SEQ ID NO: 74496 - DNA, 20 bp, Artificial
  CRISPR gRNA sequence
ttgagacagagttttgctct

SEQ ID NO: 74497 - DNA, 20 bp, Artificial
  CRISPR gRNA sequence
tgagacagagttttgctctt

SEQ ID NO: 74498 - DNA, 20 bp, Artificial
  CRISPR gRNA sequence
gagacagagttttgctcttg

SEQ ID NO: 74499 - DNA, 20 bp, Artificial
  CRISPR gRNA sequence
agacagagttttgctcttgt

SEQ ID NO: 74500 - DNA, 20 bp, Artificial
  CRISPR gRNA sequence
tgctcttgttgcccagactg

SEQ ID NO: 74501 - DNA, 20 bp, Artificial
  CRISPR gRNA sequence
gctcttgttgcccagactgg

SEQ ID NO: 74502 - DNA, 20 bp, Artificial
  CRISPR gRNA sequence
ctcttgttgcccagactgga

SEQ ID NO: 74503 - DNA, 20 bp, Artificial
  CRISPR gRNA sequence
ttgttgcccagactggagtg

SEQ ID NO: 74504 - DNA, 20 bp, Artificial
  CRISPR gRNA sequence
gttgcccagactggagtgca

SEQ ID NO: 74505 - DNA, 20 bp, Artificial
  CRISPR gRNA sequence
ttgcccagactggagtgcaa

SEQ ID NO: 74506 - DNA, 20 bp, Artificial
  CRISPR gRNA sequence
cccagactggagtgcaatgg

SEQ ID NO: 74507 - DNA, 20 bp, Artificial
  CRISPR gRNA sequence
gagtgcaatggcatgatctc

SEQ ID NO: 74508 - DNA, 20 bp, Artificial
  CRISPR gRNA sequence
agatcactgcaacctctgcc

SEQ ID NO: 74509 - DNA, 20 bp, Artificial
  CRISPR gRNA sequence
caacctctgcctcctgggtt

SEQ ID NO: 74510 - DNA, 20 bp, Artificial
  CRISPR gRNA sequence
tgcctcctgggttcaagcga

SEQ ID NO: 74511 - DNA, 20 bp, Artificial
  CRISPR gRNA sequence
cctcctgggttcaagcgatt

SEQ ID NO: 74512 - DNA, 20 bp, Artificial
  CRISPR gRNA sequence
ctgggttcaagcgattctcc

SEQ ID NO: 74513 - DNA, 20 bp, Artificial
  CRISPR gRNA sequence
ggttcaagcgattctcctgc

SEQ ID NO: 74514 - DNA, 20 bp, Artificial
  CRISPR gRNA sequence
aagcgattctcctgcctcag

SEQ ID NO: 74515 - DNA, 20 bp, Artificial
  CRISPR gRNA sequence
tcctgcctcagcctcccaag

SEQ ID NO: 74516 - DNA, 20 bp, Artificial
  CRISPR gRNA sequence
ctgcctcagcctcccaagta

SEQ ID NO: 74517 - DNA, 20 bp, Artificial
  CRISPR gRNA sequence
cctcagcctcccaagtagct

SEQ ID NO: 74518 - DNA, 20 bp, Artificial
  CRISPR gRNA sequence
agcctcccaagtagctggga

SEQ ID NO: 74519 - DNA, 20 bp, Artificial
  CRISPR gRNA sequence
ccaagtagctgggattacag

SEQ ID NO: 74520 - DNA, 20 bp, Artificial
  CRISPR gRNA sequence
ggattacaggcatgcgccac

SEQ ID NO: 74521 - DNA, 20 bp, Artificial
  CRISPR gRNA sequence
caggcatgcgccaccacgcc

SEQ ID NO: 74522 - DNA, 20 bp, Artificial
  CRISPR gRNA sequence
gctaatttttgtatttttag

SEQ ID NO: 74523 - DNA, 20 bp, Artificial
  CRISPR gRNA sequence
atttttgtatttttagtaga

SEQ ID NO: 74524 - DNA, 20 bp, Artificial
  CRISPR gRNA sequence
ttgtatttttagtagagatg

SEQ ID NO: 74525 - DNA, 20 bp, Artificial
  CRISPR gRNA sequence
tgtatttttagtagagatgg

SEQ ID NO: 74526 - DNA, 20 bp, Artificial
  CRISPR gRNA sequence
gtatttttagtagagatggg

SEQ ID NO: 74527 - DNA, 20 bp, Artificial
  CRISPR gRNA sequence
tatttttagtagagatgggg

SEQ ID NO: 74528 - DNA, 20 bp, Artificial
  CRISPR gRNA sequence
ttagtagagatggggtttca

SEQ ID NO: 74529 - DNA, 20 bp, Artificial
  CRISPR gRNA sequence
tagtagagatggggtttcac

SEQ ID NO: 74530 - DNA, 20 bp, Artificial
  CRISPR gRNA sequence
agtagagatggggtttcacc

SEQ ID NO: 74531 - DNA, 20 bp, Artificial
  CRISPR gRNA sequence
gtagagatggggtttcacca

SEQ ID NO: 74532 - DNA, 20 bp, Artificial
  CRISPR gRNA sequence
caccatgttggtcaggctgg

SEQ ID NO: 74533 - DNA, 20 bp, Artificial
  CRISPR gRNA sequence
accatgttggtcaggctggt

SEQ ID NO: 74534 - DNA, 20 bp, Artificial
  CRISPR gRNA sequence
gtcaggctggtcttgaactc

SEQ ID NO: 74535 - DNA, 20 bp, Artificial
  CRISPR gRNA sequence
gtcttgaactcctgacctca

SEQ ID NO: 74536 - DNA, 20 bp, Artificial
  CRISPR gRNA sequence
gaactcctgacctcaagtga

SEQ ID NO: 74537 - DNA, 20 bp, Artificial
  CRISPR gRNA sequence
aactcctgacctcaagtgat

SEQ ID NO: 74538 - DNA, 20 bp, Artificial
  CRISPR gRNA sequence
ctgacctcaagtgatccacc

SEQ ID NO: 74539 - DNA, 20 bp, Artificial
  CRISPR gRNA sequence
acctcaagtgatccacctgc

SEQ ID NO: 74540 - DNA, 20 bp, Artificial
  CRISPR gRNA sequence
aagtgatccacctgcctcgg

SEQ ID NO: 74541 - DNA, 20 bp, Artificial
  CRISPR gRNA sequence
cctcggcctcccaaagtgct

SEQ ID NO: 74542 - DNA, 20 bp, Artificial
  CRISPR gRNA sequence
ggcctcccaaagtgctggga

SEQ ID NO: 74543 - DNA, 20 bp, Artificial
  CRISPR gRNA sequence
ccaaagtgctgggattacag

SEQ ID NO: 74544 - DNA, 20 bp, Artificial
  CRISPR gRNA sequence
ggattacaggcgtgagccac

SEQ ID NO: 74545 - DNA, 20 bp, Artificial
  CRISPR gRNA sequence
caggcgtgagccactgcact

SEQ ID NO: 74546 - DNA, 20 bp, Artificial
  CRISPR gRNA sequence
cactgggccactgatatttt

SEQ ID NO: 74547 - DNA, 20 bp, Artificial
  CRISPR gRNA sequence
ggccactgatatttttagat

SEQ ID NO: 74548 - DNA, 20 bp, Artificial
  CRISPR gRNA sequence
atatttttagatttaagaaa

SEQ ID NO: 74549 - DNA, 20 bp, Artificial
  CRISPR gRNA sequence
ttagatttaagaaaagattc

SEQ ID NO: 74550 - DNA, 20 bp, Artificial
  CRISPR gRNA sequence
tagatttaagaaaagattca

SEQ ID NO: 74551 - DNA, 20 bp, Artificial
  CRISPR gRNA sequence
agatttaagaaaagattcac

SEQ ID NO: 74552 - DNA, 20 bp, Artificial
  CRISPR gRNA sequence
gatttaagaaaagattcaca

SEQ ID NO: 74553 - DNA, 20 bp, Artificial
  CRISPR gRNA sequence
aagaaaagattcacataatg

SEQ ID NO: 74554 - DNA, 20 bp, Artificial
  CRISPR gRNA sequence
agaaaagattcacataatgt

SEQ ID NO: 74555 - DNA, 20 bp, Artificial
  CRISPR gRNA sequence
acataatgttacatcacaaa

SEQ ID NO: 74556 - DNA, 20 bp, Artificial
  CRISPR gRNA sequence
catcacaaaggtaaggaaac

SEQ ID NO: 74557 - DNA, 20 bp, Artificial
  CRISPR gRNA sequence
tatataaaacatgatcccaa

SEQ ID NO: 74558 - DNA, 20 bp, Artificial
  CRISPR gRNA sequence
tgcatttcaaaaaaaggaaa

SEQ ID NO: 74559 - DNA, 20 bp, Artificial
  CRISPR gRNA sequence
gcatttcaaaaaaaggaaag

SEQ ID NO: 74560 - DNA, 20 bp, Artificial
  CRISPR gRNA sequence
catttcaaaaaaaggaaagt

SEQ ID NO: 74561 - DNA, 20 bp, Artificial
  CRISPR gRNA sequence
caaaaaaaggaaagtatttg

SEQ ID NO: 74562 - DNA, 20 bp, Artificial
  CRISPR gRNA sequence
aaaaaaaggaaagtatttgg

SEQ ID NO: 74563 - DNA, 20 bp, Artificial
  CRISPR gRNA sequence
ggagaaaaaaagtgtggaaa

SEQ ID NO: 74564 - DNA, 20 bp, Artificial
  CRISPR gRNA sequence
gagaaaaaaagtgtggaaag

SEQ ID NO: 74565 - DNA, 20 bp, Artificial
  CRISPR gRNA sequence
aatgttcatggtggttgttt

SEQ ID NO: 74566 - DNA, 20 bp, Artificial
  CRISPR gRNA sequence
atggtggttgtttaagatga

SEQ ID NO: 74567 - DNA, 20 bp, Artificial
  CRISPR gRNA sequence
tttaagatgatagaattctc

SEQ ID NO: 74568 - DNA, 20 bp, Artificial
  CRISPR gRNA sequence
aagatgatagaattctcatg

SEQ ID NO: 74569 - DNA, 20 bp, Artificial
  CRISPR gRNA sequence
agatgatagaattctcatga

SEQ ID NO: 74570 - DNA, 20 bp, Artificial
  CRISPR gRNA sequence
tcatgagtgatttttatttt

SEQ ID NO: 74571 - DNA, 20 bp, Artificial
  CRISPR gRNA sequence
atgagtgatttttattttat

SEQ ID NO: 74572 - DNA, 20 bp, Artificial
  CRISPR gRNA sequence
ttattttatgtcttctttaa

SEQ ID NO: 74573 - DNA, 20 bp, Artificial
  CRISPR gRNA sequence
tattttatgtcttctttaat

SEQ ID NO: 74574 - DNA, 20 bp, Artificial
  CRISPR gRNA sequence
attttatgtcttctttaatt

SEQ ID NO: 74575 - DNA, 20 bp, Artificial
  CRISPR gRNA sequence
ttttatgtcttctttaattt

SEQ ID NO: 74576 - DNA, 20 bp, Artificial
  CRISPR gRNA sequence
tatgtcttctttaattttct

SEQ ID NO: 74577 - DNA, 20 bp, Artificial
  CRISPR gRNA sequence
atgtcttctttaattttcta

SEQ ID NO: 74578 - DNA, 20 bp, Artificial
  CRISPR gRNA sequence
tgtcttctttaattttctat

SEQ ID NO: 74579 - DNA, 20 bp, Artificial
  CRISPR gRNA sequence
ctttaattttctatattttc

SEQ ID NO: 74580 - DNA, 20 bp, Artificial
  CRISPR gRNA sequence
tttaattttctatattttct

SEQ ID NO: 74581 - DNA, 20 bp, Artificial
  CRISPR gRNA sequence
taattttctatattttctaa

SEQ ID NO: 74582 - DNA, 20 bp, Artificial
  CRISPR gRNA sequence
aattttctatattttctaaa

SEQ ID NO: 74583 - DNA, 20 bp, Artificial
  CRISPR gRNA sequence
attttctatattttctaaac

SEQ ID NO: 74584 - DNA, 20 bp, Artificial
  CRISPR gRNA sequence
tctatattttctaaactttc

SEQ ID NO: 74585 - DNA, 20 bp, Artificial
  CRISPR gRNA sequence
ctatattttctaaactttct

SEQ ID NO: 74586 - DNA, 20 bp, Artificial
  CRISPR gRNA sequence
tatattttctaaactttcta

SEQ ID NO: 74587 - DNA, 20 bp, Artificial
  CRISPR gRNA sequence
tattttctaaactttctaca

SEQ ID NO: 74588 - DNA, 20 bp, Artificial
  CRISPR gRNA sequence
tctaaactttctacaatgca

SEQ ID NO: 74589 - DNA, 20 bp, Artificial
  CRISPR gRNA sequence
ctaaactttctacaatgcat

SEQ ID NO: 74590 - DNA, 20 bp, Artificial
  CRISPR gRNA sequence
taaactttctacaatgcatg

SEQ ID NO: 74591 - DNA, 20 bp, Artificial
  CRISPR gRNA sequence
aactttctacaatgcatgtg

SEQ ID NO: 74592 - DNA, 20 bp, Artificial
  CRISPR gRNA sequence
tctacaatgcatgtgcatta

SEQ ID NO: 74593 - DNA, 20 bp, Artificial
  CRISPR gRNA sequence
ctacaatgcatgtgcattaa

SEQ ID NO: 74594 - DNA, 20 bp, Artificial
  CRISPR gRNA sequence
tacaatgcatgtgcattaat

SEQ ID NO: 74595 - DNA, 20 bp, Artificial
  CRISPR gRNA sequence
caatgcatgtgcattaattt

SEQ ID NO: 74596 - DNA, 20 bp, Artificial
  CRISPR gRNA sequence
atttgaaagtaggaaaaaag

SEQ ID NO: 74597 - DNA, 20 bp, Artificial
  CRISPR gRNA sequence
gaaagtaggaaaaaagagaa

SEQ ID NO: 74598 - DNA, 20 bp, Artificial
  CRISPR gRNA sequence
aaagtaggaaaaaagagaat

SEQ ID NO: 74599 - DNA, 20 bp, Artificial
  CRISPR gRNA sequence
agtcaaatattactgcttta

SEQ ID NO: 74600 - DNA, 20 bp, Artificial
  CRISPR gRNA sequence
ctgctttaaagttatgctga

SEQ ID NO: 74601 - DNA, 20 bp, Artificial
  CRISPR gRNA sequence
ctttaaagttatgctgaatt

SEQ ID NO: 74602 - DNA, 20 bp, Artificial
  CRISPR gRNA sequence
taaagttatgctgaattttt

SEQ ID NO: 74603 - DNA, 20 bp, Artificial
  CRISPR gRNA sequence
aaagttatgctgaattttta

SEQ ID NO: 74604 - DNA, 20 bp, Artificial
  CRISPR gRNA sequence
aagttatgctgaatttttaa

SEQ ID NO: 74605 - DNA, 20 bp, Artificial
  CRISPR gRNA sequence
tgctgaatttttaaagcact

SEQ ID NO: 74606 - DNA, 20 bp, Artificial
  CRISPR gRNA sequence
aatttttaaagcactatttt

SEQ ID NO: 74607 - DNA, 20 bp, Artificial
  CRISPR gRNA sequence
ttaaagcactattttcttta

SEQ ID NO: 74608 - DNA, 20 bp, Artificial
  CRISPR gRNA sequence
taaagcactattttctttat

SEQ ID NO: 74609 - DNA, 20 bp, Artificial
  CRISPR gRNA sequence
aaagcactattttctttatg

SEQ ID NO: 74610 - DNA, 20 bp, Artificial
  CRISPR gRNA sequence
aagcactattttctttatgt

SEQ ID NO: 74611 - DNA, 20 bp, Artificial
  CRISPR gRNA sequence
ttttctttatgtatttctgg

SEQ ID NO: 74612 - DNA, 20 bp, Artificial
  CRISPR gRNA sequence
tctttatgtatttctggatt

SEQ ID NO: 74613 - DNA, 20 bp, Artificial
  CRISPR gRNA sequence
ctttatgtatttctggattt

SEQ ID NO: 74614 - DNA, 20 bp, Artificial
  CRISPR gRNA sequence
tttatgtatttctggatttt

SEQ ID NO: 74615 - DNA, 20 bp, Artificial
  CRISPR gRNA sequence
tatgtatttctggattttct

SEQ ID NO: 74616 - DNA, 20 bp, Artificial
  CRISPR gRNA sequence
atgtatttctggattttctg

SEQ ID NO: 74617 - DNA, 20 bp, Artificial
  CRISPR gRNA sequence
tgtatttctggattttctgc

SEQ ID NO: 74618 - DNA, 20 bp, Artificial
  CRISPR gRNA sequence
ctggattttctgcacatttc

SEQ ID NO: 74619 - DNA, 20 bp, Artificial
  CRISPR gRNA sequence
tggattttctgcacatttca

SEQ ID NO: 74620 - DNA, 20 bp, Artificial
  CRISPR gRNA sequence
gattttctgcacatttcaac

SEQ ID NO: 74621 - DNA, 20 bp, Artificial
  CRISPR gRNA sequence
tctgcacatttcaacaatga

SEQ ID NO: 74622 - DNA, 20 bp, Artificial
  CRISPR gRNA sequence
ctgcacatttcaacaatgat

SEQ ID NO: 74623 - DNA, 20 bp, Artificial
  CRISPR gRNA sequence
tgcacatttcaacaatgatt

SEQ ID NO: 74624 - DNA, 20 bp, Artificial
  CRISPR gRNA sequence
cacatttcaacaatgattaa

SEQ ID NO: 74625 - DNA, 20 bp, Artificial
  CRISPR gRNA sequence
caacaatgattaaatattat

SEQ ID NO: 74626 - DNA, 20 bp, Artificial
  CRISPR gRNA sequence
aacaatgattaaatattatt

SEQ ID NO: 74627 - DNA, 20 bp, Artificial
  CRISPR gRNA sequence
aatattatttttttattttt

SEQ ID NO: 74628 - DNA, 20 bp, Artificial
  CRISPR gRNA sequence
tttttttatttttatttttt

SEQ ID NO: 74629 - DNA, 20 bp, Artificial
  CRISPR gRNA sequence
ttttatttttattttttgta

SEQ ID NO: 74630 - DNA, 20 bp, Artificial
  CRISPR gRNA sequence
tttatttttattttttgtag

SEQ ID NO: 74631 - DNA, 20 bp, Artificial
  CRISPR gRNA sequence
ttatttttattttttgtaga

SEQ ID NO: 74632 - DNA, 20 bp, Artificial
  CRISPR gRNA sequence
tatttttattttttgtagat

SEQ ID NO: 74633 - DNA, 20 bp, Artificial
  CRISPR gRNA sequence
atttttattttttgtagata

SEQ ID NO: 74634 - DNA, 20 bp, Artificial
  CRISPR gRNA sequence
tttttattttttgtagatat

SEQ ID NO: 74635 - DNA, 20 bp, Artificial
  CRISPR gRNA sequence
ttattttttgtagatatggg

SEQ ID NO: 74636 - DNA, 20 bp, Artificial
  CRISPR gRNA sequence
tattttttgtagatatgggg

SEQ ID NO: 74637 - DNA, 20 bp, Artificial
  CRISPR gRNA sequence
attttttgtagatatggggt

SEQ ID NO: 74638 - DNA, 20 bp, Artificial
  CRISPR gRNA sequence
ttttttgtagatatggggtt

SEQ ID NO: 74639 - DNA, 20 bp, Artificial
  CRISPR gRNA sequence
tttgtagatatggggttttg

SEQ ID NO: 74640 - DNA, 20 bp, Artificial
  CRISPR gRNA sequence
ttgtagatatggggttttgc

SEQ ID NO: 74641 - DNA, 20 bp, Artificial
  CRISPR gRNA sequence
tgtagatatggggttttgcc

SEQ ID NO: 74642 - DNA, 20 bp, Artificial
  CRISPR gRNA sequence
gtagatatggggttttgcca

SEQ ID NO: 74643 - DNA, 20 bp, Artificial
  CRISPR gRNA sequence
tagatatggggttttgccat

SEQ ID NO: 74644 - DNA, 20 bp, Artificial
  CRISPR gRNA sequence
tgccatgttgtccaggctgg

SEQ ID NO: 74645 - DNA, 20 bp, Artificial
  CRISPR gRNA sequence
gccatgttgtccaggctggt

SEQ ID NO: 74646 - DNA, 20 bp, Artificial
  CRISPR gRNA sequence
ccatgttgtccaggctggtc

SEQ ID NO: 74647 - DNA, 20 bp, Artificial
  CRISPR gRNA sequence
tccaggctggtcttgaacgc

SEQ ID NO: 74648 - DNA, 20 bp, Artificial
  CRISPR gRNA sequence
gtcttgaacgcctgagctca

SEQ ID NO: 74649 - DNA, 20 bp, Artificial
  CRISPR gRNA sequence
gaacgcctgagctcaaacaa

SEQ ID NO: 74650 - DNA, 20 bp, Artificial
  CRISPR gRNA sequence
aacgcctgagctcaaacaat

SEQ ID NO: 74651 - DNA, 20 bp, Artificial
  CRISPR gRNA sequence
agctcaaacaatctgcccac

SEQ ID NO: 74652 - DNA, 20 bp, Artificial
  CRISPR gRNA sequence
aaacaatctgcccacctcag

SEQ ID NO: 74653 - DNA, 20 bp, Artificial
  CRISPR gRNA sequence
cccacctcagcctcccaaag

SEQ ID NO: 74654 - DNA, 20 bp, Artificial
  CRISPR gRNA sequence
agcctcccaaagtgttggga

SEQ ID NO: 74655 - DNA, 20 bp, Artificial
  CRISPR gRNA sequence
ccaaagtgttgggattacag

SEQ ID NO: 74656 - DNA, 20 bp, Artificial
  CRISPR gRNA sequence
ggattacaggcgtgtgccac

SEQ ID NO: 74657 - DNA, 20 bp, Artificial
  CRISPR gRNA sequence
caggcgtgtgccacttcccc

SEQ ID NO: 74658 - DNA, 20 bp, Artificial
  CRISPR gRNA sequence
cccccaaccaatattatttt

SEQ ID NO: 74659 - DNA, 20 bp, Artificial
  CRISPR gRNA sequence
ccccaaccaatattattttt

SEQ ID NO: 74660 - DNA, 20 bp, Artificial
  CRISPR gRNA sequence
tttttagactaagaaaagtt

SEQ ID NO: 74661 - DNA, 20 bp, Artificial
  CRISPR gRNA sequence
ttagactaagaaaagtttta

SEQ ID NO: 74662 - DNA, 20 bp, Artificial
  CRISPR gRNA sequence
tagactaagaaaagttttat

SEQ ID NO: 74663 - DNA, 20 bp, Artificial
  CRISPR gRNA sequence
agactaagaaaagttttatt

SEQ ID NO: 74664 - DNA, 20 bp, Artificial
  CRISPR gRNA sequence
gactaagaaaagttttattt

SEQ ID NO: 74665 - DNA, 20 bp, Artificial
  CRISPR gRNA sequence
agaaaagttttatttgaaaa

SEQ ID NO: 74666 - DNA, 20 bp, Artificial
  CRISPR gRNA sequence
tatttgaaaatgttattttg

SEQ ID NO: 74667 - DNA, 20 bp, Artificial
  CRISPR gRNA sequence
atttgaaaatgttattttgg

SEQ ID NO: 74668 - DNA, 20 bp, Artificial
  CRISPR gRNA sequence
tttgaaaatgttattttggc

SEQ ID NO: 74669 - DNA, 20 bp, Artificial
  CRISPR gRNA sequence
gaaaatgttattttggctgg

SEQ ID NO: 74670 - DNA, 20 bp, Artificial
  CRISPR gRNA sequence
aaaatgttattttggctggg

SEQ ID NO: 74671 - DNA, 20 bp, Artificial
  CRISPR gRNA sequence
ttttggctgggtgcagtggc

SEQ ID NO: 74672 - DNA, 20 bp, Artificial
  CRISPR gRNA sequence
tggctgggtgcagtggctca

SEQ ID NO: 74673 - DNA, 20 bp, Artificial
  CRISPR gRNA sequence
ggctgggtgcagtggctcac

SEQ ID NO: 74674 - DNA, 20 bp, Artificial
  CRISPR gRNA sequence
gctgggtgcagtggctcaca

SEQ ID NO: 74675 - DNA, 20 bp, Artificial
  CRISPR gRNA sequence
ggtgcagtggctcacacctg

SEQ ID NO: 74676 - DNA, 20 bp, Artificial
  CRISPR gRNA sequence
acacctgtaatcccagcact

SEQ ID NO: 74677 - DNA, 20 bp, Artificial
  CRISPR gRNA sequence
taatcccagcactttgggag

SEQ ID NO: 74678 - DNA, 20 bp, Artificial
  CRISPR gRNA sequence
tgggaggctgaggtgggggg

SEQ ID NO: 74679 - DNA, 20 bp, Artificial
  CRISPR gRNA sequence
gggaggctgaggtgggggga

SEQ ID NO: 74680 - DNA, 20 bp, Artificial
  CRISPR gRNA sequence
ggaggctgaggtggggggat

SEQ ID NO: 74681 - DNA, 20 bp, Artificial
  CRISPR gRNA sequence
aggtggggggatcacgaggt

SEQ ID NO: 74682 - DNA, 20 bp, Artificial
  CRISPR gRNA sequence
gctaacatggtgaaaccccg

SEQ ID NO: 74683 - DNA, 20 bp, Artificial
  CRISPR gRNA sequence
acatggtgaaaccccgtctc

SEQ ID NO: 74684 - DNA, 20 bp, Artificial
  CRISPR gRNA sequence
tactaaaaatacaaaacatt

SEQ ID NO: 74685 - DNA, 20 bp, Artificial
  CRISPR gRNA sequence
ctaaaaatacaaaacattag

SEQ ID NO: 74686 - DNA, 20 bp, Artificial
  CRISPR gRNA sequence
aaaatacaaaacattagtca

SEQ ID NO: 74687 - DNA, 20 bp, Artificial
  CRISPR gRNA sequence
gtcaggcgtggtggcgggca

SEQ ID NO: 74688 - DNA, 20 bp, Artificial
  CRISPR gRNA sequence
tagtcccagctactctggag

SEQ ID NO: 74689 - DNA, 20 bp, Artificial
  CRISPR gRNA sequence
ctctggaggctgaggcagga

SEQ ID NO: 74690 - DNA, 20 bp, Artificial
  CRISPR gRNA sequence
tggaggctgaggcaggagaa

SEQ ID NO: 74691 - DNA, 20 bp, Artificial
  CRISPR gRNA sequence
gaggctgaggcaggagaatg

SEQ ID NO: 74692 - DNA, 20 bp, Artificial
  CRISPR gRNA sequence
aggcaggagaatggcgtgaa

SEQ ID NO: 74693 - DNA, 20 bp, Artificial
  CRISPR gRNA sequence
gcagtgagccgagatcgcac

SEQ ID NO: 74694 - DNA, 20 bp, Artificial
  CRISPR gRNA sequence
cagtgagccgagatcgcacc

SEQ ID NO: 74695 - DNA, 20 bp, Artificial
  CRISPR gRNA sequence
cactccaacctgggcaacag

SEQ ID NO: 74696 - DNA, 20 bp, Artificial
  CRISPR gRNA sequence
caacctgggcaacagagcga

SEQ ID NO: 74697 - DNA, 20 bp, Artificial
  CRISPR gRNA sequence
ggcaacagagcgagactccg

SEQ ID NO: 74698 - DNA, 20 bp, Artificial
  CRISPR gRNA sequence
cgtctcaaaaaaaaaaagtt

SEQ ID NO: 74699 - DNA, 20 bp, Artificial
  CRISPR gRNA sequence
aaaaaaaaaaagttattttg

SEQ ID NO: 74700 - DNA, 20 bp, Artificial
  CRISPR gRNA sequence
ttttgggtgctctagcaatt

SEQ ID NO: 74701 - DNA, 20 bp, Artificial
  CRISPR gRNA sequence
tgggtgctctagcaattctg

SEQ ID NO: 74702 - DNA, 20 bp, Artificial
  CRISPR gRNA sequence
gggtgctctagcaattctgg

SEQ ID NO: 74703 - DNA, 20 bp, Artificial
  CRISPR gRNA sequence
ggtgctctagcaattctgga

SEQ ID NO: 74704 - DNA, 20 bp, Artificial
  CRISPR gRNA sequence
tagcaattctggatatataa

SEQ ID NO: 74705 - DNA, 20 bp, Artificial
  CRISPR gRNA sequence
gcaattctggatatataacc

SEQ ID NO: 74706 - DNA, 20 bp, Artificial
  CRISPR gRNA sequence
tggatatataaccaaaataa

SEQ ID NO: 74707 - DNA, 20 bp, Artificial
  CRISPR gRNA sequence
gatatataaccaaaataatt

SEQ ID NO: 74708 - DNA, 20 bp, Artificial
  CRISPR gRNA sequence
aaagctgggactttctggct

SEQ ID NO: 74709 - DNA, 20 bp, Artificial
  CRISPR gRNA sequence
ggactttctggctgggcatg

SEQ ID NO: 74710 - DNA, 20 bp, Artificial
  CRISPR gRNA sequence
tctggctgggcatggtggct

SEQ ID NO: 74711 - DNA, 20 bp, Artificial
  CRISPR gRNA sequence
ctggctgggcatggtggctc

SEQ ID NO: 74712 - DNA, 20 bp, Artificial
  CRISPR gRNA sequence
tggctgggcatggtggctca

SEQ ID NO: 74713 - DNA, 20 bp, Artificial
  CRISPR gRNA sequence
gctgggcatggtggctcacg

SEQ ID NO: 74714 - DNA, 20 bp, Artificial
  CRISPR gRNA sequence
ggcatggtggctcacgccta

SEQ ID NO: 74715 - DNA, 20 bp, Artificial
  CRISPR gRNA sequence
acgcctagcactttgggagg

SEQ ID NO: 74716 - DNA, 20 bp, Artificial
  CRISPR gRNA sequence
gcactttgggaggctgaggt

SEQ ID NO: 74717 - DNA, 20 bp, Artificial
  CRISPR gRNA sequence
tgggaggctgaggtgggagg

SEQ ID NO: 74718 - DNA, 20 bp, Artificial
  CRISPR gRNA sequence
gggaggctgaggtgggagga

SEQ ID NO: 74719 - DNA, 20 bp, Artificial
  CRISPR gRNA sequence
ggaggctgaggtgggaggat

SEQ ID NO: 74720 - DNA, 20 bp, Artificial
  CRISPR gRNA sequence
aggtgggaggatcacttgag

SEQ ID NO: 74721 - DNA, 20 bp, Artificial
  CRISPR gRNA sequence
gagctcaggagatcaagatc

SEQ ID NO: 74722 - DNA, 20 bp, Artificial
  CRISPR gRNA sequence
agctcaggagatcaagatca

SEQ ID NO: 74723 - DNA, 20 bp, Artificial
  CRISPR gRNA sequence
aggagatcaagatcatcctg

SEQ ID NO: 74724 - DNA, 20 bp, Artificial
  CRISPR gRNA sequence
ggcaaaacagtgagacctca

SEQ ID NO: 74725 - DNA, 20 bp, Artificial
  CRISPR gRNA sequence
atctctattgtttttgaaat

SEQ ID NO: 74726 - DNA, 20 bp, Artificial
  CRISPR gRNA sequence
tattgtttttgaaataaaat

SEQ ID NO: 74727 - DNA, 20 bp, Artificial
  CRISPR gRNA sequence
ttgtttttgaaataaaataa

SEQ ID NO: 74728 - DNA, 20 bp, Artificial
  CRISPR gRNA sequence
tttttgaaataaaataatat

SEQ ID NO: 74729 - DNA, 20 bp, Artificial
  CRISPR gRNA sequence
ttgaaataaaataatattta

SEQ ID NO: 74730 - DNA, 20 bp, Artificial
  CRISPR gRNA sequence
tgaaataaaataatatttaa

SEQ ID NO: 74731 - DNA, 20 bp, Artificial
  CRISPR gRNA sequence
gaaataaaataatatttaaa

SEQ ID NO: 74732 - DNA, 20 bp, Artificial
  CRISPR gRNA sequence
aaataaaataatatttaaaa

SEQ ID NO: 74733 - DNA, 20 bp, Artificial
  CRISPR gRNA sequence
aaaaaaagaaagcagggact

SEQ ID NO: 74734 - DNA, 20 bp, Artificial
  CRISPR gRNA sequence
aaaaaagaaagcagggactg

SEQ ID NO: 74735 - DNA, 20 bp, Artificial
  CRISPR gRNA sequence
tcaattgggcacttgaatgg

SEQ ID NO: 74736 - DNA, 20 bp, Artificial
  CRISPR gRNA sequence
ggcacttgaatggacaaccc

SEQ ID NO: 74737 - DNA, 20 bp, Artificial
  CRISPR gRNA sequence
gaatggacaacccaagtgtc

SEQ ID NO: 74738 - DNA, 20 bp, Artificial
  CRISPR gRNA sequence
aatggacaacccaagtgtca

SEQ ID NO: 74739 - DNA, 20 bp, Artificial
  CRISPR gRNA sequence
atggataagtggatacacaa

SEQ ID NO: 74740 - DNA, 20 bp, Artificial
  CRISPR gRNA sequence
tgcagccttaaaaaaggaaa

SEQ ID NO: 74741 - DNA, 20 bp, Artificial
  CRISPR gRNA sequence
aaaaaaggaaagggctgggt

SEQ ID NO: 74742 - DNA, 20 bp, Artificial
  CRISPR gRNA sequence
aaaaaggaaagggctgggtg

SEQ ID NO: 74743 - DNA, 20 bp, Artificial
  CRISPR gRNA sequence
ggtgtggtggctcatgcctg

SEQ ID NO: 74744 - DNA, 20 bp, Artificial
  CRISPR gRNA sequence
atgcctgtaatcccagcact

SEQ ID NO: 74745 - DNA, 20 bp, Artificial
  CRISPR gRNA sequence
taatcccagcactttggaag

SEQ ID NO: 74746 - DNA, 20 bp, Artificial
  CRISPR gRNA sequence
tggaaggccgaaacgggcag

SEQ ID NO: 74747 - DNA, 20 bp, Artificial
  CRISPR gRNA sequence
ggaaggccgaaacgggcaga

SEQ ID NO: 74748 - DNA, 20 bp, Artificial
  CRISPR gRNA sequence
gaaggccgaaacgggcagat

SEQ ID NO: 74749 - DNA, 20 bp, Artificial
  CRISPR gRNA sequence
aggtcaggagttcgagacca

SEQ ID NO: 74750 - DNA, 20 bp, Artificial
  CRISPR gRNA sequence
gagaccagcctcgccaacat

SEQ ID NO: 74751 - DNA, 20 bp, Artificial
  CRISPR gRNA sequence
gccaacatggtgaaaccctg

SEQ ID NO: 74752 - DNA, 20 bp, Artificial
  CRISPR gRNA sequence
tctctacaaaaatacaaaaa

SEQ ID NO: 74753 - DNA, 20 bp, Artificial
  CRISPR gRNA sequence
tacaaaaatacaaaaaaaaa

SEQ ID NO: 74754 - DNA, 20 bp, Artificial
  CRISPR gRNA sequence
caaaaatacaaaaaaaaatt

SEQ ID NO: 74755 - DNA, 20 bp, Artificial
  CRISPR gRNA sequence
gctgggtgtggtggcgggcg

SEQ ID NO: 74756 - DNA, 20 bp, Artificial
  CRISPR gRNA sequence
ggtgtggtggcgggcgcctg

SEQ ID NO: 74757 - DNA, 20 bp, Artificial
  CRISPR gRNA sequence
taatcccagctactccggag

SEQ ID NO: 74758 - DNA, 20 bp, Artificial
  CRISPR gRNA sequence
ctccggaggctgaggcagga

SEQ ID NO: 74759 - DNA, 20 bp, Artificial
  CRISPR gRNA sequence
cggaggctgaggcaggagaa

SEQ ID NO: 74760 - DNA, 20 bp, Artificial
  CRISPR gRNA sequence
aggcaggagaatcgcttgaa

SEQ ID NO: 74761 - DNA, 20 bp, Artificial
  CRISPR gRNA sequence
gaacccaagaggtggagggt

SEQ ID NO: 74762 - DNA, 20 bp, Artificial
  CRISPR gRNA sequence
aacccaagaggtggagggtg

SEQ ID NO: 74763 - DNA, 20 bp, Artificial
  CRISPR gRNA sequence
agatcgagccagtgcactcc

SEQ ID NO: 74764 - DNA, 20 bp, Artificial
  CRISPR gRNA sequence
cagcccaggtgacaagagtg

SEQ ID NO: 74765 - DNA, 20 bp, Artificial
  CRISPR gRNA sequence
tgtctcaaaaaaaaaaaaaa

SEQ ID NO: 74766 - DNA, 20 bp, Artificial
  CRISPR gRNA sequence
tctcaaaaaaaaaaaaaaaa

SEQ ID NO: 74767 - DNA, 20 bp, Artificial
  CRISPR gRNA sequence
aaaaaaaaaaaaaaaaaaaa

SEQ ID NO: 74768 - DNA, 20 bp, Artificial
  CRISPR gRNA sequence
acacagtgacacacgctgca

SEQ ID NO: 74769 - DNA, 20 bp, Artificial
  CRISPR gRNA sequence
caacatgaatgaaccagagg

SEQ ID NO: 74770 - DNA, 20 bp, Artificial
  CRISPR gRNA sequence
tgcccaatgaaatgagccag

SEQ ID NO: 74771 - DNA, 20 bp, Artificial
  CRISPR gRNA sequence
cactcatataaactatttag

SEQ ID NO: 74772 - DNA, 20 bp, Artificial
  CRISPR gRNA sequence
atataaactatttagagcag

SEQ ID NO: 74773 - DNA, 20 bp, Artificial
  CRISPR gRNA sequence
tttagagcagtccaattcat

SEQ ID NO: 74774 - DNA, 20 bp, Artificial
  CRISPR gRNA sequence
agagcagtccaattcataga

SEQ ID NO: 74775 - DNA, 20 bp, Artificial
  CRISPR gRNA sequence
gagcagtccaattcatagag

SEQ ID NO: 74776 - DNA, 20 bp, Artificial
  CRISPR gRNA sequence
atagagacagaaagcagaat

SEQ ID NO: 74777 - DNA, 20 bp, Artificial
  CRISPR gRNA sequence
ccaggggctggggtaggggg

SEQ ID NO: 74778 - DNA, 20 bp, Artificial
  CRISPR gRNA sequence
gggtaggggggaaatggggt

SEQ ID NO: 74779 - DNA, 20 bp, Artificial
  CRISPR gRNA sequence
tttaatggggatagagattc

SEQ ID NO: 74780 - DNA, 20 bp, Artificial
  CRISPR gRNA sequence
aatggggatagagattcagt

SEQ ID NO: 74781 - DNA, 20 bp, Artificial
  CRISPR gRNA sequence
atggggatagagattcagtt

SEQ ID NO: 74782 - DNA, 20 bp, Artificial
  CRISPR gRNA sequence
agttttgcaagaggaaaaga

SEQ ID NO: 74783 - DNA, 20 bp, Artificial
  CRISPR gRNA sequence
tgcaagaggaaaagagttcc

SEQ ID NO: 74784 - DNA, 20 bp, Artificial
  CRISPR gRNA sequence
gcaagaggaaaagagttccg

SEQ ID NO: 74785 - DNA, 20 bp, Artificial
  CRISPR gRNA sequence
caagaggaaaagagttccgg

SEQ ID NO: 74786 - DNA, 20 bp, Artificial
  CRISPR gRNA sequence
cggagattggccgtacaaaa

SEQ ID NO: 74787 - DNA, 20 bp, Artificial
  CRISPR gRNA sequence
gccgtacaaaaaagtggatg

SEQ ID NO: 74788 - DNA, 20 bp, Artificial
  CRISPR gRNA sequence
aacactcctgaatggtacac

SEQ ID NO: 74789 - DNA, 20 bp, Artificial
  CRISPR gRNA sequence
acactcctgaatggtacact

SEQ ID NO: 74790 - DNA, 20 bp, Artificial
  CRISPR gRNA sequence
ctgaatggtacacttagaaa

SEQ ID NO: 74791 - DNA, 20 bp, Artificial
  CRISPR gRNA sequence
aatggtacacttagaaatga

SEQ ID NO: 74792 - DNA, 20 bp, Artificial
  CRISPR gRNA sequence
agaaatgattaagatggcaa

SEQ ID NO: 74793 - DNA, 20 bp, Artificial
  CRISPR gRNA sequence
gaaatgattaagatggcaaa

SEQ ID NO: 74794 - DNA, 20 bp, Artificial
  CRISPR gRNA sequence
agatggcaaattttgttatg

SEQ ID NO: 74795 - DNA, 20 bp, Artificial
  CRISPR gRNA sequence
tgttatgtgtattttataat

SEQ ID NO: 74796 - DNA, 20 bp, Artificial
  CRISPR gRNA sequence
gttatgtgtattttataata

SEQ ID NO: 74797 - DNA, 20 bp, Artificial
  CRISPR gRNA sequence
ttatgtgtattttataataa

SEQ ID NO: 74798 - DNA, 20 bp, Artificial
  CRISPR gRNA sequence
tgtgtattttataataattt

SEQ ID NO: 74799 - DNA, 20 bp, Artificial
  CRISPR gRNA sequence
tataataatttttacaggtt

SEQ ID NO: 74800 - DNA, 20 bp, Artificial
  CRISPR gRNA sequence
ataataatttttacaggtta

SEQ ID NO: 74801 - DNA, 20 bp, Artificial
  CRISPR gRNA sequence
taataatttttacaggttat

SEQ ID NO: 74802 - DNA, 20 bp, Artificial
  CRISPR gRNA sequence
ttacaggttattttggggaa

SEQ ID NO: 74803 - DNA, 20 bp, Artificial
  CRISPR gRNA sequence
tacaggttattttggggaac

SEQ ID NO: 74804 - DNA, 20 bp, Artificial
  CRISPR gRNA sequence
acaggttattttggggaaca

SEQ ID NO: 74805 - DNA, 20 bp, Artificial
  CRISPR gRNA sequence
caggttattttggggaacag

SEQ ID NO: 74806 - DNA, 20 bp, Artificial
  CRISPR gRNA sequence
ttttggggaacagtcagttc

SEQ ID NO: 74807 - DNA, 20 bp, Artificial
  CRISPR gRNA sequence
tggggaacagtcagttctta

SEQ ID NO: 74808 - DNA, 20 bp, Artificial
  CRISPR gRNA sequence
ggggaacagtcagttcttag

SEQ ID NO: 74809 - DNA, 20 bp, Artificial
  CRISPR gRNA sequence
gggaacagtcagttcttagg

SEQ ID NO: 74810 - DNA, 20 bp, Artificial
  CRISPR gRNA sequence
ttaggtgccttgtcacaggc

SEQ ID NO: 74811 - DNA, 20 bp, Artificial
  CRISPR gRNA sequence
aggtgccttgtcacaggctg

SEQ ID NO: 74812 - DNA, 20 bp, Artificial
  CRISPR gRNA sequence
ggtgccttgtcacaggctgc

SEQ ID NO: 74813 - DNA, 20 bp, Artificial
  CRISPR gRNA sequence
gtcacaggctgcaatgagaa

SEQ ID NO: 74814 - DNA, 20 bp, Artificial
  CRISPR gRNA sequence
tcacaggctgcaatgagaag

SEQ ID NO: 74815 - DNA, 20 bp, Artificial
  CRISPR gRNA sequence
caatgagaagtgcacagctc

SEQ ID NO: 74816 - DNA, 20 bp, Artificial
  CRISPR gRNA sequence
tgtcggtgacgtaagttttt

SEQ ID NO: 74817 - DNA, 20 bp, Artificial
  CRISPR gRNA sequence
tcggtgacgtaagttttttg

SEQ ID NO: 74818 - DNA, 20 bp, Artificial
  CRISPR gRNA sequence
tttgggcacaaacatgaaac

SEQ ID NO: 74819 - DNA, 20 bp, Artificial
  CRISPR gRNA sequence
ttgggcacaaacatgaaact

SEQ ID NO: 74820 - DNA, 20 bp, Artificial
  CRISPR gRNA sequence
tgggcacaaacatgaaactg

SEQ ID NO: 74821 - DNA, 20 bp, Artificial
  CRISPR gRNA sequence
gggcacaaacatgaaactga

SEQ ID NO: 74822 - DNA, 20 bp, Artificial
  CRISPR gRNA sequence
ggcacaaacatgaaactgaa

SEQ ID NO: 74823 - DNA, 20 bp, Artificial
  CRISPR gRNA sequence
aatgtcatggagccttttga

SEQ ID NO: 74824 - DNA, 20 bp, Artificial
  CRISPR gRNA sequence
ttgatctaacgtccagtttc

SEQ ID NO: 74825 - DNA, 20 bp, Artificial
  CRISPR gRNA sequence
tgatctaacgtccagtttcc

SEQ ID NO: 74826 - DNA, 20 bp, Artificial
  CRISPR gRNA sequence
gatctaacgtccagtttcca

SEQ ID NO: 74827 - DNA, 20 bp, Artificial
  CRISPR gRNA sequence
atctaacgtccagtttccag

SEQ ID NO: 74828 - DNA, 20 bp, Artificial
  CRISPR gRNA sequence
acgtccagtttccaggaaag

SEQ ID NO: 74829 - DNA, 20 bp, Artificial
  CRISPR gRNA sequence
ccaggaaagtcggggttaga

SEQ ID NO: 74830 - DNA, 20 bp, Artificial
  CRISPR gRNA sequence
caggaaagtcggggttagag

SEQ ID NO: 74831 - DNA, 20 bp, Artificial
  CRISPR gRNA sequence
gaggaacacgtgccatgaca

SEQ ID NO: 74832 - DNA, 20 bp, Artificial
  CRISPR gRNA sequence
cagtacacacagttgctgat

SEQ ID NO: 74833 - DNA, 20 bp, Artificial
  CRISPR gRNA sequence
ctgattttgtcaacagacac

SEQ ID NO: 74834 - DNA, 20 bp, Artificial
  CRISPR gRNA sequence
attttgtcaacagacactga

SEQ ID NO: 74835 - DNA, 20 bp, Artificial
  CRISPR gRNA sequence
tgtcaacagacactgacatg

SEQ ID NO: 74836 - DNA, 20 bp, Artificial
  CRISPR gRNA sequence
gtcaacagacactgacatga

SEQ ID NO: 74837 - DNA, 20 bp, Artificial
  CRISPR gRNA sequence
tcaacagacactgacatgaa

SEQ ID NO: 74838 - DNA, 20 bp, Artificial
  CRISPR gRNA sequence
acatgaaacagaaagctgtg

SEQ ID NO: 74839 - DNA, 20 bp, Artificial
  CRISPR gRNA sequence
tggtgaggggatgggggcag

SEQ ID NO: 74840 - DNA, 20 bp, Artificial
  CRISPR gRNA sequence
gaagagtcagaagaccatcg

SEQ ID NO: 74841 - DNA, 20 bp, Artificial
  CRISPR gRNA sequence
gatcccaaaagccagctgtc

SEQ ID NO: 74842 - DNA, 20 bp, Artificial
  CRISPR gRNA sequence
tcttatctgggggacaatgg

SEQ ID NO: 74843 - DNA, 20 bp, Artificial
  CRISPR gRNA sequence
atctgggggacaatggggac

SEQ ID NO: 74844 - DNA, 20 bp, Artificial
  CRISPR gRNA sequence
tctgggggacaatggggaca

SEQ ID NO: 74845 - DNA, 20 bp, Artificial
  CRISPR gRNA sequence
ggggacaatggggacatttt

SEQ ID NO: 74846 - DNA, 20 bp, Artificial
  CRISPR gRNA sequence
tagattagactaggtagtac

SEQ ID NO: 74847 - DNA, 20 bp, Artificial
  CRISPR gRNA sequence
agattagactaggtagtacc

SEQ ID NO: 74848 - DNA, 20 bp, Artificial
  CRISPR gRNA sequence
gattagactaggtagtaccc

SEQ ID NO: 74849 - DNA, 20 bp, Artificial
  CRISPR gRNA sequence
gactaggtagtacccgacac

SEQ ID NO: 74850 - DNA, 20 bp, Artificial
  CRISPR gRNA sequence
ggtagtacccgacactaagg

SEQ ID NO: 74851 - DNA, 20 bp, Artificial
  CRISPR gRNA sequence
aggaatcgctaactgagttt

SEQ ID NO: 74852 - DNA, 20 bp, Artificial
  CRISPR gRNA sequence
actgagtttcttaggtgtcc

SEQ ID NO: 74853 - DNA, 20 bp, Artificial
  CRISPR gRNA sequence
agtttcttaggtgtcctgat

SEQ ID NO: 74854 - DNA, 20 bp, Artificial
  CRISPR gRNA sequence
cttaggtgtcctgatggaac

SEQ ID NO: 74855 - DNA, 20 bp, Artificial
  CRISPR gRNA sequence
ttaggtgtcctgatggaact

SEQ ID NO: 74856 - DNA, 20 bp, Artificial
  CRISPR gRNA sequence
aggtgtcctgatggaactgt

SEQ ID NO: 74857 - DNA, 20 bp, Artificial
  CRISPR gRNA sequence
ggtgtcctgatggaactgtg

SEQ ID NO: 74858 - DNA, 20 bp, Artificial
  CRISPR gRNA sequence
atggaactgtgattactgaa

SEQ ID NO: 74859 - DNA, 20 bp, Artificial
  CRISPR gRNA sequence
tgattactgaaaaaaatgtc

SEQ ID NO: 74860 - DNA, 20 bp, Artificial
  CRISPR gRNA sequence
ctgaaaaaaatgtccttatt

SEQ ID NO: 74861 - DNA, 20 bp, Artificial
  CRISPR gRNA sequence
aaaaaaatgtccttattttt

SEQ ID NO: 74862 - DNA, 20 bp, Artificial
  CRISPR gRNA sequence
attttttggagcttcacggt

SEQ ID NO: 74863 - DNA, 20 bp, Artificial
  CRISPR gRNA sequence
ttttttggagcttcacggtg

SEQ ID NO: 74864 - DNA, 20 bp, Artificial
  CRISPR gRNA sequence
tttggagcttcacggtgaaa

SEQ ID NO: 74865 - DNA, 20 bp, Artificial
  CRISPR gRNA sequence
ttggagcttcacggtgaaat

SEQ ID NO: 74866 - DNA, 20 bp, Artificial
  CRISPR gRNA sequence
tggagcttcacggtgaaata

SEQ ID NO: 74867 - DNA, 20 bp, Artificial
  CRISPR gRNA sequence
ggagcttcacggtgaaatat

SEQ ID NO: 74868 - DNA, 20 bp, Artificial
  CRISPR gRNA sequence
gagcttcacggtgaaatatt

SEQ ID NO: 74869 - DNA, 20 bp, Artificial
  CRISPR gRNA sequence
cacggtgaaatatttaggag

SEQ ID NO: 74870 - DNA, 20 bp, Artificial
  CRISPR gRNA sequence
acggtgaaatatttaggagt

SEQ ID NO: 74871 - DNA, 20 bp, Artificial
  CRISPR gRNA sequence
aggagtgatggattatgagg

SEQ ID NO: 74872 - DNA, 20 bp, Artificial
  CRISPR gRNA sequence
ggagtgatggattatgaggt

SEQ ID NO: 74873 - DNA, 20 bp, Artificial
  CRISPR gRNA sequence
tgaggtctataacttacttg

SEQ ID NO: 74874 - DNA, 20 bp, Artificial
  CRISPR gRNA sequence
taacttacttgaaaccgctt

SEQ ID NO: 74875 - DNA, 20 bp, Artificial
  CRISPR gRNA sequence
acttgaaaccgcttcagctg

SEQ ID NO: 74876 - DNA, 20 bp, Artificial
  CRISPR gRNA sequence
cttgaaaccgcttcagctga

SEQ ID NO: 74877 - DNA, 20 bp, Artificial
  CRISPR gRNA sequence
gaaaccgcttcagctgaaat

SEQ ID NO: 74878 - DNA, 20 bp, Artificial
  CRISPR gRNA sequence
aaaccgcttcagctgaaata

SEQ ID NO: 74879 - DNA, 20 bp, Artificial
  CRISPR gRNA sequence
cagctgaaataaaaataaaa

SEQ ID NO: 74880 - DNA, 20 bp, Artificial
  CRISPR gRNA sequence
agctgaaataaaaataaaaa

SEQ ID NO: 74881 - DNA, 20 bp, Artificial
  CRISPR gRNA sequence
aaataaaaataaaaatagaa

SEQ ID NO: 74882 - DNA, 20 bp, Artificial
  CRISPR gRNA sequence
tcaaacctaggttctgggaa

SEQ ID NO: 74883 - DNA, 20 bp, Artificial
  CRISPR gRNA sequence
ggttctgggaataggagttt

SEQ ID NO: 74884 - DNA, 20 bp, Artificial
  CRISPR gRNA sequence
tgggaataggagttttaaaa

SEQ ID NO: 74885 - DNA, 20 bp, Artificial
  CRISPR gRNA sequence
ggaataggagttttaaaaaa

SEQ ID NO: 74886 - DNA, 20 bp, Artificial
  CRISPR gRNA sequence
taaaaaattattctttctac

SEQ ID NO: 74887 - DNA, 20 bp, Artificial
  CRISPR gRNA sequence
aaaaaattattctttctact

SEQ ID NO: 74888 - DNA, 20 bp, Artificial
  CRISPR gRNA sequence
aaaaattattctttctactt

SEQ ID NO: 74889 - DNA, 20 bp, Artificial
  CRISPR gRNA sequence
ttctttctacttcggtatct

SEQ ID NO: 74890 - DNA, 20 bp, Artificial
  CRISPR gRNA sequence
tttctacttcggtatcttct

SEQ ID NO: 74891 - DNA, 20 bp, Artificial
  CRISPR gRNA sequence
tctacttcggtatcttcttt

SEQ ID NO: 74892 - DNA, 20 bp, Artificial
  CRISPR gRNA sequence
ctacttcggtatcttctttt

SEQ ID NO: 74893 - DNA, 20 bp, Artificial
  CRISPR gRNA sequence
tacttcggtatcttcttttt

SEQ ID NO: 74894 - DNA, 20 bp, Artificial
  CRISPR gRNA sequence
cttcggtatcttctttttct

SEQ ID NO: 74895 - DNA, 20 bp, Artificial
  CRISPR gRNA sequence
cggtatcttctttttctgag

SEQ ID NO: 74896 - DNA, 20 bp, Artificial
  CRISPR gRNA sequence
ggtatcttctttttctgagt

SEQ ID NO: 74897 - DNA, 20 bp, Artificial
  CRISPR gRNA sequence
ctttttctgagtgttttaaa

SEQ ID NO: 74898 - DNA, 20 bp, Artificial
  CRISPR gRNA sequence
tttttctgagtgttttaaaa

SEQ ID NO: 74899 - DNA, 20 bp, Artificial
  CRISPR gRNA sequence
tttctgagtgttttaaaatg

SEQ ID NO: 74900 - DNA, 20 bp, Artificial
  CRISPR gRNA sequence
ttctgagtgttttaaaatga

SEQ ID NO: 74901 - DNA, 20 bp, Artificial
  CRISPR gRNA sequence
tctgagtgttttaaaatgat

SEQ ID NO: 74902 - DNA, 20 bp, Artificial
  CRISPR gRNA sequence
ctgagtgttttaaaatgatc

SEQ ID NO: 74903 - DNA, 20 bp, Artificial
  CRISPR gRNA sequence
tgagtgttttaaaatgatca

SEQ ID NO: 74904 - DNA, 20 bp, Artificial
  CRISPR gRNA sequence
agtgttttaaaatgatcata

SEQ ID NO: 74905 - DNA, 20 bp, Artificial
  CRISPR gRNA sequence
taaaatgatcatagtgaaca

SEQ ID NO: 74906 - DNA, 20 bp, Artificial
  CRISPR gRNA sequence
aaaatgatcatagtgaacag

SEQ ID NO: 74907 - DNA, 20 bp, Artificial
  CRISPR gRNA sequence
aaatgatcatagtgaacaga

SEQ ID NO: 74908 - DNA, 20 bp, Artificial
  CRISPR gRNA sequence
cgtttcagtttatttttgtc

SEQ ID NO: 74909 - DNA, 20 bp, Artificial
  CRISPR gRNA sequence
gtttcagtttatttttgtcc

SEQ ID NO: 74910 - DNA, 20 bp, Artificial
  CRISPR gRNA sequence
cagtttatttttgtcctcag

SEQ ID NO: 74911 - DNA, 20 bp, Artificial
  CRISPR gRNA sequence
agtttatttttgtcctcagt

SEQ ID NO: 74912 - DNA, 20 bp, Artificial
  CRISPR gRNA sequence
atttttgtcctcagttcagt

SEQ ID NO: 74913 - DNA, 20 bp, Artificial
  CRISPR gRNA sequence
tttttgtcctcagttcagta

SEQ ID NO: 74914 - DNA, 20 bp, Artificial
  CRISPR gRNA sequence
ttgtcctcagttcagtatcc

SEQ ID NO: 74915 - DNA, 20 bp, Artificial
  CRISPR gRNA sequence
tgtcctcagttcagtatcct

SEQ ID NO: 74916 - DNA, 20 bp, Artificial
  CRISPR gRNA sequence
gtcctcagttcagtatcctc

SEQ ID NO: 74917 - DNA, 20 bp, Artificial
  CRISPR gRNA sequence
tcctcagttcagtatcctct

SEQ ID NO: 74918 - DNA, 20 bp, Artificial
  CRISPR gRNA sequence
agttcagtatcctctgaaac

SEQ ID NO: 74919 - DNA, 20 bp, Artificial
  CRISPR gRNA sequence
agtatcctctgaaaccttct

SEQ ID NO: 74920 - DNA, 20 bp, Artificial
  CRISPR gRNA sequence
tgaaaccttctttctttctt

SEQ ID NO: 74921 - DNA, 20 bp, Artificial
  CRISPR gRNA sequence
aaaccttctttctttctttc

SEQ ID NO: 74922 - DNA, 20 bp, Artificial
  CRISPR gRNA sequence
ctttctttctttctttcttt

SEQ ID NO: 74923 - DNA, 20 bp, Artificial
  CRISPR gRNA sequence
tttctttctttctttctttt

SEQ ID NO: 74924 - DNA, 20 bp, Artificial
  CRISPR gRNA sequence
tctttctttctttctttttt

SEQ ID NO: 74925 - DNA, 20 bp, Artificial
  CRISPR gRNA sequence
ctttctttctttcttttttt

SEQ ID NO: 74926 - DNA, 20 bp, Artificial
  CRISPR gRNA sequence
tttctttctttctttttttc

SEQ ID NO: 74927 - DNA, 20 bp, Artificial
  CRISPR gRNA sequence
tctttctttctttttttctt

SEQ ID NO: 74928 - DNA, 20 bp, Artificial
  CRISPR gRNA sequence
ctttctttctttttttctta

SEQ ID NO: 74929 - DNA, 20 bp, Artificial
  CRISPR gRNA sequence
tttctttctttttttcttaa

SEQ ID NO: 74930 - DNA, 20 bp, Artificial
  CRISPR gRNA sequence
tctttctttttttcttaaat

SEQ ID NO: 74931 - DNA, 20 bp, Artificial
  CRISPR gRNA sequence
ctttctttttttcttaaatc

SEQ ID NO: 74932 - DNA, 20 bp, Artificial
  CRISPR gRNA sequence
tttctttttttcttaaatcc

SEQ ID NO: 74933 - DNA, 20 bp, Artificial
  CRISPR gRNA sequence
tctttttttcttaaatccca

SEQ ID NO: 74934 - DNA, 20 bp, Artificial
  CRISPR gRNA sequence
ctttttttcttaaatcccaa

SEQ ID NO: 74935 - DNA, 20 bp, Artificial
  CRISPR gRNA sequence
tttttttcttaaatcccaaa

SEQ ID NO: 74936 - DNA, 20 bp, Artificial
  CRISPR gRNA sequence
tttttcttaaatcccaaagc

SEQ ID NO: 74937 - DNA, 20 bp, Artificial
  CRISPR gRNA sequence
ttttcttaaatcccaaagca

SEQ ID NO: 74938 - DNA, 20 bp, Artificial
  CRISPR gRNA sequence
tttcttaaatcccaaagcac

SEQ ID NO: 74939 - DNA, 20 bp, Artificial
  CRISPR gRNA sequence
ttcttaaatcccaaagcaca

SEQ ID NO: 74940 - DNA, 20 bp, Artificial
  CRISPR gRNA sequence
tcttaaatcccaaagcacag

SEQ ID NO: 74941 - DNA, 20 bp, Artificial
  CRISPR gRNA sequence
cttaaatcccaaagcacagg

SEQ ID NO: 74942 - DNA, 20 bp, Artificial
  CRISPR gRNA sequence
ttaaatcccaaagcacaggc

SEQ ID NO: 74943 - DNA, 20 bp, Artificial
  CRISPR gRNA sequence
aaatcccaaagcacaggcct

SEQ ID NO: 74944 - DNA, 20 bp, Artificial
  CRISPR gRNA sequence
aatcccaaagcacaggcctc

SEQ ID NO: 74945 - DNA, 20 bp, Artificial
  CRISPR gRNA sequence
cagtgtggggaaggacagtt

SEQ ID NO: 74946 - DNA, 20 bp, Artificial
  CRISPR gRNA sequence
ctctgtgtgccttgtggagt

SEQ ID NO: 74947 - DNA, 20 bp, Artificial
  CRISPR gRNA sequence
tctgtgtgccttgtggagtc

SEQ ID NO: 74948 - DNA, 20 bp, Artificial
  CRISPR gRNA sequence
tgtgtgccttgtggagtctc

SEQ ID NO: 74949 - DNA, 20 bp, Artificial
  CRISPR gRNA sequence
tgtgccttgtggagtctctg

SEQ ID NO: 74950 - DNA, 20 bp, Artificial
  CRISPR gRNA sequence
gtggagtctctgggacagat

SEQ ID NO: 74951 - DNA, 20 bp, Artificial
  CRISPR gRNA sequence
tggagtctctgggacagatg

SEQ ID NO: 74952 - DNA, 20 bp, Artificial
  CRISPR gRNA sequence
tgggacagatggacagggtt

SEQ ID NO: 74953 - DNA, 20 bp, Artificial
  CRISPR gRNA sequence
ggacagatggacagggtttg

SEQ ID NO: 74954 - DNA, 20 bp, Artificial
  CRISPR gRNA sequence
gctcagggtccagatggcag

SEQ ID NO: 74955 - DNA, 20 bp, Artificial
  CRISPR gRNA sequence
ctcagggtccagatggcagg

SEQ ID NO: 74956 - DNA, 20 bp, Artificial
  CRISPR gRNA sequence
agggtccagatggcagggtt

SEQ ID NO: 74957 - DNA, 20 bp, Artificial
  CRISPR gRNA sequence
tgggtacaggaaatgactgg

SEQ ID NO: 74958 - DNA, 20 bp, Artificial
  CRISPR gRNA sequence
gggccatgatcctgggggcc

SEQ ID NO: 74959 - DNA, 20 bp, Artificial
  CRISPR gRNA sequence
ggggcctcttactccagtgc

SEQ ID NO: 74960 - DNA, 20 bp, Artificial
  CRISPR gRNA sequence
ttactccagtgcccacccct

SEQ ID NO: 74961 - DNA, 20 bp, Artificial
  CRISPR gRNA sequence
actccagtgcccacccctgc

SEQ ID NO: 74962 - DNA, 20 bp, Artificial
  CRISPR gRNA sequence
ctccagtgcccacccctgct

SEQ ID NO: 74963 - DNA, 20 bp, Artificial
  CRISPR gRNA sequence
cagtgcccacccctgctccc

SEQ ID NO: 74964 - DNA, 20 bp, Artificial
  CRISPR gRNA sequence
ctcccattcatgccatggcc

SEQ ID NO: 74965 - DNA, 20 bp, Artificial
  CRISPR gRNA sequence
ccattcatgccatggcccct

SEQ ID NO: 74966 - DNA, 20 bp, Artificial
  CRISPR gRNA sequence
atgccatggcccctcccgga

SEQ ID NO: 74967 - DNA, 20 bp, Artificial
  CRISPR gRNA sequence
ccggaggcagcgggggagga

SEQ ID NO: 74968 - DNA, 20 bp, Artificial
  CRISPR gRNA sequence
aggctgaacagccctgcggg

SEQ ID NO: 74969 - DNA, 20 bp, Artificial
  CRISPR gRNA sequence
aacagccctgcgggtcgccc

SEQ ID NO: 74970 - DNA, 20 bp, Artificial
  CRISPR gRNA sequence
cgggtcgccccaccaagctc

SEQ ID NO: 74971 - DNA, 20 bp, Artificial
  CRISPR gRNA sequence
aggaggatggccagctgctt

SEQ ID NO: 74972 - DNA, 20 bp, Artificial
  CRISPR gRNA sequence
cttctggcccaggcagcact

SEQ ID NO: 74973 - DNA, 20 bp, Artificial
  CRISPR gRNA sequence
ctggcccaggcagcactggg

SEQ ID NO: 74974 - DNA, 20 bp, Artificial
  CRISPR gRNA sequence
tggcccaggcagcactgggt

SEQ ID NO: 74975 - DNA, 20 bp, Artificial
  CRISPR gRNA sequence
gcccaggcagcactgggtca

SEQ ID NO: 74976 - DNA, 20 bp, Artificial
  CRISPR gRNA sequence
ggtcagcctggagacagagg

SEQ ID NO: 74977 - DNA, 20 bp, Artificial
  CRISPR gRNA sequence
gagacagaggtcagtcactg

SEQ ID NO: 74978 - DNA, 20 bp, Artificial
  CRISPR gRNA sequence
aggtggctctggcagggtgc

SEQ ID NO: 74979 - DNA, 20 bp, Artificial
  CRISPR gRNA sequence
tggcagggtgcccccacccc

SEQ ID NO: 74980 - DNA, 20 bp, Artificial
  CRISPR gRNA sequence
gcagggtgcccccacccctc

SEQ ID NO: 74981 - DNA, 20 bp, Artificial
  CRISPR gRNA sequence
tgctgtcctcacgggctggg

SEQ ID NO: 74982 - DNA, 20 bp, Artificial
  CRISPR gRNA sequence
ctgtcctcacgggctgggtg

SEQ ID NO: 74983 - DNA, 20 bp, Artificial
  CRISPR gRNA sequence
tcctcacgggctgggtgggt

SEQ ID NO: 74984 - DNA, 20 bp, Artificial
  CRISPR gRNA sequence
acgggctgggtgggtcactc

SEQ ID NO: 74985 - DNA, 20 bp, Artificial
  CRISPR gRNA sequence
ggtgggtcactcacgtgagc

SEQ ID NO: 74986 - DNA, 20 bp, Artificial
  CRISPR gRNA sequence
acgtgagctccgtcagctgc

SEQ ID NO: 74987 - DNA, 20 bp, Artificial
  CRISPR gRNA sequence
cgtcagctgcagggacttgc

SEQ ID NO: 74988 - DNA, 20 bp, Artificial
  CRISPR gRNA sequence
cagggacttgctcaagccgg

SEQ ID NO: 74989 - DNA, 20 bp, Artificial
  CRISPR gRNA sequence
gctcaagccggtggccagcc

SEQ ID NO: 74990 - DNA, 20 bp, Artificial
  CRISPR gRNA sequence
ctcaagccggtggccagcct

SEQ ID NO: 74991 - DNA, 20 bp, Artificial
  CRISPR gRNA sequence
aagccggtggccagcctgga

SEQ ID NO: 74992 - DNA, 20 bp, Artificial
  CRISPR gRNA sequence
gacacgtgctctggccggaa

SEQ ID NO: 74993 - DNA, 20 bp, Artificial
  CRISPR gRNA sequence
tggccggaagctgcactcac

SEQ ID NO: 74994 - DNA, 20 bp, Artificial
  CRISPR gRNA sequence
gccggaagctgcactcactt

SEQ ID NO: 74995 - DNA, 20 bp, Artificial
  CRISPR gRNA sequence
cactcacttagcctgagggc

SEQ ID NO: 74996 - DNA, 20 bp, Artificial
  CRISPR gRNA sequence
acttagcctgagggcagaaa

SEQ ID NO: 74997 - DNA, 20 bp, Artificial
  CRISPR gRNA sequence
agcctgagggcagaaagcca

SEQ ID NO: 74998 - DNA, 20 bp, Artificial
  CRISPR gRNA sequence
gcctgagggcagaaagccag

SEQ ID NO: 74999 - DNA, 20 bp, Artificial
  CRISPR gRNA sequence
agggcagaaagccagggcag

SEQ ID NO: 75000 - DNA, 20 bp, Artificial
  CRISPR gRNA sequence
ggtgaggcctgtgggcactg

SEQ ID NO: 75001 - DNA, 20 bp, Artificial
  CRISPR gRNA sequence
tgggcactgctgctcagctt

SEQ ID NO: 75002 - DNA, 20 bp, Artificial
  CRISPR gRNA sequence
ctgctcagcttcatctcagc

SEQ ID NO: 75003 - DNA, 20 bp, Artificial
  CRISPR gRNA sequence
ctcagcttcatctcagcctc

SEQ ID NO: 75004 - DNA, 20 bp, Artificial
  CRISPR gRNA sequence
agcttcatctcagcctccct

SEQ ID NO: 75005 - DNA, 20 bp, Artificial
  CRISPR gRNA sequence
catctcagcctccctgaggg

SEQ ID NO: 75006 - DNA, 20 bp, Artificial
  CRISPR gRNA sequence
atctcagcctccctgagggc

SEQ ID NO: 75007 - DNA, 20 bp, Artificial
  CRISPR gRNA sequence
agcctccctgagggcctatt

SEQ ID NO: 75008 - DNA, 20 bp, Artificial
  CRISPR gRNA sequence
cctgagggcctattggggga

SEQ ID NO: 75009 - DNA, 20 bp, Artificial
  CRISPR gRNA sequence
agggcctattgggggagcat

SEQ ID NO: 75010 - DNA, 20 bp, Artificial
  CRISPR gRNA sequence
ttgggggagcatcccacctc

SEQ ID NO: 75011 - DNA, 20 bp, Artificial
  CRISPR gRNA sequence
ggggagcatcccacctctga

SEQ ID NO: 75012 - DNA, 20 bp, Artificial
  CRISPR gRNA sequence
tgagggcaaaggcctggagc

SEQ ID NO: 75013 - DNA, 20 bp, Artificial
  CRISPR gRNA sequence
agggcaaaggcctggagcag

SEQ ID NO: 75014 - DNA, 20 bp, Artificial
  CRISPR gRNA sequence
gagcagggcctgagaggcca

SEQ ID NO: 75015 - DNA, 20 bp, Artificial
  CRISPR gRNA sequence
agaggccaaatatgcagctc

SEQ ID NO: 75016 - DNA, 20 bp, Artificial
  CRISPR gRNA sequence
ctgctctgggagcttcctgt

SEQ ID NO: 75017 - DNA, 20 bp, Artificial
  CRISPR gRNA sequence
ctctgggagcttcctgtctc

SEQ ID NO: 75018 - DNA, 20 bp, Artificial
  CRISPR gRNA sequence
tgggagcttcctgtctcttt

SEQ ID NO: 75019 - DNA, 20 bp, Artificial
  CRISPR gRNA sequence
ggagcttcctgtctctttgg

SEQ ID NO: 75020 - DNA, 20 bp, Artificial
  CRISPR gRNA sequence
cctgtctctttggggaggaa

SEQ ID NO: 75021 - DNA, 20 bp, Artificial
  CRISPR gRNA sequence
ctgtctctttggggaggaac

SEQ ID NO: 75022 - DNA, 20 bp, Artificial
  CRISPR gRNA sequence
tctctttggggaggaacctc

SEQ ID NO: 75023 - DNA, 20 bp, Artificial
  CRISPR gRNA sequence
tttggggaggaacctcccac

SEQ ID NO: 75024 - DNA, 20 bp, Artificial
  CRISPR gRNA sequence
tggggaggaacctcccacac

SEQ ID NO: 75025 - DNA, 20 bp, Artificial
  CRISPR gRNA sequence
ggggaggaacctcccacacc

SEQ ID NO: 75026 - DNA, 20 bp, Artificial
  CRISPR gRNA sequence
gggaggaacctcccacaccc

SEQ ID NO: 75027 - DNA, 20 bp, Artificial
  CRISPR gRNA sequence
ccacaccccctgtaagaaag

SEQ ID NO: 75028 - DNA, 20 bp, Artificial
  CRISPR gRNA sequence
taagaaagtattaggagtaa

SEQ ID NO: 75029 - DNA, 20 bp, Artificial
  CRISPR gRNA sequence
ggagtaagttatttagggag

SEQ ID NO: 75030 - DNA, 20 bp, Artificial
  CRISPR gRNA sequence
tttagggaggctgactctag

SEQ ID NO: 75031 - DNA, 20 bp, Artificial
  CRISPR gRNA sequence
agggaggctgactctaggtc

SEQ ID NO: 75032 - DNA, 20 bp, Artificial
  CRISPR gRNA sequence
gggaggctgactctaggtca

SEQ ID NO: 75033 - DNA, 20 bp, Artificial
  CRISPR gRNA sequence
actctaggtcaggcactgtg

SEQ ID NO: 75034 - DNA, 20 bp, Artificial
  CRISPR gRNA sequence
taggtcaggcactgtgccag

SEQ ID NO: 75035 - DNA, 20 bp, Artificial
  CRISPR gRNA sequence
ggtcaggcactgtgccagcc

SEQ ID NO: 75036 - DNA, 20 bp, Artificial
  CRISPR gRNA sequence
tgccagcctctgggtgcatg

SEQ ID NO: 75037 - DNA, 20 bp, Artificial
  CRISPR gRNA sequence
tgggtgcatgggacttcctg

SEQ ID NO: 75038 - DNA, 20 bp, Artificial
  CRISPR gRNA sequence
ggtgcatgggacttcctgcc

SEQ ID NO: 75039 - DNA, 20 bp, Artificial
  CRISPR gRNA sequence
cctgccttacccgcagggtc

SEQ ID NO: 75040 - DNA, 20 bp, Artificial
  CRISPR gRNA sequence
ctgccttacccgcagggtct

SEQ ID NO: 75041 - DNA, 20 bp, Artificial
  CRISPR gRNA sequence
ccttacccgcagggtctcct

SEQ ID NO: 75042 - DNA, 20 bp, Artificial
  CRISPR gRNA sequence
acccgcagggtctcctttaa

SEQ ID NO: 75043 - DNA, 20 bp, Artificial
  CRISPR gRNA sequence
cccgcagggtctcctttaat

SEQ ID NO: 75044 - DNA, 20 bp, Artificial
  CRISPR gRNA sequence
ctttaattctcatagcacca

SEQ ID NO: 75045 - DNA, 20 bp, Artificial
  CRISPR gRNA sequence
taattctcatagcaccaatt

SEQ ID NO: 75046 - DNA, 20 bp, Artificial
  CRISPR gRNA sequence
aattctcatagcaccaatta

SEQ ID NO: 75047 - DNA, 20 bp, Artificial
  CRISPR gRNA sequence
attctcatagcaccaattag

SEQ ID NO: 75048 - DNA, 20 bp, Artificial
  CRISPR gRNA sequence
tcatagcaccaattagaggt

SEQ ID NO: 75049 - DNA, 20 bp, Artificial
  CRISPR gRNA sequence
atagcaccaattagaggtgg

SEQ ID NO: 75050 - DNA, 20 bp, Artificial
  CRISPR gRNA sequence
gaggtggggaaactgactaa

SEQ ID NO: 75051 - DNA, 20 bp, Artificial
  CRISPR gRNA sequence
actaacccaaggacacacag

SEQ ID NO: 75052 - DNA, 20 bp, Artificial
  CRISPR gRNA sequence
acccaaggacacacagcaga

SEQ ID NO: 75053 - DNA, 20 bp, Artificial
  CRISPR gRNA sequence
gtttccatccaggtcagtct

SEQ ID NO: 75054 - DNA, 20 bp, Artificial
  CRISPR gRNA sequence
ccatccaggtcagtctgact

SEQ ID NO: 75055 - DNA, 20 bp, Artificial
  CRISPR gRNA sequence
catccaggtcagtctgactg

SEQ ID NO: 75056 - DNA, 20 bp, Artificial
  CRISPR gRNA sequence
actgcagaccccaagctctt

SEQ ID NO: 75057 - DNA, 20 bp, Artificial
  CRISPR gRNA sequence
cagaccccaagctcttaacc

SEQ ID NO: 75058 - DNA, 20 bp, Artificial
  CRISPR gRNA sequence
ttaaccactgccttactctc

SEQ ID NO: 75059 - DNA, 20 bp, Artificial
  CRISPR gRNA sequence
aaccactgccttactctccc

SEQ ID NO: 75060 - DNA, 20 bp, Artificial
  CRISPR gRNA sequence
accactgccttactctcccg

SEQ ID NO: 75061 - DNA, 20 bp, Artificial
  CRISPR gRNA sequence
ccttactctcccggaccagc

SEQ ID NO: 75062 - DNA, 20 bp, Artificial
  CRISPR gRNA sequence
actctcccggaccagcactg

SEQ ID NO: 75063 - DNA, 20 bp, Artificial
  CRISPR gRNA sequence
ctctcccggaccagcactgg

SEQ ID NO: 75064 - DNA, 20 bp, Artificial
  CRISPR gRNA sequence
tcccggaccagcactggctg

SEQ ID NO: 75065 - DNA, 20 bp, Artificial
  CRISPR gRNA sequence
ccggaccagcactggctgag

SEQ ID NO: 75066 - DNA, 20 bp, Artificial
  CRISPR gRNA sequence
gctgagctccctggggaggg

SEQ ID NO: 75067 - DNA, 20 bp, Artificial
  CRISPR gRNA sequence
agctccctggggagggaggt

SEQ ID NO: 75068 - DNA, 20 bp, Artificial
  CRISPR gRNA sequence
cctggggagggaggtgtgcc

SEQ ID NO: 75069 - DNA, 20 bp, Artificial
  CRISPR gRNA sequence
gggagggaggtgtgcctggg

SEQ ID NO: 75070 - DNA, 20 bp, Artificial
  CRISPR gRNA sequence
ggattctccgtggggctctg

SEQ ID NO: 75071 - DNA, 20 bp, Artificial
  CRISPR gRNA sequence
tccgtggggctctgctgtcc

SEQ ID NO: 75072 - DNA, 20 bp, Artificial
  CRISPR gRNA sequence
cgtggggctctgctgtccag

SEQ ID NO: 75073 - DNA, 20 bp, Artificial
  CRISPR gRNA sequence
tgctgtccaggcatctcagc

SEQ ID NO: 75074 - DNA, 20 bp, Artificial
  CRISPR gRNA sequence
ctgtccaggcatctcagccc

SEQ ID NO: 75075 - DNA, 20 bp, Artificial
  CRISPR gRNA sequence
tccaggcatctcagccctgg

SEQ ID NO: 75076 - DNA, 20 bp, Artificial
  CRISPR gRNA sequence
agccctgggtggccagcaga

SEQ ID NO: 75077 - DNA, 20 bp, Artificial
  CRISPR gRNA sequence
ggtggccagcagacgggccc

SEQ ID NO: 75078 - DNA, 20 bp, Artificial
  CRISPR gRNA sequence
ggggcagttcactctgatga

SEQ ID NO: 75079 - DNA, 20 bp, Artificial
  CRISPR gRNA sequence
actctgatgaggcagggctg

SEQ ID NO: 75080 - DNA, 20 bp, Artificial
  CRISPR gRNA sequence
tgatgaggcagggctgctgg

SEQ ID NO: 75081 - DNA, 20 bp, Artificial
  CRISPR gRNA sequence
atgaggcagggctgctggga

SEQ ID NO: 75082 - DNA, 20 bp, Artificial
  CRISPR gRNA sequence
ctgggatacttccaggaggg

SEQ ID NO: 75083 - DNA, 20 bp, Artificial
  CRISPR gRNA sequence
ggatacttccaggaggggct

SEQ ID NO: 75084 - DNA, 20 bp, Artificial
  CRISPR gRNA sequence
ccaggaggggctgatgtttg

SEQ ID NO: 75085 - DNA, 20 bp, Artificial
  CRISPR gRNA sequence
caggaggggctgatgtttga

SEQ ID NO: 75086 - DNA, 20 bp, Artificial
  CRISPR gRNA sequence
atgtttgagctgggtgttaa

SEQ ID NO: 75087 - DNA, 20 bp, Artificial
  CRISPR gRNA sequence
gagctgggtgttaaaggatt

SEQ ID NO: 75088 - DNA, 20 bp, Artificial
  CRISPR gRNA sequence
agctgggtgttaaaggattg

SEQ ID NO: 75089 - DNA, 20 bp, Artificial
  CRISPR gRNA sequence
ggtgttaaaggattgggaga

SEQ ID NO: 75090 - DNA, 20 bp, Artificial
  CRISPR gRNA sequence
aaggattgggagaattttat

SEQ ID NO: 75091 - DNA, 20 bp, Artificial
  CRISPR gRNA sequence
ggagaattttatctcagaaa

SEQ ID NO: 75092 - DNA, 20 bp, Artificial
  CRISPR gRNA sequence
tatctcagaaaaggcaagga

SEQ ID NO: 75093 - DNA, 20 bp, Artificial
  CRISPR gRNA sequence
atctcagaaaaggcaaggaa

SEQ ID NO: 75094 - DNA, 20 bp, Artificial
  CRISPR gRNA sequence
tctcagaaaaggcaaggaag

SEQ ID NO: 75095 - DNA, 20 bp, Artificial
  CRISPR gRNA sequence
agaaaaggcaaggaagagaa

SEQ ID NO: 75096 - DNA, 20 bp, Artificial
  CRISPR gRNA sequence
agctgagtgcggtgtgagca

SEQ ID NO: 75097 - DNA, 20 bp, Artificial
  CRISPR gRNA sequence
agtgcggtgtgagcagaggc

SEQ ID NO: 75098 - DNA, 20 bp, Artificial
  CRISPR gRNA sequence
caggcagggcttgatctagg

SEQ ID NO: 75099 - DNA, 20 bp, Artificial
  CRISPR gRNA sequence
aggcagggcttgatctagga

SEQ ID NO: 75100 - DNA, 20 bp, Artificial
  CRISPR gRNA sequence
gatctaggagcaaatagtga

SEQ ID NO: 75101 - DNA, 20 bp, Artificial
  CRISPR gRNA sequence
atctaggagcaaatagtgaa

SEQ ID NO: 75102 - DNA, 20 bp, Artificial
  CRISPR gRNA sequence
ggagcaaatagtgaaggtta

SEQ ID NO: 75103 - DNA, 20 bp, Artificial
  CRISPR gRNA sequence
tggctgaactgtgtgtgtgt

SEQ ID NO: 75104 - DNA, 20 bp, Artificial
  CRISPR gRNA sequence
aactgtgtgtgtgtgtgtgt

SEQ ID NO: 75105 - DNA, 20 bp, Artificial
  CRISPR gRNA sequence
tgtgtgtgtgtgtgtgttgt

SEQ ID NO: 75106 - DNA, 20 bp, Artificial
  CRISPR gRNA sequence
tgtatgtggtatttgtaggt

SEQ ID NO: 75107 - DNA, 20 bp, Artificial
  CRISPR gRNA sequence
gtaggtattatgtggtgtgt

SEQ ID NO: 75108 - DNA, 20 bp, Artificial
  CRISPR gRNA sequence
taggtattatgtggtgtgtg

SEQ ID NO: 75109 - DNA, 20 bp, Artificial
  CRISPR gRNA sequence
tgtggtgtgtgtgctgtatt

SEQ ID NO: 75110 - DNA, 20 bp, Artificial
  CRISPR gRNA sequence
tatttgtaatgtgccaggta

SEQ ID NO: 75111 - DNA, 20 bp, Artificial
  CRISPR gRNA sequence
gtaatgtgccaggtatgtat

SEQ ID NO: 75112 - DNA, 20 bp, Artificial
  CRISPR gRNA sequence
taatgtgccaggtatgtatg

SEQ ID NO: 75113 - DNA, 20 bp, Artificial
  CRISPR gRNA sequence
gtttttgtggggtgtgtgta

SEQ ID NO: 75114 - DNA, 20 bp, Artificial
  CRISPR gRNA sequence
tttttgtggggtgtgtgtat

SEQ ID NO: 75115 - DNA, 20 bp, Artificial
  CRISPR gRNA sequence
ttgtggggtgtgtgtattgt

SEQ ID NO: 75116 - DNA, 20 bp, Artificial
  CRISPR gRNA sequence
tgtggggtgtgtgtattgtg

SEQ ID NO: 75117 - DNA, 20 bp, Artificial
  CRISPR gRNA sequence
gtggggtgtgtgtattgtgt

SEQ ID NO: 75118 - DNA, 20 bp, Artificial
  CRISPR gRNA sequence
tggggtgtgtgtattgtgtg

SEQ ID NO: 75119 - DNA, 20 bp, Artificial
  CRISPR gRNA sequence
tgtggtgtgtgtggtgtatg

SEQ ID NO: 75120 - DNA, 20 bp, Artificial
  CRISPR gRNA sequence
gtgtgttgtgtgtgctgtgt

SEQ ID NO: 75121 - DNA, 20 bp, Artificial
  CRISPR gRNA sequence
tgtgttgtgtgtgctgtgtg

SEQ ID NO: 75122 - DNA, 20 bp, Artificial
  CRISPR gRNA sequence
tgtgtgctgtgtggtgtgcg

SEQ ID NO: 75123 - DNA, 20 bp, Artificial
  CRISPR gRNA sequence
tgtggtgtgcgtgtgttgtg

SEQ ID NO: 75124 - DNA, 20 bp, Artificial
  CRISPR gRNA sequence
tgtgtgctgcgtgctgtgtg

SEQ ID NO: 75125 - DNA, 20 bp, Artificial
  CRISPR gRNA sequence
cgtgctgtgtggtgtgtttg

SEQ ID NO: 75126 - DNA, 20 bp, Artificial
  CRISPR gRNA sequence
tgtggtgtgtttgggtgtgc

SEQ ID NO: 75127 - DNA, 20 bp, Artificial
  CRISPR gRNA sequence
gggtgtgcttggtgtatctg

SEQ ID NO: 75128 - DNA, 20 bp, Artificial
  CRISPR gRNA sequence
ggtgtgcttggtgtatctgt

SEQ ID NO: 75129 - DNA, 20 bp, Artificial
  CRISPR gRNA sequence
ggtgtatctgtggtatatgg

SEQ ID NO: 75130 - DNA, 20 bp, Artificial
  CRISPR gRNA sequence
gtgtatctgtggtatatggg

SEQ ID NO: 75131 - DNA, 20 bp, Artificial
  CRISPR gRNA sequence
tggtatatgggttggtgtgt

SEQ ID NO: 75132 - DNA, 20 bp, Artificial
  CRISPR gRNA sequence
gtgtgtagggcgtgtgtgtg

SEQ ID NO: 75133 - DNA, 20 bp, Artificial
  CRISPR gRNA sequence
gatcagactgtgagggagaa

SEQ ID NO: 75134 - DNA, 20 bp, Artificial
  CRISPR gRNA sequence
tgagggagaagatgctaggg

SEQ ID NO: 75135 - DNA, 20 bp, Artificial
  CRISPR gRNA sequence
gggactttgaacttcaccct

SEQ ID NO: 75136 - DNA, 20 bp, Artificial
  CRISPR gRNA sequence
tgaacttcaccctggggtta

SEQ ID NO: 75137 - DNA, 20 bp, Artificial
  CRISPR gRNA sequence
gaacttcaccctggggttaa

SEQ ID NO: 75138 - DNA, 20 bp, Artificial
  CRISPR gRNA sequence
aacttcaccctggggttaat

SEQ ID NO: 75139 - DNA, 20 bp, Artificial
  CRISPR gRNA sequence
caccctggggttaatgggga

SEQ ID NO: 75140 - DNA, 20 bp, Artificial
  CRISPR gRNA sequence
accctggggttaatggggag

SEQ ID NO: 75141 - DNA, 20 bp, Artificial
  CRISPR gRNA sequence
gggttaatggggagccactg

SEQ ID NO: 75142 - DNA, 20 bp, Artificial
  CRISPR gRNA sequence
atggggagccactgaggggc

SEQ ID NO: 75143 - DNA, 20 bp, Artificial
  CRISPR gRNA sequence
aggggcacagagtagcagag

SEQ ID NO: 75144 - DNA, 20 bp, Artificial
  CRISPR gRNA sequence
tcagatgtgtgttgtgaaga

SEQ ID NO: 75145 - DNA, 20 bp, Artificial
  CRISPR gRNA sequence
tgaagatccctctgggggct

SEQ ID NO: 75146 - DNA, 20 bp, Artificial
  CRISPR gRNA sequence
tgggggctgtggagtgaatg

SEQ ID NO: 75147 - DNA, 20 bp, Artificial
  CRISPR gRNA sequence
ggggctgtggagtgaatgga

SEQ ID NO: 75148 - DNA, 20 bp, Artificial
  CRISPR gRNA sequence
tggagtgaatggaggggagg

SEQ ID NO: 75149 - DNA, 20 bp, Artificial
  CRISPR gRNA sequence
ataagatgcagggatcagtt

SEQ ID NO: 75150 - DNA, 20 bp, Artificial
  CRISPR gRNA sequence
ggaggccctgttcacagctg

SEQ ID NO: 75151 - DNA, 20 bp, Artificial
  CRISPR gRNA sequence
gaggccctgttcacagctga

SEQ ID NO: 75152 - DNA, 20 bp, Artificial
  CRISPR gRNA sequence
ttcacagctgaagtaagaca

SEQ ID NO: 75153 - DNA, 20 bp, Artificial
  CRISPR gRNA sequence
acagctgaagtaagacatgt

SEQ ID NO: 75154 - DNA, 20 bp, Artificial
  CRISPR gRNA sequence
aagtaagacatgtaaaggaa

SEQ ID NO: 75155 - DNA, 20 bp, Artificial
  CRISPR gRNA sequence
gccgtggcagtgagtcaggg

SEQ ID NO: 75156 - DNA, 20 bp, Artificial
  CRISPR gRNA sequence
ccaggggtaatgataatgat

SEQ ID NO: 75157 - DNA, 20 bp, Artificial
  CRISPR gRNA sequence
caataactgctgacagcact

SEQ ID NO: 75158 - DNA, 20 bp, Artificial
  CRISPR gRNA sequence
ctgacagcactcccatgagc

SEQ ID NO: 75159 - DNA, 20 bp, Artificial
  CRISPR gRNA sequence
acagcactcccatgagccag

SEQ ID NO: 75160 - DNA, 20 bp, Artificial
  CRISPR gRNA sequence
ccatgagccagaccttttcc

SEQ ID NO: 75161 - DNA, 20 bp, Artificial
  CRISPR gRNA sequence
ttcctggcactttatactta

SEQ ID NO: 75162 - DNA, 20 bp, Artificial
  CRISPR gRNA sequence
tcctggcactttatacttat

SEQ ID NO: 75163 - DNA, 20 bp, Artificial
  CRISPR gRNA sequence
cctggcactttatacttatt

SEQ ID NO: 75164 - DNA, 20 bp, Artificial
  CRISPR gRNA sequence
ctggcactttatacttatta

SEQ ID NO: 75165 - DNA, 20 bp, Artificial
  CRISPR gRNA sequence
gcactttatacttattaact

SEQ ID NO: 75166 - DNA, 20 bp, Artificial
  CRISPR gRNA sequence
tatacttattaactcattta

SEQ ID NO: 75167 - DNA, 20 bp, Artificial
  CRISPR gRNA sequence
atacttattaactcatttaa

SEQ ID NO: 75168 - DNA, 20 bp, Artificial
  CRISPR gRNA sequence
tacttattaactcatttaat

SEQ ID NO: 75169 - DNA, 20 bp, Artificial
  CRISPR gRNA sequence
attaactcatttaatcctca

SEQ ID NO: 75170 - DNA, 20 bp, Artificial
  CRISPR gRNA sequence
ttaactcatttaatcctcac

SEQ ID NO: 75171 - DNA, 20 bp, Artificial
  CRISPR gRNA sequence
actcatttaatcctcacaat

SEQ ID NO: 75172 - DNA, 20 bp, Artificial
  CRISPR gRNA sequence
atttaatcctcacaataacc

SEQ ID NO: 75173 - DNA, 20 bp, Artificial
  CRISPR gRNA sequence
aatcctcacaataaccctaa

SEQ ID NO: 75174 - DNA, 20 bp, Artificial
  CRISPR gRNA sequence
atcctcacaataaccctaag

SEQ ID NO: 75175 - DNA, 20 bp, Artificial
  CRISPR gRNA sequence
acaataaccctaaggggtag

SEQ ID NO: 75176 - DNA, 20 bp, Artificial
  CRISPR gRNA sequence
aggggtaggttgtgttatta

SEQ ID NO: 75177 - DNA, 20 bp, Artificial
  CRISPR gRNA sequence
tgttattatccccattttac

SEQ ID NO: 75178 - DNA, 20 bp, Artificial
  CRISPR gRNA sequence
ttatccccattttacttgtc

SEQ ID NO: 75179 - DNA, 20 bp, Artificial
  CRISPR gRNA sequence
tccccattttacttgtccag

SEQ ID NO: 75180 - DNA, 20 bp, Artificial
  CRISPR gRNA sequence
tacttgtccagggccacata

SEQ ID NO: 75181 - DNA, 20 bp, Artificial
  CRISPR gRNA sequence
acttgtccagggccacatag

SEQ ID NO: 75182 - DNA, 20 bp, Artificial
  CRISPR gRNA sequence
cttgtccagggccacatagc

SEQ ID NO: 75183 - DNA, 20 bp, Artificial
  CRISPR gRNA sequence
gtccagggccacatagctgg

SEQ ID NO: 75184 - DNA, 20 bp, Artificial
  CRISPR gRNA sequence
tccagggccacatagctggt

SEQ ID NO: 75185 - DNA, 20 bp, Artificial
  CRISPR gRNA sequence
gtaagtggcagatcagggat

SEQ ID NO: 75186 - DNA, 20 bp, Artificial
  CRISPR gRNA sequence
attttcagttggcttcaaaa

SEQ ID NO: 75187 - DNA, 20 bp, Artificial
  CRISPR gRNA sequence
ttttcagttggcttcaaaat

SEQ ID NO: 75188 - DNA, 20 bp, Artificial
  CRISPR gRNA sequence
tcagttggcttcaaaatctt

SEQ ID NO: 75189 - DNA, 20 bp, Artificial
  CRISPR gRNA sequence
cagttggcttcaaaatcttt

SEQ ID NO: 75190 - DNA, 20 bp, Artificial
  CRISPR gRNA sequence
agttggcttcaaaatcttta

SEQ ID NO: 75191 - DNA, 20 bp, Artificial
  CRISPR gRNA sequence
gcttcaaaatctttaaccgt

SEQ ID NO: 75192 - DNA, 20 bp, Artificial
  CRISPR gRNA sequence
caaaatctttaaccgtgaca

SEQ ID NO: 75193 - DNA, 20 bp, Artificial
  CRISPR gRNA sequence
aaaatctttaaccgtgacac

SEQ ID NO: 75194 - DNA, 20 bp, Artificial
  CRISPR gRNA sequence
taaccgtgacactcagaagc

SEQ ID NO: 75195 - DNA, 20 bp, Artificial
  CRISPR gRNA sequence
aaccgtgacactcagaagcc

SEQ ID NO: 75196 - DNA, 20 bp, Artificial
  CRISPR gRNA sequence
accgtgacactcagaagcct

SEQ ID NO: 75197 - DNA, 20 bp, Artificial
  CRISPR gRNA sequence
agaagcctcaaggcctgtag

SEQ ID NO: 75198 - DNA, 20 bp, Artificial
  CRISPR gRNA sequence
aaggcctgtagtcaggacat

SEQ ID NO: 75199 - DNA, 20 bp, Artificial
  CRISPR gRNA sequence
tagtcaggacatggcaagga

SEQ ID NO: 75200 - DNA, 20 bp, Artificial
  CRISPR gRNA sequence
ggctgagttgggcttaggat

SEQ ID NO: 75201 - DNA, 20 bp, Artificial
  CRISPR gRNA sequence
agttgggcttaggatggtgg

SEQ ID NO: 75202 - DNA, 20 bp, Artificial
  CRISPR gRNA sequence
ggcttaggatggtgggctaa

SEQ ID NO: 75203 - DNA, 20 bp, Artificial
  CRISPR gRNA sequence
aggatggtgggctaagaggc

SEQ ID NO: 75204 - DNA, 20 bp, Artificial
  CRISPR gRNA sequence
ggatggtgggctaagaggca

SEQ ID NO: 75205 - DNA, 20 bp, Artificial
  CRISPR gRNA sequence
agaggcacaagttcaatgcc

SEQ ID NO: 75206 - DNA, 20 bp, Artificial
  CRISPR gRNA sequence
aatgccaaggccctggctga

SEQ ID NO: 75207 - DNA, 20 bp, Artificial
  CRISPR gRNA sequence
gctgagactggagttaccag

SEQ ID NO: 75208 - DNA, 20 bp, Artificial
  CRISPR gRNA sequence
agactggagttaccagggca

SEQ ID NO: 75209 - DNA, 20 bp, Artificial
  CRISPR gRNA sequence
gagttaccagggcatcgggg

SEQ ID NO: 75210 - DNA, 20 bp, Artificial
  CRISPR gRNA sequence
ccagggcatcgggggcagat

SEQ ID NO: 75211 - DNA, 20 bp, Artificial
  CRISPR gRNA sequence
gaggaacagacccaggcagt

SEQ ID NO: 75212 - DNA, 20 bp, Artificial
  CRISPR gRNA sequence
gaagctgctctctaaaggag

SEQ ID NO: 75213 - DNA, 20 bp, Artificial
  CRISPR gRNA sequence
aagctgctctctaaaggagg

SEQ ID NO: 75214 - DNA, 20 bp, Artificial
  CRISPR gRNA sequence
ctctctaaaggaggagaggg

SEQ ID NO: 75215 - DNA, 20 bp, Artificial
  CRISPR gRNA sequence
tctaaaggaggagagggccc

SEQ ID NO: 75216 - DNA, 20 bp, Artificial
  CRISPR gRNA sequence
taaaggaggagagggcccag

SEQ ID NO: 75217 - DNA, 20 bp, Artificial
  CRISPR gRNA sequence
aaggaggagagggcccaggg

SEQ ID NO: 75218 - DNA, 20 bp, Artificial
  CRISPR gRNA sequence
ctctcccctctctgtcccct

SEQ ID NO: 75219 - DNA, 20 bp, Artificial
  CRISPR gRNA sequence
tcccctctctgtcccctgtc

SEQ ID NO: 75220 - DNA, 20 bp, Artificial
  CRISPR gRNA sequence
ccctctctgtcccctgtccc

SEQ ID NO: 75221 - DNA, 20 bp, Artificial
  CRISPR gRNA sequence
tctgtcccctgtcccatcac

SEQ ID NO: 75222 - DNA, 20 bp, Artificial
  CRISPR gRNA sequence
tgtcccctgtcccatcaccc

SEQ ID NO: 75223 - DNA, 20 bp, Artificial
  CRISPR gRNA sequence
tcccctgtcccatcaccctg

SEQ ID NO: 75224 - DNA, 20 bp, Artificial
  CRISPR gRNA sequence
tcccatcaccctgcagggat

SEQ ID NO: 75225 - DNA, 20 bp, Artificial
  CRISPR gRNA sequence
cagggattacctgagtgtct

SEQ ID NO: 75226 - DNA, 20 bp, Artificial
  CRISPR gRNA sequence
cctgagtgtcttcccagcct

SEQ ID NO: 75227 - DNA, 20 bp, Artificial
  CRISPR gRNA sequence
agtgtcttcccagcctggtc

SEQ ID NO: 75228 - DNA, 20 bp, Artificial
  CRISPR gRNA sequence
cccagcctggtcctctctgg

SEQ ID NO: 75229 - DNA, 20 bp, Artificial
  CRISPR gRNA sequence
ccagcctggtcctctctgga

SEQ ID NO: 75230 - DNA, 20 bp, Artificial
  CRISPR gRNA sequence
gtcctctctggagaagtgaa

SEQ ID NO: 75231 - DNA, 20 bp, Artificial
  CRISPR gRNA sequence
tctggagaagtgaatccgga

SEQ ID NO: 75232 - DNA, 20 bp, Artificial
  CRISPR gRNA sequence
tggagaagtgaatccggaag

SEQ ID NO: 75233 - DNA, 20 bp, Artificial
  CRISPR gRNA sequence
gagaagtgaatccggaagct

SEQ ID NO: 75234 - DNA, 20 bp, Artificial
  CRISPR gRNA sequence
tgctcagagcccaggctgca

SEQ ID NO: 75235 - DNA, 20 bp, Artificial
  CRISPR gRNA sequence
ctcagagcccaggctgcaga

SEQ ID NO: 75236 - DNA, 20 bp, Artificial
  CRISPR gRNA sequence
agagcccaggctgcagagag

SEQ ID NO: 75237 - DNA, 20 bp, Artificial
  CRISPR gRNA sequence
cagagagaagggcctgggga

SEQ ID NO: 75238 - DNA, 20 bp, Artificial
  CRISPR gRNA sequence
gggaagcacggtgcccagac

SEQ ID NO: 75239 - DNA, 20 bp, Artificial
  CRISPR gRNA sequence
cctaggcacctagggcaccc

SEQ ID NO: 75240 - DNA, 20 bp, Artificial
  CRISPR gRNA sequence
ctaggcacctagggcaccca

SEQ ID NO: 75241 - DNA, 20 bp, Artificial
  CRISPR gRNA sequence
ggcacctagggcacccacag

SEQ ID NO: 75242 - DNA, 20 bp, Artificial
  CRISPR gRNA sequence
gggcacccacagggcacaga

SEQ ID NO: 75243 - DNA, 20 bp, Artificial
  CRISPR gRNA sequence
cacccacaaggacaagggag

SEQ ID NO: 75244 - DNA, 20 bp, Artificial
  CRISPR gRNA sequence
agaaccagaggagaccccca

SEQ ID NO: 75245 - DNA, 20 bp, Artificial
  CRISPR gRNA sequence
attctgtgagcatggcaata

SEQ ID NO: 75246 - DNA, 20 bp, Artificial
  CRISPR gRNA sequence
tgtgagcatggcaatacctg

SEQ ID NO: 75247 - DNA, 20 bp, Artificial
  CRISPR gRNA sequence
tgagcatggcaatacctggc

SEQ ID NO: 75248 - DNA, 20 bp, Artificial
  CRISPR gRNA sequence
gccttcccaccccatggcct

SEQ ID NO: 75249 - DNA, 20 bp, Artificial
  CRISPR gRNA sequence
cccaccccatggcctccatg

SEQ ID NO: 75250 - DNA, 20 bp, Artificial
  CRISPR gRNA sequence
ccaccccatggcctccatgg

SEQ ID NO: 75251 - DNA, 20 bp, Artificial
  CRISPR gRNA sequence
catggtccccatggcacccg

SEQ ID NO: 75252 - DNA, 20 bp, Artificial
  CRISPR gRNA sequence
tgatcccatgcccaggaaac

SEQ ID NO: 75253 - DNA, 20 bp, Artificial
  CRISPR gRNA sequence
agattcagagaaaggcagag

SEQ ID NO: 75254 - DNA, 20 bp, Artificial
  CRISPR gRNA sequence
agagaaaggcagaggttgct

SEQ ID NO: 75255 - DNA, 20 bp, Artificial
  CRISPR gRNA sequence
ctccaagccacccagatgga

SEQ ID NO: 75256 - DNA, 20 bp, Artificial
  CRISPR gRNA sequence
caagccacccagatggaagg

SEQ ID NO: 75257 - DNA, 20 bp, Artificial
  CRISPR gRNA sequence
gcttctcccatcatcagcca

SEQ ID NO: 75258 - DNA, 20 bp, Artificial
  CRISPR gRNA sequence
cttctcccatcatcagccag

SEQ ID NO: 75259 - DNA, 20 bp, Artificial
  CRISPR gRNA sequence
ctcccatcatcagccagggg

SEQ ID NO: 75260 - DNA, 20 bp, Artificial
  CRISPR gRNA sequence
tcccatcatcagccaggggc

SEQ ID NO: 75261 - DNA, 20 bp, Artificial
  CRISPR gRNA sequence
ccatcatcagccaggggcac

SEQ ID NO: 75262 - DNA, 20 bp, Artificial
  CRISPR gRNA sequence
ttggccagcagaaaggggct

SEQ ID NO: 75263 - DNA, 20 bp, Artificial
  CRISPR gRNA sequence
gccagcagaaaggggctttt

SEQ ID NO: 75264 - DNA, 20 bp, Artificial
  CRISPR gRNA sequence
ttcggggaccaacatcccct

SEQ ID NO: 75265 - DNA, 20 bp, Artificial
  CRISPR gRNA sequence
tcggggaccaacatcccctt

SEQ ID NO: 75266 - DNA, 20 bp, Artificial
  CRISPR gRNA sequence
cggggaccaacatcccctta

SEQ ID NO: 75267 - DNA, 20 bp, Artificial
  CRISPR gRNA sequence
ggggaccaacatccccttac

SEQ ID NO: 75268 - DNA, 20 bp, Artificial
  CRISPR gRNA sequence
acttcactgaggcctcccgg

SEQ ID NO: 75269 - DNA, 20 bp, Artificial
  CRISPR gRNA sequence
cttcactgaggcctcccgga

SEQ ID NO: 75270 - DNA, 20 bp, Artificial
  CRISPR gRNA sequence
cactgaggcctcccggacac

SEQ ID NO: 75271 - DNA, 20 bp, Artificial
  CRISPR gRNA sequence
actgaggcctcccggacacg

SEQ ID NO: 75272 - DNA, 20 bp, Artificial
  CRISPR gRNA sequence
aggcctcccggacacgtggg

SEQ ID NO: 75273 - DNA, 20 bp, Artificial
  CRISPR gRNA sequence
ccggacacgtgggcaggagg

SEQ ID NO: 75274 - DNA, 20 bp, Artificial
  CRISPR gRNA sequence
cagcaggtacagggcacttt

SEQ ID NO: 75275 - DNA, 20 bp, Artificial
  CRISPR gRNA sequence
tcctgagaaatgctgttgtg

SEQ ID NO: 75276 - DNA, 20 bp, Artificial
  CRISPR gRNA sequence
cctgagaaatgctgttgtga

SEQ ID NO: 75277 - DNA, 20 bp, Artificial
  CRISPR gRNA sequence
ctgagaaatgctgttgtgac

SEQ ID NO: 75278 - DNA, 20 bp, Artificial
  CRISPR gRNA sequence
agaaatgctgttgtgactca

SEQ ID NO: 75279 - DNA, 20 bp, Artificial
  CRISPR gRNA sequence
ttgtgactcagactagaagg

SEQ ID NO: 75280 - DNA, 20 bp, Artificial
  CRISPR gRNA sequence
tgactcagactagaagggaa

SEQ ID NO: 75281 - DNA, 20 bp, Artificial
  CRISPR gRNA sequence
agactagaagggaaatggag

SEQ ID NO: 75282 - DNA, 20 bp, Artificial
  CRISPR gRNA sequence
gaagggaaatggagatgaga

SEQ ID NO: 75283 - DNA, 20 bp, Artificial
  CRISPR gRNA sequence
cttggagccctgcccagccc

SEQ ID NO: 75284 - DNA, 20 bp, Artificial
  CRISPR gRNA sequence
ggagccctgcccagccccct

SEQ ID NO: 75285 - DNA, 20 bp, Artificial
  CRISPR gRNA sequence
gagccctgcccagccccctc

SEQ ID NO: 75286 - DNA, 20 bp, Artificial
  CRISPR gRNA sequence
cccagccccctccatctccc

SEQ ID NO: 75287 - DNA, 20 bp, Artificial
  CRISPR gRNA sequence
catctcccttccagctgtca

SEQ ID NO: 75288 - DNA, 20 bp, Artificial
  CRISPR gRNA sequence
ccttccagctgtcatttcca

SEQ ID NO: 75289 - DNA, 20 bp, Artificial
  CRISPR gRNA sequence
ccagctgtcatttccaagaa

SEQ ID NO: 75290 - DNA, 20 bp, Artificial
  CRISPR gRNA sequence
cagctgtcatttccaagaag

SEQ ID NO: 75291 - DNA, 20 bp, Artificial
  CRISPR gRNA sequence
tcatttccaagaagagaagc

SEQ ID NO: 75292 - DNA, 20 bp, Artificial
  CRISPR gRNA sequence
ccaagaagagaagcctccat

SEQ ID NO: 75293 - DNA, 20 bp, Artificial
  CRISPR gRNA sequence
caagaagagaagcctccatg

SEQ ID NO: 75294 - DNA, 20 bp, Artificial
  CRISPR gRNA sequence
catgtctaagcatctattct

SEQ ID NO: 75295 - DNA, 20 bp, Artificial
  CRISPR gRNA sequence
agcatctattctccagatgg

SEQ ID NO: 75296 - DNA, 20 bp, Artificial
  CRISPR gRNA sequence
ttctccagatggacacactg

SEQ ID NO: 75297 - DNA, 20 bp, Artificial
  CRISPR gRNA sequence
tccagatggacacactgagg

SEQ ID NO: 75298 - DNA, 20 bp, Artificial
  CRISPR gRNA sequence
cagatggacacactgaggcc

SEQ ID NO: 75299 - DNA, 20 bp, Artificial
  CRISPR gRNA sequence
aggcccagaaggataccatc

SEQ ID NO: 75300 - DNA, 20 bp, Artificial
  CRISPR gRNA sequence
gcaccagaccctgagtcctt

SEQ ID NO: 75301 - DNA, 20 bp, Artificial
  CRISPR gRNA sequence
agtccttgagcgctgcactc

SEQ ID NO: 75302 - DNA, 20 bp, Artificial
  CRISPR gRNA sequence
gagcgctgcactcaccctgc

SEQ ID NO: 75303 - DNA, 20 bp, Artificial
  CRISPR gRNA sequence
agcgctgcactcaccctgcc

SEQ ID NO: 75304 - DNA, 20 bp, Artificial
  CRISPR gRNA sequence
cactcaccctgcccgctgcc

SEQ ID NO: 75305 - DNA, 20 bp, Artificial
  CRISPR gRNA sequence
accctgcccgctgcccctgt

SEQ ID NO: 75306 - DNA, 20 bp, Artificial
  CRISPR gRNA sequence
cccgctgcccctgtggtctg

SEQ ID NO: 75307 - DNA, 20 bp, Artificial
  CRISPR gRNA sequence
cccctgtggtctggggtctg

SEQ ID NO: 75308 - DNA, 20 bp, Artificial
  CRISPR gRNA sequence
tggtctggggtctgggcact

SEQ ID NO: 75309 - DNA, 20 bp, Artificial
  CRISPR gRNA sequence
gggtctgggcactggcaagg

SEQ ID NO: 75310 - DNA, 20 bp, Artificial
  CRISPR gRNA sequence
ggcactggcaaggccaggct

SEQ ID NO: 75311 - DNA, 20 bp, Artificial
  CRISPR gRNA sequence
gcaaggccaggctggcagct

SEQ ID NO: 75312 - DNA, 20 bp, Artificial
  CRISPR gRNA sequence
gcagctctagccccgcatgg

SEQ ID NO: 75313 - DNA, 20 bp, Artificial
  CRISPR gRNA sequence
tagccccgcatgggtcaagg

SEQ ID NO: 75314 - DNA, 20 bp, Artificial
  CRISPR gRNA sequence
gccccgcatgggtcaaggac

SEQ ID NO: 75315 - DNA, 20 bp, Artificial
  CRISPR gRNA sequence
ccgagcacgaagctcagttg

SEQ ID NO: 75316 - DNA, 20 bp, Artificial
  CRISPR gRNA sequence
agttgcctagcaacaagtgg

SEQ ID NO: 75317 - DNA, 20 bp, Artificial
  CRISPR gRNA sequence
cctagcaacaagtggtgtcc

SEQ ID NO: 75318 - DNA, 20 bp, Artificial
  CRISPR gRNA sequence
gcaacaagtggtgtcctgga

SEQ ID NO: 75319 - DNA, 20 bp, Artificial
  CRISPR gRNA sequence
gagctggctgtcactccagc

SEQ ID NO: 75320 - DNA, 20 bp, Artificial
  CRISPR gRNA sequence
gctgtcactccagcaggtca

SEQ ID NO: 75321 - DNA, 20 bp, Artificial
  CRISPR gRNA sequence
tcactccagcaggtcacggg

SEQ ID NO: 75322 - DNA, 20 bp, Artificial
  CRISPR gRNA sequence
cagcaggtcacgggagagat

SEQ ID NO: 75323 - DNA, 20 bp, Artificial
  CRISPR gRNA sequence
cctaaggccccttgcctgcc

SEQ ID NO: 75324 - DNA, 20 bp, Artificial
  CRISPR gRNA sequence
ctaaggccccttgcctgcca

SEQ ID NO: 75325 - DNA, 20 bp, Artificial
  CRISPR gRNA sequence
aggccccttgcctgccacag

SEQ ID NO: 75326 - DNA, 20 bp, Artificial
  CRISPR gRNA sequence
gcctgccacagggacatctc

SEQ ID NO: 75327 - DNA, 20 bp, Artificial
  CRISPR gRNA sequence
cctgccacagggacatctcc

SEQ ID NO: 75328 - DNA, 20 bp, Artificial
  CRISPR gRNA sequence
ccacagggacatctccacat

SEQ ID NO: 75329 - DNA, 20 bp, Artificial
  CRISPR gRNA sequence
cacatttatgttccacagat

SEQ ID NO: 75330 - DNA, 20 bp, Artificial
  CRISPR gRNA sequence
atgttccacagattgggtca

SEQ ID NO: 75331 - DNA, 20 bp, Artificial
  CRISPR gRNA sequence
tgttccacagattgggtcag

SEQ ID NO: 75332 - DNA, 20 bp, Artificial
  CRISPR gRNA sequence
cacagattgggtcagaagaa

SEQ ID NO: 75333 - DNA, 20 bp, Artificial
  CRISPR gRNA sequence
ggtcagaagaatttcaggga

SEQ ID NO: 75334 - DNA, 20 bp, Artificial
  CRISPR gRNA sequence
cagggacgggatggaccagg

SEQ ID NO: 75335 - DNA, 20 bp, Artificial
  CRISPR gRNA sequence
agggacgggatggaccagga

SEQ ID NO: 75336 - DNA, 20 bp, Artificial
  CRISPR gRNA sequence
caatcccgcatcagctggtt

SEQ ID NO: 75337 - DNA, 20 bp, Artificial
  CRISPR gRNA sequence
gttggggatggaatgttgct

SEQ ID NO: 75338 - DNA, 20 bp, Artificial
  CRISPR gRNA sequence
gggatggaatgttgcttccc

SEQ ID NO: 75339 - DNA, 20 bp, Artificial
  CRISPR gRNA sequence
cttccctgtccccaggtcag

SEQ ID NO: 75340 - DNA, 20 bp, Artificial
  CRISPR gRNA sequence
ccctgtccccaggtcagttt

SEQ ID NO: 75341 - DNA, 20 bp, Artificial
  CRISPR gRNA sequence
cctgtccccaggtcagtttg

SEQ ID NO: 75342 - DNA, 20 bp, Artificial
  CRISPR gRNA sequence
tccccaggtcagtttggctg

SEQ ID NO: 75343 - DNA, 20 bp, Artificial
  CRISPR gRNA sequence
ggctgtaggggtgtgtcacc

SEQ ID NO: 75344 - DNA, 20 bp, Artificial
  CRISPR gRNA sequence
gctgtaggggtgtgtcaccc

SEQ ID NO: 75345 - DNA, 20 bp, Artificial
  CRISPR gRNA sequence
taggggtgtgtcaccctgcc

SEQ ID NO: 75346 - DNA, 20 bp, Artificial
  CRISPR gRNA sequence
ccacgaatcacagcctctct

SEQ ID NO: 75347 - DNA, 20 bp, Artificial
  CRISPR gRNA sequence
tcttgggtgtttggtggagg

SEQ ID NO: 75348 - DNA, 20 bp, Artificial
  CRISPR gRNA sequence
ttgggtgtttggtggaggat

SEQ ID NO: 75349 - DNA, 20 bp, Artificial
  CRISPR gRNA sequence
gggtgtttggtggaggatct

SEQ ID NO: 75350 - DNA, 20 bp, Artificial
  CRISPR gRNA sequence
ggtgtttggtggaggatctg

SEQ ID NO: 75351 - DNA, 20 bp, Artificial
  CRISPR gRNA sequence
ggtggaggatctgcccatgg

SEQ ID NO: 75352 - DNA, 20 bp, Artificial
  CRISPR gRNA sequence
gtggaggatctgcccatggt

SEQ ID NO: 75353 - DNA, 20 bp, Artificial
  CRISPR gRNA sequence
cccatggtgggtgtgaggga

SEQ ID NO: 75354 - DNA, 20 bp, Artificial
  CRISPR gRNA sequence
ccccttgccctccacagtcc

SEQ ID NO: 75355 - DNA, 20 bp, Artificial
  CRISPR gRNA sequence
gccctccacagtccttgtcc

SEQ ID NO: 75356 - DNA, 20 bp, Artificial
  CRISPR gRNA sequence
ccctccacagtccttgtcct

SEQ ID NO: 75357 - DNA, 20 bp, Artificial
  CRISPR gRNA sequence
cacagtccttgtcctctggt

SEQ ID NO: 75358 - DNA, 20 bp, Artificial
  CRISPR gRNA sequence
gtcctctggtgctctggggg

SEQ ID NO: 75359 - DNA, 20 bp, Artificial
  CRISPR gRNA sequence
tcctctggtgctctggggga

SEQ ID NO: 75360 - DNA, 20 bp, Artificial
  CRISPR gRNA sequence
tggtgctctgggggatgccc

SEQ ID NO: 75361 - DNA, 20 bp, Artificial
  CRISPR gRNA sequence
gtgctctgggggatgccctc

SEQ ID NO: 75362 - DNA, 20 bp, Artificial
  CRISPR gRNA sequence
tgggggatgccctcagaagg

SEQ ID NO: 75363 - DNA, 20 bp, Artificial
  CRISPR gRNA sequence
ggggatgccctcagaaggag

SEQ ID NO: 75364 - DNA, 20 bp, Artificial
  CRISPR gRNA sequence
agaaggagcccccatcatgc

SEQ ID NO: 75365 - DNA, 20 bp, Artificial
  CRISPR gRNA sequence
ttggcctaggggagccttcc

SEQ ID NO: 75366 - DNA, 20 bp, Artificial
  CRISPR gRNA sequence
tggcctaggggagccttcct

SEQ ID NO: 75367 - DNA, 20 bp, Artificial
  CRISPR gRNA sequence
ggcctaggggagccttcctc

SEQ ID NO: 75368 - DNA, 20 bp, Artificial
  CRISPR gRNA sequence
gcctaggggagccttcctcc

SEQ ID NO: 75369 - DNA, 20 bp, Artificial
  CRISPR gRNA sequence
ggggagccttcctccttgct

SEQ ID NO: 75370 - DNA, 20 bp, Artificial
  CRISPR gRNA sequence
cctccttgctatctgtcctt

SEQ ID NO: 75371 - DNA, 20 bp, Artificial
  CRISPR gRNA sequence
ctccttgctatctgtccttt

SEQ ID NO: 75372 - DNA, 20 bp, Artificial
  CRISPR gRNA sequence
cttgctatctgtcctttatg

SEQ ID NO: 75373 - DNA, 20 bp, Artificial
  CRISPR gRNA sequence
gctatctgtcctttatgctg

SEQ ID NO: 75374 - DNA, 20 bp, Artificial
  CRISPR gRNA sequence
ctatctgtcctttatgctgc

SEQ ID NO: 75375 - DNA, 20 bp, Artificial
  CRISPR gRNA sequence
tctgtcctttatgctgcttt

SEQ ID NO: 75376 - DNA, 20 bp, Artificial
  CRISPR gRNA sequence
tcctttatgctgctttccac

SEQ ID NO: 75377 - DNA, 20 bp, Artificial
  CRISPR gRNA sequence
tatgctgctttccacttact

SEQ ID NO: 75378 - DNA, 20 bp, Artificial
  CRISPR gRNA sequence
atgctgctttccacttactc

SEQ ID NO: 75379 - DNA, 20 bp, Artificial
  CRISPR gRNA sequence
tgctgctttccacttactca

SEQ ID NO: 75380 - DNA, 20 bp, Artificial
  CRISPR gRNA sequence
ctttccacttactcaagcaa

SEQ ID NO: 75381 - DNA, 20 bp, Artificial
  CRISPR gRNA sequence
tccacttactcaagcaaacc

SEQ ID NO: 75382 - DNA, 20 bp, Artificial
  CRISPR gRNA sequence
ccacttactcaagcaaaccg

SEQ ID NO: 75383 - DNA, 20 bp, Artificial
  CRISPR gRNA sequence
cacttactcaagcaaaccgg

SEQ ID NO: 75384 - DNA, 20 bp, Artificial
  CRISPR gRNA sequence
actcaagcaaaccggagatg

SEQ ID NO: 75385 - DNA, 20 bp, Artificial
  CRISPR gRNA sequence
ctcaagcaaaccggagatgg

SEQ ID NO: 75386 - DNA, 20 bp, Artificial
  CRISPR gRNA sequence
aagcaaaccggagatgggca

SEQ ID NO: 75387 - DNA, 20 bp, Artificial
  CRISPR gRNA sequence
cggcagacattccagaaggc

SEQ ID NO: 75388 - DNA, 20 bp, Artificial
  CRISPR gRNA sequence
cagaaggcatctgagtccgc

SEQ ID NO: 75389 - DNA, 20 bp, Artificial
  CRISPR gRNA sequence
agtccgctgtcgcccagcag

SEQ ID NO: 75390 - DNA, 20 bp, Artificial
  CRISPR gRNA sequence
tcgcccagcaggtttgctga

SEQ ID NO: 75391 - DNA, 20 bp, Artificial
  CRISPR gRNA sequence
gctgagagactgtagggggt

SEQ ID NO: 75392 - DNA, 20 bp, Artificial
  CRISPR gRNA sequence
ctgagagactgtagggggta

SEQ ID NO: 75393 - DNA, 20 bp, Artificial
  CRISPR gRNA sequence
agagactgtagggggtaagg

SEQ ID NO: 75394 - DNA, 20 bp, Artificial
  CRISPR gRNA sequence
tagggggtaaggagcagtgg

SEQ ID NO: 75395 - DNA, 20 bp, Artificial
  CRISPR gRNA sequence
ctcagcctgagatgctcctc

SEQ ID NO: 75396 - DNA, 20 bp, Artificial
  CRISPR gRNA sequence
agcctgagatgctcctcagt

SEQ ID NO: 75397 - DNA, 20 bp, Artificial
  CRISPR gRNA sequence
agatgctcctcagtcaccag

SEQ ID NO: 75398 - DNA, 20 bp, Artificial
  CRISPR gRNA sequence
ctcagtcaccaggagcctgc

SEQ ID NO: 75399 - DNA, 20 bp, Artificial
  CRISPR gRNA sequence
agtcaccaggagcctgcatc

SEQ ID NO: 75400 - DNA, 20 bp, Artificial
  CRISPR gRNA sequence
catccactgtcactgctact

SEQ ID NO: 75401 - DNA, 20 bp, Artificial
  CRISPR gRNA sequence
tcactgctactggaccccat

SEQ ID NO: 75402 - DNA, 20 bp, Artificial
  CRISPR gRNA sequence
ctactggaccccatgtcagg

SEQ ID NO: 75403 - DNA, 20 bp, Artificial
  CRISPR gRNA sequence
ctggaccccatgtcagggtc

SEQ ID NO: 75404 - DNA, 20 bp, Artificial
  CRISPR gRNA sequence
gaccccatgtcagggtcacc

SEQ ID NO: 75405 - DNA, 20 bp, Artificial
  CRISPR gRNA sequence
ccaccatcaccaccaccact

SEQ ID NO: 75406 - DNA, 20 bp, Artificial
  CRISPR gRNA sequence
tcattatcaccacaattcta

SEQ ID NO: 75407 - DNA, 20 bp, Artificial
  CRISPR gRNA sequence
cattatcaccacaattctac

SEQ ID NO: 75408 - DNA, 20 bp, Artificial
  CRISPR gRNA sequence
attatcaccacaattctaca

SEQ ID NO: 75409 - DNA, 20 bp, Artificial
  CRISPR gRNA sequence
tcaccacaattctacaccac

SEQ ID NO: 75410 - DNA, 20 bp, Artificial
  CRISPR gRNA sequence
tacaccaccaagcccagtac

SEQ ID NO: 75411 - DNA, 20 bp, Artificial
  CRISPR gRNA sequence
caccaccaagcccagtacca

SEQ ID NO: 75412 - DNA, 20 bp, Artificial
  CRISPR gRNA sequence
ccatcaccactagaatgacc

SEQ ID NO: 75413 - DNA, 20 bp, Artificial
  CRISPR gRNA sequence
catcaccactagaatgacca

SEQ ID NO: 75414 - DNA, 20 bp, Artificial
  CRISPR gRNA sequence
gaatgaccagcaactcctac

SEQ ID NO: 75415 - DNA, 20 bp, Artificial
  CRISPR gRNA sequence
ctacgttctctgctactatc

SEQ ID NO: 75416 - DNA, 20 bp, Artificial
  CRISPR gRNA sequence
cgttctctgctactatcccc

SEQ ID NO: 75417 - DNA, 20 bp, Artificial
  CRISPR gRNA sequence
tctgctactatcccctcccc

SEQ ID NO: 75418 - DNA, 20 bp, Artificial
  CRISPR gRNA sequence
tgctactatcccctccccag

SEQ ID NO: 75419 - DNA, 20 bp, Artificial
  CRISPR gRNA sequence
ctactatcccctccccagca

SEQ ID NO: 75420 - DNA, 20 bp, Artificial
  CRISPR gRNA sequence
ctatcccctccccagcacca

SEQ ID NO: 75421 - DNA, 20 bp, Artificial
  CRISPR gRNA sequence
tcccctccccagcaccacag

SEQ ID NO: 75422 - DNA, 20 bp, Artificial
  CRISPR gRNA sequence
cccagcaccacagtaaaccc

SEQ ID NO: 75423 - DNA, 20 bp, Artificial
  CRISPR gRNA sequence
ttggtcctcttccatatcgg

SEQ ID NO: 75424 - DNA, 20 bp, Artificial
  CRISPR gRNA sequence
ggtcctcttccatatcgggt

SEQ ID NO: 75425 - DNA, 20 bp, Artificial
  CRISPR gRNA sequence
gtcctcttccatatcgggtg

SEQ ID NO: 75426 - DNA, 20 bp, Artificial
  CRISPR gRNA sequence
ttccatatcgggtgaccact

SEQ ID NO: 75427 - DNA, 20 bp, Artificial
  CRISPR gRNA sequence
ccatatcgggtgaccactca

SEQ ID NO: 75428 - DNA, 20 bp, Artificial
  CRISPR gRNA sequence
catatcgggtgaccactcat

SEQ ID NO: 75429 - DNA, 20 bp, Artificial
  CRISPR gRNA sequence
atagctcaggtgcctccagc

SEQ ID NO: 75430 - DNA, 20 bp, Artificial
  CRISPR gRNA sequence
aggtgcctccagcaggcttt

SEQ ID NO: 75431 - DNA, 20 bp, Artificial
  CRISPR gRNA sequence
cagcaggctttcaagggtta

SEQ ID NO: 75432 - DNA, 20 bp, Artificial
  CRISPR gRNA sequence
tcaagggttaaagaaaaacc

SEQ ID NO: 75433 - DNA, 20 bp, Artificial
  CRISPR gRNA sequence
caagggttaaagaaaaacca

SEQ ID NO: 75434 - DNA, 20 bp, Artificial
  CRISPR gRNA sequence
aagggttaaagaaaaaccaa

SEQ ID NO: 75435 - DNA, 20 bp, Artificial
  CRISPR gRNA sequence
aagaaaaaccaatttgcctt

SEQ ID NO: 75436 - DNA, 20 bp, Artificial
  CRISPR gRNA sequence
gccttcaccacgcccttggc

SEQ ID NO: 75437 - DNA, 20 bp, Artificial
  CRISPR gRNA sequence
ccttcaccacgcccttggcc

SEQ ID NO: 75438 - DNA, 20 bp, Artificial
  CRISPR gRNA sequence
caccacgcccttggccggca

SEQ ID NO: 75439 - DNA, 20 bp, Artificial
  CRISPR gRNA sequence
accacgcccttggccggcat

SEQ ID NO: 75440 - DNA, 20 bp, Artificial
  CRISPR gRNA sequence
ggccggcatcatttgggatc

SEQ ID NO: 75441 - DNA, 20 bp, Artificial
  CRISPR gRNA sequence
gccggcatcatttgggatcc

SEQ ID NO: 75442 - DNA, 20 bp, Artificial
  CRISPR gRNA sequence
gggatccacagtttttgaat

SEQ ID NO: 75443 - DNA, 20 bp, Artificial
  CRISPR gRNA sequence
ggatccacagtttttgaatg

SEQ ID NO: 75444 - DNA, 20 bp, Artificial
  CRISPR gRNA sequence
ttgaatgagaggaaattcag

SEQ ID NO: 75445 - DNA, 20 bp, Artificial
  CRISPR gRNA sequence
tgaatgagaggaaattcagg

SEQ ID NO: 75446 - DNA, 20 bp, Artificial
  CRISPR gRNA sequence
gaatgagaggaaattcagga

SEQ ID NO: 75447 - DNA, 20 bp, Artificial
  CRISPR gRNA sequence
aatgagaggaaattcaggaa

SEQ ID NO: 75448 - DNA, 20 bp, Artificial
  CRISPR gRNA sequence
aggaaaaaaaaatgtttgca

SEQ ID NO: 75449 - DNA, 20 bp, Artificial
  CRISPR gRNA sequence
gcaggatgcattaaacccat

SEQ ID NO: 75450 - DNA, 20 bp, Artificial
  CRISPR gRNA sequence
caggatgcattaaacccata

SEQ ID NO: 75451 - DNA, 20 bp, Artificial
  CRISPR gRNA sequence
aacccatagatttcttcttt

SEQ ID NO: 75452 - DNA, 20 bp, Artificial
  CRISPR gRNA sequence
cttcttttaatctgggaatg

SEQ ID NO: 75453 - DNA, 20 bp, Artificial
  CRISPR gRNA sequence
ttcttttaatctgggaatgc

SEQ ID NO: 75454 - DNA, 20 bp, Artificial
  CRISPR gRNA sequence
cttttaatctgggaatgcaa

SEQ ID NO: 75455 - DNA, 20 bp, Artificial
  CRISPR gRNA sequence
ttttaatctgggaatgcaat

SEQ ID NO: 75456 - DNA, 20 bp, Artificial
  CRISPR gRNA sequence
ttaatctgggaatgcaatat

SEQ ID NO: 75457 - DNA, 20 bp, Artificial
  CRISPR gRNA sequence
taatctgggaatgcaatatc

SEQ ID NO: 75458 - DNA, 20 bp, Artificial
  CRISPR gRNA sequence
aatctgggaatgcaatatca

SEQ ID NO: 75459 - DNA, 20 bp, Artificial
  CRISPR gRNA sequence
atctgggaatgcaatatcaa

SEQ ID NO: 75460 - DNA, 20 bp, Artificial
  CRISPR gRNA sequence
ggaatgcaatatcaatattg

SEQ ID NO: 75461 - DNA, 20 bp, Artificial
  CRISPR gRNA sequence
gaaacctcacctgaagtttc

SEQ ID NO: 75462 - DNA, 20 bp, Artificial
  CRISPR gRNA sequence
acctgaagtttcttacttcc

SEQ ID NO: 75463 - DNA, 20 bp, Artificial
  CRISPR gRNA sequence
aagtttcttacttcccttca

SEQ ID NO: 75464 - DNA, 20 bp, Artificial
  CRISPR gRNA sequence
cttacttcccttcattgcag

SEQ ID NO: 75465 - DNA, 20 bp, Artificial
  CRISPR gRNA sequence
ttacttcccttcattgcagc

SEQ ID NO: 75466 - DNA, 20 bp, Artificial
  CRISPR gRNA sequence
acttcccttcattgcagcat

SEQ ID NO: 75467 - DNA, 20 bp, Artificial
  CRISPR gRNA sequence
cttcccttcattgcagcatt

SEQ ID NO: 75468 - DNA, 20 bp, Artificial
  CRISPR gRNA sequence
cccttcattgcagcattctg

SEQ ID NO: 75469 - DNA, 20 bp, Artificial
  CRISPR gRNA sequence
ccttcattgcagcattctgt

SEQ ID NO: 75470 - DNA, 20 bp, Artificial
  CRISPR gRNA sequence
cattgcagcattctgtggtt

SEQ ID NO: 75471 - DNA, 20 bp, Artificial
  CRISPR gRNA sequence
attgcagcattctgtggttt

SEQ ID NO: 75472 - DNA, 20 bp, Artificial
  CRISPR gRNA sequence
cagcattctgtggttttatt

SEQ ID NO: 75473 - DNA, 20 bp, Artificial
  CRISPR gRNA sequence
tgtggttttatttatttatt

SEQ ID NO: 75474 - DNA, 20 bp, Artificial
  CRISPR gRNA sequence
tggttttatttatttattta

SEQ ID NO: 75475 - DNA, 20 bp, Artificial
  CRISPR gRNA sequence
tatttatttatttattttga

SEQ ID NO: 75476 - DNA, 20 bp, Artificial
  CRISPR gRNA sequence
atttatttatttattttgag

SEQ ID NO: 75477 - DNA, 20 bp, Artificial
  CRISPR gRNA sequence
tttatttatttattttgaga

SEQ ID NO: 75478 - DNA, 20 bp, Artificial
  CRISPR gRNA sequence
atttatttattttgagatgg

SEQ ID NO: 75479 - DNA, 20 bp, Artificial
  CRISPR gRNA sequence
tttatttattttgagatgga

SEQ ID NO: 75480 - DNA, 20 bp, Artificial
  CRISPR gRNA sequence
atttattttgagatggagtc

SEQ ID NO: 75481 - DNA, 20 bp, Artificial
  CRISPR gRNA sequence
tttattttgagatggagtct

SEQ ID NO: 75482 - DNA, 20 bp, Artificial
  CRISPR gRNA sequence
attttgagatggagtcttgc

SEQ ID NO: 75483 - DNA, 20 bp, Artificial
  CRISPR gRNA sequence
ttttgagatggagtcttgct

SEQ ID NO: 75484 - DNA, 20 bp, Artificial
  CRISPR gRNA sequence
tgagatggagtcttgctctg

SEQ ID NO: 75485 - DNA, 20 bp, Artificial
  CRISPR gRNA sequence
gagatggagtcttgctctgt

SEQ ID NO: 75486 - DNA, 20 bp, Artificial
  CRISPR gRNA sequence
agatggagtcttgctctgtt

SEQ ID NO: 75487 - DNA, 20 bp, Artificial
  CRISPR gRNA sequence
gctctgttgcccaggctgga

SEQ ID NO: 75488 - DNA, 20 bp, Artificial
  CRISPR gRNA sequence
ctctgttgcccaggctggag

SEQ ID NO: 75489 - DNA, 20 bp, Artificial
  CRISPR gRNA sequence
tgttgcccaggctggagtgc

SEQ ID NO: 75490 - DNA, 20 bp, Artificial
  CRISPR gRNA sequence
ttgcccaggctggagtgcaa

SEQ ID NO: 75491 - DNA, 20 bp, Artificial
  CRISPR gRNA sequence
cccaggctggagtgcaatgg

SEQ ID NO: 75492 - DNA, 20 bp, Artificial
  CRISPR gRNA sequence
gagtgcaatggcacgatctt

SEQ ID NO: 75493 - DNA, 20 bp, Artificial
  CRISPR gRNA sequence
ggctcactgcgacctctgtc

SEQ ID NO: 75494 - DNA, 20 bp, Artificial
  CRISPR gRNA sequence
gctcactgcgacctctgtct

SEQ ID NO: 75495 - DNA, 20 bp, Artificial
  CRISPR gRNA sequence
actgcgacctctgtctccca

SEQ ID NO: 75496 - DNA, 20 bp, Artificial
  CRISPR gRNA sequence
cgacctctgtctcccaggtt

SEQ ID NO: 75497 - DNA, 20 bp, Artificial
  CRISPR gRNA sequence
tgtctcccaggttcaagaga

SEQ ID NO: 75498 - DNA, 20 bp, Artificial
  CRISPR gRNA sequence
tctcccaggttcaagagatt

SEQ ID NO: 75499 - DNA, 20 bp, Artificial
  CRISPR gRNA sequence
ccaggttcaagagattctcc

SEQ ID NO: 75500 - DNA, 20 bp, Artificial
  CRISPR gRNA sequence
aagagattctcctgcctcag

SEQ ID NO: 75501 - DNA, 20 bp, Artificial
  CRISPR gRNA sequence
tcctgcctcagcctcccaag

SEQ ID NO: 75502 - DNA, 20 bp, Artificial
  CRISPR gRNA sequence
ctgcctcagcctcccaagta

SEQ ID NO: 75503 - DNA, 20 bp, Artificial
  CRISPR gRNA sequence
cctcagcctcccaagtagct

SEQ ID NO: 75504 - DNA, 20 bp, Artificial
  CRISPR gRNA sequence
agcctcccaagtagctggga

SEQ ID NO: 75505 - DNA, 20 bp, Artificial
  CRISPR gRNA sequence
ccaagtagctgggattacag

SEQ ID NO: 75506 - DNA, 20 bp, Artificial
  CRISPR gRNA sequence
ggattacaggcatgtgccac

SEQ ID NO: 75507 - DNA, 20 bp, Artificial
  CRISPR gRNA sequence
caggcatgtgccactatgcc

SEQ ID NO: 75508 - DNA, 20 bp, Artificial
  CRISPR gRNA sequence
tgcctggctaattatttttg

SEQ ID NO: 75509 - DNA, 20 bp, Artificial
  CRISPR gRNA sequence
gctaattatttttgtatttt

SEQ ID NO: 75510 - DNA, 20 bp, Artificial
  CRISPR gRNA sequence
attatttttgtatttttagt

SEQ ID NO: 75511 - DNA, 20 bp, Artificial
  CRISPR gRNA sequence
tttttgtatttttagtagag

SEQ ID NO: 75512 - DNA, 20 bp, Artificial
  CRISPR gRNA sequence
ttgtatttttagtagagacg

SEQ ID NO: 75513 - DNA, 20 bp, Artificial
  CRISPR gRNA sequence
tgtatttttagtagagacgg

SEQ ID NO: 75514 - DNA, 20 bp, Artificial
  CRISPR gRNA sequence
gtatttttagtagagacggg

SEQ ID NO: 75515 - DNA, 20 bp, Artificial
  CRISPR gRNA sequence
tatttttagtagagacgggt

SEQ ID NO: 75516 - DNA, 20 bp, Artificial
  CRISPR gRNA sequence
ttagtagagacgggttttca

SEQ ID NO: 75517 - DNA, 20 bp, Artificial
  CRISPR gRNA sequence
tagtagagacgggttttcac

SEQ ID NO: 75518 - DNA, 20 bp, Artificial
  CRISPR gRNA sequence
agtagagacgggttttcacc

SEQ ID NO: 75519 - DNA, 20 bp, Artificial
  CRISPR gRNA sequence
gtagagacgggttttcacca

SEQ ID NO: 75520 - DNA, 20 bp, Artificial
  CRISPR gRNA sequence
tcaccatgttgatcaggctg

SEQ ID NO: 75521 - DNA, 20 bp, Artificial
  CRISPR gRNA sequence
caccatgttgatcaggctgg

SEQ ID NO: 75522 - DNA, 20 bp, Artificial
  CRISPR gRNA sequence
accatgttgatcaggctggt

SEQ ID NO: 75523 - DNA, 20 bp, Artificial
  CRISPR gRNA sequence
atcaggctggtctcaaactc

SEQ ID NO: 75524 - DNA, 20 bp, Artificial
  CRISPR gRNA sequence
gtctcaaactcctgacctca

SEQ ID NO: 75525 - DNA, 20 bp, Artificial
  CRISPR gRNA sequence
aaactcctgacctcaggtga

SEQ ID NO: 75526 - DNA, 20 bp, Artificial
  CRISPR gRNA sequence
ctgacctcaggtgatccacc

SEQ ID NO: 75527 - DNA, 20 bp, Artificial
  CRISPR gRNA sequence
acctcaggtgatccacccgc

SEQ ID NO: 75528 - DNA, 20 bp, Artificial
  CRISPR gRNA sequence
aggtgatccacccgctttgg

SEQ ID NO: 75529 - DNA, 20 bp, Artificial
  CRISPR gRNA sequence
tggcctcccaaagtgctggg

SEQ ID NO: 75530 - DNA, 20 bp, Artificial
  CRISPR gRNA sequence
ggcctcccaaagtgctggga

SEQ ID NO: 75531 - DNA, 20 bp, Artificial
  CRISPR gRNA sequence
gcctcccaaagtgctgggat

SEQ ID NO: 75532 - DNA, 20 bp, Artificial
  CRISPR gRNA sequence
ccaaagtgctgggattacag

SEQ ID NO: 75533 - DNA, 20 bp, Artificial
  CRISPR gRNA sequence
ggattacaggcgtgagccac

SEQ ID NO: 75534 - DNA, 20 bp, Artificial
  CRISPR gRNA sequence
caggcgtgagccaccacgcc

SEQ ID NO: 75535 - DNA, 20 bp, Artificial
  CRISPR gRNA sequence
gttttaactacagtttcaga

SEQ ID NO: 75536 - DNA, 20 bp, Artificial
  CRISPR gRNA sequence
taactacagtttcagaaata

SEQ ID NO: 75537 - DNA, 20 bp, Artificial
  CRISPR gRNA sequence
aactacagtttcagaaataa

SEQ ID NO: 75538 - DNA, 20 bp, Artificial
  CRISPR gRNA sequence
actacagtttcagaaataat

SEQ ID NO: 75539 - DNA, 20 bp, Artificial
  CRISPR gRNA sequence
cagtttcagaaataatataa

SEQ ID NO: 75540 - DNA, 20 bp, Artificial
  CRISPR gRNA sequence
cagaaataatataaccagtg

SEQ ID NO: 75541 - DNA, 20 bp, Artificial
  CRISPR gRNA sequence
agaaataatataaccagtgt

SEQ ID NO: 75542 - DNA, 20 bp, Artificial
  CRISPR gRNA sequence
attttcctcctaggtctgtg

SEQ ID NO: 75543 - DNA, 20 bp, Artificial
  CRISPR gRNA sequence
tcctcctaggtctgtgacat

SEQ ID NO: 75544 - DNA, 20 bp, Artificial
  CRISPR gRNA sequence
cctcctaggtctgtgacatt

SEQ ID NO: 75545 - DNA, 20 bp, Artificial
  CRISPR gRNA sequence
ctcctaggtctgtgacattt

SEQ ID NO: 75546 - DNA, 20 bp, Artificial
  CRISPR gRNA sequence
ctaggtctgtgacatttttg

SEQ ID NO: 75547 - DNA, 20 bp, Artificial
  CRISPR gRNA sequence
ggtctgtgacatttttgatg

SEQ ID NO: 75548 - DNA, 20 bp, Artificial
  CRISPR gRNA sequence
tgacatttttgatgtttgtt

SEQ ID NO: 75549 - DNA, 20 bp, Artificial
  CRISPR gRNA sequence
ttgatgtttgttaatttcat

SEQ ID NO: 75550 - DNA, 20 bp, Artificial
  CRISPR gRNA sequence
tgatgtttgttaatttcatc

SEQ ID NO: 75551 - DNA, 20 bp, Artificial
  CRISPR gRNA sequence
gatgtttgttaatttcatct

SEQ ID NO: 75552 - DNA, 20 bp, Artificial
  CRISPR gRNA sequence
atgtttgttaatttcatctt

SEQ ID NO: 75553 - DNA, 20 bp, Artificial
  CRISPR gRNA sequence
gttaatttcatcttttcctg

SEQ ID NO: 75554 - DNA, 20 bp, Artificial
  CRISPR gRNA sequence
ttaatttcatcttttcctga

SEQ ID NO: 75555 - DNA, 20 bp, Artificial
  CRISPR gRNA sequence
atttcatcttttcctgagaa

SEQ ID NO: 75556 - DNA, 20 bp, Artificial
  CRISPR gRNA sequence
catcttttcctgagaaacgt

SEQ ID NO: 75557 - DNA, 20 bp, Artificial
  CRISPR gRNA sequence
atcttttcctgagaaacgtc

SEQ ID NO: 75558 - DNA, 20 bp, Artificial
  CRISPR gRNA sequence
ttcctgagaaacgtcattta

SEQ ID NO: 75559 - DNA, 20 bp, Artificial
  CRISPR gRNA sequence
tcctgagaaacgtcatttaa

SEQ ID NO: 75560 - DNA, 20 bp, Artificial
  CRISPR gRNA sequence
cctgagaaacgtcatttaaa

SEQ ID NO: 75561 - DNA, 20 bp, Artificial
  CRISPR gRNA sequence
ctgagaaacgtcatttaaaa

SEQ ID NO: 75562 - DNA, 20 bp, Artificial
  CRISPR gRNA sequence
agaaacgtcatttaaaaatt

SEQ ID NO: 75563 - DNA, 20 bp, Artificial
  CRISPR gRNA sequence
aaaaattggtctgtcttatg

SEQ ID NO: 75564 - DNA, 20 bp, Artificial
  CRISPR gRNA sequence
aaaattggtctgtcttatga

SEQ ID NO: 75565 - DNA, 20 bp, Artificial
  CRISPR gRNA sequence
gtctgtcttatgaagccact

SEQ ID NO: 75566 - DNA, 20 bp, Artificial
  CRISPR gRNA sequence
tcttatgaagccacttaata

SEQ ID NO: 75567 - DNA, 20 bp, Artificial
  CRISPR gRNA sequence
atgaagccacttaataaaat

SEQ ID NO: 75568 - DNA, 20 bp, Artificial
  CRISPR gRNA sequence
tgaagccacttaataaaata

SEQ ID NO: 75569 - DNA, 20 bp, Artificial
  CRISPR gRNA sequence
aataaaatagtctttaaaat

SEQ ID NO: 75570 - DNA, 20 bp, Artificial
  CRISPR gRNA sequence
ataaaatagtctttaaaata

SEQ ID NO: 75571 - DNA, 20 bp, Artificial
  CRISPR gRNA sequence
taaaataagaaaaattggct

SEQ ID NO: 75572 - DNA, 20 bp, Artificial
  CRISPR gRNA sequence
aaaataagaaaaattggctg

SEQ ID NO: 75573 - DNA, 20 bp, Artificial
  CRISPR gRNA sequence
aaataagaaaaattggctgg

SEQ ID NO: 75574 - DNA, 20 bp, Artificial
  CRISPR gRNA sequence
gctgggtgcggtggctcaag

SEQ ID NO: 75575 - DNA, 20 bp, Artificial
  CRISPR gRNA sequence
ggtgcggtggctcaaggctg

SEQ ID NO: 75576 - DNA, 20 bp, Artificial
  CRISPR gRNA sequence
aaggctgtaatcccagcact

SEQ ID NO: 75577 - DNA, 20 bp, Artificial
  CRISPR gRNA sequence
taatcccagcactttgggag

SEQ ID NO: 75578 - DNA, 20 bp, Artificial
  CRISPR gRNA sequence
tgggagggcgaggcaggcgg

SEQ ID NO: 75579 - DNA, 20 bp, Artificial
  CRISPR gRNA sequence
gggagggcgaggcaggcgga

SEQ ID NO: 75580 - DNA, 20 bp, Artificial
  CRISPR gRNA sequence
ggagggcgaggcaggcggat

SEQ ID NO: 75581 - DNA, 20 bp, Artificial
  CRISPR gRNA sequence
aggtcaggagttcaagacca

SEQ ID NO: 75582 - DNA, 20 bp, Artificial
  CRISPR gRNA sequence
aagaccagcctggccaacat

SEQ ID NO: 75583 - DNA, 20 bp, Artificial
  CRISPR gRNA sequence
gccaacatggtgaaaccccg

SEQ ID NO: 75584 - DNA, 20 bp, Artificial
  CRISPR gRNA sequence
tactaaaaataccaaaatta

SEQ ID NO: 75585 - DNA, 20 bp, Artificial
  CRISPR gRNA sequence
ctaaaaataccaaaattagc

SEQ ID NO: 75586 - DNA, 20 bp, Artificial
  CRISPR gRNA sequence
aaaataccaaaattagccag

SEQ ID NO: 75587 - DNA, 20 bp, Artificial
  CRISPR gRNA sequence
gccaggcatggtggctcatg

SEQ ID NO: 75588 - DNA, 20 bp, Artificial
  CRISPR gRNA sequence
atgcctgtaatctcagctcc

SEQ ID NO: 75589 - DNA, 20 bp, Artificial
  CRISPR gRNA sequence
taatctcagctccttgggag

SEQ ID NO: 75590 - DNA, 20 bp, Artificial
  CRISPR gRNA sequence
agctccttgggaggctgagg

SEQ ID NO: 75591 - DNA, 20 bp, Artificial
  CRISPR gRNA sequence
cttgggaggctgaggcagga

SEQ ID NO: 75592 - DNA, 20 bp, Artificial
  CRISPR gRNA sequence
gggaggctgaggcaggagaa

SEQ ID NO: 75593 - DNA, 20 bp, Artificial
  CRISPR gRNA sequence
ggaggctgaggcaggagaat

SEQ ID NO: 75594 - DNA, 20 bp, Artificial
  CRISPR gRNA sequence
aggcaggagaattgcttgaa

SEQ ID NO: 75595 - DNA, 20 bp, Artificial
  CRISPR gRNA sequence
cttgaacctgggaggcggaa

SEQ ID NO: 75596 - DNA, 20 bp, Artificial
  CRISPR gRNA sequence
gaacctgggaggcggaagtt

SEQ ID NO: 75597 - DNA, 20 bp, Artificial
  CRISPR gRNA sequence
aacctgggaggcggaagttg

SEQ ID NO: 75598 - DNA, 20 bp, Artificial
  CRISPR gRNA sequence
ggaggcggaagttgcagtga

SEQ ID NO: 75599 - DNA, 20 bp, Artificial
  CRISPR gRNA sequence
cagtgagccgaaattgcgcc

SEQ ID NO: 75600 - DNA, 20 bp, Artificial
  CRISPR gRNA sequence
cgccactgcattccagcctg

SEQ ID NO: 75601 - DNA, 20 bp, Artificial
  CRISPR gRNA sequence
cattccagcctgggcagcag

SEQ ID NO: 75602 - DNA, 20 bp, Artificial
  CRISPR gRNA sequence
cagcctgggcagcagagaaa

SEQ ID NO: 75603 - DNA, 20 bp, Artificial
  CRISPR gRNA sequence
ggcagcagagaaagactcca

SEQ ID NO: 75604 - DNA, 20 bp, Artificial
  CRISPR gRNA sequence
catctaaaaaaaaagaaaga

SEQ ID NO: 75605 - DNA, 20 bp, Artificial
  CRISPR gRNA sequence
aaaaaaaagaaagaaagaaa

SEQ ID NO: 75606 - DNA, 20 bp, Artificial
  CRISPR gRNA sequence
ccctctataatgaaaaacaa

SEQ ID NO: 75607 - DNA, 20 bp, Artificial
  CRISPR gRNA sequence
cctctataatgaaaaacaaa

SEQ ID NO: 75608 - DNA, 20 bp, Artificial
  CRISPR gRNA sequence
tataatgaaaaacaaaaaac

SEQ ID NO: 75609 - DNA, 20 bp, Artificial
  CRISPR gRNA sequence
taatgaaaaacaaaaaactc

SEQ ID NO: 75610 - DNA, 20 bp, Artificial
  CRISPR gRNA sequence
aaagacatatttcttattca

SEQ ID NO: 75611 - DNA, 20 bp, Artificial
  CRISPR gRNA sequence
cttattcatatctgtttaaa

SEQ ID NO: 75612 - DNA, 20 bp, Artificial
  CRISPR gRNA sequence
ttattcatatctgtttaaaa

SEQ ID NO: 75613 - DNA, 20 bp, Artificial
  CRISPR gRNA sequence
attcatatctgtttaaaata

SEQ ID NO: 75614 - DNA, 20 bp, Artificial
  CRISPR gRNA sequence
ttcatatctgtttaaaatac

SEQ ID NO: 75615 - DNA, 20 bp, Artificial
  CRISPR gRNA sequence
atatctgtttaaaatacatt

SEQ ID NO: 75616 - DNA, 20 bp, Artificial
  CRISPR gRNA sequence
tttaaaatacattccaagca

SEQ ID NO: 75617 - DNA, 20 bp, Artificial
  CRISPR gRNA sequence
aaaatacattccaagcacag

SEQ ID NO: 75618 - DNA, 20 bp, Artificial
  CRISPR gRNA sequence
aaatacattccaagcacagc

SEQ ID NO: 75619 - DNA, 20 bp, Artificial
  CRISPR gRNA sequence
caagcacagcggctcatgcc

SEQ ID NO: 75620 - DNA, 20 bp, Artificial
  CRISPR gRNA sequence
atgcctgtaatctcagcaac

SEQ ID NO: 75621 - DNA, 20 bp, Artificial
  CRISPR gRNA sequence
taatctcagcaacctgggag

SEQ ID NO: 75622 - DNA, 20 bp, Artificial
  CRISPR gRNA sequence
agcaacctgggaggctgagg

SEQ ID NO: 75623 - DNA, 20 bp, Artificial
  CRISPR gRNA sequence
ggaggctgaggatcacctga

SEQ ID NO: 75624 - DNA, 20 bp, Artificial
  CRISPR gRNA sequence
aggatcacctgagctcagaa

SEQ ID NO: 75625 - DNA, 20 bp, Artificial
  CRISPR gRNA sequence
agctcagaagtttgagacca

SEQ ID NO: 75626 - DNA, 20 bp, Artificial
  CRISPR gRNA sequence
agaagtttgagaccaacctg

SEQ ID NO: 75627 - DNA, 20 bp, Artificial
  CRISPR gRNA sequence
gagaccaacctggggaacat

SEQ ID NO: 75628 - DNA, 20 bp, Artificial
  CRISPR gRNA sequence
agaccaacctggggaacatg

SEQ ID NO: 75629 - DNA, 20 bp, Artificial
  CRISPR gRNA sequence
gggaacatggtgagacttca

SEQ ID NO: 75630 - DNA, 20 bp, Artificial
  CRISPR gRNA sequence
catctcttacaaaactaaac

SEQ ID NO: 75631 - DNA, 20 bp, Artificial
  CRISPR gRNA sequence
atctcttacaaaactaaact

SEQ ID NO: 75632 - DNA, 20 bp, Artificial
  CRISPR gRNA sequence
ttacaaaactaaactattag

SEQ ID NO: 75633 - DNA, 20 bp, Artificial
  CRISPR gRNA sequence
acaaaactaaactattagcc

SEQ ID NO: 75634 - DNA, 20 bp, Artificial
  CRISPR gRNA sequence
caaaactaaactattagcca

SEQ ID NO: 75635 - DNA, 20 bp, Artificial
  CRISPR gRNA sequence
aactattagccaggcatgtt

SEQ ID NO: 75636 - DNA, 20 bp, Artificial
  CRISPR gRNA sequence
ttagccaggcatgttggtgt

SEQ ID NO: 75637 - DNA, 20 bp, Artificial
  CRISPR gRNA sequence
gccaggcatgttggtgtgtg

SEQ ID NO: 75638 - DNA, 20 bp, Artificial
  CRISPR gRNA sequence
gtgtgtgcctgtagtcccag

SEQ ID NO: 75639 - DNA, 20 bp, Artificial
  CRISPR gRNA sequence
tagtcccagctactccagag

SEQ ID NO: 75640 - DNA, 20 bp, Artificial
  CRISPR gRNA sequence
ctccagaggctgaggtggga

SEQ ID NO: 75641 - DNA, 20 bp, Artificial
  CRISPR gRNA sequence
cagaggctgaggtgggagga

SEQ ID NO: 75642 - DNA, 20 bp, Artificial
  CRISPR gRNA sequence
aggtgggaggatcgcttgag

SEQ ID NO: 75643 - DNA, 20 bp, Artificial
  CRISPR gRNA sequence
gagcccaggagttggaggct

SEQ ID NO: 75644 - DNA, 20 bp, Artificial
  CRISPR gRNA sequence
agcccaggagttggaggctg

SEQ ID NO: 75645 - DNA, 20 bp, Artificial
  CRISPR gRNA sequence
gaggctgcagtgacctatca

SEQ ID NO: 75646 - DNA, 20 bp, Artificial
  CRISPR gRNA sequence
cagtgacctatcattgcacc

SEQ ID NO: 75647 - DNA, 20 bp, Artificial
  CRISPR gRNA sequence
tcattgcaccactgcactcc

SEQ ID NO: 75648 - DNA, 20 bp, Artificial
  CRISPR gRNA sequence
caccactgcactccagcctg

SEQ ID NO: 75649 - DNA, 20 bp, Artificial
  CRISPR gRNA sequence
cactccagcctgggcaacag

SEQ ID NO: 75650 - DNA, 20 bp, Artificial
  CRISPR gRNA sequence
cagcctgggcaacagagtga

SEQ ID NO: 75651 - DNA, 20 bp, Artificial
  CRISPR gRNA sequence
ggcaacagagtgagacccca

SEQ ID NO: 75652 - DNA, 20 bp, Artificial
  CRISPR gRNA sequence
aaaaaaaaaagaaatccatg

SEQ ID NO: 75653 - DNA, 20 bp, Artificial
  CRISPR gRNA sequence
aaaaaaaaagaaatccatga

SEQ ID NO: 75654 - DNA, 20 bp, Artificial
  CRISPR gRNA sequence
tatcagtcacatttttcttc

SEQ ID NO: 75655 - DNA, 20 bp, Artificial
  CRISPR gRNA sequence
atcagtcacatttttcttct

SEQ ID NO: 75656 - DNA, 20 bp, Artificial
  CRISPR gRNA sequence
tcagtcacatttttcttctc

SEQ ID NO: 75657 - DNA, 20 bp, Artificial
  CRISPR gRNA sequence
ttcttctctgccacatcaca

SEQ ID NO: 75658 - DNA, 20 bp, Artificial
  CRISPR gRNA sequence
tcttctctgccacatcacaa

SEQ ID NO: 75659 - DNA, 20 bp, Artificial
  CRISPR gRNA sequence
cttctctgccacatcacaac

SEQ ID NO: 75660 - DNA, 20 bp, Artificial
  CRISPR gRNA sequence
ttctctgccacatcacaaca

SEQ ID NO: 75661 - DNA, 20 bp, Artificial
  CRISPR gRNA sequence
ctctgccacatcacaacaga

SEQ ID NO: 75662 - DNA, 20 bp, Artificial
  CRISPR gRNA sequence
tctgccacatcacaacagaa

SEQ ID NO: 75663 - DNA, 20 bp, Artificial
  CRISPR gRNA sequence
tgccacatcacaacagaaat

SEQ ID NO: 75664 - DNA, 20 bp, Artificial
  CRISPR gRNA sequence
ccacatcacaacagaaatga

SEQ ID NO: 75665 - DNA, 20 bp, Artificial
  CRISPR gRNA sequence
tgtggcatttttggcggact

SEQ ID NO: 75666 - DNA, 20 bp, Artificial
  CRISPR gRNA sequence
ttggcggactgctctctcta

SEQ ID NO: 75667 - DNA, 20 bp, Artificial
  CRISPR gRNA sequence
tggcggactgctctctctat

SEQ ID NO: 75668 - DNA, 20 bp, Artificial
  CRISPR gRNA sequence
ggcggactgctctctctatt

SEQ ID NO: 75669 - DNA, 20 bp, Artificial
  CRISPR gRNA sequence
gcggactgctctctctattt

SEQ ID NO: 75670 - DNA, 20 bp, Artificial
  CRISPR gRNA sequence
ctctctctatttcccactgg

SEQ ID NO: 75671 - DNA, 20 bp, Artificial
  CRISPR gRNA sequence
tctctatttcccactggtcc

SEQ ID NO: 75672 - DNA, 20 bp, Artificial
  CRISPR gRNA sequence
tctatttcccactggtccta

SEQ ID NO: 75673 - DNA, 20 bp, Artificial
  CRISPR gRNA sequence
tatttcccactggtcctagg

SEQ ID NO: 75674 - DNA, 20 bp, Artificial
  CRISPR gRNA sequence
tttcccactggtcctaggct

SEQ ID NO: 75675 - DNA, 20 bp, Artificial
  CRISPR gRNA sequence
cccactggtcctaggctgga

SEQ ID NO: 75676 - DNA, 20 bp, Artificial
  CRISPR gRNA sequence
ccactggtcctaggctggat

SEQ ID NO: 75677 - DNA, 20 bp, Artificial
  CRISPR gRNA sequence
gtcctaggctggattcccaa

SEQ ID NO: 75678 - DNA, 20 bp, Artificial
  CRISPR gRNA sequence
ggctggattcccaatgcgtc

SEQ ID NO: 75679 - DNA, 20 bp, Artificial
  CRISPR gRNA sequence
gattcccaatgcgtctgagc

SEQ ID NO: 75680 - DNA, 20 bp, Artificial
  CRISPR gRNA sequence
ccaatgcgtctgagcaggga

SEQ ID NO: 75681 - DNA, 20 bp, Artificial
  CRISPR gRNA sequence
agcagggactctgcatttta

SEQ ID NO: 75682 - DNA, 20 bp, Artificial
  CRISPR gRNA sequence
tgcattttactagctgtgtg

SEQ ID NO: 75683 - DNA, 20 bp, Artificial
  CRISPR gRNA sequence
cattttactagctgtgtgac

SEQ ID NO: 75684 - DNA, 20 bp, Artificial
  CRISPR gRNA sequence
tactagctgtgtgaccttgg

SEQ ID NO: 75685 - DNA, 20 bp, Artificial
  CRISPR gRNA sequence
actagctgtgtgaccttggg

SEQ ID NO: 75686 - DNA, 20 bp, Artificial
  CRISPR gRNA sequence
ctagctgtgtgaccttgggc

SEQ ID NO: 75687 - DNA, 20 bp, Artificial
  CRISPR gRNA sequence
gctgtgtgaccttgggcaag

SEQ ID NO: 75688 - DNA, 20 bp, Artificial
  CRISPR gRNA sequence
tgtgaccttgggcaagttct

SEQ ID NO: 75689 - DNA, 20 bp, Artificial
  CRISPR gRNA sequence
gggcaagttcttacaccctc

SEQ ID NO: 75690 - DNA, 20 bp, Artificial
  CRISPR gRNA sequence
ggcaagttcttacaccctct

SEQ ID NO: 75691 - DNA, 20 bp, Artificial
  CRISPR gRNA sequence
ttacaccctctgtgtctcag

SEQ ID NO: 75692 - DNA, 20 bp, Artificial
  CRISPR gRNA sequence
acaccctctgtgtctcagtt

SEQ ID NO: 75693 - DNA, 20 bp, Artificial
  CRISPR gRNA sequence
caccctctgtgtctcagttc

SEQ ID NO: 75694 - DNA, 20 bp, Artificial
  CRISPR gRNA sequence
tgtgtctcagttccctcatc

SEQ ID NO: 75695 - DNA, 20 bp, Artificial
  CRISPR gRNA sequence
tgtctcagttccctcatctg

SEQ ID NO: 75696 - DNA, 20 bp, Artificial
  CRISPR gRNA sequence
agttccctcatctgtaaaat

SEQ ID NO: 75697 - DNA, 20 bp, Artificial
  CRISPR gRNA sequence
cctcatctgtaaaatgagaa

SEQ ID NO: 75698 - DNA, 20 bp, Artificial
  CRISPR gRNA sequence
atctgtaaaatgagaacaat

SEQ ID NO: 75699 - DNA, 20 bp, Artificial
  CRISPR gRNA sequence
taaaatgagaacaatactag

SEQ ID NO: 75700 - DNA, 20 bp, Artificial
  CRISPR gRNA sequence
gtatccagggatatgggaaa

SEQ ID NO: 75701 - DNA, 20 bp, Artificial
  CRISPR gRNA sequence
agaacagtggagaaagtgct

SEQ ID NO: 75702 - DNA, 20 bp, Artificial
  CRISPR gRNA sequence
gaacagtggagaaagtgctc

SEQ ID NO: 75703 - DNA, 20 bp, Artificial
  CRISPR gRNA sequence
agtagctgttagctattatt

SEQ ID NO: 75704 - DNA, 20 bp, Artificial
  CRISPR gRNA sequence
ttagctattattattccacc

SEQ ID NO: 75705 - DNA, 20 bp, Artificial
  CRISPR gRNA sequence
gctattattattccacccat

SEQ ID NO: 75706 - DNA, 20 bp, Artificial
  CRISPR gRNA sequence
ttattattccacccatgcag

SEQ ID NO: 75707 - DNA, 20 bp, Artificial
  CRISPR gRNA sequence
ttattccacccatgcagggg

SEQ ID NO: 75708 - DNA, 20 bp, Artificial
  CRISPR gRNA sequence
ttccacccatgcaggggctg

SEQ ID NO: 75709 - DNA, 20 bp, Artificial
  CRISPR gRNA sequence
cacccatgcaggggctgact

SEQ ID NO: 75710 - DNA, 20 bp, Artificial
  CRISPR gRNA sequence
actatttgaatatccaagac

SEQ ID NO: 75711 - DNA, 20 bp, Artificial
  CRISPR gRNA sequence
tttgaatatccaagacaggc

SEQ ID NO: 75712 - DNA, 20 bp, Artificial
  CRISPR gRNA sequence
gaatatccaagacaggccac

SEQ ID NO: 75713 - DNA, 20 bp, Artificial
  CRISPR gRNA sequence
aatatccaagacaggccacg

SEQ ID NO: 75714 - DNA, 20 bp, Artificial
  CRISPR gRNA sequence
aacaatacaagagactgcaa

SEQ ID NO: 75715 - DNA, 20 bp, Artificial
  CRISPR gRNA sequence
caagaccccaccctggctgg

SEQ ID NO: 75716 - DNA, 20 bp, Artificial
  CRISPR gRNA sequence
gctggctctgcgtccctcct

SEQ ID NO: 75717 - DNA, 20 bp, Artificial
  CRISPR gRNA sequence
gctctgcgtccctcctcagg

SEQ ID NO: 75718 - DNA, 20 bp, Artificial
  CRISPR gRNA sequence
tgcgtccctcctcaggcaga

SEQ ID NO: 75719 - DNA, 20 bp, Artificial
  CRISPR gRNA sequence
cgtccctcctcaggcagagt

SEQ ID NO: 75720 - DNA, 20 bp, Artificial
  CRISPR gRNA sequence
ctcaggcagagtcatccggt

SEQ ID NO: 75721 - DNA, 20 bp, Artificial
  CRISPR gRNA sequence
aggcagagtcatccggtact

SEQ ID NO: 75722 - DNA, 20 bp, Artificial
  CRISPR gRNA sequence
ttaaccacctgctgggccaa

SEQ ID NO: 75723 - DNA, 20 bp, Artificial
  CRISPR gRNA sequence
taaccacctgctgggccaac

SEQ ID NO: 75724 - DNA, 20 bp, Artificial
  CRISPR gRNA sequence
aaccacctgctgggccaaca

SEQ ID NO: 75725 - DNA, 20 bp, Artificial
  CRISPR gRNA sequence
accacctgctgggccaacaa

SEQ ID NO: 75726 - DNA, 20 bp, Artificial
  CRISPR gRNA sequence
ctgggccaacaatgaatcct

SEQ ID NO: 75727 - DNA, 20 bp, Artificial
  CRISPR gRNA sequence
ggccaacaatgaatcctgcg

SEQ ID NO: 75728 - DNA, 20 bp, Artificial
  CRISPR gRNA sequence
cgttttagcccccatctgcc

SEQ ID NO: 75729 - DNA, 20 bp, Artificial
  CRISPR gRNA sequence
tagcccccatctgccagcag

SEQ ID NO: 75730 - DNA, 20 bp, Artificial
  CRISPR gRNA sequence
agcccccatctgccagcaga

SEQ ID NO: 75731 - DNA, 20 bp, Artificial
  CRISPR gRNA sequence
gcccccatctgccagcagag

SEQ ID NO: 75732 - DNA, 20 bp, Artificial
  CRISPR gRNA sequence
ccagcagagcttgcacatac

SEQ ID NO: 75733 - DNA, 20 bp, Artificial
  CRISPR gRNA sequence
gcacatacttgaggctgagg

SEQ ID NO: 75734 - DNA, 20 bp, Artificial
  CRISPR gRNA sequence
cacatacttgaggctgaggg

SEQ ID NO: 75735 - DNA, 20 bp, Artificial
  CRISPR gRNA sequence
gaggctgagggctgcccaag

SEQ ID NO: 75736 - DNA, 20 bp, Artificial
  CRISPR gRNA sequence
aggctgagggctgcccaagt

SEQ ID NO: 75737 - DNA, 20 bp, Artificial
  CRISPR gRNA sequence
agggctgcccaagtcagagg

SEQ ID NO: 75738 - DNA, 20 bp, Artificial
  CRISPR gRNA sequence
cccaagtcagagggcacacc

SEQ ID NO: 75739 - DNA, 20 bp, Artificial
  CRISPR gRNA sequence
gctccaccatggcgagagtg

SEQ ID NO: 75740 - DNA, 20 bp, Artificial
  CRISPR gRNA sequence
caccatggcgagagtggggg

SEQ ID NO: 75741 - DNA, 20 bp, Artificial
  CRISPR gRNA sequence
attcagggaagctttgggta

SEQ ID NO: 75742 - DNA, 20 bp, Artificial
  CRISPR gRNA sequence
agggaagctttgggtatgtg

SEQ ID NO: 75743 - DNA, 20 bp, Artificial
  CRISPR gRNA sequence
tgggtatgtgacccaggcat

SEQ ID NO: 75744 - DNA, 20 bp, Artificial
  CRISPR gRNA sequence
gggtatgtgacccaggcatc

SEQ ID NO: 75745 - DNA, 20 bp, Artificial
  CRISPR gRNA sequence
ggtatgtgacccaggcatcc

SEQ ID NO: 75746 - DNA, 20 bp, Artificial
  CRISPR gRNA sequence
acagctggtcctgagaggtg

SEQ ID NO: 75747 - DNA, 20 bp, Artificial
  CRISPR gRNA sequence
gtcctgagaggtgtaggcag

SEQ ID NO: 75748 - DNA, 20 bp, Artificial
  CRISPR gRNA sequence
agaggtgtaggcaggcacac

SEQ ID NO: 75749 - DNA, 20 bp, Artificial
  CRISPR gRNA sequence
atacccccttcagtgcccct

SEQ ID NO: 75750 - DNA, 20 bp, Artificial
  CRISPR gRNA sequence
cagtgcccctcaggcatgcg

SEQ ID NO: 75751 - DNA, 20 bp, Artificial
  CRISPR gRNA sequence
agtgcccctcaggcatgcgt

SEQ ID NO: 75752 - DNA, 20 bp, Artificial
  CRISPR gRNA sequence
aggcatgcgtccatgctcct

SEQ ID NO: 75753 - DNA, 20 bp, Artificial
  CRISPR gRNA sequence
ctctccttcctcctcctccc

SEQ ID NO: 75754 - DNA, 20 bp, Artificial
  CRISPR gRNA sequence
tccttcctcctcctccctca

SEQ ID NO: 75755 - DNA, 20 bp, Artificial
  CRISPR gRNA sequence
cttcctcctcctccctcaac

SEQ ID NO: 75756 - DNA, 20 bp, Artificial
  CRISPR gRNA sequence
cctcctcctccctcaactta

SEQ ID NO: 75757 - DNA, 20 bp, Artificial
  CRISPR gRNA sequence
ctcctcctccctcaacttac

SEQ ID NO: 75758 - DNA, 20 bp, Artificial
  CRISPR gRNA sequence
ctcctccctcaacttactcc

SEQ ID NO: 75759 - DNA, 20 bp, Artificial
  CRISPR gRNA sequence
ctccctcaacttactccacc

SEQ ID NO: 75760 - DNA, 20 bp, Artificial
  CRISPR gRNA sequence
cctcaacttactccacctgg

SEQ ID NO: 75761 - DNA, 20 bp, Artificial
  CRISPR gRNA sequence
aacttactccacctggctga

SEQ ID NO: 75762 - DNA, 20 bp, Artificial
  CRISPR gRNA sequence
actccacctggctgaggtct

SEQ ID NO: 75763 - DNA, 20 bp, Artificial
  CRISPR gRNA sequence
ctccacctggctgaggtctt

SEQ ID NO: 75764 - DNA, 20 bp, Artificial
  CRISPR gRNA sequence
cacctggctgaggtctttac

SEQ ID NO: 75765 - DNA, 20 bp, Artificial
  CRISPR gRNA sequence
gctgaggtctttacacttgc

SEQ ID NO: 75766 - DNA, 20 bp, Artificial
  CRISPR gRNA sequence
aggtctttacacttgctcag

SEQ ID NO: 75767 - DNA, 20 bp, Artificial
  CRISPR gRNA sequence
tacacttgctcagcaaccag

SEQ ID NO: 75768 - DNA, 20 bp, Artificial
  CRISPR gRNA sequence
acacttgctcagcaaccagc

SEQ ID NO: 75769 - DNA, 20 bp, Artificial
  CRISPR gRNA sequence
cacttgctcagcaaccagca

SEQ ID NO: 75770 - DNA, 20 bp, Artificial
  CRISPR gRNA sequence
gctcagcaaccagcagagtg

SEQ ID NO: 75771 - DNA, 20 bp, Artificial
  CRISPR gRNA sequence
ctcagcaaccagcagagtga

SEQ ID NO: 75772 - DNA, 20 bp, Artificial
  CRISPR gRNA sequence
agcaaccagcagagtgactc

SEQ ID NO: 75773 - DNA, 20 bp, Artificial
  CRISPR gRNA sequence
tacgtgctcctggctgaggc

SEQ ID NO: 75774 - DNA, 20 bp, Artificial
  CRISPR gRNA sequence
cgtgctcctggctgaggctg

SEQ ID NO: 75775 - DNA, 20 bp, Artificial
  CRISPR gRNA sequence
ctggctgaggctgcagcctg

SEQ ID NO: 75776 - DNA, 20 bp, Artificial
  CRISPR gRNA sequence
gctgaggctgcagcctgtga

SEQ ID NO: 75777 - DNA, 20 bp, Artificial
  CRISPR gRNA sequence
aggctgcagcctgtgaacct

SEQ ID NO: 75778 - DNA, 20 bp, Artificial
  CRISPR gRNA sequence
cagcctgtgaacctgctgga

SEQ ID NO: 75779 - DNA, 20 bp, Artificial
  CRISPR gRNA sequence
tgaacctgctggacggaggt

SEQ ID NO: 75780 - DNA, 20 bp, Artificial
  CRISPR gRNA sequence
ctggacggaggtaaagggga

SEQ ID NO: 75781 - DNA, 20 bp, Artificial
  CRISPR gRNA sequence
gacggaggtaaaggggacaa

SEQ ID NO: 75782 - DNA, 20 bp, Artificial
  CRISPR gRNA sequence
ggccactgagaccccctccg

SEQ ID NO: 75783 - DNA, 20 bp, Artificial
  CRISPR gRNA sequence
gccactgagaccccctccgg

SEQ ID NO: 75784 - DNA, 20 bp, Artificial
  CRISPR gRNA sequence
agaccccctccggcctggct

SEQ ID NO: 75785 - DNA, 20 bp, Artificial
  CRISPR gRNA sequence
cggcctggctagcccagggc

SEQ ID NO: 75786 - DNA, 20 bp, Artificial
  CRISPR gRNA sequence
gctagcccagggcacagcct

SEQ ID NO: 75787 - DNA, 20 bp, Artificial
  CRISPR gRNA sequence
gcccagggcacagcctctgg

SEQ ID NO: 75788 - DNA, 20 bp, Artificial
  CRISPR gRNA sequence
tgggctccaggtgggtctcc

SEQ ID NO: 75789 - DNA, 20 bp, Artificial
  CRISPR gRNA sequence
ggctccaggtgggtctccac

SEQ ID NO: 75790 - DNA, 20 bp, Artificial
  CRISPR gRNA sequence
caggtgggtctccactcaag

SEQ ID NO: 75791 - DNA, 20 bp, Artificial
  CRISPR gRNA sequence
cactcaagcttggaccctct

SEQ ID NO: 75792 - DNA, 20 bp, Artificial
  CRISPR gRNA sequence
aagcttggaccctctggaag

SEQ ID NO: 75793 - DNA, 20 bp, Artificial
  CRISPR gRNA sequence
ggaccctctggaagtgtcca

SEQ ID NO: 75794 - DNA, 20 bp, Artificial
  CRISPR gRNA sequence
gaccctctggaagtgtccag

SEQ ID NO: 75795 - DNA, 20 bp, Artificial
  CRISPR gRNA sequence
tggaagtgtccagaatccac

SEQ ID NO: 75796 - DNA, 20 bp, Artificial
  CRISPR gRNA sequence
gaagtgtccagaatccactg

SEQ ID NO: 75797 - DNA, 20 bp, Artificial
  CRISPR gRNA sequence
ctcccacccccacagtagat

SEQ ID NO: 75798 - DNA, 20 bp, Artificial
  CRISPR gRNA sequence
ccacccccacagtagatccc

SEQ ID NO: 75799 - DNA, 20 bp, Artificial
  CRISPR gRNA sequence
tgtttcttcatgctgggtga

SEQ ID NO: 75800 - DNA, 20 bp, Artificial
  CRISPR gRNA sequence
cttcatgctgggtgaaacaa

SEQ ID NO: 75801 - DNA, 20 bp, Artificial
  CRISPR gRNA sequence
ttcatgctgggtgaaacaag

SEQ ID NO: 75802 - DNA, 20 bp, Artificial
  CRISPR gRNA sequence
catgctgggtgaaacaagtc

SEQ ID NO: 75803 - DNA, 20 bp, Artificial
  CRISPR gRNA sequence
atgctgggtgaaacaagtcc

SEQ ID NO: 75804 - DNA, 20 bp, Artificial
  CRISPR gRNA sequence
ggtgaaacaagtccctctgc

SEQ ID NO: 75805 - DNA, 20 bp, Artificial
  CRISPR gRNA sequence
tgcagggttgttccagggga

SEQ ID NO: 75806 - DNA, 20 bp, Artificial
  CRISPR gRNA sequence
cagggttgttccaggggaat

SEQ ID NO: 75807 - DNA, 20 bp, Artificial
  CRISPR gRNA sequence
ttccaggggaatgttttgtg

SEQ ID NO: 75808 - DNA, 20 bp, Artificial
  CRISPR gRNA sequence
caggggaatgttttgtggta

SEQ ID NO: 75809 - DNA, 20 bp, Artificial
  CRISPR gRNA sequence
tgtggtaggcagtctgcata

SEQ ID NO: 75810 - DNA, 20 bp, Artificial
  CRISPR gRNA sequence
gtggtaggcagtctgcatac

SEQ ID NO: 75811 - DNA, 20 bp, Artificial
  CRISPR gRNA sequence
tggtaggcagtctgcatact

SEQ ID NO: 75812 - DNA, 20 bp, Artificial
  CRISPR gRNA sequence
catactgctctggccaccca

SEQ ID NO: 75813 - DNA, 20 bp, Artificial
  CRISPR gRNA sequence
ctctggccacccaggaggca

SEQ ID NO: 75814 - DNA, 20 bp, Artificial
  CRISPR gRNA sequence
tggccacccaggaggcagat

SEQ ID NO: 75815 - DNA, 20 bp, Artificial
  CRISPR gRNA sequence
gccacccaggaggcagatct

SEQ ID NO: 75816 - DNA, 20 bp, Artificial
  CRISPR gRNA sequence
ctggtccccaacatcaacta

SEQ ID NO: 75817 - DNA, 20 bp, Artificial
  CRISPR gRNA sequence
gtccccaacatcaactagct

SEQ ID NO: 75818 - DNA, 20 bp, Artificial
  CRISPR gRNA sequence
gctgcctaggcatggttcaa

SEQ ID NO: 75819 - DNA, 20 bp, Artificial
  CRISPR gRNA sequence
cctaggcatggttcaagggg

SEQ ID NO: 75820 - DNA, 20 bp, Artificial
  CRISPR gRNA sequence
ggcatggttcaagggggctt

SEQ ID NO: 75821 - DNA, 20 bp, Artificial
  CRISPR gRNA sequence
aagggggcttacccacagca

SEQ ID NO: 75822 - DNA, 20 bp, Artificial
  CRISPR gRNA sequence
acccacagcacacgccttcc

SEQ ID NO: 75823 - DNA, 20 bp, Artificial
  CRISPR gRNA sequence
cccacagcacacgccttcct

SEQ ID NO: 75824 - DNA, 20 bp, Artificial
  CRISPR gRNA sequence
cctcctcctcgttggatctg

SEQ ID NO: 75825 - DNA, 20 bp, Artificial
  CRISPR gRNA sequence
ctcctcctcgttggatctga

SEQ ID NO: 75826 - DNA, 20 bp, Artificial
  CRISPR gRNA sequence
ctcctcgttggatctgaagt

SEQ ID NO: 75827 - DNA, 20 bp, Artificial
  CRISPR gRNA sequence
ctcgttggatctgaagtgca

SEQ ID NO: 75828 - DNA, 20 bp, Artificial
  CRISPR gRNA sequence
gttggatctgaagtgcaaag

SEQ ID NO: 75829 - DNA, 20 bp, Artificial
  CRISPR gRNA sequence
gatctgaagtgcaaagttgc

SEQ ID NO: 75830 - DNA, 20 bp, Artificial
  CRISPR gRNA sequence
aagtgcaaagttgcatggtg

SEQ ID NO: 75831 - DNA, 20 bp, Artificial
  CRISPR gRNA sequence
catggtgcagggacctggat

SEQ ID NO: 75832 - DNA, 20 bp, Artificial
  CRISPR gRNA sequence
gatcagacaggacctgggtc

SEQ ID NO: 75833 - DNA, 20 bp, Artificial
  CRISPR gRNA sequence
ggtcagacagctgtggccac

SEQ ID NO: 75834 - DNA, 20 bp, Artificial
  CRISPR gRNA sequence
tggccacagcctcaggatgc

SEQ ID NO: 75835 - DNA, 20 bp, Artificial
  CRISPR gRNA sequence
aggatgcccccacggggcca

SEQ ID NO: 75836 - DNA, 20 bp, Artificial
  CRISPR gRNA sequence
ctccggaagcccagcctcta

SEQ ID NO: 75837 - DNA, 20 bp, Artificial
  CRISPR gRNA sequence
cggaagcccagcctctagtt

SEQ ID NO: 75838 - DNA, 20 bp, Artificial
  CRISPR gRNA sequence
tagttgggtcctactgtctt

SEQ ID NO: 75839 - DNA, 20 bp, Artificial
  CRISPR gRNA sequence
gttgggtcctactgtcttca

SEQ ID NO: 75840 - DNA, 20 bp, Artificial
  CRISPR gRNA sequence
ggtcctactgtcttcatcct

SEQ ID NO: 75841 - DNA, 20 bp, Artificial
  CRISPR gRNA sequence
ctgtcttcatcctaccccct

SEQ ID NO: 75842 - DNA, 20 bp, Artificial
  CRISPR gRNA sequence
tcttcatcctaccccctcat

SEQ ID NO: 75843 - DNA, 20 bp, Artificial
  CRISPR gRNA sequence
catcctaccccctcataccc

SEQ ID NO: 75844 - DNA, 20 bp, Artificial
  CRISPR gRNA sequence
atcctaccccctcataccca

SEQ ID NO: 75845 - DNA, 20 bp, Artificial
  CRISPR gRNA sequence
ccccctcatacccaccagac

SEQ ID NO: 75846 - DNA, 20 bp, Artificial
  CRISPR gRNA sequence
atacccaccagactccaggc

SEQ ID NO: 75847 - DNA, 20 bp, Artificial
  CRISPR gRNA sequence
caggcacaacccttcaggac

SEQ ID NO: 75848 - DNA, 20 bp, Artificial
  CRISPR gRNA sequence
caggacgagtcctggctgtc

SEQ ID NO: 75849 - DNA, 20 bp, Artificial
  CRISPR gRNA sequence
aggacgagtcctggctgtcc

SEQ ID NO: 75850 - DNA, 20 bp, Artificial
  CRISPR gRNA sequence
gctgtcccaggggaatgccc

SEQ ID NO: 75851 - DNA, 20 bp, Artificial
  CRISPR gRNA sequence
tcccaggggaatgcccacct

SEQ ID NO: 75852 - DNA, 20 bp, Artificial
  CRISPR gRNA sequence
agatccacctttttaacccg

SEQ ID NO: 75853 - DNA, 20 bp, Artificial
  CRISPR gRNA sequence
tttaacccgtggacacaggc

SEQ ID NO: 75854 - DNA, 20 bp, Artificial
  CRISPR gRNA sequence
ttaacccgtggacacaggct

SEQ ID NO: 75855 - DNA, 20 bp, Artificial
  CRISPR gRNA sequence
taacccgtggacacaggctt

SEQ ID NO: 75856 - DNA, 20 bp, Artificial
  CRISPR gRNA sequence
aacccgtggacacaggctta

SEQ ID NO: 75857 - DNA, 20 bp, Artificial
  CRISPR gRNA sequence
acccgtggacacaggcttaa

SEQ ID NO: 75858 - DNA, 20 bp, Artificial
  CRISPR gRNA sequence
aaggtgttggccagcaggaa

SEQ ID NO: 75859 - DNA, 20 bp, Artificial
  CRISPR gRNA sequence
aggtgttggccagcaggaag

SEQ ID NO: 75860 - DNA, 20 bp, Artificial
  CRISPR gRNA sequence
gccagcaggaaggggctttt

SEQ ID NO: 75861 - DNA, 20 bp, Artificial
  CRISPR gRNA sequence
ttcggggacagtcccgtctg

SEQ ID NO: 75862 - DNA, 20 bp, Artificial
  CRISPR gRNA sequence
tcggggacagtcccgtctgg

SEQ ID NO: 75863 - DNA, 20 bp, Artificial
  CRISPR gRNA sequence
cggggacagtcccgtctggc

SEQ ID NO: 75864 - DNA, 20 bp, Artificial
  CRISPR gRNA sequence
ggggacagtcccgtctggct

SEQ ID NO: 75865 - DNA, 20 bp, Artificial
  CRISPR gRNA sequence
gctcagcctgaaaaggaaag

SEQ ID NO: 75866 - DNA, 20 bp, Artificial
  CRISPR gRNA sequence
agcctgaaaaggaaaggggg

SEQ ID NO: 75867 - DNA, 20 bp, Artificial
  CRISPR gRNA sequence
aaaaggaaagggggtagatc

SEQ ID NO: 75868 - DNA, 20 bp, Artificial
  CRISPR gRNA sequence
gctagcctggagggtaagga

SEQ ID NO: 75869 - DNA, 20 bp, Artificial
  CRISPR gRNA sequence
gcctggagggtaaggaaagg

SEQ ID NO: 75870 - DNA, 20 bp, Artificial
  CRISPR gRNA sequence
gagggtaaggaaagggaggg

SEQ ID NO: 75871 - DNA, 20 bp, Artificial
  CRISPR gRNA sequence
gcagctcagcaaggcaatag

SEQ ID NO: 75872 - DNA, 20 bp, Artificial
  CRISPR gRNA sequence
agcaaggcaatagggaagca

SEQ ID NO: 75873 - DNA, 20 bp, Artificial
  CRISPR gRNA sequence
agggacaggcagatttggat

SEQ ID NO: 75874 - DNA, 20 bp, Artificial
  CRISPR gRNA sequence
ggatttgagtcccagttctg

SEQ ID NO: 75875 - DNA, 20 bp, Artificial
  CRISPR gRNA sequence
gatttgagtcccagttctgc

SEQ ID NO: 75876 - DNA, 20 bp, Artificial
  CRISPR gRNA sequence
gagtcccagttctgcttatt

SEQ ID NO: 75877 - DNA, 20 bp, Artificial
  CRISPR gRNA sequence
agtcccagttctgcttattg

SEQ ID NO: 75878 - DNA, 20 bp, Artificial
  CRISPR gRNA sequence
tgcttattggctgtgtgacc

SEQ ID NO: 75879 - DNA, 20 bp, Artificial
  CRISPR gRNA sequence
cttattggctgtgtgacctt

SEQ ID NO: 75880 - DNA, 20 bp, Artificial
  CRISPR gRNA sequence
attggctgtgtgaccttgga

SEQ ID NO: 75881 - DNA, 20 bp, Artificial
  CRISPR gRNA sequence
ttggctgtgtgaccttggag

SEQ ID NO: 75882 - DNA, 20 bp, Artificial
  CRISPR gRNA sequence
gctgtgtgaccttggagaag

SEQ ID NO: 75883 - DNA, 20 bp, Artificial
  CRISPR gRNA sequence
tgtgaccttggagaagtgac

SEQ ID NO: 75884 - DNA, 20 bp, Artificial
  CRISPR gRNA sequence
ggagaagtgacttcacctct

SEQ ID NO: 75885 - DNA, 20 bp, Artificial
  CRISPR gRNA sequence
gagaagtgacttcacctctc

SEQ ID NO: 75886 - DNA, 20 bp, Artificial
  CRISPR gRNA sequence
cacctctctgagcttcagtt

SEQ ID NO: 75887 - DNA, 20 bp, Artificial
  CRISPR gRNA sequence
acctctctgagcttcagttt

SEQ ID NO: 75888 - DNA, 20 bp, Artificial
  CRISPR gRNA sequence
tctgagcttcagtttcctta

SEQ ID NO: 75889 - DNA, 20 bp, Artificial
  CRISPR gRNA sequence
tgagcttcagtttccttatc

SEQ ID NO: 75890 - DNA, 20 bp, Artificial
  CRISPR gRNA sequence
agcttcagtttccttatctg

SEQ ID NO: 75891 - DNA, 20 bp, Artificial
  CRISPR gRNA sequence
cagtttccttatctggaaat

SEQ ID NO: 75892 - DNA, 20 bp, Artificial
  CRISPR gRNA sequence
agtttccttatctggaaatc

SEQ ID NO: 75893 - DNA, 20 bp, Artificial
  CRISPR gRNA sequence
ccttatctggaaatcaagac

SEQ ID NO: 75894 - DNA, 20 bp, Artificial
  CRISPR gRNA sequence
cttatctggaaatcaagact

SEQ ID NO: 75895 - DNA, 20 bp, Artificial
  CRISPR gRNA sequence
atctggaaatcaagactcgt

SEQ ID NO: 75896 - DNA, 20 bp, Artificial
  CRISPR gRNA sequence
tctggaaatcaagactcgtc

SEQ ID NO: 75897 - DNA, 20 bp, Artificial
  CRISPR gRNA sequence
gaaatcaagactcgtcatgt

SEQ ID NO: 75898 - DNA, 20 bp, Artificial
  CRISPR gRNA sequence
gtcatgtatgactctcgagg

SEQ ID NO: 75899 - DNA, 20 bp, Artificial
  CRISPR gRNA sequence
tcgaggtatatgaggattta

SEQ ID NO: 75900 - DNA, 20 bp, Artificial
  CRISPR gRNA sequence
gaggtatatgaggatttaat

SEQ ID NO: 75901 - DNA, 20 bp, Artificial
  CRISPR gRNA sequence
aattacatcatgcaggtgca

SEQ ID NO: 75902 - DNA, 20 bp, Artificial
  CRISPR gRNA sequence
attacatcatgcaggtgcac

SEQ ID NO: 75903 - DNA, 20 bp, Artificial
  CRISPR gRNA sequence
catcatgcaggtgcactgcc

SEQ ID NO: 75904 - DNA, 20 bp, Artificial
  CRISPR gRNA sequence
ccgggcatgggacctgtgct

SEQ ID NO: 75905 - DNA, 20 bp, Artificial
  CRISPR gRNA sequence
tgcttgctgttattattact

SEQ ID NO: 75906 - DNA, 20 bp, Artificial
  CRISPR gRNA sequence
gctgttattattactattgt

SEQ ID NO: 75907 - DNA, 20 bp, Artificial
  CRISPR gRNA sequence
ctgttattattactattgtt

SEQ ID NO: 75908 - DNA, 20 bp, Artificial
  CRISPR gRNA sequence
ttattattactattgttttt

SEQ ID NO: 75909 - DNA, 20 bp, Artificial
  CRISPR gRNA sequence
ttattactattgtttttacc

SEQ ID NO: 75910 - DNA, 20 bp, Artificial
  CRISPR gRNA sequence
ttactattgtttttacctgc

SEQ ID NO: 75911 - DNA, 20 bp, Artificial
  CRISPR gRNA sequence
ctattgtttttacctgcaag

SEQ ID NO: 75912 - DNA, 20 bp, Artificial
  CRISPR gRNA sequence
ttgtttttacctgcaagcac

SEQ ID NO: 75913 - DNA, 20 bp, Artificial
  CRISPR gRNA sequence
tttttacctgcaagcacaga

SEQ ID NO: 75914 - DNA, 20 bp, Artificial
  CRISPR gRNA sequence
ttacctgcaagcacagattt

SEQ ID NO: 75915 - DNA, 20 bp, Artificial
  CRISPR gRNA sequence
tacctgcaagcacagatttc

SEQ ID NO: 75916 - DNA, 20 bp, Artificial
  CRISPR gRNA sequence
acctgcaagcacagatttca

SEQ ID NO: 75917 - DNA, 20 bp, Artificial
  CRISPR gRNA sequence
cctgcaagcacagatttcac

SEQ ID NO: 75918 - DNA, 20 bp, Artificial
  CRISPR gRNA sequence
caagcacagatttcacaggc

SEQ ID NO: 75919 - DNA, 20 bp, Artificial
  CRISPR gRNA sequence
cacaggcgagtccttgctca

SEQ ID NO: 75920 - DNA, 20 bp, Artificial
  CRISPR gRNA sequence
acaggcgagtccttgctcac

SEQ ID NO: 75921 - DNA, 20 bp, Artificial
  CRISPR gRNA sequence
gctcacagagagtgggaagc

SEQ ID NO: 75922 - DNA, 20 bp, Artificial
  CRISPR gRNA sequence
ctcacagagagtgggaagct

SEQ ID NO: 75923 - DNA, 20 bp, Artificial
  CRISPR gRNA sequence
acagagagtgggaagcttca

SEQ ID NO: 75924 - DNA, 20 bp, Artificial
  CRISPR gRNA sequence
caggcccttcagacacagtt

SEQ ID NO: 75925 - DNA, 20 bp, Artificial
  CRISPR gRNA sequence
aggcccttcagacacagttt

SEQ ID NO: 75926 - DNA, 20 bp, Artificial
  CRISPR gRNA sequence
cagacacagtttttaaacct

SEQ ID NO: 75927 - DNA, 20 bp, Artificial
  CRISPR gRNA sequence
agacacagtttttaaacctt

SEQ ID NO: 75928 - DNA, 20 bp, Artificial
  CRISPR gRNA sequence
ttaaaccttagcactattga

SEQ ID NO: 75929 - DNA, 20 bp, Artificial
  CRISPR gRNA sequence
taaaccttagcactattgag

SEQ ID NO: 75930 - DNA, 20 bp, Artificial
  CRISPR gRNA sequence
aaaccttagcactattgaga

SEQ ID NO: 75931 - DNA, 20 bp, Artificial
  CRISPR gRNA sequence
aaccttagcactattgagat

SEQ ID NO: 75932 - DNA, 20 bp, Artificial
  CRISPR gRNA sequence
agcactattgagatgtgagg

SEQ ID NO: 75933 - DNA, 20 bp, Artificial
  CRISPR gRNA sequence
gcactattgagatgtgaggt

SEQ ID NO: 75934 - DNA, 20 bp, Artificial
  CRISPR gRNA sequence
ttgagatgtgaggtccaata

SEQ ID NO: 75935 - DNA, 20 bp, Artificial
  CRISPR gRNA sequence
agatgtgaggtccaataatt

SEQ ID NO: 75936 - DNA, 20 bp, Artificial
  CRISPR gRNA sequence
tttgttgtgggctctcctgt

SEQ ID NO: 75937 - DNA, 20 bp, Artificial
  CRISPR gRNA sequence
tgttgtgggctctcctgtgc

SEQ ID NO: 75938 - DNA, 20 bp, Artificial
  CRISPR gRNA sequence
gttgtgggctctcctgtgcc

SEQ ID NO: 75939 - DNA, 20 bp, Artificial
  CRISPR gRNA sequence
ttgtgggctctcctgtgccc

SEQ ID NO: 75940 - DNA, 20 bp, Artificial
  CRISPR gRNA sequence
tgggctctcctgtgccctat

SEQ ID NO: 75941 - DNA, 20 bp, Artificial
  CRISPR gRNA sequence
tcctgtgccctataggatgt

SEQ ID NO: 75942 - DNA, 20 bp, Artificial
  CRISPR gRNA sequence
ctgtgccctataggatgttc

SEQ ID NO: 75943 - DNA, 20 bp, Artificial
  CRISPR gRNA sequence
tgccctataggatgttcagc

SEQ ID NO: 75944 - DNA, 20 bp, Artificial
  CRISPR gRNA sequence
taggatgttcagcagcatcc

SEQ ID NO: 75945 - DNA, 20 bp, Artificial
  CRISPR gRNA sequence
agcagcatcccagatctcta

SEQ ID NO: 75946 - DNA, 20 bp, Artificial
  CRISPR gRNA sequence
tattcattcgatgccagtag

SEQ ID NO: 75947 - DNA, 20 bp, Artificial
  CRISPR gRNA sequence
ttcattcgatgccagtagca

SEQ ID NO: 75948 - DNA, 20 bp, Artificial
  CRISPR gRNA sequence
attcgatgccagtagcagca

SEQ ID NO: 75949 - DNA, 20 bp, Artificial
  CRISPR gRNA sequence
gatgccagtagcagcacccc

SEQ ID NO: 75950 - DNA, 20 bp, Artificial
  CRISPR gRNA sequence
acccgcagtcatgaccacca

SEQ ID NO: 75951 - DNA, 20 bp, Artificial
  CRISPR gRNA sequence
cagatatttccaaatgactc

SEQ ID NO: 75952 - DNA, 20 bp, Artificial
  CRISPR gRNA sequence
ccaaatgactcccaagggtg

SEQ ID NO: 75953 - DNA, 20 bp, Artificial
  CRISPR gRNA sequence
caaatgactcccaagggtga

SEQ ID NO: 75954 - DNA, 20 bp, Artificial
  CRISPR gRNA sequence
ccaagggtgaaaatcacccc

SEQ ID NO: 75955 - DNA, 20 bp, Artificial
  CRISPR gRNA sequence
gaaaccactgccttagagaa

SEQ ID NO: 75956 - DNA, 20 bp, Artificial
  CRISPR gRNA sequence
ccttagagaaagtgagatgg

SEQ ID NO: 75957 - DNA, 20 bp, Artificial
  CRISPR gRNA sequence
agagaaagtgagatgggtcc

SEQ ID NO: 75958 - DNA, 20 bp, Artificial
  CRISPR gRNA sequence
gagaaagtgagatgggtcca

SEQ ID NO: 75959 - DNA, 20 bp, Artificial
  CRISPR gRNA sequence
tgccctcagaggcagcctca

SEQ ID NO: 75960 - DNA, 20 bp, Artificial
  CRISPR gRNA sequence
ccctcagaggcagcctcagc

SEQ ID NO: 75961 - DNA, 20 bp, Artificial
  CRISPR gRNA sequence
agaggcagcctcagcacctc

SEQ ID NO: 75962 - DNA, 20 bp, Artificial
  CRISPR gRNA sequence
agcacctccatttgcctcat

SEQ ID NO: 75963 - DNA, 20 bp, Artificial
  CRISPR gRNA sequence
catttgcctcatccagtaat

SEQ ID NO: 75964 - DNA, 20 bp, Artificial
  CRISPR gRNA sequence
gcctcatccagtaatccccc

SEQ ID NO: 75965 - DNA, 20 bp, Artificial
  CRISPR gRNA sequence
cctcatccagtaatccccct

SEQ ID NO: 75966 - DNA, 20 bp, Artificial
  CRISPR gRNA sequence
atccagtaatccccctatca

SEQ ID NO: 75967 - DNA, 20 bp, Artificial
  CRISPR gRNA sequence
tcagcttgtctgtaaattcc

SEQ ID NO: 75968 - DNA, 20 bp, Artificial
  CRISPR gRNA sequence
gtctgtaaattccactctca

SEQ ID NO: 75969 - DNA, 20 bp, Artificial
  CRISPR gRNA sequence
tctgtaaattccactctcaa

SEQ ID NO: 75970 - DNA, 20 bp, Artificial
  CRISPR gRNA sequence
taaattccactctcaagatc

SEQ ID NO: 75971 - DNA, 20 bp, Artificial
  CRISPR gRNA sequence
cactctcaagatccaccctg

SEQ ID NO: 75972 - DNA, 20 bp, Artificial
  CRISPR gRNA sequence
tcaagatccaccctgagtct

SEQ ID NO: 75973 - DNA, 20 bp, Artificial
  CRISPR gRNA sequence
aagatccaccctgagtctac

SEQ ID NO: 75974 - DNA, 20 bp, Artificial
  CRISPR gRNA sequence
agtctaccaacttctatccc

SEQ ID NO: 75975 - DNA, 20 bp, Artificial
  CRISPR gRNA sequence
ccaacttctatcccacccca

SEQ ID NO: 75976 - DNA, 20 bp, Artificial
  CRISPR gRNA sequence
ctatcccaccccagcagtga

SEQ ID NO: 75977 - DNA, 20 bp, Artificial
  CRISPR gRNA sequence
tatcccaccccagcagtgat

SEQ ID NO: 75978 - DNA, 20 bp, Artificial
  CRISPR gRNA sequence
tcccaccccagcagtgatca

SEQ ID NO: 75979 - DNA, 20 bp, Artificial
  CRISPR gRNA sequence
caccctgctgcacacatctc

SEQ ID NO: 75980 - DNA, 20 bp, Artificial
  CRISPR gRNA sequence
accctgctgcacacatctct

SEQ ID NO: 75981 - DNA, 20 bp, Artificial
  CRISPR gRNA sequence
ctgcacacatctcttcccac

SEQ ID NO: 75982 - DNA, 20 bp, Artificial
  CRISPR gRNA sequence
cacacatctcttcccactct

SEQ ID NO: 75983 - DNA, 20 bp, Artificial
  CRISPR gRNA sequence
ttcccactctcatttccact

SEQ ID NO: 75984 - DNA, 20 bp, Artificial
  CRISPR gRNA sequence
cccactctcatttccactcg

SEQ ID NO: 75985 - DNA, 20 bp, Artificial
  CRISPR gRNA sequence
ccactctcatttccactcgt

SEQ ID NO: 75986 - DNA, 20 bp, Artificial
  CRISPR gRNA sequence
tcatttccactcgtatctcc

SEQ ID NO: 75987 - DNA, 20 bp, Artificial
  CRISPR gRNA sequence
atttccactcgtatctccca

SEQ ID NO: 75988 - DNA, 20 bp, Artificial
  CRISPR gRNA sequence
ccactcgtatctcccaatcc

SEQ ID NO: 75989 - DNA, 20 bp, Artificial
  CRISPR gRNA sequence
cactcgtatctcccaatcca

SEQ ID NO: 75990 - DNA, 20 bp, Artificial
  CRISPR gRNA sequence
gtatctcccaatccattctc

SEQ ID NO: 75991 - DNA, 20 bp, Artificial
  CRISPR gRNA sequence
ccaatccattctctacccag

SEQ ID NO: 75992 - DNA, 20 bp, Artificial
  CRISPR gRNA sequence
tctacccagcactcagtctg

SEQ ID NO: 75993 - DNA, 20 bp, Artificial
  CRISPR gRNA sequence
tacccagcactcagtctgaa

SEQ ID NO: 75994 - DNA, 20 bp, Artificial
  CRISPR gRNA sequence
cccagcactcagtctgaact

SEQ ID NO: 75995 - DNA, 20 bp, Artificial
  CRISPR gRNA sequence
agtctgaacttttgaaaacc

SEQ ID NO: 75996 - DNA, 20 bp, Artificial
  CRISPR gRNA sequence
aacttttgaaaacccaaatg

SEQ ID NO: 75997 - DNA, 20 bp, Artificial
  CRISPR gRNA sequence
ttgaaaacccaaatgaggaa

SEQ ID NO: 75998 - DNA, 20 bp, Artificial
  CRISPR gRNA sequence
tgaaaacccaaatgaggaac

SEQ ID NO: 75999 - DNA, 20 bp, Artificial
  CRISPR gRNA sequence
gaaaacccaaatgaggaacg

SEQ ID NO: 76000 - DNA, 20 bp, Artificial
  CRISPR gRNA sequence
aaaacccaaatgaggaacgg

SEQ ID NO: 76001 - DNA, 20 bp, Artificial
  CRISPR gRNA sequence
ctgcctgtaatctcagtact

SEQ ID NO: 76002 - DNA, 20 bp, Artificial
  CRISPR gRNA sequence
cctgtaatctcagtactttg

SEQ ID NO: 76003 - DNA, 20 bp, Artificial
  CRISPR gRNA sequence
taatctcagtactttgggaa

SEQ ID NO: 76004 - DNA, 20 bp, Artificial
  CRISPR gRNA sequence
agtactttgggaagccgagg

SEQ ID NO: 76005 - DNA, 20 bp, Artificial
  CRISPR gRNA sequence
tgggaagccgaggcgggcgg

SEQ ID NO: 76006 - DNA, 20 bp, Artificial
  CRISPR gRNA sequence
gggaagccgaggcgggcgga

SEQ ID NO: 76007 - DNA, 20 bp, Artificial
  CRISPR gRNA sequence
ggaagccgaggcgggcggat

SEQ ID NO: 76008 - DNA, 20 bp, Artificial
  CRISPR gRNA sequence
gaggtcgggagtttgagacc

SEQ ID NO: 76009 - DNA, 20 bp, Artificial
  CRISPR gRNA sequence
aggtcgggagtttgagacca

SEQ ID NO: 76010 - DNA, 20 bp, Artificial
  CRISPR gRNA sequence
gagaccagcatggtcaacat

SEQ ID NO: 76011 - DNA, 20 bp, Artificial
  CRISPR gRNA sequence
agaccagcatggtcaacatg

SEQ ID NO: 76012 - DNA, 20 bp, Artificial
  CRISPR gRNA sequence
aactctgtctctactaaaaa

SEQ ID NO: 76013 - DNA, 20 bp, Artificial
  CRISPR gRNA sequence
tgtctctactaaaaatacaa

SEQ ID NO: 76014 - DNA, 20 bp, Artificial
  CRISPR gRNA sequence
tctctactaaaaatacaaaa

SEQ ID NO: 76015 - DNA, 20 bp, Artificial
  CRISPR gRNA sequence
tactaaaaatacaaaaatta

SEQ ID NO: 76016 - DNA, 20 bp, Artificial
  CRISPR gRNA sequence
ctaaaaatacaaaaattagc

SEQ ID NO: 76017 - DNA, 20 bp, Artificial
  CRISPR gRNA sequence
aaaatacaaaaattagctgg

SEQ ID NO: 76018 - DNA, 20 bp, Artificial
  CRISPR gRNA sequence
gctgggcatgatggtgcacg

SEQ ID NO: 76019 - DNA, 20 bp, Artificial
  CRISPR gRNA sequence
ggcatgatggtgcacgcctg

SEQ ID NO: 76020 - DNA, 20 bp, Artificial
  CRISPR gRNA sequence
taatcccagctacttgggag

SEQ ID NO: 76021 - DNA, 20 bp, Artificial
  CRISPR gRNA sequence
cttgggaggctgaggcacaa

SEQ ID NO: 76022 - DNA, 20 bp, Artificial
  CRISPR gRNA sequence
gggaggctgaggcacaagaa

SEQ ID NO: 76023 - DNA, 20 bp, Artificial
  CRISPR gRNA sequence
ggaggctgaggcacaagaat

SEQ ID NO: 76024 - DNA, 20 bp, Artificial
  CRISPR gRNA sequence
aggcacaagaattgcctgaa

SEQ ID NO: 76025 - DNA, 20 bp, Artificial
  CRISPR gRNA sequence
cctgaacctgggaggcggag

SEQ ID NO: 76026 - DNA, 20 bp, Artificial
  CRISPR gRNA sequence
aacctgggaggcggaggttg

SEQ ID NO: 76027 - DNA, 20 bp, Artificial
  CRISPR gRNA sequence
ggaggcggaggttgcagtga

SEQ ID NO: 76028 - DNA, 20 bp, Artificial
  CRISPR gRNA sequence
cagtgagccgagattgcgcc

SEQ ID NO: 76029 - DNA, 20 bp, Artificial
  CRISPR gRNA sequence
cgccattgcactccagcctg

SEQ ID NO: 76030 - DNA, 20 bp, Artificial
  CRISPR gRNA sequence
cactccagcctgtgtgacag

SEQ ID NO: 76031 - DNA, 20 bp, Artificial
  CRISPR gRNA sequence
cagcctgtgtgacagagcga

SEQ ID NO: 76032 - DNA, 20 bp, Artificial
  CRISPR gRNA sequence
tgtgacagagcgagaccctc

SEQ ID NO: 76033 - DNA, 20 bp, Artificial
  CRISPR gRNA sequence
ccccacaaaaaagaaagaaa

SEQ ID NO: 76034 - DNA, 20 bp, Artificial
  CRISPR gRNA sequence
ttcctctccctttcatgttc

SEQ ID NO: 76035 - DNA, 20 bp, Artificial
  CRISPR gRNA sequence
ctctccctttcatgttccca

SEQ ID NO: 76036 - DNA, 20 bp, Artificial
  CRISPR gRNA sequence
tccctttcatgttcccagga

SEQ ID NO: 76037 - DNA, 20 bp, Artificial
  CRISPR gRNA sequence
cctttcatgttcccaggaac

SEQ ID NO: 76038 - DNA, 20 bp, Artificial
  CRISPR gRNA sequence
tcatgttcccaggaacaaaa

SEQ ID NO: 76039 - DNA, 20 bp, Artificial
  CRISPR gRNA sequence
catgttcccaggaacaaaag

SEQ ID NO: 76040 - DNA, 20 bp, Artificial
  CRISPR gRNA sequence
atgttcccaggaacaaaagt

SEQ ID NO: 76041 - DNA, 20 bp, Artificial
  CRISPR gRNA sequence
ccaggaacaaaagtctaaac

SEQ ID NO: 76042 - DNA, 20 bp, Artificial
  CRISPR gRNA sequence
aactctccccatgggtgcca

SEQ ID NO: 76043 - DNA, 20 bp, Artificial
  CRISPR gRNA sequence
tccccatgggtgccaggccc

SEQ ID NO: 76044 - DNA, 20 bp, Artificial
  CRISPR gRNA sequence
cccatgggtgccaggcccca

SEQ ID NO: 76045 - DNA, 20 bp, Artificial
  CRISPR gRNA sequence
tctcttcctcctctcctagg

SEQ ID NO: 76046 - DNA, 20 bp, Artificial
  CRISPR gRNA sequence
tcttcctcctctcctaggac

SEQ ID NO: 76047 - DNA, 20 bp, Artificial
  CRISPR gRNA sequence
ttcctcctctcctaggactg

SEQ ID NO: 76048 - DNA, 20 bp, Artificial
  CRISPR gRNA sequence
cctcctctcctaggactgtc

SEQ ID NO: 76049 - DNA, 20 bp, Artificial
  CRISPR gRNA sequence
ctcctctcctaggactgtcc

SEQ ID NO: 76050 - DNA, 20 bp, Artificial
  CRISPR gRNA sequence
ctctcctaggactgtccctg

SEQ ID NO: 76051 - DNA, 20 bp, Artificial
  CRISPR gRNA sequence
tcctaggactgtccctgcca

SEQ ID NO: 76052 - DNA, 20 bp, Artificial
  CRISPR gRNA sequence
ctaggactgtccctgccagt

SEQ ID NO: 76053 - DNA, 20 bp, Artificial
  CRISPR gRNA sequence
ggactgtccctgccagtcac

SEQ ID NO: 76054 - DNA, 20 bp, Artificial
  CRISPR gRNA sequence
tccctgccagtcactgtgct

SEQ ID NO: 76055 - DNA, 20 bp, Artificial
  CRISPR gRNA sequence
ccagtcactgtgctctggct

SEQ ID NO: 76056 - DNA, 20 bp, Artificial
  CRISPR gRNA sequence
tgctctggctgtctcggttc

SEQ ID NO: 76057 - DNA, 20 bp, Artificial
  CRISPR gRNA sequence
tggctgtctcggttccgcgc

SEQ ID NO: 76058 - DNA, 20 bp, Artificial
  CRISPR gRNA sequence
gctgtctcggttccgcgctg

SEQ ID NO: 76059 - DNA, 20 bp, Artificial
  CRISPR gRNA sequence
tctcggttccgcgctgttcc

SEQ ID NO: 76060 - DNA, 20 bp, Artificial
  CRISPR gRNA sequence
ggttccgcgctgttcctgga

SEQ ID NO: 76061 - DNA, 20 bp, Artificial
  CRISPR gRNA sequence
cgcgctgttcctggagccca

SEQ ID NO: 76062 - DNA, 20 bp, Artificial
  CRISPR gRNA sequence
ttcctggagcccaccaagct

SEQ ID NO: 76063 - DNA, 20 bp, Artificial
  CRISPR gRNA sequence
ctggagcccaccaagcttaa

SEQ ID NO: 76064 - DNA, 20 bp, Artificial
  CRISPR gRNA sequence
gagcccaccaagcttaatca

SEQ ID NO: 76065 - DNA, 20 bp, Artificial
  CRISPR gRNA sequence
aatcatgcctcagggcctca

SEQ ID NO: 76066 - DNA, 20 bp, Artificial
  CRISPR gRNA sequence
atcatgcctcagggcctcac

SEQ ID NO: 76067 - DNA, 20 bp, Artificial
  CRISPR gRNA sequence
agggcctcacacatgccgtt

SEQ ID NO: 76068 - DNA, 20 bp, Artificial
  CRISPR gRNA sequence
acacatgccgttccctctgc

SEQ ID NO: 76069 - DNA, 20 bp, Artificial
  CRISPR gRNA sequence
cctctgcctggaatgcagtt

SEQ ID NO: 76070 - DNA, 20 bp, Artificial
  CRISPR gRNA sequence
tgcctggaatgcagttccct

SEQ ID NO: 76071 - DNA, 20 bp, Artificial
  CRISPR gRNA sequence
cctggaatgcagttccctgc

SEQ ID NO: 76072 - DNA, 20 bp, Artificial
  CRISPR gRNA sequence
gaatgcagttccctgctctt

SEQ ID NO: 76073 - DNA, 20 bp, Artificial
  CRISPR gRNA sequence
cctgctcttcacaaggcgag

SEQ ID NO: 76074 - DNA, 20 bp, Artificial
  CRISPR gRNA sequence
ctcttcacaaggcgagctct

SEQ ID NO: 76075 - DNA, 20 bp, Artificial
  CRISPR gRNA sequence
ttcacaaggcgagctctctc

SEQ ID NO: 76076 - DNA, 20 bp, Artificial
  CRISPR gRNA sequence
cacaaggcgagctctctctc

SEQ ID NO: 76077 - DNA, 20 bp, Artificial
  CRISPR gRNA sequence
acaaggcgagctctctctct

SEQ ID NO: 76078 - DNA, 20 bp, Artificial
  CRISPR gRNA sequence
tctctcttcctttaggtccc

SEQ ID NO: 76079 - DNA, 20 bp, Artificial
  CRISPR gRNA sequence
tctcttcctttaggtcccag

SEQ ID NO: 76080 - DNA, 20 bp, Artificial
  CRISPR gRNA sequence
tcttcctttaggtcccagct

SEQ ID NO: 76081 - DNA, 20 bp, Artificial
  CRISPR gRNA sequence
ttcctttaggtcccagctca

SEQ ID NO: 76082 - DNA, 20 bp, Artificial
  CRISPR gRNA sequence
cctttaggtcccagctcagc

SEQ ID NO: 76083 - DNA, 20 bp, Artificial
  CRISPR gRNA sequence
ctttaggtcccagctcagca

SEQ ID NO: 76084 - DNA, 20 bp, Artificial
  CRISPR gRNA sequence
taggtcccagctcagcatcc

SEQ ID NO: 76085 - DNA, 20 bp, Artificial
  CRISPR gRNA sequence
aggtcccagctcagcatccc

SEQ ID NO: 76086 - DNA, 20 bp, Artificial
  CRISPR gRNA sequence
ggtcccagctcagcatccct

SEQ ID NO: 76087 - DNA, 20 bp, Artificial
  CRISPR gRNA sequence
agcatccctcctcagagatg

SEQ ID NO: 76088 - DNA, 20 bp, Artificial
  CRISPR gRNA sequence
ctcagagatgttccctgatg

SEQ ID NO: 76089 - DNA, 20 bp, Artificial
  CRISPR gRNA sequence
agagatgttccctgatggct

SEQ ID NO: 76090 - DNA, 20 bp, Artificial
  CRISPR gRNA sequence
cctgatggcttctgccacat

SEQ ID NO: 76091 - DNA, 20 bp, Artificial
  CRISPR gRNA sequence
atggcttctgccacatctaa

SEQ ID NO: 76092 - DNA, 20 bp, Artificial
  CRISPR gRNA sequence
ctgccacatctaaatcacct

SEQ ID NO: 76093 - DNA, 20 bp, Artificial
  CRISPR gRNA sequence
tgccacatctaaatcacctc

SEQ ID NO: 76094 - DNA, 20 bp, Artificial
  CRISPR gRNA sequence
ccacatctaaatcacctctc

SEQ ID NO: 76095 - DNA, 20 bp, Artificial
  CRISPR gRNA sequence
aatcacctctccagccactc

SEQ ID NO: 76096 - DNA, 20 bp, Artificial
  CRISPR gRNA sequence
tccagccactcttcaccaca

SEQ ID NO: 76097 - DNA, 20 bp, Artificial
  CRISPR gRNA sequence
cagccactcttcaccacatc

SEQ ID NO: 76098 - DNA, 20 bp, Artificial
  CRISPR gRNA sequence
ttcaccacatcccgagaaaa

SEQ ID NO: 76099 - DNA, 20 bp, Artificial
  CRISPR gRNA sequence
caccacatcccgagaaaatt

SEQ ID NO: 76100 - DNA, 20 bp, Artificial
  CRISPR gRNA sequence
accacatcccgagaaaattc

SEQ ID NO: 76101 - DNA, 20 bp, Artificial
  CRISPR gRNA sequence
tcttatcactggctaagttc

SEQ ID NO: 76102 - DNA, 20 bp, Artificial
  CRISPR gRNA sequence
ttatcactggctaagttcat

SEQ ID NO: 76103 - DNA, 20 bp, Artificial
  CRISPR gRNA sequence
atcactggctaagttcatct

SEQ ID NO: 76104 - DNA, 20 bp, Artificial
  CRISPR gRNA sequence
tcactggctaagttcatctt

SEQ ID NO: 76105 - DNA, 20 bp, Artificial
  CRISPR gRNA sequence
gctaagttcatcttatttga

SEQ ID NO: 76106 - DNA, 20 bp, Artificial
  CRISPR gRNA sequence
agttcatcttatttgatttt

SEQ ID NO: 76107 - DNA, 20 bp, Artificial
  CRISPR gRNA sequence
atcttatttgattttacttt

SEQ ID NO: 76108 - DNA, 20 bp, Artificial
  CRISPR gRNA sequence
atttgattttactttactta

SEQ ID NO: 76109 - DNA, 20 bp, Artificial
  CRISPR gRNA sequence
tttgattttactttacttat

SEQ ID NO: 76110 - DNA, 20 bp, Artificial
  CRISPR gRNA sequence
gattttactttacttatttt

SEQ ID NO: 76111 - DNA, 20 bp, Artificial
  CRISPR gRNA sequence
attttactttacttattttt

SEQ ID NO: 76112 - DNA, 20 bp, Artificial
  CRISPR gRNA sequence
tactttacttatttttcagc

SEQ ID NO: 76113 - DNA, 20 bp, Artificial
  CRISPR gRNA sequence
actttacttatttttcagct

SEQ ID NO: 76114 - DNA, 20 bp, Artificial
  CRISPR gRNA sequence
ctttacttatttttcagctc

SEQ ID NO: 76115 - DNA, 20 bp, Artificial
  CRISPR gRNA sequence
tacttatttttcagctccca

SEQ ID NO: 76116 - DNA, 20 bp, Artificial
  CRISPR gRNA sequence
acttatttttcagctcccac

SEQ ID NO: 76117 - DNA, 20 bp, Artificial
  CRISPR gRNA sequence
cttatttttcagctcccact

SEQ ID NO: 76118 - DNA, 20 bp, Artificial
  CRISPR gRNA sequence
atttttcagctcccactatt

SEQ ID NO: 76119 - DNA, 20 bp, Artificial
  CRISPR gRNA sequence
tttttcagctcccactattg

SEQ ID NO: 76120 - DNA, 20 bp, Artificial
  CRISPR gRNA sequence
ttcagctcccactattgtaa

SEQ ID NO: 76121 - DNA, 20 bp, Artificial
  CRISPR gRNA sequence
tcagctcccactattgtaag

SEQ ID NO: 76122 - DNA, 20 bp, Artificial
  CRISPR gRNA sequence
cagctcccactattgtaaga

SEQ ID NO: 76123 - DNA, 20 bp, Artificial
  CRISPR gRNA sequence
agctcccactattgtaagag

SEQ ID NO: 76124 - DNA, 20 bp, Artificial
  CRISPR gRNA sequence
ccactattgtaagaggagct

SEQ ID NO: 76125 - DNA, 20 bp, Artificial
  CRISPR gRNA sequence
ttgtaagaggagctccaaga

SEQ ID NO: 76126 - DNA, 20 bp, Artificial
  CRISPR gRNA sequence
taagaggagctccaagaaga

SEQ ID NO: 76127 - DNA, 20 bp, Artificial
  CRISPR gRNA sequence
caagaagataaggacatggt

SEQ ID NO: 76128 - DNA, 20 bp, Artificial
  CRISPR gRNA sequence
tttctgctgtgtcgtcacac

SEQ ID NO: 76129 - DNA, 20 bp, Artificial
  CRISPR gRNA sequence
ttctgctgtgtcgtcacaca

SEQ ID NO: 76130 - DNA, 20 bp, Artificial
  CRISPR gRNA sequence
tctgctgtgtcgtcacacaa

SEQ ID NO: 76131 - DNA, 20 bp, Artificial
  CRISPR gRNA sequence
ctgctgtgtcgtcacacaat

SEQ ID NO: 76132 - DNA, 20 bp, Artificial
  CRISPR gRNA sequence
tgctgtgtcgtcacacaatg

SEQ ID NO: 76133 - DNA, 20 bp, Artificial
  CRISPR gRNA sequence
ctgtgtcgtcacacaatgcc

SEQ ID NO: 76134 - DNA, 20 bp, Artificial
  CRISPR gRNA sequence
tgtcgtcacacaatgcctgg

SEQ ID NO: 76135 - DNA, 20 bp, Artificial
  CRISPR gRNA sequence
gcccacagtagggccacaag

SEQ ID NO: 76136 - DNA, 20 bp, Artificial
  CRISPR gRNA sequence
cacgttgagtactacaaagt

SEQ ID NO: 76137 - DNA, 20 bp, Artificial
  CRISPR gRNA sequence
agtactacaaagtttaaacc

SEQ ID NO: 76138 - DNA, 20 bp, Artificial
  CRISPR gRNA sequence
caaagtttaaaccctggcaa

SEQ ID NO: 76139 - DNA, 20 bp, Artificial
  CRISPR gRNA sequence
aaaccctggcaaggggtcag

SEQ ID NO: 76140 - DNA, 20 bp, Artificial
  CRISPR gRNA sequence
aaccctggcaaggggtcagg

SEQ ID NO: 76141 - DNA, 20 bp, Artificial
  CRISPR gRNA sequence
gcaaggggtcaggctggcca

SEQ ID NO: 76142 - DNA, 20 bp, Artificial
  CRISPR gRNA sequence
gccacgccactccaaaggcg

SEQ ID NO: 76143 - DNA, 20 bp, Artificial
  CRISPR gRNA sequence
caaaggcggacgaggagtca

SEQ ID NO: 76144 - DNA, 20 bp, Artificial
  CRISPR gRNA sequence
tgtgatttaggcaaagagaa

SEQ ID NO: 76145 - DNA, 20 bp, Artificial
  CRISPR gRNA sequence
aggcaaagagaagttcctct

SEQ ID NO: 76146 - DNA, 20 bp, Artificial
  CRISPR gRNA sequence
ggcaaagagaagttcctctc

SEQ ID NO: 76147 - DNA, 20 bp, Artificial
  CRISPR gRNA sequence
ctctccggtctgaggtttcc

SEQ ID NO: 76148 - DNA, 20 bp, Artificial
  CRISPR gRNA sequence
tccggtctgaggtttccaac

SEQ ID NO: 76149 - DNA, 20 bp, Artificial
  CRISPR gRNA sequence
cggtctgaggtttccaacct

SEQ ID NO: 76150 - DNA, 20 bp, Artificial
  CRISPR gRNA sequence
aggtttccaacctgttcaat

SEQ ID NO: 76151 - DNA, 20 bp, Artificial
  CRISPR gRNA sequence
ccaacctgttcaattttaac

SEQ ID NO: 76152 - DNA, 20 bp, Artificial
  CRISPR gRNA sequence
caacctgttcaattttaacc

SEQ ID NO: 76153 - DNA, 20 bp, Artificial
  CRISPR gRNA sequence
ttcaattttaacctgccacc

SEQ ID NO: 76154 - DNA, 20 bp, Artificial
  CRISPR gRNA sequence
aattttaacctgccaccttt

SEQ ID NO: 76155 - DNA, 20 bp, Artificial
  CRISPR gRNA sequence
taacctgccaccttttatgt

SEQ ID NO: 76156 - DNA, 20 bp, Artificial
  CRISPR gRNA sequence
aacctgccaccttttatgtc

SEQ ID NO: 76157 - DNA, 20 bp, Artificial
  CRISPR gRNA sequence
acctgccaccttttatgtcc

SEQ ID NO: 76158 - DNA, 20 bp, Artificial
  CRISPR gRNA sequence
ccaccttttatgtccaaagg

SEQ ID NO: 76159 - DNA, 20 bp, Artificial
  CRISPR gRNA sequence
ttatgtccaaaggagtcctt

SEQ ID NO: 76160 - DNA, 20 bp, Artificial
  CRISPR gRNA sequence
tatgtccaaaggagtccttt

SEQ ID NO: 76161 - DNA, 20 bp, Artificial
  CRISPR gRNA sequence
atgtccaaaggagtcctttc

SEQ ID NO: 76162 - DNA, 20 bp, Artificial
  CRISPR gRNA sequence
tgtccaaaggagtcctttct

SEQ ID NO: 76163 - DNA, 20 bp, Artificial
  CRISPR gRNA sequence
tctgactcattatctccggg

SEQ ID NO: 76164 - DNA, 20 bp, Artificial
  CRISPR gRNA sequence
ctgactcattatctccgggc

SEQ ID NO: 76165 - DNA, 20 bp, Artificial
  CRISPR gRNA sequence
tgactcattatctccgggca

SEQ ID NO: 76166 - DNA, 20 bp, Artificial
  CRISPR gRNA sequence
actcattatctccgggcagg

SEQ ID NO: 76167 - DNA, 20 bp, Artificial
  CRISPR gRNA sequence
attatctccgggcagggtgg

SEQ ID NO: 76168 - DNA, 20 bp, Artificial
  CRISPR gRNA sequence
tctccgggcagggtgggact

SEQ ID NO: 76169 - DNA, 20 bp, Artificial
  CRISPR gRNA sequence
cgggcagggtgggactatta

SEQ ID NO: 76170 - DNA, 20 bp, Artificial
  CRISPR gRNA sequence
ttacagggtgccatggggtg

SEQ ID NO: 76171 - DNA, 20 bp, Artificial
  CRISPR gRNA sequence
cagggtgccatggggtgctg

SEQ ID NO: 76172 - DNA, 20 bp, Artificial
  CRISPR gRNA sequence
tgagctgggctgtacttgcc

SEQ ID NO: 76173 - DNA, 20 bp, Artificial
  CRISPR gRNA sequence
ggctgtacttgcccctggaa

SEQ ID NO: 76174 - DNA, 20 bp, Artificial
  CRISPR gRNA sequence
tacttgcccctggaatgttg

SEQ ID NO: 76175 - DNA, 20 bp, Artificial
  CRISPR gRNA sequence
gcccctggaatgttgtcacg

SEQ ID NO: 76176 - DNA, 20 bp, Artificial
  CRISPR gRNA sequence
cccctggaatgttgtcacgt

SEQ ID NO: 76177 - DNA, 20 bp, Artificial
  CRISPR gRNA sequence
gaatgttgtcacgtctcctc

SEQ ID NO: 76178 - DNA, 20 bp, Artificial
  CRISPR gRNA sequence
tcacgtctcctccctccctc

SEQ ID NO: 76179 - DNA, 20 bp, Artificial
  CRISPR gRNA sequence
ctccctccctcccagataaa

SEQ ID NO: 76180 - DNA, 20 bp, Artificial
  CRISPR gRNA sequence
cctccctcccagataaaacc

SEQ ID NO: 76181 - DNA, 20 bp, Artificial
  CRISPR gRNA sequence
cctcccagataaaacccaag

SEQ ID NO: 76182 - DNA, 20 bp, Artificial
  CRISPR gRNA sequence
ccagataaaacccaagcata

SEQ ID NO: 76183 - DNA, 20 bp, Artificial
  CRISPR gRNA sequence
gaggtgatgcgagccatctt

SEQ ID NO: 76184 - DNA, 20 bp, Artificial
  CRISPR gRNA sequence
agacatcccagagagcccca

SEQ ID NO: 76185 - DNA, 20 bp, Artificial
  CRISPR gRNA sequence
gacatcccagagagccccag

SEQ ID NO: 76186 - DNA, 20 bp, Artificial
  CRISPR gRNA sequence
tgcaccgatgttattaacat

SEQ ID NO: 76187 - DNA, 20 bp, Artificial
  CRISPR gRNA sequence
gcaccgatgttattaacatt

SEQ ID NO: 76188 - DNA, 20 bp, Artificial
  CRISPR gRNA sequence
caccgatgttattaacatta

SEQ ID NO: 76189 - DNA, 20 bp, Artificial
  CRISPR gRNA sequence
ttaacattatgatttacttt

SEQ ID NO: 76190 - DNA, 20 bp, Artificial
  CRISPR gRNA sequence
acattatgatttactttcct

SEQ ID NO: 76191 - DNA, 20 bp, Artificial
  CRISPR gRNA sequence
tgatttactttcctgctgta

SEQ ID NO: 76192 - DNA, 20 bp, Artificial
  CRISPR gRNA sequence
actttcctgctgtatttttt

SEQ ID NO: 76193 - DNA, 20 bp, Artificial
  CRISPR gRNA sequence
ctttcctgctgtattttttc

SEQ ID NO: 76194 - DNA, 20 bp, Artificial
  CRISPR gRNA sequence
tcctgctgtattttttcatc

SEQ ID NO: 76195 - DNA, 20 bp, Artificial
  CRISPR gRNA sequence
cctgctgtattttttcatct

SEQ ID NO: 76196 - DNA, 20 bp, Artificial
  CRISPR gRNA sequence
ctgctgtattttttcatctt

SEQ ID NO: 76197 - DNA, 20 bp, Artificial
  CRISPR gRNA sequence
ctgtattttttcatcttagc

SEQ ID NO: 76198 - DNA, 20 bp, Artificial
  CRISPR gRNA sequence
tattttttcatcttagctgc

SEQ ID NO: 76199 - DNA, 20 bp, Artificial
  CRISPR gRNA sequence
tttcatcttagctgcagctg

SEQ ID NO: 76200 - DNA, 20 bp, Artificial
  CRISPR gRNA sequence
ttcatcttagctgcagctgc

SEQ ID NO: 76201 - DNA, 20 bp, Artificial
  CRISPR gRNA sequence
tcatcttagctgcagctgct

SEQ ID NO: 76202 - DNA, 20 bp, Artificial
  CRISPR gRNA sequence
catcttagctgcagctgctt

SEQ ID NO: 76203 - DNA, 20 bp, Artificial
  CRISPR gRNA sequence
atcttagctgcagctgcttc

SEQ ID NO: 76204 - DNA, 20 bp, Artificial
  CRISPR gRNA sequence
agctgcagctgcttcccacc

SEQ ID NO: 76205 - DNA, 20 bp, Artificial
  CRISPR gRNA sequence
gctgcagctgcttcccaccc

SEQ ID NO: 76206 - DNA, 20 bp, Artificial
  CRISPR gRNA sequence
cagctgcttcccaccccgcc

SEQ ID NO: 76207 - DNA, 20 bp, Artificial
  CRISPR gRNA sequence
cttcccaccccgcctcccac

SEQ ID NO: 76208 - DNA, 20 bp, Artificial
  CRISPR gRNA sequence
cccaccccgcctcccaccac

SEQ ID NO: 76209 - DNA, 20 bp, Artificial
  CRISPR gRNA sequence
ccaccccgcctcccaccact

SEQ ID NO: 76210 - DNA, 20 bp, Artificial
  CRISPR gRNA sequence
ccaccactagaagactgttt

SEQ ID NO: 76211 - DNA, 20 bp, Artificial
  CRISPR gRNA sequence
gaagactgtttaaagtaaat

SEQ ID NO: 76212 - DNA, 20 bp, Artificial
  CRISPR gRNA sequence
tttaaagtaaatccttctaa

SEQ ID NO: 76213 - DNA, 20 bp, Artificial
  CRISPR gRNA sequence
aaagtaaatccttctaaaat

SEQ ID NO: 76214 - DNA, 20 bp, Artificial
  CRISPR gRNA sequence
aagtaaatccttctaaaatt

SEQ ID NO: 76215 - DNA, 20 bp, Artificial
  CRISPR gRNA sequence
ctaaaattctttctttttct

SEQ ID NO: 76216 - DNA, 20 bp, Artificial
  CRISPR gRNA sequence
taaaattctttctttttctt

SEQ ID NO: 76217 - DNA, 20 bp, Artificial
  CRISPR gRNA sequence
aaattctttctttttctttt

SEQ ID NO: 76218 - DNA, 20 bp, Artificial
  CRISPR gRNA sequence
tttctttttctttttttctt

SEQ ID NO: 76219 - DNA, 20 bp, Artificial
  CRISPR gRNA sequence
tctttttctttttttctttt

SEQ ID NO: 76220 - DNA, 20 bp, Artificial
  CRISPR gRNA sequence
ctttttctttttttcttttt

SEQ ID NO: 76221 - DNA, 20 bp, Artificial
  CRISPR gRNA sequence
tttttctttttttctttttt

SEQ ID NO: 76222 - DNA, 20 bp, Artificial
  CRISPR gRNA sequence
tttctttttttctttttttt

SEQ ID NO: 76223 - DNA, 20 bp, Artificial
  CRISPR gRNA sequence
ttctttttttcttttttttt

SEQ ID NO: 76224 - DNA, 20 bp, Artificial
  CRISPR gRNA sequence
tctttttttctttttttttt

SEQ ID NO: 76225 - DNA, 20 bp, Artificial
  CRISPR gRNA sequence
ctttttttcttttttttttt

SEQ ID NO: 76226 - DNA, 20 bp, Artificial
  CRISPR gRNA sequence
tttttttctttttttttttc

SEQ ID NO: 76227 - DNA, 20 bp, Artificial
  CRISPR gRNA sequence
tttttctttttttttttctg

SEQ ID NO: 76228 - DNA, 20 bp, Artificial
  CRISPR gRNA sequence
ttttctttttttttttctga

SEQ ID NO: 76229 - DNA, 20 bp, Artificial
  CRISPR gRNA sequence
tttctttttttttttctgag

SEQ ID NO: 76230 - DNA, 20 bp, Artificial
  CRISPR gRNA sequence
ttctttttttttttctgaga

SEQ ID NO: 76231 - DNA, 20 bp, Artificial
  CRISPR gRNA sequence
tctttttttttttctgagat

SEQ ID NO: 76232 - DNA, 20 bp, Artificial
  CRISPR gRNA sequence
ctttttttttttctgagatg

SEQ ID NO: 76233 - DNA, 20 bp, Artificial
  CRISPR gRNA sequence
tttttttttttctgagatgg

SEQ ID NO: 76234 - DNA, 20 bp, Artificial
  CRISPR gRNA sequence
tttttttttctgagatggag

SEQ ID NO: 76235 - DNA, 20 bp, Artificial
  CRISPR gRNA sequence
ttttttttctgagatggagt

SEQ ID NO: 76236 - DNA, 20 bp, Artificial
  CRISPR gRNA sequence
tttttttctgagatggagtt

SEQ ID NO: 76237 - DNA, 20 bp, Artificial
  CRISPR gRNA sequence
ttttttctgagatggagttt

SEQ ID NO: 76238 - DNA, 20 bp, Artificial
  CRISPR gRNA sequence
tttttctgagatggagtttc

SEQ ID NO: 76239 - DNA, 20 bp, Artificial
  CRISPR gRNA sequence
ttttctgagatggagtttca

SEQ ID NO: 76240 - DNA, 20 bp, Artificial
  CRISPR gRNA sequence
tttctgagatggagtttcac

SEQ ID NO: 76241 - DNA, 20 bp, Artificial
  CRISPR gRNA sequence
ttctgagatggagtttcact

SEQ ID NO: 76242 - DNA, 20 bp, Artificial
  CRISPR gRNA sequence
tctgagatggagtttcactc

SEQ ID NO: 76243 - DNA, 20 bp, Artificial
  CRISPR gRNA sequence
ctgagatggagtttcactct

SEQ ID NO: 76244 - DNA, 20 bp, Artificial
  CRISPR gRNA sequence
tgagatggagtttcactctt

SEQ ID NO: 76245 - DNA, 20 bp, Artificial
  CRISPR gRNA sequence
agatggagtttcactcttgt

SEQ ID NO: 76246 - DNA, 20 bp, Artificial
  CRISPR gRNA sequence
cactcttgtcgcccaagctg

SEQ ID NO: 76247 - DNA, 20 bp, Artificial
  CRISPR gRNA sequence
actcttgtcgcccaagctgg

SEQ ID NO: 76248 - DNA, 20 bp, Artificial
  CRISPR gRNA sequence
ttgtcgcccaagctggagtg

SEQ ID NO: 76249 - DNA, 20 bp, Artificial
  CRISPR gRNA sequence
gtcgcccaagctggagtgca

SEQ ID NO: 76250 - DNA, 20 bp, Artificial
  CRISPR gRNA sequence
tcgcccaagctggagtgcaa

SEQ ID NO: 76251 - DNA, 20 bp, Artificial
  CRISPR gRNA sequence
gagtgcaatggcgcgatctc

SEQ ID NO: 76252 - DNA, 20 bp, Artificial
  CRISPR gRNA sequence
ggctcactgcaacctccgcc

SEQ ID NO: 76253 - DNA, 20 bp, Artificial
  CRISPR gRNA sequence
actgcaacctccgcctccca

SEQ ID NO: 76254 - DNA, 20 bp, Artificial
  CRISPR gRNA sequence
caacctccgcctcccaagtt

SEQ ID NO: 76255 - DNA, 20 bp, Artificial
  CRISPR gRNA sequence
cgcctcccaagttcaagcaa

SEQ ID NO: 76256 - DNA, 20 bp, Artificial
  CRISPR gRNA sequence
ccaagttcaagcaattctcc

SEQ ID NO: 76257 - DNA, 20 bp, Artificial
  CRISPR gRNA sequence
aagcaattctcctgcctcag

SEQ ID NO: 76258 - DNA, 20 bp, Artificial
  CRISPR gRNA sequence
tcctgcctcagcctcccaag

SEQ ID NO: 76259 - DNA, 20 bp, Artificial
  CRISPR gRNA sequence
ctgcctcagcctcccaagta

SEQ ID NO: 76260 - DNA, 20 bp, Artificial
  CRISPR gRNA sequence
cctcagcctcccaagtagct

SEQ ID NO: 76261 - DNA, 20 bp, Artificial
  CRISPR gRNA sequence
agcctcccaagtagctggaa

SEQ ID NO: 76262 - DNA, 20 bp, Artificial
  CRISPR gRNA sequence
ccaagtagctggaattacag

SEQ ID NO: 76263 - DNA, 20 bp, Artificial
  CRISPR gRNA sequence
gaattacaggcacccaccac

SEQ ID NO: 76264 - DNA, 20 bp, Artificial
  CRISPR gRNA sequence
caggcacccaccaccacacc

SEQ ID NO: 76265 - DNA, 20 bp, Artificial
  CRISPR gRNA sequence
atttttgtatttttagtaga

SEQ ID NO: 76266 - DNA, 20 bp, Artificial
  CRISPR gRNA sequence
ttgtatttttagtagagacg

SEQ ID NO: 76267 - DNA, 20 bp, Artificial
  CRISPR gRNA sequence
tgtatttttagtagagacgg

SEQ ID NO: 76268 - DNA, 20 bp, Artificial
  CRISPR gRNA sequence
gtatttttagtagagacggg

SEQ ID NO: 76269 - DNA, 20 bp, Artificial
  CRISPR gRNA sequence
tatttttagtagagacgggg

SEQ ID NO: 76270 - DNA, 20 bp, Artificial
  CRISPR gRNA sequence
ttagtagagacggggtttca

SEQ ID NO: 76271 - DNA, 20 bp, Artificial
  CRISPR gRNA sequence
tagtagagacggggtttcac

SEQ ID NO: 76272 - DNA, 20 bp, Artificial
  CRISPR gRNA sequence
agtagagacggggtttcacc

SEQ ID NO: 76273 - DNA, 20 bp, Artificial
  CRISPR gRNA sequence
gtagagacggggtttcacca

SEQ ID NO: 76274 - DNA, 20 bp, Artificial
  CRISPR gRNA sequence
caccacattggccaggctgg

SEQ ID NO: 76275 - DNA, 20 bp, Artificial
  CRISPR gRNA sequence
accacattggccaggctggt

SEQ ID NO: 76276 - DNA, 20 bp, Artificial
  CRISPR gRNA sequence
gccaggctggtctcaaactc

SEQ ID NO: 76277 - DNA, 20 bp, Artificial
  CRISPR gRNA sequence
gtctcaaactcctgacctca

SEQ ID NO: 76278 - DNA, 20 bp, Artificial
  CRISPR gRNA sequence
aaactcctgacctcaggtga

SEQ ID NO: 76279 - DNA, 20 bp, Artificial
  CRISPR gRNA sequence
ctgacctcaggtgatctgcc

SEQ ID NO: 76280 - DNA, 20 bp, Artificial
  CRISPR gRNA sequence
acctcaggtgatctgcccgc

SEQ ID NO: 76281 - DNA, 20 bp, Artificial
  CRISPR gRNA sequence
aggtgatctgcccgcctcgg

SEQ ID NO: 76282 - DNA, 20 bp, Artificial
  CRISPR gRNA sequence
cccgcctcggcctcccaaag

SEQ ID NO: 76283 - DNA, 20 bp, Artificial
  CRISPR gRNA sequence
ggcctcccaaagtgccggga

SEQ ID NO: 76284 - DNA, 20 bp, Artificial
  CRISPR gRNA sequence
ccaaagtgccgggattacag

SEQ ID NO: 76285 - DNA, 20 bp, Artificial
  CRISPR gRNA sequence
caggcatgagccaccacaca

SEQ ID NO: 76286 - DNA, 20 bp, Artificial
  CRISPR gRNA sequence
aatacttttaaaattctaac

SEQ ID NO: 76287 - DNA, 20 bp, Artificial
  CRISPR gRNA sequence
ttaaaattctaaccagtctg

SEQ ID NO: 76288 - DNA, 20 bp, Artificial
  CRISPR gRNA sequence
taaaattctaaccagtctga

SEQ ID NO: 76289 - DNA, 20 bp, Artificial
  CRISPR gRNA sequence
aaaattctaaccagtctgag

SEQ ID NO: 76290 - DNA, 20 bp, Artificial
  CRISPR gRNA sequence
aaattctaaccagtctgagc

SEQ ID NO: 76291 - DNA, 20 bp, Artificial
  CRISPR gRNA sequence
taaccagtctgagctgaaat

SEQ ID NO: 76292 - DNA, 20 bp, Artificial
  CRISPR gRNA sequence
accagtctgagctgaaatta

SEQ ID NO: 76293 - DNA, 20 bp, Artificial
  CRISPR gRNA sequence
agctgaaattagaaaatagt

SEQ ID NO: 76294 - DNA, 20 bp, Artificial
  CRISPR gRNA sequence
aaattagaaaatagttttaa

SEQ ID NO: 76295 - DNA, 20 bp, Artificial
  CRISPR gRNA sequence
gaaaatagttttaatacttt

SEQ ID NO: 76296 - DNA, 20 bp, Artificial
  CRISPR gRNA sequence
taatactttgggggaattct

SEQ ID NO: 76297 - DNA, 20 bp, Artificial
  CRISPR gRNA sequence
aatactttgggggaattctg

SEQ ID NO: 76298 - DNA, 20 bp, Artificial
  CRISPR gRNA sequence
atactttgggggaattctgc

SEQ ID NO: 76299 - DNA, 20 bp, Artificial
  CRISPR gRNA sequence
tgggggaattctgcttaaat

SEQ ID NO: 76300 - DNA, 20 bp, Artificial
  CRISPR gRNA sequence
gggggaattctgcttaaatt

SEQ ID NO: 76301 - DNA, 20 bp, Artificial
  CRISPR gRNA sequence
ggggaattctgcttaaattc

SEQ ID NO: 76302 - DNA, 20 bp, Artificial
  CRISPR gRNA sequence
tgcttaaattccctttttgc

SEQ ID NO: 76303 - DNA, 20 bp, Artificial
  CRISPR gRNA sequence
cttaaattccctttttgcga

SEQ ID NO: 76304 - DNA, 20 bp, Artificial
  CRISPR gRNA sequence
aaattccctttttgcgagtt

SEQ ID NO: 76305 - DNA, 20 bp, Artificial
  CRISPR gRNA sequence
aattccctttttgcgagttt

SEQ ID NO: 76306 - DNA, 20 bp, Artificial
  CRISPR gRNA sequence
cctttttgcgagtttgacgg

SEQ ID NO: 76307 - DNA, 20 bp, Artificial
  CRISPR gRNA sequence
tttgcgagtttgacggtgac

SEQ ID NO: 76308 - DNA, 20 bp, Artificial
  CRISPR gRNA sequence
ttgcgagtttgacggtgacc

SEQ ID NO: 76309 - DNA, 20 bp, Artificial
  CRISPR gRNA sequence
tgcgagtttgacggtgacct

SEQ ID NO: 76310 - DNA, 20 bp, Artificial
  CRISPR gRNA sequence
gcgagtttgacggtgacctt

SEQ ID NO: 76311 - DNA, 20 bp, Artificial
  CRISPR gRNA sequence
cgagtttgacggtgaccttt

SEQ ID NO: 76312 - DNA, 20 bp, Artificial
  CRISPR gRNA sequence
gacggtgacctttaaaaagc

SEQ ID NO: 76313 - DNA, 20 bp, Artificial
  CRISPR gRNA sequence
acggtgacctttaaaaagca

SEQ ID NO: 76314 - DNA, 20 bp, Artificial
  CRISPR gRNA sequence
taaaaagcagcatgtgataa

SEQ ID NO: 76315 - DNA, 20 bp, Artificial
  CRISPR gRNA sequence
aaaaagcagcatgtgataag

SEQ ID NO: 76316 - DNA, 20 bp, Artificial
  CRISPR gRNA sequence
aaaagcagcatgtgataagt

SEQ ID NO: 76317 - DNA, 20 bp, Artificial
  CRISPR gRNA sequence
catctgtacagcccctttct

SEQ ID NO: 76318 - DNA, 20 bp, Artificial
  CRISPR gRNA sequence
tacagcccctttctacgagt

SEQ ID NO: 76319 - DNA, 20 bp, Artificial
  CRISPR gRNA sequence
tctacgagtgggtgaccctc

SEQ ID NO: 76320 - DNA, 20 bp, Artificial
  CRISPR gRNA sequence
ctacgagtgggtgaccctcc

SEQ ID NO: 76321 - DNA, 20 bp, Artificial
  CRISPR gRNA sequence
tacgagtgggtgaccctccg

SEQ ID NO: 76322 - DNA, 20 bp, Artificial
  CRISPR gRNA sequence
cgagtgggtgaccctccgtg

SEQ ID NO: 76323 - DNA, 20 bp, Artificial
  CRISPR gRNA sequence
cgtgggtggggagaagttgg

SEQ ID NO: 76324 - DNA, 20 bp, Artificial
  CRISPR gRNA sequence
gacagctcatttgtcacaga

SEQ ID NO: 76325 - DNA, 20 bp, Artificial
  CRISPR gRNA sequence
atttgtcacagatcttccat

SEQ ID NO: 76326 - DNA, 20 bp, Artificial
  CRISPR gRNA sequence
gtcacagatcttccatttct

SEQ ID NO: 76327 - DNA, 20 bp, Artificial
  CRISPR gRNA sequence
tcacagatcttccatttctt

SEQ ID NO: 76328 - DNA, 20 bp, Artificial
  CRISPR gRNA sequence
ccatttcttaaggtgatttt

SEQ ID NO: 76329 - DNA, 20 bp, Artificial
  CRISPR gRNA sequence
catttcttaaggtgatttta

SEQ ID NO: 76330 - DNA, 20 bp, Artificial
  CRISPR gRNA sequence
cttaaggtgattttagaata

SEQ ID NO: 76331 - DNA, 20 bp, Artificial
  CRISPR gRNA sequence
ttaaggtgattttagaataa

SEQ ID NO: 76332 - DNA, 20 bp, Artificial
  CRISPR gRNA sequence
aaggtgattttagaataact

SEQ ID NO: 76333 - DNA, 20 bp, Artificial
  CRISPR gRNA sequence
aggtgattttagaataactt

SEQ ID NO: 76334 - DNA, 20 bp, Artificial
  CRISPR gRNA sequence
tagaataacttatttgagtc

SEQ ID NO: 76335 - DNA, 20 bp, Artificial
  CRISPR gRNA sequence
agaataacttatttgagtcc

SEQ ID NO: 76336 - DNA, 20 bp, Artificial
  CRISPR gRNA sequence
gaataacttatttgagtccc

SEQ ID NO: 76337 - DNA, 20 bp, Artificial
  CRISPR gRNA sequence
atttgagtcccaactctggg

SEQ ID NO: 76338 - DNA, 20 bp, Artificial
  CRISPR gRNA sequence
tttgagtcccaactctgggg

SEQ ID NO: 76339 - DNA, 20 bp, Artificial
  CRISPR gRNA sequence
gagtcccaactctgggggaa

SEQ ID NO: 76340 - DNA, 20 bp, Artificial
  CRISPR gRNA sequence
agtcccaactctgggggaat

SEQ ID NO: 76341 - DNA, 20 bp, Artificial
  CRISPR gRNA sequence
tgggggaatgggcggggaat

SEQ ID NO: 76342 - DNA, 20 bp, Artificial
  CRISPR gRNA sequence
ggggaatgggcggggaatat

SEQ ID NO: 76343 - DNA, 20 bp, Artificial
  CRISPR gRNA sequence
atcccatttgtcagatgagg

SEQ ID NO: 76344 - DNA, 20 bp, Artificial
  CRISPR gRNA sequence
gtcagatgaggaaactgaga

SEQ ID NO: 76345 - DNA, 20 bp, Artificial
  CRISPR gRNA sequence
tcagatgaggaaactgagac

SEQ ID NO: 76346 - DNA, 20 bp, Artificial
  CRISPR gRNA sequence
agacgcagaggaggcaaacg

SEQ ID NO: 76347 - DNA, 20 bp, Artificial
  CRISPR gRNA sequence
aggttgacaaagtattaggg

SEQ ID NO: 76348 - DNA, 20 bp, Artificial
  CRISPR gRNA sequence
acaaagtattagggtggagc

SEQ ID NO: 76349 - DNA, 20 bp, Artificial
  CRISPR gRNA sequence
gggtggagctggaagcagat

SEQ ID NO: 76350 - DNA, 20 bp, Artificial
  CRISPR gRNA sequence
gaagcagattggagtcccca

SEQ ID NO: 76351 - DNA, 20 bp, Artificial
  CRISPR gRNA sequence
gagtccccagttgtgccagg

SEQ ID NO: 76352 - DNA, 20 bp, Artificial
  CRISPR gRNA sequence
tgccaggtaaaatgataaaa

SEQ ID NO: 76353 - DNA, 20 bp, Artificial
  CRISPR gRNA sequence
aggaaagaatggagcgggta

SEQ ID NO: 76354 - DNA, 20 bp, Artificial
  CRISPR gRNA sequence
gagggggtaaaggcgggggg

SEQ ID NO: 76355 - DNA, 20 bp, Artificial
  CRISPR gRNA sequence
aggggttagagggcaggtac

SEQ ID NO: 76356 - DNA, 20 bp, Artificial
  CRISPR gRNA sequence
gagggcaggtacagctttgc

SEQ ID NO: 76357 - DNA, 20 bp, Artificial
  CRISPR gRNA sequence
tgccatggaggagccttaga

SEQ ID NO: 76358 - DNA, 20 bp, Artificial
  CRISPR gRNA sequence
gccatggaggagccttagaa

SEQ ID NO: 76359 - DNA, 20 bp, Artificial
  CRISPR gRNA sequence
ccatggaggagccttagaaa

SEQ ID NO: 76360 - DNA, 20 bp, Artificial
  CRISPR gRNA sequence
agaaacacgagcacaaggaa

SEQ ID NO: 76361 - DNA, 20 bp, Artificial
  CRISPR gRNA sequence
gaaacacgagcacaaggaac

SEQ ID NO: 76362 - DNA, 20 bp, Artificial
  CRISPR gRNA sequence
tcgtcttactgcagcaggct

SEQ ID NO: 76363 - DNA, 20 bp, Artificial
  CRISPR gRNA sequence
gtcttactgcagcaggctca

SEQ ID NO: 76364 - DNA, 20 bp, Artificial
  CRISPR gRNA sequence
actgcagcaggctcagctga

SEQ ID NO: 76365 - DNA, 20 bp, Artificial
  CRISPR gRNA sequence
ctgcagcaggctcagctgag

SEQ ID NO: 76366 - DNA, 20 bp, Artificial
  CRISPR gRNA sequence
cagcaggctcagctgaggga

SEQ ID NO: 76367 - DNA, 20 bp, Artificial
  CRISPR gRNA sequence
agctgagggagttgaggtaa

SEQ ID NO: 76368 - DNA, 20 bp, Artificial
  CRISPR gRNA sequence
agggagttgaggtaagcagt

SEQ ID NO: 76369 - DNA, 20 bp, Artificial
  CRISPR gRNA sequence
aggtaagcagtccagtagag

SEQ ID NO: 76370 - DNA, 20 bp, Artificial
  CRISPR gRNA sequence
caggctctggtcactcagga

SEQ ID NO: 76371 - DNA, 20 bp, Artificial
  CRISPR gRNA sequence
tggtcactcaggaactcaca

SEQ ID NO: 76372 - DNA, 20 bp, Artificial
  CRISPR gRNA sequence
gtcactcaggaactcacagg

SEQ ID NO: 76373 - DNA, 20 bp, Artificial
  CRISPR gRNA sequence
aggaactcacaggacaatct

SEQ ID NO: 76374 - DNA, 20 bp, Artificial
  CRISPR gRNA sequence
acaggacaatctgtgaaaca

SEQ ID NO: 76375 - DNA, 20 bp, Artificial
  CRISPR gRNA sequence
tgaaacaaagcaggtggatg

SEQ ID NO: 76376 - DNA, 20 bp, Artificial
  CRISPR gRNA sequence
ccaggaaagcagggagcacg

SEQ ID NO: 76377 - DNA, 20 bp, Artificial
  CRISPR gRNA sequence
caggaaagcagggagcacgg

SEQ ID NO: 76378 - DNA, 20 bp, Artificial
  CRISPR gRNA sequence
atagccagagccttctggag

SEQ ID NO: 76379 - DNA, 20 bp, Artificial
  CRISPR gRNA sequence
ctggagatgggacctaacca

SEQ ID NO: 76380 - DNA, 20 bp, Artificial
  CRISPR gRNA sequence
tggagatgggacctaaccag

SEQ ID NO: 76381 - DNA, 20 bp, Artificial
  CRISPR gRNA sequence
gagatgggacctaaccaggg

SEQ ID NO: 76382 - DNA, 20 bp, Artificial
  CRISPR gRNA sequence
accagggtcacctgaaacat

SEQ ID NO: 76383 - DNA, 20 bp, Artificial
  CRISPR gRNA sequence
aaacattccctcccagcact

SEQ ID NO: 76384 - DNA, 20 bp, Artificial
  CRISPR gRNA sequence
cctcccagcactgggtccat

SEQ ID NO: 76385 - DNA, 20 bp, Artificial
  CRISPR gRNA sequence
ccagcactgggtccatgggt

SEQ ID NO: 76386 - DNA, 20 bp, Artificial
  CRISPR gRNA sequence
ggtccatgggttatccgtga

SEQ ID NO: 76387 - DNA, 20 bp, Artificial
  CRISPR gRNA sequence
tccgtgaggctggaagaaga

SEQ ID NO: 76388 - DNA, 20 bp, Artificial
  CRISPR gRNA sequence
gaagaagaggaaggtctttt

SEQ ID NO: 76389 - DNA, 20 bp, Artificial
  CRISPR gRNA sequence
ttaagtttgggaaatacggg

SEQ ID NO: 76390 - DNA, 20 bp, Artificial
  CRISPR gRNA sequence
taagtttgggaaatacgggg

SEQ ID NO: 76391 - DNA, 20 bp, Artificial
  CRISPR gRNA sequence
aagtttgggaaatacggggt

SEQ ID NO: 76392 - DNA, 20 bp, Artificial
  CRISPR gRNA sequence
agtttgggaaatacggggtt

SEQ ID NO: 76393 - DNA, 20 bp, Artificial
  CRISPR gRNA sequence
gggaaatacggggttaagcc

SEQ ID NO: 76394 - DNA, 20 bp, Artificial
  CRISPR gRNA sequence
ggaaatacggggttaagcca

SEQ ID NO: 76395 - DNA, 20 bp, Artificial
  CRISPR gRNA sequence
agccaaattaaatggttttg

SEQ ID NO: 76396 - DNA, 20 bp, Artificial
  CRISPR gRNA sequence
aatggttttgtttgctgcag

SEQ ID NO: 76397 - DNA, 20 bp, Artificial
  CRISPR gRNA sequence
tgtttgctgcagggcttctc

SEQ ID NO: 76398 - DNA, 20 bp, Artificial
  CRISPR gRNA sequence
gtttgctgcagggcttctct

SEQ ID NO: 76399 - DNA, 20 bp, Artificial
  CRISPR gRNA sequence
tttgctgcagggcttctctg

SEQ ID NO: 76400 - DNA, 20 bp, Artificial
  CRISPR gRNA sequence
gctgcagggcttctctgagg

SEQ ID NO: 76401 - DNA, 20 bp, Artificial
  CRISPR gRNA sequence
ctgcagggcttctctgaggc

SEQ ID NO: 76402 - DNA, 20 bp, Artificial
  CRISPR gRNA sequence
cagggcttctctgaggctgc

SEQ ID NO: 76403 - DNA, 20 bp, Artificial
  CRISPR gRNA sequence
ctctgaggctgcgataggct

SEQ ID NO: 76404 - DNA, 20 bp, Artificial
  CRISPR gRNA sequence
tctgaggctgcgataggctg

SEQ ID NO: 76405 - DNA, 20 bp, Artificial
  CRISPR gRNA sequence
tgaggctgcgataggctgct

SEQ ID NO: 76406 - DNA, 20 bp, Artificial
  CRISPR gRNA sequence
aggctgcgataggctgctgt

SEQ ID NO: 76407 - DNA, 20 bp, Artificial
  CRISPR gRNA sequence
cgataggctgctgtgcatta

SEQ ID NO: 76408 - DNA, 20 bp, Artificial
  CRISPR gRNA sequence
ctgtgcattatgaatttcca

SEQ ID NO: 76409 - DNA, 20 bp, Artificial
  CRISPR gRNA sequence
tgcattatgaatttccaagg

SEQ ID NO: 76410 - DNA, 20 bp, Artificial
  CRISPR gRNA sequence
tgaatttccaaggagctaca

SEQ ID NO: 76411 - DNA, 20 bp, Artificial
  CRISPR gRNA sequence
ccaaggagctacagcagact

SEQ ID NO: 76412 - DNA, 20 bp, Artificial
  CRISPR gRNA sequence
caaggagctacagcagactt

SEQ ID NO: 76413 - DNA, 20 bp, Artificial
  CRISPR gRNA sequence
cagcagacttttccccaaac

SEQ ID NO: 76414 - DNA, 20 bp, Artificial
  CRISPR gRNA sequence
ttccccaaactaaatggact

SEQ ID NO: 76415 - DNA, 20 bp, Artificial
  CRISPR gRNA sequence
tccccaaactaaatggacta

SEQ ID NO: 76416 - DNA, 20 bp, Artificial
  CRISPR gRNA sequence
ccccaaactaaatggactag

SEQ ID NO: 76417 - DNA, 20 bp, Artificial
  CRISPR gRNA sequence
cccaaactaaatggactagc

SEQ ID NO: 76418 - DNA, 20 bp, Artificial
  CRISPR gRNA sequence
aatggactagcagaattaat

SEQ ID NO: 76419 - DNA, 20 bp, Artificial
  CRISPR gRNA sequence
gcagaattaatttttaaggg

SEQ ID NO: 76420 - DNA, 20 bp, Artificial
  CRISPR gRNA sequence
atttttaagggccatgaagg

SEQ ID NO: 76421 - DNA, 20 bp, Artificial
  CRISPR gRNA sequence
ttaagggccatgaaggttag

SEQ ID NO: 76422 - DNA, 20 bp, Artificial
  CRISPR gRNA sequence
taagggccatgaaggttagt

SEQ ID NO: 76423 - DNA, 20 bp, Artificial
  CRISPR gRNA sequence
aagggccatgaaggttagtg

SEQ ID NO: 76424 - DNA, 20 bp, Artificial
  CRISPR gRNA sequence
agggccatgaaggttagtgt

SEQ ID NO: 76425 - DNA, 20 bp, Artificial
  CRISPR gRNA sequence
gtgttccgcaaaacatgttt

SEQ ID NO: 76426 - DNA, 20 bp, Artificial
  CRISPR gRNA sequence
cgcaaaacatgtttgttaag

SEQ ID NO: 76427 - DNA, 20 bp, Artificial
  CRISPR gRNA sequence
gttaagaaaagaatgcagct

SEQ ID NO: 76428 - DNA, 20 bp, Artificial
  CRISPR gRNA sequence
ttaagaaaagaatgcagctg

SEQ ID NO: 76429 - DNA, 20 bp, Artificial
  CRISPR gRNA sequence
agaaaagaatgcagctgggc

SEQ ID NO: 76430 - DNA, 20 bp, Artificial
  CRISPR gRNA sequence
ggcatggtggctcatgcctg

SEQ ID NO: 76431 - DNA, 20 bp, Artificial
  CRISPR gRNA sequence
atgcctgtaatcgcagcact

SEQ ID NO: 76432 - DNA, 20 bp, Artificial
  CRISPR gRNA sequence
taatcgcagcactttgggag

SEQ ID NO: 76433 - DNA, 20 bp, Artificial
  CRISPR gRNA sequence
tgggaggctgaggtgggtgg

SEQ ID NO: 76434 - DNA, 20 bp, Artificial
  CRISPR gRNA sequence
gggaggctgaggtgggtgga

SEQ ID NO: 76435 - DNA, 20 bp, Artificial
  CRISPR gRNA sequence
ggaggctgaggtgggtggat

SEQ ID NO: 76436 - DNA, 20 bp, Artificial
  CRISPR gRNA sequence
aggtgggtggatcatctgag

SEQ ID NO: 76437 - DNA, 20 bp, Artificial
  CRISPR gRNA sequence
aggtcaggagtctgggacca

SEQ ID NO: 76438 - DNA, 20 bp, Artificial
  CRISPR gRNA sequence
ggaccagcctgggcaacatg

SEQ ID NO: 76439 - DNA, 20 bp, Artificial
  CRISPR gRNA sequence
ggcaacatggtgaaattcca

SEQ ID NO: 76440 - DNA, 20 bp, Artificial
  CRISPR gRNA sequence
cacctctactacaaaaaacg

SEQ ID NO: 76441 - DNA, 20 bp, Artificial
  CRISPR gRNA sequence
tactacaaaaaacgaaaaaa

SEQ ID NO: 76442 - DNA, 20 bp, Artificial
  CRISPR gRNA sequence
ctacaaaaaacgaaaaaaaa

SEQ ID NO: 76443 - DNA, 20 bp, Artificial
  CRISPR gRNA sequence
caaaaaacgaaaaaaaaatt

SEQ ID NO: 76444 - DNA, 20 bp, Artificial
  CRISPR gRNA sequence
gccaggcgtggtggtgcaca

SEQ ID NO: 76445 - DNA, 20 bp, Artificial
  CRISPR gRNA sequence
tagtaatagctactcaggag

SEQ ID NO: 76446 - DNA, 20 bp, Artificial
  CRISPR gRNA sequence
ctcaggaggctgaggcatgg

SEQ ID NO: 76447 - DNA, 20 bp, Artificial
  CRISPR gRNA sequence
aggaggctgaggcatgggaa

SEQ ID NO: 76448 - DNA, 20 bp, Artificial
  CRISPR gRNA sequence
aggcatgggaatcacttgaa

SEQ ID NO: 76449 - DNA, 20 bp, Artificial
  CRISPR gRNA sequence
gaacctgggaggcagaggtt

SEQ ID NO: 76450 - DNA, 20 bp, Artificial
  CRISPR gRNA sequence
aacctgggaggcagaggttg

SEQ ID NO: 76451 - DNA, 20 bp, Artificial
  CRISPR gRNA sequence
ggaggcagaggttgcagtga

SEQ ID NO: 76452 - DNA, 20 bp, Artificial
  CRISPR gRNA sequence
cagtgagccaagatcgtacc

SEQ ID NO: 76453 - DNA, 20 bp, Artificial
  CRISPR gRNA sequence
cactccagcctgggtgacag

SEQ ID NO: 76454 - DNA, 20 bp, Artificial
  CRISPR gRNA sequence
cagcctgggtgacagagcga

SEQ ID NO: 76455 - DNA, 20 bp, Artificial
  CRISPR gRNA sequence
ggtgacagagcgagtctcta

SEQ ID NO: 76456 - DNA, 20 bp, Artificial
  CRISPR gRNA sequence
tatctcaaaaaaataaaaaa

SEQ ID NO: 76457 - DNA, 20 bp, Artificial
  CRISPR gRNA sequence
tctcaaaaaaataaaaaaga

SEQ ID NO: 76458 - DNA, 20 bp, Artificial
  CRISPR gRNA sequence
aaaaaaataaaaaagaaaag

SEQ ID NO: 76459 - DNA, 20 bp, Artificial
  CRISPR gRNA sequence
ccttaacccagaggagtgga

SEQ ID NO: 76460 - DNA, 20 bp, Artificial
  CRISPR gRNA sequence
aacccagaggagtggatatg

SEQ ID NO: 76461 - DNA, 20 bp, Artificial
  CRISPR gRNA sequence
acccagaggagtggatatga

SEQ ID NO: 76462 - DNA, 20 bp, Artificial
  CRISPR gRNA sequence
agcatacaacaggtcagcga

SEQ ID NO: 76463 - DNA, 20 bp, Artificial
  CRISPR gRNA sequence
gcttgggtctctagttgccc

SEQ ID NO: 76464 - DNA, 20 bp, Artificial
  CRISPR gRNA sequence
gggtctctagttgcccatta

SEQ ID NO: 76465 - DNA, 20 bp, Artificial
  CRISPR gRNA sequence
ggtctctagttgcccattaa

SEQ ID NO: 76466 - DNA, 20 bp, Artificial
  CRISPR gRNA sequence
tagttgcccattaacaccag

SEQ ID NO: 76467 - DNA, 20 bp, Artificial
  CRISPR gRNA sequence
gttgcccattaacaccagac

SEQ ID NO: 76468 - DNA, 20 bp, Artificial
  CRISPR gRNA sequence
cccattaacaccagaccaac

SEQ ID NO: 76469 - DNA, 20 bp, Artificial
  CRISPR gRNA sequence
acaccagaccaaccagctca

SEQ ID NO: 76470 - DNA, 20 bp, Artificial
  CRISPR gRNA sequence
atcattgttcagataattcg

SEQ ID NO: 76471 - DNA, 20 bp, Artificial
  CRISPR gRNA sequence
ttcagataattcgtcagaac

SEQ ID NO: 76472 - DNA, 20 bp, Artificial
  CRISPR gRNA sequence
agataattcgtcagaaccca

SEQ ID NO: 76473 - DNA, 20 bp, Artificial
  CRISPR gRNA sequence
gtcagaacccagtgcattta

SEQ ID NO: 76474 - DNA, 20 bp, Artificial
  CRISPR gRNA sequence
aggagaaactccagatacct

SEQ ID NO: 76475 - DNA, 20 bp, Artificial
  CRISPR gRNA sequence
ggagaaactccagatacctg

SEQ ID NO: 76476 - DNA, 20 bp, Artificial
  CRISPR gRNA sequence
cagatacctgccttgctgtc

SEQ ID NO: 76477 - DNA, 20 bp, Artificial
  CRISPR gRNA sequence
ccttgctgtctctgctctag

SEQ ID NO: 76478 - DNA, 20 bp, Artificial
  CRISPR gRNA sequence
gctgtctctgctctagatgg

SEQ ID NO: 76479 - DNA, 20 bp, Artificial
  CRISPR gRNA sequence
ctgtctctgctctagatgga

SEQ ID NO: 76480 - DNA, 20 bp, Artificial
  CRISPR gRNA sequence
tctctgctctagatggagga

SEQ ID NO: 76481 - DNA, 20 bp, Artificial
  CRISPR gRNA sequence
tgctctagatggaggaccag

SEQ ID NO: 76482 - DNA, 20 bp, Artificial
  CRISPR gRNA sequence
ctctagatggaggaccagga

SEQ ID NO: 76483 - DNA, 20 bp, Artificial
  CRISPR gRNA sequence
tagatggaggaccaggacaa

SEQ ID NO: 76484 - DNA, 20 bp, Artificial
  CRISPR gRNA sequence
gatggaggaccaggacaact

SEQ ID NO: 76485 - DNA, 20 bp, Artificial
  CRISPR gRNA sequence
aagacactgagttccctggg

SEQ ID NO: 76486 - DNA, 20 bp, Artificial
  CRISPR gRNA sequence
agttccctggggtttaccta

SEQ ID NO: 76487 - DNA, 20 bp, Artificial
  CRISPR gRNA sequence
cctggggtttacctacagcc

SEQ ID NO: 76488 - DNA, 20 bp, Artificial
  CRISPR gRNA sequence
gggtttacctacagcccctt

SEQ ID NO: 76489 - DNA, 20 bp, Artificial
  CRISPR gRNA sequence
acctacagccccttcctggg

SEQ ID NO: 76490 - DNA, 20 bp, Artificial
  CRISPR gRNA sequence
cctacagccccttcctgggg

SEQ ID NO: 76491 - DNA, 20 bp, Artificial
  CRISPR gRNA sequence
cagccccttcctggggggcc

SEQ ID NO: 76492 - DNA, 20 bp, Artificial
  CRISPR gRNA sequence
cctggggggcctggagccac

SEQ ID NO: 76493 - DNA, 20 bp, Artificial
  CRISPR gRNA sequence
ctggggggcctggagccact

SEQ ID NO: 76494 - DNA, 20 bp, Artificial
  CRISPR gRNA sequence
gggggcctggagccacttcc

SEQ ID NO: 76495 - DNA, 20 bp, Artificial
  CRISPR gRNA sequence
gagccacttcccaacccccg

SEQ ID NO: 76496 - DNA, 20 bp, Artificial
  CRISPR gRNA sequence
cccaacccccgcagacctct

SEQ ID NO: 76497 - DNA, 20 bp, Artificial
  CRISPR gRNA sequence
ccaacccccgcagacctcta

SEQ ID NO: 76498 - DNA, 20 bp, Artificial
  CRISPR gRNA sequence
tactatgttctccttctgcc

SEQ ID NO: 76499 - DNA, 20 bp, Artificial
  CRISPR gRNA sequence
ctatgttctccttctgcctt

SEQ ID NO: 76500 - DNA, 20 bp, Artificial
  CRISPR gRNA sequence
tgttctccttctgccttctc

SEQ ID NO: 76501 - DNA, 20 bp, Artificial
  CRISPR gRNA sequence
tccttctgccttctccacct

SEQ ID NO: 76502 - DNA, 20 bp, Artificial
  CRISPR gRNA sequence
cttctgccttctccacctcc

SEQ ID NO: 76503 - DNA, 20 bp, Artificial
  CRISPR gRNA sequence
ctgccttctccacctccccc

SEQ ID NO: 76504 - DNA, 20 bp, Artificial
  CRISPR gRNA sequence
tgccttctccacctccccct

SEQ ID NO: 76505 - DNA, 20 bp, Artificial
  CRISPR gRNA sequence
ccttctccacctcccccttc

SEQ ID NO: 76506 - DNA, 20 bp, Artificial
  CRISPR gRNA sequence
ctccacctcccccttcctct

SEQ ID NO: 76507 - DNA, 20 bp, Artificial
  CRISPR gRNA sequence
tccacctcccccttcctctc

SEQ ID NO: 76508 - DNA, 20 bp, Artificial
  CRISPR gRNA sequence
cacctcccccttcctctctt

SEQ ID NO: 76509 - DNA, 20 bp, Artificial
  CRISPR gRNA sequence
ccccttcctctctttctgtt

SEQ ID NO: 76510 - DNA, 20 bp, Artificial
  CRISPR gRNA sequence
cctctctttctgttccttca

SEQ ID NO: 76511 - DNA, 20 bp, Artificial
  CRISPR gRNA sequence
ctctctttctgttccttcat

SEQ ID NO: 76512 - DNA, 20 bp, Artificial
  CRISPR gRNA sequence
tctttctgttccttcatcct

SEQ ID NO: 76513 - DNA, 20 bp, Artificial
  CRISPR gRNA sequence
tttctgttccttcatcctct

SEQ ID NO: 76514 - DNA, 20 bp, Artificial
  CRISPR gRNA sequence
tctgttccttcatcctctgc

SEQ ID NO: 76515 - DNA, 20 bp, Artificial
  CRISPR gRNA sequence
ctgttccttcatcctctgca

SEQ ID NO: 76516 - DNA, 20 bp, Artificial
  CRISPR gRNA sequence
tgttccttcatcctctgcag

SEQ ID NO: 76517 - DNA, 20 bp, Artificial
  CRISPR gRNA sequence
ttccttcatcctctgcaggc

SEQ ID NO: 76518 - DNA, 20 bp, Artificial
  CRISPR gRNA sequence
cttcatcctctgcaggctgc

SEQ ID NO: 76519 - DNA, 20 bp, Artificial
  CRISPR gRNA sequence
catcctctgcaggctgccct

SEQ ID NO: 76520 - DNA, 20 bp, Artificial
  CRISPR gRNA sequence
atcctctgcaggctgccctc

SEQ ID NO: 76521 - DNA, 20 bp, Artificial
  CRISPR gRNA sequence
tgcaggctgccctctcccct

SEQ ID NO: 76522 - DNA, 20 bp, Artificial
  CRISPR gRNA sequence
caggctgccctctcccctct

SEQ ID NO: 76523 - DNA, 20 bp, Artificial
  CRISPR gRNA sequence
ccctctcccctctccggggc

SEQ ID NO: 76524 - DNA, 20 bp, Artificial
  CRISPR gRNA sequence
tcccctctccggggcctcca

SEQ ID NO: 76525 - DNA, 20 bp, Artificial
  CRISPR gRNA sequence
ccctctccggggcctccaag

SEQ ID NO: 76526 - DNA, 20 bp, Artificial
  CRISPR gRNA sequence
tccggggcctccaagggcct

SEQ ID NO: 76527 - DNA, 20 bp, Artificial
  CRISPR gRNA sequence
cggggcctccaagggcctgg

SEQ ID NO: 76528 - DNA, 20 bp, Artificial
  CRISPR gRNA sequence
caagggcctggcccatctct

SEQ ID NO: 76529 - DNA, 20 bp, Artificial
  CRISPR gRNA sequence
gcccatctctgctgctttct

SEQ ID NO: 76530 - DNA, 20 bp, Artificial
  CRISPR gRNA sequence
tgctgctttctcctctggct

SEQ ID NO: 76531 - DNA, 20 bp, Artificial
  CRISPR gRNA sequence
ctgctttctcctctggctgt

SEQ ID NO: 76532 - DNA, 20 bp, Artificial
  CRISPR gRNA sequence
ctttctcctctggctgtttg

SEQ ID NO: 76533 - DNA, 20 bp, Artificial
  CRISPR gRNA sequence
tctcctctggctgtttggag

SEQ ID NO: 76534 - DNA, 20 bp, Artificial
  CRISPR gRNA sequence
ctcctctggctgtttggagg

SEQ ID NO: 76535 - DNA, 20 bp, Artificial
  CRISPR gRNA sequence
tcctctggctgtttggaggg

SEQ ID NO: 76536 - DNA, 20 bp, Artificial
  CRISPR gRNA sequence
ctctggctgtttggagggga

SEQ ID NO: 76537 - DNA, 20 bp, Artificial
  CRISPR gRNA sequence
tggctgtttggaggggaggc

SEQ ID NO: 76538 - DNA, 20 bp, Artificial
  CRISPR gRNA sequence
gctgtttggaggggaggcat

SEQ ID NO: 76539 - DNA, 20 bp, Artificial
  CRISPR gRNA sequence
tttggaggggaggcatggag

SEQ ID NO: 76540 - DNA, 20 bp, Artificial
  CRISPR gRNA sequence
ggaggggaggcatggagtac

SEQ ID NO: 76541 - DNA, 20 bp, Artificial
  CRISPR gRNA sequence
gaggggaggcatggagtaca

SEQ ID NO: 76542 - DNA, 20 bp, Artificial
  CRISPR gRNA sequence
catcaactggctcagtgagc

SEQ ID NO: 76543 - DNA, 20 bp, Artificial
  CRISPR gRNA sequence
gctcagtgagctggggggca

SEQ ID NO: 76544 - DNA, 20 bp, Artificial
  CRISPR gRNA sequence
agtgagctggggggcagggt

SEQ ID NO: 76545 - DNA, 20 bp, Artificial
  CRISPR gRNA sequence
gggggcagggtagggcggga

SEQ ID NO: 76546 - DNA, 20 bp, Artificial
  CRISPR gRNA sequence
atgttggagcctctgccagg

SEQ ID NO: 76547 - DNA, 20 bp, Artificial
  CRISPR gRNA sequence
gagcctctgccagggcccag

SEQ ID NO: 76548 - DNA, 20 bp, Artificial
  CRISPR gRNA sequence
tgccagggcccaggctggag

SEQ ID NO: 76549 - DNA, 20 bp, Artificial
  CRISPR gRNA sequence
ccagggcccaggctggaggc

SEQ ID NO: 76550 - DNA, 20 bp, Artificial
  CRISPR gRNA sequence
gaggcccaactctacccttt

SEQ ID NO: 76551 - DNA, 20 bp, Artificial
  CRISPR gRNA sequence
taccctttctgccccaggga

SEQ ID NO: 76552 - DNA, 20 bp, Artificial
  CRISPR gRNA sequence
ccctttctgccccagggact

SEQ ID NO: 76553 - DNA, 20 bp, Artificial
  CRISPR gRNA sequence
tctgccccagggactgggca

SEQ ID NO: 76554 - DNA, 20 bp, Artificial
  CRISPR gRNA sequence
ctgccccagggactgggcat

SEQ ID NO: 76555 - DNA, 20 bp, Artificial
  CRISPR gRNA sequence
tgccccagggactgggcatg

SEQ ID NO: 76556 - DNA, 20 bp, Artificial
  CRISPR gRNA sequence
ccccagggactgggcatggg

SEQ ID NO: 76557 - DNA, 20 bp, Artificial
  CRISPR gRNA sequence
ggcatgggcccctgaggcac

SEQ ID NO: 76558 - DNA, 20 bp, Artificial
  CRISPR gRNA sequence
aggcacagtcaggactgggg

SEQ ID NO: 76559 - DNA, 20 bp, Artificial
  CRISPR gRNA sequence
gggcctttattgagggtggt

SEQ ID NO: 76560 - DNA, 20 bp, Artificial
  CRISPR gRNA sequence
tattgagggtggtctttcca

SEQ ID NO: 76561 - DNA, 20 bp, Artificial
  CRISPR gRNA sequence
attgagggtggtctttccag

SEQ ID NO: 76562 - DNA, 20 bp, Artificial
  CRISPR gRNA sequence
ttgagggtggtctttccaga

SEQ ID NO: 76563 - DNA, 20 bp, Artificial
  CRISPR gRNA sequence
agggtggtctttccagaaac

SEQ ID NO: 76564 - DNA, 20 bp, Artificial
  CRISPR gRNA sequence
tccagaaacacatcccgtat

SEQ ID NO: 76565 - DNA, 20 bp, Artificial
  CRISPR gRNA sequence
ccagaaacacatcccgtatg

SEQ ID NO: 76566 - DNA, 20 bp, Artificial
  CRISPR gRNA sequence
cagaaacacatcccgtatgg

SEQ ID NO: 76567 - DNA, 20 bp, Artificial
  CRISPR gRNA sequence
tggttggcaaaggaggtgat

SEQ ID NO: 76568 - DNA, 20 bp, Artificial
  CRISPR gRNA sequence
gttggcaaaggaggtgatta

SEQ ID NO: 76569 - DNA, 20 bp, Artificial
  CRISPR gRNA sequence
gcaaaggaggtgattacacc

SEQ ID NO: 76570 - DNA, 20 bp, Artificial
  CRISPR gRNA sequence
caccctcctttttttttttt

SEQ ID NO: 76571 - DNA, 20 bp, Artificial
  CRISPR gRNA sequence
cttttttttttttttaaagc

SEQ ID NO: 76572 - DNA, 20 bp, Artificial
  CRISPR gRNA sequence
ttttttttttttaaagcaat

SEQ ID NO: 76573 - DNA, 20 bp, Artificial
  CRISPR gRNA sequence
tttttttttttaaagcaatg

SEQ ID NO: 76574 - DNA, 20 bp, Artificial
  CRISPR gRNA sequence
ttttttttttaaagcaatgg

SEQ ID NO: 76575 - DNA, 20 bp, Artificial
  CRISPR gRNA sequence
tttttttttaaagcaatgga

SEQ ID NO: 76576 - DNA, 20 bp, Artificial
  CRISPR gRNA sequence
ttttttttaaagcaatggaa

SEQ ID NO: 76577 - DNA, 20 bp, Artificial
  CRISPR gRNA sequence
tttttttaaagcaatggaat

SEQ ID NO: 76578 - DNA, 20 bp, Artificial
  CRISPR gRNA sequence
ttttttaaagcaatggaatc

SEQ ID NO: 76579 - DNA, 20 bp, Artificial
  CRISPR gRNA sequence
tttttaaagcaatggaatct

SEQ ID NO: 76580 - DNA, 20 bp, Artificial
  CRISPR gRNA sequence
ttttaaagcaatggaatctt

SEQ ID NO: 76581 - DNA, 20 bp, Artificial
  CRISPR gRNA sequence
tttaaagcaatggaatcttt

SEQ ID NO: 76582 - DNA, 20 bp, Artificial
  CRISPR gRNA sequence
ttaaagcaatggaatcttta

SEQ ID NO: 76583 - DNA, 20 bp, Artificial
  CRISPR gRNA sequence
taaagcaatggaatctttac

SEQ ID NO: 76584 - DNA, 20 bp, Artificial
  CRISPR gRNA sequence
aaagcaatggaatctttact

SEQ ID NO: 76585 - DNA, 20 bp, Artificial
  CRISPR gRNA sequence
aagcaatggaatctttactc

SEQ ID NO: 76586 - DNA, 20 bp, Artificial
  CRISPR gRNA sequence
tactctttaccacatcccac

SEQ ID NO: 76587 - DNA, 20 bp, Artificial
  CRISPR gRNA sequence
actctttaccacatcccaca

SEQ ID NO: 76588 - DNA, 20 bp, Artificial
  CRISPR gRNA sequence
ctctttaccacatcccacat

SEQ ID NO: 76589 - DNA, 20 bp, Artificial
  CRISPR gRNA sequence
tttaccacatcccacatggt

SEQ ID NO: 76590 - DNA, 20 bp, Artificial
  CRISPR gRNA sequence
taccacatcccacatggtat

SEQ ID NO: 76591 - DNA, 20 bp, Artificial
  CRISPR gRNA sequence
accacatcccacatggtatg

SEQ ID NO: 76592 - DNA, 20 bp, Artificial
  CRISPR gRNA sequence
ccacatcccacatggtatgc

SEQ ID NO: 76593 - DNA, 20 bp, Artificial
  CRISPR gRNA sequence
cagtgcttgaattcagggag

SEQ ID NO: 76594 - DNA, 20 bp, Artificial
  CRISPR gRNA sequence
gaattcagggaggggggatg

SEQ ID NO: 76595 - DNA, 20 bp, Artificial
  CRISPR gRNA sequence
aattcagggaggggggatgg

SEQ ID NO: 76596 - DNA, 20 bp, Artificial
  CRISPR gRNA sequence
agggaggggggatggagccc

SEQ ID NO: 76597 - DNA, 20 bp, Artificial
  CRISPR gRNA sequence
tcttccctggcttccccggt

SEQ ID NO: 76598 - DNA, 20 bp, Artificial
  CRISPR gRNA sequence
ccctggcttccccggtggaa

SEQ ID NO: 76599 - DNA, 20 bp, Artificial
  CRISPR gRNA sequence
cctggcttccccggtggaac

SEQ ID NO: 76600 - DNA, 20 bp, Artificial
  CRISPR gRNA sequence
gcttccccggtggaaccccg

SEQ ID NO: 76601 - DNA, 20 bp, Artificial
  CRISPR gRNA sequence
ccccggtggaaccccgggga

SEQ ID NO: 76602 - DNA, 20 bp, Artificial
  CRISPR gRNA sequence
cccggtggaaccccggggaa

SEQ ID NO: 76603 - DNA, 20 bp, Artificial
  CRISPR gRNA sequence
gacttcagcattgagtacct

SEQ ID NO: 76604 - DNA, 20 bp, Artificial
  CRISPR gRNA sequence
cagcattgagtaccttgatg

SEQ ID NO: 76605 - DNA, 20 bp, Artificial
  CRISPR gRNA sequence
agcattgagtaccttgatga

SEQ ID NO: 76606 - DNA, 20 bp, Artificial
  CRISPR gRNA sequence
agtaccttgatgactattta

SEQ ID NO: 76607 - DNA, 20 bp, Artificial
  CRISPR gRNA sequence
gatgactatttatagcaata

SEQ ID NO: 76608 - DNA, 20 bp, Artificial
  CRISPR gRNA sequence
atgactatttatagcaataa

SEQ ID NO: 76609 - DNA, 20 bp, Artificial
  CRISPR gRNA sequence
tttatagcaataatcctgca

SEQ ID NO: 76610 - DNA, 20 bp, Artificial
  CRISPR gRNA sequence
atagcaataatcctgcaagt

SEQ ID NO: 76611 - DNA, 20 bp, Artificial
  CRISPR gRNA sequence
tagcaataatcctgcaagtg

SEQ ID NO: 76612 - DNA, 20 bp, Artificial
  CRISPR gRNA sequence
caagtgatcacagtactcta

SEQ ID NO: 76613 - DNA, 20 bp, Artificial
  CRISPR gRNA sequence
tacagttgacaaagtgcttt

SEQ ID NO: 76614 - DNA, 20 bp, Artificial
  CRISPR gRNA sequence
cagttgacaaagtgctttca

SEQ ID NO: 76615 - DNA, 20 bp, Artificial
  CRISPR gRNA sequence
acaaagtgctttcatattca

SEQ ID NO: 76616 - DNA, 20 bp, Artificial
  CRISPR gRNA sequence
tcatattcactattgcactt

SEQ ID NO: 76617 - DNA, 20 bp, Artificial
  CRISPR gRNA sequence
catattcactattgcacttt

SEQ ID NO: 76618 - DNA, 20 bp, Artificial
  CRISPR gRNA sequence
atattcactattgcactttc

SEQ ID NO: 76619 - DNA, 20 bp, Artificial
  CRISPR gRNA sequence
actattgcactttccccaac

SEQ ID NO: 76620 - DNA, 20 bp, Artificial
  CRISPR gRNA sequence
ttgcactttccccaaccaca

SEQ ID NO: 76621 - DNA, 20 bp, Artificial
  CRISPR gRNA sequence
cactttccccaaccacaggt

SEQ ID NO: 76622 - DNA, 20 bp, Artificial
  CRISPR gRNA sequence
tccccaaccacaggtaatgg

SEQ ID NO: 76623 - DNA, 20 bp, Artificial
  CRISPR gRNA sequence
ccccaaccacaggtaatgga

SEQ ID NO: 76624 - DNA, 20 bp, Artificial
  CRISPR gRNA sequence
cccaaccacaggtaatggag

SEQ ID NO: 76625 - DNA, 20 bp, Artificial
  CRISPR gRNA sequence
aaactcccacctgtgctcag

SEQ ID NO: 76626 - DNA, 20 bp, Artificial
  CRISPR gRNA sequence
ccacctgtgctcagaccgcc

SEQ ID NO: 76627 - DNA, 20 bp, Artificial
  CRISPR gRNA sequence
tgctcagaccgcccagtgct

SEQ ID NO: 76628 - DNA, 20 bp, Artificial
  CRISPR gRNA sequence
agaccgcccagtgctgccag

SEQ ID NO: 76629 - DNA, 20 bp, Artificial
  CRISPR gRNA sequence
ccagtgggctttatttattt

SEQ ID NO: 76630 - DNA, 20 bp, Artificial
  CRISPR gRNA sequence
tatttatttatttatttatt

SEQ ID NO: 76631 - DNA, 20 bp, Artificial
  CRISPR gRNA sequence
atttatttatttatttattt

SEQ ID NO: 76632 - DNA, 20 bp, Artificial
  CRISPR gRNA sequence
tttatttatttatttattta

SEQ ID NO: 76633 - DNA, 20 bp, Artificial
  CRISPR gRNA sequence
atttatttatttatttattt

SEQ ID NO: 76634 - DNA, 20 bp, Artificial
  CRISPR gRNA sequence
tttatttatttatttattta

SEQ ID NO: 76635 - DNA, 20 bp, Artificial
  CRISPR gRNA sequence
atttatttatttatttattt

SEQ ID NO: 76636 - DNA, 20 bp, Artificial
  CRISPR gRNA sequence
tttatttatttatttattta

SEQ ID NO: 76637 - DNA, 20 bp, Artificial
  CRISPR gRNA sequence
atttatttatttatttattt

SEQ ID NO: 76638 - DNA, 20 bp, Artificial
  CRISPR gRNA sequence
tttatttatttatttattta

SEQ ID NO: 76639 - DNA, 20 bp, Artificial
  CRISPR gRNA sequence
atttatttatttatttattt

SEQ ID NO: 76640 - DNA, 20 bp, Artificial
  CRISPR gRNA sequence
tttatttatttatttatttg

SEQ ID NO: 76641 - DNA, 20 bp, Artificial
  CRISPR gRNA sequence
atttatttatttatttgaga

SEQ ID NO: 76642 - DNA, 20 bp, Artificial
  CRISPR gRNA sequence
tttatttatttatttgagac

SEQ ID NO: 76643 - DNA, 20 bp, Artificial
  CRISPR gRNA sequence
atttatttatttgagacaga

SEQ ID NO: 76644 - DNA, 20 bp, Artificial
  CRISPR gRNA sequence
tttatttatttgagacagag

SEQ ID NO: 76645 - DNA, 20 bp, Artificial
  CRISPR gRNA sequence
atttatttgagacagagtct

SEQ ID NO: 76646 - DNA, 20 bp, Artificial
  CRISPR gRNA sequence
tttatttgagacagagtctt

SEQ ID NO: 76647 - DNA, 20 bp, Artificial
  CRISPR gRNA sequence
atttgagacagagtcttgct

SEQ ID NO: 76648 - DNA, 20 bp, Artificial
  CRISPR gRNA sequence
tttgagacagagtcttgctc

SEQ ID NO: 76649 - DNA, 20 bp, Artificial
  CRISPR gRNA sequence
gagacagagtcttgctctgt

SEQ ID NO: 76650 - DNA, 20 bp, Artificial
  CRISPR gRNA sequence
agacagagtcttgctctgtt

SEQ ID NO: 76651 - DNA, 20 bp, Artificial
  CRISPR gRNA sequence
gctctgttgcccaggctgga

SEQ ID NO: 76652 - DNA, 20 bp, Artificial
  CRISPR gRNA sequence
ctctgttgcccaggctggag

SEQ ID NO: 76653 - DNA, 20 bp, Artificial
  CRISPR gRNA sequence
tgttgcccaggctggaggac

SEQ ID NO: 76654 - DNA, 20 bp, Artificial
  CRISPR gRNA sequence
ttgcccaggctggaggacag

SEQ ID NO: 76655 - DNA, 20 bp, Artificial
  CRISPR gRNA sequence
cccaggctggaggacagtgg

SEQ ID NO: 76656 - DNA, 20 bp, Artificial
  CRISPR gRNA sequence
gaggacagtggcgcagtctt

SEQ ID NO: 76657 - DNA, 20 bp, Artificial
  CRISPR gRNA sequence
ggctcaccacaatctctgcc

SEQ ID NO: 76658 - DNA, 20 bp, Artificial
  CRISPR gRNA sequence
gctcaccacaatctctgcct

SEQ ID NO: 76659 - DNA, 20 bp, Artificial
  CRISPR gRNA sequence
accacaatctctgcctcccg

SEQ ID NO: 76660 - DNA, 20 bp, Artificial
  CRISPR gRNA sequence
tgcctcccgggttcaagcaa

SEQ ID NO: 76661 - DNA, 20 bp, Artificial
  CRISPR gRNA sequence
cctcccgggttcaagcaagt

SEQ ID NO: 76662 - DNA, 20 bp, Artificial
  CRISPR gRNA sequence
ccgggttcaagcaagtctcc

SEQ ID NO: 76663 - DNA, 20 bp, Artificial
  CRISPR gRNA sequence
aagcaagtctcctgcctgcc

SEQ ID NO: 76664 - DNA, 20 bp, Artificial
  CRISPR gRNA sequence
ctgcctgcctccagagtagc

SEQ ID NO: 76665 - DNA, 20 bp, Artificial
  CRISPR gRNA sequence
cctgcctccagagtagctgg

SEQ ID NO: 76666 - DNA, 20 bp, Artificial
  CRISPR gRNA sequence
cctccagagtagctgggatt

SEQ ID NO: 76667 - DNA, 20 bp, Artificial
  CRISPR gRNA sequence
cagagtagctgggattacag

SEQ ID NO: 76668 - DNA, 20 bp, Artificial
  CRISPR gRNA sequence
ggattacaggggtgcaccac

SEQ ID NO: 76669 - DNA, 20 bp, Artificial
  CRISPR gRNA sequence
caggggtgcaccaccatgcc

SEQ ID NO: 76670 - DNA, 20 bp, Artificial
  CRISPR gRNA sequence
gctaatttttgtatttttag

SEQ ID NO: 76671 - DNA, 20 bp, Artificial
  CRISPR gRNA sequence
atttttgtatttttagtaga

SEQ ID NO: 76672 - DNA, 20 bp, Artificial
  CRISPR gRNA sequence
ttgtatttttagtagagatg

SEQ ID NO: 76673 - DNA, 20 bp, Artificial
  CRISPR gRNA sequence
tgtatttttagtagagatgg

SEQ ID NO: 76674 - DNA, 20 bp, Artificial
  CRISPR gRNA sequence
gtatttttagtagagatggg

SEQ ID NO: 76675 - DNA, 20 bp, Artificial
  CRISPR gRNA sequence
tatttttagtagagatgggg

SEQ ID NO: 76676 - DNA, 20 bp, Artificial
  CRISPR gRNA sequence
ttagtagagatggggtttca

SEQ ID NO: 76677 - DNA, 20 bp, Artificial
  CRISPR gRNA sequence
tagtagagatggggtttcac

SEQ ID NO: 76678 - DNA, 20 bp, Artificial
  CRISPR gRNA sequence
agtagagatggggtttcact

SEQ ID NO: 76679 - DNA, 20 bp, Artificial
  CRISPR gRNA sequence
gtagagatggggtttcacta

SEQ ID NO: 76680 - DNA, 20 bp, Artificial
  CRISPR gRNA sequence
cactatgttggccaggctag

SEQ ID NO: 76681 - DNA, 20 bp, Artificial
  CRISPR gRNA sequence
actatgttggccaggctagt

SEQ ID NO: 76682 - DNA, 20 bp, Artificial
  CRISPR gRNA sequence
tgttggccaggctagtctcg

SEQ ID NO: 76683 - DNA, 20 bp, Artificial
  CRISPR gRNA sequence
gccaggctagtctcgaactc

SEQ ID NO: 76684 - DNA, 20 bp, Artificial
  CRISPR gRNA sequence
gtctcgaactcctgacctca

SEQ ID NO: 76685 - DNA, 20 bp, Artificial
  CRISPR gRNA sequence
gaactcctgacctcatgatc

SEQ ID NO: 76686 - DNA, 20 bp, Artificial
  CRISPR gRNA sequence
ctgacctcatgatccagcca

SEQ ID NO: 76687 - DNA, 20 bp, Artificial
  CRISPR gRNA sequence
acctcatgatccagccacct

SEQ ID NO: 76688 - DNA, 20 bp, Artificial
  CRISPR gRNA sequence
atgatccagccacctcggcc

SEQ ID NO: 76689 - DNA, 20 bp, Artificial
  CRISPR gRNA sequence
ggcctcccaaagtgctggga

SEQ ID NO: 76690 - DNA, 20 bp, Artificial
  CRISPR gRNA sequence
ccaaagtgctgggattatag

SEQ ID NO: 76691 - DNA, 20 bp, Artificial
  CRISPR gRNA sequence
ggattataggcgtgagtcac

SEQ ID NO: 76692 - DNA, 20 bp, Artificial
  CRISPR gRNA sequence
taggcgtgagtcaccgtgcc

SEQ ID NO: 76693 - DNA, 20 bp, Artificial
  CRISPR gRNA sequence
tttatattaagcttcctctg

SEQ ID NO: 76694 - DNA, 20 bp, Artificial
  CRISPR gRNA sequence
ttatattaagcttcctctgc

SEQ ID NO: 76695 - DNA, 20 bp, Artificial
  CRISPR gRNA sequence
tatattaagcttcctctgca

SEQ ID NO: 76696 - DNA, 20 bp, Artificial
  CRISPR gRNA sequence
atattaagcttcctctgcag

SEQ ID NO: 76697 - DNA, 20 bp, Artificial
  CRISPR gRNA sequence
tattaagcttcctctgcaga

SEQ ID NO: 76698 - DNA, 20 bp, Artificial
  CRISPR gRNA sequence
agcttcctctgcagatgatt

SEQ ID NO: 76699 - DNA, 20 bp, Artificial
  CRISPR gRNA sequence
cctctgcagatgatttgcct

SEQ ID NO: 76700 - DNA, 20 bp, Artificial
  CRISPR gRNA sequence
ctctgcagatgatttgcctt

SEQ ID NO: 76701 - DNA, 20 bp, Artificial
  CRISPR gRNA sequence
tgcagatgatttgccttggc

SEQ ID NO: 76702 - DNA, 20 bp, Artificial
  CRISPR gRNA sequence
cagatgatttgccttggcca

SEQ ID NO: 76703 - DNA, 20 bp, Artificial
  CRISPR gRNA sequence
gccttggccagcagagcccg

SEQ ID NO: 76704 - DNA, 20 bp, Artificial
  CRISPR gRNA sequence
ccttggccagcagagcccgc

SEQ ID NO: 76705 - DNA, 20 bp, Artificial
  CRISPR gRNA sequence
ggccagcagagcccgcatcc

SEQ ID NO: 76706 - DNA, 20 bp, Artificial
  CRISPR gRNA sequence
gccagcagagcccgcatccc

SEQ ID NO: 76707 - DNA, 20 bp, Artificial
  CRISPR gRNA sequence
cttgtgttcccaggatctgg

SEQ ID NO: 76708 - DNA, 20 bp, Artificial
  CRISPR gRNA sequence
gtgttcccaggatctggccc

SEQ ID NO: 76709 - DNA, 20 bp, Artificial
  CRISPR gRNA sequence
tgttcccaggatctggccca

SEQ ID NO: 76710 - DNA, 20 bp, Artificial
  CRISPR gRNA sequence
ccaggatctggcccagtgca

SEQ ID NO: 76711 - DNA, 20 bp, Artificial
  CRISPR gRNA sequence
gcccagtgcatggtatacaa

SEQ ID NO: 76712 - DNA, 20 bp, Artificial
  CRISPR gRNA sequence
aacagtcaaatcacgtaaga

SEQ ID NO: 76713 - DNA, 20 bp, Artificial
  CRISPR gRNA sequence
acagtcaaatcacgtaagag

SEQ ID NO: 76714 - DNA, 20 bp, Artificial
  CRISPR gRNA sequence
tttgtagcactgactgcagt

SEQ ID NO: 76715 - DNA, 20 bp, Artificial
  CRISPR gRNA sequence
ttgtagcactgactgcagtg

SEQ ID NO: 76716 - DNA, 20 bp, Artificial
  CRISPR gRNA sequence
tgtagcactgactgcagtgc

SEQ ID NO: 76717 - DNA, 20 bp, Artificial
  CRISPR gRNA sequence
gtagcactgactgcagtgct

SEQ ID NO: 76718 - DNA, 20 bp, Artificial
  CRISPR gRNA sequence
tagcactgactgcagtgcta

SEQ ID NO: 76719 - DNA, 20 bp, Artificial
  CRISPR gRNA sequence
actgcagtgctacacaaaac

SEQ ID NO: 76720 - DNA, 20 bp, Artificial
  CRISPR gRNA sequence
cagtgctacacaaaacaaaa

SEQ ID NO: 76721 - DNA, 20 bp, Artificial
  CRISPR gRNA sequence
cacaaaacaaaacacaacac

SEQ ID NO: 76722 - DNA, 20 bp, Artificial
  CRISPR gRNA sequence
gaagcagtttggatttcaat

SEQ ID NO: 76723 - DNA, 20 bp, Artificial
  CRISPR gRNA sequence
ggatttcaatctagaccaag

SEQ ID NO: 76724 - DNA, 20 bp, Artificial
  CRISPR gRNA sequence
gatttcaatctagaccaagt

SEQ ID NO: 76725 - DNA, 20 bp, Artificial
  CRISPR gRNA sequence
caatctagaccaagttgtcc

SEQ ID NO: 76726 - DNA, 20 bp, Artificial
  CRISPR gRNA sequence
aatctagaccaagttgtcca

SEQ ID NO: 76727 - DNA, 20 bp, Artificial
  CRISPR gRNA sequence
gaccaagttgtccaagccac

SEQ ID NO: 76728 - DNA, 20 bp, Artificial
  CRISPR gRNA sequence
tccaagccacatggcctgct

SEQ ID NO: 76729 - DNA, 20 bp, Artificial
  CRISPR gRNA sequence
ctgcatgcagcctaggatgg

SEQ ID NO: 76730 - DNA, 20 bp, Artificial
  CRISPR gRNA sequence
catgcagcctaggatggctt

SEQ ID NO: 76731 - DNA, 20 bp, Artificial
  CRISPR gRNA sequence
ggatggctttgaatacggcc

SEQ ID NO: 76732 - DNA, 20 bp, Artificial
  CRISPR gRNA sequence
tgaatacggcctaacaaaaa

SEQ ID NO: 76733 - DNA, 20 bp, Artificial
  CRISPR gRNA sequence
gaatacggcctaacaaaaat

SEQ ID NO: 76734 - DNA, 20 bp, Artificial
  CRISPR gRNA sequence
aatacggcctaacaaaaatt

SEQ ID NO: 76735 - DNA, 20 bp, Artificial
  CRISPR gRNA sequence
acaaaaattcgtaaactttc

SEQ ID NO: 76736 - DNA, 20 bp, Artificial
  CRISPR gRNA sequence
gtaaactttcttaaaacact

SEQ ID NO: 76737 - DNA, 20 bp, Artificial
  CRISPR gRNA sequence
tcttaaaacactatgagatt

SEQ ID NO: 76738 - DNA, 20 bp, Artificial
  CRISPR gRNA sequence
cttaaaacactatgagattt

SEQ ID NO: 76739 - DNA, 20 bp, Artificial
  CRISPR gRNA sequence
ttaaaacactatgagatttt

SEQ ID NO: 76740 - DNA, 20 bp, Artificial
  CRISPR gRNA sequence
aaaacactatgagatttttc

SEQ ID NO: 76741 - DNA, 20 bp, Artificial
  CRISPR gRNA sequence
aaacactatgagatttttct

SEQ ID NO: 76742 - DNA, 20 bp, Artificial
  CRISPR gRNA sequence
tgagatttttctttggagtt

SEQ ID NO: 76743 - DNA, 20 bp, Artificial
  CRISPR gRNA sequence
ttctttggagttttgttttt

SEQ ID NO: 76744 - DNA, 20 bp, Artificial
  CRISPR gRNA sequence
tctttggagttttgtttttt

SEQ ID NO: 76745 - DNA, 20 bp, Artificial
  CRISPR gRNA sequence
ctttggagttttgttttttt

SEQ ID NO: 76746 - DNA, 20 bp, Artificial
  CRISPR gRNA sequence
tttggagttttgtttttttt

SEQ ID NO: 76747 - DNA, 20 bp, Artificial
  CRISPR gRNA sequence
tggagttttgtttttttttt

SEQ ID NO: 76748 - DNA, 20 bp, Artificial
  CRISPR gRNA sequence
ggagttttgttttttttttt

SEQ ID NO: 76749 - DNA, 20 bp, Artificial
  CRISPR gRNA sequence
gagttttgtttttttttttt

SEQ ID NO: 76750 - DNA, 20 bp, Artificial
  CRISPR gRNA sequence
tgttttttttttttagcaca

SEQ ID NO: 76751 - DNA, 20 bp, Artificial
  CRISPR gRNA sequence
gttttttttttttagcacat

SEQ ID NO: 76752 - DNA, 20 bp, Artificial
  CRISPR gRNA sequence
ttttttttttttagcacatc

SEQ ID NO: 76753 - DNA, 20 bp, Artificial
  CRISPR gRNA sequence
tttttttttagcacatcagc

SEQ ID NO: 76754 - DNA, 20 bp, Artificial
  CRISPR gRNA sequence
ttttttttagcacatcagct

SEQ ID NO: 76755 - DNA, 20 bp, Artificial
  CRISPR gRNA sequence
tttttttagcacatcagcta

SEQ ID NO: 76756 - DNA, 20 bp, Artificial
  CRISPR gRNA sequence
ttttttagcacatcagctat

SEQ ID NO: 76757 - DNA, 20 bp, Artificial
  CRISPR gRNA sequence
tttttagcacatcagctatc

SEQ ID NO: 76758 - DNA, 20 bp, Artificial
  CRISPR gRNA sequence
ttttagcacatcagctatcg

SEQ ID NO: 76759 - DNA, 20 bp, Artificial
  CRISPR gRNA sequence
tttagcacatcagctatcgc

SEQ ID NO: 76760 - DNA, 20 bp, Artificial
  CRISPR gRNA sequence
ttagcacatcagctatcgct

SEQ ID NO: 76761 - DNA, 20 bp, Artificial
  CRISPR gRNA sequence
tagcacatcagctatcgcta

SEQ ID NO: 76762 - DNA, 20 bp, Artificial
  CRISPR gRNA sequence
agcacatcagctatcgctag

SEQ ID NO: 76763 - DNA, 20 bp, Artificial
  CRISPR gRNA sequence
gcacatcagctatcgctagt

SEQ ID NO: 76764 - DNA, 20 bp, Artificial
  CRISPR gRNA sequence
tcgctagtgttagtgtattt

SEQ ID NO: 76765 - DNA, 20 bp, Artificial
  CRISPR gRNA sequence
gtgttagtgtattttatgtg

SEQ ID NO: 76766 - DNA, 20 bp, Artificial
  CRISPR gRNA sequence
gtgtattttatgtgtggccc

SEQ ID NO: 76767 - DNA, 20 bp, Artificial
  CRISPR gRNA sequence
tatgtgtggcccaagacaat

SEQ ID NO: 76768 - DNA, 20 bp, Artificial
  CRISPR gRNA sequence
atgtgtggcccaagacaatt

SEQ ID NO: 76769 - DNA, 20 bp, Artificial
  CRISPR gRNA sequence
tgtgtggcccaagacaattc

SEQ ID NO: 76770 - DNA, 20 bp, Artificial
  CRISPR gRNA sequence
tttttcttcttccaatgtgg

SEQ ID NO: 76771 - DNA, 20 bp, Artificial
  CRISPR gRNA sequence
tttcttcttccaatgtggcc

SEQ ID NO: 76772 - DNA, 20 bp, Artificial
  CRISPR gRNA sequence
ttcttcttccaatgtggccc

SEQ ID NO: 76773 - DNA, 20 bp, Artificial
  CRISPR gRNA sequence
tcttcttccaatgtggccca

SEQ ID NO: 76774 - DNA, 20 bp, Artificial
  CRISPR gRNA sequence
cttcttccaatgtggcccag

SEQ ID NO: 76775 - DNA, 20 bp, Artificial
  CRISPR gRNA sequence
ttcttccaatgtggcccagg

SEQ ID NO: 76776 - DNA, 20 bp, Artificial
  CRISPR gRNA sequence
cttccaatgtggcccaggga

SEQ ID NO: 76777 - DNA, 20 bp, Artificial
  CRISPR gRNA sequence
ttccaatgtggcccagggaa

SEQ ID NO: 76778 - DNA, 20 bp, Artificial
  CRISPR gRNA sequence
ccaatgtggcccagggaagc

SEQ ID NO: 76779 - DNA, 20 bp, Artificial
  CRISPR gRNA sequence
caatgtggcccagggaagcc

SEQ ID NO: 76780 - DNA, 20 bp, Artificial
  CRISPR gRNA sequence
gacacccttgatctagactc

SEQ ID NO: 76781 - DNA, 20 bp, Artificial
  CRISPR gRNA sequence
gatctagactctagaagggt

SEQ ID NO: 76782 - DNA, 20 bp, Artificial
  CRISPR gRNA sequence
atctagactctagaagggtg

SEQ ID NO: 76783 - DNA, 20 bp, Artificial
  CRISPR gRNA sequence
gactctagaagggtgtggtg

SEQ ID NO: 76784 - DNA, 20 bp, Artificial
  CRISPR gRNA sequence
tagaagggtgtggtggagta

SEQ ID NO: 76785 - DNA, 20 bp, Artificial
  CRISPR gRNA sequence
gaagggtgtggtggagtaac

SEQ ID NO: 76786 - DNA, 20 bp, Artificial
  CRISPR gRNA sequence
gcagctcgtcccgtactgtg

SEQ ID NO: 76787 - DNA, 20 bp, Artificial
  CRISPR gRNA sequence
cagctcgtcccgtactgtgg

SEQ ID NO: 76788 - DNA, 20 bp, Artificial
  CRISPR gRNA sequence
gtcccgtactgtggcaattt

SEQ ID NO: 76789 - DNA, 20 bp, Artificial
  CRISPR gRNA sequence
tggcaatttagtattaaaag

SEQ ID NO: 76790 - DNA, 20 bp, Artificial
  CRISPR gRNA sequence
agtattaaaaggcatcagta

SEQ ID NO: 76791 - DNA, 20 bp, Artificial
  CRISPR gRNA sequence
gtattaaaaggcatcagtat

SEQ ID NO: 76792 - DNA, 20 bp, Artificial
  CRISPR gRNA sequence
aaaggcatcagtatatactc

SEQ ID NO: 76793 - DNA, 20 bp, Artificial
  CRISPR gRNA sequence
tgtgaaaacaggtaagagac

SEQ ID NO: 76794 - DNA, 20 bp, Artificial
  CRISPR gRNA sequence
tgaaaacaggtaagagacaa

SEQ ID NO: 76795 - DNA, 20 bp, Artificial
  CRISPR gRNA sequence
accattggttgactttaagg

SEQ ID NO: 76796 - DNA, 20 bp, Artificial
  CRISPR gRNA sequence
gttgactttaaggaattgcc

SEQ ID NO: 76797 - DNA, 20 bp, Artificial
  CRISPR gRNA sequence
actttaaggaattgccatta

SEQ ID NO: 76798 - DNA, 20 bp, Artificial
  CRISPR gRNA sequence
taaggaattgccattaatag

SEQ ID NO: 76799 - DNA, 20 bp, Artificial
  CRISPR gRNA sequence
aaggaattgccattaatagg

SEQ ID NO: 76800 - DNA, 20 bp, Artificial
  CRISPR gRNA sequence
aggaattgccattaataggg

SEQ ID NO: 76801 - DNA, 20 bp, Artificial
  CRISPR gRNA sequence
ccattaatagggtaggtctg

SEQ ID NO: 76802 - DNA, 20 bp, Artificial
  CRISPR gRNA sequence
atagggtaggtctgggccag

SEQ ID NO: 76803 - DNA, 20 bp, Artificial
  CRISPR gRNA sequence
ggccaggtgcagtggctcaa

SEQ ID NO: 76804 - DNA, 20 bp, Artificial
  CRISPR gRNA sequence
aagcctgtaatcccaacact

SEQ ID NO: 76805 - DNA, 20 bp, Artificial
  CRISPR gRNA sequence
taatcccaacactttgggag

SEQ ID NO: 76806 - DNA, 20 bp, Artificial
  CRISPR gRNA sequence
tgggaggctgaggaaggtgg

SEQ ID NO: 76807 - DNA, 20 bp, Artificial
  CRISPR gRNA sequence
gggaggctgaggaaggtgga

SEQ ID NO: 76808 - DNA, 20 bp, Artificial
  CRISPR gRNA sequence
ggaggctgaggaaggtggat

SEQ ID NO: 76809 - DNA, 20 bp, Artificial
  CRISPR gRNA sequence
aggaaggtggatcacttgag

SEQ ID NO: 76810 - DNA, 20 bp, Artificial
  CRISPR gRNA sequence
gaggtcaggagttcgagacc

SEQ ID NO: 76811 - DNA, 20 bp, Artificial
  CRISPR gRNA sequence
aggtcaggagttcgagacca

SEQ ID NO: 76812 - DNA, 20 bp, Artificial
  CRISPR gRNA sequence
gagaccagcctggccaacat

SEQ ID NO: 76813 - DNA, 20 bp, Artificial
  CRISPR gRNA sequence
gccaacatggtgaaaccctg

SEQ ID NO: 76814 - DNA, 20 bp, Artificial
  CRISPR gRNA sequence
cctctactaaaaatacaaaa

SEQ ID NO: 76815 - DNA, 20 bp, Artificial
  CRISPR gRNA sequence
tactaaaaatacaaaaatta

SEQ ID NO: 76816 - DNA, 20 bp, Artificial
  CRISPR gRNA sequence
ctaaaaatacaaaaattagc

SEQ ID NO: 76817 - DNA, 20 bp, Artificial
  CRISPR gRNA sequence
aaaatacaaaaattagccag

SEQ ID NO: 76818 - DNA, 20 bp, Artificial
  CRISPR gRNA sequence
gccaggcatgatggcgggcg

SEQ ID NO: 76819 - DNA, 20 bp, Artificial
  CRISPR gRNA sequence
taatcccagctactcaggag

SEQ ID NO: 76820 - DNA, 20 bp, Artificial
  CRISPR gRNA sequence
ctcaggaggctgaggcagga

SEQ ID NO: 76821 - DNA, 20 bp, Artificial
  CRISPR gRNA sequence
aggaggctgaggcaggagaa

SEQ ID NO: 76822 - DNA, 20 bp, Artificial
  CRISPR gRNA sequence
aggcaggagaattgcttgaa

SEQ ID NO: 76823 - DNA, 20 bp, Artificial
  CRISPR gRNA sequence
cttgaacccaggaggcagag

SEQ ID NO: 76824 - DNA, 20 bp, Artificial
  CRISPR gRNA sequence
gaacccaggaggcagaggtg

SEQ ID NO: 76825 - DNA, 20 bp, Artificial
  CRISPR gRNA sequence
aacccaggaggcagaggtgg

SEQ ID NO: 76826 - DNA, 20 bp, Artificial
  CRISPR gRNA sequence
cactccagcctgggcaacaa

SEQ ID NO: 76827 - DNA, 20 bp, Artificial
  CRISPR gRNA sequence
cagcctgggcaacaagagca

SEQ ID NO: 76828 - DNA, 20 bp, Artificial
  CRISPR gRNA sequence
ggcaacaagagcaaaactct

SEQ ID NO: 76829 - DNA, 20 bp, Artificial
  CRISPR gRNA sequence
tgtctcagaaaaaaaaaata

SEQ ID NO: 76830 - DNA, 20 bp, Artificial
  CRISPR gRNA sequence
tctcagaaaaaaaaaatagt

SEQ ID NO: 76831 - DNA, 20 bp, Artificial
  CRISPR gRNA sequence
agaaaaaaaaaatagtgtag

SEQ ID NO: 76832 - DNA, 20 bp, Artificial
  CRISPR gRNA sequence
ataatggttttgtggttata

SEQ ID NO: 76833 - DNA, 20 bp, Artificial
  CRISPR gRNA sequence
tgtggttatatgtttgaacc

SEQ ID NO: 76834 - DNA, 20 bp, Artificial
  CRISPR gRNA sequence
gtggttatatgtttgaacct

SEQ ID NO: 76835 - DNA, 20 bp, Artificial
  CRISPR gRNA sequence
tggttatatgtttgaacctg

SEQ ID NO: 76836 - DNA, 20 bp, Artificial
  CRISPR gRNA sequence
tatgtttgaacctggagaag

SEQ ID NO: 76837 - DNA, 20 bp, Artificial
  CRISPR gRNA sequence
gaacctggagaaggacatgg

SEQ ID NO: 76838 - DNA, 20 bp, Artificial
  CRISPR gRNA sequence
aacctggagaaggacatggg

SEQ ID NO: 76839 - DNA, 20 bp, Artificial
  CRISPR gRNA sequence
gagaaggacatgggaaggcc

SEQ ID NO: 76840 - DNA, 20 bp, Artificial
  CRISPR gRNA sequence
cagggggtcaaaccggatta

SEQ ID NO: 76841 - DNA, 20 bp, Artificial
  CRISPR gRNA sequence
tctggttggaagggctggaa

SEQ ID NO: 76842 - DNA, 20 bp, Artificial
  CRISPR gRNA sequence
gttggaagggctggaagggc

SEQ ID NO: 76843 - DNA, 20 bp, Artificial
  CRISPR gRNA sequence
gaagggctggaagggcattt

SEQ ID NO: 76844 - DNA, 20 bp, Artificial
  CRISPR gRNA sequence
gaagggcatttgagatgggg

SEQ ID NO: 76845 - DNA, 20 bp, Artificial
  CRISPR gRNA sequence
gagatgggggctagaaagca

SEQ ID NO: 76846 - DNA, 20 bp, Artificial
  CRISPR gRNA sequence
agatgggggctagaaagcaa

SEQ ID NO: 76847 - DNA, 20 bp, Artificial
  CRISPR gRNA sequence
gaaagcaagaaaaaagactg

SEQ ID NO: 76848 - DNA, 20 bp, Artificial
  CRISPR gRNA sequence
aagcaaaatggaaaacacag

SEQ ID NO: 76849 - DNA, 20 bp, Artificial
  CRISPR gRNA sequence
tgaaaacacagtgcatgaaa

SEQ ID NO: 76850 - DNA, 20 bp, Artificial
  CRISPR gRNA sequence
gtttatgactgcaaacaggt

SEQ ID NO: 76851 - DNA, 20 bp, Artificial
  CRISPR gRNA sequence
atgactgcaaacaggtagaa

SEQ ID NO: 76852 - DNA, 20 bp, Artificial
  CRISPR gRNA sequence
tgactgcaaacaggtagaaa

SEQ ID NO: 76853 - DNA, 20 bp, Artificial
  CRISPR gRNA sequence
caaacaggtagaaactgaat

SEQ ID NO: 76854 - DNA, 20 bp, Artificial
  CRISPR gRNA sequence
aatatgcaaataggcaagga

SEQ ID NO: 76855 - DNA, 20 bp, Artificial
  CRISPR gRNA sequence
tggacacatgacaacatgga

SEQ ID NO: 76856 - DNA, 20 bp, Artificial
  CRISPR gRNA sequence
gatgagagaagaggttgttt

SEQ ID NO: 76857 - DNA, 20 bp, Artificial
  CRISPR gRNA sequence
atgagagaagaggttgttta

SEQ ID NO: 76858 - DNA, 20 bp, Artificial
  CRISPR gRNA sequence
tttaggtgaggcaggttttg

SEQ ID NO: 76859 - DNA, 20 bp, Artificial
  CRISPR gRNA sequence
aggtgaggcaggttttgtct

SEQ ID NO: 76860 - DNA, 20 bp, Artificial
  CRISPR gRNA sequence
ggtgaggcaggttttgtctt

SEQ ID NO: 76861 - DNA, 20 bp, Artificial
  CRISPR gRNA sequence
tgtcttggatttctttattt

SEQ ID NO: 76862 - DNA, 20 bp, Artificial
  CRISPR gRNA sequence
gtcttggatttctttatttt

SEQ ID NO: 76863 - DNA, 20 bp, Artificial
  CRISPR gRNA sequence
tcttggatttctttatttta

SEQ ID NO: 76864 - DNA, 20 bp, Artificial
  CRISPR gRNA sequence
ggatttctttattttaaggt

SEQ ID NO: 76865 - DNA, 20 bp, Artificial
  CRISPR gRNA sequence
gatttctttattttaaggta

SEQ ID NO: 76866 - DNA, 20 bp, Artificial
  CRISPR gRNA sequence
ctttattttaaggtaattac

SEQ ID NO: 76867 - DNA, 20 bp, Artificial
  CRISPR gRNA sequence
tttattttaaggtaattact

SEQ ID NO: 76868 - DNA, 20 bp, Artificial
  CRISPR gRNA sequence
tattttaaggtaattactat

SEQ ID NO: 76869 - DNA, 20 bp, Artificial
  CRISPR gRNA sequence
attttaaggtaattactata

SEQ ID NO: 76870 - DNA, 20 bp, Artificial
  CRISPR gRNA sequence
ttttaaggtaattactataa

SEQ ID NO: 76871 - DNA, 20 bp, Artificial
  CRISPR gRNA sequence
taaggtaattactataatag

SEQ ID NO: 76872 - DNA, 20 bp, Artificial
  CRISPR gRNA sequence
aaggtaattactataataga

SEQ ID NO: 76873 - DNA, 20 bp, Artificial
  CRISPR gRNA sequence
aggtaattactataatagaa

SEQ ID NO: 76874 - DNA, 20 bp, Artificial
  CRISPR gRNA sequence
ctataatagaatcaccacaa

SEQ ID NO: 76875 - DNA, 20 bp, Artificial
  CRISPR gRNA sequence
taatagaatcaccacaatga

SEQ ID NO: 76876 - DNA, 20 bp, Artificial
  CRISPR gRNA sequence
accatccactgtgcagatga

SEQ ID NO: 76877 - DNA, 20 bp, Artificial
  CRISPR gRNA sequence
tgcagatgaagaagctgagg

SEQ ID NO: 76878 - DNA, 20 bp, Artificial
  CRISPR gRNA sequence
aggcccggggagttaaatcc

SEQ ID NO: 76879 - DNA, 20 bp, Artificial
  CRISPR gRNA sequence
aatcccttttgagccaagag

SEQ ID NO: 76880 - DNA, 20 bp, Artificial
  CRISPR gRNA sequence
ttgagccaagagtcctgatt

SEQ ID NO: 76881 - DNA, 20 bp, Artificial
  CRISPR gRNA sequence
tgagccaagagtcctgattc

SEQ ID NO: 76882 - DNA, 20 bp, Artificial
  CRISPR gRNA sequence
gagccaagagtcctgattcc

SEQ ID NO: 76883 - DNA, 20 bp, Artificial
  CRISPR gRNA sequence
agccaagagtcctgattcca

SEQ ID NO: 76884 - DNA, 20 bp, Artificial
  CRISPR gRNA sequence
attccaggtccagtctctgg

SEQ ID NO: 76885 - DNA, 20 bp, Artificial
  CRISPR gRNA sequence
caggtccagtctctggttac

SEQ ID NO: 76886 - DNA, 20 bp, Artificial
  CRISPR gRNA sequence
tggttacagacccagatgtt

SEQ ID NO: 76887 - DNA, 20 bp, Artificial
  CRISPR gRNA sequence
gttacagacccagatgttct

SEQ ID NO: 76888 - DNA, 20 bp, Artificial
  CRISPR gRNA sequence
cagacccagatgttctgggg

SEQ ID NO: 76889 - DNA, 20 bp, Artificial
  CRISPR gRNA sequence
tggggcgagtgaggtggtaa

SEQ ID NO: 76890 - DNA, 20 bp, Artificial
  CRISPR gRNA sequence
gggcgagtgaggtggtaacc

SEQ ID NO: 76891 - DNA, 20 bp, Artificial
  CRISPR gRNA sequence
gaggaagggctttcagaagt

SEQ ID NO: 76892 - DNA, 20 bp, Artificial
  CRISPR gRNA sequence
aggaagggctttcagaagtg

SEQ ID NO: 76893 - DNA, 20 bp, Artificial
  CRISPR gRNA sequence
tcagaagtgctacgctccag

SEQ ID NO: 76894 - DNA, 20 bp, Artificial
  CRISPR gRNA sequence
cagaagtgctacgctccagc

SEQ ID NO: 76895 - DNA, 20 bp, Artificial
  CRISPR gRNA sequence
agaagtgctacgctccagcc

SEQ ID NO: 76896 - DNA, 20 bp, Artificial
  CRISPR gRNA sequence
cgctccagccatgcaggcag

SEQ ID NO: 76897 - DNA, 20 bp, Artificial
  CRISPR gRNA sequence
cagccatgcaggcaggttca

SEQ ID NO: 76898 - DNA, 20 bp, Artificial
  CRISPR gRNA sequence
aagtgggtgccctggtgagg

SEQ ID NO: 76899 - DNA, 20 bp, Artificial
  CRISPR gRNA sequence
gtgaggctccaggggtgggg

SEQ ID NO: 76900 - DNA, 20 bp, Artificial
  CRISPR gRNA sequence
caggggtggggttggaggtg

SEQ ID NO: 76901 - DNA, 20 bp, Artificial
  CRISPR gRNA sequence
gaggtggacagggctcccag

SEQ ID NO: 76902 - DNA, 20 bp, Artificial
  CRISPR gRNA sequence
ccaggtgccctgagttgagt

SEQ ID NO: 76903 - DNA, 20 bp, Artificial
  CRISPR gRNA sequence
agttgagtggatggtgcagg

SEQ ID NO: 76904 - DNA, 20 bp, Artificial
  CRISPR gRNA sequence
agtggatggtgcaggtgaag

SEQ ID NO: 76905 - DNA, 20 bp, Artificial
  CRISPR gRNA sequence
ccccagtccagcacagcatc

SEQ ID NO: 76906 - DNA, 20 bp, Artificial
  CRISPR gRNA sequence
cccagtccagcacagcatct

SEQ ID NO: 76907 - DNA, 20 bp, Artificial
  CRISPR gRNA sequence
ccagtgggagacatgcgctg

SEQ ID NO: 76908 - DNA, 20 bp, Artificial
  CRISPR gRNA sequence
cctaaggctgggggctgccg

SEQ ID NO: 76909 - DNA, 20 bp, Artificial
  CRISPR gRNA sequence
aggctgggggctgccgagag

SEQ ID NO: 76910 - DNA, 20 bp, Artificial
  CRISPR gRNA sequence
ggggctgccgagagacagcc

SEQ ID NO: 76911 - DNA, 20 bp, Artificial
  CRISPR gRNA sequence
ccgagagacagccaagtttc

SEQ ID NO: 76912 - DNA, 20 bp, Artificial
  CRISPR gRNA sequence
ctaccaaaggccaggggact

SEQ ID NO: 76913 - DNA, 20 bp, Artificial
  CRISPR gRNA sequence
taccaaaggccaggggactc

SEQ ID NO: 76914 - DNA, 20 bp, Artificial
  CRISPR gRNA sequence
ccaaaggccaggggactctc

SEQ ID NO: 76915 - DNA, 20 bp, Artificial
  CRISPR gRNA sequence
tcatggggcagggctggtgg

SEQ ID NO: 76916 - DNA, 20 bp, Artificial
  CRISPR gRNA sequence
atggggcagggctggtggga

SEQ ID NO: 76917 - DNA, 20 bp, Artificial
  CRISPR gRNA sequence
gtgggaagaaatcgagaaag

SEQ ID NO: 76918 - DNA, 20 bp, Artificial
  CRISPR gRNA sequence
acctgtcttctaaccaagaa

SEQ ID NO: 76919 - DNA, 20 bp, Artificial
  CRISPR gRNA sequence
tcttctaaccaagaagcccc

SEQ ID NO: 76920 - DNA, 20 bp, Artificial
  CRISPR gRNA sequence
ctaaccaagaagccccctcc

SEQ ID NO: 76921 - DNA, 20 bp, Artificial
  CRISPR gRNA sequence
taaccaagaagccccctccc

SEQ ID NO: 76922 - DNA, 20 bp, Artificial
  CRISPR gRNA sequence
accaagaagccccctcccag

SEQ ID NO: 76923 - DNA, 20 bp, Artificial
  CRISPR gRNA sequence
ccaggtcactgggcagatcc

SEQ ID NO: 76924 - DNA, 20 bp, Artificial
  CRISPR gRNA sequence
ggcagatccccacatggtgc

SEQ ID NO: 76925 - DNA, 20 bp, Artificial
  CRISPR gRNA sequence
tggggctgtgtcctcgttac

SEQ ID NO: 76926 - DNA, 20 bp, Artificial
  CRISPR gRNA sequence
gggctgtgtcctcgttactt

SEQ ID NO: 76927 - DNA, 20 bp, Artificial
  CRISPR gRNA sequence
tgtcctcgttacttactgca

SEQ ID NO: 76928 - DNA, 20 bp, Artificial
  CRISPR gRNA sequence
gttacttactgcagttccag

SEQ ID NO: 76929 - DNA, 20 bp, Artificial
  CRISPR gRNA sequence
cttactgcagttccaggggt

SEQ ID NO: 76930 - DNA, 20 bp, Artificial
  CRISPR gRNA sequence
actgcagttccaggggtccc

SEQ ID NO: 76931 - DNA, 20 bp, Artificial
  CRISPR gRNA sequence
ctgcagttccaggggtcccg

SEQ ID NO: 76932 - DNA, 20 bp, Artificial
  CRISPR gRNA sequence
cagttccaggggtcccgggc

SEQ ID NO: 76933 - DNA, 20 bp, Artificial
  CRISPR gRNA sequence
caggggtcccgggcagtcct

SEQ ID NO: 76934 - DNA, 20 bp, Artificial
  CRISPR gRNA sequence
cagagtggcacagaggcggg

SEQ ID NO: 76935 - DNA, 20 bp, Artificial
  CRISPR gRNA sequence
agagtggcacagaggcgggt

SEQ ID NO: 76936 - DNA, 20 bp, Artificial
  CRISPR gRNA sequence
gggggctccagaggacactc

SEQ ID NO: 76937 - DNA, 20 bp, Artificial
  CRISPR gRNA sequence
ggggctccagaggacactca

SEQ ID NO: 76938 - DNA, 20 bp, Artificial
  CRISPR gRNA sequence
cagaggacactcactgaggc

SEQ ID NO: 76939 - DNA, 20 bp, Artificial
  CRISPR gRNA sequence
actgaggctgcaaaggggca

SEQ ID NO: 76940 - DNA, 20 bp, Artificial
  CRISPR gRNA sequence
aggctgcaaaggggcaatgg

SEQ ID NO: 76941 - DNA, 20 bp, Artificial
  CRISPR gRNA sequence
caaaggggcaatgggcaggg

SEQ ID NO: 76942 - DNA, 20 bp, Artificial
  CRISPR gRNA sequence
gctagccccaggggctctat

SEQ ID NO: 76943 - DNA, 20 bp, Artificial
  CRISPR gRNA sequence
gccccaggggctctatcctt

SEQ ID NO: 76944 - DNA, 20 bp, Artificial
  CRISPR gRNA sequence
tatccttctcccagcatccc

SEQ ID NO: 76945 - DNA, 20 bp, Artificial
  CRISPR gRNA sequence
tccttctcccagcatccctc

SEQ ID NO: 76946 - DNA, 20 bp, Artificial
  CRISPR gRNA sequence
ctcccagcatccctcactct

SEQ ID NO: 76947 - DNA, 20 bp, Artificial
  CRISPR gRNA sequence
tcccagcatccctcactcta

SEQ ID NO: 76948 - DNA, 20 bp, Artificial
  CRISPR gRNA sequence
ccagcatccctcactctaag

SEQ ID NO: 76949 - DNA, 20 bp, Artificial
  CRISPR gRNA sequence
actctaagtgggaggccaca

SEQ ID NO: 76950 - DNA, 20 bp, Artificial
  CRISPR gRNA sequence
taagtgggaggccacaggcc

SEQ ID NO: 76951 - DNA, 20 bp, Artificial
  CRISPR gRNA sequence
agtgggaggccacaggcccc

SEQ ID NO: 76952 - DNA, 20 bp, Artificial
  CRISPR gRNA sequence
cccctgtggggcactcgctt

SEQ ID NO: 76953 - DNA, 20 bp, Artificial
  CRISPR gRNA sequence
ccctgtggggcactcgcttc

SEQ ID NO: 76954 - DNA, 20 bp, Artificial
  CRISPR gRNA sequence
tggggcactcgcttccctct

SEQ ID NO: 76955 - DNA, 20 bp, Artificial
  CRISPR gRNA sequence
gcttccctctcgagtctccc

SEQ ID NO: 76956 - DNA, 20 bp, Artificial
  CRISPR gRNA sequence
ccctctcgagtctcccctgc

SEQ ID NO: 76957 - DNA, 20 bp, Artificial
  CRISPR gRNA sequence
cctctcgagtctcccctgca

SEQ ID NO: 76958 - DNA, 20 bp, Artificial
  CRISPR gRNA sequence
tcgagtctcccctgcagccc

SEQ ID NO: 76959 - DNA, 20 bp, Artificial
  CRISPR gRNA sequence
gagtctcccctgcagccccc

SEQ ID NO: 76960 - DNA, 20 bp, Artificial
  CRISPR gRNA sequence
ccctgcagcccccaatcctc

SEQ ID NO: 76961 - DNA, 20 bp, Artificial
  CRISPR gRNA sequence
cagcccccaatcctcctgcc

SEQ ID NO: 76962 - DNA, 20 bp, Artificial
  CRISPR gRNA sequence
ctgccctgacagtgacagtg

SEQ ID NO: 76963 - DNA, 20 bp, Artificial
  CRISPR gRNA sequence
ccctgacagtgacagtgcag

SEQ ID NO: 76964 - DNA, 20 bp, Artificial
  CRISPR gRNA sequence
acagtgacagtgcaggaccc

SEQ ID NO: 76965 - DNA, 20 bp, Artificial
  CRISPR gRNA sequence
agttcccagctgcccttgtc

SEQ ID NO: 76966 - DNA, 20 bp, Artificial
  CRISPR gRNA sequence
ccagctgcccttgtcagtga

SEQ ID NO: 76967 - DNA, 20 bp, Artificial
  CRISPR gRNA sequence
cccttgtcagtgactctcca

SEQ ID NO: 76968 - DNA, 20 bp, Artificial
  CRISPR gRNA sequence
gtcagtgactctccaagtcc

SEQ ID NO: 76969 - DNA, 20 bp, Artificial
  CRISPR gRNA sequence
tcagtgactctccaagtcct

SEQ ID NO: 76970 - DNA, 20 bp, Artificial
  CRISPR gRNA sequence
tccaagtcctccccaccgcc

SEQ ID NO: 76971 - DNA, 20 bp, Artificial
  CRISPR gRNA sequence
caagtcctccccaccgcccc

SEQ ID NO: 76972 - DNA, 20 bp, Artificial
  CRISPR gRNA sequence
cccaccgccccctccagagc

SEQ ID NO: 76973 - DNA, 20 bp, Artificial
  CRISPR gRNA sequence
cagagcccaggccaccatcc

SEQ ID NO: 76974 - DNA, 20 bp, Artificial
  CRISPR gRNA sequence
actcaccttgaccatttaac

SEQ ID NO: 76975 - DNA, 20 bp, Artificial
  CRISPR gRNA sequence
accttgaccatttaacaccc

SEQ ID NO: 76976 - DNA, 20 bp, Artificial
  CRISPR gRNA sequence
gaccatttaacaccctctgg

SEQ ID NO: 76977 - DNA, 20 bp, Artificial
  CRISPR gRNA sequence
accatttaacaccctctggg

SEQ ID NO: 76978 - DNA, 20 bp, Artificial
  CRISPR gRNA sequence
aacaccctctgggcttccac

SEQ ID NO: 76979 - DNA, 20 bp, Artificial
  CRISPR gRNA sequence
acaccctctgggcttccact

SEQ ID NO: 76980 - DNA, 20 bp, Artificial
  CRISPR gRNA sequence
tgggcttccactcttgcctc

SEQ ID NO: 76981 - DNA, 20 bp, Artificial
  CRISPR gRNA sequence
ggcttccactcttgcctccc

SEQ ID NO: 76982 - DNA, 20 bp, Artificial
  CRISPR gRNA sequence
ccactcttgcctccctttaa

SEQ ID NO: 76983 - DNA, 20 bp, Artificial
  CRISPR gRNA sequence
cactcttgcctccctttaat

SEQ ID NO: 76984 - DNA, 20 bp, Artificial
  CRISPR gRNA sequence
ttgcctccctttaatccctc

SEQ ID NO: 76985 - DNA, 20 bp, Artificial
  CRISPR gRNA sequence
gcctccctttaatccctctc

SEQ ID NO: 76986 - DNA, 20 bp, Artificial
  CRISPR gRNA sequence
cctccctttaatccctctct

SEQ ID NO: 76987 - DNA, 20 bp, Artificial
  CRISPR gRNA sequence
cctttaatccctctctgccc

SEQ ID NO: 76988 - DNA, 20 bp, Artificial
  CRISPR gRNA sequence
taatccctctctgccccaca

SEQ ID NO: 76989 - DNA, 20 bp, Artificial
  CRISPR gRNA sequence
aatccctctctgccccacaa

SEQ ID NO: 76990 - DNA, 20 bp, Artificial
  CRISPR gRNA sequence
atccctctctgccccacaag

SEQ ID NO: 76991 - DNA, 20 bp, Artificial
  CRISPR gRNA sequence
tctgccccacaagtgtctca

SEQ ID NO: 76992 - DNA, 20 bp, Artificial
  CRISPR gRNA sequence
tgccccacaagtgtctcaca

SEQ ID NO: 76993 - DNA, 20 bp, Artificial
  CRISPR gRNA sequence
ccccacaagtgtctcacatt

SEQ ID NO: 76994 - DNA, 20 bp, Artificial
  CRISPR gRNA sequence
acattttaacactgcacatc

SEQ ID NO: 76995 - DNA, 20 bp, Artificial
  CRISPR gRNA sequence
taacactgcacatctgacca

SEQ ID NO: 76996 - DNA, 20 bp, Artificial
  CRISPR gRNA sequence
aacactgcacatctgaccag

SEQ ID NO: 76997 - DNA, 20 bp, Artificial
  CRISPR gRNA sequence
acactgcacatctgaccagg

SEQ ID NO: 76998 - DNA, 20 bp, Artificial
  CRISPR gRNA sequence
cacatctgaccaggcctctc

SEQ ID NO: 76999 - DNA, 20 bp, Artificial
  CRISPR gRNA sequence
accaggcctctccctgttac

SEQ ID NO: 77000 - DNA, 20 bp, Artificial
  CRISPR gRNA sequence
tccctgttacccccgtggct

SEQ ID NO: 77001 - DNA, 20 bp, Artificial
  CRISPR gRNA sequence
cctgttacccccgtggctcc

SEQ ID NO: 77002 - DNA, 20 bp, Artificial
  CRISPR gRNA sequence
ttacccccgtggctccccat

SEQ ID NO: 77003 - DNA, 20 bp, Artificial
  CRISPR gRNA sequence
cccccgtggctccccattgc

SEQ ID NO: 77004 - DNA, 20 bp, Artificial
  CRISPR gRNA sequence
cccattgccctggggctaac

SEQ ID NO: 77005 - DNA, 20 bp, Artificial
  CRISPR gRNA sequence
ccctggggctaacagtgaaa

SEQ ID NO: 77006 - DNA, 20 bp, Artificial
  CRISPR gRNA sequence
gggctaacagtgaaattgaa

SEQ ID NO: 77007 - DNA, 20 bp, Artificial
  CRISPR gRNA sequence
acagtgaaattgaaatgtcc

SEQ ID NO: 77008 - DNA, 20 bp, Artificial
  CRISPR gRNA sequence
aaatgtccttcccagggcct

SEQ ID NO: 77009 - DNA, 20 bp, Artificial
  CRISPR gRNA sequence
cccagggcctcacttgcctc

SEQ ID NO: 77010 - DNA, 20 bp, Artificial
  CRISPR gRNA sequence
ccagggcctcacttgcctcc

SEQ ID NO: 77011 - DNA, 20 bp, Artificial
  CRISPR gRNA sequence
acttgcctccacttccctgg

SEQ ID NO: 77012 - DNA, 20 bp, Artificial
  CRISPR gRNA sequence
gcctccacttccctggaggc

SEQ ID NO: 77013 - DNA, 20 bp, Artificial
  CRISPR gRNA sequence
cctccacttccctggaggcc

SEQ ID NO: 77014 - DNA, 20 bp, Artificial
  CRISPR gRNA sequence
cacttccctggaggcctaga

SEQ ID NO: 77015 - DNA, 20 bp, Artificial
  CRISPR gRNA sequence
ccctggaggcctagagagag

SEQ ID NO: 77016 - DNA, 20 bp, Artificial
  CRISPR gRNA sequence
cctggaggcctagagagagg

SEQ ID NO: 77017 - DNA, 20 bp, Artificial
  CRISPR gRNA sequence
gaggcctagagagaggtggg

SEQ ID NO: 77018 - DNA, 20 bp, Artificial
  CRISPR gRNA sequence
gagagaggtggggccaagtc

SEQ ID NO: 77019 - DNA, 20 bp, Artificial
  CRISPR gRNA sequence
acagcctctcatggcagagc

SEQ ID NO: 77020 - DNA, 20 bp, Artificial
  CRISPR gRNA sequence
tcatggcagagcttgcagat

SEQ ID NO: 77021 - DNA, 20 bp, Artificial
  CRISPR gRNA sequence
atggcagagcttgcagatgg

SEQ ID NO: 77022 - DNA, 20 bp, Artificial
  CRISPR gRNA sequence
gcagatggggagtgtattag

SEQ ID NO: 77023 - DNA, 20 bp, Artificial
  CRISPR gRNA sequence
cagatggggagtgtattagt

SEQ ID NO: 77024 - DNA, 20 bp, Artificial
  CRISPR gRNA sequence
gtggggagacaggccaaccc

SEQ ID NO: 77025 - DNA, 20 bp, Artificial
  CRISPR gRNA sequence
tctttctggaaagtgggtgt

SEQ ID NO: 77026 - DNA, 20 bp, Artificial
  CRISPR gRNA sequence
ctttctggaaagtgggtgtc

SEQ ID NO: 77027 - DNA, 20 bp, Artificial
  CRISPR gRNA sequence
tttctggaaagtgggtgtcc

SEQ ID NO: 77028 - DNA, 20 bp, Artificial
  CRISPR gRNA sequence
tctggaaagtgggtgtcccc

SEQ ID NO: 77029 - DNA, 20 bp, Artificial
  CRISPR gRNA sequence
ctggaaagtgggtgtccccc

SEQ ID NO: 77030 - DNA, 20 bp, Artificial
  CRISPR gRNA sequence
tggaaagtgggtgtccccca

SEQ ID NO: 77031 - DNA, 20 bp, Artificial
  CRISPR gRNA sequence
gaaagtgggtgtcccccaga

SEQ ID NO: 77032 - DNA, 20 bp, Artificial
  CRISPR gRNA sequence
agctgctctgtttgcttcac

SEQ ID NO: 77033 - DNA, 20 bp, Artificial
  CRISPR gRNA sequence
ctctgtttgcttcacagaaa

SEQ ID NO: 77034 - DNA, 20 bp, Artificial
  CRISPR gRNA sequence
tgtttgcttcacagaaatgt

SEQ ID NO: 77035 - DNA, 20 bp, Artificial
  CRISPR gRNA sequence
tttgcttcacagaaatgtgg

SEQ ID NO: 77036 - DNA, 20 bp, Artificial
  CRISPR gRNA sequence
gcttcacagaaatgtggaat

SEQ ID NO: 77037 - DNA, 20 bp, Artificial
  CRISPR gRNA sequence
cttcacagaaatgtggaatc

SEQ ID NO: 77038 - DNA, 20 bp, Artificial
  CRISPR gRNA sequence
cacagaaatgtggaatcttc

SEQ ID NO: 77039 - DNA, 20 bp, Artificial
  CRISPR gRNA sequence
acagaaatgtggaatcttct

SEQ ID NO: 77040 - DNA, 20 bp, Artificial
  CRISPR gRNA sequence
ctctccaaggagaatgcggg

SEQ ID NO: 77041 - DNA, 20 bp, Artificial
  CRISPR gRNA sequence
tctccaaggagaatgcgggg

SEQ ID NO: 77042 - DNA, 20 bp, Artificial
  CRISPR gRNA sequence
tccaaggagaatgcggggca

SEQ ID NO: 77043 - DNA, 20 bp, Artificial
  CRISPR gRNA sequence
caaggagaatgcggggcatg

SEQ ID NO: 77044 - DNA, 20 bp, Artificial
  CRISPR gRNA sequence
agctgcccgtcaggggccag

SEQ ID NO: 77045 - DNA, 20 bp, Artificial
  CRISPR gRNA sequence
cccgtcaggggccagagctc

SEQ ID NO: 77046 - DNA, 20 bp, Artificial
  CRISPR gRNA sequence
cccaactcccagcacccctc

SEQ ID NO: 77047 - DNA, 20 bp, Artificial
  CRISPR gRNA sequence
ccagcacccctcacacccac

SEQ ID NO: 77048 - DNA, 20 bp, Artificial
  CRISPR gRNA sequence
acacccacgcctctttcttt

SEQ ID NO: 77049 - DNA, 20 bp, Artificial
  CRISPR gRNA sequence
tttcttttccttttctctta

SEQ ID NO: 77050 - DNA, 20 bp, Artificial
  CRISPR gRNA sequence
tcttttccttttctcttaaa

SEQ ID NO: 77051 - DNA, 20 bp, Artificial
  CRISPR gRNA sequence
cttttccttttctcttaaac

SEQ ID NO: 77052 - DNA, 20 bp, Artificial
  CRISPR gRNA sequence
ttttccttttctcttaaact

SEQ ID NO: 77053 - DNA, 20 bp, Artificial
  CRISPR gRNA sequence
ttccttttctcttaaactcc

SEQ ID NO: 77054 - DNA, 20 bp, Artificial
  CRISPR gRNA sequence
tccttttctcttaaactccc

SEQ ID NO: 77055 - DNA, 20 bp, Artificial
  CRISPR gRNA sequence
ccttttctcttaaactccct

SEQ ID NO: 77056 - DNA, 20 bp, Artificial
  CRISPR gRNA sequence
cttttctcttaaactccctc

SEQ ID NO: 77057 - DNA, 20 bp, Artificial
  CRISPR gRNA sequence
ttctcttaaactccctctct

SEQ ID NO: 77058 - DNA, 20 bp, Artificial
  CRISPR gRNA sequence
tctcttaaactccctctctt

SEQ ID NO: 77059 - DNA, 20 bp, Artificial
  CRISPR gRNA sequence
ctcttaaactccctctcttc

SEQ ID NO: 77060 - DNA, 20 bp, Artificial
  CRISPR gRNA sequence
tcttaaactccctctcttcc

SEQ ID NO: 77061 - DNA, 20 bp, Artificial
  CRISPR gRNA sequence
ttaaactccctctcttccct

SEQ ID NO: 77062 - DNA, 20 bp, Artificial
  CRISPR gRNA sequence
aaactccctctcttccctct

SEQ ID NO: 77063 - DNA, 20 bp, Artificial
  CRISPR gRNA sequence
aactccctctcttccctcta

SEQ ID NO: 77064 - DNA, 20 bp, Artificial
  CRISPR gRNA sequence
cctctcttccctctatccca

SEQ ID NO: 77065 - DNA, 20 bp, Artificial
  CRISPR gRNA sequence
tcttccctctatcccaatcc

SEQ ID NO: 77066 - DNA, 20 bp, Artificial
  CRISPR gRNA sequence
ttccctctatcccaatcccc

SEQ ID NO: 77067 - DNA, 20 bp, Artificial
  CRISPR gRNA sequence
ccctctatcccaatccccag

SEQ ID NO: 77068 - DNA, 20 bp, Artificial
  CRISPR gRNA sequence
cctctatcccaatccccagc

SEQ ID NO: 77069 - DNA, 20 bp, Artificial
  CRISPR gRNA sequence
tatcccaatccccagcccta

SEQ ID NO: 77070 - DNA, 20 bp, Artificial
  CRISPR gRNA sequence
tcccaatccccagccctagc

SEQ ID NO: 77071 - DNA, 20 bp, Artificial
  CRISPR gRNA sequence
gccccctgccagctctgccc

SEQ ID NO: 77072 - DNA, 20 bp, Artificial
  CRISPR gRNA sequence
ccagctctgccccctctgac

SEQ ID NO: 77073 - DNA, 20 bp, Artificial
  CRISPR gRNA sequence
tgccccctctgacgcctcat

SEQ ID NO: 77074 - DNA, 20 bp, Artificial
  CRISPR gRNA sequence
ccccctctgacgcctcatcc

SEQ ID NO: 77075 - DNA, 20 bp, Artificial
  CRISPR gRNA sequence
tgacgcctcatccctattat

SEQ ID NO: 77076 - DNA, 20 bp, Artificial
  CRISPR gRNA sequence
acgcctcatccctattatgg

SEQ ID NO: 77077 - DNA, 20 bp, Artificial
  CRISPR gRNA sequence
atccctattatggttacccc

SEQ ID NO: 77078 - DNA, 20 bp, Artificial
  CRISPR gRNA sequence
ttatggttacccccaaacaa

SEQ ID NO: 77079 - DNA, 20 bp, Artificial
  CRISPR gRNA sequence
tggttacccccaaacaagaa

SEQ ID NO: 77080 - DNA, 20 bp, Artificial
  CRISPR gRNA sequence
cccccaaacaagaagggctg

SEQ ID NO: 77081 - DNA, 20 bp, Artificial
  CRISPR gRNA sequence
ggacagtaccagaggctcct

SEQ ID NO: 77082 - DNA, 20 bp, Artificial
  CRISPR gRNA sequence
ctggggatgcagcgctgacg

SEQ ID NO: 77083 - DNA, 20 bp, Artificial
  CRISPR gRNA sequence
gggatgcagcgctgacggaa

SEQ ID NO: 77084 - DNA, 20 bp, Artificial
  CRISPR gRNA sequence
acggaaccctaagaacttgg

SEQ ID NO: 77085 - DNA, 20 bp, Artificial
  CRISPR gRNA sequence
agaacttggctgcagctggg

SEQ ID NO: 77086 - DNA, 20 bp, Artificial
  CRISPR gRNA sequence
ggctgcagctgggaagtctg

SEQ ID NO: 77087 - DNA, 20 bp, Artificial
  CRISPR gRNA sequence
gctgcagctgggaagtctgg

SEQ ID NO: 77088 - DNA, 20 bp, Artificial
  CRISPR gRNA sequence
cagctgggaagtctggcaaa

SEQ ID NO: 77089 - DNA, 20 bp, Artificial
  CRISPR gRNA sequence
ggaagtctggcaaagatcca

SEQ ID NO: 77090 - DNA, 20 bp, Artificial
  CRISPR gRNA sequence
gcaaagatccagtggcccac

SEQ ID NO: 77091 - DNA, 20 bp, Artificial
  CRISPR gRNA sequence
ggagggggatcatttagaaa

SEQ ID NO: 77092 - DNA, 20 bp, Artificial
  CRISPR gRNA sequence
agaaaggaaagttcagatca

SEQ ID NO: 77093 - DNA, 20 bp, Artificial
  CRISPR gRNA sequence
gaaaggaaagttcagatcac

SEQ ID NO: 77094 - DNA, 20 bp, Artificial
  CRISPR gRNA sequence
agatcaccccctcggactcc

SEQ ID NO: 77095 - DNA, 20 bp, Artificial
  CRISPR gRNA sequence
ggactcccagcccagcccat

SEQ ID NO: 77096 - DNA, 20 bp, Artificial
  CRISPR gRNA sequence
ccagcccagcccatataccc

SEQ ID NO: 77097 - DNA, 20 bp, Artificial
  CRISPR gRNA sequence
ggagggggatcgtttagaaa

SEQ ID NO: 77098 - DNA, 20 bp, Artificial
  CRISPR gRNA sequence
agaaaggaaagttcagatca

SEQ ID NO: 77099 - DNA, 20 bp, Artificial
  CRISPR gRNA sequence
gaaaggaaagttcagatcac

SEQ ID NO: 77100 - DNA, 20 bp, Artificial
  CRISPR gRNA sequence
agatcacccacattggactc

SEQ ID NO: 77101 - DNA, 20 bp, Artificial
  CRISPR gRNA sequence
gactcccagacttggaaagt

SEQ ID NO: 77102 - DNA, 20 bp, Artificial
  CRISPR gRNA sequence
ccagacttggaaagtcaggg

SEQ ID NO: 77103 - DNA, 20 bp, Artificial
  CRISPR gRNA sequence
ggaaagtcagggctggaagg

SEQ ID NO: 77104 - DNA, 20 bp, Artificial
  CRISPR gRNA sequence
gaaagtcagggctggaaggc

SEQ ID NO: 77105 - DNA, 20 bp, Artificial
  CRISPR gRNA sequence
gaaggcatctcagagacaat

SEQ ID NO: 77106 - DNA, 20 bp, Artificial
  CRISPR gRNA sequence
agagacaatgcagtcactag

SEQ ID NO: 77107 - DNA, 20 bp, Artificial
  CRISPR gRNA sequence
gatcctagctcagtccctca

SEQ ID NO: 77108 - DNA, 20 bp, Artificial
  CRISPR gRNA sequence
gctcagtccctcattgttca

SEQ ID NO: 77109 - DNA, 20 bp, Artificial
  CRISPR gRNA sequence
agtccctcattgttcagatg

SEQ ID NO: 77110 - DNA, 20 bp, Artificial
  CRISPR gRNA sequence
attgttcagatggggaaact

SEQ ID NO: 77111 - DNA, 20 bp, Artificial
  CRISPR gRNA sequence
ttcagatggggaaactgagg

SEQ ID NO: 77112 - DNA, 20 bp, Artificial
  CRISPR gRNA sequence
agatggggaaactgaggctc

SEQ ID NO: 77113 - DNA, 20 bp, Artificial
  CRISPR gRNA sequence
aggctcagggaagggaagcc

SEQ ID NO: 77114 - DNA, 20 bp, Artificial
  CRISPR gRNA sequence
agggaagggaagcctgagtt

SEQ ID NO: 77115 - DNA, 20 bp, Artificial
  CRISPR gRNA sequence
agttagaaaagccagcagct

SEQ ID NO: 77116 - DNA, 20 bp, Artificial
  CRISPR gRNA sequence
gaaaagccagcagcttgttc

SEQ ID NO: 77117 - DNA, 20 bp, Artificial
  CRISPR gRNA sequence
gttcctgtccaggtgagcag

SEQ ID NO: 77118 - DNA, 20 bp, Artificial
  CRISPR gRNA sequence
ttcctgtccaggtgagcagg

SEQ ID NO: 77119 - DNA, 20 bp, Artificial
  CRISPR gRNA sequence
ctgtccaggtgagcaggcag

SEQ ID NO: 77120 - DNA, 20 bp, Artificial
  CRISPR gRNA sequence
tccaggtgagcaggcaggag

SEQ ID NO: 77121 - DNA, 20 bp, Artificial
  CRISPR gRNA sequence
tctgaccactgcttggcatc

SEQ ID NO: 77122 - DNA, 20 bp, Artificial
  CRISPR gRNA sequence
tgaccactgcttggcatcac

SEQ ID NO: 77123 - DNA, 20 bp, Artificial
  CRISPR gRNA sequence
accactgcttggcatcacat

SEQ ID NO: 77124 - DNA, 20 bp, Artificial
  CRISPR gRNA sequence
cttggcatcacatgacttct

SEQ ID NO: 77125 - DNA, 20 bp, Artificial
  CRISPR gRNA sequence
ggcatcacatgacttctgcc

SEQ ID NO: 77126 - DNA, 20 bp, Artificial
  CRISPR gRNA sequence
gcatcacatgacttctgcct

SEQ ID NO: 77127 - DNA, 20 bp, Artificial
  CRISPR gRNA sequence
ctgcctccctgtacgtcagt

SEQ ID NO: 77128 - DNA, 20 bp, Artificial
  CRISPR gRNA sequence
tgcctccctgtacgtcagtt

SEQ ID NO: 77129 - DNA, 20 bp, Artificial
  CRISPR gRNA sequence
cctccctgtacgtcagttct

SEQ ID NO: 77130 - DNA, 20 bp, Artificial
  CRISPR gRNA sequence
cctgtacgtcagttctttgg

SEQ ID NO: 77131 - DNA, 20 bp, Artificial
  CRISPR gRNA sequence
tacgtcagttctttgggcct

SEQ ID NO: 77132 - DNA, 20 bp, Artificial
  CRISPR gRNA sequence
tttgggcctcaagaacccgg

SEQ ID NO: 77133 - DNA, 20 bp, Artificial
  CRISPR gRNA sequence
tgggcctcaagaacccgggg

SEQ ID NO: 77134 - DNA, 20 bp, Artificial
  CRISPR gRNA sequence
gggcctcaagaacccggggg

SEQ ID NO: 77135 - DNA, 20 bp, Artificial
  CRISPR gRNA sequence
ggcctcaagaacccgggggt

SEQ ID NO: 77136 - DNA, 20 bp, Artificial
  CRISPR gRNA sequence
aagaacccgggggttcccca

SEQ ID NO: 77137 - DNA, 20 bp, Artificial
  CRISPR gRNA sequence
cccagaaacagagatcctat

SEQ ID NO: 77138 - DNA, 20 bp, Artificial
  CRISPR gRNA sequence
tcctgggaagcaagaccacc

SEQ ID NO: 77139 - DNA, 20 bp, Artificial
  CRISPR gRNA sequence
ggaagcaagaccacccaggc

SEQ ID NO: 77140 - DNA, 20 bp, Artificial
  CRISPR gRNA sequence
gagccacccctgactcctga

SEQ ID NO: 77141 - DNA, 20 bp, Artificial
  CRISPR gRNA sequence
agccacccctgactcctgac

SEQ ID NO: 77142 - DNA, 20 bp, Artificial
  CRISPR gRNA sequence
actcctgacagcccatctgt

SEQ ID NO: 77143 - DNA, 20 bp, Artificial
  CRISPR gRNA sequence
ctgacagcccatctgtacgg

SEQ ID NO: 77144 - DNA, 20 bp, Artificial
  CRISPR gRNA sequence
acagcccatctgtacggcag

SEQ ID NO: 77145 - DNA, 20 bp, Artificial
  CRISPR gRNA sequence
tacggcagtgccttttcttg

SEQ ID NO: 77146 - DNA, 20 bp, Artificial
  CRISPR gRNA sequence
ttcttgacacactagctgtg

SEQ ID NO: 77147 - DNA, 20 bp, Artificial
  CRISPR gRNA sequence
tcttgacacactagctgtga

SEQ ID NO: 77148 - DNA, 20 bp, Artificial
  CRISPR gRNA sequence
cttgacacactagctgtgac

SEQ ID NO: 77149 - DNA, 20 bp, Artificial
  CRISPR gRNA sequence
ttgacacactagctgtgact

SEQ ID NO: 77150 - DNA, 20 bp, Artificial
  CRISPR gRNA sequence
gacacactagctgtgactct

SEQ ID NO: 77151 - DNA, 20 bp, Artificial
  CRISPR gRNA sequence
acacactagctgtgactctc

SEQ ID NO: 77152 - DNA, 20 bp, Artificial
  CRISPR gRNA sequence
gctgtgactctctccaccca

SEQ ID NO: 77153 - DNA, 20 bp, Artificial
  CRISPR gRNA sequence
tgactctctccacccagcca

SEQ ID NO: 77154 - DNA, 20 bp, Artificial
  CRISPR gRNA sequence
tctccacccagccagctgca

SEQ ID NO: 77155 - DNA, 20 bp, Artificial
  CRISPR gRNA sequence
tccacccagccagctgcaca

SEQ ID NO: 77156 - DNA, 20 bp, Artificial
  CRISPR gRNA sequence
cacccagccagctgcacatg

SEQ ID NO: 77157 - DNA, 20 bp, Artificial
  CRISPR gRNA sequence
cacatgggcccaccctgtcc

SEQ ID NO: 77158 - DNA, 20 bp, Artificial
  CRISPR gRNA sequence
tccgctgccactgctcccaa

SEQ ID NO: 77159 - DNA, 20 bp, Artificial
  CRISPR gRNA sequence
ccactgctcccaagtgaggc

SEQ ID NO: 77160 - DNA, 20 bp, Artificial
  CRISPR gRNA sequence
ctcccaagtgaggccaagag

SEQ ID NO: 77161 - DNA, 20 bp, Artificial
  CRISPR gRNA sequence
ccaagtgaggccaagaggcc

SEQ ID NO: 77162 - DNA, 20 bp, Artificial
  CRISPR gRNA sequence
gtcccactagagggcagccg

SEQ ID NO: 77163 - DNA, 20 bp, Artificial
  CRISPR gRNA sequence
gagggcagccgggaacatca

SEQ ID NO: 77164 - DNA, 20 bp, Artificial
  CRISPR gRNA sequence
aactagtattggttgtttac

SEQ ID NO: 77165 - DNA, 20 bp, Artificial
  CRISPR gRNA sequence
gtattggttgtttactgcga

SEQ ID NO: 77166 - DNA, 20 bp, Artificial
  CRISPR gRNA sequence
gttgtttactgcgaagacgg

SEQ ID NO: 77167 - DNA, 20 bp, Artificial
  CRISPR gRNA sequence
tttactgcgaagacggggaa

SEQ ID NO: 77168 - DNA, 20 bp, Artificial
  CRISPR gRNA sequence
actgcgaagacggggaaaat

SEQ ID NO: 77169 - DNA, 20 bp, Artificial
  CRISPR gRNA sequence
ctgcgaagacggggaaaatg

SEQ ID NO: 77170 - DNA, 20 bp, Artificial
  CRISPR gRNA sequence
cgaagacggggaaaatgttt

SEQ ID NO: 77171 - DNA, 20 bp, Artificial
  CRISPR gRNA sequence
tttcagagcacccacggccc

SEQ ID NO: 77172 - DNA, 20 bp, Artificial
  CRISPR gRNA sequence
ttcagagcacccacggcccc

SEQ ID NO: 77173 - DNA, 20 bp, Artificial
  CRISPR gRNA sequence
tcagagcacccacggcccct

SEQ ID NO: 77174 - DNA, 20 bp, Artificial
  CRISPR gRNA sequence
cagagcacccacggcccctg

SEQ ID NO: 77175 - DNA, 20 bp, Artificial
  CRISPR gRNA sequence
agagcacccacggcccctgc

SEQ ID NO: 77176 - DNA, 20 bp, Artificial
  CRISPR gRNA sequence
ccttcagagcgtgaaagggc

SEQ ID NO: 77177 - DNA, 20 bp, Artificial
  CRISPR gRNA sequence
cagagcgtgaaagggcagtg

SEQ ID NO: 77178 - DNA, 20 bp, Artificial
  CRISPR gRNA sequence
agagcgtgaaagggcagtga

SEQ ID NO: 77179 - DNA, 20 bp, Artificial
  CRISPR gRNA sequence
caaaattccccgaaacgcag

SEQ ID NO: 77180 - DNA, 20 bp, Artificial
  CRISPR gRNA sequence
cccgaaacgcagaagcacaa

SEQ ID NO: 77181 - DNA, 20 bp, Artificial
  CRISPR gRNA sequence
tcctgtctcctcccacacag

SEQ ID NO: 77182 - DNA, 20 bp, Artificial
  CRISPR gRNA sequence
ctgtctcctcccacacagca

SEQ ID NO: 77183 - DNA, 20 bp, Artificial
  CRISPR gRNA sequence
tctcctcccacacagcagca

SEQ ID NO: 77184 - DNA, 20 bp, Artificial
  CRISPR gRNA sequence
ctcccacacagcagcaatct

SEQ ID NO: 77185 - DNA, 20 bp, Artificial
  CRISPR gRNA sequence
ccacacagcagcaatctgcg

SEQ ID NO: 77186 - DNA, 20 bp, Artificial
  CRISPR gRNA sequence
cgggcacctgccctgctctg

SEQ ID NO: 77187 - DNA, 20 bp, Artificial
  CRISPR gRNA sequence
ccctgctctgggacctctcc

SEQ ID NO: 77188 - DNA, 20 bp, Artificial
  CRISPR gRNA sequence
ctctgggacctctcccaacc

SEQ ID NO: 77189 - DNA, 20 bp, Artificial
  CRISPR gRNA sequence
tgggacctctcccaaccata

SEQ ID NO: 77190 - DNA, 20 bp, Artificial
  CRISPR gRNA sequence
ggacctctcccaaccatatc

SEQ ID NO: 77191 - DNA, 20 bp, Artificial
  CRISPR gRNA sequence
tcccaaccatatccctccct

SEQ ID NO: 77192 - DNA, 20 bp, Artificial
  CRISPR gRNA sequence
ccaaccatatccctcccttc

SEQ ID NO: 77193 - DNA, 20 bp, Artificial
  CRISPR gRNA sequence
ccttcctcccatctgcattg

SEQ ID NO: 77194 - DNA, 20 bp, Artificial
  CRISPR gRNA sequence
cctcccatctgcattgcctc

SEQ ID NO: 77195 - DNA, 20 bp, Artificial
  CRISPR gRNA sequence
ctcccatctgcattgcctcc

SEQ ID NO: 77196 - DNA, 20 bp, Artificial
  CRISPR gRNA sequence
ccatctgcattgcctccttc

SEQ ID NO: 77197 - DNA, 20 bp, Artificial
  CRISPR gRNA sequence
cattgcctccttccaagggg

SEQ ID NO: 77198 - DNA, 20 bp, Artificial
  CRISPR gRNA sequence
cctccttccaaggggaaaac

SEQ ID NO: 77199 - DNA, 20 bp, Artificial
  CRISPR gRNA sequence
cttccaaggggaaaacaggg

SEQ ID NO: 77200 - DNA, 20 bp, Artificial
  CRISPR gRNA sequence
ccaaggggaaaacagggcag

SEQ ID NO: 77201 - DNA, 20 bp, Artificial
  CRISPR gRNA sequence
caaggggaaaacagggcagt

SEQ ID NO: 77202 - DNA, 20 bp, Artificial
  CRISPR gRNA sequence
attactgacaatttatgggg

SEQ ID NO: 77203 - DNA, 20 bp, Artificial
  CRISPR gRNA sequence
ctgacaatttatgggggggg

SEQ ID NO: 77204 - DNA, 20 bp, Artificial
  CRISPR gRNA sequence
acaatttatggggggggcgg

SEQ ID NO: 77205 - DNA, 20 bp, Artificial
  CRISPR gRNA sequence
atggggggggcggtggttac

SEQ ID NO: 77206 - DNA, 20 bp, Artificial
  CRISPR gRNA sequence
tggggggggcggtggttact

SEQ ID NO: 77207 - DNA, 20 bp, Artificial
  CRISPR gRNA sequence
ctgaagtggtgattaaacct

SEQ ID NO: 77208 - DNA, 20 bp, Artificial
  CRISPR gRNA sequence
aagtggtgattaaacctagt

SEQ ID NO: 77209 - DNA, 20 bp, Artificial
  CRISPR gRNA sequence
aacctagtgtgccggacttg

SEQ ID NO: 77210 - DNA, 20 bp, Artificial
  CRISPR gRNA sequence
gtgtgccggacttgggtggt

SEQ ID NO: 77211 - DNA, 20 bp, Artificial
  CRISPR gRNA sequence
gggtggtttaactgagagct

SEQ ID NO: 77212 - DNA, 20 bp, Artificial
  CRISPR gRNA sequence
ggtggtttaactgagagctg

SEQ ID NO: 77213 - DNA, 20 bp, Artificial
  CRISPR gRNA sequence
aactgagagctgagtggtca

SEQ ID NO: 77214 - DNA, 20 bp, Artificial
  CRISPR gRNA sequence
actgagagctgagtggtcag

SEQ ID NO: 77215 - DNA, 20 bp, Artificial
  CRISPR gRNA sequence
agagctgagtggtcagcatg

SEQ ID NO: 77216 - DNA, 20 bp, Artificial
  CRISPR gRNA sequence
agtggtcagcatgggtctgg

SEQ ID NO: 77217 - DNA, 20 bp, Artificial
  CRISPR gRNA sequence
ggggtggggggacctccaac

SEQ ID NO: 77218 - DNA, 20 bp, Artificial
  CRISPR gRNA sequence
caacagacggggaccagagc

SEQ ID NO: 77219 - DNA, 20 bp, Artificial
  CRISPR gRNA sequence
ccccaccccgagcgttccct

SEQ ID NO: 77220 - DNA, 20 bp, Artificial
  CRISPR gRNA sequence
cctcctcacctgcttgtctt

SEQ ID NO: 77221 - DNA, 20 bp, Artificial
  CRISPR gRNA sequence
ctcacctgcttgtcttgtcc

SEQ ID NO: 77222 - DNA, 20 bp, Artificial
  CRISPR gRNA sequence
acctgcttgtcttgtcccct

SEQ ID NO: 77223 - DNA, 20 bp, Artificial
  CRISPR gRNA sequence
cttgtcttgtcccctctcag

SEQ ID NO: 77224 - DNA, 20 bp, Artificial
  CRISPR gRNA sequence
gtcttgtcccctctcaggag

SEQ ID NO: 77225 - DNA, 20 bp, Artificial
  CRISPR gRNA sequence
tcttgtcccctctcaggagg

SEQ ID NO: 77226 - DNA, 20 bp, Artificial
  CRISPR gRNA sequence
gtcccctctcaggaggatgt

SEQ ID NO: 77227 - DNA, 20 bp, Artificial
  CRISPR gRNA sequence
tcccctctcaggaggatgtg

SEQ ID NO: 77228 - DNA, 20 bp, Artificial
  CRISPR gRNA sequence
tcaggaggatgtgttggctt

SEQ ID NO: 77229 - DNA, 20 bp, Artificial
  CRISPR gRNA sequence
aggaggatgtgttggctttc

SEQ ID NO: 77230 - DNA, 20 bp, Artificial
  CRISPR gRNA sequence
gctttcaaagctggaagcag

SEQ ID NO: 77231 - DNA, 20 bp, Artificial
  CRISPR gRNA sequence
tcaaagctggaagcagagag

SEQ ID NO: 77232 - DNA, 20 bp, Artificial
  CRISPR gRNA sequence
caaagctggaagcagagagg

SEQ ID NO: 77233 - DNA, 20 bp, Artificial
  CRISPR gRNA sequence
aaagctggaagcagagagga

SEQ ID NO: 77234 - DNA, 20 bp, Artificial
  CRISPR gRNA sequence
gaagcagagaggaagcagca

SEQ ID NO: 77235 - DNA, 20 bp, Artificial
  CRISPR gRNA sequence
gaaaatggtcaaagaccaac

SEQ ID NO: 77236 - DNA, 20 bp, Artificial
  CRISPR gRNA sequence
aaaatggtcaaagaccaact

SEQ ID NO: 77237 - DNA, 20 bp, Artificial
  CRISPR gRNA sequence
ccctggcagtggcaagaacc

SEQ ID NO: 77238 - DNA, 20 bp, Artificial
  CRISPR gRNA sequence
cctggcagtggcaagaaccc

SEQ ID NO: 77239 - DNA, 20 bp, Artificial
  CRISPR gRNA sequence
gcagtggcaagaacccagac

SEQ ID NO: 77240 - DNA, 20 bp, Artificial
  CRISPR gRNA sequence
gtcagggcaaggagggcctg

SEQ ID NO: 77241 - DNA, 20 bp, Artificial
  CRISPR gRNA sequence
gggtggcctgctttcttagc

SEQ ID NO: 77242 - DNA, 20 bp, Artificial
  CRISPR gRNA sequence
ctttcttagcaaacaaggaa

SEQ ID NO: 77243 - DNA, 20 bp, Artificial
  CRISPR gRNA sequence
tcttagcaaacaaggaatag

SEQ ID NO: 77244 - DNA, 20 bp, Artificial
  CRISPR gRNA sequence
cttagcaaacaaggaataga

SEQ ID NO: 77245 - DNA, 20 bp, Artificial
  CRISPR gRNA sequence
ttagcaaacaaggaatagat

SEQ ID NO: 77246 - DNA, 20 bp, Artificial
  CRISPR gRNA sequence
agcaaacaaggaatagatta

SEQ ID NO: 77247 - DNA, 20 bp, Artificial
  CRISPR gRNA sequence
gcaaacaaggaatagattaa

SEQ ID NO: 77248 - DNA, 20 bp, Artificial
  CRISPR gRNA sequence
agcaacaattacatgtatca

SEQ ID NO: 77249 - DNA, 20 bp, Artificial
  CRISPR gRNA sequence
catgtatcaagtcacatgca

SEQ ID NO: 77250 - DNA, 20 bp, Artificial
  CRISPR gRNA sequence
ctcatttgattctcacaata

SEQ ID NO: 77251 - DNA, 20 bp, Artificial
  CRISPR gRNA sequence
tcatttgattctcacaataa

SEQ ID NO: 77252 - DNA, 20 bp, Artificial
  CRISPR gRNA sequence
atttgattctcacaataaac

SEQ ID NO: 77253 - DNA, 20 bp, Artificial
  CRISPR gRNA sequence
gattctcacaataaacaatg

SEQ ID NO: 77254 - DNA, 20 bp, Artificial
  CRISPR gRNA sequence
attctcacaataaacaatga

SEQ ID NO: 77255 - DNA, 20 bp, Artificial
  CRISPR gRNA sequence
tcacaataaacaatgaggta

SEQ ID NO: 77256 - DNA, 20 bp, Artificial
  CRISPR gRNA sequence
acaataaacaatgaggtaag

SEQ ID NO: 77257 - DNA, 20 bp, Artificial
  CRISPR gRNA sequence
ttctttgttgttgtttcgaa

SEQ ID NO: 77258 - DNA, 20 bp, Artificial
  CRISPR gRNA sequence
ctttgttgttgtttcgaaga

SEQ ID NO: 77259 - DNA, 20 bp, Artificial
  CRISPR gRNA sequence
tttgttgttgtttcgaagaa

SEQ ID NO: 77260 - DNA, 20 bp, Artificial
  CRISPR gRNA sequence
tgttgttgtttcgaagaaag

SEQ ID NO: 77261 - DNA, 20 bp, Artificial
  CRISPR gRNA sequence
gttgttgtttcgaagaaagg

SEQ ID NO: 77262 - DNA, 20 bp, Artificial
  CRISPR gRNA sequence
ttgttgtttcgaagaaaggg

SEQ ID NO: 77263 - DNA, 20 bp, Artificial
  CRISPR gRNA sequence
ttgtttcgaagaaagggtct

SEQ ID NO: 77264 - DNA, 20 bp, Artificial
  CRISPR gRNA sequence
tttcgaagaaagggtcttgc

SEQ ID NO: 77265 - DNA, 20 bp, Artificial
  CRISPR gRNA sequence
cgaagaaagggtcttgctct

SEQ ID NO: 77266 - DNA, 20 bp, Artificial
  CRISPR gRNA sequence
gaagaaagggtcttgctctg

SEQ ID NO: 77267 - DNA, 20 bp, Artificial
  CRISPR gRNA sequence
gctctgtcgcccaggctggt

SEQ ID NO: 77268 - DNA, 20 bp, Artificial
  CRISPR gRNA sequence
ctctgtcgcccaggctggtg

SEQ ID NO: 77269 - DNA, 20 bp, Artificial
  CRISPR gRNA sequence
tgtcgcccaggctggtgtgc

SEQ ID NO: 77270 - DNA, 20 bp, Artificial
  CRISPR gRNA sequence
tcgcccaggctggtgtgcag

SEQ ID NO: 77271 - DNA, 20 bp, Artificial
  CRISPR gRNA sequence
gtgtgcagtggtgcagtcat

SEQ ID NO: 77272 - DNA, 20 bp, Artificial
  CRISPR gRNA sequence
actgcagcctcaaccttccc

SEQ ID NO: 77273 - DNA, 20 bp, Artificial
  CRISPR gRNA sequence
cagcctcaaccttccccggg

SEQ ID NO: 77274 - DNA, 20 bp, Artificial
  CRISPR gRNA sequence
aaccttccccgggctcaact

SEQ ID NO: 77275 - DNA, 20 bp, Artificial
  CRISPR gRNA sequence
ccccgggctcaactgatcct

SEQ ID NO: 77276 - DNA, 20 bp, Artificial
  CRISPR gRNA sequence
cccgggctcaactgatccta

SEQ ID NO: 77277 - DNA, 20 bp, Artificial
  CRISPR gRNA sequence
aactgatcctactgcctcag

SEQ ID NO: 77278 - DNA, 20 bp, Artificial
  CRISPR gRNA sequence
atcctactgcctcagcctcc

SEQ ID NO: 77279 - DNA, 20 bp, Artificial
  CRISPR gRNA sequence
ctgcctcagcctcccaagta

SEQ ID NO: 77280 - DNA, 20 bp, Artificial
  CRISPR gRNA sequence
cctcagcctcccaagtagct

SEQ ID NO: 77281 - DNA, 20 bp, Artificial
  CRISPR gRNA sequence
agcctcccaagtagctggga

SEQ ID NO: 77282 - DNA, 20 bp, Artificial
  CRISPR gRNA sequence
ccaagtagctgggactacag

SEQ ID NO: 77283 - DNA, 20 bp, Artificial
  CRISPR gRNA sequence
ggactacaggaacgccccac

SEQ ID NO: 77284 - DNA, 20 bp, Artificial
  CRISPR gRNA sequence
caggaacgccccaccatgac

SEQ ID NO: 77285 - DNA, 20 bp, Artificial
  CRISPR gRNA sequence
tctaatttttgtattttttg

SEQ ID NO: 77286 - DNA, 20 bp, Artificial
  CRISPR gRNA sequence
atttttgtattttttgtaga

SEQ ID NO: 77287 - DNA, 20 bp, Artificial
  CRISPR gRNA sequence
ttgtattttttgtagagatg

SEQ ID NO: 77288 - DNA, 20 bp, Artificial
  CRISPR gRNA sequence
tgtattttttgtagagatgg

SEQ ID NO: 77289 - DNA, 20 bp, Artificial
  CRISPR gRNA sequence
gtattttttgtagagatggg

SEQ ID NO: 77290 - DNA, 20 bp, Artificial
  CRISPR gRNA sequence
tattttttgtagagatgggg

SEQ ID NO: 77291 - DNA, 20 bp, Artificial
  CRISPR gRNA sequence
tttgtagagatggggttttg

SEQ ID NO: 77292 - DNA, 20 bp, Artificial
  CRISPR gRNA sequence
ttgtagagatggggttttgc

SEQ ID NO: 77293 - DNA, 20 bp, Artificial
  CRISPR gRNA sequence
tgtagagatggggttttgcc

SEQ ID NO: 77294 - DNA, 20 bp, Artificial
  CRISPR gRNA sequence
gtagagatggggttttgcca

SEQ ID NO: 77295 - DNA, 20 bp, Artificial
  CRISPR gRNA sequence
tagagatggggttttgccat

SEQ ID NO: 77296 - DNA, 20 bp, Artificial
  CRISPR gRNA sequence
tgccatgttgagcaggctgg

SEQ ID NO: 77297 - DNA, 20 bp, Artificial
  CRISPR gRNA sequence
gccatgttgagcaggctggt

SEQ ID NO: 77298 - DNA, 20 bp, Artificial
  CRISPR gRNA sequence
ccatgttgagcaggctggtc

SEQ ID NO: 77299 - DNA, 20 bp, Artificial
  CRISPR gRNA sequence
agcaggctggtctcaaactc

SEQ ID NO: 77300 - DNA, 20 bp, Artificial
  CRISPR gRNA sequence
gtctcaaactccatggctca

SEQ ID NO: 77301 - DNA, 20 bp, Artificial
  CRISPR gRNA sequence
aaactccatggctcaaacga

SEQ ID NO: 77302 - DNA, 20 bp, Artificial
  CRISPR gRNA sequence
catggctcaaacgatcctcc

SEQ ID NO: 77303 - DNA, 20 bp, Artificial
  CRISPR gRNA sequence
aaacgatcctcctgccttag

SEQ ID NO: 77304 - DNA, 20 bp, Artificial
  CRISPR gRNA sequence
ctgccttagcctcccaaagt

SEQ ID NO: 77305 - DNA, 20 bp, Artificial
  CRISPR gRNA sequence
ccttagcctcccaaagtgct

SEQ ID NO: 77306 - DNA, 20 bp, Artificial
  CRISPR gRNA sequence
agcctcccaaagtgctggaa

SEQ ID NO: 77307 - DNA, 20 bp, Artificial
  CRISPR gRNA sequence
gcctcccaaagtgctggaat

SEQ ID NO: 77308 - DNA, 20 bp, Artificial
  CRISPR gRNA sequence
ccaaagtgctggaattacag

SEQ ID NO: 77309 - DNA, 20 bp, Artificial
  CRISPR gRNA sequence
gaattacagatgtgagccat

SEQ ID NO: 77310 - DNA, 20 bp, Artificial
  CRISPR gRNA sequence
cagatgtgagccattgtgcc

SEQ ID NO: 77311 - DNA, 20 bp, Artificial
  CRISPR gRNA sequence
tgcctgacatttttttttct

SEQ ID NO: 77312 - DNA, 20 bp, Artificial
  CRISPR gRNA sequence
acatttttttttctttgaga

SEQ ID NO: 77313 - DNA, 20 bp, Artificial
  CRISPR gRNA sequence
ttttttctttgagacagagt

SEQ ID NO: 77314 - DNA, 20 bp, Artificial
  CRISPR gRNA sequence
tttttctttgagacagagtc

SEQ ID NO: 77315 - DNA, 20 bp, Artificial
  CRISPR gRNA sequence
ttttctttgagacagagtct

SEQ ID NO: 77316 - DNA, 20 bp, Artificial
  CRISPR gRNA sequence
tttctttgagacagagtctt

SEQ ID NO: 77317 - DNA, 20 bp, Artificial
  CRISPR gRNA sequence
ttctttgagacagagtcttg

SEQ ID NO: 77318 - DNA, 20 bp, Artificial
  CRISPR gRNA sequence
tctttgagacagagtcttgc

SEQ ID NO: 77319 - DNA, 20 bp, Artificial
  CRISPR gRNA sequence
ctttgagacagagtcttgct

SEQ ID NO: 77320 - DNA, 20 bp, Artificial
  CRISPR gRNA sequence
tttgagacagagtcttgctc

SEQ ID NO: 77321 - DNA, 20 bp, Artificial
  CRISPR gRNA sequence
tgagacagagtcttgctctg

SEQ ID NO: 77322 - DNA, 20 bp, Artificial
  CRISPR gRNA sequence
gagacagagtcttgctctgt

SEQ ID NO: 77323 - DNA, 20 bp, Artificial
  CRISPR gRNA sequence
agacagagtcttgctctgtt

SEQ ID NO: 77324 - DNA, 20 bp, Artificial
  CRISPR gRNA sequence
gctctgttgcccaggctgga

SEQ ID NO: 77325 - DNA, 20 bp, Artificial
  CRISPR gRNA sequence
ctctgttgcccaggctggag

SEQ ID NO: 77326 - DNA, 20 bp, Artificial
  CRISPR gRNA sequence
tgttgcccaggctggagtgc

SEQ ID NO: 77327 - DNA, 20 bp, Artificial
  CRISPR gRNA sequence
ttgcccaggctggagtgcaa

SEQ ID NO: 77328 - DNA, 20 bp, Artificial
  CRISPR gRNA sequence
cccaggctggagtgcaatgg

SEQ ID NO: 77329 - DNA, 20 bp, Artificial
  CRISPR gRNA sequence
gagtgcaatggtgtgatcac

SEQ ID NO: 77330 - DNA, 20 bp, Artificial
  CRISPR gRNA sequence
actgtagcctcgatctcctg

SEQ ID NO: 77331 - DNA, 20 bp, Artificial
  CRISPR gRNA sequence
tagcctcgatctcctgagtc

SEQ ID NO: 77332 - DNA, 20 bp, Artificial
  CRISPR gRNA sequence
gatctcctgagtctaagcaa

SEQ ID NO: 77333 - DNA, 20 bp, Artificial
  CRISPR gRNA sequence
ctgagtctaagcaatcctcc

SEQ ID NO: 77334 - DNA, 20 bp, Artificial
  CRISPR gRNA sequence
agtctaagcaatcctcccac

SEQ ID NO: 77335 - DNA, 20 bp, Artificial
  CRISPR gRNA sequence
agcaatcctcccacctcagc

SEQ ID NO: 77336 - DNA, 20 bp, Artificial
  CRISPR gRNA sequence
ccacctcagcctcccaagta

SEQ ID NO: 77337 - DNA, 20 bp, Artificial
  CRISPR gRNA sequence
agcctcccaagtaggtgcat

SEQ ID NO: 77338 - DNA, 20 bp, Artificial
  CRISPR gRNA sequence
ccaagtaggtgcatgccatc

SEQ ID NO: 77339 - DNA, 20 bp, Artificial
  CRISPR gRNA sequence
ggctaatttttaaagtttct

SEQ ID NO: 77340 - DNA, 20 bp, Artificial
  CRISPR gRNA sequence
gctaatttttaaagtttctg

SEQ ID NO: 77341 - DNA, 20 bp, Artificial
  CRISPR gRNA sequence
atttttaaagtttctgtaga

SEQ ID NO: 77342 - DNA, 20 bp, Artificial
  CRISPR gRNA sequence
ttaaagtttctgtagagatg

SEQ ID NO: 77343 - DNA, 20 bp, Artificial
  CRISPR gRNA sequence
taaagtttctgtagagatgg

SEQ ID NO: 77344 - DNA, 20 bp, Artificial
  CRISPR gRNA sequence
aaagtttctgtagagatggg

SEQ ID NO: 77345 - DNA, 20 bp, Artificial
  CRISPR gRNA sequence
aagtttctgtagagatgggg

SEQ ID NO: 77346 - DNA, 20 bp, Artificial
  CRISPR gRNA sequence
ctgtagagatgggggggtct

SEQ ID NO: 77347 - DNA, 20 bp, Artificial
  CRISPR gRNA sequence
tgtagagatgggggggtctc

SEQ ID NO: 77348 - DNA, 20 bp, Artificial
  CRISPR gRNA sequence
tagagatgggggggtctcac

SEQ ID NO: 77349 - DNA, 20 bp, Artificial
  CRISPR gRNA sequence
accatgttgtccaggctggt

SEQ ID NO: 77350 - DNA, 20 bp, Artificial
  CRISPR gRNA sequence
tccaggctggtctcaaactc

SEQ ID NO: 77351 - DNA, 20 bp, Artificial
  CRISPR gRNA sequence
gtctcaaactcctaggctca

SEQ ID NO: 77352 - DNA, 20 bp, Artificial
  CRISPR gRNA sequence
aaactcctaggctcaggtga

SEQ ID NO: 77353 - DNA, 20 bp, Artificial
  CRISPR gRNA sequence
ctaggctcaggtgatcctcc

SEQ ID NO: 77354 - DNA, 20 bp, Artificial
  CRISPR gRNA sequence
ggctcaggtgatcctcctcc

SEQ ID NO: 77355 - DNA, 20 bp, Artificial
  CRISPR gRNA sequence
aggtgatcctcctcctcctg

SEQ ID NO: 77356 - DNA, 20 bp, Artificial
  CRISPR gRNA sequence
ctcctcctgtcttggcctcc

SEQ ID NO: 77357 - DNA, 20 bp, Artificial
  CRISPR gRNA sequence
ctcctgtcttggcctcccaa

SEQ ID NO: 77358 - DNA, 20 bp, Artificial
  CRISPR gRNA sequence
ctgtcttggcctcccaaagt

SEQ ID NO: 77359 - DNA, 20 bp, Artificial
  CRISPR gRNA sequence
tcttggcctcccaaagtgct

SEQ ID NO: 77360 - DNA, 20 bp, Artificial
  CRISPR gRNA sequence
ggcctcccaaagtgctggga

SEQ ID NO: 77361 - DNA, 20 bp, Artificial
  CRISPR gRNA sequence
gcctcccaaagtgctgggat

SEQ ID NO: 77362 - DNA, 20 bp, Artificial
  CRISPR gRNA sequence
ccaaagtgctgggattacag

SEQ ID NO: 77363 - DNA, 20 bp, Artificial
  CRISPR gRNA sequence
ggattacaggcttgagccac

SEQ ID NO: 77364 - DNA, 20 bp, Artificial
  CRISPR gRNA sequence
caggcttgagccactgtgcc

SEQ ID NO: 77365 - DNA, 20 bp, Artificial
  CRISPR gRNA sequence
gagccactgtgccaggccag

SEQ ID NO: 77366 - DNA, 20 bp, Artificial
  CRISPR gRNA sequence
agccactgtgccaggccagt

SEQ ID NO: 77367 - DNA, 20 bp, Artificial
  CRISPR gRNA sequence
tgccaggccagtaattattc

SEQ ID NO: 77368 - DNA, 20 bp, Artificial
  CRISPR gRNA sequence
ttcttatctccattttacag

SEQ ID NO: 77369 - DNA, 20 bp, Artificial
  CRISPR gRNA sequence
ttatctccattttacagatg

SEQ ID NO: 77370 - DNA, 20 bp, Artificial
  CRISPR gRNA sequence
atctccattttacagatgag

SEQ ID NO: 77371 - DNA, 20 bp, Artificial
  CRISPR gRNA sequence
tctccattttacagatgagg

SEQ ID NO: 77372 - DNA, 20 bp, Artificial
  CRISPR gRNA sequence
cattttacagatgaggaaac

SEQ ID NO: 77373 - DNA, 20 bp, Artificial
  CRISPR gRNA sequence
tacagatgaggaaactgagg

SEQ ID NO: 77374 - DNA, 20 bp, Artificial
  CRISPR gRNA sequence
acagatgaggaaactgaggc

SEQ ID NO: 77375 - DNA, 20 bp, Artificial
  CRISPR gRNA sequence
cagatgaggaaactgaggcc

SEQ ID NO: 77376 - DNA, 20 bp, Artificial
  CRISPR gRNA sequence
aggcctggagaggctctggg

SEQ ID NO: 77377 - DNA, 20 bp, Artificial
  CRISPR gRNA sequence
gagaggctctgggacctgct

SEQ ID NO: 77378 - DNA, 20 bp, Artificial
  CRISPR gRNA sequence
tgggacctgctctgagctcg

SEQ ID NO: 77379 - DNA, 20 bp, Artificial
  CRISPR gRNA sequence
ggacctgctctgagctcgca

SEQ ID NO: 77380 - DNA, 20 bp, Artificial
  CRISPR gRNA sequence
ctctgagctcgcagcagtta

SEQ ID NO: 77381 - DNA, 20 bp, Artificial
  CRISPR gRNA sequence
tgagctcgcagcagttaagt

SEQ ID NO: 77382 - DNA, 20 bp, Artificial
  CRISPR gRNA sequence
agctcgcagcagttaagtaa

SEQ ID NO: 77383 - DNA, 20 bp, Artificial
  CRISPR gRNA sequence
gcagcagttaagtaactgag

SEQ ID NO: 77384 - DNA, 20 bp, Artificial
  CRISPR gRNA sequence
agtaactgagcctggtccat

SEQ ID NO: 77385 - DNA, 20 bp, Artificial
  CRISPR gRNA sequence
agcctggtccatctgctgtg

SEQ ID NO: 77386 - DNA, 20 bp, Artificial
  CRISPR gRNA sequence
gtccatctgctgtggcacct

SEQ ID NO: 77387 - DNA, 20 bp, Artificial
  CRISPR gRNA sequence
ctgtggcacctcccattctt

SEQ ID NO: 77388 - DNA, 20 bp, Artificial
  CRISPR gRNA sequence
tggcacctcccattcttggg

SEQ ID NO: 77389 - DNA, 20 bp, Artificial
  CRISPR gRNA sequence
ccattcttgggggtccttag

SEQ ID NO: 77390 - DNA, 20 bp, Artificial
  CRISPR gRNA sequence
ttgggggtccttagggaagg

SEQ ID NO: 77391 - DNA, 20 bp, Artificial
  CRISPR gRNA sequence
gggggtccttagggaaggga

SEQ ID NO: 77392 - DNA, 20 bp, Artificial
  CRISPR gRNA sequence
ggggtccttagggaagggaa

SEQ ID NO: 77393 - DNA, 20 bp, Artificial
  CRISPR gRNA sequence
agggaagggaaagggaagca

SEQ ID NO: 77394 - DNA, 20 bp, Artificial
  CRISPR gRNA sequence
gggaagggaaagggaagcag

SEQ ID NO: 77395 - DNA, 20 bp, Artificial
  CRISPR gRNA sequence
ccctgaaaatcatggatgcg

SEQ ID NO: 77396 - DNA, 20 bp, Artificial
  CRISPR gRNA sequence
aaaatcatggatgcggtgcc

SEQ ID NO: 77397 - DNA, 20 bp, Artificial
  CRISPR gRNA sequence
agtgcctggggtggcttggc

SEQ ID NO: 77398 - DNA, 20 bp, Artificial
  CRISPR gRNA sequence
gggtggcttggctggctggt

SEQ ID NO: 77399 - DNA, 20 bp, Artificial
  CRISPR gRNA sequence
ggctggctggtgcctcccct

SEQ ID NO: 77400 - DNA, 20 bp, Artificial
  CRISPR gRNA sequence
gctggctggtgcctcccctt

SEQ ID NO: 77401 - DNA, 20 bp, Artificial
  CRISPR gRNA sequence
gctggtgcctccccttttat

SEQ ID NO: 77402 - DNA, 20 bp, Artificial
  CRISPR gRNA sequence
gtgcctccccttttatattc

SEQ ID NO: 77403 - DNA, 20 bp, Artificial
  CRISPR gRNA sequence
cccttttatattctcatcag

SEQ ID NO: 77404 - DNA, 20 bp, Artificial
  CRISPR gRNA sequence
ttatattctcatcagctccc

SEQ ID NO: 77405 - DNA, 20 bp, Artificial
  CRISPR gRNA sequence
tatattctcatcagctccca

SEQ ID NO: 77406 - DNA, 20 bp, Artificial
  CRISPR gRNA sequence
atattctcatcagctcccac

SEQ ID NO: 77407 - DNA, 20 bp, Artificial
  CRISPR gRNA sequence
tattctcatcagctcccaca

SEQ ID NO: 77408 - DNA, 20 bp, Artificial
  CRISPR gRNA sequence
tcatcagctcccacaattaa

SEQ ID NO: 77409 - DNA, 20 bp, Artificial
  CRISPR gRNA sequence
atcagctcccacaattaaga

SEQ ID NO: 77410 - DNA, 20 bp, Artificial
  CRISPR gRNA sequence
ccacaattaagacaggtccc

SEQ ID NO: 77411 - DNA, 20 bp, Artificial
  CRISPR gRNA sequence
agacaggtccctgagtcccc

SEQ ID NO: 77412 - DNA, 20 bp, Artificial
  CRISPR gRNA sequence
agtccccagtggcaactagg

SEQ ID NO: 77413 - DNA, 20 bp, Artificial
  CRISPR gRNA sequence
ggaagctcccagttttcttt

SEQ ID NO: 77414 - DNA, 20 bp, Artificial
  CRISPR gRNA sequence
ccagttttcttttcttttct

SEQ ID NO: 77415 - DNA, 20 bp, Artificial
  CRISPR gRNA sequence
tcttttcttttctttttttt

SEQ ID NO: 77416 - DNA, 20 bp, Artificial
  CRISPR gRNA sequence
cttttcttttcttttttttt

SEQ ID NO: 77417 - DNA, 20 bp, Artificial
  CRISPR gRNA sequence
ttttcttttctttttttttt

SEQ ID NO: 77418 - DNA, 20 bp, Artificial
  CRISPR gRNA sequence
ttcttttctttttttttttg

SEQ ID NO: 77419 - DNA, 20 bp, Artificial
  CRISPR gRNA sequence
tcttttctttttttttttga

SEQ ID NO: 77420 - DNA, 20 bp, Artificial
  CRISPR gRNA sequence
cttttctttttttttttgag

SEQ ID NO: 77421 - DNA, 20 bp, Artificial
  CRISPR gRNA sequence
ttttctttttttttttgaga

SEQ ID NO: 77422 - DNA, 20 bp, Artificial
  CRISPR gRNA sequence
ttctttttttttttgagatg

SEQ ID NO: 77423 - DNA, 20 bp, Artificial
  CRISPR gRNA sequence
tctttttttttttgagatgg

SEQ ID NO: 77424 - DNA, 20 bp, Artificial
  CRISPR gRNA sequence
ctttttttttttgagatgga

SEQ ID NO: 77425 - DNA, 20 bp, Artificial
  CRISPR gRNA sequence
tttttttttttgagatggag

SEQ ID NO: 77426 - DNA, 20 bp, Artificial
  CRISPR gRNA sequence
tttttttttgagatggagtc

SEQ ID NO: 77427 - DNA, 20 bp, Artificial
  CRISPR gRNA sequence
ttttttttgagatggagtct

SEQ ID NO: 77428 - DNA, 20 bp, Artificial
  CRISPR gRNA sequence
tttttttgagatggagtctc

SEQ ID NO: 77429 - DNA, 20 bp, Artificial
  CRISPR gRNA sequence
ttttttgagatggagtctca

SEQ ID NO: 77430 - DNA, 20 bp, Artificial
  CRISPR gRNA sequence
tttttgagatggagtctcac

SEQ ID NO: 77431 - DNA, 20 bp, Artificial
  CRISPR gRNA sequence
ttttgagatggagtctcact

SEQ ID NO: 77432 - DNA, 20 bp, Artificial
  CRISPR gRNA sequence
tttgagatggagtctcactc

SEQ ID NO: 77433 - DNA, 20 bp, Artificial
  CRISPR gRNA sequence
ttgagatggagtctcactct

SEQ ID NO: 77434 - DNA, 20 bp, Artificial
  CRISPR gRNA sequence
tgagatggagtctcactctg

SEQ ID NO: 77435 - DNA, 20 bp, Artificial
  CRISPR gRNA sequence
gagatggagtctcactctgt

SEQ ID NO: 77436 - DNA, 20 bp, Artificial
  CRISPR gRNA sequence
agatggagtctcactctgtc

SEQ ID NO: 77437 - DNA, 20 bp, Artificial
  CRISPR gRNA sequence
actctgtcgcccaggctgga

SEQ ID NO: 77438 - DNA, 20 bp, Artificial
  CRISPR gRNA sequence
tgtcgcccaggctggagtgc

SEQ ID NO: 77439 - DNA, 20 bp, Artificial
  CRISPR gRNA sequence
tcgcccaggctggagtgcag

SEQ ID NO: 77440 - DNA, 20 bp, Artificial
  CRISPR gRNA sequence
gagtgcagtggcacgatctc

SEQ ID NO: 77441 - DNA, 20 bp, Artificial
  CRISPR gRNA sequence
agctcactgcaaccttcgcc

SEQ ID NO: 77442 - DNA, 20 bp, Artificial
  CRISPR gRNA sequence
actgcaaccttcgcctcctg

SEQ ID NO: 77443 - DNA, 20 bp, Artificial
  CRISPR gRNA sequence
caaccttcgcctcctgggtt

SEQ ID NO: 77444 - DNA, 20 bp, Artificial
  CRISPR gRNA sequence
cgcctcctgggttcaagtga

SEQ ID NO: 77445 - DNA, 20 bp, Artificial
  CRISPR gRNA sequence
gcctcctgggttcaagtgat

SEQ ID NO: 77446 - DNA, 20 bp, Artificial
  CRISPR gRNA sequence
ctgggttcaagtgattctcc

SEQ ID NO: 77447 - DNA, 20 bp, Artificial
  CRISPR gRNA sequence
ggttcaagtgattctcctga

SEQ ID NO: 77448 - DNA, 20 bp, Artificial
  CRISPR gRNA sequence
aagtgattctcctgactcct

SEQ ID NO: 77449 - DNA, 20 bp, Artificial
  CRISPR gRNA sequence
tcctgactcctgagcggctg

SEQ ID NO: 77450 - DNA, 20 bp, Artificial
  CRISPR gRNA sequence
ctgactcctgagcggctggc

SEQ ID NO: 77451 - DNA, 20 bp, Artificial
  CRISPR gRNA sequence
actcctgagcggctggcact

SEQ ID NO: 77452 - DNA, 20 bp, Artificial
  CRISPR gRNA sequence
ctgagcggctggcactacaa

SEQ ID NO: 77453 - DNA, 20 bp, Artificial
  CRISPR gRNA sequence
agcggctggcactacaaggg

SEQ ID NO: 77454 - DNA, 20 bp, Artificial
  CRISPR gRNA sequence
gcactacaagggctcacaac

SEQ ID NO: 77455 - DNA, 20 bp, Artificial
  CRISPR gRNA sequence
caagggctcacaaccacgcc

SEQ ID NO: 77456 - DNA, 20 bp, Artificial
  CRISPR gRNA sequence
acaaccacgcccagatactt

SEQ ID NO: 77457 - DNA, 20 bp, Artificial
  CRISPR gRNA sequence
ttttttttttttttggtatt

SEQ ID NO: 77458 - DNA, 20 bp, Artificial
  CRISPR gRNA sequence
tttttttttttttggtattt

SEQ ID NO: 77459 - DNA, 20 bp, Artificial
  CRISPR gRNA sequence
ttttttttttttggtatttt

SEQ ID NO: 77460 - DNA, 20 bp, Artificial
  CRISPR gRNA sequence
tttttttttttggtattttt

SEQ ID NO: 77461 - DNA, 20 bp, Artificial
  CRISPR gRNA sequence
ttttttttttggtattttta

SEQ ID NO: 77462 - DNA, 20 bp, Artificial
  CRISPR gRNA sequence
tttttttttggtatttttag

SEQ ID NO: 77463 - DNA, 20 bp, Artificial
  CRISPR gRNA sequence
ttttttttggtatttttagc

SEQ ID NO: 77464 - DNA, 20 bp, Artificial
  CRISPR gRNA sequence
tttttttggtatttttagca

SEQ ID NO: 77465 - DNA, 20 bp, Artificial
  CRISPR gRNA sequence
ttttttggtatttttagcag

SEQ ID NO: 77466 - DNA, 20 bp, Artificial
  CRISPR gRNA sequence
tttttggtatttttagcaga

SEQ ID NO: 77467 - DNA, 20 bp, Artificial
  CRISPR gRNA sequence
ttttggtatttttagcagag

SEQ ID NO: 77468 - DNA, 20 bp, Artificial
  CRISPR gRNA sequence
tttggtatttttagcagaga

SEQ ID NO: 77469 - DNA, 20 bp, Artificial
  CRISPR gRNA sequence
ttggtatttttagcagagac

SEQ ID NO: 77470 - DNA, 20 bp, Artificial
  CRISPR gRNA sequence
tggtatttttagcagagaca

SEQ ID NO: 77471 - DNA, 20 bp, Artificial
  CRISPR gRNA sequence
ggtatttttagcagagacag

SEQ ID NO: 77472 - DNA, 20 bp, Artificial
  CRISPR gRNA sequence
gtatttttagcagagacagg

SEQ ID NO: 77473 - DNA, 20 bp, Artificial
  CRISPR gRNA sequence
ttagcagagacagggtttca

SEQ ID NO: 77474 - DNA, 20 bp, Artificial
  CRISPR gRNA sequence
tagcagagacagggtttcac

SEQ ID NO: 77475 - DNA, 20 bp, Artificial
  CRISPR gRNA sequence
agcagagacagggtttcacc

SEQ ID NO: 77476 - DNA, 20 bp, Artificial
  CRISPR gRNA sequence
gcagagacagggtttcaccc

SEQ ID NO: 77477 - DNA, 20 bp, Artificial
  CRISPR gRNA sequence
caccctgttggccaggctgt

SEQ ID NO: 77478 - DNA, 20 bp, Artificial
  CRISPR gRNA sequence
accctgttggccaggctgtt

SEQ ID NO: 77479 - DNA, 20 bp, Artificial
  CRISPR gRNA sequence
ttggccaggctgttctcaaa

SEQ ID NO: 77480 - DNA, 20 bp, Artificial
  CRISPR gRNA sequence
gccaggctgttctcaaactc

SEQ ID NO: 77481 - DNA, 20 bp, Artificial
  CRISPR gRNA sequence
ttctcaaactcctgacctca

SEQ ID NO: 77482 - DNA, 20 bp, Artificial
  CRISPR gRNA sequence
tcaaactcctgacctcacgt

SEQ ID NO: 77483 - DNA, 20 bp, Artificial
  CRISPR gRNA sequence
aaactcctgacctcacgtga

SEQ ID NO: 77484 - DNA, 20 bp, Artificial
  CRISPR gRNA sequence
ctgacctcacgtgatccgcc

SEQ ID NO: 77485 - DNA, 20 bp, Artificial
  CRISPR gRNA sequence
acctcacgtgatccgcccac

SEQ ID NO: 77486 - DNA, 20 bp, Artificial
  CRISPR gRNA sequence
acgtgatccgcccaccttgg

SEQ ID NO: 77487 - DNA, 20 bp, Artificial
  CRISPR gRNA sequence
ggcctcccaaaatgctggga

SEQ ID NO: 77488 - DNA, 20 bp, Artificial
  CRISPR gRNA sequence
gcctcccaaaatgctgggat

SEQ ID NO: 77489 - DNA, 20 bp, Artificial
  CRISPR gRNA sequence
ccaaaatgctgggattacag

SEQ ID NO: 77490 - DNA, 20 bp, Artificial
  CRISPR gRNA sequence
ggattacaggcgtgagccac

SEQ ID NO: 77491 - DNA, 20 bp, Artificial
  CRISPR gRNA sequence
caggcgtgagccaccgcgcc

SEQ ID NO: 77492 - DNA, 20 bp, Artificial
  CRISPR gRNA sequence
gcccccagttttcttaaaag

SEQ ID NO: 77493 - DNA, 20 bp, Artificial
  CRISPR gRNA sequence
tcttaaaagtctctgcagca

SEQ ID NO: 77494 - DNA, 20 bp, Artificial
  CRISPR gRNA sequence
cttaaaagtctctgcagcat

SEQ ID NO: 77495 - DNA, 20 bp, Artificial
  CRISPR gRNA sequence
ttaaaagtctctgcagcata

SEQ ID NO: 77496 - DNA, 20 bp, Artificial
  CRISPR gRNA sequence
aaaagtctctgcagcatacc

SEQ ID NO: 77497 - DNA, 20 bp, Artificial
  CRISPR gRNA sequence
aaagtctctgcagcatacca

SEQ ID NO: 77498 - DNA, 20 bp, Artificial
  CRISPR gRNA sequence
tgcagcataccaacatggca

SEQ ID NO: 77499 - DNA, 20 bp, Artificial
  CRISPR gRNA sequence
cagcataccaacatggcaca

SEQ ID NO: 77500 - DNA, 20 bp, Artificial
  CRISPR gRNA sequence
tatgttgtgcacatgtaccc

SEQ ID NO: 77501 - DNA, 20 bp, Artificial
  CRISPR gRNA sequence
tgcacatgtaccctagaact

SEQ ID NO: 77502 - DNA, 20 bp, Artificial
  CRISPR gRNA sequence
gaacttaaagtataataatt

SEQ ID NO: 77503 - DNA, 20 bp, Artificial
  CRISPR gRNA sequence
aaagtataataattaaaaaa

SEQ ID NO: 77504 - DNA, 20 bp, Artificial
  CRISPR gRNA sequence
aagtataataattaaaaaaa

SEQ ID NO: 77505 - DNA, 20 bp, Artificial
  CRISPR gRNA sequence
aaaaaaaaatcctaaaaaaa

SEQ ID NO: 77506 - DNA, 20 bp, Artificial
  CRISPR gRNA sequence
aaaaaaaaaatctctaagga

SEQ ID NO: 77507 - DNA, 20 bp, Artificial
  CRISPR gRNA sequence
taaggactatccaaagaacg

SEQ ID NO: 77508 - DNA, 20 bp, Artificial
  CRISPR gRNA sequence
aggactatccaaagaacgag

SEQ ID NO: 77509 - DNA, 20 bp, Artificial
  CRISPR gRNA sequence
tccaaagaacgagtgaggca

SEQ ID NO: 77510 - DNA, 20 bp, Artificial
  CRISPR gRNA sequence
tctaatggtgaatttggaga

SEQ ID NO: 77511 - DNA, 20 bp, Artificial
  CRISPR gRNA sequence
taatggtgaatttggagaaa

SEQ ID NO: 77512 - DNA, 20 bp, Artificial
  CRISPR gRNA sequence
atggtgaatttggagaaatt

SEQ ID NO: 77513 - DNA, 20 bp, Artificial
  CRISPR gRNA sequence
ggagaaatttgagcatccgt

SEQ ID NO: 77514 - DNA, 20 bp, Artificial
  CRISPR gRNA sequence
gagaaatttgagcatccgtg

SEQ ID NO: 77515 - DNA, 20 bp, Artificial
  CRISPR gRNA sequence
gagcatccgtgaggccatac

SEQ ID NO: 77516 - DNA, 20 bp, Artificial
  CRISPR gRNA sequence
agcatccgtgaggccatact

SEQ ID NO: 77517 - DNA, 20 bp, Artificial
  CRISPR gRNA sequence
attcattcatttgatcattc

SEQ ID NO: 77518 - DNA, 20 bp, Artificial
  CRISPR gRNA sequence
ttcattcatttgatcattca

SEQ ID NO: 77519 - DNA, 20 bp, Artificial
  CRISPR gRNA sequence
attcatttgatcattcattc

SEQ ID NO: 77520 - DNA, 20 bp, Artificial
  CRISPR gRNA sequence
atttgatcattcattcattc

SEQ ID NO: 77521 - DNA, 20 bp, Artificial
  CRISPR gRNA sequence
gatcattcattcattcagtg

SEQ ID NO: 77522 - DNA, 20 bp, Artificial
  CRISPR gRNA sequence
atcattcattcattcagtgg

SEQ ID NO: 77523 - DNA, 20 bp, Artificial
  CRISPR gRNA sequence
attcattcagtggacgccca

SEQ ID NO: 77524 - DNA, 20 bp, Artificial
  CRISPR gRNA sequence
attcagtggacgcccatcac

SEQ ID NO: 77525 - DNA, 20 bp, Artificial
  CRISPR gRNA sequence
agtggacgcccatcacatgc

SEQ ID NO: 77526 - DNA, 20 bp, Artificial
  CRISPR gRNA sequence
tgcagatctggtactgccca

SEQ ID NO: 77527 - DNA, 20 bp, Artificial
  CRISPR gRNA sequence
cagatctggtactgcccaag

SEQ ID NO: 77528 - DNA, 20 bp, Artificial
  CRISPR gRNA sequence
gtactgcccaaggtgctgag

SEQ ID NO: 77529 - DNA, 20 bp, Artificial
  CRISPR gRNA sequence
cccaaggtgctgaggatgac

SEQ ID NO: 77530 - DNA, 20 bp, Artificial
  CRISPR gRNA sequence
aggatgacaggttggcatga

SEQ ID NO: 77531 - DNA, 20 bp, Artificial
  CRISPR gRNA sequence
gcatgaaactggtggacaag

SEQ ID NO: 77532 - DNA, 20 bp, Artificial
  CRISPR gRNA sequence
gtggacaaggggcccacgtg

SEQ ID NO: 77533 - DNA, 20 bp, Artificial
  CRISPR gRNA sequence
tgggatgggggacaggggca

SEQ ID NO: 77534 - DNA, 20 bp, Artificial
  CRISPR gRNA sequence
ggggcggagaggcacgctca

SEQ ID NO: 77535 - DNA, 20 bp, Artificial
  CRISPR gRNA sequence
acctgatgtccaagcggaag

SEQ ID NO: 77536 - DNA, 20 bp, Artificial
  CRISPR gRNA sequence
atgtccaagcggaagagcca

SEQ ID NO: 77537 - DNA, 20 bp, Artificial
  CRISPR gRNA sequence
cagagtggagaagcaccgaa

SEQ ID NO: 77538 - DNA, 20 bp, Artificial
  CRISPR gRNA sequence
tcactgaggctggagatcac

SEQ ID NO: 77539 - DNA, 20 bp, Artificial
  CRISPR gRNA sequence
actgaggctggagatcacag

SEQ ID NO: 77540 - DNA, 20 bp, Artificial
  CRISPR gRNA sequence
aggctggagatcacaggggt

SEQ ID NO: 77541 - DNA, 20 bp, Artificial
  CRISPR gRNA sequence
gagatcacaggggtggcaca

SEQ ID NO: 77542 - DNA, 20 bp, Artificial
  CRISPR gRNA sequence
aggacccaaacacatcctct

SEQ ID NO: 77543 - DNA, 20 bp, Artificial
  CRISPR gRNA sequence
tttgtggtcagggcacaggg

SEQ ID NO: 77544 - DNA, 20 bp, Artificial
  CRISPR gRNA sequence
tgtggtcagggcacagggcg

SEQ ID NO: 77545 - DNA, 20 bp, Artificial
  CRISPR gRNA sequence
gtggtcagggcacagggcgg

SEQ ID NO: 77546 - DNA, 20 bp, Artificial
  CRISPR gRNA sequence
tggtcagggcacagggcggg

SEQ ID NO: 77547 - DNA, 20 bp, Artificial
  CRISPR gRNA sequence
gttccagatgacggaaccca

SEQ ID NO: 77548 - DNA, 20 bp, Artificial
  CRISPR gRNA sequence
cagatgacggaacccactga

SEQ ID NO: 77549 - DNA, 20 bp, Artificial
  CRISPR gRNA sequence
aacccaagatggtcagagag

SEQ ID NO: 77550 - DNA, 20 bp, Artificial
  CRISPR gRNA sequence
gcaagtcctcatggtggaga

SEQ ID NO: 77551 - DNA, 20 bp, Artificial
  CRISPR gRNA sequence
caagtcctcatggtggagat

SEQ ID NO: 77552 - DNA, 20 bp, Artificial
  CRISPR gRNA sequence
atggtggagatggggaaaca

SEQ ID NO: 77553 - DNA, 20 bp, Artificial
  CRISPR gRNA sequence
gagagaatcaaggtctagcc

SEQ ID NO: 77554 - DNA, 20 bp, Artificial
  CRISPR gRNA sequence
gcccaaggttatgagacatg

SEQ ID NO: 77555 - DNA, 20 bp, Artificial
  CRISPR gRNA sequence
tgagacatgttggtgacaga

SEQ ID NO: 77556 - DNA, 20 bp, Artificial
  CRISPR gRNA sequence
gtgacagagctgagatgggc

SEQ ID NO: 77557 - DNA, 20 bp, Artificial
  CRISPR gRNA sequence
agatgggcacccagtgggtc

SEQ ID NO: 77558 - DNA, 20 bp, Artificial
  CRISPR gRNA sequence
ggtctgtgatggatctgagg

SEQ ID NO: 77559 - DNA, 20 bp, Artificial
  CRISPR gRNA sequence
tgatggatctgaggagtgct

SEQ ID NO: 77560 - DNA, 20 bp, Artificial
  CRISPR gRNA sequence
aggagtgctttctggctgga

SEQ ID NO: 77561 - DNA, 20 bp, Artificial
  CRISPR gRNA sequence
tctggctggagctgggcctc

SEQ ID NO: 77562 - DNA, 20 bp, Artificial
  CRISPR gRNA sequence
ctggctggagctgggcctcc

SEQ ID NO: 77563 - DNA, 20 bp, Artificial
  CRISPR gRNA sequence
tggctggagctgggcctcct

SEQ ID NO: 77564 - DNA, 20 bp, Artificial
  CRISPR gRNA sequence
gctggagctgggcctccttt

SEQ ID NO: 77565 - DNA, 20 bp, Artificial
  CRISPR gRNA sequence
gagctgggcctccttttctc

SEQ ID NO: 77566 - DNA, 20 bp, Artificial
  CRISPR gRNA sequence
ggcctccttttctccacctg

SEQ ID NO: 77567 - DNA, 20 bp, Artificial
  CRISPR gRNA sequence
cttttctccacctgataagg

SEQ ID NO: 77568 - DNA, 20 bp, Artificial
  CRISPR gRNA sequence
ttctccacctgataagggag

SEQ ID NO: 77569 - DNA, 20 bp, Artificial
  CRISPR gRNA sequence
tctccacctgataagggagg

SEQ ID NO: 77570 - DNA, 20 bp, Artificial
  CRISPR gRNA sequence
ctccacctgataagggaggg

SEQ ID NO: 77571 - DNA, 20 bp, Artificial
  CRISPR gRNA sequence
tccacctgataagggagggg

SEQ ID NO: 77572 - DNA, 20 bp, Artificial
  CRISPR gRNA sequence
cacctgataagggaggggtg

SEQ ID NO: 77573 - DNA, 20 bp, Artificial
  CRISPR gRNA sequence
ataagggaggggtggtaccc

SEQ ID NO: 77574 - DNA, 20 bp, Artificial
  CRISPR gRNA sequence
ttgtgcagaaagcaggaaca

SEQ ID NO: 77575 - DNA, 20 bp, Artificial
  CRISPR gRNA sequence
gtgcagaaagcaggaacaaa

SEQ ID NO: 77576 - DNA, 20 bp, Artificial
  CRISPR gRNA sequence
tgcagaaagcaggaacaaag

SEQ ID NO: 77577 - DNA, 20 bp, Artificial
  CRISPR gRNA sequence
ctttctttcagggtctcctg

SEQ ID NO: 77578 - DNA, 20 bp, Artificial
  CRISPR gRNA sequence
tctttcagggtctcctgtca

SEQ ID NO: 77579 - DNA, 20 bp, Artificial
  CRISPR gRNA sequence
ctttcagggtctcctgtcaa

SEQ ID NO: 77580 - DNA, 20 bp, Artificial
  CRISPR gRNA sequence
tttcagggtctcctgtcaac

SEQ ID NO: 77581 - DNA, 20 bp, Artificial
  CRISPR gRNA sequence
tcagggtctcctgtcaactt

SEQ ID NO: 77582 - DNA, 20 bp, Artificial
  CRISPR gRNA sequence
cagggtctcctgtcaacttg

SEQ ID NO: 77583 - DNA, 20 bp, Artificial
  CRISPR gRNA sequence
agggtctcctgtcaacttgt

SEQ ID NO: 77584 - DNA, 20 bp, Artificial
  CRISPR gRNA sequence
ctgtcaacttgttattgttt

SEQ ID NO: 77585 - DNA, 20 bp, Artificial
  CRISPR gRNA sequence
tcaacttgttattgttttct

SEQ ID NO: 77586 - DNA, 20 bp, Artificial
  CRISPR gRNA sequence
gttattgttttctatttact

SEQ ID NO: 77587 - DNA, 20 bp, Artificial
  CRISPR gRNA sequence
ttattgttttctatttacta

SEQ ID NO: 77588 - DNA, 20 bp, Artificial
  CRISPR gRNA sequence
ttgttttctatttactattt

SEQ ID NO: 77589 - DNA, 20 bp, Artificial
  CRISPR gRNA sequence
ttttctatttactatttaat

SEQ ID NO: 77590 - DNA, 20 bp, Artificial
  CRISPR gRNA sequence
tctatttactatttaatgct

SEQ ID NO: 77591 - DNA, 20 bp, Artificial
  CRISPR gRNA sequence
ctatttactatttaatgcta

SEQ ID NO: 77592 - DNA, 20 bp, Artificial
  CRISPR gRNA sequence
tatttactatttaatgctac

SEQ ID NO: 77593 - DNA, 20 bp, Artificial
  CRISPR gRNA sequence
tttactatttaatgctacac

SEQ ID NO: 77594 - DNA, 20 bp, Artificial
  CRISPR gRNA sequence
actatttaatgctacactcc

SEQ ID NO: 77595 - DNA, 20 bp, Artificial
  CRISPR gRNA sequence
ctatttaatgctacactccc

SEQ ID NO: 77596 - DNA, 20 bp, Artificial
  CRISPR gRNA sequence
tttaatgctacactcccctc

SEQ ID NO: 77597 - DNA, 20 bp, Artificial
  CRISPR gRNA sequence
aatgctacactcccctccca

SEQ ID NO: 77598 - DNA, 20 bp, Artificial
  CRISPR gRNA sequence
atgctacactcccctcccac

SEQ ID NO: 77599 - DNA, 20 bp, Artificial
  CRISPR gRNA sequence
cactcccctcccacggggac

SEQ ID NO: 77600 - DNA, 20 bp, Artificial
  CRISPR gRNA sequence
ccctcccacggggacactgg

SEQ ID NO: 77601 - DNA, 20 bp, Artificial
  CRISPR gRNA sequence
ccacggggacactggtaggg

SEQ ID NO: 77602 - DNA, 20 bp, Artificial
  CRISPR gRNA sequence
gtagggcgagtgtggaccct

SEQ ID NO: 77603 - DNA, 20 bp, Artificial
  CRISPR gRNA sequence
acagcaccaggtcacgagtc

SEQ ID NO: 77604 - DNA, 20 bp, Artificial
  CRISPR gRNA sequence
ataagaaggtcacatgagga

SEQ ID NO: 77605 - DNA, 20 bp, Artificial
  CRISPR gRNA sequence
aaacctccagtcttcatgta

SEQ ID NO: 77606 - DNA, 20 bp, Artificial
  CRISPR gRNA sequence
cagtcttcatgtaatttgcc

SEQ ID NO: 77607 - DNA, 20 bp, Artificial
  CRISPR gRNA sequence
catgtaatttgcctgcaatg

SEQ ID NO: 77608 - DNA, 20 bp, Artificial
  CRISPR gRNA sequence
atgtaatttgcctgcaatgg

SEQ ID NO: 77609 - DNA, 20 bp, Artificial
  CRISPR gRNA sequence
gcctgcaatggttagacctt

SEQ ID NO: 77610 - DNA, 20 bp, Artificial
  CRISPR gRNA sequence
cctgcaatggttagaccttc

SEQ ID NO: 77611 - DNA, 20 bp, Artificial
  CRISPR gRNA sequence
caatggttagaccttccttc

SEQ ID NO: 77612 - DNA, 20 bp, Artificial
  CRISPR gRNA sequence
gaccttccttccttcccagg

SEQ ID NO: 77613 - DNA, 20 bp, Artificial
  CRISPR gRNA sequence
ccttccttcccaggtgcagg

SEQ ID NO: 77614 - DNA, 20 bp, Artificial
  CRISPR gRNA sequence
cttccttcccaggtgcaggc

SEQ ID NO: 77615 - DNA, 20 bp, Artificial
  CRISPR gRNA sequence
ccttcccaggtgcaggccct

SEQ ID NO: 77616 - DNA, 20 bp, Artificial
  CRISPR gRNA sequence
cttcccaggtgcaggccctg

SEQ ID NO: 77617 - DNA, 20 bp, Artificial
  CRISPR gRNA sequence
cccaggtgcaggccctgaac

SEQ ID NO: 77618 - DNA, 20 bp, Artificial
  CRISPR gRNA sequence
ccaggtgcaggccctgaaca

SEQ ID NO: 77619 - DNA, 20 bp, Artificial
  CRISPR gRNA sequence
aacaggaaccaaggcaactc

SEQ ID NO: 77620 - DNA, 20 bp, Artificial
  CRISPR gRNA sequence
ccttccttcccagcattgca

SEQ ID NO: 77621 - DNA, 20 bp, Artificial
  CRISPR gRNA sequence
ccttcccagcattgcacaaa

SEQ ID NO: 77622 - DNA, 20 bp, Artificial
  CRISPR gRNA sequence
cttcccagcattgcacaaaa

SEQ ID NO: 77623 - DNA, 20 bp, Artificial
  CRISPR gRNA sequence
cccagcattgcacaaaaaca

SEQ ID NO: 77624 - DNA, 20 bp, Artificial
  CRISPR gRNA sequence
ccagcattgcacaaaaacag

SEQ ID NO: 77625 - DNA, 20 bp, Artificial
  CRISPR gRNA sequence
cacaaaaacagggtgtgagc

SEQ ID NO: 77626 - DNA, 20 bp, Artificial
  CRISPR gRNA sequence
aggccccagcactcatttca

SEQ ID NO: 77627 - DNA, 20 bp, Artificial
  CRISPR gRNA sequence
ggccccagcactcatttcag

SEQ ID NO: 77628 - DNA, 20 bp, Artificial
  CRISPR gRNA sequence
atttcagagatcgtagccac

SEQ ID NO: 77629 - DNA, 20 bp, Artificial
  CRISPR gRNA sequence
cagagatcgtagccaccaac

SEQ ID NO: 77630 - DNA, 20 bp, Artificial
  CRISPR gRNA sequence
agagatcgtagccaccaaca

SEQ ID NO: 77631 - DNA, 20 bp, Artificial
  CRISPR gRNA sequence
caatttatgtatttaccgac

SEQ ID NO: 77632 - DNA, 20 bp, Artificial
  CRISPR gRNA sequence
atgtatttaccgactgggaa

SEQ ID NO: 77633 - DNA, 20 bp, Artificial
  CRISPR gRNA sequence
tgtatttaccgactgggaac

SEQ ID NO: 77634 - DNA, 20 bp, Artificial
  CRISPR gRNA sequence
accgactgggaaccagggac

SEQ ID NO: 77635 - DNA, 20 bp, Artificial
  CRISPR gRNA sequence
ccgactgggaaccagggact

SEQ ID NO: 77636 - DNA, 20 bp, Artificial
  CRISPR gRNA sequence
ggaaccagggactcggagag

SEQ ID NO: 77637 - DNA, 20 bp, Artificial
  CRISPR gRNA sequence
ggagaggggatgtaacttgc

SEQ ID NO: 77638 - DNA, 20 bp, Artificial
  CRISPR gRNA sequence
gcccagaatcacacagcaaa

SEQ ID NO: 77639 - DNA, 20 bp, Artificial
  CRISPR gRNA sequence
cccagaatcacacagcaaag

SEQ ID NO: 77640 - DNA, 20 bp, Artificial
  CRISPR gRNA sequence
acagagacagcctggaatat

SEQ ID NO: 77641 - DNA, 20 bp, Artificial
  CRISPR gRNA sequence
gaatataggacctgtgacct

SEQ ID NO: 77642 - DNA, 20 bp, Artificial
  CRISPR gRNA sequence
tgacctctcccctgggctcc

SEQ ID NO: 77643 - DNA, 20 bp, Artificial
  CRISPR gRNA sequence
tcccctgggctcctctggct

SEQ ID NO: 77644 - DNA, 20 bp, Artificial
  CRISPR gRNA sequence
ccctgggctcctctggcttt

SEQ ID NO: 77645 - DNA, 20 bp, Artificial
  CRISPR gRNA sequence
ggctcctctggctttggccc

SEQ ID NO: 77646 - DNA, 20 bp, Artificial
  CRISPR gRNA sequence
ctctggctttggcccagaag

SEQ ID NO: 77647 - DNA, 20 bp, Artificial
  CRISPR gRNA sequence
tggctttggcccagaagtgc

SEQ ID NO: 77648 - DNA, 20 bp, Artificial
  CRISPR gRNA sequence
gctttggcccagaagtgcct

SEQ ID NO: 77649 - DNA, 20 bp, Artificial
  CRISPR gRNA sequence
tggcccagaagtgcctggga

SEQ ID NO: 77650 - DNA, 20 bp, Artificial
  CRISPR gRNA sequence
ggcccagaagtgcctgggag

SEQ ID NO: 77651 - DNA, 20 bp, Artificial
  CRISPR gRNA sequence
gcccagaagtgcctgggagg

SEQ ID NO: 77652 - DNA, 20 bp, Artificial
  CRISPR gRNA sequence
ggaggagggggtgctttgtg

SEQ ID NO: 77653 - DNA, 20 bp, Artificial
  CRISPR gRNA sequence
tgtgagccaaaagcaccaag

SEQ ID NO: 77654 - DNA, 20 bp, Artificial
  CRISPR gRNA sequence
gtgagccaaaagcaccaagg

SEQ ID NO: 77655 - DNA, 20 bp, Artificial
  CRISPR gRNA sequence
tgagccaaaagcaccaaggg

SEQ ID NO: 77656 - DNA, 20 bp, Artificial
  CRISPR gRNA sequence
agggatcaagaactctggtc

SEQ ID NO: 77657 - DNA, 20 bp, Artificial
  CRISPR gRNA sequence
gggatcaagaactctggtcc

SEQ ID NO: 77658 - DNA, 20 bp, Artificial
  CRISPR gRNA sequence
tggtccattgcaggcaaact

SEQ ID NO: 77659 - DNA, 20 bp, Artificial
  CRISPR gRNA sequence
gtccattgcaggcaaacttt

SEQ ID NO: 77660 - DNA, 20 bp, Artificial
  CRISPR gRNA sequence
caggcaaactttggggattc

SEQ ID NO: 77661 - DNA, 20 bp, Artificial
  CRISPR gRNA sequence
tggggattcctcctacacac

SEQ ID NO: 77662 - DNA, 20 bp, Artificial
  CRISPR gRNA sequence
ggggattcctcctacacact

SEQ ID NO: 77663 - DNA, 20 bp, Artificial
  CRISPR gRNA sequence
gggattcctcctacacactc

SEQ ID NO: 77664 - DNA, 20 bp, Artificial
  CRISPR gRNA sequence
ctcctacacactctctgcca

SEQ ID NO: 77665 - DNA, 20 bp, Artificial
  CRISPR gRNA sequence
ctacacactctctgccaggt

SEQ ID NO: 77666 - DNA, 20 bp, Artificial
  CRISPR gRNA sequence
cacactctctgccaggtact

SEQ ID NO: 77667 - DNA, 20 bp, Artificial
  CRISPR gRNA sequence
tctgccaggtactcagggat

SEQ ID NO: 77668 - DNA, 20 bp, Artificial
  CRISPR gRNA sequence
tgccaggtactcagggatcc

SEQ ID NO: 77669 - DNA, 20 bp, Artificial
  CRISPR gRNA sequence
ccaggtactcagggatcctt

SEQ ID NO: 77670 - DNA, 20 bp, Artificial
  CRISPR gRNA sequence
agggatccttggcagccctg

SEQ ID NO: 77671 - DNA, 20 bp, Artificial
  CRISPR gRNA sequence
ggcagccctgggcaccctgc

SEQ ID NO: 77672 - DNA, 20 bp, Artificial
  CRISPR gRNA sequence
gcagccctgggcaccctgct

SEQ ID NO: 77673 - DNA, 20 bp, Artificial
  CRISPR gRNA sequence
ggcaccctgcttgagtgtcc

SEQ ID NO: 77674 - DNA, 20 bp, Artificial
  CRISPR gRNA sequence
cttgagtgtcctctctggta

SEQ ID NO: 77675 - DNA, 20 bp, Artificial
  CRISPR gRNA sequence
gagtgtcctctctggtacaa

SEQ ID NO: 77676 - DNA, 20 bp, Artificial
  CRISPR gRNA sequence
agtgtcctctctggtacaaa

SEQ ID NO: 77677 - DNA, 20 bp, Artificial
  CRISPR gRNA sequence
tctggtacaaaccctccctg

SEQ ID NO: 77678 - DNA, 20 bp, Artificial
  CRISPR gRNA sequence
tggtacaaaccctccctgtc

SEQ ID NO: 77679 - DNA, 20 bp, Artificial
  CRISPR gRNA sequence
gtacaaaccctccctgtcta

SEQ ID NO: 77680 - DNA, 20 bp, Artificial
  CRISPR gRNA sequence
cctgtctaccctgaccatac

SEQ ID NO: 77681 - DNA, 20 bp, Artificial
  CRISPR gRNA sequence
tctaccctgaccatacccca

SEQ ID NO: 77682 - DNA, 20 bp, Artificial
  CRISPR gRNA sequence
ccctgaccataccccagcta

SEQ ID NO: 77683 - DNA, 20 bp, Artificial
  CRISPR gRNA sequence
accataccccagctaacagc

SEQ ID NO: 77684 - DNA, 20 bp, Artificial
  CRISPR gRNA sequence
acagccccagcccctcccgg

SEQ ID NO: 77685 - DNA, 20 bp, Artificial
  CRISPR gRNA sequence
ccggcaccccagggccagaa

SEQ ID NO: 77686 - DNA, 20 bp, Artificial
  CRISPR gRNA sequence
ccagccgttagtcatacttc

SEQ ID NO: 77687 - DNA, 20 bp, Artificial
  CRISPR gRNA sequence
gtcatacttcgcacccacac

SEQ ID NO: 77688 - DNA, 20 bp, Artificial
  CRISPR gRNA sequence
cgcacccacacctgccctcc

SEQ ID NO: 77689 - DNA, 20 bp, Artificial
  CRISPR gRNA sequence
gcacccacacctgccctccc

SEQ ID NO: 77690 - DNA, 20 bp, Artificial
  CRISPR gRNA sequence
ccctccccagggtggcctca

SEQ ID NO: 77691 - DNA, 20 bp, Artificial
  CRISPR gRNA sequence
cccagggtggcctcagaagc

SEQ ID NO: 77692 - DNA, 20 bp, Artificial
  CRISPR gRNA sequence
agaagcctgttcagagatgc

SEQ ID NO: 77693 - DNA, 20 bp, Artificial
  CRISPR gRNA sequence
ttcagagatgcggagacagg

SEQ ID NO: 77694 - DNA, 20 bp, Artificial
  CRISPR gRNA sequence
agagatgcggagacaggttc

SEQ ID NO: 77695 - DNA, 20 bp, Artificial
  CRISPR gRNA sequence
cagaagtgaaaccttgaatc

SEQ ID NO: 77696 - DNA, 20 bp, Artificial
  CRISPR gRNA sequence
gaatcagaagtgggattatt

SEQ ID NO: 77697 - DNA, 20 bp, Artificial
  CRISPR gRNA sequence
aatcagaagtgggattattg

SEQ ID NO: 77698 - DNA, 20 bp, Artificial
  CRISPR gRNA sequence
ttgagtcacagactctctga

SEQ ID NO: 77699 - DNA, 20 bp, Artificial
  CRISPR gRNA sequence
agtcacagactctctgagta

SEQ ID NO: 77700 - DNA, 20 bp, Artificial
  CRISPR gRNA sequence
tctgagtaagaatcatctat

SEQ ID NO: 77701 - DNA, 20 bp, Artificial
  CRISPR gRNA sequence
tgagtaagaatcatctatta

SEQ ID NO: 77702 - DNA, 20 bp, Artificial
  CRISPR gRNA sequence
agtaagaatcatctattagc

SEQ ID NO: 77703 - DNA, 20 bp, Artificial
  CRISPR gRNA sequence
ttagctagccttcaccgaga

SEQ ID NO: 77704 - DNA, 20 bp, Artificial
  CRISPR gRNA sequence
gctagccttcaccgagaact

SEQ ID NO: 77705 - DNA, 20 bp, Artificial
  CRISPR gRNA sequence
gccttcaccgagaacttaca

SEQ ID NO: 77706 - DNA, 20 bp, Artificial
  CRISPR gRNA sequence
caccgagaacttacattgta

SEQ ID NO: 77707 - DNA, 20 bp, Artificial
  CRISPR gRNA sequence
accgagaacttacattgtat

SEQ ID NO: 77708 - DNA, 20 bp, Artificial
  CRISPR gRNA sequence
acattgtattaggggcaatt

SEQ ID NO: 77709 - DNA, 20 bp, Artificial
  CRISPR gRNA sequence
cattgtattaggggcaattt

SEQ ID NO: 77710 - DNA, 20 bp, Artificial
  CRISPR gRNA sequence
tattaggggcaattttcatg

SEQ ID NO: 77711 - DNA, 20 bp, Artificial
  CRISPR gRNA sequence
ggggcaattttcatgcattt

SEQ ID NO: 77712 - DNA, 20 bp, Artificial
  CRISPR gRNA sequence
tcatgcattttccgatttaa

SEQ ID NO: 77713 - DNA, 20 bp, Artificial
  CRISPR gRNA sequence
catgcattttccgatttaat

SEQ ID NO: 77714 - DNA, 20 bp, Artificial
  CRISPR gRNA sequence
atgcattttccgatttaatc

SEQ ID NO: 77715 - DNA, 20 bp, Artificial
  CRISPR gRNA sequence
tccgatttaatctttacaat

SEQ ID NO: 77716 - DNA, 20 bp, Artificial
  CRISPR gRNA sequence
ccgatttaatctttacaata

SEQ ID NO: 77717 - DNA, 20 bp, Artificial
  CRISPR gRNA sequence
cgatttaatctttacaataa

SEQ ID NO: 77718 - DNA, 20 bp, Artificial
  CRISPR gRNA sequence
aatctttacaataaccccag

SEQ ID NO: 77719 - DNA, 20 bp, Artificial
  CRISPR gRNA sequence
atctttacaataaccccagg

SEQ ID NO: 77720 - DNA, 20 bp, Artificial
  CRISPR gRNA sequence
tacaataaccccaggaaaga

SEQ ID NO: 77721 - DNA, 20 bp, Artificial
  CRISPR gRNA sequence
acaataaccccaggaaagag

SEQ ID NO: 77722 - DNA, 20 bp, Artificial
  CRISPR gRNA sequence
caataaccccaggaaagagg

SEQ ID NO: 77723 - DNA, 20 bp, Artificial
  CRISPR gRNA sequence
cccccctgccccagcctcag

SEQ ID NO: 77724 - DNA, 20 bp, Artificial
  CRISPR gRNA sequence
ccccagcctcagaggctctg

SEQ ID NO: 77725 - DNA, 20 bp, Artificial
  CRISPR gRNA sequence
agaggctctgcctagcgggc

SEQ ID NO: 77726 - DNA, 20 bp, Artificial
  CRISPR gRNA sequence
tgcctagcgggctactcact

SEQ ID NO: 77727 - DNA, 20 bp, Artificial
  CRISPR gRNA sequence
cctagcgggctactcacttc

SEQ ID NO: 77728 - DNA, 20 bp, Artificial
  CRISPR gRNA sequence
gcgggctactcacttcaagg

SEQ ID NO: 77729 - DNA, 20 bp, Artificial
  CRISPR gRNA sequence
ctcacttcaaggactgcaga

SEQ ID NO: 77730 - DNA, 20 bp, Artificial
  CRISPR gRNA sequence
acttcaaggactgcagagct

SEQ ID NO: 77731 - DNA, 20 bp, Artificial
  CRISPR gRNA sequence
caaggactgcagagctccca

SEQ ID NO: 77732 - DNA, 20 bp, Artificial
  CRISPR gRNA sequence
aaggactgcagagctcccag

SEQ ID NO: 77733 - DNA, 20 bp, Artificial
  CRISPR gRNA sequence
cagagctcccagccctggga

SEQ ID NO: 77734 - DNA, 20 bp, Artificial
  CRISPR gRNA sequence
ccagccctgggagcagctga

SEQ ID NO: 77735 - DNA, 20 bp, Artificial
  CRISPR gRNA sequence
ggagcagctgagccagccgg

SEQ ID NO: 77736 - DNA, 20 bp, Artificial
  CRISPR gRNA sequence
agccagccgggctgcacctt

SEQ ID NO: 77737 - DNA, 20 bp, Artificial
  CRISPR gRNA sequence
caccttcatcccccagagca

SEQ ID NO: 77738 - DNA, 20 bp, Artificial
  CRISPR gRNA sequence
catcccccagagcattgcct

SEQ ID NO: 77739 - DNA, 20 bp, Artificial
  CRISPR gRNA sequence
atcccccagagcattgcctg

SEQ ID NO: 77740 - DNA, 20 bp, Artificial
  CRISPR gRNA sequence
cctgagaagctgggggtggg

SEQ ID NO: 77741 - DNA, 20 bp, Artificial
  CRISPR gRNA sequence
agaagctgggggtggggaga

SEQ ID NO: 77742 - DNA, 20 bp, Artificial
  CRISPR gRNA sequence
ggggtggggagaagggaggg

SEQ ID NO: 77743 - DNA, 20 bp, Artificial
  CRISPR gRNA sequence
gcaggtggggagtgggttgc

SEQ ID NO: 77744 - DNA, 20 bp, Artificial
  CRISPR gRNA sequence
ctggcagcatggtccctgca

SEQ ID NO: 77745 - DNA, 20 bp, Artificial
  CRISPR gRNA sequence
gcagcatggtccctgcattc

SEQ ID NO: 77746 - DNA, 20 bp, Artificial
  CRISPR gRNA sequence
cattccagttactcaacttc

SEQ ID NO: 77747 - DNA, 20 bp, Artificial
  CRISPR gRNA sequence
cagttactcaacttcctgaa

SEQ ID NO: 77748 - DNA, 20 bp, Artificial
  CRISPR gRNA sequence
ctcaacttcctgaaactgga

SEQ ID NO: 77749 - DNA, 20 bp, Artificial
  CRISPR gRNA sequence
aacttcctgaaactggacac

SEQ ID NO: 77750 - DNA, 20 bp, Artificial
  CRISPR gRNA sequence
cctgaaactggacacagccc

SEQ ID NO: 77751 - DNA, 20 bp, Artificial
  CRISPR gRNA sequence
ctgaaactggacacagccct

SEQ ID NO: 77752 - DNA, 20 bp, Artificial
  CRISPR gRNA sequence
aaactggacacagccctggg

SEQ ID NO: 77753 - DNA, 20 bp, Artificial
  CRISPR gRNA sequence
gacacagccctgggctgcca

SEQ ID NO: 77754 - DNA, 20 bp, Artificial
  CRISPR gRNA sequence
ggctgccaggccagatctca

SEQ ID NO: 77755 - DNA, 20 bp, Artificial
  CRISPR gRNA sequence
ccaggccagatctcagcaga

SEQ ID NO: 77756 - DNA, 20 bp, Artificial
  CRISPR gRNA sequence
agcagatctggcacgggcag

SEQ ID NO: 77757 - DNA, 20 bp, Artificial
  CRISPR gRNA sequence
gcacgggcagctggggtctc

SEQ ID NO: 77758 - DNA, 20 bp, Artificial
  CRISPR gRNA sequence
gggtctcccccaggttctta

SEQ ID NO: 77759 - DNA, 20 bp, Artificial
  CRISPR gRNA sequence
ccccaggttcttattctgag

SEQ ID NO: 77760 - DNA, 20 bp, Artificial
  CRISPR gRNA sequence
ttattctgaggttcgtggac

SEQ ID NO: 77761 - DNA, 20 bp, Artificial
  CRISPR gRNA sequence
attctgaggttcgtggacct

SEQ ID NO: 77762 - DNA, 20 bp, Artificial
  CRISPR gRNA sequence
ttctgaggttcgtggacctc

SEQ ID NO: 77763 - DNA, 20 bp, Artificial
  CRISPR gRNA sequence
tgaggttcgtggacctctga

SEQ ID NO: 77764 - DNA, 20 bp, Artificial
  CRISPR gRNA sequence
aggttcgtggacctctgagg

SEQ ID NO: 77765 - DNA, 20 bp, Artificial
  CRISPR gRNA sequence
gtggacctctgagggaccag

SEQ ID NO: 77766 - DNA, 20 bp, Artificial
  CRISPR gRNA sequence
tgagggaccaggggtgagcc

SEQ ID NO: 77767 - DNA, 20 bp, Artificial
  CRISPR gRNA sequence
agggaccaggggtgagcctc

SEQ ID NO: 77768 - DNA, 20 bp, Artificial
  CRISPR gRNA sequence
cgagcgtgtcagacatgggg

SEQ ID NO: 77769 - DNA, 20 bp, Artificial
  CRISPR gRNA sequence
tatcttgggaggaagagtca

SEQ ID NO: 77770 - DNA, 20 bp, Artificial
  CRISPR gRNA sequence
gggaggaagagtcacaactt

SEQ ID NO: 77771 - DNA, 20 bp, Artificial
  CRISPR gRNA sequence
ggaggaagagtcacaacttt

SEQ ID NO: 77772 - DNA, 20 bp, Artificial
  CRISPR gRNA sequence
tcaccagattctccaagggg

SEQ ID NO: 77773 - DNA, 20 bp, Artificial
  CRISPR gRNA sequence
caccagattctccaaggggt

SEQ ID NO: 77774 - DNA, 20 bp, Artificial
  CRISPR gRNA sequence
accagattctccaaggggtt

SEQ ID NO: 77775 - DNA, 20 bp, Artificial
  CRISPR gRNA sequence
tccaaggggtttctgacttc

SEQ ID NO: 77776 - DNA, 20 bp, Artificial
  CRISPR gRNA sequence
caaggggtttctgacttcag

SEQ ID NO: 77777 - DNA, 20 bp, Artificial
  CRISPR gRNA sequence
ctgacttcagcagggaaaga

SEQ ID NO: 77778 - DNA, 20 bp, Artificial
  CRISPR gRNA sequence
tgacttcagcagggaaagaa

SEQ ID NO: 77779 - DNA, 20 bp, Artificial
  CRISPR gRNA sequence
acttcagcagggaaagaaca

SEQ ID NO: 77780 - DNA, 20 bp, Artificial
  CRISPR gRNA sequence
cagcagggaaagaacagttg

SEQ ID NO: 77781 - DNA, 20 bp, Artificial
  CRISPR gRNA sequence
agcagggaaagaacagttga

SEQ ID NO: 77782 - DNA, 20 bp, Artificial
  CRISPR gRNA sequence
atctaaatcttaaaaaccaa

SEQ ID NO: 77783 - DNA, 20 bp, Artificial
  CRISPR gRNA sequence
aatcttaaaaaccaaaccca

SEQ ID NO: 77784 - DNA, 20 bp, Artificial
  CRISPR gRNA sequence
aaaaaccaaacccaaacacc

SEQ ID NO: 77785 - DNA, 20 bp, Artificial
  CRISPR gRNA sequence
aaaaccaaacccaaacacca

SEQ ID NO: 77786 - DNA, 20 bp, Artificial
  CRISPR gRNA sequence
actcactgtaattggcccca

SEQ ID NO: 77787 - DNA, 20 bp, Artificial
  CRISPR gRNA sequence
actgtaattggccccaccca

SEQ ID NO: 77788 - DNA, 20 bp, Artificial
  CRISPR gRNA sequence
taattggccccacccaccca

SEQ ID NO: 77789 - DNA, 20 bp, Artificial
  CRISPR gRNA sequence
gccccacccacccaccttcc

SEQ ID NO: 77790 - DNA, 20 bp, Artificial
  CRISPR gRNA sequence
ccaacacacaaaccactcac

SEQ ID NO: 77791 - DNA, 20 bp, Artificial
  CRISPR gRNA sequence
caacacacaaaccactcact

SEQ ID NO: 77792 - DNA, 20 bp, Artificial
  CRISPR gRNA sequence
actcgaggtggaggtgaccg

SEQ ID NO: 77793 - DNA, 20 bp, Artificial
  CRISPR gRNA sequence
gaggtggaggtgaccgaggt

SEQ ID NO: 77794 - DNA, 20 bp, Artificial
  CRISPR gRNA sequence
cctcccagagccttgcagag

SEQ ID NO: 77795 - DNA, 20 bp, Artificial
  CRISPR gRNA sequence
ctcccagagccttgcagagc

SEQ ID NO: 77796 - DNA, 20 bp, Artificial
  CRISPR gRNA sequence
ccagagccttgcagagctgc

SEQ ID NO: 77797 - DNA, 20 bp, Artificial
  CRISPR gRNA sequence
gcagagctgctctaggtgct

SEQ ID NO: 77798 - DNA, 20 bp, Artificial
  CRISPR gRNA sequence
cagagctgctctaggtgctt

SEQ ID NO: 77799 - DNA, 20 bp, Artificial
  CRISPR gRNA sequence
ctctaggtgcttttcttgga

SEQ ID NO: 77800 - DNA, 20 bp, Artificial
  CRISPR gRNA sequence
taggtgcttttcttggaggc

SEQ ID NO: 77801 - DNA, 20 bp, Artificial
  CRISPR gRNA sequence
ggtgcttttcttggaggcca

SEQ ID NO: 77802 - DNA, 20 bp, Artificial
  CRISPR gRNA sequence
ttcttggaggccacaatgtg

SEQ ID NO: 77803 - DNA, 20 bp, Artificial
  CRISPR gRNA sequence
tcttggaggccacaatgtgt

SEQ ID NO: 77804 - DNA, 20 bp, Artificial
  CRISPR gRNA sequence
cttggaggccacaatgtgtc

SEQ ID NO: 77805 - DNA, 20 bp, Artificial
  CRISPR gRNA sequence
ttggaggccacaatgtgtca

SEQ ID NO: 77806 - DNA, 20 bp, Artificial
  CRISPR gRNA sequence
ggaggccacaatgtgtcagc

SEQ ID NO: 77807 - DNA, 20 bp, Artificial
  CRISPR gRNA sequence
gaggccacaatgtgtcagcc

SEQ ID NO: 77808 - DNA, 20 bp, Artificial
  CRISPR gRNA sequence
cccagggacaaaaacacagt

SEQ ID NO: 77809 - DNA, 20 bp, Artificial
  CRISPR gRNA sequence
catgccccactgaacagagg

SEQ ID NO: 77810 - DNA, 20 bp, Artificial
  CRISPR gRNA sequence
aacagaggcgggaaggagcc

SEQ ID NO: 77811 - DNA, 20 bp, Artificial
  CRISPR gRNA sequence
tcccaccccccagacacaga

SEQ ID NO: 77812 - DNA, 20 bp, Artificial
  CRISPR gRNA sequence
cccaccccccagacacagag

SEQ ID NO: 77813 - DNA, 20 bp, Artificial
  CRISPR gRNA sequence
ccaccccccagacacagagg

SEQ ID NO: 77814 - DNA, 20 bp, Artificial
  CRISPR gRNA sequence
gcaggagaggagggactggg

SEQ ID NO: 77815 - DNA, 20 bp, Artificial
  CRISPR gRNA sequence
caggagaggagggactggga

SEQ ID NO: 77816 - DNA, 20 bp, Artificial
  CRISPR gRNA sequence
ggatgtatctggcacctaga

SEQ ID NO: 77817 - DNA, 20 bp, Artificial
  CRISPR gRNA sequence
gcacctagacagacggacaa

SEQ ID NO: 77818 - DNA, 20 bp, Artificial
  CRISPR gRNA sequence
gacagacggacaaagaggga

SEQ ID NO: 77819 - DNA, 20 bp, Artificial
  CRISPR gRNA sequence
agagagagagagcagatcag

SEQ ID NO: 77820 - DNA, 20 bp, Artificial
  CRISPR gRNA sequence
aaataacagttaaataaact

SEQ ID NO: 77821 - DNA, 20 bp, Artificial
  CRISPR gRNA sequence
aataaactgataaaacagaa

SEQ ID NO: 77822 - DNA, 20 bp, Artificial
  CRISPR gRNA sequence
ataaaacagaaatacacgat

SEQ ID NO: 77823 - DNA, 20 bp, Artificial
  CRISPR gRNA sequence
ggacagacaaagaccaagag

SEQ ID NO: 77824 - DNA, 20 bp, Artificial
  CRISPR gRNA sequence
atgggagcccccaggcccag

SEQ ID NO: 77825 - DNA, 20 bp, Artificial
  CRISPR gRNA sequence
cccttcacctcttttcagag

SEQ ID NO: 77826 - DNA, 20 bp, Artificial
  CRISPR gRNA sequence
cacctcttttcagagtctcc

SEQ ID NO: 77827 - DNA, 20 bp, Artificial
  CRISPR gRNA sequence
acctcttttcagagtctcca

SEQ ID NO: 77828 - DNA, 20 bp, Artificial
  CRISPR gRNA sequence
ttttcagagtctccacaacc

SEQ ID NO: 77829 - DNA, 20 bp, Artificial
  CRISPR gRNA sequence
ttcagagtctccacaacccc

SEQ ID NO: 77830 - DNA, 20 bp, Artificial
  CRISPR gRNA sequence
tcagagtctccacaacccct

SEQ ID NO: 77831 - DNA, 20 bp, Artificial
  CRISPR gRNA sequence
cagagtctccacaacccctc

SEQ ID NO: 77832 - DNA, 20 bp, Artificial
  CRISPR gRNA sequence
agagtctccacaacccctca

SEQ ID NO: 77833 - DNA, 20 bp, Artificial
  CRISPR gRNA sequence
cacaacccctcagctgctgg

SEQ ID NO: 77834 - DNA, 20 bp, Artificial
  CRISPR gRNA sequence
agctgctgggggtcagggag

SEQ ID NO: 77835 - DNA, 20 bp, Artificial
  CRISPR gRNA sequence
ctgggggtcagggagctaag

SEQ ID NO: 77836 - DNA, 20 bp, Artificial
  CRISPR gRNA sequence
ggggtcagggagctaagggg

SEQ ID NO: 77837 - DNA, 20 bp, Artificial
  CRISPR gRNA sequence
aggggagtggggtctcctgg

SEQ ID NO: 77838 - DNA, 20 bp, Artificial
  CRISPR gRNA sequence
ctgggcttgggaaggtggtt

SEQ ID NO: 77839 - DNA, 20 bp, Artificial
  CRISPR gRNA sequence
ggcttgggaaggtggttgac

SEQ ID NO: 77840 - DNA, 20 bp, Artificial
  CRISPR gRNA sequence
gggaaggtggttgacggggc

SEQ ID NO: 77841 - DNA, 20 bp, Artificial
  CRISPR gRNA sequence
ggaaggtggttgacggggct

SEQ ID NO: 77842 - DNA, 20 bp, Artificial
  CRISPR gRNA sequence
acggggctgccttgtgagcc

SEQ ID NO: 77843 - DNA, 20 bp, Artificial
  CRISPR gRNA sequence
ccttgtgagccctgtctggg

SEQ ID NO: 77844 - DNA, 20 bp, Artificial
  CRISPR gRNA sequence
gtgagccctgtctggggtgg

SEQ ID NO: 77845 - DNA, 20 bp, Artificial
  CRISPR gRNA sequence
tgagccctgtctggggtggg

SEQ ID NO: 77846 - DNA, 20 bp, Artificial
  CRISPR gRNA sequence
tctggggtgggctgggcagg

SEQ ID NO: 77847 - DNA, 20 bp, Artificial
  CRISPR gRNA sequence
gggtgggctgggcaggggag

SEQ ID NO: 77848 - DNA, 20 bp, Artificial
  CRISPR gRNA sequence
ggcaggggaggtaggaggta

SEQ ID NO: 77849 - DNA, 20 bp, Artificial
  CRISPR gRNA sequence
gacacagcaggtcaggtgtc

SEQ ID NO: 77850 - DNA, 20 bp, Artificial
  CRISPR gRNA sequence
cagggagcatgtggggcctg

SEQ ID NO: 77851 - DNA, 20 bp, Artificial
  CRISPR gRNA sequence
agggagcatgtggggcctgg

SEQ ID NO: 77852 - DNA, 20 bp, Artificial
  CRISPR gRNA sequence
ggcacaggtttgggagcagg

SEQ ID NO: 77853 - DNA, 20 bp, Artificial
  CRISPR gRNA sequence
gggagcaggctctgagcagg

SEQ ID NO: 77854 - DNA, 20 bp, Artificial
  CRISPR gRNA sequence
ggagcaggctctgagcaggg

SEQ ID NO: 77855 - DNA, 20 bp, Artificial
  CRISPR gRNA sequence
tgagcaggggaagggagggg

SEQ ID NO: 77856 - DNA, 20 bp, Artificial
  CRISPR gRNA sequence
agcaggggaagggagggggc

SEQ ID NO: 77857 - DNA, 20 bp, Artificial
  CRISPR gRNA sequence
gaatcacacacagggctgga

SEQ ID NO: 77858 - DNA, 20 bp, Artificial
  CRISPR gRNA sequence
gaggccatcactgtacctca

SEQ ID NO: 77859 - DNA, 20 bp, Artificial
  CRISPR gRNA sequence
tacctcatccttcgggagct

SEQ ID NO: 77860 - DNA, 20 bp, Artificial
  CRISPR gRNA sequence
atccttcgggagctcagagg

SEQ ID NO: 77861 - DNA, 20 bp, Artificial
  CRISPR gRNA sequence
cgggagctcagaggcagctc

SEQ ID NO: 77862 - DNA, 20 bp, Artificial
  CRISPR gRNA sequence
gggagctcagaggcagctca

SEQ ID NO: 77863 - DNA, 20 bp, Artificial
  CRISPR gRNA sequence
agaggcagctcagagggcat

SEQ ID NO: 77864 - DNA, 20 bp, Artificial
  CRISPR gRNA sequence
agagggcatctggagcatga

SEQ ID NO: 77865 - DNA, 20 bp, Artificial
  CRISPR gRNA sequence
gagcatgaggctgtcaagaa

SEQ ID NO: 77866 - DNA, 20 bp, Artificial
  CRISPR gRNA sequence
tcaagaaatgcagccctgga

SEQ ID NO: 77867 - DNA, 20 bp, Artificial
  CRISPR gRNA sequence
gagggacatcaccaaggcca

SEQ ID NO: 77868 - DNA, 20 bp, Artificial
  CRISPR gRNA sequence
agcaaaggccatgtccgcca

SEQ ID NO: 77869 - DNA, 20 bp, Artificial
  CRISPR gRNA sequence
cagaatccatcctcagcctg

SEQ ID NO: 77870 - DNA, 20 bp, Artificial
  CRISPR gRNA sequence
agcctggccttccaccatcg

SEQ ID NO: 77871 - DNA, 20 bp, Artificial
  CRISPR gRNA sequence
gccttccaccatcgagccct

SEQ ID NO: 77872 - DNA, 20 bp, Artificial
  CRISPR gRNA sequence
ccaccatcgagccctatcct

SEQ ID NO: 77873 - DNA, 20 bp, Artificial
  CRISPR gRNA sequence
caccatcgagccctatcctc

SEQ ID NO: 77874 - DNA, 20 bp, Artificial
  CRISPR gRNA sequence
tcctccacctagagtcaatc

SEQ ID NO: 77875 - DNA, 20 bp, Artificial
  CRISPR gRNA sequence
cacctagagtcaatcagacc

SEQ ID NO: 77876 - DNA, 20 bp, Artificial
  CRISPR gRNA sequence
gagtcaatcagaccttggtg

SEQ ID NO: 77877 - DNA, 20 bp, Artificial
  CRISPR gRNA sequence
ggtgccaatttggcttctcc

SEQ ID NO: 77878 - DNA, 20 bp, Artificial
  CRISPR gRNA sequence
gtgccaatttggcttctcca

SEQ ID NO: 77879 - DNA, 20 bp, Artificial
  CRISPR gRNA sequence
ggcttctccacttcctggtt

SEQ ID NO: 77880 - DNA, 20 bp, Artificial
  CRISPR gRNA sequence
gcttctccacttcctggttg

SEQ ID NO: 77881 - DNA, 20 bp, Artificial
  CRISPR gRNA sequence
ctccacttcctggttgtgtg

SEQ ID NO: 77882 - DNA, 20 bp, Artificial
  CRISPR gRNA sequence
tccacttcctggttgtgtga

SEQ ID NO: 77883 - DNA, 20 bp, Artificial
  CRISPR gRNA sequence
cacttcctggttgtgtgacc

SEQ ID NO: 77884 - DNA, 20 bp, Artificial
  CRISPR gRNA sequence
cctggttgtgtgaccctgga

SEQ ID NO: 77885 - DNA, 20 bp, Artificial
  CRISPR gRNA sequence
ctggttgtgtgaccctggac

SEQ ID NO: 77886 - DNA, 20 bp, Artificial
  CRISPR gRNA sequence
gttgtgtgaccctggacaaa

SEQ ID NO: 77887 - DNA, 20 bp, Artificial
  CRISPR gRNA sequence
tgtgaccctggacaaatcac

SEQ ID NO: 77888 - DNA, 20 bp, Artificial
  CRISPR gRNA sequence
gacaaatcacagcctctcaa

SEQ ID NO: 77889 - DNA, 20 bp, Artificial
  CRISPR gRNA sequence
tcaatgggagactgtatgtg

SEQ ID NO: 77890 - DNA, 20 bp, Artificial
  CRISPR gRNA sequence
aatgggagactgtatgtgaa

SEQ ID NO: 77891 - DNA, 20 bp, Artificial
  CRISPR gRNA sequence
tatgtgaactgccttagttt

SEQ ID NO: 77892 - DNA, 20 bp, Artificial
  CRISPR gRNA sequence
ccttagtttggtgcttggtg

SEQ ID NO: 77893 - DNA, 20 bp, Artificial
  CRISPR gRNA sequence
agtttggtgcttggtgcata

SEQ ID NO: 77894 - DNA, 20 bp, Artificial
  CRISPR gRNA sequence
gtttggtgcttggtgcatac

SEQ ID NO: 77895 - DNA, 20 bp, Artificial
  CRISPR gRNA sequence
ggtgcttggtgcatacatgg

SEQ ID NO: 77896 - DNA, 20 bp, Artificial
  CRISPR gRNA sequence
gtgcttggtgcatacatggc

SEQ ID NO: 77897 - DNA, 20 bp, Artificial
  CRISPR gRNA sequence
ggtgcatacatggcaagtac

SEQ ID NO: 77898 - DNA, 20 bp, Artificial
  CRISPR gRNA sequence
gtgcatacatggcaagtact

SEQ ID NO: 77899 - DNA, 20 bp, Artificial
  CRISPR gRNA sequence
aattgaccttgactgctatt

SEQ ID NO: 77900 - DNA, 20 bp, Artificial
  CRISPR gRNA sequence
accttgactgctattatcat

SEQ ID NO: 77901 - DNA, 20 bp, Artificial
  CRISPR gRNA sequence
gactgctattatcattaatc

SEQ ID NO: 77902 - DNA, 20 bp, Artificial
  CRISPR gRNA sequence
actgctattatcattaatct

SEQ ID NO: 77903 - DNA, 20 bp, Artificial
  CRISPR gRNA sequence
ctattatcattaatctcatc

SEQ ID NO: 77904 - DNA, 20 bp, Artificial
  CRISPR gRNA sequence
ttatcattaatctcatcctc

SEQ ID NO: 77905 - DNA, 20 bp, Artificial
  CRISPR gRNA sequence
tcattaatctcatcctcctc

SEQ ID NO: 77906 - DNA, 20 bp, Artificial
  CRISPR gRNA sequence
atctcatcctcctcctcatc

SEQ ID NO: 77907 - DNA, 20 bp, Artificial
  CRISPR gRNA sequence
atcctcctcctcatctgtgc

SEQ ID NO: 77908 - DNA, 20 bp, Artificial
  CRISPR gRNA sequence
ctcctcatctgtgcttcaga

SEQ ID NO: 77909 - DNA, 20 bp, Artificial
  CRISPR gRNA sequence
ctcatctgtgcttcagagat

SEQ ID NO: 77910 - DNA, 20 bp, Artificial
  CRISPR gRNA sequence
atctgtgcttcagagatgtc

SEQ ID NO: 77911 - DNA, 20 bp, Artificial
  CRISPR gRNA sequence
tgcttcagagatgtcagccc

SEQ ID NO: 77912 - DNA, 20 bp, Artificial
  CRISPR gRNA sequence
cagagatgtcagccccagct

SEQ ID NO: 77913 - DNA, 20 bp, Artificial
  CRISPR gRNA sequence
agagatgtcagccccagctg

SEQ ID NO: 77914 - DNA, 20 bp, Artificial
  CRISPR gRNA sequence
gaatcgagccttcagtagtc

SEQ ID NO: 77915 - DNA, 20 bp, Artificial
  CRISPR gRNA sequence
cagtagtccagactctacag

SEQ ID NO: 77916 - DNA, 20 bp, Artificial
  CRISPR gRNA sequence
agtagtccagactctacaga

SEQ ID NO: 77917 - DNA, 20 bp, Artificial
  CRISPR gRNA sequence
tacagaagagattgtgggtg

SEQ ID NO: 77918 - DNA, 20 bp, Artificial
  CRISPR gRNA sequence
cagaagagattgtgggtggg

SEQ ID NO: 77919 - DNA, 20 bp, Artificial
  CRISPR gRNA sequence
tgggtgggctccgggagcaa

SEQ ID NO: 77920 - DNA, 20 bp, Artificial
  CRISPR gRNA sequence
cgggagcaaagagctgagtc

SEQ ID NO: 77921 - DNA, 20 bp, Artificial
  CRISPR gRNA sequence
agtctctacccatgcgctag

SEQ ID NO: 77922 - DNA, 20 bp, Artificial
  CRISPR gRNA sequence
tacccatgcgctaggctggg

SEQ ID NO: 77923 - DNA, 20 bp, Artificial
  CRISPR gRNA sequence
cccatgcgctaggctggggc

SEQ ID NO: 77924 - DNA, 20 bp, Artificial
  CRISPR gRNA sequence
ggctggggcaatccaggacc

SEQ ID NO: 77925 - DNA, 20 bp, Artificial
  CRISPR gRNA sequence
gggcaatccaggaccctaat

SEQ ID NO: 77926 - DNA, 20 bp, Artificial
  CRISPR gRNA sequence
atgggtccttgtgtgaaagg

SEQ ID NO: 77927 - DNA, 20 bp, Artificial
  CRISPR gRNA sequence
gtgtgaaagggatacagaag

SEQ ID NO: 77928 - DNA, 20 bp, Artificial
  CRISPR gRNA sequence
tgtgaaagggatacagaagt

SEQ ID NO: 77929 - DNA, 20 bp, Artificial
  CRISPR gRNA sequence
cgaccaggaccagagctaca

SEQ ID NO: 77930 - DNA, 20 bp, Artificial
  CRISPR gRNA sequence
caggccaggcaatcccctgg

SEQ ID NO: 77931 - DNA, 20 bp, Artificial
  CRISPR gRNA sequence
ggtttaagctggagggctct

SEQ ID NO: 77932 - DNA, 20 bp, Artificial
  CRISPR gRNA sequence
aagctggagggctctagtct

SEQ ID NO: 77933 - DNA, 20 bp, Artificial
  CRISPR gRNA sequence
agctggagggctctagtctc

SEQ ID NO: 77934 - DNA, 20 bp, Artificial
  CRISPR gRNA sequence
gagggctctagtctcccgga

SEQ ID NO: 77935 - DNA, 20 bp, Artificial
  CRISPR gRNA sequence
tagtctcccggaatccccct

SEQ ID NO: 77936 - DNA, 20 bp, Artificial
  CRISPR gRNA sequence
gtctcccggaatccccctct

SEQ ID NO: 77937 - DNA, 20 bp, Artificial
  CRISPR gRNA sequence
ccggaatccccctctggcta

SEQ ID NO: 77938 - DNA, 20 bp, Artificial
  CRISPR gRNA sequence
tggctacccaactcctgccc

SEQ ID NO: 77939 - DNA, 20 bp, Artificial
  CRISPR gRNA sequence
gctacccaactcctgccctg

SEQ ID NO: 77940 - DNA, 20 bp, Artificial
  CRISPR gRNA sequence
cccaactcctgccctggcct

SEQ ID NO: 77941 - DNA, 20 bp, Artificial
  CRISPR gRNA sequence
ctgccctggcctgctgtcta

SEQ ID NO: 77942 - DNA, 20 bp, Artificial
  CRISPR gRNA sequence
ccctggcctgctgtctatat

SEQ ID NO: 77943 - DNA, 20 bp, Artificial
  CRISPR gRNA sequence
gcctgctgtctatatcctac

SEQ ID NO: 77944 - DNA, 20 bp, Artificial
  CRISPR gRNA sequence
ctgtctatatcctacacact

SEQ ID NO: 77945 - DNA, 20 bp, Artificial
  CRISPR gRNA sequence
tctatatcctacacactggg

SEQ ID NO: 77946 - DNA, 20 bp, Artificial
  CRISPR gRNA sequence
tatcctacacactggggctc

SEQ ID NO: 77947 - DNA, 20 bp, Artificial
  CRISPR gRNA sequence
cacactggggctcctttcag

SEQ ID NO: 77948 - DNA, 20 bp, Artificial
  CRISPR gRNA sequence
gggctcctttcaggcaccat

SEQ ID NO: 77949 - DNA, 20 bp, Artificial
  CRISPR gRNA sequence
ctttcaggcaccatgagagg

SEQ ID NO: 77950 - DNA, 20 bp, Artificial
  CRISPR gRNA sequence
tcaggcaccatgagaggcgg

SEQ ID NO: 77951 - DNA, 20 bp, Artificial
  CRISPR gRNA sequence
caggcaccatgagaggcgga

SEQ ID NO: 77952 - DNA, 20 bp, Artificial
  CRISPR gRNA sequence
aggcaccatgagaggcggag

SEQ ID NO: 77953 - DNA, 20 bp, Artificial
  CRISPR gRNA sequence
gatttggaccctcccccttt

SEQ ID NO: 77954 - DNA, 20 bp, Artificial
  CRISPR gRNA sequence
ggaccctccccctttggggc

SEQ ID NO: 77955 - DNA, 20 bp, Artificial
  CRISPR gRNA sequence
gaccctccccctttggggct

SEQ ID NO: 77956 - DNA, 20 bp, Artificial
  CRISPR gRNA sequence
cccctttggggctgcatcct

SEQ ID NO: 77957 - DNA, 20 bp, Artificial
  CRISPR gRNA sequence
tggggctgcatcctttgcca

SEQ ID NO: 77958 - DNA, 20 bp, Artificial
  CRISPR gRNA sequence
ggggctgcatcctttgccaa

SEQ ID NO: 77959 - DNA, 20 bp, Artificial
  CRISPR gRNA sequence
gggctgcatcctttgccaag

SEQ ID NO: 77960 - DNA, 20 bp, Artificial
  CRISPR gRNA sequence
catcctttgccaagcctgct

SEQ ID NO: 77961 - DNA, 20 bp, Artificial
  CRISPR gRNA sequence
tgccaagcctgctcacttcc

SEQ ID NO: 77962 - DNA, 20 bp, Artificial
  CRISPR gRNA sequence
gccaagcctgctcacttccc

SEQ ID NO: 77963 - DNA, 20 bp, Artificial
  CRISPR gRNA sequence
ccaagcctgctcacttcccg

SEQ ID NO: 77964 - DNA, 20 bp, Artificial
  CRISPR gRNA sequence
ctcacttcccgctcttccgt

SEQ ID NO: 77965 - DNA, 20 bp, Artificial
  CRISPR gRNA sequence
acttcccgctcttccgtgaa

SEQ ID NO: 77966 - DNA, 20 bp, Artificial
  CRISPR gRNA sequence
cccgctcttccgtgaatttg

SEQ ID NO: 77967 - DNA, 20 bp, Artificial
  CRISPR gRNA sequence
ccgctcttccgtgaatttgt

SEQ ID NO: 77968 - DNA, 20 bp, Artificial
  CRISPR gRNA sequence
ttccgtgaatttgtccaggt

SEQ ID NO: 77969 - DNA, 20 bp, Artificial
  CRISPR gRNA sequence
ccgtgaatttgtccaggtca

SEQ ID NO: 77970 - DNA, 20 bp, Artificial
  CRISPR gRNA sequence
cgtgaatttgtccaggtcac

SEQ ID NO: 77971 - DNA, 20 bp, Artificial
  CRISPR gRNA sequence
gtccaggtcaccctggcagt

SEQ ID NO: 77972 - DNA, 20 bp, Artificial
  CRISPR gRNA sequence
tccaggtcaccctggcagtt

SEQ ID NO: 77973 - DNA, 20 bp, Artificial
  CRISPR gRNA sequence
gcagttgactgactggcact

SEQ ID NO: 77974 - DNA, 20 bp, Artificial
  CRISPR gRNA sequence
actgactggcactgcccagc

SEQ ID NO: 77975 - DNA, 20 bp, Artificial
  CRISPR gRNA sequence
actggcactgcccagctgtg

SEQ ID NO: 77976 - DNA, 20 bp, Artificial
  CRISPR gRNA sequence
gcactgcccagctgtggagg

SEQ ID NO: 77977 - DNA, 20 bp, Artificial
  CRISPR gRNA sequence
cccagctgtggagggtagag

SEQ ID NO: 77978 - DNA, 20 bp, Artificial
  CRISPR gRNA sequence
tggagggtagagaggggaat

SEQ ID NO: 77979 - DNA, 20 bp, Artificial
  CRISPR gRNA sequence
actgagcatggagttggggt

SEQ ID NO: 77980 - DNA, 20 bp, Artificial
  CRISPR gRNA sequence
agcatggagttggggtgaaa

SEQ ID NO: 77981 - DNA, 20 bp, Artificial
  CRISPR gRNA sequence
gggtgaaatcgggccctacc

SEQ ID NO: 77982 - DNA, 20 bp, Artificial
  CRISPR gRNA sequence
cctctcctggggccccttct

SEQ ID NO: 77983 - DNA, 20 bp, Artificial
  CRISPR gRNA sequence
tcctggggccccttctgctc

SEQ ID NO: 77984 - DNA, 20 bp, Artificial
  CRISPR gRNA sequence
ctggggccccttctgctcct

SEQ ID NO: 77985 - DNA, 20 bp, Artificial
  CRISPR gRNA sequence
gggccccttctgctcctctg

SEQ ID NO: 77986 - DNA, 20 bp, Artificial
  CRISPR gRNA sequence
ctgctcctctggctcctggg

SEQ ID NO: 77987 - DNA, 20 bp, Artificial
  CRISPR gRNA sequence
tgctcctctggctcctgggc

SEQ ID NO: 77988 - DNA, 20 bp, Artificial
  CRISPR gRNA sequence
ctcctctggctcctgggcaa

SEQ ID NO: 77989 - DNA, 20 bp, Artificial
  CRISPR gRNA sequence
ctctggctcctgggcaaaca

SEQ ID NO: 77990 - DNA, 20 bp, Artificial
  CRISPR gRNA sequence
tggctcctgggcaaacatga

SEQ ID NO: 77991 - DNA, 20 bp, Artificial
  CRISPR gRNA sequence
gctcctgggcaaacatgaag

SEQ ID NO: 77992 - DNA, 20 bp, Artificial
  CRISPR gRNA sequence
ctgggcaaacatgaagatca

SEQ ID NO: 77993 - DNA, 20 bp, Artificial
  CRISPR gRNA sequence
ggcaaacatgaagatcacag

SEQ ID NO: 77994 - DNA, 20 bp, Artificial
  CRISPR gRNA sequence
tgtgctgcaggctgtgaaga

SEQ ID NO: 77995 - DNA, 20 bp, Artificial
  CRISPR gRNA sequence
gtgctgcaggctgtgaagac

SEQ ID NO: 77996 - DNA, 20 bp, Artificial
  CRISPR gRNA sequence
tgctgcaggctgtgaagaca

SEQ ID NO: 77997 - DNA, 20 bp, Artificial
  CRISPR gRNA sequence
caggctgtgaagacaaaaga

SEQ ID NO: 77998 - DNA, 20 bp, Artificial
  CRISPR gRNA sequence
tgaagacaaaagaggggtga

SEQ ID NO: 77999 - DNA, 20 bp, Artificial
  CRISPR gRNA sequence
ttggctccctgttactattt

SEQ ID NO: 78000 - DNA, 20 bp, Artificial
  CRISPR gRNA sequence
gctccctgttactatttctt

SEQ ID NO: 78001 - DNA, 20 bp, Artificial
  CRISPR gRNA sequence
cctgttactatttctttttg

SEQ ID NO: 78002 - DNA, 20 bp, Artificial
  CRISPR gRNA sequence
ttactatttctttttgagag

SEQ ID NO: 78003 - DNA, 20 bp, Artificial
  CRISPR gRNA sequence
ctatttctttttgagagaag

SEQ ID NO: 78004 - DNA, 20 bp, Artificial
  CRISPR gRNA sequence
tttctttttgagagaaggtc

SEQ ID NO: 78005 - DNA, 20 bp, Artificial
  CRISPR gRNA sequence
ctttttgagagaaggtctca

SEQ ID NO: 78006 - DNA, 20 bp, Artificial
  CRISPR gRNA sequence
tttttgagagaaggtctcag

SEQ ID NO: 78007 - DNA, 20 bp, Artificial
  CRISPR gRNA sequence
tttgagagaaggtctcagtc

SEQ ID NO: 78008 - DNA, 20 bp, Artificial
  CRISPR gRNA sequence
ttgagagaaggtctcagtct

SEQ ID NO: 78009 - DNA, 20 bp, Artificial
  CRISPR gRNA sequence
tgagagaaggtctcagtctg

SEQ ID NO: 78010 - DNA, 20 bp, Artificial
  CRISPR gRNA sequence
gagagaaggtctcagtctgt

SEQ ID NO: 78011 - DNA, 20 bp, Artificial
  CRISPR gRNA sequence
agagaaggtctcagtctgtt

SEQ ID NO: 78012 - DNA, 20 bp, Artificial
  CRISPR gRNA sequence
agtctgttgcccaagctggt

SEQ ID NO: 78013 - DNA, 20 bp, Artificial
  CRISPR gRNA sequence
ttgcccaagctggtgtgcag

SEQ ID NO: 78014 - DNA, 20 bp, Artificial
  CRISPR gRNA sequence
cccaagctggtgtgcagtgg

SEQ ID NO: 78015 - DNA, 20 bp, Artificial
  CRISPR gRNA sequence
gtgtgcagtggtgcaatcat

SEQ ID NO: 78016 - DNA, 20 bp, Artificial
  CRISPR gRNA sequence
actgaagcctccacctcctg

SEQ ID NO: 78017 - DNA, 20 bp, Artificial
  CRISPR gRNA sequence
aagcctccacctcctgggct

SEQ ID NO: 78018 - DNA, 20 bp, Artificial
  CRISPR gRNA sequence
cacctcctgggctcaagcaa

SEQ ID NO: 78019 - DNA, 20 bp, Artificial
  CRISPR gRNA sequence
ctgggctcaagcaatcctcc

SEQ ID NO: 78020 - DNA, 20 bp, Artificial
  CRISPR gRNA sequence
ggctcaagcaatcctcccac

SEQ ID NO: 78021 - DNA, 20 bp, Artificial
  CRISPR gRNA sequence
aagcaatcctcccacttcag

SEQ ID NO: 78022 - DNA, 20 bp, Artificial
  CRISPR gRNA sequence
ccacttcagcctcctgagta

SEQ ID NO: 78023 - DNA, 20 bp, Artificial
  CRISPR gRNA sequence
cagcctcctgagtagctggg

SEQ ID NO: 78024 - DNA, 20 bp, Artificial
  CRISPR gRNA sequence
agcctcctgagtagctggga

SEQ ID NO: 78025 - DNA, 20 bp, Artificial
  CRISPR gRNA sequence
ctgagtagctgggattacag

SEQ ID NO: 78026 - DNA, 20 bp, Artificial
  CRISPR gRNA sequence
agtagctgggattacaggct

SEQ ID NO: 78027 - DNA, 20 bp, Artificial
  CRISPR gRNA sequence
ggattacaggcttgtgccat

SEQ ID NO: 78028 - DNA, 20 bp, Artificial
  CRISPR gRNA sequence
caggcttgtgccatcaggcc

SEQ ID NO: 78029 - DNA, 20 bp, Artificial
  CRISPR gRNA sequence
gtgccatcaggcccagctaa

SEQ ID NO: 78030 - DNA, 20 bp, Artificial
  CRISPR gRNA sequence
tgccatcaggcccagctaat

SEQ ID NO: 78031 - DNA, 20 bp, Artificial
  CRISPR gRNA sequence
attaaaaaaaaaagtatgta

SEQ ID NO: 78032 - DNA, 20 bp, Artificial
  CRISPR gRNA sequence
aaaaaaaaagtatgtagaga

SEQ ID NO: 78033 - DNA, 20 bp, Artificial
  CRISPR gRNA sequence
tgttgtctactctggtctcg

SEQ ID NO: 78034 - DNA, 20 bp, Artificial
  CRISPR gRNA sequence
tctactctggtctcgaactt

SEQ ID NO: 78035 - DNA, 20 bp, Artificial
  CRISPR gRNA sequence
ctctggtctcgaacttctgg

SEQ ID NO: 78036 - DNA, 20 bp, Artificial
  CRISPR gRNA sequence
tggtctcgaacttctgggct

SEQ ID NO: 78037 - DNA, 20 bp, Artificial
  CRISPR gRNA sequence
gtctcgaacttctgggctca

SEQ ID NO: 78038 - DNA, 20 bp, Artificial
  CRISPR gRNA sequence
gaacttctgggctcaggtga

SEQ ID NO: 78039 - DNA, 20 bp, Artificial
  CRISPR gRNA sequence
ctgggctcaggtgatcctcc

SEQ ID NO: 78040 - DNA, 20 bp, Artificial
  CRISPR gRNA sequence
tgggctcaggtgatcctccc

SEQ ID NO: 78041 - DNA, 20 bp, Artificial
  CRISPR gRNA sequence
ggctcaggtgatcctcccac

SEQ ID NO: 78042 - DNA, 20 bp, Artificial
  CRISPR gRNA sequence
aggtgatcctcccacctttg

SEQ ID NO: 78043 - DNA, 20 bp, Artificial
  CRISPR gRNA sequence
ccacctttgcttcccaaagt

SEQ ID NO: 78044 - DNA, 20 bp, Artificial
  CRISPR gRNA sequence
tgcttcccaaagtgctggga

SEQ ID NO: 78045 - DNA, 20 bp, Artificial
  CRISPR gRNA sequence
gcttcccaaagtgctgggat

SEQ ID NO: 78046 - DNA, 20 bp, Artificial
  CRISPR gRNA sequence
cttcccaaagtgctgggatg

SEQ ID NO: 78047 - DNA, 20 bp, Artificial
  CRISPR gRNA sequence
cccaaagtgctgggatgata

SEQ ID NO: 78048 - DNA, 20 bp, Artificial
  CRISPR gRNA sequence
ccaaagtgctgggatgatag

SEQ ID NO: 78049 - DNA, 20 bp, Artificial
  CRISPR gRNA sequence
ggatgataggtgtgagccac

SEQ ID NO: 78050 - DNA, 20 bp, Artificial
  CRISPR gRNA sequence
tcactttttacccctggccc

SEQ ID NO: 78051 - DNA, 20 bp, Artificial
  CRISPR gRNA sequence
tttacccctggcccgggagg

SEQ ID NO: 78052 - DNA, 20 bp, Artificial
  CRISPR gRNA sequence
ttacccctggcccgggagga

SEQ ID NO: 78053 - DNA, 20 bp, Artificial
  CRISPR gRNA sequence
tacccctggcccgggaggac

SEQ ID NO: 78054 - DNA, 20 bp, Artificial
  CRISPR gRNA sequence
acccctggcccgggaggacc

SEQ ID NO: 78055 - DNA, 20 bp, Artificial
  CRISPR gRNA sequence
cccctggcccgggaggacct

SEQ ID NO: 78056 - DNA, 20 bp, Artificial
  CRISPR gRNA sequence
gcccgggaggacctctcaag

SEQ ID NO: 78057 - DNA, 20 bp, Artificial
  CRISPR gRNA sequence
tcaagttccatccccctgcc

SEQ ID NO: 78058 - DNA, 20 bp, Artificial
  CRISPR gRNA sequence
aagttccatccccctgcctc

SEQ ID NO: 78059 - DNA, 20 bp, Artificial
  CRISPR gRNA sequence
catccccctgcctccagctg

SEQ ID NO: 78060 - DNA, 20 bp, Artificial
  CRISPR gRNA sequence
cctccagctgcagccacttc

SEQ ID NO: 78061 - DNA, 20 bp, Artificial
  CRISPR gRNA sequence
cagctgcagccacttcctct

SEQ ID NO: 78062 - DNA, 20 bp, Artificial
  CRISPR gRNA sequence
cagccacttcctctgactcc

SEQ ID NO: 78063 - DNA, 20 bp, Artificial
  CRISPR gRNA sequence
cctctgactcccctctgact

SEQ ID NO: 78064 - DNA, 20 bp, Artificial
  CRISPR gRNA sequence
ctctgactcccctctgactt

SEQ ID NO: 78065 - DNA, 20 bp, Artificial
  CRISPR gRNA sequence
tgactcccctctgacttcct

SEQ ID NO: 78066 - DNA, 20 bp, Artificial
  CRISPR gRNA sequence
actcccctctgacttcctct

SEQ ID NO: 78067 - DNA, 20 bp, Artificial
  CRISPR gRNA sequence
ccctctgacttcctctgagc

SEQ ID NO: 78068 - DNA, 20 bp, Artificial
  CRISPR gRNA sequence
tgacttcctctgagcttttg

SEQ ID NO: 78069 - DNA, 20 bp, Artificial
  CRISPR gRNA sequence
acttcctctgagcttttgga

SEQ ID NO: 78070 - DNA, 20 bp, Artificial
  CRISPR gRNA sequence
cctctgagcttttggagggc

SEQ ID NO: 78071 - DNA, 20 bp, Artificial
  CRISPR gRNA sequence
ctctgagcttttggagggct

SEQ ID NO: 78072 - DNA, 20 bp, Artificial
  CRISPR gRNA sequence
tgagcttttggagggctgaa

SEQ ID NO: 78073 - DNA, 20 bp, Artificial
  CRISPR gRNA sequence
agcttttggagggctgaaat

SEQ ID NO: 78074 - DNA, 20 bp, Artificial
  CRISPR gRNA sequence
ttggagggctgaaatctttc

SEQ ID NO: 78075 - DNA, 20 bp, Artificial
  CRISPR gRNA sequence
tggagggctgaaatctttct

SEQ ID NO: 78076 - DNA, 20 bp, Artificial
  CRISPR gRNA sequence
ggagggctgaaatctttcta

SEQ ID NO: 78077 - DNA, 20 bp, Artificial
  CRISPR gRNA sequence
gagggctgaaatctttctac

SEQ ID NO: 78078 - DNA, 20 bp, Artificial
  CRISPR gRNA sequence
aaatctttctaccacagata

SEQ ID NO: 78079 - DNA, 20 bp, Artificial
  CRISPR gRNA sequence
tctaccacagatatttcaca

SEQ ID NO: 78080 - DNA, 20 bp, Artificial
  CRISPR gRNA sequence
ctaccacagatatttcacaa

SEQ ID NO: 78081 - DNA, 20 bp, Artificial
  CRISPR gRNA sequence
taccacagatatttcacaaa

SEQ ID NO: 78082 - DNA, 20 bp, Artificial
  CRISPR gRNA sequence
ccacagatatttcacaaatg

SEQ ID NO: 78083 - DNA, 20 bp, Artificial
  CRISPR gRNA sequence
cacaaatgtatctattgcct

SEQ ID NO: 78084 - DNA, 20 bp, Artificial
  CRISPR gRNA sequence
acaaatgtatctattgccta

SEQ ID NO: 78085 - DNA, 20 bp, Artificial
  CRISPR gRNA sequence
ttgcctaagtaagccccatt

SEQ ID NO: 78086 - DNA, 20 bp, Artificial
  CRISPR gRNA sequence
cctaagtaagccccatttcc

SEQ ID NO: 78087 - DNA, 20 bp, Artificial
  CRISPR gRNA sequence
agtaagccccatttcctggc

SEQ ID NO: 78088 - DNA, 20 bp, Artificial
  CRISPR gRNA sequence
cctggcaagtcttaaaagaa

SEQ ID NO: 78089 - DNA, 20 bp, Artificial
  CRISPR gRNA sequence
ctggcaagtcttaaaagaaa

SEQ ID NO: 78090 - DNA, 20 bp, Artificial
  CRISPR gRNA sequence
gcaagtcttaaaagaaaaca

SEQ ID NO: 78091 - DNA, 20 bp, Artificial
  CRISPR gRNA sequence
aaaagaaaacaaattctgtg

SEQ ID NO: 78092 - DNA, 20 bp, Artificial
  CRISPR gRNA sequence
aaagaaaacaaattctgtgt

SEQ ID NO: 78093 - DNA, 20 bp, Artificial
  CRISPR gRNA sequence
tgtgttctctcttttagccc

SEQ ID NO: 78094 - DNA, 20 bp, Artificial
  CRISPR gRNA sequence
tgttctctcttttagcccca

SEQ ID NO: 78095 - DNA, 20 bp, Artificial
  CRISPR gRNA sequence
tctcttttagccccagactg

SEQ ID NO: 78096 - DNA, 20 bp, Artificial
  CRISPR gRNA sequence
tcttttagccccagactgaa

SEQ ID NO: 78097 - DNA, 20 bp, Artificial
  CRISPR gRNA sequence
ttttagccccagactgaaac

SEQ ID NO: 78098 - DNA, 20 bp, Artificial
  CRISPR gRNA sequence
ttagccccagactgaaaccc

SEQ ID NO: 78099 - DNA, 20 bp, Artificial
  CRISPR gRNA sequence
tagccccagactgaaacccc

SEQ ID NO: 78100 - DNA, 20 bp, Artificial
  CRISPR gRNA sequence
agccccagactgaaacccct

SEQ ID NO: 78101 - DNA, 20 bp, Artificial
  CRISPR gRNA sequence
gccccagactgaaacccctc

SEQ ID NO: 78102 - DNA, 20 bp, Artificial
  CRISPR gRNA sequence
aaacccctctctctgctagt

SEQ ID NO: 78103 - DNA, 20 bp, Artificial
  CRISPR gRNA sequence
tctctgctagtcagtgttct

SEQ ID NO: 78104 - DNA, 20 bp, Artificial
  CRISPR gRNA sequence
tctgctagtcagtgttctgt

SEQ ID NO: 78105 - DNA, 20 bp, Artificial
  CRISPR gRNA sequence
tgctagtcagtgttctgtct

SEQ ID NO: 78106 - DNA, 20 bp, Artificial
  CRISPR gRNA sequence
ctagtcagtgttctgtctgt

SEQ ID NO: 78107 - DNA, 20 bp, Artificial
  CRISPR gRNA sequence
gtcagtgttctgtctgtgct

SEQ ID NO: 78108 - DNA, 20 bp, Artificial
  CRISPR gRNA sequence
tgtctgtgctcaaagtatgt

SEQ ID NO: 78109 - DNA, 20 bp, Artificial
  CRISPR gRNA sequence
tctgtgctcaaagtatgtgt

SEQ ID NO: 78110 - DNA, 20 bp, Artificial
  CRISPR gRNA sequence
tgctcaaagtatgtgtggat

SEQ ID NO: 78111 - DNA, 20 bp, Artificial
  CRISPR gRNA sequence
aaagtatgtgtggattaccc

SEQ ID NO: 78112 - DNA, 20 bp, Artificial
  CRISPR gRNA sequence
cccctggtaacctttggagt

SEQ ID NO: 78113 - DNA, 20 bp, Artificial
  CRISPR gRNA sequence
gtaacctttggagtgagtcc

SEQ ID NO: 78114 - DNA, 20 bp, Artificial
  CRISPR gRNA sequence
tggagtgagtccttcaaacc

SEQ ID NO: 78115 - DNA, 20 bp, Artificial
  CRISPR gRNA sequence
ggagtgagtccttcaaacct

SEQ ID NO: 78116 - DNA, 20 bp, Artificial
  CRISPR gRNA sequence
gagtgagtccttcaaacctt

SEQ ID NO: 78117 - DNA, 20 bp, Artificial
  CRISPR gRNA sequence
caaaccttccattttctagt

SEQ ID NO: 78118 - DNA, 20 bp, Artificial
  CRISPR gRNA sequence
aaaccttccattttctagtg

SEQ ID NO: 78119 - DNA, 20 bp, Artificial
  CRISPR gRNA sequence
ccattttctagtgcaataat

SEQ ID NO: 78120 - DNA, 20 bp, Artificial
  CRISPR gRNA sequence
cattttctagtgcaataatt

SEQ ID NO: 78121 - DNA, 20 bp, Artificial
  CRISPR gRNA sequence
tctagtgcaataatttttgt

SEQ ID NO: 78122 - DNA, 20 bp, Artificial
  CRISPR gRNA sequence
ctagtgcaataatttttgtt

SEQ ID NO: 78123 - DNA, 20 bp, Artificial
  CRISPR gRNA sequence
tagtgcaataatttttgttt

SEQ ID NO: 78124 - DNA, 20 bp, Artificial
  CRISPR gRNA sequence
gtgcaataatttttgtttta

SEQ ID NO: 78125 - DNA, 20 bp, Artificial
  CRISPR gRNA sequence
ttgttttacaaacatgggat

SEQ ID NO: 78126 - DNA, 20 bp, Artificial
  CRISPR gRNA sequence
tgttttacaaacatgggatt

SEQ ID NO: 78127 - DNA, 20 bp, Artificial
  CRISPR gRNA sequence
gttttacaaacatgggatta

SEQ ID NO: 78128 - DNA, 20 bp, Artificial
  CRISPR gRNA sequence
ttttacaaacatgggattaa

SEQ ID NO: 78129 - DNA, 20 bp, Artificial
  CRISPR gRNA sequence
tacaaacatgggattaaact

SEQ ID NO: 78130 - DNA, 20 bp, Artificial
  CRISPR gRNA sequence
acaaacatgggattaaacta

SEQ ID NO: 78131 - DNA, 20 bp, Artificial
  CRISPR gRNA sequence
caaacatgggattaaactat

SEQ ID NO: 78132 - DNA, 20 bp, Artificial
  CRISPR gRNA sequence
aactatagattctcttttta

SEQ ID NO: 78133 - DNA, 20 bp, Artificial
  CRISPR gRNA sequence
tagattctctttttaaacat

SEQ ID NO: 78134 - DNA, 20 bp, Artificial
  CRISPR gRNA sequence
tctttttaaacattagtttt

SEQ ID NO: 78135 - DNA, 20 bp, Artificial
  CRISPR gRNA sequence
tttttaaacattagtttttt

SEQ ID NO: 78136 - DNA, 20 bp, Artificial
  CRISPR gRNA sequence
tttaaacattagttttttaa

SEQ ID NO: 78137 - DNA, 20 bp, Artificial
  CRISPR gRNA sequence
ttaaacattagttttttaag

SEQ ID NO: 78138 - DNA, 20 bp, Artificial
  CRISPR gRNA sequence
taaacattagttttttaagg

SEQ ID NO: 78139 - DNA, 20 bp, Artificial
  CRISPR gRNA sequence
aaacattagttttttaaggg

SEQ ID NO: 78140 - DNA, 20 bp, Artificial
  CRISPR gRNA sequence
aacattagttttttaagggc

SEQ ID NO: 78141 - DNA, 20 bp, Artificial
  CRISPR gRNA sequence
gttttttaagggctagaagc

SEQ ID NO: 78142 - DNA, 20 bp, Artificial
  CRISPR gRNA sequence
tttaagggctagaagcaggg

SEQ ID NO: 78143 - DNA, 20 bp, Artificial
  CRISPR gRNA sequence
ttaagggctagaagcaggga

SEQ ID NO: 78144 - DNA, 20 bp, Artificial
  CRISPR gRNA sequence
taagggctagaagcagggat

SEQ ID NO: 78145 - DNA, 20 bp, Artificial
  CRISPR gRNA sequence
aagggctagaagcagggatg

SEQ ID NO: 78146 - DNA, 20 bp, Artificial
  CRISPR gRNA sequence
agggctagaagcagggatga

SEQ ID NO: 78147 - DNA, 20 bp, Artificial
  CRISPR gRNA sequence
gaagcagggatgacaaataa

SEQ ID NO: 78148 - DNA, 20 bp, Artificial
  CRISPR gRNA sequence
ttaatacttgatcattattg

SEQ ID NO: 78149 - DNA, 20 bp, Artificial
  CRISPR gRNA sequence
atacttgatcattattgatg

SEQ ID NO: 78150 - DNA, 20 bp, Artificial
  CRISPR gRNA sequence
gatcattattgatgggaaca

SEQ ID NO: 78151 - DNA, 20 bp, Artificial
  CRISPR gRNA sequence
atcattattgatgggaacag

SEQ ID NO: 78152 - DNA, 20 bp, Artificial
  CRISPR gRNA sequence
ttgatgggaacagattatat

SEQ ID NO: 78153 - DNA, 20 bp, Artificial
  CRISPR gRNA sequence
atgggaacagattatatata

SEQ ID NO: 78154 - DNA, 20 bp, Artificial
  CRISPR gRNA sequence
tatataccatgctctctctt

SEQ ID NO: 78155 - DNA, 20 bp, Artificial
  CRISPR gRNA sequence
tctctttttttttttttttt

SEQ ID NO: 78156 - DNA, 20 bp, Artificial
  CRISPR gRNA sequence
tctttttttttttttttttt

SEQ ID NO: 78157 - DNA, 20 bp, Artificial
  CRISPR gRNA sequence
ttttttttttttttttttta

SEQ ID NO: 78158 - DNA, 20 bp, Artificial
  CRISPR gRNA sequence
tttttttttttttttttaat

SEQ ID NO: 78159 - DNA, 20 bp, Artificial
  CRISPR gRNA sequence
ttttttttttttttttaatt

SEQ ID NO: 78160 - DNA, 20 bp, Artificial
  CRISPR gRNA sequence
tttttttttttttttaattt

SEQ ID NO: 78161 - DNA, 20 bp, Artificial
  CRISPR gRNA sequence
ttttttttttttttaatttg

SEQ ID NO: 78162 - DNA, 20 bp, Artificial
  CRISPR gRNA sequence
tttttttttttttaatttga

SEQ ID NO: 78163 - DNA, 20 bp, Artificial
  CRISPR gRNA sequence
ttttttttttttaatttgag

SEQ ID NO: 78164 - DNA, 20 bp, Artificial
  CRISPR gRNA sequence
tttttttttttaatttgaga

SEQ ID NO: 78165 - DNA, 20 bp, Artificial
  CRISPR gRNA sequence
ttttttttttaatttgagac

SEQ ID NO: 78166 - DNA, 20 bp, Artificial
  CRISPR gRNA sequence
tttttttttaatttgagaca

SEQ ID NO: 78167 - DNA, 20 bp, Artificial
  CRISPR gRNA sequence
ttttttttaatttgagacag

SEQ ID NO: 78168 - DNA, 20 bp, Artificial
  CRISPR gRNA sequence
tttttttaatttgagacaga

SEQ ID NO: 78169 - DNA, 20 bp, Artificial
  CRISPR gRNA sequence
ttttttaatttgagacagag

SEQ ID NO: 78170 - DNA, 20 bp, Artificial
  CRISPR gRNA sequence
tttttaatttgagacagagt

SEQ ID NO: 78171 - DNA, 20 bp, Artificial
  CRISPR gRNA sequence
ttttaatttgagacagagtc

SEQ ID NO: 78172 - DNA, 20 bp, Artificial
  CRISPR gRNA sequence
tttaatttgagacagagtct

SEQ ID NO: 78173 - DNA, 20 bp, Artificial
  CRISPR gRNA sequence
ttaatttgagacagagtctt

SEQ ID NO: 78174 - DNA, 20 bp, Artificial
  CRISPR gRNA sequence
taatttgagacagagtcttg

SEQ ID NO: 78175 - DNA, 20 bp, Artificial
  CRISPR gRNA sequence
aatttgagacagagtcttgc

SEQ ID NO: 78176 - DNA, 20 bp, Artificial
  CRISPR gRNA sequence
atttgagacagagtcttgct

SEQ ID NO: 78177 - DNA, 20 bp, Artificial
  CRISPR gRNA sequence
gagacagagtcttgctctgt

SEQ ID NO: 78178 - DNA, 20 bp, Artificial
  CRISPR gRNA sequence
agacagagtcttgctctgtc

SEQ ID NO: 78179 - DNA, 20 bp, Artificial
  CRISPR gRNA sequence
gctctgtctcccaggctgga

SEQ ID NO: 78180 - DNA, 20 bp, Artificial
  CRISPR gRNA sequence
ctctgtctcccaggctggag

SEQ ID NO: 78181 - DNA, 20 bp, Artificial
  CRISPR gRNA sequence
tgtctcccaggctggagtgc

SEQ ID NO: 78182 - DNA, 20 bp, Artificial
  CRISPR gRNA sequence
tctcccaggctggagtgcag

SEQ ID NO: 78183 - DNA, 20 bp, Artificial
  CRISPR gRNA sequence
ccaggctggagtgcagtggc

SEQ ID NO: 78184 - DNA, 20 bp, Artificial
  CRISPR gRNA sequence
gagtgcagtggcatgatctc

SEQ ID NO: 78185 - DNA, 20 bp, Artificial
  CRISPR gRNA sequence
ggctcactgcaacctccgcc

SEQ ID NO: 78186 - DNA, 20 bp, Artificial
  CRISPR gRNA sequence
actgcaacctccgcctccca

SEQ ID NO: 78187 - DNA, 20 bp, Artificial
  CRISPR gRNA sequence
caacctccgcctcccaggtt

SEQ ID NO: 78188 - DNA, 20 bp, Artificial
  CRISPR gRNA sequence
cgcctcccaggttccagcga

SEQ ID NO: 78189 - DNA, 20 bp, Artificial
  CRISPR gRNA sequence
ccaggttccagcgattctcc

SEQ ID NO: 78190 - DNA, 20 bp, Artificial
  CRISPR gRNA sequence
cagcgattctcctgcctcag

SEQ ID NO: 78191 - DNA, 20 bp, Artificial
  CRISPR gRNA sequence
tcctgcctcagcctcctgag

SEQ ID NO: 78192 - DNA, 20 bp, Artificial
  CRISPR gRNA sequence
ctgcctcagcctcctgagta

SEQ ID NO: 78193 - DNA, 20 bp, Artificial
  CRISPR gRNA sequence
cctcagcctcctgagtagct

SEQ ID NO: 78194 - DNA, 20 bp, Artificial
  CRISPR gRNA sequence
agcctcctgagtagctggaa

SEQ ID NO: 78195 - DNA, 20 bp, Artificial
  CRISPR gRNA sequence
ctgagtagctggaattacag

SEQ ID NO: 78196 - DNA, 20 bp, Artificial
  CRISPR gRNA sequence
agtagctggaattacaggtg

SEQ ID NO: 78197 - DNA, 20 bp, Artificial
  CRISPR gRNA sequence
gaattacaggtgcacgccac

SEQ ID NO: 78198 - DNA, 20 bp, Artificial
  CRISPR gRNA sequence
caggtgcacgccaccatgcc

SEQ ID NO: 78199 - DNA, 20 bp, Artificial
  CRISPR gRNA sequence
gtttttgtatttttagtaga

SEQ ID NO: 78200 - DNA, 20 bp, Artificial
  CRISPR gRNA sequence
ttgtatttttagtagagacg

SEQ ID NO: 78201 - DNA, 20 bp, Artificial
  CRISPR gRNA sequence
tgtatttttagtagagacgg

SEQ ID NO: 78202 - DNA, 20 bp, Artificial
  CRISPR gRNA sequence
gtatttttagtagagacggg

SEQ ID NO: 78203 - DNA, 20 bp, Artificial
  CRISPR gRNA sequence
tatttttagtagagacgggg

SEQ ID NO: 78204 - DNA, 20 bp, Artificial
  CRISPR gRNA sequence
ttagtagagacggggtttca

SEQ ID NO: 78205 - DNA, 20 bp, Artificial
  CRISPR gRNA sequence
tagtagagacggggtttcat

SEQ ID NO: 78206 - DNA, 20 bp, Artificial
  CRISPR gRNA sequence
agtagagacggggtttcatc

SEQ ID NO: 78207 - DNA, 20 bp, Artificial
  CRISPR gRNA sequence
gtagagacggggtttcatcc

SEQ ID NO: 78208 - DNA, 20 bp, Artificial
  CRISPR gRNA sequence
catcctattggccaggctgg

SEQ ID NO: 78209 - DNA, 20 bp, Artificial
  CRISPR gRNA sequence
atcctattggccaggctggt

SEQ ID NO: 78210 - DNA, 20 bp, Artificial
  CRISPR gRNA sequence
ttggccaggctggtcttgaa

SEQ ID NO: 78211 - DNA, 20 bp, Artificial
  CRISPR gRNA sequence
gccaggctggtcttgaactc

SEQ ID NO: 78212 - DNA, 20 bp, Artificial
  CRISPR gRNA sequence
gtcttgaactcctgacctca

SEQ ID NO: 78213 - DNA, 20 bp, Artificial
  CRISPR gRNA sequence
gaactcctgacctcaggtga

SEQ ID NO: 78214 - DNA, 20 bp, Artificial
  CRISPR gRNA sequence
aactcctgacctcaggtgat

SEQ ID NO: 78215 - DNA, 20 bp, Artificial
  CRISPR gRNA sequence
ctgacctcaggtgatccccc

SEQ ID NO: 78216 - DNA, 20 bp, Artificial
  CRISPR gRNA sequence
acctcaggtgatccccctgc

SEQ ID NO: 78217 - DNA, 20 bp, Artificial
  CRISPR gRNA sequence
aggtgatccccctgcctcag

SEQ ID NO: 78218 - DNA, 20 bp, Artificial
  CRISPR gRNA sequence
cctcagcctcccaaagtgct

SEQ ID NO: 78219 - DNA, 20 bp, Artificial
  CRISPR gRNA sequence
agcctcccaaagtgctgggt

SEQ ID NO: 78220 - DNA, 20 bp, Artificial
  CRISPR gRNA sequence
ccaaagtgctgggtttacag

SEQ ID NO: 78221 - DNA, 20 bp, Artificial
  CRISPR gRNA sequence
ggtttacagcatgagccaca

SEQ ID NO: 78222 - DNA, 20 bp, Artificial
  CRISPR gRNA sequence
acagcatgagccacagcacc

SEQ ID NO: 78223 - DNA, 20 bp, Artificial
  CRISPR gRNA sequence
cagcatgagccacagcacct

SEQ ID NO: 78224 - DNA, 20 bp, Artificial
  CRISPR gRNA sequence
gcccagattataccattctt

SEQ ID NO: 78225 - DNA, 20 bp, Artificial
  CRISPR gRNA sequence
taccattctttctgccattg

SEQ ID NO: 78226 - DNA, 20 bp, Artificial
  CRISPR gRNA sequence
tttctgccattgcatatctt

SEQ ID NO: 78227 - DNA, 20 bp, Artificial
  CRISPR gRNA sequence
tctgccattgcatatcttga

SEQ ID NO: 78228 - DNA, 20 bp, Artificial
  CRISPR gRNA sequence
ctgccattgcatatcttgaa

SEQ ID NO: 78229 - DNA, 20 bp, Artificial
  CRISPR gRNA sequence
tgccattgcatatcttgaaa

SEQ ID NO: 78230 - DNA, 20 bp, Artificial
  CRISPR gRNA sequence
ccattgcatatcttgaaaag

SEQ ID NO: 78231 - DNA, 20 bp, Artificial
  CRISPR gRNA sequence
catatcttgaaaagctttat

SEQ ID NO: 78232 - DNA, 20 bp, Artificial
  CRISPR gRNA sequence
gaaaagctttattataatct

SEQ ID NO: 78233 - DNA, 20 bp, Artificial
  CRISPR gRNA sequence
aaaagctttattataatctt

SEQ ID NO: 78234 - DNA, 20 bp, Artificial
  CRISPR gRNA sequence
tattataatcttttataatc

SEQ ID NO: 78235 - DNA, 20 bp, Artificial
  CRISPR gRNA sequence
attataatcttttataatct

SEQ ID NO: 78236 - DNA, 20 bp, Artificial
  CRISPR gRNA sequence
ttataatcttttataatctt

SEQ ID NO: 78237 - DNA, 20 bp, Artificial
  CRISPR gRNA sequence
taatcttttataatctttta

SEQ ID NO: 78238 - DNA, 20 bp, Artificial
  CRISPR gRNA sequence
ttataatcttttaagataat

SEQ ID NO: 78239 - DNA, 20 bp, Artificial
  CRISPR gRNA sequence
tataatcttttaagataatg

SEQ ID NO: 78240 - DNA, 20 bp, Artificial
  CRISPR gRNA sequence
ataatcttttaagataatga

SEQ ID NO: 78241 - DNA, 20 bp, Artificial
  CRISPR gRNA sequence
taatcttttaagataatgag

SEQ ID NO: 78242 - DNA, 20 bp, Artificial
  CRISPR gRNA sequence
ttaagataatgagttaaaat

SEQ ID NO: 78243 - DNA, 20 bp, Artificial
  CRISPR gRNA sequence
taagataatgagttaaaatt

SEQ ID NO: 78244 - DNA, 20 bp, Artificial
  CRISPR gRNA sequence
aagataatgagttaaaattt

SEQ ID NO: 78245 - DNA, 20 bp, Artificial
  CRISPR gRNA sequence
agataatgagttaaaatttt

SEQ ID NO: 78246 - DNA, 20 bp, Artificial
  CRISPR gRNA sequence
aaatttttatgtttggcctg

SEQ ID NO: 78247 - DNA, 20 bp, Artificial
  CRISPR gRNA sequence
ttatgtttggcctggtgcag

SEQ ID NO: 78248 - DNA, 20 bp, Artificial
  CRISPR gRNA sequence
tatgtttggcctggtgcagt

SEQ ID NO: 78249 - DNA, 20 bp, Artificial
  CRISPR gRNA sequence
atgtttggcctggtgcagtg

SEQ ID NO: 78250 - DNA, 20 bp, Artificial
  CRISPR gRNA sequence
tgtttggcctggtgcagtgg

SEQ ID NO: 78251 - DNA, 20 bp, Artificial
  CRISPR gRNA sequence
ggcctggtgcagtggttcat

SEQ ID NO: 78252 - DNA, 20 bp, Artificial
  CRISPR gRNA sequence
gcctggtgcagtggttcata

SEQ ID NO: 78253 - DNA, 20 bp, Artificial
  CRISPR gRNA sequence
gtgcagtggttcatacctat

SEQ ID NO: 78254 - DNA, 20 bp, Artificial
  CRISPR gRNA sequence
atacctataatccttgctct

SEQ ID NO: 78255 - DNA, 20 bp, Artificial
  CRISPR gRNA sequence
taatccttgctctttgggag

SEQ ID NO: 78256 - DNA, 20 bp, Artificial
  CRISPR gRNA sequence
gctctttgggaggccagggc

SEQ ID NO: 78257 - DNA, 20 bp, Artificial
  CRISPR gRNA sequence
ctctttgggaggccagggca

SEQ ID NO: 78258 - DNA, 20 bp, Artificial
  CRISPR gRNA sequence
tttgggaggccagggcagga

SEQ ID NO: 78259 - DNA, 20 bp, Artificial
  CRISPR gRNA sequence
tgggaggccagggcaggagg

SEQ ID NO: 78260 - DNA, 20 bp, Artificial
  CRISPR gRNA sequence
gggaggccagggcaggagga

SEQ ID NO: 78261 - DNA, 20 bp, Artificial
  CRISPR gRNA sequence
ggaggccagggcaggaggat

SEQ ID NO: 78262 - DNA, 20 bp, Artificial
  CRISPR gRNA sequence
gggagtttgagaacagcctg

SEQ ID NO: 78263 - DNA, 20 bp, Artificial
  CRISPR gRNA sequence
gagaacagcctggtcaatat

SEQ ID NO: 78264 - DNA, 20 bp, Artificial
  CRISPR gRNA sequence
agaacagcctggtcaatata

SEQ ID NO: 78265 - DNA, 20 bp, Artificial
  CRISPR gRNA sequence
gtcaatatagcaagaccctc

SEQ ID NO: 78266 - DNA, 20 bp, Artificial
  CRISPR gRNA sequence
tctctactaaaaataaaaaa

SEQ ID NO: 78267 - DNA, 20 bp, Artificial
  CRISPR gRNA sequence
tctactaaaaataaaaaaaa

SEQ ID NO: 78268 - DNA, 20 bp, Artificial
  CRISPR gRNA sequence
tactaaaaataaaaaaaatt

SEQ ID NO: 78269 - DNA, 20 bp, Artificial
  CRISPR gRNA sequence
ctaaaaataaaaaaaattgc

SEQ ID NO: 78270 - DNA, 20 bp, Artificial
  CRISPR gRNA sequence
aaaataaaaaaaattgccag

SEQ ID NO: 78271 - DNA, 20 bp, Artificial
  CRISPR gRNA sequence
ccaggcatagtgactcatga

SEQ ID NO: 78272 - DNA, 20 bp, Artificial
  CRISPR gRNA sequence
atgactgtaatcccagcact

SEQ ID NO: 78273 - DNA, 20 bp, Artificial
  CRISPR gRNA sequence
taatcccagcactttgggag

SEQ ID NO: 78274 - DNA, 20 bp, Artificial
  CRISPR gRNA sequence
tgggagactaagagagatgg

SEQ ID NO: 78275 - DNA, 20 bp, Artificial
  CRISPR gRNA sequence
gggagactaagagagatgga

SEQ ID NO: 78276 - DNA, 20 bp, Artificial
  CRISPR gRNA sequence
ggagactaagagagatggat

SEQ ID NO: 78277 - DNA, 20 bp, Artificial
  CRISPR gRNA sequence
agagagatggattgctgagc

SEQ ID NO: 78278 - DNA, 20 bp, Artificial
  CRISPR gRNA sequence
ctgagcccaggatttggagg

SEQ ID NO: 78279 - DNA, 20 bp, Artificial
  CRISPR gRNA sequence
agcccaggatttggaggtta

SEQ ID NO: 78280 - DNA, 20 bp, Artificial
  CRISPR gRNA sequence
ggaggttacagtgagctgtg

SEQ ID NO: 78281 - DNA, 20 bp, Artificial
  CRISPR gRNA sequence
gaggttacagtgagctgtga

SEQ ID NO: 78282 - DNA, 20 bp, Artificial
  CRISPR gRNA sequence
cagtgagctgtgattgtgtc

SEQ ID NO: 78283 - DNA, 20 bp, Artificial
  CRISPR gRNA sequence
tgattgtgtcactgtactcc

SEQ ID NO: 78284 - DNA, 20 bp, Artificial
  CRISPR gRNA sequence
tgtcactgtactccagcctt

SEQ ID NO: 78285 - DNA, 20 bp, Artificial
  CRISPR gRNA sequence
tactccagccttggtaacag

SEQ ID NO: 78286 - DNA, 20 bp, Artificial
  CRISPR gRNA sequence
cagccttggtaacagagcaa

SEQ ID NO: 78287 - DNA, 20 bp, Artificial
  CRISPR gRNA sequence
ggtaacagagcaagatcctg

SEQ ID NO: 78288 - DNA, 20 bp, Artificial
  CRISPR gRNA sequence
gtaacagagcaagatcctgt

SEQ ID NO: 78289 - DNA, 20 bp, Artificial
  CRISPR gRNA sequence
tctctaaagaaatttcttta

SEQ ID NO: 78290 - DNA, 20 bp, Artificial
  CRISPR gRNA sequence
taaagaaatttctttatgtt

SEQ ID NO: 78291 - DNA, 20 bp, Artificial
  CRISPR gRNA sequence
aagaaatttctttatgttta

SEQ ID NO: 78292 - DNA, 20 bp, Artificial
  CRISPR gRNA sequence
ctttatgtttacttaataac

SEQ ID NO: 78293 - DNA, 20 bp, Artificial
  CRISPR gRNA sequence
tttatgtttacttaataact

SEQ ID NO: 78294 - DNA, 20 bp, Artificial
  CRISPR gRNA sequence
tatgtttacttaataactcc

SEQ ID NO: 78295 - DNA, 20 bp, Artificial
  CRISPR gRNA sequence
atgtttacttaataactccc

SEQ ID NO: 78296 - DNA, 20 bp, Artificial
  CRISPR gRNA sequence
tgtttacttaataactcccc

SEQ ID NO: 78297 - DNA, 20 bp, Artificial
  CRISPR gRNA sequence
acttaataactccccgtcac

SEQ ID NO: 78298 - DNA, 20 bp, Artificial
  CRISPR gRNA sequence
cttaataactccccgtcacc

SEQ ID NO: 78299 - DNA, 20 bp, Artificial
  CRISPR gRNA sequence
aataactccccgtcacccct

SEQ ID NO: 78300 - DNA, 20 bp, Artificial
  CRISPR gRNA sequence
ataactccccgtcacccctc

SEQ ID NO: 78301 - DNA, 20 bp, Artificial
  CRISPR gRNA sequence
cccgtcacccctccatattg

SEQ ID NO: 78302 - DNA, 20 bp, Artificial
  CRISPR gRNA sequence
catattgaaactgcacctat

SEQ ID NO: 78303 - DNA, 20 bp, Artificial
  CRISPR gRNA sequence
aaactgcacctatattatca

SEQ ID NO: 78304 - DNA, 20 bp, Artificial
  CRISPR gRNA sequence
cacctatattatcatttttt

SEQ ID NO: 78305 - DNA, 20 bp, Artificial
  CRISPR gRNA sequence
tattatcatttttttttcta

SEQ ID NO: 78306 - DNA, 20 bp, Artificial
  CRISPR gRNA sequence
tcatttttttttctatggtt

SEQ ID NO: 78307 - DNA, 20 bp, Artificial
  CRISPR gRNA sequence
ttttttctatggttccactg

SEQ ID NO: 78308 - DNA, 20 bp, Artificial
  CRISPR gRNA sequence
tttttctatggttccactga

SEQ ID NO: 78309 - DNA, 20 bp, Artificial
  CRISPR gRNA sequence
ttttctatggttccactgag

SEQ ID NO: 78310 - DNA, 20 bp, Artificial
  CRISPR gRNA sequence
tttctatggttccactgagt

SEQ ID NO: 78311 - DNA, 20 bp, Artificial
  CRISPR gRNA sequence
ttctatggttccactgagtt

SEQ ID NO: 78312 - DNA, 20 bp, Artificial
  CRISPR gRNA sequence
tctatggttccactgagttc

SEQ ID NO: 78313 - DNA, 20 bp, Artificial
  CRISPR gRNA sequence
ctatggttccactgagttct

SEQ ID NO: 78314 - DNA, 20 bp, Artificial
  CRISPR gRNA sequence
tatggttccactgagttctc

SEQ ID NO: 78315 - DNA, 20 bp, Artificial
  CRISPR gRNA sequence
tggttccactgagttctctc

SEQ ID NO: 78316 - DNA, 20 bp, Artificial
  CRISPR gRNA sequence
cactgagttctctctggaag

SEQ ID NO: 78317 - DNA, 20 bp, Artificial
  CRISPR gRNA sequence
agttctctctggaagtaact

SEQ ID NO: 78318 - DNA, 20 bp, Artificial
  CRISPR gRNA sequence
tctctggaagtaacttagtc

SEQ ID NO: 78319 - DNA, 20 bp, Artificial
  CRISPR gRNA sequence
tctggaagtaacttagtcta

SEQ ID NO: 78320 - DNA, 20 bp, Artificial
  CRISPR gRNA sequence
tggaagtaacttagtctaac

SEQ ID NO: 78321 - DNA, 20 bp, Artificial
  CRISPR gRNA sequence
gaagtaacttagtctaacta

SEQ ID NO: 78322 - DNA, 20 bp, Artificial
  CRISPR gRNA sequence
agtctaactaatatccctcg

SEQ ID NO: 78323 - DNA, 20 bp, Artificial
  CRISPR gRNA sequence
gtctaactaatatccctcgg

SEQ ID NO: 78324 - DNA, 20 bp, Artificial
  CRISPR gRNA sequence
actaatatccctcggttaaa

SEQ ID NO: 78325 - DNA, 20 bp, Artificial
  CRISPR gRNA sequence
atatccctcggttaaacatt

SEQ ID NO: 78326 - DNA, 20 bp, Artificial
  CRISPR gRNA sequence
ggttaaacattccagctatt

SEQ ID NO: 78327 - DNA, 20 bp, Artificial
  CRISPR gRNA sequence
aacattccagctattttctt

SEQ ID NO: 78328 - DNA, 20 bp, Artificial
  CRISPR gRNA sequence
cagctattttcttttttttt

SEQ ID NO: 78329 - DNA, 20 bp, Artificial
  CRISPR gRNA sequence
ttttctttttttttcctatt

SEQ ID NO: 78330 - DNA, 20 bp, Artificial
  CRISPR gRNA sequence
tctttttttttcctattata

SEQ ID NO: 78331 - DNA, 20 bp, Artificial
  CRISPR gRNA sequence
ctttttttttcctattataa

SEQ ID NO: 78332 - DNA, 20 bp, Artificial
  CRISPR gRNA sequence
tttttttttcctattataac

SEQ ID NO: 78333 - DNA, 20 bp, Artificial
  CRISPR gRNA sequence
tttttttcctattataacca

SEQ ID NO: 78334 - DNA, 20 bp, Artificial
  CRISPR gRNA sequence
ttttttcctattataaccaa

SEQ ID NO: 78335 - DNA, 20 bp, Artificial
  CRISPR gRNA sequence
tttttcctattataaccaat

SEQ ID NO: 78336 - DNA, 20 bp, Artificial
  CRISPR gRNA sequence
ttttcctattataaccaata

SEQ ID NO: 78337 - DNA, 20 bp, Artificial
  CRISPR gRNA sequence
tttcctattataaccaatac

SEQ ID NO: 78338 - DNA, 20 bp, Artificial
  CRISPR gRNA sequence
ttcctattataaccaatact

SEQ ID NO: 78339 - DNA, 20 bp, Artificial
  CRISPR gRNA sequence
tcctattataaccaatactg

SEQ ID NO: 78340 - DNA, 20 bp, Artificial
  CRISPR gRNA sequence
cctattataaccaatactga

SEQ ID NO: 78341 - DNA, 20 bp, Artificial
  CRISPR gRNA sequence
ctattataaccaatactgag

SEQ ID NO: 78342 - DNA, 20 bp, Artificial
  CRISPR gRNA sequence
ttataaccaatactgaggtg

SEQ ID NO: 78343 - DNA, 20 bp, Artificial
  CRISPR gRNA sequence
taaccaatactgaggtgaac

SEQ ID NO: 78344 - DNA, 20 bp, Artificial
  CRISPR gRNA sequence
aggtgaacatccctacagct

SEQ ID NO: 78345 - DNA, 20 bp, Artificial
  CRISPR gRNA sequence
cagctaaatgtgtttgcaca

SEQ ID NO: 78346 - DNA, 20 bp, Artificial
  CRISPR gRNA sequence
aatgtgtttgcacaatcgtg

SEQ ID NO: 78347 - DNA, 20 bp, Artificial
  CRISPR gRNA sequence
gcacaatcgtgataatttat

SEQ ID NO: 78348 - DNA, 20 bp, Artificial
  CRISPR gRNA sequence
cacaatcgtgataatttatt

SEQ ID NO: 78349 - DNA, 20 bp, Artificial
  CRISPR gRNA sequence
atttagtataagttcctgga

SEQ ID NO: 78350 - DNA, 20 bp, Artificial
  CRISPR gRNA sequence
tttagtataagttcctggaa

SEQ ID NO: 78351 - DNA, 20 bp, Artificial
  CRISPR gRNA sequence
agtataagttcctggaagtg

SEQ ID NO: 78352 - DNA, 20 bp, Artificial
  CRISPR gRNA sequence
gtataagttcctggaagtga

SEQ ID NO: 78353 - DNA, 20 bp, Artificial
  CRISPR gRNA sequence
ctggaagtgaacagggcatc

SEQ ID NO: 78354 - DNA, 20 bp, Artificial
  CRISPR gRNA sequence
gaagtgaacagggcatcgct

SEQ ID NO: 78355 - DNA, 20 bp, Artificial
  CRISPR gRNA sequence
ggaatgcactagggaccctt

SEQ ID NO: 78356 - DNA, 20 bp, Artificial
  CRISPR gRNA sequence
gaatgcactagggacccttt

SEQ ID NO: 78357 - DNA, 20 bp, Artificial
  CRISPR gRNA sequence
gggaccctttattgaatcat

SEQ ID NO: 78358 - DNA, 20 bp, Artificial
  CRISPR gRNA sequence
tattgaatcatcatatacag

SEQ ID NO: 78359 - DNA, 20 bp, Artificial
  CRISPR gRNA sequence
attgaatcatcatatacagt

SEQ ID NO: 78360 - DNA, 20 bp, Artificial
  CRISPR gRNA sequence
ttgaatcatcatatacagtg

SEQ ID NO: 78361 - DNA, 20 bp, Artificial
  CRISPR gRNA sequence
aatcatcatatacagtgaac

SEQ ID NO: 78362 - DNA, 20 bp, Artificial
  CRISPR gRNA sequence
atctaccttttgggtgaatc

SEQ ID NO: 78363 - DNA, 20 bp, Artificial
  CRISPR gRNA sequence
ccttttgggtgaatcggttt

SEQ ID NO: 78364 - DNA, 20 bp, Artificial
  CRISPR gRNA sequence
ttgggtgaatcggtttccct

SEQ ID NO: 78365 - DNA, 20 bp, Artificial
  CRISPR gRNA sequence
tgggtgaatcggtttccctc

SEQ ID NO: 78366 - DNA, 20 bp, Artificial
  CRISPR gRNA sequence
gggtgaatcggtttccctct

SEQ ID NO: 78367 - DNA, 20 bp, Artificial
  CRISPR gRNA sequence
ggtgaatcggtttccctctc

SEQ ID NO: 78368 - DNA, 20 bp, Artificial
  CRISPR gRNA sequence
ccctctcctcccttgagggg

SEQ ID NO: 78369 - DNA, 20 bp, Artificial
  CRISPR gRNA sequence
cctctcctcccttgaggggt

SEQ ID NO: 78370 - DNA, 20 bp, Artificial
  CRISPR gRNA sequence
tcctcccttgaggggtgttt

SEQ ID NO: 78371 - DNA, 20 bp, Artificial
  CRISPR gRNA sequence
ctcccttgaggggtgtttaa

SEQ ID NO: 78372 - DNA, 20 bp, Artificial
  CRISPR gRNA sequence
ccttgaggggtgtttaaagc

SEQ ID NO: 78373 - DNA, 20 bp, Artificial
  CRISPR gRNA sequence
gaggggtgtttaaagcaggg

SEQ ID NO: 78374 - DNA, 20 bp, Artificial
  CRISPR gRNA sequence
aggggtgtttaaagcaggga

SEQ ID NO: 78375 - DNA, 20 bp, Artificial
  CRISPR gRNA sequence
aaagcagggaccaccctact

SEQ ID NO: 78376 - DNA, 20 bp, Artificial
  CRISPR gRNA sequence
aagcagggaccaccctactg

SEQ ID NO: 78377 - DNA, 20 bp, Artificial
  CRISPR gRNA sequence
ctgggttgagaatgaggctt

SEQ ID NO: 78378 - DNA, 20 bp, Artificial
  CRISPR gRNA sequence
ggttgagaatgaggctttcc

SEQ ID NO: 78379 - DNA, 20 bp, Artificial
  CRISPR gRNA sequence
agaatgaggctttcctccga

SEQ ID NO: 78380 - DNA, 20 bp, Artificial
  CRISPR gRNA sequence
tcctccgagtgggaactgag

SEQ ID NO: 78381 - DNA, 20 bp, Artificial
  CRISPR gRNA sequence
cctccgagtgggaactgagt

SEQ ID NO: 78382 - DNA, 20 bp, Artificial
  CRISPR gRNA sequence
ctccgagtgggaactgagtt

SEQ ID NO: 78383 - DNA, 20 bp, Artificial
  CRISPR gRNA sequence
cgagtgggaactgagttgac

SEQ ID NO: 78384 - DNA, 20 bp, Artificial
  CRISPR gRNA sequence
agttgacattaatcatcatc

SEQ ID NO: 78385 - DNA, 20 bp, Artificial
  CRISPR gRNA sequence
acattaatcatcatctgtcc

SEQ ID NO: 78386 - DNA, 20 bp, Artificial
  CRISPR gRNA sequence
atcatcatctgtcctcacct

SEQ ID NO: 78387 - DNA, 20 bp, Artificial
  CRISPR gRNA sequence
tcctcacctccccatactca

SEQ ID NO: 78388 - DNA, 20 bp, Artificial
  CRISPR gRNA sequence
acctccccatactcaacggc

SEQ ID NO: 78389 - DNA, 20 bp, Artificial
  CRISPR gRNA sequence
cccatactcaacggcgagac

SEQ ID NO: 78390 - DNA, 20 bp, Artificial
  CRISPR gRNA sequence
aacggcgagacttacagaaa

SEQ ID NO: 78391 - DNA, 20 bp, Artificial
  CRISPR gRNA sequence
acagaaataggattgggttc

SEQ ID NO: 78392 - DNA, 20 bp, Artificial
  CRISPR gRNA sequence
cagaaataggattgggttcc

SEQ ID NO: 78393 - DNA, 20 bp, Artificial
  CRISPR gRNA sequence
ggttccctagtggcagagcc

SEQ ID NO: 78394 - DNA, 20 bp, Artificial
  CRISPR gRNA sequence
cctagtggcagagcctgggt

SEQ ID NO: 78395 - DNA, 20 bp, Artificial
  CRISPR gRNA sequence
gtggcagagcctgggtctgt

SEQ ID NO: 78396 - DNA, 20 bp, Artificial
  CRISPR gRNA sequence
ggtctgtgagtggggtaggg

SEQ ID NO: 78397 - DNA, 20 bp, Artificial
  CRISPR gRNA sequence
tgagtggggtagggggtcgc

SEQ ID NO: 78398 - DNA, 20 bp, Artificial
  CRISPR gRNA sequence
gtcagttgcgcacatcatga

SEQ ID NO: 78399 - DNA, 20 bp, Artificial
  CRISPR gRNA sequence
tcagttgcgcacatcatgaa

SEQ ID NO: 78400 - DNA, 20 bp, Artificial
  CRISPR gRNA sequence
cgcacatcatgaactgacgg

SEQ ID NO: 78401 - DNA, 20 bp, Artificial
  CRISPR gRNA sequence
acggtctgctctcaggagaa

SEQ ID NO: 78402 - DNA, 20 bp, Artificial
  CRISPR gRNA sequence
ctctcaggagaaacagtaag

SEQ ID NO: 78403 - DNA, 20 bp, Artificial
  CRISPR gRNA sequence
tcaggagaaacagtaaggga

SEQ ID NO: 78404 - DNA, 20 bp, Artificial
  CRISPR gRNA sequence
aggagaaacagtaagggact

SEQ ID NO: 78405 - DNA, 20 bp, Artificial
  CRISPR gRNA sequence
agggaagccaaacggagcaa

SEQ ID NO: 78406 - DNA, 20 bp, Artificial
  CRISPR gRNA sequence
ggcctagtctcccagggagc

SEQ ID NO: 78407 - DNA, 20 bp, Artificial
  CRISPR gRNA sequence
gcctagtctcccagggagct

SEQ ID NO: 78408 - DNA, 20 bp, Artificial
  CRISPR gRNA sequence
gtctcccagggagctttgtc

SEQ ID NO: 78409 - DNA, 20 bp, Artificial
  CRISPR gRNA sequence
ccagggagctttgtcccact

SEQ ID NO: 78410 - DNA, 20 bp, Artificial
  CRISPR gRNA sequence
tgtcccactggagagtttgg

SEQ ID NO: 78411 - DNA, 20 bp, Artificial
  CRISPR gRNA sequence
gtcccactggagagtttggg

SEQ ID NO: 78412 - DNA, 20 bp, Artificial
  CRISPR gRNA sequence
tcccactggagagtttgggc

SEQ ID NO: 78413 - DNA, 20 bp, Artificial
  CRISPR gRNA sequence
gagagtttgggctggagagt

SEQ ID NO: 78414 - DNA, 20 bp, Artificial
  CRISPR gRNA sequence
gggctggagagttgtgccct

SEQ ID NO: 78415 - DNA, 20 bp, Artificial
  CRISPR gRNA sequence
ggctggagagttgtgccctc

SEQ ID NO: 78416 - DNA, 20 bp, Artificial
  CRISPR gRNA sequence
gagagttgtgccctctgcct

SEQ ID NO: 78417 - DNA, 20 bp, Artificial
  CRISPR gRNA sequence
tgccctctgcctctgtcatt

SEQ ID NO: 78418 - DNA, 20 bp, Artificial
  CRISPR gRNA sequence
tgcctctgtcattggccact

SEQ ID NO: 78419 - DNA, 20 bp, Artificial
  CRISPR gRNA sequence
cctctgtcattggccactct

SEQ ID NO: 78420 - DNA, 20 bp, Artificial
  CRISPR gRNA sequence
tgtcattggccactctaggt

SEQ ID NO: 78421 - DNA, 20 bp, Artificial
  CRISPR gRNA sequence
tcattggccactctaggtta

SEQ ID NO: 78422 - DNA, 20 bp, Artificial
  CRISPR gRNA sequence
gccactctaggttaggggaa

SEQ ID NO: 78423 - DNA, 20 bp, Artificial
  CRISPR gRNA sequence
taggttaggggaaagtgggg

SEQ ID NO: 78424 - DNA, 20 bp, Artificial
  CRISPR gRNA sequence
ggttaggggaaagtgggggt

SEQ ID NO: 78425 - DNA, 20 bp, Artificial
  CRISPR gRNA sequence
ggggaaagtgggggttgtac

SEQ ID NO: 78426 - DNA, 20 bp, Artificial
  CRISPR gRNA sequence
taccctgccaggcgtctctg

SEQ ID NO: 78427 - DNA, 20 bp, Artificial
  CRISPR gRNA sequence
ccaggcgtctctggttctta

SEQ ID NO: 78428 - DNA, 20 bp, Artificial
  CRISPR gRNA sequence
tggttcttatcagccaaggg

SEQ ID NO: 78429 - DNA, 20 bp, Artificial
  CRISPR gRNA sequence
gttcttatcagccaagggta

SEQ ID NO: 78430 - DNA, 20 bp, Artificial
  CRISPR gRNA sequence
ttatcagccaagggtagttc

SEQ ID NO: 78431 - DNA, 20 bp, Artificial
  CRISPR gRNA sequence
atcagccaagggtagttctc

SEQ ID NO: 78432 - DNA, 20 bp, Artificial
  CRISPR gRNA sequence
tcagccaagggtagttctcc

SEQ ID NO: 78433 - DNA, 20 bp, Artificial
  CRISPR gRNA sequence
tccagaggtataaaccatga

SEQ ID NO: 78434 - DNA, 20 bp, Artificial
  CRISPR gRNA sequence
cagaggtataaaccatgagc

SEQ ID NO: 78435 - DNA, 20 bp, Artificial
  CRISPR gRNA sequence
tatccacagcagctaggaag

SEQ ID NO: 78436 - DNA, 20 bp, Artificial
  CRISPR gRNA sequence
ggaagaggggtgccggctgt

SEQ ID NO: 78437 - DNA, 20 bp, Artificial
  CRISPR gRNA sequence
taacggggtctgggtgggac

SEQ ID NO: 78438 - DNA, 20 bp, Artificial
  CRISPR gRNA sequence
ggtgggacagcagcagcatc

SEQ ID NO: 78439 - DNA, 20 bp, Artificial
  CRISPR gRNA sequence
ctgcccgtcccaaggcctgg

SEQ ID NO: 78440 - DNA, 20 bp, Artificial
  CRISPR gRNA sequence
tgcccgtcccaaggcctggg

SEQ ID NO: 78441 - DNA, 20 bp, Artificial
  CRISPR gRNA sequence
cccgtcccaaggcctgggcc

SEQ ID NO: 78442 - DNA, 20 bp, Artificial
  CRISPR gRNA sequence
ggcccagaaggaattccaag

SEQ ID NO: 78443 - DNA, 20 bp, Artificial
  CRISPR gRNA sequence
caagggcttcagagagagca

SEQ ID NO: 78444 - DNA, 20 bp, Artificial
  CRISPR gRNA sequence
cagagagagcatgatggggg

SEQ ID NO: 78445 - DNA, 20 bp, Artificial
  CRISPR gRNA sequence
agagagagcatgatgggggg

SEQ ID NO: 78446 - DNA, 20 bp, Artificial
  CRISPR gRNA sequence
agggagctcccacctgatgt

SEQ ID NO: 78447 - DNA, 20 bp, Artificial
  CRISPR gRNA sequence
ccacctgatgtgcagctctg

SEQ ID NO: 78448 - DNA, 20 bp, Artificial
  CRISPR gRNA sequence
atgtgcagctctgccagggt

SEQ ID NO: 78449 - DNA, 20 bp, Artificial
  CRISPR gRNA sequence
tgccagggtccagcacgcac

SEQ ID NO: 78450 - DNA, 20 bp, Artificial
  CRISPR gRNA sequence
ccagggtccagcacgcactc

SEQ ID NO: 78451 - DNA, 20 bp, Artificial
  CRISPR gRNA sequence
acggccctcagcacacaatg

SEQ ID NO: 78452 - DNA, 20 bp, Artificial
  CRISPR gRNA sequence
agcacacaatgcaccccggc

SEQ ID NO: 78453 - DNA, 20 bp, Artificial
  CRISPR gRNA sequence
ttactgaggctgtggagagc

SEQ ID NO: 78454 - DNA, 20 bp, Artificial
  CRISPR gRNA sequence
ctgaggctgtggagagcagg

SEQ ID NO: 78455 - DNA, 20 bp, Artificial
  CRISPR gRNA sequence
aggctgtggagagcaggaga

SEQ ID NO: 78456 - DNA, 20 bp, Artificial
  CRISPR gRNA sequence
tggagagcaggagaaggcag

SEQ ID NO: 78457 - DNA, 20 bp, Artificial
  CRISPR gRNA sequence
gcatgtggctgaggtaccca

SEQ ID NO: 78458 - DNA, 20 bp, Artificial
  CRISPR gRNA sequence
aggtacccagccccagccag

SEQ ID NO: 78459 - DNA, 20 bp, Artificial
  CRISPR gRNA sequence
tagcccctccctgtggctca

SEQ ID NO: 78460 - DNA, 20 bp, Artificial
  CRISPR gRNA sequence
gcccctccctgtggctcagc

SEQ ID NO: 78461 - DNA, 20 bp, Artificial
  CRISPR gRNA sequence
cctgtggctcagcagcttgc

SEQ ID NO: 78462 - DNA, 20 bp, Artificial
  CRISPR gRNA sequence
tggctcagcagcttgctggc

SEQ ID NO: 78463 - DNA, 20 bp, Artificial
  CRISPR gRNA sequence
agcagcttgctggctgtcac

SEQ ID NO: 78464 - DNA, 20 bp, Artificial
  CRISPR gRNA sequence
gctggctgtcactcctggat

SEQ ID NO: 78465 - DNA, 20 bp, Artificial
  CRISPR gRNA sequence
ctggctgtcactcctggatg

SEQ ID NO: 78466 - DNA, 20 bp, Artificial
  CRISPR gRNA sequence
gctgtcactcctggatgtcc

SEQ ID NO: 78467 - DNA, 20 bp, Artificial
  CRISPR gRNA sequence
tcactcctggatgtcctagg

SEQ ID NO: 78468 - DNA, 20 bp, Artificial
  CRISPR gRNA sequence
ctggatgtcctaggtccctt

SEQ ID NO: 78469 - DNA, 20 bp, Artificial
  CRISPR gRNA sequence
gatgtcctaggtcccttgcc

SEQ ID NO: 78470 - DNA, 20 bp, Artificial
  CRISPR gRNA sequence
ggtcccttgccaggggatct

SEQ ID NO: 78471 - DNA, 20 bp, Artificial
  CRISPR gRNA sequence
gccaggggatctcaaaggat

SEQ ID NO: 78472 - DNA, 20 bp, Artificial
  CRISPR gRNA sequence
ccaggggatctcaaaggatt

SEQ ID NO: 78473 - DNA, 20 bp, Artificial
  CRISPR gRNA sequence
aaaggattctggtgcgtgtg

SEQ ID NO: 78474 - DNA, 20 bp, Artificial
  CRISPR gRNA sequence
tggtgcgtgtgagtaagcca

SEQ ID NO: 78475 - DNA, 20 bp, Artificial
  CRISPR gRNA sequence
gtgcgtgtgagtaagccaaa

SEQ ID NO: 78476 - DNA, 20 bp, Artificial
  CRISPR gRNA sequence
ggaaaataaagttgtccagc

SEQ ID NO: 78477 - DNA, 20 bp, Artificial
  CRISPR gRNA sequence
gaaaataaagttgtccagct

SEQ ID NO: 78478 - DNA, 20 bp, Artificial
  CRISPR gRNA sequence
tccagcttgacagcaagaac

SEQ ID NO: 78479 - DNA, 20 bp, Artificial
  CRISPR gRNA sequence
gacagcaagaactcagtgtt

SEQ ID NO: 78480 - DNA, 20 bp, Artificial
  CRISPR gRNA sequence
acagcaagaactcagtgttt

SEQ ID NO: 78481 - DNA, 20 bp, Artificial
  CRISPR gRNA sequence
agtgttttcacctctctgac

SEQ ID NO: 78482 - DNA, 20 bp, Artificial
  CRISPR gRNA sequence
tcacctctctgacccccagt

SEQ ID NO: 78483 - DNA, 20 bp, Artificial
  CRISPR gRNA sequence
cacctctctgacccccagtt

SEQ ID NO: 78484 - DNA, 20 bp, Artificial
  CRISPR gRNA sequence
acctctctgacccccagttt

SEQ ID NO: 78485 - DNA, 20 bp, Artificial
  CRISPR gRNA sequence
tctgacccccagttttctca

SEQ ID NO: 78486 - DNA, 20 bp, Artificial
  CRISPR gRNA sequence
tgacccccagttttctcatc

SEQ ID NO: 78487 - DNA, 20 bp, Artificial
  CRISPR gRNA sequence
acccccagttttctcatctg

SEQ ID NO: 78488 - DNA, 20 bp, Artificial
  CRISPR gRNA sequence
tctcatctgtaaaataacca

SEQ ID NO: 78489 - DNA, 20 bp, Artificial
  CRISPR gRNA sequence
ctcatctgtaaaataaccac

SEQ ID NO: 78490 - DNA, 20 bp, Artificial
  CRISPR gRNA sequence
tcatctgtaaaataaccacc

SEQ ID NO: 78491 - DNA, 20 bp, Artificial
  CRISPR gRNA sequence
atctgtaaaataaccaccat

SEQ ID NO: 78492 - DNA, 20 bp, Artificial
  CRISPR gRNA sequence
taaaataaccaccattttct

SEQ ID NO: 78493 - DNA, 20 bp, Artificial
  CRISPR gRNA sequence
tctgagccctgactatacca

SEQ ID NO: 78494 - DNA, 20 bp, Artificial
  CRISPR gRNA sequence
ctgagccctgactataccag

SEQ ID NO: 78495 - DNA, 20 bp, Artificial
  CRISPR gRNA sequence
tgagccctgactataccaga

SEQ ID NO: 78496 - DNA, 20 bp, Artificial
  CRISPR gRNA sequence
agccctgactataccagact

SEQ ID NO: 78497 - DNA, 20 bp, Artificial
  CRISPR gRNA sequence
actataccagactctgtaca

SEQ ID NO: 78498 - DNA, 20 bp, Artificial
  CRISPR gRNA sequence
taccagactctgtacaaaag

SEQ ID NO: 78499 - DNA, 20 bp, Artificial
  CRISPR gRNA sequence
tgtacaaaaggctttgtaca

SEQ ID NO: 78500 - DNA, 20 bp, Artificial
  CRISPR gRNA sequence
tacaaaaggctttgtacata

SEQ ID NO: 78501 - DNA, 20 bp, Artificial
  CRISPR gRNA sequence
tgtacatatatggtttcatg

SEQ ID NO: 78502 - DNA, 20 bp, Artificial
  CRISPR gRNA sequence
gtacatatatggtttcatgt

SEQ ID NO: 78503 - DNA, 20 bp, Artificial
  CRISPR gRNA sequence
tacatatatggtttcatgtg

SEQ ID NO: 78504 - DNA, 20 bp, Artificial
  CRISPR gRNA sequence
catgtgatcccattttacag

SEQ ID NO: 78505 - DNA, 20 bp, Artificial
  CRISPR gRNA sequence
atgtgatcccattttacaga

SEQ ID NO: 78506 - DNA, 20 bp, Artificial
  CRISPR gRNA sequence
tacagaggggaaaccgaggc

SEQ ID NO: 78507 - DNA, 20 bp, Artificial
  CRISPR gRNA sequence
acagaggggaaaccgaggcc

SEQ ID NO: 78508 - DNA, 20 bp, Artificial
  CRISPR gRNA sequence
cagaggggaaaccgaggccc

SEQ ID NO: 78509 - DNA, 20 bp, Artificial
  CRISPR gRNA sequence
aattactttcccaggttcac

SEQ ID NO: 78510 - DNA, 20 bp, Artificial
  CRISPR gRNA sequence
ctttcccaggttcacaatgc

SEQ ID NO: 78511 - DNA, 20 bp, Artificial
  CRISPR gRNA sequence
tcccaggttcacaatgctac

SEQ ID NO: 78512 - DNA, 20 bp, Artificial
  CRISPR gRNA sequence
cccaggttcacaatgctact

SEQ ID NO: 78513 - DNA, 20 bp, Artificial
  CRISPR gRNA sequence
ccaggttcacaatgctacta

SEQ ID NO: 78514 - DNA, 20 bp, Artificial
  CRISPR gRNA sequence
acaatgctactaagtgacag

SEQ ID NO: 78515 - DNA, 20 bp, Artificial
  CRISPR gRNA sequence
ctaagtgacagagcgaagat

SEQ ID NO: 78516 - DNA, 20 bp, Artificial
  CRISPR gRNA sequence
agtgacagagcgaagattga

SEQ ID NO: 78517 - DNA, 20 bp, Artificial
  CRISPR gRNA sequence
aaatccaaagctgaggcccc

SEQ ID NO: 78518 - DNA, 20 bp, Artificial
  CRISPR gRNA sequence
aggccccaaaccactgctac

SEQ ID NO: 78519 - DNA, 20 bp, Artificial
  CRISPR gRNA sequence
ctacccaatctcaacactcc

SEQ ID NO: 78520 - DNA, 20 bp, Artificial
  CRISPR gRNA sequence
cccaatctcaacactcccca

SEQ ID NO: 78521 - DNA, 20 bp, Artificial
  CRISPR gRNA sequence
aacactccccaaacccgacc

SEQ ID NO: 78522 - DNA, 20 bp, Artificial
  CRISPR gRNA sequence
cccaaacccgacccacactt

SEQ ID NO: 78523 - DNA, 20 bp, Artificial
  CRISPR gRNA sequence
gatcctaagacccccaagac

SEQ ID NO: 78524 - DNA, 20 bp, Artificial
  CRISPR gRNA sequence
atcctaagacccccaagaca

SEQ ID NO: 78525 - DNA, 20 bp, Artificial
  CRISPR gRNA sequence
agacccccaagacaccccca

SEQ ID NO: 78526 - DNA, 20 bp, Artificial
  CRISPR gRNA sequence
accccatgcaacaccacagc

SEQ ID NO: 78527 - DNA, 20 bp, Artificial
  CRISPR gRNA sequence
atagcctacctttccatctc

SEQ ID NO: 78528 - DNA, 20 bp, Artificial
  CRISPR gRNA sequence
cctttccatctcaccacccc

SEQ ID NO: 78529 - DNA, 20 bp, Artificial
  CRISPR gRNA sequence
tccatctcaccacccctcac

SEQ ID NO: 78530 - DNA, 20 bp, Artificial
  CRISPR gRNA sequence
ccatctcaccacccctcacc

SEQ ID NO: 78531 - DNA, 20 bp, Artificial
  CRISPR gRNA sequence
catctcaccacccctcaccc

SEQ ID NO: 78532 - DNA, 20 bp, Artificial
  CRISPR gRNA sequence
accacccctcaccccaacag

SEQ ID NO: 78533 - DNA, 20 bp, Artificial
  CRISPR gRNA sequence
accccaacagtgtatcccca

SEQ ID NO: 78534 - DNA, 20 bp, Artificial
  CRISPR gRNA sequence
cctaccctagcaccccagca

SEQ ID NO: 78535 - DNA, 20 bp, Artificial
  CRISPR gRNA sequence
ccctagcaccccagcatgac

SEQ ID NO: 78536 - DNA, 20 bp, Artificial
  CRISPR gRNA sequence
gcaccccagcatgacacctc

SEQ ID NO: 78537 - DNA, 20 bp, Artificial
  CRISPR gRNA sequence
cacagtgcaacatcccaccc

SEQ ID NO: 78538 - DNA, 20 bp, Artificial
  CRISPR gRNA sequence
acacctccccagtgcaacac

SEQ ID NO: 78539 - DNA, 20 bp, Artificial
  CRISPR gRNA sequence
cccagtgcaacaccccaccc

SEQ ID NO: 78540 - DNA, 20 bp, Artificial
  CRISPR gRNA sequence
cagggcagctacaaagatga

SEQ ID NO: 78541 - DNA, 20 bp, Artificial
  CRISPR gRNA sequence
caaagatgaattggaatgca

SEQ ID NO: 78542 - DNA, 20 bp, Artificial
  CRISPR gRNA sequence
gaatgcaagccactgatgta

SEQ ID NO: 78543 - DNA, 20 bp, Artificial
  CRISPR gRNA sequence
atgtataatgaacgcatttt

SEQ ID NO: 78544 - DNA, 20 bp, Artificial
  CRISPR gRNA sequence
tacacatgtaagggtgctag

SEQ ID NO: 78545 - DNA, 20 bp, Artificial
  CRISPR gRNA sequence
acacatgtaagggtgctaga

SEQ ID NO: 78546 - DNA, 20 bp, Artificial
  CRISPR gRNA sequence
cacatgtaagggtgctagat

SEQ ID NO: 78547 - DNA, 20 bp, Artificial
  CRISPR gRNA sequence
gatgattggactaagacagt

SEQ ID NO: 78548 - DNA, 20 bp, Artificial
  CRISPR gRNA sequence
gactaagacagtggctcatg

SEQ ID NO: 78549 - DNA, 20 bp, Artificial
  CRISPR gRNA sequence
agacagtggctcatgccgga

SEQ ID NO: 78550 - DNA, 20 bp, Artificial
  CRISPR gRNA sequence
atgccggaggtgaaggcaag

SEQ ID NO: 78551 - DNA, 20 bp, Artificial
  CRISPR gRNA sequence
gactttgctggagttgggag

SEQ ID NO: 78552 - DNA, 20 bp, Artificial
  CRISPR gRNA sequence
actttgctggagttgggagg

SEQ ID NO: 78553 - DNA, 20 bp, Artificial
  CRISPR gRNA sequence
tgctggagttgggaggaagc

SEQ ID NO: 78554 - DNA, 20 bp, Artificial
  CRISPR gRNA sequence
gctggagttgggaggaagca

SEQ ID NO: 78555 - DNA, 20 bp, Artificial
  CRISPR gRNA sequence
ctggagttgggaggaagcag

SEQ ID NO: 78556 - DNA, 20 bp, Artificial
  CRISPR gRNA sequence
gagttgggaggaagcagggg

SEQ ID NO: 78557 - DNA, 20 bp, Artificial
  CRISPR gRNA sequence
ggaggaagcaggggtggcag

SEQ ID NO: 78558 - DNA, 20 bp, Artificial
  CRISPR gRNA sequence
actgctgattacgaacacgg

SEQ ID NO: 78559 - DNA, 20 bp, Artificial
  CRISPR gRNA sequence
ctgctgattacgaacacggg

SEQ ID NO: 78560 - DNA, 20 bp, Artificial
  CRISPR gRNA sequence
ctgattacgaacacggggac

SEQ ID NO: 78561 - DNA, 20 bp, Artificial
  CRISPR gRNA sequence
attacgaacacggggacctc

SEQ ID NO: 78562 - DNA, 20 bp, Artificial
  CRISPR gRNA sequence
cgaacacggggacctcctgg

SEQ ID NO: 78563 - DNA, 20 bp, Artificial
  CRISPR gRNA sequence
ctggggctctacagggcctt

SEQ ID NO: 78564 - DNA, 20 bp, Artificial
  CRISPR gRNA sequence
gggctctacagggccttccc

SEQ ID NO: 78565 - DNA, 20 bp, Artificial
  CRISPR gRNA sequence
tacagggccttccctggtac

SEQ ID NO: 78566 - DNA, 20 bp, Artificial
  CRISPR gRNA sequence
cagggccttccctggtaccc

SEQ ID NO: 78567 - DNA, 20 bp, Artificial
  CRISPR gRNA sequence
ccctggtacccagcggtggg

SEQ ID NO: 78568 - DNA, 20 bp, Artificial
  CRISPR gRNA sequence
cctggtacccagcggtgggg

SEQ ID NO: 78569 - DNA, 20 bp, Artificial
  CRISPR gRNA sequence
gtacccagcggtggggtgga

SEQ ID NO: 78570 - DNA, 20 bp, Artificial
  CRISPR gRNA sequence
actccagcttcctggcgatg

SEQ ID NO: 78571 - DNA, 20 bp, Artificial
  CRISPR gRNA sequence
cagcttcctggcgatgtgca

SEQ ID NO: 78572 - DNA, 20 bp, Artificial
  CRISPR gRNA sequence
cctggcgatgtgcagctggg

SEQ ID NO: 78573 - DNA, 20 bp, Artificial
  CRISPR gRNA sequence
ctggcgatgtgcagctggga

SEQ ID NO: 78574 - DNA, 20 bp, Artificial
  CRISPR gRNA sequence
gcgatgtgcagctgggatgc

SEQ ID NO: 78575 - DNA, 20 bp, Artificial
  CRISPR gRNA sequence
ggatgcagcctctgccatca

SEQ ID NO: 78576 - DNA, 20 bp, Artificial
  CRISPR gRNA sequence
tgccatcagccgacagcctt

SEQ ID NO: 78577 - DNA, 20 bp, Artificial
  CRISPR gRNA sequence
ccatcagccgacagccttca

SEQ ID NO: 78578 - DNA, 20 bp, Artificial
  CRISPR gRNA sequence
catcttccagctggttccct

SEQ ID NO: 78579 - DNA, 20 bp, Artificial
  CRISPR gRNA sequence
atcttccagctggttccctg

SEQ ID NO: 78580 - DNA, 20 bp, Artificial
  CRISPR gRNA sequence
ccagctggttccctgagagg

SEQ ID NO: 78581 - DNA, 20 bp, Artificial
  CRISPR gRNA sequence
cagctggttccctgagaggc

SEQ ID NO: 78582 - DNA, 20 bp, Artificial
  CRISPR gRNA sequence
gttccctgagaggctgagac

SEQ ID NO: 78583 - DNA, 20 bp, Artificial
  CRISPR gRNA sequence
cctgagaggctgagacgggg

SEQ ID NO: 78584 - DNA, 20 bp, Artificial
  CRISPR gRNA sequence
agaggctgagacggggggcc

SEQ ID NO: 78585 - DNA, 20 bp, Artificial
  CRISPR gRNA sequence
agacggggggcccaatgcac

SEQ ID NO: 78586 - DNA, 20 bp, Artificial
  CRISPR gRNA sequence
tattgtggggctggagtcct

SEQ ID NO: 78587 - DNA, 20 bp, Artificial
  CRISPR gRNA sequence
tggggctggagtcctccctc

SEQ ID NO: 78588 - DNA, 20 bp, Artificial
  CRISPR gRNA sequence
gagtcctccctcaatcccca

SEQ ID NO: 78589 - DNA, 20 bp, Artificial
  CRISPR gRNA sequence
cctcaatccccatcacttac

SEQ ID NO: 78590 - DNA, 20 bp, Artificial
  CRISPR gRNA sequence
aatccccatcacttactcct

SEQ ID NO: 78591 - DNA, 20 bp, Artificial
  CRISPR gRNA sequence
actcctcctttgctaacttt

SEQ ID NO: 78592 - DNA, 20 bp, Artificial
  CRISPR gRNA sequence
ctcctcctttgctaacttta

SEQ ID NO: 78593 - DNA, 20 bp, Artificial
  CRISPR gRNA sequence
ctcctttgctaactttagtc

SEQ ID NO: 78594 - DNA, 20 bp, Artificial
  CRISPR gRNA sequence
ctttgctaactttagtcaaa

SEQ ID NO: 78595 - DNA, 20 bp, Artificial
  CRISPR gRNA sequence
tgctaactttagtcaaagtg

SEQ ID NO: 78596 - DNA, 20 bp, Artificial
  CRISPR gRNA sequence
gctaactttagtcaaagtgt

SEQ ID NO: 78597 - DNA, 20 bp, Artificial
  CRISPR gRNA sequence
ctaactttagtcaaagtgtc

SEQ ID NO: 78598 - DNA, 20 bp, Artificial
  CRISPR gRNA sequence
actttagtcaaagtgtcact

SEQ ID NO: 78599 - DNA, 20 bp, Artificial
  CRISPR gRNA sequence
tagtcaaagtgtcactctca

SEQ ID NO: 78600 - DNA, 20 bp, Artificial
  CRISPR gRNA sequence
agtcaaagtgtcactctcag

SEQ ID NO: 78601 - DNA, 20 bp, Artificial
  CRISPR gRNA sequence
gtcaaagtgtcactctcagg

SEQ ID NO: 78602 - DNA, 20 bp, Artificial
  CRISPR gRNA sequence
tcaggaatgaaccttgataa

SEQ ID NO: 78603 - DNA, 20 bp, Artificial
  CRISPR gRNA sequence
aggaatgaaccttgataata

SEQ ID NO: 78604 - DNA, 20 bp, Artificial
  CRISPR gRNA sequence
gataataactgaaatcgaca

SEQ ID NO: 78605 - DNA, 20 bp, Artificial
  CRISPR gRNA sequence
ataataactgaaatcgacag

SEQ ID NO: 78606 - DNA, 20 bp, Artificial
  CRISPR gRNA sequence
aaatcgacagactccatacc

SEQ ID NO: 78607 - DNA, 20 bp, Artificial
  CRISPR gRNA sequence
cataccacatgcctggcaac

SEQ ID NO: 78608 - DNA, 20 bp, Artificial
  CRISPR gRNA sequence
gcaacatcctaggttcttct

SEQ ID NO: 78609 - DNA, 20 bp, Artificial
  CRISPR gRNA sequence
ggttcttctatgactattgg

SEQ ID NO: 78610 - DNA, 20 bp, Artificial
  CRISPR gRNA sequence
ttctatgactattggcctat

SEQ ID NO: 78611 - DNA, 20 bp, Artificial
  CRISPR gRNA sequence
ctatgactattggcctattt

SEQ ID NO: 78612 - DNA, 20 bp, Artificial
  CRISPR gRNA sequence
tatgactattggcctatttc

SEQ ID NO: 78613 - DNA, 20 bp, Artificial
  CRISPR gRNA sequence
tgactattggcctatttcat

SEQ ID NO: 78614 - DNA, 20 bp, Artificial
  CRISPR gRNA sequence
ttggcctatttcatcctcat

SEQ ID NO: 78615 - DNA, 20 bp, Artificial
  CRISPR gRNA sequence
gcctatttcatcctcatagt

SEQ ID NO: 78616 - DNA, 20 bp, Artificial
  CRISPR gRNA sequence
tttcatcctcatagtgccga

SEQ ID NO: 78617 - DNA, 20 bp, Artificial
  CRISPR gRNA sequence
catcctcatagtgccgatga

SEQ ID NO: 78618 - DNA, 20 bp, Artificial
  CRISPR gRNA sequence
atcctcatagtgccgatgac

SEQ ID NO: 78619 - DNA, 20 bp, Artificial
  CRISPR gRNA sequence
atagtgccgatgacgtgggc

SEQ ID NO: 78620 - DNA, 20 bp, Artificial
  CRISPR gRNA sequence
taattatcctcaccttactg

SEQ ID NO: 78621 - DNA, 20 bp, Artificial
  CRISPR gRNA sequence
tcctcaccttactgatgagt

SEQ ID NO: 78622 - DNA, 20 bp, Artificial
  CRISPR gRNA sequence
accttactgatgagtaaact

SEQ ID NO: 78623 - DNA, 20 bp, Artificial
  CRISPR gRNA sequence
actgatgagtaaactcaagt

SEQ ID NO: 78624 - DNA, 20 bp, Artificial
  CRISPR gRNA sequence
ctgatgagtaaactcaagtg

SEQ ID NO: 78625 - DNA, 20 bp, Artificial
  CRISPR gRNA sequence
atgagtaaactcaagtgcag

SEQ ID NO: 78626 - DNA, 20 bp, Artificial
  CRISPR gRNA sequence
aagtgcagagtggttaagtg

SEQ ID NO: 78627 - DNA, 20 bp, Artificial
  CRISPR gRNA sequence
agtgcagagtaaagttaagg

SEQ ID NO: 78628 - DNA, 20 bp, Artificial
  CRISPR gRNA sequence
aggcacttgctcgagggaga

SEQ ID NO: 78629 - DNA, 20 bp, Artificial
  CRISPR gRNA sequence
gctcgagggagaacctggat

SEQ ID NO: 78630 - DNA, 20 bp, Artificial
  CRISPR gRNA sequence
ctcgagggagaacctggatt

SEQ ID NO: 78631 - DNA, 20 bp, Artificial
  CRISPR gRNA sequence
gagggagaacctggatttga

SEQ ID NO: 78632 - DNA, 20 bp, Artificial
  CRISPR gRNA sequence
gatttgaacccaggcagcct

SEQ ID NO: 78633 - DNA, 20 bp, Artificial
  CRISPR gRNA sequence
gaacccaggcagcctgcctt

SEQ ID NO: 78634 - DNA, 20 bp, Artificial
  CRISPR gRNA sequence
aacccaggcagcctgccttc

SEQ ID NO: 78635 - DNA, 20 bp, Artificial
  CRISPR gRNA sequence
ccttcaaggccccaccctca

SEQ ID NO: 78636 - DNA, 20 bp, Artificial
  CRISPR gRNA sequence
caaggccccaccctcaactc

SEQ ID NO: 78637 - DNA, 20 bp, Artificial
  CRISPR gRNA sequence
aaggccccaccctcaactct

SEQ ID NO: 78638 - DNA, 20 bp, Artificial
  CRISPR gRNA sequence
aactcttcctttatgctgca

SEQ ID NO: 78639 - DNA, 20 bp, Artificial
  CRISPR gRNA sequence
ttcctttatgctgcaagtta

SEQ ID NO: 78640 - DNA, 20 bp, Artificial
  CRISPR gRNA sequence
cctttatgctgcaagttaca

SEQ ID NO: 78641 - DNA, 20 bp, Artificial
  CRISPR gRNA sequence
ctttatgctgcaagttacat

SEQ ID NO: 78642 - DNA, 20 bp, Artificial
  CRISPR gRNA sequence
tatgctgcaagttacataat

SEQ ID NO: 78643 - DNA, 20 bp, Artificial
  CRISPR gRNA sequence
atgctgcaagttacataatt

SEQ ID NO: 78644 - DNA, 20 bp, Artificial
  CRISPR gRNA sequence
tgctgcaagttacataattg

SEQ ID NO: 78645 - DNA, 20 bp, Artificial
  CRISPR gRNA sequence
caagttacataattgctttt

SEQ ID NO: 78646 - DNA, 20 bp, Artificial
  CRISPR gRNA sequence
cataattgctttttgtgata

SEQ ID NO: 78647 - DNA, 20 bp, Artificial
  CRISPR gRNA sequence
ctttttgtgataaacttcat

SEQ ID NO: 78648 - DNA, 20 bp, Artificial
  CRISPR gRNA sequence
tttgtgataaacttcatgat

SEQ ID NO: 78649 - DNA, 20 bp, Artificial
  CRISPR gRNA sequence
ttgtgataaacttcatgatt

SEQ ID NO: 78650 - DNA, 20 bp, Artificial
  CRISPR gRNA sequence
tgtgataaacttcatgatta

SEQ ID NO: 78651 - DNA, 20 bp, Artificial
  CRISPR gRNA sequence
gtgataaacttcatgattat

SEQ ID NO: 78652 - DNA, 20 bp, Artificial
  CRISPR gRNA sequence
tgataaacttcatgattatg

SEQ ID NO: 78653 - DNA, 20 bp, Artificial
  CRISPR gRNA sequence
catgattatgggggcatctg

SEQ ID NO: 78654 - DNA, 20 bp, Artificial
  CRISPR gRNA sequence
atgattatgggggcatctga

SEQ ID NO: 78655 - DNA, 20 bp, Artificial
  CRISPR gRNA sequence
tgggggcatctgacctagtc

SEQ ID NO: 78656 - DNA, 20 bp, Artificial
  CRISPR gRNA sequence
acctagtctgggagtcgggg

SEQ ID NO: 78657 - DNA, 20 bp, Artificial
  CRISPR gRNA sequence
gtctgggagtcggggatggc

SEQ ID NO: 78658 - DNA, 20 bp, Artificial
  CRISPR gRNA sequence
ggagtcggggatggcttatt

SEQ ID NO: 78659 - DNA, 20 bp, Artificial
  CRISPR gRNA sequence
atttgttgcttaagctactt

SEQ ID NO: 78660 - DNA, 20 bp, Artificial
  CRISPR gRNA sequence
tttgttgcttaagctacttg

SEQ ID NO: 78661 - DNA, 20 bp, Artificial
  CRISPR gRNA sequence
gttgcttaagctacttgctg

SEQ ID NO: 78662 - DNA, 20 bp, Artificial
  CRISPR gRNA sequence
ttgcttaagctacttgctga

SEQ ID NO: 78663 - DNA, 20 bp, Artificial
  CRISPR gRNA sequence
cttaagctacttgctgaaat

SEQ ID NO: 78664 - DNA, 20 bp, Artificial
  CRISPR gRNA sequence
aagctacttgctgaaataac

SEQ ID NO: 78665 - DNA, 20 bp, Artificial
  CRISPR gRNA sequence
agctacttgctgaaataact

SEQ ID NO: 78666 - DNA, 20 bp, Artificial
  CRISPR gRNA sequence
cttgctgaaataactgggag

SEQ ID NO: 78667 - DNA, 20 bp, Artificial
  CRISPR gRNA sequence
gctgaaataactgggagttc

SEQ ID NO: 78668 - DNA, 20 bp, Artificial
  CRISPR gRNA sequence
ctgaaataactgggagttca

SEQ ID NO: 78669 - DNA, 20 bp, Artificial
  CRISPR gRNA sequence
aaataactgggagttcagta

SEQ ID NO: 78670 - DNA, 20 bp, Artificial
  CRISPR gRNA sequence
ggagttcagtaggtaaaagg

SEQ ID NO: 78671 - DNA, 20 bp, Artificial
  CRISPR gRNA sequence
agtaggtaaaaggttggggg

SEQ ID NO: 78672 - DNA, 20 bp, Artificial
  CRISPR gRNA sequence
ggggagagatggaggaaggg

SEQ ID NO: 78673 - DNA, 20 bp, Artificial
  CRISPR gRNA sequence
ctggtggtagaagcagtaca

SEQ ID NO: 78674 - DNA, 20 bp, Artificial
  CRISPR gRNA sequence
gtggtagaagcagtacattc

SEQ ID NO: 78675 - DNA, 20 bp, Artificial
  CRISPR gRNA sequence
aaaggccctgtggcataaca

SEQ ID NO: 78676 - DNA, 20 bp, Artificial
  CRISPR gRNA sequence
tggcataacacatatgagga

SEQ ID NO: 78677 - DNA, 20 bp, Artificial
  CRISPR gRNA sequence
aaagagagccagtgtgtctg

SEQ ID NO: 78678 - DNA, 20 bp, Artificial
  CRISPR gRNA sequence
gattggagattgagtggaag

SEQ ID NO: 78679 - DNA, 20 bp, Artificial
  CRISPR gRNA sequence
gagattgagtggaaggatgg

SEQ ID NO: 78680 - DNA, 20 bp, Artificial
  CRISPR gRNA sequence
agtggaaggatggggtcaga

SEQ ID NO: 78681 - DNA, 20 bp, Artificial
  CRISPR gRNA sequence
aggaggctgggggcagggtt

SEQ ID NO: 78682 - DNA, 20 bp, Artificial
  CRISPR gRNA sequence
ggaggctgggggcagggttc

SEQ ID NO: 78683 - DNA, 20 bp, Artificial
  CRISPR gRNA sequence
ggggcagggttctggaccac

SEQ ID NO: 78684 - DNA, 20 bp, Artificial
  CRISPR gRNA sequence
tggaccacctgggagtttag

SEQ ID NO: 78685 - DNA, 20 bp, Artificial
  CRISPR gRNA sequence
gaccacctgggagtttagaa

SEQ ID NO: 78686 - DNA, 20 bp, Artificial
  CRISPR gRNA sequence
ggagtttagaatgtgggttt

SEQ ID NO: 78687 - DNA, 20 bp, Artificial
  CRISPR gRNA sequence
agaatgtgggttttatcctg

SEQ ID NO: 78688 - DNA, 20 bp, Artificial
  CRISPR gRNA sequence
gaatgtgggttttatcctga

SEQ ID NO: 78689 - DNA, 20 bp, Artificial
  CRISPR gRNA sequence
tatcctgagcagtgggaagg

SEQ ID NO: 78690 - DNA, 20 bp, Artificial
  CRISPR gRNA sequence
atcctgagcagtgggaagga

SEQ ID NO: 78691 - DNA, 20 bp, Artificial
  CRISPR gRNA sequence
tcctgagcagtgggaaggag

SEQ ID NO: 78692 - DNA, 20 bp, Artificial
  CRISPR gRNA sequence
agcagtgggaaggagtgaag

SEQ ID NO: 78693 - DNA, 20 bp, Artificial
  CRISPR gRNA sequence
ctctctgccaggtggaagtg

SEQ ID NO: 78694 - DNA, 20 bp, Artificial
  CRISPR gRNA sequence
tctgccaggtggaagtggcc

SEQ ID NO: 78695 - DNA, 20 bp, Artificial
  CRISPR gRNA sequence
tgccaggtggaagtggccag

SEQ ID NO: 78696 - DNA, 20 bp, Artificial
  CRISPR gRNA sequence
ccaggtggaagtggccaggg

SEQ ID NO: 78697 - DNA, 20 bp, Artificial
  CRISPR gRNA sequence
gactagaaaggtggaggaaa

SEQ ID NO: 78698 - DNA, 20 bp, Artificial
  CRISPR gRNA sequence
gaaaggtggaggaaaagagg

SEQ ID NO: 78699 - DNA, 20 bp, Artificial
  CRISPR gRNA sequence
tgagcgctaccagtaggtcc

SEQ ID NO: 78700 - DNA, 20 bp, Artificial
  CRISPR gRNA sequence
gagcgctaccagtaggtcca

SEQ ID NO: 78701 - DNA, 20 bp, Artificial
  CRISPR gRNA sequence
agcgctaccagtaggtccat

SEQ ID NO: 78702 - DNA, 20 bp, Artificial
  CRISPR gRNA sequence
ccagtaggtccatctggagg

SEQ ID NO: 78703 - DNA, 20 bp, Artificial
  CRISPR gRNA sequence
gagggactaaatgtgggaga

SEQ ID NO: 78704 - DNA, 20 bp, Artificial
  CRISPR gRNA sequence
aatgtgggagaagggcaagg

SEQ ID NO: 78705 - DNA, 20 bp, Artificial
  CRISPR gRNA sequence
ggaggtggctgcgtaaccag

SEQ ID NO: 78706 - DNA, 20 bp, Artificial
  CRISPR gRNA sequence
cgtaaccaggcgggtgatgg

SEQ ID NO: 78707 - DNA, 20 bp, Artificial
  CRISPR gRNA sequence
cttctgcaggtgatggcact

SEQ ID NO: 78708 - DNA, 20 bp, Artificial
  CRISPR gRNA sequence
ctgcaggtgatggcactcgg

SEQ ID NO: 78709 - DNA, 20 bp, Artificial
  CRISPR gRNA sequence
tgcaggtgatggcactcggg

SEQ ID NO: 78710 - DNA, 20 bp, Artificial
  CRISPR gRNA sequence
caggtgatggcactcgggga

SEQ ID NO: 78711 - DNA, 20 bp, Artificial
  CRISPR gRNA sequence
ggggaggggcatgctcagtg

SEQ ID NO: 78712 - DNA, 20 bp, Artificial
  CRISPR gRNA sequence
agtgctggtgaggcaggtag

SEQ ID NO: 78713 - DNA, 20 bp, Artificial
  CRISPR gRNA sequence
gtgaggcaggtagaagtgtg

SEQ ID NO: 78714 - DNA, 20 bp, Artificial
  CRISPR gRNA sequence
gttaaaaaaccaccttctaa

SEQ ID NO: 78715 - DNA, 20 bp, Artificial
  CRISPR gRNA sequence
ttaaaaaaccaccttctaat

SEQ ID NO: 78716 - DNA, 20 bp, Artificial
  CRISPR gRNA sequence
aaaaaccaccttctaattct

SEQ ID NO: 78717 - DNA, 20 bp, Artificial
  CRISPR gRNA sequence
ctaattctgtcctggttctc

SEQ ID NO: 78718 - DNA, 20 bp, Artificial
  CRISPR gRNA sequence
taattctgtcctggttctcc

SEQ ID NO: 78719 - DNA, 20 bp, Artificial
  CRISPR gRNA sequence
attctgtcctggttctccca

SEQ ID NO: 78720 - DNA, 20 bp, Artificial
  CRISPR gRNA sequence
tgtcctggttctcccaatgg

SEQ ID NO: 78721 - DNA, 20 bp, Artificial
  CRISPR gRNA sequence
tcctggttctcccaatggga

SEQ ID NO: 78722 - DNA, 20 bp, Artificial
  CRISPR gRNA sequence
gttctcccaatgggacgagg

SEQ ID NO: 78723 - DNA, 20 bp, Artificial
  CRISPR gRNA sequence
tcccaatgggacgaggtcca

SEQ ID NO: 78724 - DNA, 20 bp, Artificial
  CRISPR gRNA sequence
ccaatgggacgaggtccagg

SEQ ID NO: 78725 - DNA, 20 bp, Artificial
  CRISPR gRNA sequence
acccctatccgtcttaccct

SEQ ID NO: 78726 - DNA, 20 bp, Artificial
  CRISPR gRNA sequence
tccgtcttaccctgaggtgg

SEQ ID NO: 78727 - DNA, 20 bp, Artificial
  CRISPR gRNA sequence
accctgaggtggggccactc

SEQ ID NO: 78728 - DNA, 20 bp, Artificial
  CRISPR gRNA sequence
ccctgaggtggggccactcg

SEQ ID NO: 78729 - DNA, 20 bp, Artificial
  CRISPR gRNA sequence
aggtggggccactcgaccca

SEQ ID NO: 78730 - DNA, 20 bp, Artificial
  CRISPR gRNA sequence
gacccagaacacatcctggc

SEQ ID NO: 78731 - DNA, 20 bp, Artificial
  CRISPR gRNA sequence
gcgttccatcatctgccttc

SEQ ID NO: 78732 - DNA, 20 bp, Artificial
  CRISPR gRNA sequence
catcatctgccttcatgttc

SEQ ID NO: 78733 - DNA, 20 bp, Artificial
  CRISPR gRNA sequence
ccttcatgttcacttggagg

SEQ ID NO: 78734 - DNA, 20 bp, Artificial
  CRISPR gRNA sequence
catgttcacttggaggtttc

SEQ ID NO: 78735 - DNA, 20 bp, Artificial
  CRISPR gRNA sequence
atgttcacttggaggtttcc

SEQ ID NO: 78736 - DNA, 20 bp, Artificial
  CRISPR gRNA sequence
acttggaggtttcctggagg

SEQ ID NO: 78737 - DNA, 20 bp, Artificial
  CRISPR gRNA sequence
ggaggtttcctggaggggcg

SEQ ID NO: 78738 - DNA, 20 bp, Artificial
  CRISPR gRNA sequence
gaggtttcctggaggggcgc

SEQ ID NO: 78739 - DNA, 20 bp, Artificial
  CRISPR gRNA sequence
cctggaggggcgcccctcct

SEQ ID NO: 78740 - DNA, 20 bp, Artificial
  CRISPR gRNA sequence
ctggaggggcgcccctccta

SEQ ID NO: 78741 - DNA, 20 bp, Artificial
  CRISPR gRNA sequence
gaggggcgcccctcctaggg

SEQ ID NO: 78742 - DNA, 20 bp, Artificial
  CRISPR gRNA sequence
ctagggtcgtgacagagcct

SEQ ID NO: 78743 - DNA, 20 bp, Artificial
  CRISPR gRNA sequence
gggtcgtgacagagcctccg

SEQ ID NO: 78744 - DNA, 20 bp, Artificial
  CRISPR gRNA sequence
cgtccatccccaagcactac

SEQ ID NO: 78745 - DNA, 20 bp, Artificial
  CRISPR gRNA sequence
ctcttattggcttcagccag

SEQ ID NO: 78746 - DNA, 20 bp, Artificial
  CRISPR gRNA sequence
ttattggcttcagccagggg

SEQ ID NO: 78747 - DNA, 20 bp, Artificial
  CRISPR gRNA sequence
attggcttcagccaggggct

SEQ ID NO: 78748 - DNA, 20 bp, Artificial
  CRISPR gRNA sequence
ttggcttcagccaggggctg

SEQ ID NO: 78749 - DNA, 20 bp, Artificial
  CRISPR gRNA sequence
gcttcagccaggggctggac

SEQ ID NO: 78750 - DNA, 20 bp, Artificial
  CRISPR gRNA sequence
cagccaggggctggacgcca

SEQ ID NO: 78751 - DNA, 20 bp, Artificial
  CRISPR gRNA sequence
agccaggggctggacgccat

SEQ ID NO: 78752 - DNA, 20 bp, Artificial
  CRISPR gRNA sequence
gacgccatgggaatttctcc

SEQ ID NO: 78753 - DNA, 20 bp, Artificial
  CRISPR gRNA sequence
ctccatcccgaaaagagaag

SEQ ID NO: 78754 - DNA, 20 bp, Artificial
  CRISPR gRNA sequence
tccatcccgaaaagagaagg

SEQ ID NO: 78755 - DNA, 20 bp, Artificial
  CRISPR gRNA sequence
catcccgaaaagagaaggtt

SEQ ID NO: 78756 - DNA, 20 bp, Artificial
  CRISPR gRNA sequence
tcccactctactctgggaga

SEQ ID NO: 78757 - DNA, 20 bp, Artificial
  CRISPR gRNA sequence
tactctgggagaaggatgaa

SEQ ID NO: 78758 - DNA, 20 bp, Artificial
  CRISPR gRNA sequence
ctctgggagaaggatgaagg

SEQ ID NO: 78759 - DNA, 20 bp, Artificial
  CRISPR gRNA sequence
tgggagaaggatgaaggggg

SEQ ID NO: 78760 - DNA, 20 bp, Artificial
  CRISPR gRNA sequence
ggagaaggatgaagggggtg

SEQ ID NO: 78761 - DNA, 20 bp, Artificial
  CRISPR gRNA sequence
agggactgtggtttggaagg

SEQ ID NO: 78762 - DNA, 20 bp, Artificial
  CRISPR gRNA sequence
tggtttggaaggcagaccca

SEQ ID NO: 78763 - DNA, 20 bp, Artificial
  CRISPR gRNA sequence
ggaaggcagacccaggtgtg

SEQ ID NO: 78764 - DNA, 20 bp, Artificial
  CRISPR gRNA sequence
gaaggcagacccaggtgtgg

SEQ ID NO: 78765 - DNA, 20 bp, Artificial
  CRISPR gRNA sequence
ctacttggcagatctcagca

SEQ ID NO: 78766 - DNA, 20 bp, Artificial
  CRISPR gRNA sequence
tacttggcagatctcagcaa

SEQ ID NO: 78767 - DNA, 20 bp, Artificial
  CRISPR gRNA sequence
cttggcagatctcagcaaga

SEQ ID NO: 78768 - DNA, 20 bp, Artificial
  CRISPR gRNA sequence
ggcagatctcagcaagagag

SEQ ID NO: 78769 - DNA, 20 bp, Artificial
  CRISPR gRNA sequence
gcagatctcagcaagagagg

SEQ ID NO: 78770 - DNA, 20 bp, Artificial
  CRISPR gRNA sequence
agcaagagaggtagcagtgg

SEQ ID NO: 78771 - DNA, 20 bp, Artificial
  CRISPR gRNA sequence
tgaggatgaggctgcgagcc

SEQ ID NO: 78772 - DNA, 20 bp, Artificial
  CRISPR gRNA sequence
cgagccagactgtctgggct

SEQ ID NO: 78773 - DNA, 20 bp, Artificial
  CRISPR gRNA sequence
tctgggcttgaaccctagcc

SEQ ID NO: 78774 - DNA, 20 bp, Artificial
  CRISPR gRNA sequence
ggcttgaaccctagcctaga

SEQ ID NO: 78775 - DNA, 20 bp, Artificial
  CRISPR gRNA sequence
gaaccctagcctagactctt

SEQ ID NO: 78776 - DNA, 20 bp, Artificial
  CRISPR gRNA sequence
aaccctagcctagactcttc

SEQ ID NO: 78777 - DNA, 20 bp, Artificial
  CRISPR gRNA sequence
gcctagactcttcctacctg

SEQ ID NO: 78778 - DNA, 20 bp, Artificial
  CRISPR gRNA sequence
gactcttcctacctgtgtgg

SEQ ID NO: 78779 - DNA, 20 bp, Artificial
  CRISPR gRNA sequence
ttcctacctgtgtggccttg

SEQ ID NO: 78780 - DNA, 20 bp, Artificial
  CRISPR gRNA sequence
cctacctgtgtggccttgag

SEQ ID NO: 78781 - DNA, 20 bp, Artificial
  CRISPR gRNA sequence
ctacctgtgtggccttgagc

SEQ ID NO: 78782 - DNA, 20 bp, Artificial
  CRISPR gRNA sequence
cctgtgtggccttgagcaag

SEQ ID NO: 78783 - DNA, 20 bp, Artificial
  CRISPR gRNA sequence
tgtggccttgagcaagttta

SEQ ID NO: 78784 - DNA, 20 bp, Artificial
  CRISPR gRNA sequence
gagcaagtttatctttctgc

SEQ ID NO: 78785 - DNA, 20 bp, Artificial
  CRISPR gRNA sequence
agcaagtttatctttctgca

SEQ ID NO: 78786 - DNA, 20 bp, Artificial
  CRISPR gRNA sequence
atctttctgcagcttaactt

SEQ ID NO: 78787 - DNA, 20 bp, Artificial
  CRISPR gRNA sequence
tctttctgcagcttaacttc

SEQ ID NO: 78788 - DNA, 20 bp, Artificial
  CRISPR gRNA sequence
tctgcagcttaacttcctcc

SEQ ID NO: 78789 - DNA, 20 bp, Artificial
  CRISPR gRNA sequence
ctgcagcttaacttcctcct

SEQ ID NO: 78790 - DNA, 20 bp, Artificial
  CRISPR gRNA sequence
tgcagcttaacttcctcctc

SEQ ID NO: 78791 - DNA, 20 bp, Artificial
  CRISPR gRNA sequence
cagcttaacttcctcctcta

SEQ ID NO: 78792 - DNA, 20 bp, Artificial
  CRISPR gRNA sequence
aacttcctcctctataaaat

SEQ ID NO: 78793 - DNA, 20 bp, Artificial
  CRISPR gRNA sequence
acttcctcctctataaaatg

SEQ ID NO: 78794 - DNA, 20 bp, Artificial
  CRISPR gRNA sequence
cctcctctataaaatgagga

SEQ ID NO: 78795 - DNA, 20 bp, Artificial
  CRISPR gRNA sequence
ctcctctataaaatgaggac

SEQ ID NO: 78796 - DNA, 20 bp, Artificial
  CRISPR gRNA sequence
ctctataaaatgaggacagt

SEQ ID NO: 78797 - DNA, 20 bp, Artificial
  CRISPR gRNA sequence
tataaaatgaggacagtaac

SEQ ID NO: 78798 - DNA, 20 bp, Artificial
  CRISPR gRNA sequence
taaaatgaggacagtaacag

SEQ ID NO: 78799 - DNA, 20 bp, Artificial
  CRISPR gRNA sequence
acatcacagagatgtgagga

SEQ ID NO: 78800 - DNA, 20 bp, Artificial
  CRISPR gRNA sequence
catcacagagatgtgaggag

SEQ ID NO: 78801 - DNA, 20 bp, Artificial
  CRISPR gRNA sequence
gcacagcacctgacccggga

SEQ ID NO: 78802 - DNA, 20 bp, Artificial
  CRISPR gRNA sequence
acccgggacaagtgctgaat

SEQ ID NO: 78803 - DNA, 20 bp, Artificial
  CRISPR gRNA sequence
aatagtagcagctgttacaa

SEQ ID NO: 78804 - DNA, 20 bp, Artificial
  CRISPR gRNA sequence
ttacaatgatctgattcccc

SEQ ID NO: 78805 - DNA, 20 bp, Artificial
  CRISPR gRNA sequence
caatgatctgattcccccaa

SEQ ID NO: 78806 - DNA, 20 bp, Artificial
  CRISPR gRNA sequence
attcccccaaattcttcatg

SEQ ID NO: 78807 - DNA, 20 bp, Artificial
  CRISPR gRNA sequence
ccccaaattcttcatgaggc

SEQ ID NO: 78808 - DNA, 20 bp, Artificial
  CRISPR gRNA sequence
ttcatgaggcagcatgcccc

SEQ ID NO: 78809 - DNA, 20 bp, Artificial
  CRISPR gRNA sequence
catgaggcagcatgcccctc

SEQ ID NO: 78810 - DNA, 20 bp, Artificial
  CRISPR gRNA sequence
atgaggcagcatgcccctcc

SEQ ID NO: 78811 - DNA, 20 bp, Artificial
  CRISPR gRNA sequence
ccccacaccacccacccaaa

SEQ ID NO: 78812 - DNA, 20 bp, Artificial
  CRISPR gRNA sequence
cccaccctctccaacctcct

SEQ ID NO: 78813 - DNA, 20 bp, Artificial
  CRISPR gRNA sequence
tccaacctcctttcctggct

SEQ ID NO: 78814 - DNA, 20 bp, Artificial
  CRISPR gRNA sequence
caacctcctttcctggctcc

SEQ ID NO: 78815 - DNA, 20 bp, Artificial
  CRISPR gRNA sequence
ctttcctggctcctacgcca

SEQ ID NO: 78816 - DNA, 20 bp, Artificial
  CRISPR gRNA sequence
tcctggctcctacgccaggg

SEQ ID NO: 78817 - DNA, 20 bp, Artificial
  CRISPR gRNA sequence
cctggctcctacgccagggc

SEQ ID NO: 78818 - DNA, 20 bp, Artificial
  CRISPR gRNA sequence
ctggctcctacgccagggct

SEQ ID NO: 78819 - DNA, 20 bp, Artificial
  CRISPR gRNA sequence
gctcctacgccagggcttcc

SEQ ID NO: 78820 - DNA, 20 bp, Artificial
  CRISPR gRNA sequence
ctacgccagggcttcccgtg

SEQ ID NO: 78821 - DNA, 20 bp, Artificial
  CRISPR gRNA sequence
cgccagggcttcccgtgata

SEQ ID NO: 78822 - DNA, 20 bp, Artificial
  CRISPR gRNA sequence
cccgtgatactcactccact

SEQ ID NO: 78823 - DNA, 20 bp, Artificial
  CRISPR gRNA sequence
ccgtgatactcactccactt

SEQ ID NO: 78824 - DNA, 20 bp, Artificial
  CRISPR gRNA sequence
actccacttcctccaggtga

SEQ ID NO: 78825 - DNA, 20 bp, Artificial
  CRISPR gRNA sequence
cacttcctccaggtgagggc

SEQ ID NO: 78826 - DNA, 20 bp, Artificial
  CRISPR gRNA sequence
cctccaggtgagggccttcc

SEQ ID NO: 78827 - DNA, 20 bp, Artificial
  CRISPR gRNA sequence
ctccaggtgagggccttcct

SEQ ID NO: 78828 - DNA, 20 bp, Artificial
  CRISPR gRNA sequence
caggtgagggccttcctgga

SEQ ID NO: 78829 - DNA, 20 bp, Artificial
  CRISPR gRNA sequence
cctggagcagggctatgagg

SEQ ID NO: 78830 - DNA, 20 bp, Artificial
  CRISPR gRNA sequence
ctggagcagggctatgaggg

SEQ ID NO: 78831 - DNA, 20 bp, Artificial
  CRISPR gRNA sequence
gagcagggctatgagggcct

SEQ ID NO: 78832 - DNA, 20 bp, Artificial
  CRISPR gRNA sequence
tgagggcctccgcatcgtgg

SEQ ID NO: 78833 - DNA, 20 bp, Artificial
  CRISPR gRNA sequence
cgcatcgtggacctggagct

SEQ ID NO: 78834 - DNA, 20 bp, Artificial
  CRISPR gRNA sequence
gagctgacacttctgcagcc

SEQ ID NO: 78835 - DNA, 20 bp, Artificial
  CRISPR gRNA sequence
acacttctgcagccttgggt

SEQ ID NO: 78836 - DNA, 20 bp, Artificial
  CRISPR gRNA sequence
ctgcagccttgggtaggagt

SEQ ID NO: 78837 - DNA, 20 bp, Artificial
  CRISPR gRNA sequence
tgcagccttgggtaggagtg

SEQ ID NO: 78838 - DNA, 20 bp, Artificial
  CRISPR gRNA sequence
cagccttgggtaggagtggg

SEQ ID NO: 78839 - DNA, 20 bp, Artificial
  CRISPR gRNA sequence
gggtaggagtgggggacaga

SEQ ID NO: 78840 - DNA, 20 bp, Artificial
  CRISPR gRNA sequence
ggtaggagtgggggacagaa

SEQ ID NO: 78841 - DNA, 20 bp, Artificial
  CRISPR gRNA sequence
agggcaaacagcccctactc

SEQ ID NO: 78842 - DNA, 20 bp, Artificial
  CRISPR gRNA sequence
ctccatggcccctccagctt

SEQ ID NO: 78843 - DNA, 20 bp, Artificial
  CRISPR gRNA sequence
catggcccctccagcttcca

SEQ ID NO: 78844 - DNA, 20 bp, Artificial
  CRISPR gRNA sequence
cagcttccaatgctggggga

SEQ ID NO: 78845 - DNA, 20 bp, Artificial
  CRISPR gRNA sequence
ccaatgctgggggagtcagg

SEQ ID NO: 78846 - DNA, 20 bp, Artificial
  CRISPR gRNA sequence
caatgctgggggagtcaggg

SEQ ID NO: 78847 - DNA, 20 bp, Artificial
  CRISPR gRNA sequence
ggggagtcagggggcccaca

SEQ ID NO: 78848 - DNA, 20 bp, Artificial
  CRISPR gRNA sequence
ggtctaatcctagccacacc

SEQ ID NO: 78849 - DNA, 20 bp, Artificial
  CRISPR gRNA sequence
atcctagccacacctcttag

SEQ ID NO: 78850 - DNA, 20 bp, Artificial
  CRISPR gRNA sequence
gccacacctcttagtagctg

SEQ ID NO: 78851 - DNA, 20 bp, Artificial
  CRISPR gRNA sequence
ttagtagctgggtgatcttg

SEQ ID NO: 78852 - DNA, 20 bp, Artificial
  CRISPR gRNA sequence
agtagctgggtgatcttgag

SEQ ID NO: 78853 - DNA, 20 bp, Artificial
  CRISPR gRNA sequence
gtagctgggtgatcttgagc

SEQ ID NO: 78854 - DNA, 20 bp, Artificial
  CRISPR gRNA sequence
ggtgatcttgagcaagggac

SEQ ID NO: 78855 - DNA, 20 bp, Artificial
  CRISPR gRNA sequence
gagcaagggacttaacctgt

SEQ ID NO: 78856 - DNA, 20 bp, Artificial
  CRISPR gRNA sequence
agcaagggacttaacctgtc

SEQ ID NO: 78857 - DNA, 20 bp, Artificial
  CRISPR gRNA sequence
aacctgtctgagactcagtt

SEQ ID NO: 78858 - DNA, 20 bp, Artificial
  CRISPR gRNA sequence
acctgtctgagactcagttt

SEQ ID NO: 78859 - DNA, 20 bp, Artificial
  CRISPR gRNA sequence
tctgagactcagtttcctcc

SEQ ID NO: 78860 - DNA, 20 bp, Artificial
  CRISPR gRNA sequence
agactcagtttcctcctccc

SEQ ID NO: 78861 - DNA, 20 bp, Artificial
  CRISPR gRNA sequence
agtttcctcctccctcaaag

SEQ ID NO: 78862 - DNA, 20 bp, Artificial
  CRISPR gRNA sequence
cctcctccctcaaaggggaa

SEQ ID NO: 78863 - DNA, 20 bp, Artificial
  CRISPR gRNA sequence
ctcctccctcaaaggggaat

SEQ ID NO: 78864 - DNA, 20 bp, Artificial
  CRISPR gRNA sequence
ctccctcaaaggggaataat

SEQ ID NO: 78865 - DNA, 20 bp, Artificial
  CRISPR gRNA sequence
cctcaaaggggaataataat

SEQ ID NO: 78866 - DNA, 20 bp, Artificial
  CRISPR gRNA sequence
aaaggggaataataatgtgt

SEQ ID NO: 78867 - DNA, 20 bp, Artificial
  CRISPR gRNA sequence
cacagagattctaaaggaat

SEQ ID NO: 78868 - DNA, 20 bp, Artificial
  CRISPR gRNA sequence
acagagattctaaaggaatt

SEQ ID NO: 78869 - DNA, 20 bp, Artificial
  CRISPR gRNA sequence
taaaggaattacagtgaggt

SEQ ID NO: 78870 - DNA, 20 bp, Artificial
  CRISPR gRNA sequence
aaggaattacagtgaggtaa

SEQ ID NO: 78871 - DNA, 20 bp, Artificial
  CRISPR gRNA sequence
cagtgaggtaatggatgtaa

SEQ ID NO: 78872 - DNA, 20 bp, Artificial
  CRISPR gRNA sequence
gtgcaatgcccggcatatag

SEQ ID NO: 78873 - DNA, 20 bp, Artificial
  CRISPR gRNA sequence
cattaagttgcagctattgt

SEQ ID NO: 78874 - DNA, 20 bp, Artificial
  CRISPR gRNA sequence
agttgcagctattgttatta

SEQ ID NO: 78875 - DNA, 20 bp, Artificial
  CRISPR gRNA sequence
cagctattgttattatgaca

SEQ ID NO: 78876 - DNA, 20 bp, Artificial
  CRISPR gRNA sequence
ttgttattatgacagatgct

SEQ ID NO: 78877 - DNA, 20 bp, Artificial
  CRISPR gRNA sequence
ttattatgacagatgctcct

SEQ ID NO: 78878 - DNA, 20 bp, Artificial
  CRISPR gRNA sequence
ttatgacagatgctccttat

SEQ ID NO: 78879 - DNA, 20 bp, Artificial
  CRISPR gRNA sequence
tgacagatgctccttattca

SEQ ID NO: 78880 - DNA, 20 bp, Artificial
  CRISPR gRNA sequence
cttattcaagccaggatggg

SEQ ID NO: 78881 - DNA, 20 bp, Artificial
  CRISPR gRNA sequence
attcaagccaggatgggcta

SEQ ID NO: 78882 - DNA, 20 bp, Artificial
  CRISPR gRNA sequence
ttcaagccaggatgggctat

SEQ ID NO: 78883 - DNA, 20 bp, Artificial
  CRISPR gRNA sequence
aagccaggatgggctatcca

SEQ ID NO: 78884 - DNA, 20 bp, Artificial
  CRISPR gRNA sequence
tccaggatgggcaccacacc

SEQ ID NO: 78885 - DNA, 20 bp, Artificial
  CRISPR gRNA sequence
atcctttccctgtccctcat

SEQ ID NO: 78886 - DNA, 20 bp, Artificial
  CRISPR gRNA sequence
tccctgtccctcatctgctt

SEQ ID NO: 78887 - DNA, 20 bp, Artificial
  CRISPR gRNA sequence
ccctgtccctcatctgcttt

SEQ ID NO: 78888 - DNA, 20 bp, Artificial
  CRISPR gRNA sequence
cctgtccctcatctgctttt

SEQ ID NO: 78889 - DNA, 20 bp, Artificial
  CRISPR gRNA sequence
tccctcatctgcttttccct

SEQ ID NO: 78890 - DNA, 20 bp, Artificial
  CRISPR gRNA sequence
atctgcttttccctttatcc

SEQ ID NO: 78891 - DNA, 20 bp, Artificial
  CRISPR gRNA sequence
cttttccctttatcctccct

SEQ ID NO: 78892 - DNA, 20 bp, Artificial
  CRISPR gRNA sequence
ttccctttatcctccctgcc

SEQ ID NO: 78893 - DNA, 20 bp, Artificial
  CRISPR gRNA sequence
tccctttatcctccctgccc

SEQ ID NO: 78894 - DNA, 20 bp, Artificial
  CRISPR gRNA sequence
ccctttatcctccctgcccc

SEQ ID NO: 78895 - DNA, 20 bp, Artificial
  CRISPR gRNA sequence
cctttatcctccctgcccct

SEQ ID NO: 78896 - DNA, 20 bp, Artificial
  CRISPR gRNA sequence
tatcctccctgcccctgctc

SEQ ID NO: 78897 - DNA, 20 bp, Artificial
  CRISPR gRNA sequence
atcctccctgcccctgctct

SEQ ID NO: 78898 - DNA, 20 bp, Artificial
  CRISPR gRNA sequence
tcctccctgcccctgctctc

SEQ ID NO: 78899 - DNA, 20 bp, Artificial
  CRISPR gRNA sequence
cctgcccctgctctcccttg

SEQ ID NO: 78900 - DNA, 20 bp, Artificial
  CRISPR gRNA sequence
cccctgctctcccttgcctc

SEQ ID NO: 78901 - DNA, 20 bp, Artificial
  CRISPR gRNA sequence
ctctcccttgcctcggactt

SEQ ID NO: 78902 - DNA, 20 bp, Artificial
  CRISPR gRNA sequence
tcccttgcctcggactttcc

SEQ ID NO: 78903 - DNA, 20 bp, Artificial
  CRISPR gRNA sequence
ccttgcctcggactttcccc

SEQ ID NO: 78904 - DNA, 20 bp, Artificial
  CRISPR gRNA sequence
gcctcggactttcccccata

SEQ ID NO: 78905 - DNA, 20 bp, Artificial
  CRISPR gRNA sequence
cctcggactttcccccatat

SEQ ID NO: 78906 - DNA, 20 bp, Artificial
  CRISPR gRNA sequence
ggactttcccccatatcata

SEQ ID NO: 78907 - DNA, 20 bp, Artificial
  CRISPR gRNA sequence
tcccccatatcatatccctc

SEQ ID NO: 78908 - DNA, 20 bp, Artificial
  CRISPR gRNA sequence
cccccatatcatatccctct

SEQ ID NO: 78909 - DNA, 20 bp, Artificial
  CRISPR gRNA sequence
ccccatatcatatccctctc

SEQ ID NO: 78910 - DNA, 20 bp, Artificial
  CRISPR gRNA sequence
tcctaaggcaatagatccct

SEQ ID NO: 78911 - DNA, 20 bp, Artificial
  CRISPR gRNA sequence
ctaaggcaatagatccctcc

SEQ ID NO: 78912 - DNA, 20 bp, Artificial
  CRISPR gRNA sequence
aggcaatagatccctccaag

SEQ ID NO: 78913 - DNA, 20 bp, Artificial
  CRISPR gRNA sequence
caaggtacctgagcgtcaag

SEQ ID NO: 78914 - DNA, 20 bp, Artificial
  CRISPR gRNA sequence
agcgtcaagcttctgctctg

SEQ ID NO: 78915 - DNA, 20 bp, Artificial
  CRISPR gRNA sequence
ctgctctgagcccctttcct

SEQ ID NO: 78916 - DNA, 20 bp, Artificial
  CRISPR gRNA sequence
tgctctgagcccctttcctc

SEQ ID NO: 78917 - DNA, 20 bp, Artificial
  CRISPR gRNA sequence
ctctgagcccctttcctctg

SEQ ID NO: 78918 - DNA, 20 bp, Artificial
  CRISPR gRNA sequence
tgagcccctttcctctggcc

SEQ ID NO: 78919 - DNA, 20 bp, Artificial
  CRISPR gRNA sequence
agcccctttcctctggccgt

SEQ ID NO: 78920 - DNA, 20 bp, Artificial
  CRISPR gRNA sequence
tcctctggccgtcactttcc

SEQ ID NO: 78921 - DNA, 20 bp, Artificial
  CRISPR gRNA sequence
cctctggccgtcactttcct

SEQ ID NO: 78922 - DNA, 20 bp, Artificial
  CRISPR gRNA sequence
ctctggccgtcactttcctg

SEQ ID NO: 78923 - DNA, 20 bp, Artificial
  CRISPR gRNA sequence
tggccgtcactttcctgcag

SEQ ID NO: 78924 - DNA, 20 bp, Artificial
  CRISPR gRNA sequence
gccgtcactttcctgcaggt

SEQ ID NO: 78925 - DNA, 20 bp, Artificial
  CRISPR gRNA sequence
tcctgcaggtctggagctct

SEQ ID NO: 78926 - DNA, 20 bp, Artificial
  CRISPR gRNA sequence
cctgcaggtctggagctctg

SEQ ID NO: 78927 - DNA, 20 bp, Artificial
  CRISPR gRNA sequence
ctgcaggtctggagctctgg

SEQ ID NO: 78928 - DNA, 20 bp, Artificial
  CRISPR gRNA sequence
caggtctggagctctggcaa

SEQ ID NO: 78929 - DNA, 20 bp, Artificial
  CRISPR gRNA sequence
gagctctggcaagaacaaat

SEQ ID NO: 78930 - DNA, 20 bp, Artificial
  CRISPR gRNA sequence
tggcaagaacaaatcaagca

SEQ ID NO: 78931 - DNA, 20 bp, Artificial
  CRISPR gRNA sequence
gcaagaacaaatcaagcatt

SEQ ID NO: 78932 - DNA, 20 bp, Artificial
  CRISPR gRNA sequence
gcctgggctcaggcatctag

SEQ ID NO: 78933 - DNA, 20 bp, Artificial
  CRISPR gRNA sequence
ggctcaggcatctagggcct

SEQ ID NO: 78934 - DNA, 20 bp, Artificial
  CRISPR gRNA sequence
aggcatctagggcctggtgg

SEQ ID NO: 78935 - DNA, 20 bp, Artificial
  CRISPR gRNA sequence
gggcctggtggatcaagcct

SEQ ID NO: 78936 - DNA, 20 bp, Artificial
  CRISPR gRNA sequence
gtggatcaagcctctttcct

SEQ ID NO: 78937 - DNA, 20 bp, Artificial
  CRISPR gRNA sequence
tttccttggcttctagaggc

SEQ ID NO: 78938 - DNA, 20 bp, Artificial
  CRISPR gRNA sequence
tccttggcttctagaggctg

SEQ ID NO: 78939 - DNA, 20 bp, Artificial
  CRISPR gRNA sequence
ccttggcttctagaggctga

SEQ ID NO: 78940 - DNA, 20 bp, Artificial
  CRISPR gRNA sequence
cttggcttctagaggctgaa

SEQ ID NO: 78941 - DNA, 20 bp, Artificial
  CRISPR gRNA sequence
ggcttctagaggctgaagac

SEQ ID NO: 78942 - DNA, 20 bp, Artificial
  CRISPR gRNA sequence
gcttctagaggctgaagacc

SEQ ID NO: 78943 - DNA, 20 bp, Artificial
  CRISPR gRNA sequence
ctagaggctgaagaccctga

SEQ ID NO: 78944 - DNA, 20 bp, Artificial
  CRISPR gRNA sequence
tagaggctgaagaccctgaa

SEQ ID NO: 78945 - DNA, 20 bp, Artificial
  CRISPR gRNA sequence
gaggctgaagaccctgaagc

SEQ ID NO: 78946 - DNA, 20 bp, Artificial
  CRISPR gRNA sequence
aagaccctgaagcacaaccc

SEQ ID NO: 78947 - DNA, 20 bp, Artificial
  CRISPR gRNA sequence
aagcacaacccaaagtgagt

SEQ ID NO: 78948 - DNA, 20 bp, Artificial
  CRISPR gRNA sequence
cttgcagatgctcaagatgt

SEQ ID NO: 78949 - DNA, 20 bp, Artificial
  CRISPR gRNA sequence
gcagatgctcaagatgtgat

SEQ ID NO: 78950 - DNA, 20 bp, Artificial
  CRISPR gRNA sequence
cagatgctcaagatgtgatt

SEQ ID NO: 78951 - DNA, 20 bp, Artificial
  CRISPR gRNA sequence
aagatgtgattcagcagagc

SEQ ID NO: 78952 - DNA, 20 bp, Artificial
  CRISPR gRNA sequence
agcagagcaggaggggcaac

SEQ ID NO: 78953 - DNA, 20 bp, Artificial
  CRISPR gRNA sequence
gaggtcaaatggaaccttta

SEQ ID NO: 78954 - DNA, 20 bp, Artificial
  CRISPR gRNA sequence
aggtcaaatggaacctttat

SEQ ID NO: 78955 - DNA, 20 bp, Artificial
  CRISPR gRNA sequence
tattcaaattttggctctgc

SEQ ID NO: 78956 - DNA, 20 bp, Artificial
  CRISPR gRNA sequence
attcaaattttggctctgcc

SEQ ID NO: 78957 - DNA, 20 bp, Artificial
  CRISPR gRNA sequence
ttcaaattttggctctgcca

SEQ ID NO: 78958 - DNA, 20 bp, Artificial
  CRISPR gRNA sequence
aaattttggctctgccatgt

SEQ ID NO: 78959 - DNA, 20 bp, Artificial
  CRISPR gRNA sequence
tggctctgccatgtatagcc

SEQ ID NO: 78960 - DNA, 20 bp, Artificial
  CRISPR gRNA sequence
ggctctgccatgtatagcca

SEQ ID NO: 78961 - DNA, 20 bp, Artificial
  CRISPR gRNA sequence
gctctgccatgtatagccat

SEQ ID NO: 78962 - DNA, 20 bp, Artificial
  CRISPR gRNA sequence
tgccatgtatagccatgtgg

SEQ ID NO: 78963 - DNA, 20 bp, Artificial
  CRISPR gRNA sequence
ccatgtatagccatgtggcc

SEQ ID NO: 78964 - DNA, 20 bp, Artificial
  CRISPR gRNA sequence
gggcaaatcactgcagtcgg

SEQ ID NO: 78965 - DNA, 20 bp, Artificial
  CRISPR gRNA sequence
ggcaaatcactgcagtcggc

SEQ ID NO: 78966 - DNA, 20 bp, Artificial
  CRISPR gRNA sequence
cagtcggctcccttttctct

SEQ ID NO: 78967 - DNA, 20 bp, Artificial
  CRISPR gRNA sequence
ccttttctcttttctaaaac

SEQ ID NO: 78968 - DNA, 20 bp, Artificial
  CRISPR gRNA sequence
ttctcttttctaaaacggat

SEQ ID NO: 78969 - DNA, 20 bp, Artificial
  CRISPR gRNA sequence
tctcttttctaaaacggatg

SEQ ID NO: 78970 - DNA, 20 bp, Artificial
  CRISPR gRNA sequence
ctcttttctaaaacggatga

SEQ ID NO: 78971 - DNA, 20 bp, Artificial
  CRISPR gRNA sequence
tcttttctaaaacggatgac

SEQ ID NO: 78972 - DNA, 20 bp, Artificial
  CRISPR gRNA sequence
ttttctaaaacggatgacaa

SEQ ID NO: 78973 - DNA, 20 bp, Artificial
  CRISPR gRNA sequence
ttctaaaacggatgacaaca

SEQ ID NO: 78974 - DNA, 20 bp, Artificial
  CRISPR gRNA sequence
tctaaaacggatgacaacat

SEQ ID NO: 78975 - DNA, 20 bp, Artificial
  CRISPR gRNA sequence
ctaaaacggatgacaacatc

SEQ ID NO: 78976 - DNA, 20 bp, Artificial
  CRISPR gRNA sequence
taaaacggatgacaacatct

SEQ ID NO: 78977 - DNA, 20 bp, Artificial
  CRISPR gRNA sequence
aaacggatgacaacatctag

SEQ ID NO: 78978 - DNA, 20 bp, Artificial
  CRISPR gRNA sequence
gcacataggtacctgaagga

SEQ ID NO: 78979 - DNA, 20 bp, Artificial
  CRISPR gRNA sequence
aaggattgaatgagacaatg

SEQ ID NO: 78980 - DNA, 20 bp, Artificial
  CRISPR gRNA sequence
aatgagacaatgtatgtcca

SEQ ID NO: 78981 - DNA, 20 bp, Artificial
  CRISPR gRNA sequence
gtaaacagaagctgctattg

SEQ ID NO: 78982 - DNA, 20 bp, Artificial
  CRISPR gRNA sequence
ctattgtcgatgatgtgatg

SEQ ID NO: 78983 - DNA, 20 bp, Artificial
  CRISPR gRNA sequence
ttgtcgatgatgtgatggtc

SEQ ID NO: 78984 - DNA, 20 bp, Artificial
  CRISPR gRNA sequence
tcgatgatgtgatggtctcc

SEQ ID NO: 78985 - DNA, 20 bp, Artificial
  CRISPR gRNA sequence
catttgtggatgtgctgtct

SEQ ID NO: 78986 - DNA, 20 bp, Artificial
  CRISPR gRNA sequence
gtggatgtgctgtctgtggt

SEQ ID NO: 78987 - DNA, 20 bp, Artificial
  CRISPR gRNA sequence
tggatgtgctgtctgtggtt

SEQ ID NO: 78988 - DNA, 20 bp, Artificial
  CRISPR gRNA sequence
tctgtggttcagaaggcgag

SEQ ID NO: 78989 - DNA, 20 bp, Artificial
  CRISPR gRNA sequence
tggttcagaaggcgaggagc

SEQ ID NO: 78990 - DNA, 20 bp, Artificial
  CRISPR gRNA sequence
agaaggcgaggagcatgagc

SEQ ID NO: 78991 - DNA, 20 bp, Artificial
  CRISPR gRNA sequence
tatgcagtgagtccaggcta

SEQ ID NO: 78992 - DNA, 20 bp, Artificial
  CRISPR gRNA sequence
tggtaaaccacagactctct

SEQ ID NO: 78993 - DNA, 20 bp, Artificial
  CRISPR gRNA sequence
tctcccactgggctgaggga

SEQ ID NO: 78994 - DNA, 20 bp, Artificial
  CRISPR gRNA sequence
tcccactgggctgagggagc

SEQ ID NO: 78995 - DNA, 20 bp, Artificial
  CRISPR gRNA sequence
ccactgggctgagggagcgt

SEQ ID NO: 78996 - DNA, 20 bp, Artificial
  CRISPR gRNA sequence
ggctgagggagcgttagggg

SEQ ID NO: 78997 - DNA, 20 bp, Artificial
  CRISPR gRNA sequence
agggagcgttaggggatgca

SEQ ID NO: 78998 - DNA, 20 bp, Artificial
  CRISPR gRNA sequence
ggggatgcagggaagctagg

SEQ ID NO: 78999 - DNA, 20 bp, Artificial
  CRISPR gRNA sequence
ggacatcatgagccaggttt

SEQ ID NO: 79000 - DNA, 20 bp, Artificial
  CRISPR gRNA sequence
cacagactttttggattggt

SEQ ID NO: 79001 - DNA, 20 bp, Artificial
  CRISPR gRNA sequence
acagactttttggattggtg

SEQ ID NO: 79002 - DNA, 20 bp, Artificial
  CRISPR gRNA sequence
tttggattggtgctaaccat

SEQ ID NO: 79003 - DNA, 20 bp, Artificial
  CRISPR gRNA sequence
ttggattggtgctaaccatt

SEQ ID NO: 79004 - DNA, 20 bp, Artificial
  CRISPR gRNA sequence
tggattggtgctaaccattt

SEQ ID NO: 79005 - DNA, 20 bp, Artificial
  CRISPR gRNA sequence
ggattggtgctaaccatttt

SEQ ID NO: 79006 - DNA, 20 bp, Artificial
  CRISPR gRNA sequence
gattggtgctaaccattttt

SEQ ID NO: 79007 - DNA, 20 bp, Artificial
  CRISPR gRNA sequence
gtgctaaccatttttttttt

SEQ ID NO: 79008 - DNA, 20 bp, Artificial
  CRISPR gRNA sequence
accatttttttttttttaga

SEQ ID NO: 79009 - DNA, 20 bp, Artificial
  CRISPR gRNA sequence
ttttttttttagagacaggg

SEQ ID NO: 79010 - DNA, 20 bp, Artificial
  CRISPR gRNA sequence
tttttttttagagacagggt

SEQ ID NO: 79011 - DNA, 20 bp, Artificial
  CRISPR gRNA sequence
ttttttttagagacagggtc

SEQ ID NO: 79012 - DNA, 20 bp, Artificial
  CRISPR gRNA sequence
tttttttagagacagggtcc

SEQ ID NO: 79013 - DNA, 20 bp, Artificial
  CRISPR gRNA sequence
ttttttagagacagggtccc

SEQ ID NO: 79014 - DNA, 20 bp, Artificial
  CRISPR gRNA sequence
tttttagagacagggtccca

SEQ ID NO: 79015 - DNA, 20 bp, Artificial
  CRISPR gRNA sequence
ttttagagacagggtcccac

SEQ ID NO: 79016 - DNA, 20 bp, Artificial
  CRISPR gRNA sequence
tttagagacagggtcccact

SEQ ID NO: 79017 - DNA, 20 bp, Artificial
  CRISPR gRNA sequence
ttagagacagggtcccactc

SEQ ID NO: 79018 - DNA, 20 bp, Artificial
  CRISPR gRNA sequence
tagagacagggtcccactca

SEQ ID NO: 79019 - DNA, 20 bp, Artificial
  CRISPR gRNA sequence
agagacagggtcccactcag

SEQ ID NO: 79020 - DNA, 20 bp, Artificial
  CRISPR gRNA sequence
gagacagggtcccactcagt

SEQ ID NO: 79021 - DNA, 20 bp, Artificial
  CRISPR gRNA sequence
agtccccaagctggagtgca

SEQ ID NO: 79022 - DNA, 20 bp, Artificial
  CRISPR gRNA sequence
gagtgcagtggctctatccc

SEQ ID NO: 79023 - DNA, 20 bp, Artificial
  CRISPR gRNA sequence
tatcccagttcactgcagcc

SEQ ID NO: 79024 - DNA, 20 bp, Artificial
  CRISPR gRNA sequence
tcccagttcactgcagcctc

SEQ ID NO: 79025 - DNA, 20 bp, Artificial
  CRISPR gRNA sequence
actgcagcctcaaactcctg

SEQ ID NO: 79026 - DNA, 20 bp, Artificial
  CRISPR gRNA sequence
cagcctcaaactcctgggct

SEQ ID NO: 79027 - DNA, 20 bp, Artificial
  CRISPR gRNA sequence
aaactcctgggctcaagtga

SEQ ID NO: 79028 - DNA, 20 bp, Artificial
  CRISPR gRNA sequence
ctgggctcaagtgatcctcc

SEQ ID NO: 79029 - DNA, 20 bp, Artificial
  CRISPR gRNA sequence
ggctcaagtgatcctcccac

SEQ ID NO: 79030 - DNA, 20 bp, Artificial
  CRISPR gRNA sequence
aagtgatcctcccaccttgg

SEQ ID NO: 79031 - DNA, 20 bp, Artificial
  CRISPR gRNA sequence
ccaccttggcttcctgagta

SEQ ID NO: 79032 - DNA, 20 bp, Artificial
  CRISPR gRNA sequence
ggcttcctgagtaactggta

SEQ ID NO: 79033 - DNA, 20 bp, Artificial
  CRISPR gRNA sequence
gcttcctgagtaactggtac

SEQ ID NO: 79034 - DNA, 20 bp, Artificial
  CRISPR gRNA sequence
cctgagtaactggtactata

SEQ ID NO: 79035 - DNA, 20 bp, Artificial
  CRISPR gRNA sequence
ctgagtaactggtactatag

SEQ ID NO: 79036 - DNA, 20 bp, Artificial
  CRISPR gRNA sequence
agtaactggtactataggag

SEQ ID NO: 79037 - DNA, 20 bp, Artificial
  CRISPR gRNA sequence
gtactataggagtgaatcac

SEQ ID NO: 79038 - DNA, 20 bp, Artificial
  CRISPR gRNA sequence
taggagtgaatcaccatgcc

SEQ ID NO: 79039 - DNA, 20 bp, Artificial
  CRISPR gRNA sequence
ttttttttttttttttgtag

SEQ ID NO: 79040 - DNA, 20 bp, Artificial
  CRISPR gRNA sequence
tttttttttttttgtagaga

SEQ ID NO: 79041 - DNA, 20 bp, Artificial
  CRISPR gRNA sequence
ttttttttttttgtagagat

SEQ ID NO: 79042 - DNA, 20 bp, Artificial
  CRISPR gRNA sequence
tttttttttttgtagagatg

SEQ ID NO: 79043 - DNA, 20 bp, Artificial
  CRISPR gRNA sequence
ttttttttttgtagagatgg

SEQ ID NO: 79044 - DNA, 20 bp, Artificial
  CRISPR gRNA sequence
tttttttttgtagagatggg

SEQ ID NO: 79045 - DNA, 20 bp, Artificial
  CRISPR gRNA sequence
ttttttttgtagagatgggg

SEQ ID NO: 79046 - DNA, 20 bp, Artificial
  CRISPR gRNA sequence
tttttttgtagagatggggg

SEQ ID NO: 79047 - DNA, 20 bp, Artificial
  CRISPR gRNA sequence
ttttttgtagagatgggggt

SEQ ID NO: 79048 - DNA, 20 bp, Artificial
  CRISPR gRNA sequence
tttttgtagagatgggggtc

SEQ ID NO: 79049 - DNA, 20 bp, Artificial
  CRISPR gRNA sequence
ttttgtagagatgggggtct

SEQ ID NO: 79050 - DNA, 20 bp, Artificial
  CRISPR gRNA sequence
tttgtagagatgggggtctc

SEQ ID NO: 79051 - DNA, 20 bp, Artificial
  CRISPR gRNA sequence
ttgtagagatgggggtctca

SEQ ID NO: 79052 - DNA, 20 bp, Artificial
  CRISPR gRNA sequence
tgtagagatgggggtctcac

SEQ ID NO: 79053 - DNA, 20 bp, Artificial
  CRISPR gRNA sequence
gtagagatgggggtctcact

SEQ ID NO: 79054 - DNA, 20 bp, Artificial
  CRISPR gRNA sequence
tagagatgggggtctcactt

SEQ ID NO: 79055 - DNA, 20 bp, Artificial
  CRISPR gRNA sequence
actttgttgcccaggctggt

SEQ ID NO: 79056 - DNA, 20 bp, Artificial
  CRISPR gRNA sequence
tgttgcccaggctggtcttg

SEQ ID NO: 79057 - DNA, 20 bp, Artificial
  CRISPR gRNA sequence
gttgcccaggctggtcttga

SEQ ID NO: 79058 - DNA, 20 bp, Artificial
  CRISPR gRNA sequence
ttgcccaggctggtcttgaa

SEQ ID NO: 79059 - DNA, 20 bp, Artificial
  CRISPR gRNA sequence
cccaggctggtcttgaactc

SEQ ID NO: 79060 - DNA, 20 bp, Artificial
  CRISPR gRNA sequence
gtcttgaactcctagcttca

SEQ ID NO: 79061 - DNA, 20 bp, Artificial
  CRISPR gRNA sequence
gaactcctagcttcaagcga

SEQ ID NO: 79062 - DNA, 20 bp, Artificial
  CRISPR gRNA sequence
aactcctagcttcaagcgat

SEQ ID NO: 79063 - DNA, 20 bp, Artificial
  CRISPR gRNA sequence
ctagcttcaagcgatcctgc

SEQ ID NO: 79064 - DNA, 20 bp, Artificial
  CRISPR gRNA sequence
gcttcaagcgatcctgcccc

SEQ ID NO: 79065 - DNA, 20 bp, Artificial
  CRISPR gRNA sequence
caagcgatcctgccccctca

SEQ ID NO: 79066 - DNA, 20 bp, Artificial
  CRISPR gRNA sequence
aagcgatcctgccccctcag

SEQ ID NO: 79067 - DNA, 20 bp, Artificial
  CRISPR gRNA sequence
ccccctcagcctctcaaagt

SEQ ID NO: 79068 - DNA, 20 bp, Artificial
  CRISPR gRNA sequence
agcctctcaaagtgctgggg

SEQ ID NO: 79069 - DNA, 20 bp, Artificial
  CRISPR gRNA sequence
tcaaagtgctggggttacag

SEQ ID NO: 79070 - DNA, 20 bp, Artificial
  CRISPR gRNA sequence
aaagtgctggggttacagac

SEQ ID NO: 79071 - DNA, 20 bp, Artificial
  CRISPR gRNA sequence
gggttacagacatgagccac

SEQ ID NO: 79072 - DNA, 20 bp, Artificial
  CRISPR gRNA sequence
cagacatgagccaccatgcc

SEQ ID NO: 79073 - DNA, 20 bp, Artificial
  CRISPR gRNA sequence
tttaatagaactttctgcaa

SEQ ID NO: 79074 - DNA, 20 bp, Artificial
  CRISPR gRNA sequence
aatagaactttctgcaatga

SEQ ID NO: 79075 - DNA, 20 bp, Artificial
  CRISPR gRNA sequence
atagaactttctgcaatgat

SEQ ID NO: 79076 - DNA, 20 bp, Artificial
  CRISPR gRNA sequence
tctgcaatgatggaaatgtc

SEQ ID NO: 79077 - DNA, 20 bp, Artificial
  CRISPR gRNA sequence
ctgcaatgatggaaatgtcc

SEQ ID NO: 79078 - DNA, 20 bp, Artificial
  CRISPR gRNA sequence
tgcaatgatggaaatgtcct

SEQ ID NO: 79079 - DNA, 20 bp, Artificial
  CRISPR gRNA sequence
caatgatggaaatgtcctgg

SEQ ID NO: 79080 - DNA, 20 bp, Artificial
  CRISPR gRNA sequence
gcatctgtaccacttgctat

SEQ ID NO: 79081 - DNA, 20 bp, Artificial
  CRISPR gRNA sequence
taccacttgctatgggagcc

SEQ ID NO: 79082 - DNA, 20 bp, Artificial
  CRISPR gRNA sequence
gctatgggagccactagcca

SEQ ID NO: 79083 - DNA, 20 bp, Artificial
  CRISPR gRNA sequence
ctatgggagccactagccac

SEQ ID NO: 79084 - DNA, 20 bp, Artificial
  CRISPR gRNA sequence
tgggagccactagccaccta

SEQ ID NO: 79085 - DNA, 20 bp, Artificial
  CRISPR gRNA sequence
gccacctatggccactgagc

SEQ ID NO: 79086 - DNA, 20 bp, Artificial
  CRISPR gRNA sequence
tggccactgagcagttgaaa

SEQ ID NO: 79087 - DNA, 20 bp, Artificial
  CRISPR gRNA sequence
agcagttgaaatatagctaa

SEQ ID NO: 79088 - DNA, 20 bp, Artificial
  CRISPR gRNA sequence
aaatatagctaatgtgacta

SEQ ID NO: 79089 - DNA, 20 bp, Artificial
  CRISPR gRNA sequence
atgtgactaatgaactgaaa

SEQ ID NO: 79090 - DNA, 20 bp, Artificial
  CRISPR gRNA sequence
atgaactgaaaatttcattt

SEQ ID NO: 79091 - DNA, 20 bp, Artificial
  CRISPR gRNA sequence
aaaatttcattttacttaat

SEQ ID NO: 79092 - DNA, 20 bp, Artificial
  CRISPR gRNA sequence
cattttacttaattttaatt

SEQ ID NO: 79093 - DNA, 20 bp, Artificial
  CRISPR gRNA sequence
attttacttaattttaattt

SEQ ID NO: 79094 - DNA, 20 bp, Artificial
  CRISPR gRNA sequence
tacttaattttaatttattt

SEQ ID NO: 79095 - DNA, 20 bp, Artificial
  CRISPR gRNA sequence
acttaattttaatttattta

SEQ ID NO: 79096 - DNA, 20 bp, Artificial
  CRISPR gRNA sequence
cttaattttaatttatttaa

SEQ ID NO: 79097 - DNA, 20 bp, Artificial
  CRISPR gRNA sequence
aattttaatttatttaaatt

SEQ ID NO: 79098 - DNA, 20 bp, Artificial
  CRISPR gRNA sequence
attttaatttatttaaatta

SEQ ID NO: 79099 - DNA, 20 bp, Artificial
  CRISPR gRNA sequence
taatttatttaaattaaaat

SEQ ID NO: 79100 - DNA, 20 bp, Artificial
  CRISPR gRNA sequence
aatttatttaaattaaaata

SEQ ID NO: 79101 - DNA, 20 bp, Artificial
  CRISPR gRNA sequence
atttatttaaattaaaatag

SEQ ID NO: 79102 - DNA, 20 bp, Artificial
  CRISPR gRNA sequence
atttaaattaaaatagcatt

SEQ ID NO: 79103 - DNA, 20 bp, Artificial
  CRISPR gRNA sequence
tttaaattaaaatagcatta

SEQ ID NO: 79104 - DNA, 20 bp, Artificial
  CRISPR gRNA sequence
aaattaaaatagcattaaaa

SEQ ID NO: 79105 - DNA, 20 bp, Artificial
  CRISPR gRNA sequence
aattaaaatagcattaaaat

SEQ ID NO: 79106 - DNA, 20 bp, Artificial
  CRISPR gRNA sequence
aaatagcattaaaattttaa

SEQ ID NO: 79107 - DNA, 20 bp, Artificial
  CRISPR gRNA sequence
aaattttaatttatttaaat

SEQ ID NO: 79108 - DNA, 20 bp, Artificial
  CRISPR gRNA sequence
taatttatttaaattgaaat

SEQ ID NO: 79109 - DNA, 20 bp, Artificial
  CRISPR gRNA sequence
aatttatttaaattgaaata

SEQ ID NO: 79110 - DNA, 20 bp, Artificial
  CRISPR gRNA sequence
atttatttaaattgaaatag

SEQ ID NO: 79111 - DNA, 20 bp, Artificial
  CRISPR gRNA sequence
atttaaattgaaatagcatt

SEQ ID NO: 79112 - DNA, 20 bp, Artificial
  CRISPR gRNA sequence
tttaaattgaaatagcatta

SEQ ID NO: 79113 - DNA, 20 bp, Artificial
  CRISPR gRNA sequence
aaattgaaatagcattaaaa

SEQ ID NO: 79114 - DNA, 20 bp, Artificial
  CRISPR gRNA sequence
aattgaaatagcattaaaat

SEQ ID NO: 79115 - DNA, 20 bp, Artificial
  CRISPR gRNA sequence
aaatagcattaaaattttaa

SEQ ID NO: 79116 - DNA, 20 bp, Artificial
  CRISPR gRNA sequence
aaattttaatttatttaaat

SEQ ID NO: 79117 - DNA, 20 bp, Artificial
  CRISPR gRNA sequence
taatttatttaaattgaaat

SEQ ID NO: 79118 - DNA, 20 bp, Artificial
  CRISPR gRNA sequence
aatttatttaaattgaaata

SEQ ID NO: 79119 - DNA, 20 bp, Artificial
  CRISPR gRNA sequence
atttatttaaattgaaatag

SEQ ID NO: 79120 - DNA, 20 bp, Artificial
  CRISPR gRNA sequence
atttaaattgaaatagccat

SEQ ID NO: 79121 - DNA, 20 bp, Artificial
  CRISPR gRNA sequence
tttaaattgaaatagccata

SEQ ID NO: 79122 - DNA, 20 bp, Artificial
  CRISPR gRNA sequence
aaattgaaatagccatatgg

SEQ ID NO: 79123 - DNA, 20 bp, Artificial
  CRISPR gRNA sequence
aattgaaatagccatatggg

SEQ ID NO: 79124 - DNA, 20 bp, Artificial
  CRISPR gRNA sequence
aaatagccatatggggctag

SEQ ID NO: 79125 - DNA, 20 bp, Artificial
  CRISPR gRNA sequence
gtggctatcctactgagcat

SEQ ID NO: 79126 - DNA, 20 bp, Artificial
  CRISPR gRNA sequence
tcctactgagcatcacagct

SEQ ID NO: 79127 - DNA, 20 bp, Artificial
  CRISPR gRNA sequence
ctgagcatcacagctttaag

SEQ ID NO: 79128 - DNA, 20 bp, Artificial
  CRISPR gRNA sequence
agcatcacagctttaagcag

SEQ ID NO: 79129 - DNA, 20 bp, Artificial
  CRISPR gRNA sequence
taagcagttagagggaaaag

SEQ ID NO: 79130 - DNA, 20 bp, Artificial
  CRISPR gRNA sequence
aagcagttagagggaaaaga

SEQ ID NO: 79131 - DNA, 20 bp, Artificial
  CRISPR gRNA sequence
agcagttagagggaaaagaa

SEQ ID NO: 79132 - DNA, 20 bp, Artificial
  CRISPR gRNA sequence
gagggaaaagaaagtgacac

SEQ ID NO: 79133 - DNA, 20 bp, Artificial
  CRISPR gRNA sequence
gtcctagtgggtcatttttt

SEQ ID NO: 79134 - DNA, 20 bp, Artificial
  CRISPR gRNA sequence
gtgggtcattttttgagaca

SEQ ID NO: 79135 - DNA, 20 bp, Artificial
  CRISPR gRNA sequence
tttgagacagagtccctctc

SEQ ID NO: 79136 - DNA, 20 bp, Artificial
  CRISPR gRNA sequence
ttgagacagagtccctctct

SEQ ID NO: 79137 - DNA, 20 bp, Artificial
  CRISPR gRNA sequence
tgagacagagtccctctctg

SEQ ID NO: 79138 - DNA, 20 bp, Artificial
  CRISPR gRNA sequence
gagacagagtccctctctgt

SEQ ID NO: 79139 - DNA, 20 bp, Artificial
  CRISPR gRNA sequence
agacagagtccctctctgtc

SEQ ID NO: 79140 - DNA, 20 bp, Artificial
  CRISPR gRNA sequence
tctgtcacccaggctggagt

SEQ ID NO: 79141 - DNA, 20 bp, Artificial
  CRISPR gRNA sequence
tgtcacccaggctggagtac

SEQ ID NO: 79142 - DNA, 20 bp, Artificial
  CRISPR gRNA sequence
tcacccaggctggagtacag

SEQ ID NO: 79143 - DNA, 20 bp, Artificial
  CRISPR gRNA sequence
gagtacagtggtgtgatcat

SEQ ID NO: 79144 - DNA, 20 bp, Artificial
  CRISPR gRNA sequence
aagctcccaggctcaagcga

SEQ ID NO: 79145 - DNA, 20 bp, Artificial
  CRISPR gRNA sequence
ccaggctcaagcgatcctcc

SEQ ID NO: 79146 - DNA, 20 bp, Artificial
  CRISPR gRNA sequence
aagcgatcctcccaacgtca

SEQ ID NO: 79147 - DNA, 20 bp, Artificial
  CRISPR gRNA sequence
ccaacgtcagcatcttgagt

SEQ ID NO: 79148 - DNA, 20 bp, Artificial
  CRISPR gRNA sequence
gagtagctgggactacaggt

SEQ ID NO: 79149 - DNA, 20 bp, Artificial
  CRISPR gRNA sequence
agtagctgggactacaggtg

SEQ ID NO: 79150 - DNA, 20 bp, Artificial
  CRISPR gRNA sequence
ggactacaggtgtgcaccac

SEQ ID NO: 79151 - DNA, 20 bp, Artificial
  CRISPR gRNA sequence
caggtgtgcaccaccacgcc

SEQ ID NO: 79152 - DNA, 20 bp, Artificial
  CRISPR gRNA sequence
ccttttttttttagagatgg

SEQ ID NO: 79153 - DNA, 20 bp, Artificial
  CRISPR gRNA sequence
ttttttttagagatggggtc

SEQ ID NO: 79154 - DNA, 20 bp, Artificial
  CRISPR gRNA sequence
tttttttagagatggggtct

SEQ ID NO: 79155 - DNA, 20 bp, Artificial
  CRISPR gRNA sequence
ttttttagagatggggtctt

SEQ ID NO: 79156 - DNA, 20 bp, Artificial
  CRISPR gRNA sequence
tttttagagatggggtcttg

SEQ ID NO: 79157 - DNA, 20 bp, Artificial
  CRISPR gRNA sequence
ttttagagatggggtcttgc

SEQ ID NO: 79158 - DNA, 20 bp, Artificial
  CRISPR gRNA sequence
tttagagatggggtcttgct

SEQ ID NO: 79159 - DNA, 20 bp, Artificial
  CRISPR gRNA sequence
ttagagatggggtcttgcta

SEQ ID NO: 79160 - DNA, 20 bp, Artificial
  CRISPR gRNA sequence
tagagatggggtcttgctat

SEQ ID NO: 79161 - DNA, 20 bp, Artificial
  CRISPR gRNA sequence
agagatggggtcttgctatg

SEQ ID NO: 79162 - DNA, 20 bp, Artificial
  CRISPR gRNA sequence
gagatggggtcttgctatgt

SEQ ID NO: 79163 - DNA, 20 bp, Artificial
  CRISPR gRNA sequence
gctatgttgcccaggctggt

SEQ ID NO: 79164 - DNA, 20 bp, Artificial
  CRISPR gRNA sequence
ctatgttgcccaggctggtc

SEQ ID NO: 79165 - DNA, 20 bp, Artificial
  CRISPR gRNA sequence
tgttgcccaggctggtcttg

SEQ ID NO: 79166 - DNA, 20 bp, Artificial
  CRISPR gRNA sequence
cccaggctggtcttgaacac

SEQ ID NO: 79167 - DNA, 20 bp, Artificial
  CRISPR gRNA sequence
gtcttgaacacctggaatca

SEQ ID NO: 79168 - DNA, 20 bp, Artificial
  CRISPR gRNA sequence
gaacacctggaatcaagaga

SEQ ID NO: 79169 - DNA, 20 bp, Artificial
  CRISPR gRNA sequence
aacacctggaatcaagagat

SEQ ID NO: 79170 - DNA, 20 bp, Artificial
  CRISPR gRNA sequence
gaatcaagagattctcgtgc

SEQ ID NO: 79171 - DNA, 20 bp, Artificial
  CRISPR gRNA sequence
tcgtgcttggcgttccaaag

SEQ ID NO: 79172 - DNA, 20 bp, Artificial
  CRISPR gRNA sequence
gtgcttggcgttccaaagtg

SEQ ID NO: 79173 - DNA, 20 bp, Artificial
  CRISPR gRNA sequence
ggcgttccaaagtgctagga

SEQ ID NO: 79174 - DNA, 20 bp, Artificial
  CRISPR gRNA sequence
gcgttccaaagtgctaggat

SEQ ID NO: 79175 - DNA, 20 bp, Artificial
  CRISPR gRNA sequence
caaagtgctaggattacagg

SEQ ID NO: 79176 - DNA, 20 bp, Artificial
  CRISPR gRNA sequence
ggattacaggcatgagccac

SEQ ID NO: 79177 - DNA, 20 bp, Artificial
  CRISPR gRNA sequence
caggcatgagccaccgcacc

SEQ ID NO: 79178 - DNA, 20 bp, Artificial
  CRISPR gRNA sequence
gtcctacactaccaggtcat

SEQ ID NO: 79179 - DNA, 20 bp, Artificial
  CRISPR gRNA sequence
cactaccaggtcattataca

SEQ ID NO: 79180 - DNA, 20 bp, Artificial
  CRISPR gRNA sequence
ccaggtcattatacaagcaa

SEQ ID NO: 79181 - DNA, 20 bp, Artificial
  CRISPR gRNA sequence
tacaagcaaggaatcgagat

SEQ ID NO: 79182 - DNA, 20 bp, Artificial
  CRISPR gRNA sequence
ctcaggggcatacatacatc

SEQ ID NO: 79183 - DNA, 20 bp, Artificial
  CRISPR gRNA sequence
aggggcatacatacatctgt

SEQ ID NO: 79184 - DNA, 20 bp, Artificial
  CRISPR gRNA sequence
tctctgagtcttagccagga

SEQ ID NO: 79185 - DNA, 20 bp, Artificial
  CRISPR gRNA sequence
tgagtcttagccaggagagc

SEQ ID NO: 79186 - DNA, 20 bp, Artificial
  CRISPR gRNA sequence
agtcttagccaggagagcaa

SEQ ID NO: 79187 - DNA, 20 bp, Artificial
  CRISPR gRNA sequence
agccaggagagcaaagtgtg

SEQ ID NO: 79188 - DNA, 20 bp, Artificial
  CRISPR gRNA sequence
gccaggagagcaaagtgtgg

SEQ ID NO: 79189 - DNA, 20 bp, Artificial
  CRISPR gRNA sequence
ggatggtcttttagggaaaa

SEQ ID NO: 79190 - DNA, 20 bp, Artificial
  CRISPR gRNA sequence
ttagggaaaagcagctccct

SEQ ID NO: 79191 - DNA, 20 bp, Artificial
  CRISPR gRNA sequence
tagggaaaagcagctccctt

SEQ ID NO: 79192 - DNA, 20 bp, Artificial
  CRISPR gRNA sequence
agggaaaagcagctcccttt

SEQ ID NO: 79193 - DNA, 20 bp, Artificial
  CRISPR gRNA sequence
gggaaaagcagctccctttt

SEQ ID NO: 79194 - DNA, 20 bp, Artificial
  CRISPR gRNA sequence
ccttttctcagcccatccaa

SEQ ID NO: 79195 - DNA, 20 bp, Artificial
  CRISPR gRNA sequence
ttctcagcccatccaagact

SEQ ID NO: 79196 - DNA, 20 bp, Artificial
  CRISPR gRNA sequence
tctcagcccatccaagactg

SEQ ID NO: 79197 - DNA, 20 bp, Artificial
  CRISPR gRNA sequence
ctcagcccatccaagactgg

SEQ ID NO: 79198 - DNA, 20 bp, Artificial
  CRISPR gRNA sequence
tcagcccatccaagactggc

SEQ ID NO: 79199 - DNA, 20 bp, Artificial
  CRISPR gRNA sequence
agcccatccaagactggcca

SEQ ID NO: 79200 - DNA, 20 bp, Artificial
  CRISPR gRNA sequence
gccaagctggaatccatgca

SEQ ID NO: 79201 - DNA, 20 bp, Artificial
  CRISPR gRNA sequence
gaatccatgcacagctggaa

SEQ ID NO: 79202 - DNA, 20 bp, Artificial
  CRISPR gRNA sequence
gaatagccagcatttgactg

SEQ ID NO: 79203 - DNA, 20 bp, Artificial
  CRISPR gRNA sequence
gactgcccactgcatgccaa

SEQ ID NO: 79204 - DNA, 20 bp, Artificial
  CRISPR gRNA sequence
actgcccactgcatgccaac

SEQ ID NO: 79205 - DNA, 20 bp, Artificial
  CRISPR gRNA sequence
cccactgcatgccaacagtg

SEQ ID NO: 79206 - DNA, 20 bp, Artificial
  CRISPR gRNA sequence
catgccaacagtgctctaaa

SEQ ID NO: 79207 - DNA, 20 bp, Artificial
  CRISPR gRNA sequence
taaactccttaagtgtagta

SEQ ID NO: 79208 - DNA, 20 bp, Artificial
  CRISPR gRNA sequence
aactccttaagtgtagtaac

SEQ ID NO: 79209 - DNA, 20 bp, Artificial
  CRISPR gRNA sequence
cttaagtgtagtaactcatt

SEQ ID NO: 79210 - DNA, 20 bp, Artificial
  CRISPR gRNA sequence
aagtgtagtaactcatttaa

SEQ ID NO: 79211 - DNA, 20 bp, Artificial
  CRISPR gRNA sequence
agtgtagtaactcatttaat

SEQ ID NO: 79212 - DNA, 20 bp, Artificial
  CRISPR gRNA sequence
atttaattctcagaacaacc

SEQ ID NO: 79213 - DNA, 20 bp, Artificial
  CRISPR gRNA sequence
aattctcagaacaaccctaa

SEQ ID NO: 79214 - DNA, 20 bp, Artificial
  CRISPR gRNA sequence
attctcagaacaaccctaag

SEQ ID NO: 79215 - DNA, 20 bp, Artificial
  CRISPR gRNA sequence
tcagaacaaccctaagatgt

SEQ ID NO: 79216 - DNA, 20 bp, Artificial
  CRISPR gRNA sequence
agaacaaccctaagatgtag

SEQ ID NO: 79217 - DNA, 20 bp, Artificial
  CRISPR gRNA sequence
agatgtaggtaccataattg

SEQ ID NO: 79218 - DNA, 20 bp, Artificial
  CRISPR gRNA sequence
ccctccctgtcttttttcag

SEQ ID NO: 79219 - DNA, 20 bp, Artificial
  CRISPR gRNA sequence
cctgtcttttttcagttgta

SEQ ID NO: 79220 - DNA, 20 bp, Artificial
  CRISPR gRNA sequence
tcttttttcagttgtaaggg

SEQ ID NO: 79221 - DNA, 20 bp, Artificial
  CRISPR gRNA sequence
ttttcagttgtaagggcttt

SEQ ID NO: 79222 - DNA, 20 bp, Artificial
  CRISPR gRNA sequence
tttcagttgtaagggctttt

SEQ ID NO: 79223 - DNA, 20 bp, Artificial
  CRISPR gRNA sequence
ttcagttgtaagggcttttc

SEQ ID NO: 79224 - DNA, 20 bp, Artificial
  CRISPR gRNA sequence
tcagttgtaagggcttttcc

SEQ ID NO: 79225 - DNA, 20 bp, Artificial
  CRISPR gRNA sequence
cagttgtaagggcttttcca

SEQ ID NO: 79226 - DNA, 20 bp, Artificial
  CRISPR gRNA sequence
agttgtaagggcttttccag

SEQ ID NO: 79227 - DNA, 20 bp, Artificial
  CRISPR gRNA sequence
taagggcttttccagagttt

SEQ ID NO: 79228 - DNA, 20 bp, Artificial
  CRISPR gRNA sequence
ttccagagttttcaccatct

SEQ ID NO: 79229 - DNA, 20 bp, Artificial
  CRISPR gRNA sequence
tccagagttttcaccatcta

SEQ ID NO: 79230 - DNA, 20 bp, Artificial
  CRISPR gRNA sequence
ccagagttttcaccatctag

SEQ ID NO: 79231 - DNA, 20 bp, Artificial
  CRISPR gRNA sequence
cagagttttcaccatctagt

SEQ ID NO: 79232 - DNA, 20 bp, Artificial
  CRISPR gRNA sequence
tcaccatctagtaatgccag

SEQ ID NO: 79233 - DNA, 20 bp, Artificial
  CRISPR gRNA sequence
caccatctagtaatgccagt

SEQ ID NO: 79234 - DNA, 20 bp, Artificial
  CRISPR gRNA sequence
accatctagtaatgccagtc

SEQ ID NO: 79235 - DNA, 20 bp, Artificial
  CRISPR gRNA sequence
gtaatgccagtctaacagta

SEQ ID NO: 79236 - DNA, 20 bp, Artificial
  CRISPR gRNA sequence
acagtatctttatgttctcc

SEQ ID NO: 79237 - DNA, 20 bp, Artificial
  CRISPR gRNA sequence
tatgttctccccaagggttt

SEQ ID NO: 79238 - DNA, 20 bp, Artificial
  CRISPR gRNA sequence
atgttctccccaagggtttg

SEQ ID NO: 79239 - DNA, 20 bp, Artificial
  CRISPR gRNA sequence
tgttctccccaagggtttgc

SEQ ID NO: 79240 - DNA, 20 bp, Artificial
  CRISPR gRNA sequence
tccccaagggtttgccttcc

SEQ ID NO: 79241 - DNA, 20 bp, Artificial
  CRISPR gRNA sequence
cccaagggtttgccttcctc

SEQ ID NO: 79242 - DNA, 20 bp, Artificial
  CRISPR gRNA sequence
gccttcctctgagtcttctg

SEQ ID NO: 79243 - DNA, 20 bp, Artificial
  CRISPR gRNA sequence
ccttcctctgagtcttctgg

SEQ ID NO: 79244 - DNA, 20 bp, Artificial
  CRISPR gRNA sequence
cctctgagtcttctggggat

SEQ ID NO: 79245 - DNA, 20 bp, Artificial
  CRISPR gRNA sequence
ctctgagtcttctggggatg

SEQ ID NO: 79246 - DNA, 20 bp, Artificial
  CRISPR gRNA sequence
tgagtcttctggggatgctt

SEQ ID NO: 79247 - DNA, 20 bp, Artificial
  CRISPR gRNA sequence
agtcttctggggatgcttcc

SEQ ID NO: 79248 - DNA, 20 bp, Artificial
  CRISPR gRNA sequence
ctggggatgcttccttccac

SEQ ID NO: 79249 - DNA, 20 bp, Artificial
  CRISPR gRNA sequence
tggggatgcttccttccaca

SEQ ID NO: 79250 - DNA, 20 bp, Artificial
  CRISPR gRNA sequence
gggatgcttccttccacagg

SEQ ID NO: 79251 - DNA, 20 bp, Artificial
  CRISPR gRNA sequence
ccttccacagggaccagatg

SEQ ID NO: 79252 - DNA, 20 bp, Artificial
  CRISPR gRNA sequence
cttccacagggaccagatgt

SEQ ID NO: 79253 - DNA, 20 bp, Artificial
  CRISPR gRNA sequence
ccacagggaccagatgtggt

SEQ ID NO: 79254 - DNA, 20 bp, Artificial
  CRISPR gRNA sequence
cacagggaccagatgtggtc

SEQ ID NO: 79255 - DNA, 20 bp, Artificial
  CRISPR gRNA sequence
gacacgctagaggaagttaa

SEQ ID NO: 79256 - DNA, 20 bp, Artificial
  CRISPR gRNA sequence
gaggaagttaaaatcctttg

SEQ ID NO: 79257 - DNA, 20 bp, Artificial
  CRISPR gRNA sequence
aaatcctttgccaacctaag

SEQ ID NO: 79258 - DNA, 20 bp, Artificial
  CRISPR gRNA sequence
tgccaacctaagcagtaatt

SEQ ID NO: 79259 - DNA, 20 bp, Artificial
  CRISPR gRNA sequence
gccaacctaagcagtaattc

SEQ ID NO: 79260 - DNA, 20 bp, Artificial
  CRISPR gRNA sequence
ccaacctaagcagtaattca

SEQ ID NO: 79261 - DNA, 20 bp, Artificial
  CRISPR gRNA sequence
agcagtaattcattcctcag

SEQ ID NO: 79262 - DNA, 20 bp, Artificial
  CRISPR gRNA sequence
attcctcagtgcagcagtag

SEQ ID NO: 79263 - DNA, 20 bp, Artificial
  CRISPR gRNA sequence
ctcagtgcagcagtagcagg

SEQ ID NO: 79264 - DNA, 20 bp, Artificial
  CRISPR gRNA sequence
agtgcagcagtagcaggaag

SEQ ID NO: 79265 - DNA, 20 bp, Artificial
  CRISPR gRNA sequence
ccataccccagctcttccta

SEQ ID NO: 79266 - DNA, 20 bp, Artificial
  CRISPR gRNA sequence
ttcctagtctcttggtcacc

SEQ ID NO: 79267 - DNA, 20 bp, Artificial
  CRISPR gRNA sequence
cctagtctcttggtcacctt

SEQ ID NO: 79268 - DNA, 20 bp, Artificial
  CRISPR gRNA sequence
ctagtctcttggtcaccttt

SEQ ID NO: 79269 - DNA, 20 bp, Artificial
  CRISPR gRNA sequence
gtctcttggtcacctttccc

SEQ ID NO: 79270 - DNA, 20 bp, Artificial
  CRISPR gRNA sequence
ttggtcacctttcccctcaa

SEQ ID NO: 79271 - DNA, 20 bp, Artificial
  CRISPR gRNA sequence
ggtcacctttcccctcaact

SEQ ID NO: 79272 - DNA, 20 bp, Artificial
  CRISPR gRNA sequence
gtcacctttcccctcaactg

SEQ ID NO: 79273 - DNA, 20 bp, Artificial
  CRISPR gRNA sequence
tcccctcaactgcctgagcc

SEQ ID NO: 79274 - DNA, 20 bp, Artificial
  CRISPR gRNA sequence
cccctcaactgcctgagccc

SEQ ID NO: 79275 - DNA, 20 bp, Artificial
  CRISPR gRNA sequence
ccctcaactgcctgagccca

SEQ ID NO: 79276 - DNA, 20 bp, Artificial
  CRISPR gRNA sequence
aactgcctgagcccaagttg

SEQ ID NO: 79277 - DNA, 20 bp, Artificial
  CRISPR gRNA sequence
cctgagcccaagttgcttct

SEQ ID NO: 79278 - DNA, 20 bp, Artificial
  CRISPR gRNA sequence
agcccaagttgcttctaagg

SEQ ID NO: 79279 - DNA, 20 bp, Artificial
  CRISPR gRNA sequence
cttctaaggatggccccagg

SEQ ID NO: 79280 - DNA, 20 bp, Artificial
  CRISPR gRNA sequence
ctaaggatggccccaggccc

SEQ ID NO: 79281 - DNA, 20 bp, Artificial
  CRISPR gRNA sequence
taaggatggccccaggccca

SEQ ID NO: 79282 - DNA, 20 bp, Artificial
  CRISPR gRNA sequence
aggatggccccaggcccacc

SEQ ID NO: 79283 - DNA, 20 bp, Artificial
  CRISPR gRNA sequence
ttggcttcttacctttgtag

SEQ ID NO: 79284 - DNA, 20 bp, Artificial
  CRISPR gRNA sequence
ggcttcttacctttgtagct

SEQ ID NO: 79285 - DNA, 20 bp, Artificial
  CRISPR gRNA sequence
gcttcttacctttgtagctc

SEQ ID NO: 79286 - DNA, 20 bp, Artificial
  CRISPR gRNA sequence
cttacctttgtagctctgca

SEQ ID NO: 79287 - DNA, 20 bp, Artificial
  CRISPR gRNA sequence
ttacctttgtagctctgcag

SEQ ID NO: 79288 - DNA, 20 bp, Artificial
  CRISPR gRNA sequence
acctttgtagctctgcagtt

SEQ ID NO: 79289 - DNA, 20 bp, Artificial
  CRISPR gRNA sequence
cctttgtagctctgcagttg

SEQ ID NO: 79290 - DNA, 20 bp, Artificial
  CRISPR gRNA sequence
tgtagctctgcagttgtctc

SEQ ID NO: 79291 - DNA, 20 bp, Artificial
  CRISPR gRNA sequence
gtagctctgcagttgtctct

SEQ ID NO: 79292 - DNA, 20 bp, Artificial
  CRISPR gRNA sequence
tagctctgcagttgtctctg

SEQ ID NO: 79293 - DNA, 20 bp, Artificial
  CRISPR gRNA sequence
tgcagttgtctctgtgggcg

SEQ ID NO: 79294 - DNA, 20 bp, Artificial
  CRISPR gRNA sequence
cagttgtctctgtgggcggg

SEQ ID NO: 79295 - DNA, 20 bp, Artificial
  CRISPR gRNA sequence
tctctgtgggcggggaaaga

SEQ ID NO: 79296 - DNA, 20 bp, Artificial
  CRISPR gRNA sequence
tgtgggcggggaaagaagga

SEQ ID NO: 79297 - DNA, 20 bp, Artificial
  CRISPR gRNA sequence
tgggcggggaaagaaggaag

SEQ ID NO: 79298 - DNA, 20 bp, Artificial
  CRISPR gRNA sequence
cctgcaggatcagataccaa

SEQ ID NO: 79299 - DNA, 20 bp, Artificial
  CRISPR gRNA sequence
caggatcagataccaagcca

SEQ ID NO: 79300 - DNA, 20 bp, Artificial
  CRISPR gRNA sequence
gaaaccagcacatcacccac

SEQ ID NO: 79301 - DNA, 20 bp, Artificial
  CRISPR gRNA sequence
ttctgccccaaatgttcaaa

SEQ ID NO: 79302 - DNA, 20 bp, Artificial
  CRISPR gRNA sequence
tctgccccaaatgttcaaac

SEQ ID NO: 79303 - DNA, 20 bp, Artificial
  CRISPR gRNA sequence
ctgccccaaatgttcaaaca

SEQ ID NO: 79304 - DNA, 20 bp, Artificial
  CRISPR gRNA sequence
tgccccaaatgttcaaacat

SEQ ID NO: 79305 - DNA, 20 bp, Artificial
  CRISPR gRNA sequence
ccccaaatgttcaaacatcc

SEQ ID NO: 79306 - DNA, 20 bp, Artificial
  CRISPR gRNA sequence
aaacatccagataaagctga

SEQ ID NO: 79307 - DNA, 20 bp, Artificial
  CRISPR gRNA sequence
attttgcaattgacagggaa

SEQ ID NO: 79308 - DNA, 20 bp, Artificial
  CRISPR gRNA sequence
tgcaattgacagggaaacat

SEQ ID NO: 79309 - DNA, 20 bp, Artificial
  CRISPR gRNA sequence
gcaattgacagggaaacata

SEQ ID NO: 79310 - DNA, 20 bp, Artificial
  CRISPR gRNA sequence
caattgacagggaaacataa

SEQ ID NO: 79311 - DNA, 20 bp, Artificial
  CRISPR gRNA sequence
acagggaaacataacggaac

SEQ ID NO: 79312 - DNA, 20 bp, Artificial
  CRISPR gRNA sequence
gcaaaagtgttttaaatcag

SEQ ID NO: 79313 - DNA, 20 bp, Artificial
  CRISPR gRNA sequence
taaatcaggcatgtgaaata

SEQ ID NO: 79314 - DNA, 20 bp, Artificial
  CRISPR gRNA sequence
aaatcaggcatgtgaaatac

SEQ ID NO: 79315 - DNA, 20 bp, Artificial
  CRISPR gRNA sequence
aatcaggcatgtgaaatact

SEQ ID NO: 79316 - DNA, 20 bp, Artificial
  CRISPR gRNA sequence
attatgtctttgcttgatga

SEQ ID NO: 79317 - DNA, 20 bp, Artificial
  CRISPR gRNA sequence
tgtctttgcttgatgaatcc

SEQ ID NO: 79318 - DNA, 20 bp, Artificial
  CRISPR gRNA sequence
tgcttgatgaatcctgcaag

SEQ ID NO: 79319 - DNA, 20 bp, Artificial
  CRISPR gRNA sequence
gcttgatgaatcctgcaaga

SEQ ID NO: 79320 - DNA, 20 bp, Artificial
  CRISPR gRNA sequence
cttgatgaatcctgcaagag

SEQ ID NO: 79321 - DNA, 20 bp, Artificial
  CRISPR gRNA sequence
gatgaatcctgcaagagtgt

SEQ ID NO: 79322 - DNA, 20 bp, Artificial
  CRISPR gRNA sequence
atgaatcctgcaagagtgtt

SEQ ID NO: 79323 - DNA, 20 bp, Artificial
  CRISPR gRNA sequence
caagagtgttttaaaaagtc

SEQ ID NO: 79324 - DNA, 20 bp, Artificial
  CRISPR gRNA sequence
taaaaagtcagaaaaacaat

SEQ ID NO: 79325 - DNA, 20 bp, Artificial
  CRISPR gRNA sequence
aaaaagtcagaaaaacaatt

SEQ ID NO: 79326 - DNA, 20 bp, Artificial
  CRISPR gRNA sequence
aaaagtcagaaaaacaattt

SEQ ID NO: 79327 - DNA, 20 bp, Artificial
  CRISPR gRNA sequence
tcacaagaaatataataaaa

SEQ ID NO: 79328 - DNA, 20 bp, Artificial
  CRISPR gRNA sequence
cacaagaaatataataaaaa

SEQ ID NO: 79329 - DNA, 20 bp, Artificial
  CRISPR gRNA sequence
acaagaaatataataaaaat

SEQ ID NO: 79330 - DNA, 20 bp, Artificial
  CRISPR gRNA sequence
agaatgttgtgagttttttt

SEQ ID NO: 79331 - DNA, 20 bp, Artificial
  CRISPR gRNA sequence
tgagtttttttttttccttt

SEQ ID NO: 79332 - DNA, 20 bp, Artificial
  CRISPR gRNA sequence
ttttttttcctttcttttta

SEQ ID NO: 79333 - DNA, 20 bp, Artificial
  CRISPR gRNA sequence
tttttttcctttctttttaa

SEQ ID NO: 79334 - DNA, 20 bp, Artificial
  CRISPR gRNA sequence
ttttttcctttctttttaaa

SEQ ID NO: 79335 - DNA, 20 bp, Artificial
  CRISPR gRNA sequence
tttttcctttctttttaaat

SEQ ID NO: 79336 - DNA, 20 bp, Artificial
  CRISPR gRNA sequence
ttttcctttctttttaaatt

SEQ ID NO: 79337 - DNA, 20 bp, Artificial
  CRISPR gRNA sequence
tttcctttctttttaaattt

SEQ ID NO: 79338 - DNA, 20 bp, Artificial
  CRISPR gRNA sequence
ttcctttctttttaaatttg

SEQ ID NO: 79339 - DNA, 20 bp, Artificial
  CRISPR gRNA sequence
tcctttctttttaaatttga

SEQ ID NO: 79340 - DNA, 20 bp, Artificial
  CRISPR gRNA sequence
cctttctttttaaatttgag

SEQ ID NO: 79341 - DNA, 20 bp, Artificial
  CRISPR gRNA sequence
ctttctttttaaatttgaga

SEQ ID NO: 79342 - DNA, 20 bp, Artificial
  CRISPR gRNA sequence
tctttttaaatttgagatgg

SEQ ID NO: 79343 - DNA, 20 bp, Artificial
  CRISPR gRNA sequence
ctttttaaatttgagatgga

SEQ ID NO: 79344 - DNA, 20 bp, Artificial
  CRISPR gRNA sequence
tttttaaatttgagatggag

SEQ ID NO: 79345 - DNA, 20 bp, Artificial
  CRISPR gRNA sequence
tttaaatttgagatggagat

SEQ ID NO: 79346 - DNA, 20 bp, Artificial
  CRISPR gRNA sequence
ttaaatttgagatggagatc

SEQ ID NO: 79347 - DNA, 20 bp, Artificial
  CRISPR gRNA sequence
taaatttgagatggagatct

SEQ ID NO: 79348 - DNA, 20 bp, Artificial
  CRISPR gRNA sequence
aaatttgagatggagatctc

SEQ ID NO: 79349 - DNA, 20 bp, Artificial
  CRISPR gRNA sequence
aatttgagatggagatctca

SEQ ID NO: 79350 - DNA, 20 bp, Artificial
  CRISPR gRNA sequence
gagatggagatctcactctg

SEQ ID NO: 79351 - DNA, 20 bp, Artificial
  CRISPR gRNA sequence
agatggagatctcactctgc

SEQ ID NO: 79352 - DNA, 20 bp, Artificial
  CRISPR gRNA sequence
actctgctactcaggctgga

SEQ ID NO: 79353 - DNA, 20 bp, Artificial
  CRISPR gRNA sequence
tgctactcaggctggagtgc

SEQ ID NO: 79354 - DNA, 20 bp, Artificial
  CRISPR gRNA sequence
ctactcaggctggagtgcag

SEQ ID NO: 79355 - DNA, 20 bp, Artificial
  CRISPR gRNA sequence
ctcaggctggagtgcagtgg

SEQ ID NO: 79356 - DNA, 20 bp, Artificial
  CRISPR gRNA sequence
aggctggagtgcagtggtgt

SEQ ID NO: 79357 - DNA, 20 bp, Artificial
  CRISPR gRNA sequence
gagtgcagtggtgtgttcac

SEQ ID NO: 79358 - DNA, 20 bp, Artificial
  CRISPR gRNA sequence
acacctcactgcagcctcaa

SEQ ID NO: 79359 - DNA, 20 bp, Artificial
  CRISPR gRNA sequence
actgcagcctcaacctccac

SEQ ID NO: 79360 - DNA, 20 bp, Artificial
  CRISPR gRNA sequence
cagcctcaacctccacggct

SEQ ID NO: 79361 - DNA, 20 bp, Artificial
  CRISPR gRNA sequence
aacctccacggctcaagcaa

SEQ ID NO: 79362 - DNA, 20 bp, Artificial
  CRISPR gRNA sequence
cacggctcaagcaatcttcc

SEQ ID NO: 79363 - DNA, 20 bp, Artificial
  CRISPR gRNA sequence
aagcaatcttcccacctcag

SEQ ID NO: 79364 - DNA, 20 bp, Artificial
  CRISPR gRNA sequence
cccacctcagcctcccaaat

SEQ ID NO: 79365 - DNA, 20 bp, Artificial
  CRISPR gRNA sequence
ccacctcagcctcccaaata

SEQ ID NO: 79366 - DNA, 20 bp, Artificial
  CRISPR gRNA sequence
agcctcccaaatagctggaa

SEQ ID NO: 79367 - DNA, 20 bp, Artificial
  CRISPR gRNA sequence
ccaaatagctggaaccacag

SEQ ID NO: 79368 - DNA, 20 bp, Artificial
  CRISPR gRNA sequence
gaaccacaggcatgcaccac

SEQ ID NO: 79369 - DNA, 20 bp, Artificial
  CRISPR gRNA sequence
attttgttcattttttgtag

SEQ ID NO: 79370 - DNA, 20 bp, Artificial
  CRISPR gRNA sequence
tgttcattttttgtagagac

SEQ ID NO: 79371 - DNA, 20 bp, Artificial
  CRISPR gRNA sequence
gttcattttttgtagagact

SEQ ID NO: 79372 - DNA, 20 bp, Artificial
  CRISPR gRNA sequence
ttcattttttgtagagacta

SEQ ID NO: 79373 - DNA, 20 bp, Artificial
  CRISPR gRNA sequence
attttttgtagagactatgt

SEQ ID NO: 79374 - DNA, 20 bp, Artificial
  CRISPR gRNA sequence
tttgtagagactatgttgcc

SEQ ID NO: 79375 - DNA, 20 bp, Artificial
  CRISPR gRNA sequence
ttgtagagactatgttgccc

SEQ ID NO: 79376 - DNA, 20 bp, Artificial
  CRISPR gRNA sequence
tgtagagactatgttgccca

SEQ ID NO: 79377 - DNA, 20 bp, Artificial
  CRISPR gRNA sequence
gtagagactatgttgcccag

SEQ ID NO: 79378 - DNA, 20 bp, Artificial
  CRISPR gRNA sequence
tagagactatgttgcccagg

SEQ ID NO: 79379 - DNA, 20 bp, Artificial
  CRISPR gRNA sequence
tgttgcccaggttggtctcg

SEQ ID NO: 79380 - DNA, 20 bp, Artificial
  CRISPR gRNA sequence
cccaggttggtctcgaactc

SEQ ID NO: 79381 - DNA, 20 bp, Artificial
  CRISPR gRNA sequence
gtctcgaactcctgagctca

SEQ ID NO: 79382 - DNA, 20 bp, Artificial
  CRISPR gRNA sequence
gaactcctgagctcaagtaa

SEQ ID NO: 79383 - DNA, 20 bp, Artificial
  CRISPR gRNA sequence
ctgagctcaagtaatcctct

SEQ ID NO: 79384 - DNA, 20 bp, Artificial
  CRISPR gRNA sequence
agctcaagtaatcctcttgc

SEQ ID NO: 79385 - DNA, 20 bp, Artificial
  CRISPR gRNA sequence
aagtaatcctcttgccttgg

SEQ ID NO: 79386 - DNA, 20 bp, Artificial
  CRISPR gRNA sequence
ttgccttggccttccaaagt

SEQ ID NO: 79387 - DNA, 20 bp, Artificial
  CRISPR gRNA sequence
gccttggccttccaaagtgt

SEQ ID NO: 79388 - DNA, 20 bp, Artificial
  CRISPR gRNA sequence
ccttggccttccaaagtgtt

SEQ ID NO: 79389 - DNA, 20 bp, Artificial
  CRISPR gRNA sequence
ggccttccaaagtgttggaa

SEQ ID NO: 79390 - DNA, 20 bp, Artificial
  CRISPR gRNA sequence
gccttccaaagtgttggaat

SEQ ID NO: 79391 - DNA, 20 bp, Artificial
  CRISPR gRNA sequence
ccaaagtgttggaattacag

SEQ ID NO: 79392 - DNA, 20 bp, Artificial
  CRISPR gRNA sequence
caaagtgttggaattacagg

SEQ ID NO: 79393 - DNA, 20 bp, Artificial
  CRISPR gRNA sequence
gaattacaggcatgagccac

SEQ ID NO: 79394 - DNA, 20 bp, Artificial
  CRISPR gRNA sequence
caggcatgagccactgagcc

SEQ ID NO: 79395 - DNA, 20 bp, Artificial
  CRISPR gRNA sequence
agcccggctgaatttttttt

SEQ ID NO: 79396 - DNA, 20 bp, Artificial
  CRISPR gRNA sequence
aattttttttaatagaaatt

SEQ ID NO: 79397 - DNA, 20 bp, Artificial
  CRISPR gRNA sequence
tttttaatagaaatttttat

SEQ ID NO: 79398 - DNA, 20 bp, Artificial
  CRISPR gRNA sequence
ttttaatagaaatttttatg

SEQ ID NO: 79399 - DNA, 20 bp, Artificial
  CRISPR gRNA sequence
tttaatagaaatttttatga

SEQ ID NO: 79400 - DNA, 20 bp, Artificial
  CRISPR gRNA sequence
ttaatagaaatttttatgag

SEQ ID NO: 79401 - DNA, 20 bp, Artificial
  CRISPR gRNA sequence
taatagaaatttttatgagt

SEQ ID NO: 79402 - DNA, 20 bp, Artificial
  CRISPR gRNA sequence
aatagaaatttttatgagta

SEQ ID NO: 79403 - DNA, 20 bp, Artificial
  CRISPR gRNA sequence
atagaaatttttatgagtaa

SEQ ID NO: 79404 - DNA, 20 bp, Artificial
  CRISPR gRNA sequence
ttatgagtaagaaaaatgac

SEQ ID NO: 79405 - DNA, 20 bp, Artificial
  CRISPR gRNA sequence
tatgagtaagaaaaatgaca

SEQ ID NO: 79406 - DNA, 20 bp, Artificial
  CRISPR gRNA sequence
atgagtaagaaaaatgacac

SEQ ID NO: 79407 - DNA, 20 bp, Artificial
  CRISPR gRNA sequence
tgagtaagaaaaatgacacc

SEQ ID NO: 79408 - DNA, 20 bp, Artificial
  CRISPR gRNA sequence
acctaccccatgatcaaaac

SEQ ID NO: 79409 - DNA, 20 bp, Artificial
  CRISPR gRNA sequence
ccccatgatcaaaactggct

SEQ ID NO: 79410 - DNA, 20 bp, Artificial
  CRISPR gRNA sequence
gctatattggttcagcacca

SEQ ID NO: 79411 - DNA, 20 bp, Artificial
  CRISPR gRNA sequence
tattggttcagcaccatgga

SEQ ID NO: 79412 - DNA, 20 bp, Artificial
  CRISPR gRNA sequence
gttcagcaccatggagggca

SEQ ID NO: 79413 - DNA, 20 bp, Artificial
  CRISPR gRNA sequence
agcaccatggagggcaacac

SEQ ID NO: 79414 - DNA, 20 bp, Artificial
  CRISPR gRNA sequence
attattcctttggctatgcc

SEQ ID NO: 79415 - DNA, 20 bp, Artificial
  CRISPR gRNA sequence
ttcctttggctatgcctgtg

SEQ ID NO: 79416 - DNA, 20 bp, Artificial
  CRISPR gRNA sequence
ctttggctatgcctgtgctt

SEQ ID NO: 79417 - DNA, 20 bp, Artificial
  CRISPR gRNA sequence
tggctatgcctgtgcttcgt

SEQ ID NO: 79418 - DNA, 20 bp, Artificial
  CRISPR gRNA sequence
ggctatgcctgtgcttcgta

SEQ ID NO: 79419 - DNA, 20 bp, Artificial
  CRISPR gRNA sequence
gctatgcctgtgcttcgtag

SEQ ID NO: 79420 - DNA, 20 bp, Artificial
  CRISPR gRNA sequence
tgcctgtgcttcgtagactt

SEQ ID NO: 79421 - DNA, 20 bp, Artificial
  CRISPR gRNA sequence
tgcttcgtagacttgttgac

SEQ ID NO: 79422 - DNA, 20 bp, Artificial
  CRISPR gRNA sequence
cgtagacttgttgactcatt

SEQ ID NO: 79423 - DNA, 20 bp, Artificial
  CRISPR gRNA sequence
gtagacttgttgactcattc

SEQ ID NO: 79424 - DNA, 20 bp, Artificial
  CRISPR gRNA sequence
gttgactcattccttcatcc

SEQ ID NO: 79425 - DNA, 20 bp, Artificial
  CRISPR gRNA sequence
ttgactcattccttcatcca

SEQ ID NO: 79426 - DNA, 20 bp, Artificial
  CRISPR gRNA sequence
actcattccttcatccatcc

SEQ ID NO: 79427 - DNA, 20 bp, Artificial
  CRISPR gRNA sequence
attccttcatccatccatcc

SEQ ID NO: 79428 - DNA, 20 bp, Artificial
  CRISPR gRNA sequence
cttcatccatccatccatcc

SEQ ID NO: 79429 - DNA, 20 bp, Artificial
  CRISPR gRNA sequence
catccatccatccatccatc

SEQ ID NO: 79430 - DNA, 20 bp, Artificial
  CRISPR gRNA sequence
atccatccatccatccatcc

SEQ ID NO: 79431 - DNA, 20 bp, Artificial
  CRISPR gRNA sequence
ttcacacacctatccatctt

SEQ ID NO: 79432 - DNA, 20 bp, Artificial
  CRISPR gRNA sequence
tcacacacctatccatcttt

SEQ ID NO: 79433 - DNA, 20 bp, Artificial
  CRISPR gRNA sequence
cacacacctatccatctttt

SEQ ID NO: 79434 - DNA, 20 bp, Artificial
  CRISPR gRNA sequence
acacacctatccatcttttc

SEQ ID NO: 79435 - DNA, 20 bp, Artificial
  CRISPR gRNA sequence
tccatcttttcagctagcca

SEQ ID NO: 79436 - DNA, 20 bp, Artificial
  CRISPR gRNA sequence
ttcagctagccatctatcca

SEQ ID NO: 79437 - DNA, 20 bp, Artificial
  CRISPR gRNA sequence
tcagctagccatctatccat

SEQ ID NO: 79438 - DNA, 20 bp, Artificial
  CRISPR gRNA sequence
cagctagccatctatccatc

SEQ ID NO: 79439 - DNA, 20 bp, Artificial
  CRISPR gRNA sequence
agctagccatctatccatcc

SEQ ID NO: 79440 - DNA, 20 bp, Artificial
  CRISPR gRNA sequence
gccatctatccatccatcca

SEQ ID NO: 79441 - DNA, 20 bp, Artificial
  CRISPR gRNA sequence
tccatccatccattcatcta

SEQ ID NO: 79442 - DNA, 20 bp, Artificial
  CRISPR gRNA sequence
atctatccatccatccattc

SEQ ID NO: 79443 - DNA, 20 bp, Artificial
  CRISPR gRNA sequence
tccatccatccattcatctt

SEQ ID NO: 79444 - DNA, 20 bp, Artificial
  CRISPR gRNA sequence
atcttttcatccacccatca

SEQ ID NO: 79445 - DNA, 20 bp, Artificial
  CRISPR gRNA sequence
ttcatccacccatcaatctt

SEQ ID NO: 79446 - DNA, 20 bp, Artificial
  CRISPR gRNA sequence
tcatccacccatcaatcttt

SEQ ID NO: 79447 - DNA, 20 bp, Artificial
  CRISPR gRNA sequence
catccacccatcaatctttc

SEQ ID NO: 79448 - DNA, 20 bp, Artificial
  CRISPR gRNA sequence
atccacccatcaatctttcc

SEQ ID NO: 79449 - DNA, 20 bp, Artificial
  CRISPR gRNA sequence
tccatccatccatccatcca

SEQ ID NO: 79450 - DNA, 20 bp, Artificial
  CRISPR gRNA sequence
ccatccatccatccatccat

SEQ ID NO: 79451 - DNA, 20 bp, Artificial
  CRISPR gRNA sequence
catccatccatccatccatc

SEQ ID NO: 79452 - DNA, 20 bp, Artificial
  CRISPR gRNA sequence
ttcatccacccatccatctt

SEQ ID NO: 79453 - DNA, 20 bp, Artificial
  CRISPR gRNA sequence
tcatccacccatccatcttt

SEQ ID NO: 79454 - DNA, 20 bp, Artificial
  CRISPR gRNA sequence
catccacccatccatctttt

SEQ ID NO: 79455 - DNA, 20 bp, Artificial
  CRISPR gRNA sequence
atccacccatccatcttttc

SEQ ID NO: 79456 - DNA, 20 bp, Artificial
  CRISPR gRNA sequence
ttcatccatccatccatcca

SEQ ID NO: 79457 - DNA, 20 bp, Artificial
  CRISPR gRNA sequence
tcatccatccatccatccat

SEQ ID NO: 79458 - DNA, 20 bp, Artificial
  CRISPR gRNA sequence
catccatccatccatccatc

SEQ ID NO: 79459 - DNA, 20 bp, Artificial
  CRISPR gRNA sequence
atccatccatccatccatcc

SEQ ID NO: 79460 - DNA, 20 bp, Artificial
  CRISPR gRNA sequence
ttcatccacccatccatctt

SEQ ID NO: 79461 - DNA, 20 bp, Artificial
  CRISPR gRNA sequence
tcatccacccatccatcttt

SEQ ID NO: 79462 - DNA, 20 bp, Artificial
  CRISPR gRNA sequence
catccacccatccatctttt

SEQ ID NO: 79463 - DNA, 20 bp, Artificial
  CRISPR gRNA sequence
atccacccatccatcttttc

SEQ ID NO: 79464 - DNA, 20 bp, Artificial
  CRISPR gRNA sequence
ttcagccatccatccatcca

SEQ ID NO: 79465 - DNA, 20 bp, Artificial
  CRISPR gRNA sequence
tcagccatccatccatccat

SEQ ID NO: 79466 - DNA, 20 bp, Artificial
  CRISPR gRNA sequence
cagccatccatccatccatc

SEQ ID NO: 79467 - DNA, 20 bp, Artificial
  CRISPR gRNA sequence
agccatccatccatccatcc

SEQ ID NO: 79468 - DNA, 20 bp, Artificial
  CRISPR gRNA sequence
ttcatccacccatccatctt

SEQ ID NO: 79469 - DNA, 20 bp, Artificial
  CRISPR gRNA sequence
tcatccacccatccatcttt

SEQ ID NO: 79470 - DNA, 20 bp, Artificial
  CRISPR gRNA sequence
catccacccatccatctttt

SEQ ID NO: 79471 - DNA, 20 bp, Artificial
  CRISPR gRNA sequence
atccacccatccatcttttc

SEQ ID NO: 79472 - DNA, 20 bp, Artificial
  CRISPR gRNA sequence
ttcagccatccattcatcca

SEQ ID NO: 79473 - DNA, 20 bp, Artificial
  CRISPR gRNA sequence
tcagccatccattcatccat

SEQ ID NO: 79474 - DNA, 20 bp, Artificial
  CRISPR gRNA sequence
cagccatccattcatccatc

SEQ ID NO: 79475 - DNA, 20 bp, Artificial
  CRISPR gRNA sequence
agccatccattcatccatcc

SEQ ID NO: 79476 - DNA, 20 bp, Artificial
  CRISPR gRNA sequence
atccatccatcttttcatcc

SEQ ID NO: 79477 - DNA, 20 bp, Artificial
  CRISPR gRNA sequence
ttcatccacccatccatctt

SEQ ID NO: 79478 - DNA, 20 bp, Artificial
  CRISPR gRNA sequence
tcatccacccatccatcttt

SEQ ID NO: 79479 - DNA, 20 bp, Artificial
  CRISPR gRNA sequence
catccacccatccatctttt

SEQ ID NO: 79480 - DNA, 20 bp, Artificial
  CRISPR gRNA sequence
atccacccatccatcttttc

SEQ ID NO: 79481 - DNA, 20 bp, Artificial
  CRISPR gRNA sequence
ttcagccatccatccataca

SEQ ID NO: 79482 - DNA, 20 bp, Artificial
  CRISPR gRNA sequence
tcagccatccatccatacat

SEQ ID NO: 79483 - DNA, 20 bp, Artificial
  CRISPR gRNA sequence
cagccatccatccatacatc

SEQ ID NO: 79484 - DNA, 20 bp, Artificial
  CRISPR gRNA sequence
agccatccatccatacatcc

SEQ ID NO: 79485 - DNA, 20 bp, Artificial
  CRISPR gRNA sequence
ttcatccatccattaattca

SEQ ID NO: 79486 - DNA, 20 bp, Artificial
  CRISPR gRNA sequence
tcatccatccattaattcaa

SEQ ID NO: 79487 - DNA, 20 bp, Artificial
  CRISPR gRNA sequence
catccatccattaattcaat

SEQ ID NO: 79488 - DNA, 20 bp, Artificial
  CRISPR gRNA sequence
atccatccattaattcaata

SEQ ID NO: 79489 - DNA, 20 bp, Artificial
  CRISPR gRNA sequence
attcaatatataccaagtac

SEQ ID NO: 79490 - DNA, 20 bp, Artificial
  CRISPR gRNA sequence
aatatataccaagtaccagg

SEQ ID NO: 79491 - DNA, 20 bp, Artificial
  CRISPR gRNA sequence
agctaggttctgaaggtaaa

SEQ ID NO: 79492 - DNA, 20 bp, Artificial
  CRISPR gRNA sequence
ggttctgaaggtaaagctgt

SEQ ID NO: 79493 - DNA, 20 bp, Artificial
  CRISPR gRNA sequence
tgaaggtaaagctgtgagta

SEQ ID NO: 79494 - DNA, 20 bp, Artificial
  CRISPR gRNA sequence
aaggtaaagctgtgagtaaa

SEQ ID NO: 79495 - DNA, 20 bp, Artificial
  CRISPR gRNA sequence
tgagtaaaacagtagggtat

SEQ ID NO: 79496 - DNA, 20 bp, Artificial
  CRISPR gRNA sequence
atcctgcagacgaggggcct

SEQ ID NO: 79497 - DNA, 20 bp, Artificial
  CRISPR gRNA sequence
tcctgcagacgaggggcctc

SEQ ID NO: 79498 - DNA, 20 bp, Artificial
  CRISPR gRNA sequence
cagacgaggggcctcctcca

SEQ ID NO: 79499 - DNA, 20 bp, Artificial
  CRISPR gRNA sequence
ctccatttcccatcccactt

SEQ ID NO: 79500 - DNA, 20 bp, Artificial
  CRISPR gRNA sequence
catttcccatcccactttcc

SEQ ID NO: 79501 - DNA, 20 bp, Artificial
  CRISPR gRNA sequence
cccatcccactttcccctcc

SEQ ID NO: 79502 - DNA, 20 bp, Artificial
  CRISPR gRNA sequence
ccatcccactttcccctcct

SEQ ID NO: 79503 - DNA, 20 bp, Artificial
  CRISPR gRNA sequence
tcccctcctcttttctcaag

SEQ ID NO: 79504 - DNA, 20 bp, Artificial
  CRISPR gRNA sequence
cccctcctcttttctcaagg

SEQ ID NO: 79505 - DNA, 20 bp, Artificial
  CRISPR gRNA sequence
ccctcctcttttctcaaggc

SEQ ID NO: 79506 - DNA, 20 bp, Artificial
  CRISPR gRNA sequence
ctcttttctcaaggcccata

SEQ ID NO: 79507 - DNA, 20 bp, Artificial
  CRISPR gRNA sequence
ttttctcaaggcccataagg

SEQ ID NO: 79508 - DNA, 20 bp, Artificial
  CRISPR gRNA sequence
ttctcaaggcccataaggcc

SEQ ID NO: 79509 - DNA, 20 bp, Artificial
  CRISPR gRNA sequence
tctcaaggcccataaggcca

SEQ ID NO: 79510 - DNA, 20 bp, Artificial
  CRISPR gRNA sequence
ctcaaggcccataaggccaa

SEQ ID NO: 79511 - DNA, 20 bp, Artificial
  CRISPR gRNA sequence
tcaaggcccataaggccaag

SEQ ID NO: 79512 - DNA, 20 bp, Artificial
  CRISPR gRNA sequence
aaggcccataaggccaagat

SEQ ID NO: 79513 - DNA, 20 bp, Artificial
  CRISPR gRNA sequence
tccttctgctcacctggcct

SEQ ID NO: 79514 - DNA, 20 bp, Artificial
  CRISPR gRNA sequence
ccttctgctcacctggcctg

SEQ ID NO: 79515 - DNA, 20 bp, Artificial
  CRISPR gRNA sequence
cttctgctcacctggcctga

SEQ ID NO: 79516 - DNA, 20 bp, Artificial
  CRISPR gRNA sequence
ctgctcacctggcctgaagc

SEQ ID NO: 79517 - DNA, 20 bp, Artificial
  CRISPR gRNA sequence
tgctcacctggcctgaagca

SEQ ID NO: 79518 - DNA, 20 bp, Artificial
  CRISPR gRNA sequence
ctcacctggcctgaagcatc

SEQ ID NO: 79519 - DNA, 20 bp, Artificial
  CRISPR gRNA sequence
acctggcctgaagcatcctg

SEQ ID NO: 79520 - DNA, 20 bp, Artificial
  CRISPR gRNA sequence
gcctgaagcatcctgacggt

SEQ ID NO: 79521 - DNA, 20 bp, Artificial
  CRISPR gRNA sequence
aagcatcctgacggtaggac

SEQ ID NO: 79522 - DNA, 20 bp, Artificial
  CRISPR gRNA sequence
acggtaggacacgtgactgc

SEQ ID NO: 79523 - DNA, 20 bp, Artificial
  CRISPR gRNA sequence
ccacccttgccaagcagagt

SEQ ID NO: 79524 - DNA, 20 bp, Artificial
  CRISPR gRNA sequence
gccaagcagagtagggttga

SEQ ID NO: 79525 - DNA, 20 bp, Artificial
  CRISPR gRNA sequence
ccaagcagagtagggttgac

SEQ ID NO: 79526 - DNA, 20 bp, Artificial
  CRISPR gRNA sequence
acacgcagatgctgttgctg

SEQ ID NO: 79527 - DNA, 20 bp, Artificial
  CRISPR gRNA sequence
ttgctgctcaggctgcaaga

SEQ ID NO: 79528 - DNA, 20 bp, Artificial
  CRISPR gRNA sequence
ctgctcaggctgcaagattg

SEQ ID NO: 79529 - DNA, 20 bp, Artificial
  CRISPR gRNA sequence
ctcaggctgcaagattgtgg

SEQ ID NO: 79530 - DNA, 20 bp, Artificial
  CRISPR gRNA sequence
aggctgcaagattgtggcaa

SEQ ID NO: 79531 - DNA, 20 bp, Artificial
  CRISPR gRNA sequence
caagattgtggcaaaggtgt

SEQ ID NO: 79532 - DNA, 20 bp, Artificial
  CRISPR gRNA sequence
tggcaaaggtgtcaggagtg

SEQ ID NO: 79533 - DNA, 20 bp, Artificial
  CRISPR gRNA sequence
ccccaggggccccagacctt

SEQ ID NO: 79534 - DNA, 20 bp, Artificial
  CRISPR gRNA sequence
ccttgccttgcaagggagtg

SEQ ID NO: 79535 - DNA, 20 bp, Artificial
  CRISPR gRNA sequence
cttgccttgcaagggagtgg

SEQ ID NO: 79536 - DNA, 20 bp, Artificial
  CRISPR gRNA sequence
gccttgcaagggagtggggt

SEQ ID NO: 79537 - DNA, 20 bp, Artificial
  CRISPR gRNA sequence
ccttgcaagggagtggggtg

SEQ ID NO: 79538 - DNA, 20 bp, Artificial
  CRISPR gRNA sequence
gcaagggagtggggtgaatc

SEQ ID NO: 79539 - DNA, 20 bp, Artificial
  CRISPR gRNA sequence
caagggagtggggtgaatca

SEQ ID NO: 79540 - DNA, 20 bp, Artificial
  CRISPR gRNA sequence
ggctgcagaggcagtggaaa

SEQ ID NO: 79541 - DNA, 20 bp, Artificial
  CRISPR gRNA sequence
cagaggcagtggaaagatca

SEQ ID NO: 79542 - DNA, 20 bp, Artificial
  CRISPR gRNA sequence
actcaagcttccggagccgt

SEQ ID NO: 79543 - DNA, 20 bp, Artificial
  CRISPR gRNA sequence
ctcaagcttccggagccgtg

SEQ ID NO: 79544 - DNA, 20 bp, Artificial
  CRISPR gRNA sequence
aagcttccggagccgtggta

SEQ ID NO: 79545 - DNA, 20 bp, Artificial
  CRISPR gRNA sequence
ccggagccgtggtaggtgag

SEQ ID NO: 79546 - DNA, 20 bp, Artificial
  CRISPR gRNA sequence
cggagccgtggtaggtgagg

SEQ ID NO: 79547 - DNA, 20 bp, Artificial
  CRISPR gRNA sequence
cacaatgttcagcaccacct

SEQ ID NO: 79548 - DNA, 20 bp, Artificial
  CRISPR gRNA sequence
agcaccacctggtcactgag

SEQ ID NO: 79549 - DNA, 20 bp, Artificial
  CRISPR gRNA sequence
gtcactgagctggttgtccc

SEQ ID NO: 79550 - DNA, 20 bp, Artificial
  CRISPR gRNA sequence
agctggttgtcccgaaaact

SEQ ID NO: 79551 - DNA, 20 bp, Artificial
  CRISPR gRNA sequence
gttgtcccgaaaactgcgag

SEQ ID NO: 79552 - DNA, 20 bp, Artificial
  CRISPR gRNA sequence
tcccgaaaactgcgaggaga

SEQ ID NO: 79553 - DNA, 20 bp, Artificial
  CRISPR gRNA sequence
cgaggagaccaaggcccagt

SEQ ID NO: 79554 - DNA, 20 bp, Artificial
  CRISPR gRNA sequence
tgccctggggttggggcact

SEQ ID NO: 79555 - DNA, 20 bp, Artificial
  CRISPR gRNA sequence
gccctggggttggggcactt

SEQ ID NO: 79556 - DNA, 20 bp, Artificial
  CRISPR gRNA sequence
ccctggggttggggcacttg

SEQ ID NO: 79557 - DNA, 20 bp, Artificial
  CRISPR gRNA sequence
gggttggggcacttgcaagc

SEQ ID NO: 79558 - DNA, 20 bp, Artificial
  CRISPR gRNA sequence
gggcacttgcaagccccagt

SEQ ID NO: 79559 - DNA, 20 bp, Artificial
  CRISPR gRNA sequence
gcaagccccagttagcaagt

SEQ ID NO: 79560 - DNA, 20 bp, Artificial
  CRISPR gRNA sequence
caagccccagttagcaagtg

SEQ ID NO: 79561 - DNA, 20 bp, Artificial
  CRISPR gRNA sequence
gcaagtgacaggatggccac

SEQ ID NO: 79562 - DNA, 20 bp, Artificial
  CRISPR gRNA sequence
atgtgggagacataagacag

SEQ ID NO: 79563 - DNA, 20 bp, Artificial
  CRISPR gRNA sequence
atggcctgctcgccggattc

SEQ ID NO: 79564 - DNA, 20 bp, Artificial
  CRISPR gRNA sequence
ctcgccggattccagcaggc

SEQ ID NO: 79565 - DNA, 20 bp, Artificial
  CRISPR gRNA sequence
gccggattccagcaggcacg

SEQ ID NO: 79566 - DNA, 20 bp, Artificial
  CRISPR gRNA sequence
cagcaggcacggctaggagg

SEQ ID NO: 79567 - DNA, 20 bp, Artificial
  CRISPR gRNA sequence
ggaggaaagaccctctgctg

SEQ ID NO: 79568 - DNA, 20 bp, Artificial
  CRISPR gRNA sequence
tgctggcctcaattctgggt

SEQ ID NO: 79569 - DNA, 20 bp, Artificial
  CRISPR gRNA sequence
ctggcctcaattctgggtct

SEQ ID NO: 79570 - DNA, 20 bp, Artificial
  CRISPR gRNA sequence
gcctcaattctgggtctatt

SEQ ID NO: 79571 - DNA, 20 bp, Artificial
  CRISPR gRNA sequence
aattctgggtctattctgtt

SEQ ID NO: 79572 - DNA, 20 bp, Artificial
  CRISPR gRNA sequence
tgggtctattctgttcctat

SEQ ID NO: 79573 - DNA, 20 bp, Artificial
  CRISPR gRNA sequence
ggtctattctgttcctatgg

SEQ ID NO: 79574 - DNA, 20 bp, Artificial
  CRISPR gRNA sequence
ttctgttcctatggggaagt

SEQ ID NO: 79575 - DNA, 20 bp, Artificial
  CRISPR gRNA sequence
tgttcctatggggaagtttt

SEQ ID NO: 79576 - DNA, 20 bp, Artificial
  CRISPR gRNA sequence
ttcctatggggaagtttttg

SEQ ID NO: 79577 - DNA, 20 bp, Artificial
  CRISPR gRNA sequence
ctatggggaagtttttgcct

SEQ ID NO: 79578 - DNA, 20 bp, Artificial
  CRISPR gRNA sequence
tggggaagtttttgcctggc

SEQ ID NO: 79579 - DNA, 20 bp, Artificial
  CRISPR gRNA sequence
ttgcctggcggctcaaggga

SEQ ID NO: 79580 - DNA, 20 bp, Artificial
  CRISPR gRNA sequence
tgcctggcggctcaagggat

SEQ ID NO: 79581 - DNA, 20 bp, Artificial
  CRISPR gRNA sequence
gcctggcggctcaagggatc

SEQ ID NO: 79582 - DNA, 20 bp, Artificial
  CRISPR gRNA sequence
cctggcggctcaagggatct

SEQ ID NO: 79583 - DNA, 20 bp, Artificial
  CRISPR gRNA sequence
gcggctcaagggatctagaa

SEQ ID NO: 79584 - DNA, 20 bp, Artificial
  CRISPR gRNA sequence
aagggatctagaagacagac

SEQ ID NO: 79585 - DNA, 20 bp, Artificial
  CRISPR gRNA sequence
gaagacagactgacggcctc

SEQ ID NO: 79586 - DNA, 20 bp, Artificial
  CRISPR gRNA sequence
acggcctcttcatgaggcac

SEQ ID NO: 79587 - DNA, 20 bp, Artificial
  CRISPR gRNA sequence
ttcatgaggcacaatgagga

SEQ ID NO: 79588 - DNA, 20 bp, Artificial
  CRISPR gRNA sequence
catgaggcacaatgaggaga

SEQ ID NO: 79589 - DNA, 20 bp, Artificial
  CRISPR gRNA sequence
atgaggcacaatgaggagac

SEQ ID NO: 79590 - DNA, 20 bp, Artificial
  CRISPR gRNA sequence
gcaccctgctcccagggctt

SEQ ID NO: 79591 - DNA, 20 bp, Artificial
  CRISPR gRNA sequence
ctcccagggcttatgcctgg

SEQ ID NO: 79592 - DNA, 20 bp, Artificial
  CRISPR gRNA sequence
ccagggcttatgcctgggat

SEQ ID NO: 79593 - DNA, 20 bp, Artificial
  CRISPR gRNA sequence
atgcctgggatgtgcctggg

SEQ ID NO: 79594 - DNA, 20 bp, Artificial
  CRISPR gRNA sequence
tgcctgggatgtgcctggga

SEQ ID NO: 79595 - DNA, 20 bp, Artificial
  CRISPR gRNA sequence
ggatgtgcctgggataggcc

SEQ ID NO: 79596 - DNA, 20 bp, Artificial
  CRISPR gRNA sequence
ggataggccccccaggcaat

SEQ ID NO: 79597 - DNA, 20 bp, Artificial
  CRISPR gRNA sequence
gactgggacgctgcagacat

SEQ ID NO: 79598 - DNA, 20 bp, Artificial
  CRISPR gRNA sequence
ggacgctgcagacatcgctt

SEQ ID NO: 79599 - DNA, 20 bp, Artificial
  CRISPR gRNA sequence
cagacatcgcttccagcctc

SEQ ID NO: 79600 - DNA, 20 bp, Artificial
  CRISPR gRNA sequence
ccagcctcggctgtggccct

SEQ ID NO: 79601 - DNA, 20 bp, Artificial
  CRISPR gRNA sequence
cagcctcggctgtggccctg

SEQ ID NO: 79602 - DNA, 20 bp, Artificial
  CRISPR gRNA sequence
ggctgtggccctgactcacc

SEQ ID NO: 79603 - DNA, 20 bp, Artificial
  CRISPR gRNA sequence
tggccctgactcacccagag

SEQ ID NO: 79604 - DNA, 20 bp, Artificial
  CRISPR gRNA sequence
actcacccagagccctgagc

SEQ ID NO: 79605 - DNA, 20 bp, Artificial
  CRISPR gRNA sequence
acccagagccctgagccaag

SEQ ID NO: 79606 - DNA, 20 bp, Artificial
  CRISPR gRNA sequence
agccaagcgcattcctctct

SEQ ID NO: 79607 - DNA, 20 bp, Artificial
  CRISPR gRNA sequence
ctctctgacctcactttccc

SEQ ID NO: 79608 - DNA, 20 bp, Artificial
  CRISPR gRNA sequence
tctgacctcactttccccac

SEQ ID NO: 79609 - DNA, 20 bp, Artificial
  CRISPR gRNA sequence
tgacctcactttccccacct

SEQ ID NO: 79610 - DNA, 20 bp, Artificial
  CRISPR gRNA sequence
acctcactttccccacctgt

SEQ ID NO: 79611 - DNA, 20 bp, Artificial
  CRISPR gRNA sequence
actttccccacctgttcaca

SEQ ID NO: 79612 - DNA, 20 bp, Artificial
  CRISPR gRNA sequence
tccccacctgttcacaagcc

SEQ ID NO: 79613 - DNA, 20 bp, Artificial
  CRISPR gRNA sequence
ccccacctgttcacaagcca

SEQ ID NO: 79614 - DNA, 20 bp, Artificial
  CRISPR gRNA sequence
cccacctgttcacaagccag

SEQ ID NO: 79615 - DNA, 20 bp, Artificial
  CRISPR gRNA sequence
ttcacaagccagccttgcct

SEQ ID NO: 79616 - DNA, 20 bp, Artificial
  CRISPR gRNA sequence
acaagccagccttgcctggg

SEQ ID NO: 79617 - DNA, 20 bp, Artificial
  CRISPR gRNA sequence
gcctgggttcctagctgggg

SEQ ID NO: 79618 - DNA, 20 bp, Artificial
  CRISPR gRNA sequence
cctgggttcctagctgggga

SEQ ID NO: 79619 - DNA, 20 bp, Artificial
  CRISPR gRNA sequence
ggttcctagctggggagaca

SEQ ID NO: 79620 - DNA, 20 bp, Artificial
  CRISPR gRNA sequence
ctagctggggagacagatga

SEQ ID NO: 79621 - DNA, 20 bp, Artificial
  CRISPR gRNA sequence
gctggggagacagatgagtt

SEQ ID NO: 79622 - DNA, 20 bp, Artificial
  CRISPR gRNA sequence
gggagacagatgagttgagg

SEQ ID NO: 79623 - DNA, 20 bp, Artificial
  CRISPR gRNA sequence
aggggagtgagggtgattaa

SEQ ID NO: 79624 - DNA, 20 bp, Artificial
  CRISPR gRNA sequence
agaacaatggtgggtgatga

SEQ ID NO: 79625 - DNA, 20 bp, Artificial
  CRISPR gRNA sequence
aagtcactttcaatagccag

SEQ ID NO: 79626 - DNA, 20 bp, Artificial
  CRISPR gRNA sequence
tcaatagccagggaagaaaa

SEQ ID NO: 79627 - DNA, 20 bp, Artificial
  CRISPR gRNA sequence
caatagccagggaagaaaaa

SEQ ID NO: 79628 - DNA, 20 bp, Artificial
  CRISPR gRNA sequence
aatagccagggaagaaaaat

SEQ ID NO: 79629 - DNA, 20 bp, Artificial
  CRISPR gRNA sequence
agtacttctgaaccttggct

SEQ ID NO: 79630 - DNA, 20 bp, Artificial
  CRISPR gRNA sequence
ctgaaccttggcttaatcac

SEQ ID NO: 79631 - DNA, 20 bp, Artificial
  CRISPR gRNA sequence
tgaaccttggcttaatcacg

SEQ ID NO: 79632 - DNA, 20 bp, Artificial
  CRISPR gRNA sequence
aaccttggcttaatcacggt

SEQ ID NO: 79633 - DNA, 20 bp, Artificial
  CRISPR gRNA sequence
ggcttaatcacggttcacag

SEQ ID NO: 79634 - DNA, 20 bp, Artificial
  CRISPR gRNA sequence
gcttaatcacggttcacaga

SEQ ID NO: 79635 - DNA, 20 bp, Artificial
  CRISPR gRNA sequence
aatcacggttcacagatgcc

SEQ ID NO: 79636 - DNA, 20 bp, Artificial
  CRISPR gRNA sequence
atcacggttcacagatgccc

SEQ ID NO: 79637 - DNA, 20 bp, Artificial
  CRISPR gRNA sequence
acagatgcccagccgagacg

SEQ ID NO: 79638 - DNA, 20 bp, Artificial
  CRISPR gRNA sequence
tggtccaacttattattttc

SEQ ID NO: 79639 - DNA, 20 bp, Artificial
  CRISPR gRNA sequence
attattttcactcaacaagt

SEQ ID NO: 79640 - DNA, 20 bp, Artificial
  CRISPR gRNA sequence
ttattttcactcaacaagtg

SEQ ID NO: 79641 - DNA, 20 bp, Artificial
  CRISPR gRNA sequence
ttttcactcaacaagtgctg

SEQ ID NO: 79642 - DNA, 20 bp, Artificial
  CRISPR gRNA sequence
tcactcaacaagtgctgaac

SEQ ID NO: 79643 - DNA, 20 bp, Artificial
  CRISPR gRNA sequence
cactcaacaagtgctgaacc

SEQ ID NO: 79644 - DNA, 20 bp, Artificial
  CRISPR gRNA sequence
actcaacaagtgctgaacct

SEQ ID NO: 79645 - DNA, 20 bp, Artificial
  CRISPR gRNA sequence
aacaagtgctgaaccttagt

SEQ ID NO: 79646 - DNA, 20 bp, Artificial
  CRISPR gRNA sequence
aaccttagtgacaggctgca

SEQ ID NO: 79647 - DNA, 20 bp, Artificial
  CRISPR gRNA sequence
agtgacaggctgcatctgtg

SEQ ID NO: 79648 - DNA, 20 bp, Artificial
  CRISPR gRNA sequence
gtgacaggctgcatctgtgt

SEQ ID NO: 79649 - DNA, 20 bp, Artificial
  CRISPR gRNA sequence
catctgtgtggatgaagtgg

SEQ ID NO: 79650 - DNA, 20 bp, Artificial
  CRISPR gRNA sequence
tgtggatgaagtggtgcctt

SEQ ID NO: 79651 - DNA, 20 bp, Artificial
  CRISPR gRNA sequence
ctctaaatgtcataaaggtg

SEQ ID NO: 79652 - DNA, 20 bp, Artificial
  CRISPR gRNA sequence
tctaaatgtcataaaggtgc

SEQ ID NO: 79653 - DNA, 20 bp, Artificial
  CRISPR gRNA sequence
taaatgtcataaaggtgcca

SEQ ID NO: 79654 - DNA, 20 bp, Artificial
  CRISPR gRNA sequence
aatgtcataaaggtgccata

SEQ ID NO: 79655 - DNA, 20 bp, Artificial
  CRISPR gRNA sequence
gcagcgttctgccagggagg

SEQ ID NO: 79656 - DNA, 20 bp, Artificial
  CRISPR gRNA sequence
tgccagggaggagggtcact

SEQ ID NO: 79657 - DNA, 20 bp, Artificial
  CRISPR gRNA sequence
ccagggaggagggtcactgg

SEQ ID NO: 79658 - DNA, 20 bp, Artificial
  CRISPR gRNA sequence
gtcccactcctccccatggt

SEQ ID NO: 79659 - DNA, 20 bp, Artificial
  CRISPR gRNA sequence
ctccccatggtactgagtcc

SEQ ID NO: 79660 - DNA, 20 bp, Artificial
  CRISPR gRNA sequence
cccatggtactgagtcccag

SEQ ID NO: 79661 - DNA, 20 bp, Artificial
  CRISPR gRNA sequence
agtcccagacacagggcagg

SEQ ID NO: 79662 - DNA, 20 bp, Artificial
  CRISPR gRNA sequence
gtgcatacaagcttagttag

SEQ ID NO: 79663 - DNA, 20 bp, Artificial
  CRISPR gRNA sequence
tgcatacaagcttagttagt

SEQ ID NO: 79664 - DNA, 20 bp, Artificial
  CRISPR gRNA sequence
agttagttagagtgtgctgg

SEQ ID NO: 79665 - DNA, 20 bp, Artificial
  CRISPR gRNA sequence
gttagttagagtgtgctggc

SEQ ID NO: 79666 - DNA, 20 bp, Artificial
  CRISPR gRNA sequence
gttagagtgtgctggcatca

SEQ ID NO: 79667 - DNA, 20 bp, Artificial
  CRISPR gRNA sequence
gagtgtgctggcatcaaaat

SEQ ID NO: 79668 - DNA, 20 bp, Artificial
  CRISPR gRNA sequence
gcatcaaaatgtgtacatgt

SEQ ID NO: 79669 - DNA, 20 bp, Artificial
  CRISPR gRNA sequence
aaggtgcatgtgtgcgctgc

SEQ ID NO: 79670 - DNA, 20 bp, Artificial
  CRISPR gRNA sequence
catacatgtgcacacctatg

SEQ ID NO: 79671 - DNA, 20 bp, Artificial
  CRISPR gRNA sequence
tgagtgggcatgtgtgggtg

SEQ ID NO: 79672 - DNA, 20 bp, Artificial
  CRISPR gRNA sequence
ttgcatatgcctgtgtactt

SEQ ID NO: 79673 - DNA, 20 bp, Artificial
  CRISPR gRNA sequence
gcatatgcctgtgtacttct

SEQ ID NO: 79674 - DNA, 20 bp, Artificial
  CRISPR gRNA sequence
catatgcctgtgtacttctg

SEQ ID NO: 79675 - DNA, 20 bp, Artificial
  CRISPR gRNA sequence
tgtacttctgtgcaagtgta

SEQ ID NO: 79676 - DNA, 20 bp, Artificial
  CRISPR gRNA sequence
ctgtgcaagtgtagacatgt

SEQ ID NO: 79677 - DNA, 20 bp, Artificial
  CRISPR gRNA sequence
tgtgcaagtgtagacatgtg

SEQ ID NO: 79678 - DNA, 20 bp, Artificial
  CRISPR gRNA sequence
tgcaagtgtagacatgtgtg

SEQ ID NO: 79679 - DNA, 20 bp, Artificial
  CRISPR gRNA sequence
catgtagttatgtgtaccca

SEQ ID NO: 79680 - DNA, 20 bp, Artificial
  CRISPR gRNA sequence
atgtagttatgtgtacccac

SEQ ID NO: 79681 - DNA, 20 bp, Artificial
  CRISPR gRNA sequence
tgtgtacccacagtgcctga

SEQ ID NO: 79682 - DNA, 20 bp, Artificial
  CRISPR gRNA sequence
attcctgcctacgcactgct

SEQ ID NO: 79683 - DNA, 20 bp, Artificial
  CRISPR gRNA sequence
ctgcctacgcactgctatcc

SEQ ID NO: 79684 - DNA, 20 bp, Artificial
  CRISPR gRNA sequence
cctacgcactgctatccctt

SEQ ID NO: 79685 - DNA, 20 bp, Artificial
  CRISPR gRNA sequence
cgcactgctatcccttctcc

SEQ ID NO: 79686 - DNA, 20 bp, Artificial
  CRISPR gRNA sequence
ctatcccttctcctgggatt

SEQ ID NO: 79687 - DNA, 20 bp, Artificial
  CRISPR gRNA sequence
tcccttctcctgggatttca

SEQ ID NO: 79688 - DNA, 20 bp, Artificial
  CRISPR gRNA sequence
ctcctgggatttcagaaaga

SEQ ID NO: 79689 - DNA, 20 bp, Artificial
  CRISPR gRNA sequence
tcctgggatttcagaaagag

SEQ ID NO: 79690 - DNA, 20 bp, Artificial
  CRISPR gRNA sequence
ctgggatttcagaaagaggg

SEQ ID NO: 79691 - DNA, 20 bp, Artificial
  CRISPR gRNA sequence
ggatttcagaaagagggagg

SEQ ID NO: 79692 - DNA, 20 bp, Artificial
  CRISPR gRNA sequence
cagaaagagggagggagcct

SEQ ID NO: 79693 - DNA, 20 bp, Artificial
  CRISPR gRNA sequence
agaaagagggagggagcctt

SEQ ID NO: 79694 - DNA, 20 bp, Artificial
  CRISPR gRNA sequence
aacactcatgctcctccaag

SEQ ID NO: 79695 - DNA, 20 bp, Artificial
  CRISPR gRNA sequence
acactcatgctcctccaaga

SEQ ID NO: 79696 - DNA, 20 bp, Artificial
  CRISPR gRNA sequence
atgctcctccaagacagtct

SEQ ID NO: 79697 - DNA, 20 bp, Artificial
  CRISPR gRNA sequence
ctccaagacagtctaaaata

SEQ ID NO: 79698 - DNA, 20 bp, Artificial
  CRISPR gRNA sequence
caagacagtctaaaatatta

SEQ ID NO: 79699 - DNA, 20 bp, Artificial
  CRISPR gRNA sequence
aaatattagatgaaggaagc

SEQ ID NO: 79700 - DNA, 20 bp, Artificial
  CRISPR gRNA sequence
gatgaaggaagccttgctct

SEQ ID NO: 79701 - DNA, 20 bp, Artificial
  CRISPR gRNA sequence
gctctggggactctgggagc

SEQ ID NO: 79702 - DNA, 20 bp, Artificial
  CRISPR gRNA sequence
ctctggggactctgggagcc

SEQ ID NO: 79703 - DNA, 20 bp, Artificial
  CRISPR gRNA sequence
tggggactctgggagccttg

SEQ ID NO: 79704 - DNA, 20 bp, Artificial
  CRISPR gRNA sequence
gggactctgggagccttggg

SEQ ID NO: 79705 - DNA, 20 bp, Artificial
  CRISPR gRNA sequence
tgggagccttgggtttggac

SEQ ID NO: 79706 - DNA, 20 bp, Artificial
  CRISPR gRNA sequence
ggagccttgggtttggactc

SEQ ID NO: 79707 - DNA, 20 bp, Artificial
  CRISPR gRNA sequence
gggtttggactcagccctac

SEQ ID NO: 79708 - DNA, 20 bp, Artificial
  CRISPR gRNA sequence
ggtttggactcagccctact

SEQ ID NO: 79709 - DNA, 20 bp, Artificial
  CRISPR gRNA sequence
ggactcagccctactgagta

SEQ ID NO: 79710 - DNA, 20 bp, Artificial
  CRISPR gRNA sequence
gactcagccctactgagtac

SEQ ID NO: 79711 - DNA, 20 bp, Artificial
  CRISPR gRNA sequence
agccctactgagtacttgga

SEQ ID NO: 79712 - DNA, 20 bp, Artificial
  CRISPR gRNA sequence
ctgagtacttggactgatgc

SEQ ID NO: 79713 - DNA, 20 bp, Artificial
  CRISPR gRNA sequence
agtacttggactgatgcctt

SEQ ID NO: 79714 - DNA, 20 bp, Artificial
  CRISPR gRNA sequence
ggactgatgccttccctctc

SEQ ID NO: 79715 - DNA, 20 bp, Artificial
  CRISPR gRNA sequence
gactgatgccttccctctct

SEQ ID NO: 79716 - DNA, 20 bp, Artificial
  CRISPR gRNA sequence
atgccttccctctctgggtc

SEQ ID NO: 79717 - DNA, 20 bp, Artificial
  CRISPR gRNA sequence
ccctctctgggtctcactga

SEQ ID NO: 79718 - DNA, 20 bp, Artificial
  CRISPR gRNA sequence
cctctctgggtctcactgaa

SEQ ID NO: 79719 - DNA, 20 bp, Artificial
  CRISPR gRNA sequence
tctgggtctcactgaaaaac

SEQ ID NO: 79720 - DNA, 20 bp, Artificial
  CRISPR gRNA sequence
tgggtctcactgaaaaacta

SEQ ID NO: 79721 - DNA, 20 bp, Artificial
  CRISPR gRNA sequence
ggtctcactgaaaaactact

SEQ ID NO: 79722 - DNA, 20 bp, Artificial
  CRISPR gRNA sequence
actgaaaaactactggtcag

SEQ ID NO: 79723 - DNA, 20 bp, Artificial
  CRISPR gRNA sequence
aaaaactactggtcagactt

SEQ ID NO: 79724 - DNA, 20 bp, Artificial
  CRISPR gRNA sequence
ctggtcagacttggaggaac

SEQ ID NO: 79725 - DNA, 20 bp, Artificial
  CRISPR gRNA sequence
gtcagacttggaggaacatg

SEQ ID NO: 79726 - DNA, 20 bp, Artificial
  CRISPR gRNA sequence
ggaggaacatgcaggcccca

SEQ ID NO: 79727 - DNA, 20 bp, Artificial
  CRISPR gRNA sequence
gaggaacatgcaggccccag

SEQ ID NO: 79728 - DNA, 20 bp, Artificial
  CRISPR gRNA sequence
tgggacctgggcagtggctc

SEQ ID NO: 79729 - DNA, 20 bp, Artificial
  CRISPR gRNA sequence
ggacctgggcagtggctcat

SEQ ID NO: 79730 - DNA, 20 bp, Artificial
  CRISPR gRNA sequence
ggcagtggctcatctcccca

SEQ ID NO: 79731 - DNA, 20 bp, Artificial
  CRISPR gRNA sequence
atctccccagtcagtgagcc

SEQ ID NO: 79732 - DNA, 20 bp, Artificial
  CRISPR gRNA sequence
cccagtcagtgagccctcct

SEQ ID NO: 79733 - DNA, 20 bp, Artificial
  CRISPR gRNA sequence
ctggagatcactcacctgac

SEQ ID NO: 79734 - DNA, 20 bp, Artificial
  CRISPR gRNA sequence
gagatcactcacctgacttc

SEQ ID NO: 79735 - DNA, 20 bp, Artificial
  CRISPR gRNA sequence
acctgacttctttcagctgt

SEQ ID NO: 79736 - DNA, 20 bp, Artificial
  CRISPR gRNA sequence
acttctttcagctgtggaca

SEQ ID NO: 79737 - DNA, 20 bp, Artificial
  CRISPR gRNA sequence
ctttcagctgtggacagaga

SEQ ID NO: 79738 - DNA, 20 bp, Artificial
  CRISPR gRNA sequence
tttcagctgtggacagagag

SEQ ID NO: 79739 - DNA, 20 bp, Artificial
  CRISPR gRNA sequence
tcagctgtggacagagaggc

SEQ ID NO: 79740 - DNA, 20 bp, Artificial
  CRISPR gRNA sequence
cagctgtggacagagaggca

SEQ ID NO: 79741 - DNA, 20 bp, Artificial
  CRISPR gRNA sequence
agctgtggacagagaggcaa

SEQ ID NO: 79742 - DNA, 20 bp, Artificial
  CRISPR gRNA sequence
tggacagagaggcaaagctt

SEQ ID NO: 79743 - DNA, 20 bp, Artificial
  CRISPR gRNA sequence
tcaccaggtggctgatgcct

SEQ ID NO: 79744 - DNA, 20 bp, Artificial
  CRISPR gRNA sequence
caccaggtggctgatgcctc

SEQ ID NO: 79745 - DNA, 20 bp, Artificial
  CRISPR gRNA sequence
accaggtggctgatgcctcg

SEQ ID NO: 79746 - DNA, 20 bp, Artificial
  CRISPR gRNA sequence
atgcctcgggcagtgatttt

SEQ ID NO: 79747 - DNA, 20 bp, Artificial
  CRISPR gRNA sequence
gggcagtgattttacttcct

SEQ ID NO: 79748 - DNA, 20 bp, Artificial
  CRISPR gRNA sequence
tacttcctgctaacctacag

SEQ ID NO: 79749 - DNA, 20 bp, Artificial
  CRISPR gRNA sequence
acttcctgctaacctacaga

SEQ ID NO: 79750 - DNA, 20 bp, Artificial
  CRISPR gRNA sequence
cttcctgctaacctacagag

SEQ ID NO: 79751 - DNA, 20 bp, Artificial
  CRISPR gRNA sequence
cctgctaacctacagagtaa

SEQ ID NO: 79752 - DNA, 20 bp, Artificial
  CRISPR gRNA sequence
ctgctaacctacagagtaag

SEQ ID NO: 79753 - DNA, 20 bp, Artificial
  CRISPR gRNA sequence
ctaacctacagagtaagcaa

SEQ ID NO: 79754 - DNA, 20 bp, Artificial
  CRISPR gRNA sequence
acctacagagtaagcaaaga

SEQ ID NO: 79755 - DNA, 20 bp, Artificial
  CRISPR gRNA sequence
cagagtaagcaaagatggtg

SEQ ID NO: 79756 - DNA, 20 bp, Artificial
  CRISPR gRNA sequence
ccttgtgtaggattaaggag

SEQ ID NO: 79757 - DNA, 20 bp, Artificial
  CRISPR gRNA sequence
gtgtaggattaaggagaggg

SEQ ID NO: 79758 - DNA, 20 bp, Artificial
  CRISPR gRNA sequence
tgtaggattaaggagaggga

SEQ ID NO: 79759 - DNA, 20 bp, Artificial
  CRISPR gRNA sequence
aggagagggaggagagtacc

SEQ ID NO: 79760 - DNA, 20 bp, Artificial
  CRISPR gRNA sequence
aagacccttctcagctccaa

SEQ ID NO: 79761 - DNA, 20 bp, Artificial
  CRISPR gRNA sequence
ctcagctccaaggcctggct

SEQ ID NO: 79762 - DNA, 20 bp, Artificial
  CRISPR gRNA sequence
tcagctccaaggcctggctc

SEQ ID NO: 79763 - DNA, 20 bp, Artificial
  CRISPR gRNA sequence
agctccaaggcctggctcac

SEQ ID NO: 79764 - DNA, 20 bp, Artificial
  CRISPR gRNA sequence
caaggcctggctcaccccag

SEQ ID NO: 79765 - DNA, 20 bp, Artificial
  CRISPR gRNA sequence
gctcaccccagcatctgcag

SEQ ID NO: 79766 - DNA, 20 bp, Artificial
  CRISPR gRNA sequence
accccagcatctgcagcctc

SEQ ID NO: 79767 - DNA, 20 bp, Artificial
  CRISPR gRNA sequence
cagcctccccattgtcggca

SEQ ID NO: 79768 - DNA, 20 bp, Artificial
  CRISPR gRNA sequence
cccattgtcggcaagctcct

SEQ ID NO: 79769 - DNA, 20 bp, Artificial
  CRISPR gRNA sequence
tcggcaagctcctggagagg

SEQ ID NO: 79770 - DNA, 20 bp, Artificial
  CRISPR gRNA sequence
ctggagagggcttctgcaaa

SEQ ID NO: 79771 - DNA, 20 bp, Artificial
  CRISPR gRNA sequence
gagagggcttctgcaaaggc

SEQ ID NO: 79772 - DNA, 20 bp, Artificial
  CRISPR gRNA sequence
ctgcaaaggcatccccacac

SEQ ID NO: 79773 - DNA, 20 bp, Artificial
  CRISPR gRNA sequence
tgcaaaggcatccccacact

SEQ ID NO: 79774 - DNA, 20 bp, Artificial
  CRISPR gRNA sequence
caaaggcatccccacacttc

SEQ ID NO: 79775 - DNA, 20 bp, Artificial
  CRISPR gRNA sequence
cctgctcttaaagctgccat

SEQ ID NO: 79776 - DNA, 20 bp, Artificial
  CRISPR gRNA sequence
ctgctcttaaagctgccata

SEQ ID NO: 79777 - DNA, 20 bp, Artificial
  CRISPR gRNA sequence
ctcttaaagctgccataaga

SEQ ID NO: 79778 - DNA, 20 bp, Artificial
  CRISPR gRNA sequence
ttaaagctgccataagaaga

SEQ ID NO: 79779 - DNA, 20 bp, Artificial
  CRISPR gRNA sequence
aaagctgccataagaagaag

SEQ ID NO: 79780 - DNA, 20 bp, Artificial
  CRISPR gRNA sequence
aagctgccataagaagaagc

SEQ ID NO: 79781 - DNA, 20 bp, Artificial
  CRISPR gRNA sequence
ccataagaagaagcgaagtg

SEQ ID NO: 79782 - DNA, 20 bp, Artificial
  CRISPR gRNA sequence
ggcagagctgagaagtcatc

SEQ ID NO: 79783 - DNA, 20 bp, Artificial
  CRISPR gRNA sequence
agaagtcatcgccatcccct

SEQ ID NO: 79784 - DNA, 20 bp, Artificial
  CRISPR gRNA sequence
agagagatggggcttaatac

SEQ ID NO: 79785 - DNA, 20 bp, Artificial
  CRISPR gRNA sequence
aatacagtagtactaacaaa

SEQ ID NO: 79786 - DNA, 20 bp, Artificial
  CRISPR gRNA sequence
atacagtagtactaacaaat

SEQ ID NO: 79787 - DNA, 20 bp, Artificial
  CRISPR gRNA sequence
acaaatacatattatggccg

SEQ ID NO: 79788 - DNA, 20 bp, Artificial
  CRISPR gRNA sequence
tggccgagacttctaatcgt

SEQ ID NO: 79789 - DNA, 20 bp, Artificial
  CRISPR gRNA sequence
ctaatcgtccaccaaagccc

SEQ ID NO: 79790 - DNA, 20 bp, Artificial
  CRISPR gRNA sequence
taatcgtccaccaaagccca

SEQ ID NO: 79791 - DNA, 20 bp, Artificial
  CRISPR gRNA sequence
atcgtccaccaaagcccatt

SEQ ID NO: 79792 - DNA, 20 bp, Artificial
  CRISPR gRNA sequence
tccacttcatctacagcaat

SEQ ID NO: 79793 - DNA, 20 bp, Artificial
  CRISPR gRNA sequence
cacttcatctacagcaatag

SEQ ID NO: 79794 - DNA, 20 bp, Artificial
  CRISPR gRNA sequence
catctacagcaatagagcta

SEQ ID NO: 79795 - DNA, 20 bp, Artificial
  CRISPR gRNA sequence
atctacagcaatagagctat

SEQ ID NO: 79796 - DNA, 20 bp, Artificial
  CRISPR gRNA sequence
cagcaatagagctatcatga

SEQ ID NO: 79797 - DNA, 20 bp, Artificial
  CRISPR gRNA sequence
tcatgaggaacatggtttcc

SEQ ID NO: 79798 - DNA, 20 bp, Artificial
  CRISPR gRNA sequence
cccagccagagatcacattt

SEQ ID NO: 79799 - DNA, 20 bp, Artificial
  CRISPR gRNA sequence
ccagccagagatcacatttc

SEQ ID NO: 79800 - DNA, 20 bp, Artificial
  CRISPR gRNA sequence
cccagcctcccttgcagctc

SEQ ID NO: 79801 - DNA, 20 bp, Artificial
  CRISPR gRNA sequence
ccagcctcccttgcagctca

SEQ ID NO: 79802 - DNA, 20 bp, Artificial
  CRISPR gRNA sequence
ccttgcagctcagtgtggcc

SEQ ID NO: 79803 - DNA, 20 bp, Artificial
  CRISPR gRNA sequence
gcagctcagtgtggccaggt

SEQ ID NO: 79804 - DNA, 20 bp, Artificial
  CRISPR gRNA sequence
cagctcagtgtggccaggtg

SEQ ID NO: 79805 - DNA, 20 bp, Artificial
  CRISPR gRNA sequence
agtgtggccaggtgactatg

SEQ ID NO: 79806 - DNA, 20 bp, Artificial
  CRISPR gRNA sequence
tgttctcaccaatggaatgt

SEQ ID NO: 79807 - DNA, 20 bp, Artificial
  CRISPR gRNA sequence
tcaccaatggaatgtgagtg

SEQ ID NO: 79808 - DNA, 20 bp, Artificial
  CRISPR gRNA sequence
accaatggaatgtgagtgga

SEQ ID NO: 79809 - DNA, 20 bp, Artificial
  CRISPR gRNA sequence
gtttcaggactgaactttaa

SEQ ID NO: 79810 - DNA, 20 bp, Artificial
  CRISPR gRNA sequence
caggactgaactttaatgca

SEQ ID NO: 79811 - DNA, 20 bp, Artificial
  CRISPR gRNA sequence
aggactgaactttaatgcat

SEQ ID NO: 79812 - DNA, 20 bp, Artificial
  CRISPR gRNA sequence
aactttaatgcattgacatg

SEQ ID NO: 79813 - DNA, 20 bp, Artificial
  CRISPR gRNA sequence
taatgcattgacatgttcct

SEQ ID NO: 79814 - DNA, 20 bp, Artificial
  CRISPR gRNA sequence
aatgcattgacatgttcctc

SEQ ID NO: 79815 - DNA, 20 bp, Artificial
  CRISPR gRNA sequence
atgcattgacatgttcctcc

SEQ ID NO: 79816 - DNA, 20 bp, Artificial
  CRISPR gRNA sequence
acatgttcctccatgctctt

SEQ ID NO: 79817 - DNA, 20 bp, Artificial
  CRISPR gRNA sequence
ctccatgctctttccttgtt

SEQ ID NO: 79818 - DNA, 20 bp, Artificial
  CRISPR gRNA sequence
catgctctttccttgttccc

SEQ ID NO: 79819 - DNA, 20 bp, Artificial
  CRISPR gRNA sequence
tttccttgttcccaagccag

SEQ ID NO: 79820 - DNA, 20 bp, Artificial
  CRISPR gRNA sequence
tccttgttcccaagccagag

SEQ ID NO: 79821 - DNA, 20 bp, Artificial
  CRISPR gRNA sequence
ccttgttcccaagccagagc

SEQ ID NO: 79822 - DNA, 20 bp, Artificial
  CRISPR gRNA sequence
cttgttcccaagccagagca

SEQ ID NO: 79823 - DNA, 20 bp, Artificial
  CRISPR gRNA sequence
gttcccaagccagagcacag

SEQ ID NO: 79824 - DNA, 20 bp, Artificial
  CRISPR gRNA sequence
ttcccaagccagagcacaga

SEQ ID NO: 79825 - DNA, 20 bp, Artificial
  CRISPR gRNA sequence
ccaagccagagcacagatat

SEQ ID NO: 79826 - DNA, 20 bp, Artificial
  CRISPR gRNA sequence
tgactgtgcagataggattc

SEQ ID NO: 79827 - DNA, 20 bp, Artificial
  CRISPR gRNA sequence
gactgtgcagataggattcc

SEQ ID NO: 79828 - DNA, 20 bp, Artificial
  CRISPR gRNA sequence
actgtgcagataggattccc

SEQ ID NO: 79829 - DNA, 20 bp, Artificial
  CRISPR gRNA sequence
tgcagataggattcccaagg

SEQ ID NO: 79830 - DNA, 20 bp, Artificial
  CRISPR gRNA sequence
ccaaggggataatggagcaa

SEQ ID NO: 79831 - DNA, 20 bp, Artificial
  CRISPR gRNA sequence
ggtacctgcatgactgcgtg

SEQ ID NO: 79832 - DNA, 20 bp, Artificial
  CRISPR gRNA sequence
catgactgcgtggagctgag

SEQ ID NO: 79833 - DNA, 20 bp, Artificial
  CRISPR gRNA sequence
cgtggagctgagccattcca

SEQ ID NO: 79834 - DNA, 20 bp, Artificial
  CRISPR gRNA sequence
agccattccactgacctgga

SEQ ID NO: 79835 - DNA, 20 bp, Artificial
  CRISPR gRNA sequence
cactgacctggaccacctac

SEQ ID NO: 79836 - DNA, 20 bp, Artificial
  CRISPR gRNA sequence
acctggaccacctacctctg

SEQ ID NO: 79837 - DNA, 20 bp, Artificial
  CRISPR gRNA sequence
gaccacctacctctgactct

SEQ ID NO: 79838 - DNA, 20 bp, Artificial
  CRISPR gRNA sequence
cctctgactcttccatgaga

SEQ ID NO: 79839 - DNA, 20 bp, Artificial
  CRISPR gRNA sequence
tgactcttccatgagagaga

SEQ ID NO: 79840 - DNA, 20 bp, Artificial
  CRISPR gRNA sequence
actcttccatgagagagaaa

SEQ ID NO: 79841 - DNA, 20 bp, Artificial
  CRISPR gRNA sequence
ttccatgagagagaaataaa

SEQ ID NO: 79842 - DNA, 20 bp, Artificial
  CRISPR gRNA sequence
ccatgagagagaaataaaat

SEQ ID NO: 79843 - DNA, 20 bp, Artificial
  CRISPR gRNA sequence
catgagagagaaataaaatt

SEQ ID NO: 79844 - DNA, 20 bp, Artificial
  CRISPR gRNA sequence
tacattatttaacctactgt

SEQ ID NO: 79845 - DNA, 20 bp, Artificial
  CRISPR gRNA sequence
cattatttaacctactgtat

SEQ ID NO: 79846 - DNA, 20 bp, Artificial
  CRISPR gRNA sequence
tttaacctactgtatttggg

SEQ ID NO: 79847 - DNA, 20 bp, Artificial
  CRISPR gRNA sequence
aacctactgtatttggggag

SEQ ID NO: 79848 - DNA, 20 bp, Artificial
  CRISPR gRNA sequence
acctactgtatttggggagg

SEQ ID NO: 79849 - DNA, 20 bp, Artificial
  CRISPR gRNA sequence
ctgtatttggggaggaggtt

SEQ ID NO: 79850 - DNA, 20 bp, Artificial
  CRISPR gRNA sequence
tatttggggaggaggtttct

SEQ ID NO: 79851 - DNA, 20 bp, Artificial
  CRISPR gRNA sequence
ggggaggaggtttctctgtt

SEQ ID NO: 79852 - DNA, 20 bp, Artificial
  CRISPR gRNA sequence
gggaggaggtttctctgtta

SEQ ID NO: 79853 - DNA, 20 bp, Artificial
  CRISPR gRNA sequence
ctctgttactgcagcctagc

SEQ ID NO: 79854 - DNA, 20 bp, Artificial
  CRISPR gRNA sequence
tctgttactgcagcctagcc

SEQ ID NO: 79855 - DNA, 20 bp, Artificial
  CRISPR gRNA sequence
tgttactgcagcctagcctt

SEQ ID NO: 79856 - DNA, 20 bp, Artificial
  CRISPR gRNA sequence
ttactgcagcctagcctttt

SEQ ID NO: 79857 - DNA, 20 bp, Artificial
  CRISPR gRNA sequence
ctgcagcctagccttttctc

SEQ ID NO: 79858 - DNA, 20 bp, Artificial
  CRISPR gRNA sequence
cagcctagccttttctctag

SEQ ID NO: 79859 - DNA, 20 bp, Artificial
  CRISPR gRNA sequence
gccttttctctagctaatat

SEQ ID NO: 79860 - DNA, 20 bp, Artificial
  CRISPR gRNA sequence
ttctctagctaatatgcaca

SEQ ID NO: 79861 - DNA, 20 bp, Artificial
  CRISPR gRNA sequence
tctctagctaatatgcacac

SEQ ID NO: 79862 - DNA, 20 bp, Artificial
  CRISPR gRNA sequence
ctctagctaatatgcacact

SEQ ID NO: 79863 - DNA, 20 bp, Artificial
  CRISPR gRNA sequence
tctagctaatatgcacactg

SEQ ID NO: 79864 - DNA, 20 bp, Artificial
  CRISPR gRNA sequence
tagctaatatgcacactgag

SEQ ID NO: 79865 - DNA, 20 bp, Artificial
  CRISPR gRNA sequence
gctaatatgcacactgagcc

SEQ ID NO: 79866 - DNA, 20 bp, Artificial
  CRISPR gRNA sequence
atatgcacactgagcctttg

SEQ ID NO: 79867 - DNA, 20 bp, Artificial
  CRISPR gRNA sequence
agcctttgctctgtgctagg

SEQ ID NO: 79868 - DNA, 20 bp, Artificial
  CRISPR gRNA sequence
tgctctgtgctaggcactgt

SEQ ID NO: 79869 - DNA, 20 bp, Artificial
  CRISPR gRNA sequence
gctctgtgctaggcactgtg

SEQ ID NO: 79870 - DNA, 20 bp, Artificial
  CRISPR gRNA sequence
ctctgtgctaggcactgtgc

SEQ ID NO: 79871 - DNA, 20 bp, Artificial
  CRISPR gRNA sequence
tgtgctaggcactgtgctac

SEQ ID NO: 79872 - DNA, 20 bp, Artificial
  CRISPR gRNA sequence
tgctaggcactgtgctacaa

SEQ ID NO: 79873 - DNA, 20 bp, Artificial
  CRISPR gRNA sequence
ggcactgtgctacaaaatgt

SEQ ID NO: 79874 - DNA, 20 bp, Artificial
  CRISPR gRNA sequence
tgctacaaaatgtttttcat

SEQ ID NO: 79875 - DNA, 20 bp, Artificial
  CRISPR gRNA sequence
caaaatgtttttcatgcacc

SEQ ID NO: 79876 - DNA, 20 bp, Artificial
  CRISPR gRNA sequence
ttcatgcaccatcccatctc

SEQ ID NO: 79877 - DNA, 20 bp, Artificial
  CRISPR gRNA sequence
tcatgcaccatcccatctca

SEQ ID NO: 79878 - DNA, 20 bp, Artificial
  CRISPR gRNA sequence
catgcaccatcccatctcat

SEQ ID NO: 79879 - DNA, 20 bp, Artificial
  CRISPR gRNA sequence
atgcaccatcccatctcatt

SEQ ID NO: 79880 - DNA, 20 bp, Artificial
  CRISPR gRNA sequence
attcttgcaatgaccatatg

SEQ ID NO: 79881 - DNA, 20 bp, Artificial
  CRISPR gRNA sequence
ttgcaatgaccatatgagtt

SEQ ID NO: 79882 - DNA, 20 bp, Artificial
  CRISPR gRNA sequence
gcaatgaccatatgagttgg

SEQ ID NO: 79883 - DNA, 20 bp, Artificial
  CRISPR gRNA sequence
caatgaccatatgagttggc

SEQ ID NO: 79884 - DNA, 20 bp, Artificial
  CRISPR gRNA sequence
gctattgttacagattcgtt

SEQ ID NO: 79885 - DNA, 20 bp, Artificial
  CRISPR gRNA sequence
ttgttacagattcgttttag

SEQ ID NO: 79886 - DNA, 20 bp, Artificial
  CRISPR gRNA sequence
ttacagattcgttttaggaa

SEQ ID NO: 79887 - DNA, 20 bp, Artificial
  CRISPR gRNA sequence
cagattcgttttaggaacga

SEQ ID NO: 79888 - DNA, 20 bp, Artificial
  CRISPR gRNA sequence
gttttaggaacgaagaaact

SEQ ID NO: 79889 - DNA, 20 bp, Artificial
  CRISPR gRNA sequence
taggaacgaagaaactctgg

SEQ ID NO: 79890 - DNA, 20 bp, Artificial
  CRISPR gRNA sequence
aggaacgaagaaactctggc

SEQ ID NO: 79891 - DNA, 20 bp, Artificial
  CRISPR gRNA sequence
ggaacgaagaaactctggcc

SEQ ID NO: 79892 - DNA, 20 bp, Artificial
  CRISPR gRNA sequence
tggcctagacagtgtgcatg

SEQ ID NO: 79893 - DNA, 20 bp, Artificial
  CRISPR gRNA sequence
gcctagacagtgtgcatgtg

SEQ ID NO: 79894 - DNA, 20 bp, Artificial
  CRISPR gRNA sequence
gacagtgtgcatgtgtgtgc

SEQ ID NO: 79895 - DNA, 20 bp, Artificial
  CRISPR gRNA sequence
catatacttgcccaaagtcc

SEQ ID NO: 79896 - DNA, 20 bp, Artificial
  CRISPR gRNA sequence
gcccaaagtccaccagcctc

SEQ ID NO: 79897 - DNA, 20 bp, Artificial
  CRISPR gRNA sequence
cccaaagtccaccagcctct

SEQ ID NO: 79898 - DNA, 20 bp, Artificial
  CRISPR gRNA sequence
tatagacagcctggatctgt

SEQ ID NO: 79899 - DNA, 20 bp, Artificial
  CRISPR gRNA sequence
tagacagcctggatctgtgg

SEQ ID NO: 79900 - DNA, 20 bp, Artificial
  CRISPR gRNA sequence
gatctgtggtttcagcccat

SEQ ID NO: 79901 - DNA, 20 bp, Artificial
  CRISPR gRNA sequence
tggtttcagcccatgattga

SEQ ID NO: 79902 - DNA, 20 bp, Artificial
  CRISPR gRNA sequence
cagcccatgattgacagaga

SEQ ID NO: 79903 - DNA, 20 bp, Artificial
  CRISPR gRNA sequence
agcccatgattgacagagag

SEQ ID NO: 79904 - DNA, 20 bp, Artificial
  CRISPR gRNA sequence
acagagagactgagagtcca

SEQ ID NO: 79905 - DNA, 20 bp, Artificial
  CRISPR gRNA sequence
agagtccagaaaccacagac

SEQ ID NO: 79906 - DNA, 20 bp, Artificial
  CRISPR gRNA sequence
ggactccagaggtcctgtca

SEQ ID NO: 79907 - DNA, 20 bp, Artificial
  CRISPR gRNA sequence
gactccagaggtcctgtcaa

SEQ ID NO: 79908 - DNA, 20 bp, Artificial
  CRISPR gRNA sequence
cagaggtcctgtcaaggtat

SEQ ID NO: 79909 - DNA, 20 bp, Artificial
  CRISPR gRNA sequence
tcaaggtatggagcttcctc

SEQ ID NO: 79910 - DNA, 20 bp, Artificial
  CRISPR gRNA sequence
cctctcttgcattgcaggcc

SEQ ID NO: 79911 - DNA, 20 bp, Artificial
  CRISPR gRNA sequence
ctctcttgcattgcaggcca

SEQ ID NO: 79912 - DNA, 20 bp, Artificial
  CRISPR gRNA sequence
tcttgcattgcaggccatta

SEQ ID NO: 79913 - DNA, 20 bp, Artificial
  CRISPR gRNA sequence
ttgcattgcaggccattatg

SEQ ID NO: 79914 - DNA, 20 bp, Artificial
  CRISPR gRNA sequence
gcattgcaggccattatgtt

SEQ ID NO: 79915 - DNA, 20 bp, Artificial
  CRISPR gRNA sequence
cattgcaggccattatgttc

SEQ ID NO: 79916 - DNA, 20 bp, Artificial
  CRISPR gRNA sequence
caggccattatgttctgata

SEQ ID NO: 79917 - DNA, 20 bp, Artificial
  CRISPR gRNA sequence
tgttctgatattcaagattc

SEQ ID NO: 79918 - DNA, 20 bp, Artificial
  CRISPR gRNA sequence
tgatattcaagattcttatc

SEQ ID NO: 79919 - DNA, 20 bp, Artificial
  CRISPR gRNA sequence
atattcaagattcttatcca

SEQ ID NO: 79920 - DNA, 20 bp, Artificial
  CRISPR gRNA sequence
aagattcttatccagtcctc

SEQ ID NO: 79921 - DNA, 20 bp, Artificial
  CRISPR gRNA sequence
ttatccagtcctcttggcag

SEQ ID NO: 79922 - DNA, 20 bp, Artificial
  CRISPR gRNA sequence
atccagtcctcttggcagag

SEQ ID NO: 79923 - DNA, 20 bp, Artificial
  CRISPR gRNA sequence
tccagtcctcttggcagagg

SEQ ID NO: 79924 - DNA, 20 bp, Artificial
  CRISPR gRNA sequence
ttggcagaggtttgctagac

SEQ ID NO: 79925 - DNA, 20 bp, Artificial
  CRISPR gRNA sequence
ggcagaggtttgctagactg

SEQ ID NO: 79926 - DNA, 20 bp, Artificial
  CRISPR gRNA sequence
gcagaggtttgctagactgg

SEQ ID NO: 79927 - DNA, 20 bp, Artificial
  CRISPR gRNA sequence
gctagactggttggcctctg

SEQ ID NO: 79928 - DNA, 20 bp, Artificial
  CRISPR gRNA sequence
ctagactggttggcctctgc

SEQ ID NO: 79929 - DNA, 20 bp, Artificial
  CRISPR gRNA sequence
gactggttggcctctgctcc

SEQ ID NO: 79930 - DNA, 20 bp, Artificial
  CRISPR gRNA sequence
gttggcctctgctcccccaa

SEQ ID NO: 79931 - DNA, 20 bp, Artificial
  CRISPR gRNA sequence
gcctctgctcccccaaaagc

SEQ ID NO: 79932 - DNA, 20 bp, Artificial
  CRISPR gRNA sequence
tgctcccccaaaagcccaat

SEQ ID NO: 79933 - DNA, 20 bp, Artificial
  CRISPR gRNA sequence
ctcccccaaaagcccaatcc

SEQ ID NO: 79934 - DNA, 20 bp, Artificial
  CRISPR gRNA sequence
ccccaaaagcccaatcccct

SEQ ID NO: 79935 - DNA, 20 bp, Artificial
  CRISPR gRNA sequence
cccggtcctcctccactctt

SEQ ID NO: 79936 - DNA, 20 bp, Artificial
  CRISPR gRNA sequence
ctccactcttactcacctga

SEQ ID NO: 79937 - DNA, 20 bp, Artificial
  CRISPR gRNA sequence
cactcttactcacctgagat

SEQ ID NO: 79938 - DNA, 20 bp, Artificial
  CRISPR gRNA sequence
ttactcacctgagattctct

SEQ ID NO: 79939 - DNA, 20 bp, Artificial
  CRISPR gRNA sequence
actcacctgagattctctat

SEQ ID NO: 79940 - DNA, 20 bp, Artificial
  CRISPR gRNA sequence
ctcacctgagattctctatc

SEQ ID NO: 79941 - DNA, 20 bp, Artificial
  CRISPR gRNA sequence
acctgagattctctatctgc

SEQ ID NO: 79942 - DNA, 20 bp, Artificial
  CRISPR gRNA sequence
agattctctatctgcccaca

SEQ ID NO: 79943 - DNA, 20 bp, Artificial
  CRISPR gRNA sequence
tctatctgcccacagcctac

SEQ ID NO: 79944 - DNA, 20 bp, Artificial
  CRISPR gRNA sequence
tatctgcccacagcctacca

SEQ ID NO: 79945 - DNA, 20 bp, Artificial
  CRISPR gRNA sequence
tctgcccacagcctaccaga

SEQ ID NO: 79946 - DNA, 20 bp, Artificial
  CRISPR gRNA sequence
cccacagcctaccagagcct

SEQ ID NO: 79947 - DNA, 20 bp, Artificial
  CRISPR gRNA sequence
ccagagcctcagggcagtgg

SEQ ID NO: 79948 - DNA, 20 bp, Artificial
  CRISPR gRNA sequence
agggcagtggggctccaggg

SEQ ID NO: 79949 - DNA, 20 bp, Artificial
  CRISPR gRNA sequence
caggggacagccatcaaaat

SEQ ID NO: 79950 - DNA, 20 bp, Artificial
  CRISPR gRNA sequence
cctgtgctctaggatgttgg

SEQ ID NO: 79951 - DNA, 20 bp, Artificial
  CRISPR gRNA sequence
tgctctaggatgttggtcag

SEQ ID NO: 79952 - DNA, 20 bp, Artificial
  CRISPR gRNA sequence
taggatgttggtcagggtgg

SEQ ID NO: 79953 - DNA, 20 bp, Artificial
  CRISPR gRNA sequence
ggatgttggtcagggtggcc

SEQ ID NO: 79954 - DNA, 20 bp, Artificial
  CRISPR gRNA sequence
gtcagggtggccaggtcggt

SEQ ID NO: 79955 - DNA, 20 bp, Artificial
  CRISPR gRNA sequence
tggaagggcagttgataggg

SEQ ID NO: 79956 - DNA, 20 bp, Artificial
  CRISPR gRNA sequence
ataggggaggctttgtgcgg

SEQ ID NO: 79957 - DNA, 20 bp, Artificial
  CRISPR gRNA sequence
tgtgcggtgagactggccag

SEQ ID NO: 79958 - DNA, 20 bp, Artificial
  CRISPR gRNA sequence
gtgcggtgagactggccagc

SEQ ID NO: 79959 - DNA, 20 bp, Artificial
  CRISPR gRNA sequence
tgcggtgagactggccagct

SEQ ID NO: 79960 - DNA, 20 bp, Artificial
  CRISPR gRNA sequence
gccagctcaggctcctgtgt

SEQ ID NO: 79961 - DNA, 20 bp, Artificial
  CRISPR gRNA sequence
aggctcctgtgtctcatcca

SEQ ID NO: 79962 - DNA, 20 bp, Artificial
  CRISPR gRNA sequence
ctgtgtctcatccacacagt

SEQ ID NO: 79963 - DNA, 20 bp, Artificial
  CRISPR gRNA sequence
tgtctcatccacacagtgac

SEQ ID NO: 79964 - DNA, 20 bp, Artificial
  CRISPR gRNA sequence
atccacacagtgacacagct

SEQ ID NO: 79965 - DNA, 20 bp, Artificial
  CRISPR gRNA sequence
tacaacctttggccctgtga

SEQ ID NO: 79966 - DNA, 20 bp, Artificial
  CRISPR gRNA sequence
caacctttggccctgtgagc

SEQ ID NO: 79967 - DNA, 20 bp, Artificial
  CRISPR gRNA sequence
tggccctgtgagcttgcggg

SEQ ID NO: 79968 - DNA, 20 bp, Artificial
  CRISPR gRNA sequence
ggccctgtgagcttgcgggt

SEQ ID NO: 79969 - DNA, 20 bp, Artificial
  CRISPR gRNA sequence
gccctgtgagcttgcgggtg

SEQ ID NO: 79970 - DNA, 20 bp, Artificial
  CRISPR gRNA sequence
tgagcttgcgggtggccaac

SEQ ID NO: 79971 - DNA, 20 bp, Artificial
  CRISPR gRNA sequence
gcgggtggccaacttcttca

SEQ ID NO: 79972 - DNA, 20 bp, Artificial
  CRISPR gRNA sequence
cgggtggccaacttcttcaa

SEQ ID NO: 79973 - DNA, 20 bp, Artificial
  CRISPR gRNA sequence
cttcaacacctgcactacag

SEQ ID NO: 79974 - DNA, 20 bp, Artificial
  CRISPR gRNA sequence
ttcaacacctgcactacagc

SEQ ID NO: 79975 - DNA, 20 bp, Artificial
  CRISPR gRNA sequence
caacacctgcactacagcag

SEQ ID NO: 79976 - DNA, 20 bp, Artificial
  CRISPR gRNA sequence
aacacctgcactacagcagc

SEQ ID NO: 79977 - DNA, 20 bp, Artificial
  CRISPR gRNA sequence
cactacagcagcctgcttgg

SEQ ID NO: 79978 - DNA, 20 bp, Artificial
  CRISPR gRNA sequence
cagcagcctgcttggcaccc

SEQ ID NO: 79979 - DNA, 20 bp, Artificial
  CRISPR gRNA sequence
cttggcacccacacagtcct

SEQ ID NO: 79980 - DNA, 20 bp, Artificial
  CRISPR gRNA sequence
ggcacccacacagtcctcat

SEQ ID NO: 79981 - DNA, 20 bp, Artificial
  CRISPR gRNA sequence
gcacccacacagtcctcatt

SEQ ID NO: 79982 - DNA, 20 bp, Artificial
  CRISPR gRNA sequence
attgccctgcgccaggtggc

SEQ ID NO: 79983 - DNA, 20 bp, Artificial
  CRISPR gRNA sequence
ccctgcgccaggtggctaag

SEQ ID NO: 79984 - DNA, 20 bp, Artificial
  CRISPR gRNA sequence
cgccaggtggctaaggaagg

SEQ ID NO: 79985 - DNA, 20 bp, Artificial
  CRISPR gRNA sequence
aggaaggggcggcaggtgca

SEQ ID NO: 79986 - DNA, 20 bp, Artificial
  CRISPR gRNA sequence
agaggcccagtctagctttg

SEQ ID NO: 79987 - DNA, 20 bp, Artificial
  CRISPR gRNA sequence
gctttggtccgctgtaccca

SEQ ID NO: 79988 - DNA, 20 bp, Artificial
  CRISPR gRNA sequence
tggtccgctgtacccagcgg

SEQ ID NO: 79989 - DNA, 20 bp, Artificial
  CRISPR gRNA sequence
ggtccgctgtacccagcggg

SEQ ID NO: 79990 - DNA, 20 bp, Artificial
  CRISPR gRNA sequence
gtccgctgtacccagcggga

SEQ ID NO: 79991 - DNA, 20 bp, Artificial
  CRISPR gRNA sequence
tacccagcgggaatggaggg

SEQ ID NO: 79992 - DNA, 20 bp, Artificial
  CRISPR gRNA sequence
ggtaagtgtgtctttgttca

SEQ ID NO: 79993 - DNA, 20 bp, Artificial
  CRISPR gRNA sequence
tgttcaccttggggctggcc

SEQ ID NO: 79994 - DNA, 20 bp, Artificial
  CRISPR gRNA sequence
gttcaccttggggctggcca

SEQ ID NO: 79995 - DNA, 20 bp, Artificial
  CRISPR gRNA sequence
ttcaccttggggctggccat

SEQ ID NO: 79996 - DNA, 20 bp, Artificial
  CRISPR gRNA sequence
accttggggctggccatcag

SEQ ID NO: 79997 - DNA, 20 bp, Artificial
  CRISPR gRNA sequence
ggggctggccatcaggtgca

SEQ ID NO: 79998 - DNA, 20 bp, Artificial
  CRISPR gRNA sequence
gggctggccatcaggtgcag

SEQ ID NO: 79999 - DNA, 20 bp, Artificial
  CRISPR gRNA sequence
gccatcaggtgcagggcagc

SEQ ID NO: 80000 - DNA, 20 bp, Artificial
  CRISPR gRNA sequence
ctgcaggctgaggtgggtga

SEQ ID NO: 80001 - DNA, 20 bp, Artificial
  CRISPR gRNA sequence
caggctgaggtgggtgaaag

SEQ ID NO: 80002 - DNA, 20 bp, Artificial
  CRISPR gRNA sequence
aggtgggtgaaagcatagcc

SEQ ID NO: 80003 - DNA, 20 bp, Artificial
  CRISPR gRNA sequence
tctgctggtgcccagggcct

SEQ ID NO: 80004 - DNA, 20 bp, Artificial
  CRISPR gRNA sequence
ctggtgcccagggcctgtgc

SEQ ID NO: 80005 - DNA, 20 bp, Artificial
  CRISPR gRNA sequence
gtgcccagggcctgtgcaga

SEQ ID NO: 80006 - DNA, 20 bp, Artificial
  CRISPR gRNA sequence
tgcagacgcagaaggaagtc

SEQ ID NO: 80007 - DNA, 20 bp, Artificial
  CRISPR gRNA sequence
tgagtggccccaaaagctat

SEQ ID NO: 80008 - DNA, 20 bp, Artificial
  CRISPR gRNA sequence
tcaagggtggagcaatatct

SEQ ID NO: 80009 - DNA, 20 bp, Artificial
  CRISPR gRNA sequence
ttgcatagaagataaccttc

SEQ ID NO: 80010 - DNA, 20 bp, Artificial
  CRISPR gRNA sequence
tgcatagaagataaccttcc

SEQ ID NO: 80011 - DNA, 20 bp, Artificial
  CRISPR gRNA sequence
gcatagaagataaccttccc

SEQ ID NO: 80012 - DNA, 20 bp, Artificial
  CRISPR gRNA sequence
catagaagataaccttccct

SEQ ID NO: 80013 - DNA, 20 bp, Artificial
  CRISPR gRNA sequence
ccctgtctccaggcccctca

SEQ ID NO: 80014 - DNA, 20 bp, Artificial
  CRISPR gRNA sequence
cctgtctccaggcccctcag

SEQ ID NO: 80015 - DNA, 20 bp, Artificial
  CRISPR gRNA sequence
tctccaggcccctcagggcc

SEQ ID NO: 80016 - DNA, 20 bp, Artificial
  CRISPR gRNA sequence
caggcccctcagggccacct

SEQ ID NO: 80017 - DNA, 20 bp, Artificial
  CRISPR gRNA sequence
agggccacctcccccaggtc

SEQ ID NO: 80018 - DNA, 20 bp, Artificial
  CRISPR gRNA sequence
ccccaggtccagtagggacg

SEQ ID NO: 80019 - DNA, 20 bp, Artificial
  CRISPR gRNA sequence
agggcgagcaccatctgcat

SEQ ID NO: 80020 - DNA, 20 bp, Artificial
  CRISPR gRNA sequence
catatagagctgagtcatgt

SEQ ID NO: 80021 - DNA, 20 bp, Artificial
  CRISPR gRNA sequence
agtcatgttgggcaggaggg

SEQ ID NO: 80022 - DNA, 20 bp, Artificial
  CRISPR gRNA sequence
ggcaggagggccacagactg

SEQ ID NO: 80023 - DNA, 20 bp, Artificial
  CRISPR gRNA sequence
gcctggggcgtggtcaggaa

SEQ ID NO: 80024 - DNA, 20 bp, Artificial
  CRISPR gRNA sequence
gggcgtggtcaggaagcaga

SEQ ID NO: 80025 - DNA, 20 bp, Artificial
  CRISPR gRNA sequence
ggcacagtgcgggcaccgca

SEQ ID NO: 80026 - DNA, 20 bp, Artificial
  CRISPR gRNA sequence
gcacagtgcgggcaccgcac

SEQ ID NO: 80027 - DNA, 20 bp, Artificial
  CRISPR gRNA sequence
cggagacgtccatttgtctg

SEQ ID NO: 80028 - DNA, 20 bp, Artificial
  CRISPR gRNA sequence
ggagacgtccatttgtctgt

SEQ ID NO: 80029 - DNA, 20 bp, Artificial
  CRISPR gRNA sequence
gtctgtaactccaccagggc

SEQ ID NO: 80030 - DNA, 20 bp, Artificial
  CRISPR gRNA sequence
tctgtaactccaccagggcc

SEQ ID NO: 80031 - DNA, 20 bp, Artificial
  CRISPR gRNA sequence
taactccaccagggccccct

SEQ ID NO: 80032 - DNA, 20 bp, Artificial
  CRISPR gRNA sequence
caccagggccccctcccgcg

SEQ ID NO: 80033 - DNA, 20 bp, Artificial
  CRISPR gRNA sequence
ccgcgatggctgggcgctga

SEQ ID NO: 80034 - DNA, 20 bp, Artificial
  CRISPR gRNA sequence
ggcgctgaagaagtgattca

SEQ ID NO: 80035 - DNA, 20 bp, Artificial
  CRISPR gRNA sequence
aagaagtgattcacatattc

SEQ ID NO: 80036 - DNA, 20 bp, Artificial
  CRISPR gRNA sequence
acatattcttccacccgtgg

SEQ ID NO: 80037 - DNA, 20 bp, Artificial
  CRISPR gRNA sequence
ttccacccgtggcccatcaa

SEQ ID NO: 80038 - DNA, 20 bp, Artificial
  CRISPR gRNA sequence
ccacccgtggcccatcaaag

SEQ ID NO: 80039 - DNA, 20 bp, Artificial
  CRISPR gRNA sequence
cacccgtggcccatcaaagc

SEQ ID NO: 80040 - DNA, 20 bp, Artificial
  CRISPR gRNA sequence
cctctgcaggcaggcaggca

SEQ ID NO: 80041 - DNA, 20 bp, Artificial
  CRISPR gRNA sequence
tgcaggcaggcaggcaggca

SEQ ID NO: 80042 - DNA, 20 bp, Artificial
  CRISPR gRNA sequence
caggcaggcaggcaggcagc

SEQ ID NO: 80043 - DNA, 20 bp, Artificial
  CRISPR gRNA sequence
ccctggacgggaggtagcca

SEQ ID NO: 80044 - DNA, 20 bp, Artificial
  CRISPR gRNA sequence
cctggacgggaggtagccat

SEQ ID NO: 80045 - DNA, 20 bp, Artificial
  CRISPR gRNA sequence
gacgggaggtagccatcacc

SEQ ID NO: 80046 - DNA, 20 bp, Artificial
  CRISPR gRNA sequence
cagagatgggagaaaagggt

SEQ ID NO: 80047 - DNA, 20 bp, Artificial
  CRISPR gRNA sequence
ggcctgggccatcaggaccc

SEQ ID NO: 80048 - DNA, 20 bp, Artificial
  CRISPR gRNA sequence
ggccatcaggacccataggc

SEQ ID NO: 80049 - DNA, 20 bp, Artificial
  CRISPR gRNA sequence
gagggcctcatctagcccat

SEQ ID NO: 80050 - DNA, 20 bp, Artificial
  CRISPR gRNA sequence
atctagcccatcaaagatca

SEQ ID NO: 80051 - DNA, 20 bp, Artificial
  CRISPR gRNA sequence
gcccatcaaagatcagcagg

SEQ ID NO: 80052 - DNA, 20 bp, Artificial
  CRISPR gRNA sequence
ggtcagcgttcttctccagg

SEQ ID NO: 80053 - DNA, 20 bp, Artificial
  CRISPR gRNA sequence
gtcagcgttcttctccaggt

SEQ ID NO: 80054 - DNA, 20 bp, Artificial
  CRISPR gRNA sequence
ttctccaggtactggaagac

SEQ ID NO: 80055 - DNA, 20 bp, Artificial
  CRISPR gRNA sequence
ctccaggtactggaagacag

SEQ ID NO: 80056 - DNA, 20 bp, Artificial
  CRISPR gRNA sequence
tccaggtactggaagacagt

SEQ ID NO: 80057 - DNA, 20 bp, Artificial
  CRISPR gRNA sequence
caggtactggaagacagtgt

SEQ ID NO: 80058 - DNA, 20 bp, Artificial
  CRISPR gRNA sequence
gaagacagtgtcgtggtccg

SEQ ID NO: 80059 - DNA, 20 bp, Artificial
  CRISPR gRNA sequence
agggctcaggtacagatcaa

SEQ ID NO: 80060 - DNA, 20 bp, Artificial
  CRISPR gRNA sequence
aggtacagatcaaaaaggag

SEQ ID NO: 80061 - DNA, 20 bp, Artificial
  CRISPR gRNA sequence
ggacggtgtcaggaacctcg

SEQ ID NO: 80062 - DNA, 20 bp, Artificial
  CRISPR gRNA sequence
gtgatcaagttgagctggcg

SEQ ID NO: 80063 - DNA, 20 bp, Artificial
  CRISPR gRNA sequence
agctggcggaattcaaaaag

SEQ ID NO: 80064 - DNA, 20 bp, Artificial
  CRISPR gRNA sequence
gcggaattcaaaaaggaaca

SEQ ID NO: 80065 - DNA, 20 bp, Artificial
  CRISPR gRNA sequence
aaaaaggaacagggcctgga

SEQ ID NO: 80066 - DNA, 20 bp, Artificial
  CRISPR gRNA sequence
gaaacagttcagatggccct

SEQ ID NO: 80067 - DNA, 20 bp, Artificial
  CRISPR gRNA sequence
agatggccctctgcccactt

SEQ ID NO: 80068 - DNA, 20 bp, Artificial
  CRISPR gRNA sequence
tgcccacttctggcagagcc

SEQ ID NO: 80069 - DNA, 20 bp, Artificial
  CRISPR gRNA sequence
cccacttctggcagagccgg

SEQ ID NO: 80070 - DNA, 20 bp, Artificial
  CRISPR gRNA sequence
ctggcagagccggtgggcca

SEQ ID NO: 80071 - DNA, 20 bp, Artificial
  CRISPR gRNA sequence
tggcagagccggtgggccag

SEQ ID NO: 80072 - DNA, 20 bp, Artificial
  CRISPR gRNA sequence
gcagagccggtgggccagcg

SEQ ID NO: 80073 - DNA, 20 bp, Artificial
  CRISPR gRNA sequence
gcccatgccagccttcccca

SEQ ID NO: 80074 - DNA, 20 bp, Artificial
  CRISPR gRNA sequence
cccatgccagccttccccaa

SEQ ID NO: 80075 - DNA, 20 bp, Artificial
  CRISPR gRNA sequence
ccccaaaagcacggtcaccc

SEQ ID NO: 80076 - DNA, 20 bp, Artificial
  CRISPR gRNA sequence
cccaaaagcacggtcaccct

SEQ ID NO: 80077 - DNA, 20 bp, Artificial
  CRISPR gRNA sequence
gggcccttgttaaccctggt

SEQ ID NO: 80078 - DNA, 20 bp, Artificial
  CRISPR gRNA sequence
gttaaccctggtgttgaaga

SEQ ID NO: 80079 - DNA, 20 bp, Artificial
  CRISPR gRNA sequence
ttaaccctggtgttgaagag

SEQ ID NO: 80080 - DNA, 20 bp, Artificial
  CRISPR gRNA sequence
accctggtgttgaagaggtc

SEQ ID NO: 80081 - DNA, 20 bp, Artificial
  CRISPR gRNA sequence
gtgttgaagaggtccgagat

SEQ ID NO: 80082 - DNA, 20 bp, Artificial
  CRISPR gRNA sequence
aagaggtccgagatgctcac

SEQ ID NO: 80083 - DNA, 20 bp, Artificial
  CRISPR gRNA sequence
acgtcagcaccatcttccac

SEQ ID NO: 80084 - DNA, 20 bp, Artificial
  CRISPR gRNA sequence
ccaccttgacgtcccccata

SEQ ID NO: 80085 - DNA, 20 bp, Artificial
  CRISPR gRNA sequence
caccttgacgtcccccataa

SEQ ID NO: 80086 - DNA, 20 bp, Artificial
  CRISPR gRNA sequence
gacgtcccccataatggccc

SEQ ID NO: 80087 - DNA, 20 bp, Artificial
  CRISPR gRNA sequence
acgtcccccataatggcccc

SEQ ID NO: 80088 - DNA, 20 bp, Artificial
  CRISPR gRNA sequence
cggagtgtctaaggatgctg

SEQ ID NO: 80089 - DNA, 20 bp, Artificial
  CRISPR gRNA sequence
aggatgctgtggcccggcgc

SEQ ID NO: 80090 - DNA, 20 bp, Artificial
  CRISPR gRNA sequence
tggcccggcgcaggattgga

SEQ ID NO: 80091 - DNA, 20 bp, Artificial
  CRISPR gRNA sequence
gagggacatagacctggtgg

SEQ ID NO: 80092 - DNA, 20 bp, Artificial
  CRISPR gRNA sequence
gtggaaggcgtggggctgcc

SEQ ID NO: 80093 - DNA, 20 bp, Artificial
  CRISPR gRNA sequence
ccctgacccagggatttggc

SEQ ID NO: 80094 - DNA, 20 bp, Artificial
  CRISPR gRNA sequence
acccagggatttggctcctg

SEQ ID NO: 80095 - DNA, 20 bp, Artificial
  CRISPR gRNA sequence
ggctcctgtagcgctgctgg

SEQ ID NO: 80096 - DNA, 20 bp, Artificial
  CRISPR gRNA sequence
gctcctgtagcgctgctggg

SEQ ID NO: 80097 - DNA, 20 bp, Artificial
  CRISPR gRNA sequence
ctgtagcgctgctgggcaga

SEQ ID NO: 80098 - DNA, 20 bp, Artificial
  CRISPR gRNA sequence
tagcgctgctgggcagaggt

SEQ ID NO: 80099 - DNA, 20 bp, Artificial
  CRISPR gRNA sequence
ctgggcagaggtccgcagga

SEQ ID NO: 80100 - DNA, 20 bp, Artificial
  CRISPR gRNA sequence
ggcagaggtccgcaggagct

SEQ ID NO: 80101 - DNA, 20 bp, Artificial
  CRISPR gRNA sequence
caggtacttcttggccaact

SEQ ID NO: 80102 - DNA, 20 bp, Artificial
  CRISPR gRNA sequence
cttggccaactctgcaaggg

SEQ ID NO: 80103 - DNA, 20 bp, Artificial
  CRISPR gRNA sequence
ttggccaactctgcaagggg

SEQ ID NO: 80104 - DNA, 20 bp, Artificial
  CRISPR gRNA sequence
ggccaactctgcaaggggca

SEQ ID NO: 80105 - DNA, 20 bp, Artificial
  CRISPR gRNA sequence
gccaactctgcaaggggcag

SEQ ID NO: 80106 - DNA, 20 bp, Artificial
  CRISPR gRNA sequence
tgcaaggggcagggacatgg

SEQ ID NO: 80107 - DNA, 20 bp, Artificial
  CRISPR gRNA sequence
caaggggcagggacatggca

SEQ ID NO: 80108 - DNA, 20 bp, Artificial
  CRISPR gRNA sequence
tgctcatgtcttcttgcccc

SEQ ID NO: 80109 - DNA, 20 bp, Artificial
  CRISPR gRNA sequence
ctcatgtcttcttgccccag

SEQ ID NO: 80110 - DNA, 20 bp, Artificial
  CRISPR gRNA sequence
atgtcttcttgccccagtat

SEQ ID NO: 80111 - DNA, 20 bp, Artificial
  CRISPR gRNA sequence
cttgccccagtattgggctg

SEQ ID NO: 80112 - DNA, 20 bp, Artificial
  CRISPR gRNA sequence
ttgccccagtattgggctgt

SEQ ID NO: 80113 - DNA, 20 bp, Artificial
  CRISPR gRNA sequence
gccccagtattgggctgttg

SEQ ID NO: 80114 - DNA, 20 bp, Artificial
  CRISPR gRNA sequence
ccccagtattgggctgttgg

SEQ ID NO: 80115 - DNA, 20 bp, Artificial
  CRISPR gRNA sequence
ggctgttgggagcctgtagc

SEQ ID NO: 80116 - DNA, 20 bp, Artificial
  CRISPR gRNA sequence
ttgggagcctgtagccccag

SEQ ID NO: 80117 - DNA, 20 bp, Artificial
  CRISPR gRNA sequence
ggagcctgtagccccagatg

SEQ ID NO: 80118 - DNA, 20 bp, Artificial
  CRISPR gRNA sequence
tagccccagatgtgtatgta

SEQ ID NO: 80119 - DNA, 20 bp, Artificial
  CRISPR gRNA sequence
tgccaccccaacttccagaa

SEQ ID NO: 80120 - DNA, 20 bp, Artificial
  CRISPR gRNA sequence
ccagaaggaatcagttctaa

SEQ ID NO: 80121 - DNA, 20 bp, Artificial
  CRISPR gRNA sequence
cagaaggaatcagttctaag

SEQ ID NO: 80122 - DNA, 20 bp, Artificial
  CRISPR gRNA sequence
taagggagcataggctctcc

SEQ ID NO: 80123 - DNA, 20 bp, Artificial
  CRISPR gRNA sequence
agggagcataggctctccgg

SEQ ID NO: 80124 - DNA, 20 bp, Artificial
  CRISPR gRNA sequence
tccggtagctatttaaacag

SEQ ID NO: 80125 - DNA, 20 bp, Artificial
  CRISPR gRNA sequence
cggtagctatttaaacaggc

SEQ ID NO: 80126 - DNA, 20 bp, Artificial
  CRISPR gRNA sequence
tttaaacaggcaggtgggaa

SEQ ID NO: 80127 - DNA, 20 bp, Artificial
  CRISPR gRNA sequence
aaacaggcaggtgggaatgg

SEQ ID NO: 80128 - DNA, 20 bp, Artificial
  CRISPR gRNA sequence
aacaggcaggtgggaatggg

SEQ ID NO: 80129 - DNA, 20 bp, Artificial
  CRISPR gRNA sequence
tatccattctgcaatagtac

SEQ ID NO: 80130 - DNA, 20 bp, Artificial
  CRISPR gRNA sequence
tccattctgcaatagtacac

SEQ ID NO: 80131 - DNA, 20 bp, Artificial
  CRISPR gRNA sequence
tgcaatagtacacgtggtgt

SEQ ID NO: 80132 - DNA, 20 bp, Artificial
  CRISPR gRNA sequence
caatagtacacgtggtgtaa

SEQ ID NO: 80133 - DNA, 20 bp, Artificial
  CRISPR gRNA sequence
agtaagatggggggagggga

SEQ ID NO: 80134 - DNA, 20 bp, Artificial
  CRISPR gRNA sequence
ctttgcaacatctctttttt

SEQ ID NO: 80135 - DNA, 20 bp, Artificial
  CRISPR gRNA sequence
tgcaacatctcttttttttc

SEQ ID NO: 80136 - DNA, 20 bp, Artificial
  CRISPR gRNA sequence
gcaacatctcttttttttct

SEQ ID NO: 80137 - DNA, 20 bp, Artificial
  CRISPR gRNA sequence
caacatctcttttttttctt

SEQ ID NO: 80138 - DNA, 20 bp, Artificial
  CRISPR gRNA sequence
ttttttttcttttttcccag

SEQ ID NO: 80139 - DNA, 20 bp, Artificial
  CRISPR gRNA sequence
ttttttcttttttcccagag

SEQ ID NO: 80140 - DNA, 20 bp, Artificial
  CRISPR gRNA sequence
tttttcttttttcccagaga

SEQ ID NO: 80141 - DNA, 20 bp, Artificial
  CRISPR gRNA sequence
ttttcttttttcccagagac

SEQ ID NO: 80142 - DNA, 20 bp, Artificial
  CRISPR gRNA sequence
tttcttttttcccagagaca

SEQ ID NO: 80143 - DNA, 20 bp, Artificial
  CRISPR gRNA sequence
ttcttttttcccagagacag

SEQ ID NO: 80144 - DNA, 20 bp, Artificial
  CRISPR gRNA sequence
tcttttttcccagagacaga

SEQ ID NO: 80145 - DNA, 20 bp, Artificial
  CRISPR gRNA sequence
cttttttcccagagacagag

SEQ ID NO: 80146 - DNA, 20 bp, Artificial
  CRISPR gRNA sequence
ttttttcccagagacagagt

SEQ ID NO: 80147 - DNA, 20 bp, Artificial
  CRISPR gRNA sequence
ttttcccagagacagagtct

SEQ ID NO: 80148 - DNA, 20 bp, Artificial
  CRISPR gRNA sequence
tttcccagagacagagtctc

SEQ ID NO: 80149 - DNA, 20 bp, Artificial
  CRISPR gRNA sequence
ttcccagagacagagtctca

SEQ ID NO: 80150 - DNA, 20 bp, Artificial
  CRISPR gRNA sequence
tcccagagacagagtctcag

SEQ ID NO: 80151 - DNA, 20 bp, Artificial
  CRISPR gRNA sequence
cccagagacagagtctcagt

SEQ ID NO: 80152 - DNA, 20 bp, Artificial
  CRISPR gRNA sequence
ccagagacagagtctcagtc

SEQ ID NO: 80153 - DNA, 20 bp, Artificial
  CRISPR gRNA sequence
agtcttgcccaggctccagt

SEQ ID NO: 80154 - DNA, 20 bp, Artificial
  CRISPR gRNA sequence
gcccaggctccagtgcagtg

SEQ ID NO: 80155 - DNA, 20 bp, Artificial
  CRISPR gRNA sequence
cccaggctccagtgcagtgg

SEQ ID NO: 80156 - DNA, 20 bp, Artificial
  CRISPR gRNA sequence
cagtgcagtggcacgatcct

SEQ ID NO: 80157 - DNA, 20 bp, Artificial
  CRISPR gRNA sequence
gcttactgtagccgcaaact

SEQ ID NO: 80158 - DNA, 20 bp, Artificial
  CRISPR gRNA sequence
actgtagccgcaaactcctg

SEQ ID NO: 80159 - DNA, 20 bp, Artificial
  CRISPR gRNA sequence
ctgtagccgcaaactcctgg

SEQ ID NO: 80160 - DNA, 20 bp, Artificial
  CRISPR gRNA sequence
tagccgcaaactcctggtct

SEQ ID NO: 80161 - DNA, 20 bp, Artificial
  CRISPR gRNA sequence
ctggtctcaagtgatcctcc

SEQ ID NO: 80162 - DNA, 20 bp, Artificial
  CRISPR gRNA sequence
gtctcaagtgatcctcctgc

SEQ ID NO: 80163 - DNA, 20 bp, Artificial
  CRISPR gRNA sequence
aagtgatcctcctgcctcag

SEQ ID NO: 80164 - DNA, 20 bp, Artificial
  CRISPR gRNA sequence
ctgcctcagcctcctgagta

SEQ ID NO: 80165 - DNA, 20 bp, Artificial
  CRISPR gRNA sequence
cctcagcctcctgagtagct

SEQ ID NO: 80166 - DNA, 20 bp, Artificial
  CRISPR gRNA sequence
agcctcctgagtagctggga

SEQ ID NO: 80167 - DNA, 20 bp, Artificial
  CRISPR gRNA sequence
ctgagtagctgggactacag

SEQ ID NO: 80168 - DNA, 20 bp, Artificial
  CRISPR gRNA sequence
agtagctgggactacaggtg

SEQ ID NO: 80169 - DNA, 20 bp, Artificial
  CRISPR gRNA sequence
ggactacaggtgcacaccac

SEQ ID NO: 80170 - DNA, 20 bp, Artificial
  CRISPR gRNA sequence
caggtgcacaccaccacacc

SEQ ID NO: 80171 - DNA, 20 bp, Artificial
  CRISPR gRNA sequence
atttttgtatttttagtaga

SEQ ID NO: 80172 - DNA, 20 bp, Artificial
  CRISPR gRNA sequence
ttgtatttttagtagagaca

SEQ ID NO: 80173 - DNA, 20 bp, Artificial
  CRISPR gRNA sequence
tgtatttttagtagagacaa

SEQ ID NO: 80174 - DNA, 20 bp, Artificial
  CRISPR gRNA sequence
gtatttttagtagagacaag

SEQ ID NO: 80175 - DNA, 20 bp, Artificial
  CRISPR gRNA sequence
tatttttagtagagacaagg

SEQ ID NO: 80176 - DNA, 20 bp, Artificial
  CRISPR gRNA sequence
ttagtagagacaaggttttg

SEQ ID NO: 80177 - DNA, 20 bp, Artificial
  CRISPR gRNA sequence
tagtagagacaaggttttgt

SEQ ID NO: 80178 - DNA, 20 bp, Artificial
  CRISPR gRNA sequence
agtagagacaaggttttgtc

SEQ ID NO: 80179 - DNA, 20 bp, Artificial
  CRISPR gRNA sequence
gtagagacaaggttttgtca

SEQ ID NO: 80180 - DNA, 20 bp, Artificial
  CRISPR gRNA sequence
tgtcacgttggccaggctag

SEQ ID NO: 80181 - DNA, 20 bp, Artificial
  CRISPR gRNA sequence
gtcacgttggccaggctagt

SEQ ID NO: 80182 - DNA, 20 bp, Artificial
  CRISPR gRNA sequence
tcacgttggccaggctagta

SEQ ID NO: 80183 - DNA, 20 bp, Artificial
  CRISPR gRNA sequence
gccaggctagtattgaattc

SEQ ID NO: 80184 - DNA, 20 bp, Artificial
  CRISPR gRNA sequence
gtattgaattcctgggctca

SEQ ID NO: 80185 - DNA, 20 bp, Artificial
  CRISPR gRNA sequence
aattcctgggctcaactgat

SEQ ID NO: 80186 - DNA, 20 bp, Artificial
  CRISPR gRNA sequence
ctgggctcaactgatccacc

SEQ ID NO: 80187 - DNA, 20 bp, Artificial
  CRISPR gRNA sequence
ggctcaactgatccacctgc

SEQ ID NO: 80188 - DNA, 20 bp, Artificial
  CRISPR gRNA sequence
aactgatccacctgcctcag

SEQ ID NO: 80189 - DNA, 20 bp, Artificial
  CRISPR gRNA sequence
atccacctgcctcagccctc

SEQ ID NO: 80190 - DNA, 20 bp, Artificial
  CRISPR gRNA sequence
cctcagccctccaaagtgct

SEQ ID NO: 80191 - DNA, 20 bp, Artificial
  CRISPR gRNA sequence
agccctccaaagtgctggga

SEQ ID NO: 80192 - DNA, 20 bp, Artificial
  CRISPR gRNA sequence
caaagtgctgggattacagg

SEQ ID NO: 80193 - DNA, 20 bp, Artificial
  CRISPR gRNA sequence
ggattacaggtgtgagccac

SEQ ID NO: 80194 - DNA, 20 bp, Artificial
  CRISPR gRNA sequence
caggtgtgagccaccgcgcc

SEQ ID NO: 80195 - DNA, 20 bp, Artificial
  CRISPR gRNA sequence
ctttgcaatatcttattgaa

SEQ ID NO: 80196 - DNA, 20 bp, Artificial
  CRISPR gRNA sequence
tgcaatatcttattgaaaca

SEQ ID NO: 80197 - DNA, 20 bp, Artificial
  CRISPR gRNA sequence
gcaatatcttattgaaacaa

SEQ ID NO: 80198 - DNA, 20 bp, Artificial
  CRISPR gRNA sequence
caatatcttattgaaacaac

SEQ ID NO: 80199 - DNA, 20 bp, Artificial
  CRISPR gRNA sequence
attgaaacaacctctttctg

SEQ ID NO: 80200 - DNA, 20 bp, Artificial
  CRISPR gRNA sequence
ttgaaacaacctctttctgt

SEQ ID NO: 80201 - DNA, 20 bp, Artificial
  CRISPR gRNA sequence
aaacaacctctttctgtaat

SEQ ID NO: 80202 - DNA, 20 bp, Artificial
  CRISPR gRNA sequence
tttctgtaatatctggatcc

SEQ ID NO: 80203 - DNA, 20 bp, Artificial
  CRISPR gRNA sequence
tctgtaatatctggatcccc

SEQ ID NO: 80204 - DNA, 20 bp, Artificial
  CRISPR gRNA sequence
ctgtaatatctggatcccca

SEQ ID NO: 80205 - DNA, 20 bp, Artificial
  CRISPR gRNA sequence
tgtaatatctggatccccag

SEQ ID NO: 80206 - DNA, 20 bp, Artificial
  CRISPR gRNA sequence
taatatctggatccccagtg

SEQ ID NO: 80207 - DNA, 20 bp, Artificial
  CRISPR gRNA sequence
gatccccagtgcctcttccc

SEQ ID NO: 80208 - DNA, 20 bp, Artificial
  CRISPR gRNA sequence
ttcccaatatttcagttctg

SEQ ID NO: 80209 - DNA, 20 bp, Artificial
  CRISPR gRNA sequence
cccaatatttcagttctgca

SEQ ID NO: 80210 - DNA, 20 bp, Artificial
  CRISPR gRNA sequence
ccaatatttcagttctgcaa

SEQ ID NO: 80211 - DNA, 20 bp, Artificial
  CRISPR gRNA sequence
cagttctgcaatgcccaggg

SEQ ID NO: 80212 - DNA, 20 bp, Artificial
  CRISPR gRNA sequence
agttctgcaatgcccagggg

SEQ ID NO: 80213 - DNA, 20 bp, Artificial
  CRISPR gRNA sequence
tgcaatgcccaggggtgagc

SEQ ID NO: 80214 - DNA, 20 bp, Artificial
  CRISPR gRNA sequence
caatgcccaggggtgagcac

SEQ ID NO: 80215 - DNA, 20 bp, Artificial
  CRISPR gRNA sequence
acaacctgtaggcctaggca

SEQ ID NO: 80216 - DNA, 20 bp, Artificial
  CRISPR gRNA sequence
taggcctaggcattaccgat

SEQ ID NO: 80217 - DNA, 20 bp, Artificial
  CRISPR gRNA sequence
ggcattaccgatcggaactg

SEQ ID NO: 80218 - DNA, 20 bp, Artificial
  CRISPR gRNA sequence
ccgatcggaactgtgggagc

SEQ ID NO: 80219 - DNA, 20 bp, Artificial
  CRISPR gRNA sequence
tgggagctgggcccctacag

SEQ ID NO: 80220 - DNA, 20 bp, Artificial
  CRISPR gRNA sequence
ggcccctacagtgccagatg

SEQ ID NO: 80221 - DNA, 20 bp, Artificial
  CRISPR gRNA sequence
cagtgccagatgttaacctt

SEQ ID NO: 80222 - DNA, 20 bp, Artificial
  CRISPR gRNA sequence
accttttaattcctgggtca

SEQ ID NO: 80223 - DNA, 20 bp, Artificial
  CRISPR gRNA sequence
ttaattcctgggtcattgag

SEQ ID NO: 80224 - DNA, 20 bp, Artificial
  CRISPR gRNA sequence
taattcctgggtcattgaga

SEQ ID NO: 80225 - DNA, 20 bp, Artificial
  CRISPR gRNA sequence
aattcctgggtcattgagag

SEQ ID NO: 80226 - DNA, 20 bp, Artificial
  CRISPR gRNA sequence
attcctgggtcattgagagg

SEQ ID NO: 80227 - DNA, 20 bp, Artificial
  CRISPR gRNA sequence
ctgggtcattgagaggtctc

SEQ ID NO: 80228 - DNA, 20 bp, Artificial
  CRISPR gRNA sequence
ggtcattgagaggtctcagg

SEQ ID NO: 80229 - DNA, 20 bp, Artificial
  CRISPR gRNA sequence
agaggtctcaggtgacccag

SEQ ID NO: 80230 - DNA, 20 bp, Artificial
  CRISPR gRNA sequence
aggtgacccagggaaagggc

SEQ ID NO: 80231 - DNA, 20 bp, Artificial
  CRISPR gRNA sequence
gggctgcttttgggggaacc

SEQ ID NO: 80232 - DNA, 20 bp, Artificial
  CRISPR gRNA sequence
cttttgggggaaccctatgg

SEQ ID NO: 80233 - DNA, 20 bp, Artificial
  CRISPR gRNA sequence
ttgggggaaccctatgggga

SEQ ID NO: 80234 - DNA, 20 bp, Artificial
  CRISPR gRNA sequence
tgggggaaccctatggggaa

SEQ ID NO: 80235 - DNA, 20 bp, Artificial
  CRISPR gRNA sequence
gggggaaccctatggggaaa

SEQ ID NO: 80236 - DNA, 20 bp, Artificial
  CRISPR gRNA sequence
ggggaaccctatggggaaag

SEQ ID NO: 80237 - DNA, 20 bp, Artificial
  CRISPR gRNA sequence
tggggaaaggccaaggtagt

SEQ ID NO: 80238 - DNA, 20 bp, Artificial
  CRISPR gRNA sequence
ttttgagcggatgtgaatcc

SEQ ID NO: 80239 - DNA, 20 bp, Artificial
  CRISPR gRNA sequence
tgagcggatgtgaatcctct

SEQ ID NO: 80240 - DNA, 20 bp, Artificial
  CRISPR gRNA sequence
gagcggatgtgaatcctctg

SEQ ID NO: 80241 - DNA, 20 bp, Artificial
  CRISPR gRNA sequence
agcggatgtgaatcctctgg

SEQ ID NO: 80242 - DNA, 20 bp, Artificial
  CRISPR gRNA sequence
tggttatagccatggttggc

SEQ ID NO: 80243 - DNA, 20 bp, Artificial
  CRISPR gRNA sequence
gttatagccatggttggcag

SEQ ID NO: 80244 - DNA, 20 bp, Artificial
  CRISPR gRNA sequence
tagccatggttggcagcagt

SEQ ID NO: 80245 - DNA, 20 bp, Artificial
  CRISPR gRNA sequence
gcagcagtgggggcagagaa

SEQ ID NO: 80246 - DNA, 20 bp, Artificial
  CRISPR gRNA sequence
tagttagtgggacaactcgt

SEQ ID NO: 80247 - DNA, 20 bp, Artificial
  CRISPR gRNA sequence
gttagtgggacaactcgtgg

SEQ ID NO: 80248 - DNA, 20 bp, Artificial
  CRISPR gRNA sequence
gtgggacaactcgtggagaa

SEQ ID NO: 80249 - DNA, 20 bp, Artificial
  CRISPR gRNA sequence
gtggagaacgaggaccattc

SEQ ID NO: 80250 - DNA, 20 bp, Artificial
  CRISPR gRNA sequence
tgagaactggtcaagaatga

SEQ ID NO: 80251 - DNA, 20 bp, Artificial
  CRISPR gRNA sequence
agaactggtcaagaatgaga

SEQ ID NO: 80252 - DNA, 20 bp, Artificial
  CRISPR gRNA sequence
gtcaagaatgagagaagtcc

SEQ ID NO: 80253 - DNA, 20 bp, Artificial
  CRISPR gRNA sequence
tcttctctcactggcctggc

SEQ ID NO: 80254 - DNA, 20 bp, Artificial
  CRISPR gRNA sequence
cttctctcactggcctggcc

SEQ ID NO: 80255 - DNA, 20 bp, Artificial
  CRISPR gRNA sequence
ttctctcactggcctggcct

SEQ ID NO: 80256 - DNA, 20 bp, Artificial
  CRISPR gRNA sequence
ctctcactggcctggcctgc

SEQ ID NO: 80257 - DNA, 20 bp, Artificial
  CRISPR gRNA sequence
tctcactggcctggcctgcc

SEQ ID NO: 80258 - DNA, 20 bp, Artificial
  CRISPR gRNA sequence
tcactggcctggcctgccct

SEQ ID NO: 80259 - DNA, 20 bp, Artificial
  CRISPR gRNA sequence
actggcctggcctgccctaa

SEQ ID NO: 80260 - DNA, 20 bp, Artificial
  CRISPR gRNA sequence
gcctggcctgccctaagcag

SEQ ID NO: 80261 - DNA, 20 bp, Artificial
  CRISPR gRNA sequence
gcctgccctaagcagctcca

SEQ ID NO: 80262 - DNA, 20 bp, Artificial
  CRISPR gRNA sequence
ccctaagcagctccatgtct

SEQ ID NO: 80263 - DNA, 20 bp, Artificial
  CRISPR gRNA sequence
agcagctccatgtctcccca

SEQ ID NO: 80264 - DNA, 20 bp, Artificial
  CRISPR gRNA sequence
catgtctccccatgggcccc

SEQ ID NO: 80265 - DNA, 20 bp, Artificial
  CRISPR gRNA sequence
cccatgggcccccagggcct

SEQ ID NO: 80266 - DNA, 20 bp, Artificial
  CRISPR gRNA sequence
tgtcttgaaggtttctccca

SEQ ID NO: 80267 - DNA, 20 bp, Artificial
  CRISPR gRNA sequence
tcttgaaggtttctcccagg

SEQ ID NO: 80268 - DNA, 20 bp, Artificial
  CRISPR gRNA sequence
gaaggtttctcccaggcctc

SEQ ID NO: 80269 - DNA, 20 bp, Artificial
  CRISPR gRNA sequence
aaggtttctcccaggcctcc

SEQ ID NO: 80270 - DNA, 20 bp, Artificial
  CRISPR gRNA sequence
ctcccaggcctcctcacccc

SEQ ID NO: 80271 - DNA, 20 bp, Artificial
  CRISPR gRNA sequence
tcccaggcctcctcacccct

SEQ ID NO: 80272 - DNA, 20 bp, Artificial
  CRISPR gRNA sequence
ccaggcctcctcacccctcc

SEQ ID NO: 80273 - DNA, 20 bp, Artificial
  CRISPR gRNA sequence
ctcacccctccccatccctg

SEQ ID NO: 80274 - DNA, 20 bp, Artificial
  CRISPR gRNA sequence
acccctccccatccctgctc

SEQ ID NO: 80275 - DNA, 20 bp, Artificial
  CRISPR gRNA sequence
cccatccctgctcaccccca

SEQ ID NO: 80276 - DNA, 20 bp, Artificial
  CRISPR gRNA sequence
ctcacccccaaactggtctc

SEQ ID NO: 80277 - DNA, 20 bp, Artificial
  CRISPR gRNA sequence
acccccaaactggtctcctc

SEQ ID NO: 80278 - DNA, 20 bp, Artificial
  CRISPR gRNA sequence
gtctcctccctgggtctcct

SEQ ID NO: 80279 - DNA, 20 bp, Artificial
  CRISPR gRNA sequence
ctccctgggtctccttcaac

SEQ ID NO: 80280 - DNA, 20 bp, Artificial
  CRISPR gRNA sequence
cctgggtctccttcaacact

SEQ ID NO: 80281 - DNA, 20 bp, Artificial
  CRISPR gRNA sequence
ggtctccttcaacactgagg

SEQ ID NO: 80282 - DNA, 20 bp, Artificial
  CRISPR gRNA sequence
cttcaacactgaggacatag

SEQ ID NO: 80283 - DNA, 20 bp, Artificial
  CRISPR gRNA sequence
caacactgaggacatagggt

SEQ ID NO: 80284 - DNA, 20 bp, Artificial
  CRISPR gRNA sequence
aacactgaggacatagggtg

SEQ ID NO: 80285 - DNA, 20 bp, Artificial
  CRISPR gRNA sequence
aggacatagggtgtccctgg

SEQ ID NO: 80286 - DNA, 20 bp, Artificial
  CRISPR gRNA sequence
gaaaagcctggacagcgaag

SEQ ID NO: 80287 - DNA, 20 bp, Artificial
  CRISPR gRNA sequence
gacagcgaagctgagacctg

SEQ ID NO: 80288 - DNA, 20 bp, Artificial
  CRISPR gRNA sequence
agacctgtatggtgcttcca

SEQ ID NO: 80289 - DNA, 20 bp, Artificial
  CRISPR gRNA sequence
tatggtgcttccagctcctt

SEQ ID NO: 80290 - DNA, 20 bp, Artificial
  CRISPR gRNA sequence
ccagctccttcagcggagcc

SEQ ID NO: 80291 - DNA, 20 bp, Artificial
  CRISPR gRNA sequence
cagctccttcagcggagccc

SEQ ID NO: 80292 - DNA, 20 bp, Artificial
  CRISPR gRNA sequence
cttcagcggagccctcttca

SEQ ID NO: 80293 - DNA, 20 bp, Artificial
  CRISPR gRNA sequence
cagcggagccctcttcagag

SEQ ID NO: 80294 - DNA, 20 bp, Artificial
  CRISPR gRNA sequence
agcggagccctcttcagaga

SEQ ID NO: 80295 - DNA, 20 bp, Artificial
  CRISPR gRNA sequence
ttcagagaagtccccatgca

SEQ ID NO: 80296 - DNA, 20 bp, Artificial
  CRISPR gRNA sequence
cagagaagtccccatgcagc

SEQ ID NO: 80297 - DNA, 20 bp, Artificial
  CRISPR gRNA sequence
agagaagtccccatgcagcc

SEQ ID NO: 80298 - DNA, 20 bp, Artificial
  CRISPR gRNA sequence
cgctgccagcccaggcctct

SEQ ID NO: 80299 - DNA, 20 bp, Artificial
  CRISPR gRNA sequence
gctgccagcccaggcctctc

SEQ ID NO: 80300 - DNA, 20 bp, Artificial
  CRISPR gRNA sequence
ccagcccaggcctctcctct

SEQ ID NO: 80301 - DNA, 20 bp, Artificial
  CRISPR gRNA sequence
tcctctgcctgtgcaagacc

SEQ ID NO: 80302 - DNA, 20 bp, Artificial
  CRISPR gRNA sequence
ctctgcctgtgcaagacctc

SEQ ID NO: 80303 - DNA, 20 bp, Artificial
  CRISPR gRNA sequence
tgcctgtgcaagacctccag

SEQ ID NO: 80304 - DNA, 20 bp, Artificial
  CRISPR gRNA sequence
cctgtgcaagacctccagtc

SEQ ID NO: 80305 - DNA, 20 bp, Artificial
  CRISPR gRNA sequence
tgcaagacctccagtccttt

SEQ ID NO: 80306 - DNA, 20 bp, Artificial
  CRISPR gRNA sequence
cagtccttttctcctggaaa

SEQ ID NO: 80307 - DNA, 20 bp, Artificial
  CRISPR gRNA sequence
ttctcctggaaacttgcgag

SEQ ID NO: 80308 - DNA, 20 bp, Artificial
  CRISPR gRNA sequence
tctcctggaaacttgcgaga

SEQ ID NO: 80309 - DNA, 20 bp, Artificial
  CRISPR gRNA sequence
ctcctggaaacttgcgagac

SEQ ID NO: 80310 - DNA, 20 bp, Artificial
  CRISPR gRNA sequence
tcctggaaacttgcgagaca

SEQ ID NO: 80311 - DNA, 20 bp, Artificial
  CRISPR gRNA sequence
ctggaaacttgcgagacaag

SEQ ID NO: 80312 - DNA, 20 bp, Artificial
  CRISPR gRNA sequence
gaaacttgcgagacaagagt

SEQ ID NO: 80313 - DNA, 20 bp, Artificial
  CRISPR gRNA sequence
gcgagacaagagtcactggg

SEQ ID NO: 80314 - DNA, 20 bp, Artificial
  CRISPR gRNA sequence
cgagacaagagtcactgggc

SEQ ID NO: 80315 - DNA, 20 bp, Artificial
  CRISPR gRNA sequence
ggcctctggaggcttattgg

SEQ ID NO: 80316 - DNA, 20 bp, Artificial
  CRISPR gRNA sequence
tggaggcttattggcagggg

SEQ ID NO: 80317 - DNA, 20 bp, Artificial
  CRISPR gRNA sequence
gaggcttattggcaggggac

SEQ ID NO: 80318 - DNA, 20 bp, Artificial
  CRISPR gRNA sequence
attggcaggggacaaggtcc

SEQ ID NO: 80319 - DNA, 20 bp, Artificial
  CRISPR gRNA sequence
ttggcaggggacaaggtcca

SEQ ID NO: 80320 - DNA, 20 bp, Artificial
  CRISPR gRNA sequence
gcaggggacaaggtccaggg

SEQ ID NO: 80321 - DNA, 20 bp, Artificial
  CRISPR gRNA sequence
ggcccccaggcaaccccatc

SEQ ID NO: 80322 - DNA, 20 bp, Artificial
  CRISPR gRNA sequence
gcccccaggcaaccccatct

SEQ ID NO: 80323 - DNA, 20 bp, Artificial
  CRISPR gRNA sequence
tctgtttatgttcctcccca

SEQ ID NO: 80324 - DNA, 20 bp, Artificial
  CRISPR gRNA sequence
tgtttatgttcctccccaca

SEQ ID NO: 80325 - DNA, 20 bp, Artificial
  CRISPR gRNA sequence
tttatgttcctccccacact

SEQ ID NO: 80326 - DNA, 20 bp, Artificial
  CRISPR gRNA sequence
atgttcctccccacactggt

SEQ ID NO: 80327 - DNA, 20 bp, Artificial
  CRISPR gRNA sequence
tgttcctccccacactggta

SEQ ID NO: 80328 - DNA, 20 bp, Artificial
  CRISPR gRNA sequence
ctccccacactggtacccac

SEQ ID NO: 80329 - DNA, 20 bp, Artificial
  CRISPR gRNA sequence
cccacactggtacccaccta

SEQ ID NO: 80330 - DNA, 20 bp, Artificial
  CRISPR gRNA sequence
gtacccacctagctgctgct

SEQ ID NO: 80331 - DNA, 20 bp, Artificial
  CRISPR gRNA sequence
gctgctgcttcttgcactgc

SEQ ID NO: 80332 - DNA, 20 bp, Artificial
  CRISPR gRNA sequence
ctgcttcttgcactgcttcc

SEQ ID NO: 80333 - DNA, 20 bp, Artificial
  CRISPR gRNA sequence
cttcttgcactgcttccggc

SEQ ID NO: 80334 - DNA, 20 bp, Artificial
  CRISPR gRNA sequence
cttgcactgcttccggcggg

SEQ ID NO: 80335 - DNA, 20 bp, Artificial
  CRISPR gRNA sequence
ttgcactgcttccggcgggg

SEQ ID NO: 80336 - DNA, 20 bp, Artificial
  CRISPR gRNA sequence
gcactgcttccggcggggtg

SEQ ID NO: 80337 - DNA, 20 bp, Artificial
  CRISPR gRNA sequence
cactgcttccggcggggtga

SEQ ID NO: 80338 - DNA, 20 bp, Artificial
  CRISPR gRNA sequence
cttccggcggggtgaggacc

SEQ ID NO: 80339 - DNA, 20 bp, Artificial
  CRISPR gRNA sequence
ccggcggggtgaggacccac

SEQ ID NO: 80340 - DNA, 20 bp, Artificial
  CRISPR gRNA sequence
cggcggggtgaggacccaca

SEQ ID NO: 80341 - DNA, 20 bp, Artificial
  CRISPR gRNA sequence
tgatgtgggcgcttcaggcc

SEQ ID NO: 80342 - DNA, 20 bp, Artificial
  CRISPR gRNA sequence
atgtgggcgcttcaggcctg

SEQ ID NO: 80343 - DNA, 20 bp, Artificial
  CRISPR gRNA sequence
caggcctgaaaaagcaaagg

SEQ ID NO: 80344 - DNA, 20 bp, Artificial
  CRISPR gRNA sequence
aggcctgaaaaagcaaagga

SEQ ID NO: 80345 - DNA, 20 bp, Artificial
  CRISPR gRNA sequence
aaaaagcaaaggaaggggtg

SEQ ID NO: 80346 - DNA, 20 bp, Artificial
  CRISPR gRNA sequence
gggatctgggctgaggggtt

SEQ ID NO: 80347 - DNA, 20 bp, Artificial
  CRISPR gRNA sequence
ggctgaggggttacccagaa

SEQ ID NO: 80348 - DNA, 20 bp, Artificial
  CRISPR gRNA sequence
aggggttacccagaaccttt

SEQ ID NO: 80349 - DNA, 20 bp, Artificial
  CRISPR gRNA sequence
cccagaacctttggggaact

SEQ ID NO: 80350 - DNA, 20 bp, Artificial
  CRISPR gRNA sequence
tggggaactccagtccacag

SEQ ID NO: 80351 - DNA, 20 bp, Artificial
  CRISPR gRNA sequence
ggggaactccagtccacaga

SEQ ID NO: 80352 - DNA, 20 bp, Artificial
  CRISPR gRNA sequence
gggaactccagtccacagac

SEQ ID NO: 80353 - DNA, 20 bp, Artificial
  CRISPR gRNA sequence
cagtccacagacaggtggca

SEQ ID NO: 80354 - DNA, 20 bp, Artificial
  CRISPR gRNA sequence
gaaaggcaggcagcaggcag

SEQ ID NO: 80355 - DNA, 20 bp, Artificial
  CRISPR gRNA sequence
ggtcaacaccagcttctatt

SEQ ID NO: 80356 - DNA, 20 bp, Artificial
  CRISPR gRNA sequence
ctatttgcagagtggacttc

SEQ ID NO: 80357 - DNA, 20 bp, Artificial
  CRISPR gRNA sequence
tatttgcagagtggacttct

SEQ ID NO: 80358 - DNA, 20 bp, Artificial
  CRISPR gRNA sequence
tttgcagagtggacttctag

SEQ ID NO: 80359 - DNA, 20 bp, Artificial
  CRISPR gRNA sequence
gcagagtggacttctaggca

SEQ ID NO: 80360 - DNA, 20 bp, Artificial
  CRISPR gRNA sequence
cagagtggacttctaggcac

SEQ ID NO: 80361 - DNA, 20 bp, Artificial
  CRISPR gRNA sequence
ctaggcacccccattggaag

SEQ ID NO: 80362 - DNA, 20 bp, Artificial
  CRISPR gRNA sequence
taggcacccccattggaagg

SEQ ID NO: 80363 - DNA, 20 bp, Artificial
  CRISPR gRNA sequence
ggcacccccattggaaggtg

SEQ ID NO: 80364 - DNA, 20 bp, Artificial
  CRISPR gRNA sequence
gaaggtggatgttctgggcc

SEQ ID NO: 80365 - DNA, 20 bp, Artificial
  CRISPR gRNA sequence
tgggcctggcagtcttgcag

SEQ ID NO: 80366 - DNA, 20 bp, Artificial
  CRISPR gRNA sequence
ggcctggcagtcttgcagtc

SEQ ID NO: 80367 - DNA, 20 bp, Artificial
  CRISPR gRNA sequence
gcagtcttgcagtccaggat

SEQ ID NO: 80368 - DNA, 20 bp, Artificial
  CRISPR gRNA sequence
gcagtccaggatgcaggaag

SEQ ID NO: 80369 - DNA, 20 bp, Artificial
  CRISPR gRNA sequence
cagtccaggatgcaggaagc

SEQ ID NO: 80370 - DNA, 20 bp, Artificial
  CRISPR gRNA sequence
agctccaagcactaaatggc

SEQ ID NO: 80371 - DNA, 20 bp, Artificial
  CRISPR gRNA sequence
caagcactaaatggccatct

SEQ ID NO: 80372 - DNA, 20 bp, Artificial
  CRISPR gRNA sequence
aatggccatctgtccatcag

SEQ ID NO: 80373 - DNA, 20 bp, Artificial
  CRISPR gRNA sequence
tccatcagggaaggaccaag

SEQ ID NO: 80374 - DNA, 20 bp, Artificial
  CRISPR gRNA sequence
tatggaagccgccggtggtc

SEQ ID NO: 80375 - DNA, 20 bp, Artificial
  CRISPR gRNA sequence
tggaagccgccggtggtcat

SEQ ID NO: 80376 - DNA, 20 bp, Artificial
  CRISPR gRNA sequence
ccagtgagtttggccaggcc

SEQ ID NO: 80377 - DNA, 20 bp, Artificial
  CRISPR gRNA sequence
ggccaggcctgcaacctccc

SEQ ID NO: 80378 - DNA, 20 bp, Artificial
  CRISPR gRNA sequence
gccaggcctgcaacctccct

SEQ ID NO: 80379 - DNA, 20 bp, Artificial
  CRISPR gRNA sequence
caacctccctcctctgttag

SEQ ID NO: 80380 - DNA, 20 bp, Artificial
  CRISPR gRNA sequence
cctcctctgttagggtttta

SEQ ID NO: 80381 - DNA, 20 bp, Artificial
  CRISPR gRNA sequence
ctctgttagggttttatcat

SEQ ID NO: 80382 - DNA, 20 bp, Artificial
  CRISPR gRNA sequence
tgttagggttttatcatccc

SEQ ID NO: 80383 - DNA, 20 bp, Artificial
  CRISPR gRNA sequence
ttagggttttatcatcccga

SEQ ID NO: 80384 - DNA, 20 bp, Artificial
  CRISPR gRNA sequence
gggttttatcatcccgattt

SEQ ID NO: 80385 - DNA, 20 bp, Artificial
  CRISPR gRNA sequence
tatcatcccgatttcttatc

SEQ ID NO: 80386 - DNA, 20 bp, Artificial
  CRISPR gRNA sequence
atcatcccgatttcttatca

SEQ ID NO: 80387 - DNA, 20 bp, Artificial
  CRISPR gRNA sequence
tcatcccgatttcttatcac

SEQ ID NO: 80388 - DNA, 20 bp, Artificial
  CRISPR gRNA sequence
cttatcacccacatttcctc

SEQ ID NO: 80389 - DNA, 20 bp, Artificial
  CRISPR gRNA sequence
ttatcacccacatttcctca

SEQ ID NO: 80390 - DNA, 20 bp, Artificial
  CRISPR gRNA sequence
atcacccacatttcctcact

SEQ ID NO: 80391 - DNA, 20 bp, Artificial
  CRISPR gRNA sequence
tcacccacatttcctcactt

SEQ ID NO: 80392 - DNA, 20 bp, Artificial
  CRISPR gRNA sequence
cctcacttcccttaatagtt

SEQ ID NO: 80393 - DNA, 20 bp, Artificial
  CRISPR gRNA sequence
ctcacttcccttaatagttt

SEQ ID NO: 80394 - DNA, 20 bp, Artificial
  CRISPR gRNA sequence
acttcccttaatagtttctg

SEQ ID NO: 80395 - DNA, 20 bp, Artificial
  CRISPR gRNA sequence
cccttaatagtttctggagt

SEQ ID NO: 80396 - DNA, 20 bp, Artificial
  CRISPR gRNA sequence
ccttaatagtttctggagtc

SEQ ID NO: 80397 - DNA, 20 bp, Artificial
  CRISPR gRNA sequence
aatagtttctggagtcttgt

SEQ ID NO: 80398 - DNA, 20 bp, Artificial
  CRISPR gRNA sequence
atagtttctggagtcttgtc

SEQ ID NO: 80399 - DNA, 20 bp, Artificial
  CRISPR gRNA sequence
ctggagtcttgtctcattgt

SEQ ID NO: 80400 - DNA, 20 bp, Artificial
  CRISPR gRNA sequence
tggagtcttgtctcattgta

SEQ ID NO: 80401 - DNA, 20 bp, Artificial
  CRISPR gRNA sequence
gagtcttgtctcattgtatg

SEQ ID NO: 80402 - DNA, 20 bp, Artificial
  CRISPR gRNA sequence
gtctcattgtatggattttc

SEQ ID NO: 80403 - DNA, 20 bp, Artificial
  CRISPR gRNA sequence
tctcattgtatggattttca

SEQ ID NO: 80404 - DNA, 20 bp, Artificial
  CRISPR gRNA sequence
attgtatggattttcaacaa

SEQ ID NO: 80405 - DNA, 20 bp, Artificial
  CRISPR gRNA sequence
tatggattttcaacaatcac

SEQ ID NO: 80406 - DNA, 20 bp, Artificial
  CRISPR gRNA sequence
tcaacaatcactttaatgcc

SEQ ID NO: 80407 - DNA, 20 bp, Artificial
  CRISPR gRNA sequence
caacaatcactttaatgcct

SEQ ID NO: 80408 - DNA, 20 bp, Artificial
  CRISPR gRNA sequence
aacaatcactttaatgcctt

SEQ ID NO: 80409 - DNA, 20 bp, Artificial
  CRISPR gRNA sequence
taatgcctttctggaagagt

SEQ ID NO: 80410 - DNA, 20 bp, Artificial
  CRISPR gRNA sequence
aatgcctttctggaagagtt

SEQ ID NO: 80411 - DNA, 20 bp, Artificial
  CRISPR gRNA sequence
atgcctttctggaagagttt

SEQ ID NO: 80412 - DNA, 20 bp, Artificial
  CRISPR gRNA sequence
tctggaagagtttgagaaag

SEQ ID NO: 80413 - DNA, 20 bp, Artificial
  CRISPR gRNA sequence
ctggaagagtttgagaaagg

SEQ ID NO: 80414 - DNA, 20 bp, Artificial
  CRISPR gRNA sequence
tggaagagtttgagaaagga

SEQ ID NO: 80415 - DNA, 20 bp, Artificial
  CRISPR gRNA sequence
gaagagtttgagaaaggaag

SEQ ID NO: 80416 - DNA, 20 bp, Artificial
  CRISPR gRNA sequence
gagaaaggaagaaggaaaac

SEQ ID NO: 80417 - DNA, 20 bp, Artificial
  CRISPR gRNA sequence
agaaaggaagaaggaaaaca

SEQ ID NO: 80418 - DNA, 20 bp, Artificial
  CRISPR gRNA sequence
aggaaagaattttaagaagt

SEQ ID NO: 80419 - DNA, 20 bp, Artificial
  CRISPR gRNA sequence
taagaagtcaagcagggtcc

SEQ ID NO: 80420 - DNA, 20 bp, Artificial
  CRISPR gRNA sequence
aagaagtcaagcagggtcct

SEQ ID NO: 80421 - DNA, 20 bp, Artificial
  CRISPR gRNA sequence
agaagtcaagcagggtcctc

SEQ ID NO: 80422 - DNA, 20 bp, Artificial
  CRISPR gRNA sequence
ctacagctaagctaagtgac

SEQ ID NO: 80423 - DNA, 20 bp, Artificial
  CRISPR gRNA sequence
cagctaagctaagtgaccaa

SEQ ID NO: 80424 - DNA, 20 bp, Artificial
  CRISPR gRNA sequence
agctaagtgaccaataggaa

SEQ ID NO: 80425 - DNA, 20 bp, Artificial
  CRISPR gRNA sequence
agtgaccaataggaacagcc

SEQ ID NO: 80426 - DNA, 20 bp, Artificial
  CRISPR gRNA sequence
gagcagggccctgggctcct

SEQ ID NO: 80427 - DNA, 20 bp, Artificial
  CRISPR gRNA sequence
ggctccttgtccagctagga

SEQ ID NO: 80428 - DNA, 20 bp, Artificial
  CRISPR gRNA sequence
cttgtccagctaggaggctg

SEQ ID NO: 80429 - DNA, 20 bp, Artificial
  CRISPR gRNA sequence
gtccagctaggaggctggaa

SEQ ID NO: 80430 - DNA, 20 bp, Artificial
  CRISPR gRNA sequence
tccagctaggaggctggaac

SEQ ID NO: 80431 - DNA, 20 bp, Artificial
  CRISPR gRNA sequence
ggaggctggaaccagttcga

SEQ ID NO: 80432 - DNA, 20 bp, Artificial
  CRISPR gRNA sequence
gaaccagttcgagagcactt

SEQ ID NO: 80433 - DNA, 20 bp, Artificial
  CRISPR gRNA sequence
gagagcacttcaatatctta

SEQ ID NO: 80434 - DNA, 20 bp, Artificial
  CRISPR gRNA sequence
caatatcttaacaaatccta

SEQ ID NO: 80435 - DNA, 20 bp, Artificial
  CRISPR gRNA sequence
aatatcttaacaaatcctat

SEQ ID NO: 80436 - DNA, 20 bp, Artificial
  CRISPR gRNA sequence
aacaaatcctatattaaaaa

SEQ ID NO: 80437 - DNA, 20 bp, Artificial
  CRISPR gRNA sequence
acaaatcctatattaaaaag

SEQ ID NO: 80438 - DNA, 20 bp, Artificial
  CRISPR gRNA sequence
tattaaaaagggactcactg

SEQ ID NO: 80439 - DNA, 20 bp, Artificial
  CRISPR gRNA sequence
aaaagggactcactggccaa

SEQ ID NO: 80440 - DNA, 20 bp, Artificial
  CRISPR gRNA sequence
actggccaaatatcaatcag

SEQ ID NO: 80441 - DNA, 20 bp, Artificial
  CRISPR gRNA sequence
gccaaatatcaatcagatct

SEQ ID NO: 80442 - DNA, 20 bp, Artificial
  CRISPR gRNA sequence
gttacagccatgagataatg

SEQ ID NO: 80443 - DNA, 20 bp, Artificial
  CRISPR gRNA sequence
cagccatgagataatgatgc

SEQ ID NO: 80444 - DNA, 20 bp, Artificial
  CRISPR gRNA sequence
agtgatgcgggcctattgga

SEQ ID NO: 80445 - DNA, 20 bp, Artificial
  CRISPR gRNA sequence
ttggaccagggacttggaca

SEQ ID NO: 80446 - DNA, 20 bp, Artificial
  CRISPR gRNA sequence
gaccagggacttggacagtt

SEQ ID NO: 80447 - DNA, 20 bp, Artificial
  CRISPR gRNA sequence
ggacagttttgattcactgg

SEQ ID NO: 80448 - DNA, 20 bp, Artificial
  CRISPR gRNA sequence
gacagttttgattcactggg

SEQ ID NO: 80449 - DNA, 20 bp, Artificial
  CRISPR gRNA sequence
tgattcactggggagctgag

SEQ ID NO: 80450 - DNA, 20 bp, Artificial
  CRISPR gRNA sequence
gattcactggggagctgagg

SEQ ID NO: 80451 - DNA, 20 bp, Artificial
  CRISPR gRNA sequence
attcactggggagctgaggt

SEQ ID NO: 80452 - DNA, 20 bp, Artificial
  CRISPR gRNA sequence
actggggagctgaggttata

SEQ ID NO: 80453 - DNA, 20 bp, Artificial
  CRISPR gRNA sequence
gggagctgaggttatagggt

SEQ ID NO: 80454 - DNA, 20 bp, Artificial
  CRISPR gRNA sequence
aggttatagggtgggttttc

SEQ ID NO: 80455 - DNA, 20 bp, Artificial
  CRISPR gRNA sequence
tagggtgggttttctgttgg

SEQ ID NO: 80456 - DNA, 20 bp, Artificial
  CRISPR gRNA sequence
tctgttggcattactgccat

SEQ ID NO: 80457 - DNA, 20 bp, Artificial
  CRISPR gRNA sequence
ctgttggcattactgccatg

SEQ ID NO: 80458 - DNA, 20 bp, Artificial
  CRISPR gRNA sequence
tgttggcattactgccatgc

SEQ ID NO: 80459 - DNA, 20 bp, Artificial
  CRISPR gRNA sequence
ttggcattactgccatgcac

SEQ ID NO: 80460 - DNA, 20 bp, Artificial
  CRISPR gRNA sequence
gcattactgccatgcacagc

SEQ ID NO: 80461 - DNA, 20 bp, Artificial
  CRISPR gRNA sequence
ctgccatgcacagcgataag

SEQ ID NO: 80462 - DNA, 20 bp, Artificial
  CRISPR gRNA sequence
ccatgcacagcgataagtaa

SEQ ID NO: 80463 - DNA, 20 bp, Artificial
  CRISPR gRNA sequence
ctgtagaaatcaaggtgctg

SEQ ID NO: 80464 - DNA, 20 bp, Artificial
  CRISPR gRNA sequence
tgtagaaatcaaggtgctga

SEQ ID NO: 80465 - DNA, 20 bp, Artificial
  CRISPR gRNA sequence
tagaaatcaaggtgctgaga

SEQ ID NO: 80466 - DNA, 20 bp, Artificial
  CRISPR gRNA sequence
agatgaaagtgtgacccacg

SEQ ID NO: 80467 - DNA, 20 bp, Artificial
  CRISPR gRNA sequence
tttaatcactggcccttccg

SEQ ID NO: 80468 - DNA, 20 bp, Artificial
  CRISPR gRNA sequence
aatcactggcccttccgagc

SEQ ID NO: 80469 - DNA, 20 bp, Artificial
  CRISPR gRNA sequence
atcactggcccttccgagct

SEQ ID NO: 80470 - DNA, 20 bp, Artificial
  CRISPR gRNA sequence
gcccttccgagctccttcag

SEQ ID NO: 80471 - DNA, 20 bp, Artificial
  CRISPR gRNA sequence
ccgagctccttcagaaaatc

SEQ ID NO: 80472 - DNA, 20 bp, Artificial
  CRISPR gRNA sequence
cgagctccttcagaaaatca

SEQ ID NO: 80473 - DNA, 20 bp, Artificial
  CRISPR gRNA sequence
cttcagaaaatcagccaaag

SEQ ID NO: 80474 - DNA, 20 bp, Artificial
  CRISPR gRNA sequence
cagaaaatcagccaaaggct

SEQ ID NO: 80475 - DNA, 20 bp, Artificial
  CRISPR gRNA sequence
agaaaatcagccaaaggctc

SEQ ID NO: 80476 - DNA, 20 bp, Artificial
  CRISPR gRNA sequence
ccccgctgaagacagcagct

SEQ ID NO: 80477 - DNA, 20 bp, Artificial
  CRISPR gRNA sequence
aagacagcagctgtgggtga

SEQ ID NO: 80478 - DNA, 20 bp, Artificial
  CRISPR gRNA sequence
tgggtgagtgtcaagtccaa

SEQ ID NO: 80479 - DNA, 20 bp, Artificial
  CRISPR gRNA sequence
gggcttccccatgaagcctg

SEQ ID NO: 80480 - DNA, 20 bp, Artificial
  CRISPR gRNA sequence
ccccatgaagcctgacactt

SEQ ID NO: 80481 - DNA, 20 bp, Artificial
  CRISPR gRNA sequence
cccatgaagcctgacacttt

SEQ ID NO: 80482 - DNA, 20 bp, Artificial
  CRISPR gRNA sequence
acactttggggctgggagat

SEQ ID NO: 80483 - DNA, 20 bp, Artificial
  CRISPR gRNA sequence
tggggctgggagatgaggcc

SEQ ID NO: 80484 - DNA, 20 bp, Artificial
  CRISPR gRNA sequence
ggggctgggagatgaggccc

SEQ ID NO: 80485 - DNA, 20 bp, Artificial
  CRISPR gRNA sequence
gggctgggagatgaggccct

SEQ ID NO: 80486 - DNA, 20 bp, Artificial
  CRISPR gRNA sequence
ggagatgaggccctgcgggt

SEQ ID NO: 80487 - DNA, 20 bp, Artificial
  CRISPR gRNA sequence
cgggttgcgggcaggaaagt

SEQ ID NO: 80488 - DNA, 20 bp, Artificial
  CRISPR gRNA sequence
cgggcaggaaagtgagaaca

SEQ ID NO: 80489 - DNA, 20 bp, Artificial
  CRISPR gRNA sequence
cctgaggggttccaggttag

SEQ ID NO: 80490 - DNA, 20 bp, Artificial
  CRISPR gRNA sequence
ctgaggggttccaggttaga

SEQ ID NO: 80491 - DNA, 20 bp, Artificial
  CRISPR gRNA sequence
aggggttccaggttagaccc

SEQ ID NO: 80492 - DNA, 20 bp, Artificial
  CRISPR gRNA sequence
caggttagaccctttagaat

SEQ ID NO: 80493 - DNA, 20 bp, Artificial
  CRISPR gRNA sequence
gaccctttagaattggtaac

SEQ ID NO: 80494 - DNA, 20 bp, Artificial
  CRISPR gRNA sequence
tagaattggtaacgggacaa

SEQ ID NO: 80495 - DNA, 20 bp, Artificial
  CRISPR gRNA sequence
agaattggtaacgggacaag

SEQ ID NO: 80496 - DNA, 20 bp, Artificial
  CRISPR gRNA sequence
gaattggtaacgggacaagc

SEQ ID NO: 80497 - DNA, 20 bp, Artificial
  CRISPR gRNA sequence
gtaacgggacaagctaaagc

SEQ ID NO: 80498 - DNA, 20 bp, Artificial
  CRISPR gRNA sequence
aagccttgaaagtcactgca

SEQ ID NO: 80499 - DNA, 20 bp, Artificial
  CRISPR gRNA sequence
gaaagtcactgcaggaggag

SEQ ID NO: 80500 - DNA, 20 bp, Artificial
  CRISPR gRNA sequence
aaagtcactgcaggaggagg

SEQ ID NO: 80501 - DNA, 20 bp, Artificial
  CRISPR gRNA sequence
caggaggaggtggggctggg

SEQ ID NO: 80502 - DNA, 20 bp, Artificial
  CRISPR gRNA sequence
ggagacacagttaggggctt

SEQ ID NO: 80503 - DNA, 20 bp, Artificial
  CRISPR gRNA sequence
ggggcttgacacacttgcaa

SEQ ID NO: 80504 - DNA, 20 bp, Artificial
  CRISPR gRNA sequence
gacacacttgcaaatgggtc

SEQ ID NO: 80505 - DNA, 20 bp, Artificial
  CRISPR gRNA sequence
acacacttgcaaatgggtca

SEQ ID NO: 80506 - DNA, 20 bp, Artificial
  CRISPR gRNA sequence
gcaaatgggtcagggacaga

SEQ ID NO: 80507 - DNA, 20 bp, Artificial
  CRISPR gRNA sequence
caaatgggtcagggacagac

SEQ ID NO: 80508 - DNA, 20 bp, Artificial
  CRISPR gRNA sequence
tgagaaatggctgtgaccag

SEQ ID NO: 80509 - DNA, 20 bp, Artificial
  CRISPR gRNA sequence
tgaccagccaccacagcctc

SEQ ID NO: 80510 - DNA, 20 bp, Artificial
  CRISPR gRNA sequence
cacagcctcctccagcttgg

SEQ ID NO: 80511 - DNA, 20 bp, Artificial
  CRISPR gRNA sequence
ctccagcttggaagtgggga

SEQ ID NO: 80512 - DNA, 20 bp, Artificial
  CRISPR gRNA sequence
cagcttggaagtggggactt

SEQ ID NO: 80513 - DNA, 20 bp, Artificial
  CRISPR gRNA sequence
ggaagtggggacttcacagt

SEQ ID NO: 80514 - DNA, 20 bp, Artificial
  CRISPR gRNA sequence
gaagtggggacttcacagtg

SEQ ID NO: 80515 - DNA, 20 bp, Artificial
  CRISPR gRNA sequence
cacagtgctcaccaccccct

SEQ ID NO: 80516 - DNA, 20 bp, Artificial
  CRISPR gRNA sequence
acagtgctcaccaccccctt

SEQ ID NO: 80517 - DNA, 20 bp, Artificial
  CRISPR gRNA sequence
accacccccttcccaccccc

SEQ ID NO: 80518 - DNA, 20 bp, Artificial
  CRISPR gRNA sequence
cccaccccccaactccagtc

SEQ ID NO: 80519 - DNA, 20 bp, Artificial
  CRISPR gRNA sequence
ccaccccccaactccagtcc

SEQ ID NO: 80520 - DNA, 20 bp, Artificial
  CRISPR gRNA sequence
cagtcctcaccatggtggag

SEQ ID NO: 80521 - DNA, 20 bp, Artificial
  CRISPR gRNA sequence
accatggtggagctgagatt

SEQ ID NO: 80522 - DNA, 20 bp, Artificial
  CRISPR gRNA sequence
agattcaggttggcttttcc

SEQ ID NO: 80523 - DNA, 20 bp, Artificial
  CRISPR gRNA sequence
aggttggcttttcccctcag

SEQ ID NO: 80524 - DNA, 20 bp, Artificial
  CRISPR gRNA sequence
gcttttcccctcagctccca

SEQ ID NO: 80525 - DNA, 20 bp, Artificial
  CRISPR gRNA sequence
ttcccctcagctcccagctg

SEQ ID NO: 80526 - DNA, 20 bp, Artificial
  CRISPR gRNA sequence
tcccctcagctcccagctgg

SEQ ID NO: 80527 - DNA, 20 bp, Artificial
  CRISPR gRNA sequence
cccctcagctcccagctggc

SEQ ID NO: 80528 - DNA, 20 bp, Artificial
  CRISPR gRNA sequence
ccctcagctcccagctggct

SEQ ID NO: 80529 - DNA, 20 bp, Artificial
  CRISPR gRNA sequence
agctcccagctggctggtga

SEQ ID NO: 80530 - DNA, 20 bp, Artificial
  CRISPR gRNA sequence
ccagctggctggtgaaccct

SEQ ID NO: 80531 - DNA, 20 bp, Artificial
  CRISPR gRNA sequence
gctggtgaaccctgcaagag

SEQ ID NO: 80532 - DNA, 20 bp, Artificial
  CRISPR gRNA sequence
gtgaaccctgcaagagaggg

SEQ ID NO: 80533 - DNA, 20 bp, Artificial
  CRISPR gRNA sequence
caagagaggggagagtataa

SEQ ID NO: 80534 - DNA, 20 bp, Artificial
  CRISPR gRNA sequence
tcgagggatgctggggacca

SEQ ID NO: 80535 - DNA, 20 bp, Artificial
  CRISPR gRNA sequence
gggaccagctctggcctggc

SEQ ID NO: 80536 - DNA, 20 bp, Artificial
  CRISPR gRNA sequence
tggcctggcgcctggctcag

SEQ ID NO: 80537 - DNA, 20 bp, Artificial
  CRISPR gRNA sequence
gcctggcgcctggctcaggg

SEQ ID NO: 80538 - DNA, 20 bp, Artificial
  CRISPR gRNA sequence
gcgcctggctcagggctcat

SEQ ID NO: 80539 - DNA, 20 bp, Artificial
  CRISPR gRNA sequence
gctcagggctcatctcacag

SEQ ID NO: 80540 - DNA, 20 bp, Artificial
  CRISPR gRNA sequence
agggctcatctcacagggag

SEQ ID NO: 80541 - DNA, 20 bp, Artificial
  CRISPR gRNA sequence
atctcacagggagataccca

SEQ ID NO: 80542 - DNA, 20 bp, Artificial
  CRISPR gRNA sequence
acagggagatacccagcaag

SEQ ID NO: 80543 - DNA, 20 bp, Artificial
  CRISPR gRNA sequence
aatggaacactcagttatct

SEQ ID NO: 80544 - DNA, 20 bp, Artificial
  CRISPR gRNA sequence
agttatctgttgtggagaaa

SEQ ID NO: 80545 - DNA, 20 bp, Artificial
  CRISPR gRNA sequence
tctgttgtggagaaaatgtg

SEQ ID NO: 80546 - DNA, 20 bp, Artificial
  CRISPR gRNA sequence
ttgtggagaaaatgtggtgg

SEQ ID NO: 80547 - DNA, 20 bp, Artificial
  CRISPR gRNA sequence
tggagaaaatgtggtggtga

SEQ ID NO: 80548 - DNA, 20 bp, Artificial
  CRISPR gRNA sequence
tgaaggcagtgctgggcaga

SEQ ID NO: 80549 - DNA, 20 bp, Artificial
  CRISPR gRNA sequence
gaaggcagtgctgggcagaa

SEQ ID NO: 80550 - DNA, 20 bp, Artificial
  CRISPR gRNA sequence
aaggcagtgctgggcagaaa

SEQ ID NO: 80551 - DNA, 20 bp, Artificial
  CRISPR gRNA sequence
ggcagaaatgtgtgtatatg

SEQ ID NO: 80552 - DNA, 20 bp, Artificial
  CRISPR gRNA sequence
atgtatgtgtgtgcacaggc

SEQ ID NO: 80553 - DNA, 20 bp, Artificial
  CRISPR gRNA sequence
tgtatgtgtgtgcacaggca

SEQ ID NO: 80554 - DNA, 20 bp, Artificial
  CRISPR gRNA sequence
tgcatgtgggcacacttgca

SEQ ID NO: 80555 - DNA, 20 bp, Artificial
  CRISPR gRNA sequence
gcatgcatgtgtacatgggt

SEQ ID NO: 80556 - DNA, 20 bp, Artificial
  CRISPR gRNA sequence
catgcatgtgtacatgggtt

SEQ ID NO: 80557 - DNA, 20 bp, Artificial
  CRISPR gRNA sequence
acgcacatacccacatgtat

SEQ ID NO: 80558 - DNA, 20 bp, Artificial
  CRISPR gRNA sequence
cgcacatacccacatgtata

SEQ ID NO: 80559 - DNA, 20 bp, Artificial
  CRISPR gRNA sequence
tgtgtatctgcatatgtctg

SEQ ID NO: 80560 - DNA, 20 bp, Artificial
  CRISPR gRNA sequence
catatgtctgcacatatgtg

SEQ ID NO: 80561 - DNA, 20 bp, Artificial
  CRISPR gRNA sequence
cacatatgtgcatgcgccgc

SEQ ID NO: 80562 - DNA, 20 bp, Artificial
  CRISPR gRNA sequence
ccacactctgccttgaagta

SEQ ID NO: 80563 - DNA, 20 bp, Artificial
  CRISPR gRNA sequence
tgccttgaagtagggttctt

SEQ ID NO: 80564 - DNA, 20 bp, Artificial
  CRISPR gRNA sequence
ccttgaagtagggttcttaa

SEQ ID NO: 80565 - DNA, 20 bp, Artificial
  CRISPR gRNA sequence
gaagtagggttcttaagtga

SEQ ID NO: 80566 - DNA, 20 bp, Artificial
  CRISPR gRNA sequence
aagtagggttcttaagtgag

SEQ ID NO: 80567 - DNA, 20 bp, Artificial
  CRISPR gRNA sequence
ttaagtgagttcccattttc

SEQ ID NO: 80568 - DNA, 20 bp, Artificial
  CRISPR gRNA sequence
aagtgagttcccattttctc

SEQ ID NO: 80569 - DNA, 20 bp, Artificial
  CRISPR gRNA sequence
agtgagttcccattttctct

SEQ ID NO: 80570 - DNA, 20 bp, Artificial
  CRISPR gRNA sequence
ccattttctctccaaaaacg

SEQ ID NO: 80571 - DNA, 20 bp, Artificial
  CRISPR gRNA sequence
tctctccaaaaacgctgttg

SEQ ID NO: 80572 - DNA, 20 bp, Artificial
  CRISPR gRNA sequence
ctctccaaaaacgctgttgc

SEQ ID NO: 80573 - DNA, 20 bp, Artificial
  CRISPR gRNA sequence
tctccaaaaacgctgttgcc

SEQ ID NO: 80574 - DNA, 20 bp, Artificial
  CRISPR gRNA sequence
tccaaaaacgctgttgcccc

SEQ ID NO: 80575 - DNA, 20 bp, Artificial
  CRISPR gRNA sequence
caaaaacgctgttgcccctc

SEQ ID NO: 80576 - DNA, 20 bp, Artificial
  CRISPR gRNA sequence
ttgcccctcaatgtcctgtg

SEQ ID NO: 80577 - DNA, 20 bp, Artificial
  CRISPR gRNA sequence
cccctcaatgtcctgtgttt

SEQ ID NO: 80578 - DNA, 20 bp, Artificial
  CRISPR gRNA sequence
aatgtcctgtgtttcccctc

SEQ ID NO: 80579 - DNA, 20 bp, Artificial
  CRISPR gRNA sequence
tgtttcccctcagtgctgtg

SEQ ID NO: 80580 - DNA, 20 bp, Artificial
  CRISPR gRNA sequence
cccctcagtgctgtgcaaac

SEQ ID NO: 80581 - DNA, 20 bp, Artificial
  CRISPR gRNA sequence
ccctcagtgctgtgcaaaca

SEQ ID NO: 80582 - DNA, 20 bp, Artificial
  CRISPR gRNA sequence
agtgctgtgcaaacagaagg

SEQ ID NO: 80583 - DNA, 20 bp, Artificial
  CRISPR gRNA sequence
tgcaaacagaaggtgcccaa

SEQ ID NO: 80584 - DNA, 20 bp, Artificial
  CRISPR gRNA sequence
cccgtcactgtttctgacca

SEQ ID NO: 80585 - DNA, 20 bp, Artificial
  CRISPR gRNA sequence
tttctgaccatgttgcaaaa

SEQ ID NO: 80586 - DNA, 20 bp, Artificial
  CRISPR gRNA sequence
ctgaccatgttgcaaaacaa

SEQ ID NO: 80587 - DNA, 20 bp, Artificial
  CRISPR gRNA sequence
tgaccatgttgcaaaacaaa

SEQ ID NO: 80588 - DNA, 20 bp, Artificial
  CRISPR gRNA sequence
accatgttgcaaaacaaaca

SEQ ID NO: 80589 - DNA, 20 bp, Artificial
  CRISPR gRNA sequence
caaaacaaacaaacaaacaa

SEQ ID NO: 80590 - DNA, 20 bp, Artificial
  CRISPR gRNA sequence
tagccaggtgtgatggctca

SEQ ID NO: 80591 - DNA, 20 bp, Artificial
  CRISPR gRNA sequence
gccaggtgtgatggctcaca

SEQ ID NO: 80592 - DNA, 20 bp, Artificial
  CRISPR gRNA sequence
acatctataatcccagcact

SEQ ID NO: 80593 - DNA, 20 bp, Artificial
  CRISPR gRNA sequence
taatcccagcactttgggag

SEQ ID NO: 80594 - DNA, 20 bp, Artificial
  CRISPR gRNA sequence
tgggaggccaagggaggagg

SEQ ID NO: 80595 - DNA, 20 bp, Artificial
  CRISPR gRNA sequence
gggaggccaagggaggagga

SEQ ID NO: 80596 - DNA, 20 bp, Artificial
  CRISPR gRNA sequence
ggaggccaagggaggaggat

SEQ ID NO: 80597 - DNA, 20 bp, Artificial
  CRISPR gRNA sequence
aaggccaggagttcaagacc

SEQ ID NO: 80598 - DNA, 20 bp, Artificial
  CRISPR gRNA sequence
aggccaggagttcaagacca

SEQ ID NO: 80599 - DNA, 20 bp, Artificial
  CRISPR gRNA sequence
aagaccagcctgggcaacac

SEQ ID NO: 80600 - DNA, 20 bp, Artificial
  CRISPR gRNA sequence
ggcaacacagtgatgtcctg

SEQ ID NO: 80601 - DNA, 20 bp, Artificial
  CRISPR gRNA sequence
tctctacaaaagaatgaaaa

SEQ ID NO: 80602 - DNA, 20 bp, Artificial
  CRISPR gRNA sequence
tacaaaagaatgaaaaatta

SEQ ID NO: 80603 - DNA, 20 bp, Artificial
  CRISPR gRNA sequence
caaaagaatgaaaaattagc

SEQ ID NO: 80604 - DNA, 20 bp, Artificial
  CRISPR gRNA sequence
gcctaatgtggtggcatgca

SEQ ID NO: 80605 - DNA, 20 bp, Artificial
  CRISPR gRNA sequence
atgtggtggcatgcacctat

SEQ ID NO: 80606 - DNA, 20 bp, Artificial
  CRISPR gRNA sequence
tagttctactgtagtctcag

SEQ ID NO: 80607 - DNA, 20 bp, Artificial
  CRISPR gRNA sequence
tactgtagtctcagctactt

SEQ ID NO: 80608 - DNA, 20 bp, Artificial
  CRISPR gRNA sequence
ctgtagtctcagctacttgg

SEQ ID NO: 80609 - DNA, 20 bp, Artificial
  CRISPR gRNA sequence
tagtctcagctacttgggag

SEQ ID NO: 80610 - DNA, 20 bp, Artificial
  CRISPR gRNA sequence
agctacttgggaggctgaag

SEQ ID NO: 80611 - DNA, 20 bp, Artificial
  CRISPR gRNA sequence
cttgggaggctgaagtggga

SEQ ID NO: 80612 - DNA, 20 bp, Artificial
  CRISPR gRNA sequence
gggaggctgaagtgggaagg

SEQ ID NO: 80613 - DNA, 20 bp, Artificial
  CRISPR gRNA sequence
ggaggctgaagtgggaagga

SEQ ID NO: 80614 - DNA, 20 bp, Artificial
  CRISPR gRNA sequence
aagtgggaaggatcacctga

SEQ ID NO: 80615 - DNA, 20 bp, Artificial
  CRISPR gRNA sequence
agtcctggagttggatgctg

SEQ ID NO: 80616 - DNA, 20 bp, Artificial
  CRISPR gRNA sequence
gagttggatgctgtagtgag

SEQ ID NO: 80617 - DNA, 20 bp, Artificial
  CRISPR gRNA sequence
gatgctgtagtgagctatga

SEQ ID NO: 80618 - DNA, 20 bp, Artificial
  CRISPR gRNA sequence
tagtgagctatgattgtgcc

SEQ ID NO: 80619 - DNA, 20 bp, Artificial
  CRISPR gRNA sequence
tgattgtgccactgcactcc

SEQ ID NO: 80620 - DNA, 20 bp, Artificial
  CRISPR gRNA sequence
tgccactgcactccagccta

SEQ ID NO: 80621 - DNA, 20 bp, Artificial
  CRISPR gRNA sequence
cactccagcctaggcaacag

SEQ ID NO: 80622 - DNA, 20 bp, Artificial
  CRISPR gRNA sequence
cagcctaggcaacagagcaa

SEQ ID NO: 80623 - DNA, 20 bp, Artificial
  CRISPR gRNA sequence
ggcaacagagcaagaccttg

SEQ ID NO: 80624 - DNA, 20 bp, Artificial
  CRISPR gRNA sequence
gtctcaaaaataaaaaacaa

SEQ ID NO: 80625 - DNA, 20 bp, Artificial
  CRISPR gRNA sequence
tctcaaaaataaaaaacaaa

SEQ ID NO: 80626 - DNA, 20 bp, Artificial
  CRISPR gRNA sequence
aaaaataaaaaacaaacaaa

SEQ ID NO: 80627 - DNA, 20 bp, Artificial
  CRISPR gRNA sequence
tcgggcattatgggctatgt

SEQ ID NO: 80628 - DNA, 20 bp, Artificial
  CRISPR gRNA sequence
gggcattatgggctatgtgg

SEQ ID NO: 80629 - DNA, 20 bp, Artificial
  CRISPR gRNA sequence
tgggctatgtgggattttgt

SEQ ID NO: 80630 - DNA, 20 bp, Artificial
  CRISPR gRNA sequence
tgtgggattttgtggctgga

SEQ ID NO: 80631 - DNA, 20 bp, Artificial
  CRISPR gRNA sequence
tgtggctggaagcagtcact

SEQ ID NO: 80632 - DNA, 20 bp, Artificial
  CRISPR gRNA sequence
gtggctggaagcagtcactc

SEQ ID NO: 80633 - DNA, 20 bp, Artificial
  CRISPR gRNA sequence
tggctggaagcagtcactca

SEQ ID NO: 80634 - DNA, 20 bp, Artificial
  CRISPR gRNA sequence
gaagcagtcactcagcaatt

SEQ ID NO: 80635 - DNA, 20 bp, Artificial
  CRISPR gRNA sequence
agcaattcgagcaattcgag

SEQ ID NO: 80636 - DNA, 20 bp, Artificial
  CRISPR gRNA sequence
gagcaattcgagtgaagcca

SEQ ID NO: 80637 - DNA, 20 bp, Artificial
  CRISPR gRNA sequence
gagtgaagccaggtagaagg

SEQ ID NO: 80638 - DNA, 20 bp, Artificial
  CRISPR gRNA sequence
caggccccagcagatttggg

SEQ ID NO: 80639 - DNA, 20 bp, Artificial
  CRISPR gRNA sequence
gggcgcattaggaaatttgt

SEQ ID NO: 80640 - DNA, 20 bp, Artificial
  CRISPR gRNA sequence
ggcgcattaggaaatttgtt

SEQ ID NO: 80641 - DNA, 20 bp, Artificial
  CRISPR gRNA sequence
ggaaatttgttctgggaagt

SEQ ID NO: 80642 - DNA, 20 bp, Artificial
  CRISPR gRNA sequence
gttctgggaagtgtccagaa

SEQ ID NO: 80643 - DNA, 20 bp, Artificial
  CRISPR gRNA sequence
ttctgggaagtgtccagaaa

SEQ ID NO: 80644 - DNA, 20 bp, Artificial
  CRISPR gRNA sequence
tgggaagtgtccagaaatat

SEQ ID NO: 80645 - DNA, 20 bp, Artificial
  CRISPR gRNA sequence
ggaagtgtccagaaatatag

SEQ ID NO: 80646 - DNA, 20 bp, Artificial
  CRISPR gRNA sequence
agatcgtggctgggctacac

SEQ ID NO: 80647 - DNA, 20 bp, Artificial
  CRISPR gRNA sequence
ggctacaccctctctctgac

SEQ ID NO: 80648 - DNA, 20 bp, Artificial
  CRISPR gRNA sequence
caccctctctctgacttagg

SEQ ID NO: 80649 - DNA, 20 bp, Artificial
  CRISPR gRNA sequence
tctctgacttaggtgggtcc

SEQ ID NO: 80650 - DNA, 20 bp, Artificial
  CRISPR gRNA sequence
tctgacttaggtgggtccct

SEQ ID NO: 80651 - DNA, 20 bp, Artificial
  CRISPR gRNA sequence
tgacttaggtgggtccctgg

SEQ ID NO: 80652 - DNA, 20 bp, Artificial
  CRISPR gRNA sequence
acttaggtgggtccctgggc

SEQ ID NO: 80653 - DNA, 20 bp, Artificial
  CRISPR gRNA sequence
aggtgggtccctgggctcct

SEQ ID NO: 80654 - DNA, 20 bp, Artificial
  CRISPR gRNA sequence
ggtgggtccctgggctcctc

SEQ ID NO: 80655 - DNA, 20 bp, Artificial
  CRISPR gRNA sequence
ggctcctcccggctccccat

SEQ ID NO: 80656 - DNA, 20 bp, Artificial
  CRISPR gRNA sequence
ctcccggctccccatgacgc

SEQ ID NO: 80657 - DNA, 20 bp, Artificial
  CRISPR gRNA sequence
ccggctccccatgacgcagg

SEQ ID NO: 80658 - DNA, 20 bp, Artificial
  CRISPR gRNA sequence
cccatgacgcaggtactggc

SEQ ID NO: 80659 - DNA, 20 bp, Artificial
  CRISPR gRNA sequence
gcccggctgctttgcgtctc

SEQ ID NO: 80660 - DNA, 20 bp, Artificial
  CRISPR gRNA sequence
ctttgcgtctctcacacctg

SEQ ID NO: 80661 - DNA, 20 bp, Artificial
  CRISPR gRNA sequence
tgcgtctctcacacctgccc

SEQ ID NO: 80662 - DNA, 20 bp, Artificial
  CRISPR gRNA sequence
gcgtctctcacacctgccct

SEQ ID NO: 80663 - DNA, 20 bp, Artificial
  CRISPR gRNA sequence
cgtctctcacacctgccctt

SEQ ID NO: 80664 - DNA, 20 bp, Artificial
  CRISPR gRNA sequence
tcacacctgcccttaccatc

SEQ ID NO: 80665 - DNA, 20 bp, Artificial
  CRISPR gRNA sequence
acacctgcccttaccatcat

SEQ ID NO: 80666 - DNA, 20 bp, Artificial
  CRISPR gRNA sequence
cccttaccatcatcatagcc

SEQ ID NO: 80667 - DNA, 20 bp, Artificial
  CRISPR gRNA sequence
accatcatcatagccaaaag

SEQ ID NO: 80668 - DNA, 20 bp, Artificial
  CRISPR gRNA sequence
ccatcatcatagccaaaagt

SEQ ID NO: 80669 - DNA, 20 bp, Artificial
  CRISPR gRNA sequence
agcagcagcacctccaggtc

SEQ ID NO: 80670 - DNA, 20 bp, Artificial
  CRISPR gRNA sequence
caggtccagaggcacctcca

SEQ ID NO: 80671 - DNA, 20 bp, Artificial
  CRISPR gRNA sequence
cagctgcatgcacacacaat

SEQ ID NO: 80672 - DNA, 20 bp, Artificial
  CRISPR gRNA sequence
catgcacacacaatgaatga

SEQ ID NO: 80673 - DNA, 20 bp, Artificial
  CRISPR gRNA sequence
ccaggtgtccgaaccctgga

SEQ ID NO: 80674 - DNA, 20 bp, Artificial
  CRISPR gRNA sequence
gacatgcagcttgttgagtt

SEQ ID NO: 80675 - DNA, 20 bp, Artificial
  CRISPR gRNA sequence
gttgagttgcaggatgactc

SEQ ID NO: 80676 - DNA, 20 bp, Artificial
  CRISPR gRNA sequence
ttgagttgcaggatgactct

SEQ ID NO: 80677 - DNA, 20 bp, Artificial
  CRISPR gRNA sequence
agttgcaggatgactctctg

SEQ ID NO: 80678 - DNA, 20 bp, Artificial
  CRISPR gRNA sequence
caggatgactctctgttcag

SEQ ID NO: 80679 - DNA, 20 bp, Artificial
  CRISPR gRNA sequence
tctgttcagggtccaaggtc

SEQ ID NO: 80680 - DNA, 20 bp, Artificial
  CRISPR gRNA sequence
tgttcagggtccaaggtctc

SEQ ID NO: 80681 - DNA, 20 bp, Artificial
  CRISPR gRNA sequence
ttcagggtccaaggtctcgt

SEQ ID NO: 80682 - DNA, 20 bp, Artificial
  CRISPR gRNA sequence
agggtccaaggtctcgttcc

SEQ ID NO: 80683 - DNA, 20 bp, Artificial
  CRISPR gRNA sequence
gttcctggaatccaggtccg

SEQ ID NO: 80684 - DNA, 20 bp, Artificial
  CRISPR gRNA sequence
ctggaatccaggtccgtgtt

SEQ ID NO: 80685 - DNA, 20 bp, Artificial
  CRISPR gRNA sequence
gaatccaggtccgtgttggg

SEQ ID NO: 80686 - DNA, 20 bp, Artificial
  CRISPR gRNA sequence
gggaggaagaacttcatctt

SEQ ID NO: 80687 - DNA, 20 bp, Artificial
  CRISPR gRNA sequence
catcttggcgttcagccatt

SEQ ID NO: 80688 - DNA, 20 bp, Artificial
  CRISPR gRNA sequence
atcttggcgttcagccattc

SEQ ID NO: 80689 - DNA, 20 bp, Artificial
  CRISPR gRNA sequence
ggcgttcagccattctgggt

SEQ ID NO: 80690 - DNA, 20 bp, Artificial
  CRISPR gRNA sequence
gcgttcagccattctgggtc

SEQ ID NO: 80691 - DNA, 20 bp, Artificial
  CRISPR gRNA sequence
agccattctgggtctttggt

SEQ ID NO: 80692 - DNA, 20 bp, Artificial
  CRISPR gRNA sequence
tgggtctttggtgagcagcc

SEQ ID NO: 80693 - DNA, 20 bp, Artificial
  CRISPR gRNA sequence
ggtctttggtgagcagcctc

SEQ ID NO: 80694 - DNA, 20 bp, Artificial
  CRISPR gRNA sequence
tggtgagcagcctcacaaga

SEQ ID NO: 80695 - DNA, 20 bp, Artificial
  CRISPR gRNA sequence
ggtgagcagcctcacaagac

SEQ ID NO: 80696 - DNA, 20 bp, Artificial
  CRISPR gRNA sequence
gtgagcagcctcacaagaca

SEQ ID NO: 80697 - DNA, 20 bp, Artificial
  CRISPR gRNA sequence
acaagacagctccacaggtt

SEQ ID NO: 80698 - DNA, 20 bp, Artificial
  CRISPR gRNA sequence
cacaggttcttgttgccgag

SEQ ID NO: 80699 - DNA, 20 bp, Artificial
  CRISPR gRNA sequence
ttgttgccgagctggaggcc

SEQ ID NO: 80700 - DNA, 20 bp, Artificial
  CRISPR gRNA sequence
gttgccgagctggaggccaa

SEQ ID NO: 80701 - DNA, 20 bp, Artificial
  CRISPR gRNA sequence
ttgccgagctggaggccaac

SEQ ID NO: 80702 - DNA, 20 bp, Artificial
  CRISPR gRNA sequence
ccgagctggaggccaacggg

SEQ ID NO: 80703 - DNA, 20 bp, Artificial
  CRISPR gRNA sequence
gaggccaacggggtccatga

SEQ ID NO: 80704 - DNA, 20 bp, Artificial
  CRISPR gRNA sequence
gagggacagggaagataggt

SEQ ID NO: 80705 - DNA, 20 bp, Artificial
  CRISPR gRNA sequence
agggggacaggtaaactggg

SEQ ID NO: 80706 - DNA, 20 bp, Artificial
  CRISPR gRNA sequence
ggggcagatgagctgaggga

SEQ ID NO: 80707 - DNA, 20 bp, Artificial
  CRISPR gRNA sequence
agggacaggggaacttgggg

SEQ ID NO: 80708 - DNA, 20 bp, Artificial
  CRISPR gRNA sequence
ggggggagttgagctggggg

SEQ ID NO: 80709 - DNA, 20 bp, Artificial
  CRISPR gRNA sequence
gggggagttgagctggggga

SEQ ID NO: 80710 - DNA, 20 bp, Artificial
  CRISPR gRNA sequence
agctgggggacaggcaaact

SEQ ID NO: 80711 - DNA, 20 bp, Artificial
  CRISPR gRNA sequence
ggggacaggcaaactggggg

SEQ ID NO: 80712 - DNA, 20 bp, Artificial
  CRISPR gRNA sequence
gggggaggtgagctggggga

SEQ ID NO: 80713 - DNA, 20 bp, Artificial
  CRISPR gRNA sequence
ggggacaggtaaactggggg

SEQ ID NO: 80714 - DNA, 20 bp, Artificial
  CRISPR gRNA sequence
ggggggaggtgagctagggg

SEQ ID NO: 80715 - DNA, 20 bp, Artificial
  CRISPR gRNA sequence
ggggacaggtaaactggggg

SEQ ID NO: 80716 - DNA, 20 bp, Artificial
  CRISPR gRNA sequence
ggggcagatgagctggggga

SEQ ID NO: 80717 - DNA, 20 bp, Artificial
  CRISPR gRNA sequence
ggggacaggagagctgaggg

SEQ ID NO: 80718 - DNA, 20 bp, Artificial
  CRISPR gRNA sequence
agggggaggtgagctggggg

SEQ ID NO: 80719 - DNA, 20 bp, Artificial
  CRISPR gRNA sequence
ggggacaggggaactggggg

SEQ ID NO: 80720 - DNA, 20 bp, Artificial
  CRISPR gRNA sequence
ggggacaggggagctggggc

SEQ ID NO: 80721 - DNA, 20 bp, Artificial
  CRISPR gRNA sequence
gggcacaggtgagctagggg

SEQ ID NO: 80722 - DNA, 20 bp, Artificial
  CRISPR gRNA sequence
ggggacaggggagctaggag

SEQ ID NO: 80723 - DNA, 20 bp, Artificial
  CRISPR gRNA sequence
ggaggaagatgaactggggg

SEQ ID NO: 80724 - DNA, 20 bp, Artificial
  CRISPR gRNA sequence
ggggacaggtgaactgaggg

SEQ ID NO: 80725 - DNA, 20 bp, Artificial
  CRISPR gRNA sequence
agggcaggcaggtgagctgg

SEQ ID NO: 80726 - DNA, 20 bp, Artificial
  CRISPR gRNA sequence
ggggacaggggaactggaag

SEQ ID NO: 80727 - DNA, 20 bp, Artificial
  CRISPR gRNA sequence
gaaggaagatgagctgggga

SEQ ID NO: 80728 - DNA, 20 bp, Artificial
  CRISPR gRNA sequence
gggaaccggtgagctggagg

SEQ ID NO: 80729 - DNA, 20 bp, Artificial
  CRISPR gRNA sequence
gaggacaagcaaattggggg

SEQ ID NO: 80730 - DNA, 20 bp, Artificial
  CRISPR gRNA sequence
ggggcaggtgatttggggga

SEQ ID NO: 80731 - DNA, 20 bp, Artificial
  CRISPR gRNA sequence
gggggacaggggagctggga

SEQ ID NO: 80732 - DNA, 20 bp, Artificial
  CRISPR gRNA sequence
ggggacaggggagctgggag

SEQ ID NO: 80733 - DNA, 20 bp, Artificial
  CRISPR gRNA sequence
ggaggaagattagatggaga

SEQ ID NO: 80734 - DNA, 20 bp, Artificial
  CRISPR gRNA sequence
gatggagaacaggtgagttg

SEQ ID NO: 80735 - DNA, 20 bp, Artificial
  CRISPR gRNA sequence
tggggcaggtgacctgaggg

SEQ ID NO: 80736 - DNA, 20 bp, Artificial
  CRISPR gRNA sequence
agggcaggtgagtggggtac

SEQ ID NO: 80737 - DNA, 20 bp, Artificial
  CRISPR gRNA sequence
gggggaaggtgatctgggga

SEQ ID NO: 80738 - DNA, 20 bp, Artificial
  CRISPR gRNA sequence
gggaaggtgagttgggggat

SEQ ID NO: 80739 - DNA, 20 bp, Artificial
  CRISPR gRNA sequence
ggggataagggagtttctag

SEQ ID NO: 80740 - DNA, 20 bp, Artificial
  CRISPR gRNA sequence
ctagggaagtcaagcagtca

SEQ ID NO: 80741 - DNA, 20 bp, Artificial
  CRISPR gRNA sequence
tagggaagtcaagcagtcaa

SEQ ID NO: 80742 - DNA, 20 bp, Artificial
  CRISPR gRNA sequence
gggaagtcaagcagtcaaga

SEQ ID NO: 80743 - DNA, 20 bp, Artificial
  CRISPR gRNA sequence
catttgagcgacataaaata

SEQ ID NO: 80744 - DNA, 20 bp, Artificial
  CRISPR gRNA sequence
gagcgacataaaataggcag

SEQ ID NO: 80745 - DNA, 20 bp, Artificial
  CRISPR gRNA sequence
agcgacataaaataggcagg

SEQ ID NO: 80746 - DNA, 20 bp, Artificial
  CRISPR gRNA sequence
tccatggagtcttgatgtct

SEQ ID NO: 80747 - DNA, 20 bp, Artificial
  CRISPR gRNA sequence
catggagtcttgatgtctct

SEQ ID NO: 80748 - DNA, 20 bp, Artificial
  CRISPR gRNA sequence
gatgtctctgcccagggatc

SEQ ID NO: 80749 - DNA, 20 bp, Artificial
  CRISPR gRNA sequence
atgtctctgcccagggatca

SEQ ID NO: 80750 - DNA, 20 bp, Artificial
  CRISPR gRNA sequence
tgcccagggatcagctccag

SEQ ID NO: 80751 - DNA, 20 bp, Artificial
  CRISPR gRNA sequence
cccagggatcagctccagag

SEQ ID NO: 80752 - DNA, 20 bp, Artificial
  CRISPR gRNA sequence
cagagatcagtctgtttctt

SEQ ID NO: 80753 - DNA, 20 bp, Artificial
  CRISPR gRNA sequence
tttcttctgcaccccctccc

SEQ ID NO: 80754 - DNA, 20 bp, Artificial
  CRISPR gRNA sequence
cttctgcaccccctccctac

SEQ ID NO: 80755 - DNA, 20 bp, Artificial
  CRISPR gRNA sequence
ttctgcaccccctccctact

SEQ ID NO: 80756 - DNA, 20 bp, Artificial
  CRISPR gRNA sequence
ctgcaccccctccctactcc

SEQ ID NO: 80757 - DNA, 20 bp, Artificial
  CRISPR gRNA sequence
tgcaccccctccctactcca

SEQ ID NO: 80758 - DNA, 20 bp, Artificial
  CRISPR gRNA sequence
caccccctccctactccatt

SEQ ID NO: 80759 - DNA, 20 bp, Artificial
  CRISPR gRNA sequence
cctactccatttgtgcctgc

SEQ ID NO: 80760 - DNA, 20 bp, Artificial
  CRISPR gRNA sequence
ctccatttgtgcctgcaccc

SEQ ID NO: 80761 - DNA, 20 bp, Artificial
  CRISPR gRNA sequence
catttgtgcctgcaccctgg

SEQ ID NO: 80762 - DNA, 20 bp, Artificial
  CRISPR gRNA sequence
gtgcctgcaccctggctctc

SEQ ID NO: 80763 - DNA, 20 bp, Artificial
  CRISPR gRNA sequence
tgcctgcaccctggctctct

SEQ ID NO: 80764 - DNA, 20 bp, Artificial
  CRISPR gRNA sequence
caccctggctctctggaatg

SEQ ID NO: 80765 - DNA, 20 bp, Artificial
  CRISPR gRNA sequence
gctctctggaatggtcttgt

SEQ ID NO: 80766 - DNA, 20 bp, Artificial
  CRISPR gRNA sequence
tctggaatggtcttgttcat

SEQ ID NO: 80767 - DNA, 20 bp, Artificial
  CRISPR gRNA sequence
tggaatggtcttgttcatcc

SEQ ID NO: 80768 - DNA, 20 bp, Artificial
  CRISPR gRNA sequence
gaatggtcttgttcatcccc

SEQ ID NO: 80769 - DNA, 20 bp, Artificial
  CRISPR gRNA sequence
gttcatcccctgtggacagt

SEQ ID NO: 80770 - DNA, 20 bp, Artificial
  CRISPR gRNA sequence
ttcatcccctgtggacagtc

SEQ ID NO: 80771 - DNA, 20 bp, Artificial
  CRISPR gRNA sequence
atcccctgtggacagtcccg

SEQ ID NO: 80772 - DNA, 20 bp, Artificial
  CRISPR gRNA sequence
tggacagtcccgtgaggatg

SEQ ID NO: 80773 - DNA, 20 bp, Artificial
  CRISPR gRNA sequence
ctcattcttatttccatgaa

SEQ ID NO: 80774 - DNA, 20 bp, Artificial
  CRISPR gRNA sequence
attcttatttccatgaacca

SEQ ID NO: 80775 - DNA, 20 bp, Artificial
  CRISPR gRNA sequence
ttatttccatgaaccattta

SEQ ID NO: 80776 - DNA, 20 bp, Artificial
  CRISPR gRNA sequence
atttccatgaaccatttatg

SEQ ID NO: 80777 - DNA, 20 bp, Artificial
  CRISPR gRNA sequence
tttccatgaaccatttatgc

SEQ ID NO: 80778 - DNA, 20 bp, Artificial
  CRISPR gRNA sequence
ccatgaaccatttatgctgc

SEQ ID NO: 80779 - DNA, 20 bp, Artificial
  CRISPR gRNA sequence
catgaaccatttatgctgct

SEQ ID NO: 80780 - DNA, 20 bp, Artificial
  CRISPR gRNA sequence
atgctgctctcagtctgagc

SEQ ID NO: 80781 - DNA, 20 bp, Artificial
  CRISPR gRNA sequence
tgctgctctcagtctgagct

SEQ ID NO: 80782 - DNA, 20 bp, Artificial
  CRISPR gRNA sequence
ctctcagtctgagctaacct

SEQ ID NO: 80783 - DNA, 20 bp, Artificial
  CRISPR gRNA sequence
tcagtctgagctaacctcat

SEQ ID NO: 80784 - DNA, 20 bp, Artificial
  CRISPR gRNA sequence
agtctgagctaacctcatgg

SEQ ID NO: 80785 - DNA, 20 bp, Artificial
  CRISPR gRNA sequence
agctaacctcatggcagaga

SEQ ID NO: 80786 - DNA, 20 bp, Artificial
  CRISPR gRNA sequence
acctcatggcagagacaact

SEQ ID NO: 80787 - DNA, 20 bp, Artificial
  CRISPR gRNA sequence
atggcagagacaactagttg

SEQ ID NO: 80788 - DNA, 20 bp, Artificial
  CRISPR gRNA sequence
gttgtctcccaaaatctgtt

SEQ ID NO: 80789 - DNA, 20 bp, Artificial
  CRISPR gRNA sequence
tctcccaaaatctgttcttc

SEQ ID NO: 80790 - DNA, 20 bp, Artificial
  CRISPR gRNA sequence
ccaaaatctgttcttccctt

SEQ ID NO: 80791 - DNA, 20 bp, Artificial
  CRISPR gRNA sequence
ttcttcccttcttcctcagt

SEQ ID NO: 80792 - DNA, 20 bp, Artificial
  CRISPR gRNA sequence
ttcccttcttcctcagtatt

SEQ ID NO: 80793 - DNA, 20 bp, Artificial
  CRISPR gRNA sequence
cccttcttcctcagtattag

SEQ ID NO: 80794 - DNA, 20 bp, Artificial
  CRISPR gRNA sequence
ccttcttcctcagtattaga

SEQ ID NO: 80795 - DNA, 20 bp, Artificial
  CRISPR gRNA sequence
cttcctcagtattagaacta

SEQ ID NO: 80796 - DNA, 20 bp, Artificial
  CRISPR gRNA sequence
ttcctcagtattagaactac

SEQ ID NO: 80797 - DNA, 20 bp, Artificial
  CRISPR gRNA sequence
cctcagtattagaactacta

SEQ ID NO: 80798 - DNA, 20 bp, Artificial
  CRISPR gRNA sequence
ctcagtattagaactactaa

SEQ ID NO: 80799 - DNA, 20 bp, Artificial
  CRISPR gRNA sequence
agtattagaactactaaata

SEQ ID NO: 80800 - DNA, 20 bp, Artificial
  CRISPR gRNA sequence
gaactactaaatattctctg

SEQ ID NO: 80801 - DNA, 20 bp, Artificial
  CRISPR gRNA sequence
ctaaatattctctggtcatc

SEQ ID NO: 80802 - DNA, 20 bp, Artificial
  CRISPR gRNA sequence
aatattctctggtcatctag

SEQ ID NO: 80803 - DNA, 20 bp, Artificial
  CRISPR gRNA sequence
tctggtcatctagaatagat

SEQ ID NO: 80804 - DNA, 20 bp, Artificial
  CRISPR gRNA sequence
tggtcatctagaatagatta

SEQ ID NO: 80805 - DNA, 20 bp, Artificial
  CRISPR gRNA sequence
gtcatctagaatagattatt

SEQ ID NO: 80806 - DNA, 20 bp, Artificial
  CRISPR gRNA sequence
gaatagattattatatccca

SEQ ID NO: 80807 - DNA, 20 bp, Artificial
  CRISPR gRNA sequence
ttatatcccagtctcccttg

SEQ ID NO: 80808 - DNA, 20 bp, Artificial
  CRISPR gRNA sequence
tatcccagtctcccttgcag

SEQ ID NO: 80809 - DNA, 20 bp, Artificial
  CRISPR gRNA sequence
ccttgcagttatatgtagcc

SEQ ID NO: 80810 - DNA, 20 bp, Artificial
  CRISPR gRNA sequence
gcagttatatgtagccatgt

SEQ ID NO: 80811 - DNA, 20 bp, Artificial
  CRISPR gRNA sequence
cagttatatgtagccatgta

SEQ ID NO: 80812 - DNA, 20 bp, Artificial
  CRISPR gRNA sequence
tatgtagccatgtaatttgg

SEQ ID NO: 80813 - DNA, 20 bp, Artificial
  CRISPR gRNA sequence
ggccagtggaatgtaagtag

SEQ ID NO: 80814 - DNA, 20 bp, Artificial
  CRISPR gRNA sequence
gccagtggaatgtaagtaga

SEQ ID NO: 80815 - DNA, 20 bp, Artificial
  CRISPR gRNA sequence
tctattcttctttgctcctt

SEQ ID NO: 80816 - DNA, 20 bp, Artificial
  CRISPR gRNA sequence
ttcttctttgctccttcctg

SEQ ID NO: 80817 - DNA, 20 bp, Artificial
  CRISPR gRNA sequence
ttctttgctccttcctgttg

SEQ ID NO: 80818 - DNA, 20 bp, Artificial
  CRISPR gRNA sequence
ctttgctccttcctgttgtc

SEQ ID NO: 80819 - DNA, 20 bp, Artificial
  CRISPR gRNA sequence
tttgctccttcctgttgtct

SEQ ID NO: 80820 - DNA, 20 bp, Artificial
  CRISPR gRNA sequence
tgctccttcctgttgtctgg

SEQ ID NO: 80821 - DNA, 20 bp, Artificial
  CRISPR gRNA sequence
gctccttcctgttgtctgga

SEQ ID NO: 80822 - DNA, 20 bp, Artificial
  CRISPR gRNA sequence
ctccttcctgttgtctggat

SEQ ID NO: 80823 - DNA, 20 bp, Artificial
  CRISPR gRNA sequence
cttcctgttgtctggattgt

SEQ ID NO: 80824 - DNA, 20 bp, Artificial
  CRISPR gRNA sequence
cctgttgtctggattgttga

SEQ ID NO: 80825 - DNA, 20 bp, Artificial
  CRISPR gRNA sequence
ctgttgtctggattgttgat

SEQ ID NO: 80826 - DNA, 20 bp, Artificial
  CRISPR gRNA sequence
ttgtctggattgttgatggg

SEQ ID NO: 80827 - DNA, 20 bp, Artificial
  CRISPR gRNA sequence
tctggattgttgatgggatg

SEQ ID NO: 80828 - DNA, 20 bp, Artificial
  CRISPR gRNA sequence
gattgttgatgggatggctg

SEQ ID NO: 80829 - DNA, 20 bp, Artificial
  CRISPR gRNA sequence
ttgatgggatggctggatct

SEQ ID NO: 80830 - DNA, 20 bp, Artificial
  CRISPR gRNA sequence
atgggatggctggatcttgg

SEQ ID NO: 80831 - DNA, 20 bp, Artificial
  CRISPR gRNA sequence
gatcttgggcagccatattg

SEQ ID NO: 80832 - DNA, 20 bp, Artificial
  CRISPR gRNA sequence
gggcagccatattgaatcat

SEQ ID NO: 80833 - DNA, 20 bp, Artificial
  CRISPR gRNA sequence
ggcagccatattgaatcatg

SEQ ID NO: 80834 - DNA, 20 bp, Artificial
  CRISPR gRNA sequence
aatcatgaggtggaacccat

SEQ ID NO: 80835 - DNA, 20 bp, Artificial
  CRISPR gRNA sequence
aggaaggtggaaggtaaagc

SEQ ID NO: 80836 - DNA, 20 bp, Artificial
  CRISPR gRNA sequence
cccatctgccctgtgctcac

SEQ ID NO: 80837 - DNA, 20 bp, Artificial
  CRISPR gRNA sequence
ccctgtgctcactgactttg

SEQ ID NO: 80838 - DNA, 20 bp, Artificial
  CRISPR gRNA sequence
tgctcactgactttggactt

SEQ ID NO: 80839 - DNA, 20 bp, Artificial
  CRISPR gRNA sequence
actgactttggacttctgtt

SEQ ID NO: 80840 - DNA, 20 bp, Artificial
  CRISPR gRNA sequence
actttggacttctgttacat

SEQ ID NO: 80841 - DNA, 20 bp, Artificial
  CRISPR gRNA sequence
tggacttctgttacatggca

SEQ ID NO: 80842 - DNA, 20 bp, Artificial
  CRISPR gRNA sequence
ggacttctgttacatggcag

SEQ ID NO: 80843 - DNA, 20 bp, Artificial
  CRISPR gRNA sequence
gacttctgttacatggcagg

SEQ ID NO: 80844 - DNA, 20 bp, Artificial
  CRISPR gRNA sequence
ctgttacatggcagggaaat

SEQ ID NO: 80845 - DNA, 20 bp, Artificial
  CRISPR gRNA sequence
tgttacatggcagggaaata

SEQ ID NO: 80846 - DNA, 20 bp, Artificial
  CRISPR gRNA sequence
ttacatggcagggaaataca

SEQ ID NO: 80847 - DNA, 20 bp, Artificial
  CRISPR gRNA sequence
catggcagggaaatacactt

SEQ ID NO: 80848 - DNA, 20 bp, Artificial
  CRISPR gRNA sequence
ccattctggttaagccactg

SEQ ID NO: 80849 - DNA, 20 bp, Artificial
  CRISPR gRNA sequence
cattctggttaagccactgt

SEQ ID NO: 80850 - DNA, 20 bp, Artificial
  CRISPR gRNA sequence
tggttaagccactgttgttt

SEQ ID NO: 80851 - DNA, 20 bp, Artificial
  CRISPR gRNA sequence
gttaagccactgttgtttag

SEQ ID NO: 80852 - DNA, 20 bp, Artificial
  CRISPR gRNA sequence
agccactgttgtttagtgct

SEQ ID NO: 80853 - DNA, 20 bp, Artificial
  CRISPR gRNA sequence
ttgtttagtgctttctgcta

SEQ ID NO: 80854 - DNA, 20 bp, Artificial
  CRISPR gRNA sequence
tttagtgctttctgctactc

SEQ ID NO: 80855 - DNA, 20 bp, Artificial
  CRISPR gRNA sequence
agtgctttctgctactcaca

SEQ ID NO: 80856 - DNA, 20 bp, Artificial
  CRISPR gRNA sequence
gtgctttctgctactcacag

SEQ ID NO: 80857 - DNA, 20 bp, Artificial
  CRISPR gRNA sequence
tctgctactcacagtgaact

SEQ ID NO: 80858 - DNA, 20 bp, Artificial
  CRISPR gRNA sequence
ctgctactcacagtgaactc

SEQ ID NO: 80859 - DNA, 20 bp, Artificial
  CRISPR gRNA sequence
tgctactcacagtgaactct

SEQ ID NO: 80860 - DNA, 20 bp, Artificial
  CRISPR gRNA sequence
ctactcacagtgaactctaa

SEQ ID NO: 80861 - DNA, 20 bp, Artificial
  CRISPR gRNA sequence
ctcacagtgaactctaatcc

SEQ ID NO: 80862 - DNA, 20 bp, Artificial
  CRISPR gRNA sequence
acagtgaactctaatcctag

SEQ ID NO: 80863 - DNA, 20 bp, Artificial
  CRISPR gRNA sequence
taatcctagctaacacagac

SEQ ID NO: 80864 - DNA, 20 bp, Artificial
  CRISPR gRNA sequence
atcctagctaacacagacca

SEQ ID NO: 80865 - DNA, 20 bp, Artificial
  CRISPR gRNA sequence
gctaacacagaccatcacct

SEQ ID NO: 80866 - DNA, 20 bp, Artificial
  CRISPR gRNA sequence
acacagaccatcacctcttt

SEQ ID NO: 80867 - DNA, 20 bp, Artificial
  CRISPR gRNA sequence
ttttgctaagcaaattcttc

SEQ ID NO: 80868 - DNA, 20 bp, Artificial
  CRISPR gRNA sequence
ttgctaagcaaattcttccc

SEQ ID NO: 80869 - DNA, 20 bp, Artificial
  CRISPR gRNA sequence
tgctaagcaaattcttccct

SEQ ID NO: 80870 - DNA, 20 bp, Artificial
  CRISPR gRNA sequence
gctaagcaaattcttccctt

SEQ ID NO: 80871 - DNA, 20 bp, Artificial
  CRISPR gRNA sequence
ctaagcaaattcttcccttc

SEQ ID NO: 80872 - DNA, 20 bp, Artificial
  CRISPR gRNA sequence
agcaaattcttcccttctga

SEQ ID NO: 80873 - DNA, 20 bp, Artificial
  CRISPR gRNA sequence
ttcccttctgaactggaact

SEQ ID NO: 80874 - DNA, 20 bp, Artificial
  CRISPR gRNA sequence
cccttctgaactggaactct

SEQ ID NO: 80875 - DNA, 20 bp, Artificial
  CRISPR gRNA sequence
ccttctgaactggaactctt

SEQ ID NO: 80876 - DNA, 20 bp, Artificial
  CRISPR gRNA sequence
ctgaactggaactctttttt

SEQ ID NO: 80877 - DNA, 20 bp, Artificial
  CRISPR gRNA sequence
tgaactggaactcttttttt

SEQ ID NO: 80878 - DNA, 20 bp, Artificial
  CRISPR gRNA sequence
aactggaactcttttttttt

SEQ ID NO: 80879 - DNA, 20 bp, Artificial
  CRISPR gRNA sequence
gaactcttttttttttgaga

SEQ ID NO: 80880 - DNA, 20 bp, Artificial
  CRISPR gRNA sequence
ttttttttttgagacagagt

SEQ ID NO: 80881 - DNA, 20 bp, Artificial
  CRISPR gRNA sequence
ttttttttgagacagagtct

SEQ ID NO: 80882 - DNA, 20 bp, Artificial
  CRISPR gRNA sequence
tttttttgagacagagtctc

SEQ ID NO: 80883 - DNA, 20 bp, Artificial
  CRISPR gRNA sequence
ttttttgagacagagtctcg

SEQ ID NO: 80884 - DNA, 20 bp, Artificial
  CRISPR gRNA sequence
tttttgagacagagtctcgc

SEQ ID NO: 80885 - DNA, 20 bp, Artificial
  CRISPR gRNA sequence
ttttgagacagagtctcgct

SEQ ID NO: 80886 - DNA, 20 bp, Artificial
  CRISPR gRNA sequence
tttgagacagagtctcgctc

SEQ ID NO: 80887 - DNA, 20 bp, Artificial
  CRISPR gRNA sequence
ttgagacagagtctcgctct

SEQ ID NO: 80888 - DNA, 20 bp, Artificial
  CRISPR gRNA sequence
tgagacagagtctcgctctg

SEQ ID NO: 80889 - DNA, 20 bp, Artificial
  CRISPR gRNA sequence
gagacagagtctcgctctgt

SEQ ID NO: 80890 - DNA, 20 bp, Artificial
  CRISPR gRNA sequence
agacagagtctcgctctgtc

SEQ ID NO: 80891 - DNA, 20 bp, Artificial
  CRISPR gRNA sequence
gctctgtcacccaggctgga

SEQ ID NO: 80892 - DNA, 20 bp, Artificial
  CRISPR gRNA sequence
tgtcacccaggctggagtgc

SEQ ID NO: 80893 - DNA, 20 bp, Artificial
  CRISPR gRNA sequence
tcacccaggctggagtgcaa

SEQ ID NO: 80894 - DNA, 20 bp, Artificial
  CRISPR gRNA sequence
gagtgcaatggtgcaatctc

SEQ ID NO: 80895 - DNA, 20 bp, Artificial
  CRISPR gRNA sequence
ggctcactgcagcctccgcc

SEQ ID NO: 80896 - DNA, 20 bp, Artificial
  CRISPR gRNA sequence
actgcagcctccgcctcccg

SEQ ID NO: 80897 - DNA, 20 bp, Artificial
  CRISPR gRNA sequence
cagcctccgcctcccgggtt

SEQ ID NO: 80898 - DNA, 20 bp, Artificial
  CRISPR gRNA sequence
cgcctcccgggttcaagcga

SEQ ID NO: 80899 - DNA, 20 bp, Artificial
  CRISPR gRNA sequence
ccgggttcaagcgattcttc

SEQ ID NO: 80900 - DNA, 20 bp, Artificial
  CRISPR gRNA sequence
aagcgattcttctgcctcag

SEQ ID NO: 80901 - DNA, 20 bp, Artificial
  CRISPR gRNA sequence
ttctgcctcagcctcccgag

SEQ ID NO: 80902 - DNA, 20 bp, Artificial
  CRISPR gRNA sequence
ctgcctcagcctcccgagta

SEQ ID NO: 80903 - DNA, 20 bp, Artificial
  CRISPR gRNA sequence
tgcctcagcctcccgagtag

SEQ ID NO: 80904 - DNA, 20 bp, Artificial
  CRISPR gRNA sequence
cctcagcctcccgagtagct

SEQ ID NO: 80905 - DNA, 20 bp, Artificial
  CRISPR gRNA sequence
agcctcccgagtagctggga

SEQ ID NO: 80906 - DNA, 20 bp, Artificial
  CRISPR gRNA sequence
ccgagtagctgggattacag

SEQ ID NO: 80907 - DNA, 20 bp, Artificial
  CRISPR gRNA sequence
ggattacaggtgcacaccac

SEQ ID NO: 80908 - DNA, 20 bp, Artificial
  CRISPR gRNA sequence
caggtgcacaccacaatgcc

SEQ ID NO: 80909 - DNA, 20 bp, Artificial
  CRISPR gRNA sequence
atttttgtaatttttagtac

SEQ ID NO: 80910 - DNA, 20 bp, Artificial
  CRISPR gRNA sequence
ttgtaatttttagtacagat

SEQ ID NO: 80911 - DNA, 20 bp, Artificial
  CRISPR gRNA sequence
tgtaatttttagtacagatg

SEQ ID NO: 80912 - DNA, 20 bp, Artificial
  CRISPR gRNA sequence
gtaatttttagtacagatgg

SEQ ID NO: 80913 - DNA, 20 bp, Artificial
  CRISPR gRNA sequence
taatttttagtacagatggg

SEQ ID NO: 80914 - DNA, 20 bp, Artificial
  CRISPR gRNA sequence
ttagtacagatggggtttca

SEQ ID NO: 80915 - DNA, 20 bp, Artificial
  CRISPR gRNA sequence
tagtacagatggggtttcac

SEQ ID NO: 80916 - DNA, 20 bp, Artificial
  CRISPR gRNA sequence
agtacagatggggtttcacc

SEQ ID NO: 80917 - DNA, 20 bp, Artificial
  CRISPR gRNA sequence
gtacagatggggtttcacca

SEQ ID NO: 80918 - DNA, 20 bp, Artificial
  CRISPR gRNA sequence
caccatgttggccaggctgg

SEQ ID NO: 80919 - DNA, 20 bp, Artificial
  CRISPR gRNA sequence
accatgttggccaggctggg

SEQ ID NO: 80920 - DNA, 20 bp, Artificial
  CRISPR gRNA sequence
gccaggctgggctcaaactc

SEQ ID NO: 80921 - DNA, 20 bp, Artificial
  CRISPR gRNA sequence
ggctcaaactcctgacctca

SEQ ID NO: 80922 - DNA, 20 bp, Artificial
  CRISPR gRNA sequence
aaactcctgacctcagggtg

SEQ ID NO: 80923 - DNA, 20 bp, Artificial
  CRISPR gRNA sequence
ctgacctcagggtgatctgc

SEQ ID NO: 80924 - DNA, 20 bp, Artificial
  CRISPR gRNA sequence
acctcagggtgatctgccca

SEQ ID NO: 80925 - DNA, 20 bp, Artificial
  CRISPR gRNA sequence
agggtgatctgcccacctcg

SEQ ID NO: 80926 - DNA, 20 bp, Artificial
  CRISPR gRNA sequence
cccacctcggcctcccaaag

SEQ ID NO: 80927 - DNA, 20 bp, Artificial
  CRISPR gRNA sequence
ggcctcccaaagtgctggga

SEQ ID NO: 80928 - DNA, 20 bp, Artificial
  CRISPR gRNA sequence
ccaaagtgctgggattacag

SEQ ID NO: 80929 - DNA, 20 bp, Artificial
  CRISPR gRNA sequence
ggattacaggtgtgagccat

SEQ ID NO: 80930 - DNA, 20 bp, Artificial
  CRISPR gRNA sequence
caggtgtgagccatcatgat

SEQ ID NO: 80931 - DNA, 20 bp, Artificial
  CRISPR gRNA sequence
gaactcttaaaccacctcct

SEQ ID NO: 80932 - DNA, 20 bp, Artificial
  CRISPR gRNA sequence
ttaaaccacctccttctaga

SEQ ID NO: 80933 - DNA, 20 bp, Artificial
  CRISPR gRNA sequence
aaaccacctccttctagaag

SEQ ID NO: 80934 - DNA, 20 bp, Artificial
  CRISPR gRNA sequence
aaccacctccttctagaagt

SEQ ID NO: 80935 - DNA, 20 bp, Artificial
  CRISPR gRNA sequence
cttctagaagtaccaataga

SEQ ID NO: 80936 - DNA, 20 bp, Artificial
  CRISPR gRNA sequence
ctagaagtaccaatagaggg

SEQ ID NO: 80937 - DNA, 20 bp, Artificial
  CRISPR gRNA sequence
tagaagtaccaatagagggc

SEQ ID NO: 80938 - DNA, 20 bp, Artificial
  CRISPR gRNA sequence
gaagtaccaatagagggcac

SEQ ID NO: 80939 - DNA, 20 bp, Artificial
  CRISPR gRNA sequence
acacagcaaaagcctaaata

SEQ ID NO: 80940 - DNA, 20 bp, Artificial
  CRISPR gRNA sequence
cacagcaaaagcctaaataa

SEQ ID NO: 80941 - DNA, 20 bp, Artificial
  CRISPR gRNA sequence
aataatgtgcagttcctttg

SEQ ID NO: 80942 - DNA, 20 bp, Artificial
  CRISPR gRNA sequence
ctttgattcagtaattccat

SEQ ID NO: 80943 - DNA, 20 bp, Artificial
  CRISPR gRNA sequence
tgattcagtaattccatttc

SEQ ID NO: 80944 - DNA, 20 bp, Artificial
  CRISPR gRNA sequence
gattcagtaattccatttct

SEQ ID NO: 80945 - DNA, 20 bp, Artificial
  CRISPR gRNA sequence
attcagtaattccatttcta

SEQ ID NO: 80946 - DNA, 20 bp, Artificial
  CRISPR gRNA sequence
agtaattccatttctaggac

SEQ ID NO: 80947 - DNA, 20 bp, Artificial
  CRISPR gRNA sequence
catttctaggactctaacct

SEQ ID NO: 80948 - DNA, 20 bp, Artificial
  CRISPR gRNA sequence
ctaggactctaaccttggca

SEQ ID NO: 80949 - DNA, 20 bp, Artificial
  CRISPR gRNA sequence
taggactctaaccttggcaa

SEQ ID NO: 80950 - DNA, 20 bp, Artificial
  CRISPR gRNA sequence
ggactctaaccttggcaaac

SEQ ID NO: 80951 - DNA, 20 bp, Artificial
  CRISPR gRNA sequence
taaccttggcaaacgatcat

SEQ ID NO: 80952 - DNA, 20 bp, Artificial
  CRISPR gRNA sequence
accttggcaaacgatcatga

SEQ ID NO: 80953 - DNA, 20 bp, Artificial
  CRISPR gRNA sequence
ggcaaacgatcatgaacgta

SEQ ID NO: 80954 - DNA, 20 bp, Artificial
  CRISPR gRNA sequence
gcaaacgatcatgaacgtat

SEQ ID NO: 80955 - DNA, 20 bp, Artificial
  CRISPR gRNA sequence
aattgcaaagatgctcactg

SEQ ID NO: 80956 - DNA, 20 bp, Artificial
  CRISPR gRNA sequence
attgcaaagatgctcactgc

SEQ ID NO: 80957 - DNA, 20 bp, Artificial
  CRISPR gRNA sequence
caaagatgctcactgcaaga

SEQ ID NO: 80958 - DNA, 20 bp, Artificial
  CRISPR gRNA sequence
actgcaagattatttataat

SEQ ID NO: 80959 - DNA, 20 bp, Artificial
  CRISPR gRNA sequence
caagattatttataattatt

SEQ ID NO: 80960 - DNA, 20 bp, Artificial
  CRISPR gRNA sequence
tttataattattaaaaattg

SEQ ID NO: 80961 - DNA, 20 bp, Artificial
  CRISPR gRNA sequence
ataattattaaaaattggaa

SEQ ID NO: 80962 - DNA, 20 bp, Artificial
  CRISPR gRNA sequence
taattattaaaaattggaaa

SEQ ID NO: 80963 - DNA, 20 bp, Artificial
  CRISPR gRNA sequence
ttaaaaattggaaacaacct

SEQ ID NO: 80964 - DNA, 20 bp, Artificial
  CRISPR gRNA sequence
aaaattggaaacaacctaaa

SEQ ID NO: 80965 - DNA, 20 bp, Artificial
  CRISPR gRNA sequence
gaaacaacctaaatgtccaa

SEQ ID NO: 80966 - DNA, 20 bp, Artificial
  CRISPR gRNA sequence
aatgtccaacagttggggat

SEQ ID NO: 80967 - DNA, 20 bp, Artificial
  CRISPR gRNA sequence
gggattggccaactaaatgg

SEQ ID NO: 80968 - DNA, 20 bp, Artificial
  CRISPR gRNA sequence
gccaactaaatggtggtcca

SEQ ID NO: 80969 - DNA, 20 bp, Artificial
  CRISPR gRNA sequence
aatggtggtccatcatctag

SEQ ID NO: 80970 - DNA, 20 bp, Artificial
  CRISPR gRNA sequence
gtggactatgctatcacatt

SEQ ID NO: 80971 - DNA, 20 bp, Artificial
  CRISPR gRNA sequence
tgctatcacatttccggatg

SEQ ID NO: 80972 - DNA, 20 bp, Artificial
  CRISPR gRNA sequence
tcacatttccggatgtactt

SEQ ID NO: 80973 - DNA, 20 bp, Artificial
  CRISPR gRNA sequence
ccggatgtactttctggtac

SEQ ID NO: 80974 - DNA, 20 bp, Artificial
  CRISPR gRNA sequence
cggatgtactttctggtact

SEQ ID NO: 80975 - DNA, 20 bp, Artificial
  CRISPR gRNA sequence
tctggtactatgtccttcct

SEQ ID NO: 80976 - DNA, 20 bp, Artificial
  CRISPR gRNA sequence
ctggtactatgtccttcctc

SEQ ID NO: 80977 - DNA, 20 bp, Artificial
  CRISPR gRNA sequence
tggtactatgtccttcctca

SEQ ID NO: 80978 - DNA, 20 bp, Artificial
  CRISPR gRNA sequence
gtactatgtccttcctcata

SEQ ID NO: 80979 - DNA, 20 bp, Artificial
  CRISPR gRNA sequence
tgtccttcctcatagcagta

SEQ ID NO: 80980 - DNA, 20 bp, Artificial
  CRISPR gRNA sequence
cctcatagcagtacacactt

SEQ ID NO: 80981 - DNA, 20 bp, Artificial
  CRISPR gRNA sequence
ctcatagcagtacacacttg

SEQ ID NO: 80982 - DNA, 20 bp, Artificial
  CRISPR gRNA sequence
atagcagtacacacttggaa

SEQ ID NO: 80983 - DNA, 20 bp, Artificial
  CRISPR gRNA sequence
ggaaagcactcactgtgtat

SEQ ID NO: 80984 - DNA, 20 bp, Artificial
  CRISPR gRNA sequence
gaaagcactcactgtgtatt

SEQ ID NO: 80985 - DNA, 20 bp, Artificial
  CRISPR gRNA sequence
actgtgtattaggcactgtc

SEQ ID NO: 80986 - DNA, 20 bp, Artificial
  CRISPR gRNA sequence
tgtattaggcactgtctaag

SEQ ID NO: 80987 - DNA, 20 bp, Artificial
  CRISPR gRNA sequence
ggcactgtctaagtgcttta

SEQ ID NO: 80988 - DNA, 20 bp, Artificial
  CRISPR gRNA sequence
tctaagtgctttatatacct

SEQ ID NO: 80989 - DNA, 20 bp, Artificial
  CRISPR gRNA sequence
agtgctttatataccttatt

SEQ ID NO: 80990 - DNA, 20 bp, Artificial
  CRISPR gRNA sequence
tatataccttattttatcct

SEQ ID NO: 80991 - DNA, 20 bp, Artificial
  CRISPR gRNA sequence
atataccttattttatcctc

SEQ ID NO: 80992 - DNA, 20 bp, Artificial
  CRISPR gRNA sequence
tataccttattttatcctca

SEQ ID NO: 80993 - DNA, 20 bp, Artificial
  CRISPR gRNA sequence
attttatcctcacaactcca

SEQ ID NO: 80994 - DNA, 20 bp, Artificial
  CRISPR gRNA sequence
ttttatcctcacaactccag

SEQ ID NO: 80995 - DNA, 20 bp, Artificial
  CRISPR gRNA sequence
tatcctcacaactccagaga

SEQ ID NO: 80996 - DNA, 20 bp, Artificial
  CRISPR gRNA sequence
atcctcacaactccagagag

SEQ ID NO: 80997 - DNA, 20 bp, Artificial
  CRISPR gRNA sequence
tcctcacaactccagagagt

SEQ ID NO: 80998 - DNA, 20 bp, Artificial
  CRISPR gRNA sequence
acaactccagagagtccacc

SEQ ID NO: 80999 - DNA, 20 bp, Artificial
  CRISPR gRNA sequence
cagagagtccacctctaact

SEQ ID NO: 81000 - DNA, 20 bp, Artificial
  CRISPR gRNA sequence
taactctgaaaagagtagga

SEQ ID NO: 81001 - DNA, 20 bp, Artificial
  CRISPR gRNA sequence
actctgaaaagagtaggagg

SEQ ID NO: 81002 - DNA, 20 bp, Artificial
  CRISPR gRNA sequence
tgaaaagagtaggaggtcca

SEQ ID NO: 81003 - DNA, 20 bp, Artificial
  CRISPR gRNA sequence
aaaagagtaggaggtccacc

SEQ ID NO: 81004 - DNA, 20 bp, Artificial
  CRISPR gRNA sequence
cccaattcccagaggctgag

SEQ ID NO: 81005 - DNA, 20 bp, Artificial
  CRISPR gRNA sequence
ccaattcccagaggctgagg

SEQ ID NO: 81006 - DNA, 20 bp, Artificial
  CRISPR gRNA sequence
ccagaggctgaggccagtac

SEQ ID NO: 81007 - DNA, 20 bp, Artificial
  CRISPR gRNA sequence
aggccagtactatgcgtcct

SEQ ID NO: 81008 - DNA, 20 bp, Artificial
  CRISPR gRNA sequence
tgcgtcctggggtttagagc

SEQ ID NO: 81009 - DNA, 20 bp, Artificial
  CRISPR gRNA sequence
gggtttagagcccagctgct

SEQ ID NO: 81010 - DNA, 20 bp, Artificial
  CRISPR gRNA sequence
agagcccagctgctccctgg

SEQ ID NO: 81011 - DNA, 20 bp, Artificial
  CRISPR gRNA sequence
gagcccagctgctccctggg

SEQ ID NO: 81012 - DNA, 20 bp, Artificial
  CRISPR gRNA sequence
ctccctgggcatgcagtaga

SEQ ID NO: 81013 - DNA, 20 bp, Artificial
  CRISPR gRNA sequence
cctgggcatgcagtagagac

SEQ ID NO: 81014 - DNA, 20 bp, Artificial
  CRISPR gRNA sequence
ggcatgcagtagagacatac

SEQ ID NO: 81015 - DNA, 20 bp, Artificial
  CRISPR gRNA sequence
ggatgtactgtcagccccac

SEQ ID NO: 81016 - DNA, 20 bp, Artificial
  CRISPR gRNA sequence
gatgtactgtcagccccact

SEQ ID NO: 81017 - DNA, 20 bp, Artificial
  CRISPR gRNA sequence
tcagccccactggtcatttc

SEQ ID NO: 81018 - DNA, 20 bp, Artificial
  CRISPR gRNA sequence
gtcatttctcctcaactggg

SEQ ID NO: 81019 - DNA, 20 bp, Artificial
  CRISPR gRNA sequence
ctcctcaactgggctaatag

SEQ ID NO: 81020 - DNA, 20 bp, Artificial
  CRISPR gRNA sequence
tcctcaactgggctaatagc

SEQ ID NO: 81021 - DNA, 20 bp, Artificial
  CRISPR gRNA sequence
ctcaactgggctaatagcaa

SEQ ID NO: 81022 - DNA, 20 bp, Artificial
  CRISPR gRNA sequence
aactgggctaatagcaatag

SEQ ID NO: 81023 - DNA, 20 bp, Artificial
  CRISPR gRNA sequence
ggctaatagcaataggtcct

SEQ ID NO: 81024 - DNA, 20 bp, Artificial
  CRISPR gRNA sequence
atagcaataggtcctcactc

SEQ ID NO: 81025 - DNA, 20 bp, Artificial
  CRISPR gRNA sequence
actcaggcagagagtcttag

SEQ ID NO: 81026 - DNA, 20 bp, Artificial
  CRISPR gRNA sequence
aggcagagagtcttagaatt

SEQ ID NO: 81027 - DNA, 20 bp, Artificial
  CRISPR gRNA sequence
agaatttatgaaacatgctc

SEQ ID NO: 81028 - DNA, 20 bp, Artificial
  CRISPR gRNA sequence
gaatttatgaaacatgctca

SEQ ID NO: 81029 - DNA, 20 bp, Artificial
  CRISPR gRNA sequence
atgaaacatgctcacaccat

SEQ ID NO: 81030 - DNA, 20 bp, Artificial
  CRISPR gRNA sequence
tgaaacatgctcacaccatg

SEQ ID NO: 81031 - DNA, 20 bp, Artificial
  CRISPR gRNA sequence
acaccatgatcctcaggcag

SEQ ID NO: 81032 - DNA, 20 bp, Artificial
  CRISPR gRNA sequence
aggcagggatcaccacctcc

SEQ ID NO: 81033 - DNA, 20 bp, Artificial
  CRISPR gRNA sequence
cactaagcagacggaaagac

SEQ ID NO: 81034 - DNA, 20 bp, Artificial
  CRISPR gRNA sequence
agcagacggaaagaccatgg

SEQ ID NO: 81035 - DNA, 20 bp, Artificial
  CRISPR gRNA sequence
aggtttcttgcctcccaggc

SEQ ID NO: 81036 - DNA, 20 bp, Artificial
  CRISPR gRNA sequence
cttgcctcccaggccagtaa

SEQ ID NO: 81037 - DNA, 20 bp, Artificial
  CRISPR gRNA sequence
ttgcctcccaggccagtaaa

SEQ ID NO: 81038 - DNA, 20 bp, Artificial
  CRISPR gRNA sequence
gcctcccaggccagtaaatt

SEQ ID NO: 81039 - DNA, 20 bp, Artificial
  CRISPR gRNA sequence
cctcccaggccagtaaattt

SEQ ID NO: 81040 - DNA, 20 bp, Artificial
  CRISPR gRNA sequence
ccaggccagtaaatttccaa

SEQ ID NO: 81041 - DNA, 20 bp, Artificial
  CRISPR gRNA sequence
ccaaggccttggaggcctag

SEQ ID NO: 81042 - DNA, 20 bp, Artificial
  CRISPR gRNA sequence
caaggccttggaggcctaga

SEQ ID NO: 81043 - DNA, 20 bp, Artificial
  CRISPR gRNA sequence
ggaggcctagatggcaccag

SEQ ID NO: 81044 - DNA, 20 bp, Artificial
  CRISPR gRNA sequence
gaggcctagatggcaccaga

SEQ ID NO: 81045 - DNA, 20 bp, Artificial
  CRISPR gRNA sequence
gatggcaccagacaaggcta

SEQ ID NO: 81046 - DNA, 20 bp, Artificial
  CRISPR gRNA sequence
agtccctggattttgtgtga

SEQ ID NO: 81047 - DNA, 20 bp, Artificial
  CRISPR gRNA sequence
gattttgtgtgatctcggca

SEQ ID NO: 81048 - DNA, 20 bp, Artificial
  CRISPR gRNA sequence
tgtgtgatctcggcaaaagg

SEQ ID NO: 81049 - DNA, 20 bp, Artificial
  CRISPR gRNA sequence
gtgtgatctcggcaaaagga

SEQ ID NO: 81050 - DNA, 20 bp, Artificial
  CRISPR gRNA sequence
tgtgatctcggcaaaaggat

SEQ ID NO: 81051 - DNA, 20 bp, Artificial
  CRISPR gRNA sequence
ggcaaaaggatgtggccata

SEQ ID NO: 81052 - DNA, 20 bp, Artificial
  CRISPR gRNA sequence
gggcataacttcttttccag

SEQ ID NO: 81053 - DNA, 20 bp, Artificial
  CRISPR gRNA sequence
cttttccaggctatggtgtc

SEQ ID NO: 81054 - DNA, 20 bp, Artificial
  CRISPR gRNA sequence
ttttccaggctatggtgtcc

SEQ ID NO: 81055 - DNA, 20 bp, Artificial
  CRISPR gRNA sequence
ttccaggctatggtgtccag

SEQ ID NO: 81056 - DNA, 20 bp, Artificial
  CRISPR gRNA sequence
tccaggctatggtgtccagc

SEQ ID NO: 81057 - DNA, 20 bp, Artificial
  CRISPR gRNA sequence
ccaggctatggtgtccagca

SEQ ID NO: 81058 - DNA, 20 bp, Artificial
  CRISPR gRNA sequence
caggctatggtgtccagcat

SEQ ID NO: 81059 - DNA, 20 bp, Artificial
  CRISPR gRNA sequence
tggtgtccagcatccatgct

SEQ ID NO: 81060 - DNA, 20 bp, Artificial
  CRISPR gRNA sequence
cccatgaagaaatggtccag

SEQ ID NO: 81061 - DNA, 20 bp, Artificial
  CRISPR gRNA sequence
gatggtgtgatttctggtga

SEQ ID NO: 81062 - DNA, 20 bp, Artificial
  CRISPR gRNA sequence
ctggtgatgtttctcatcct

SEQ ID NO: 81063 - DNA, 20 bp, Artificial
  CRISPR gRNA sequence
tggtgatgtttctcatcctc

SEQ ID NO: 81064 - DNA, 20 bp, Artificial
  CRISPR gRNA sequence
gtgatgtttctcatcctcaa

SEQ ID NO: 81065 - DNA, 20 bp, Artificial
  CRISPR gRNA sequence
ctcatcctcaaatttctcct

SEQ ID NO: 81066 - DNA, 20 bp, Artificial
  CRISPR gRNA sequence
tcatcctcaaatttctcctc

SEQ ID NO: 81067 - DNA, 20 bp, Artificial
  CRISPR gRNA sequence
atcctcaaatttctcctcca

SEQ ID NO: 81068 - DNA, 20 bp, Artificial
  CRISPR gRNA sequence
aaatttctcctccagccagt

SEQ ID NO: 81069 - DNA, 20 bp, Artificial
  CRISPR gRNA sequence
ctcctccagccagtctaaca

SEQ ID NO: 81070 - DNA, 20 bp, Artificial
  CRISPR gRNA sequence
tcctccagccagtctaacac

SEQ ID NO: 81071 - DNA, 20 bp, Artificial
  CRISPR gRNA sequence
ctccagccagtctaacacaa

SEQ ID NO: 81072 - DNA, 20 bp, Artificial
  CRISPR gRNA sequence
cagccagtctaacacaatac

SEQ ID NO: 81073 - DNA, 20 bp, Artificial
  CRISPR gRNA sequence
acacaatacctttgtttcca

SEQ ID NO: 81074 - DNA, 20 bp, Artificial
  CRISPR gRNA sequence
tgtttccatcattagtgttc

SEQ ID NO: 81075 - DNA, 20 bp, Artificial
  CRISPR gRNA sequence
gtttccatcattagtgttct

SEQ ID NO: 81076 - DNA, 20 bp, Artificial
  CRISPR gRNA sequence
tttccatcattagtgttcta

SEQ ID NO: 81077 - DNA, 20 bp, Artificial
  CRISPR gRNA sequence
ccatcattagtgttctatcc

SEQ ID NO: 81078 - DNA, 20 bp, Artificial
  CRISPR gRNA sequence
catcattagtgttctatccc

SEQ ID NO: 81079 - DNA, 20 bp, Artificial
  CRISPR gRNA sequence
gtgttctatccccttaggat

SEQ ID NO: 81080 - DNA, 20 bp, Artificial
  CRISPR gRNA sequence
tatccccttaggatatgaca

SEQ ID NO: 81081 - DNA, 20 bp, Artificial
  CRISPR gRNA sequence
tccccttaggatatgacaca

SEQ ID NO: 81082 - DNA, 20 bp, Artificial
  CRISPR gRNA sequence
aggatatgacacaaatctct

SEQ ID NO: 81083 - DNA, 20 bp, Artificial
  CRISPR gRNA sequence
ggatatgacacaaatctctt

SEQ ID NO: 81084 - DNA, 20 bp, Artificial
  CRISPR gRNA sequence
tttaaggctaaccatcctca

SEQ ID NO: 81085 - DNA, 20 bp, Artificial
  CRISPR gRNA sequence
taaggctaaccatcctcagg

SEQ ID NO: 81086 - DNA, 20 bp, Artificial
  CRISPR gRNA sequence
aaggctaaccatcctcagga

SEQ ID NO: 81087 - DNA, 20 bp, Artificial
  CRISPR gRNA sequence
aggctaaccatcctcaggag

SEQ ID NO: 81088 - DNA, 20 bp, Artificial
  CRISPR gRNA sequence
accatcctcaggagaaaaag

SEQ ID NO: 81089 - DNA, 20 bp, Artificial
  CRISPR gRNA sequence
aggagaaaaagcacatggca

SEQ ID NO: 81090 - DNA, 20 bp, Artificial
  CRISPR gRNA sequence
tcagtcattgagatttccat

SEQ ID NO: 81091 - DNA, 20 bp, Artificial
  CRISPR gRNA sequence
agatttccatggggaataat

SEQ ID NO: 81092 - DNA, 20 bp, Artificial
  CRISPR gRNA sequence
ccatggggaataatcttgga

SEQ ID NO: 81093 - DNA, 20 bp, Artificial
  CRISPR gRNA sequence
catggggaataatcttggag

SEQ ID NO: 81094 - DNA, 20 bp, Artificial
  CRISPR gRNA sequence
ggagacagaggacgatggtt

SEQ ID NO: 81095 - DNA, 20 bp, Artificial
  CRISPR gRNA sequence
gagacagaggacgatggttg

SEQ ID NO: 81096 - DNA, 20 bp, Artificial
  CRISPR gRNA sequence
aaagatccatggcccagctc

SEQ ID NO: 81097 - DNA, 20 bp, Artificial
  CRISPR gRNA sequence
tgttactaattctctgtggt

SEQ ID NO: 81098 - DNA, 20 bp, Artificial
  CRISPR gRNA sequence
ttactaattctctgtggtag

SEQ ID NO: 81099 - DNA, 20 bp, Artificial
  CRISPR gRNA sequence
ctaattctctgtggtaggca

SEQ ID NO: 81100 - DNA, 20 bp, Artificial
  CRISPR gRNA sequence
attctctgtggtaggcatta

SEQ ID NO: 81101 - DNA, 20 bp, Artificial
  CRISPR gRNA sequence
tctgtggtaggcattagggc

SEQ ID NO: 81102 - DNA, 20 bp, Artificial
  CRISPR gRNA sequence
tgtggtaggcattagggctg

SEQ ID NO: 81103 - DNA, 20 bp, Artificial
  CRISPR gRNA sequence
tggtaggcattagggctgtt

SEQ ID NO: 81104 - DNA, 20 bp, Artificial
  CRISPR gRNA sequence
gggctgttcacagatactct

SEQ ID NO: 81105 - DNA, 20 bp, Artificial
  CRISPR gRNA sequence
ttcacagatactctttctcc

SEQ ID NO: 81106 - DNA, 20 bp, Artificial
  CRISPR gRNA sequence
acagatactctttctcctct

SEQ ID NO: 81107 - DNA, 20 bp, Artificial
  CRISPR gRNA sequence
tttctcctctttctaggcct

SEQ ID NO: 81108 - DNA, 20 bp, Artificial
  CRISPR gRNA sequence
tctcctctttctaggccttt

SEQ ID NO: 81109 - DNA, 20 bp, Artificial
  CRISPR gRNA sequence
ctcctctttctaggcctttg

SEQ ID NO: 81110 - DNA, 20 bp, Artificial
  CRISPR gRNA sequence
tcctctttctaggcctttgg

SEQ ID NO: 81111 - DNA, 20 bp, Artificial
  CRISPR gRNA sequence
ctctttctaggcctttggtg

SEQ ID NO: 81112 - DNA, 20 bp, Artificial
  CRISPR gRNA sequence
tttctaggcctttggtggga

SEQ ID NO: 81113 - DNA, 20 bp, Artificial
  CRISPR gRNA sequence
tctaggcctttggtgggatt

SEQ ID NO: 81114 - DNA, 20 bp, Artificial
  CRISPR gRNA sequence
ctaggcctttggtgggatta

SEQ ID NO: 81115 - DNA, 20 bp, Artificial
  CRISPR gRNA sequence
taggcctttggtgggattac

SEQ ID NO: 81116 - DNA, 20 bp, Artificial
  CRISPR gRNA sequence
ggcctttggtgggattacac

SEQ ID NO: 81117 - DNA, 20 bp, Artificial
  CRISPR gRNA sequence
tggtgggattacacttctct

SEQ ID NO: 81118 - DNA, 20 bp, Artificial
  CRISPR gRNA sequence
ggtgggattacacttctctg

SEQ ID NO: 81119 - DNA, 20 bp, Artificial
  CRISPR gRNA sequence
gtgggattacacttctctgc

SEQ ID NO: 81120 - DNA, 20 bp, Artificial
  CRISPR gRNA sequence
cacttctctgcctccttgaa

SEQ ID NO: 81121 - DNA, 20 bp, Artificial
  CRISPR gRNA sequence
ctctgcctccttgaaattgg

SEQ ID NO: 81122 - DNA, 20 bp, Artificial
  CRISPR gRNA sequence
tctgcctccttgaaattggg

SEQ ID NO: 81123 - DNA, 20 bp, Artificial
  CRISPR gRNA sequence
tgcctccttgaaattgggca

SEQ ID NO: 81124 - DNA, 20 bp, Artificial
  CRISPR gRNA sequence
cctccttgaaattgggcaca

SEQ ID NO: 81125 - DNA, 20 bp, Artificial
  CRISPR gRNA sequence
cttgaaattgggcacagcca

SEQ ID NO: 81126 - DNA, 20 bp, Artificial
  CRISPR gRNA sequence
gaaattgggcacagccatga

SEQ ID NO: 81127 - DNA, 20 bp, Artificial
  CRISPR gRNA sequence
aaattgggcacagccatgaa

SEQ ID NO: 81128 - DNA, 20 bp, Artificial
  CRISPR gRNA sequence
ggcacagccatgaaacttgc

SEQ ID NO: 81129 - DNA, 20 bp, Artificial
  CRISPR gRNA sequence
gctttggtcaatgaaacatg

SEQ ID NO: 81130 - DNA, 20 bp, Artificial
  CRISPR gRNA sequence
ctttggtcaatgaaacatgc

SEQ ID NO: 81131 - DNA, 20 bp, Artificial
  CRISPR gRNA sequence
tggtcaatgaaacatgctaa

SEQ ID NO: 81132 - DNA, 20 bp, Artificial
  CRISPR gRNA sequence
ggtcaatgaaacatgctaaa

SEQ ID NO: 81133 - DNA, 20 bp, Artificial
  CRISPR gRNA sequence
gtcaatgaaacatgctaaaa

SEQ ID NO: 81134 - DNA, 20 bp, Artificial
  CRISPR gRNA sequence
aaaaagactcatgtcatgcc

SEQ ID NO: 81135 - DNA, 20 bp, Artificial
  CRISPR gRNA sequence
atgtcatgcctgtagttgtt

SEQ ID NO: 81136 - DNA, 20 bp, Artificial
  CRISPR gRNA sequence
tagttgttttaagaaccaag

SEQ ID NO: 81137 - DNA, 20 bp, Artificial
  CRISPR gRNA sequence
ttttaagaaccaaggtgtaa

SEQ ID NO: 81138 - DNA, 20 bp, Artificial
  CRISPR gRNA sequence
taagaaccaaggtgtaattg

SEQ ID NO: 81139 - DNA, 20 bp, Artificial
  CRISPR gRNA sequence
aagaaccaaggtgtaattga

SEQ ID NO: 81140 - DNA, 20 bp, Artificial
  CRISPR gRNA sequence
agaaccaaggtgtaattgac

SEQ ID NO: 81141 - DNA, 20 bp, Artificial
  CRISPR gRNA sequence
acagtactttttcttttttt

SEQ ID NO: 81142 - DNA, 20 bp, Artificial
  CRISPR gRNA sequence
tttctttttttctactccag

SEQ ID NO: 81143 - DNA, 20 bp, Artificial
  CRISPR gRNA sequence
ttctttttttctactccagg

SEQ ID NO: 81144 - DNA, 20 bp, Artificial
  CRISPR gRNA sequence
tctttttttctactccaggg

SEQ ID NO: 81145 - DNA, 20 bp, Artificial
  CRISPR gRNA sequence
ctttttttctactccaggga

SEQ ID NO: 81146 - DNA, 20 bp, Artificial
  CRISPR gRNA sequence
tttttttctactccagggac

SEQ ID NO: 81147 - DNA, 20 bp, Artificial
  CRISPR gRNA sequence
tttttctactccagggacca

SEQ ID NO: 81148 - DNA, 20 bp, Artificial
  CRISPR gRNA sequence
ttttctactccagggaccag

SEQ ID NO: 81149 - DNA, 20 bp, Artificial
  CRISPR gRNA sequence
tttctactccagggaccaga

SEQ ID NO: 81150 - DNA, 20 bp, Artificial
  CRISPR gRNA sequence
ttctactccagggaccagaa

SEQ ID NO: 81151 - DNA, 20 bp, Artificial
  CRISPR gRNA sequence
tctactccagggaccagaaa

SEQ ID NO: 81152 - DNA, 20 bp, Artificial
  CRISPR gRNA sequence
ctactccagggaccagaaat

SEQ ID NO: 81153 - DNA, 20 bp, Artificial
  CRISPR gRNA sequence
tactccagggaccagaaata

SEQ ID NO: 81154 - DNA, 20 bp, Artificial
  CRISPR gRNA sequence
ctccagggaccagaaatatt

SEQ ID NO: 81155 - DNA, 20 bp, Artificial
  CRISPR gRNA sequence
cagggaccagaaatattgca

SEQ ID NO: 81156 - DNA, 20 bp, Artificial
  CRISPR gRNA sequence
caaatcatggctaccctgtt

SEQ ID NO: 81157 - DNA, 20 bp, Artificial
  CRISPR gRNA sequence
ccctgttagcctgagtgtgg

SEQ ID NO: 81158 - DNA, 20 bp, Artificial
  CRISPR gRNA sequence
ttagcctgagtgtgggagac

SEQ ID NO: 81159 - DNA, 20 bp, Artificial
  CRISPR gRNA sequence
gcctgagtgtgggagacagg

SEQ ID NO: 81160 - DNA, 20 bp, Artificial
  CRISPR gRNA sequence
agtgtgggagacaggatgat

SEQ ID NO: 81161 - DNA, 20 bp, Artificial
  CRISPR gRNA sequence
ttgttgccatgagtcactgg

SEQ ID NO: 81162 - DNA, 20 bp, Artificial
  CRISPR gRNA sequence
tgttgccatgagtcactggg

SEQ ID NO: 81163 - DNA, 20 bp, Artificial
  CRISPR gRNA sequence
gttgccatgagtcactggga

SEQ ID NO: 81164 - DNA, 20 bp, Artificial
  CRISPR gRNA sequence
ttgccatgagtcactgggac

SEQ ID NO: 81165 - DNA, 20 bp, Artificial
  CRISPR gRNA sequence
ccatgagtcactgggacttt

SEQ ID NO: 81166 - DNA, 20 bp, Artificial
  CRISPR gRNA sequence
ggactttggagggtgcatgt

SEQ ID NO: 81167 - DNA, 20 bp, Artificial
  CRISPR gRNA sequence
tggagggtgcatgtactaca

SEQ ID NO: 81168 - DNA, 20 bp, Artificial
  CRISPR gRNA sequence
ggagggtgcatgtactacag

SEQ ID NO: 81169 - DNA, 20 bp, Artificial
  CRISPR gRNA sequence
gagggtgcatgtactacagt

SEQ ID NO: 81170 - DNA, 20 bp, Artificial
  CRISPR gRNA sequence
cagtgtaacctggcctatcc

SEQ ID NO: 81171 - DNA, 20 bp, Artificial
  CRISPR gRNA sequence
gcctatcctagctgatacac

SEQ ID NO: 81172 - DNA, 20 bp, Artificial
  CRISPR gRNA sequence
tcctagctgatacactcata

SEQ ID NO: 81173 - DNA, 20 bp, Artificial
  CRISPR gRNA sequence
gctgatacactcatagtgtg

SEQ ID NO: 81174 - DNA, 20 bp, Artificial
  CRISPR gRNA sequence
atacactcatagtgtgacct

SEQ ID NO: 81175 - DNA, 20 bp, Artificial
  CRISPR gRNA sequence
atagtgtgaccttgagcaag

SEQ ID NO: 81176 - DNA, 20 bp, Artificial
  CRISPR gRNA sequence
gagcaagcctttttcctata

SEQ ID NO: 81177 - DNA, 20 bp, Artificial
  CRISPR gRNA sequence
agcaagcctttttcctatat

SEQ ID NO: 81178 - DNA, 20 bp, Artificial
  CRISPR gRNA sequence
tttcctatataagcctcagt

SEQ ID NO: 81179 - DNA, 20 bp, Artificial
  CRISPR gRNA sequence
ttcctatataagcctcagtc

SEQ ID NO: 81180 - DNA, 20 bp, Artificial
  CRISPR gRNA sequence
tcctatataagcctcagtca

SEQ ID NO: 81181 - DNA, 20 bp, Artificial
  CRISPR gRNA sequence
cctatataagcctcagtcat

SEQ ID NO: 81182 - DNA, 20 bp, Artificial
  CRISPR gRNA sequence
ctatataagcctcagtcata

SEQ ID NO: 81183 - DNA, 20 bp, Artificial
  CRISPR gRNA sequence
tataagcctcagtcatacca

SEQ ID NO: 81184 - DNA, 20 bp, Artificial
  CRISPR gRNA sequence
agtcataccatctctaaaat

SEQ ID NO: 81185 - DNA, 20 bp, Artificial
  CRISPR gRNA sequence
taaaatgggtagattagatg

SEQ ID NO: 81186 - DNA, 20 bp, Artificial
  CRISPR gRNA sequence
aaatgggtagattagatgct

SEQ ID NO: 81187 - DNA, 20 bp, Artificial
  CRISPR gRNA sequence
gatgctgtctcaaaactctt

SEQ ID NO: 81188 - DNA, 20 bp, Artificial
  CRISPR gRNA sequence
tctcaaaactcttcctgatt

SEQ ID NO: 81189 - DNA, 20 bp, Artificial
  CRISPR gRNA sequence
aaaactcttcctgattttct

SEQ ID NO: 81190 - DNA, 20 bp, Artificial
  CRISPR gRNA sequence
ttcctgattttctgtgtctg

SEQ ID NO: 81191 - DNA, 20 bp, Artificial
  CRISPR gRNA sequence
cctgattttctgtgtctgat

SEQ ID NO: 81192 - DNA, 20 bp, Artificial
  CRISPR gRNA sequence
ctgattttctgtgtctgatc

SEQ ID NO: 81193 - DNA, 20 bp, Artificial
  CRISPR gRNA sequence
attttctgtgtctgatcatt

SEQ ID NO: 81194 - DNA, 20 bp, Artificial
  CRISPR gRNA sequence
tctgtgtctgatcattacat

SEQ ID NO: 81195 - DNA, 20 bp, Artificial
  CRISPR gRNA sequence
ctgtgtctgatcattacatt

SEQ ID NO: 81196 - DNA, 20 bp, Artificial
  CRISPR gRNA sequence
tgtgtctgatcattacattc

SEQ ID NO: 81197 - DNA, 20 bp, Artificial
  CRISPR gRNA sequence
tgtctgatcattacattctc

SEQ ID NO: 81198 - DNA, 20 bp, Artificial
  CRISPR gRNA sequence
atcattacattctcatgctg

SEQ ID NO: 81199 - DNA, 20 bp, Artificial
  CRISPR gRNA sequence
cattctcatgctgaatgatg

SEQ ID NO: 81200 - DNA, 20 bp, Artificial
  CRISPR gRNA sequence
tcatgctgaatgatggtcaa

SEQ ID NO: 81201 - DNA, 20 bp, Artificial
  CRISPR gRNA sequence
atgctgaatgatggtcaagg

SEQ ID NO: 81202 - DNA, 20 bp, Artificial
  CRISPR gRNA sequence
aatgatggtcaagggcaggt

SEQ ID NO: 81203 - DNA, 20 bp, Artificial
  CRISPR gRNA sequence
gttgtgttgggggcagccca

SEQ ID NO: 81204 - DNA, 20 bp, Artificial
  CRISPR gRNA sequence
ttgtgttgggggcagcccag

SEQ ID NO: 81205 - DNA, 20 bp, Artificial
  CRISPR gRNA sequence
tgttgggggcagcccagtaa

SEQ ID NO: 81206 - DNA, 20 bp, Artificial
  CRISPR gRNA sequence
ggggcagcccagtaaggcag

SEQ ID NO: 81207 - DNA, 20 bp, Artificial
  CRISPR gRNA sequence
gggtagggaccagtcttggc

SEQ ID NO: 81208 - DNA, 20 bp, Artificial
  CRISPR gRNA sequence
ggtagggaccagtcttggca

SEQ ID NO: 81209 - DNA, 20 bp, Artificial
  CRISPR gRNA sequence
ggcagtaggagaaaagtgac

SEQ ID NO: 81210 - DNA, 20 bp, Artificial
  CRISPR gRNA sequence
gcagtaggagaaaagtgacg

SEQ ID NO: 81211 - DNA, 20 bp, Artificial
  CRISPR gRNA sequence
cttggtctcctcgttcatga

SEQ ID NO: 81212 - DNA, 20 bp, Artificial
  CRISPR gRNA sequence
ggtctcctcgttcatgatag

SEQ ID NO: 81213 - DNA, 20 bp, Artificial
  CRISPR gRNA sequence
gtctcctcgttcatgatagg

SEQ ID NO: 81214 - DNA, 20 bp, Artificial
  CRISPR gRNA sequence
ctcgttcatgataggtgctc

SEQ ID NO: 81215 - DNA, 20 bp, Artificial
  CRISPR gRNA sequence
gttcatgataggtgctctag

SEQ ID NO: 81216 - DNA, 20 bp, Artificial
  CRISPR gRNA sequence
atgataggtgctctagggtc

SEQ ID NO: 81217 - DNA, 20 bp, Artificial
  CRISPR gRNA sequence
tagggtccccacggagaggg

SEQ ID NO: 81218 - DNA, 20 bp, Artificial
  CRISPR gRNA sequence
gggtccccacggagagggtc

SEQ ID NO: 81219 - DNA, 20 bp, Artificial
  CRISPR gRNA sequence
atgggtgtctgggctatgtg

SEQ ID NO: 81220 - DNA, 20 bp, Artificial
  CRISPR gRNA sequence
ggctatgtgtgccttgagct

SEQ ID NO: 81221 - DNA, 20 bp, Artificial
  CRISPR gRNA sequence
tgtgtgccttgagctggatt

SEQ ID NO: 81222 - DNA, 20 bp, Artificial
  CRISPR gRNA sequence
gagctggattgacaggttgt

SEQ ID NO: 81223 - DNA, 20 bp, Artificial
  CRISPR gRNA sequence
agctggattgacaggttgtt

SEQ ID NO: 81224 - DNA, 20 bp, Artificial
  CRISPR gRNA sequence
gattgacaggttgtttccat

SEQ ID NO: 81225 - DNA, 20 bp, Artificial
  CRISPR gRNA sequence
acaggttgtttccatagtgc

SEQ ID NO: 81226 - DNA, 20 bp, Artificial
  CRISPR gRNA sequence
tttccatagtgcagactcct

SEQ ID NO: 81227 - DNA, 20 bp, Artificial
  CRISPR gRNA sequence
ccatagtgcagactcctaag

SEQ ID NO: 81228 - DNA, 20 bp, Artificial
  CRISPR gRNA sequence
catagtgcagactcctaagg

SEQ ID NO: 81229 - DNA, 20 bp, Artificial
  CRISPR gRNA sequence
ctaaggggagagaagacagg

SEQ ID NO: 81230 - DNA, 20 bp, Artificial
  CRISPR gRNA sequence
aggggagagaagacagggag

SEQ ID NO: 81231 - DNA, 20 bp, Artificial
  CRISPR gRNA sequence
tccccactattccagactcc

SEQ ID NO: 81232 - DNA, 20 bp, Artificial
  CRISPR gRNA sequence
ccccactattccagactcca

SEQ ID NO: 81233 - DNA, 20 bp, Artificial
  CRISPR gRNA sequence
cccactattccagactccaa

SEQ ID NO: 81234 - DNA, 20 bp, Artificial
  CRISPR gRNA sequence
ttccagactccaaaaggaat

SEQ ID NO: 81235 - DNA, 20 bp, Artificial
  CRISPR gRNA sequence
cagactccaaaaggaatgct

SEQ ID NO: 81236 - DNA, 20 bp, Artificial
  CRISPR gRNA sequence
caaaaggaatgctgtaaacc

SEQ ID NO: 81237 - DNA, 20 bp, Artificial
  CRISPR gRNA sequence
taaaccaggcaccagccctt

SEQ ID NO: 81238 - DNA, 20 bp, Artificial
  CRISPR gRNA sequence
gcccctgcctgccggagaca

SEQ ID NO: 81239 - DNA, 20 bp, Artificial
  CRISPR gRNA sequence
cccctgcctgccggagacac

SEQ ID NO: 81240 - DNA, 20 bp, Artificial
  CRISPR gRNA sequence
gaaagtccctctctctaacc

SEQ ID NO: 81241 - DNA, 20 bp, Artificial
  CRISPR gRNA sequence
ctaacctggcactgcgtcgc

SEQ ID NO: 81242 - DNA, 20 bp, Artificial
  CRISPR gRNA sequence
ctggcactgcgtcgctggct

SEQ ID NO: 81243 - DNA, 20 bp, Artificial
  CRISPR gRNA sequence
ggcactgcgtcgctggcttg

SEQ ID NO: 81244 - DNA, 20 bp, Artificial
  CRISPR gRNA sequence
ctgcgtcgctggcttggaga

SEQ ID NO: 81245 - DNA, 20 bp, Artificial
  CRISPR gRNA sequence
tgcgtcgctggcttggagac

SEQ ID NO: 81246 - DNA, 20 bp, Artificial
  CRISPR gRNA sequence
gctggcttggagacaggtga

SEQ ID NO: 81247 - DNA, 20 bp, Artificial
  CRISPR gRNA sequence
gagacaggtgacggtccctg

SEQ ID NO: 81248 - DNA, 20 bp, Artificial
  CRISPR gRNA sequence
agacaggtgacggtccctgc

SEQ ID NO: 81249 - DNA, 20 bp, Artificial
  CRISPR gRNA sequence
cctgcgggccttgtcctgat

SEQ ID NO: 81250 - DNA, 20 bp, Artificial
  CRISPR gRNA sequence
cgggccttgtcctgattggc

SEQ ID NO: 81251 - DNA, 20 bp, Artificial
  CRISPR gRNA sequence
gggccttgtcctgattggct

SEQ ID NO: 81252 - DNA, 20 bp, Artificial
  CRISPR gRNA sequence
gctgggcacgcgtttaatat

SEQ ID NO: 81253 - DNA, 20 bp, Artificial
  CRISPR gRNA sequence
gggcacgcgtttaatataag

SEQ ID NO: 81254 - DNA, 20 bp, Artificial
  CRISPR gRNA sequence
gcacgcgtttaatataagtg

SEQ ID NO: 81255 - DNA, 20 bp, Artificial
  CRISPR gRNA sequence
cacgcgtttaatataagtgg

SEQ ID NO: 81256 - DNA, 20 bp, Artificial
  CRISPR gRNA sequence
tataagtggaggcgtcgcgc

SEQ ID NO: 81257 - DNA, 20 bp, Artificial
  CRISPR gRNA sequence
aagtggaggcgtcgcgctgg

SEQ ID NO: 81258 - DNA, 20 bp, Artificial
  CRISPR gRNA sequence
agtggaggcgtcgcgctggc

SEQ ID NO: 81259 - DNA, 20 bp, Artificial
  CRISPR gRNA sequence
cgcgctggcgggcattcctg

SEQ ID NO: 81260 - DNA, 20 bp, Artificial
  CRISPR gRNA sequence
gcgggcattcctgaagctga

SEQ ID NO: 81261 - DNA, 20 bp, Artificial
  CRISPR gRNA sequence
ttcctgaagctgacagcatt

SEQ ID NO: 81262 - DNA, 20 bp, Artificial
  CRISPR gRNA sequence
tcctgaagctgacagcattc

SEQ ID NO: 81263 - DNA, 20 bp, Artificial
  CRISPR gRNA sequence
aagctgacagcattcgggcc

SEQ ID NO: 81264 - DNA, 20 bp, Artificial
  CRISPR gRNA sequence
ggccgagatgtctcgctccg

SEQ ID NO: 81265 - DNA, 20 bp, Artificial
  CRISPR gRNA sequence
gatgtctcgctccgtggcct

SEQ ID NO: 81266 - DNA, 20 bp, Artificial
  CRISPR gRNA sequence
ctcgcgctactctctctttc

SEQ ID NO: 81267 - DNA, 20 bp, Artificial
  CRISPR gRNA sequence
gctactctctctttctggcc

SEQ ID NO: 81268 - DNA, 20 bp, Artificial
  CRISPR gRNA sequence
tactctctctttctggcctg

SEQ ID NO: 81269 - DNA, 20 bp, Artificial
  CRISPR gRNA sequence
actctctctttctggcctgg

SEQ ID NO: 81270 - DNA, 20 bp, Artificial
  CRISPR gRNA sequence
tttctggcctggaggctatc

SEQ ID NO: 81271 - DNA, 20 bp, Artificial
  CRISPR gRNA sequence
gcctggaggctatccagcgt

SEQ ID NO: 81272 - DNA, 20 bp, Artificial
  CRISPR gRNA sequence
tctctcctaccctcccgctc

SEQ ID NO: 81273 - DNA, 20 bp, Artificial
  CRISPR gRNA sequence
ctcccgctctgcaccctctg

SEQ ID NO: 81274 - DNA, 20 bp, Artificial
  CRISPR gRNA sequence
ctccgtgacttcccttctcc

SEQ ID NO: 81275 - DNA, 20 bp, Artificial
  CRISPR gRNA sequence
tcccttctccaagttctcct

SEQ ID NO: 81276 - DNA, 20 bp, Artificial
  CRISPR gRNA sequence
cttctccaagttctccttgg

SEQ ID NO: 81277 - DNA, 20 bp, Artificial
  CRISPR gRNA sequence
ttctccttggtggcccgccg

SEQ ID NO: 81278 - DNA, 20 bp, Artificial
  CRISPR gRNA sequence
tctccttggtggcccgccgt

SEQ ID NO: 81279 - DNA, 20 bp, Artificial
  CRISPR gRNA sequence
ctccttggtggcccgccgtg

SEQ ID NO: 81280 - DNA, 20 bp, Artificial
  CRISPR gRNA sequence
ttggtggcccgccgtggggc

SEQ ID NO: 81281 - DNA, 20 bp, Artificial
  CRISPR gRNA sequence
ggcccgccgtggggctagtc

SEQ ID NO: 81282 - DNA, 20 bp, Artificial
  CRISPR gRNA sequence
gcccgccgtggggctagtcc

SEQ ID NO: 81283 - DNA, 20 bp, Artificial
  CRISPR gRNA sequence
cccgccgtggggctagtcca

SEQ ID NO: 81284 - DNA, 20 bp, Artificial
  CRISPR gRNA sequence
ccgtggggctagtccagggc

SEQ ID NO: 81285 - DNA, 20 bp, Artificial
  CRISPR gRNA sequence
gctagtccagggctggatct

SEQ ID NO: 81286 - DNA, 20 bp, Artificial
  CRISPR gRNA sequence
ctagtccagggctggatctc

SEQ ID NO: 81287 - DNA, 20 bp, Artificial
  CRISPR gRNA sequence
tagtccagggctggatctcg

SEQ ID NO: 81288 - DNA, 20 bp, Artificial
  CRISPR gRNA sequence
tccagggctggatctcgggg

SEQ ID NO: 81289 - DNA, 20 bp, Artificial
  CRISPR gRNA sequence
agggctggatctcggggaag

SEQ ID NO: 81290 - DNA, 20 bp, Artificial
  CRISPR gRNA sequence
gctggatctcggggaagcgg

SEQ ID NO: 81291 - DNA, 20 bp, Artificial
  CRISPR gRNA sequence
ctggatctcggggaagcggc

SEQ ID NO: 81292 - DNA, 20 bp, Artificial
  CRISPR gRNA sequence
tggatctcggggaagcggcg

SEQ ID NO: 81293 - DNA, 20 bp, Artificial
  CRISPR gRNA sequence
atctcggggaagcggcgggg

SEQ ID NO: 81294 - DNA, 20 bp, Artificial
  CRISPR gRNA sequence
ggggaagcggcggggtggcc

SEQ ID NO: 81295 - DNA, 20 bp, Artificial
  CRISPR gRNA sequence
gggaagcggcggggtggcct

SEQ ID NO: 81296 - DNA, 20 bp, Artificial
  CRISPR gRNA sequence
gaagcggcggggtggcctgg

SEQ ID NO: 81297 - DNA, 20 bp, Artificial
  CRISPR gRNA sequence
gcggcggggtggcctgggag

SEQ ID NO: 81298 - DNA, 20 bp, Artificial
  CRISPR gRNA sequence
cggcggggtggcctgggagt

SEQ ID NO: 81299 - DNA, 20 bp, Artificial
  CRISPR gRNA sequence
ggcggggtggcctgggagtg

SEQ ID NO: 81300 - DNA, 20 bp, Artificial
  CRISPR gRNA sequence
ggggtggcctgggagtgggg

SEQ ID NO: 81301 - DNA, 20 bp, Artificial
  CRISPR gRNA sequence
gggtggcctgggagtgggga

SEQ ID NO: 81302 - DNA, 20 bp, Artificial
  CRISPR gRNA sequence
ggtggcctgggagtggggaa

SEQ ID NO: 81303 - DNA, 20 bp, Artificial
  CRISPR gRNA sequence
gtggcctgggagtggggaag

SEQ ID NO: 81304 - DNA, 20 bp, Artificial
  CRISPR gRNA sequence
tggcctgggagtggggaagg

SEQ ID NO: 81305 - DNA, 20 bp, Artificial
  CRISPR gRNA sequence
tggggaagggggtgcgcacc

SEQ ID NO: 81306 - DNA, 20 bp, Artificial
  CRISPR gRNA sequence
ggggaagggggtgcgcaccc

SEQ ID NO: 81307 - DNA, 20 bp, Artificial
  CRISPR gRNA sequence
cgcgcgctacttgccccttt

SEQ ID NO: 81308 - DNA, 20 bp, Artificial
  CRISPR gRNA sequence
gcgctacttgcccctttcgg

SEQ ID NO: 81309 - DNA, 20 bp, Artificial
  CRISPR gRNA sequence
cgctacttgcccctttcggc

SEQ ID NO: 81310 - DNA, 20 bp, Artificial
  CRISPR gRNA sequence
gctacttgcccctttcggcg

SEQ ID NO: 81311 - DNA, 20 bp, Artificial
  CRISPR gRNA sequence
tacttgcccctttcggcggg

SEQ ID NO: 81312 - DNA, 20 bp, Artificial
  CRISPR gRNA sequence
ttgcccctttcggcggggag

SEQ ID NO: 81313 - DNA, 20 bp, Artificial
  CRISPR gRNA sequence
tgcccctttcggcggggagc

SEQ ID NO: 81314 - DNA, 20 bp, Artificial
  CRISPR gRNA sequence
gcccctttcggcggggagca

SEQ ID NO: 81315 - DNA, 20 bp, Artificial
  CRISPR gRNA sequence
cccctttcggcggggagcag

SEQ ID NO: 81316 - DNA, 20 bp, Artificial
  CRISPR gRNA sequence
cctttcggcggggagcaggg

SEQ ID NO: 81317 - DNA, 20 bp, Artificial
  CRISPR gRNA sequence
cggggagcaggggagacctt

SEQ ID NO: 81318 - DNA, 20 bp, Artificial
  CRISPR gRNA sequence
caggggagacctttggccta

SEQ ID NO: 81319 - DNA, 20 bp, Artificial
  CRISPR gRNA sequence
agacctttggcctacggcga

SEQ ID NO: 81320 - DNA, 20 bp, Artificial
  CRISPR gRNA sequence
gacctttggcctacggcgac

SEQ ID NO: 81321 - DNA, 20 bp, Artificial
  CRISPR gRNA sequence
cctttggcctacggcgacgg

SEQ ID NO: 81322 - DNA, 20 bp, Artificial
  CRISPR gRNA sequence
ctttggcctacggcgacggg

SEQ ID NO: 81323 - DNA, 20 bp, Artificial
  CRISPR gRNA sequence
tttggcctacggcgacggga

SEQ ID NO: 81324 - DNA, 20 bp, Artificial
  CRISPR gRNA sequence
gcctacggcgacgggagggt

SEQ ID NO: 81325 - DNA, 20 bp, Artificial
  CRISPR gRNA sequence
cctacggcgacgggagggtc

SEQ ID NO: 81326 - DNA, 20 bp, Artificial
  CRISPR gRNA sequence
gcgacgggagggtcgggaca

SEQ ID NO: 81327 - DNA, 20 bp, Artificial
  CRISPR gRNA sequence
gggagggtcgggacaaagtt

SEQ ID NO: 81328 - DNA, 20 bp, Artificial
  CRISPR gRNA sequence
ggagggtcgggacaaagttt

SEQ ID NO: 81329 - DNA, 20 bp, Artificial
  CRISPR gRNA sequence
gagggtcgggacaaagttta

SEQ ID NO: 81330 - DNA, 20 bp, Artificial
  CRISPR gRNA sequence
acaaagtttagggcgtcgat

SEQ ID NO: 81331 - DNA, 20 bp, Artificial
  CRISPR gRNA sequence
tttagggcgtcgataagcgt

SEQ ID NO: 81332 - DNA, 20 bp, Artificial
  CRISPR gRNA sequence
tagggcgtcgataagcgtca

SEQ ID NO: 81333 - DNA, 20 bp, Artificial
  CRISPR gRNA sequence
tcgataagcgtcagagcgcc

SEQ ID NO: 81334 - DNA, 20 bp, Artificial
  CRISPR gRNA sequence
cgataagcgtcagagcgccg

SEQ ID NO: 81335 - DNA, 20 bp, Artificial
  CRISPR gRNA sequence
aagcgtcagagcgccgaggt

SEQ ID NO: 81336 - DNA, 20 bp, Artificial
  CRISPR gRNA sequence
agcgtcagagcgccgaggtt

SEQ ID NO: 81337 - DNA, 20 bp, Artificial
  CRISPR gRNA sequence
gcgtcagagcgccgaggttg

SEQ ID NO: 81338 - DNA, 20 bp, Artificial
  CRISPR gRNA sequence
cgtcagagcgccgaggttgg

SEQ ID NO: 81339 - DNA, 20 bp, Artificial
  CRISPR gRNA sequence
tcagagcgccgaggttgggg

SEQ ID NO: 81340 - DNA, 20 bp, Artificial
  CRISPR gRNA sequence
cagagcgccgaggttggggg

SEQ ID NO: 81341 - DNA, 20 bp, Artificial
  CRISPR gRNA sequence
agagcgccgaggttggggga

SEQ ID NO: 81342 - DNA, 20 bp, Artificial
  CRISPR gRNA sequence
gtttctcttccgctctttcg

SEQ ID NO: 81343 - DNA, 20 bp, Artificial
  CRISPR gRNA sequence
tttctcttccgctctttcgc

SEQ ID NO: 81344 - DNA, 20 bp, Artificial
  CRISPR gRNA sequence
ttctcttccgctctttcgcg

SEQ ID NO: 81345 - DNA, 20 bp, Artificial
  CRISPR gRNA sequence
ccgctctttcgcggggcctc

SEQ ID NO: 81346 - DNA, 20 bp, Artificial
  CRISPR gRNA sequence
cgcggggcctctggctcccc

SEQ ID NO: 81347 - DNA, 20 bp, Artificial
  CRISPR gRNA sequence
ggcctctggctcccccagcg

SEQ ID NO: 81348 - DNA, 20 bp, Artificial
  CRISPR gRNA sequence
tctggctcccccagcgcagc

SEQ ID NO: 81349 - DNA, 20 bp, Artificial
  CRISPR gRNA sequence
tggctcccccagcgcagctg

SEQ ID NO: 81350 - DNA, 20 bp, Artificial
  CRISPR gRNA sequence
ctcccccagcgcagctggag

SEQ ID NO: 81351 - DNA, 20 bp, Artificial
  CRISPR gRNA sequence
tcccccagcgcagctggagt

SEQ ID NO: 81352 - DNA, 20 bp, Artificial
  CRISPR gRNA sequence
cccccagcgcagctggagtg

SEQ ID NO: 81353 - DNA, 20 bp, Artificial
  CRISPR gRNA sequence
ccccagcgcagctggagtgg

SEQ ID NO: 81354 - DNA, 20 bp, Artificial
  CRISPR gRNA sequence
agcgcagctggagtggggga

SEQ ID NO: 81355 - DNA, 20 bp, Artificial
  CRISPR gRNA sequence
gcgcagctggagtgggggac

SEQ ID NO: 81356 - DNA, 20 bp, Artificial
  CRISPR gRNA sequence
cagctggagtgggggacggg

SEQ ID NO: 81357 - DNA, 20 bp, Artificial
  CRISPR gRNA sequence
agctggagtgggggacgggt

SEQ ID NO: 81358 - DNA, 20 bp, Artificial
  CRISPR gRNA sequence
ggacgggtaggctcgtccca

SEQ ID NO: 81359 - DNA, 20 bp, Artificial
  CRISPR gRNA sequence
gacgggtaggctcgtcccaa

SEQ ID NO: 81360 - DNA, 20 bp, Artificial
  CRISPR gRNA sequence
gtaggctcgtcccaaaggcg

SEQ ID NO: 81361 - DNA, 20 bp, Artificial
  CRISPR gRNA sequence
cgtcccaaaggcgcggcgct

SEQ ID NO: 81362 - DNA, 20 bp, Artificial
  CRISPR gRNA sequence
gtcccaaaggcgcggcgctg

SEQ ID NO: 81363 - DNA, 20 bp, Artificial
  CRISPR gRNA sequence
cgctgaggtttgtgaacgcg

SEQ ID NO: 81364 - DNA, 20 bp, Artificial
  CRISPR gRNA sequence
ctgaggtttgtgaacgcgtg

SEQ ID NO: 81365 - DNA, 20 bp, Artificial
  CRISPR gRNA sequence
tgaggtttgtgaacgcgtgg

SEQ ID NO: 81366 - DNA, 20 bp, Artificial
  CRISPR gRNA sequence
gaggtttgtgaacgcgtgga

SEQ ID NO: 81367 - DNA, 20 bp, Artificial
  CRISPR gRNA sequence
aggtttgtgaacgcgtggag

SEQ ID NO: 81368 - DNA, 20 bp, Artificial
  CRISPR gRNA sequence
tgaacgcgtggaggggcgct

SEQ ID NO: 81369 - DNA, 20 bp, Artificial
  CRISPR gRNA sequence
gaacgcgtggaggggcgctt

SEQ ID NO: 81370 - DNA, 20 bp, Artificial
  CRISPR gRNA sequence
aacgcgtggaggggcgcttg

SEQ ID NO: 81371 - DNA, 20 bp, Artificial
  CRISPR gRNA sequence
gtggaggggcgcttggggtc

SEQ ID NO: 81372 - DNA, 20 bp, Artificial
  CRISPR gRNA sequence
tggaggggcgcttggggtct

SEQ ID NO: 81373 - DNA, 20 bp, Artificial
  CRISPR gRNA sequence
ggaggggcgcttggggtctg

SEQ ID NO: 81374 - DNA, 20 bp, Artificial
  CRISPR gRNA sequence
gaggggcgcttggggtctgg

SEQ ID NO: 81375 - DNA, 20 bp, Artificial
  CRISPR gRNA sequence
ggggcgcttggggtctgggg

SEQ ID NO: 81376 - DNA, 20 bp, Artificial
  CRISPR gRNA sequence
gggcgcttggggtctggggg

SEQ ID NO: 81377 - DNA, 20 bp, Artificial
  CRISPR gRNA sequence
ggtctgggggaggcgtcgcc

SEQ ID NO: 81378 - DNA, 20 bp, Artificial
  CRISPR gRNA sequence
gtctgggggaggcgtcgccc

SEQ ID NO: 81379 - DNA, 20 bp, Artificial
  CRISPR gRNA sequence
gggggaggcgtcgcccgggt

SEQ ID NO: 81380 - DNA, 20 bp, Artificial
  CRISPR gRNA sequence
ccgggtaagcctgtctgctg

SEQ ID NO: 81381 - DNA, 20 bp, Artificial
  CRISPR gRNA sequence
tgctgcggctctgcttccct

SEQ ID NO: 81382 - DNA, 20 bp, Artificial
  CRISPR gRNA sequence
cggctctgcttcccttagac

SEQ ID NO: 81383 - DNA, 20 bp, Artificial
  CRISPR gRNA sequence
gctctgcttcccttagactg

SEQ ID NO: 81384 - DNA, 20 bp, Artificial
  CRISPR gRNA sequence
tctgcttcccttagactgga

SEQ ID NO: 81385 - DNA, 20 bp, Artificial
  CRISPR gRNA sequence
tcccttagactggagagctg

SEQ ID NO: 81386 - DNA, 20 bp, Artificial
  CRISPR gRNA sequence
ggagagctgtggacttcgtc

SEQ ID NO: 81387 - DNA, 20 bp, Artificial
  CRISPR gRNA sequence
gagagctgtggacttcgtct

SEQ ID NO: 81388 - DNA, 20 bp, Artificial
  CRISPR gRNA sequence
acttcgtctaggcgcccgct

SEQ ID NO: 81389 - DNA, 20 bp, Artificial
  CRISPR gRNA sequence
cccgctaagttcgcatgtcc

SEQ ID NO: 81390 - DNA, 20 bp, Artificial
  CRISPR gRNA sequence
ttcgcatgtcctagcacctc

SEQ ID NO: 81391 - DNA, 20 bp, Artificial
  CRISPR gRNA sequence
tcgcatgtcctagcacctct

SEQ ID NO: 81392 - DNA, 20 bp, Artificial
  CRISPR gRNA sequence
ctagcacctctgggtctatg

SEQ ID NO: 81393 - DNA, 20 bp, Artificial
  CRISPR gRNA sequence
tagcacctctgggtctatgt

SEQ ID NO: 81394 - DNA, 20 bp, Artificial
  CRISPR gRNA sequence
agcacctctgggtctatgtg

SEQ ID NO: 81395 - DNA, 20 bp, Artificial
  CRISPR gRNA sequence
gtctatgtggggccacaccg

SEQ ID NO: 81396 - DNA, 20 bp, Artificial
  CRISPR gRNA sequence
tctatgtggggccacaccgt

SEQ ID NO: 81397 - DNA, 20 bp, Artificial
  CRISPR gRNA sequence
ctatgtggggccacaccgtg

SEQ ID NO: 81398 - DNA, 20 bp, Artificial
  CRISPR gRNA sequence
atgtggggccacaccgtggg

SEQ ID NO: 81399 - DNA, 20 bp, Artificial
  CRISPR gRNA sequence
tgtggggccacaccgtgggg

SEQ ID NO: 81400 - DNA, 20 bp, Artificial
  CRISPR gRNA sequence
gccacaccgtggggaggaaa

SEQ ID NO: 81401 - DNA, 20 bp, Artificial
  CRISPR gRNA sequence
gaaacagcacgcgacgtttg

SEQ ID NO: 81402 - DNA, 20 bp, Artificial
  CRISPR gRNA sequence
cgcgacgtttgtagaatgct

SEQ ID NO: 81403 - DNA, 20 bp, Artificial
  CRISPR gRNA sequence
gaatgcttggctgtgataca

SEQ ID NO: 81404 - DNA, 20 bp, Artificial
  CRISPR gRNA sequence
tgcttggctgtgatacaaag

SEQ ID NO: 81405 - DNA, 20 bp, Artificial
  CRISPR gRNA sequence
tgtcacttttaaaaaattat

SEQ ID NO: 81406 - DNA, 20 bp, Artificial
  CRISPR gRNA sequence
ttgacatctttctgtgtgcc

SEQ ID NO: 81407 - DNA, 20 bp, Artificial
  CRISPR gRNA sequence
tgacatctttctgtgtgcca

SEQ ID NO: 81408 - DNA, 20 bp, Artificial
  CRISPR gRNA sequence
gcgtcatttaattttgaaaa

SEQ ID NO: 81409 - DNA, 20 bp, Artificial
  CRISPR gRNA sequence
aaaacagttatcttccgcca

SEQ ID NO: 81410 - DNA, 20 bp, Artificial
  CRISPR gRNA sequence
tccgccatagataactacta

SEQ ID NO: 81411 - DNA, 20 bp, Artificial
  CRISPR gRNA sequence
tggttatcttctgcctctca

SEQ ID NO: 81412 - DNA, 20 bp, Artificial
  CRISPR gRNA sequence
tcttctgcctctcacagatg

SEQ ID NO: 81413 - DNA, 20 bp, Artificial
  CRISPR gRNA sequence
ctctcacagatgaagaaact

SEQ ID NO: 81414 - DNA, 20 bp, Artificial
  CRISPR gRNA sequence
tctcacagatgaagaaacta

SEQ ID NO: 81415 - DNA, 20 bp, Artificial
  CRISPR gRNA sequence
gatgaagaaactaaggcacc

SEQ ID NO: 81416 - DNA, 20 bp, Artificial
  CRISPR gRNA sequence
aactaaggcaccgagatttt

SEQ ID NO: 81417 - DNA, 20 bp, Artificial
  CRISPR gRNA sequence
ttttaagaaacttaattaca

SEQ ID NO: 81418 - DNA, 20 bp, Artificial
  CRISPR gRNA sequence
tttaagaaacttaattacac

SEQ ID NO: 81419 - DNA, 20 bp, Artificial
  CRISPR gRNA sequence
ttaagaaacttaattacaca

SEQ ID NO: 81420 - DNA, 20 bp, Artificial
  CRISPR gRNA sequence
taagaaacttaattacacag

SEQ ID NO: 81421 - DNA, 20 bp, Artificial
  CRISPR gRNA sequence
ttaattacacaggggataaa

SEQ ID NO: 81422 - DNA, 20 bp, Artificial
  CRISPR gRNA sequence
attacacaggggataaatgg

SEQ ID NO: 81423 - DNA, 20 bp, Artificial
  CRISPR gRNA sequence
ggggataaatggcagcaatc

SEQ ID NO: 81424 - DNA, 20 bp, Artificial
  CRISPR gRNA sequence
aatggcagcaatcgagattg

SEQ ID NO: 81425 - DNA, 20 bp, Artificial
  CRISPR gRNA sequence
cagcaatcgagattgaagtc

SEQ ID NO: 81426 - DNA, 20 bp, Artificial
  CRISPR gRNA sequence
agattgaagtcaagcctaac

SEQ ID NO: 81427 - DNA, 20 bp, Artificial
  CRISPR gRNA sequence
gattgaagtcaagcctaacc

SEQ ID NO: 81428 - DNA, 20 bp, Artificial
  CRISPR gRNA sequence
attgaagtcaagcctaacca

SEQ ID NO: 81429 - DNA, 20 bp, Artificial
  CRISPR gRNA sequence
aagcctaaccagggcttttg

SEQ ID NO: 81430 - DNA, 20 bp, Artificial
  CRISPR gRNA sequence
agcctaaccagggcttttgc

SEQ ID NO: 81431 - DNA, 20 bp, Artificial
  CRISPR gRNA sequence
cctaaccagggcttttgcgg

SEQ ID NO: 81432 - DNA, 20 bp, Artificial
  CRISPR gRNA sequence
ttgcgggagcgcatgccttt

SEQ ID NO: 81433 - DNA, 20 bp, Artificial
  CRISPR gRNA sequence
taattcgtgcattttttttt

SEQ ID NO: 81434 - DNA, 20 bp, Artificial
  CRISPR gRNA sequence
aaaacgcctgccttctgcgt

SEQ ID NO: 81435 - DNA, 20 bp, Artificial
  CRISPR gRNA sequence
gccttctgcgtgagattctc

SEQ ID NO: 81436 - DNA, 20 bp, Artificial
  CRISPR gRNA sequence
cttctgcgtgagattctcca

SEQ ID NO: 81437 - DNA, 20 bp, Artificial
  CRISPR gRNA sequence
tgagattctccagagcaaac

SEQ ID NO: 81438 - DNA, 20 bp, Artificial
  CRISPR gRNA sequence
gagattctccagagcaaact

SEQ ID NO: 81439 - DNA, 20 bp, Artificial
  CRISPR gRNA sequence
attctccagagcaaactggg

SEQ ID NO: 81440 - DNA, 20 bp, Artificial
  CRISPR gRNA sequence
ccagagcaaactgggcggca

SEQ ID NO: 81441 - DNA, 20 bp, Artificial
  CRISPR gRNA sequence
cagagcaaactgggcggcat

SEQ ID NO: 81442 - DNA, 20 bp, Artificial
  CRISPR gRNA sequence
actgggcggcatgggccctg

SEQ ID NO: 81443 - DNA, 20 bp, Artificial
  CRISPR gRNA sequence
ggccctgtggtcttttcgta

SEQ ID NO: 81444 - DNA, 20 bp, Artificial
  CRISPR gRNA sequence
ccctgtggtcttttcgtaca

SEQ ID NO: 81445 - DNA, 20 bp, Artificial
  CRISPR gRNA sequence
cctgtggtcttttcgtacag

SEQ ID NO: 81446 - DNA, 20 bp, Artificial
  CRISPR gRNA sequence
ctgtggtcttttcgtacaga

SEQ ID NO: 81447 - DNA, 20 bp, Artificial
  CRISPR gRNA sequence
cgtacagagggcttcctctt

SEQ ID NO: 81448 - DNA, 20 bp, Artificial
  CRISPR gRNA sequence
ttcctctttggctctttgcc

SEQ ID NO: 81449 - DNA, 20 bp, Artificial
  CRISPR gRNA sequence
ctctttgcctggttgtttcc

SEQ ID NO: 81450 - DNA, 20 bp, Artificial
  CRISPR gRNA sequence
tgtactgtgcctcttacttt

SEQ ID NO: 81451 - DNA, 20 bp, Artificial
  CRISPR gRNA sequence
actttcggttttgaaaacat

SEQ ID NO: 81452 - DNA, 20 bp, Artificial
  CRISPR gRNA sequence
ctttcggttttgaaaacatg

SEQ ID NO: 81453 - DNA, 20 bp, Artificial
  CRISPR gRNA sequence
tttcggttttgaaaacatga

SEQ ID NO: 81454 - DNA, 20 bp, Artificial
  CRISPR gRNA sequence
ttcggttttgaaaacatgag

SEQ ID NO: 81455 - DNA, 20 bp, Artificial
  CRISPR gRNA sequence
tcggttttgaaaacatgagg

SEQ ID NO: 81456 - DNA, 20 bp, Artificial
  CRISPR gRNA sequence
ttttgaaaacatgagggggt

SEQ ID NO: 81457 - DNA, 20 bp, Artificial
  CRISPR gRNA sequence
tttgaaaacatgagggggtt

SEQ ID NO: 81458 - DNA, 20 bp, Artificial
  CRISPR gRNA sequence
aaacatgagggggttgggcg

SEQ ID NO: 81459 - DNA, 20 bp, Artificial
  CRISPR gRNA sequence
catgagggggttgggcgtgg

SEQ ID NO: 81460 - DNA, 20 bp, Artificial
  CRISPR gRNA sequence
gtagcttacgcctgtaatcc

SEQ ID NO: 81461 - DNA, 20 bp, Artificial
  CRISPR gRNA sequence
acgcctgtaatcccagcact

SEQ ID NO: 81462 - DNA, 20 bp, Artificial
  CRISPR gRNA sequence
cgcctgtaatcccagcactt

SEQ ID NO: 81463 - DNA, 20 bp, Artificial
  CRISPR gRNA sequence
gcctgtaatcccagcactta

SEQ ID NO: 81464 - DNA, 20 bp, Artificial
  CRISPR gRNA sequence
ctgtaatcccagcacttagg

SEQ ID NO: 81465 - DNA, 20 bp, Artificial
  CRISPR gRNA sequence
tgtaatcccagcacttaggg

SEQ ID NO: 81466 - DNA, 20 bp, Artificial
  CRISPR gRNA sequence
tcccagcacttagggaggcc

SEQ ID NO: 81467 - DNA, 20 bp, Artificial
  CRISPR gRNA sequence
cccagcacttagggaggccg

SEQ ID NO: 81468 - DNA, 20 bp, Artificial
  CRISPR gRNA sequence
agcacttagggaggccgagg

SEQ ID NO: 81469 - DNA, 20 bp, Artificial
  CRISPR gRNA sequence
gcacttagggaggccgaggc

SEQ ID NO: 81470 - DNA, 20 bp, Artificial
  CRISPR gRNA sequence
acttagggaggccgaggcgg

SEQ ID NO: 81471 - DNA, 20 bp, Artificial
  CRISPR gRNA sequence
cttagggaggccgaggcggg

SEQ ID NO: 81472 - DNA, 20 bp, Artificial
  CRISPR gRNA sequence
gggaggccgaggcgggagga

SEQ ID NO: 81473 - DNA, 20 bp, Artificial
  CRISPR gRNA sequence
ccgaggcgggaggatggctt

SEQ ID NO: 81474 - DNA, 20 bp, Artificial
  CRISPR gRNA sequence
cgaggcgggaggatggcttg

SEQ ID NO: 81475 - DNA, 20 bp, Artificial
  CRISPR gRNA sequence
ggaggatggcttgaggtccg

SEQ ID NO: 81476 - DNA, 20 bp, Artificial
  CRISPR gRNA sequence
atggcttgaggtccgtagtt

SEQ ID NO: 81477 - DNA, 20 bp, Artificial
  CRISPR gRNA sequence
ttgaggtccgtagttgagac

SEQ ID NO: 81478 - DNA, 20 bp, Artificial
  CRISPR gRNA sequence
gtccgtagttgagaccagcc

SEQ ID NO: 81479 - DNA, 20 bp, Artificial
  CRISPR gRNA sequence
tgagaccagcctggccaaca

SEQ ID NO: 81480 - DNA, 20 bp, Artificial
  CRISPR gRNA sequence
ccagcctggccaacatggtg

SEQ ID NO: 81481 - DNA, 20 bp, Artificial
  CRISPR gRNA sequence
ctggccaacatggtgaagcc

SEQ ID NO: 81482 - DNA, 20 bp, Artificial
  CRISPR gRNA sequence
caaaaaataataacaaaaat

SEQ ID NO: 81483 - DNA, 20 bp, Artificial
  CRISPR gRNA sequence
aaataataacaaaaattagc

SEQ ID NO: 81484 - DNA, 20 bp, Artificial
  CRISPR gRNA sequence
aataataacaaaaattagcc

SEQ ID NO: 81485 - DNA, 20 bp, Artificial
  CRISPR gRNA sequence
taacaaaaattagccgggtg

SEQ ID NO: 81486 - DNA, 20 bp, Artificial
  CRISPR gRNA sequence
caaaaattagccgggtgtgg

SEQ ID NO: 81487 - DNA, 20 bp, Artificial
  CRISPR gRNA sequence
ggtgtggtggctcgtgcctg

SEQ ID NO: 81488 - DNA, 20 bp, Artificial
  CRISPR gRNA sequence
gtggctcgtgcctgtggtcc

SEQ ID NO: 81489 - DNA, 20 bp, Artificial
  CRISPR gRNA sequence
gcctgtggtcccagctgctc

SEQ ID NO: 81490 - DNA, 20 bp, Artificial
  CRISPR gRNA sequence
tgtggtcccagctgctccgg

SEQ ID NO: 81491 - DNA, 20 bp, Artificial
  CRISPR gRNA sequence
tcccagctgctccggtggct

SEQ ID NO: 81492 - DNA, 20 bp, Artificial
  CRISPR gRNA sequence
cccagctgctccggtggctg

SEQ ID NO: 81493 - DNA, 20 bp, Artificial
  CRISPR gRNA sequence
agctgctccggtggctgagg

SEQ ID NO: 81494 - DNA, 20 bp, Artificial
  CRISPR gRNA sequence
gctgctccggtggctgaggc

SEQ ID NO: 81495 - DNA, 20 bp, Artificial
  CRISPR gRNA sequence
tgctccggtggctgaggcgg

SEQ ID NO: 81496 - DNA, 20 bp, Artificial
  CRISPR gRNA sequence
gctccggtggctgaggcggg

SEQ ID NO: 81497 - DNA, 20 bp, Artificial
  CRISPR gRNA sequence
ctgaggcgggaggatctctt

SEQ ID NO: 81498 - DNA, 20 bp, Artificial
  CRISPR gRNA sequence
gcgggaggatctcttgagct

SEQ ID NO: 81499 - DNA, 20 bp, Artificial
  CRISPR gRNA sequence
cgggaggatctcttgagctt

SEQ ID NO: 81500 - DNA, 20 bp, Artificial
  CRISPR gRNA sequence
tctcttgagcttaggctttt

SEQ ID NO: 81501 - DNA, 20 bp, Artificial
  CRISPR gRNA sequence
cttaggcttttgagctatca

SEQ ID NO: 81502 - DNA, 20 bp, Artificial
  CRISPR gRNA sequence
cttttgagctatcatggcgc

SEQ ID NO: 81503 - DNA, 20 bp, Artificial
  CRISPR gRNA sequence
atcatggcgccagtgcactc

SEQ ID NO: 81504 - DNA, 20 bp, Artificial
  CRISPR gRNA sequence
ggcgccagtgcactccagcg

SEQ ID NO: 81505 - DNA, 20 bp, Artificial
  CRISPR gRNA sequence
gcgccagtgcactccagcgt

SEQ ID NO: 81506 - DNA, 20 bp, Artificial
  CRISPR gRNA sequence
gtgcactccagcgtgggcaa

SEQ ID NO: 81507 - DNA, 20 bp, Artificial
  CRISPR gRNA sequence
gcactccagcgtgggcaaca

SEQ ID NO: 81508 - DNA, 20 bp, Artificial
  CRISPR gRNA sequence
tccagcgtgggcaacagagc

SEQ ID NO: 81509 - DNA, 20 bp, Artificial
  CRISPR gRNA sequence
cgagaccctgtctctcaaaa

SEQ ID NO: 81510 - DNA, 20 bp, Artificial
  CRISPR gRNA sequence
aaaaaagaaaaaaaaaaaaa

SEQ ID NO: 81511 - DNA, 20 bp, Artificial
  CRISPR gRNA sequence
aagaaaaaaaaaaaaaaaga

SEQ ID NO: 81512 - DNA, 20 bp, Artificial
  CRISPR gRNA sequence
gaaaaaaaaaaaaaaagaaa

SEQ ID NO: 81513 - DNA, 20 bp, Artificial
  CRISPR gRNA sequence
aaaaaaaaaaagaaagagaa

SEQ ID NO: 81514 - DNA, 20 bp, Artificial
  CRISPR gRNA sequence
aaaaaagaaagagaaaagaa

SEQ ID NO: 81515 - DNA, 20 bp, Artificial
  CRISPR gRNA sequence
aagaaagagaaaagaaaaga

SEQ ID NO: 81516 - DNA, 20 bp, Artificial
  CRISPR gRNA sequence
aagagaaaagaaaagaaaga

SEQ ID NO: 81517 - DNA, 20 bp, Artificial
  CRISPR gRNA sequence
agaaaagaaaagaaagaaag

SEQ ID NO: 81518 - DNA, 20 bp, Artificial
  CRISPR gRNA sequence
agaaaagaaagaaagaagtg

SEQ ID NO: 81519 - DNA, 20 bp, Artificial
  CRISPR gRNA sequence
gaaaagaaagaaagaagtga

SEQ ID NO: 81520 - DNA, 20 bp, Artificial
  CRISPR gRNA sequence
agaaagaagtgaaggtttgt

SEQ ID NO: 81521 - DNA, 20 bp, Artificial
  CRISPR gRNA sequence
agaagtgaaggtttgtcagt

SEQ ID NO: 81522 - DNA, 20 bp, Artificial
  CRISPR gRNA sequence
gaagtgaaggtttgtcagtc

SEQ ID NO: 81523 - DNA, 20 bp, Artificial
  CRISPR gRNA sequence
aagtgaaggtttgtcagtca

SEQ ID NO: 81524 - DNA, 20 bp, Artificial
  CRISPR gRNA sequence
agtgaaggtttgtcagtcag

SEQ ID NO: 81525 - DNA, 20 bp, Artificial
  CRISPR gRNA sequence
tgaaggtttgtcagtcaggg

SEQ ID NO: 81526 - DNA, 20 bp, Artificial
  CRISPR gRNA sequence
gagctgtaaaaccattaata

SEQ ID NO: 81527 - DNA, 20 bp, Artificial
  CRISPR gRNA sequence
accattaataaagataatcc

SEQ ID NO: 81528 - DNA, 20 bp, Artificial
  CRISPR gRNA sequence
ttaataaagataatccaaga

SEQ ID NO: 81529 - DNA, 20 bp, Artificial
  CRISPR gRNA sequence
gataatccaagatggttacc

SEQ ID NO: 81530 - DNA, 20 bp, Artificial
  CRISPR gRNA sequence
agatggttaccaagactgtt

SEQ ID NO: 81531 - DNA, 20 bp, Artificial
  CRISPR gRNA sequence
gatggttaccaagactgttg

SEQ ID NO: 81532 - DNA, 20 bp, Artificial
  CRISPR gRNA sequence
accaagactgttgaggacgc

SEQ ID NO: 81533 - DNA, 20 bp, Artificial
  CRISPR gRNA sequence
caagactgttgaggacgcca

SEQ ID NO: 81534 - DNA, 20 bp, Artificial
  CRISPR gRNA sequence
ttgaggacgccagagatctt

SEQ ID NO: 81535 - DNA, 20 bp, Artificial
  CRISPR gRNA sequence
agagatcttgagcactttct

SEQ ID NO: 81536 - DNA, 20 bp, Artificial
  CRISPR gRNA sequence
ttgagcactttctaagtacc

SEQ ID NO: 81537 - DNA, 20 bp, Artificial
  CRISPR gRNA sequence
taagtacctggcaatacact

SEQ ID NO: 81538 - DNA, 20 bp, Artificial
  CRISPR gRNA sequence
agcgcgctcaccttttcctc

SEQ ID NO: 81539 - DNA, 20 bp, Artificial
  CRISPR gRNA sequence
ctctggcaaaacatgatcga

SEQ ID NO: 81540 - DNA, 20 bp, Artificial
  CRISPR gRNA sequence
tggcaaaacatgatcgaaag

SEQ ID NO: 81541 - DNA, 20 bp, Artificial
  CRISPR gRNA sequence
aagcagaatgttttgatcat

SEQ ID NO: 81542 - DNA, 20 bp, Artificial
  CRISPR gRNA sequence
tacaatttatttacaacata

SEQ ID NO: 81543 - DNA, 20 bp, Artificial
  CRISPR gRNA sequence
acaatttatttacaacataa

SEQ ID NO: 81544 - DNA, 20 bp, Artificial
  CRISPR gRNA sequence
gtatatatcaccaccattac

SEQ ID NO: 81545 - DNA, 20 bp, Artificial
  CRISPR gRNA sequence
ccaccattactggtatttgc

SEQ ID NO: 81546 - DNA, 20 bp, Artificial
  CRISPR gRNA sequence
ctggtatttgctggttatgt

SEQ ID NO: 81547 - DNA, 20 bp, Artificial
  CRISPR gRNA sequence
tcttattttgaaaatttcca

SEQ ID NO: 81548 - DNA, 20 bp, Artificial
  CRISPR gRNA sequence
aaagtaatacatgccatgca

SEQ ID NO: 81549 - DNA, 20 bp, Artificial
  CRISPR gRNA sequence
tgccatgcatagaccatttc

SEQ ID NO: 81550 - DNA, 20 bp, Artificial
  CRISPR gRNA sequence
catgcatagaccatttctgg

SEQ ID NO: 81551 - DNA, 20 bp, Artificial
  CRISPR gRNA sequence
ccatttctggaagataccac

SEQ ID NO: 81552 - DNA, 20 bp, Artificial
  CRISPR gRNA sequence
tgtaatgatgattgcctctg

SEQ ID NO: 81553 - DNA, 20 bp, Artificial
  CRISPR gRNA sequence
gtaatgatgattgcctctga

SEQ ID NO: 81554 - DNA, 20 bp, Artificial
  CRISPR gRNA sequence
ttcctcctctgacctgtgtg

SEQ ID NO: 81555 - DNA, 20 bp, Artificial
  CRISPR gRNA sequence
tcctcctctgacctgtgtgt

SEQ ID NO: 81556 - DNA, 20 bp, Artificial
  CRISPR gRNA sequence
gttttgtttttgttttactg

SEQ ID NO: 81557 - DNA, 20 bp, Artificial
  CRISPR gRNA sequence
ttttgtttttgttttactgt

SEQ ID NO: 81558 - DNA, 20 bp, Artificial
  CRISPR gRNA sequence
gtgggcataaattaattttt

SEQ ID NO: 81559 - DNA, 20 bp, Artificial
  CRISPR gRNA sequence
cataaattaatttttcagtt

SEQ ID NO: 81560 - DNA, 20 bp, Artificial
  CRISPR gRNA sequence
ttaatttttcagttaagttt

SEQ ID NO: 81561 - DNA, 20 bp, Artificial
  CRISPR gRNA sequence
atttttcagttaagttttgg

SEQ ID NO: 81562 - DNA, 20 bp, Artificial
  CRISPR gRNA sequence
aagcttaaataactctccaa

SEQ ID NO: 81563 - DNA, 20 bp, Artificial
  CRISPR gRNA sequence
ataactctccaaaagtcata

SEQ ID NO: 81564 - DNA, 20 bp, Artificial
  CRISPR gRNA sequence
ctctccaaaagtcataaagc

SEQ ID NO: 81565 - DNA, 20 bp, Artificial
  CRISPR gRNA sequence
aaagtcataaagccagtaac

SEQ ID NO: 81566 - DNA, 20 bp, Artificial
  CRISPR gRNA sequence
cataaagccagtaactggtt

SEQ ID NO: 81567 - DNA, 20 bp, Artificial
  CRISPR gRNA sequence
gttgagcccaaattcaaacc

SEQ ID NO: 81568 - DNA, 20 bp, Artificial
  CRISPR gRNA sequence
tctgatacttgtcctcttct

SEQ ID NO: 81569 - DNA, 20 bp, Artificial
  CRISPR gRNA sequence
tacttgtcctcttcttagaa

SEQ ID NO: 81570 - DNA, 20 bp, Artificial
  CRISPR gRNA sequence
cctcttcttagaaaagatta

SEQ ID NO: 81571 - DNA, 20 bp, Artificial
  CRISPR gRNA sequence
tcttgccgccttccctcaaa

SEQ ID NO: 81572 - DNA, 20 bp, Artificial
  CRISPR gRNA sequence
ttgccgccttccctcaaaca

SEQ ID NO: 81573 - DNA, 20 bp, Artificial
  CRISPR gRNA sequence
gccgccttccctcaaacaga

SEQ ID NO: 81574 - DNA, 20 bp, Artificial
  CRISPR gRNA sequence
ttccctcaaacagagagttc

SEQ ID NO: 81575 - DNA, 20 bp, Artificial
  CRISPR gRNA sequence
tccctcaaacagagagttcc

SEQ ID NO: 81576 - DNA, 20 bp, Artificial
  CRISPR gRNA sequence
ctcaaacagagagttccagg

SEQ ID NO: 81577 - DNA, 20 bp, Artificial
  CRISPR gRNA sequence
tcaaacagagagttccaggc

SEQ ID NO: 81578 - DNA, 20 bp, Artificial
  CRISPR gRNA sequence
gaatctgtgctctgatccct

SEQ ID NO: 81579 - DNA, 20 bp, Artificial
  CRISPR gRNA sequence
aatctgtgctctgatccctg

SEQ ID NO: 81580 - DNA, 20 bp, Artificial
  CRISPR gRNA sequence
atttaatatgttcttattat

SEQ ID NO: 81581 - DNA, 20 bp, Artificial
  CRISPR gRNA sequence
taatatgttcttattattag

SEQ ID NO: 81582 - DNA, 20 bp, Artificial
  CRISPR gRNA sequence
tgttcttattattagaagct

SEQ ID NO: 81583 - DNA, 20 bp, Artificial
  CRISPR gRNA sequence
ttattagaagctcagatgca

SEQ ID NO: 81584 - DNA, 20 bp, Artificial
  CRISPR gRNA sequence
attagaagctcagatgcaaa

SEQ ID NO: 81585 - DNA, 20 bp, Artificial
  CRISPR gRNA sequence
tcagatgcaaagagctctct

SEQ ID NO: 81586 - DNA, 20 bp, Artificial
  CRISPR gRNA sequence
tttaatgttatgaaaaaaat

SEQ ID NO: 81587 - DNA, 20 bp, Artificial
  CRISPR gRNA sequence
ttaatgttatgaaaaaaatc

SEQ ID NO: 81588 - DNA, 20 bp, Artificial
  CRISPR gRNA sequence
gaaaaaaatcaggtcttcat

SEQ ID NO: 81589 - DNA, 20 bp, Artificial
  CRISPR gRNA sequence
ttccccaatccacctcttga

SEQ ID NO: 81590 - DNA, 20 bp, Artificial
  CRISPR gRNA sequence
tccccaatccacctcttgat

SEQ ID NO: 81591 - DNA, 20 bp, Artificial
  CRISPR gRNA sequence
ccccaatccacctcttgatg

SEQ ID NO: 81592 - DNA, 20 bp, Artificial
  CRISPR gRNA sequence
aatccacctcttgatggggc

SEQ ID NO: 81593 - DNA, 20 bp, Artificial
  CRISPR gRNA sequence
ccacctcttgatggggctag

SEQ ID NO: 81594 - DNA, 20 bp, Artificial
  CRISPR gRNA sequence
tagtagcctttccttaatga

SEQ ID NO: 81595 - DNA, 20 bp, Artificial
  CRISPR gRNA sequence
agtagcctttccttaatgat

SEQ ID NO: 81596 - DNA, 20 bp, Artificial
  CRISPR gRNA sequence
gtagcctttccttaatgata

SEQ ID NO: 81597 - DNA, 20 bp, Artificial
  CRISPR gRNA sequence
ccttaatgatagggtgtttc

SEQ ID NO: 81598 - DNA, 20 bp, Artificial
  CRISPR gRNA sequence
ttaatgatagggtgtttcta

SEQ ID NO: 81599 - DNA, 20 bp, Artificial
  CRISPR gRNA sequence
aatgatagggtgtttctaga

SEQ ID NO: 81600 - DNA, 20 bp, Artificial
  CRISPR gRNA sequence
tgtttctagagagatatatc

SEQ ID NO: 81601 - DNA, 20 bp, Artificial
  CRISPR gRNA sequence
ctagagagatatatctggtc

SEQ ID NO: 81602 - DNA, 20 bp, Artificial
  CRISPR gRNA sequence
tagagagatatatctggtca

SEQ ID NO: 81603 - DNA, 20 bp, Artificial
  CRISPR gRNA sequence
agagatatatctggtcaagg

SEQ ID NO: 81604 - DNA, 20 bp, Artificial
  CRISPR gRNA sequence
tatatctggtcaaggtggcc

SEQ ID NO: 81605 - DNA, 20 bp, Artificial
  CRISPR gRNA sequence
ggtactcctccttctcccca

SEQ ID NO: 81606 - DNA, 20 bp, Artificial
  CRISPR gRNA sequence
tccttctccccacagcctcc

SEQ ID NO: 81607 - DNA, 20 bp, Artificial
  CRISPR gRNA sequence
ctccccacagcctcccagac

SEQ ID NO: 81608 - DNA, 20 bp, Artificial
  CRISPR gRNA sequence
tccccacagcctcccagaca

SEQ ID NO: 81609 - DNA, 20 bp, Artificial
  CRISPR gRNA sequence
cccacagcctcccagacaag

SEQ ID NO: 81610 - DNA, 20 bp, Artificial
  CRISPR gRNA sequence
ccacagcctcccagacaagg

SEQ ID NO: 81611 - DNA, 20 bp, Artificial
  CRISPR gRNA sequence
acagcctcccagacaaggag

SEQ ID NO: 81612 - DNA, 20 bp, Artificial
  CRISPR gRNA sequence
gcctcccagacaaggaggag

SEQ ID NO: 81613 - DNA, 20 bp, Artificial
  CRISPR gRNA sequence
aaggaggagtagctgccttt

SEQ ID NO: 81614 - DNA, 20 bp, Artificial
  CRISPR gRNA sequence
tgatcatgtaccctgaatat

SEQ ID NO: 81615 - DNA, 20 bp, Artificial
  CRISPR gRNA sequence
ctgaatataagtgtatttaa

SEQ ID NO: 81616 - DNA, 20 bp, Artificial
  CRISPR gRNA sequence
gaattttatacacatatatt

SEQ ID NO: 81617 - DNA, 20 bp, Artificial
  CRISPR gRNA sequence
ttagtgtcaatctgtatatt

SEQ ID NO: 81618 - DNA, 20 bp, Artificial
  CRISPR gRNA sequence
gtgtcaatctgtatatttag

SEQ ID NO: 81619 - DNA, 20 bp, Artificial
  CRISPR gRNA sequence
ttcattttcaatgaaaaata

SEQ ID NO: 81620 - DNA, 20 bp, Artificial
  CRISPR gRNA sequence
cattttcaatgaaaaatata

SEQ ID NO: 81621 - DNA, 20 bp, Artificial
  CRISPR gRNA sequence
attttcttcccacttcccca

SEQ ID NO: 81622 - DNA, 20 bp, Artificial
  CRISPR gRNA sequence
tcttcccacttccccatgga

SEQ ID NO: 81623 - DNA, 20 bp, Artificial
  CRISPR gRNA sequence
ccacttccccatggatggtc

SEQ ID NO: 81624 - DNA, 20 bp, Artificial
  CRISPR gRNA sequence
tctagtcatgcctctcattt

SEQ ID NO: 81625 - DNA, 20 bp, Artificial
  CRISPR gRNA sequence
gtcatgcctctcattttgga

SEQ ID NO: 81626 - DNA, 20 bp, Artificial
  CRISPR gRNA sequence
aagtactgtttctgaaacat

SEQ ID NO: 81627 - DNA, 20 bp, Artificial
  CRISPR gRNA sequence
agtactgtttctgaaacatt

SEQ ID NO: 81628 - DNA, 20 bp, Artificial
  CRISPR gRNA sequence
taggcaatatattcccaacc

SEQ ID NO: 81629 - DNA, 20 bp, Artificial
  CRISPR gRNA sequence
caatatattcccaacctggc

SEQ ID NO: 81630 - DNA, 20 bp, Artificial
  CRISPR gRNA sequence
ttcccaacctggctagttta

SEQ ID NO: 81631 - DNA, 20 bp, Artificial
  CRISPR gRNA sequence
tagtttacagcaatcacctg

SEQ ID NO: 81632 - DNA, 20 bp, Artificial
  CRISPR gRNA sequence
attactccatttgatcataa

SEQ ID NO: 81633 - DNA, 20 bp, Artificial
  CRISPR gRNA sequence
ctccatttgatcataatgga

SEQ ID NO: 81634 - DNA, 20 bp, Artificial
  CRISPR gRNA sequence
atgttctgtcccatttgcca

SEQ ID NO: 81635 - DNA, 20 bp, Artificial
  CRISPR gRNA sequence
ctatccctgttgtattttat

SEQ ID NO: 81636 - DNA, 20 bp, Artificial
  CRISPR gRNA sequence
tatccctgttgtattttatc

SEQ ID NO: 81637 - DNA, 20 bp, Artificial
  CRISPR gRNA sequence
cgggtccaactcaaccattt

SEQ ID NO: 81638 - DNA, 20 bp, Artificial
  CRISPR gRNA sequence
gggtccaactcaaccattta

SEQ ID NO: 81639 - DNA, 20 bp, Artificial
  CRISPR gRNA sequence
caaccatttaaggtatttgc

SEQ ID NO: 81640 - DNA, 20 bp, Artificial
  CRISPR gRNA sequence
tgccagctcttgtatgcatt

SEQ ID NO: 81641 - DNA, 20 bp, Artificial
  CRISPR gRNA sequence
gccagctcttgtatgcattt

SEQ ID NO: 81642 - DNA, 20 bp, Artificial
  CRISPR gRNA sequence
ggttttgtttctttgttttt

SEQ ID NO: 81643 - DNA, 20 bp, Artificial
  CRISPR gRNA sequence
tgttttttagctcatgaaat

SEQ ID NO: 81644 - DNA, 20 bp, Artificial
  CRISPR gRNA sequence
gttttttagctcatgaaatt

SEQ ID NO: 81645 - DNA, 20 bp, Artificial
  CRISPR gRNA sequence
agctcatgaaattaggtaca

SEQ ID NO: 81646 - DNA, 20 bp, Artificial
  CRISPR gRNA sequence
catgaaattaggtacaaagt

SEQ ID NO: 81647 - DNA, 20 bp, Artificial
  CRISPR gRNA sequence
tgaaattaggtacaaagtca

SEQ ID NO: 81648 - DNA, 20 bp, Artificial
  CRISPR gRNA sequence
aaattaggtacaaagtcaga

SEQ ID NO: 81649 - DNA, 20 bp, Artificial
  CRISPR gRNA sequence
aattaggtacaaagtcagag

SEQ ID NO: 81650 - DNA, 20 bp, Artificial
  CRISPR gRNA sequence
attaggtacaaagtcagaga

SEQ ID NO: 81651 - DNA, 20 bp, Artificial
  CRISPR gRNA sequence
ttaggtacaaagtcagagag

SEQ ID NO: 81652 - DNA, 20 bp, Artificial
  CRISPR gRNA sequence
tacaaagtcagagaggggtc

SEQ ID NO: 81653 - DNA, 20 bp, Artificial
  CRISPR gRNA sequence
gggtctggcatataaaacct

SEQ ID NO: 81654 - DNA, 20 bp, Artificial
  CRISPR gRNA sequence
tctggcatataaaacctcag

SEQ ID NO: 81655 - DNA, 20 bp, Artificial
  CRISPR gRNA sequence
ataaaacctcagcagaaata

SEQ ID NO: 81656 - DNA, 20 bp, Artificial
  CRISPR gRNA sequence
aaaacctcagcagaaataaa

SEQ ID NO: 81657 - DNA, 20 bp, Artificial
  CRISPR gRNA sequence
aaacctcagcagaaataaag

SEQ ID NO: 81658 - DNA, 20 bp, Artificial
  CRISPR gRNA sequence
aataaagaggttttgttgtt

SEQ ID NO: 81659 - DNA, 20 bp, Artificial
  CRISPR gRNA sequence
aagaggttttgttgtttggt

SEQ ID NO: 81660 - DNA, 20 bp, Artificial
  CRISPR gRNA sequence
tgtttggtaagaacatacct

SEQ ID NO: 81661 - DNA, 20 bp, Artificial
  CRISPR gRNA sequence
gtttggtaagaacatacctt

SEQ ID NO: 81662 - DNA, 20 bp, Artificial
  CRISPR gRNA sequence
ggtaagaacataccttgggt

SEQ ID NO: 81663 - DNA, 20 bp, Artificial
  CRISPR gRNA sequence
agaacataccttgggttggt

SEQ ID NO: 81664 - DNA, 20 bp, Artificial
  CRISPR gRNA sequence
gaacataccttgggttggtt

SEQ ID NO: 81665 - DNA, 20 bp, Artificial
  CRISPR gRNA sequence
taccttgggttggttgggca

SEQ ID NO: 81666 - DNA, 20 bp, Artificial
  CRISPR gRNA sequence
cttgggttggttgggcacgg

SEQ ID NO: 81667 - DNA, 20 bp, Artificial
  CRISPR gRNA sequence
tgcctgtaatcccaacactt

SEQ ID NO: 81668 - DNA, 20 bp, Artificial
  CRISPR gRNA sequence
gcctgtaatcccaacacttt

SEQ ID NO: 81669 - DNA, 20 bp, Artificial
  CRISPR gRNA sequence
ctgtaatcccaacactttgg

SEQ ID NO: 81670 - DNA, 20 bp, Artificial
  CRISPR gRNA sequence
tgtaatcccaacactttggg

SEQ ID NO: 81671 - DNA, 20 bp, Artificial
  CRISPR gRNA sequence
tcccaacactttgggaggcc

SEQ ID NO: 81672 - DNA, 20 bp, Artificial
  CRISPR gRNA sequence
cccaacactttgggaggcca

SEQ ID NO: 81673 - DNA, 20 bp, Artificial
  CRISPR gRNA sequence
aacactttgggaggccaagg

SEQ ID NO: 81674 - DNA, 20 bp, Artificial
  CRISPR gRNA sequence
acactttgggaggccaaggc

SEQ ID NO: 81675 - DNA, 20 bp, Artificial
  CRISPR gRNA sequence
caaggcaggctgatcacttg

SEQ ID NO: 81676 - DNA, 20 bp, Artificial
  CRISPR gRNA sequence
gcaggctgatcacttgaagt

SEQ ID NO: 81677 - DNA, 20 bp, Artificial
  CRISPR gRNA sequence
caggctgatcacttgaagtt

SEQ ID NO: 81678 - DNA, 20 bp, Artificial
  CRISPR gRNA sequence
ggctgatcacttgaagttgg

SEQ ID NO: 81679 - DNA, 20 bp, Artificial
  CRISPR gRNA sequence
tcacttgaagttgggagttc

SEQ ID NO: 81680 - DNA, 20 bp, Artificial
  CRISPR gRNA sequence
tgaagttgggagttcaagac

SEQ ID NO: 81681 - DNA, 20 bp, Artificial
  CRISPR gRNA sequence
ttgggagttcaagaccagcc

SEQ ID NO: 81682 - DNA, 20 bp, Artificial
  CRISPR gRNA sequence
caagaccagcctggccaaca

SEQ ID NO: 81683 - DNA, 20 bp, Artificial
  CRISPR gRNA sequence
ctgaaaatacaaaaattaac

SEQ ID NO: 81684 - DNA, 20 bp, Artificial
  CRISPR gRNA sequence
tgaaaatacaaaaattaacc

SEQ ID NO: 81685 - DNA, 20 bp, Artificial
  CRISPR gRNA sequence
atacaaaaattaaccaggca

SEQ ID NO: 81686 - DNA, 20 bp, Artificial
  CRISPR gRNA sequence
caaaaattaaccaggcatgg

SEQ ID NO: 81687 - DNA, 20 bp, Artificial
  CRISPR gRNA sequence
ggcatggtggtgtgtgcctg

SEQ ID NO: 81688 - DNA, 20 bp, Artificial
  CRISPR gRNA sequence
gtggtgtgtgcctgtagtcc

SEQ ID NO: 81689 - DNA, 20 bp, Artificial
  CRISPR gRNA sequence
tggtgtgtgcctgtagtccc

SEQ ID NO: 81690 - DNA, 20 bp, Artificial
  CRISPR gRNA sequence
tcccaggaatcacttgaacc

SEQ ID NO: 81691 - DNA, 20 bp, Artificial
  CRISPR gRNA sequence
cccaggaatcacttgaaccc

SEQ ID NO: 81692 - DNA, 20 bp, Artificial
  CRISPR gRNA sequence
caggaatcacttgaacccag

SEQ ID NO: 81693 - DNA, 20 bp, Artificial
  CRISPR gRNA sequence
aggaatcacttgaacccagg

SEQ ID NO: 81694 - DNA, 20 bp, Artificial
  CRISPR gRNA sequence
aatcacttgaacccaggagg

SEQ ID NO: 81695 - DNA, 20 bp, Artificial
  CRISPR gRNA sequence
tcacttgaacccaggaggcg

SEQ ID NO: 81696 - DNA, 20 bp, Artificial
  CRISPR gRNA sequence
cacttgaacccaggaggcgg

SEQ ID NO: 81697 - DNA, 20 bp, Artificial
  CRISPR gRNA sequence
aacccaggaggcggaggttg

SEQ ID NO: 81698 - DNA, 20 bp, Artificial
  CRISPR gRNA sequence
caggaggcggaggttgcagt

SEQ ID NO: 81699 - DNA, 20 bp, Artificial
  CRISPR gRNA sequence
ggcggaggttgcagtgagct

SEQ ID NO: 81700 - DNA, 20 bp, Artificial
  CRISPR gRNA sequence
caccactgcacactgcactc

SEQ ID NO: 81701 - DNA, 20 bp, Artificial
  CRISPR gRNA sequence
ctgcacactgcactccagcc

SEQ ID NO: 81702 - DNA, 20 bp, Artificial
  CRISPR gRNA sequence
tgcacactgcactccagcct

SEQ ID NO: 81703 - DNA, 20 bp, Artificial
  CRISPR gRNA sequence
ctgcactccagcctgggcaa

SEQ ID NO: 81704 - DNA, 20 bp, Artificial
  CRISPR gRNA sequence
tccagcctgggcaatggaat

SEQ ID NO: 81705 - DNA, 20 bp, Artificial
  CRISPR gRNA sequence
aataaaaaaataaaaaaata

SEQ ID NO: 81706 - DNA, 20 bp, Artificial
  CRISPR gRNA sequence
aaaaaataaagaacatacct

SEQ ID NO: 81707 - DNA, 20 bp, Artificial
  CRISPR gRNA sequence
aaaaataaagaacatacctt

SEQ ID NO: 81708 - DNA, 20 bp, Artificial
  CRISPR gRNA sequence
ataccttgggttgatccact

SEQ ID NO: 81709 - DNA, 20 bp, Artificial
  CRISPR gRNA sequence
taccttgggttgatccactt

SEQ ID NO: 81710 - DNA, 20 bp, Artificial
  CRISPR gRNA sequence
gttgatccacttaggaacct

SEQ ID NO: 81711 - DNA, 20 bp, Artificial
  CRISPR gRNA sequence
ataataacatctgccacgta

SEQ ID NO: 81712 - DNA, 20 bp, Artificial
  CRISPR gRNA sequence
aataacatctgccacgtata

SEQ ID NO: 81713 - DNA, 20 bp, Artificial
  CRISPR gRNA sequence
atagagcaattgctatgtcc

SEQ ID NO: 81714 - DNA, 20 bp, Artificial
  CRISPR gRNA sequence
tagagcaattgctatgtccc

SEQ ID NO: 81715 - DNA, 20 bp, Artificial
  CRISPR gRNA sequence
ctatgtcccaggcactctac

SEQ ID NO: 81716 - DNA, 20 bp, Artificial
  CRISPR gRNA sequence
actctactagacacttcata

SEQ ID NO: 81717 - DNA, 20 bp, Artificial
  CRISPR gRNA sequence
actagacacttcatacagtt

SEQ ID NO: 81718 - DNA, 20 bp, Artificial
  CRISPR gRNA sequence
cttcatacagtttagaaaat

SEQ ID NO: 81719 - DNA, 20 bp, Artificial
  CRISPR gRNA sequence
atacagtttagaaaatcaga

SEQ ID NO: 81720 - DNA, 20 bp, Artificial
  CRISPR gRNA sequence
tacagtttagaaaatcagat

SEQ ID NO: 81721 - DNA, 20 bp, Artificial
  CRISPR gRNA sequence
tttagaaaatcagatgggtg

SEQ ID NO: 81722 - DNA, 20 bp, Artificial
  CRISPR gRNA sequence
aaatcagatgggtgtagatc

SEQ ID NO: 81723 - DNA, 20 bp, Artificial
  CRISPR gRNA sequence
aatcagatgggtgtagatca

SEQ ID NO: 81724 - DNA, 20 bp, Artificial
  CRISPR gRNA sequence
cagatgggtgtagatcaagg

SEQ ID NO: 81725 - DNA, 20 bp, Artificial
  CRISPR gRNA sequence
agatgggtgtagatcaaggc

SEQ ID NO: 81726 - DNA, 20 bp, Artificial
  CRISPR gRNA sequence
atgggtgtagatcaaggcag

SEQ ID NO: 81727 - DNA, 20 bp, Artificial
  CRISPR gRNA sequence
ggtgtagatcaaggcaggag

SEQ ID NO: 81728 - DNA, 20 bp, Artificial
  CRISPR gRNA sequence
gtgtagatcaaggcaggagc

SEQ ID NO: 81729 - DNA, 20 bp, Artificial
  CRISPR gRNA sequence
aggcaggagcaggaaccaaa

SEQ ID NO: 81730 - DNA, 20 bp, Artificial
  CRISPR gRNA sequence
aggagcaggaaccaaaaaga

SEQ ID NO: 81731 - DNA, 20 bp, Artificial
  CRISPR gRNA sequence
ggagcaggaaccaaaaagaa

SEQ ID NO: 81732 - DNA, 20 bp, Artificial
  CRISPR gRNA sequence
aaaaagaaaggcataaacat

SEQ ID NO: 81733 - DNA, 20 bp, Artificial
  CRISPR gRNA sequence
cataaacataagaaaaaaaa

SEQ ID NO: 81734 - DNA, 20 bp, Artificial
  CRISPR gRNA sequence
aaacataagaaaaaaaatgg

SEQ ID NO: 81735 - DNA, 20 bp, Artificial
  CRISPR gRNA sequence
aacataagaaaaaaaatgga

SEQ ID NO: 81736 - DNA, 20 bp, Artificial
  CRISPR gRNA sequence
acataagaaaaaaaatggaa

SEQ ID NO: 81737 - DNA, 20 bp, Artificial
  CRISPR gRNA sequence
cataagaaaaaaaatggaag

SEQ ID NO: 81738 - DNA, 20 bp, Artificial
  CRISPR gRNA sequence
aagaaaaaaaatggaagggg

SEQ ID NO: 81739 - DNA, 20 bp, Artificial
  CRISPR gRNA sequence
aaaaatggaaggggtggaaa

SEQ ID NO: 81740 - DNA, 20 bp, Artificial
  CRISPR gRNA sequence
aaatggaaggggtggaaaca

SEQ ID NO: 81741 - DNA, 20 bp, Artificial
  CRISPR gRNA sequence
gaaacagagtacaataacat

SEQ ID NO: 81742 - DNA, 20 bp, Artificial
  CRISPR gRNA sequence
caataacatgagtaatttga

SEQ ID NO: 81743 - DNA, 20 bp, Artificial
  CRISPR gRNA sequence
aataacatgagtaatttgat

SEQ ID NO: 81744 - DNA, 20 bp, Artificial
  CRISPR gRNA sequence
ataacatgagtaatttgatg

SEQ ID NO: 81745 - DNA, 20 bp, Artificial
  CRISPR gRNA sequence
taacatgagtaatttgatgg

SEQ ID NO: 81746 - DNA, 20 bp, Artificial
  CRISPR gRNA sequence
gatgggggctattatgaact

SEQ ID NO: 81747 - DNA, 20 bp, Artificial
  CRISPR gRNA sequence
actgagaaatgaactttgaa

SEQ ID NO: 81748 - DNA, 20 bp, Artificial
  CRISPR gRNA sequence
atgaactttgaaaagtatct

SEQ ID NO: 81749 - DNA, 20 bp, Artificial
  CRISPR gRNA sequence
tgaactttgaaaagtatctt

SEQ ID NO: 81750 - DNA, 20 bp, Artificial
  CRISPR gRNA sequence
gaactttgaaaagtatcttg

SEQ ID NO: 81751 - DNA, 20 bp, Artificial
  CRISPR gRNA sequence
tatcttggggccaaatcatg

SEQ ID NO: 81752 - DNA, 20 bp, Artificial
  CRISPR gRNA sequence
gccaaatcatgtagactctt

SEQ ID NO: 81753 - DNA, 20 bp, Artificial
  CRISPR gRNA sequence
agactcttgagtgatgtgtt

SEQ ID NO: 81754 - DNA, 20 bp, Artificial
  CRISPR gRNA sequence
gactcttgagtgatgtgtta

SEQ ID NO: 81755 - DNA, 20 bp, Artificial
  CRISPR gRNA sequence
gatgtgttaaggaatgctat

SEQ ID NO: 81756 - DNA, 20 bp, Artificial
  CRISPR gRNA sequence
taaggaatgctatgagtgct

SEQ ID NO: 81757 - DNA, 20 bp, Artificial
  CRISPR gRNA sequence
aggaatgctatgagtgctga

SEQ ID NO: 81758 - DNA, 20 bp, Artificial
  CRISPR gRNA sequence
ggaatgctatgagtgctgag

SEQ ID NO: 81759 - DNA, 20 bp, Artificial
  CRISPR gRNA sequence
gaatgctatgagtgctgaga

SEQ ID NO: 81760 - DNA, 20 bp, Artificial
  CRISPR gRNA sequence
tatgagtgctgagagggcat

SEQ ID NO: 81761 - DNA, 20 bp, Artificial
  CRISPR gRNA sequence
gagtgctgagagggcatcag

SEQ ID NO: 81762 - DNA, 20 bp, Artificial
  CRISPR gRNA sequence
agagggcatcagaagtcctt

SEQ ID NO: 81763 - DNA, 20 bp, Artificial
  CRISPR gRNA sequence
agggcatcagaagtccttga

SEQ ID NO: 81764 - DNA, 20 bp, Artificial
  CRISPR gRNA sequence
cagaagtccttgagagcctc

SEQ ID NO: 81765 - DNA, 20 bp, Artificial
  CRISPR gRNA sequence
gaagtccttgagagcctcca

SEQ ID NO: 81766 - DNA, 20 bp, Artificial
  CRISPR gRNA sequence
tccttgagagcctccagaga

SEQ ID NO: 81767 - DNA, 20 bp, Artificial
  CRISPR gRNA sequence
ccttgagagcctccagagaa

SEQ ID NO: 81768 - DNA, 20 bp, Artificial
  CRISPR gRNA sequence
gagaaaggctcttaaaaatg

SEQ ID NO: 81769 - DNA, 20 bp, Artificial
  CRISPR gRNA sequence
taaaaatgcagcgcaatctc

SEQ ID NO: 81770 - DNA, 20 bp, Artificial
  CRISPR gRNA sequence
tgcagcgcaatctccagtga

SEQ ID NO: 81771 - DNA, 20 bp, Artificial
  CRISPR gRNA sequence
agcgcaatctccagtgacag

SEQ ID NO: 81772 - DNA, 20 bp, Artificial
  CRISPR gRNA sequence
ccagtgacagaagatactgc

SEQ ID NO: 81773 - DNA, 20 bp, Artificial
  CRISPR gRNA sequence
agatactgctagaaatctgc

SEQ ID NO: 81774 - DNA, 20 bp, Artificial
  CRISPR gRNA sequence
ctgctagaaaaaaaacaaaa

SEQ ID NO: 81775 - DNA, 20 bp, Artificial
  CRISPR gRNA sequence
tgctagaaaaaaaacaaaaa

SEQ ID NO: 81776 - DNA, 20 bp, Artificial
  CRISPR gRNA sequence
aaaaacaaaaaaggcatgta

SEQ ID NO: 81777 - DNA, 20 bp, Artificial
  CRISPR gRNA sequence
aaacaaaaaaggcatgtata

SEQ ID NO: 81778 - DNA, 20 bp, Artificial
  CRISPR gRNA sequence
aacaaaaaaggcatgtatag

SEQ ID NO: 81779 - DNA, 20 bp, Artificial
  CRISPR gRNA sequence
ggcatgtatagaggaattat

SEQ ID NO: 81780 - DNA, 20 bp, Artificial
  CRISPR gRNA sequence
gcatgtatagaggaattatg

SEQ ID NO: 81781 - DNA, 20 bp, Artificial
  CRISPR gRNA sequence
catgtatagaggaattatga

SEQ ID NO: 81782 - DNA, 20 bp, Artificial
  CRISPR gRNA sequence
tatagaggaattatgaggga

SEQ ID NO: 81783 - DNA, 20 bp, Artificial
  CRISPR gRNA sequence
aattatgagggaaagatacc

SEQ ID NO: 81784 - DNA, 20 bp, Artificial
  CRISPR gRNA sequence
gagggaaagataccaagtca

SEQ ID NO: 81785 - DNA, 20 bp, Artificial
  CRISPR gRNA sequence
tcacggtttattcttcaaaa

SEQ ID NO: 81786 - DNA, 20 bp, Artificial
  CRISPR gRNA sequence
acggtttattcttcaaaatg

SEQ ID NO: 81787 - DNA, 20 bp, Artificial
  CRISPR gRNA sequence
cggtttattcttcaaaatgg

SEQ ID NO: 81788 - DNA, 20 bp, Artificial
  CRISPR gRNA sequence
tttattcttcaaaatggagg

SEQ ID NO: 81789 - DNA, 20 bp, Artificial
  CRISPR gRNA sequence
tcaaaatggaggtggcttgt

SEQ ID NO: 81790 - DNA, 20 bp, Artificial
  CRISPR gRNA sequence
caaaatggaggtggcttgtt

SEQ ID NO: 81791 - DNA, 20 bp, Artificial
  CRISPR gRNA sequence
aatggaggtggcttgttggg

SEQ ID NO: 81792 - DNA, 20 bp, Artificial
  CRISPR gRNA sequence
atggaggtggcttgttggga

SEQ ID NO: 81793 - DNA, 20 bp, Artificial
  CRISPR gRNA sequence
gaggtggcttgttgggaagg

SEQ ID NO: 81794 - DNA, 20 bp, Artificial
  CRISPR gRNA sequence
gtggcttgttgggaaggtgg

SEQ ID NO: 81795 - DNA, 20 bp, Artificial
  CRISPR gRNA sequence
tgggaaggtggaagctcatt

SEQ ID NO: 81796 - DNA, 20 bp, Artificial
  CRISPR gRNA sequence
aaggtggaagctcatttggc

SEQ ID NO: 81797 - DNA, 20 bp, Artificial
  CRISPR gRNA sequence
ggtggaagctcatttggcca

SEQ ID NO: 81798 - DNA, 20 bp, Artificial
  CRISPR gRNA sequence
ggaagctcatttggccagag

SEQ ID NO: 81799 - DNA, 20 bp, Artificial
  CRISPR gRNA sequence
tcatttggccagagtggaaa

SEQ ID NO: 81800 - DNA, 20 bp, Artificial
  CRISPR gRNA sequence
ggccagagtggaaatggaat

SEQ ID NO: 81801 - DNA, 20 bp, Artificial
  CRISPR gRNA sequence
gccagagtggaaatggaatt

SEQ ID NO: 81802 - DNA, 20 bp, Artificial
  CRISPR gRNA sequence
cagagtggaaatggaattgg

SEQ ID NO: 81803 - DNA, 20 bp, Artificial
  CRISPR gRNA sequence
gatgaccaaatgtaaacact

SEQ ID NO: 81804 - DNA, 20 bp, Artificial
  CRISPR gRNA sequence
taaacacttggtgcctgata

SEQ ID NO: 81805 - DNA, 20 bp, Artificial
  CRISPR gRNA sequence
gcctgatatagcttgacacc

SEQ ID NO: 81806 - DNA, 20 bp, Artificial
  CRISPR gRNA sequence
gatatagcttgacaccaagt

SEQ ID NO: 81807 - DNA, 20 bp, Artificial
  CRISPR gRNA sequence
cttgacaccaagttagcccc

SEQ ID NO: 81808 - DNA, 20 bp, Artificial
  CRISPR gRNA sequence
tagccccaagtgaaataccc

SEQ ID NO: 81809 - DNA, 20 bp, Artificial
  CRISPR gRNA sequence
tgtcttttcccgatattcct

SEQ ID NO: 81810 - DNA, 20 bp, Artificial
  CRISPR gRNA sequence
gtcttttcccgatattcctc

SEQ ID NO: 81811 - DNA, 20 bp, Artificial
  CRISPR gRNA sequence
gatattcctcaggtactcca

SEQ ID NO: 81812 - DNA, 20 bp, Artificial
  CRISPR gRNA sequence
cctcaggtactccaaagatt

SEQ ID NO: 81813 - DNA, 20 bp, Artificial
  CRISPR gRNA sequence
ctcaggtactccaaagattc

SEQ ID NO: 81814 - DNA, 20 bp, Artificial
  CRISPR gRNA sequence
tcaggtttactcacgtcatc

SEQ ID NO: 81815 - DNA, 20 bp, Artificial
  CRISPR gRNA sequence
ggtttactcacgtcatccag

SEQ ID NO: 81816 - DNA, 20 bp, Artificial
  CRISPR gRNA sequence
tttactcacgtcatccagca

SEQ ID NO: 81817 - DNA, 20 bp, Artificial
  CRISPR gRNA sequence
tcacgtcatccagcagagaa

SEQ ID NO: 81818 - DNA, 20 bp, Artificial
  CRISPR gRNA sequence
gtcatccagcagagaatgga

SEQ ID NO: 81819 - DNA, 20 bp, Artificial
  CRISPR gRNA sequence
ttcctgaattgctatgtgtc

SEQ ID NO: 81820 - DNA, 20 bp, Artificial
  CRISPR gRNA sequence
tcctgaattgctatgtgtct

SEQ ID NO: 81821 - DNA, 20 bp, Artificial
  CRISPR gRNA sequence
gtttcatccatccgacattg

SEQ ID NO: 81822 - DNA, 20 bp, Artificial
  CRISPR gRNA sequence
acattgaagttgacttactg

SEQ ID NO: 81823 - DNA, 20 bp, Artificial
  CRISPR gRNA sequence
gaagttgacttactgaagaa

SEQ ID NO: 81824 - DNA, 20 bp, Artificial
  CRISPR gRNA sequence
agttgacttactgaagaatg

SEQ ID NO: 81825 - DNA, 20 bp, Artificial
  CRISPR gRNA sequence
ttgacttactgaagaatgga

SEQ ID NO: 81826 - DNA, 20 bp, Artificial
  CRISPR gRNA sequence
gacttactgaagaatggaga

SEQ ID NO: 81827 - DNA, 20 bp, Artificial
  CRISPR gRNA sequence
gaatggagagagaattgaaa

SEQ ID NO: 81828 - DNA, 20 bp, Artificial
  CRISPR gRNA sequence
tggagagagaattgaaaaag

SEQ ID NO: 81829 - DNA, 20 bp, Artificial
  CRISPR gRNA sequence
gagagagaattgaaaaagtg

SEQ ID NO: 81830 - DNA, 20 bp, Artificial
  CRISPR gRNA sequence
aattgaaaaagtggagcatt

SEQ ID NO: 81831 - DNA, 20 bp, Artificial
  CRISPR gRNA sequence
gagcattcagacttgtcttt

SEQ ID NO: 81832 - DNA, 20 bp, Artificial
  CRISPR gRNA sequence
attcagacttgtctttcagc

SEQ ID NO: 81833 - DNA, 20 bp, Artificial
  CRISPR gRNA sequence
ttcagacttgtctttcagca

SEQ ID NO: 81834 - DNA, 20 bp, Artificial
  CRISPR gRNA sequence
acttgtctttcagcaaggac

SEQ ID NO: 81835 - DNA, 20 bp, Artificial
  CRISPR gRNA sequence
tgaattcacccccactgaaa

SEQ ID NO: 81836 - DNA, 20 bp, Artificial
  CRISPR gRNA sequence
tcacccccactgaaaaagat

SEQ ID NO: 81837 - DNA, 20 bp, Artificial
  CRISPR gRNA sequence
tgaaccatgtgactttgtca

SEQ ID NO: 81838 - DNA, 20 bp, Artificial
  CRISPR gRNA sequence
atgtgactttgtcacagccc

SEQ ID NO: 81839 - DNA, 20 bp, Artificial
  CRISPR gRNA sequence
gactttgtcacagcccaaga

SEQ ID NO: 81840 - DNA, 20 bp, Artificial
  CRISPR gRNA sequence
tgtcacagcccaagatagtt

SEQ ID NO: 81841 - DNA, 20 bp, Artificial
  CRISPR gRNA sequence
cacagcccaagatagttaag

SEQ ID NO: 81842 - DNA, 20 bp, Artificial
  CRISPR gRNA sequence
acagcccaagatagttaagt

SEQ ID NO: 81843 - DNA, 20 bp, Artificial
  CRISPR gRNA sequence
cagcccaagatagttaagtg

SEQ ID NO: 81844 - DNA, 20 bp, Artificial
  CRISPR gRNA sequence
ccaagatagttaagtggggt

SEQ ID NO: 81845 - DNA, 20 bp, Artificial
  CRISPR gRNA sequence
taagtcttacattcttttgt

SEQ ID NO: 81846 - DNA, 20 bp, Artificial
  CRISPR gRNA sequence
attcttttgtaagctgctga

SEQ ID NO: 81847 - DNA, 20 bp, Artificial
  CRISPR gRNA sequence
agctgctgaaagttgtgtat

SEQ ID NO: 81848 - DNA, 20 bp, Artificial
  CRISPR gRNA sequence
tgctgaaagttgtgtatgag

SEQ ID NO: 81849 - DNA, 20 bp, Artificial
  CRISPR gRNA sequence
gtatgagtagtcatatcata

SEQ ID NO: 81850 - DNA, 20 bp, Artificial
  CRISPR gRNA sequence
aaagctgctttgatataaaa

SEQ ID NO: 81851 - DNA, 20 bp, Artificial
  CRISPR gRNA sequence
aagctgctttgatataaaaa

SEQ ID NO: 81852 - DNA, 20 bp, Artificial
  CRISPR gRNA sequence
tttgatataaaaaaggtcta

SEQ ID NO: 81853 - DNA, 20 bp, Artificial
  CRISPR gRNA sequence
atggccatactaccctgaat

SEQ ID NO: 81854 - DNA, 20 bp, Artificial
  CRISPR gRNA sequence
gatataaacaatctgcatat

SEQ ID NO: 81855 - DNA, 20 bp, Artificial
  CRISPR gRNA sequence
atataaacaatctgcatatt

SEQ ID NO: 81856 - DNA, 20 bp, Artificial
  CRISPR gRNA sequence
aatctgcatattgggattgt

SEQ ID NO: 81857 - DNA, 20 bp, Artificial
  CRISPR gRNA sequence
atctgcatattgggattgtc

SEQ ID NO: 81858 - DNA, 20 bp, Artificial
  CRISPR gRNA sequence
tctgcatattgggattgtca

SEQ ID NO: 81859 - DNA, 20 bp, Artificial
  CRISPR gRNA sequence
attgtcagggaatgttctta

SEQ ID NO: 81860 - DNA, 20 bp, Artificial
  CRISPR gRNA sequence
cagggaatgttcttaaagat

SEQ ID NO: 81861 - DNA, 20 bp, Artificial
  CRISPR gRNA sequence
aatgttcttaaagatcagat

SEQ ID NO: 81862 - DNA, 20 bp, Artificial
  CRISPR gRNA sequence
gttcttaaagatcagattag

SEQ ID NO: 81863 - DNA, 20 bp, Artificial
  CRISPR gRNA sequence
tcagattagtggcacctgct

SEQ ID NO: 81864 - DNA, 20 bp, Artificial
  CRISPR gRNA sequence
cctgctgagatactgatgca

SEQ ID NO: 81865 - DNA, 20 bp, Artificial
  CRISPR gRNA sequence
tgagatactgatgcacagca

SEQ ID NO: 81866 - DNA, 20 bp, Artificial
  CRISPR gRNA sequence
gcacagcatggtttctgaac

SEQ ID NO: 81867 - DNA, 20 bp, Artificial
  CRISPR gRNA sequence
cagcatggtttctgaaccag

SEQ ID NO: 81868 - DNA, 20 bp, Artificial
  CRISPR gRNA sequence
ctgaaccagtagtttccctg

SEQ ID NO: 81869 - DNA, 20 bp, Artificial
  CRISPR gRNA sequence
ccagtagtttccctgcagtt

SEQ ID NO: 81870 - DNA, 20 bp, Artificial
  CRISPR gRNA sequence
gtagtttccctgcagttgag

SEQ ID NO: 81871 - DNA, 20 bp, Artificial
  CRISPR gRNA sequence
tagtttccctgcagttgagc

SEQ ID NO: 81872 - DNA, 20 bp, Artificial
  CRISPR gRNA sequence
agtttccctgcagttgagca

SEQ ID NO: 81873 - DNA, 20 bp, Artificial
  CRISPR gRNA sequence
tttccctgcagttgagcagg

SEQ ID NO: 81874 - DNA, 20 bp, Artificial
  CRISPR gRNA sequence
ccctgcagttgagcagggag

SEQ ID NO: 81875 - DNA, 20 bp, Artificial
  CRISPR gRNA sequence
tgcagttgagcagggagcag

SEQ ID NO: 81876 - DNA, 20 bp, Artificial
  CRISPR gRNA sequence
agttgagcagggagcagcag

SEQ ID NO: 81877 - DNA, 20 bp, Artificial
  CRISPR gRNA sequence
tcttaacacttcttacctac

SEQ ID NO: 81878 - DNA, 20 bp, Artificial
  CRISPR gRNA sequence
tcttacctactggcttcctc

SEQ ID NO: 81879 - DNA, 20 bp, Artificial
  CRISPR gRNA sequence
ctggcttcctctagcttttg

SEQ ID NO: 81880 - DNA, 20 bp, Artificial
  CRISPR gRNA sequence
gcttcctctagcttttgtgg

SEQ ID NO: 81881 - DNA, 20 bp, Artificial
  CRISPR gRNA sequence
tctagcttttgtggcagctt

SEQ ID NO: 81882 - DNA, 20 bp, Artificial
  CRISPR gRNA sequence
ctagcttttgtggcagcttc

SEQ ID NO: 81883 - DNA, 20 bp, Artificial
  CRISPR gRNA sequence
gtggcagcttcaggtatatt

SEQ ID NO: 81884 - DNA, 20 bp, Artificial
  CRISPR gRNA sequence
tagcactgaacgaacatctc

SEQ ID NO: 81885 - DNA, 20 bp, Artificial
  CRISPR gRNA sequence
cactgaacgaacatctcaag

SEQ ID NO: 81886 - DNA, 20 bp, Artificial
  CRISPR gRNA sequence
actgaacgaacatctcaaga

SEQ ID NO: 81887 - DNA, 20 bp, Artificial
  CRISPR gRNA sequence
acgaacatctcaagaaggta

SEQ ID NO: 81888 - DNA, 20 bp, Artificial
  CRISPR gRNA sequence
cgaacatctcaagaaggtat

SEQ ID NO: 81889 - DNA, 20 bp, Artificial
  CRISPR gRNA sequence
aggtataggcctttgtttgt

SEQ ID NO: 81890 - DNA, 20 bp, Artificial
  CRISPR gRNA sequence
gtttgtaagtcctgctgtcc

SEQ ID NO: 81891 - DNA, 20 bp, Artificial
  CRISPR gRNA sequence
gtcctagcatcctataatcc

SEQ ID NO: 81892 - DNA, 20 bp, Artificial
  CRISPR gRNA sequence
cctataatcctggacttctc

SEQ ID NO: 81893 - DNA, 20 bp, Artificial
  CRISPR gRNA sequence
tggacttctccagtactttc

SEQ ID NO: 81894 - DNA, 20 bp, Artificial
  CRISPR gRNA sequence
cttctccagtactttctggc

SEQ ID NO: 81895 - DNA, 20 bp, Artificial
  CRISPR gRNA sequence
ccagtactttctggctggat

SEQ ID NO: 81896 - DNA, 20 bp, Artificial
  CRISPR gRNA sequence
ttctggctggattggtatct

SEQ ID NO: 81897 - DNA, 20 bp, Artificial
  CRISPR gRNA sequence
tctggctggattggtatctg

SEQ ID NO: 81898 - DNA, 20 bp, Artificial
  CRISPR gRNA sequence
gctggattggtatctgaggc

SEQ ID NO: 81899 - DNA, 20 bp, Artificial
  CRISPR gRNA sequence
ggattggtatctgaggctag

SEQ ID NO: 81900 - DNA, 20 bp, Artificial
  CRISPR gRNA sequence
gattggtatctgaggctagt

SEQ ID NO: 81901 - DNA, 20 bp, Artificial
  CRISPR gRNA sequence
tggtatctgaggctagtagg

SEQ ID NO: 81902 - DNA, 20 bp, Artificial
  CRISPR gRNA sequence
ggtatctgaggctagtagga

SEQ ID NO: 81903 - DNA, 20 bp, Artificial
  CRISPR gRNA sequence
gtatctgaggctagtaggaa

SEQ ID NO: 81904 - DNA, 20 bp, Artificial
  CRISPR gRNA sequence
taggaagggcttgttcctgc

SEQ ID NO: 81905 - DNA, 20 bp, Artificial
  CRISPR gRNA sequence
aggaagggcttgttcctgct

SEQ ID NO: 81906 - DNA, 20 bp, Artificial
  CRISPR gRNA sequence
aagggcttgttcctgctggg

SEQ ID NO: 81907 - DNA, 20 bp, Artificial
  CRISPR gRNA sequence
agctctaaacaatgtattca

SEQ ID NO: 81908 - DNA, 20 bp, Artificial
  CRISPR gRNA sequence
gctctaaacaatgtattcat

SEQ ID NO: 81909 - DNA, 20 bp, Artificial
  CRISPR gRNA sequence
ctaaacaatgtattcatggg

SEQ ID NO: 81910 - DNA, 20 bp, Artificial
  CRISPR gRNA sequence
taaacaatgtattcatgggt

SEQ ID NO: 81911 - DNA, 20 bp, Artificial
  CRISPR gRNA sequence
aatgtattcatgggtaggaa

SEQ ID NO: 81912 - DNA, 20 bp, Artificial
  CRISPR gRNA sequence
gtattcatgggtaggaacag

SEQ ID NO: 81913 - DNA, 20 bp, Artificial
  CRISPR gRNA sequence
ggaacagcagcctattctgc

SEQ ID NO: 81914 - DNA, 20 bp, Artificial
  CRISPR gRNA sequence
agccttatttctaaccattt

SEQ ID NO: 81915 - DNA, 20 bp, Artificial
  CRISPR gRNA sequence
taaccattttagacatttgt

SEQ ID NO: 81916 - DNA, 20 bp, Artificial
  CRISPR gRNA sequence
tttagacatttgttagtaca

SEQ ID NO: 81917 - DNA, 20 bp, Artificial
  CRISPR gRNA sequence
gttagtacatggtattttaa

SEQ ID NO: 81918 - DNA, 20 bp, Artificial
  CRISPR gRNA sequence
tttctccactgtctttttca

SEQ ID NO: 81919 - DNA, 20 bp, Artificial
  CRISPR gRNA sequence
cactgtctttttcatagatc

SEQ ID NO: 81920 - DNA, 20 bp, Artificial
  CRISPR gRNA sequence
tttcatagatcgagacatgt

SEQ ID NO: 81921 - DNA, 20 bp, Artificial
  CRISPR gRNA sequence
catagatcgagacatgtaag

SEQ ID NO: 81922 - DNA, 20 bp, Artificial
  CRISPR gRNA sequence
gagacatgtaagcagcatca

SEQ ID NO: 81923 - DNA, 20 bp, Artificial
  CRISPR gRNA sequence
gacatgtaagcagcatcatg

SEQ ID NO: 81924 - DNA, 20 bp, Artificial
  CRISPR gRNA sequence
acatgtaagcagcatcatgg

SEQ ID NO: 81925 - DNA, 20 bp, Artificial
  CRISPR gRNA sequence
gtaagcagcatcatggaggt

SEQ ID NO: 81926 - DNA, 20 bp, Artificial
  CRISPR gRNA sequence
ggaggtaagtttttgacctt

SEQ ID NO: 81927 - DNA, 20 bp, Artificial
  CRISPR gRNA sequence
tgtttttgtttcactgtcct

SEQ ID NO: 81928 - DNA, 20 bp, Artificial
  CRISPR gRNA sequence
gtttttgtttcactgtcctg

SEQ ID NO: 81929 - DNA, 20 bp, Artificial
  CRISPR gRNA sequence
actgtcctgaggactattta

SEQ ID NO: 81930 - DNA, 20 bp, Artificial
  CRISPR gRNA sequence
tcctgaggactatttataga

SEQ ID NO: 81931 - DNA, 20 bp, Artificial
  CRISPR gRNA sequence
acatgataaccctcactatg

SEQ ID NO: 81932 - DNA, 20 bp, Artificial
  CRISPR gRNA sequence
atgataaccctcactatgtg

SEQ ID NO: 81933 - DNA, 20 bp, Artificial
  CRISPR gRNA sequence
cactatgtggagaacattga

SEQ ID NO: 81934 - DNA, 20 bp, Artificial
  CRISPR gRNA sequence
ctatgtggagaacattgaca

SEQ ID NO: 81935 - DNA, 20 bp, Artificial
  CRISPR gRNA sequence
acattgacagagtaacattt

SEQ ID NO: 81936 - DNA, 20 bp, Artificial
  CRISPR gRNA sequence
ttgacagagtaacattttag

SEQ ID NO: 81937 - DNA, 20 bp, Artificial
  CRISPR gRNA sequence
tgacagagtaacattttagc

SEQ ID NO: 81938 - DNA, 20 bp, Artificial
  CRISPR gRNA sequence
gacagagtaacattttagca

SEQ ID NO: 81939 - DNA, 20 bp, Artificial
  CRISPR gRNA sequence
gagtaacattttagcaggga

SEQ ID NO: 81940 - DNA, 20 bp, Artificial
  CRISPR gRNA sequence
taacattttagcagggaaag

SEQ ID NO: 81941 - DNA, 20 bp, Artificial
  CRISPR gRNA sequence
gcagggaaagaagaatccta

SEQ ID NO: 81942 - DNA, 20 bp, Artificial
  CRISPR gRNA sequence
cagggaaagaagaatcctac

SEQ ID NO: 81943 - DNA, 20 bp, Artificial
  CRISPR gRNA sequence
agggaaagaagaatcctaca

SEQ ID NO: 81944 - DNA, 20 bp, Artificial
  CRISPR gRNA sequence
ggtcatgttcccttctcctg

SEQ ID NO: 81945 - DNA, 20 bp, Artificial
  CRISPR gRNA sequence
tcatgttcccttctcctgtg

SEQ ID NO: 81946 - DNA, 20 bp, Artificial
  CRISPR gRNA sequence
tgttcccttctcctgtggag

SEQ ID NO: 81947 - DNA, 20 bp, Artificial
  CRISPR gRNA sequence
ttctcctgtggagtggcatg

SEQ ID NO: 81948 - DNA, 20 bp, Artificial
  CRISPR gRNA sequence
tcctgtggagtggcatgaag

SEQ ID NO: 81949 - DNA, 20 bp, Artificial
  CRISPR gRNA sequence
cctgtggagtggcatgaaga

SEQ ID NO: 81950 - DNA, 20 bp, Artificial
  CRISPR gRNA sequence
agtggcatgaagaaggtgta

SEQ ID NO: 81951 - DNA, 20 bp, Artificial
  CRISPR gRNA sequence
atgaagaaggtgtatggccc

SEQ ID NO: 81952 - DNA, 20 bp, Artificial
  CRISPR gRNA sequence
tgaagaaggtgtatggcccc

SEQ ID NO: 81953 - DNA, 20 bp, Artificial
  CRISPR gRNA sequence
aaggtgtatggccccaggta

SEQ ID NO: 81954 - DNA, 20 bp, Artificial
  CRISPR gRNA sequence
gccatattactgaccctcta

SEQ ID NO: 81955 - DNA, 20 bp, Artificial
  CRISPR gRNA sequence
catattactgaccctctaca

SEQ ID NO: 81956 - DNA, 20 bp, Artificial
  CRISPR gRNA sequence
tattactgaccctctacaga

SEQ ID NO: 81957 - DNA, 20 bp, Artificial
  CRISPR gRNA sequence
attactgaccctctacagag

SEQ ID NO: 81958 - DNA, 20 bp, Artificial
  CRISPR gRNA sequence
ttactgaccctctacagaga

SEQ ID NO: 81959 - DNA, 20 bp, Artificial
  CRISPR gRNA sequence
gaccctctacagagagggca

SEQ ID NO: 81960 - DNA, 20 bp, Artificial
  CRISPR gRNA sequence
accctctacagagagggcaa

SEQ ID NO: 81961 - DNA, 20 bp, Artificial
  CRISPR gRNA sequence
agagagggcaaaggaactgc

SEQ ID NO: 81962 - DNA, 20 bp, Artificial
  CRISPR gRNA sequence
gggcaaaggaactgccagta

SEQ ID NO: 81963 - DNA, 20 bp, Artificial
  CRISPR gRNA sequence
gaactgccagtatggtattg

SEQ ID NO: 81964 - DNA, 20 bp, Artificial
  CRISPR gRNA sequence
aactgccagtatggtattgc

SEQ ID NO: 81965 - DNA, 20 bp, Artificial
  CRISPR gRNA sequence
cagtatggtattgcaggata

SEQ ID NO: 81966 - DNA, 20 bp, Artificial
  CRISPR gRNA sequence
agtatggtattgcaggataa

SEQ ID NO: 81967 - DNA, 20 bp, Artificial
  CRISPR gRNA sequence
atggtattgcaggataaagg

SEQ ID NO: 81968 - DNA, 20 bp, Artificial
  CRISPR gRNA sequence
tggtattgcaggataaaggc

SEQ ID NO: 81969 - DNA, 20 bp, Artificial
  CRISPR gRNA sequence
tattgcaggataaaggcagg

SEQ ID NO: 81970 - DNA, 20 bp, Artificial
  CRISPR gRNA sequence
tggttacccacattacctgc

SEQ ID NO: 81971 - DNA, 20 bp, Artificial
  CRISPR gRNA sequence
ggttacccacattacctgca

SEQ ID NO: 81972 - DNA, 20 bp, Artificial
  CRISPR gRNA sequence
ttcttctgccatttccacat

SEQ ID NO: 81973 - DNA, 20 bp, Artificial
  CRISPR gRNA sequence
ccacattggacatctctgct

SEQ ID NO: 81974 - DNA, 20 bp, Artificial
  CRISPR gRNA sequence
cacattggacatctctgctg

SEQ ID NO: 81975 - DNA, 20 bp, Artificial
  CRISPR gRNA sequence
cattggacatctctgctgag

SEQ ID NO: 81976 - DNA, 20 bp, Artificial
  CRISPR gRNA sequence
ttggacatctctgctgagga

SEQ ID NO: 81977 - DNA, 20 bp, Artificial
  CRISPR gRNA sequence
tataatgttgttttattctt

SEQ ID NO: 81978 - DNA, 20 bp, Artificial
  CRISPR gRNA sequence
atgttgttttattcttcaga

SEQ ID NO: 81979 - DNA, 20 bp, Artificial
  CRISPR gRNA sequence
ttgttttattcttcagacag

SEQ ID NO: 81980 - DNA, 20 bp, Artificial
  CRISPR gRNA sequence
gttttattcttcagacagaa

SEQ ID NO: 81981 - DNA, 20 bp, Artificial
  CRISPR gRNA sequence
tttattcttcagacagaaga

SEQ ID NO: 81982 - DNA, 20 bp, Artificial
  CRISPR gRNA sequence
ttattcttcagacagaagag

SEQ ID NO: 81983 - DNA, 20 bp, Artificial
  CRISPR gRNA sequence
attcttcagacagaagagag

SEQ ID NO: 81984 - DNA, 20 bp, Artificial
  CRISPR gRNA sequence
gacagaagagaggagttata

SEQ ID NO: 81985 - DNA, 20 bp, Artificial
  CRISPR gRNA sequence
agaggagttatacagctctg

SEQ ID NO: 81986 - DNA, 20 bp, Artificial
  CRISPR gRNA sequence
gcagacatcccattcctgta

SEQ ID NO: 81987 - DNA, 20 bp, Artificial
  CRISPR gRNA sequence
cagacatcccattcctgtat

SEQ ID NO: 81988 - DNA, 20 bp, Artificial
  CRISPR gRNA sequence
agacatcccattcctgtatg

SEQ ID NO: 81989 - DNA, 20 bp, Artificial
  CRISPR gRNA sequence
tggggactgtgtttgcctct

SEQ ID NO: 81990 - DNA, 20 bp, Artificial
  CRISPR gRNA sequence
gggactgtgtttgcctctta

SEQ ID NO: 81991 - DNA, 20 bp, Artificial
  CRISPR gRNA sequence
ggactgtgtttgcctcttag

SEQ ID NO: 81992 - DNA, 20 bp, Artificial
  CRISPR gRNA sequence
gtttgcctcttagaggttcc

SEQ ID NO: 81993 - DNA, 20 bp, Artificial
  CRISPR gRNA sequence
tttgcctcttagaggttccc

SEQ ID NO: 81994 - DNA, 20 bp, Artificial
  CRISPR gRNA sequence
cttagaggttcccaggccac

SEQ ID NO: 81995 - DNA, 20 bp, Artificial
  CRISPR gRNA sequence
tagaggttcccaggccacta

SEQ ID NO: 81996 - DNA, 20 bp, Artificial
  CRISPR gRNA sequence
agaggttcccaggccactag

SEQ ID NO: 81997 - DNA, 20 bp, Artificial
  CRISPR gRNA sequence
aggttcccaggccactagag

SEQ ID NO: 81998 - DNA, 20 bp, Artificial
  CRISPR gRNA sequence
ccaggccactagaggagata

SEQ ID NO: 81999 - DNA, 20 bp, Artificial
  CRISPR gRNA sequence
caggccactagaggagataa

SEQ ID NO: 82000 - DNA, 20 bp, Artificial
  CRISPR gRNA sequence
aggccactagaggagataaa

SEQ ID NO: 82001 - DNA, 20 bp, Artificial
  CRISPR gRNA sequence
ctagaggagataaagggaaa

SEQ ID NO: 82002 - DNA, 20 bp, Artificial
  CRISPR gRNA sequence
ttgatataatgatactataa

SEQ ID NO: 82003 - DNA, 20 bp, Artificial
  CRISPR gRNA sequence
actataatagatgtaactac

SEQ ID NO: 82004 - DNA, 20 bp, Artificial
  CRISPR gRNA sequence
ctataatagatgtaactaca

SEQ ID NO: 82005 - DNA, 20 bp, Artificial
  CRISPR gRNA sequence
ataatagatgtaactacaag

SEQ ID NO: 82006 - DNA, 20 bp, Artificial
  CRISPR gRNA sequence
gatgtaactacaaggagctc

SEQ ID NO: 82007 - DNA, 20 bp, Artificial
  CRISPR gRNA sequence
gtaactacaaggagctccag

SEQ ID NO: 82008 - DNA, 20 bp, Artificial
  CRISPR gRNA sequence
ctacaaggagctccagaagc

SEQ ID NO: 82009 - DNA, 20 bp, Artificial
  CRISPR gRNA sequence
acaaggagctccagaagcaa

SEQ ID NO: 82010 - DNA, 20 bp, Artificial
  CRISPR gRNA sequence
aaggagctccagaagcaaga

SEQ ID NO: 82011 - DNA, 20 bp, Artificial
  CRISPR gRNA sequence
ggagctccagaagcaagaga

SEQ ID NO: 82012 - DNA, 20 bp, Artificial
  CRISPR gRNA sequence
gagctccagaagcaagagag

SEQ ID NO: 82013 - DNA, 20 bp, Artificial
  CRISPR gRNA sequence
agctccagaagcaagagaga

SEQ ID NO: 82014 - DNA, 20 bp, Artificial
  CRISPR gRNA sequence
ctccagaagcaagagagagg

SEQ ID NO: 82015 - DNA, 20 bp, Artificial
  CRISPR gRNA sequence
tccagaagcaagagagaggg

SEQ ID NO: 82016 - DNA, 20 bp, Artificial
  CRISPR gRNA sequence
gcaagagagagggaggaact

SEQ ID NO: 82017 - DNA, 20 bp, Artificial
  CRISPR gRNA sequence
cttggacttctctgcatctt

SEQ ID NO: 82018 - DNA, 20 bp, Artificial
  CRISPR gRNA sequence
gacttctctgcatctttagt

SEQ ID NO: 82019 - DNA, 20 bp, Artificial
  CRISPR gRNA sequence
cttctctgcatctttagttg

SEQ ID NO: 82020 - DNA, 20 bp, Artificial
  CRISPR gRNA sequence
gcatctttagttggagtcca

SEQ ID NO: 82021 - DNA, 20 bp, Artificial
  CRISPR gRNA sequence
catctttagttggagtccaa

SEQ ID NO: 82022 - DNA, 20 bp, Artificial
  CRISPR gRNA sequence
ttcaatgaaattctactgcc

SEQ ID NO: 82023 - DNA, 20 bp, Artificial
  CRISPR gRNA sequence
tcaatgaaattctactgccc

SEQ ID NO: 82024 - DNA, 20 bp, Artificial
  CRISPR gRNA sequence
caatgaaattctactgccca

SEQ ID NO: 82025 - DNA, 20 bp, Artificial
  CRISPR gRNA sequence
tcaaatctcctgttatattc

SEQ ID NO: 82026 - DNA, 20 bp, Artificial
  CRISPR gRNA sequence
tctcctgttatattctagaa

SEQ ID NO: 82027 - DNA, 20 bp, Artificial
  CRISPR gRNA sequence
ctcctgttatattctagaac

SEQ ID NO: 82028 - DNA, 20 bp, Artificial
  CRISPR gRNA sequence
tcctgttatattctagaaca

SEQ ID NO: 82029 - DNA, 20 bp, Artificial
  CRISPR gRNA sequence
tctagaacagggaattgatt

SEQ ID NO: 82030 - DNA, 20 bp, Artificial
  CRISPR gRNA sequence
ctagaacagggaattgattt

SEQ ID NO: 82031 - DNA, 20 bp, Artificial
  CRISPR gRNA sequence
agaacagggaattgatttgg

SEQ ID NO: 82032 - DNA, 20 bp, Artificial
  CRISPR gRNA sequence
aacagggaattgatttggga

SEQ ID NO: 82033 - DNA, 20 bp, Artificial
  CRISPR gRNA sequence
gaattgatttgggagagcat

SEQ ID NO: 82034 - DNA, 20 bp, Artificial
  CRISPR gRNA sequence
aattgatttgggagagcatc

SEQ ID NO: 82035 - DNA, 20 bp, Artificial
  CRISPR gRNA sequence
tgatttgggagagcatcagg

SEQ ID NO: 82036 - DNA, 20 bp, Artificial
  CRISPR gRNA sequence
gatttgggagagcatcagga

SEQ ID NO: 82037 - DNA, 20 bp, Artificial
  CRISPR gRNA sequence
ttgggagagcatcaggaagg

SEQ ID NO: 82038 - DNA, 20 bp, Artificial
  CRISPR gRNA sequence
aggaaggtggatgatctgcc

SEQ ID NO: 82039 - DNA, 20 bp, Artificial
  CRISPR gRNA sequence
gatctgcccagtcacactgt

SEQ ID NO: 82040 - DNA, 20 bp, Artificial
  CRISPR gRNA sequence
gtcacactgttagtaaattg

SEQ ID NO: 82041 - DNA, 20 bp, Artificial
  CRISPR gRNA sequence
cacactgttagtaaattgta

SEQ ID NO: 82042 - DNA, 20 bp, Artificial
  CRISPR gRNA sequence
ctgttagtaaattgtagagc

SEQ ID NO: 82043 - DNA, 20 bp, Artificial
  CRISPR gRNA sequence
tgttagtaaattgtagagcc

SEQ ID NO: 82044 - DNA, 20 bp, Artificial
  CRISPR gRNA sequence
ccaggacctgaactctaata

SEQ ID NO: 82045 - DNA, 20 bp, Artificial
  CRISPR gRNA sequence
agtcatgtgttacttaatga

SEQ ID NO: 82046 - DNA, 20 bp, Artificial
  CRISPR gRNA sequence
gtcatgtgttacttaatgac

SEQ ID NO: 82047 - DNA, 20 bp, Artificial
  CRISPR gRNA sequence
tcatgtgttacttaatgacg

SEQ ID NO: 82048 - DNA, 20 bp, Artificial
  CRISPR gRNA sequence
taatgacggggacatgttct

SEQ ID NO: 82049 - DNA, 20 bp, Artificial
  CRISPR gRNA sequence
gagaaatgcttacacaaacc

SEQ ID NO: 82050 - DNA, 20 bp, Artificial
  CRISPR gRNA sequence
agaaatgcttacacaaacct

SEQ ID NO: 82051 - DNA, 20 bp, Artificial
  CRISPR gRNA sequence
ttacacaaacctaggtgttg

SEQ ID NO: 82052 - DNA, 20 bp, Artificial
  CRISPR gRNA sequence
gttgtagcctactacacgca

SEQ ID NO: 82053 - DNA, 20 bp, Artificial
  CRISPR gRNA sequence
ttgtagcctactacacgcat

SEQ ID NO: 82054 - DNA, 20 bp, Artificial
  CRISPR gRNA sequence
tactacacgcataggctaca

SEQ ID NO: 82055 - DNA, 20 bp, Artificial
  CRISPR gRNA sequence
cacgcataggctacatggta

SEQ ID NO: 82056 - DNA, 20 bp, Artificial
  CRISPR gRNA sequence
atggtatagcctattgctcc

SEQ ID NO: 82057 - DNA, 20 bp, Artificial
  CRISPR gRNA sequence
tcctagactacaaacctgta

SEQ ID NO: 82058 - DNA, 20 bp, Artificial
  CRISPR gRNA sequence
tgttactgtactgaatactg

SEQ ID NO: 82059 - DNA, 20 bp, Artificial
  CRISPR gRNA sequence
gttactgtactgaatactgt

SEQ ID NO: 82060 - DNA, 20 bp, Artificial
  CRISPR gRNA sequence
actgtactgaatactgtggg

SEQ ID NO: 82061 - DNA, 20 bp, Artificial
  CRISPR gRNA sequence
tgtgggcagttgtaacacaa

SEQ ID NO: 82062 - DNA, 20 bp, Artificial
  CRISPR gRNA sequence
ggcagttgtaacacaatggt

SEQ ID NO: 82063 - DNA, 20 bp, Artificial
  CRISPR gRNA sequence
agtatttgtgtatctaaaca

SEQ ID NO: 82064 - DNA, 20 bp, Artificial
  CRISPR gRNA sequence
atttgtgtatctaaacatag

SEQ ID NO: 82065 - DNA, 20 bp, Artificial
  CRISPR gRNA sequence
gtatctaaacatagaagttg

SEQ ID NO: 82066 - DNA, 20 bp, Artificial
  CRISPR gRNA sequence
atatgctattttaatcttat

SEQ ID NO: 82067 - DNA, 20 bp, Artificial
  CRISPR gRNA sequence
tgagaccactgtcatatata

SEQ ID NO: 82068 - DNA, 20 bp, Artificial
  CRISPR gRNA sequence
cattgaccaaaacatcatat

SEQ ID NO: 82069 - DNA, 20 bp, Artificial
  CRISPR gRNA sequence
atatcagcattttttcttct

SEQ ID NO: 82070 - DNA, 20 bp, Artificial
  CRISPR gRNA sequence
cattttttcttctaagattt

SEQ ID NO: 82071 - DNA, 20 bp, Artificial
  CRISPR gRNA sequence
attttttcttctaagatttt

SEQ ID NO: 82072 - DNA, 20 bp, Artificial
  CRISPR gRNA sequence
tttttcttctaagattttgg

SEQ ID NO: 82073 - DNA, 20 bp, Artificial
  CRISPR gRNA sequence
ctaagattttgggagcacca

SEQ ID NO: 82074 - DNA, 20 bp, Artificial
  CRISPR gRNA sequence
taagattttgggagcaccaa

SEQ ID NO: 82075 - DNA, 20 bp, Artificial
  CRISPR gRNA sequence
aagattttgggagcaccaaa

SEQ ID NO: 82076 - DNA, 20 bp, Artificial
  CRISPR gRNA sequence
gcaccaaagggatacactaa

SEQ ID NO: 82077 - DNA, 20 bp, Artificial
  CRISPR gRNA sequence
caccaaagggatacactaac

SEQ ID NO: 82078 - DNA, 20 bp, Artificial
  CRISPR gRNA sequence
acaggatatactctttataa

SEQ ID NO: 82079 - DNA, 20 bp, Artificial
  CRISPR gRNA sequence
caggatatactctttataat

SEQ ID NO: 82080 - DNA, 20 bp, Artificial
  CRISPR gRNA sequence
tatactctttataatgggtt

SEQ ID NO: 82081 - DNA, 20 bp, Artificial
  CRISPR gRNA sequence
tactctttataatgggtttg

SEQ ID NO: 82082 - DNA, 20 bp, Artificial
  CRISPR gRNA sequence
tgggtttggagaactgtctg

SEQ ID NO: 82083 - DNA, 20 bp, Artificial
  CRISPR gRNA sequence
ctgcagctacttcttttaaa

SEQ ID NO: 82084 - DNA, 20 bp, Artificial
  CRISPR gRNA sequence
tgcagctacttcttttaaaa

SEQ ID NO: 82085 - DNA, 20 bp, Artificial
  CRISPR gRNA sequence
ttttaaaaaggtgatctaca

SEQ ID NO: 82086 - DNA, 20 bp, Artificial
  CRISPR gRNA sequence
taaaaaggtgatctacacag

SEQ ID NO: 82087 - DNA, 20 bp, Artificial
  CRISPR gRNA sequence
gtgatctacacagtagaaat

SEQ ID NO: 82088 - DNA, 20 bp, Artificial
  CRISPR gRNA sequence
ctacacagtagaaattagac

SEQ ID NO: 82089 - DNA, 20 bp, Artificial
  CRISPR gRNA sequence
cagtagaaattagacaagtt

SEQ ID NO: 82090 - DNA, 20 bp, Artificial
  CRISPR gRNA sequence
aattagacaagtttggtaat

SEQ ID NO: 82091 - DNA, 20 bp, Artificial
  CRISPR gRNA sequence
taacctttttcttttctttt

SEQ ID NO: 82092 - DNA, 20 bp, Artificial
  CRISPR gRNA sequence
aacctttttcttttcttttc

SEQ ID NO: 82093 - DNA, 20 bp, Artificial
  CRISPR gRNA sequence
ttcttttcttttcaggtttg

SEQ ID NO: 82094 - DNA, 20 bp, Artificial
  CRISPR gRNA sequence
aggtttgaagatgccgcatt

SEQ ID NO: 82095 - DNA, 20 bp, Artificial
  CRISPR gRNA sequence
tgaagatgccgcatttggat

SEQ ID NO: 82096 - DNA, 20 bp, Artificial
  CRISPR gRNA sequence
tacactttatgcacaaaatg

SEQ ID NO: 82097 - DNA, 20 bp, Artificial
  CRISPR gRNA sequence
acactttatgcacaaaatgt

SEQ ID NO: 82098 - DNA, 20 bp, Artificial
  CRISPR gRNA sequence
cactttatgcacaaaatgta

SEQ ID NO: 82099 - DNA, 20 bp, Artificial
  CRISPR gRNA sequence
gggttataataatgttaaca

SEQ ID NO: 82100 - DNA, 20 bp, Artificial
  CRISPR gRNA sequence
cttctttataattctacttt

SEQ ID NO: 82101 - DNA, 20 bp, Artificial
  CRISPR gRNA sequence
tctccatgtttgatgtatct

SEQ ID NO: 82102 - DNA, 20 bp, Artificial
  CRISPR gRNA sequence
ccatgtttgatgtatctgag

SEQ ID NO: 82103 - DNA, 20 bp, Artificial
  CRISPR gRNA sequence
catgtttgatgtatctgagc

SEQ ID NO: 82104 - DNA, 20 bp, Artificial
  CRISPR gRNA sequence
tatctgagcaggttgctcca

SEQ ID NO: 82105 - DNA, 20 bp, Artificial
  CRISPR gRNA sequence
atctgagcaggttgctccac

SEQ ID NO: 82106 - DNA, 20 bp, Artificial
  CRISPR gRNA sequence
tgagcaggttgctccacagg

SEQ ID NO: 82107 - DNA, 20 bp, Artificial
  CRISPR gRNA sequence
ggttgctccacaggtagctc

SEQ ID NO: 82108 - DNA, 20 bp, Artificial
  CRISPR gRNA sequence
gttgctccacaggtagctct

SEQ ID NO: 82109 - DNA, 20 bp, Artificial
  CRISPR gRNA sequence
tgctccacaggtagctctag

SEQ ID NO: 82110 - DNA, 20 bp, Artificial
  CRISPR gRNA sequence
gctccacaggtagctctagg

SEQ ID NO: 82111 - DNA, 20 bp, Artificial
  CRISPR gRNA sequence
ctccacaggtagctctagga

SEQ ID NO: 82112 - DNA, 20 bp, Artificial
  CRISPR gRNA sequence
acaggtagctctaggagggc

SEQ ID NO: 82113 - DNA, 20 bp, Artificial
  CRISPR gRNA sequence
ctctaggagggctggcaact

SEQ ID NO: 82114 - DNA, 20 bp, Artificial
  CRISPR gRNA sequence
ctaggagggctggcaactta

SEQ ID NO: 82115 - DNA, 20 bp, Artificial
  CRISPR gRNA sequence
taggagggctggcaacttag

SEQ ID NO: 82116 - DNA, 20 bp, Artificial
  CRISPR gRNA sequence
gagggctggcaacttagagg

SEQ ID NO: 82117 - DNA, 20 bp, Artificial
  CRISPR gRNA sequence
agggctggcaacttagaggt

SEQ ID NO: 82118 - DNA, 20 bp, Artificial
  CRISPR gRNA sequence
gggctggcaacttagaggtg

SEQ ID NO: 82119 - DNA, 20 bp, Artificial
  CRISPR gRNA sequence
gctggcaacttagaggtggg

SEQ ID NO: 82120 - DNA, 20 bp, Artificial
  CRISPR gRNA sequence
ggcaacttagaggtggggag

SEQ ID NO: 82121 - DNA, 20 bp, Artificial
  CRISPR gRNA sequence
caacttagaggtggggagca

SEQ ID NO: 82122 - DNA, 20 bp, Artificial
  CRISPR gRNA sequence
cttatccaacatcaacatct

SEQ ID NO: 82123 - DNA, 20 bp, Artificial
  CRISPR gRNA sequence
tccaacatcaacatcttggt

SEQ ID NO: 82124 - DNA, 20 bp, Artificial
  CRISPR gRNA sequence
tcttcaatctcttgcactca

SEQ ID NO: 82125 - DNA, 20 bp, Artificial
  CRISPR gRNA sequence
tcttgcactcaaagcttgtt

SEQ ID NO: 82126 - DNA, 20 bp, Artificial
  CRISPR gRNA sequence
gcactcaaagcttgttaaga

SEQ ID NO: 82127 - DNA, 20 bp, Artificial
  CRISPR gRNA sequence
caaagcttgttaagatagtt

SEQ ID NO: 82128 - DNA, 20 bp, Artificial
  CRISPR gRNA sequence
taagatagttaagcgtgcat

SEQ ID NO: 82129 - DNA, 20 bp, Artificial
  CRISPR gRNA sequence
tccaatttacatactctgct

SEQ ID NO: 82130 - DNA, 20 bp, Artificial
  CRISPR gRNA sequence
tacatactctgcttagaatt

SEQ ID NO: 82131 - DNA, 20 bp, Artificial
  CRISPR gRNA sequence
acatactctgcttagaattt

SEQ ID NO: 82132 - DNA, 20 bp, Artificial
  CRISPR gRNA sequence
catactctgcttagaatttg

SEQ ID NO: 82133 - DNA, 20 bp, Artificial
  CRISPR gRNA sequence
atactctgcttagaatttgg

SEQ ID NO: 82134 - DNA, 20 bp, Artificial
  CRISPR gRNA sequence
ttagaatttgggggaaaatt

SEQ ID NO: 82135 - DNA, 20 bp, Artificial
  CRISPR gRNA sequence
aaatttagaaatataattga

SEQ ID NO: 82136 - DNA, 20 bp, Artificial
  CRISPR gRNA sequence
aatttagaaatataattgac

SEQ ID NO: 82137 - DNA, 20 bp, Artificial
  CRISPR gRNA sequence
aatataattgacaggattat

SEQ ID NO: 82138 - DNA, 20 bp, Artificial
  CRISPR gRNA sequence
aatgaaacattttgtcatat

SEQ ID NO: 82139 - DNA, 20 bp, Artificial
  CRISPR gRNA sequence
tacttcttatacatttgata

SEQ ID NO: 82140 - DNA, 20 bp, Artificial
  CRISPR gRNA sequence
tcttatacatttgataaagt

SEQ ID NO: 82141 - DNA, 20 bp, Artificial
  CRISPR gRNA sequence
cttatacatttgataaagta

SEQ ID NO: 82142 - DNA, 20 bp, Artificial
  CRISPR gRNA sequence
acatttgataaagtaaggca

SEQ ID NO: 82143 - DNA, 20 bp, Artificial
  CRISPR gRNA sequence
gataaagtaaggcatggttg

SEQ ID NO: 82144 - DNA, 20 bp, Artificial
  CRISPR gRNA sequence
aggcatggttgtggttaatc

SEQ ID NO: 82145 - DNA, 20 bp, Artificial
  CRISPR gRNA sequence
ctggtttatttttgttccac

SEQ ID NO: 82146 - DNA, 20 bp, Artificial
  CRISPR gRNA sequence
attacccctttattttcaaa

SEQ ID NO: 82147 - DNA, 20 bp, Artificial
  CRISPR gRNA sequence
ttacccctttattttcaaac

SEQ ID NO: 82148 - DNA, 20 bp, Artificial
  CRISPR gRNA sequence
tacccctttattttcaaaca

SEQ ID NO: 82149 - DNA, 20 bp, Artificial
  CRISPR gRNA sequence
tttattttcaaacagggaaa

SEQ ID NO: 82150 - DNA, 20 bp, Artificial
  CRISPR gRNA sequence
caaacagggaaacagtcttc

SEQ ID NO: 82151 - DNA, 20 bp, Artificial
  CRISPR gRNA sequence
aacagtcttcaagttccact

SEQ ID NO: 82152 - DNA, 20 bp, Artificial
  CRISPR gRNA sequence
aaatgtgaaccccttgtata

SEQ ID NO: 82153 - DNA, 20 bp, Artificial
  CRISPR gRNA sequence
atgtgaaccccttgtatata

SEQ ID NO: 82154 - DNA, 20 bp, Artificial
  CRISPR gRNA sequence
aaccccttgtatatagagtt

SEQ ID NO: 82155 - DNA, 20 bp, Artificial
  CRISPR gRNA sequence
agccaaactctatatacaag

SEQ ID NO: 82156 - DNA, 20 bp, Artificial
  CRISPR gRNA sequence
aggggttcacattttttacc

SEQ ID NO: 82157 - DNA, 20 bp, Artificial
  CRISPR gRNA sequence
ggttcacattttttaccaag

SEQ ID NO: 82158 - DNA, 20 bp, Artificial
  CRISPR gRNA sequence
tttttaccaagtggaacttg

SEQ ID NO: 82159 - DNA, 20 bp, Artificial
  CRISPR gRNA sequence
tgtttccctgtttgaaaata

SEQ ID NO: 82160 - DNA, 20 bp, Artificial
  CRISPR gRNA sequence
gtttccctgtttgaaaataa

SEQ ID NO: 82161 - DNA, 20 bp, Artificial
  CRISPR gRNA sequence
tttccctgtttgaaaataaa

SEQ ID NO: 82162 - DNA, 20 bp, Artificial
  CRISPR gRNA sequence
ttccctgtttgaaaataaag

SEQ ID NO: 82163 - DNA, 20 bp, Artificial
  CRISPR gRNA sequence
gtttgaaaataaaggggtaa

SEQ ID NO: 82164 - DNA, 20 bp, Artificial
  CRISPR gRNA sequence
tgaaaataaaggggtaatag

SEQ ID NO: 82165 - DNA, 20 bp, Artificial
  CRISPR gRNA sequence
gaaaataaaggggtaatagt

SEQ ID NO: 82166 - DNA, 20 bp, Artificial
  CRISPR gRNA sequence
aaataaaggggtaatagtgg

SEQ ID NO: 82167 - DNA, 20 bp, Artificial
  CRISPR gRNA sequence
aaaggggtaatagtgggagt

SEQ ID NO: 82168 - DNA, 20 bp, Artificial
  CRISPR gRNA sequence
taatagtgggagtgagatat

SEQ ID NO: 82169 - DNA, 20 bp, Artificial
  CRISPR gRNA sequence
atagtgggagtgagatataa

SEQ ID NO: 82170 - DNA, 20 bp, Artificial
  CRISPR gRNA sequence
gatataagagataacacatc

SEQ ID NO: 82171 - DNA, 20 bp, Artificial
  CRISPR gRNA sequence
tttatgatttatttaacttg

SEQ ID NO: 82172 - DNA, 20 bp, Artificial
  CRISPR gRNA sequence
cttgtggaacaaaaataaac

SEQ ID NO: 82173 - DNA, 20 bp, Artificial
  CRISPR gRNA sequence
ccttactttatcaaatgtat

SEQ ID NO: 82174 - DNA, 20 bp, Artificial
  CRISPR gRNA sequence
tactttatcaaatgtataag

SEQ ID NO: 82175 - DNA, 20 bp, Artificial
  CRISPR gRNA sequence
taaattttcccccaaattct

SEQ ID NO: 82176 - DNA, 20 bp, Artificial
  CRISPR gRNA sequence
attttcccccaaattctaag

SEQ ID NO: 82177 - DNA, 20 bp, Artificial
  CRISPR gRNA sequence
tttcccccaaattctaagca

SEQ ID NO: 82178 - DNA, 20 bp, Artificial
  CRISPR gRNA sequence
tctaagcagagtatgtaaat

SEQ ID NO: 82179 - DNA, 20 bp, Artificial
  CRISPR gRNA sequence
aagcagagtatgtaaattgg

SEQ ID NO: 82180 - DNA, 20 bp, Artificial
  CRISPR gRNA sequence
gcacgcttaactatcttaac

SEQ ID NO: 82181 - DNA, 20 bp, Artificial
  CRISPR gRNA sequence
taactatcttaacaagcttt

SEQ ID NO: 82182 - DNA, 20 bp, Artificial
  CRISPR gRNA sequence
tcttaacaagctttgagtgc

SEQ ID NO: 82183 - DNA, 20 bp, Artificial
  CRISPR gRNA sequence
ttaacaagctttgagtgcaa

SEQ ID NO: 82184 - DNA, 20 bp, Artificial
  CRISPR gRNA sequence
gctttgagtgcaagagattg

SEQ ID NO: 82185 - DNA, 20 bp, Artificial
  CRISPR gRNA sequence
tttgagtgcaagagattgaa

SEQ ID NO: 82186 - DNA, 20 bp, Artificial
  CRISPR gRNA sequence
tgaagagttcaaatctgacc

SEQ ID NO: 82187 - DNA, 20 bp, Artificial
  CRISPR gRNA sequence
tctgaccaagatgttgatgt

SEQ ID NO: 82188 - DNA, 20 bp, Artificial
  CRISPR gRNA sequence
ccaagatgttgatgttggat

SEQ ID NO: 82189 - DNA, 20 bp, Artificial
  CRISPR gRNA sequence
aagatgttgatgttggataa

SEQ ID NO: 82190 - DNA, 20 bp, Artificial
  CRISPR gRNA sequence
attctctgctccccacctct

SEQ ID NO: 82191 - DNA, 20 bp, Artificial
  CRISPR gRNA sequence
gctccccacctctaagttgc

SEQ ID NO: 82192 - DNA, 20 bp, Artificial
  CRISPR gRNA sequence
ctctaagttgccagccctcc

SEQ ID NO: 82193 - DNA, 20 bp, Artificial
  CRISPR gRNA sequence
ctaagttgccagccctccta

SEQ ID NO: 82194 - DNA, 20 bp, Artificial
  CRISPR gRNA sequence
agccctcctagagctacctg

SEQ ID NO: 82195 - DNA, 20 bp, Artificial
  CRISPR gRNA sequence
ccctcctagagctacctgtg

SEQ ID NO: 82196 - DNA, 20 bp, Artificial
  CRISPR gRNA sequence
tacctgtggagcaacctgct

SEQ ID NO: 82197 - DNA, 20 bp, Artificial
  CRISPR gRNA sequence
ctgctcagatacatcaaaca

SEQ ID NO: 82198 - DNA, 20 bp, Artificial
  CRISPR gRNA sequence
gctcagatacatcaaacatg

SEQ ID NO: 82199 - DNA, 20 bp, Artificial
  CRISPR gRNA sequence
agatacatcaaacatggaga

SEQ ID NO: 82200 - DNA, 20 bp, Artificial
  CRISPR gRNA sequence
aaacatggagacagcactca

SEQ ID NO: 82201 - DNA, 20 bp, Artificial
  CRISPR gRNA sequence
catggagacagcactcaaag

SEQ ID NO: 82202 - DNA, 20 bp, Artificial
  CRISPR gRNA sequence
gcactcaaagtagaattata

SEQ ID NO: 82203 - DNA, 20 bp, Artificial
  CRISPR gRNA sequence
ctcaaagtagaattataaag

SEQ ID NO: 82204 - DNA, 20 bp, Artificial
  CRISPR gRNA sequence
aaccctacattttgtgcata

SEQ ID NO: 82205 - DNA, 20 bp, Artificial
  CRISPR gRNA sequence
acattttgtgcataaagtgt

SEQ ID NO: 82206 - DNA, 20 bp, Artificial
  CRISPR gRNA sequence
tgcataaagtgtaagtgtat

SEQ ID NO: 82207 - DNA, 20 bp, Artificial
  CRISPR gRNA sequence
ataagcatatcaatattaaa

SEQ ID NO: 82208 - DNA, 20 bp, Artificial
  CRISPR gRNA sequence
gcatatcaatattaaaaagc

SEQ ID NO: 82209 - DNA, 20 bp, Artificial
  CRISPR gRNA sequence
atcaatattaaaaagcaagc

SEQ ID NO: 82210 - DNA, 20 bp, Artificial
  CRISPR gRNA sequence
aatattaaaaagcaagcaag

SEQ ID NO: 82211 - DNA, 20 bp, Artificial
  CRISPR gRNA sequence
aaaagcaagcaagcagaatt

SEQ ID NO: 82212 - DNA, 20 bp, Artificial
  CRISPR gRNA sequence
gaattcatccaatccaaatg

SEQ ID NO: 82213 - DNA, 20 bp, Artificial
  CRISPR gRNA sequence
gcggcatcttcaaacctgaa

SEQ ID NO: 82214 - DNA, 20 bp, Artificial
  CRISPR gRNA sequence
atcttcaaacctgaaaagaa

SEQ ID NO: 82215 - DNA, 20 bp, Artificial
  CRISPR gRNA sequence
aaacctgaaaagaaaagaaa

SEQ ID NO: 82216 - DNA, 20 bp, Artificial
  CRISPR gRNA sequence
aacctgaaaagaaaagaaaa

SEQ ID NO: 82217 - DNA, 20 bp, Artificial
  CRISPR gRNA sequence
tgaaaagaaaagaaaaaggt

SEQ ID NO: 82218 - DNA, 20 bp, Artificial
  CRISPR gRNA sequence
agcaatgaatttattttatt

SEQ ID NO: 82219 - DNA, 20 bp, Artificial
  CRISPR gRNA sequence
aatttattttatttggattg

SEQ ID NO: 82220 - DNA, 20 bp, Artificial
  CRISPR gRNA sequence
cttgtctaatttctactgtg

SEQ ID NO: 82221 - DNA, 20 bp, Artificial
  CRISPR gRNA sequence
tgtgtagatcacctttttaa

SEQ ID NO: 82222 - DNA, 20 bp, Artificial
  CRISPR gRNA sequence
gtagatcacctttttaaaag

SEQ ID NO: 82223 - DNA, 20 bp, Artificial
  CRISPR gRNA sequence
gatcacctttttaaaagaag

SEQ ID NO: 82224 - DNA, 20 bp, Artificial
  CRISPR gRNA sequence
ctttttaaaagaagtagctg

SEQ ID NO: 82225 - DNA, 20 bp, Artificial
  CRISPR gRNA sequence
ttaaaagaagtagctgcaga

SEQ ID NO: 82226 - DNA, 20 bp, Artificial
  CRISPR gRNA sequence
agttctccaaacccattata

SEQ ID NO: 82227 - DNA, 20 bp, Artificial
  CRISPR gRNA sequence
ttctccaaacccattataaa

SEQ ID NO: 82228 - DNA, 20 bp, Artificial
  CRISPR gRNA sequence
ttataaagagtatatcctgt

SEQ ID NO: 82229 - DNA, 20 bp, Artificial
  CRISPR gRNA sequence
atcctgttagtgtatccctt

SEQ ID NO: 82230 - DNA, 20 bp, Artificial
  CRISPR gRNA sequence
ctttggtgctcccaaaatct

SEQ ID NO: 82231 - DNA, 20 bp, Artificial
  CRISPR gRNA sequence
tggtgctcccaaaatcttag

SEQ ID NO: 82232 - DNA, 20 bp, Artificial
  CRISPR gRNA sequence
aaaatgctgatatgatgttt

SEQ ID NO: 82233 - DNA, 20 bp, Artificial
  CRISPR gRNA sequence
tatgatgttttggtcaatga

SEQ ID NO: 82234 - DNA, 20 bp, Artificial
  CRISPR gRNA sequence
atgatggactgtatatatga

SEQ ID NO: 82235 - DNA, 20 bp, Artificial
  CRISPR gRNA sequence
atggactgtatatatgacag

SEQ ID NO: 82236 - DNA, 20 bp, Artificial
  CRISPR gRNA sequence
atatatgacagtggtctcat

SEQ ID NO: 82237 - DNA, 20 bp, Artificial
  CRISPR gRNA sequence
gtggtctcataagattaaaa

SEQ ID NO: 82238 - DNA, 20 bp, Artificial
  CRISPR gRNA sequence
tttactgcaacttctatgtt

SEQ ID NO: 82239 - DNA, 20 bp, Artificial
  CRISPR gRNA sequence
cattgtgttacaactgccca

SEQ ID NO: 82240 - DNA, 20 bp, Artificial
  CRISPR gRNA sequence
ttacaactgcccacagtatt

SEQ ID NO: 82241 - DNA, 20 bp, Artificial
  CRISPR gRNA sequence
actgcccacagtattcagta

SEQ ID NO: 82242 - DNA, 20 bp, Artificial
  CRISPR gRNA sequence
cacagtattcagtacagtaa

SEQ ID NO: 82243 - DNA, 20 bp, Artificial
  CRISPR gRNA sequence
acagtattcagtacagtaac

SEQ ID NO: 82244 - DNA, 20 bp, Artificial
  CRISPR gRNA sequence
cagtacagtaacaggctgta

SEQ ID NO: 82245 - DNA, 20 bp, Artificial
  CRISPR gRNA sequence
agtacagtaacaggctgtac

SEQ ID NO: 82246 - DNA, 20 bp, Artificial
  CRISPR gRNA sequence
taacaggctgtacaggtttg

SEQ ID NO: 82247 - DNA, 20 bp, Artificial
  CRISPR gRNA sequence
ggctgtacaggtttgtagtc

SEQ ID NO: 82248 - DNA, 20 bp, Artificial
  CRISPR gRNA sequence
gctgtacaggtttgtagtct

SEQ ID NO: 82249 - DNA, 20 bp, Artificial
  CRISPR gRNA sequence
tgtacaggtttgtagtctag

SEQ ID NO: 82250 - DNA, 20 bp, Artificial
  CRISPR gRNA sequence
ggtttgtagtctaggagcaa

SEQ ID NO: 82251 - DNA, 20 bp, Artificial
  CRISPR gRNA sequence
gtttgtagtctaggagcaat

SEQ ID NO: 82252 - DNA, 20 bp, Artificial
  CRISPR gRNA sequence
gagcaataggctataccatg

SEQ ID NO: 82253 - DNA, 20 bp, Artificial
  CRISPR gRNA sequence
taccatgtagcctatgcgtg

SEQ ID NO: 82254 - DNA, 20 bp, Artificial
  CRISPR gRNA sequence
catgtagcctatgcgtgtag

SEQ ID NO: 82255 - DNA, 20 bp, Artificial
  CRISPR gRNA sequence
atgtagcctatgcgtgtagt

SEQ ID NO: 82256 - DNA, 20 bp, Artificial
  CRISPR gRNA sequence
gtgtagtaggctacaacacc

SEQ ID NO: 82257 - DNA, 20 bp, Artificial
  CRISPR gRNA sequence
tgtagtaggctacaacacct

SEQ ID NO: 82258 - DNA, 20 bp, Artificial
  CRISPR gRNA sequence
tacaacacctaggtttgtgt

SEQ ID NO: 82259 - DNA, 20 bp, Artificial
  CRISPR gRNA sequence
aggtttgtgtaagcatttct

SEQ ID NO: 82260 - DNA, 20 bp, Artificial
  CRISPR gRNA sequence
cagaacatgtccccgtcatt

SEQ ID NO: 82261 - DNA, 20 bp, Artificial
  CRISPR gRNA sequence
taagtaacacatgactatat

SEQ ID NO: 82262 - DNA, 20 bp, Artificial
  CRISPR gRNA sequence
agtaacacatgactatatta

SEQ ID NO: 82263 - DNA, 20 bp, Artificial
  CRISPR gRNA sequence
cacatgactatattagagtt

SEQ ID NO: 82264 - DNA, 20 bp, Artificial
  CRISPR gRNA sequence
acatgactatattagagttc

SEQ ID NO: 82265 - DNA, 20 bp, Artificial
  CRISPR gRNA sequence
ctatattagagttcaggtcc

SEQ ID NO: 82266 - DNA, 20 bp, Artificial
  CRISPR gRNA sequence
ctggctctacaatttactaa

SEQ ID NO: 82267 - DNA, 20 bp, Artificial
  CRISPR gRNA sequence
caatttactaacagtgtgac

SEQ ID NO: 82268 - DNA, 20 bp, Artificial
  CRISPR gRNA sequence
aatttactaacagtgtgact

SEQ ID NO: 82269 - DNA, 20 bp, Artificial
  CRISPR gRNA sequence
ttactaacagtgtgactggg

SEQ ID NO: 82270 - DNA, 20 bp, Artificial
  CRISPR gRNA sequence
cccaaatcaattccctgttc

SEQ ID NO: 82271 - DNA, 20 bp, Artificial
  CRISPR gRNA sequence
ttccctgttctagaatataa

SEQ ID NO: 82272 - DNA, 20 bp, Artificial
  CRISPR gRNA sequence
tccctgttctagaatataac

SEQ ID NO: 82273 - DNA, 20 bp, Artificial
  CRISPR gRNA sequence
cctgttctagaatataacag

SEQ ID NO: 82274 - DNA, 20 bp, Artificial
  CRISPR gRNA sequence
aatataacaggagatttgaa

SEQ ID NO: 82275 - DNA, 20 bp, Artificial
  CRISPR gRNA sequence
atataacaggagatttgaat

SEQ ID NO: 82276 - DNA, 20 bp, Artificial
  CRISPR gRNA sequence
tataacaggagatttgaatg

SEQ ID NO: 82277 - DNA, 20 bp, Artificial
  CRISPR gRNA sequence
aggagatttgaatggggttt

SEQ ID NO: 82278 - DNA, 20 bp, Artificial
  CRISPR gRNA sequence
gtttcagcatcaatgtaccc

SEQ ID NO: 82279 - DNA, 20 bp, Artificial
  CRISPR gRNA sequence
tttcagcatcaatgtaccct

SEQ ID NO: 82280 - DNA, 20 bp, Artificial
  CRISPR gRNA sequence
cagcatcaatgtaccctggg

SEQ ID NO: 82281 - DNA, 20 bp, Artificial
  CRISPR gRNA sequence
catcaatgtaccctgggcag

SEQ ID NO: 82282 - DNA, 20 bp, Artificial
  CRISPR gRNA sequence
ggcagtagaatttcattgaa

SEQ ID NO: 82283 - DNA, 20 bp, Artificial
  CRISPR gRNA sequence
gaatttcattgaaaagcctt

SEQ ID NO: 82284 - DNA, 20 bp, Artificial
  CRISPR gRNA sequence
aagcctttggactccaacta

SEQ ID NO: 82285 - DNA, 20 bp, Artificial
  CRISPR gRNA sequence
ttggactccaactaaagatg

SEQ ID NO: 82286 - DNA, 20 bp, Artificial
  CRISPR gRNA sequence
ggactccaactaaagatgca

SEQ ID NO: 82287 - DNA, 20 bp, Artificial
  CRISPR gRNA sequence
ctccaactaaagatgcagag

SEQ ID NO: 82288 - DNA, 20 bp, Artificial
  CRISPR gRNA sequence
ctaaagatgcagagaagtcc

SEQ ID NO: 82289 - DNA, 20 bp, Artificial
  CRISPR gRNA sequence
tcctccctctctcttgcttc

SEQ ID NO: 82290 - DNA, 20 bp, Artificial
  CRISPR gRNA sequence
ctccctctctcttgcttctg

SEQ ID NO: 82291 - DNA, 20 bp, Artificial
  CRISPR gRNA sequence
cttgcttctggagctccttg

SEQ ID NO: 82292 - DNA, 20 bp, Artificial
  CRISPR gRNA sequence
ccttgtagttacatctatta

SEQ ID NO: 82293 - DNA, 20 bp, Artificial
  CRISPR gRNA sequence
tattatagtatcattatatc

SEQ ID NO: 82294 - DNA, 20 bp, Artificial
  CRISPR gRNA sequence
ctgtttccctttatctcctc

SEQ ID NO: 82295 - DNA, 20 bp, Artificial
  CRISPR gRNA sequence
tttccctttatctcctctag

SEQ ID NO: 82296 - DNA, 20 bp, Artificial
  CRISPR gRNA sequence
ctttatctcctctagtggcc

SEQ ID NO: 82297 - DNA, 20 bp, Artificial
  CRISPR gRNA sequence
tttatctcctctagtggcct

SEQ ID NO: 82298 - DNA, 20 bp, Artificial
  CRISPR gRNA sequence
ctagtggcctgggaacctct

SEQ ID NO: 82299 - DNA, 20 bp, Artificial
  CRISPR gRNA sequence
agtggcctgggaacctctaa

SEQ ID NO: 82300 - DNA, 20 bp, Artificial
  CRISPR gRNA sequence
gtggcctgggaacctctaag

SEQ ID NO: 82301 - DNA, 20 bp, Artificial
  CRISPR gRNA sequence
gaacctctaagaggcaaaca

SEQ ID NO: 82302 - DNA, 20 bp, Artificial
  CRISPR gRNA sequence
aggcaaacacagtccccata

SEQ ID NO: 82303 - DNA, 20 bp, Artificial
  CRISPR gRNA sequence
ggcaaacacagtccccatac

SEQ ID NO: 82304 - DNA, 20 bp, Artificial
  CRISPR gRNA sequence
acacagtccccatacaggaa

SEQ ID NO: 82305 - DNA, 20 bp, Artificial
  CRISPR gRNA sequence
cacagtccccatacaggaat

SEQ ID NO: 82306 - DNA, 20 bp, Artificial
  CRISPR gRNA sequence
atacaggaatgggatgtctg

SEQ ID NO: 82307 - DNA, 20 bp, Artificial
  CRISPR gRNA sequence
acaggaatgggatgtctgca

SEQ ID NO: 82308 - DNA, 20 bp, Artificial
  CRISPR gRNA sequence
taactcctctcttctgtctg

SEQ ID NO: 82309 - DNA, 20 bp, Artificial
  CRISPR gRNA sequence
gaataaaacaacattataca

SEQ ID NO: 82310 - DNA, 20 bp, Artificial
  CRISPR gRNA sequence
aataaaacaacattatacaa

SEQ ID NO: 82311 - DNA, 20 bp, Artificial
  CRISPR gRNA sequence
aacaacattatacaaaggaa

SEQ ID NO: 82312 - DNA, 20 bp, Artificial
  CRISPR gRNA sequence
caacattatacaaaggaaaa

SEQ ID NO: 82313 - DNA, 20 bp, Artificial
  CRISPR gRNA sequence
cattatacaaaggaaaagag

SEQ ID NO: 82314 - DNA, 20 bp, Artificial
  CRISPR gRNA sequence
agtggttcattttctctcct

SEQ ID NO: 82315 - DNA, 20 bp, Artificial
  CRISPR gRNA sequence
ggttcattttctctcctcag

SEQ ID NO: 82316 - DNA, 20 bp, Artificial
  CRISPR gRNA sequence
ttcattttctctcctcagca

SEQ ID NO: 82317 - DNA, 20 bp, Artificial
  CRISPR gRNA sequence
ctcagcagagatgtccaatg

SEQ ID NO: 82318 - DNA, 20 bp, Artificial
  CRISPR gRNA sequence
agagatgtccaatgtggaaa

SEQ ID NO: 82319 - DNA, 20 bp, Artificial
  CRISPR gRNA sequence
gatgtccaatgtggaaatgg

SEQ ID NO: 82320 - DNA, 20 bp, Artificial
  CRISPR gRNA sequence
gtccaatgtggaaatggcag

SEQ ID NO: 82321 - DNA, 20 bp, Artificial
  CRISPR gRNA sequence
aatgtggaaatggcagaaga

SEQ ID NO: 82322 - DNA, 20 bp, Artificial
  CRISPR gRNA sequence
aaatggcagaagaaagatca

SEQ ID NO: 82323 - DNA, 20 bp, Artificial
  CRISPR gRNA sequence
gaagaaagatcaaagccttg

SEQ ID NO: 82324 - DNA, 20 bp, Artificial
  CRISPR gRNA sequence
aagaaagatcaaagccttgc

SEQ ID NO: 82325 - DNA, 20 bp, Artificial
  CRISPR gRNA sequence
tcaaagccttgcaggtaatg

SEQ ID NO: 82326 - DNA, 20 bp, Artificial
  CRISPR gRNA sequence
caaagccttgcaggtaatgt

SEQ ID NO: 82327 - DNA, 20 bp, Artificial
  CRISPR gRNA sequence
tttatcctgcaataccatac

SEQ ID NO: 82328 - DNA, 20 bp, Artificial
  CRISPR gRNA sequence
atcctgcaataccatactgg

SEQ ID NO: 82329 - DNA, 20 bp, Artificial
  CRISPR gRNA sequence
cagttcctttgccctctctg

SEQ ID NO: 82330 - DNA, 20 bp, Artificial
  CRISPR gRNA sequence
gttcctttgccctctctgta

SEQ ID NO: 82331 - DNA, 20 bp, Artificial
  CRISPR gRNA sequence
ttcctttgccctctctgtag

SEQ ID NO: 82332 - DNA, 20 bp, Artificial
  CRISPR gRNA sequence
tcctttgccctctctgtaga

SEQ ID NO: 82333 - DNA, 20 bp, Artificial
  CRISPR gRNA sequence
ttgccctctctgtagagggt

SEQ ID NO: 82334 - DNA, 20 bp, Artificial
  CRISPR gRNA sequence
tctgtagagggtcagtaata

SEQ ID NO: 82335 - DNA, 20 bp, Artificial
  CRISPR gRNA sequence
gtcagtaatatggccatacc

SEQ ID NO: 82336 - DNA, 20 bp, Artificial
  CRISPR gRNA sequence
tcagtaatatggccatacct

SEQ ID NO: 82337 - DNA, 20 bp, Artificial
  CRISPR gRNA sequence
cagtaatatggccatacctg

SEQ ID NO: 82338 - DNA, 20 bp, Artificial
  CRISPR gRNA sequence
accttcttcatgccactcca

SEQ ID NO: 82339 - DNA, 20 bp, Artificial
  CRISPR gRNA sequence
ccttcttcatgccactccac

SEQ ID NO: 82340 - DNA, 20 bp, Artificial
  CRISPR gRNA sequence
ttcttcatgccactccacag

SEQ ID NO: 82341 - DNA, 20 bp, Artificial
  CRISPR gRNA sequence
ttcatgccactccacaggag

SEQ ID NO: 82342 - DNA, 20 bp, Artificial
  CRISPR gRNA sequence
tcatgccactccacaggaga

SEQ ID NO: 82343 - DNA, 20 bp, Artificial
  CRISPR gRNA sequence
catgccactccacaggagaa

SEQ ID NO: 82344 - DNA, 20 bp, Artificial
  CRISPR gRNA sequence
gagaagggaacatgaccctg

SEQ ID NO: 82345 - DNA, 20 bp, Artificial
  CRISPR gRNA sequence
agaagggaacatgaccctgt

SEQ ID NO: 82346 - DNA, 20 bp, Artificial
  CRISPR gRNA sequence
ctctgtcaatgttctccaca

SEQ ID NO: 82347 - DNA, 20 bp, Artificial
  CRISPR gRNA sequence
gtcaatgttctccacatagt

SEQ ID NO: 82348 - DNA, 20 bp, Artificial
  CRISPR gRNA sequence
tcaatgttctccacatagtg

SEQ ID NO: 82349 - DNA, 20 bp, Artificial
  CRISPR gRNA sequence
caatgttctccacatagtga

SEQ ID NO: 82350 - DNA, 20 bp, Artificial
  CRISPR gRNA sequence
catagtgagggttatcatgt

SEQ ID NO: 82351 - DNA, 20 bp, Artificial
  CRISPR gRNA sequence
tagtgagggttatcatgtta

SEQ ID NO: 82352 - DNA, 20 bp, Artificial
  CRISPR gRNA sequence
atgttagagctgtctataaa

SEQ ID NO: 82353 - DNA, 20 bp, Artificial
  CRISPR gRNA sequence
agctgtctataaatagtcct

SEQ ID NO: 82354 - DNA, 20 bp, Artificial
  CRISPR gRNA sequence
gctgtctataaatagtcctc

SEQ ID NO: 82355 - DNA, 20 bp, Artificial
  CRISPR gRNA sequence
tctataaatagtcctcagga

SEQ ID NO: 82356 - DNA, 20 bp, Artificial
  CRISPR gRNA sequence
tgaaacaaaaacattttctc

SEQ ID NO: 82357 - DNA, 20 bp, Artificial
  CRISPR gRNA sequence
gaaacaaaaacattttctca

SEQ ID NO: 82358 - DNA, 20 bp, Artificial
  CRISPR gRNA sequence
acatgtctcgatctatgaaa

SEQ ID NO: 82359 - DNA, 20 bp, Artificial
  CRISPR gRNA sequence
gtctcgatctatgaaaaaga

SEQ ID NO: 82360 - DNA, 20 bp, Artificial
  CRISPR gRNA sequence
tcgatctatgaaaaagacag

SEQ ID NO: 82361 - DNA, 20 bp, Artificial
  CRISPR gRNA sequence
gatctatgaaaaagacagtg

SEQ ID NO: 82362 - DNA, 20 bp, Artificial
  CRISPR gRNA sequence
aaaagacagtggagaaaaaa

SEQ ID NO: 82363 - DNA, 20 bp, Artificial
  CRISPR gRNA sequence
aaagacagtggagaaaaaaa

SEQ ID NO: 82364 - DNA, 20 bp, Artificial
  CRISPR gRNA sequence
gacagtggagaaaaaaaagg

SEQ ID NO: 82365 - DNA, 20 bp, Artificial
  CRISPR gRNA sequence
agaaaaaaaaggaagacatt

SEQ ID NO: 82366 - DNA, 20 bp, Artificial
  CRISPR gRNA sequence
gtactaacaaatgtctaaaa

SEQ ID NO: 82367 - DNA, 20 bp, Artificial
  CRISPR gRNA sequence
taacaaatgtctaaaatggt

SEQ ID NO: 82368 - DNA, 20 bp, Artificial
  CRISPR gRNA sequence
tgtctaaaatggttagaaat

SEQ ID NO: 82369 - DNA, 20 bp, Artificial
  CRISPR gRNA sequence
gtctaaaatggttagaaata

SEQ ID NO: 82370 - DNA, 20 bp, Artificial
  CRISPR gRNA sequence
aaaatggttagaaataaggc

SEQ ID NO: 82371 - DNA, 20 bp, Artificial
  CRISPR gRNA sequence
atggttagaaataaggctgg

SEQ ID NO: 82372 - DNA, 20 bp, Artificial
  CRISPR gRNA sequence
tagaaataaggctggcagaa

SEQ ID NO: 82373 - DNA, 20 bp, Artificial
  CRISPR gRNA sequence
agaaataaggctggcagaat

SEQ ID NO: 82374 - DNA, 20 bp, Artificial
  CRISPR gRNA sequence
ctacccatgaatacattgtt

SEQ ID NO: 82375 - DNA, 20 bp, Artificial
  CRISPR gRNA sequence
acccatgaatacattgttta

SEQ ID NO: 82376 - DNA, 20 bp, Artificial
  CRISPR gRNA sequence
atacattgtttagagctacc

SEQ ID NO: 82377 - DNA, 20 bp, Artificial
  CRISPR gRNA sequence
cattgtttagagctacccag

SEQ ID NO: 82378 - DNA, 20 bp, Artificial
  CRISPR gRNA sequence
attgtttagagctacccagc

SEQ ID NO: 82379 - DNA, 20 bp, Artificial
  CRISPR gRNA sequence
tagagctacccagcaggaac

SEQ ID NO: 82380 - DNA, 20 bp, Artificial
  CRISPR gRNA sequence
caggaacaagcccttcctac

SEQ ID NO: 82381 - DNA, 20 bp, Artificial
  CRISPR gRNA sequence
caagcccttcctactagcct

SEQ ID NO: 82382 - DNA, 20 bp, Artificial
  CRISPR gRNA sequence
actagcctcagataccaatc

SEQ ID NO: 82383 - DNA, 20 bp, Artificial
  CRISPR gRNA sequence
gcctcagataccaatccagc

SEQ ID NO: 82384 - DNA, 20 bp, Artificial
  CRISPR gRNA sequence
cagataccaatccagccaga

SEQ ID NO: 82385 - DNA, 20 bp, Artificial
  CRISPR gRNA sequence
ccaatccagccagaaagtac

SEQ ID NO: 82386 - DNA, 20 bp, Artificial
  CRISPR gRNA sequence
aatccagccagaaagtactg

SEQ ID NO: 82387 - DNA, 20 bp, Artificial
  CRISPR gRNA sequence
ccagccagaaagtactggag

SEQ ID NO: 82388 - DNA, 20 bp, Artificial
  CRISPR gRNA sequence
cagaaagtactggagaagtc

SEQ ID NO: 82389 - DNA, 20 bp, Artificial
  CRISPR gRNA sequence
agaaagtactggagaagtcc

SEQ ID NO: 82390 - DNA, 20 bp, Artificial
  CRISPR gRNA sequence
actggagaagtccaggatta

SEQ ID NO: 82391 - DNA, 20 bp, Artificial
  CRISPR gRNA sequence
ctggagaagtccaggattat

SEQ ID NO: 82392 - DNA, 20 bp, Artificial
  CRISPR gRNA sequence
agtccaggattataggatgc

SEQ ID NO: 82393 - DNA, 20 bp, Artificial
  CRISPR gRNA sequence
gtccaggattataggatgct

SEQ ID NO: 82394 - DNA, 20 bp, Artificial
  CRISPR gRNA sequence
aggattataggatgctagga

SEQ ID NO: 82395 - DNA, 20 bp, Artificial
  CRISPR gRNA sequence
attataggatgctaggacag

SEQ ID NO: 82396 - DNA, 20 bp, Artificial
  CRISPR gRNA sequence
ttataggatgctaggacagc

SEQ ID NO: 82397 - DNA, 20 bp, Artificial
  CRISPR gRNA sequence
gacagcaggacttacaaaca

SEQ ID NO: 82398 - DNA, 20 bp, Artificial
  CRISPR gRNA sequence
acagcaggacttacaaacaa

SEQ ID NO: 82399 - DNA, 20 bp, Artificial
  CRISPR gRNA sequence
acaaaggcctataccttctt

SEQ ID NO: 82400 - DNA, 20 bp, Artificial
  CRISPR gRNA sequence
accttcttgagatgttcgtt

SEQ ID NO: 82401 - DNA, 20 bp, Artificial
  CRISPR gRNA sequence
ttcagtgctaaatatacctg

SEQ ID NO: 82402 - DNA, 20 bp, Artificial
  CRISPR gRNA sequence
tatacctgaagctgccacaa

SEQ ID NO: 82403 - DNA, 20 bp, Artificial
  CRISPR gRNA sequence
cctgaagctgccacaaaagc

SEQ ID NO: 82404 - DNA, 20 bp, Artificial
  CRISPR gRNA sequence
tgaagctgccacaaaagcta

SEQ ID NO: 82405 - DNA, 20 bp, Artificial
  CRISPR gRNA sequence
gaagctgccacaaaagctag

SEQ ID NO: 82406 - DNA, 20 bp, Artificial
  CRISPR gRNA sequence
gctgccacaaaagctagagg

SEQ ID NO: 82407 - DNA, 20 bp, Artificial
  CRISPR gRNA sequence
ccacaaaagctagaggaagc

SEQ ID NO: 82408 - DNA, 20 bp, Artificial
  CRISPR gRNA sequence
caaaagctagaggaagccag

SEQ ID NO: 82409 - DNA, 20 bp, Artificial
  CRISPR gRNA sequence
aaaagctagaggaagccagt

SEQ ID NO: 82410 - DNA, 20 bp, Artificial
  CRISPR gRNA sequence
gctagaggaagccagtaggt

SEQ ID NO: 82411 - DNA, 20 bp, Artificial
  CRISPR gRNA sequence
agaggaagccagtaggtaag

SEQ ID NO: 82412 - DNA, 20 bp, Artificial
  CRISPR gRNA sequence
gccagtaggtaagaagtgtt

SEQ ID NO: 82413 - DNA, 20 bp, Artificial
  CRISPR gRNA sequence
cagtaggtaagaagtgttaa

SEQ ID NO: 82414 - DNA, 20 bp, Artificial
  CRISPR gRNA sequence
gagtgtatatgtatttgtgc

SEQ ID NO: 82415 - DNA, 20 bp, Artificial
  CRISPR gRNA sequence
tgctgctccctgctcaactg

SEQ ID NO: 82416 - DNA, 20 bp, Artificial
  CRISPR gRNA sequence
gctgctccctgctcaactgc

SEQ ID NO: 82417 - DNA, 20 bp, Artificial
  CRISPR gRNA sequence
ctgctccctgctcaactgca

SEQ ID NO: 82418 - DNA, 20 bp, Artificial
  CRISPR gRNA sequence
ctcaactgcagggaaactac

SEQ ID NO: 82419 - DNA, 20 bp, Artificial
  CRISPR gRNA sequence
ctgcagggaaactactggtt

SEQ ID NO: 82420 - DNA, 20 bp, Artificial
  CRISPR gRNA sequence
tcagaaaccatgctgtgcat

SEQ ID NO: 82421 - DNA, 20 bp, Artificial
  CRISPR gRNA sequence
catgctgtgcatcagtatct

SEQ ID NO: 82422 - DNA, 20 bp, Artificial
  CRISPR gRNA sequence
gctgtgcatcagtatctcag

SEQ ID NO: 82423 - DNA, 20 bp, Artificial
  CRISPR gRNA sequence
ctgtgcatcagtatctcagc

SEQ ID NO: 82424 - DNA, 20 bp, Artificial
  CRISPR gRNA sequence
gtgccactaatctgatcttt

SEQ ID NO: 82425 - DNA, 20 bp, Artificial
  CRISPR gRNA sequence
tccctgacaatcccaatatg

SEQ ID NO: 82426 - DNA, 20 bp, Artificial
  CRISPR gRNA sequence
aatatgcagattgtttatat

SEQ ID NO: 82427 - DNA, 20 bp, Artificial
  CRISPR gRNA sequence
tgcagattgtttatatcaga

SEQ ID NO: 82428 - DNA, 20 bp, Artificial
  CRISPR gRNA sequence
gcagattgtttatatcagat

SEQ ID NO: 82429 - DNA, 20 bp, Artificial
  CRISPR gRNA sequence
attgtttatatcagatggga

SEQ ID NO: 82430 - DNA, 20 bp, Artificial
  CRISPR gRNA sequence
ttgtttatatcagatgggat

SEQ ID NO: 82431 - DNA, 20 bp, Artificial
  CRISPR gRNA sequence
cagatgggatgggactcatt

SEQ ID NO: 82432 - DNA, 20 bp, Artificial
  CRISPR gRNA sequence
agatgggatgggactcattc

SEQ ID NO: 82433 - DNA, 20 bp, Artificial
  CRISPR gRNA sequence
gatgggatgggactcattca

SEQ ID NO: 82434 - DNA, 20 bp, Artificial
  CRISPR gRNA sequence
gggatgggactcattcaggg

SEQ ID NO: 82435 - DNA, 20 bp, Artificial
  CRISPR gRNA sequence
gggactcattcagggtagta

SEQ ID NO: 82436 - DNA, 20 bp, Artificial
  CRISPR gRNA sequence
cattcagggtagtatggcca

SEQ ID NO: 82437 - DNA, 20 bp, Artificial
  CRISPR gRNA sequence
catagaccttttttatatca

SEQ ID NO: 82438 - DNA, 20 bp, Artificial
  CRISPR gRNA sequence
agaccttttttatatcaaag

SEQ ID NO: 82439 - DNA, 20 bp, Artificial
  CRISPR gRNA sequence
gactactcatacacaacttt

SEQ ID NO: 82440 - DNA, 20 bp, Artificial
  CRISPR gRNA sequence
tactcatacacaactttcag

SEQ ID NO: 82441 - DNA, 20 bp, Artificial
  CRISPR gRNA sequence
caactttcagcagcttacaa

SEQ ID NO: 82442 - DNA, 20 bp, Artificial
  CRISPR gRNA sequence
agcagcttacaaaagaatgt

SEQ ID NO: 82443 - DNA, 20 bp, Artificial
  CRISPR gRNA sequence
cttaccccacttaactatct

SEQ ID NO: 82444 - DNA, 20 bp, Artificial
  CRISPR gRNA sequence
ttaccccacttaactatctt

SEQ ID NO: 82445 - DNA, 20 bp, Artificial
  CRISPR gRNA sequence
aactatcttgggctgtgaca

SEQ ID NO: 82446 - DNA, 20 bp, Artificial
  CRISPR gRNA sequence
tgggctgtgacaaagtcaca

SEQ ID NO: 82447 - DNA, 20 bp, Artificial
  CRISPR gRNA sequence
acaaagtcacatggttcaca

SEQ ID NO: 82448 - DNA, 20 bp, Artificial
  CRISPR gRNA sequence
aagtcacatggttcacacgg

SEQ ID NO: 82449 - DNA, 20 bp, Artificial
  CRISPR gRNA sequence
agtcacatggttcacacggc

SEQ ID NO: 82450 - DNA, 20 bp, Artificial
  CRISPR gRNA sequence
gcaggcatactcatcttttt

SEQ ID NO: 82451 - DNA, 20 bp, Artificial
  CRISPR gRNA sequence
ggcatactcatctttttcag

SEQ ID NO: 82452 - DNA, 20 bp, Artificial
  CRISPR gRNA sequence
gcatactcatctttttcagt

SEQ ID NO: 82453 - DNA, 20 bp, Artificial
  CRISPR gRNA sequence
catactcatctttttcagtg

SEQ ID NO: 82454 - DNA, 20 bp, Artificial
  CRISPR gRNA sequence
atactcatctttttcagtgg

SEQ ID NO: 82455 - DNA, 20 bp, Artificial
  CRISPR gRNA sequence
tttttcagtgggggtgaatt

SEQ ID NO: 82456 - DNA, 20 bp, Artificial
  CRISPR gRNA sequence
cagtgggggtgaattcagtg

SEQ ID NO: 82457 - DNA, 20 bp, Artificial
  CRISPR gRNA sequence
gggtgaattcagtgtagtac

SEQ ID NO: 82458 - DNA, 20 bp, Artificial
  CRISPR gRNA sequence
gtgaattcagtgtagtacaa

SEQ ID NO: 82459 - DNA, 20 bp, Artificial
  CRISPR gRNA sequence
attcagtgtagtacaagaga

SEQ ID NO: 82460 - DNA, 20 bp, Artificial
  CRISPR gRNA sequence
agtgtagtacaagagataga

SEQ ID NO: 82461 - DNA, 20 bp, Artificial
  CRISPR gRNA sequence
agtacaagagatagaaagac

SEQ ID NO: 82462 - DNA, 20 bp, Artificial
  CRISPR gRNA sequence
gaaagaccagtccttgctga

SEQ ID NO: 82463 - DNA, 20 bp, Artificial
  CRISPR gRNA sequence
accagtccttgctgaaagac

SEQ ID NO: 82464 - DNA, 20 bp, Artificial
  CRISPR gRNA sequence
tcaattctctctccattctt

SEQ ID NO: 82465 - DNA, 20 bp, Artificial
  CRISPR gRNA sequence
ttctctctccattcttcagt

SEQ ID NO: 82466 - DNA, 20 bp, Artificial
  CRISPR gRNA sequence
cagtaagtcaacttcaatgt

SEQ ID NO: 82467 - DNA, 20 bp, Artificial
  CRISPR gRNA sequence
aagtcaacttcaatgtcgga

SEQ ID NO: 82468 - DNA, 20 bp, Artificial
  CRISPR gRNA sequence
aatgtcggatggatgaaacc

SEQ ID NO: 82469 - DNA, 20 bp, Artificial
  CRISPR gRNA sequence
atggatgaaacccagacaca

SEQ ID NO: 82470 - DNA, 20 bp, Artificial
  CRISPR gRNA sequence
aacccagacacatagcaatt

SEQ ID NO: 82471 - DNA, 20 bp, Artificial
  CRISPR gRNA sequence
acccagacacatagcaattc

SEQ ID NO: 82472 - DNA, 20 bp, Artificial
  CRISPR gRNA sequence
tttgactttccattctctgc

SEQ ID NO: 82473 - DNA, 20 bp, Artificial
  CRISPR gRNA sequence
cattctctgctggatgacgt

SEQ ID NO: 82474 - DNA, 20 bp, Artificial
  CRISPR gRNA sequence
cgtgagtaaacctgaatctt

SEQ ID NO: 82475 - DNA, 20 bp, Artificial
  CRISPR gRNA sequence
tgagtaaacctgaatctttg

SEQ ID NO: 82476 - DNA, 20 bp, Artificial
  CRISPR gRNA sequence
cctgaatctttggagtacct

SEQ ID NO: 82477 - DNA, 20 bp, Artificial
  CRISPR gRNA sequence
ctgaatctttggagtacctg

SEQ ID NO: 82478 - DNA, 20 bp, Artificial
  CRISPR gRNA sequence
ttggagtacctgaggaatat

SEQ ID NO: 82479 - DNA, 20 bp, Artificial
  CRISPR gRNA sequence
tggagtacctgaggaatatc

SEQ ID NO: 82480 - DNA, 20 bp, Artificial
  CRISPR gRNA sequence
tacctgaggaatatcgggaa

SEQ ID NO: 82481 - DNA, 20 bp, Artificial
  CRISPR gRNA sequence
aaaagacacattaatattgc

SEQ ID NO: 82482 - DNA, 20 bp, Artificial
  CRISPR gRNA sequence
aaagacacattaatattgcc

SEQ ID NO: 82483 - DNA, 20 bp, Artificial
  CRISPR gRNA sequence
aagacacattaatattgcca

SEQ ID NO: 82484 - DNA, 20 bp, Artificial
  CRISPR gRNA sequence
tattgccagggtatttcact

SEQ ID NO: 82485 - DNA, 20 bp, Artificial
  CRISPR gRNA sequence
attgccagggtatttcactt

SEQ ID NO: 82486 - DNA, 20 bp, Artificial
  CRISPR gRNA sequence
ttgccagggtatttcacttg

SEQ ID NO: 82487 - DNA, 20 bp, Artificial
  CRISPR gRNA sequence
tatttcacttggggctaact

SEQ ID NO: 82488 - DNA, 20 bp, Artificial
  CRISPR gRNA sequence
cttggggctaacttggtgtc

SEQ ID NO: 82489 - DNA, 20 bp, Artificial
  CRISPR gRNA sequence
aacttggtgtcaagctatat

SEQ ID NO: 82490 - DNA, 20 bp, Artificial
  CRISPR gRNA sequence
acttggtgtcaagctatatc

SEQ ID NO: 82491 - DNA, 20 bp, Artificial
  CRISPR gRNA sequence
gtcaagctatatcaggcacc

SEQ ID NO: 82492 - DNA, 20 bp, Artificial
  CRISPR gRNA sequence
aggcaccaagtgtttacatt

SEQ ID NO: 82493 - DNA, 20 bp, Artificial
  CRISPR gRNA sequence
tcccaattccatttccactc

SEQ ID NO: 82494 - DNA, 20 bp, Artificial
  CRISPR gRNA sequence
catttccactctggccaaat

SEQ ID NO: 82495 - DNA, 20 bp, Artificial
  CRISPR gRNA sequence
tgagcttccaccttcccaac

SEQ ID NO: 82496 - DNA, 20 bp, Artificial
  CRISPR gRNA sequence
aacaagccacctccattttg

SEQ ID NO: 82497 - DNA, 20 bp, Artificial
  CRISPR gRNA sequence
ttgaagaataaaccgtgact

SEQ ID NO: 82498 - DNA, 20 bp, Artificial
  CRISPR gRNA sequence
tgccttttttgttttttttc

SEQ ID NO: 82499 - DNA, 20 bp, Artificial
  CRISPR gRNA sequence
cttttttgttttttttctag

SEQ ID NO: 82500 - DNA, 20 bp, Artificial
  CRISPR gRNA sequence
ttttttttctagcagatttc

SEQ ID NO: 82501 - DNA, 20 bp, Artificial
  CRISPR gRNA sequence
tttttctagcagatttctag

SEQ ID NO: 82502 - DNA, 20 bp, Artificial
  CRISPR gRNA sequence
ctagcagtatcttctgtcac

SEQ ID NO: 82503 - DNA, 20 bp, Artificial
  CRISPR gRNA sequence
agcagtatcttctgtcactg

SEQ ID NO: 82504 - DNA, 20 bp, Artificial
  CRISPR gRNA sequence
ggagattgcgctgcattttt

SEQ ID NO: 82505 - DNA, 20 bp, Artificial
  CRISPR gRNA sequence
agattgcgctgcatttttaa

SEQ ID NO: 82506 - DNA, 20 bp, Artificial
  CRISPR gRNA sequence
catttttaagagcctttctc

SEQ ID NO: 82507 - DNA, 20 bp, Artificial
  CRISPR gRNA sequence
tttttaagagcctttctctg

SEQ ID NO: 82508 - DNA, 20 bp, Artificial
  CRISPR gRNA sequence
ttttaagagcctttctctgg

SEQ ID NO: 82509 - DNA, 20 bp, Artificial
  CRISPR gRNA sequence
gcctttctctggaggctctc

SEQ ID NO: 82510 - DNA, 20 bp, Artificial
  CRISPR gRNA sequence
cctttctctggaggctctca

SEQ ID NO: 82511 - DNA, 20 bp, Artificial
  CRISPR gRNA sequence
aaggacttctgatgccctct

SEQ ID NO: 82512 - DNA, 20 bp, Artificial
  CRISPR gRNA sequence
tgatgccctctcagcactca

SEQ ID NO: 82513 - DNA, 20 bp, Artificial
  CRISPR gRNA sequence
cattccttaacacatcactc

SEQ ID NO: 82514 - DNA, 20 bp, Artificial
  CRISPR gRNA sequence
ttccttaacacatcactcaa

SEQ ID NO: 82515 - DNA, 20 bp, Artificial
  CRISPR gRNA sequence
actcaagagtctacatgatt

SEQ ID NO: 82516 - DNA, 20 bp, Artificial
  CRISPR gRNA sequence
agtctacatgatttggcccc

SEQ ID NO: 82517 - DNA, 20 bp, Artificial
  CRISPR gRNA sequence
tggccccaagatacttttca

SEQ ID NO: 82518 - DNA, 20 bp, Artificial
  CRISPR gRNA sequence
acttttcaaagttcatttct

SEQ ID NO: 82519 - DNA, 20 bp, Artificial
  CRISPR gRNA sequence
gttcatttctcagttcataa

SEQ ID NO: 82520 - DNA, 20 bp, Artificial
  CRISPR gRNA sequence
tatgtttatgcctttctttt

SEQ ID NO: 82521 - DNA, 20 bp, Artificial
  CRISPR gRNA sequence
ctgattttctaaactgtatg

SEQ ID NO: 82522 - DNA, 20 bp, Artificial
  CRISPR gRNA sequence
tctaaactgtatgaagtgtc

SEQ ID NO: 82523 - DNA, 20 bp, Artificial
  CRISPR gRNA sequence
aaactgtatgaagtgtctag

SEQ ID NO: 82524 - DNA, 20 bp, Artificial
  CRISPR gRNA sequence
actgtatgaagtgtctagta

SEQ ID NO: 82525 - DNA, 20 bp, Artificial
  CRISPR gRNA sequence
gaagtgtctagtagagtgcc

SEQ ID NO: 82526 - DNA, 20 bp, Artificial
  CRISPR gRNA sequence
aagtgtctagtagagtgcct

SEQ ID NO: 82527 - DNA, 20 bp, Artificial
  CRISPR gRNA sequence
ctagtagagtgcctgggaca

SEQ ID NO: 82528 - DNA, 20 bp, Artificial
  CRISPR gRNA sequence
catagcaattgctctatacg

SEQ ID NO: 82529 - DNA, 20 bp, Artificial
  CRISPR gRNA sequence
agcaattgctctatacgtgg

SEQ ID NO: 82530 - DNA, 20 bp, Artificial
  CRISPR gRNA sequence
cgtggcagatgttattatct

SEQ ID NO: 82531 - DNA, 20 bp, Artificial
  CRISPR gRNA sequence
gtggcagatgttattatctg

SEQ ID NO: 82532 - DNA, 20 bp, Artificial
  CRISPR gRNA sequence
tgttattatctgaggttcct

SEQ ID NO: 82533 - DNA, 20 bp, Artificial
  CRISPR gRNA sequence
tattatctgaggttcctaag

SEQ ID NO: 82534 - DNA, 20 bp, Artificial
  CRISPR gRNA sequence
gttcctaagtggatcaaccc

SEQ ID NO: 82535 - DNA, 20 bp, Artificial
  CRISPR gRNA sequence
ttcctaagtggatcaaccca

SEQ ID NO: 82536 - DNA, 20 bp, Artificial
  CRISPR gRNA sequence
ttttttatttttttattttt

SEQ ID NO: 82537 - DNA, 20 bp, Artificial
  CRISPR gRNA sequence
tttttatttttttatttttt

SEQ ID NO: 82538 - DNA, 20 bp, Artificial
  CRISPR gRNA sequence
tatttttttattttttggga

SEQ ID NO: 82539 - DNA, 20 bp, Artificial
  CRISPR gRNA sequence
tggaatctcattccattgcc

SEQ ID NO: 82540 - DNA, 20 bp, Artificial
  CRISPR gRNA sequence
ggaatctcattccattgccc

SEQ ID NO: 82541 - DNA, 20 bp, Artificial
  CRISPR gRNA sequence
tctcattccattgcccaggc

SEQ ID NO: 82542 - DNA, 20 bp, Artificial
  CRISPR gRNA sequence
tcattccattgcccaggctg

SEQ ID NO: 82543 - DNA, 20 bp, Artificial
  CRISPR gRNA sequence
ccattgcccaggctggagtg

SEQ ID NO: 82544 - DNA, 20 bp, Artificial
  CRISPR gRNA sequence
ccaggctggagtgcagtgtg

SEQ ID NO: 82545 - DNA, 20 bp, Artificial
  CRISPR gRNA sequence
ggctggagtgcagtgtgcag

SEQ ID NO: 82546 - DNA, 20 bp, Artificial
  CRISPR gRNA sequence
ggagtgcagtgtgcagtggt

SEQ ID NO: 82547 - DNA, 20 bp, Artificial
  CRISPR gRNA sequence
agtgtgcagtggtgagatct

SEQ ID NO: 82548 - DNA, 20 bp, Artificial
  CRISPR gRNA sequence
tcactgcaacctccgcctcc

SEQ ID NO: 82549 - DNA, 20 bp, Artificial
  CRISPR gRNA sequence
cactgcaacctccgcctcct

SEQ ID NO: 82550 - DNA, 20 bp, Artificial
  CRISPR gRNA sequence
aacctccgcctcctgggttc

SEQ ID NO: 82551 - DNA, 20 bp, Artificial
  CRISPR gRNA sequence
tcctgggttcaagtgattcc

SEQ ID NO: 82552 - DNA, 20 bp, Artificial
  CRISPR gRNA sequence
cctgggttcaagtgattcct

SEQ ID NO: 82553 - DNA, 20 bp, Artificial
  CRISPR gRNA sequence
tcaagtgattcctgggacta

SEQ ID NO: 82554 - DNA, 20 bp, Artificial
  CRISPR gRNA sequence
caagtgattcctgggactac

SEQ ID NO: 82555 - DNA, 20 bp, Artificial
  CRISPR gRNA sequence
caggcacacaccaccatgcc

SEQ ID NO: 82556 - DNA, 20 bp, Artificial
  CRISPR gRNA sequence
ctggttaatttttgtatttt

SEQ ID NO: 82557 - DNA, 20 bp, Artificial
  CRISPR gRNA sequence
gttaatttttgtattttcag

SEQ ID NO: 82558 - DNA, 20 bp, Artificial
  CRISPR gRNA sequence
taatttttgtattttcagta

SEQ ID NO: 82559 - DNA, 20 bp, Artificial
  CRISPR gRNA sequence
ttttgtattttcagtagaga

SEQ ID NO: 82560 - DNA, 20 bp, Artificial
  CRISPR gRNA sequence
tttgtattttcagtagagac

SEQ ID NO: 82561 - DNA, 20 bp, Artificial
  CRISPR gRNA sequence
gagacgggatttcaccatgt

SEQ ID NO: 82562 - DNA, 20 bp, Artificial
  CRISPR gRNA sequence
cgggatttcaccatgttggc

SEQ ID NO: 82563 - DNA, 20 bp, Artificial
  CRISPR gRNA sequence
gggatttcaccatgttggcc

SEQ ID NO: 82564 - DNA, 20 bp, Artificial
  CRISPR gRNA sequence
tttcaccatgttggccaggc

SEQ ID NO: 82565 - DNA, 20 bp, Artificial
  CRISPR gRNA sequence
ggtcttgaactcccaacttc

SEQ ID NO: 82566 - DNA, 20 bp, Artificial
  CRISPR gRNA sequence
aactcccaacttcaagtgat

SEQ ID NO: 82567 - DNA, 20 bp, Artificial
  CRISPR gRNA sequence
ttcaagtgatcagcctgcct

SEQ ID NO: 82568 - DNA, 20 bp, Artificial
  CRISPR gRNA sequence
cagcctgccttggcctccca

SEQ ID NO: 82569 - DNA, 20 bp, Artificial
  CRISPR gRNA sequence
gccttggcctcccaaagtgt

SEQ ID NO: 82570 - DNA, 20 bp, Artificial
  CRISPR gRNA sequence
ccttggcctcccaaagtgtt

SEQ ID NO: 82571 - DNA, 20 bp, Artificial
  CRISPR gRNA sequence
ctcccaaagtgttgggatta

SEQ ID NO: 82572 - DNA, 20 bp, Artificial
  CRISPR gRNA sequence
tcccaaagtgttgggattac

SEQ ID NO: 82573 - DNA, 20 bp, Artificial
  CRISPR gRNA sequence
agtgttgggattacaggcac

SEQ ID NO: 82574 - DNA, 20 bp, Artificial
  CRISPR gRNA sequence
ccaccgtgcccaaccaaccc

SEQ ID NO: 82575 - DNA, 20 bp, Artificial
  CRISPR gRNA sequence
caccgtgcccaaccaaccca

SEQ ID NO: 82576 - DNA, 20 bp, Artificial
  CRISPR gRNA sequence
aaaacctctttatttctgct

SEQ ID NO: 82577 - DNA, 20 bp, Artificial
  CRISPR gRNA sequence
aaacctctttatttctgctg

SEQ ID NO: 82578 - DNA, 20 bp, Artificial
  CRISPR gRNA sequence
tctgctgaggttttatatgc

SEQ ID NO: 82579 - DNA, 20 bp, Artificial
  CRISPR gRNA sequence
gactttgtacctaatttcat

SEQ ID NO: 82580 - DNA, 20 bp, Artificial
  CRISPR gRNA sequence
atttcatgagctaaaaaaca

SEQ ID NO: 82581 - DNA, 20 bp, Artificial
  CRISPR gRNA sequence
aacaaaacctaaatgcatac

SEQ ID NO: 82582 - DNA, 20 bp, Artificial
  CRISPR gRNA sequence
caaaacctaaatgcatacaa

SEQ ID NO: 82583 - DNA, 20 bp, Artificial
  CRISPR gRNA sequence
acctaaatgcatacaagagc

SEQ ID NO: 82584 - DNA, 20 bp, Artificial
  CRISPR gRNA sequence
gagctggcaaataccttaaa

SEQ ID NO: 82585 - DNA, 20 bp, Artificial
  CRISPR gRNA sequence
ggcaaataccttaaatggtt

SEQ ID NO: 82586 - DNA, 20 bp, Artificial
  CRISPR gRNA sequence
aataccttaaatggttgagt

SEQ ID NO: 82587 - DNA, 20 bp, Artificial
  CRISPR gRNA sequence
ttggacccgataaaatacaa

SEQ ID NO: 82588 - DNA, 20 bp, Artificial
  CRISPR gRNA sequence
tggacccgataaaatacaac

SEQ ID NO: 82589 - DNA, 20 bp, Artificial
  CRISPR gRNA sequence
ggacccgataaaatacaaca

SEQ ID NO: 82590 - DNA, 20 bp, Artificial
  CRISPR gRNA sequence
ccgataaaatacaacaggga

SEQ ID NO: 82591 - DNA, 20 bp, Artificial
  CRISPR gRNA sequence
cgataaaatacaacagggat

SEQ ID NO: 82592 - DNA, 20 bp, Artificial
  CRISPR gRNA sequence
aaaatacaacagggataggt

SEQ ID NO: 82593 - DNA, 20 bp, Artificial
  CRISPR gRNA sequence
aaatacaacagggataggtg

SEQ ID NO: 82594 - DNA, 20 bp, Artificial
  CRISPR gRNA sequence
acagggataggtgaggacta

SEQ ID NO: 82595 - DNA, 20 bp, Artificial
  CRISPR gRNA sequence
taggtgaggactatggcaaa

SEQ ID NO: 82596 - DNA, 20 bp, Artificial
  CRISPR gRNA sequence
aggtgaggactatggcaaat

SEQ ID NO: 82597 - DNA, 20 bp, Artificial
  CRISPR gRNA sequence
gaggactatggcaaatggga

SEQ ID NO: 82598 - DNA, 20 bp, Artificial
  CRISPR gRNA sequence
tactttccattatgatcaaa

SEQ ID NO: 82599 - DNA, 20 bp, Artificial
  CRISPR gRNA sequence
ctttccattatgatcaaatg

SEQ ID NO: 82600 - DNA, 20 bp, Artificial
  CRISPR gRNA sequence
aaatggagtaatgcatgtga

SEQ ID NO: 82601 - DNA, 20 bp, Artificial
  CRISPR gRNA sequence
tggagtaatgcatgtgacag

SEQ ID NO: 82602 - DNA, 20 bp, Artificial
  CRISPR gRNA sequence
ggagtaatgcatgtgacagt

SEQ ID NO: 82603 - DNA, 20 bp, Artificial
  CRISPR gRNA sequence
agtgggatttgcgttttaat

SEQ ID NO: 82604 - DNA, 20 bp, Artificial
  CRISPR gRNA sequence
tgcgttttaattagcatcca

SEQ ID NO: 82605 - DNA, 20 bp, Artificial
  CRISPR gRNA sequence
gcgttttaattagcatccac

SEQ ID NO: 82606 - DNA, 20 bp, Artificial
  CRISPR gRNA sequence
cacaggtgattgctgtaaac

SEQ ID NO: 82607 - DNA, 20 bp, Artificial
  CRISPR gRNA sequence
ggtgattgctgtaaactagc

SEQ ID NO: 82608 - DNA, 20 bp, Artificial
  CRISPR gRNA sequence
gtgattgctgtaaactagcc

SEQ ID NO: 82609 - DNA, 20 bp, Artificial
  CRISPR gRNA sequence
ttgctgtaaactagccaggt

SEQ ID NO: 82610 - DNA, 20 bp, Artificial
  CRISPR gRNA sequence
tgctgtaaactagccaggtt

SEQ ID NO: 82611 - DNA, 20 bp, Artificial
  CRISPR gRNA sequence
gaatatattgcctaatgttt

SEQ ID NO: 82612 - DNA, 20 bp, Artificial
  CRISPR gRNA sequence
attgcctaatgtttcagaaa

SEQ ID NO: 82613 - DNA, 20 bp, Artificial
  CRISPR gRNA sequence
gaaacagtactttccaaaat

SEQ ID NO: 82614 - DNA, 20 bp, Artificial
  CRISPR gRNA sequence
aacagtactttccaaaatga

SEQ ID NO: 82615 - DNA, 20 bp, Artificial
  CRISPR gRNA sequence
acagtactttccaaaatgag

SEQ ID NO: 82616 - DNA, 20 bp, Artificial
  CRISPR gRNA sequence
tccaaaatgagaggcatgac

SEQ ID NO: 82617 - DNA, 20 bp, Artificial
  CRISPR gRNA sequence
aggcatgactagaccatcca

SEQ ID NO: 82618 - DNA, 20 bp, Artificial
  CRISPR gRNA sequence
ggcatgactagaccatccat

SEQ ID NO: 82619 - DNA, 20 bp, Artificial
  CRISPR gRNA sequence
gcatgactagaccatccatg

SEQ ID NO: 82620 - DNA, 20 bp, Artificial
  CRISPR gRNA sequence
tgactagaccatccatgggg

SEQ ID NO: 82621 - DNA, 20 bp, Artificial
  CRISPR gRNA sequence
ctagaccatccatggggaag

SEQ ID NO: 82622 - DNA, 20 bp, Artificial
  CRISPR gRNA sequence
tagaccatccatggggaagt

SEQ ID NO: 82623 - DNA, 20 bp, Artificial
  CRISPR gRNA sequence
accatccatggggaagtggg

SEQ ID NO: 82624 - DNA, 20 bp, Artificial
  CRISPR gRNA sequence
tatatttttcattgaaaatg

SEQ ID NO: 82625 - DNA, 20 bp, Artificial
  CRISPR gRNA sequence
tatttttcattgaaaatgaa

SEQ ID NO: 82626 - DNA, 20 bp, Artificial
  CRISPR gRNA sequence
ttttcattgaaaatgaagag

SEQ ID NO: 82627 - DNA, 20 bp, Artificial
  CRISPR gRNA sequence
ttgaaaatgaagagaagtgt

SEQ ID NO: 82628 - DNA, 20 bp, Artificial
  CRISPR gRNA sequence
tgttagtgctactaaatata

SEQ ID NO: 82629 - DNA, 20 bp, Artificial
  CRISPR gRNA sequence
cttttaaatacacttatatt

SEQ ID NO: 82630 - DNA, 20 bp, Artificial
  CRISPR gRNA sequence
ttttaaatacacttatattc

SEQ ID NO: 82631 - DNA, 20 bp, Artificial
  CRISPR gRNA sequence
tttaaatacacttatattca

SEQ ID NO: 82632 - DNA, 20 bp, Artificial
  CRISPR gRNA sequence
tcagggtacatgatcactaa

SEQ ID NO: 82633 - DNA, 20 bp, Artificial
  CRISPR gRNA sequence
cagggtacatgatcactaaa

SEQ ID NO: 82634 - DNA, 20 bp, Artificial
  CRISPR gRNA sequence
ggtacatgatcactaaaagg

SEQ ID NO: 82635 - DNA, 20 bp, Artificial
  CRISPR gRNA sequence
ggcagctactcctccttgtc

SEQ ID NO: 82636 - DNA, 20 bp, Artificial
  CRISPR gRNA sequence
gcagctactcctccttgtct

SEQ ID NO: 82637 - DNA, 20 bp, Artificial
  CRISPR gRNA sequence
agctactcctccttgtctgg

SEQ ID NO: 82638 - DNA, 20 bp, Artificial
  CRISPR gRNA sequence
gctactcctccttgtctggg

SEQ ID NO: 82639 - DNA, 20 bp, Artificial
  CRISPR gRNA sequence
cctccttgtctgggaggctg

SEQ ID NO: 82640 - DNA, 20 bp, Artificial
  CRISPR gRNA sequence
ctccttgtctgggaggctgt

SEQ ID NO: 82641 - DNA, 20 bp, Artificial
  CRISPR gRNA sequence
tccttgtctgggaggctgtg

SEQ ID NO: 82642 - DNA, 20 bp, Artificial
  CRISPR gRNA sequence
cttgtctgggaggctgtggg

SEQ ID NO: 82643 - DNA, 20 bp, Artificial
  CRISPR gRNA sequence
gtctgggaggctgtggggag

SEQ ID NO: 82644 - DNA, 20 bp, Artificial
  CRISPR gRNA sequence
tctgggaggctgtggggaga

SEQ ID NO: 82645 - DNA, 20 bp, Artificial
  CRISPR gRNA sequence
tgggaggctgtggggagaag

SEQ ID NO: 82646 - DNA, 20 bp, Artificial
  CRISPR gRNA sequence
gggaggctgtggggagaagg

SEQ ID NO: 82647 - DNA, 20 bp, Artificial
  CRISPR gRNA sequence
gaggctgtggggagaaggag

SEQ ID NO: 82648 - DNA, 20 bp, Artificial
  CRISPR gRNA sequence
gtggggagaaggaggagtac

SEQ ID NO: 82649 - DNA, 20 bp, Artificial
  CRISPR gRNA sequence
tggggagaaggaggagtacc

SEQ ID NO: 82650 - DNA, 20 bp, Artificial
  CRISPR gRNA sequence
gagtaccaggccaccttgac

SEQ ID NO: 82651 - DNA, 20 bp, Artificial
  CRISPR gRNA sequence
cttgaccagatatatctctc

SEQ ID NO: 82652 - DNA, 20 bp, Artificial
  CRISPR gRNA sequence
tctagaaacaccctatcatt

SEQ ID NO: 82653 - DNA, 20 bp, Artificial
  CRISPR gRNA sequence
ctagaaacaccctatcatta

SEQ ID NO: 82654 - DNA, 20 bp, Artificial
  CRISPR gRNA sequence
aaacaccctatcattaagga

SEQ ID NO: 82655 - DNA, 20 bp, Artificial
  CRISPR gRNA sequence
aacaccctatcattaaggaa

SEQ ID NO: 82656 - DNA, 20 bp, Artificial
  CRISPR gRNA sequence
tatcattaaggaaaggctac

SEQ ID NO: 82657 - DNA, 20 bp, Artificial
  CRISPR gRNA sequence
gaaaggctactagccccatc

SEQ ID NO: 82658 - DNA, 20 bp, Artificial
  CRISPR gRNA sequence
aaggctactagccccatcaa

SEQ ID NO: 82659 - DNA, 20 bp, Artificial
  CRISPR gRNA sequence
aggctactagccccatcaag

SEQ ID NO: 82660 - DNA, 20 bp, Artificial
  CRISPR gRNA sequence
ctactagccccatcaagagg

SEQ ID NO: 82661 - DNA, 20 bp, Artificial
  CRISPR gRNA sequence
agccccatcaagaggtggat

SEQ ID NO: 82662 - DNA, 20 bp, Artificial
  CRISPR gRNA sequence
gccccatcaagaggtggatt

SEQ ID NO: 82663 - DNA, 20 bp, Artificial
  CRISPR gRNA sequence
ccccatcaagaggtggattg

SEQ ID NO: 82664 - DNA, 20 bp, Artificial
  CRISPR gRNA sequence
gtggattggggaatctaatg

SEQ ID NO: 82665 - DNA, 20 bp, Artificial
  CRISPR gRNA sequence
gatttttttcataacattaa

SEQ ID NO: 82666 - DNA, 20 bp, Artificial
  CRISPR gRNA sequence
ttttcataacattaaaagct

SEQ ID NO: 82667 - DNA, 20 bp, Artificial
  CRISPR gRNA sequence
ttcataacattaaaagctaa

SEQ ID NO: 82668 - DNA, 20 bp, Artificial
  CRISPR gRNA sequence
cataacattaaaagctaaga

SEQ ID NO: 82669 - DNA, 20 bp, Artificial
  CRISPR gRNA sequence
taagagagctctttgcatct

SEQ ID NO: 82670 - DNA, 20 bp, Artificial
  CRISPR gRNA sequence
gcatctgagcttctaataat

SEQ ID NO: 82671 - DNA, 20 bp, Artificial
  CRISPR gRNA sequence
taagaacatattaaatgcct

SEQ ID NO: 82672 - DNA, 20 bp, Artificial
  CRISPR gRNA sequence
aagaacatattaaatgcctc

SEQ ID NO: 82673 - DNA, 20 bp, Artificial
  CRISPR gRNA sequence
agaacatattaaatgcctca

SEQ ID NO: 82674 - DNA, 20 bp, Artificial
  CRISPR gRNA sequence
atattaaatgcctcagggat

SEQ ID NO: 82675 - DNA, 20 bp, Artificial
  CRISPR gRNA sequence
attaaatgcctcagggatca

SEQ ID NO: 82676 - DNA, 20 bp, Artificial
  CRISPR gRNA sequence
atgcctcagggatcagagca

SEQ ID NO: 82677 - DNA, 20 bp, Artificial
  CRISPR gRNA sequence
gagcacagattcatcctgcc

SEQ ID NO: 82678 - DNA, 20 bp, Artificial
  CRISPR gRNA sequence
ctgcctggaactctctgttt

SEQ ID NO: 82679 - DNA, 20 bp, Artificial
  CRISPR gRNA sequence
tgcctggaactctctgtttg

SEQ ID NO: 82680 - DNA, 20 bp, Artificial
  CRISPR gRNA sequence
gcctggaactctctgtttga

SEQ ID NO: 82681 - DNA, 20 bp, Artificial
  CRISPR gRNA sequence
tggaactctctgtttgaggg

SEQ ID NO: 82682 - DNA, 20 bp, Artificial
  CRISPR gRNA sequence
ggaactctctgtttgaggga

SEQ ID NO: 82683 - DNA, 20 bp, Artificial
  CRISPR gRNA sequence
actctctgtttgagggaagg

SEQ ID NO: 82684 - DNA, 20 bp, Artificial
  CRISPR gRNA sequence
tctgtttgagggaaggcggc

SEQ ID NO: 82685 - DNA, 20 bp, Artificial
  CRISPR gRNA sequence
ggaaggcggcaagattttgt

SEQ ID NO: 82686 - DNA, 20 bp, Artificial
  CRISPR gRNA sequence
aaggcggcaagattttgtga

SEQ ID NO: 82687 - DNA, 20 bp, Artificial
  CRISPR gRNA sequence
gcatcactgtaatcttttct

SEQ ID NO: 82688 - DNA, 20 bp, Artificial
  CRISPR gRNA sequence
tcactgtaatcttttctaag

SEQ ID NO: 82689 - DNA, 20 bp, Artificial
  CRISPR gRNA sequence
actgtaatcttttctaagaa

SEQ ID NO: 82690 - DNA, 20 bp, Artificial
  CRISPR gRNA sequence
ctgtaatcttttctaagaag

SEQ ID NO: 82691 - DNA, 20 bp, Artificial
  CRISPR gRNA sequence
atcttttctaagaagaggac

SEQ ID NO: 82692 - DNA, 20 bp, Artificial
  CRISPR gRNA sequence
tctaagaagaggacaagtat

SEQ ID NO: 82693 - DNA, 20 bp, Artificial
  CRISPR gRNA sequence
agaagaggacaagtatcaga

SEQ ID NO: 82694 - DNA, 20 bp, Artificial
  CRISPR gRNA sequence
gaagaggacaagtatcagac

SEQ ID NO: 82695 - DNA, 20 bp, Artificial
  CRISPR gRNA sequence
aggacaagtatcagacaggc

SEQ ID NO: 82696 - DNA, 20 bp, Artificial
  CRISPR gRNA sequence
ggacaagtatcagacaggct

SEQ ID NO: 82697 - DNA, 20 bp, Artificial
  CRISPR gRNA sequence
agacaggctgggtttgaatt

SEQ ID NO: 82698 - DNA, 20 bp, Artificial
  CRISPR gRNA sequence
gacaggctgggtttgaattt

SEQ ID NO: 82699 - DNA, 20 bp, Artificial
  CRISPR gRNA sequence
ggtttgaatttgggctcaac

SEQ ID NO: 82700 - DNA, 20 bp, Artificial
  CRISPR gRNA sequence
atttgggctcaaccagttac

SEQ ID NO: 82701 - DNA, 20 bp, Artificial
  CRISPR gRNA sequence
gttactggctttatgacttt

SEQ ID NO: 82702 - DNA, 20 bp, Artificial
  CRISPR gRNA sequence
tactggctttatgacttttg

SEQ ID NO: 82703 - DNA, 20 bp, Artificial
  CRISPR gRNA sequence
ctggctttatgacttttgga

SEQ ID NO: 82704 - DNA, 20 bp, Artificial
  CRISPR gRNA sequence
tgacttttggagagttattt

SEQ ID NO: 82705 - DNA, 20 bp, Artificial
  CRISPR gRNA sequence
gaaaaattaatttatgccca

SEQ ID NO: 82706 - DNA, 20 bp, Artificial
  CRISPR gRNA sequence
acaaaaacaaaacccacaca

SEQ ID NO: 82707 - DNA, 20 bp, Artificial
  CRISPR gRNA sequence
caaaaacaaaacccacacac

SEQ ID NO: 82708 - DNA, 20 bp, Artificial
  CRISPR gRNA sequence
aacaaaacccacacacaggt

SEQ ID NO: 82709 - DNA, 20 bp, Artificial
  CRISPR gRNA sequence
caaaacccacacacaggtca

SEQ ID NO: 82710 - DNA, 20 bp, Artificial
  CRISPR gRNA sequence
aaaacccacacacaggtcag

SEQ ID NO: 82711 - DNA, 20 bp, Artificial
  CRISPR gRNA sequence
aacccacacacaggtcagag

SEQ ID NO: 82712 - DNA, 20 bp, Artificial
  CRISPR gRNA sequence
acccacacacaggtcagagg

SEQ ID NO: 82713 - DNA, 20 bp, Artificial
  CRISPR gRNA sequence
cacaggtcagaggaggaaaa

SEQ ID NO: 82714 - DNA, 20 bp, Artificial
  CRISPR gRNA sequence
agaggaggaaaatagacctt

SEQ ID NO: 82715 - DNA, 20 bp, Artificial
  CRISPR gRNA sequence
aggaggaaaatagaccttca

SEQ ID NO: 82716 - DNA, 20 bp, Artificial
  CRISPR gRNA sequence
ggaggaaaatagaccttcag

SEQ ID NO: 82717 - DNA, 20 bp, Artificial
  CRISPR gRNA sequence
tcatcattacatgtttcttg

SEQ ID NO: 82718 - DNA, 20 bp, Artificial
  CRISPR gRNA sequence
atgtttcttgtggtatcttc

SEQ ID NO: 82719 - DNA, 20 bp, Artificial
  CRISPR gRNA sequence
cttgtggtatcttccagaaa

SEQ ID NO: 82720 - DNA, 20 bp, Artificial
  CRISPR gRNA sequence
ttccagaaatggtctatgca

SEQ ID NO: 82721 - DNA, 20 bp, Artificial
  CRISPR gRNA sequence
atgcatggcatgtattactt

SEQ ID NO: 82722 - DNA, 20 bp, Artificial
  CRISPR gRNA sequence
actttggaaattttcaaaat

SEQ ID NO: 82723 - DNA, 20 bp, Artificial
  CRISPR gRNA sequence
taagatttttttttaaatat

SEQ ID NO: 82724 - DNA, 20 bp, Artificial
  CRISPR gRNA sequence
aaaatgacatctaacataac

SEQ ID NO: 82725 - DNA, 20 bp, Artificial
  CRISPR gRNA sequence
ctaacataaccagcaaatac

SEQ ID NO: 82726 - DNA, 20 bp, Artificial
  CRISPR gRNA sequence
taaccagcaaataccagtaa

SEQ ID NO: 82727 - DNA, 20 bp, Artificial
  CRISPR gRNA sequence
ccagcaaataccagtaatgg

SEQ ID NO: 82728 - DNA, 20 bp, Artificial
  CRISPR gRNA sequence
tgctttcgatcatgttttgc

SEQ ID NO: 82729 - DNA, 20 bp, Artificial
  CRISPR gRNA sequence
ctttcgatcatgttttgcca

SEQ ID NO: 82730 - DNA, 20 bp, Artificial
  CRISPR gRNA sequence
tttcgatcatgttttgccag

SEQ ID NO: 82731 - DNA, 20 bp, Artificial
  CRISPR gRNA sequence
atcatgttttgccagaggaa

SEQ ID NO: 82732 - DNA, 20 bp, Artificial
  CRISPR gRNA sequence
tcatgttttgccagaggaaa

SEQ ID NO: 82733 - DNA, 20 bp, Artificial
  CRISPR gRNA sequence
gttttgccagaggaaaaggt

SEQ ID NO: 82734 - DNA, 20 bp, Artificial
  CRISPR gRNA sequence
gaggaaaaggtgagcgcgct

SEQ ID NO: 82735 - DNA, 20 bp, Artificial
  CRISPR gRNA sequence
gagcgcgcttagtgtattgc

SEQ ID NO: 82736 - DNA, 20 bp, Artificial
  CRISPR gRNA sequence
agcgcgcttagtgtattgcc

SEQ ID NO: 82737 - DNA, 20 bp, Artificial
  CRISPR gRNA sequence
ttagtgtattgccaggtact

SEQ ID NO: 82738 - DNA, 20 bp, Artificial
  CRISPR gRNA sequence
tgtattgccaggtacttaga

SEQ ID NO: 82739 - DNA, 20 bp, Artificial
  CRISPR gRNA sequence
caggtacttagaaagtgctc

SEQ ID NO: 82740 - DNA, 20 bp, Artificial
  CRISPR gRNA sequence
tagaaagtgctcaagatctc

SEQ ID NO: 82741 - DNA, 20 bp, Artificial
  CRISPR gRNA sequence
aagatctctggcgtcctcaa

SEQ ID NO: 82742 - DNA, 20 bp, Artificial
  CRISPR gRNA sequence
tctggcgtcctcaacagtct

SEQ ID NO: 82743 - DNA, 20 bp, Artificial
  CRISPR gRNA sequence
aacagtcttggtaaccatct

SEQ ID NO: 82744 - DNA, 20 bp, Artificial
  CRISPR gRNA sequence
tcttggattatctttattaa

SEQ ID NO: 82745 - DNA, 20 bp, Artificial
  CRISPR gRNA sequence
tatctttattaatggtttta

SEQ ID NO: 82746 - DNA, 20 bp, Artificial
  CRISPR gRNA sequence
tttttttttttttctttttt

SEQ ID NO: 82747 - DNA, 20 bp, Artificial
  CRISPR gRNA sequence
tttttttttttcttttttga

SEQ ID NO: 82748 - DNA, 20 bp, Artificial
  CRISPR gRNA sequence
tttttttcttttttgagaga

SEQ ID NO: 82749 - DNA, 20 bp, Artificial
  CRISPR gRNA sequence
ttttttcttttttgagagac

SEQ ID NO: 82750 - DNA, 20 bp, Artificial
  CRISPR gRNA sequence
tttttcttttttgagagaca

SEQ ID NO: 82751 - DNA, 20 bp, Artificial
  CRISPR gRNA sequence
tctcgctctgttgcccacgc

SEQ ID NO: 82752 - DNA, 20 bp, Artificial
  CRISPR gRNA sequence
tcgctctgttgcccacgctg

SEQ ID NO: 82753 - DNA, 20 bp, Artificial
  CRISPR gRNA sequence
ttgcccacgctggagtgcac

SEQ ID NO: 82754 - DNA, 20 bp, Artificial
  CRISPR gRNA sequence
ggagtgcactggcgccatga

SEQ ID NO: 82755 - DNA, 20 bp, Artificial
  CRISPR gRNA sequence
ctggcgccatgatagctcaa

SEQ ID NO: 82756 - DNA, 20 bp, Artificial
  CRISPR gRNA sequence
ccatgatagctcaaaagcct

SEQ ID NO: 82757 - DNA, 20 bp, Artificial
  CRISPR gRNA sequence
tagctcaaaagcctaagctc

SEQ ID NO: 82758 - DNA, 20 bp, Artificial
  CRISPR gRNA sequence
gctcaaaagcctaagctcaa

SEQ ID NO: 82759 - DNA, 20 bp, Artificial
  CRISPR gRNA sequence
ctcaagagatcctcccgcct

SEQ ID NO: 82760 - DNA, 20 bp, Artificial
  CRISPR gRNA sequence
gatcctcccgcctcagccac

SEQ ID NO: 82761 - DNA, 20 bp, Artificial
  CRISPR gRNA sequence
tcctcccgcctcagccaccg

SEQ ID NO: 82762 - DNA, 20 bp, Artificial
  CRISPR gRNA sequence
tcccgcctcagccaccggag

SEQ ID NO: 82763 - DNA, 20 bp, Artificial
  CRISPR gRNA sequence
gcctcagccaccggagcagc

SEQ ID NO: 82764 - DNA, 20 bp, Artificial
  CRISPR gRNA sequence
cctcagccaccggagcagct

SEQ ID NO: 82765 - DNA, 20 bp, Artificial
  CRISPR gRNA sequence
caccggagcagctgggacca

SEQ ID NO: 82766 - DNA, 20 bp, Artificial
  CRISPR gRNA sequence
accggagcagctgggaccac

SEQ ID NO: 82767 - DNA, 20 bp, Artificial
  CRISPR gRNA sequence
gcagctgggaccacaggcac

SEQ ID NO: 82768 - DNA, 20 bp, Artificial
  CRISPR gRNA sequence
caggcacgagccaccacacc

SEQ ID NO: 82769 - DNA, 20 bp, Artificial
  CRISPR gRNA sequence
atttttgttattattttttg

SEQ ID NO: 82770 - DNA, 20 bp, Artificial
  CRISPR gRNA sequence
ttttgttattattttttgta

SEQ ID NO: 82771 - DNA, 20 bp, Artificial
  CRISPR gRNA sequence
ttattattttttgtagagac

SEQ ID NO: 82772 - DNA, 20 bp, Artificial
  CRISPR gRNA sequence
tattattttttgtagagacc

SEQ ID NO: 82773 - DNA, 20 bp, Artificial
  CRISPR gRNA sequence
gagaccaggcttcaccatgt

SEQ ID NO: 82774 - DNA, 20 bp, Artificial
  CRISPR gRNA sequence
ccaggcttcaccatgttggc

SEQ ID NO: 82775 - DNA, 20 bp, Artificial
  CRISPR gRNA sequence
caggcttcaccatgttggcc

SEQ ID NO: 82776 - DNA, 20 bp, Artificial
  CRISPR gRNA sequence
cttcaccatgttggccaggc

SEQ ID NO: 82777 - DNA, 20 bp, Artificial
  CRISPR gRNA sequence
ggccaggctggtctcaacta

SEQ ID NO: 82778 - DNA, 20 bp, Artificial
  CRISPR gRNA sequence
tggtctcaactacggacctc

SEQ ID NO: 82779 - DNA, 20 bp, Artificial
  CRISPR gRNA sequence
ctcaagccatcctcccgcct

SEQ ID NO: 82780 - DNA, 20 bp, Artificial
  CRISPR gRNA sequence
cctcccgcctcggcctccct

SEQ ID NO: 82781 - DNA, 20 bp, Artificial
  CRISPR gRNA sequence
gcctcggcctccctaagtgc

SEQ ID NO: 82782 - DNA, 20 bp, Artificial
  CRISPR gRNA sequence
cctcggcctccctaagtgct

SEQ ID NO: 82783 - DNA, 20 bp, Artificial
  CRISPR gRNA sequence
ctccctaagtgctgggatta

SEQ ID NO: 82784 - DNA, 20 bp, Artificial
  CRISPR gRNA sequence
tccctaagtgctgggattac

SEQ ID NO: 82785 - DNA, 20 bp, Artificial
  CRISPR gRNA sequence
agtgctgggattacaggcgt

SEQ ID NO: 82786 - DNA, 20 bp, Artificial
  CRISPR gRNA sequence
cctcatgttttcaaaaccga

SEQ ID NO: 82787 - DNA, 20 bp, Artificial
  CRISPR gRNA sequence
atgttttcaaaaccgaaagt

SEQ ID NO: 82788 - DNA, 20 bp, Artificial
  CRISPR gRNA sequence
gttttcaaaaccgaaagtaa

SEQ ID NO: 82789 - DNA, 20 bp, Artificial
  CRISPR gRNA sequence
ttttcaaaaccgaaagtaag

SEQ ID NO: 82790 - DNA, 20 bp, Artificial
  CRISPR gRNA sequence
aaaaccgaaagtaagaggca

SEQ ID NO: 82791 - DNA, 20 bp, Artificial
  CRISPR gRNA sequence
gtaagaggcacagtacatct

SEQ ID NO: 82792 - DNA, 20 bp, Artificial
  CRISPR gRNA sequence
cagtacatcttggaaacaac

SEQ ID NO: 82793 - DNA, 20 bp, Artificial
  CRISPR gRNA sequence
agtacatcttggaaacaacc

SEQ ID NO: 82794 - DNA, 20 bp, Artificial
  CRISPR gRNA sequence
atcttggaaacaaccaggca

SEQ ID NO: 82795 - DNA, 20 bp, Artificial
  CRISPR gRNA sequence
cttggaaacaaccaggcaaa

SEQ ID NO: 82796 - DNA, 20 bp, Artificial
  CRISPR gRNA sequence
aacaaccaggcaaagagcca

SEQ ID NO: 82797 - DNA, 20 bp, Artificial
  CRISPR gRNA sequence
caaccaggcaaagagccaaa

SEQ ID NO: 82798 - DNA, 20 bp, Artificial
  CRISPR gRNA sequence
aaccaggcaaagagccaaag

SEQ ID NO: 82799 - DNA, 20 bp, Artificial
  CRISPR gRNA sequence
caggcaaagagccaaagagg

SEQ ID NO: 82800 - DNA, 20 bp, Artificial
  CRISPR gRNA sequence
gaggaagccctctgtacgaa

SEQ ID NO: 82801 - DNA, 20 bp, Artificial
  CRISPR gRNA sequence
ccctctgtacgaaaagacca

SEQ ID NO: 82802 - DNA, 20 bp, Artificial
  CRISPR gRNA sequence
cctctgtacgaaaagaccac

SEQ ID NO: 82803 - DNA, 20 bp, Artificial
  CRISPR gRNA sequence
ctctgtacgaaaagaccaca

SEQ ID NO: 82804 - DNA, 20 bp, Artificial
  CRISPR gRNA sequence
accacagggcccatgccgcc

SEQ ID NO: 82805 - DNA, 20 bp, Artificial
  CRISPR gRNA sequence
ccatgccgcccagtttgctc

SEQ ID NO: 82806 - DNA, 20 bp, Artificial
  CRISPR gRNA sequence
atgccgcccagtttgctctg

SEQ ID NO: 82807 - DNA, 20 bp, Artificial
  CRISPR gRNA sequence
ttgctctggagaatctcacg

SEQ ID NO: 82808 - DNA, 20 bp, Artificial
  CRISPR gRNA sequence
ctctggagaatctcacgcag

SEQ ID NO: 82809 - DNA, 20 bp, Artificial
  CRISPR gRNA sequence
tctggagaatctcacgcaga

SEQ ID NO: 82810 - DNA, 20 bp, Artificial
  CRISPR gRNA sequence
ggagaatctcacgcagaagg

SEQ ID NO: 82811 - DNA, 20 bp, Artificial
  CRISPR gRNA sequence
gagaatctcacgcagaaggc

SEQ ID NO: 82812 - DNA, 20 bp, Artificial
  CRISPR gRNA sequence
aaaaaaaaatgcacgaatta

SEQ ID NO: 82813 - DNA, 20 bp, Artificial
  CRISPR gRNA sequence
aatgcacgaattacagccaa

SEQ ID NO: 82814 - DNA, 20 bp, Artificial
  CRISPR gRNA sequence
atgcacgaattacagccaaa

SEQ ID NO: 82815 - DNA, 20 bp, Artificial
  CRISPR gRNA sequence
aaaggcatgcgctcccgcaa

SEQ ID NO: 82816 - DNA, 20 bp, Artificial
  CRISPR gRNA sequence
atgcgctcccgcaaaagccc

SEQ ID NO: 82817 - DNA, 20 bp, Artificial
  CRISPR gRNA sequence
gctcccgcaaaagccctggt

SEQ ID NO: 82818 - DNA, 20 bp, Artificial
  CRISPR gRNA sequence
ctcccgcaaaagccctggtt

SEQ ID NO: 82819 - DNA, 20 bp, Artificial
  CRISPR gRNA sequence
catttatcccctgtgtaatt

SEQ ID NO: 82820 - DNA, 20 bp, Artificial
  CRISPR gRNA sequence
aattaagtttcttaaaatct

SEQ ID NO: 82821 - DNA, 20 bp, Artificial
  CRISPR gRNA sequence
ttcttaaaatctcggtgcct

SEQ ID NO: 82822 - DNA, 20 bp, Artificial
  CRISPR gRNA sequence
gccttagtttcttcatctgt

SEQ ID NO: 82823 - DNA, 20 bp, Artificial
  CRISPR gRNA sequence
cttagtttcttcatctgtga

SEQ ID NO: 82824 - DNA, 20 bp, Artificial
  CRISPR gRNA sequence
ttagtttcttcatctgtgag

SEQ ID NO: 82825 - DNA, 20 bp, Artificial
  CRISPR gRNA sequence
gtttcttcatctgtgagagg

SEQ ID NO: 82826 - DNA, 20 bp, Artificial
  CRISPR gRNA sequence
tcttcatctgtgagaggcag

SEQ ID NO: 82827 - DNA, 20 bp, Artificial
  CRISPR gRNA sequence
tgagaggcagaagataacca

SEQ ID NO: 82828 - DNA, 20 bp, Artificial
  CRISPR gRNA sequence
gaggcagaagataaccatag

SEQ ID NO: 82829 - DNA, 20 bp, Artificial
  CRISPR gRNA sequence
ataaccatagtagttatcta

SEQ ID NO: 82830 - DNA, 20 bp, Artificial
  CRISPR gRNA sequence
accatagtagttatctatgg

SEQ ID NO: 82831 - DNA, 20 bp, Artificial
  CRISPR gRNA sequence
atagtagttatctatggcgg

SEQ ID NO: 82832 - DNA, 20 bp, Artificial
  CRISPR gRNA sequence
tttcaaaattaaatgacgca

SEQ ID NO: 82833 - DNA, 20 bp, Artificial
  CRISPR gRNA sequence
taaatgacgcaaagcacata

SEQ ID NO: 82834 - DNA, 20 bp, Artificial
  CRISPR gRNA sequence
cgcaaagcacataaagtcct

SEQ ID NO: 82835 - DNA, 20 bp, Artificial
  CRISPR gRNA sequence
cacataaagtccttggcaca

SEQ ID NO: 82836 - DNA, 20 bp, Artificial
  CRISPR gRNA sequence
taaagtccttggcacacaga

SEQ ID NO: 82837 - DNA, 20 bp, Artificial
  CRISPR gRNA sequence
acacagaaagatgtcaataa

SEQ ID NO: 82838 - DNA, 20 bp, Artificial
  CRISPR gRNA sequence
cacagaaagatgtcaataac

SEQ ID NO: 82839 - DNA, 20 bp, Artificial
  CRISPR gRNA sequence
agaaagatgtcaataacggg

SEQ ID NO: 82840 - DNA, 20 bp, Artificial
  CRISPR gRNA sequence
tagttcttataattttttaa

SEQ ID NO: 82841 - DNA, 20 bp, Artificial
  CRISPR gRNA sequence
tttttaaaagtgacatgtga

SEQ ID NO: 82842 - DNA, 20 bp, Artificial
  CRISPR gRNA sequence
ttttaaaagtgacatgtgat

SEQ ID NO: 82843 - DNA, 20 bp, Artificial
  CRISPR gRNA sequence
gacatgtgatgggaacaaat

SEQ ID NO: 82844 - DNA, 20 bp, Artificial
  CRISPR gRNA sequence
ttcgaaaccgctttgtatca

SEQ ID NO: 82845 - DNA, 20 bp, Artificial
  CRISPR gRNA sequence
aaccgctttgtatcacagcc

SEQ ID NO: 82846 - DNA, 20 bp, Artificial
  CRISPR gRNA sequence
cgcgtgctgtttcctcccca

SEQ ID NO: 82847 - DNA, 20 bp, Artificial
  CRISPR gRNA sequence
gctgtttcctccccacggtg

SEQ ID NO: 82848 - DNA, 20 bp, Artificial
  CRISPR gRNA sequence
ccccacggtgtggccccaca

SEQ ID NO: 82849 - DNA, 20 bp, Artificial
  CRISPR gRNA sequence
ggtgtggccccacatagacc

SEQ ID NO: 82850 - DNA, 20 bp, Artificial
  CRISPR gRNA sequence
tgtggccccacatagaccca

SEQ ID NO: 82851 - DNA, 20 bp, Artificial
  CRISPR gRNA sequence
gtggccccacatagacccag

SEQ ID NO: 82852 - DNA, 20 bp, Artificial
  CRISPR gRNA sequence
ccacatagacccagaggtgc

SEQ ID NO: 82853 - DNA, 20 bp, Artificial
  CRISPR gRNA sequence
cacatagacccagaggtgct

SEQ ID NO: 82854 - DNA, 20 bp, Artificial
  CRISPR gRNA sequence
ggtgctaggacatgcgaact

SEQ ID NO: 82855 - DNA, 20 bp, Artificial
  CRISPR gRNA sequence
gctaggacatgcgaacttag

SEQ ID NO: 82856 - DNA, 20 bp, Artificial
  CRISPR gRNA sequence
ctaggacatgcgaacttagc

SEQ ID NO: 82857 - DNA, 20 bp, Artificial
  CRISPR gRNA sequence
atgcgaacttagcgggcgcc

SEQ ID NO: 82858 - DNA, 20 bp, Artificial
  CRISPR gRNA sequence
acttagcgggcgcctagacg

SEQ ID NO: 82859 - DNA, 20 bp, Artificial
  CRISPR gRNA sequence
gggcgcctagacgaagtcca

SEQ ID NO: 82860 - DNA, 20 bp, Artificial
  CRISPR gRNA sequence
agacgaagtccacagctctc

SEQ ID NO: 82861 - DNA, 20 bp, Artificial
  CRISPR gRNA sequence
agtccacagctctccagtct

SEQ ID NO: 82862 - DNA, 20 bp, Artificial
  CRISPR gRNA sequence
gtccacagctctccagtcta

SEQ ID NO: 82863 - DNA, 20 bp, Artificial
  CRISPR gRNA sequence
tccacagctctccagtctaa

SEQ ID NO: 82864 - DNA, 20 bp, Artificial
  CRISPR gRNA sequence
acagctctccagtctaaggg

SEQ ID NO: 82865 - DNA, 20 bp, Artificial
  CRISPR gRNA sequence
gctctccagtctaagggaag

SEQ ID NO: 82866 - DNA, 20 bp, Artificial
  CRISPR gRNA sequence
tctccagtctaagggaagca

SEQ ID NO: 82867 - DNA, 20 bp, Artificial
  CRISPR gRNA sequence
gtctaagggaagcagagccg

SEQ ID NO: 82868 - DNA, 20 bp, Artificial
  CRISPR gRNA sequence
taagggaagcagagccgcag

SEQ ID NO: 82869 - DNA, 20 bp, Artificial
  CRISPR gRNA sequence
ggaagcagagccgcagcaga

SEQ ID NO: 82870 - DNA, 20 bp, Artificial
  CRISPR gRNA sequence
gaagcagagccgcagcagac

SEQ ID NO: 82871 - DNA, 20 bp, Artificial
  CRISPR gRNA sequence
ccgcagcagacaggcttacc

SEQ ID NO: 82872 - DNA, 20 bp, Artificial
  CRISPR gRNA sequence
cgcagcagacaggcttaccc

SEQ ID NO: 82873 - DNA, 20 bp, Artificial
  CRISPR gRNA sequence
tacccgggcgacgcctcccc

SEQ ID NO: 82874 - DNA, 20 bp, Artificial
  CRISPR gRNA sequence
cgacgcctcccccagacccc

SEQ ID NO: 82875 - DNA, 20 bp, Artificial
  CRISPR gRNA sequence
ctccacgcgttcacaaacct

SEQ ID NO: 82876 - DNA, 20 bp, Artificial
  CRISPR gRNA sequence
aaacctcagcgccgcgcctt

SEQ ID NO: 82877 - DNA, 20 bp, Artificial
  CRISPR gRNA sequence
aacctcagcgccgcgccttt

SEQ ID NO: 82878 - DNA, 20 bp, Artificial
  CRISPR gRNA sequence
cagcgccgcgcctttgggac

SEQ ID NO: 82879 - DNA, 20 bp, Artificial
  CRISPR gRNA sequence
agcctacccgtcccccactc

SEQ ID NO: 82880 - DNA, 20 bp, Artificial
  CRISPR gRNA sequence
gtcccccactccagctgcgc

SEQ ID NO: 82881 - DNA, 20 bp, Artificial
  CRISPR gRNA sequence
tcccccactccagctgcgct

SEQ ID NO: 82882 - DNA, 20 bp, Artificial
  CRISPR gRNA sequence
cccccactccagctgcgctg

SEQ ID NO: 82883 - DNA, 20 bp, Artificial
  CRISPR gRNA sequence
ccccactccagctgcgctgg

SEQ ID NO: 82884 - DNA, 20 bp, Artificial
  CRISPR gRNA sequence
ccactccagctgcgctgggg

SEQ ID NO: 82885 - DNA, 20 bp, Artificial
  CRISPR gRNA sequence
tccagctgcgctgggggagc

SEQ ID NO: 82886 - DNA, 20 bp, Artificial
  CRISPR gRNA sequence
cagctgcgctgggggagcca

SEQ ID NO: 82887 - DNA, 20 bp, Artificial
  CRISPR gRNA sequence
agctgcgctgggggagccag

SEQ ID NO: 82888 - DNA, 20 bp, Artificial
  CRISPR gRNA sequence
gggagccagaggccccgcga

SEQ ID NO: 82889 - DNA, 20 bp, Artificial
  CRISPR gRNA sequence
gagccagaggccccgcgaaa

SEQ ID NO: 82890 - DNA, 20 bp, Artificial
  CRISPR gRNA sequence
ccagaggccccgcgaaagag

SEQ ID NO: 82891 - DNA, 20 bp, Artificial
  CRISPR gRNA sequence
gaggccccgcgaaagagcgg

SEQ ID NO: 82892 - DNA, 20 bp, Artificial
  CRISPR gRNA sequence
ggccccgcgaaagagcggaa

SEQ ID NO: 82893 - DNA, 20 bp, Artificial
  CRISPR gRNA sequence
gagaaaccctcccccaacct

SEQ ID NO: 82894 - DNA, 20 bp, Artificial
  CRISPR gRNA sequence
tcccgaccctcccgtcgccg

SEQ ID NO: 82895 - DNA, 20 bp, Artificial
  CRISPR gRNA sequence
cccgaccctcccgtcgccgt

SEQ ID NO: 82896 - DNA, 20 bp, Artificial
  CRISPR gRNA sequence
cctcccgtcgccgtaggcca

SEQ ID NO: 82897 - DNA, 20 bp, Artificial
  CRISPR gRNA sequence
ctcccgtcgccgtaggccaa

SEQ ID NO: 82898 - DNA, 20 bp, Artificial
  CRISPR gRNA sequence
tctcccctgctccccgccga

SEQ ID NO: 82899 - DNA, 20 bp, Artificial
  CRISPR gRNA sequence
ctcccctgctccccgccgaa

SEQ ID NO: 82900 - DNA, 20 bp, Artificial
  CRISPR gRNA sequence
tcccctgctccccgccgaaa

SEQ ID NO: 82901 - DNA, 20 bp, Artificial
  CRISPR gRNA sequence
cccctgctccccgccgaaag

SEQ ID NO: 82902 - DNA, 20 bp, Artificial
  CRISPR gRNA sequence
tgctccccgccgaaaggggc

SEQ ID NO: 82903 - DNA, 20 bp, Artificial
  CRISPR gRNA sequence
tccccgccgaaaggggcaag

SEQ ID NO: 82904 - DNA, 20 bp, Artificial
  CRISPR gRNA sequence
ggggcaagtagcgcgcgtcc

SEQ ID NO: 82905 - DNA, 20 bp, Artificial
  CRISPR gRNA sequence
gggcaagtagcgcgcgtccc

SEQ ID NO: 82906 - DNA, 20 bp, Artificial
  CRISPR gRNA sequence
cgcacccccttccccactcc

SEQ ID NO: 82907 - DNA, 20 bp, Artificial
  CRISPR gRNA sequence
gcacccccttccccactccc

SEQ ID NO: 82908 - DNA, 20 bp, Artificial
  CRISPR gRNA sequence
ggccaccccgccgcttcccc

SEQ ID NO: 82909 - DNA, 20 bp, Artificial
  CRISPR gRNA sequence
cccgccgcttccccgagatc

SEQ ID NO: 82910 - DNA, 20 bp, Artificial
  CRISPR gRNA sequence
gcttccccgagatccagccc

SEQ ID NO: 82911 - DNA, 20 bp, Artificial
  CRISPR gRNA sequence
cccgagatccagccctggac

SEQ ID NO: 82912 - DNA, 20 bp, Artificial
  CRISPR gRNA sequence
ccagccctggactagcccca

SEQ ID NO: 82913 - DNA, 20 bp, Artificial
  CRISPR gRNA sequence
gccctggactagccccacgg

SEQ ID NO: 82914 - DNA, 20 bp, Artificial
  CRISPR gRNA sequence
ccctggactagccccacggc

SEQ ID NO: 82915 - DNA, 20 bp, Artificial
  CRISPR gRNA sequence
tagccccacggcgggccacc

SEQ ID NO: 82916 - DNA, 20 bp, Artificial
  CRISPR gRNA sequence
agccccacggcgggccacca

SEQ ID NO: 82917 - DNA, 20 bp, Artificial
  CRISPR gRNA sequence
ccccacggcgggccaccaag

SEQ ID NO: 82918 - DNA, 20 bp, Artificial
  CRISPR gRNA sequence
gcgggccaccaaggagaact

SEQ ID NO: 82919 - DNA, 20 bp, Artificial
  CRISPR gRNA sequence
gggccaccaaggagaacttg

SEQ ID NO: 82920 - DNA, 20 bp, Artificial
  CRISPR gRNA sequence
ccaccaaggagaacttggag

SEQ ID NO: 82921 - DNA, 20 bp, Artificial
  CRISPR gRNA sequence
caccaaggagaacttggaga

SEQ ID NO: 82922 - DNA, 20 bp, Artificial
  CRISPR gRNA sequence
accaaggagaacttggagaa

SEQ ID NO: 82923 - DNA, 20 bp, Artificial
  CRISPR gRNA sequence
aaggagaacttggagaaggg

SEQ ID NO: 82924 - DNA, 20 bp, Artificial
  CRISPR gRNA sequence
aacttggagaagggaagtca

SEQ ID NO: 82925 - DNA, 20 bp, Artificial
  CRISPR gRNA sequence
cttggagaagggaagtcacg

SEQ ID NO: 82926 - DNA, 20 bp, Artificial
  CRISPR gRNA sequence
gagaagggaagtcacggagc

SEQ ID NO: 82927 - DNA, 20 bp, Artificial
  CRISPR gRNA sequence
gaagggaagtcacggagcga

SEQ ID NO: 82928 - DNA, 20 bp, Artificial
  CRISPR gRNA sequence
agggaagtcacggagcgaga

SEQ ID NO: 82929 - DNA, 20 bp, Artificial
  CRISPR gRNA sequence
agtcacggagcgagagagca

SEQ ID NO: 82930 - DNA, 20 bp, Artificial
  CRISPR gRNA sequence
acggagcgagagagcacagc

SEQ ID NO: 82931 - DNA, 20 bp, Artificial
  CRISPR gRNA sequence
cggagcgagagagcacagcg

SEQ ID NO: 82932 - DNA, 20 bp, Artificial
  CRISPR gRNA sequence
ggagcgagagagcacagcga

SEQ ID NO: 82933 - DNA, 20 bp, Artificial
  CRISPR gRNA sequence
agagagcacagcgagggcca

SEQ ID NO: 82934 - DNA, 20 bp, Artificial
  CRISPR gRNA sequence
agagcacagcgagggccaca

SEQ ID NO: 82935 - DNA, 20 bp, Artificial
  CRISPR gRNA sequence
gagcacagcgagggccacag

SEQ ID NO: 82936 - DNA, 20 bp, Artificial
  CRISPR gRNA sequence
agcacagcgagggccacaga

SEQ ID NO: 82937 - DNA, 20 bp, Artificial
  CRISPR gRNA sequence
agcgagggccacagagggtg

SEQ ID NO: 82938 - DNA, 20 bp, Artificial
  CRISPR gRNA sequence
cgagggccacagagggtgca

SEQ ID NO: 82939 - DNA, 20 bp, Artificial
  CRISPR gRNA sequence
gggccacagagggtgcagag

SEQ ID NO: 82940 - DNA, 20 bp, Artificial
  CRISPR gRNA sequence
ggccacagagggtgcagagc

SEQ ID NO: 82941 - DNA, 20 bp, Artificial
  CRISPR gRNA sequence
ccacagagggtgcagagcgg

SEQ ID NO: 82942 - DNA, 20 bp, Artificial
  CRISPR gRNA sequence
acagagggtgcagagcggga

SEQ ID NO: 82943 - DNA, 20 bp, Artificial
  CRISPR gRNA sequence
cagagggtgcagagcgggag

SEQ ID NO: 82944 - DNA, 20 bp, Artificial
  CRISPR gRNA sequence
agggtgcagagcgggagagg

SEQ ID NO: 82945 - DNA, 20 bp, Artificial
  CRISPR gRNA sequence
gggtgcagagcgggagagga

SEQ ID NO: 82946 - DNA, 20 bp, Artificial
  CRISPR gRNA sequence
cagagcgggagaggaaggac

SEQ ID NO: 82947 - DNA, 20 bp, Artificial
  CRISPR gRNA sequence
gagcgggagaggaaggacca

SEQ ID NO: 82948 - DNA, 20 bp, Artificial
  CRISPR gRNA sequence
cgggagaggaaggaccagag

SEQ ID NO: 82949 - DNA, 20 bp, Artificial
  CRISPR gRNA sequence
gggagaggaaggaccagagc

SEQ ID NO: 82950 - DNA, 20 bp, Artificial
  CRISPR gRNA sequence
gagaggaaggaccagagcgg

SEQ ID NO: 82951 - DNA, 20 bp, Artificial
  CRISPR gRNA sequence
agaggaaggaccagagcggg

SEQ ID NO: 82952 - DNA, 20 bp, Artificial
  CRISPR gRNA sequence
gaggaaggaccagagcggga

SEQ ID NO: 82953 - DNA, 20 bp, Artificial
  CRISPR gRNA sequence
gaaggaccagagcgggaggg

SEQ ID NO: 82954 - DNA, 20 bp, Artificial
  CRISPR gRNA sequence
aaggaccagagcgggagggt

SEQ ID NO: 82955 - DNA, 20 bp, Artificial
  CRISPR gRNA sequence
ggaccagagcgggagggtag

SEQ ID NO: 82956 - DNA, 20 bp, Artificial
  CRISPR gRNA sequence
accagagcgggagggtagga

SEQ ID NO: 82957 - DNA, 20 bp, Artificial
  CRISPR gRNA sequence
agggtaggagagactcacgc

SEQ ID NO: 82958 - DNA, 20 bp, Artificial
  CRISPR gRNA sequence
taggagagactcacgctgga

SEQ ID NO: 82959 - DNA, 20 bp, Artificial
  CRISPR gRNA sequence
gactcacgctggatagcctc

SEQ ID NO: 82960 - DNA, 20 bp, Artificial
  CRISPR gRNA sequence
actcacgctggatagcctcc

SEQ ID NO: 82961 - DNA, 20 bp, Artificial
  CRISPR gRNA sequence
acgctggatagcctccaggc

SEQ ID NO: 82962 - DNA, 20 bp, Artificial
  CRISPR gRNA sequence
tggatagcctccaggccaga

SEQ ID NO: 82963 - DNA, 20 bp, Artificial
  CRISPR gRNA sequence
gatagcctccaggccagaaa

SEQ ID NO: 82964 - DNA, 20 bp, Artificial
  CRISPR gRNA sequence
tagcctccaggccagaaaga

SEQ ID NO: 82965 - DNA, 20 bp, Artificial
  CRISPR gRNA sequence
gcctccaggccagaaagaga

SEQ ID NO: 82966 - DNA, 20 bp, Artificial
  CRISPR gRNA sequence
tccaggccagaaagagagag

SEQ ID NO: 82967 - DNA, 20 bp, Artificial
  CRISPR gRNA sequence
ccagaaagagagagtagcgc

SEQ ID NO: 82968 - DNA, 20 bp, Artificial
  CRISPR gRNA sequence
aagagagagtagcgcgagca

SEQ ID NO: 82969 - DNA, 20 bp, Artificial
  CRISPR gRNA sequence
agagtagcgcgagcacagct

SEQ ID NO: 82970 - DNA, 20 bp, Artificial
  CRISPR gRNA sequence
gagtagcgcgagcacagcta

SEQ ID NO: 82971 - DNA, 20 bp, Artificial
  CRISPR gRNA sequence
cgcgagcacagctaaggcca

SEQ ID NO: 82972 - DNA, 20 bp, Artificial
  CRISPR gRNA sequence
cgagcacagctaaggccacg

SEQ ID NO: 82973 - DNA, 20 bp, Artificial
  CRISPR gRNA sequence
cacagctaaggccacggagc

SEQ ID NO: 82974 - DNA, 20 bp, Artificial
  CRISPR gRNA sequence
ggccacggagcgagacatct

SEQ ID NO: 82975 - DNA, 20 bp, Artificial
  CRISPR gRNA sequence
catctcggcccgaatgctgt

SEQ ID NO: 82976 - DNA, 20 bp, Artificial
  CRISPR gRNA sequence
ggcccgaatgctgtcagctt

SEQ ID NO: 82977 - DNA, 20 bp, Artificial
  CRISPR gRNA sequence
gcccgaatgctgtcagcttc

SEQ ID NO: 82978 - DNA, 20 bp, Artificial
  CRISPR gRNA sequence
tcagcttcaggaatgcccgc

SEQ ID NO: 82979 - DNA, 20 bp, Artificial
  CRISPR gRNA sequence
acttatattaaacgcgtgcc

SEQ ID NO: 82980 - DNA, 20 bp, Artificial
  CRISPR gRNA sequence
taaacgcgtgcccagccaat

SEQ ID NO: 82981 - DNA, 20 bp, Artificial
  CRISPR gRNA sequence
aaacgcgtgcccagccaatc

SEQ ID NO: 82982 - DNA, 20 bp, Artificial
  CRISPR gRNA sequence
cgtgcccagccaatcaggac

SEQ ID NO: 82983 - DNA, 20 bp, Artificial
  CRISPR gRNA sequence
gtgcccagccaatcaggaca

SEQ ID NO: 82984 - DNA, 20 bp, Artificial
  CRISPR gRNA sequence
gccaatcaggacaaggcccg

SEQ ID NO: 82985 - DNA, 20 bp, Artificial
  CRISPR gRNA sequence
ccaatcaggacaaggcccgc

SEQ ID NO: 82986 - DNA, 20 bp, Artificial
  CRISPR gRNA sequence
caatcaggacaaggcccgca

SEQ ID NO: 82987 - DNA, 20 bp, Artificial
  CRISPR gRNA sequence
agggaccgtcacctgtctcc

SEQ ID NO: 82988 - DNA, 20 bp, Artificial
  CRISPR gRNA sequence
accgtcacctgtctccaagc

SEQ ID NO: 82989 - DNA, 20 bp, Artificial
  CRISPR gRNA sequence
ctgtctccaagccagcgacg

SEQ ID NO: 82990 - DNA, 20 bp, Artificial
  CRISPR gRNA sequence
ccaagccagcgacgcagtgc

SEQ ID NO: 82991 - DNA, 20 bp, Artificial
  CRISPR gRNA sequence
caagccagcgacgcagtgcc

SEQ ID NO: 82992 - DNA, 20 bp, Artificial
  CRISPR gRNA sequence
ccagcgacgcagtgccaggt

SEQ ID NO: 82993 - DNA, 20 bp, Artificial
  CRISPR gRNA sequence
agcgacgcagtgccaggtta

SEQ ID NO: 82994 - DNA, 20 bp, Artificial
  CRISPR gRNA sequence
cgacgcagtgccaggttaga

SEQ ID NO: 82995 - DNA, 20 bp, Artificial
  CRISPR gRNA sequence
acgcagtgccaggttagaga

SEQ ID NO: 82996 - DNA, 20 bp, Artificial
  CRISPR gRNA sequence
cgcagtgccaggttagagag

SEQ ID NO: 82997 - DNA, 20 bp, Artificial
  CRISPR gRNA sequence
gcagtgccaggttagagaga

SEQ ID NO: 82998 - DNA, 20 bp, Artificial
  CRISPR gRNA sequence
tggcctggaggctatccagc

SEQ ID NO: 82999 - DNA, 20 bp, Artificial
  CRISPR gRNA sequence
gccgtggggctagtccaggg

SEQ ID NO: 83000 - DNA, 20 bp, Artificial
  CRISPR gRNA sequence
gctggatctcggggaagcgg

SEQ ID NO: 83001 - DNA, 20 bp, Artificial
  CRISPR gRNA sequence
gggaagcggcggggtggcct

SEQ ID NO: 83002 - DNA, 20 bp, Artificial
  CRISPR gRNA sequence
ggtggcctgggagtggggaa

SEQ ID NO: 83003 - DNA, 20 bp, Artificial
  CRISPR gRNA sequence
cctttggcctacggcgacgg

SEQ ID NO: 83004 - DNA, 20 bp, Artificial
  CRISPR gRNA sequence
tcagagcgccgaggttgggg

SEQ ID NO: 83005 - DNA, 20 bp, Artificial
  CRISPR gRNA sequence
tctggctcccccagcgcagc

SEQ ID NO: 83006 - DNA, 20 bp, Artificial
  CRISPR gRNA sequence
cagcgcagctggagtggggg

SEQ ID NO: 83007 - DNA, 20 bp, Artificial
  CRISPR gRNA sequence
tgaacgcgtggaggggcgct

SEQ ID NO: 83008 - DNA, 20 bp, Artificial
  CRISPR gRNA sequence
gggtctgggggaggcgtcgc

SEQ ID NO: 83009 - DNA, 20 bp, Artificial
  CRISPR gRNA sequence
gttcgcatgtcctagcacct

SEQ ID NO: 83010 - DNA, 20 bp, Artificial
  CRISPR gRNA sequence
gaaacagcacgcgacgtttg

SEQ ID NO: 83011 - DNA, 20 bp, Artificial
  CRISPR gRNA sequence
ggctgtgatacaaagcggtt

SEQ ID NO: 83012 - DNA, 20 bp, Artificial
  CRISPR gRNA sequence
ttaagaaacttaattacaca

SEQ ID NO: 83013 - DNA, 20 bp, Artificial
  CRISPR gRNA sequence
tttcggttttgaaaacatga

SEQ ID NO: 83014 - DNA, 20 bp, Artificial
  CRISPR gRNA sequence
acttagggaggccgaggcgg

SEQ ID NO: 83015 - DNA, 20 bp, Artificial
  CRISPR gRNA sequence
aaaataataacaaaaattag

SEQ ID NO: 83016 - DNA, 20 bp, Artificial
  CRISPR gRNA sequence
tgctccggtggctgaggcgg

SEQ ID NO: 83017 - DNA, 20 bp, Artificial
  CRISPR gRNA sequence
tggcaaaacatgatcgaaag

SEQ ID NO: 83018 - DNA, 20 bp, Artificial
  CRISPR gRNA sequence
atgagaaaattgcatttaat

SEQ ID NO: 83019 - DNA, 20 bp, Artificial
  CRISPR gRNA sequence
tacaatttatttacaacata

SEQ ID NO: 83020 - DNA, 20 bp, Artificial
  CRISPR gRNA sequence
tttcctcctctgacctgtgt

SEQ ID NO: 83021 - DNA, 20 bp, Artificial
  CRISPR gRNA sequence
ttgccgccttccctcaaaca

SEQ ID NO: 83022 - DNA, 20 bp, Artificial
  CRISPR gRNA sequence
ctcaaacagagagttccagg

SEQ ID NO: 83023 - DNA, 20 bp, Artificial
  CRISPR gRNA sequence
aacagagagttccaggcagg

SEQ ID NO: 83024 - DNA, 20 bp, Artificial
  CRISPR gRNA sequence
tagtagcctttccttaatga

SEQ ID NO: 83025 - DNA, 20 bp, Artificial
  CRISPR gRNA sequence
ccacagcctcccagacaagg

SEQ ID NO: 83026 - DNA, 20 bp, Artificial
  CRISPR gRNA sequence
ccttttagtgatcatgtacc

SEQ ID NO: 83027 - DNA, 20 bp, Artificial
  CRISPR gRNA sequence
ctgaatataagtgtatttaa

SEQ ID NO: 83028 - DNA, 20 bp, Artificial
  CRISPR gRNA sequence
ttcattttcaatgaaaaata

SEQ ID NO: 83029 - DNA, 20 bp, Artificial
  CRISPR gRNA sequence
tattttcttcccacttcccc

SEQ ID NO: 83030 - DNA, 20 bp, Artificial
  CRISPR gRNA sequence
ctagtttacagcaatcacct

SEQ ID NO: 83031 - DNA, 20 bp, Artificial
  CRISPR gRNA sequence
cctatccctgttgtatttta

SEQ ID NO: 83032 - DNA, 20 bp, Artificial
  CRISPR gRNA sequence
aattaggtacaaagtcagag

SEQ ID NO: 83033 - DNA, 20 bp, Artificial
  CRISPR gRNA sequence
ttgtttggtaagaacatacc

SEQ ID NO: 83034 - DNA, 20 bp, Artificial
  CRISPR gRNA sequence
caggctgatcacttgaagtt

SEQ ID NO: 83035 - DNA, 20 bp, Artificial
  CRISPR gRNA sequence
tggtgtgtgcctgtagtccc

SEQ ID NO: 83036 - DNA, 20 bp, Artificial
  CRISPR gRNA sequence
ctgcactccagcctgggcaa

SEQ ID NO: 83037 - DNA, 20 bp, Artificial
  CRISPR gRNA sequence
aaaaaaataaagaacatacc

SEQ ID NO: 83038 - DNA, 20 bp, Artificial
  CRISPR gRNA sequence
catacagtttagaaaatcag

SEQ ID NO: 83039 - DNA, 20 bp, Artificial
  CRISPR gRNA sequence
aacataagaaaaaaaatgga

SEQ ID NO: 83040 - DNA, 20 bp, Artificial
  CRISPR gRNA sequence
aaaaatggaaggggtggaaa

SEQ ID NO: 83041 - DNA, 20 bp, Artificial
  CRISPR gRNA sequence
tggaaacagagtacaataac

SEQ ID NO: 83042 - DNA, 20 bp, Artificial
  CRISPR gRNA sequence
gggccaaatcatgtagactc

SEQ ID NO: 83043 - DNA, 20 bp, Artificial
  CRISPR gRNA sequence
gactcttgagtgatgtgtta

SEQ ID NO: 83044 - DNA, 20 bp, Artificial
  CRISPR gRNA sequence
gtgatgtgttaaggaatgct

SEQ ID NO: 83045 - DNA, 20 bp, Artificial
  CRISPR gRNA sequence
aacaaaaaaggcatgtatag

SEQ ID NO: 83046 - DNA, 20 bp, Artificial
  CRISPR gRNA sequence
aaggtggaagctcatttggc

SEQ ID NO: 83047 - DNA, 20 bp, Artificial
  CRISPR gRNA sequence
tcatttggccagagtggaaa

SEQ ID NO: 83048 - DNA, 20 bp, Artificial
  CRISPR gRNA sequence
tttactcacgtcatccagca

SEQ ID NO: 83049 - DNA, 20 bp, Artificial
  CRISPR gRNA sequence
agaatggaaagtcaaatttc

SEQ ID NO: 83050 - DNA, 20 bp, Artificial
  CRISPR gRNA sequence
tttcctgaattgctatgtgt

SEQ ID NO: 83051 - DNA, 20 bp, Artificial
  CRISPR gRNA sequence
acattgaagttgacttactg

SEQ ID NO: 83052 - DNA, 20 bp, Artificial
  CRISPR gRNA sequence
gacttactgaagaatggaga

SEQ ID NO: 83053 - DNA, 20 bp, Artificial
  CRISPR gRNA sequence
tttctatctcttgtactaca

SEQ ID NO: 83054 - DNA, 20 bp, Artificial
  CRISPR gRNA sequence
attcacccccactgaaaaag

SEQ ID NO: 83055 - DNA, 20 bp, Artificial
  CRISPR gRNA sequence
cacagcccaagatagttaag

SEQ ID NO: 83056 - DNA, 20 bp, Artificial
  CRISPR gRNA sequence
taagctgctgaaagttgtgt

SEQ ID NO: 83057 - DNA, 20 bp, Artificial
  CRISPR gRNA sequence
aggtctatggccatactacc

SEQ ID NO: 83058 - DNA, 20 bp, Artificial
  CRISPR gRNA sequence
ctatggccatactaccctga

SEQ ID NO: 83059 - DNA, 20 bp, Artificial
  CRISPR gRNA sequence
gatataaacaatctgcatat

SEQ ID NO: 83060 - DNA, 20 bp, Artificial
  CRISPR gRNA sequence
tctgcatattgggattgtca

SEQ ID NO: 83061 - DNA, 20 bp, Artificial
  CRISPR gRNA sequence
acttctccagtactttctgg

SEQ ID NO: 83062 - DNA, 20 bp, Artificial
  CRISPR gRNA sequence
gtaggaagggcttgttcctg

SEQ ID NO: 83063 - DNA, 20 bp, Artificial
  CRISPR gRNA sequence
tagctctaaacaatgtattc

SEQ ID NO: 83064 - DNA, 20 bp, Artificial
  CRISPR gRNA sequence
cactatgtggagaacattga

SEQ ID NO: 83065 - DNA, 20 bp, Artificial
  CRISPR gRNA sequence
taacattttagcagggaaag

SEQ ID NO: 83066 - DNA, 20 bp, Artificial
  CRISPR gRNA sequence
gcagggaaagaagaatccta

SEQ ID NO: 83067 - DNA, 20 bp, Artificial
  CRISPR gRNA sequence
ggtcatgttcccttctcctg

SEQ ID NO: 83068 - DNA, 20 bp, Artificial
  CRISPR gRNA sequence
gaactgccagtatggtattg

SEQ ID NO: 83069 - DNA, 20 bp, Artificial
  CRISPR gRNA sequence
ttattcttcagacagaagag

SEQ ID NO: 83070 - DNA, 20 bp, Artificial
  CRISPR gRNA sequence
gacttctctgcatctttagt

SEQ ID NO: 83071 - DNA, 20 bp, Artificial
  CRISPR gRNA sequence
ttcaatgaaattctactgcc

SEQ ID NO: 83072 - DNA, 20 bp, Artificial
  CRISPR gRNA sequence
tcctgttatattctagaaca

SEQ ID NO: 83073 - DNA, 20 bp, Artificial
  CRISPR gRNA sequence
tttgggagagcatcaggaag

SEQ ID NO: 83074 - DNA, 20 bp, Artificial
  CRISPR gRNA sequence
ctgtacagcctgttactgta

SEQ ID NO: 83075 - DNA, 20 bp, Artificial
  CRISPR gRNA sequence
taagattttgggagcaccaa

SEQ ID NO: 83076 - DNA, 20 bp, Artificial
  CRISPR gRNA sequence
gcaccaaagggatacactaa

SEQ ID NO: 83077 - DNA, 20 bp, Artificial
  CRISPR gRNA sequence
aacaggatatactctttata

SEQ ID NO: 83078 - DNA, 20 bp, Artificial
  CRISPR gRNA sequence
caggtttgaagatgccgcat

SEQ ID NO: 83079 - DNA, 20 bp, Artificial
  CRISPR gRNA sequence
ttgaagatgccgcatttgga

SEQ ID NO: 83080 - DNA, 20 bp, Artificial
  CRISPR gRNA sequence
agatgccgcatttggattgg

SEQ ID NO: 83081 - DNA, 20 bp, Artificial
  CRISPR gRNA sequence
tacactttatgcacaaaatg

SEQ ID NO: 83082 - DNA, 20 bp, Artificial
  CRISPR gRNA sequence
atcttctttataattctact

SEQ ID NO: 83083 - DNA, 20 bp, Artificial
  CRISPR gRNA sequence
caacttagaggtggggagca

SEQ ID NO: 83084 - DNA, 20 bp, Artificial
  CRISPR gRNA sequence
tccaatttacatactctgct

SEQ ID NO: 83085 - DNA, 20 bp, Artificial
  CRISPR gRNA sequence
aaatttagaaatataattga

SEQ ID NO: 83086 - DNA, 20 bp, Artificial
  CRISPR gRNA sequence
attattggaaatttgttata

SEQ ID NO: 83087 - DNA, 20 bp, Artificial
  CRISPR gRNA sequence
aaatgtgaaccccttgtata

SEQ ID NO: 83088 - DNA, 20 bp, Artificial
  CRISPR gRNA sequence
gtttccctgtttgaaaataa

SEQ ID NO: 83089 - DNA, 20 bp, Artificial
  CRISPR gRNA sequence
gaaaataaaggggtaatagt

SEQ ID NO: 83090 - DNA, 20 bp, Artificial
  CRISPR gRNA sequence
caaatgtataagaagtaaat

SEQ ID NO: 83091 - DNA, 20 bp, Artificial
  CRISPR gRNA sequence
attttcccccaaattctaag

SEQ ID NO: 83092 - DNA, 20 bp, Artificial
  CRISPR gRNA sequence
cttaactatcttaacaagct

SEQ ID NO: 83093 - DNA, 20 bp, Artificial
  CRISPR gRNA sequence
gctttgagtgcaagagattg

SEQ ID NO: 83094 - DNA, 20 bp, Artificial
  CRISPR gRNA sequence
atctgaccaagatgttgatg

SEQ ID NO: 83095 - DNA, 20 bp, Artificial
  CRISPR gRNA sequence
aagatgttgatgttggataa

SEQ ID NO: 83096 - DNA, 20 bp, Artificial
  CRISPR gRNA sequence
catggagacagcactcaaag

SEQ ID NO: 83097 - DNA, 20 bp, Artificial
  CRISPR gRNA sequence
aatattaaaaagcaagcaag

SEQ ID NO: 83098 - DNA, 20 bp, Artificial
  CRISPR gRNA sequence
aaaagcaagcaagcagaatt

SEQ ID NO: 83099 - DNA, 20 bp, Artificial
  CRISPR gRNA sequence
agaaaagaaaaaggttagca

SEQ ID NO: 83100 - DNA, 20 bp, Artificial
  CRISPR gRNA sequence
tagcaatgaatttattttat

SEQ ID NO: 83101 - DNA, 20 bp, Artificial
  CRISPR gRNA sequence
agttctccaaacccattata

SEQ ID NO: 83102 - DNA, 20 bp, Artificial
  CRISPR gRNA sequence
taagtaacacatgactatat

SEQ ID NO: 83103 - DNA, 20 bp, Artificial
  CRISPR gRNA sequence
cccaaatcaattccctgttc

SEQ ID NO: 83104 - DNA, 20 bp, Artificial
  CRISPR gRNA sequence
tctagaatataacaggagat

SEQ ID NO: 83105 - DNA, 20 bp, Artificial
  CRISPR gRNA sequence
aatataacaggagatttgaa

SEQ ID NO: 83106 - DNA, 20 bp, Artificial
  CRISPR gRNA sequence
catcaatgtaccctgggcag

SEQ ID NO: 83107 - DNA, 20 bp, Artificial
  CRISPR gRNA sequence
ggcaaacacagtccccatac

SEQ ID NO: 83108 - DNA, 20 bp, Artificial
  CRISPR gRNA sequence
acacagtccccatacaggaa

SEQ ID NO: 83109 - DNA, 20 bp, Artificial
  CRISPR gRNA sequence
taactcctctcttctgtctg

SEQ ID NO: 83110 - DNA, 20 bp, Artificial
  CRISPR gRNA sequence
aacaacattatacaaaggaa

SEQ ID NO: 83111 - DNA, 20 bp, Artificial
  CRISPR gRNA sequence
atcaaagccttgcaggtaat

SEQ ID NO: 83112 - DNA, 20 bp, Artificial
  CRISPR gRNA sequence
gttcctttgccctctctgta

SEQ ID NO: 83113 - DNA, 20 bp, Artificial
  CRISPR gRNA sequence
gagaagggaacatgaccctg

SEQ ID NO: 83114 - DNA, 20 bp, Artificial
  CRISPR gRNA sequence
gtcaatgttctccacatagt

SEQ ID NO: 83115 - DNA, 20 bp, Artificial
  CRISPR gRNA sequence
atggttagaaataaggctgg

SEQ ID NO: 83116 - DNA, 20 bp, Artificial
  CRISPR gRNA sequence
ataggctgctgttcctaccc

SEQ ID NO: 83117 - DNA, 20 bp, Artificial
  CRISPR gRNA sequence
cagaaagtactggagaagtc

SEQ ID NO: 83118 - DNA, 20 bp, Artificial
  CRISPR gRNA sequence
actggagaagtccaggatta

SEQ ID NO: 83119 - DNA, 20 bp, Artificial
  CRISPR gRNA sequence
gccagtaggtaagaagtgtt

SEQ ID NO: 83120 - DNA, 20 bp, Artificial
  CRISPR gRNA sequence
tgcagattgtttatatcaga

SEQ ID NO: 83121 - DNA, 20 bp, Artificial
  CRISPR gRNA sequence
cagatgggatgggactcatt

SEQ ID NO: 83122 - DNA, 20 bp, Artificial
  CRISPR gRNA sequence
caactttcagcagcttacaa

SEQ ID NO: 83123 - DNA, 20 bp, Artificial
  CRISPR gRNA sequence
gcatactcatctttttcagt

SEQ ID NO: 83124 - DNA, 20 bp, Artificial
  CRISPR gRNA sequence
actcatctttttcagtgggg

SEQ ID NO: 83125 - DNA, 20 bp, Artificial
  CRISPR gRNA sequence
gtccttgctgaaagacaagt

SEQ ID NO: 83126 - DNA, 20 bp, Artificial
  CRISPR gRNA sequence
tcagtaagtcaacttcaatg

SEQ ID NO: 83127 - DNA, 20 bp, Artificial
  CRISPR gRNA sequence
taagtcaacttcaatgtcgg

SEQ ID NO: 83128 - DNA, 20 bp, Artificial
  CRISPR gRNA sequence
atttgactttccattctctg

SEQ ID NO: 83129 - DNA, 20 bp, Artificial
  CRISPR gRNA sequence
tccattctctgctggatgac

SEQ ID NO: 83130 - DNA, 20 bp, Artificial
  CRISPR gRNA sequence
gctggatgacgtgagtaaac

SEQ ID NO: 83131 - DNA, 20 bp, Artificial
  CRISPR gRNA sequence
cgtgagtaaacctgaatctt

SEQ ID NO: 83132 - DNA, 20 bp, Artificial
  CRISPR gRNA sequence
ctgaatctttggagtacctg

SEQ ID NO: 83133 - DNA, 20 bp, Artificial
  CRISPR gRNA sequence
aaaagacacattaatattgc

SEQ ID NO: 83134 - DNA, 20 bp, Artificial
  CRISPR gRNA sequence
aacaagccacctccattttg

SEQ ID NO: 83135 - DNA, 20 bp, Artificial
  CRISPR gRNA sequence
cattccttaacacatcactc

SEQ ID NO: 83136 - DNA, 20 bp, Artificial
  CRISPR gRNA sequence
aaactgtatgaagtgtctag

SEQ ID NO: 83137 - DNA, 20 bp, Artificial
  CRISPR gRNA sequence
ttattatctgaggttcctaa

SEQ ID NO: 83138 - DNA, 20 bp, Artificial
  CRISPR gRNA sequence
ttttttatttttttattttt

SEQ ID NO: 83139 - DNA, 20 bp, Artificial
  CRISPR gRNA sequence
tatttttttattttttggga

SEQ ID NO: 83140 - DNA, 20 bp, Artificial
  CRISPR gRNA sequence
tctcattccattgcccaggc

SEQ ID NO: 83141 - DNA, 20 bp, Artificial
  CRISPR gRNA sequence
ctcactgcaacctccgcctc

SEQ ID NO: 83142 - DNA, 20 bp, Artificial
  CRISPR gRNA sequence
ttttgtattttcagtagaga

SEQ ID NO: 83143 - DNA, 20 bp, Artificial
  CRISPR gRNA sequence
gccttggcctcccaaagtgt

SEQ ID NO: 83144 - DNA, 20 bp, Artificial
  CRISPR gRNA sequence
ctggcaaataccttaaatgg

SEQ ID NO: 83145 - DNA, 20 bp, Artificial
  CRISPR gRNA sequence
tggacccgataaaatacaac

SEQ ID NO: 83146 - DNA, 20 bp, Artificial
  CRISPR gRNA sequence
tactttccattatgatcaaa

SEQ ID NO: 83147 - DNA, 20 bp, Artificial
  CRISPR gRNA sequence
tggagtaatgcatgtgacag

SEQ ID NO: 83148 - DNA, 20 bp, Artificial
  CRISPR gRNA sequence
tgctgtaaactagccaggtt

SEQ ID NO: 83149 - DNA, 20 bp, Artificial
  CRISPR gRNA sequence
cttttaaatacacttatatt

SEQ ID NO: 83150 - DNA, 20 bp, Artificial
  CRISPR gRNA sequence
gggaggctgtggggagaagg

SEQ ID NO: 83151 - DNA, 20 bp, Artificial
  CRISPR gRNA sequence
gctactagccccatcaagag

SEQ ID NO: 83152 - DNA, 20 bp, Artificial
  CRISPR gRNA sequence
ccccatcaagaggtggattg

SEQ ID NO: 83153 - DNA, 20 bp, Artificial
  CRISPR gRNA sequence
aagaacatattaaatgcctc

SEQ ID NO: 83154 - DNA, 20 bp, Artificial
  CRISPR gRNA sequence
gaggacaagtatcagacagg

SEQ ID NO: 83155 - DNA, 20 bp, Artificial
  CRISPR gRNA sequence
aagtatcagacaggctgggt

SEQ ID NO: 83156 - DNA, 20 bp, Artificial
  CRISPR gRNA sequence
tactggctttatgacttttg

SEQ ID NO: 83157 - DNA, 20 bp, Artificial
  CRISPR gRNA sequence
caacagtcttggtaaccatc

SEQ ID NO: 83158 - DNA, 20 bp, Artificial
  CRISPR gRNA sequence
tttttttcttttttgagaga

SEQ ID NO: 83159 - DNA, 20 bp, Artificial
  CRISPR gRNA sequence
tctcgctctgttgcccacgc

SEQ ID NO: 83160 - DNA, 20 bp, Artificial
  CRISPR gRNA sequence
gcctcggcctccctaagtgc

SEQ ID NO: 83161 - DNA, 20 bp, Artificial
  CRISPR gRNA sequence
atgccgcccagtttgctctg

SEQ ID NO: 83162 - DNA, 20 bp, Artificial
  CRISPR gRNA sequence
tttttcttaaaaaaaaatgc

SEQ ID NO: 83163 - DNA, 20 bp, Artificial
  CRISPR gRNA sequence
cacacagaaagatgtcaata

SEQ ID NO: 83164 - DNA, 20 bp, Artificial
  CRISPR gRNA sequence
aggggcaagtagcgcgcgtc

SEQ ID NO: 83165 - DNA, 20 bp, Artificial
  CRISPR gRNA sequence
agagcacagcgagggccaca

SEQ ID NO: 83166 - DNA, 20 bp, Artificial
  CRISPR gRNA sequence
gagaggaaggaccagagcgg

SEQ ID NO: 83167 - DNA, 20 bp, Artificial
  CRISPR gRNA sequence
gagggtaggagagactcacg

SEQ ID NO: 83168 - DNA, 20 bp, Artificial
  CRISPR gRNA sequence
tagcctccaggccagaaaga

SEQ ID NO: 83169 - DNA, 20 bp, Artificial
  CRISPR gRNA sequence
acggagcgagacatctcggc

SEQ ID NO: 83170 - DNA, 20 bp, Artificial
  CRISPR gRNA sequence
gcccgaatgctgtcagcttc

SEQ ID NO: 83171 - DNA, 20 bp, Artificial
  CRISPR gRNA sequence
ctctaacctggcactgcgtc

SEQ ID NO: 83172 - DNA, 20 bp, Artificial
  CRISPR gRNA sequence
gacggtccctgcgggccttg

SEQ ID NO: 83173 - DNA, 20 bp, Artificial
  CRISPR gRNA sequence
cttgtcctgattggctgggc

SEQ ID NO: 83174 - DNA, 20 bp, Artificial
  CRISPR gRNA sequence
cggcgacgggagggtcggga

SEQ ID NO: 83175 - DNA, 20 bp, Artificial
  CRISPR gRNA sequence
tcagagcgccgaggttgggg

SEQ ID NO: 83176 - DNA, 20 bp, Artificial
  CRISPR gRNA sequence
tcgtcccaaaggcgcggcgc

SEQ ID NO: 83177 - DNA, 20 bp, Artificial
  CRISPR gRNA sequence
aggtttgtgaacgcgtggag

SEQ ID NO: 83178 - DNA, 20 bp, Artificial
  CRISPR gRNA sequence
ggtaagcctgtctgctgcgg

SEQ ID NO: 83179 - DNA, 20 bp, Artificial
  CRISPR gRNA sequence
cgtggggaggaaacagcacg

SEQ ID NO: 83180 - DNA, 20 bp, Artificial
  CRISPR gRNA sequence
aacagcacgcgacgtttgta

SEQ ID NO: 83181 - DNA, 20 bp, Artificial
  CRISPR gRNA sequence
aatgcttggctgtgatacaa

SEQ ID NO: 83182 - DNA, 20 bp, Artificial
  CRISPR gRNA sequence
ttctgtgtgccaaggacttt

SEQ ID NO: 83183 - DNA, 20 bp, Artificial
  CRISPR gRNA sequence
cagatgaagaaactaaggca

SEQ ID NO: 83184 - DNA, 20 bp, Artificial
  CRISPR gRNA sequence
caggggataaatggcagcaa

SEQ ID NO: 83185 - DNA, 20 bp, Artificial
  CRISPR gRNA sequence
agattgaagtcaagcctaac

SEQ ID NO: 83186 - DNA, 20 bp, Artificial
  CRISPR gRNA sequence
gaaaaacgcctgccttctgc

SEQ ID NO: 83187 - DNA, 20 bp, Artificial
  CRISPR gRNA sequence
ccctgtggtcttttcgtaca

SEQ ID NO: 83188 - DNA, 20 bp, Artificial
  CRISPR gRNA sequence
tcctctttggctctttgcct

SEQ ID NO: 83189 - DNA, 20 bp, Artificial
  CRISPR gRNA sequence
gatgtactgtgcctcttact

SEQ ID NO: 83190 - DNA, 20 bp, Artificial
  CRISPR gRNA sequence
aacatgagggggttgggcgt

SEQ ID NO: 83191 - DNA, 20 bp, Artificial
  CRISPR gRNA sequence
tagggaggccgaggcgggag

SEQ ID NO: 83192 - DNA, 20 bp, Artificial
  CRISPR gRNA sequence
ggctgaggcgggaggatctc

SEQ ID NO: 83193 - DNA, 20 bp, Artificial
  CRISPR gRNA sequence
ggcgggaggatctcttgagc

SEQ ID NO: 83194 - DNA, 20 bp, Artificial
  CRISPR gRNA sequence
aagaaaagaaagaaagaagt

SEQ ID NO: 83195 - DNA, 20 bp, Artificial
  CRISPR gRNA sequence
gcaaaacatgatcgaaagca

SEQ ID NO: 83196 - DNA, 20 bp, Artificial
  CRISPR gRNA sequence
ataccacaagaaacatgtaa

SEQ ID NO: 83197 - DNA, 20 bp, Artificial
  CRISPR gRNA sequence
tttcctcctctgacctgtgt

SEQ ID NO: 83198 - DNA, 20 bp, Artificial
  CRISPR gRNA sequence
tcctctgacctgtgtgtggg

SEQ ID NO: 83199 - DNA, 20 bp, Artificial
  CRISPR gRNA sequence
gacctgtgtgtgggttttgt

SEQ ID NO: 83200 - DNA, 20 bp, Artificial
  CRISPR gRNA sequence
ggcataaattaatttttcag

SEQ ID NO: 83201 - DNA, 20 bp, Artificial
  CRISPR gRNA sequence
taatttttcagttaagtttt

SEQ ID NO: 83202 - DNA, 20 bp, Artificial
  CRISPR gRNA sequence
gatacttgtcctcttcttag

SEQ ID NO: 83203 - DNA, 20 bp, Artificial
  CRISPR gRNA sequence
gctcagatgcaaagagctct

SEQ ID NO: 83204 - DNA, 20 bp, Artificial
  CRISPR gRNA sequence
atgaaaaaaatcaggtcttc

SEQ ID NO: 83205 - DNA, 20 bp, Artificial
  CRISPR gRNA sequence
gtagcctttccttaatgata

SEQ ID NO: 83206 - DNA, 20 bp, Artificial
  CRISPR gRNA sequence
ttcattttcaatgaaaaata

SEQ ID NO: 83207 - DNA, 20 bp, Artificial
  CRISPR gRNA sequence
atgcctctcattttggaaag

SEQ ID NO: 83208 - DNA, 20 bp, Artificial
  CRISPR gRNA sequence
ggcaatatattcccaacctg

SEQ ID NO: 83209 - DNA, 20 bp, Artificial
  CRISPR gRNA sequence
ttgccagctcttgtatgcat

SEQ ID NO: 83210 - DNA, 20 bp, Artificial
  CRISPR gRNA sequence
agctcttgtatgcatttagg

SEQ ID NO: 83211 - DNA, 20 bp, Artificial
  CRISPR gRNA sequence
tatgcatttaggttttgttt

SEQ ID NO: 83212 - DNA, 20 bp, Artificial
  CRISPR gRNA sequence
taaaacctcagcagaaataa

SEQ ID NO: 83213 - DNA, 20 bp, Artificial
  CRISPR gRNA sequence
cagcagaaataaagaggttt

SEQ ID NO: 83214 - DNA, 20 bp, Artificial
  CRISPR gRNA sequence
actccagcctgggcaatgga

SEQ ID NO: 83215 - DNA, 20 bp, Artificial
  CRISPR gRNA sequence
gcactctactagacacttca

SEQ ID NO: 83216 - DNA, 20 bp, Artificial
  CRISPR gRNA sequence
atgagggaaagataccaagt

SEQ ID NO: 83217 - DNA, 20 bp, Artificial
  CRISPR gRNA sequence
ggtttattcttcaaaatgga

SEQ ID NO: 83218 - DNA, 20 bp, Artificial
  CRISPR gRNA sequence
tgtaaacacttggtgcctga

SEQ ID NO: 83219 - DNA, 20 bp, Artificial
  CRISPR gRNA sequence
ccgatattcctcaggtactc

SEQ ID NO: 83220 - DNA, 20 bp, Artificial
  CRISPR gRNA sequence
tcctcaggtactccaaagat

SEQ ID NO: 83221 - DNA, 20 bp, Artificial
  CRISPR gRNA sequence
tttcctgaattgctatgtgt

SEQ ID NO: 83222 - DNA, 20 bp, Artificial
  CRISPR gRNA sequence
tatgagtagtcatatcataa

SEQ ID NO: 83223 - DNA, 20 bp, Artificial
  CRISPR gRNA sequence
tgatataaacaatctgcata

SEQ ID NO: 83224 - DNA, 20 bp, Artificial
  CRISPR gRNA sequence
gtcagggaatgttcttaaag

SEQ ID NO: 83225 - DNA, 20 bp, Artificial
  CRISPR gRNA sequence
gctgagatactgatgcacag

SEQ ID NO: 83226 - DNA, 20 bp, Artificial
  CRISPR gRNA sequence
cacagcatggtttctgaacc

SEQ ID NO: 83227 - DNA, 20 bp, Artificial
  CRISPR gRNA sequence
actcttaacacttcttacct

SEQ ID NO: 83228 - DNA, 20 bp, Artificial
  CRISPR gRNA sequence
cttcttacctactggcttcc

SEQ ID NO: 83229 - DNA, 20 bp, Artificial
  CRISPR gRNA sequence
tggcttcctctagcttttgt

SEQ ID NO: 83230 - DNA, 20 bp, Artificial
  CRISPR gRNA sequence
catctcaagaaggtataggc

SEQ ID NO: 83231 - DNA, 20 bp, Artificial
  CRISPR gRNA sequence
gacttctccagtactttctg

SEQ ID NO: 83232 - DNA, 20 bp, Artificial
  CRISPR gRNA sequence
tggtatctgaggctagtagg

SEQ ID NO: 83233 - DNA, 20 bp, Artificial
  CRISPR gRNA sequence
atgtaagcagcatcatggag

SEQ ID NO: 83234 - DNA, 20 bp, Artificial
  CRISPR gRNA sequence
gtaagtttttgaccttgaga

SEQ ID NO: 83235 - DNA, 20 bp, Artificial
  CRISPR gRNA sequence
ttttgaccttgagaaaatgt

SEQ ID NO: 83236 - DNA, 20 bp, Artificial
  CRISPR gRNA sequence
gtggttacccacattacctg

SEQ ID NO: 83237 - DNA, 20 bp, Artificial
  CRISPR gRNA sequence
cactcttttcctttgtataa

SEQ ID NO: 83238 - DNA, 20 bp, Artificial
  CRISPR gRNA sequence
atcccattcctgtatgggga

SEQ ID NO: 83239 - DNA, 20 bp, Artificial
  CRISPR gRNA sequence
cactagaggagataaaggga

SEQ ID NO: 83240 - DNA, 20 bp, Artificial
  CRISPR gRNA sequence
tgcatctttagttggagtcc

SEQ ID NO: 83241 - DNA, 20 bp, Artificial
  CRISPR gRNA sequence
tgttatattctagaacaggg

SEQ ID NO: 83242 - DNA, 20 bp, Artificial
  CRISPR gRNA sequence
tgacggggacatgttctgag

SEQ ID NO: 83243 - DNA, 20 bp, Artificial
  CRISPR gRNA sequence
tcatatcagcattttttctt

SEQ ID NO: 83244 - DNA, 20 bp, Artificial
  CRISPR gRNA sequence
aacaggatatactctttata

SEQ ID NO: 83245 - DNA, 20 bp, Artificial
  CRISPR gRNA sequence
atctacacagtagaaattag

SEQ ID NO: 83246 - DNA, 20 bp, Artificial
  CRISPR gRNA sequence
ctaacctttttcttttcttt

SEQ ID NO: 83247 - DNA, 20 bp, Artificial
  CRISPR gRNA sequence
tcaggtttgaagatgccgca

SEQ ID NO: 83248 - DNA, 20 bp, Artificial
  CRISPR gRNA sequence
tggattggatgaattccaaa

SEQ ID NO: 83249 - DNA, 20 bp, Artificial
  CRISPR gRNA sequence
ttggatgaattccaaattct

SEQ ID NO: 83250 - DNA, 20 bp, Artificial
  CRISPR gRNA sequence
atgaattccaaattctgctt

SEQ ID NO: 83251 - DNA, 20 bp, Artificial
  CRISPR gRNA sequence
ttgcttgctttttaatattg

SEQ ID NO: 83252 - DNA, 20 bp, Artificial
  CRISPR gRNA sequence
ttctactttgagtgctgtct

SEQ ID NO: 83253 - DNA, 20 bp, Artificial
  CRISPR gRNA sequence
tatccaacatcaacatcttg

SEQ ID NO: 83254 - DNA, 20 bp, Artificial
  CRISPR gRNA sequence
actcttcaatctcttgcact

SEQ ID NO: 83255 - DNA, 20 bp, Artificial
  CRISPR gRNA sequence
gttaacttccaatttacata

SEQ ID NO: 83256 - DNA, 20 bp, Artificial
  CRISPR gRNA sequence
aaaatttagaaatataattg

SEQ ID NO: 83257 - DNA, 20 bp, Artificial
  CRISPR gRNA sequence
tgaatgaaacattttgtcat

SEQ ID NO: 83258 - DNA, 20 bp, Artificial
  CRISPR gRNA sequence
taaggcatggttgtggttaa

SEQ ID NO: 83259 - DNA, 20 bp, Artificial
  CRISPR gRNA sequence
aaatgtgaaccccttgtata

SEQ ID NO: 83260 - DNA, 20 bp, Artificial
  CRISPR gRNA sequence
tttaccaagtggaacttgaa

SEQ ID NO: 83261 - DNA, 20 bp, Artificial
  CRISPR gRNA sequence
gtggaacttgaagactgttt

SEQ ID NO: 83262 - DNA, 20 bp, Artificial
  CRISPR gRNA sequence
gagatataagagataacaca

SEQ ID NO: 83263 - DNA, 20 bp, Artificial
  CRISPR gRNA sequence
aagagataacacatcaagtt

SEQ ID NO: 83264 - DNA, 20 bp, Artificial
  CRISPR gRNA sequence
aacttgtggaacaaaaataa

SEQ ID NO: 83265 - DNA, 20 bp, Artificial
  CRISPR gRNA sequence
aatatgaatcttatatgaca

SEQ ID NO: 83266 - DNA, 20 bp, Artificial
  CRISPR gRNA sequence
taaattggaagttaacttat

SEQ ID NO: 83267 - DNA, 20 bp, Artificial
  CRISPR gRNA sequence
atgcacgcttaactatctta

SEQ ID NO: 83268 - DNA, 20 bp, Artificial
  CRISPR gRNA sequence
tcttaacaagctttgagtgc

SEQ ID NO: 83269 - DNA, 20 bp, Artificial
  CRISPR gRNA sequence
ttagcaatgaatttatttta

SEQ ID NO: 83270 - DNA, 20 bp, Artificial
  CRISPR gRNA sequence
tagaagaaaaaatgctgata

SEQ ID NO: 83271 - DNA, 20 bp, Artificial
  CRISPR gRNA sequence
gtatatatgacagtggtctc

SEQ ID NO: 83272 - DNA, 20 bp, Artificial
  CRISPR gRNA sequence
gcatatttttactgcaactt

SEQ ID NO: 83273 - DNA, 20 bp, Artificial
  CRISPR gRNA sequence
tcagtacagtaacaggctgt

SEQ ID NO: 83274 - DNA, 20 bp, Artificial
  CRISPR gRNA sequence
cgtgtagtaggctacaacac

SEQ ID NO: 83275 - DNA, 20 bp, Artificial
  CRISPR gRNA sequence
tccctgttctagaatataac

SEQ ID NO: 83276 - DNA, 20 bp, Artificial
  CRISPR gRNA sequence
aatataacaggagatttgaa

SEQ ID NO: 83277 - DNA, 20 bp, Artificial
  CRISPR gRNA sequence
agtccaagttcctccctctc

SEQ ID NO: 83278 - DNA, 20 bp, Artificial
  CRISPR gRNA sequence
cattatatcaagttataaca

SEQ ID NO: 83279 - DNA, 20 bp, Artificial
  CRISPR gRNA sequence
ggagaagggaacatgaccct

SEQ ID NO: 83280 - DNA, 20 bp, Artificial
  CRISPR gRNA sequence
tcaaaaacttacctccatga

SEQ ID NO: 83281 - DNA, 20 bp, Artificial
  CRISPR gRNA sequence
ggagaaaaaaaaggaagaca

SEQ ID NO: 83282 - DNA, 20 bp, Artificial
  CRISPR gRNA sequence
gctgttcctacccatgaata

SEQ ID NO: 83283 - DNA, 20 bp, Artificial
  CRISPR gRNA sequence
ccagaaagtactggagaagt

SEQ ID NO: 83284 - DNA, 20 bp, Artificial
  CRISPR gRNA sequence
attccctgacaatcccaata

SEQ ID NO: 83285 - DNA, 20 bp, Artificial
  CRISPR gRNA sequence
cctgacaatcccaatatgca

SEQ ID NO: 83286 - DNA, 20 bp, Artificial
  CRISPR gRNA sequence
atagaccttttttatatcaa

SEQ ID NO: 83287 - DNA, 20 bp, Artificial
  CRISPR gRNA sequence
actactcatacacaactttc

SEQ ID NO: 83288 - DNA, 20 bp, Artificial
  CRISPR gRNA sequence
gtcaagctatatcaggcacc

SEQ ID NO: 83289 - DNA, 20 bp, Artificial
  CRISPR gRNA sequence
accaagtgtttacatttggt

SEQ ID NO: 83290 - DNA, 20 bp, Artificial
  CRISPR gRNA sequence
tccatttccactctggccaa

SEQ ID NO: 83291 - DNA, 20 bp, Artificial
  CRISPR gRNA sequence
aattcctctatacatgcctt

SEQ ID NO: 83292 - DNA, 20 bp, Artificial
  CRISPR gRNA sequence
gccttttttgttttttttct

SEQ ID NO: 83293 - DNA, 20 bp, Artificial
  CRISPR gRNA sequence
ctagcagtatcttctgtcac

SEQ ID NO: 83294 - DNA, 20 bp, Artificial
  CRISPR gRNA sequence
aacacatcactcaagagtct

SEQ ID NO: 83295 - DNA, 20 bp, Artificial
  CRISPR gRNA sequence
aaattactcatgttattgta

SEQ ID NO: 83296 - DNA, 20 bp, Artificial
  CRISPR gRNA sequence
caccccttccattttttttc

SEQ ID NO: 83297 - DNA, 20 bp, Artificial
  CRISPR gRNA sequence
tcctgccttgatctacaccc

SEQ ID NO: 83298 - DNA, 20 bp, Artificial
  CRISPR gRNA sequence
aacctccgcctcctgggttc

SEQ ID NO: 83299 - DNA, 20 bp, Artificial
  CRISPR gRNA sequence
tttttgtattttcagtagag

SEQ ID NO: 83300 - DNA, 20 bp, Artificial
  CRISPR gRNA sequence
tgccttggcctcccaaagtg

SEQ ID NO: 83301 - DNA, 20 bp, Artificial
  CRISPR gRNA sequence
caaaacctctttatttctgc

SEQ ID NO: 83302 - DNA, 20 bp, Artificial
  CRISPR gRNA sequence
atggagtaatgcatgtgaca

SEQ ID NO: 83303 - DNA, 20 bp, Artificial
  CRISPR gRNA sequence
aatgcatgtgacagtgggat

SEQ ID NO: 83304 - DNA, 20 bp, Artificial
  CRISPR gRNA sequence
gcgttttaattagcatccac

SEQ ID NO: 83305 - DNA, 20 bp, Artificial
  CRISPR gRNA sequence
caggttgggaatatattgcc

SEQ ID NO: 83306 - DNA, 20 bp, Artificial
  CRISPR gRNA sequence
agtgttagtgctactaaata

SEQ ID NO: 83307 - DNA, 20 bp, Artificial
  CRISPR gRNA sequence
ggctactagccccatcaaga

SEQ ID NO: 83308 - DNA, 20 bp, Artificial
  CRISPR gRNA sequence
gattggggaatctaatgaag

SEQ ID NO: 83309 - DNA, 20 bp, Artificial
  CRISPR gRNA sequence
gctaagagagctctttgcat

SEQ ID NO: 83310 - DNA, 20 bp, Artificial
  CRISPR gRNA sequence
aaatgcctcagggatcagag

SEQ ID NO: 83311 - DNA, 20 bp, Artificial
  CRISPR gRNA sequence
gattcatcctgcctggaact

SEQ ID NO: 83312 - DNA, 20 bp, Artificial
  CRISPR gRNA sequence
tctctgtttgagggaaggcg

SEQ ID NO: 83313 - DNA, 20 bp, Artificial
  CRISPR gRNA sequence
gaggacaagtatcagacagg

SEQ ID NO: 83314 - DNA, 20 bp, Artificial
  CRISPR gRNA sequence
gaatttgggctcaaccagtt

SEQ ID NO: 83315 - DNA, 20 bp, Artificial
  CRISPR gRNA sequence
tatgacttttggagagttat

SEQ ID NO: 83316 - DNA, 20 bp, Artificial
  CRISPR gRNA sequence
cttcagaggcaatcatcatt

SEQ ID NO: 83317 - DNA, 20 bp, Artificial
  CRISPR gRNA sequence
ttactttggaaattttcaaa

SEQ ID NO: 83318 - DNA, 20 bp, Artificial
  CRISPR gRNA sequence
aataagatttttttttaaat

SEQ ID NO: 83319 - DNA, 20 bp, Artificial
  CRISPR gRNA sequence
attttctcatgatcaaaaca

SEQ ID NO: 83320 - DNA, 20 bp, Artificial
  CRISPR gRNA sequence
tcaaaacattctgctttcga

SEQ ID NO: 83321 - DNA, 20 bp, Artificial
  CRISPR gRNA sequence
tttgccagaggaaaaggtga

SEQ ID NO: 83322 - DNA, 20 bp, Artificial
  CRISPR gRNA sequence
tcaacagtcttggtaaccat

SEQ ID NO: 83323 - DNA, 20 bp, Artificial
  CRISPR gRNA sequence
catcttggattatctttatt

SEQ ID NO: 83324 - DNA, 20 bp, Artificial
  CRISPR gRNA sequence
gttattattttttgtagaga

SEQ ID NO: 83325 - DNA, 20 bp, Artificial
  CRISPR gRNA sequence
cgcctcggcctccctaagtg

SEQ ID NO: 83326 - DNA, 20 bp, Artificial
  CRISPR gRNA sequence
agctaccacgcccaaccccc

SEQ ID NO: 83327 - DNA, 20 bp, Artificial
  CRISPR gRNA sequence
agaccacagggcccatgccg

SEQ ID NO: 83328 - DNA, 20 bp, Artificial
  CRISPR gRNA sequence
gagaatctcacgcagaaggc

SEQ ID NO: 83329 - DNA, 20 bp, Artificial
  CRISPR gRNA sequence
cgctcccgcaaaagccctgg

SEQ ID NO: 83330 - DNA, 20 bp, Artificial
  CRISPR gRNA sequence
ctggttaggcttgacttcaa

SEQ ID NO: 83331 - DNA, 20 bp, Artificial
  CRISPR gRNA sequence
gccatttatcccctgtgtaa

SEQ ID NO: 83332 - DNA, 20 bp, Artificial
  CRISPR gRNA sequence
gtttcttaaaatctcggtgc

SEQ ID NO: 83333 - DNA, 20 bp, Artificial
  CRISPR gRNA sequence
agttatctatggcggaagat

SEQ ID NO: 83334 - DNA, 20 bp, Artificial
  CRISPR gRNA sequence
caaataagttaattattcga

SEQ ID NO: 83335 - DNA, 20 bp, Artificial
  CRISPR gRNA sequence
agcattctacaaacgtcgcg

SEQ ID NO: 83336 - DNA, 20 bp, Artificial
  CRISPR gRNA sequence
gggaagcagagccgcagcag

SEQ ID NO: 83337 - DNA, 20 bp, Artificial
  CRISPR gRNA sequence
ctcccccaacctcggcgctc

SEQ ID NO: 83338 - DNA, 20 bp, Artificial
  CRISPR gRNA sequence
tccccactcccaggccaccc

SEQ ID NO: 83339 - DNA, 20 bp, Artificial
  CRISPR gRNA sequence
gacatctcggcccgaatgct

SEQ ID NO: 83340 - DNA, 20 bp, Artificial
  CRISPR gRNA sequence
caggttagagagagggactt

SEQ ID NO: 83341 - DNA, 20 bp, Artificial
  CRISPR gRNA sequence
ggaaacagcacgcgacgttt

SEQ ID NO: 83342 - DNA, 20 bp, Artificial
  CRISPR gRNA sequence
atcttctgcctctcacagat

SEQ ID NO: 83343 - DNA, 20 bp, Artificial
  CRISPR gRNA sequence
aaactaaggcaccgagattt

SEQ ID NO: 83344 - DNA, 20 bp, Artificial
  CRISPR gRNA sequence
gtaattcgtgcatttttttt

SEQ ID NO: 83345 - DNA, 20 bp, Artificial
  CRISPR gRNA sequence
gcgagaccctgtctctcaaa

SEQ ID NO: 83346 - DNA, 20 bp, Artificial
  CRISPR gRNA sequence
caaaaaagaaaaaaaaaaaa

SEQ ID NO: 83347 - DNA, 20 bp, Artificial
  CRISPR gRNA sequence
agaaaaaaaaaaaaaaagaa

SEQ ID NO: 83348 - DNA, 20 bp, Artificial
  CRISPR gRNA sequence
aaaaaaaaaaaagaaagaga

SEQ ID NO: 83349 - DNA, 20 bp, Artificial
  CRISPR gRNA sequence
aaaaaaagaaagagaaaaga

SEQ ID NO: 83350 - DNA, 20 bp, Artificial
  CRISPR gRNA sequence
aaagaaagagaaaagaaaag

SEQ ID NO: 83351 - DNA, 20 bp, Artificial
  CRISPR gRNA sequence
ctggcaaaacatgatcgaaa

SEQ ID NO: 83352 - DNA, 20 bp, Artificial
  CRISPR gRNA sequence
aaagcagaatgttttgatca

SEQ ID NO: 83353 - DNA, 20 bp, Artificial
  CRISPR gRNA sequence
accatttctggaagatacca

SEQ ID NO: 83354 - DNA, 20 bp, Artificial
  CRISPR gRNA sequence
gtctgatacttgtcctcttc

SEQ ID NO: 83355 - DNA, 20 bp, Artificial
  CRISPR gRNA sequence
cctgaatataagtgtattta

SEQ ID NO: 83356 - DNA, 20 bp, Artificial
  CRISPR gRNA sequence
gtctggcatataaaacctca

SEQ ID NO: 83357 - DNA, 20 bp, Artificial
  CRISPR gRNA sequence
tactagacacttcatacagt

SEQ ID NO: 83358 - DNA, 20 bp, Artificial
  CRISPR gRNA sequence
aaggcaggagcaggaaccaa

SEQ ID NO: 83359 - DNA, 20 bp, Artificial
  CRISPR gRNA sequence
caaaaagaaaggcataaaca

SEQ ID NO: 83360 - DNA, 20 bp, Artificial
  CRISPR gRNA sequence
tgatgggggctattatgaac

SEQ ID NO: 83361 - DNA, 20 bp, Artificial
  CRISPR gRNA sequence
agaagtccttgagagcctcc

SEQ ID NO: 83362 - DNA, 20 bp, Artificial
  CRISPR gRNA sequence
tccagtgacagaagatactg

SEQ ID NO: 83363 - DNA, 20 bp, Artificial
  CRISPR gRNA sequence
aagatactgctagaaatctg

SEQ ID NO: 83364 - DNA, 20 bp, Artificial
  CRISPR gRNA sequence
ccagagtggaaatggaattg

SEQ ID NO: 83365 - DNA, 20 bp, Artificial
  CRISPR gRNA sequence
gtttactcacgtcatccagc

SEQ ID NO: 83366 - DNA, 20 bp, Artificial
  CRISPR gRNA sequence
gacattgaagttgacttact

SEQ ID NO: 83367 - DNA, 20 bp, Artificial
  CRISPR gRNA sequence
tgacttactgaagaatggag

SEQ ID NO: 83368 - DNA, 20 bp, Artificial
  CRISPR gRNA sequence
tggaggtaagtttttgacct

SEQ ID NO: 83369 - DNA, 20 bp, Artificial
  CRISPR gRNA sequence
gtaacattttagcagggaaa

SEQ ID NO: 83370 - DNA, 20 bp, Artificial
  CRISPR gRNA sequence
attggacatctctgctgagg

SEQ ID NO: 83371 - DNA, 20 bp, Artificial
  CRISPR gRNA sequence
ttaatgacggggacatgttc

SEQ ID NO: 83372 - DNA, 20 bp, Artificial
  CRISPR gRNA sequence
ttaaaaaggtgatctacaca

SEQ ID NO: 83373 - DNA, 20 bp, Artificial
  CRISPR gRNA sequence
gcaacttagaggtggggagc

SEQ ID NO: 83374 - DNA, 20 bp, Artificial
  CRISPR gRNA sequence
ttccaatttacatactctgc

SEQ ID NO: 83375 - DNA, 20 bp, Artificial
  CRISPR gRNA sequence
cttagaatttgggggaaaat

SEQ ID NO: 83376 - DNA, 20 bp, Artificial
  CRISPR gRNA sequence
caagatgttgatgttggata

SEQ ID NO: 83377 - DNA, 20 bp, Artificial
  CRISPR gRNA sequence
acatggagacagcactcaaa

SEQ ID NO: 83378 - DNA, 20 bp, Artificial
  CRISPR gRNA sequence
caatattaaaaagcaagcaa

SEQ ID NO: 83379 - DNA, 20 bp, Artificial
  CRISPR gRNA sequence
tgcggcatcttcaaacctga

SEQ ID NO: 83380 - DNA, 20 bp, Artificial
  CRISPR gRNA sequence
catcttcaaacctgaaaaga

SEQ ID NO: 83381 - DNA, 20 bp, Artificial
  CRISPR gRNA sequence
ttggtgctcccaaaatctta

SEQ ID NO: 83382 - DNA, 20 bp, Artificial
  CRISPR gRNA sequence
tcccaaatcaattccctgtt

SEQ ID NO: 83383 - DNA, 20 bp, Artificial
  CRISPR gRNA sequence
gcatcaatgtaccctgggca

SEQ ID NO: 83384 - DNA, 20 bp, Artificial
  CRISPR gRNA sequence
ataactcctctcttctgtct

SEQ ID NO: 83385 - DNA, 20 bp, Artificial
  CRISPR gRNA sequence
tgtccaatgtggaaatggca

SEQ ID NO: 83386 - DNA, 20 bp, Artificial
  CRISPR gRNA sequence
cgatctatgaaaaagacagt

SEQ ID NO: 83387 - DNA, 20 bp, Artificial
  CRISPR gRNA sequence
ctaacaaatgtctaaaatgg

SEQ ID NO: 83388 - DNA, 20 bp, Artificial
  CRISPR gRNA sequence
aatggttagaaataaggctg

SEQ ID NO: 83389 - DNA, 20 bp, Artificial
  CRISPR gRNA sequence
agcctcagataccaatccag

SEQ ID NO: 83390 - DNA, 20 bp, Artificial
  CRISPR gRNA sequence
actgcagggaaactactggt

SEQ ID NO: 83391 - DNA, 20 bp, Artificial
  CRISPR gRNA sequence
acaactttcagcagcttaca

SEQ ID NO: 83392 - DNA, 20 bp, Artificial
  CRISPR gRNA sequence
aattcagtgtagtacaagag

SEQ ID NO: 83393 - DNA, 20 bp, Artificial
  CRISPR gRNA sequence
caacaagccacctccatttt

SEQ ID NO: 83394 - DNA, 20 bp, Artificial
  CRISPR gRNA sequence
aatttcatgagctaaaaaac

SEQ ID NO: 83395 - DNA, 20 bp, Artificial
  CRISPR gRNA sequence
ggaatatattgcctaatgtt

SEQ ID NO: 83396 - DNA, 20 bp, Artificial
  CRISPR gRNA sequence
gaccatccatggggaagtgg

SEQ ID NO: 83397 - DNA, 20 bp, Artificial
  CRISPR gRNA sequence
ccttgaccagatatatctct

SEQ ID NO: 83398 - DNA, 20 bp, Artificial
  CRISPR gRNA sequence
catgtttcttgtggtatctt

SEQ ID NO: 83399 - DNA, 20 bp, Artificial
  CRISPR gRNA sequence
cttagtgtattgccaggtac

SEQ ID NO: 83400 - DNA, 20 bp, Artificial
  CRISPR gRNA sequence
catgccgcccagtttgctct

SEQ ID NO: 83401 - DNA, 20 bp, Artificial
  CRISPR gRNA sequence
gcacataaagtccttggcac

SEQ ID NO: 83402 - DNA, 20 bp, Artificial
  CRISPR gRNA sequence
aggccccgcgaaagagcgga

SEQ ID NO: 83403 - DNA, 20 bp, Artificial
  CRISPR gRNA sequence
cacgctggatagcctccagg

SEQ ID NO: 83404 - DNA, 20 bp, Artificial
  CRISPR gRNA sequence
gctttgcgtcatttaatttt

SEQ ID NO: 83405 - DNA, 20 bp, Artificial
  CRISPR gRNA sequence
ttcgtgcatttttttttaag

SEQ ID NO: 83406 - DNA, 20 bp, Artificial
  CRISPR gRNA sequence
tgcctcttactttcggtttt

SEQ ID NO: 83407 - DNA, 20 bp, Artificial
  CRISPR gRNA sequence
tttgtcagtcaggggagctg

SEQ ID NO: 83408 - DNA, 20 bp, Artificial
  CRISPR gRNA sequence
gcgctcaccttttcctctgg

SEQ ID NO: 83409 - DNA, 20 bp, Artificial
  CRISPR gRNA sequence
aatcacctgtggatgctaat

SEQ ID NO: 83410 - DNA, 20 bp, Artificial
  CRISPR gRNA sequence
tcagagaggggtctggcata

SEQ ID NO: 83411 - DNA, 20 bp, Artificial
  CRISPR gRNA sequence
tgctagaaatctgctagaaa

SEQ ID NO: 83412 - DNA, 20 bp, Artificial
  CRISPR gRNA sequence
agtacatggtattttaaaag

SEQ ID NO: 83413 - DNA, 20 bp, Artificial
  CRISPR gRNA sequence
atatacagtccatcattgac

SEQ ID NO: 83414 - DNA, 20 bp, Artificial
  CRISPR gRNA sequence
tccacaagttaaataaatca

SEQ ID NO: 83415 - DNA, 20 bp, Artificial
  CRISPR gRNA sequence
cctctcttctgtctgaagaa

SEQ ID NO: 83416 - DNA, 20 bp, Artificial
  CRISPR gRNA sequence
agtcctcaggacagtgaaac

SEQ ID NO: 83417 - DNA, 20 bp, Artificial
  CRISPR gRNA sequence
aaaaacattttctcaaggtc

SEQ ID NO: 83418 - DNA, 20 bp, Artificial
  CRISPR gRNA sequence
ggtatgttcttaccaaacaa

SEQ ID NO: 83419 - DNA, 20 bp, Artificial
  CRISPR gRNA sequence
gtacctaatttcatgagcta

SEQ ID NO: 83420 - DNA, 20 bp, Artificial
  CRISPR gRNA sequence
tgagctaaaaaacaaagaaa

SEQ ID NO: 83421 - DNA, 20 bp, Artificial
  CRISPR gRNA sequence
tggagagttatttaagcttc

SEQ ID NO: 83422 - DNA, 20 bp, Artificial
  CRISPR gRNA sequence
aaattaatttatgcccacag

SEQ ID NO: 83423 - DNA, 20 bp, Artificial
  CRISPR gRNA sequence
atttatgcccacagtaaaac

SEQ ID NO: 83424 - DNA, 20 bp, Artificial
  CRISPR gRNA sequence
tgcccacagtaaaacaaaaa

SEQ ID NO: 83425 - DNA, 20 bp, Artificial
  CRISPR gRNA sequence
aaatgcaattttctcatgat

SEQ ID NO: 83426 - DNA, 20 bp, Artificial
  CRISPR gRNA sequence
gcccaaccccctcatgtttt

SEQ ID NO: 83427 - DNA, 20 bp, Artificial
  CRISPR gRNA sequence
tctctaacctggcactgcgt

SEQ ID NO: 83428 - DNA, 20 bp, Artificial
  CRISPR gRNA sequence
tctaacctggcactgcgtcg

SEQ ID NO: 83429 - DNA, 20 bp, Artificial
  CRISPR gRNA sequence
taacctggcactgcgtcgct

SEQ ID NO: 83430 - DNA, 20 bp, Artificial
  CRISPR gRNA sequence
acctggcactgcgtcgctgg

SEQ ID NO: 83431 - DNA, 20 bp, Artificial
  CRISPR gRNA sequence
gcactgcgtcgctggcttgg

SEQ ID NO: 83432 - DNA, 20 bp, Artificial
  CRISPR gRNA sequence
cgtcgctggcttggagacag

SEQ ID NO: 83433 - DNA, 20 bp, Artificial
  CRISPR gRNA sequence
gcttggagacaggtgacggt

SEQ ID NO: 83434 - DNA, 20 bp, Artificial
  CRISPR gRNA sequence
ggagacaggtgacggtccct

SEQ ID NO: 83435 - DNA, 20 bp, Artificial
  CRISPR gRNA sequence
gagacaggtgacggtccctg

SEQ ID NO: 83436 - DNA, 20 bp, Artificial
  CRISPR gRNA sequence
cgggccttgtcctgattggc

SEQ ID NO: 83437 - DNA, 20 bp, Artificial
  CRISPR gRNA sequence
gtcctgattggctgggcacg

SEQ ID NO: 83438 - DNA, 20 bp, Artificial
  CRISPR gRNA sequence
tcctgattggctgggcacgc

SEQ ID NO: 83439 - DNA, 20 bp, Artificial
  CRISPR gRNA sequence
attggctgggcacgcgttta

SEQ ID NO: 83440 - DNA, 20 bp, Artificial
  CRISPR gRNA sequence
gctgggcacgcgtttaatat

SEQ ID NO: 83441 - DNA, 20 bp, Artificial
  CRISPR gRNA sequence
ggcacgcgtttaatataagt

SEQ ID NO: 83442 - DNA, 20 bp, Artificial
  CRISPR gRNA sequence
aatataagtggaggcgtcgc

SEQ ID NO: 83443 - DNA, 20 bp, Artificial
  CRISPR gRNA sequence
atataagtggaggcgtcgcg

SEQ ID NO: 83444 - DNA, 20 bp, Artificial
  CRISPR gRNA sequence
gcgggcattcctgaagctga

SEQ ID NO: 83445 - DNA, 20 bp, Artificial
  CRISPR gRNA sequence
ctgaagctgacagcattcgg

SEQ ID NO: 83446 - DNA, 20 bp, Artificial
  CRISPR gRNA sequence
aagctgacagcattcgggcc

SEQ ID NO: 83447 - DNA, 20 bp, Artificial
  CRISPR gRNA sequence
acagcattcgggccgagatg

SEQ ID NO: 83448 - DNA, 20 bp, Artificial
  CRISPR gRNA sequence
gggccgagatgtctcgctcc

SEQ ID NO: 83449 - DNA, 20 bp, Artificial
  CRISPR gRNA sequence
gctccgtggccttagctgtg

SEQ ID NO: 83450 - DNA, 20 bp, Artificial
  CRISPR gRNA sequence
cgtggccttagctgtgctcg

SEQ ID NO: 83451 - DNA, 20 bp, Artificial
  CRISPR gRNA sequence
agctgtgctcgcgctactct

SEQ ID NO: 83452 - DNA, 20 bp, Artificial
  CRISPR gRNA sequence
gctgtgctcgcgctactctc

SEQ ID NO: 83453 - DNA, 20 bp, Artificial
  CRISPR gRNA sequence
tgctcgcgctactctctctt

SEQ ID NO: 83454 - DNA, 20 bp, Artificial
  CRISPR gRNA sequence
gcgctactctctctttctgg

SEQ ID NO: 83455 - DNA, 20 bp, Artificial
  CRISPR gRNA sequence
ctctctctttctggcctgga

SEQ ID NO: 83456 - DNA, 20 bp, Artificial
  CRISPR gRNA sequence
tctctttctggcctggaggc

SEQ ID NO: 83457 - DNA, 20 bp, Artificial
  CRISPR gRNA sequence
tctttctggcctggaggcta

SEQ ID NO: 83458 - DNA, 20 bp, Artificial
  CRISPR gRNA sequence
tttctggcctggaggctatc

SEQ ID NO: 83459 - DNA, 20 bp, Artificial
  CRISPR gRNA sequence
tctggcctggaggctatcca

SEQ ID NO: 83460 - DNA, 20 bp, Artificial
  CRISPR gRNA sequence
ctggcctggaggctatccag

SEQ ID NO: 83461 - DNA, 20 bp, Artificial
  CRISPR gRNA sequence
tggcctggaggctatccagc

SEQ ID NO: 83462 - DNA, 20 bp, Artificial
  CRISPR gRNA sequence
gcctggaggctatccagcgt

SEQ ID NO: 83463 - DNA, 20 bp, Artificial
  CRISPR gRNA sequence
gaggctatccagcgtgagtc

SEQ ID NO: 83464 - DNA, 20 bp, Artificial
  CRISPR gRNA sequence
tccagcgtgagtctctccta

SEQ ID NO: 83465 - DNA, 20 bp, Artificial
  CRISPR gRNA sequence
tcctaccctcccgctctggt

SEQ ID NO: 83466 - DNA, 20 bp, Artificial
  CRISPR gRNA sequence
ctaccctcccgctctggtcc

SEQ ID NO: 83467 - DNA, 20 bp, Artificial
  CRISPR gRNA sequence
ccctcccgctctggtccttc

SEQ ID NO: 83468 - DNA, 20 bp, Artificial
  CRISPR gRNA sequence
ccgctctggtccttcctctc

SEQ ID NO: 83469 - DNA, 20 bp, Artificial
  CRISPR gRNA sequence
tggtccttcctctcccgctc

SEQ ID NO: 83470 - DNA, 20 bp, Artificial
  CRISPR gRNA sequence
gtccttcctctcccgctctg

SEQ ID NO: 83471 - DNA, 20 bp, Artificial
  CRISPR gRNA sequence
cctctcccgctctgcaccct

SEQ ID NO: 83472 - DNA, 20 bp, Artificial
  CRISPR gRNA sequence
ctctcccgctctgcaccctc

SEQ ID NO: 83473 - DNA, 20 bp, Artificial
  CRISPR gRNA sequence
tcccgctctgcaccctctgt

SEQ ID NO: 83474 - DNA, 20 bp, Artificial
  CRISPR gRNA sequence
ccgctctgcaccctctgtgg

SEQ ID NO: 83475 - DNA, 20 bp, Artificial
  CRISPR gRNA sequence
tgcaccctctgtggccctcg

SEQ ID NO: 83476 - DNA, 20 bp, Artificial
  CRISPR gRNA sequence
caccctctgtggccctcgct

SEQ ID NO: 83477 - DNA, 20 bp, Artificial
  CRISPR gRNA sequence
tgtggccctcgctgtgctct

SEQ ID NO: 83478 - DNA, 20 bp, Artificial
  CRISPR gRNA sequence
tggccctcgctgtgctctct

SEQ ID NO: 83479 - DNA, 20 bp, Artificial
  CRISPR gRNA sequence
gctgtgctctctcgctccgt

SEQ ID NO: 83480 - DNA, 20 bp, Artificial
  CRISPR gRNA sequence
tgctctctcgctccgtgact

SEQ ID NO: 83481 - DNA, 20 bp, Artificial
  CRISPR gRNA sequence
tctcgctccgtgacttccct

SEQ ID NO: 83482 - DNA, 20 bp, Artificial
  CRISPR gRNA sequence
tcgctccgtgacttcccttc

SEQ ID NO: 83483 - DNA, 20 bp, Artificial
  CRISPR gRNA sequence
gctccgtgacttcccttctc

SEQ ID NO: 83484 - DNA, 20 bp, Artificial
  CRISPR gRNA sequence
cgtgacttcccttctccaag

SEQ ID NO: 83485 - DNA, 20 bp, Artificial
  CRISPR gRNA sequence
cccttctccaagttctcctt

SEQ ID NO: 83486 - DNA, 20 bp, Artificial
  CRISPR gRNA sequence
ccttctccaagttctccttg

SEQ ID NO: 83487 - DNA, 20 bp, Artificial
  CRISPR gRNA sequence
ctccaagttctccttggtgg

SEQ ID NO: 83488 - DNA, 20 bp, Artificial
  CRISPR gRNA sequence
tccaagttctccttggtggc

SEQ ID NO: 83489 - DNA, 20 bp, Artificial
  CRISPR gRNA sequence
caagttctccttggtggccc

SEQ ID NO: 83490 - DNA, 20 bp, Artificial
  CRISPR gRNA sequence
tccttggtggcccgccgtgg

SEQ ID NO: 83491 - DNA, 20 bp, Artificial
  CRISPR gRNA sequence
cttggtggcccgccgtgggg

SEQ ID NO: 83492 - DNA, 20 bp, Artificial
  CRISPR gRNA sequence
ggtggcccgccgtggggcta

SEQ ID NO: 83493 - DNA, 20 bp, Artificial
  CRISPR gRNA sequence
gtggcccgccgtggggctag

SEQ ID NO: 83494 - DNA, 20 bp, Artificial
  CRISPR gRNA sequence
gtccagggctggatctcggg

SEQ ID NO: 83495 - DNA, 20 bp, Artificial
  CRISPR gRNA sequence
gatctcggggaagcggcggg

SEQ ID NO: 83496 - DNA, 20 bp, Artificial
  CRISPR gRNA sequence
ggggaagcggcggggtggcc

SEQ ID NO: 83497 - DNA, 20 bp, Artificial
  CRISPR gRNA sequence
ggagtggggaagggggtgcg

SEQ ID NO: 83498 - DNA, 20 bp, Artificial
  CRISPR gRNA sequence
cttgcccctttcggcgggga

SEQ ID NO: 83499 - DNA, 20 bp, Artificial
  CRISPR gRNA sequence
gcccctttcggcggggagca

SEQ ID NO: 83500 - DNA, 20 bp, Artificial
  CRISPR gRNA sequence
cccctttcggcggggagcag

SEQ ID NO: 83501 - DNA, 20 bp, Artificial
  CRISPR gRNA sequence
tcggcggggagcaggggaga

SEQ ID NO: 83502 - DNA, 20 bp, Artificial
  CRISPR gRNA sequence
cggcggggagcaggggagac

SEQ ID NO: 83503 - DNA, 20 bp, Artificial
  CRISPR gRNA sequence
ggcggggagcaggggagacc

SEQ ID NO: 83504 - DNA, 20 bp, Artificial
  CRISPR gRNA sequence
tggcctacggcgacgggagg

SEQ ID NO: 83505 - DNA, 20 bp, Artificial
  CRISPR gRNA sequence
ggcctacggcgacgggaggg

SEQ ID NO: 83506 - DNA, 20 bp, Artificial
  CRISPR gRNA sequence
gcctacggcgacgggagggt

SEQ ID NO: 83507 - DNA, 20 bp, Artificial
  CRISPR gRNA sequence
cggcgacgggagggtcggga

SEQ ID NO: 83508 - DNA, 20 bp, Artificial
  CRISPR gRNA sequence
agggcgtcgataagcgtcag

SEQ ID NO: 83509 - DNA, 20 bp, Artificial
  CRISPR gRNA sequence
gggcgtcgataagcgtcaga

SEQ ID NO: 83510 - DNA, 20 bp, Artificial
  CRISPR gRNA sequence
ggggagggtttctcttccgc

SEQ ID NO: 83511 - DNA, 20 bp, Artificial
  CRISPR gRNA sequence
ctcttccgctctttcgcggg

SEQ ID NO: 83512 - DNA, 20 bp, Artificial
  CRISPR gRNA sequence
tcttccgctctttcgcgggg

SEQ ID NO: 83513 - DNA, 20 bp, Artificial
  CRISPR gRNA sequence
ttccgctctttcgcggggcc

SEQ ID NO: 83514 - DNA, 20 bp, Artificial
  CRISPR gRNA sequence
ccgctctttcgcggggcctc

SEQ ID NO: 83515 - DNA, 20 bp, Artificial
  CRISPR gRNA sequence
cgctctttcgcggggcctct

SEQ ID NO: 83516 - DNA, 20 bp, Artificial
  CRISPR gRNA sequence
tttcgcggggcctctggctc

SEQ ID NO: 83517 - DNA, 20 bp, Artificial
  CRISPR gRNA sequence
tcgcggggcctctggctccc

SEQ ID NO: 83518 - DNA, 20 bp, Artificial
  CRISPR gRNA sequence
cgcggggcctctggctcccc

SEQ ID NO: 83519 - DNA, 20 bp, Artificial
  CRISPR gRNA sequence
gcggggcctctggctccccc

SEQ ID NO: 83520 - DNA, 20 bp, Artificial
  CRISPR gRNA sequence
tggctcccccagcgcagctg

SEQ ID NO: 83521 - DNA, 20 bp, Artificial
  CRISPR gRNA sequence
gctcccccagcgcagctgga

SEQ ID NO: 83522 - DNA, 20 bp, Artificial
  CRISPR gRNA sequence
ccccagcgcagctggagtgg

SEQ ID NO: 83523 - DNA, 20 bp, Artificial
  CRISPR gRNA sequence
gagtgggggacgggtaggct

SEQ ID NO: 83524 - DNA, 20 bp, Artificial
  CRISPR gRNA sequence
gtcccaaaggcgcggcgctg

SEQ ID NO: 83525 - DNA, 20 bp, Artificial
  CRISPR gRNA sequence
aggtttgtgaacgcgtggag

SEQ ID NO: 83526 - DNA, 20 bp, Artificial
  CRISPR gRNA sequence
gtgaacgcgtggaggggcgc

SEQ ID NO: 83527 - DNA, 20 bp, Artificial
  CRISPR gRNA sequence
tgaacgcgtggaggggcgct

SEQ ID NO: 83528 - DNA, 20 bp, Artificial
  CRISPR gRNA sequence
ggggtctgggggaggcgtcg

SEQ ID NO: 83529 - DNA, 20 bp, Artificial
  CRISPR gRNA sequence
gggtctgggggaggcgtcgc

SEQ ID NO: 83530 - DNA, 20 bp, Artificial
  CRISPR gRNA sequence
ggggaggcgtcgcccgggta

SEQ ID NO: 83531 - DNA, 20 bp, Artificial
  CRISPR gRNA sequence
tctgctgcggctctgcttcc

SEQ ID NO: 83532 - DNA, 20 bp, Artificial
  CRISPR gRNA sequence
ctgcggctctgcttccctta

SEQ ID NO: 83533 - DNA, 20 bp, Artificial
  CRISPR gRNA sequence
cggctctgcttcccttagac

SEQ ID NO: 83534 - DNA, 20 bp, Artificial
  CRISPR gRNA sequence
tgcttcccttagactggaga

SEQ ID NO: 83535 - DNA, 20 bp, Artificial
  CRISPR gRNA sequence
cttcccttagactggagagc

SEQ ID NO: 83536 - DNA, 20 bp, Artificial
  CRISPR gRNA sequence
cccttagactggagagctgt

SEQ ID NO: 83537 - DNA, 20 bp, Artificial
  CRISPR gRNA sequence
ccttagactggagagctgtg

SEQ ID NO: 83538 - DNA, 20 bp, Artificial
  CRISPR gRNA sequence
agactggagagctgtggact

SEQ ID NO: 83539 - DNA, 20 bp, Artificial
  CRISPR gRNA sequence
gactggagagctgtggactt

SEQ ID NO: 83540 - DNA, 20 bp, Artificial
  CRISPR gRNA sequence
gagagctgtggacttcgtct

SEQ ID NO: 83541 - DNA, 20 bp, Artificial
  CRISPR gRNA sequence
tggacttcgtctaggcgccc

SEQ ID NO: 83542 - DNA, 20 bp, Artificial
  CRISPR gRNA sequence
cgtctaggcgcccgctaagt

SEQ ID NO: 83543 - DNA, 20 bp, Artificial
  CRISPR gRNA sequence
gtctaggcgcccgctaagtt

SEQ ID NO: 83544 - DNA, 20 bp, Artificial
  CRISPR gRNA sequence
ggcgcccgctaagttcgcat

SEQ ID NO: 83545 - DNA, 20 bp, Artificial
  CRISPR gRNA sequence
agttcgcatgtcctagcacc

SEQ ID NO: 83546 - DNA, 20 bp, Artificial
  CRISPR gRNA sequence
gcatgtcctagcacctctgg

SEQ ID NO: 83547 - DNA, 20 bp, Artificial
  CRISPR gRNA sequence
gcacctctgggtctatgtgg

SEQ ID NO: 83548 - DNA, 20 bp, Artificial
  CRISPR gRNA sequence
tgggtctatgtggggccaca

SEQ ID NO: 83549 - DNA, 20 bp, Artificial
  CRISPR gRNA sequence
ggtctatgtggggccacacc

SEQ ID NO: 83550 - DNA, 20 bp, Artificial
  CRISPR gRNA sequence
tgtggggccacaccgtgggg

SEQ ID NO: 83551 - DNA, 20 bp, Artificial
  CRISPR gRNA sequence
gtagaatgcttggctgtgat

SEQ ID NO: 83552 - DNA, 20 bp, Artificial
  CRISPR gRNA sequence
tagaatgcttggctgtgata

SEQ ID NO: 83553 - DNA, 20 bp, Artificial
  CRISPR gRNA sequence
ggctgtgatacaaagcggtt

SEQ ID NO: 83554 - DNA, 20 bp, Artificial
  CRISPR gRNA sequence
gctgtgatacaaagcggttt

SEQ ID NO: 83555 - DNA, 20 bp, Artificial
  CRISPR gRNA sequence
tgatacaaagcggtttcgaa

SEQ ID NO: 83556 - DNA, 20 bp, Artificial
  CRISPR gRNA sequence
cgaataattaacttatttgt

SEQ ID NO: 83557 - DNA, 20 bp, Artificial
  CRISPR gRNA sequence
gaataattaacttatttgtt

SEQ ID NO: 83558 - DNA, 20 bp, Artificial
  CRISPR gRNA sequence
acttatttgttcccatcaca

SEQ ID NO: 83559 - DNA, 20 bp, Artificial
  CRISPR gRNA sequence
atttgttcccatcacatgtc

SEQ ID NO: 83560 - DNA, 20 bp, Artificial
  CRISPR gRNA sequence
tttgttcccatcacatgtca

SEQ ID NO: 83561 - DNA, 20 bp, Artificial
  CRISPR gRNA sequence
gttcccatcacatgtcactt

SEQ ID NO: 83562 - DNA, 20 bp, Artificial
  CRISPR gRNA sequence
ttcccatcacatgtcacttt

SEQ ID NO: 83563 - DNA, 20 bp, Artificial
  CRISPR gRNA sequence
ccatcacatgtcacttttaa

SEQ ID NO: 83564 - DNA, 20 bp, Artificial
  CRISPR gRNA sequence
ttaaaaaattataagaacta

SEQ ID NO: 83565 - DNA, 20 bp, Artificial
  CRISPR gRNA sequence
taaaaaattataagaactac

SEQ ID NO: 83566 - DNA, 20 bp, Artificial
  CRISPR gRNA sequence
aaaaaattataagaactacc

SEQ ID NO: 83567 - DNA, 20 bp, Artificial
  CRISPR gRNA sequence
aaaaattataagaactaccc

SEQ ID NO: 83568 - DNA, 20 bp, Artificial
  CRISPR gRNA sequence
taagaactacccgttattga

SEQ ID NO: 83569 - DNA, 20 bp, Artificial
  CRISPR gRNA sequence
cccgttattgacatctttct

SEQ ID NO: 83570 - DNA, 20 bp, Artificial
  CRISPR gRNA sequence
ttgacatctttctgtgtgcc

SEQ ID NO: 83571 - DNA, 20 bp, Artificial
  CRISPR gRNA sequence
acatctttctgtgtgccaag

SEQ ID NO: 83572 - DNA, 20 bp, Artificial
  CRISPR gRNA sequence
tctgtgtgccaaggacttta

SEQ ID NO: 83573 - DNA, 20 bp, Artificial
  CRISPR gRNA sequence
ctgtgtgccaaggactttat

SEQ ID NO: 83574 - DNA, 20 bp, Artificial
  CRISPR gRNA sequence
tgtgtgccaaggactttatg

SEQ ID NO: 83575 - DNA, 20 bp, Artificial
  CRISPR gRNA sequence
tgtgccaaggactttatgtg

SEQ ID NO: 83576 - DNA, 20 bp, Artificial
  CRISPR gRNA sequence
tatgtgctttgcgtcattta

SEQ ID NO: 83577 - DNA, 20 bp, Artificial
  CRISPR gRNA sequence
atgtgctttgcgtcatttaa

SEQ ID NO: 83578 - DNA, 20 bp, Artificial
  CRISPR gRNA sequence
tgtgctttgcgtcatttaat

SEQ ID NO: 83579 - DNA, 20 bp, Artificial
  CRISPR gRNA sequence
tgcgtcatttaattttgaaa

SEQ ID NO: 83580 - DNA, 20 bp, Artificial
  CRISPR gRNA sequence
gcgtcatttaattttgaaaa

SEQ ID NO: 83581 - DNA, 20 bp, Artificial
  CRISPR gRNA sequence
cgtcatttaattttgaaaac

SEQ ID NO: 83582 - DNA, 20 bp, Artificial
  CRISPR gRNA sequence
aattttgaaaacagttatct

SEQ ID NO: 83583 - DNA, 20 bp, Artificial
  CRISPR gRNA sequence
attttgaaaacagttatctt

SEQ ID NO: 83584 - DNA, 20 bp, Artificial
  CRISPR gRNA sequence
tgaaaacagttatcttccgc

SEQ ID NO: 83585 - DNA, 20 bp, Artificial
  CRISPR gRNA sequence
gaaaacagttatcttccgcc

SEQ ID NO: 83586 - DNA, 20 bp, Artificial
  CRISPR gRNA sequence
aaaacagttatcttccgcca

SEQ ID NO: 83587 - DNA, 20 bp, Artificial
  CRISPR gRNA sequence
tcttccgccatagataacta

SEQ ID NO: 83588 - DNA, 20 bp, Artificial
  CRISPR gRNA sequence
ccgccatagataactactat

SEQ ID NO: 83589 - DNA, 20 bp, Artificial
  CRISPR gRNA sequence
cgccatagataactactatg

SEQ ID NO: 83590 - DNA, 20 bp, Artificial
  CRISPR gRNA sequence
ctatggttatcttctgcctc

SEQ ID NO: 83591 - DNA, 20 bp, Artificial
  CRISPR gRNA sequence
tggttatcttctgcctctca

SEQ ID NO: 83592 - DNA, 20 bp, Artificial
  CRISPR gRNA sequence
tcttctgcctctcacagatg

SEQ ID NO: 83593 - DNA, 20 bp, Artificial
  CRISPR gRNA sequence
ctgcctctcacagatgaaga

SEQ ID NO: 83594 - DNA, 20 bp, Artificial
  CRISPR gRNA sequence
tgcctctcacagatgaagaa

SEQ ID NO: 83595 - DNA, 20 bp, Artificial
  CRISPR gRNA sequence
cctctcacagatgaagaaac

SEQ ID NO: 83596 - DNA, 20 bp, Artificial
  CRISPR gRNA sequence
tcacagatgaagaaactaag

SEQ ID NO: 83597 - DNA, 20 bp, Artificial
  CRISPR gRNA sequence
acagatgaagaaactaaggc

SEQ ID NO: 83598 - DNA, 20 bp, Artificial
  CRISPR gRNA sequence
aggcaccgagattttaagaa

SEQ ID NO: 83599 - DNA, 20 bp, Artificial
  CRISPR gRNA sequence
taagaaacttaattacacag

SEQ ID NO: 83600 - DNA, 20 bp, Artificial
  CRISPR gRNA sequence
aagaaacttaattacacagg

SEQ ID NO: 83601 - DNA, 20 bp, Artificial
  CRISPR gRNA sequence
agaaacttaattacacaggg

SEQ ID NO: 83602 - DNA, 20 bp, Artificial
  CRISPR gRNA sequence
aattacacaggggataaatg

SEQ ID NO: 83603 - DNA, 20 bp, Artificial
  CRISPR gRNA sequence
attacacaggggataaatgg

SEQ ID NO: 83604 - DNA, 20 bp, Artificial
  CRISPR gRNA sequence
cacaggggataaatggcagc

SEQ ID NO: 83605 - DNA, 20 bp, Artificial
  CRISPR gRNA sequence
aagtcaagcctaaccagggc

SEQ ID NO: 83606 - DNA, 20 bp, Artificial
  CRISPR gRNA sequence
accagggcttttgcgggagc

SEQ ID NO: 83607 - DNA, 20 bp, Artificial
  CRISPR gRNA sequence
ttgcgggagcgcatgccttt

SEQ ID NO: 83608 - DNA, 20 bp, Artificial
  CRISPR gRNA sequence
tgcgggagcgcatgcctttt

SEQ ID NO: 83609 - DNA, 20 bp, Artificial
  CRISPR gRNA sequence
gcgggagcgcatgccttttg

SEQ ID NO: 83610 - DNA, 20 bp, Artificial
  CRISPR gRNA sequence
cgggagcgcatgccttttgg

SEQ ID NO: 83611 - DNA, 20 bp, Artificial
  CRISPR gRNA sequence
ttggctgtaattcgtgcatt

SEQ ID NO: 83612 - DNA, 20 bp, Artificial
  CRISPR gRNA sequence
tggctgtaattcgtgcattt

SEQ ID NO: 83613 - DNA, 20 bp, Artificial
  CRISPR gRNA sequence
ggctgtaattcgtgcatttt

SEQ ID NO: 83614 - DNA, 20 bp, Artificial
  CRISPR gRNA sequence
gctgtaattcgtgcattttt

SEQ ID NO: 83615 - DNA, 20 bp, Artificial
  CRISPR gRNA sequence
taattcgtgcattttttttt

SEQ ID NO: 83616 - DNA, 20 bp, Artificial
  CRISPR gRNA sequence
gtgcatttttttttaagaaa

SEQ ID NO: 83617 - DNA, 20 bp, Artificial
  CRISPR gRNA sequence
ttttttaagaaaaacgcctg

SEQ ID NO: 83618 - DNA, 20 bp, Artificial
  CRISPR gRNA sequence
tttttaagaaaaacgcctgc

SEQ ID NO: 83619 - DNA, 20 bp, Artificial
  CRISPR gRNA sequence
ttttaagaaaaacgcctgcc

SEQ ID NO: 83620 - DNA, 20 bp, Artificial
  CRISPR gRNA sequence
tttaagaaaaacgcctgcct

SEQ ID NO: 83621 - DNA, 20 bp, Artificial
  CRISPR gRNA sequence
ttaagaaaaacgcctgcctt

SEQ ID NO: 83622 - DNA, 20 bp, Artificial
  CRISPR gRNA sequence
taagaaaaacgcctgccttc

SEQ ID NO: 83623 - DNA, 20 bp, Artificial
  CRISPR gRNA sequence
aagaaaaacgcctgccttct

SEQ ID NO: 83624 - DNA, 20 bp, Artificial
  CRISPR gRNA sequence
agaaaaacgcctgccttctg

SEQ ID NO: 83625 - DNA, 20 bp, Artificial
  CRISPR gRNA sequence
ccttctgcgtgagattctcc

SEQ ID NO: 83626 - DNA, 20 bp, Artificial
  CRISPR gRNA sequence
ctgcgtgagattctccagag

SEQ ID NO: 83627 - DNA, 20 bp, Artificial
  CRISPR gRNA sequence
tgcgtgagattctccagagc

SEQ ID NO: 83628 - DNA, 20 bp, Artificial
  CRISPR gRNA sequence
cgtgagattctccagagcaa

SEQ ID NO: 83629 - DNA, 20 bp, Artificial
  CRISPR gRNA sequence
tccagagcaaactgggcggc

SEQ ID NO: 83630 - DNA, 20 bp, Artificial
  CRISPR gRNA sequence
cagagcaaactgggcggcat

SEQ ID NO: 83631 - DNA, 20 bp, Artificial
  CRISPR gRNA sequence
ggcggcatgggccctgtggt

SEQ ID NO: 83632 - DNA, 20 bp, Artificial
  CRISPR gRNA sequence
tggtcttttcgtacagaggg

SEQ ID NO: 83633 - DNA, 20 bp, Artificial
  CRISPR gRNA sequence
ttcgtacagagggcttcctc

SEQ ID NO: 83634 - DNA, 20 bp, Artificial
  CRISPR gRNA sequence
tcgtacagagggcttcctct

SEQ ID NO: 83635 - DNA, 20 bp, Artificial
  CRISPR gRNA sequence
cgtacagagggcttcctctt

SEQ ID NO: 83636 - DNA, 20 bp, Artificial
  CRISPR gRNA sequence
gtacagagggcttcctcttt

SEQ ID NO: 83637 - DNA, 20 bp, Artificial
  CRISPR gRNA sequence
cctctttggctctttgcctg

SEQ ID NO: 83638 - DNA, 20 bp, Artificial
  CRISPR gRNA sequence
ctctttggctctttgcctgg

SEQ ID NO: 83639 - DNA, 20 bp, Artificial
  CRISPR gRNA sequence
tttggctctttgcctggttg

SEQ ID NO: 83640 - DNA, 20 bp, Artificial
  CRISPR gRNA sequence
tggctctttgcctggttgtt

SEQ ID NO: 83641 - DNA, 20 bp, Artificial
  CRISPR gRNA sequence
ggctctttgcctggttgttt

SEQ ID NO: 83642 - DNA, 20 bp, Artificial
  CRISPR gRNA sequence
gctctttgcctggttgtttc

SEQ ID NO: 83643 - DNA, 20 bp, Artificial
  CRISPR gRNA sequence
tttgcctggttgtttccaag

SEQ ID NO: 83644 - DNA, 20 bp, Artificial
  CRISPR gRNA sequence
tgcctggttgtttccaagat

SEQ ID NO: 83645 - DNA, 20 bp, Artificial
  CRISPR gRNA sequence
gcctggttgtttccaagatg

SEQ ID NO: 83646 - DNA, 20 bp, Artificial
  CRISPR gRNA sequence
cctggttgtttccaagatgt

SEQ ID NO: 83647 - DNA, 20 bp, Artificial
  CRISPR gRNA sequence
gttgtttccaagatgtactg

SEQ ID NO: 83648 - DNA, 20 bp, Artificial
  CRISPR gRNA sequence
tttccaagatgtactgtgcc

SEQ ID NO: 83649 - DNA, 20 bp, Artificial
  CRISPR gRNA sequence
ccaagatgtactgtgcctct

SEQ ID NO: 83650 - DNA, 20 bp, Artificial
  CRISPR gRNA sequence
caagatgtactgtgcctctt

SEQ ID NO: 83651 - DNA, 20 bp, Artificial
  CRISPR gRNA sequence
tgcctcttactttcggtttt

SEQ ID NO: 83652 - DNA, 20 bp, Artificial
  CRISPR gRNA sequence
ttactttcggttttgaaaac

SEQ ID NO: 83653 - DNA, 20 bp, Artificial
  CRISPR gRNA sequence
actttcggttttgaaaacat

SEQ ID NO: 83654 - DNA, 20 bp, Artificial
  CRISPR gRNA sequence
ctttcggttttgaaaacatg

SEQ ID NO: 83655 - DNA, 20 bp, Artificial
  CRISPR gRNA sequence
tcggttttgaaaacatgagg

SEQ ID NO: 83656 - DNA, 20 bp, Artificial
  CRISPR gRNA sequence
cggttttgaaaacatgaggg

SEQ ID NO: 83657 - DNA, 20 bp, Artificial
  CRISPR gRNA sequence
ggttttgaaaacatgagggg

SEQ ID NO: 83658 - DNA, 20 bp, Artificial
  CRISPR gRNA sequence
tgaaaacatgagggggttgg

SEQ ID NO: 83659 - DNA, 20 bp, Artificial
  CRISPR gRNA sequence
gaaaacatgagggggttggg

SEQ ID NO: 83660 - DNA, 20 bp, Artificial
  CRISPR gRNA sequence
aaaacatgagggggttgggc

SEQ ID NO: 83661 - DNA, 20 bp, Artificial
  CRISPR gRNA sequence
ggcgtggtagcttacgcctg

SEQ ID NO: 83662 - DNA, 20 bp, Artificial
  CRISPR gRNA sequence
acgcctgtaatcccagcact

SEQ ID NO: 83663 - DNA, 20 bp, Artificial
  CRISPR gRNA sequence
cgcctgtaatcccagcactt

SEQ ID NO: 83664 - DNA, 20 bp, Artificial
  CRISPR gRNA sequence
taatcccagcacttagggag

SEQ ID NO: 83665 - DNA, 20 bp, Artificial
  CRISPR gRNA sequence
agggaggccgaggcgggagg

SEQ ID NO: 83666 - DNA, 20 bp, Artificial
  CRISPR gRNA sequence
gggaggccgaggcgggagga

SEQ ID NO: 83667 - DNA, 20 bp, Artificial
  CRISPR gRNA sequence
gaggtccgtagttgagacca

SEQ ID NO: 83668 - DNA, 20 bp, Artificial
  CRISPR gRNA sequence
aggtccgtagttgagaccag

SEQ ID NO: 83669 - DNA, 20 bp, Artificial
  CRISPR gRNA sequence
agaccagcctggccaacatg

SEQ ID NO: 83670 - DNA, 20 bp, Artificial
  CRISPR gRNA sequence
gccaacatggtgaagcctgg

SEQ ID NO: 83671 - DNA, 20 bp, Artificial
  CRISPR gRNA sequence
gtctctacaaaaaataataa

SEQ ID NO: 83672 - DNA, 20 bp, Artificial
  CRISPR gRNA sequence
tacaaaaaataataacaaaa

SEQ ID NO: 83673 - DNA, 20 bp, Artificial
  CRISPR gRNA sequence
caaaaaataataacaaaaat

SEQ ID NO: 83674 - DNA, 20 bp, Artificial
  CRISPR gRNA sequence
gccgggtgtggtggctcgtg

SEQ ID NO: 83675 - DNA, 20 bp, Artificial
  CRISPR gRNA sequence
gtgcctgtggtcccagctgc

SEQ ID NO: 83676 - DNA, 20 bp, Artificial
  CRISPR gRNA sequence
tggtcccagctgctccggtg

SEQ ID NO: 83677 - DNA, 20 bp, Artificial
  CRISPR gRNA sequence
ctccggtggctgaggcggga

SEQ ID NO: 83678 - DNA, 20 bp, Artificial
  CRISPR gRNA sequence
cggtggctgaggcgggagga

SEQ ID NO: 83679 - DNA, 20 bp, Artificial
  CRISPR gRNA sequence
aggcgggaggatctcttgag

SEQ ID NO: 83680 - DNA, 20 bp, Artificial
  CRISPR gRNA sequence
ttgagcttaggcttttgagc

SEQ ID NO: 83681 - DNA, 20 bp, Artificial
  CRISPR gRNA sequence
gagcttaggcttttgagcta

SEQ ID NO: 83682 - DNA, 20 bp, Artificial
  CRISPR gRNA sequence
agcttaggcttttgagctat

SEQ ID NO: 83683 - DNA, 20 bp, Artificial
  CRISPR gRNA sequence
aggcttttgagctatcatgg

SEQ ID NO: 83684 - DNA, 20 bp, Artificial
  CRISPR gRNA sequence
ggcttttgagctatcatggc

SEQ ID NO: 83685 - DNA, 20 bp, Artificial
  CRISPR gRNA sequence
ttgagctatcatggcgccag

SEQ ID NO: 83686 - DNA, 20 bp, Artificial
  CRISPR gRNA sequence
tgagctatcatggcgccagt

SEQ ID NO: 83687 - DNA, 20 bp, Artificial
  CRISPR gRNA sequence
gagctatcatggcgccagtg

SEQ ID NO: 83688 - DNA, 20 bp, Artificial
  CRISPR gRNA sequence
agctatcatggcgccagtgc

SEQ ID NO: 83689 - DNA, 20 bp, Artificial
  CRISPR gRNA sequence
tcatggcgccagtgcactcc

SEQ ID NO: 83690 - DNA, 20 bp, Artificial
  CRISPR gRNA sequence
cagcgtgggcaacagagcga

SEQ ID NO: 83691 - DNA, 20 bp, Artificial
  CRISPR gRNA sequence
tctctcaaaaaagaaaaaaa

SEQ ID NO: 83692 - DNA, 20 bp, Artificial
  CRISPR gRNA sequence
tcaaaaaagaaaaaaaaaaa

SEQ ID NO: 83693 - DNA, 20 bp, Artificial
  CRISPR gRNA sequence
aaaaaagaaaaaaaaaaaaa

SEQ ID NO: 83694 - DNA, 20 bp, Artificial
  CRISPR gRNA sequence
gtcagtcaggggagctgtaa

SEQ ID NO: 83695 - DNA, 20 bp, Artificial
  CRISPR gRNA sequence
tcagtcaggggagctgtaaa

SEQ ID NO: 83696 - DNA, 20 bp, Artificial
  CRISPR gRNA sequence
taaaaccattaataaagata

SEQ ID NO: 83697 - DNA, 20 bp, Artificial
  CRISPR gRNA sequence
ataaagataatccaagatgg

SEQ ID NO: 83698 - DNA, 20 bp, Artificial
  CRISPR gRNA sequence
ccaagactgttgaggacgcc

SEQ ID NO: 83699 - DNA, 20 bp, Artificial
  CRISPR gRNA sequence
ttgaggacgccagagatctt

SEQ ID NO: 83700 - DNA, 20 bp, Artificial
  CRISPR gRNA sequence
aggacgccagagatcttgag

SEQ ID NO: 83701 - DNA, 20 bp, Artificial
  CRISPR gRNA sequence
gagcactttctaagtacctg

SEQ ID NO: 83702 - DNA, 20 bp, Artificial
  CRISPR gRNA sequence
agcactttctaagtacctgg

SEQ ID NO: 83703 - DNA, 20 bp, Artificial
  CRISPR gRNA sequence
tctaagtacctggcaataca

SEQ ID NO: 83704 - DNA, 20 bp, Artificial
  CRISPR gRNA sequence
ctaagtacctggcaatacac

SEQ ID NO: 83705 - DNA, 20 bp, Artificial
  CRISPR gRNA sequence
taagtacctggcaatacact

SEQ ID NO: 83706 - DNA, 20 bp, Artificial
  CRISPR gRNA sequence
agtacctggcaatacactaa

SEQ ID NO: 83707 - DNA, 20 bp, Artificial
  CRISPR gRNA sequence
gcaatacactaagcgcgctc

SEQ ID NO: 83708 - DNA, 20 bp, Artificial
  CRISPR gRNA sequence
agcgcgctcaccttttcctc

SEQ ID NO: 83709 - DNA, 20 bp, Artificial
  CRISPR gRNA sequence
accttttcctctggcaaaac

SEQ ID NO: 83710 - DNA, 20 bp, Artificial
  CRISPR gRNA sequence
ttcctctggcaaaacatgat

SEQ ID NO: 83711 - DNA, 20 bp, Artificial
  CRISPR gRNA sequence
tcctctggcaaaacatgatc

SEQ ID NO: 83712 - DNA, 20 bp, Artificial
  CRISPR gRNA sequence
cctctggcaaaacatgatcg

SEQ ID NO: 83713 - DNA, 20 bp, Artificial
  CRISPR gRNA sequence
ctctggcaaaacatgatcga

SEQ ID NO: 83714 - DNA, 20 bp, Artificial
  CRISPR gRNA sequence
tggcaaaacatgatcgaaag

SEQ ID NO: 83715 - DNA, 20 bp, Artificial
  CRISPR gRNA sequence
gcaaaacatgatcgaaagca

SEQ ID NO: 83716 - DNA, 20 bp, Artificial
  CRISPR gRNA sequence
tgatcatgagaaaattgcat

SEQ ID NO: 83717 - DNA, 20 bp, Artificial
  CRISPR gRNA sequence
gatcatgagaaaattgcatt

SEQ ID NO: 83718 - DNA, 20 bp, Artificial
  CRISPR gRNA sequence
atcatgagaaaattgcattt

SEQ ID NO: 83719 - DNA, 20 bp, Artificial
  CRISPR gRNA sequence
catttaatttgaatacaatt

SEQ ID NO: 83720 - DNA, 20 bp, Artificial
  CRISPR gRNA sequence
aatttgaatacaatttattt

SEQ ID NO: 83721 - DNA, 20 bp, Artificial
  CRISPR gRNA sequence
atttgaatacaatttattta

SEQ ID NO: 83722 - DNA, 20 bp, Artificial
  CRISPR gRNA sequence
gaatacaatttatttacaac

SEQ ID NO: 83723 - DNA, 20 bp, Artificial
  CRISPR gRNA sequence
aatacaatttatttacaaca

SEQ ID NO: 83724 - DNA, 20 bp, Artificial
  CRISPR gRNA sequence
atttacaacataaaggataa

SEQ ID NO: 83725 - DNA, 20 bp, Artificial
  CRISPR gRNA sequence
tttacaacataaaggataat

SEQ ID NO: 83726 - DNA, 20 bp, Artificial
  CRISPR gRNA sequence
acaacataaaggataatgta

SEQ ID NO: 83727 - DNA, 20 bp, Artificial
  CRISPR gRNA sequence
caacataaaggataatgtat

SEQ ID NO: 83728 - DNA, 20 bp, Artificial
  CRISPR gRNA sequence
ctggtatttgctggttatgt

SEQ ID NO: 83729 - DNA, 20 bp, Artificial
  CRISPR gRNA sequence
gtatttgctggttatgttag

SEQ ID NO: 83730 - DNA, 20 bp, Artificial
  CRISPR gRNA sequence
gctggttatgttagatgtca

SEQ ID NO: 83731 - DNA, 20 bp, Artificial
  CRISPR gRNA sequence
ctggttatgttagatgtcat

SEQ ID NO: 83732 - DNA, 20 bp, Artificial
  CRISPR gRNA sequence
gttatgttagatgtcatttt

SEQ ID NO: 83733 - DNA, 20 bp, Artificial
  CRISPR gRNA sequence
tgttagatgtcattttaaaa

SEQ ID NO: 83734 - DNA, 20 bp, Artificial
  CRISPR gRNA sequence
gatgtcattttaaaaaataa

SEQ ID NO: 83735 - DNA, 20 bp, Artificial
  CRISPR gRNA sequence
taaaaaataacaatctgata

SEQ ID NO: 83736 - DNA, 20 bp, Artificial
  CRISPR gRNA sequence
aaaaaataacaatctgatat

SEQ ID NO: 83737 - DNA, 20 bp, Artificial
  CRISPR gRNA sequence
aaaaataacaatctgatatt

SEQ ID NO: 83738 - DNA, 20 bp, Artificial
  CRISPR gRNA sequence
atatttaaaaaaaaatctta

SEQ ID NO: 83739 - DNA, 20 bp, Artificial
  CRISPR gRNA sequence
aaaaaaaaatcttattttga

SEQ ID NO: 83740 - DNA, 20 bp, Artificial
  CRISPR gRNA sequence
aaaaaaaatcttattttgaa

SEQ ID NO: 83741 - DNA, 20 bp, Artificial
  CRISPR gRNA sequence
attttgaaaatttccaaagt

SEQ ID NO: 83742 - DNA, 20 bp, Artificial
  CRISPR gRNA sequence
ttttgaaaatttccaaagta

SEQ ID NO: 83743 - DNA, 20 bp, Artificial
  CRISPR gRNA sequence
tgaaaatttccaaagtaata

SEQ ID NO: 83744 - DNA, 20 bp, Artificial
  CRISPR gRNA sequence
gaaaatttccaaagtaatac

SEQ ID NO: 83745 - DNA, 20 bp, Artificial
  CRISPR gRNA sequence
aaaatttccaaagtaataca

SEQ ID NO: 83746 - DNA, 20 bp, Artificial
  CRISPR gRNA sequence
ccaaagtaatacatgccatg

SEQ ID NO: 83747 - DNA, 20 bp, Artificial
  CRISPR gRNA sequence
caaagtaatacatgccatgc

SEQ ID NO: 83748 - DNA, 20 bp, Artificial
  CRISPR gRNA sequence
ctggaagataccacaagaaa

SEQ ID NO: 83749 - DNA, 20 bp, Artificial
  CRISPR gRNA sequence
tggaagataccacaagaaac

SEQ ID NO: 83750 - DNA, 20 bp, Artificial
  CRISPR gRNA sequence
gaagataccacaagaaacat

SEQ ID NO: 83751 - DNA, 20 bp, Artificial
  CRISPR gRNA sequence
cctctgaaggtctattttcc

SEQ ID NO: 83752 - DNA, 20 bp, Artificial
  CRISPR gRNA sequence
tgaaggtctattttcctcct

SEQ ID NO: 83753 - DNA, 20 bp, Artificial
  CRISPR gRNA sequence
aaggtctattttcctcctct

SEQ ID NO: 83754 - DNA, 20 bp, Artificial
  CRISPR gRNA sequence
ttttcctcctctgacctgtg

SEQ ID NO: 83755 - DNA, 20 bp, Artificial
  CRISPR gRNA sequence
tcctcctctgacctgtgtgt

SEQ ID NO: 83756 - DNA, 20 bp, Artificial
  CRISPR gRNA sequence
cctcctctgacctgtgtgtg

SEQ ID NO: 83757 - DNA, 20 bp, Artificial
  CRISPR gRNA sequence
ctcctctgacctgtgtgtgg

SEQ ID NO: 83758 - DNA, 20 bp, Artificial
  CRISPR gRNA sequence
ctctgacctgtgtgtgggtt

SEQ ID NO: 83759 - DNA, 20 bp, Artificial
  CRISPR gRNA sequence
tgacctgtgtgtgggttttg

SEQ ID NO: 83760 - DNA, 20 bp, Artificial
  CRISPR gRNA sequence
acctgtgtgtgggttttgtt

SEQ ID NO: 83761 - DNA, 20 bp, Artificial
  CRISPR gRNA sequence
tgtgtgggttttgtttttgt

SEQ ID NO: 83762 - DNA, 20 bp, Artificial
  CRISPR gRNA sequence
tgtttttgttttactgtggg

SEQ ID NO: 83763 - DNA, 20 bp, Artificial
  CRISPR gRNA sequence
gtttttgttttactgtgggc

SEQ ID NO: 83764 - DNA, 20 bp, Artificial
  CRISPR gRNA sequence
tttttgttttactgtgggca

SEQ ID NO: 83765 - DNA, 20 bp, Artificial
  CRISPR gRNA sequence
ttgttttactgtgggcataa

SEQ ID NO: 83766 - DNA, 20 bp, Artificial
  CRISPR gRNA sequence
tgttttactgtgggcataaa

SEQ ID NO: 83767 - DNA, 20 bp, Artificial
  CRISPR gRNA sequence
gttttactgtgggcataaat

SEQ ID NO: 83768 - DNA, 20 bp, Artificial
  CRISPR gRNA sequence
ttttactgtgggcataaatt

SEQ ID NO: 83769 - DNA, 20 bp, Artificial
  CRISPR gRNA sequence
tactgtgggcataaattaat

SEQ ID NO: 83770 - DNA, 20 bp, Artificial
  CRISPR gRNA sequence
actgtgggcataaattaatt

SEQ ID NO: 83771 - DNA, 20 bp, Artificial
  CRISPR gRNA sequence
ctgtgggcataaattaattt

SEQ ID NO: 83772 - DNA, 20 bp, Artificial
  CRISPR gRNA sequence
tgggcataaattaatttttc

SEQ ID NO: 83773 - DNA, 20 bp, Artificial
  CRISPR gRNA sequence
atttttcagttaagttttgg

SEQ ID NO: 83774 - DNA, 20 bp, Artificial
  CRISPR gRNA sequence
ttcagttaagttttggaagc

SEQ ID NO: 83775 - DNA, 20 bp, Artificial
  CRISPR gRNA sequence
tcagttaagttttggaagct

SEQ ID NO: 83776 - DNA, 20 bp, Artificial
  CRISPR gRNA sequence
cagttaagttttggaagctt

SEQ ID NO: 83777 - DNA, 20 bp, Artificial
  CRISPR gRNA sequence
agttaagttttggaagctta

SEQ ID NO: 83778 - DNA, 20 bp, Artificial
  CRISPR gRNA sequence
agttttggaagcttaaataa

SEQ ID NO: 83779 - DNA, 20 bp, Artificial
  CRISPR gRNA sequence
tggaagcttaaataactctc

SEQ ID NO: 83780 - DNA, 20 bp, Artificial
  CRISPR gRNA sequence
ggaagcttaaataactctcc

SEQ ID NO: 83781 - DNA, 20 bp, Artificial
  CRISPR gRNA sequence
gaagcttaaataactctcca

SEQ ID NO: 83782 - DNA, 20 bp, Artificial
  CRISPR gRNA sequence
aaataactctccaaaagtca

SEQ ID NO: 83783 - DNA, 20 bp, Artificial
  CRISPR gRNA sequence
aataactctccaaaagtcat

SEQ ID NO: 83784 - DNA, 20 bp, Artificial
  CRISPR gRNA sequence
tccaaaagtcataaagccag

SEQ ID NO: 83785 - DNA, 20 bp, Artificial
  CRISPR gRNA sequence
caaaagtcataaagccagta

SEQ ID NO: 83786 - DNA, 20 bp, Artificial
  CRISPR gRNA sequence
gttgagcccaaattcaaacc

SEQ ID NO: 83787 - DNA, 20 bp, Artificial
  CRISPR gRNA sequence
agcccaaattcaaacccagc

SEQ ID NO: 83788 - DNA, 20 bp, Artificial
  CRISPR gRNA sequence
aaacccagcctgtctgatac

SEQ ID NO: 83789 - DNA, 20 bp, Artificial
  CRISPR gRNA sequence
tctgatacttgtcctcttct

SEQ ID NO: 83790 - DNA, 20 bp, Artificial
  CRISPR gRNA sequence
atacttgtcctcttcttaga

SEQ ID NO: 83791 - DNA, 20 bp, Artificial
  CRISPR gRNA sequence
gtcctcttcttagaaaagat

SEQ ID NO: 83792 - DNA, 20 bp, Artificial
  CRISPR gRNA sequence
tcctcttcttagaaaagatt

SEQ ID NO: 83793 - DNA, 20 bp, Artificial
  CRISPR gRNA sequence
ttcttagaaaagattacagt

SEQ ID NO: 83794 - DNA, 20 bp, Artificial
  CRISPR gRNA sequence
cttagaaaagattacagtga

SEQ ID NO: 83795 - DNA, 20 bp, Artificial
  CRISPR gRNA sequence
ttagaaaagattacagtgat

SEQ ID NO: 83796 - DNA, 20 bp, Artificial
  CRISPR gRNA sequence
agaaaagattacagtgatgc

SEQ ID NO: 83797 - DNA, 20 bp, Artificial
  CRISPR gRNA sequence
gaaaagattacagtgatgct

SEQ ID NO: 83798 - DNA, 20 bp, Artificial
  CRISPR gRNA sequence
cagtgatgctctcacaaaat

SEQ ID NO: 83799 - DNA, 20 bp, Artificial
  CRISPR gRNA sequence
tcacaaaatcttgccgcctt

SEQ ID NO: 83800 - DNA, 20 bp, Artificial
  CRISPR gRNA sequence
acaaaatcttgccgccttcc

SEQ ID NO: 83801 - DNA, 20 bp, Artificial
  CRISPR gRNA sequence
gccgccttccctcaaacaga

SEQ ID NO: 83802 - DNA, 20 bp, Artificial
  CRISPR gRNA sequence
ccgccttccctcaaacagag

SEQ ID NO: 83803 - DNA, 20 bp, Artificial
  CRISPR gRNA sequence
ccctcaaacagagagttcca

SEQ ID NO: 83804 - DNA, 20 bp, Artificial
  CRISPR gRNA sequence
cctcaaacagagagttccag

SEQ ID NO: 83805 - DNA, 20 bp, Artificial
  CRISPR gRNA sequence
aaacagagagttccaggcag

SEQ ID NO: 83806 - DNA, 20 bp, Artificial
  CRISPR gRNA sequence
caggcaggatgaatctgtgc

SEQ ID NO: 83807 - DNA, 20 bp, Artificial
  CRISPR gRNA sequence
tgctctgatccctgaggcat

SEQ ID NO: 83808 - DNA, 20 bp, Artificial
  CRISPR gRNA sequence
tgatccctgaggcatttaat

SEQ ID NO: 83809 - DNA, 20 bp, Artificial
  CRISPR gRNA sequence
atccctgaggcatttaatat

SEQ ID NO: 83810 - DNA, 20 bp, Artificial
  CRISPR gRNA sequence
aggcatttaatatgttctta

SEQ ID NO: 83811 - DNA, 20 bp, Artificial
  CRISPR gRNA sequence
aatatgttcttattattaga

SEQ ID NO: 83812 - DNA, 20 bp, Artificial
  CRISPR gRNA sequence
atatgttcttattattagaa

SEQ ID NO: 83813 - DNA, 20 bp, Artificial
  CRISPR gRNA sequence
ttattattagaagctcagat

SEQ ID NO: 83814 - DNA, 20 bp, Artificial
  CRISPR gRNA sequence
attattagaagctcagatgc

SEQ ID NO: 83815 - DNA, 20 bp, Artificial
  CRISPR gRNA sequence
ttattagaagctcagatgca

SEQ ID NO: 83816 - DNA, 20 bp, Artificial
  CRISPR gRNA sequence
ttagaagctcagatgcaaag

SEQ ID NO: 83817 - DNA, 20 bp, Artificial
  CRISPR gRNA sequence
gaagctcagatgcaaagagc

SEQ ID NO: 83818 - DNA, 20 bp, Artificial
  CRISPR gRNA sequence
agatgcaaagagctctctta

SEQ ID NO: 83819 - DNA, 20 bp, Artificial
  CRISPR gRNA sequence
tcttagcttttaatgttatg

SEQ ID NO: 83820 - DNA, 20 bp, Artificial
  CRISPR gRNA sequence
ttagcttttaatgttatgaa

SEQ ID NO: 83821 - DNA, 20 bp, Artificial
  CRISPR gRNA sequence
agcttttaatgttatgaaaa

SEQ ID NO: 83822 - DNA, 20 bp, Artificial
  CRISPR gRNA sequence
gcttttaatgttatgaaaaa

SEQ ID NO: 83823 - DNA, 20 bp, Artificial
  CRISPR gRNA sequence
ttaatgttatgaaaaaaatc

SEQ ID NO: 83824 - DNA, 20 bp, Artificial
  CRISPR gRNA sequence
taatgttatgaaaaaaatca

SEQ ID NO: 83825 - DNA, 20 bp, Artificial
  CRISPR gRNA sequence
aatgttatgaaaaaaatcag

SEQ ID NO: 83826 - DNA, 20 bp, Artificial
  CRISPR gRNA sequence
atgttatgaaaaaaatcagg

SEQ ID NO: 83827 - DNA, 20 bp, Artificial
  CRISPR gRNA sequence
tgaaaaaaatcaggtcttca

SEQ ID NO: 83828 - DNA, 20 bp, Artificial
  CRISPR gRNA sequence
cattagattccccaatccac

SEQ ID NO: 83829 - DNA, 20 bp, Artificial
  CRISPR gRNA sequence
attagattccccaatccacc

SEQ ID NO: 83830 - DNA, 20 bp, Artificial
  CRISPR gRNA sequence
gattccccaatccacctctt

SEQ ID NO: 83831 - DNA, 20 bp, Artificial
  CRISPR gRNA sequence
cccaatccacctcttgatgg

SEQ ID NO: 83832 - DNA, 20 bp, Artificial
  CRISPR gRNA sequence
ttgatggggctagtagcctt

SEQ ID NO: 83833 - DNA, 20 bp, Artificial
  CRISPR gRNA sequence
gatggggctagtagcctttc

SEQ ID NO: 83834 - DNA, 20 bp, Artificial
  CRISPR gRNA sequence
atggggctagtagcctttcc

SEQ ID NO: 83835 - DNA, 20 bp, Artificial
  CRISPR gRNA sequence
gtagcctttccttaatgata

SEQ ID NO: 83836 - DNA, 20 bp, Artificial
  CRISPR gRNA sequence
tccttaatgatagggtgttt

SEQ ID NO: 83837 - DNA, 20 bp, Artificial
  CRISPR gRNA sequence
ccttaatgatagggtgtttc

SEQ ID NO: 83838 - DNA, 20 bp, Artificial
  CRISPR gRNA sequence
cttaatgatagggtgtttct

SEQ ID NO: 83839 - DNA, 20 bp, Artificial
  CRISPR gRNA sequence
aatgatagggtgtttctaga

SEQ ID NO: 83840 - DNA, 20 bp, Artificial
  CRISPR gRNA sequence
atgatagggtgtttctagag

SEQ ID NO: 83841 - DNA, 20 bp, Artificial
  CRISPR gRNA sequence
ctagagagatatatctggtc

SEQ ID NO: 83842 - DNA, 20 bp, Artificial
  CRISPR gRNA sequence
tagagagatatatctggtca

SEQ ID NO: 83843 - DNA, 20 bp, Artificial
  CRISPR gRNA sequence
gagagatatatctggtcaag

SEQ ID NO: 83844 - DNA, 20 bp, Artificial
  CRISPR gRNA sequence
gtcaaggtggcctggtactc

SEQ ID NO: 83845 - DNA, 20 bp, Artificial
  CRISPR gRNA sequence
gtactcctccttctccccac

SEQ ID NO: 83846 - DNA, 20 bp, Artificial
  CRISPR gRNA sequence
ctccttctccccacagcctc

SEQ ID NO: 83847 - DNA, 20 bp, Artificial
  CRISPR gRNA sequence
cttctccccacagcctccca

SEQ ID NO: 83848 - DNA, 20 bp, Artificial
  CRISPR gRNA sequence
ctccccacagcctcccagac

SEQ ID NO: 83849 - DNA, 20 bp, Artificial
  CRISPR gRNA sequence
tccccacagcctcccagaca

SEQ ID NO: 83850 - DNA, 20 bp, Artificial
  CRISPR gRNA sequence
cccacagcctcccagacaag

SEQ ID NO: 83851 - DNA, 20 bp, Artificial
  CRISPR gRNA sequence
ccagacaaggaggagtagct

SEQ ID NO: 83852 - DNA, 20 bp, Artificial
  CRISPR gRNA sequence
ccttttagtgatcatgtacc

SEQ ID NO: 83853 - DNA, 20 bp, Artificial
  CRISPR gRNA sequence
ttagtgatcatgtaccctga

SEQ ID NO: 83854 - DNA, 20 bp, Artificial
  CRISPR gRNA sequence
tagtgatcatgtaccctgaa

SEQ ID NO: 83855 - DNA, 20 bp, Artificial
  CRISPR gRNA sequence
agtgatcatgtaccctgaat

SEQ ID NO: 83856 - DNA, 20 bp, Artificial
  CRISPR gRNA sequence
gtgatcatgtaccctgaata

SEQ ID NO: 83857 - DNA, 20 bp, Artificial
  CRISPR gRNA sequence
aatataagtgtatttaaaag

SEQ ID NO: 83858 - DNA, 20 bp, Artificial
  CRISPR gRNA sequence
aaaagaattttatacacata

SEQ ID NO: 83859 - DNA, 20 bp, Artificial
  CRISPR gRNA sequence
aaagaattttatacacatat

SEQ ID NO: 83860 - DNA, 20 bp, Artificial
  CRISPR gRNA sequence
tatacacatatatttagtgt

SEQ ID NO: 83861 - DNA, 20 bp, Artificial
  CRISPR gRNA sequence
atacacatatatttagtgtc

SEQ ID NO: 83862 - DNA, 20 bp, Artificial
  CRISPR gRNA sequence
tacacatatatttagtgtca

SEQ ID NO: 83863 - DNA, 20 bp, Artificial
  CRISPR gRNA sequence
agtgtcaatctgtatattta

SEQ ID NO: 83864 - DNA, 20 bp, Artificial
  CRISPR gRNA sequence
gtgtcaatctgtatatttag

SEQ ID NO: 83865 - DNA, 20 bp, Artificial
  CRISPR gRNA sequence
tatatttagtagcactaaca

SEQ ID NO: 83866 - DNA, 20 bp, Artificial
  CRISPR gRNA sequence
agtagcactaacacttctct

SEQ ID NO: 83867 - DNA, 20 bp, Artificial
  CRISPR gRNA sequence
gtagcactaacacttctctt

SEQ ID NO: 83868 - DNA, 20 bp, Artificial
  CRISPR gRNA sequence
acacttctcttcattttcaa

SEQ ID NO: 83869 - DNA, 20 bp, Artificial
  CRISPR gRNA sequence
ctcttcattttcaatgaaaa

SEQ ID NO: 83870 - DNA, 20 bp, Artificial
  CRISPR gRNA sequence
tcttcattttcaatgaaaaa

SEQ ID NO: 83871 - DNA, 20 bp, Artificial
  CRISPR gRNA sequence
ttcattttcaatgaaaaata

SEQ ID NO: 83872 - DNA, 20 bp, Artificial
  CRISPR gRNA sequence
cattttcaatgaaaaatata

SEQ ID NO: 83873 - DNA, 20 bp, Artificial
  CRISPR gRNA sequence
attttcaatgaaaaatatag

SEQ ID NO: 83874 - DNA, 20 bp, Artificial
  CRISPR gRNA sequence
tcaatgaaaaatatagagtt

SEQ ID NO: 83875 - DNA, 20 bp, Artificial
  CRISPR gRNA sequence
caatgaaaaatatagagttt

SEQ ID NO: 83876 - DNA, 20 bp, Artificial
  CRISPR gRNA sequence
aatgaaaaatatagagttta

SEQ ID NO: 83877 - DNA, 20 bp, Artificial
  CRISPR gRNA sequence
ataatattttcttcccactt

SEQ ID NO: 83878 - DNA, 20 bp, Artificial
  CRISPR gRNA sequence
taatattttcttcccacttc

SEQ ID NO: 83879 - DNA, 20 bp, Artificial
  CRISPR gRNA sequence
tcttcccacttccccatgga

SEQ ID NO: 83880 - DNA, 20 bp, Artificial
  CRISPR gRNA sequence
cttcccacttccccatggat

SEQ ID NO: 83881 - DNA, 20 bp, Artificial
  CRISPR gRNA sequence
ttcccacttccccatggatg

SEQ ID NO: 83882 - DNA, 20 bp, Artificial
  CRISPR gRNA sequence
cccacttccccatggatggt

SEQ ID NO: 83883 - DNA, 20 bp, Artificial
  CRISPR gRNA sequence
ccacttccccatggatggtc

SEQ ID NO: 83884 - DNA, 20 bp, Artificial
  CRISPR gRNA sequence
ccccatggatggtctagtca

SEQ ID NO: 83885 - DNA, 20 bp, Artificial
  CRISPR gRNA sequence
cccatggatggtctagtcat

SEQ ID NO: 83886 - DNA, 20 bp, Artificial
  CRISPR gRNA sequence
gtcatgcctctcattttgga

SEQ ID NO: 83887 - DNA, 20 bp, Artificial
  CRISPR gRNA sequence
tcattttggaaagtactgtt

SEQ ID NO: 83888 - DNA, 20 bp, Artificial
  CRISPR gRNA sequence
attttggaaagtactgtttc

SEQ ID NO: 83889 - DNA, 20 bp, Artificial
  CRISPR gRNA sequence
tggaaagtactgtttctgaa

SEQ ID NO: 83890 - DNA, 20 bp, Artificial
  CRISPR gRNA sequence
ggaaagtactgtttctgaaa

SEQ ID NO: 83891 - DNA, 20 bp, Artificial
  CRISPR gRNA sequence
gaaagtactgtttctgaaac

SEQ ID NO: 83892 - DNA, 20 bp, Artificial
  CRISPR gRNA sequence
tttctgaaacattaggcaat

SEQ ID NO: 83893 - DNA, 20 bp, Artificial
  CRISPR gRNA sequence
ctgaaacattaggcaatata

SEQ ID NO: 83894 - DNA, 20 bp, Artificial
  CRISPR gRNA sequence
tgaaacattaggcaatatat

SEQ ID NO: 83895 - DNA, 20 bp, Artificial
  CRISPR gRNA sequence
aaacattaggcaatatattc

SEQ ID NO: 83896 - DNA, 20 bp, Artificial
  CRISPR gRNA sequence
ggcaatatattcccaacctg

SEQ ID NO: 83897 - DNA, 20 bp, Artificial
  CRISPR gRNA sequence
ccaacctggctagtttacag

SEQ ID NO: 83898 - DNA, 20 bp, Artificial
  CRISPR gRNA sequence
gctagtttacagcaatcacc

SEQ ID NO: 83899 - DNA, 20 bp, Artificial
  CRISPR gRNA sequence
gtttacagcaatcacctgtg

SEQ ID NO: 83900 - DNA, 20 bp, Artificial
  CRISPR gRNA sequence
acagcaatcacctgtggatg

SEQ ID NO: 83901 - DNA, 20 bp, Artificial
  CRISPR gRNA sequence
cagcaatcacctgtggatgc

SEQ ID NO: 83902 - DNA, 20 bp, Artificial
  CRISPR gRNA sequence
tggatgctaattaaaacgca

SEQ ID NO: 83903 - DNA, 20 bp, Artificial
  CRISPR gRNA sequence
attaaaacgcaaatcccact

SEQ ID NO: 83904 - DNA, 20 bp, Artificial
  CRISPR gRNA sequence
aaacgcaaatcccactgtca

SEQ ID NO: 83905 - DNA, 20 bp, Artificial
  CRISPR gRNA sequence
tcacatgcattactccattt

SEQ ID NO: 83906 - DNA, 20 bp, Artificial
  CRISPR gRNA sequence
ctccatttgatcataatgga

SEQ ID NO: 83907 - DNA, 20 bp, Artificial
  CRISPR gRNA sequence
catttgatcataatggaaag

SEQ ID NO: 83908 - DNA, 20 bp, Artificial
  CRISPR gRNA sequence
gatcataatggaaagtatgt

SEQ ID NO: 83909 - DNA, 20 bp, Artificial
  CRISPR gRNA sequence
atcataatggaaagtatgtt

SEQ ID NO: 83910 - DNA, 20 bp, Artificial
  CRISPR gRNA sequence
tgtcccatttgccatagtcc

SEQ ID NO: 83911 - DNA, 20 bp, Artificial
  CRISPR gRNA sequence
tcccatttgccatagtcctc

SEQ ID NO: 83912 - DNA, 20 bp, Artificial
  CRISPR gRNA sequence
gccatagtcctcacctatcc

SEQ ID NO: 83913 - DNA, 20 bp, Artificial
  CRISPR gRNA sequence
ccatagtcctcacctatccc

SEQ ID NO: 83914 - DNA, 20 bp, Artificial
  CRISPR gRNA sequence
acctatccctgttgtatttt

SEQ ID NO: 83915 - DNA, 20 bp, Artificial
  CRISPR gRNA sequence
tccctgttgtattttatcgg

SEQ ID NO: 83916 - DNA, 20 bp, Artificial
  CRISPR gRNA sequence
ttgtattttatcgggtccaa

SEQ ID NO: 83917 - DNA, 20 bp, Artificial
  CRISPR gRNA sequence
tattttatcgggtccaactc

SEQ ID NO: 83918 - DNA, 20 bp, Artificial
  CRISPR gRNA sequence
tatcgggtccaactcaacca

SEQ ID NO: 83919 - DNA, 20 bp, Artificial
  CRISPR gRNA sequence
atcgggtccaactcaaccat

SEQ ID NO: 83920 - DNA, 20 bp, Artificial
  CRISPR gRNA sequence
tcgggtccaactcaaccatt

SEQ ID NO: 83921 - DNA, 20 bp, Artificial
  CRISPR gRNA sequence
aaccatttaaggtatttgcc

SEQ ID NO: 83922 - DNA, 20 bp, Artificial
  CRISPR gRNA sequence
aaggtatttgccagctcttg

SEQ ID NO: 83923 - DNA, 20 bp, Artificial
  CRISPR gRNA sequence
aggtatttgccagctcttgt

SEQ ID NO: 83924 - DNA, 20 bp, Artificial
  CRISPR gRNA sequence
gccagctcttgtatgcattt

SEQ ID NO: 83925 - DNA, 20 bp, Artificial
  CRISPR gRNA sequence
ccagctcttgtatgcattta

SEQ ID NO: 83926 - DNA, 20 bp, Artificial
  CRISPR gRNA sequence
ttgtatgcatttaggttttg

SEQ ID NO: 83927 - DNA, 20 bp, Artificial
  CRISPR gRNA sequence
gtatgcatttaggttttgtt

SEQ ID NO: 83928 - DNA, 20 bp, Artificial
  CRISPR gRNA sequence
tatgcatttaggttttgttt

SEQ ID NO: 83929 - DNA, 20 bp, Artificial
  CRISPR gRNA sequence
aggttttgtttctttgtttt

SEQ ID NO: 83930 - DNA, 20 bp, Artificial
  CRISPR gRNA sequence
ggttttgtttctttgttttt

SEQ ID NO: 83931 - DNA, 20 bp, Artificial
  CRISPR gRNA sequence
tgtttctttgttttttagct

SEQ ID NO: 83932 - DNA, 20 bp, Artificial
  CRISPR gRNA sequence
gtttctttgttttttagctc

SEQ ID NO: 83933 - DNA, 20 bp, Artificial
  CRISPR gRNA sequence
tttctttgttttttagctca

SEQ ID NO: 83934 - DNA, 20 bp, Artificial
  CRISPR gRNA sequence
ctttgttttttagctcatga

SEQ ID NO: 83935 - DNA, 20 bp, Artificial
  CRISPR gRNA sequence
tttgttttttagctcatgaa

SEQ ID NO: 83936 - DNA, 20 bp, Artificial
  CRISPR gRNA sequence
tgttttttagctcatgaaat

SEQ ID NO: 83937 - DNA, 20 bp, Artificial
  CRISPR gRNA sequence
gttttttagctcatgaaatt

SEQ ID NO: 83938 - DNA, 20 bp, Artificial
  CRISPR gRNA sequence
ttttttagctcatgaaatta

SEQ ID NO: 83939 - DNA, 20 bp, Artificial
  CRISPR gRNA sequence
tttagctcatgaaattaggt

SEQ ID NO: 83940 - DNA, 20 bp, Artificial
  CRISPR gRNA sequence
ttagctcatgaaattaggta

SEQ ID NO: 83941 - DNA, 20 bp, Artificial
  CRISPR gRNA sequence
tagctcatgaaattaggtac

SEQ ID NO: 83942 - DNA, 20 bp, Artificial
  CRISPR gRNA sequence
agctcatgaaattaggtaca

SEQ ID NO: 83943 - DNA, 20 bp, Artificial
  CRISPR gRNA sequence
gctcatgaaattaggtacaa

SEQ ID NO: 83944 - DNA, 20 bp, Artificial
  CRISPR gRNA sequence
atgaaattaggtacaaagtc

SEQ ID NO: 83945 - DNA, 20 bp, Artificial
  CRISPR gRNA sequence
ggtacaaagtcagagagggg

SEQ ID NO: 83946 - DNA, 20 bp, Artificial
  CRISPR gRNA sequence
gcatataaaacctcagcaga

SEQ ID NO: 83947 - DNA, 20 bp, Artificial
  CRISPR gRNA sequence
agcagaaataaagaggtttt

SEQ ID NO: 83948 - DNA, 20 bp, Artificial
  CRISPR gRNA sequence
tgttgtttggtaagaacata

SEQ ID NO: 83949 - DNA, 20 bp, Artificial
  CRISPR gRNA sequence
gttgtttggtaagaacatac

SEQ ID NO: 83950 - DNA, 20 bp, Artificial
  CRISPR gRNA sequence
ttgtttggtaagaacatacc

SEQ ID NO: 83951 - DNA, 20 bp, Artificial
  CRISPR gRNA sequence
tttggtaagaacataccttg

SEQ ID NO: 83952 - DNA, 20 bp, Artificial
  CRISPR gRNA sequence
ggtaagaacataccttgggt

SEQ ID NO: 83953 - DNA, 20 bp, Artificial
  CRISPR gRNA sequence
gtaagaacataccttgggtt

SEQ ID NO: 83954 - DNA, 20 bp, Artificial
  CRISPR gRNA sequence
gggttggttgggcacggtgg

SEQ ID NO: 83955 - DNA, 20 bp, Artificial
  CRISPR gRNA sequence
ggttggttgggcacggtggc

SEQ ID NO: 83956 - DNA, 20 bp, Artificial
  CRISPR gRNA sequence
gttgggcacggtggctcgtg

SEQ ID NO: 83957 - DNA, 20 bp, Artificial
  CRISPR gRNA sequence
ggcacggtggctcgtgcctg

SEQ ID NO: 83958 - DNA, 20 bp, Artificial
  CRISPR gRNA sequence
gtgcctgtaatcccaacact

SEQ ID NO: 83959 - DNA, 20 bp, Artificial
  CRISPR gRNA sequence
taatcccaacactttgggag

SEQ ID NO: 83960 - DNA, 20 bp, Artificial
  CRISPR gRNA sequence
tgggaggccaaggcaggctg

SEQ ID NO: 83961 - DNA, 20 bp, Artificial
  CRISPR gRNA sequence
gggaggccaaggcaggctga

SEQ ID NO: 83962 - DNA, 20 bp, Artificial
  CRISPR gRNA sequence
ggaggccaaggcaggctgat

SEQ ID NO: 83963 - DNA, 20 bp, Artificial
  CRISPR gRNA sequence
atcacttgaagttgggagtt

SEQ ID NO: 83964 - DNA, 20 bp, Artificial
  CRISPR gRNA sequence
gaagttgggagttcaagacc

SEQ ID NO: 83965 - DNA, 20 bp, Artificial
  CRISPR gRNA sequence
aagttgggagttcaagacca

SEQ ID NO: 83966 - DNA, 20 bp, Artificial
  CRISPR gRNA sequence
ggagttcaagaccagcctgg

SEQ ID NO: 83967 - DNA, 20 bp, Artificial
  CRISPR gRNA sequence
aagaccagcctggccaacat

SEQ ID NO: 83968 - DNA, 20 bp, Artificial
  CRISPR gRNA sequence
gccaacatggtgaaatcccg

SEQ ID NO: 83969 - DNA, 20 bp, Artificial
  CRISPR gRNA sequence
tactgaaaatacaaaaatta

SEQ ID NO: 83970 - DNA, 20 bp, Artificial
  CRISPR gRNA sequence
ctgaaaatacaaaaattaac

SEQ ID NO: 83971 - DNA, 20 bp, Artificial
  CRISPR gRNA sequence
aaaatacaaaaattaaccag

SEQ ID NO: 83972 - DNA, 20 bp, Artificial
  CRISPR gRNA sequence
accaggcatggtggtgtgtg

SEQ ID NO: 83973 - DNA, 20 bp, Artificial
  CRISPR gRNA sequence
tagtcccaggaatcacttga

SEQ ID NO: 83974 - DNA, 20 bp, Artificial
  CRISPR gRNA sequence
gaacccaggaggcggaggtt

SEQ ID NO: 83975 - DNA, 20 bp, Artificial
  CRISPR gRNA sequence
aacccaggaggcggaggttg

SEQ ID NO: 83976 - DNA, 20 bp, Artificial
  CRISPR gRNA sequence
cagtgagctgagatctcacc

SEQ ID NO: 83977 - DNA, 20 bp, Artificial
  CRISPR gRNA sequence
agatctcaccactgcacact

SEQ ID NO: 83978 - DNA, 20 bp, Artificial
  CRISPR gRNA sequence
accactgcacactgcactcc

SEQ ID NO: 83979 - DNA, 20 bp, Artificial
  CRISPR gRNA sequence
cacactgcactccagcctgg

SEQ ID NO: 83980 - DNA, 20 bp, Artificial
  CRISPR gRNA sequence
cactccagcctgggcaatgg

SEQ ID NO: 83981 - DNA, 20 bp, Artificial
  CRISPR gRNA sequence
cagcctgggcaatggaatga

SEQ ID NO: 83982 - DNA, 20 bp, Artificial
  CRISPR gRNA sequence
ggcaatggaatgagattcca

SEQ ID NO: 83983 - DNA, 20 bp, Artificial
  CRISPR gRNA sequence
catcccaaaaaataaaaaaa

SEQ ID NO: 83984 - DNA, 20 bp, Artificial
  CRISPR gRNA sequence
gggttgatccacttaggaac

SEQ ID NO: 83985 - DNA, 20 bp, Artificial
  CRISPR gRNA sequence
ggttgatccacttaggaacc

SEQ ID NO: 83986 - DNA, 20 bp, Artificial
  CRISPR gRNA sequence
atccacttaggaacctcaga

SEQ ID NO: 83987 - DNA, 20 bp, Artificial
  CRISPR gRNA sequence
aggaacctcagataataaca

SEQ ID NO: 83988 - DNA, 20 bp, Artificial
  CRISPR gRNA sequence
ggaacctcagataataacat

SEQ ID NO: 83989 - DNA, 20 bp, Artificial
  CRISPR gRNA sequence
agataataacatctgccacg

SEQ ID NO: 83990 - DNA, 20 bp, Artificial
  CRISPR gRNA sequence
ccacgtatagagcaattgct

SEQ ID NO: 83991 - DNA, 20 bp, Artificial
  CRISPR gRNA sequence
ctatgtcccaggcactctac

SEQ ID NO: 83992 - DNA, 20 bp, Artificial
  CRISPR gRNA sequence
tgtcccaggcactctactag

SEQ ID NO: 83993 - DNA, 20 bp, Artificial
  CRISPR gRNA sequence
tactagacacttcatacagt

SEQ ID NO: 83994 - DNA, 20 bp, Artificial
  CRISPR gRNA sequence
ctagacacttcatacagttt

SEQ ID NO: 83995 - DNA, 20 bp, Artificial
  CRISPR gRNA sequence
gacacttcatacagtttaga

SEQ ID NO: 83996 - DNA, 20 bp, Artificial
  CRISPR gRNA sequence
catacagtttagaaaatcag

SEQ ID NO: 83997 - DNA, 20 bp, Artificial
  CRISPR gRNA sequence
atacagtttagaaaatcaga

SEQ ID NO: 83998 - DNA, 20 bp, Artificial
  CRISPR gRNA sequence
agaaaatcagatgggtgtag

SEQ ID NO: 83999 - DNA, 20 bp, Artificial
  CRISPR gRNA sequence
gaaaatcagatgggtgtaga

SEQ ID NO: 84000 - DNA, 20 bp, Artificial
  CRISPR gRNA sequence
gatgggggctattatgaact

SEQ ID NO: 84001 - DNA, 20 bp, Artificial
  CRISPR gRNA sequence
atgggggctattatgaactg

SEQ ID NO: 84002 - DNA, 20 bp, Artificial
  CRISPR gRNA sequence
ttatgaactgagaaatgaac

SEQ ID NO: 84003 - DNA, 20 bp, Artificial
  CRISPR gRNA sequence
tgaactgagaaatgaacttt

SEQ ID NO: 84004 - DNA, 20 bp, Artificial
  CRISPR gRNA sequence
agaaatgaactttgaaaagt

SEQ ID NO: 84005 - DNA, 20 bp, Artificial
  CRISPR gRNA sequence
tgaaaagtatcttggggcca

SEQ ID NO: 84006 - DNA, 20 bp, Artificial
  CRISPR gRNA sequence
gaaaagtatcttggggccaa

SEQ ID NO: 84007 - DNA, 20 bp, Artificial
  CRISPR gRNA sequence
aaaagtatcttggggccaaa

SEQ ID NO: 84008 - DNA, 20 bp, Artificial
  CRISPR gRNA sequence
ggggccaaatcatgtagact

SEQ ID NO: 84009 - DNA, 20 bp, Artificial
  CRISPR gRNA sequence
gggccaaatcatgtagactc

SEQ ID NO: 84010 - DNA, 20 bp, Artificial
  CRISPR gRNA sequence
ttgagtgatgtgttaaggaa

SEQ ID NO: 84011 - DNA, 20 bp, Artificial
  CRISPR gRNA sequence
gagtgatgtgttaaggaatg

SEQ ID NO: 84012 - DNA, 20 bp, Artificial
  CRISPR gRNA sequence
agtgatgtgttaaggaatgc

SEQ ID NO: 84013 - DNA, 20 bp, Artificial
  CRISPR gRNA sequence
aggaatgctatgagtgctga

SEQ ID NO: 84014 - DNA, 20 bp, Artificial
  CRISPR gRNA sequence
tgagtgctgagagggcatca

SEQ ID NO: 84015 - DNA, 20 bp, Artificial
  CRISPR gRNA sequence
agagggcatcagaagtcctt

SEQ ID NO: 84016 - DNA, 20 bp, Artificial
  CRISPR gRNA sequence
gagagcctccagagaaaggc

SEQ ID NO: 84017 - DNA, 20 bp, Artificial
  CRISPR gRNA sequence
agagcctccagagaaaggct

SEQ ID NO: 84018 - DNA, 20 bp, Artificial
  CRISPR gRNA sequence
cagagaaaggctcttaaaaa

SEQ ID NO: 84019 - DNA, 20 bp, Artificial
  CRISPR gRNA sequence
ttaaaaatgcagcgcaatct

SEQ ID NO: 84020 - DNA, 20 bp, Artificial
  CRISPR gRNA sequence
aaaaatgcagcgcaatctcc

SEQ ID NO: 84021 - DNA, 20 bp, Artificial
  CRISPR gRNA sequence
aaaatgcagcgcaatctcca

SEQ ID NO: 84022 - DNA, 20 bp, Artificial
  CRISPR gRNA sequence
cagtgacagaagatactgct

SEQ ID NO: 84023 - DNA, 20 bp, Artificial
  CRISPR gRNA sequence
ctagaaatctgctagaaaaa

SEQ ID NO: 84024 - DNA, 20 bp, Artificial
  CRISPR gRNA sequence
gaaatctgctagaaaaaaaa

SEQ ID NO: 84025 - DNA, 20 bp, Artificial
  CRISPR gRNA sequence
ctagaaaaaaaacaaaaaag

SEQ ID NO: 84026 - DNA, 20 bp, Artificial
  CRISPR gRNA sequence
gaaaaaaaacaaaaaaggca

SEQ ID NO: 84027 - DNA, 20 bp, Artificial
  CRISPR gRNA sequence
tgagggaaagataccaagtc

SEQ ID NO: 84028 - DNA, 20 bp, Artificial
  CRISPR gRNA sequence
attcttcaaaatggaggtgg

SEQ ID NO: 84029 - DNA, 20 bp, Artificial
  CRISPR gRNA sequence
ttcttcaaaatggaggtggc

SEQ ID NO: 84030 - DNA, 20 bp, Artificial
  CRISPR gRNA sequence
ttcaaaatggaggtggcttg

SEQ ID NO: 84031 - DNA, 20 bp, Artificial
  CRISPR gRNA sequence
caaaatggaggtggcttgtt

SEQ ID NO: 84032 - DNA, 20 bp, Artificial
  CRISPR gRNA sequence
aaaatggaggtggcttgttg

SEQ ID NO: 84033 - DNA, 20 bp, Artificial
  CRISPR gRNA sequence
gttgggaaggtggaagctca

SEQ ID NO: 84034 - DNA, 20 bp, Artificial
  CRISPR gRNA sequence
ttgggaaggtggaagctcat

SEQ ID NO: 84035 - DNA, 20 bp, Artificial
  CRISPR gRNA sequence
ggaaggtggaagctcatttg

SEQ ID NO: 84036 - DNA, 20 bp, Artificial
  CRISPR gRNA sequence
atttggccagagtggaaatg

SEQ ID NO: 84037 - DNA, 20 bp, Artificial
  CRISPR gRNA sequence
ggccagagtggaaatggaat

SEQ ID NO: 84038 - DNA, 20 bp, Artificial
  CRISPR gRNA sequence
gccagagtggaaatggaatt

SEQ ID NO: 84039 - DNA, 20 bp, Artificial
  CRISPR gRNA sequence
ggagaaatcgatgaccaaat

SEQ ID NO: 84040 - DNA, 20 bp, Artificial
  CRISPR gRNA sequence
ggtgcctgatatagcttgac

SEQ ID NO: 84041 - DNA, 20 bp, Artificial
  CRISPR gRNA sequence
gtgcctgatatagcttgaca

SEQ ID NO: 84042 - DNA, 20 bp, Artificial
  CRISPR gRNA sequence
atatagcttgacaccaagtt

SEQ ID NO: 84043 - DNA, 20 bp, Artificial
  CRISPR gRNA sequence
gacaccaagttagccccaag

SEQ ID NO: 84044 - DNA, 20 bp, Artificial
  CRISPR gRNA sequence
acaccaagttagccccaagt

SEQ ID NO: 84045 - DNA, 20 bp, Artificial
  CRISPR gRNA sequence
gccccaagtgaaataccctg

SEQ ID NO: 84046 - DNA, 20 bp, Artificial
  CRISPR gRNA sequence
gcaatattaatgtgtctttt

SEQ ID NO: 84047 - DNA, 20 bp, Artificial
  CRISPR gRNA sequence
atgtgtcttttcccgatatt

SEQ ID NO: 84048 - DNA, 20 bp, Artificial
  CRISPR gRNA sequence
ttcccgatattcctcaggta

SEQ ID NO: 84049 - DNA, 20 bp, Artificial
  CRISPR gRNA sequence
tcccgatattcctcaggtac

SEQ ID NO: 84050 - DNA, 20 bp, Artificial
  CRISPR gRNA sequence
cccgatattcctcaggtact

SEQ ID NO: 84051 - DNA, 20 bp, Artificial
  CRISPR gRNA sequence
ccgatattcctcaggtactc

SEQ ID NO: 84052 - DNA, 20 bp, Artificial
  CRISPR gRNA sequence
ctcaggtactccaaagattc

SEQ ID NO: 84053 - DNA, 20 bp, Artificial
  CRISPR gRNA sequence
aggtactccaaagattcagg

SEQ ID NO: 84054 - DNA, 20 bp, Artificial
  CRISPR gRNA sequence
caaagattcaggtttactca

SEQ ID NO: 84055 - DNA, 20 bp, Artificial
  CRISPR gRNA sequence
aggtttactcacgtcatcca

SEQ ID NO: 84056 - DNA, 20 bp, Artificial
  CRISPR gRNA sequence
actcacgtcatccagcagag

SEQ ID NO: 84057 - DNA, 20 bp, Artificial
  CRISPR gRNA sequence
ctcacgtcatccagcagaga

SEQ ID NO: 84058 - DNA, 20 bp, Artificial
  CRISPR gRNA sequence
acgtcatccagcagagaatg

SEQ ID NO: 84059 - DNA, 20 bp, Artificial
  CRISPR gRNA sequence
cctgaattgctatgtgtctg

SEQ ID NO: 84060 - DNA, 20 bp, Artificial
  CRISPR gRNA sequence
ctgaattgctatgtgtctgg

SEQ ID NO: 84061 - DNA, 20 bp, Artificial
  CRISPR gRNA sequence
aattgctatgtgtctgggtt

SEQ ID NO: 84062 - DNA, 20 bp, Artificial
  CRISPR gRNA sequence
ctatgtgtctgggtttcatc

SEQ ID NO: 84063 - DNA, 20 bp, Artificial
  CRISPR gRNA sequence
tgtgtctgggtttcatccat

SEQ ID NO: 84064 - DNA, 20 bp, Artificial
  CRISPR gRNA sequence
ggtttcatccatccgacatt

SEQ ID NO: 84065 - DNA, 20 bp, Artificial
  CRISPR gRNA sequence
catccatccgacattgaagt

SEQ ID NO: 84066 - DNA, 20 bp, Artificial
  CRISPR gRNA sequence
atccatccgacattgaagtt

SEQ ID NO: 84067 - DNA, 20 bp, Artificial
  CRISPR gRNA sequence
aagttgacttactgaagaat

SEQ ID NO: 84068 - DNA, 20 bp, Artificial
  CRISPR gRNA sequence
acttactgaagaatggagag

SEQ ID NO: 84069 - DNA, 20 bp, Artificial
  CRISPR gRNA sequence
actgaagaatggagagagaa

SEQ ID NO: 84070 - DNA, 20 bp, Artificial
  CRISPR gRNA sequence
ctgaagaatggagagagaat

SEQ ID NO: 84071 - DNA, 20 bp, Artificial
  CRISPR gRNA sequence
aagaatggagagagaattga

SEQ ID NO: 84072 - DNA, 20 bp, Artificial
  CRISPR gRNA sequence
aaaaagtggagcattcagac

SEQ ID NO: 84073 - DNA, 20 bp, Artificial
  CRISPR gRNA sequence
agacttgtctttcagcaagg

SEQ ID NO: 84074 - DNA, 20 bp, Artificial
  CRISPR gRNA sequence
gtctttcagcaaggactggt

SEQ ID NO: 84075 - DNA, 20 bp, Artificial
  CRISPR gRNA sequence
tctttcagcaaggactggtc

SEQ ID NO: 84076 - DNA, 20 bp, Artificial
  CRISPR gRNA sequence
tcagcaaggactggtctttc

SEQ ID NO: 84077 - DNA, 20 bp, Artificial
  CRISPR gRNA sequence
cagcaaggactggtctttct

SEQ ID NO: 84078 - DNA, 20 bp, Artificial
  CRISPR gRNA sequence
agcaaggactggtctttcta

SEQ ID NO: 84079 - DNA, 20 bp, Artificial
  CRISPR gRNA sequence
gtctttctatctcttgtact

SEQ ID NO: 84080 - DNA, 20 bp, Artificial
  CRISPR gRNA sequence
tctatctcttgtactacact

SEQ ID NO: 84081 - DNA, 20 bp, Artificial
  CRISPR gRNA sequence
ctatctcttgtactacactg

SEQ ID NO: 84082 - DNA, 20 bp, Artificial
  CRISPR gRNA sequence
tatctcttgtactacactga

SEQ ID NO: 84083 - DNA, 20 bp, Artificial
  CRISPR gRNA sequence
tctcttgtactacactgaat

SEQ ID NO: 84084 - DNA, 20 bp, Artificial
  CRISPR gRNA sequence
ttgtactacactgaattcac

SEQ ID NO: 84085 - DNA, 20 bp, Artificial
  CRISPR gRNA sequence
gtactacactgaattcaccc

SEQ ID NO: 84086 - DNA, 20 bp, Artificial
  CRISPR gRNA sequence
tactacactgaattcacccc

SEQ ID NO: 84087 - DNA, 20 bp, Artificial
  CRISPR gRNA sequence
cactgaattcacccccactg

SEQ ID NO: 84088 - DNA, 20 bp, Artificial
  CRISPR gRNA sequence
aattcacccccactgaaaaa

SEQ ID NO: 84089 - DNA, 20 bp, Artificial
  CRISPR gRNA sequence
acccccactgaaaaagatga

SEQ ID NO: 84090 - DNA, 20 bp, Artificial
  CRISPR gRNA sequence
aaaaagatgagtatgcctgc

SEQ ID NO: 84091 - DNA, 20 bp, Artificial
  CRISPR gRNA sequence
ccgtgtgaaccatgtgactt

SEQ ID NO: 84092 - DNA, 20 bp, Artificial
  CRISPR gRNA sequence
tgtcacagcccaagatagtt

SEQ ID NO: 84093 - DNA, 20 bp, Artificial
  CRISPR gRNA sequence
gtcacagcccaagatagtta

SEQ ID NO: 84094 - DNA, 20 bp, Artificial
  CRISPR gRNA sequence
tcacagcccaagatagttaa

SEQ ID NO: 84095 - DNA, 20 bp, Artificial
  CRISPR gRNA sequence
agtggggtaagtcttacatt

SEQ ID NO: 84096 - DNA, 20 bp, Artificial
  CRISPR gRNA sequence
acattcttttgtaagctgct

SEQ ID NO: 84097 - DNA, 20 bp, Artificial
  CRISPR gRNA sequence
cattcttttgtaagctgctg

SEQ ID NO: 84098 - DNA, 20 bp, Artificial
  CRISPR gRNA sequence
ttttgtaagctgctgaaagt

SEQ ID NO: 84099 - DNA, 20 bp, Artificial
  CRISPR gRNA sequence
ttgtaagctgctgaaagttg

SEQ ID NO: 84100 - DNA, 20 bp, Artificial
  CRISPR gRNA sequence
tgtaagctgctgaaagttgt

SEQ ID NO: 84101 - DNA, 20 bp, Artificial
  CRISPR gRNA sequence
gtaagctgctgaaagttgtg

SEQ ID NO: 84102 - DNA, 20 bp, Artificial
  CRISPR gRNA sequence
taagctgctgaaagttgtgt

SEQ ID NO: 84103 - DNA, 20 bp, Artificial
  CRISPR gRNA sequence
ctgaaagttgtgtatgagta

SEQ ID NO: 84104 - DNA, 20 bp, Artificial
  CRISPR gRNA sequence
aaagttgtgtatgagtagtc

SEQ ID NO: 84105 - DNA, 20 bp, Artificial
  CRISPR gRNA sequence
tgtatgagtagtcatatcat

SEQ ID NO: 84106 - DNA, 20 bp, Artificial
  CRISPR gRNA sequence
ctttgatataaaaaaggtct

SEQ ID NO: 84107 - DNA, 20 bp, Artificial
  CRISPR gRNA sequence
tgatataaaaaaggtctatg

SEQ ID NO: 84108 - DNA, 20 bp, Artificial
  CRISPR gRNA sequence
gatataaaaaaggtctatgg

SEQ ID NO: 84109 - DNA, 20 bp, Artificial
  CRISPR gRNA sequence
atataaaaaaggtctatggc

SEQ ID NO: 84110 - DNA, 20 bp, Artificial
  CRISPR gRNA sequence
tggccatactaccctgaatg

SEQ ID NO: 84111 - DNA, 20 bp, Artificial
  CRISPR gRNA sequence
ccctgaatgagtcccatccc

SEQ ID NO: 84112 - DNA, 20 bp, Artificial
  CRISPR gRNA sequence
aatgagtcccatcccatctg

SEQ ID NO: 84113 - DNA, 20 bp, Artificial
  CRISPR gRNA sequence
atataaacaatctgcatatt

SEQ ID NO: 84114 - DNA, 20 bp, Artificial
  CRISPR gRNA sequence
catattgggattgtcaggga

SEQ ID NO: 84115 - DNA, 20 bp, Artificial
  CRISPR gRNA sequence
ggattgtcagggaatgttct

SEQ ID NO: 84116 - DNA, 20 bp, Artificial
  CRISPR gRNA sequence
tcagggaatgttcttaaaga

SEQ ID NO: 84117 - DNA, 20 bp, Artificial
  CRISPR gRNA sequence
ttaaagatcagattagtggc

SEQ ID NO: 84118 - DNA, 20 bp, Artificial
  CRISPR gRNA sequence
aaagatcagattagtggcac

SEQ ID NO: 84119 - DNA, 20 bp, Artificial
  CRISPR gRNA sequence
aagatcagattagtggcacc

SEQ ID NO: 84120 - DNA, 20 bp, Artificial
  CRISPR gRNA sequence
gtggcacctgctgagatact

SEQ ID NO: 84121 - DNA, 20 bp, Artificial
  CRISPR gRNA sequence
ctgagatactgatgcacagc

SEQ ID NO: 84122 - DNA, 20 bp, Artificial
  CRISPR gRNA sequence
agatactgatgcacagcatg

SEQ ID NO: 84123 - DNA, 20 bp, Artificial
  CRISPR gRNA sequence
atgcacagcatggtttctga

SEQ ID NO: 84124 - DNA, 20 bp, Artificial
  CRISPR gRNA sequence
ctgaaccagtagtttccctg

SEQ ID NO: 84125 - DNA, 20 bp, Artificial
  CRISPR gRNA sequence
tgaaccagtagtttccctgc

SEQ ID NO: 84126 - DNA, 20 bp, Artificial
  CRISPR gRNA sequence
aaccagtagtttccctgcag

SEQ ID NO: 84127 - DNA, 20 bp, Artificial
  CRISPR gRNA sequence
ccctgcagttgagcagggag

SEQ ID NO: 84128 - DNA, 20 bp, Artificial
  CRISPR gRNA sequence
cctgcagttgagcagggagc

SEQ ID NO: 84129 - DNA, 20 bp, Artificial
  CRISPR gRNA sequence
cagttgagcagggagcagca

SEQ ID NO: 84130 - DNA, 20 bp, Artificial
  CRISPR gRNA sequence
agcagggagcagcagcagca

SEQ ID NO: 84131 - DNA, 20 bp, Artificial
  CRISPR gRNA sequence
gcacaaatacatatacactc

SEQ ID NO: 84132 - DNA, 20 bp, Artificial
  CRISPR gRNA sequence
cacaaatacatatacactct

SEQ ID NO: 84133 - DNA, 20 bp, Artificial
  CRISPR gRNA sequence
ttaacacttcttacctactg

SEQ ID NO: 84134 - DNA, 20 bp, Artificial
  CRISPR gRNA sequence
aacacttcttacctactggc

SEQ ID NO: 84135 - DNA, 20 bp, Artificial
  CRISPR gRNA sequence
acacttcttacctactggct

SEQ ID NO: 84136 - DNA, 20 bp, Artificial
  CRISPR gRNA sequence
cttacctactggcttcctct

SEQ ID NO: 84137 - DNA, 20 bp, Artificial
  CRISPR gRNA sequence
ttacctactggcttcctcta

SEQ ID NO: 84138 - DNA, 20 bp, Artificial
  CRISPR gRNA sequence
acctactggcttcctctagc

SEQ ID NO: 84139 - DNA, 20 bp, Artificial
  CRISPR gRNA sequence
cctactggcttcctctagct

SEQ ID NO: 84140 - DNA, 20 bp, Artificial
  CRISPR gRNA sequence
ctggcttcctctagcttttg

SEQ ID NO: 84141 - DNA, 20 bp, Artificial
  CRISPR gRNA sequence
gcttcctctagcttttgtgg

SEQ ID NO: 84142 - DNA, 20 bp, Artificial
  CRISPR gRNA sequence
cctctagcttttgtggcagc

SEQ ID NO: 84143 - DNA, 20 bp, Artificial
  CRISPR gRNA sequence
ctctagcttttgtggcagct

SEQ ID NO: 84144 - DNA, 20 bp, Artificial
  CRISPR gRNA sequence
tagcttttgtggcagcttca

SEQ ID NO: 84145 - DNA, 20 bp, Artificial
  CRISPR gRNA sequence
gcttttgtggcagcttcagg

SEQ ID NO: 84146 - DNA, 20 bp, Artificial
  CRISPR gRNA sequence
ttgtggcagcttcaggtata

SEQ ID NO: 84147 - DNA, 20 bp, Artificial
  CRISPR gRNA sequence
tgtggcagcttcaggtatat

SEQ ID NO: 84148 - DNA, 20 bp, Artificial
  CRISPR gRNA sequence
gtggcagcttcaggtatatt

SEQ ID NO: 84149 - DNA, 20 bp, Artificial
  CRISPR gRNA sequence
tggcagcttcaggtatattt

SEQ ID NO: 84150 - DNA, 20 bp, Artificial
  CRISPR gRNA sequence
caggtatatttagcactgaa

SEQ ID NO: 84151 - DNA, 20 bp, Artificial
  CRISPR gRNA sequence
aggtatatttagcactgaac

SEQ ID NO: 84152 - DNA, 20 bp, Artificial
  CRISPR gRNA sequence
agcactgaacgaacatctca

SEQ ID NO: 84153 - DNA, 20 bp, Artificial
  CRISPR gRNA sequence
gcactgaacgaacatctcaa

SEQ ID NO: 84154 - DNA, 20 bp, Artificial
  CRISPR gRNA sequence
aacgaacatctcaagaaggt

SEQ ID NO: 84155 - DNA, 20 bp, Artificial
  CRISPR gRNA sequence
aagaaggtataggcctttgt

SEQ ID NO: 84156 - DNA, 20 bp, Artificial
  CRISPR gRNA sequence
tgtttgtaagtcctgctgtc

SEQ ID NO: 84157 - DNA, 20 bp, Artificial
  CRISPR gRNA sequence
gtttgtaagtcctgctgtcc

SEQ ID NO: 84158 - DNA, 20 bp, Artificial
  CRISPR gRNA sequence
tttgtaagtcctgctgtcct

SEQ ID NO: 84159 - DNA, 20 bp, Artificial
  CRISPR gRNA sequence
gtaagtcctgctgtcctagc

SEQ ID NO: 84160 - DNA, 20 bp, Artificial
  CRISPR gRNA sequence
taagtcctgctgtcctagca

SEQ ID NO: 84161 - DNA, 20 bp, Artificial
  CRISPR gRNA sequence
ctgtcctagcatcctataat

SEQ ID NO: 84162 - DNA, 20 bp, Artificial
  CRISPR gRNA sequence
tcctagcatcctataatcct

SEQ ID NO: 84163 - DNA, 20 bp, Artificial
  CRISPR gRNA sequence
gcatcctataatcctggact

SEQ ID NO: 84164 - DNA, 20 bp, Artificial
  CRISPR gRNA sequence
taatcctggacttctccagt

SEQ ID NO: 84165 - DNA, 20 bp, Artificial
  CRISPR gRNA sequence
gacttctccagtactttctg

SEQ ID NO: 84166 - DNA, 20 bp, Artificial
  CRISPR gRNA sequence
ctccagtactttctggctgg

SEQ ID NO: 84167 - DNA, 20 bp, Artificial
  CRISPR gRNA sequence
tccagtactttctggctgga

SEQ ID NO: 84168 - DNA, 20 bp, Artificial
  CRISPR gRNA sequence
cagtactttctggctggatt

SEQ ID NO: 84169 - DNA, 20 bp, Artificial
  CRISPR gRNA sequence
tctggctggattggtatctg

SEQ ID NO: 84170 - DNA, 20 bp, Artificial
  CRISPR gRNA sequence
ctggctggattggtatctga

SEQ ID NO: 84171 - DNA, 20 bp, Artificial
  CRISPR gRNA sequence
tggctggattggtatctgag

SEQ ID NO: 84172 - DNA, 20 bp, Artificial
  CRISPR gRNA sequence
gctggattggtatctgaggc

SEQ ID NO: 84173 - DNA, 20 bp, Artificial
  CRISPR gRNA sequence
gattggtatctgaggctagt

SEQ ID NO: 84174 - DNA, 20 bp, Artificial
  CRISPR gRNA sequence
gtatctgaggctagtaggaa

SEQ ID NO: 84175 - DNA, 20 bp, Artificial
  CRISPR gRNA sequence
aggctagtaggaagggcttg

SEQ ID NO: 84176 - DNA, 20 bp, Artificial
  CRISPR gRNA sequence
gtaggaagggcttgttcctg

SEQ ID NO: 84177 - DNA, 20 bp, Artificial
  CRISPR gRNA sequence
gttcctgctgggtagctcta

SEQ ID NO: 84178 - DNA, 20 bp, Artificial
  CRISPR gRNA sequence
ttcctgctgggtagctctaa

SEQ ID NO: 84179 - DNA, 20 bp, Artificial
  CRISPR gRNA sequence
ctgctgggtagctctaaaca

SEQ ID NO: 84180 - DNA, 20 bp, Artificial
  CRISPR gRNA sequence
ctgggtagctctaaacaatg

SEQ ID NO: 84181 - DNA, 20 bp, Artificial
  CRISPR gRNA sequence
ggtagctctaaacaatgtat

SEQ ID NO: 84182 - DNA, 20 bp, Artificial
  CRISPR gRNA sequence
taaacaatgtattcatgggt

SEQ ID NO: 84183 - DNA, 20 bp, Artificial
  CRISPR gRNA sequence
aacaatgtattcatgggtag

SEQ ID NO: 84184 - DNA, 20 bp, Artificial
  CRISPR gRNA sequence
atgggtaggaacagcagcct

SEQ ID NO: 84185 - DNA, 20 bp, Artificial
  CRISPR gRNA sequence
ttctgccagccttatttcta

SEQ ID NO: 84186 - DNA, 20 bp, Artificial
  CRISPR gRNA sequence
tgccagccttatttctaacc

SEQ ID NO: 84187 - DNA, 20 bp, Artificial
  CRISPR gRNA sequence
ccagccttatttctaaccat

SEQ ID NO: 84188 - DNA, 20 bp, Artificial
  CRISPR gRNA sequence
atttctaaccattttagaca

SEQ ID NO: 84189 - DNA, 20 bp, Artificial
  CRISPR gRNA sequence
tttctaaccattttagacat

SEQ ID NO: 84190 - DNA, 20 bp, Artificial
  CRISPR gRNA sequence
ctaaccattttagacatttg

SEQ ID NO: 84191 - DNA, 20 bp, Artificial
  CRISPR gRNA sequence
taaccattttagacatttgt

SEQ ID NO: 84192 - DNA, 20 bp, Artificial
  CRISPR gRNA sequence
accattttagacatttgtta

SEQ ID NO: 84193 - DNA, 20 bp, Artificial
  CRISPR gRNA sequence
tagacatttgttagtacatg

SEQ ID NO: 84194 - DNA, 20 bp, Artificial
  CRISPR gRNA sequence
agacatttgttagtacatgg

SEQ ID NO: 84195 - DNA, 20 bp, Artificial
  CRISPR gRNA sequence
gacatttgttagtacatggt

SEQ ID NO: 84196 - DNA, 20 bp, Artificial
  CRISPR gRNA sequence
gttagtacatggtattttaa

SEQ ID NO: 84197 - DNA, 20 bp, Artificial
  CRISPR gRNA sequence
ttagtacatggtattttaaa

SEQ ID NO: 84198 - DNA, 20 bp, Artificial
  CRISPR gRNA sequence
gtacatggtattttaaaagt

SEQ ID NO: 84199 - DNA, 20 bp, Artificial
  CRISPR gRNA sequence
taaaagtaaaacttaatgtc

SEQ ID NO: 84200 - DNA, 20 bp, Artificial
  CRISPR gRNA sequence
aaaagtaaaacttaatgtct

SEQ ID NO: 84201 - DNA, 20 bp, Artificial
  CRISPR gRNA sequence
aaagtaaaacttaatgtctt

SEQ ID NO: 84202 - DNA, 20 bp, Artificial
  CRISPR gRNA sequence
aatgtcttccttttttttct

SEQ ID NO: 84203 - DNA, 20 bp, Artificial
  CRISPR gRNA sequence
atgtcttccttttttttctc

SEQ ID NO: 84204 - DNA, 20 bp, Artificial
  CRISPR gRNA sequence
ccttttttttctccactgtc

SEQ ID NO: 84205 - DNA, 20 bp, Artificial
  CRISPR gRNA sequence
cttttttttctccactgtct

SEQ ID NO: 84206 - DNA, 20 bp, Artificial
  CRISPR gRNA sequence
ttttttctccactgtctttt

SEQ ID NO: 84207 - DNA, 20 bp, Artificial
  CRISPR gRNA sequence
tttttctccactgtcttttt

SEQ ID NO: 84208 - DNA, 20 bp, Artificial
  CRISPR gRNA sequence
ttttctccactgtctttttc

SEQ ID NO: 84209 - DNA, 20 bp, Artificial
  CRISPR gRNA sequence
tttctccactgtctttttca

SEQ ID NO: 84210 - DNA, 20 bp, Artificial
  CRISPR gRNA sequence
ttctccactgtctttttcat

SEQ ID NO: 84211 - DNA, 20 bp, Artificial
  CRISPR gRNA sequence
tctccactgtctttttcata

SEQ ID NO: 84212 - DNA, 20 bp, Artificial
  CRISPR gRNA sequence
ctccactgtctttttcatag

SEQ ID NO: 84213 - DNA, 20 bp, Artificial
  CRISPR gRNA sequence
tccactgtctttttcataga

SEQ ID NO: 84214 - DNA, 20 bp, Artificial
  CRISPR gRNA sequence
cactgtctttttcatagatc

SEQ ID NO: 84215 - DNA, 20 bp, Artificial
  CRISPR gRNA sequence
tctttttcatagatcgagac

SEQ ID NO: 84216 - DNA, 20 bp, Artificial
  CRISPR gRNA sequence
tttcatagatcgagacatgt

SEQ ID NO: 84217 - DNA, 20 bp, Artificial
  CRISPR gRNA sequence
ttcatagatcgagacatgta

SEQ ID NO: 84218 - DNA, 20 bp, Artificial
  CRISPR gRNA sequence
tcatagatcgagacatgtaa

SEQ ID NO: 84219 - DNA, 20 bp, Artificial
  CRISPR gRNA sequence
catagatcgagacatgtaag

SEQ ID NO: 84220 - DNA, 20 bp, Artificial
  CRISPR gRNA sequence
atagatcgagacatgtaagc

SEQ ID NO: 84221 - DNA, 20 bp, Artificial
  CRISPR gRNA sequence
ttgaccttgagaaaatgttt

SEQ ID NO: 84222 - DNA, 20 bp, Artificial
  CRISPR gRNA sequence
tgaccttgagaaaatgtttt

SEQ ID NO: 84223 - DNA, 20 bp, Artificial
  CRISPR gRNA sequence
gaccttgagaaaatgttttt

SEQ ID NO: 84224 - DNA, 20 bp, Artificial
  CRISPR gRNA sequence
accttgagaaaatgtttttg

SEQ ID NO: 84225 - DNA, 20 bp, Artificial
  CRISPR gRNA sequence
gagaaaatgtttttgtttca

SEQ ID NO: 84226 - DNA, 20 bp, Artificial
  CRISPR gRNA sequence
agaaaatgtttttgtttcac

SEQ ID NO: 84227 - DNA, 20 bp, Artificial
  CRISPR gRNA sequence
ttgtttcactgtcctgagga

SEQ ID NO: 84228 - DNA, 20 bp, Artificial
  CRISPR gRNA sequence
tgtttcactgtcctgaggac

SEQ ID NO: 84229 - DNA, 20 bp, Artificial
  CRISPR gRNA sequence
gtttcactgtcctgaggact

SEQ ID NO: 84230 - DNA, 20 bp, Artificial
  CRISPR gRNA sequence
tttcactgtcctgaggacta

SEQ ID NO: 84231 - DNA, 20 bp, Artificial
  CRISPR gRNA sequence
cactgtcctgaggactattt

SEQ ID NO: 84232 - DNA, 20 bp, Artificial
  CRISPR gRNA sequence
actgtcctgaggactattta

SEQ ID NO: 84233 - DNA, 20 bp, Artificial
  CRISPR gRNA sequence
tcctgaggactatttataga

SEQ ID NO: 84234 - DNA, 20 bp, Artificial
  CRISPR gRNA sequence
aggactatttatagacagct

SEQ ID NO: 84235 - DNA, 20 bp, Artificial
  CRISPR gRNA sequence
tttatagacagctctaacat

SEQ ID NO: 84236 - DNA, 20 bp, Artificial
  CRISPR gRNA sequence
atagacagctctaacatgat

SEQ ID NO: 84237 - DNA, 20 bp, Artificial
  CRISPR gRNA sequence
tagacagctctaacatgata

SEQ ID NO: 84238 - DNA, 20 bp, Artificial
  CRISPR gRNA sequence
taacatgataaccctcacta

SEQ ID NO: 84239 - DNA, 20 bp, Artificial
  CRISPR gRNA sequence
acatgataaccctcactatg

SEQ ID NO: 84240 - DNA, 20 bp, Artificial
  CRISPR gRNA sequence
actatgtggagaacattgac

SEQ ID NO: 84241 - DNA, 20 bp, Artificial
  CRISPR gRNA sequence
tgtggagaacattgacagag

SEQ ID NO: 84242 - DNA, 20 bp, Artificial
  CRISPR gRNA sequence
acagagtaacattttagcag

SEQ ID NO: 84243 - DNA, 20 bp, Artificial
  CRISPR gRNA sequence
tagcagggaaagaagaatcc

SEQ ID NO: 84244 - DNA, 20 bp, Artificial
  CRISPR gRNA sequence
agcagggaaagaagaatcct

SEQ ID NO: 84245 - DNA, 20 bp, Artificial
  CRISPR gRNA sequence
gcagggaaagaagaatccta

SEQ ID NO: 84246 - DNA, 20 bp, Artificial
  CRISPR gRNA sequence
cagggtcatgttcccttctc

SEQ ID NO: 84247 - DNA, 20 bp, Artificial
  CRISPR gRNA sequence
ccttctcctgtggagtggca

SEQ ID NO: 84248 - DNA, 20 bp, Artificial
  CRISPR gRNA sequence
ctcctgtggagtggcatgaa

SEQ ID NO: 84249 - DNA, 20 bp, Artificial
  CRISPR gRNA sequence
tcctgtggagtggcatgaag

SEQ ID NO: 84250 - DNA, 20 bp, Artificial
  CRISPR gRNA sequence
ctgtggagtggcatgaagaa

SEQ ID NO: 84251 - DNA, 20 bp, Artificial
  CRISPR gRNA sequence
tggagtggcatgaagaaggt

SEQ ID NO: 84252 - DNA, 20 bp, Artificial
  CRISPR gRNA sequence
ctgaccctctacagagaggg

SEQ ID NO: 84253 - DNA, 20 bp, Artificial
  CRISPR gRNA sequence
accctctacagagagggcaa

SEQ ID NO: 84254 - DNA, 20 bp, Artificial
  CRISPR gRNA sequence
tacagagagggcaaaggaac

SEQ ID NO: 84255 - DNA, 20 bp, Artificial
  CRISPR gRNA sequence
cagagagggcaaaggaactg

SEQ ID NO: 84256 - DNA, 20 bp, Artificial
  CRISPR gRNA sequence
ccagtatggtattgcaggat

SEQ ID NO: 84257 - DNA, 20 bp, Artificial
  CRISPR gRNA sequence
caggataaaggcaggtggtt

SEQ ID NO: 84258 - DNA, 20 bp, Artificial
  CRISPR gRNA sequence
cccacattacctgcaaggct

SEQ ID NO: 84259 - DNA, 20 bp, Artificial
  CRISPR gRNA sequence
cctgcaaggctttgatcttt

SEQ ID NO: 84260 - DNA, 20 bp, Artificial
  CRISPR gRNA sequence
caaggctttgatctttcttc

SEQ ID NO: 84261 - DNA, 20 bp, Artificial
  CRISPR gRNA sequence
tgatctttcttctgccattt

SEQ ID NO: 84262 - DNA, 20 bp, Artificial
  CRISPR gRNA sequence
gatctttcttctgccatttc

SEQ ID NO: 84263 - DNA, 20 bp, Artificial
  CRISPR gRNA sequence
atctttcttctgccatttcc

SEQ ID NO: 84264 - DNA, 20 bp, Artificial
  CRISPR gRNA sequence
tcttctgccatttccacatt

SEQ ID NO: 84265 - DNA, 20 bp, Artificial
  CRISPR gRNA sequence
cttctgccatttccacattg

SEQ ID NO: 84266 - DNA, 20 bp, Artificial
  CRISPR gRNA sequence
ttctgccatttccacattgg

SEQ ID NO: 84267 - DNA, 20 bp, Artificial
  CRISPR gRNA sequence
ctgccatttccacattggac

SEQ ID NO: 84268 - DNA, 20 bp, Artificial
  CRISPR gRNA sequence
tgccatttccacattggaca

SEQ ID NO: 84269 - DNA, 20 bp, Artificial
  CRISPR gRNA sequence
ccatttccacattggacatc

SEQ ID NO: 84270 - DNA, 20 bp, Artificial
  CRISPR gRNA sequence
ccacattggacatctctgct

SEQ ID NO: 84271 - DNA, 20 bp, Artificial
  CRISPR gRNA sequence
cacattggacatctctgctg

SEQ ID NO: 84272 - DNA, 20 bp, Artificial
  CRISPR gRNA sequence
gacatctctgctgaggagag

SEQ ID NO: 84273 - DNA, 20 bp, Artificial
  CRISPR gRNA sequence
tgctgaggagagaaaatgaa

SEQ ID NO: 84274 - DNA, 20 bp, Artificial
  CRISPR gRNA sequence
ctgaggagagaaaatgaacc

SEQ ID NO: 84275 - DNA, 20 bp, Artificial
  CRISPR gRNA sequence
aggagagaaaatgaaccact

SEQ ID NO: 84276 - DNA, 20 bp, Artificial
  CRISPR gRNA sequence
ttttcctttgtataatgttg

SEQ ID NO: 84277 - DNA, 20 bp, Artificial
  CRISPR gRNA sequence
ttcctttgtataatgttgtt

SEQ ID NO: 84278 - DNA, 20 bp, Artificial
  CRISPR gRNA sequence
tcctttgtataatgttgttt

SEQ ID NO: 84279 - DNA, 20 bp, Artificial
  CRISPR gRNA sequence
cctttgtataatgttgtttt

SEQ ID NO: 84280 - DNA, 20 bp, Artificial
  CRISPR gRNA sequence
ctttgtataatgttgtttta

SEQ ID NO: 84281 - DNA, 20 bp, Artificial
  CRISPR gRNA sequence
tgtataatgttgttttattc

SEQ ID NO: 84282 - DNA, 20 bp, Artificial
  CRISPR gRNA sequence
gtataatgttgttttattct

SEQ ID NO: 84283 - DNA, 20 bp, Artificial
  CRISPR gRNA sequence
tataatgttgttttattctt

SEQ ID NO: 84284 - DNA, 20 bp, Artificial
  CRISPR gRNA sequence
ttttattcttcagacagaag

SEQ ID NO: 84285 - DNA, 20 bp, Artificial
  CRISPR gRNA sequence
tattcttcagacagaagaga

SEQ ID NO: 84286 - DNA, 20 bp, Artificial
  CRISPR gRNA sequence
attcttcagacagaagagag

SEQ ID NO: 84287 - DNA, 20 bp, Artificial
  CRISPR gRNA sequence
ttcttcagacagaagagagg

SEQ ID NO: 84288 - DNA, 20 bp, Artificial
  CRISPR gRNA sequence
ttcagacagaagagaggagt

SEQ ID NO: 84289 - DNA, 20 bp, Artificial
  CRISPR gRNA sequence
cagacagaagagaggagtta

SEQ ID NO: 84290 - DNA, 20 bp, Artificial
  CRISPR gRNA sequence
agacagaagagaggagttat

SEQ ID NO: 84291 - DNA, 20 bp, Artificial
  CRISPR gRNA sequence
tacagctctgcagacatccc

SEQ ID NO: 84292 - DNA, 20 bp, Artificial
  CRISPR gRNA sequence
tgcagacatcccattcctgt

SEQ ID NO: 84293 - DNA, 20 bp, Artificial
  CRISPR gRNA sequence
cagacatcccattcctgtat

SEQ ID NO: 84294 - DNA, 20 bp, Artificial
  CRISPR gRNA sequence
ctgtatggggactgtgtttg

SEQ ID NO: 84295 - DNA, 20 bp, Artificial
  CRISPR gRNA sequence
tatggggactgtgtttgcct

SEQ ID NO: 84296 - DNA, 20 bp, Artificial
  CRISPR gRNA sequence
tgtttgcctcttagaggttc

SEQ ID NO: 84297 - DNA, 20 bp, Artificial
  CRISPR gRNA sequence
gcctcttagaggttcccagg

SEQ ID NO: 84298 - DNA, 20 bp, Artificial
  CRISPR gRNA sequence
cctcttagaggttcccaggc

SEQ ID NO: 84299 - DNA, 20 bp, Artificial
  CRISPR gRNA sequence
ttagaggttcccaggccact

SEQ ID NO: 84300 - DNA, 20 bp, Artificial
  CRISPR gRNA sequence
agaggttcccaggccactag

SEQ ID NO: 84301 - DNA, 20 bp, Artificial
  CRISPR gRNA sequence
gaggttcccaggccactaga

SEQ ID NO: 84302 - DNA, 20 bp, Artificial
  CRISPR gRNA sequence
ccaggccactagaggagata

SEQ ID NO: 84303 - DNA, 20 bp, Artificial
  CRISPR gRNA sequence
gaggagataaagggaaacag

SEQ ID NO: 84304 - DNA, 20 bp, Artificial
  CRISPR gRNA sequence
ttataacttgatataatgat

SEQ ID NO: 84305 - DNA, 20 bp, Artificial
  CRISPR gRNA sequence
taacttgatataatgatact

SEQ ID NO: 84306 - DNA, 20 bp, Artificial
  CRISPR gRNA sequence
gatataatgatactataata

SEQ ID NO: 84307 - DNA, 20 bp, Artificial
  CRISPR gRNA sequence
atataatgatactataatag

SEQ ID NO: 84308 - DNA, 20 bp, Artificial
  CRISPR gRNA sequence
taatagatgtaactacaagg

SEQ ID NO: 84309 - DNA, 20 bp, Artificial
  CRISPR gRNA sequence
caaggagctccagaagcaag

SEQ ID NO: 84310 - DNA, 20 bp, Artificial
  CRISPR gRNA sequence
cagaagcaagagagagggag

SEQ ID NO: 84311 - DNA, 20 bp, Artificial
  CRISPR gRNA sequence
ggacttctctgcatctttag

SEQ ID NO: 84312 - DNA, 20 bp, Artificial
  CRISPR gRNA sequence
gacttctctgcatctttagt

SEQ ID NO: 84313 - DNA, 20 bp, Artificial
  CRISPR gRNA sequence
ctctgcatctttagttggag

SEQ ID NO: 84314 - DNA, 20 bp, Artificial
  CRISPR gRNA sequence
tctgcatctttagttggagt

SEQ ID NO: 84315 - DNA, 20 bp, Artificial
  CRISPR gRNA sequence
tgcatctttagttggagtcc

SEQ ID NO: 84316 - DNA, 20 bp, Artificial
  CRISPR gRNA sequence
catctttagttggagtccaa

SEQ ID NO: 84317 - DNA, 20 bp, Artificial
  CRISPR gRNA sequence
tagttggagtccaaaggctt

SEQ ID NO: 84318 - DNA, 20 bp, Artificial
  CRISPR gRNA sequence
agttggagtccaaaggcttt

SEQ ID NO: 84319 - DNA, 20 bp, Artificial
  CRISPR gRNA sequence
gttggagtccaaaggctttt

SEQ ID NO: 84320 - DNA, 20 bp, Artificial
  CRISPR gRNA sequence
gagtccaaaggcttttcaat

SEQ ID NO: 84321 - DNA, 20 bp, Artificial
  CRISPR gRNA sequence
ttcaatgaaattctactgcc

SEQ ID NO: 84322 - DNA, 20 bp, Artificial
  CRISPR gRNA sequence
tcaatgaaattctactgccc

SEQ ID NO: 84323 - DNA, 20 bp, Artificial
  CRISPR gRNA sequence
caatgaaattctactgccca

SEQ ID NO: 84324 - DNA, 20 bp, Artificial
  CRISPR gRNA sequence
aatgaaattctactgcccag

SEQ ID NO: 84325 - DNA, 20 bp, Artificial
  CRISPR gRNA sequence
tactgcccagggtacattga

SEQ ID NO: 84326 - DNA, 20 bp, Artificial
  CRISPR gRNA sequence
ctgcccagggtacattgatg

SEQ ID NO: 84327 - DNA, 20 bp, Artificial
  CRISPR gRNA sequence
cccagggtacattgatgctg

SEQ ID NO: 84328 - DNA, 20 bp, Artificial
  CRISPR gRNA sequence
atgctgaaaccccattcaaa

SEQ ID NO: 84329 - DNA, 20 bp, Artificial
  CRISPR gRNA sequence
aaaccccattcaaatctcct

SEQ ID NO: 84330 - DNA, 20 bp, Artificial
  CRISPR gRNA sequence
aaatctcctgttatattcta

SEQ ID NO: 84331 - DNA, 20 bp, Artificial
  CRISPR gRNA sequence
ctgttatattctagaacagg

SEQ ID NO: 84332 - DNA, 20 bp, Artificial
  CRISPR gRNA sequence
ttatattctagaacagggaa

SEQ ID NO: 84333 - DNA, 20 bp, Artificial
  CRISPR gRNA sequence
tattctagaacagggaattg

SEQ ID NO: 84334 - DNA, 20 bp, Artificial
  CRISPR gRNA sequence
tagaacagggaattgatttg

SEQ ID NO: 84335 - DNA, 20 bp, Artificial
  CRISPR gRNA sequence
gaacagggaattgatttggg

SEQ ID NO: 84336 - DNA, 20 bp, Artificial
  CRISPR gRNA sequence
atttgggagagcatcaggaa

SEQ ID NO: 84337 - DNA, 20 bp, Artificial
  CRISPR gRNA sequence
gggagagcatcaggaaggtg

SEQ ID NO: 84338 - DNA, 20 bp, Artificial
  CRISPR gRNA sequence
ggagagcatcaggaaggtgg

SEQ ID NO: 84339 - DNA, 20 bp, Artificial
  CRISPR gRNA sequence
cccagtcacactgttagtaa

SEQ ID NO: 84340 - DNA, 20 bp, Artificial
  CRISPR gRNA sequence
ttagtaaattgtagagccag

SEQ ID NO: 84341 - DNA, 20 bp, Artificial
  CRISPR gRNA sequence
gtaaattgtagagccaggac

SEQ ID NO: 84342 - DNA, 20 bp, Artificial
  CRISPR gRNA sequence
tagagccaggacctgaactc

SEQ ID NO: 84343 - DNA, 20 bp, Artificial
  CRISPR gRNA sequence
aactctaatatagtcatgtg

SEQ ID NO: 84344 - DNA, 20 bp, Artificial
  CRISPR gRNA sequence
taatatagtcatgtgttact

SEQ ID NO: 84345 - DNA, 20 bp, Artificial
  CRISPR gRNA sequence
atatagtcatgtgttactta

SEQ ID NO: 84346 - DNA, 20 bp, Artificial
  CRISPR gRNA sequence
cttaatgacggggacatgtt

SEQ ID NO: 84347 - DNA, 20 bp, Artificial
  CRISPR gRNA sequence
aatgacggggacatgttctg

SEQ ID NO: 84348 - DNA, 20 bp, Artificial
  CRISPR gRNA sequence
atgacggggacatgttctga

SEQ ID NO: 84349 - DNA, 20 bp, Artificial
  CRISPR gRNA sequence
tgagaaatgcttacacaaac

SEQ ID NO: 84350 - DNA, 20 bp, Artificial
  CRISPR gRNA sequence
agaaatgcttacacaaacct

SEQ ID NO: 84351 - DNA, 20 bp, Artificial
  CRISPR gRNA sequence
acacaaacctaggtgttgta

SEQ ID NO: 84352 - DNA, 20 bp, Artificial
  CRISPR gRNA sequence
cacaaacctaggtgttgtag

SEQ ID NO: 84353 - DNA, 20 bp, Artificial
  CRISPR gRNA sequence
ggtgttgtagcctactacac

SEQ ID NO: 84354 - DNA, 20 bp, Artificial
  CRISPR gRNA sequence
tagcctactacacgcatagg

SEQ ID NO: 84355 - DNA, 20 bp, Artificial
  CRISPR gRNA sequence
ctacacgcataggctacatg

SEQ ID NO: 84356 - DNA, 20 bp, Artificial
  CRISPR gRNA sequence
cacgcataggctacatggta

SEQ ID NO: 84357 - DNA, 20 bp, Artificial
  CRISPR gRNA sequence
catggtatagcctattgctc

SEQ ID NO: 84358 - DNA, 20 bp, Artificial
  CRISPR gRNA sequence
ttgctcctagactacaaacc

SEQ ID NO: 84359 - DNA, 20 bp, Artificial
  CRISPR gRNA sequence
ctcctagactacaaacctgt

SEQ ID NO: 84360 - DNA, 20 bp, Artificial
  CRISPR gRNA sequence
ctagactacaaacctgtaca

SEQ ID NO: 84361 - DNA, 20 bp, Artificial
  CRISPR gRNA sequence
gactacaaacctgtacagcc

SEQ ID NO: 84362 - DNA, 20 bp, Artificial
  CRISPR gRNA sequence
caaacctgtacagcctgtta

SEQ ID NO: 84363 - DNA, 20 bp, Artificial
  CRISPR gRNA sequence
tacagcctgttactgtactg

SEQ ID NO: 84364 - DNA, 20 bp, Artificial
  CRISPR gRNA sequence
ttactgtactgaatactgtg

SEQ ID NO: 84365 - DNA, 20 bp, Artificial
  CRISPR gRNA sequence
ctgtactgaatactgtgggc

SEQ ID NO: 84366 - DNA, 20 bp, Artificial
  CRISPR gRNA sequence
tactgaatactgtgggcagt

SEQ ID NO: 84367 - DNA, 20 bp, Artificial
  CRISPR gRNA sequence
aatactgtgggcagttgtaa

SEQ ID NO: 84368 - DNA, 20 bp, Artificial
  CRISPR gRNA sequence
tgggcagttgtaacacaatg

SEQ ID NO: 84369 - DNA, 20 bp, Artificial
  CRISPR gRNA sequence
taacacaatggtaagtattt

SEQ ID NO: 84370 - DNA, 20 bp, Artificial
  CRISPR gRNA sequence
gtgtatctaaacatagaagt

SEQ ID NO: 84371 - DNA, 20 bp, Artificial
  CRISPR gRNA sequence
tgtatctaaacatagaagtt

SEQ ID NO: 84372 - DNA, 20 bp, Artificial
  CRISPR gRNA sequence
aacatagaagttgcagtaaa

SEQ ID NO: 84373 - DNA, 20 bp, Artificial
  CRISPR gRNA sequence
cagtaaaaatatgctatttt

SEQ ID NO: 84374 - DNA, 20 bp, Artificial
  CRISPR gRNA sequence
ttttaatcttatgagaccac

SEQ ID NO: 84375 - DNA, 20 bp, Artificial
  CRISPR gRNA sequence
taatcttatgagaccactgt

SEQ ID NO: 84376 - DNA, 20 bp, Artificial
  CRISPR gRNA sequence
aatcttatgagaccactgtc

SEQ ID NO: 84377 - DNA, 20 bp, Artificial
  CRISPR gRNA sequence
atcttatgagaccactgtca

SEQ ID NO: 84378 - DNA, 20 bp, Artificial
  CRISPR gRNA sequence
atgagaccactgtcatatat

SEQ ID NO: 84379 - DNA, 20 bp, Artificial
  CRISPR gRNA sequence
tgagaccactgtcatatata

SEQ ID NO: 84380 - DNA, 20 bp, Artificial
  CRISPR gRNA sequence
tcatatatacagtccatcat

SEQ ID NO: 84381 - DNA, 20 bp, Artificial
  CRISPR gRNA sequence
accaaaacatcatatcagca

SEQ ID NO: 84382 - DNA, 20 bp, Artificial
  CRISPR gRNA sequence
tttcttctaagattttggga

SEQ ID NO: 84383 - DNA, 20 bp, Artificial
  CRISPR gRNA sequence
ttcttctaagattttgggag

SEQ ID NO: 84384 - DNA, 20 bp, Artificial
  CRISPR gRNA sequence
tcttctaagattttgggagc

SEQ ID NO: 84385 - DNA, 20 bp, Artificial
  CRISPR gRNA sequence
cttctaagattttgggagca

SEQ ID NO: 84386 - DNA, 20 bp, Artificial
  CRISPR gRNA sequence
ttctaagattttgggagcac

SEQ ID NO: 84387 - DNA, 20 bp, Artificial
  CRISPR gRNA sequence
ctaagattttgggagcacca

SEQ ID NO: 84388 - DNA, 20 bp, Artificial
  CRISPR gRNA sequence
taagattttgggagcaccaa

SEQ ID NO: 84389 - DNA, 20 bp, Artificial
  CRISPR gRNA sequence
agattttgggagcaccaaag

SEQ ID NO: 84390 - DNA, 20 bp, Artificial
  CRISPR gRNA sequence
tgggagcaccaaagggatac

SEQ ID NO: 84391 - DNA, 20 bp, Artificial
  CRISPR gRNA sequence
gggagcaccaaagggataca

SEQ ID NO: 84392 - DNA, 20 bp, Artificial
  CRISPR gRNA sequence
ggagcaccaaagggatacac

SEQ ID NO: 84393 - DNA, 20 bp, Artificial
  CRISPR gRNA sequence
acaggatatactctttataa

SEQ ID NO: 84394 - DNA, 20 bp, Artificial
  CRISPR gRNA sequence
tttataatgggtttggagaa

SEQ ID NO: 84395 - DNA, 20 bp, Artificial
  CRISPR gRNA sequence
tataatgggtttggagaact

SEQ ID NO: 84396 - DNA, 20 bp, Artificial
  CRISPR gRNA sequence
ataatgggtttggagaactg

SEQ ID NO: 84397 - DNA, 20 bp, Artificial
  CRISPR gRNA sequence
taatgggtttggagaactgt

SEQ ID NO: 84398 - DNA, 20 bp, Artificial
  CRISPR gRNA sequence
ggagaactgtctgcagctac

SEQ ID NO: 84399 - DNA, 20 bp, Artificial
  CRISPR gRNA sequence
gagaactgtctgcagctact

SEQ ID NO: 84400 - DNA, 20 bp, Artificial
  CRISPR gRNA sequence
tctgcagctacttcttttaa

SEQ ID NO: 84401 - DNA, 20 bp, Artificial
  CRISPR gRNA sequence
cagctacttcttttaaaaag

SEQ ID NO: 84402 - DNA, 20 bp, Artificial
  CRISPR gRNA sequence
cttcttttaaaaaggtgatc

SEQ ID NO: 84403 - DNA, 20 bp, Artificial
  CRISPR gRNA sequence
cttttaaaaaggtgatctac

SEQ ID NO: 84404 - DNA, 20 bp, Artificial
  CRISPR gRNA sequence
ttttaaaaaggtgatctaca

SEQ ID NO: 84405 - DNA, 20 bp, Artificial
  CRISPR gRNA sequence
ttaaaaaggtgatctacaca

SEQ ID NO: 84406 - DNA, 20 bp, Artificial
  CRISPR gRNA sequence
taaaaaggtgatctacacag

SEQ ID NO: 84407 - DNA, 20 bp, Artificial
  CRISPR gRNA sequence
aaaaaggtgatctacacagt

SEQ ID NO: 84408 - DNA, 20 bp, Artificial
  CRISPR gRNA sequence
aaaaggtgatctacacagta

SEQ ID NO: 84409 - DNA, 20 bp, Artificial
  CRISPR gRNA sequence
cacagtagaaattagacaag

SEQ ID NO: 84410 - DNA, 20 bp, Artificial
  CRISPR gRNA sequence
gacaagtttggtaatgagat

SEQ ID NO: 84411 - DNA, 20 bp, Artificial
  CRISPR gRNA sequence
ggtaatgagatctgcaatcc

SEQ ID NO: 84412 - DNA, 20 bp, Artificial
  CRISPR gRNA sequence
gtaatgagatctgcaatcca

SEQ ID NO: 84413 - DNA, 20 bp, Artificial
  CRISPR gRNA sequence
caatccaaataaaataaatt

SEQ ID NO: 84414 - DNA, 20 bp, Artificial
  CRISPR gRNA sequence
attgctaacctttttctttt

SEQ ID NO: 84415 - DNA, 20 bp, Artificial
  CRISPR gRNA sequence
ctaacctttttcttttcttt

SEQ ID NO: 84416 - DNA, 20 bp, Artificial
  CRISPR gRNA sequence
acctttttcttttcttttca

SEQ ID NO: 84417 - DNA, 20 bp, Artificial
  CRISPR gRNA sequence
tttcttttcttttcaggttt

SEQ ID NO: 84418 - DNA, 20 bp, Artificial
  CRISPR gRNA sequence
ttcttttcttttcaggtttg

SEQ ID NO: 84419 - DNA, 20 bp, Artificial
  CRISPR gRNA sequence
tcttttcttttcaggtttga

SEQ ID NO: 84420 - DNA, 20 bp, Artificial
  CRISPR gRNA sequence
cttttcttttcaggtttgaa

SEQ ID NO: 84421 - DNA, 20 bp, Artificial
  CRISPR gRNA sequence
ttttcttttcaggtttgaag

SEQ ID NO: 84422 - DNA, 20 bp, Artificial
  CRISPR gRNA sequence
ttcttttcaggtttgaagat

SEQ ID NO: 84423 - DNA, 20 bp, Artificial
  CRISPR gRNA sequence
tcttttcaggtttgaagatg

SEQ ID NO: 84424 - DNA, 20 bp, Artificial
  CRISPR gRNA sequence
cttttcaggtttgaagatgc

SEQ ID NO: 84425 - DNA, 20 bp, Artificial
  CRISPR gRNA sequence
ttttcaggtttgaagatgcc

SEQ ID NO: 84426 - DNA, 20 bp, Artificial
  CRISPR gRNA sequence
ttcaggtttgaagatgccgc

SEQ ID NO: 84427 - DNA, 20 bp, Artificial
  CRISPR gRNA sequence
tcaggtttgaagatgccgca

SEQ ID NO: 84428 - DNA, 20 bp, Artificial
  CRISPR gRNA sequence
caggtttgaagatgccgcat

SEQ ID NO: 84429 - DNA, 20 bp, Artificial
  CRISPR gRNA sequence
aggtttgaagatgccgcatt

SEQ ID NO: 84430 - DNA, 20 bp, Artificial
  CRISPR gRNA sequence
gaagatgccgcatttggatt

SEQ ID NO: 84431 - DNA, 20 bp, Artificial
  CRISPR gRNA sequence
aagatgccgcatttggattg

SEQ ID NO: 84432 - DNA, 20 bp, Artificial
  CRISPR gRNA sequence
ggattggatgaattccaaat

SEQ ID NO: 84433 - DNA, 20 bp, Artificial
  CRISPR gRNA sequence
gattggatgaattccaaatt

SEQ ID NO: 84434 - DNA, 20 bp, Artificial
  CRISPR gRNA sequence
gatgaattccaaattctgct

SEQ ID NO: 84435 - DNA, 20 bp, Artificial
  CRISPR gRNA sequence
caaattctgcttgcttgctt

SEQ ID NO: 84436 - DNA, 20 bp, Artificial
  CRISPR gRNA sequence
tgcttgcttgctttttaata

SEQ ID NO: 84437 - DNA, 20 bp, Artificial
  CRISPR gRNA sequence
cttgcttgctttttaatatt

SEQ ID NO: 84438 - DNA, 20 bp, Artificial
  CRISPR gRNA sequence
gcttgctttttaatattgat

SEQ ID NO: 84439 - DNA, 20 bp, Artificial
  CRISPR gRNA sequence
cttgctttttaatattgata

SEQ ID NO: 84440 - DNA, 20 bp, Artificial
  CRISPR gRNA sequence
gctttttaatattgatatgc

SEQ ID NO: 84441 - DNA, 20 bp, Artificial
  CRISPR gRNA sequence
ctttttaatattgatatgct

SEQ ID NO: 84442 - DNA, 20 bp, Artificial
  CRISPR gRNA sequence
tttaatattgatatgcttat

SEQ ID NO: 84443 - DNA, 20 bp, Artificial
  CRISPR gRNA sequence
ttaatattgatatgcttata

SEQ ID NO: 84444 - DNA, 20 bp, Artificial
  CRISPR gRNA sequence
taatattgatatgcttatac

SEQ ID NO: 84445 - DNA, 20 bp, Artificial
  CRISPR gRNA sequence
aatattgatatgcttataca

SEQ ID NO: 84446 - DNA, 20 bp, Artificial
  CRISPR gRNA sequence
atattgatatgcttatacac

SEQ ID NO: 84447 - DNA, 20 bp, Artificial
  CRISPR gRNA sequence
atatgcttatacacttacac

SEQ ID NO: 84448 - DNA, 20 bp, Artificial
  CRISPR gRNA sequence
atacacttacactttatgca

SEQ ID NO: 84449 - DNA, 20 bp, Artificial
  CRISPR gRNA sequence
tacacttacactttatgcac

SEQ ID NO: 84450 - DNA, 20 bp, Artificial
  CRISPR gRNA sequence
acactttatgcacaaaatgt

SEQ ID NO: 84451 - DNA, 20 bp, Artificial
  CRISPR gRNA sequence
cactttatgcacaaaatgta

SEQ ID NO: 84452 - DNA, 20 bp, Artificial
  CRISPR gRNA sequence
tatgcacaaaatgtagggtt

SEQ ID NO: 84453 - DNA, 20 bp, Artificial
  CRISPR gRNA sequence
atgcacaaaatgtagggtta

SEQ ID NO: 84454 - DNA, 20 bp, Artificial
  CRISPR gRNA sequence
tgcacaaaatgtagggttat

SEQ ID NO: 84455 - DNA, 20 bp, Artificial
  CRISPR gRNA sequence
taataatgttaacatggaca

SEQ ID NO: 84456 - DNA, 20 bp, Artificial
  CRISPR gRNA sequence
acatggacatgatcttcttt

SEQ ID NO: 84457 - DNA, 20 bp, Artificial
  CRISPR gRNA sequence
ctttataattctactttgag

SEQ ID NO: 84458 - DNA, 20 bp, Artificial
  CRISPR gRNA sequence
tttataattctactttgagt

SEQ ID NO: 84459 - DNA, 20 bp, Artificial
  CRISPR gRNA sequence
tataattctactttgagtgc

SEQ ID NO: 84460 - DNA, 20 bp, Artificial
  CRISPR gRNA sequence
ataattctactttgagtgct

SEQ ID NO: 84461 - DNA, 20 bp, Artificial
  CRISPR gRNA sequence
taattctactttgagtgctg

SEQ ID NO: 84462 - DNA, 20 bp, Artificial
  CRISPR gRNA sequence
tactttgagtgctgtctcca

SEQ ID NO: 84463 - DNA, 20 bp, Artificial
  CRISPR gRNA sequence
ctttgagtgctgtctccatg

SEQ ID NO: 84464 - DNA, 20 bp, Artificial
  CRISPR gRNA sequence
tgagtgctgtctccatgttt

SEQ ID NO: 84465 - DNA, 20 bp, Artificial
  CRISPR gRNA sequence
gagtgctgtctccatgtttg

SEQ ID NO: 84466 - DNA, 20 bp, Artificial
  CRISPR gRNA sequence
agtgctgtctccatgtttga

SEQ ID NO: 84467 - DNA, 20 bp, Artificial
  CRISPR gRNA sequence
tctccatgtttgatgtatct

SEQ ID NO: 84468 - DNA, 20 bp, Artificial
  CRISPR gRNA sequence
catgtttgatgtatctgagc

SEQ ID NO: 84469 - DNA, 20 bp, Artificial
  CRISPR gRNA sequence
gatgtatctgagcaggttgc

SEQ ID NO: 84470 - DNA, 20 bp, Artificial
  CRISPR gRNA sequence
atgtatctgagcaggttgct

SEQ ID NO: 84471 - DNA, 20 bp, Artificial
  CRISPR gRNA sequence
agcaggttgctccacaggta

SEQ ID NO: 84472 - DNA, 20 bp, Artificial
  CRISPR gRNA sequence
ctccacaggtagctctagga

SEQ ID NO: 84473 - DNA, 20 bp, Artificial
  CRISPR gRNA sequence
cacaggtagctctaggaggg

SEQ ID NO: 84474 - DNA, 20 bp, Artificial
  CRISPR gRNA sequence
taggagggctggcaacttag

SEQ ID NO: 84475 - DNA, 20 bp, Artificial
  CRISPR gRNA sequence
ggagggctggcaacttagag

SEQ ID NO: 84476 - DNA, 20 bp, Artificial
  CRISPR gRNA sequence
gcaacttagaggtggggagc

SEQ ID NO: 84477 - DNA, 20 bp, Artificial
  CRISPR gRNA sequence
agaggtggggagcagagaat

SEQ ID NO: 84478 - DNA, 20 bp, Artificial
  CRISPR gRNA sequence
gaggtggggagcagagaatt

SEQ ID NO: 84479 - DNA, 20 bp, Artificial
  CRISPR gRNA sequence
tcttatccaacatcaacatc

SEQ ID NO: 84480 - DNA, 20 bp, Artificial
  CRISPR gRNA sequence
ttatccaacatcaacatctt

SEQ ID NO: 84481 - DNA, 20 bp, Artificial
  CRISPR gRNA sequence
atccaacatcaacatcttgg

SEQ ID NO: 84482 - DNA, 20 bp, Artificial
  CRISPR gRNA sequence
tccaacatcaacatcttggt

SEQ ID NO: 84483 - DNA, 20 bp, Artificial
  CRISPR gRNA sequence
ggtcagatttgaactcttca

SEQ ID NO: 84484 - DNA, 20 bp, Artificial
  CRISPR gRNA sequence
gtcagatttgaactcttcaa

SEQ ID NO: 84485 - DNA, 20 bp, Artificial
  CRISPR gRNA sequence
gaactcttcaatctcttgca

SEQ ID NO: 84486 - DNA, 20 bp, Artificial
  CRISPR gRNA sequence
aactcttcaatctcttgcac

SEQ ID NO: 84487 - DNA, 20 bp, Artificial
  CRISPR gRNA sequence
ttcaatctcttgcactcaaa

SEQ ID NO: 84488 - DNA, 20 bp, Artificial
  CRISPR gRNA sequence
caatctcttgcactcaaagc

SEQ ID NO: 84489 - DNA, 20 bp, Artificial
  CRISPR gRNA sequence
aatctcttgcactcaaagct

SEQ ID NO: 84490 - DNA, 20 bp, Artificial
  CRISPR gRNA sequence
ttgcactcaaagcttgttaa

SEQ ID NO: 84491 - DNA, 20 bp, Artificial
  CRISPR gRNA sequence
gcactcaaagcttgttaaga

SEQ ID NO: 84492 - DNA, 20 bp, Artificial
  CRISPR gRNA sequence
cactcaaagcttgttaagat

SEQ ID NO: 84493 - DNA, 20 bp, Artificial
  CRISPR gRNA sequence
aaagcttgttaagatagtta

SEQ ID NO: 84494 - DNA, 20 bp, Artificial
  CRISPR gRNA sequence
gttaagatagttaagcgtgc

SEQ ID NO: 84495 - DNA, 20 bp, Artificial
  CRISPR gRNA sequence
ttaagatagttaagcgtgca

SEQ ID NO: 84496 - DNA, 20 bp, Artificial
  CRISPR gRNA sequence
agatagttaagcgtgcataa

SEQ ID NO: 84497 - DNA, 20 bp, Artificial
  CRISPR gRNA sequence
agcgtgcataagttaacttc

SEQ ID NO: 84498 - DNA, 20 bp, Artificial
  CRISPR gRNA sequence
acttccaatttacatactct

SEQ ID NO: 84499 - DNA, 20 bp, Artificial
  CRISPR gRNA sequence
ccaatttacatactctgctt

SEQ ID NO: 84500 - DNA, 20 bp, Artificial
  CRISPR gRNA sequence
caatttacatactctgctta

SEQ ID NO: 84501 - DNA, 20 bp, Artificial
  CRISPR gRNA sequence
acatactctgcttagaattt

SEQ ID NO: 84502 - DNA, 20 bp, Artificial
  CRISPR gRNA sequence
catactctgcttagaatttg

SEQ ID NO: 84503 - DNA, 20 bp, Artificial
  CRISPR gRNA sequence
tgcttagaatttgggggaaa

SEQ ID NO: 84504 - DNA, 20 bp, Artificial
  CRISPR gRNA sequence
cttagaatttgggggaaaat

SEQ ID NO: 84505 - DNA, 20 bp, Artificial
  CRISPR gRNA sequence
agaatttgggggaaaattta

SEQ ID NO: 84506 - DNA, 20 bp, Artificial
  CRISPR gRNA sequence
gaatttgggggaaaatttag

SEQ ID NO: 84507 - DNA, 20 bp, Artificial
  CRISPR gRNA sequence
gggggaaaatttagaaatat

SEQ ID NO: 84508 - DNA, 20 bp, Artificial
  CRISPR gRNA sequence
ggggaaaatttagaaatata

SEQ ID NO: 84509 - DNA, 20 bp, Artificial
  CRISPR gRNA sequence
agaaatataattgacaggat

SEQ ID NO: 84510 - DNA, 20 bp, Artificial
  CRISPR gRNA sequence
gaaatataattgacaggatt

SEQ ID NO: 84511 - DNA, 20 bp, Artificial
  CRISPR gRNA sequence
acaggattattggaaatttg

SEQ ID NO: 84512 - DNA, 20 bp, Artificial
  CRISPR gRNA sequence
ttggaaatttgttataatga

SEQ ID NO: 84513 - DNA, 20 bp, Artificial
  CRISPR gRNA sequence
gaaatttgttataatgaatg

SEQ ID NO: 84514 - DNA, 20 bp, Artificial
  CRISPR gRNA sequence
gttataatgaatgaaacatt

SEQ ID NO: 84515 - DNA, 20 bp, Artificial
  CRISPR gRNA sequence
ttataatgaatgaaacattt

SEQ ID NO: 84516 - DNA, 20 bp, Artificial
  CRISPR gRNA sequence
taatgaatgaaacattttgt

SEQ ID NO: 84517 - DNA, 20 bp, Artificial
  CRISPR gRNA sequence
tgtcatataagattcatatt

SEQ ID NO: 84518 - DNA, 20 bp, Artificial
  CRISPR gRNA sequence
gtcatataagattcatattt

SEQ ID NO: 84519 - DNA, 20 bp, Artificial
  CRISPR gRNA sequence
tcatataagattcatattta

SEQ ID NO: 84520 - DNA, 20 bp, Artificial
  CRISPR gRNA sequence
atatttacttcttatacatt

SEQ ID NO: 84521 - DNA, 20 bp, Artificial
  CRISPR gRNA sequence
acttcttatacatttgataa

SEQ ID NO: 84522 - DNA, 20 bp, Artificial
  CRISPR gRNA sequence
cttcttatacatttgataaa

SEQ ID NO: 84523 - DNA, 20 bp, Artificial
  CRISPR gRNA sequence
cttatacatttgataaagta

SEQ ID NO: 84524 - DNA, 20 bp, Artificial
  CRISPR gRNA sequence
ttatacatttgataaagtaa

SEQ ID NO: 84525 - DNA, 20 bp, Artificial
  CRISPR gRNA sequence
atacatttgataaagtaagg

SEQ ID NO: 84526 - DNA, 20 bp, Artificial
  CRISPR gRNA sequence
tacatttgataaagtaaggc

SEQ ID NO: 84527 - DNA, 20 bp, Artificial
  CRISPR gRNA sequence
gataaagtaaggcatggttg

SEQ ID NO: 84528 - DNA, 20 bp, Artificial
  CRISPR gRNA sequence
ataaagtaaggcatggttgt

SEQ ID NO: 84529 - DNA, 20 bp, Artificial
  CRISPR gRNA sequence
tggttaatctggtttatttt

SEQ ID NO: 84530 - DNA, 20 bp, Artificial
  CRISPR gRNA sequence
atctggtttatttttgttcc

SEQ ID NO: 84531 - DNA, 20 bp, Artificial
  CRISPR gRNA sequence
gtttatttttgttccacaag

SEQ ID NO: 84532 - DNA, 20 bp, Artificial
  CRISPR gRNA sequence
atttttgttccacaagttaa

SEQ ID NO: 84533 - DNA, 20 bp, Artificial
  CRISPR gRNA sequence
tttttgttccacaagttaaa

SEQ ID NO: 84534 - DNA, 20 bp, Artificial
  CRISPR gRNA sequence
ttgttccacaagttaaataa

SEQ ID NO: 84535 - DNA, 20 bp, Artificial
  CRISPR gRNA sequence
tgttccacaagttaaataaa

SEQ ID NO: 84536 - DNA, 20 bp, Artificial
  CRISPR gRNA sequence
gttccacaagttaaataaat

SEQ ID NO: 84537 - DNA, 20 bp, Artificial
  CRISPR gRNA sequence
ttccacaagttaaataaatc

SEQ ID NO: 84538 - DNA, 20 bp, Artificial
  CRISPR gRNA sequence
cacaagttaaataaatcata

SEQ ID NO: 84539 - DNA, 20 bp, Artificial
  CRISPR gRNA sequence
aataaatcataaaacttgat

SEQ ID NO: 84540 - DNA, 20 bp, Artificial
  CRISPR gRNA sequence
gatgtgttatctcttatatc

SEQ ID NO: 84541 - DNA, 20 bp, Artificial
  CRISPR gRNA sequence
atgtgttatctcttatatct

SEQ ID NO: 84542 - DNA, 20 bp, Artificial
  CRISPR gRNA sequence
tctcttatatctcactccca

SEQ ID NO: 84543 - DNA, 20 bp, Artificial
  CRISPR gRNA sequence
ttatatctcactcccactat

SEQ ID NO: 84544 - DNA, 20 bp, Artificial
  CRISPR gRNA sequence
atatctcactcccactatta

SEQ ID NO: 84545 - DNA, 20 bp, Artificial
  CRISPR gRNA sequence
tatctcactcccactattac

SEQ ID NO: 84546 - DNA, 20 bp, Artificial
  CRISPR gRNA sequence
actcccactattaccccttt

SEQ ID NO: 84547 - DNA, 20 bp, Artificial
  CRISPR gRNA sequence
ccactattacccctttattt

SEQ ID NO: 84548 - DNA, 20 bp, Artificial
  CRISPR gRNA sequence
ttacccctttattttcaaac

SEQ ID NO: 84549 - DNA, 20 bp, Artificial
  CRISPR gRNA sequence
cccctttattttcaaacagg

SEQ ID NO: 84550 - DNA, 20 bp, Artificial
  CRISPR gRNA sequence
tattttcaaacagggaaaca

SEQ ID NO: 84551 - DNA, 20 bp, Artificial
  CRISPR gRNA sequence
attttcaaacagggaaacag

SEQ ID NO: 84552 - DNA, 20 bp, Artificial
  CRISPR gRNA sequence
ttttcaaacagggaaacagt

SEQ ID NO: 84553 - DNA, 20 bp, Artificial
  CRISPR gRNA sequence
tcaaacagggaaacagtctt

SEQ ID NO: 84554 - DNA, 20 bp, Artificial
  CRISPR gRNA sequence
caaacagggaaacagtcttc

SEQ ID NO: 84555 - DNA, 20 bp, Artificial
  CRISPR gRNA sequence
aaacagggaaacagtcttca

SEQ ID NO: 84556 - DNA, 20 bp, Artificial
  CRISPR gRNA sequence
caagttccacttggtaaaaa

SEQ ID NO: 84557 - DNA, 20 bp, Artificial
  CRISPR gRNA sequence
aagttccacttggtaaaaaa

SEQ ID NO: 84558 - DNA, 20 bp, Artificial
  CRISPR gRNA sequence
cacttggtaaaaaatgtgaa

SEQ ID NO: 84559 - DNA, 20 bp, Artificial
  CRISPR gRNA sequence
ggtaaaaaatgtgaacccct

SEQ ID NO: 84560 - DNA, 20 bp, Artificial
  CRISPR gRNA sequence
gtaaaaaatgtgaacccctt

SEQ ID NO: 84561 - DNA, 20 bp, Artificial
  CRISPR gRNA sequence
tatatacaaggggttcacat

SEQ ID NO: 84562 - DNA, 20 bp, Artificial
  CRISPR gRNA sequence
tatacaaggggttcacattt

SEQ ID NO: 84563 - DNA, 20 bp, Artificial
  CRISPR gRNA sequence
acattttttaccaagtggaa

SEQ ID NO: 84564 - DNA, 20 bp, Artificial
  CRISPR gRNA sequence
tttaccaagtggaacttgaa

SEQ ID NO: 84565 - DNA, 20 bp, Artificial
  CRISPR gRNA sequence
ttaccaagtggaacttgaag

SEQ ID NO: 84566 - DNA, 20 bp, Artificial
  CRISPR gRNA sequence
taccaagtggaacttgaaga

SEQ ID NO: 84567 - DNA, 20 bp, Artificial
  CRISPR gRNA sequence
accaagtggaacttgaagac

SEQ ID NO: 84568 - DNA, 20 bp, Artificial
  CRISPR gRNA sequence
ccaagtggaacttgaagact

SEQ ID NO: 84569 - DNA, 20 bp, Artificial
  CRISPR gRNA sequence
gaagactgtttccctgtttg

SEQ ID NO: 84570 - DNA, 20 bp, Artificial
  CRISPR gRNA sequence
aagactgtttccctgtttga

SEQ ID NO: 84571 - DNA, 20 bp, Artificial
  CRISPR gRNA sequence
tttccctgtttgaaaataaa

SEQ ID NO: 84572 - DNA, 20 bp, Artificial
  CRISPR gRNA sequence
ccctgtttgaaaataaaggg

SEQ ID NO: 84573 - DNA, 20 bp, Artificial
  CRISPR gRNA sequence
cctgtttgaaaataaagggg

SEQ ID NO: 84574 - DNA, 20 bp, Artificial
  CRISPR gRNA sequence
tttgaaaataaaggggtaat

SEQ ID NO: 84575 - DNA, 20 bp, Artificial
  CRISPR gRNA sequence
gaaaataaaggggtaatagt

SEQ ID NO: 84576 - DNA, 20 bp, Artificial
  CRISPR gRNA sequence
aaaataaaggggtaatagtg

SEQ ID NO: 84577 - DNA, 20 bp, Artificial
  CRISPR gRNA sequence
tatgatttatttaacttgtg

SEQ ID NO: 84578 - DNA, 20 bp, Artificial
  CRISPR gRNA sequence
atgatttatttaacttgtgg

SEQ ID NO: 84579 - DNA, 20 bp, Artificial
  CRISPR gRNA sequence
tgatttatttaacttgtgga

SEQ ID NO: 84580 - DNA, 20 bp, Artificial
  CRISPR gRNA sequence
atttaacttgtggaacaaaa

SEQ ID NO: 84581 - DNA, 20 bp, Artificial
  CRISPR gRNA sequence
tttaacttgtggaacaaaaa

SEQ ID NO: 84582 - DNA, 20 bp, Artificial
  CRISPR gRNA sequence
aacttgtggaacaaaaataa

SEQ ID NO: 84583 - DNA, 20 bp, Artificial
  CRISPR gRNA sequence
acttgtggaacaaaaataaa

SEQ ID NO: 84584 - DNA, 20 bp, Artificial
  CRISPR gRNA sequence
gtggaacaaaaataaaccag

SEQ ID NO: 84585 - DNA, 20 bp, Artificial
  CRISPR gRNA sequence
tggaacaaaaataaaccaga

SEQ ID NO: 84586 - DNA, 20 bp, Artificial
  CRISPR gRNA sequence
accacaaccatgccttactt

SEQ ID NO: 84587 - DNA, 20 bp, Artificial
  CRISPR gRNA sequence
actttatcaaatgtataaga

SEQ ID NO: 84588 - DNA, 20 bp, Artificial
  CRISPR gRNA sequence
ctttatcaaatgtataagaa

SEQ ID NO: 84589 - DNA, 20 bp, Artificial
  CRISPR gRNA sequence
tatcaaatgtataagaagta

SEQ ID NO: 84590 - DNA, 20 bp, Artificial
  CRISPR gRNA sequence
atcaaatgtataagaagtaa

SEQ ID NO: 84591 - DNA, 20 bp, Artificial
  CRISPR gRNA sequence
tcaaatgtataagaagtaaa

SEQ ID NO: 84592 - DNA, 20 bp, Artificial
  CRISPR gRNA sequence
atatgacaaaatgtttcatt

SEQ ID NO: 84593 - DNA, 20 bp, Artificial
  CRISPR gRNA sequence
tatgacaaaatgtttcattc

SEQ ID NO: 84594 - DNA, 20 bp, Artificial
  CRISPR gRNA sequence
cattcattataacaaatttc

SEQ ID NO: 84595 - DNA, 20 bp, Artificial
  CRISPR gRNA sequence
attcattataacaaatttcc

SEQ ID NO: 84596 - DNA, 20 bp, Artificial
  CRISPR gRNA sequence
attataacaaatttccaata

SEQ ID NO: 84597 - DNA, 20 bp, Artificial
  CRISPR gRNA sequence
taacaaatttccaataatcc

SEQ ID NO: 84598 - DNA, 20 bp, Artificial
  CRISPR gRNA sequence
ccaataatcctgtcaattat

SEQ ID NO: 84599 - DNA, 20 bp, Artificial
  CRISPR gRNA sequence
caataatcctgtcaattata

SEQ ID NO: 84600 - DNA, 20 bp, Artificial
  CRISPR gRNA sequence
tcaattatatttctaaattt

SEQ ID NO: 84601 - DNA, 20 bp, Artificial
  CRISPR gRNA sequence
tatttctaaattttccccca

SEQ ID NO: 84602 - DNA, 20 bp, Artificial
  CRISPR gRNA sequence
ctaaattttcccccaaattc

SEQ ID NO: 84603 - DNA, 20 bp, Artificial
  CRISPR gRNA sequence
taaattttcccccaaattct

SEQ ID NO: 84604 - DNA, 20 bp, Artificial
  CRISPR gRNA sequence
aattttcccccaaattctaa

SEQ ID NO: 84605 - DNA, 20 bp, Artificial
  CRISPR gRNA sequence
tcccccaaattctaagcaga

SEQ ID NO: 84606 - DNA, 20 bp, Artificial
  CRISPR gRNA sequence
cccccaaattctaagcagag

SEQ ID NO: 84607 - DNA, 20 bp, Artificial
  CRISPR gRNA sequence
ccccaaattctaagcagagt

SEQ ID NO: 84608 - DNA, 20 bp, Artificial
  CRISPR gRNA sequence
taagcagagtatgtaaattg

SEQ ID NO: 84609 - DNA, 20 bp, Artificial
  CRISPR gRNA sequence
agcagagtatgtaaattgga

SEQ ID NO: 84610 - DNA, 20 bp, Artificial
  CRISPR gRNA sequence
gaagttaacttatgcacgct

SEQ ID NO: 84611 - DNA, 20 bp, Artificial
  CRISPR gRNA sequence
acttatgcacgcttaactat

SEQ ID NO: 84612 - DNA, 20 bp, Artificial
  CRISPR gRNA sequence
atgcacgcttaactatctta

SEQ ID NO: 84613 - DNA, 20 bp, Artificial
  CRISPR gRNA sequence
tgcacgcttaactatcttaa

SEQ ID NO: 84614 - DNA, 20 bp, Artificial
  CRISPR gRNA sequence
aactatcttaacaagctttg

SEQ ID NO: 84615 - DNA, 20 bp, Artificial
  CRISPR gRNA sequence
actatcttaacaagctttga

SEQ ID NO: 84616 - DNA, 20 bp, Artificial
  CRISPR gRNA sequence
tcttaacaagctttgagtgc

SEQ ID NO: 84617 - DNA, 20 bp, Artificial
  CRISPR gRNA sequence
aacaagctttgagtgcaaga

SEQ ID NO: 84618 - DNA, 20 bp, Artificial
  CRISPR gRNA sequence
acaagctttgagtgcaagag

SEQ ID NO: 84619 - DNA, 20 bp, Artificial
  CRISPR gRNA sequence
tgagtgcaagagattgaaga

SEQ ID NO: 84620 - DNA, 20 bp, Artificial
  CRISPR gRNA sequence
gagtgcaagagattgaagag

SEQ ID NO: 84621 - DNA, 20 bp, Artificial
  CRISPR gRNA sequence
agtgcaagagattgaagagt

SEQ ID NO: 84622 - DNA, 20 bp, Artificial
  CRISPR gRNA sequence
aagagttcaaatctgaccaa

SEQ ID NO: 84623 - DNA, 20 bp, Artificial
  CRISPR gRNA sequence
aaatctgaccaagatgttga

SEQ ID NO: 84624 - DNA, 20 bp, Artificial
  CRISPR gRNA sequence
accaagatgttgatgttgga

SEQ ID NO: 84625 - DNA, 20 bp, Artificial
  CRISPR gRNA sequence
atgttggataagagaattct

SEQ ID NO: 84626 - DNA, 20 bp, Artificial
  CRISPR gRNA sequence
gataagagaattctctgctc

SEQ ID NO: 84627 - DNA, 20 bp, Artificial
  CRISPR gRNA sequence
tctgctccccacctctaagt

SEQ ID NO: 84628 - DNA, 20 bp, Artificial
  CRISPR gRNA sequence
tgctccccacctctaagttg

SEQ ID NO: 84629 - DNA, 20 bp, Artificial
  CRISPR gRNA sequence
ctccccacctctaagttgcc

SEQ ID NO: 84630 - DNA, 20 bp, Artificial
  CRISPR gRNA sequence
cccacctctaagttgccagc

SEQ ID NO: 84631 - DNA, 20 bp, Artificial
  CRISPR gRNA sequence
taagttgccagccctcctag

SEQ ID NO: 84632 - DNA, 20 bp, Artificial
  CRISPR gRNA sequence
agttgccagccctcctagag

SEQ ID NO: 84633 - DNA, 20 bp, Artificial
  CRISPR gRNA sequence
ccagccctcctagagctacc

SEQ ID NO: 84634 - DNA, 20 bp, Artificial
  CRISPR gRNA sequence
ctagagctacctgtggagca

SEQ ID NO: 84635 - DNA, 20 bp, Artificial
  CRISPR gRNA sequence
gagctacctgtggagcaacc

SEQ ID NO: 84636 - DNA, 20 bp, Artificial
  CRISPR gRNA sequence
cctgtggagcaacctgctca

SEQ ID NO: 84637 - DNA, 20 bp, Artificial
  CRISPR gRNA sequence
tggagcaacctgctcagata

SEQ ID NO: 84638 - DNA, 20 bp, Artificial
  CRISPR gRNA sequence
ctcagatacatcaaacatgg

SEQ ID NO: 84639 - DNA, 20 bp, Artificial
  CRISPR gRNA sequence
agatacatcaaacatggaga

SEQ ID NO: 84640 - DNA, 20 bp, Artificial
  CRISPR gRNA sequence
aaagtagaattataaagaag

SEQ ID NO: 84641 - DNA, 20 bp, Artificial
  CRISPR gRNA sequence
taaagaagatcatgtccatg

SEQ ID NO: 84642 - DNA, 20 bp, Artificial
  CRISPR gRNA sequence
acattattataaccctacat

SEQ ID NO: 84643 - DNA, 20 bp, Artificial
  CRISPR gRNA sequence
ttataaccctacattttgtg

SEQ ID NO: 84644 - DNA, 20 bp, Artificial
  CRISPR gRNA sequence
taaccctacattttgtgcat

SEQ ID NO: 84645 - DNA, 20 bp, Artificial
  CRISPR gRNA sequence
cattttgtgcataaagtgta

SEQ ID NO: 84646 - DNA, 20 bp, Artificial
  CRISPR gRNA sequence
tgtgcataaagtgtaagtgt

SEQ ID NO: 84647 - DNA, 20 bp, Artificial
  CRISPR gRNA sequence
gtgcataaagtgtaagtgta

SEQ ID NO: 84648 - DNA, 20 bp, Artificial
  CRISPR gRNA sequence
tgcataaagtgtaagtgtat

SEQ ID NO: 84649 - DNA, 20 bp, Artificial
  CRISPR gRNA sequence
aaaagcaagcaagcagaatt

SEQ ID NO: 84650 - DNA, 20 bp, Artificial
  CRISPR gRNA sequence
ggaattcatccaatccaaat

SEQ ID NO: 84651 - DNA, 20 bp, Artificial
  CRISPR gRNA sequence
gaattcatccaatccaaatg

SEQ ID NO: 84652 - DNA, 20 bp, Artificial
  CRISPR gRNA sequence
atccaatccaaatgcggcat

SEQ ID NO: 84653 - DNA, 20 bp, Artificial
  CRISPR gRNA sequence
caaacctgaaaagaaaagaa

SEQ ID NO: 84654 - DNA, 20 bp, Artificial
  CRISPR gRNA sequence
aaacctgaaaagaaaagaaa

SEQ ID NO: 84655 - DNA, 20 bp, Artificial
  CRISPR gRNA sequence
aaaagaaaagaaaaaggtta

SEQ ID NO: 84656 - DNA, 20 bp, Artificial
  CRISPR gRNA sequence
gcaatgaatttattttattt

SEQ ID NO: 84657 - DNA, 20 bp, Artificial
  CRISPR gRNA sequence
attttatttggattgcagat

SEQ ID NO: 84658 - DNA, 20 bp, Artificial
  CRISPR gRNA sequence
ttttatttggattgcagatc

SEQ ID NO: 84659 - DNA, 20 bp, Artificial
  CRISPR gRNA sequence
tatttggattgcagatctca

SEQ ID NO: 84660 - DNA, 20 bp, Artificial
  CRISPR gRNA sequence
atttggattgcagatctcat

SEQ ID NO: 84661 - DNA, 20 bp, Artificial
  CRISPR gRNA sequence
tttggattgcagatctcatt

SEQ ID NO: 84662 - DNA, 20 bp, Artificial
  CRISPR gRNA sequence
ggattgcagatctcattacc

SEQ ID NO: 84663 - DNA, 20 bp, Artificial
  CRISPR gRNA sequence
gattgcagatctcattacca

SEQ ID NO: 84664 - DNA, 20 bp, Artificial
  CRISPR gRNA sequence
cagatctcattaccaaactt

SEQ ID NO: 84665 - DNA, 20 bp, Artificial
  CRISPR gRNA sequence
attaccaaacttgtctaatt

SEQ ID NO: 84666 - DNA, 20 bp, Artificial
  CRISPR gRNA sequence
ccaaacttgtctaatttcta

SEQ ID NO: 84667 - DNA, 20 bp, Artificial
  CRISPR gRNA sequence
gtctaatttctactgtgtag

SEQ ID NO: 84668 - DNA, 20 bp, Artificial
  CRISPR gRNA sequence
tctaatttctactgtgtaga

SEQ ID NO: 84669 - DNA, 20 bp, Artificial
  CRISPR gRNA sequence
atttctactgtgtagatcac

SEQ ID NO: 84670 - DNA, 20 bp, Artificial
  CRISPR gRNA sequence
ctactgtgtagatcaccttt

SEQ ID NO: 84671 - DNA, 20 bp, Artificial
  CRISPR gRNA sequence
tactgtgtagatcacctttt

SEQ ID NO: 84672 - DNA, 20 bp, Artificial
  CRISPR gRNA sequence
ctgtgtagatcaccttttta

SEQ ID NO: 84673 - DNA, 20 bp, Artificial
  CRISPR gRNA sequence
tgtagatcacctttttaaaa

SEQ ID NO: 84674 - DNA, 20 bp, Artificial
  CRISPR gRNA sequence
tttaaaagaagtagctgcag

SEQ ID NO: 84675 - DNA, 20 bp, Artificial
  CRISPR gRNA sequence
ttaaaagaagtagctgcaga

SEQ ID NO: 84676 - DNA, 20 bp, Artificial
  CRISPR gRNA sequence
taaaagaagtagctgcagac

SEQ ID NO: 84677 - DNA, 20 bp, Artificial
  CRISPR gRNA sequence
aaaagaagtagctgcagaca

SEQ ID NO: 84678 - DNA, 20 bp, Artificial
  CRISPR gRNA sequence
aaagaagtagctgcagacag

SEQ ID NO: 84679 - DNA, 20 bp, Artificial
  CRISPR gRNA sequence
cagacagttctccaaaccca

SEQ ID NO: 84680 - DNA, 20 bp, Artificial
  CRISPR gRNA sequence
tccaaacccattataaagag

SEQ ID NO: 84681 - DNA, 20 bp, Artificial
  CRISPR gRNA sequence
caaacccattataaagagta

SEQ ID NO: 84682 - DNA, 20 bp, Artificial
  CRISPR gRNA sequence
taaagagtatatcctgttag

SEQ ID NO: 84683 - DNA, 20 bp, Artificial
  CRISPR gRNA sequence
ttagtgtatccctttggtgc

SEQ ID NO: 84684 - DNA, 20 bp, Artificial
  CRISPR gRNA sequence
gtgtatccctttggtgctcc

SEQ ID NO: 84685 - DNA, 20 bp, Artificial
  CRISPR gRNA sequence
tggtgctcccaaaatcttag

SEQ ID NO: 84686 - DNA, 20 bp, Artificial
  CRISPR gRNA sequence
ggtgctcccaaaatcttaga

SEQ ID NO: 84687 - DNA, 20 bp, Artificial
  CRISPR gRNA sequence
gtgctcccaaaatcttagaa

SEQ ID NO: 84688 - DNA, 20 bp, Artificial
  CRISPR gRNA sequence
ccaaaatcttagaagaaaaa

SEQ ID NO: 84689 - DNA, 20 bp, Artificial
  CRISPR gRNA sequence
agaagaaaaaatgctgatat

SEQ ID NO: 84690 - DNA, 20 bp, Artificial
  CRISPR gRNA sequence
gaagaaaaaatgctgatatg

SEQ ID NO: 84691 - DNA, 20 bp, Artificial
  CRISPR gRNA sequence
atatgatgttttggtcaatg

SEQ ID NO: 84692 - DNA, 20 bp, Artificial
  CRISPR gRNA sequence
tggtcaatgatggactgtat

SEQ ID NO: 84693 - DNA, 20 bp, Artificial
  CRISPR gRNA sequence
ggtcaatgatggactgtata

SEQ ID NO: 84694 - DNA, 20 bp, Artificial
  CRISPR gRNA sequence
gtcaatgatggactgtatat

SEQ ID NO: 84695 - DNA, 20 bp, Artificial
  CRISPR gRNA sequence
tatatatgacagtggtctca

SEQ ID NO: 84696 - DNA, 20 bp, Artificial
  CRISPR gRNA sequence
ataagattaaaatagcatat

SEQ ID NO: 84697 - DNA, 20 bp, Artificial
  CRISPR gRNA sequence
aaatagcatatttttactgc

SEQ ID NO: 84698 - DNA, 20 bp, Artificial
  CRISPR gRNA sequence
ttactgcaacttctatgttt

SEQ ID NO: 84699 - DNA, 20 bp, Artificial
  CRISPR gRNA sequence
tactgcaacttctatgttta

SEQ ID NO: 84700 - DNA, 20 bp, Artificial
  CRISPR gRNA sequence
actgcaacttctatgtttag

SEQ ID NO: 84701 - DNA, 20 bp, Artificial
  CRISPR gRNA sequence
ctgcaacttctatgtttaga

SEQ ID NO: 84702 - DNA, 20 bp, Artificial
  CRISPR gRNA sequence
caacttctatgtttagatac

SEQ ID NO: 84703 - DNA, 20 bp, Artificial
  CRISPR gRNA sequence
ctatgtttagatacacaaat

SEQ ID NO: 84704 - DNA, 20 bp, Artificial
  CRISPR gRNA sequence
tatgtttagatacacaaata

SEQ ID NO: 84705 - DNA, 20 bp, Artificial
  CRISPR gRNA sequence
tgtttagatacacaaatact

SEQ ID NO: 84706 - DNA, 20 bp, Artificial
  CRISPR gRNA sequence
agatacacaaatacttacca

SEQ ID NO: 84707 - DNA, 20 bp, Artificial
  CRISPR gRNA sequence
gatacacaaatacttaccat

SEQ ID NO: 84708 - DNA, 20 bp, Artificial
  CRISPR gRNA sequence
accattgtgttacaactgcc

SEQ ID NO: 84709 - DNA, 20 bp, Artificial
  CRISPR gRNA sequence
ccattgtgttacaactgccc

SEQ ID NO: 84710 - DNA, 20 bp, Artificial
  CRISPR gRNA sequence
tgttacaactgcccacagta

SEQ ID NO: 84711 - DNA, 20 bp, Artificial
  CRISPR gRNA sequence
caactgcccacagtattcag

SEQ ID NO: 84712 - DNA, 20 bp, Artificial
  CRISPR gRNA sequence
cccacagtattcagtacagt

SEQ ID NO: 84713 - DNA, 20 bp, Artificial
  CRISPR gRNA sequence
agtacagtaacaggctgtac

SEQ ID NO: 84714 - DNA, 20 bp, Artificial
  CRISPR gRNA sequence
tacaggtttgtagtctagga

SEQ ID NO: 84715 - DNA, 20 bp, Artificial
  CRISPR gRNA sequence
gtagtctaggagcaataggc

SEQ ID NO: 84716 - DNA, 20 bp, Artificial
  CRISPR gRNA sequence
tagtctaggagcaataggct

SEQ ID NO: 84717 - DNA, 20 bp, Artificial
  CRISPR gRNA sequence
ggagcaataggctataccat

SEQ ID NO: 84718 - DNA, 20 bp, Artificial
  CRISPR gRNA sequence
taccatgtagcctatgcgtg

SEQ ID NO: 84719 - DNA, 20 bp, Artificial
  CRISPR gRNA sequence
tgcgtgtagtaggctacaac

SEQ ID NO: 84720 - DNA, 20 bp, Artificial
  CRISPR gRNA sequence
caacacctaggtttgtgtaa

SEQ ID NO: 84721 - DNA, 20 bp, Artificial
  CRISPR gRNA sequence
ggtttgtgtaagcatttctc

SEQ ID NO: 84722 - DNA, 20 bp, Artificial
  CRISPR gRNA sequence
gtgtaagcatttctcagaac

SEQ ID NO: 84723 - DNA, 20 bp, Artificial
  CRISPR gRNA sequence
tgtaagcatttctcagaaca

SEQ ID NO: 84724 - DNA, 20 bp, Artificial
  CRISPR gRNA sequence
ctcagaacatgtccccgtca

SEQ ID NO: 84725 - DNA, 20 bp, Artificial
  CRISPR gRNA sequence
tcagaacatgtccccgtcat

SEQ ID NO: 84726 - DNA, 20 bp, Artificial
  CRISPR gRNA sequence
agaacatgtccccgtcatta

SEQ ID NO: 84727 - DNA, 20 bp, Artificial
  CRISPR gRNA sequence
agtaacacatgactatatta

SEQ ID NO: 84728 - DNA, 20 bp, Artificial
  CRISPR gRNA sequence
tattagagttcaggtcctgg

SEQ ID NO: 84729 - DNA, 20 bp, Artificial
  CRISPR gRNA sequence
gagttcaggtcctggctcta

SEQ ID NO: 84730 - DNA, 20 bp, Artificial
  CRISPR gRNA sequence
aggtcctggctctacaattt

SEQ ID NO: 84731 - DNA, 20 bp, Artificial
  CRISPR gRNA sequence
gctctacaatttactaacag

SEQ ID NO: 84732 - DNA, 20 bp, Artificial
  CRISPR gRNA sequence
tacaatttactaacagtgtg

SEQ ID NO: 84733 - DNA, 20 bp, Artificial
  CRISPR gRNA sequence
caatttactaacagtgtgac

SEQ ID NO: 84734 - DNA, 20 bp, Artificial
  CRISPR gRNA sequence
actaacagtgtgactgggca

SEQ ID NO: 84735 - DNA, 20 bp, Artificial
  CRISPR gRNA sequence
ctaacagtgtgactgggcag

SEQ ID NO: 84736 - DNA, 20 bp, Artificial
  CRISPR gRNA sequence
acagtgtgactgggcagatc

SEQ ID NO: 84737 - DNA, 20 bp, Artificial
  CRISPR gRNA sequence
ggcagatcatccaccttcct

SEQ ID NO: 84738 - DNA, 20 bp, Artificial
  CRISPR gRNA sequence
cctgatgctctcccaaatca

SEQ ID NO: 84739 - DNA, 20 bp, Artificial
  CRISPR gRNA sequence
ctgatgctctcccaaatcaa

SEQ ID NO: 84740 - DNA, 20 bp, Artificial
  CRISPR gRNA sequence
atgctctcccaaatcaattc

SEQ ID NO: 84741 - DNA, 20 bp, Artificial
  CRISPR gRNA sequence
tcccaaatcaattccctgtt

SEQ ID NO: 84742 - DNA, 20 bp, Artificial
  CRISPR gRNA sequence
ccaaatcaattccctgttct

SEQ ID NO: 84743 - DNA, 20 bp, Artificial
  CRISPR gRNA sequence
cctgttctagaatataacag

SEQ ID NO: 84744 - DNA, 20 bp, Artificial
  CRISPR gRNA sequence
ttctagaatataacaggaga

SEQ ID NO: 84745 - DNA, 20 bp, Artificial
  CRISPR gRNA sequence
tagaatataacaggagattt

SEQ ID NO: 84746 - DNA, 20 bp, Artificial
  CRISPR gRNA sequence
gaatataacaggagatttga

SEQ ID NO: 84747 - DNA, 20 bp, Artificial
  CRISPR gRNA sequence
gaatggggtttcagcatcaa

SEQ ID NO: 84748 - DNA, 20 bp, Artificial
  CRISPR gRNA sequence
aatggggtttcagcatcaat

SEQ ID NO: 84749 - DNA, 20 bp, Artificial
  CRISPR gRNA sequence
cagcatcaatgtaccctggg

SEQ ID NO: 84750 - DNA, 20 bp, Artificial
  CRISPR gRNA sequence
agcatcaatgtaccctgggc

SEQ ID NO: 84751 - DNA, 20 bp, Artificial
  CRISPR gRNA sequence
ggcagtagaatttcattgaa

SEQ ID NO: 84752 - DNA, 20 bp, Artificial
  CRISPR gRNA sequence
cattgaaaagcctttggact

SEQ ID NO: 84753 - DNA, 20 bp, Artificial
  CRISPR gRNA sequence
attgaaaagcctttggactc

SEQ ID NO: 84754 - DNA, 20 bp, Artificial
  CRISPR gRNA sequence
aaaagcctttggactccaac

SEQ ID NO: 84755 - DNA, 20 bp, Artificial
  CRISPR gRNA sequence
tggactccaactaaagatgc

SEQ ID NO: 84756 - DNA, 20 bp, Artificial
  CRISPR gRNA sequence
ggactccaactaaagatgca

SEQ ID NO: 84757 - DNA, 20 bp, Artificial
  CRISPR gRNA sequence
gactccaactaaagatgcag

SEQ ID NO: 84758 - DNA, 20 bp, Artificial
  CRISPR gRNA sequence
caactaaagatgcagagaag

SEQ ID NO: 84759 - DNA, 20 bp, Artificial
  CRISPR gRNA sequence
aagatgcagagaagtccaag

SEQ ID NO: 84760 - DNA, 20 bp, Artificial
  CRISPR gRNA sequence
ctccctctctcttgcttctg

SEQ ID NO: 84761 - DNA, 20 bp, Artificial
  CRISPR gRNA sequence
cctctctcttgcttctggag

SEQ ID NO: 84762 - DNA, 20 bp, Artificial
  CRISPR gRNA sequence
tctcttgcttctggagctcc

SEQ ID NO: 84763 - DNA, 20 bp, Artificial
  CRISPR gRNA sequence
tcttgcttctggagctcctt

SEQ ID NO: 84764 - DNA, 20 bp, Artificial
  CRISPR gRNA sequence
ttgcttctggagctccttgt

SEQ ID NO: 84765 - DNA, 20 bp, Artificial
  CRISPR gRNA sequence
gcttctggagctccttgtag

SEQ ID NO: 84766 - DNA, 20 bp, Artificial
  CRISPR gRNA sequence
cttctggagctccttgtagt

SEQ ID NO: 84767 - DNA, 20 bp, Artificial
  CRISPR gRNA sequence
ctggagctccttgtagttac

SEQ ID NO: 84768 - DNA, 20 bp, Artificial
  CRISPR gRNA sequence
tggagctccttgtagttaca

SEQ ID NO: 84769 - DNA, 20 bp, Artificial
  CRISPR gRNA sequence
gagctccttgtagttacatc

SEQ ID NO: 84770 - DNA, 20 bp, Artificial
  CRISPR gRNA sequence
cttgtagttacatctattat

SEQ ID NO: 84771 - DNA, 20 bp, Artificial
  CRISPR gRNA sequence
gtagttacatctattatagt

SEQ ID NO: 84772 - DNA, 20 bp, Artificial
  CRISPR gRNA sequence
tagttacatctattatagta

SEQ ID NO: 84773 - DNA, 20 bp, Artificial
  CRISPR gRNA sequence
catctattatagtatcatta

SEQ ID NO: 84774 - DNA, 20 bp, Artificial
  CRISPR gRNA sequence
ttatagtatcattatatcaa

SEQ ID NO: 84775 - DNA, 20 bp, Artificial
  CRISPR gRNA sequence
tagtatcattatatcaagtt

SEQ ID NO: 84776 - DNA, 20 bp, Artificial
  CRISPR gRNA sequence
tatcaagttataacaatctg

SEQ ID NO: 84777 - DNA, 20 bp, Artificial
  CRISPR gRNA sequence
taacaatctgtttcccttta

SEQ ID NO: 84778 - DNA, 20 bp, Artificial
  CRISPR gRNA sequence
tttccctttatctcctctag

SEQ ID NO: 84779 - DNA, 20 bp, Artificial
  CRISPR gRNA sequence
ccctttatctcctctagtgg

SEQ ID NO: 84780 - DNA, 20 bp, Artificial
  CRISPR gRNA sequence
cctttatctcctctagtggc

SEQ ID NO: 84781 - DNA, 20 bp, Artificial
  CRISPR gRNA sequence
tatctcctctagtggcctgg

SEQ ID NO: 84782 - DNA, 20 bp, Artificial
  CRISPR gRNA sequence
atctcctctagtggcctggg

SEQ ID NO: 84783 - DNA, 20 bp, Artificial
  CRISPR gRNA sequence
tctcctctagtggcctggga

SEQ ID NO: 84784 - DNA, 20 bp, Artificial
  CRISPR gRNA sequence
ctctagtggcctgggaacct

SEQ ID NO: 84785 - DNA, 20 bp, Artificial
  CRISPR gRNA sequence
tagtggcctgggaacctcta

SEQ ID NO: 84786 - DNA, 20 bp, Artificial
  CRISPR gRNA sequence
gtggcctgggaacctctaag

SEQ ID NO: 84787 - DNA, 20 bp, Artificial
  CRISPR gRNA sequence
ggaacctctaagaggcaaac

SEQ ID NO: 84788 - DNA, 20 bp, Artificial
  CRISPR gRNA sequence
taagaggcaaacacagtccc

SEQ ID NO: 84789 - DNA, 20 bp, Artificial
  CRISPR gRNA sequence
agaggcaaacacagtcccca

SEQ ID NO: 84790 - DNA, 20 bp, Artificial
  CRISPR gRNA sequence
cagagctgtataactcctct

SEQ ID NO: 84791 - DNA, 20 bp, Artificial
  CRISPR gRNA sequence
tataactcctctcttctgtc

SEQ ID NO: 84792 - DNA, 20 bp, Artificial
  CRISPR gRNA sequence
ctctcttctgtctgaagaat

SEQ ID NO: 84793 - DNA, 20 bp, Artificial
  CRISPR gRNA sequence
tcttctgtctgaagaataaa

SEQ ID NO: 84794 - DNA, 20 bp, Artificial
  CRISPR gRNA sequence
ttctgtctgaagaataaaac

SEQ ID NO: 84795 - DNA, 20 bp, Artificial
  CRISPR gRNA sequence
ctgtctgaagaataaaacaa

SEQ ID NO: 84796 - DNA, 20 bp, Artificial
  CRISPR gRNA sequence
tgtctgaagaataaaacaac

SEQ ID NO: 84797 - DNA, 20 bp, Artificial
  CRISPR gRNA sequence
tctgaagaataaaacaacat

SEQ ID NO: 84798 - DNA, 20 bp, Artificial
  CRISPR gRNA sequence
aagaataaaacaacattata

SEQ ID NO: 84799 - DNA, 20 bp, Artificial
  CRISPR gRNA sequence
tacaaaggaaaagagtggtt

SEQ ID NO: 84800 - DNA, 20 bp, Artificial
  CRISPR gRNA sequence
attttctctcctcagcagag

SEQ ID NO: 84801 - DNA, 20 bp, Artificial
  CRISPR gRNA sequence
tctctcctcagcagagatgt

SEQ ID NO: 84802 - DNA, 20 bp, Artificial
  CRISPR gRNA sequence
ctctcctcagcagagatgtc

SEQ ID NO: 84803 - DNA, 20 bp, Artificial
  CRISPR gRNA sequence
tctcctcagcagagatgtcc

SEQ ID NO: 84804 - DNA, 20 bp, Artificial
  CRISPR gRNA sequence
tcctcagcagagatgtccaa

SEQ ID NO: 84805 - DNA, 20 bp, Artificial
  CRISPR gRNA sequence
ctcagcagagatgtccaatg

SEQ ID NO: 84806 - DNA, 20 bp, Artificial
  CRISPR gRNA sequence
agcagagatgtccaatgtgg

SEQ ID NO: 84807 - DNA, 20 bp, Artificial
  CRISPR gRNA sequence
gcaggtaatgtgggtaacca

SEQ ID NO: 84808 - DNA, 20 bp, Artificial
  CRISPR gRNA sequence
caggtaatgtgggtaaccac

SEQ ID NO: 84809 - DNA, 20 bp, Artificial
  CRISPR gRNA sequence
cctttatcctgcaataccat

SEQ ID NO: 84810 - DNA, 20 bp, Artificial
  CRISPR gRNA sequence
tatcctgcaataccatactg

SEQ ID NO: 84811 - DNA, 20 bp, Artificial
  CRISPR gRNA sequence
atcctgcaataccatactgg

SEQ ID NO: 84812 - DNA, 20 bp, Artificial
  CRISPR gRNA sequence
tcctgcaataccatactggc

SEQ ID NO: 84813 - DNA, 20 bp, Artificial
  CRISPR gRNA sequence
caataccatactggcagttc

SEQ ID NO: 84814 - DNA, 20 bp, Artificial
  CRISPR gRNA sequence
gcagttcctttgccctctct

SEQ ID NO: 84815 - DNA, 20 bp, Artificial
  CRISPR gRNA sequence
ctttgccctctctgtagagg

SEQ ID NO: 84816 - DNA, 20 bp, Artificial
  CRISPR gRNA sequence
tgccctctctgtagagggtc

SEQ ID NO: 84817 - DNA, 20 bp, Artificial
  CRISPR gRNA sequence
gccctctctgtagagggtca

SEQ ID NO: 84818 - DNA, 20 bp, Artificial
  CRISPR gRNA sequence
ccctctctgtagagggtcag

SEQ ID NO: 84819 - DNA, 20 bp, Artificial
  CRISPR gRNA sequence
tctgtagagggtcagtaata

SEQ ID NO: 84820 - DNA, 20 bp, Artificial
  CRISPR gRNA sequence
tgtagagggtcagtaatatg

SEQ ID NO: 84821 - DNA, 20 bp, Artificial
  CRISPR gRNA sequence
tagagggtcagtaatatggc

SEQ ID NO: 84822 - DNA, 20 bp, Artificial
  CRISPR gRNA sequence
gggccatacaccttcttcat

SEQ ID NO: 84823 - DNA, 20 bp, Artificial
  CRISPR gRNA sequence
cttcatgccactccacagga

SEQ ID NO: 84824 - DNA, 20 bp, Artificial
  CRISPR gRNA sequence
ttcatgccactccacaggag

SEQ ID NO: 84825 - DNA, 20 bp, Artificial
  CRISPR gRNA sequence
catgccactccacaggagaa

SEQ ID NO: 84826 - DNA, 20 bp, Artificial
  CRISPR gRNA sequence
atgccactccacaggagaag

SEQ ID NO: 84827 - DNA, 20 bp, Artificial
  CRISPR gRNA sequence
cacaggagaagggaacatga

SEQ ID NO: 84828 - DNA, 20 bp, Artificial
  CRISPR gRNA sequence
taggattcttctttccctgc

SEQ ID NO: 84829 - DNA, 20 bp, Artificial
  CRISPR gRNA sequence
ttctttccctgctaaaatgt

SEQ ID NO: 84830 - DNA, 20 bp, Artificial
  CRISPR gRNA sequence
ctttccctgctaaaatgtta

SEQ ID NO: 84831 - DNA, 20 bp, Artificial
  CRISPR gRNA sequence
tttccctgctaaaatgttac

SEQ ID NO: 84832 - DNA, 20 bp, Artificial
  CRISPR gRNA sequence
tccctgctaaaatgttactc

SEQ ID NO: 84833 - DNA, 20 bp, Artificial
  CRISPR gRNA sequence
ccctgctaaaatgttactct

SEQ ID NO: 84834 - DNA, 20 bp, Artificial
  CRISPR gRNA sequence
cctgctaaaatgttactctg

SEQ ID NO: 84835 - DNA, 20 bp, Artificial
  CRISPR gRNA sequence
ctaaaatgttactctgtcaa

SEQ ID NO: 84836 - DNA, 20 bp, Artificial
  CRISPR gRNA sequence
aaatgttactctgtcaatgt

SEQ ID NO: 84837 - DNA, 20 bp, Artificial
  CRISPR gRNA sequence
ctctgtcaatgttctccaca

SEQ ID NO: 84838 - DNA, 20 bp, Artificial
  CRISPR gRNA sequence
tgtcaatgttctccacatag

SEQ ID NO: 84839 - DNA, 20 bp, Artificial
  CRISPR gRNA sequence
tcaatgttctccacatagtg

SEQ ID NO: 84840 - DNA, 20 bp, Artificial
  CRISPR gRNA sequence
tccacatagtgagggttatc

SEQ ID NO: 84841 - DNA, 20 bp, Artificial
  CRISPR gRNA sequence
cacatagtgagggttatcat

SEQ ID NO: 84842 - DNA, 20 bp, Artificial
  CRISPR gRNA sequence
tcatgttagagctgtctata

SEQ ID NO: 84843 - DNA, 20 bp, Artificial
  CRISPR gRNA sequence
gagctgtctataaatagtcc

SEQ ID NO: 84844 - DNA, 20 bp, Artificial
  CRISPR gRNA sequence
tctataaatagtcctcagga

SEQ ID NO: 84845 - DNA, 20 bp, Artificial
  CRISPR gRNA sequence
taaatagtcctcaggacagt

SEQ ID NO: 84846 - DNA, 20 bp, Artificial
  CRISPR gRNA sequence
aggacagtgaaacaaaaaca

SEQ ID NO: 84847 - DNA, 20 bp, Artificial
  CRISPR gRNA sequence
tctcaaggtcaaaaacttac

SEQ ID NO: 84848 - DNA, 20 bp, Artificial
  CRISPR gRNA sequence
ctcaaggtcaaaaacttacc

SEQ ID NO: 84849 - DNA, 20 bp, Artificial
  CRISPR gRNA sequence
tcaaggtcaaaaacttacct

SEQ ID NO: 84850 - DNA, 20 bp, Artificial
  CRISPR gRNA sequence
aaggtcaaaaacttacctcc

SEQ ID NO: 84851 - DNA, 20 bp, Artificial
  CRISPR gRNA sequence
acctccatgatgctgcttac

SEQ ID NO: 84852 - DNA, 20 bp, Artificial
  CRISPR gRNA sequence
cctccatgatgctgcttaca

SEQ ID NO: 84853 - DNA, 20 bp, Artificial
  CRISPR gRNA sequence
catgatgctgcttacatgtc

SEQ ID NO: 84854 - DNA, 20 bp, Artificial
  CRISPR gRNA sequence
cttacatgtctcgatctatg

SEQ ID NO: 84855 - DNA, 20 bp, Artificial
  CRISPR gRNA sequence
acatgtctcgatctatgaaa

SEQ ID NO: 84856 - DNA, 20 bp, Artificial
  CRISPR gRNA sequence
catgtctcgatctatgaaaa

SEQ ID NO: 84857 - DNA, 20 bp, Artificial
  CRISPR gRNA sequence
gatctatgaaaaagacagtg

SEQ ID NO: 84858 - DNA, 20 bp, Artificial
  CRISPR gRNA sequence
tgaaaaagacagtggagaaa

SEQ ID NO: 84859 - DNA, 20 bp, Artificial
  CRISPR gRNA sequence
agttttacttttaaaatacc

SEQ ID NO: 84860 - DNA, 20 bp, Artificial
  CRISPR gRNA sequence
tacttttaaaataccatgta

SEQ ID NO: 84861 - DNA, 20 bp, Artificial
  CRISPR gRNA sequence
acttttaaaataccatgtac

SEQ ID NO: 84862 - DNA, 20 bp, Artificial
  CRISPR gRNA sequence
cttttaaaataccatgtact

SEQ ID NO: 84863 - DNA, 20 bp, Artificial
  CRISPR gRNA sequence
ttaaaataccatgtactaac

SEQ ID NO: 84864 - DNA, 20 bp, Artificial
  CRISPR gRNA sequence
taaaataccatgtactaaca

SEQ ID NO: 84865 - DNA, 20 bp, Artificial
  CRISPR gRNA sequence
aaaataccatgtactaacaa

SEQ ID NO: 84866 - DNA, 20 bp, Artificial
  CRISPR gRNA sequence
aaataccatgtactaacaaa

SEQ ID NO: 84867 - DNA, 20 bp, Artificial
  CRISPR gRNA sequence
acaaatgtctaaaatggtta

SEQ ID NO: 84868 - DNA, 20 bp, Artificial
  CRISPR gRNA sequence
aaatggttagaaataaggct

SEQ ID NO: 84869 - DNA, 20 bp, Artificial
  CRISPR gRNA sequence
gaaataaggctggcagaata

SEQ ID NO: 84870 - DNA, 20 bp, Artificial
  CRISPR gRNA sequence
gcagaataggctgctgttcc

SEQ ID NO: 84871 - DNA, 20 bp, Artificial
  CRISPR gRNA sequence
ctgttcctacccatgaatac

SEQ ID NO: 84872 - DNA, 20 bp, Artificial
  CRISPR gRNA sequence
ttcctacccatgaatacatt

SEQ ID NO: 84873 - DNA, 20 bp, Artificial
  CRISPR gRNA sequence
ctacccatgaatacattgtt

SEQ ID NO: 84874 - DNA, 20 bp, Artificial
  CRISPR gRNA sequence
cccatgaatacattgtttag

SEQ ID NO: 84875 - DNA, 20 bp, Artificial
  CRISPR gRNA sequence
tttagagctacccagcagga

SEQ ID NO: 84876 - DNA, 20 bp, Artificial
  CRISPR gRNA sequence
agagctacccagcaggaaca

SEQ ID NO: 84877 - DNA, 20 bp, Artificial
  CRISPR gRNA sequence
gagctacccagcaggaacaa

SEQ ID NO: 84878 - DNA, 20 bp, Artificial
  CRISPR gRNA sequence
cccagcaggaacaagccctt

SEQ ID NO: 84879 - DNA, 20 bp, Artificial
  CRISPR gRNA sequence
cctactagcctcagatacca

SEQ ID NO: 84880 - DNA, 20 bp, Artificial
  CRISPR gRNA sequence
ctactagcctcagataccaa

SEQ ID NO: 84881 - DNA, 20 bp, Artificial
  CRISPR gRNA sequence
ctagcctcagataccaatcc

SEQ ID NO: 84882 - DNA, 20 bp, Artificial
  CRISPR gRNA sequence
gcctcagataccaatccagc

SEQ ID NO: 84883 - DNA, 20 bp, Artificial
  CRISPR gRNA sequence
agataccaatccagccagaa

SEQ ID NO: 84884 - DNA, 20 bp, Artificial
  CRISPR gRNA sequence
gagaagtccaggattatagg

SEQ ID NO: 84885 - DNA, 20 bp, Artificial
  CRISPR gRNA sequence
taggatgctaggacagcagg

SEQ ID NO: 84886 - DNA, 20 bp, Artificial
  CRISPR gRNA sequence
ggacagcaggacttacaaac

SEQ ID NO: 84887 - DNA, 20 bp, Artificial
  CRISPR gRNA sequence
acaaacaaaggcctatacct

SEQ ID NO: 84888 - DNA, 20 bp, Artificial
  CRISPR gRNA sequence
caaacaaaggcctatacctt

SEQ ID NO: 84889 - DNA, 20 bp, Artificial
  CRISPR gRNA sequence
taccttcttgagatgttcgt

SEQ ID NO: 84890 - DNA, 20 bp, Artificial
  CRISPR gRNA sequence
cttgagatgttcgttcagtg

SEQ ID NO: 84891 - DNA, 20 bp, Artificial
  CRISPR gRNA sequence
ttgagatgttcgttcagtgc

SEQ ID NO: 84892 - DNA, 20 bp, Artificial
  CRISPR gRNA sequence
gagatgttcgttcagtgcta

SEQ ID NO: 84893 - DNA, 20 bp, Artificial
  CRISPR gRNA sequence
agatgttcgttcagtgctaa

SEQ ID NO: 84894 - DNA, 20 bp, Artificial
  CRISPR gRNA sequence
gttcagtgctaaatatacct

SEQ ID NO: 84895 - DNA, 20 bp, Artificial
  CRISPR gRNA sequence
agtgctaaatatacctgaag

SEQ ID NO: 84896 - DNA, 20 bp, Artificial
  CRISPR gRNA sequence
aatatacctgaagctgccac

SEQ ID NO: 84897 - DNA, 20 bp, Artificial
  CRISPR gRNA sequence
aagctgccacaaaagctaga

SEQ ID NO: 84898 - DNA, 20 bp, Artificial
  CRISPR gRNA sequence
ccacaaaagctagaggaagc

SEQ ID NO: 84899 - DNA, 20 bp, Artificial
  CRISPR gRNA sequence
gaggaagccagtaggtaaga

SEQ ID NO: 84900 - DNA, 20 bp, Artificial
  CRISPR gRNA sequence
agagtgtatatgtatttgtg

SEQ ID NO: 84901 - DNA, 20 bp, Artificial
  CRISPR gRNA sequence
gtgcaagtgctgctgctgct

SEQ ID NO: 84902 - DNA, 20 bp, Artificial
  CRISPR gRNA sequence
tgcaagtgctgctgctgctc

SEQ ID NO: 84903 - DNA, 20 bp, Artificial
  CRISPR gRNA sequence
ctgctgctccctgctcaact

SEQ ID NO: 84904 - DNA, 20 bp, Artificial
  CRISPR gRNA sequence
ctgctccctgctcaactgca

SEQ ID NO: 84905 - DNA, 20 bp, Artificial
  CRISPR gRNA sequence
ctccctgctcaactgcaggg

SEQ ID NO: 84906 - DNA, 20 bp, Artificial
  CRISPR gRNA sequence
cctgctcaactgcagggaaa

SEQ ID NO: 84907 - DNA, 20 bp, Artificial
  CRISPR gRNA sequence
ctcaactgcagggaaactac

SEQ ID NO: 84908 - DNA, 20 bp, Artificial
  CRISPR gRNA sequence
aactgcagggaaactactgg

SEQ ID NO: 84909 - DNA, 20 bp, Artificial
  CRISPR gRNA sequence
cagggaaactactggttcag

SEQ ID NO: 84910 - DNA, 20 bp, Artificial
  CRISPR gRNA sequence
ctggttcagaaaccatgctg

SEQ ID NO: 84911 - DNA, 20 bp, Artificial
  CRISPR gRNA sequence
gttcagaaaccatgctgtgc

SEQ ID NO: 84912 - DNA, 20 bp, Artificial
  CRISPR gRNA sequence
agaaaccatgctgtgcatca

SEQ ID NO: 84913 - DNA, 20 bp, Artificial
  CRISPR gRNA sequence
tgcatcagtatctcagcagg

SEQ ID NO: 84914 - DNA, 20 bp, Artificial
  CRISPR gRNA sequence
agcaggtgccactaatctga

SEQ ID NO: 84915 - DNA, 20 bp, Artificial
  CRISPR gRNA sequence
atctgatctttaagaacatt

SEQ ID NO: 84916 - DNA, 20 bp, Artificial
  CRISPR gRNA sequence
atctttaagaacattccctg

SEQ ID NO: 84917 - DNA, 20 bp, Artificial
  CRISPR gRNA sequence
taagaacattccctgacaat

SEQ ID NO: 84918 - DNA, 20 bp, Artificial
  CRISPR gRNA sequence
aagaacattccctgacaatc

SEQ ID NO: 84919 - DNA, 20 bp, Artificial
  CRISPR gRNA sequence
agaacattccctgacaatcc

SEQ ID NO: 84920 - DNA, 20 bp, Artificial
  CRISPR gRNA sequence
cctgacaatcccaatatgca

SEQ ID NO: 84921 - DNA, 20 bp, Artificial
  CRISPR gRNA sequence
acaatcccaatatgcagatt

SEQ ID NO: 84922 - DNA, 20 bp, Artificial
  CRISPR gRNA sequence
tttatatcagatgggatggg

SEQ ID NO: 84923 - DNA, 20 bp, Artificial
  CRISPR gRNA sequence
atatcagatgggatgggact

SEQ ID NO: 84924 - DNA, 20 bp, Artificial
  CRISPR gRNA sequence
tatcagatgggatgggactc

SEQ ID NO: 84925 - DNA, 20 bp, Artificial
  CRISPR gRNA sequence
attcagggtagtatggccat

SEQ ID NO: 84926 - DNA, 20 bp, Artificial
  CRISPR gRNA sequence
agggtagtatggccatagac

SEQ ID NO: 84927 - DNA, 20 bp, Artificial
  CRISPR gRNA sequence
ttttatatcaaagcagcttt

SEQ ID NO: 84928 - DNA, 20 bp, Artificial
  CRISPR gRNA sequence
tttatatcaaagcagcttta

SEQ ID NO: 84929 - DNA, 20 bp, Artificial
  CRISPR gRNA sequence
ttatatcaaagcagctttat

SEQ ID NO: 84930 - DNA, 20 bp, Artificial
  CRISPR gRNA sequence
tatatcaaagcagctttatg

SEQ ID NO: 84931 - DNA, 20 bp, Artificial
  CRISPR gRNA sequence
atatcaaagcagctttatga

SEQ ID NO: 84932 - DNA, 20 bp, Artificial
  CRISPR gRNA sequence
tatcaaagcagctttatgat

SEQ ID NO: 84933 - DNA, 20 bp, Artificial
  CRISPR gRNA sequence
tatgatatgactactcatac

SEQ ID NO: 84934 - DNA, 20 bp, Artificial
  CRISPR gRNA sequence
atgatatgactactcataca

SEQ ID NO: 84935 - DNA, 20 bp, Artificial
  CRISPR gRNA sequence
tgatatgactactcatacac

SEQ ID NO: 84936 - DNA, 20 bp, Artificial
  CRISPR gRNA sequence
ctcatacacaactttcagca

SEQ ID NO: 84937 - DNA, 20 bp, Artificial
  CRISPR gRNA sequence
atacacaactttcagcagct

SEQ ID NO: 84938 - DNA, 20 bp, Artificial
  CRISPR gRNA sequence
tcagcagcttacaaaagaat

SEQ ID NO: 84939 - DNA, 20 bp, Artificial
  CRISPR gRNA sequence
cagcagcttacaaaagaatg

SEQ ID NO: 84940 - DNA, 20 bp, Artificial
  CRISPR gRNA sequence
agcagcttacaaaagaatgt

SEQ ID NO: 84941 - DNA, 20 bp, Artificial
  CRISPR gRNA sequence
acaaaagaatgtaagactta

SEQ ID NO: 84942 - DNA, 20 bp, Artificial
  CRISPR gRNA sequence
caaaagaatgtaagacttac

SEQ ID NO: 84943 - DNA, 20 bp, Artificial
  CRISPR gRNA sequence
accccacttaactatcttgg

SEQ ID NO: 84944 - DNA, 20 bp, Artificial
  CRISPR gRNA sequence
ccccacttaactatcttggg

SEQ ID NO: 84945 - DNA, 20 bp, Artificial
  CRISPR gRNA sequence
aactatcttgggctgtgaca

SEQ ID NO: 84946 - DNA, 20 bp, Artificial
  CRISPR gRNA sequence
actatcttgggctgtgacaa

SEQ ID NO: 84947 - DNA, 20 bp, Artificial
  CRISPR gRNA sequence
tcttgggctgtgacaaagtc

SEQ ID NO: 84948 - DNA, 20 bp, Artificial
  CRISPR gRNA sequence
gggctgtgacaaagtcacat

SEQ ID NO: 84949 - DNA, 20 bp, Artificial
  CRISPR gRNA sequence
ggctgtgacaaagtcacatg

SEQ ID NO: 84950 - DNA, 20 bp, Artificial
  CRISPR gRNA sequence
tgacaaagtcacatggttca

SEQ ID NO: 84951 - DNA, 20 bp, Artificial
  CRISPR gRNA sequence
acacggcaggcatactcatc

SEQ ID NO: 84952 - DNA, 20 bp, Artificial
  CRISPR gRNA sequence
atctttttcagtgggggtga

SEQ ID NO: 84953 - DNA, 20 bp, Artificial
  CRISPR gRNA sequence
tttcagtgggggtgaattca

SEQ ID NO: 84954 - DNA, 20 bp, Artificial
  CRISPR gRNA sequence
ttcagtgggggtgaattcag

SEQ ID NO: 84955 - DNA, 20 bp, Artificial
  CRISPR gRNA sequence
tcagtgggggtgaattcagt

SEQ ID NO: 84956 - DNA, 20 bp, Artificial
  CRISPR gRNA sequence
cagtgggggtgaattcagtg

SEQ ID NO: 84957 - DNA, 20 bp, Artificial
  CRISPR gRNA sequence
agtgggggtgaattcagtgt

SEQ ID NO: 84958 - DNA, 20 bp, Artificial
  CRISPR gRNA sequence
agtgtagtacaagagataga

SEQ ID NO: 84959 - DNA, 20 bp, Artificial
  CRISPR gRNA sequence
gctgaaagacaagtctgaat

SEQ ID NO: 84960 - DNA, 20 bp, Artificial
  CRISPR gRNA sequence
ctgaaagacaagtctgaatg

SEQ ID NO: 84961 - DNA, 20 bp, Artificial
  CRISPR gRNA sequence
aaagacaagtctgaatgctc

SEQ ID NO: 84962 - DNA, 20 bp, Artificial
  CRISPR gRNA sequence
aatgctccactttttcaatt

SEQ ID NO: 84963 - DNA, 20 bp, Artificial
  CRISPR gRNA sequence
cactttttcaattctctctc

SEQ ID NO: 84964 - DNA, 20 bp, Artificial
  CRISPR gRNA sequence
tttcaattctctctccattc

SEQ ID NO: 84965 - DNA, 20 bp, Artificial
  CRISPR gRNA sequence
ttcaattctctctccattct

SEQ ID NO: 84966 - DNA, 20 bp, Artificial
  CRISPR gRNA sequence
tcaattctctctccattctt

SEQ ID NO: 84967 - DNA, 20 bp, Artificial
  CRISPR gRNA sequence
caattctctctccattcttc

SEQ ID NO: 84968 - DNA, 20 bp, Artificial
  CRISPR gRNA sequence
aattctctctccattcttca

SEQ ID NO: 84969 - DNA, 20 bp, Artificial
  CRISPR gRNA sequence
tctctccattcttcagtaag

SEQ ID NO: 84970 - DNA, 20 bp, Artificial
  CRISPR gRNA sequence
tctccattcttcagtaagtc

SEQ ID NO: 84971 - DNA, 20 bp, Artificial
  CRISPR gRNA sequence
tccattcttcagtaagtcaa

SEQ ID NO: 84972 - DNA, 20 bp, Artificial
  CRISPR gRNA sequence
cattcttcagtaagtcaact

SEQ ID NO: 84973 - DNA, 20 bp, Artificial
  CRISPR gRNA sequence
ttcagtaagtcaacttcaat

SEQ ID NO: 84974 - DNA, 20 bp, Artificial
  CRISPR gRNA sequence
cagtaagtcaacttcaatgt

SEQ ID NO: 84975 - DNA, 20 bp, Artificial
  CRISPR gRNA sequence
agtaagtcaacttcaatgtc

SEQ ID NO: 84976 - DNA, 20 bp, Artificial
  CRISPR gRNA sequence
caatgtcggatggatgaaac

SEQ ID NO: 84977 - DNA, 20 bp, Artificial
  CRISPR gRNA sequence
aatgtcggatggatgaaacc

SEQ ID NO: 84978 - DNA, 20 bp, Artificial
  CRISPR gRNA sequence
aggaaatttgactttccatt

SEQ ID NO: 84979 - DNA, 20 bp, Artificial
  CRISPR gRNA sequence
gactttccattctctgctgg

SEQ ID NO: 84980 - DNA, 20 bp, Artificial
  CRISPR gRNA sequence
actttccattctctgctgga

SEQ ID NO: 84981 - DNA, 20 bp, Artificial
  CRISPR gRNA sequence
tccattctctgctggatgac

SEQ ID NO: 84982 - DNA, 20 bp, Artificial
  CRISPR gRNA sequence
ccattctctgctggatgacg

SEQ ID NO: 84983 - DNA, 20 bp, Artificial
  CRISPR gRNA sequence
cattctctgctggatgacgt

SEQ ID NO: 84984 - DNA, 20 bp, Artificial
  CRISPR gRNA sequence
tctgctggatgacgtgagta

SEQ ID NO: 84985 - DNA, 20 bp, Artificial
  CRISPR gRNA sequence
tgctggatgacgtgagtaaa

SEQ ID NO: 84986 - DNA, 20 bp, Artificial
  CRISPR gRNA sequence
ctggatgacgtgagtaaacc

SEQ ID NO: 84987 - DNA, 20 bp, Artificial
  CRISPR gRNA sequence
gatgacgtgagtaaacctga

SEQ ID NO: 84988 - DNA, 20 bp, Artificial
  CRISPR gRNA sequence
aatctttggagtacctgagg

SEQ ID NO: 84989 - DNA, 20 bp, Artificial
  CRISPR gRNA sequence
tggagtacctgaggaatatc

SEQ ID NO: 84990 - DNA, 20 bp, Artificial
  CRISPR gRNA sequence
ggagtacctgaggaatatcg

SEQ ID NO: 84991 - DNA, 20 bp, Artificial
  CRISPR gRNA sequence
gagtacctgaggaatatcgg

SEQ ID NO: 84992 - DNA, 20 bp, Artificial
  CRISPR gRNA sequence
aggaatatcgggaaaagaca

SEQ ID NO: 84993 - DNA, 20 bp, Artificial
  CRISPR gRNA sequence
atattgccagggtatttcac

SEQ ID NO: 84994 - DNA, 20 bp, Artificial
  CRISPR gRNA sequence
ccagggtatttcacttgggg

SEQ ID NO: 84995 - DNA, 20 bp, Artificial
  CRISPR gRNA sequence
cacttggggctaacttggtg

SEQ ID NO: 84996 - DNA, 20 bp, Artificial
  CRISPR gRNA sequence
acttggggctaacttggtgt

SEQ ID NO: 84997 - DNA, 20 bp, Artificial
  CRISPR gRNA sequence
ggggctaacttggtgtcaag

SEQ ID NO: 84998 - DNA, 20 bp, Artificial
  CRISPR gRNA sequence
gggctaacttggtgtcaagc

SEQ ID NO: 84999 - DNA, 20 bp, Artificial
  CRISPR gRNA sequence
acttggtgtcaagctatatc

SEQ ID NO: 85000 - DNA, 20 bp, Artificial
  CRISPR gRNA sequence
ggtgtcaagctatatcaggc

SEQ ID NO: 85001 - DNA, 20 bp, Artificial
  CRISPR gRNA sequence
gtgtcaagctatatcaggca

SEQ ID NO: 85002 - DNA, 20 bp, Artificial
  CRISPR gRNA sequence
tatcaggcaccaagtgttta

SEQ ID NO: 85003 - DNA, 20 bp, Artificial
  CRISPR gRNA sequence
acatttggtcatcgatttct

SEQ ID NO: 85004 - DNA, 20 bp, Artificial
  CRISPR gRNA sequence
catttggtcatcgatttctc

SEQ ID NO: 85005 - DNA, 20 bp, Artificial
  CRISPR gRNA sequence
ggtcatcgatttctcccaat

SEQ ID NO: 85006 - DNA, 20 bp, Artificial
  CRISPR gRNA sequence
gtcatcgatttctcccaatt

SEQ ID NO: 85007 - DNA, 20 bp, Artificial
  CRISPR gRNA sequence
ctcccaattccatttccact

SEQ ID NO: 85008 - DNA, 20 bp, Artificial
  CRISPR gRNA sequence
tcccaattccatttccactc

SEQ ID NO: 85009 - DNA, 20 bp, Artificial
  CRISPR gRNA sequence
ccaattccatttccactctg

SEQ ID NO: 85010 - DNA, 20 bp, Artificial
  CRISPR gRNA sequence
catttccactctggccaaat

SEQ ID NO: 85011 - DNA, 20 bp, Artificial
  CRISPR gRNA sequence
ccactctggccaaatgagct

SEQ ID NO: 85012 - DNA, 20 bp, Artificial
  CRISPR gRNA sequence
cactctggccaaatgagctt

SEQ ID NO: 85013 - DNA, 20 bp, Artificial
  CRISPR gRNA sequence
tggccaaatgagcttccacc

SEQ ID NO: 85014 - DNA, 20 bp, Artificial
  CRISPR gRNA sequence
gccaaatgagcttccacctt

SEQ ID NO: 85015 - DNA, 20 bp, Artificial
  CRISPR gRNA sequence
ccaccttcccaacaagccac

SEQ ID NO: 85016 - DNA, 20 bp, Artificial
  CRISPR gRNA sequence
caccttcccaacaagccacc

SEQ ID NO: 85017 - DNA, 20 bp, Artificial
  CRISPR gRNA sequence
cccaacaagccacctccatt

SEQ ID NO: 85018 - DNA, 20 bp, Artificial
  CRISPR gRNA sequence
ccaacaagccacctccattt

SEQ ID NO: 85019 - DNA, 20 bp, Artificial
  CRISPR gRNA sequence
cattttgaagaataaaccgt

SEQ ID NO: 85020 - DNA, 20 bp, Artificial
  CRISPR gRNA sequence
tgaagaataaaccgtgactt

SEQ ID NO: 85021 - DNA, 20 bp, Artificial
  CRISPR gRNA sequence
gaagaataaaccgtgacttg

SEQ ID NO: 85022 - DNA, 20 bp, Artificial
  CRISPR gRNA sequence
aagaataaaccgtgacttgg

SEQ ID NO: 85023 - DNA, 20 bp, Artificial
  CRISPR gRNA sequence
ggtatctttccctcataatt

SEQ ID NO: 85024 - DNA, 20 bp, Artificial
  CRISPR gRNA sequence
gtatctttccctcataattc

SEQ ID NO: 85025 - DNA, 20 bp, Artificial
  CRISPR gRNA sequence
tccctcataattcctctata

SEQ ID NO: 85026 - DNA, 20 bp, Artificial
  CRISPR gRNA sequence
ccctcataattcctctatac

SEQ ID NO: 85027 - DNA, 20 bp, Artificial
  CRISPR gRNA sequence
cctcataattcctctataca

SEQ ID NO: 85028 - DNA, 20 bp, Artificial
  CRISPR gRNA sequence
ataattcctctatacatgcc

SEQ ID NO: 85029 - DNA, 20 bp, Artificial
  CRISPR gRNA sequence
ctctatacatgccttttttg

SEQ ID NO: 85030 - DNA, 20 bp, Artificial
  CRISPR gRNA sequence
tatacatgccttttttgttt

SEQ ID NO: 85031 - DNA, 20 bp, Artificial
  CRISPR gRNA sequence
tacatgccttttttgttttt

SEQ ID NO: 85032 - DNA, 20 bp, Artificial
  CRISPR gRNA sequence
ttttgttttttttctagcag

SEQ ID NO: 85033 - DNA, 20 bp, Artificial
  CRISPR gRNA sequence
tttgttttttttctagcaga

SEQ ID NO: 85034 - DNA, 20 bp, Artificial
  CRISPR gRNA sequence
ttgttttttttctagcagat

SEQ ID NO: 85035 - DNA, 20 bp, Artificial
  CRISPR gRNA sequence
tgttttttttctagcagatt

SEQ ID NO: 85036 - DNA, 20 bp, Artificial
  CRISPR gRNA sequence
gttttttttctagcagattt

SEQ ID NO: 85037 - DNA, 20 bp, Artificial
  CRISPR gRNA sequence
ttttttttctagcagatttc

SEQ ID NO: 85038 - DNA, 20 bp, Artificial
  CRISPR gRNA sequence
tttttctagcagatttctag

SEQ ID NO: 85039 - DNA, 20 bp, Artificial
  CRISPR gRNA sequence
ttttctagcagatttctagc

SEQ ID NO: 85040 - DNA, 20 bp, Artificial
  CRISPR gRNA sequence
tttctagcagatttctagca

SEQ ID NO: 85041 - DNA, 20 bp, Artificial
  CRISPR gRNA sequence
ttctagcagatttctagcag

SEQ ID NO: 85042 - DNA, 20 bp, Artificial
  CRISPR gRNA sequence
tctagcagatttctagcagt

SEQ ID NO: 85043 - DNA, 20 bp, Artificial
  CRISPR gRNA sequence
ctagcagatttctagcagta

SEQ ID NO: 85044 - DNA, 20 bp, Artificial
  CRISPR gRNA sequence
tagcagatttctagcagtat

SEQ ID NO: 85045 - DNA, 20 bp, Artificial
  CRISPR gRNA sequence
gcagatttctagcagtatct

SEQ ID NO: 85046 - DNA, 20 bp, Artificial
  CRISPR gRNA sequence
ctagcagtatcttctgtcac

SEQ ID NO: 85047 - DNA, 20 bp, Artificial
  CRISPR gRNA sequence
tagcagtatcttctgtcact

SEQ ID NO: 85048 - DNA, 20 bp, Artificial
  CRISPR gRNA sequence
gcagtatcttctgtcactgg

SEQ ID NO: 85049 - DNA, 20 bp, Artificial
  CRISPR gRNA sequence
ctgtcactggagattgcgct

SEQ ID NO: 85050 - DNA, 20 bp, Artificial
  CRISPR gRNA sequence
tgtcactggagattgcgctg

SEQ ID NO: 85051 - DNA, 20 bp, Artificial
  CRISPR gRNA sequence
tcactggagattgcgctgca

SEQ ID NO: 85052 - DNA, 20 bp, Artificial
  CRISPR gRNA sequence
gagattgcgctgcattttta

SEQ ID NO: 85053 - DNA, 20 bp, Artificial
  CRISPR gRNA sequence
cgctgcatttttaagagcct

SEQ ID NO: 85054 - DNA, 20 bp, Artificial
  CRISPR gRNA sequence
catttttaagagcctttctc

SEQ ID NO: 85055 - DNA, 20 bp, Artificial
  CRISPR gRNA sequence
ttaagagcctttctctggag

SEQ ID NO: 85056 - DNA, 20 bp, Artificial
  CRISPR gRNA sequence
taagagcctttctctggagg

SEQ ID NO: 85057 - DNA, 20 bp, Artificial
  CRISPR gRNA sequence
aagagcctttctctggaggc

SEQ ID NO: 85058 - DNA, 20 bp, Artificial
  CRISPR gRNA sequence
agagcctttctctggaggct

SEQ ID NO: 85059 - DNA, 20 bp, Artificial
  CRISPR gRNA sequence
tctctggaggctctcaagga

SEQ ID NO: 85060 - DNA, 20 bp, Artificial
  CRISPR gRNA sequence
ctctggaggctctcaaggac

SEQ ID NO: 85061 - DNA, 20 bp, Artificial
  CRISPR gRNA sequence
tctggaggctctcaaggact

SEQ ID NO: 85062 - DNA, 20 bp, Artificial
  CRISPR gRNA sequence
tggaggctctcaaggacttc

SEQ ID NO: 85063 - DNA, 20 bp, Artificial
  CRISPR gRNA sequence
gaggctctcaaggacttctg

SEQ ID NO: 85064 - DNA, 20 bp, Artificial
  CRISPR gRNA sequence
tcaaggacttctgatgccct

SEQ ID NO: 85065 - DNA, 20 bp, Artificial
  CRISPR gRNA sequence
aaggacttctgatgccctct

SEQ ID NO: 85066 - DNA, 20 bp, Artificial
  CRISPR gRNA sequence
ctgatgccctctcagcactc

SEQ ID NO: 85067 - DNA, 20 bp, Artificial
  CRISPR gRNA sequence
tgatgccctctcagcactca

SEQ ID NO: 85068 - DNA, 20 bp, Artificial
  CRISPR gRNA sequence
atgccctctcagcactcata

SEQ ID NO: 85069 - DNA, 20 bp, Artificial
  CRISPR gRNA sequence
tcagcactcatagcattcct

SEQ ID NO: 85070 - DNA, 20 bp, Artificial
  CRISPR gRNA sequence
agcactcatagcattcctta

SEQ ID NO: 85071 - DNA, 20 bp, Artificial
  CRISPR gRNA sequence
atagcattccttaacacatc

SEQ ID NO: 85072 - DNA, 20 bp, Artificial
  CRISPR gRNA sequence
cttaacacatcactcaagag

SEQ ID NO: 85073 - DNA, 20 bp, Artificial
  CRISPR gRNA sequence
aacacatcactcaagagtct

SEQ ID NO: 85074 - DNA, 20 bp, Artificial
  CRISPR gRNA sequence
acacatcactcaagagtcta

SEQ ID NO: 85075 - DNA, 20 bp, Artificial
  CRISPR gRNA sequence
aagagtctacatgatttggc

SEQ ID NO: 85076 - DNA, 20 bp, Artificial
  CRISPR gRNA sequence
catgatttggccccaagata

SEQ ID NO: 85077 - DNA, 20 bp, Artificial
  CRISPR gRNA sequence
ggccccaagatacttttcaa

SEQ ID NO: 85078 - DNA, 20 bp, Artificial
  CRISPR gRNA sequence
gccccaagatacttttcaaa

SEQ ID NO: 85079 - DNA, 20 bp, Artificial
  CRISPR gRNA sequence
ttcaaagttcatttctcagt

SEQ ID NO: 85080 - DNA, 20 bp, Artificial
  CRISPR gRNA sequence
tcaaagttcatttctcagtt

SEQ ID NO: 85081 - DNA, 20 bp, Artificial
  CRISPR gRNA sequence
caaagttcatttctcagttc

SEQ ID NO: 85082 - DNA, 20 bp, Artificial
  CRISPR gRNA sequence
aaagttcatttctcagttca

SEQ ID NO: 85083 - DNA, 20 bp, Artificial
  CRISPR gRNA sequence
atttctcagttcataatagc

SEQ ID NO: 85084 - DNA, 20 bp, Artificial
  CRISPR gRNA sequence
ctcagttcataatagccccc

SEQ ID NO: 85085 - DNA, 20 bp, Artificial
  CRISPR gRNA sequence
tcagttcataatagccccca

SEQ ID NO: 85086 - DNA, 20 bp, Artificial
  CRISPR gRNA sequence
agttcataatagcccccatc

SEQ ID NO: 85087 - DNA, 20 bp, Artificial
  CRISPR gRNA sequence
ataatagcccccatcaaatt

SEQ ID NO: 85088 - DNA, 20 bp, Artificial
  CRISPR gRNA sequence
ctcatgttattgtactctgt

SEQ ID NO: 85089 - DNA, 20 bp, Artificial
  CRISPR gRNA sequence
atgttattgtactctgtttc

SEQ ID NO: 85090 - DNA, 20 bp, Artificial
  CRISPR gRNA sequence
ttgtactctgtttccacccc

SEQ ID NO: 85091 - DNA, 20 bp, Artificial
  CRISPR gRNA sequence
tactctgtttccaccccttc

SEQ ID NO: 85092 - DNA, 20 bp, Artificial
  CRISPR gRNA sequence
tgtttccaccccttccattt

SEQ ID NO: 85093 - DNA, 20 bp, Artificial
  CRISPR gRNA sequence
tttccaccccttccattttt

SEQ ID NO: 85094 - DNA, 20 bp, Artificial
  CRISPR gRNA sequence
ccaccccttccatttttttt

SEQ ID NO: 85095 - DNA, 20 bp, Artificial
  CRISPR gRNA sequence
caccccttccattttttttc

SEQ ID NO: 85096 - DNA, 20 bp, Artificial
  CRISPR gRNA sequence
ccattttttttcttatgttt

SEQ ID NO: 85097 - DNA, 20 bp, Artificial
  CRISPR gRNA sequence
cattttttttcttatgttta

SEQ ID NO: 85098 - DNA, 20 bp, Artificial
  CRISPR gRNA sequence
tttttcttatgtttatgcct

SEQ ID NO: 85099 - DNA, 20 bp, Artificial
  CRISPR gRNA sequence
ttttcttatgtttatgcctt

SEQ ID NO: 85100 - DNA, 20 bp, Artificial
  CRISPR gRNA sequence
tttcttatgtttatgccttt

SEQ ID NO: 85101 - DNA, 20 bp, Artificial
  CRISPR gRNA sequence
ttcttatgtttatgcctttc

SEQ ID NO: 85102 - DNA, 20 bp, Artificial
  CRISPR gRNA sequence
tcttatgtttatgcctttct

SEQ ID NO: 85103 - DNA, 20 bp, Artificial
  CRISPR gRNA sequence
cttatgtttatgcctttctt

SEQ ID NO: 85104 - DNA, 20 bp, Artificial
  CRISPR gRNA sequence
ttatgtttatgcctttcttt

SEQ ID NO: 85105 - DNA, 20 bp, Artificial
  CRISPR gRNA sequence
atgtttatgcctttcttttt

SEQ ID NO: 85106 - DNA, 20 bp, Artificial
  CRISPR gRNA sequence
tgtttatgcctttctttttg

SEQ ID NO: 85107 - DNA, 20 bp, Artificial
  CRISPR gRNA sequence
atgcctttctttttggttcc

SEQ ID NO: 85108 - DNA, 20 bp, Artificial
  CRISPR gRNA sequence
tgcctttctttttggttcct

SEQ ID NO: 85109 - DNA, 20 bp, Artificial
  CRISPR gRNA sequence
tctttttggttcctgctcct

SEQ ID NO: 85110 - DNA, 20 bp, Artificial
  CRISPR gRNA sequence
ctttttggttcctgctcctg

SEQ ID NO: 85111 - DNA, 20 bp, Artificial
  CRISPR gRNA sequence
tttttggttcctgctcctgc

SEQ ID NO: 85112 - DNA, 20 bp, Artificial
  CRISPR gRNA sequence
tttggttcctgctcctgcct

SEQ ID NO: 85113 - DNA, 20 bp, Artificial
  CRISPR gRNA sequence
ttggttcctgctcctgcctt

SEQ ID NO: 85114 - DNA, 20 bp, Artificial
  CRISPR gRNA sequence
tggttcctgctcctgccttg

SEQ ID NO: 85115 - DNA, 20 bp, Artificial
  CRISPR gRNA sequence
ggttcctgctcctgccttga

SEQ ID NO: 85116 - DNA, 20 bp, Artificial
  CRISPR gRNA sequence
gttcctgctcctgccttgat

SEQ ID NO: 85117 - DNA, 20 bp, Artificial
  CRISPR gRNA sequence
ctgctcctgccttgatctac

SEQ ID NO: 85118 - DNA, 20 bp, Artificial
  CRISPR gRNA sequence
ctcctgccttgatctacacc

SEQ ID NO: 85119 - DNA, 20 bp, Artificial
  CRISPR gRNA sequence
ctgccttgatctacacccat

SEQ ID NO: 85120 - DNA, 20 bp, Artificial
  CRISPR gRNA sequence
ccttgatctacacccatctg

SEQ ID NO: 85121 - DNA, 20 bp, Artificial
  CRISPR gRNA sequence
gatctacacccatctgattt

SEQ ID NO: 85122 - DNA, 20 bp, Artificial
  CRISPR gRNA sequence
atctacacccatctgatttt

SEQ ID NO: 85123 - DNA, 20 bp, Artificial
  CRISPR gRNA sequence
cacccatctgattttctaaa

SEQ ID NO: 85124 - DNA, 20 bp, Artificial
  CRISPR gRNA sequence
attttctaaactgtatgaag

SEQ ID NO: 85125 - DNA, 20 bp, Artificial
  CRISPR gRNA sequence
tctaaactgtatgaagtgtc

SEQ ID NO: 85126 - DNA, 20 bp, Artificial
  CRISPR gRNA sequence
ctaaactgtatgaagtgtct

SEQ ID NO: 85127 - DNA, 20 bp, Artificial
  CRISPR gRNA sequence
taaactgtatgaagtgtcta

SEQ ID NO: 85128 - DNA, 20 bp, Artificial
  CRISPR gRNA sequence
aactgtatgaagtgtctagt

SEQ ID NO: 85129 - DNA, 20 bp, Artificial
  CRISPR gRNA sequence
tatgaagtgtctagtagagt

SEQ ID NO: 85130 - DNA, 20 bp, Artificial
  CRISPR gRNA sequence
gtagagtgcctgggacatag

SEQ ID NO: 85131 - DNA, 20 bp, Artificial
  CRISPR gRNA sequence
ggacatagcaattgctctat

SEQ ID NO: 85132 - DNA, 20 bp, Artificial
  CRISPR gRNA sequence
ctctatacgtggcagatgtt

SEQ ID NO: 85133 - DNA, 20 bp, Artificial
  CRISPR gRNA sequence
tatacgtggcagatgttatt

SEQ ID NO: 85134 - DNA, 20 bp, Artificial
  CRISPR gRNA sequence
tacgtggcagatgttattat

SEQ ID NO: 85135 - DNA, 20 bp, Artificial
  CRISPR gRNA sequence
ttatctgaggttcctaagtg

SEQ ID NO: 85136 - DNA, 20 bp, Artificial
  CRISPR gRNA sequence
tctgaggttcctaagtggat

SEQ ID NO: 85137 - DNA, 20 bp, Artificial
  CRISPR gRNA sequence
aggttcctaagtggatcaac

SEQ ID NO: 85138 - DNA, 20 bp, Artificial
  CRISPR gRNA sequence
ctaagtggatcaacccaagg

SEQ ID NO: 85139 - DNA, 20 bp, Artificial
  CRISPR gRNA sequence
agtggatcaacccaaggtat

SEQ ID NO: 85140 - DNA, 20 bp, Artificial
  CRISPR gRNA sequence
tttatttttttattttttta

SEQ ID NO: 85141 - DNA, 20 bp, Artificial
  CRISPR gRNA sequence
tatttttttatttttttatt

SEQ ID NO: 85142 - DNA, 20 bp, Artificial
  CRISPR gRNA sequence
atttttttatttttttattt

SEQ ID NO: 85143 - DNA, 20 bp, Artificial
  CRISPR gRNA sequence
tttttttatttttttatttt

SEQ ID NO: 85144 - DNA, 20 bp, Artificial
  CRISPR gRNA sequence
ttttatttttttattttttg

SEQ ID NO: 85145 - DNA, 20 bp, Artificial
  CRISPR gRNA sequence
tttatttttttattttttgg

SEQ ID NO: 85146 - DNA, 20 bp, Artificial
  CRISPR gRNA sequence
ttatttttttattttttggg

SEQ ID NO: 85147 - DNA, 20 bp, Artificial
  CRISPR gRNA sequence
tatttttttattttttggga

SEQ ID NO: 85148 - DNA, 20 bp, Artificial
  CRISPR gRNA sequence
atttttttattttttgggat

SEQ ID NO: 85149 - DNA, 20 bp, Artificial
  CRISPR gRNA sequence
tttttttattttttgggatg

SEQ ID NO: 85150 - DNA, 20 bp, Artificial
  CRISPR gRNA sequence
ttttattttttgggatggaa

SEQ ID NO: 85151 - DNA, 20 bp, Artificial
  CRISPR gRNA sequence
tttattttttgggatggaat

SEQ ID NO: 85152 - DNA, 20 bp, Artificial
  CRISPR gRNA sequence
ttattttttgggatggaatc

SEQ ID NO: 85153 - DNA, 20 bp, Artificial
  CRISPR gRNA sequence
tattttttgggatggaatct

SEQ ID NO: 85154 - DNA, 20 bp, Artificial
  CRISPR gRNA sequence
attttttgggatggaatctc

SEQ ID NO: 85155 - DNA, 20 bp, Artificial
  CRISPR gRNA sequence
ttttttgggatggaatctca

SEQ ID NO: 85156 - DNA, 20 bp, Artificial
  CRISPR gRNA sequence
tttgggatggaatctcattc

SEQ ID NO: 85157 - DNA, 20 bp, Artificial
  CRISPR gRNA sequence
ttgggatggaatctcattcc

SEQ ID NO: 85158 - DNA, 20 bp, Artificial
  CRISPR gRNA sequence
tgggatggaatctcattcca

SEQ ID NO: 85159 - DNA, 20 bp, Artificial
  CRISPR gRNA sequence
gggatggaatctcattccat

SEQ ID NO: 85160 - DNA, 20 bp, Artificial
  CRISPR gRNA sequence
ggatggaatctcattccatt

SEQ ID NO: 85161 - DNA, 20 bp, Artificial
  CRISPR gRNA sequence
attccattgcccaggctgga

SEQ ID NO: 85162 - DNA, 20 bp, Artificial
  CRISPR gRNA sequence
cattgcccaggctggagtgc

SEQ ID NO: 85163 - DNA, 20 bp, Artificial
  CRISPR gRNA sequence
cccaggctggagtgcagtgt

SEQ ID NO: 85164 - DNA, 20 bp, Artificial
  CRISPR gRNA sequence
gagtgcagtgtgcagtggtg

SEQ ID NO: 85165 - DNA, 20 bp, Artificial
  CRISPR gRNA sequence
agctcactgcaacctccgcc

SEQ ID NO: 85166 - DNA, 20 bp, Artificial
  CRISPR gRNA sequence
actgcaacctccgcctcctg

SEQ ID NO: 85167 - DNA, 20 bp, Artificial
  CRISPR gRNA sequence
caacctccgcctcctgggtt

SEQ ID NO: 85168 - DNA, 20 bp, Artificial
  CRISPR gRNA sequence
cgcctcctgggttcaagtga

SEQ ID NO: 85169 - DNA, 20 bp, Artificial
  CRISPR gRNA sequence
ctgggttcaagtgattcctg

SEQ ID NO: 85170 - DNA, 20 bp, Artificial
  CRISPR gRNA sequence
ggttcaagtgattcctggga

SEQ ID NO: 85171 - DNA, 20 bp, Artificial
  CRISPR gRNA sequence
aagtgattcctgggactaca

SEQ ID NO: 85172 - DNA, 20 bp, Artificial
  CRISPR gRNA sequence
ctgggactacaggcacacac

SEQ ID NO: 85173 - DNA, 20 bp, Artificial
  CRISPR gRNA sequence
ggactacaggcacacaccac

SEQ ID NO: 85174 - DNA, 20 bp, Artificial
  CRISPR gRNA sequence
caggcacacaccaccatgcc

SEQ ID NO: 85175 - DNA, 20 bp, Artificial
  CRISPR gRNA sequence
gttaatttttgtattttcag

SEQ ID NO: 85176 - DNA, 20 bp, Artificial
  CRISPR gRNA sequence
atttttgtattttcagtaga

SEQ ID NO: 85177 - DNA, 20 bp, Artificial
  CRISPR gRNA sequence
ttgtattttcagtagagacg

SEQ ID NO: 85178 - DNA, 20 bp, Artificial
  CRISPR gRNA sequence
tgtattttcagtagagacgg

SEQ ID NO: 85179 - DNA, 20 bp, Artificial
  CRISPR gRNA sequence
gtattttcagtagagacggg

SEQ ID NO: 85180 - DNA, 20 bp, Artificial
  CRISPR gRNA sequence
tattttcagtagagacggga

SEQ ID NO: 85181 - DNA, 20 bp, Artificial
  CRISPR gRNA sequence
tcagtagagacgggatttca

SEQ ID NO: 85182 - DNA, 20 bp, Artificial
  CRISPR gRNA sequence
cagtagagacgggatttcac

SEQ ID NO: 85183 - DNA, 20 bp, Artificial
  CRISPR gRNA sequence
agtagagacgggatttcacc

SEQ ID NO: 85184 - DNA, 20 bp, Artificial
  CRISPR gRNA sequence
caccatgttggccaggctgg

SEQ ID NO: 85185 - DNA, 20 bp, Artificial
  CRISPR gRNA sequence
accatgttggccaggctggt

SEQ ID NO: 85186 - DNA, 20 bp, Artificial
  CRISPR gRNA sequence
gccaggctggtcttgaactc

SEQ ID NO: 85187 - DNA, 20 bp, Artificial
  CRISPR gRNA sequence
gtcttgaactcccaacttca

SEQ ID NO: 85188 - DNA, 20 bp, Artificial
  CRISPR gRNA sequence
gaactcccaacttcaagtga

SEQ ID NO: 85189 - DNA, 20 bp, Artificial
  CRISPR gRNA sequence
aactcccaacttcaagtgat

SEQ ID NO: 85190 - DNA, 20 bp, Artificial
  CRISPR gRNA sequence
ccaacttcaagtgatcagcc

SEQ ID NO: 85191 - DNA, 20 bp, Artificial
  CRISPR gRNA sequence
caagtgatcagcctgccttg

SEQ ID NO: 85192 - DNA, 20 bp, Artificial
  CRISPR gRNA sequence
aagtgatcagcctgccttgg

SEQ ID NO: 85193 - DNA, 20 bp, Artificial
  CRISPR gRNA sequence
ccttggcctcccaaagtgtt

SEQ ID NO: 85194 - DNA, 20 bp, Artificial
  CRISPR gRNA sequence
ggcctcccaaagtgttggga

SEQ ID NO: 85195 - DNA, 20 bp, Artificial
  CRISPR gRNA sequence
gcctcccaaagtgttgggat

SEQ ID NO: 85196 - DNA, 20 bp, Artificial
  CRISPR gRNA sequence
ccaaagtgttgggattacag

SEQ ID NO: 85197 - DNA, 20 bp, Artificial
  CRISPR gRNA sequence
ggattacaggcacgagccac

SEQ ID NO: 85198 - DNA, 20 bp, Artificial
  CRISPR gRNA sequence
caggcacgagccaccgtgcc

SEQ ID NO: 85199 - DNA, 20 bp, Artificial
  CRISPR gRNA sequence
ttaccaaacaacaaaacctc

SEQ ID NO: 85200 - DNA, 20 bp, Artificial
  CRISPR gRNA sequence
accaaacaacaaaacctctt

SEQ ID NO: 85201 - DNA, 20 bp, Artificial
  CRISPR gRNA sequence
ccaaacaacaaaacctcttt

SEQ ID NO: 85202 - DNA, 20 bp, Artificial
  CRISPR gRNA sequence
tttatttctgctgaggtttt

SEQ ID NO: 85203 - DNA, 20 bp, Artificial
  CRISPR gRNA sequence
tatttctgctgaggttttat

SEQ ID NO: 85204 - DNA, 20 bp, Artificial
  CRISPR gRNA sequence
atttctgctgaggttttata

SEQ ID NO: 85205 - DNA, 20 bp, Artificial
  CRISPR gRNA sequence
tttctgctgaggttttatat

SEQ ID NO: 85206 - DNA, 20 bp, Artificial
  CRISPR gRNA sequence
ctgctgaggttttatatgcc

SEQ ID NO: 85207 - DNA, 20 bp, Artificial
  CRISPR gRNA sequence
tgctgaggttttatatgcca

SEQ ID NO: 85208 - DNA, 20 bp, Artificial
  CRISPR gRNA sequence
ctgaggttttatatgccaga

SEQ ID NO: 85209 - DNA, 20 bp, Artificial
  CRISPR gRNA sequence
aggttttatatgccagaccc

SEQ ID NO: 85210 - DNA, 20 bp, Artificial
  CRISPR gRNA sequence
tatatgccagacccctctct

SEQ ID NO: 85211 - DNA, 20 bp, Artificial
  CRISPR gRNA sequence
atatgccagacccctctctg

SEQ ID NO: 85212 - DNA, 20 bp, Artificial
  CRISPR gRNA sequence
tatgccagacccctctctga

SEQ ID NO: 85213 - DNA, 20 bp, Artificial
  CRISPR gRNA sequence
tctgactttgtacctaattt

SEQ ID NO: 85214 - DNA, 20 bp, Artificial
  CRISPR gRNA sequence
tgactttgtacctaatttca

SEQ ID NO: 85215 - DNA, 20 bp, Artificial
  CRISPR gRNA sequence
actttgtacctaatttcatg

SEQ ID NO: 85216 - DNA, 20 bp, Artificial
  CRISPR gRNA sequence
tgtacctaatttcatgagct

SEQ ID NO: 85217 - DNA, 20 bp, Artificial
  CRISPR gRNA sequence
gtacctaatttcatgagcta

SEQ ID NO: 85218 - DNA, 20 bp, Artificial
  CRISPR gRNA sequence
tacctaatttcatgagctaa

SEQ ID NO: 85219 - DNA, 20 bp, Artificial
  CRISPR gRNA sequence
atttcatgagctaaaaaaca

SEQ ID NO: 85220 - DNA, 20 bp, Artificial
  CRISPR gRNA sequence
catgagctaaaaaacaaaga

SEQ ID NO: 85221 - DNA, 20 bp, Artificial
  CRISPR gRNA sequence
atgagctaaaaaacaaagaa

SEQ ID NO: 85222 - DNA, 20 bp, Artificial
  CRISPR gRNA sequence
aaaaacaaagaaacaaaacc

SEQ ID NO: 85223 - DNA, 20 bp, Artificial
  CRISPR gRNA sequence
aatgcatacaagagctggca

SEQ ID NO: 85224 - DNA, 20 bp, Artificial
  CRISPR gRNA sequence
gcaaataccttaaatggttg

SEQ ID NO: 85225 - DNA, 20 bp, Artificial
  CRISPR gRNA sequence
aaatggttgagttggacccg

SEQ ID NO: 85226 - DNA, 20 bp, Artificial
  CRISPR gRNA sequence
aatggttgagttggacccga

SEQ ID NO: 85227 - DNA, 20 bp, Artificial
  CRISPR gRNA sequence
agttggacccgataaaatac

SEQ ID NO: 85228 - DNA, 20 bp, Artificial
  CRISPR gRNA sequence
gacccgataaaatacaacag

SEQ ID NO: 85229 - DNA, 20 bp, Artificial
  CRISPR gRNA sequence
tggcaaatgggacagaacat

SEQ ID NO: 85230 - DNA, 20 bp, Artificial
  CRISPR gRNA sequence
tccattatgatcaaatggag

SEQ ID NO: 85231 - DNA, 20 bp, Artificial
  CRISPR gRNA sequence
ccattatgatcaaatggagt

SEQ ID NO: 85232 - DNA, 20 bp, Artificial
  CRISPR gRNA sequence
cattatgatcaaatggagta

SEQ ID NO: 85233 - DNA, 20 bp, Artificial
  CRISPR gRNA sequence
tgatcaaatggagtaatgca

SEQ ID NO: 85234 - DNA, 20 bp, Artificial
  CRISPR gRNA sequence
gcgttttaattagcatccac

SEQ ID NO: 85235 - DNA, 20 bp, Artificial
  CRISPR gRNA sequence
cgttttaattagcatccaca

SEQ ID NO: 85236 - DNA, 20 bp, Artificial
  CRISPR gRNA sequence
taattagcatccacaggtga

SEQ ID NO: 85237 - DNA, 20 bp, Artificial
  CRISPR gRNA sequence
aattagcatccacaggtgat

SEQ ID NO: 85238 - DNA, 20 bp, Artificial
  CRISPR gRNA sequence
attagcatccacaggtgatt

SEQ ID NO: 85239 - DNA, 20 bp, Artificial
  CRISPR gRNA sequence
gcatccacaggtgattgctg

SEQ ID NO: 85240 - DNA, 20 bp, Artificial
  CRISPR gRNA sequence
ctgtaaactagccaggttgg

SEQ ID NO: 85241 - DNA, 20 bp, Artificial
  CRISPR gRNA sequence
taaactagccaggttgggaa

SEQ ID NO: 85242 - DNA, 20 bp, Artificial
  CRISPR gRNA sequence
gccaggttgggaatatattg

SEQ ID NO: 85243 - DNA, 20 bp, Artificial
  CRISPR gRNA sequence
ggaatatattgcctaatgtt

SEQ ID NO: 85244 - DNA, 20 bp, Artificial
  CRISPR gRNA sequence
cctaatgtttcagaaacagt

SEQ ID NO: 85245 - DNA, 20 bp, Artificial
  CRISPR gRNA sequence
atgtttcagaaacagtactt

SEQ ID NO: 85246 - DNA, 20 bp, Artificial
  CRISPR gRNA sequence
cagaaacagtactttccaaa

SEQ ID NO: 85247 - DNA, 20 bp, Artificial
  CRISPR gRNA sequence
agaaacagtactttccaaaa

SEQ ID NO: 85248 - DNA, 20 bp, Artificial
  CRISPR gRNA sequence
tccaaaatgagaggcatgac

SEQ ID NO: 85249 - DNA, 20 bp, Artificial
  CRISPR gRNA sequence
ccaaaatgagaggcatgact

SEQ ID NO: 85250 - DNA, 20 bp, Artificial
  CRISPR gRNA sequence
caaaatgagaggcatgacta

SEQ ID NO: 85251 - DNA, 20 bp, Artificial
  CRISPR gRNA sequence
gaccatccatggggaagtgg

SEQ ID NO: 85252 - DNA, 20 bp, Artificial
  CRISPR gRNA sequence
taaactctatatttttcatt

SEQ ID NO: 85253 - DNA, 20 bp, Artificial
  CRISPR gRNA sequence
tatatttttcattgaaaatg

SEQ ID NO: 85254 - DNA, 20 bp, Artificial
  CRISPR gRNA sequence
tatttttcattgaaaatgaa

SEQ ID NO: 85255 - DNA, 20 bp, Artificial
  CRISPR gRNA sequence
ttcattgaaaatgaagagaa

SEQ ID NO: 85256 - DNA, 20 bp, Artificial
  CRISPR gRNA sequence
tcattgaaaatgaagagaag

SEQ ID NO: 85257 - DNA, 20 bp, Artificial
  CRISPR gRNA sequence
cattgaaaatgaagagaagt

SEQ ID NO: 85258 - DNA, 20 bp, Artificial
  CRISPR gRNA sequence
attgaaaatgaagagaagtg

SEQ ID NO: 85259 - DNA, 20 bp, Artificial
  CRISPR gRNA sequence
aaaatgaagagaagtgttag

SEQ ID NO: 85260 - DNA, 20 bp, Artificial
  CRISPR gRNA sequence
gtgctactaaatatacagat

SEQ ID NO: 85261 - DNA, 20 bp, Artificial
  CRISPR gRNA sequence
ctaaatatacagattgacac

SEQ ID NO: 85262 - DNA, 20 bp, Artificial
  CRISPR gRNA sequence
aatatacagattgacactaa

SEQ ID NO: 85263 - DNA, 20 bp, Artificial
  CRISPR gRNA sequence
acactaaatatatgtgtata

SEQ ID NO: 85264 - DNA, 20 bp, Artificial
  CRISPR gRNA sequence
aatatatgtgtataaaattc

SEQ ID NO: 85265 - DNA, 20 bp, Artificial
  CRISPR gRNA sequence
ttttaaatacacttatattc

SEQ ID NO: 85266 - DNA, 20 bp, Artificial
  CRISPR gRNA sequence
ttaaatacacttatattcag

SEQ ID NO: 85267 - DNA, 20 bp, Artificial
  CRISPR gRNA sequence
taaatacacttatattcagg

SEQ ID NO: 85268 - DNA, 20 bp, Artificial
  CRISPR gRNA sequence
aaatacacttatattcaggg

SEQ ID NO: 85269 - DNA, 20 bp, Artificial
  CRISPR gRNA sequence
aatacacttatattcagggt

SEQ ID NO: 85270 - DNA, 20 bp, Artificial
  CRISPR gRNA sequence
atattcagggtacatgatca

SEQ ID NO: 85271 - DNA, 20 bp, Artificial
  CRISPR gRNA sequence
tattcagggtacatgatcac

SEQ ID NO: 85272 - DNA, 20 bp, Artificial
  CRISPR gRNA sequence
agggtacatgatcactaaaa

SEQ ID NO: 85273 - DNA, 20 bp, Artificial
  CRISPR gRNA sequence
aaaggcagctactcctcctt

SEQ ID NO: 85274 - DNA, 20 bp, Artificial
  CRISPR gRNA sequence
ctcctccttgtctgggaggc

SEQ ID NO: 85275 - DNA, 20 bp, Artificial
  CRISPR gRNA sequence
ctccttgtctgggaggctgt

SEQ ID NO: 85276 - DNA, 20 bp, Artificial
  CRISPR gRNA sequence
cttgtctgggaggctgtggg

SEQ ID NO: 85277 - DNA, 20 bp, Artificial
  CRISPR gRNA sequence
gtctgggaggctgtggggag

SEQ ID NO: 85278 - DNA, 20 bp, Artificial
  CRISPR gRNA sequence
tctgggaggctgtggggaga

SEQ ID NO: 85279 - DNA, 20 bp, Artificial
  CRISPR gRNA sequence
ggaggctgtggggagaagga

SEQ ID NO: 85280 - DNA, 20 bp, Artificial
  CRISPR gRNA sequence
tggggagaaggaggagtacc

SEQ ID NO: 85281 - DNA, 20 bp, Artificial
  CRISPR gRNA sequence
gaccagatatatctctctag

SEQ ID NO: 85282 - DNA, 20 bp, Artificial
  CRISPR gRNA sequence
accagatatatctctctaga

SEQ ID NO: 85283 - DNA, 20 bp, Artificial
  CRISPR gRNA sequence
tctagaaacaccctatcatt

SEQ ID NO: 85284 - DNA, 20 bp, Artificial
  CRISPR gRNA sequence
tagaaacaccctatcattaa

SEQ ID NO: 85285 - DNA, 20 bp, Artificial
  CRISPR gRNA sequence
gaaacaccctatcattaagg

SEQ ID NO: 85286 - DNA, 20 bp, Artificial
  CRISPR gRNA sequence
tcattaaggaaaggctacta

SEQ ID NO: 85287 - DNA, 20 bp, Artificial
  CRISPR gRNA sequence
aggaaaggctactagcccca

SEQ ID NO: 85288 - DNA, 20 bp, Artificial
  CRISPR gRNA sequence
ctagccccatcaagaggtgg

SEQ ID NO: 85289 - DNA, 20 bp, Artificial
  CRISPR gRNA sequence
gccccatcaagaggtggatt

SEQ ID NO: 85290 - DNA, 20 bp, Artificial
  CRISPR gRNA sequence
gggaatctaatgaagacctg

SEQ ID NO: 85291 - DNA, 20 bp, Artificial
  CRISPR gRNA sequence
atgaagacctgatttttttc

SEQ ID NO: 85292 - DNA, 20 bp, Artificial
  CRISPR gRNA sequence
atttttttcataacattaaa

SEQ ID NO: 85293 - DNA, 20 bp, Artificial
  CRISPR gRNA sequence
ttttcataacattaaaagct

SEQ ID NO: 85294 - DNA, 20 bp, Artificial
  CRISPR gRNA sequence
tttcataacattaaaagcta

SEQ ID NO: 85295 - DNA, 20 bp, Artificial
  CRISPR gRNA sequence
ttcataacattaaaagctaa

SEQ ID NO: 85296 - DNA, 20 bp, Artificial
  CRISPR gRNA sequence
tcataacattaaaagctaag

SEQ ID NO: 85297 - DNA, 20 bp, Artificial
  CRISPR gRNA sequence
cataacattaaaagctaaga

SEQ ID NO: 85298 - DNA, 20 bp, Artificial
  CRISPR gRNA sequence
ataacattaaaagctaagag

SEQ ID NO: 85299 - DNA, 20 bp, Artificial
  CRISPR gRNA sequence
aaagctaagagagctctttg

SEQ ID NO: 85300 - DNA, 20 bp, Artificial
  CRISPR gRNA sequence
agagagctctttgcatctga

SEQ ID NO: 85301 - DNA, 20 bp, Artificial
  CRISPR gRNA sequence
tttgcatctgagcttctaat

SEQ ID NO: 85302 - DNA, 20 bp, Artificial
  CRISPR gRNA sequence
tgcatctgagcttctaataa

SEQ ID NO: 85303 - DNA, 20 bp, Artificial
  CRISPR gRNA sequence
gcatctgagcttctaataat

SEQ ID NO: 85304 - DNA, 20 bp, Artificial
  CRISPR gRNA sequence
catctgagcttctaataata

SEQ ID NO: 85305 - DNA, 20 bp, Artificial
  CRISPR gRNA sequence
agcttctaataataagaaca

SEQ ID NO: 85306 - DNA, 20 bp, Artificial
  CRISPR gRNA sequence
ctaataataagaacatatta

SEQ ID NO: 85307 - DNA, 20 bp, Artificial
  CRISPR gRNA sequence
taataataagaacatattaa

SEQ ID NO: 85308 - DNA, 20 bp, Artificial
  CRISPR gRNA sequence
ataataagaacatattaaat

SEQ ID NO: 85309 - DNA, 20 bp, Artificial
  CRISPR gRNA sequence
aatgcctcagggatcagagc

SEQ ID NO: 85310 - DNA, 20 bp, Artificial
  CRISPR gRNA sequence
agggatcagagcacagattc

SEQ ID NO: 85311 - DNA, 20 bp, Artificial
  CRISPR gRNA sequence
atcctgcctggaactctctg

SEQ ID NO: 85312 - DNA, 20 bp, Artificial
  CRISPR gRNA sequence
cctggaactctctgtttgag

SEQ ID NO: 85313 - DNA, 20 bp, Artificial
  CRISPR gRNA sequence
gaactctctgtttgagggaa

SEQ ID NO: 85314 - DNA, 20 bp, Artificial
  CRISPR gRNA sequence
tctgtttgagggaaggcggc

SEQ ID NO: 85315 - DNA, 20 bp, Artificial
  CRISPR gRNA sequence
tgtttgagggaaggcggcaa

SEQ ID NO: 85316 - DNA, 20 bp, Artificial
  CRISPR gRNA sequence
tttgagggaaggcggcaaga

SEQ ID NO: 85317 - DNA, 20 bp, Artificial
  CRISPR gRNA sequence
gagggaaggcggcaagattt

SEQ ID NO: 85318 - DNA, 20 bp, Artificial
  CRISPR gRNA sequence
agggaaggcggcaagatttt

SEQ ID NO: 85319 - DNA, 20 bp, Artificial
  CRISPR gRNA sequence
tgtgagagcatcactgtaat

SEQ ID NO: 85320 - DNA, 20 bp, Artificial
  CRISPR gRNA sequence
gtgagagcatcactgtaatc

SEQ ID NO: 85321 - DNA, 20 bp, Artificial
  CRISPR gRNA sequence
tgagagcatcactgtaatct

SEQ ID NO: 85322 - DNA, 20 bp, Artificial
  CRISPR gRNA sequence
taatcttttctaagaagagg

SEQ ID NO: 85323 - DNA, 20 bp, Artificial
  CRISPR gRNA sequence
ttctaagaagaggacaagta

SEQ ID NO: 85324 - DNA, 20 bp, Artificial
  CRISPR gRNA sequence
tctaagaagaggacaagtat

SEQ ID NO: 85325 - DNA, 20 bp, Artificial
  CRISPR gRNA sequence
ctaagaagaggacaagtatc

SEQ ID NO: 85326 - DNA, 20 bp, Artificial
  CRISPR gRNA sequence
taagaagaggacaagtatca

SEQ ID NO: 85327 - DNA, 20 bp, Artificial
  CRISPR gRNA sequence
agaagaggacaagtatcaga

SEQ ID NO: 85328 - DNA, 20 bp, Artificial
  CRISPR gRNA sequence
ggtttgaatttgggctcaac

SEQ ID NO: 85329 - DNA, 20 bp, Artificial
  CRISPR gRNA sequence
gaatttgggctcaaccagtt

SEQ ID NO: 85330 - DNA, 20 bp, Artificial
  CRISPR gRNA sequence
aatttgggctcaaccagtta

SEQ ID NO: 85331 - DNA, 20 bp, Artificial
  CRISPR gRNA sequence
gggctcaaccagttactggc

SEQ ID NO: 85332 - DNA, 20 bp, Artificial
  CRISPR gRNA sequence
ggctcaaccagttactggct

SEQ ID NO: 85333 - DNA, 20 bp, Artificial
  CRISPR gRNA sequence
aaccagttactggctttatg

SEQ ID NO: 85334 - DNA, 20 bp, Artificial
  CRISPR gRNA sequence
ctggctttatgacttttgga

SEQ ID NO: 85335 - DNA, 20 bp, Artificial
  CRISPR gRNA sequence
gctttatgacttttggagag

SEQ ID NO: 85336 - DNA, 20 bp, Artificial
  CRISPR gRNA sequence
tatgacttttggagagttat

SEQ ID NO: 85337 - DNA, 20 bp, Artificial
  CRISPR gRNA sequence
atgacttttggagagttatt

SEQ ID NO: 85338 - DNA, 20 bp, Artificial
  CRISPR gRNA sequence
tgacttttggagagttattt

SEQ ID NO: 85339 - DNA, 20 bp, Artificial
  CRISPR gRNA sequence
ttggagagttatttaagctt

SEQ ID NO: 85340 - DNA, 20 bp, Artificial
  CRISPR gRNA sequence
tggagagttatttaagcttc

SEQ ID NO: 85341 - DNA, 20 bp, Artificial
  CRISPR gRNA sequence
ggagagttatttaagcttcc

SEQ ID NO: 85342 - DNA, 20 bp, Artificial
  CRISPR gRNA sequence
gagagttatttaagcttcca

SEQ ID NO: 85343 - DNA, 20 bp, Artificial
  CRISPR gRNA sequence
tttaagcttccaaaacttaa

SEQ ID NO: 85344 - DNA, 20 bp, Artificial
  CRISPR gRNA sequence
aagcttccaaaacttaactg

SEQ ID NO: 85345 - DNA, 20 bp, Artificial
  CRISPR gRNA sequence
agcttccaaaacttaactga

SEQ ID NO: 85346 - DNA, 20 bp, Artificial
  CRISPR gRNA sequence
ccaaaacttaactgaaaaat

SEQ ID NO: 85347 - DNA, 20 bp, Artificial
  CRISPR gRNA sequence
caaaacttaactgaaaaatt

SEQ ID NO: 85348 - DNA, 20 bp, Artificial
  CRISPR gRNA sequence
aactgaaaaattaatttatg

SEQ ID NO: 85349 - DNA, 20 bp, Artificial
  CRISPR gRNA sequence
actgaaaaattaatttatgc

SEQ ID NO: 85350 - DNA, 20 bp, Artificial
  CRISPR gRNA sequence
aaaaattaatttatgcccac

SEQ ID NO: 85351 - DNA, 20 bp, Artificial
  CRISPR gRNA sequence
atttatgcccacagtaaaac

SEQ ID NO: 85352 - DNA, 20 bp, Artificial
  CRISPR gRNA sequence
atgcccacagtaaaacaaaa

SEQ ID NO: 85353 - DNA, 20 bp, Artificial
  CRISPR gRNA sequence
tgcccacagtaaaacaaaaa

SEQ ID NO: 85354 - DNA, 20 bp, Artificial
  CRISPR gRNA sequence
cagaggcaatcatcattaca

SEQ ID NO: 85355 - DNA, 20 bp, Artificial
  CRISPR gRNA sequence
agaggcaatcatcattacat

SEQ ID NO: 85356 - DNA, 20 bp, Artificial
  CRISPR gRNA sequence
catgtttcttgtggtatctt

SEQ ID NO: 85357 - DNA, 20 bp, Artificial
  CRISPR gRNA sequence
cttgtggtatcttccagaaa

SEQ ID NO: 85358 - DNA, 20 bp, Artificial
  CRISPR gRNA sequence
ttgtggtatcttccagaaat

SEQ ID NO: 85359 - DNA, 20 bp, Artificial
  CRISPR gRNA sequence
gtggtatcttccagaaatgg

SEQ ID NO: 85360 - DNA, 20 bp, Artificial
  CRISPR gRNA sequence
tggtatcttccagaaatggt

SEQ ID NO: 85361 - DNA, 20 bp, Artificial
  CRISPR gRNA sequence
ccagaaatggtctatgcatg

SEQ ID NO: 85362 - DNA, 20 bp, Artificial
  CRISPR gRNA sequence
cagaaatggtctatgcatgg

SEQ ID NO: 85363 - DNA, 20 bp, Artificial
  CRISPR gRNA sequence
tgcatggcatgtattacttt

SEQ ID NO: 85364 - DNA, 20 bp, Artificial
  CRISPR gRNA sequence
ctttggaaattttcaaaata

SEQ ID NO: 85365 - DNA, 20 bp, Artificial
  CRISPR gRNA sequence
tggaaattttcaaaataaga

SEQ ID NO: 85366 - DNA, 20 bp, Artificial
  CRISPR gRNA sequence
ggaaattttcaaaataagat

SEQ ID NO: 85367 - DNA, 20 bp, Artificial
  CRISPR gRNA sequence
gaaattttcaaaataagatt

SEQ ID NO: 85368 - DNA, 20 bp, Artificial
  CRISPR gRNA sequence
tcaaaataagattttttttt

SEQ ID NO: 85369 - DNA, 20 bp, Artificial
  CRISPR gRNA sequence
caaaataagattttttttta

SEQ ID NO: 85370 - DNA, 20 bp, Artificial
  CRISPR gRNA sequence
aaaataagatttttttttaa

SEQ ID NO: 85371 - DNA, 20 bp, Artificial
  CRISPR gRNA sequence
ttttttaaatatcagattgt

SEQ ID NO: 85372 - DNA, 20 bp, Artificial
  CRISPR gRNA sequence
tttttaaatatcagattgtt

SEQ ID NO: 85373 - DNA, 20 bp, Artificial
  CRISPR gRNA sequence
ttttaaatatcagattgtta

SEQ ID NO: 85374 - DNA, 20 bp, Artificial
  CRISPR gRNA sequence
tttaaatatcagattgttat

SEQ ID NO: 85375 - DNA, 20 bp, Artificial
  CRISPR gRNA sequence
ttaaatatcagattgttatt

SEQ ID NO: 85376 - DNA, 20 bp, Artificial
  CRISPR gRNA sequence
taaatatcagattgttattt

SEQ ID NO: 85377 - DNA, 20 bp, Artificial
  CRISPR gRNA sequence
aaatatcagattgttatttt

SEQ ID NO: 85378 - DNA, 20 bp, Artificial
  CRISPR gRNA sequence
aatatcagattgttattttt

SEQ ID NO: 85379 - DNA, 20 bp, Artificial
  CRISPR gRNA sequence
ttattttttaaaatgacatc

SEQ ID NO: 85380 - DNA, 20 bp, Artificial
  CRISPR gRNA sequence
ttttttaaaatgacatctaa

SEQ ID NO: 85381 - DNA, 20 bp, Artificial
  CRISPR gRNA sequence
tttaaaatgacatctaacat

SEQ ID NO: 85382 - DNA, 20 bp, Artificial
  CRISPR gRNA sequence
ttaaaatgacatctaacata

SEQ ID NO: 85383 - DNA, 20 bp, Artificial
  CRISPR gRNA sequence
taaaatgacatctaacataa

SEQ ID NO: 85384 - DNA, 20 bp, Artificial
  CRISPR gRNA sequence
aaaatgacatctaacataac

SEQ ID NO: 85385 - DNA, 20 bp, Artificial
  CRISPR gRNA sequence
aaatgacatctaacataacc

SEQ ID NO: 85386 - DNA, 20 bp, Artificial
  CRISPR gRNA sequence
acataaccagcaaataccag

SEQ ID NO: 85387 - DNA, 20 bp, Artificial
  CRISPR gRNA sequence
tcctttatgttgtaaataaa

SEQ ID NO: 85388 - DNA, 20 bp, Artificial
  CRISPR gRNA sequence
tatgttgtaaataaattgta

SEQ ID NO: 85389 - DNA, 20 bp, Artificial
  CRISPR gRNA sequence
atgttgtaaataaattgtat

SEQ ID NO: 85390 - DNA, 20 bp, Artificial
  CRISPR gRNA sequence
tgttgtaaataaattgtatt

SEQ ID NO: 85391 - DNA, 20 bp, Artificial
  CRISPR gRNA sequence
taaataaattgtattcaaat

SEQ ID NO: 85392 - DNA, 20 bp, Artificial
  CRISPR gRNA sequence
tattcaaattaaatgcaatt

SEQ ID NO: 85393 - DNA, 20 bp, Artificial
  CRISPR gRNA sequence
aaattaaatgcaattttctc

SEQ ID NO: 85394 - DNA, 20 bp, Artificial
  CRISPR gRNA sequence
aatgcaattttctcatgatc

SEQ ID NO: 85395 - DNA, 20 bp, Artificial
  CRISPR gRNA sequence
tctcatgatcaaaacattct

SEQ ID NO: 85396 - DNA, 20 bp, Artificial
  CRISPR gRNA sequence
ctcatgatcaaaacattctg

SEQ ID NO: 85397 - DNA, 20 bp, Artificial
  CRISPR gRNA sequence
tcatgatcaaaacattctgc

SEQ ID NO: 85398 - DNA, 20 bp, Artificial
  CRISPR gRNA sequence
atgatcaaaacattctgctt

SEQ ID NO: 85399 - DNA, 20 bp, Artificial
  CRISPR gRNA sequence
tgctttcgatcatgttttgc

SEQ ID NO: 85400 - DNA, 20 bp, Artificial
  CRISPR gRNA sequence
ctttcgatcatgttttgcca

SEQ ID NO: 85401 - DNA, 20 bp, Artificial
  CRISPR gRNA sequence
tcgatcatgttttgccagag

SEQ ID NO: 85402 - DNA, 20 bp, Artificial
  CRISPR gRNA sequence
cgatcatgttttgccagagg

SEQ ID NO: 85403 - DNA, 20 bp, Artificial
  CRISPR gRNA sequence
gatcatgttttgccagagga

SEQ ID NO: 85404 - DNA, 20 bp, Artificial
  CRISPR gRNA sequence
tgccagaggaaaaggtgagc

SEQ ID NO: 85405 - DNA, 20 bp, Artificial
  CRISPR gRNA sequence
gccagaggaaaaggtgagcg

SEQ ID NO: 85406 - DNA, 20 bp, Artificial
  CRISPR gRNA sequence
ccagaggaaaaggtgagcgc

SEQ ID NO: 85407 - DNA, 20 bp, Artificial
  CRISPR gRNA sequence
agtgtattgccaggtactta

SEQ ID NO: 85408 - DNA, 20 bp, Artificial
  CRISPR gRNA sequence
gtgtattgccaggtacttag

SEQ ID NO: 85409 - DNA, 20 bp, Artificial
  CRISPR gRNA sequence
ccaggtacttagaaagtgct

SEQ ID NO: 85410 - DNA, 20 bp, Artificial
  CRISPR gRNA sequence
agaaagtgctcaagatctct

SEQ ID NO: 85411 - DNA, 20 bp, Artificial
  CRISPR gRNA sequence
gaaagtgctcaagatctctg

SEQ ID NO: 85412 - DNA, 20 bp, Artificial
  CRISPR gRNA sequence
aagatctctggcgtcctcaa

SEQ ID NO: 85413 - DNA, 20 bp, Artificial
  CRISPR gRNA sequence
tggcgtcctcaacagtcttg

SEQ ID NO: 85414 - DNA, 20 bp, Artificial
  CRISPR gRNA sequence
gcgtcctcaacagtcttggt

SEQ ID NO: 85415 - DNA, 20 bp, Artificial
  CRISPR gRNA sequence
aacagtcttggtaaccatct

SEQ ID NO: 85416 - DNA, 20 bp, Artificial
  CRISPR gRNA sequence
ggtaaccatcttggattatc

SEQ ID NO: 85417 - DNA, 20 bp, Artificial
  CRISPR gRNA sequence
gtaaccatcttggattatct

SEQ ID NO: 85418 - DNA, 20 bp, Artificial
  CRISPR gRNA sequence
ggattatctttattaatggt

SEQ ID NO: 85419 - DNA, 20 bp, Artificial
  CRISPR gRNA sequence
gattatctttattaatggtt

SEQ ID NO: 85420 - DNA, 20 bp, Artificial
  CRISPR gRNA sequence
tctttattaatggttttaca

SEQ ID NO: 85421 - DNA, 20 bp, Artificial
  CRISPR gRNA sequence
tattaatggttttacagctc

SEQ ID NO: 85422 - DNA, 20 bp, Artificial
  CRISPR gRNA sequence
attaatggttttacagctcc

SEQ ID NO: 85423 - DNA, 20 bp, Artificial
  CRISPR gRNA sequence
ttaatggttttacagctccc

SEQ ID NO: 85424 - DNA, 20 bp, Artificial
  CRISPR gRNA sequence
atggttttacagctcccctg

SEQ ID NO: 85425 - DNA, 20 bp, Artificial
  CRISPR gRNA sequence
tacagctcccctgactgaca

SEQ ID NO: 85426 - DNA, 20 bp, Artificial
  CRISPR gRNA sequence
acagctcccctgactgacaa

SEQ ID NO: 85427 - DNA, 20 bp, Artificial
  CRISPR gRNA sequence
cagctcccctgactgacaaa

SEQ ID NO: 85428 - DNA, 20 bp, Artificial
  CRISPR gRNA sequence
ccctgactgacaaaccttca

SEQ ID NO: 85429 - DNA, 20 bp, Artificial
  CRISPR gRNA sequence
actgacaaaccttcacttct

SEQ ID NO: 85430 - DNA, 20 bp, Artificial
  CRISPR gRNA sequence
acaaaccttcacttctttct

SEQ ID NO: 85431 - DNA, 20 bp, Artificial
  CRISPR gRNA sequence
cacttctttctttcttttct

SEQ ID NO: 85432 - DNA, 20 bp, Artificial
  CRISPR gRNA sequence
acttctttctttcttttctt

SEQ ID NO: 85433 - DNA, 20 bp, Artificial
  CRISPR gRNA sequence
ctttctttcttttcttttct

SEQ ID NO: 85434 - DNA, 20 bp, Artificial
  CRISPR gRNA sequence
tttctttcttttcttttctc

SEQ ID NO: 85435 - DNA, 20 bp, Artificial
  CRISPR gRNA sequence
tctttcttttcttttctctt

SEQ ID NO: 85436 - DNA, 20 bp, Artificial
  CRISPR gRNA sequence
ctttcttttcttttctcttt

SEQ ID NO: 85437 - DNA, 20 bp, Artificial
  CRISPR gRNA sequence
tttcttttcttttctctttc

SEQ ID NO: 85438 - DNA, 20 bp, Artificial
  CRISPR gRNA sequence
tcttttcttttctctttctt

SEQ ID NO: 85439 - DNA, 20 bp, Artificial
  CRISPR gRNA sequence
cttttcttttctctttcttt

SEQ ID NO: 85440 - DNA, 20 bp, Artificial
  CRISPR gRNA sequence
ttttcttttctctttctttt

SEQ ID NO: 85441 - DNA, 20 bp, Artificial
  CRISPR gRNA sequence
ttcttttctctttctttttt

SEQ ID NO: 85442 - DNA, 20 bp, Artificial
  CRISPR gRNA sequence
tcttttctctttcttttttt

SEQ ID NO: 85443 - DNA, 20 bp, Artificial
  CRISPR gRNA sequence
cttttctctttctttttttt

SEQ ID NO: 85444 - DNA, 20 bp, Artificial
  CRISPR gRNA sequence
ttttctctttcttttttttt

SEQ ID NO: 85445 - DNA, 20 bp, Artificial
  CRISPR gRNA sequence
ttctctttcttttttttttt

SEQ ID NO: 85446 - DNA, 20 bp, Artificial
  CRISPR gRNA sequence
tctctttctttttttttttt

SEQ ID NO: 85447 - DNA, 20 bp, Artificial
  CRISPR gRNA sequence
ctctttcttttttttttttt

SEQ ID NO: 85448 - DNA, 20 bp, Artificial
  CRISPR gRNA sequence
tctttctttttttttttttt

SEQ ID NO: 85449 - DNA, 20 bp, Artificial
  CRISPR gRNA sequence
tttctttttttttttttttc

SEQ ID NO: 85450 - DNA, 20 bp, Artificial
  CRISPR gRNA sequence
tctttttttttttttttctt

SEQ ID NO: 85451 - DNA, 20 bp, Artificial
  CRISPR gRNA sequence
ctttttttttttttttcttt

SEQ ID NO: 85452 - DNA, 20 bp, Artificial
  CRISPR gRNA sequence
tttttttttttttttctttt

SEQ ID NO: 85453 - DNA, 20 bp, Artificial
  CRISPR gRNA sequence
tttttttttttttctttttt

SEQ ID NO: 85454 - DNA, 20 bp, Artificial
  CRISPR gRNA sequence
ttttttttttttcttttttg

SEQ ID NO: 85455 - DNA, 20 bp, Artificial
  CRISPR gRNA sequence
tttttttttttcttttttga

SEQ ID NO: 85456 - DNA, 20 bp, Artificial
  CRISPR gRNA sequence
ttttttttttcttttttgag

SEQ ID NO: 85457 - DNA, 20 bp, Artificial
  CRISPR gRNA sequence
tttttttttcttttttgaga

SEQ ID NO: 85458 - DNA, 20 bp, Artificial
  CRISPR gRNA sequence
ttttttttcttttttgagag

SEQ ID NO: 85459 - DNA, 20 bp, Artificial
  CRISPR gRNA sequence
tttttttcttttttgagaga

SEQ ID NO: 85460 - DNA, 20 bp, Artificial
  CRISPR gRNA sequence
ttttttcttttttgagagac

SEQ ID NO: 85461 - DNA, 20 bp, Artificial
  CRISPR gRNA sequence
tttttcttttttgagagaca

SEQ ID NO: 85462 - DNA, 20 bp, Artificial
  CRISPR gRNA sequence
ttttcttttttgagagacag

SEQ ID NO: 85463 - DNA, 20 bp, Artificial
  CRISPR gRNA sequence
tttcttttttgagagacagg

SEQ ID NO: 85464 - DNA, 20 bp, Artificial
  CRISPR gRNA sequence
ttcttttttgagagacaggg

SEQ ID NO: 85465 - DNA, 20 bp, Artificial
  CRISPR gRNA sequence
tcttttttgagagacagggt

SEQ ID NO: 85466 - DNA, 20 bp, Artificial
  CRISPR gRNA sequence
cttttttgagagacagggtc

SEQ ID NO: 85467 - DNA, 20 bp, Artificial
  CRISPR gRNA sequence
ttttttgagagacagggtct

SEQ ID NO: 85468 - DNA, 20 bp, Artificial
  CRISPR gRNA sequence
ttttgagagacagggtctcg

SEQ ID NO: 85469 - DNA, 20 bp, Artificial
  CRISPR gRNA sequence
tttgagagacagggtctcgc

SEQ ID NO: 85470 - DNA, 20 bp, Artificial
  CRISPR gRNA sequence
ttgagagacagggtctcgct

SEQ ID NO: 85471 - DNA, 20 bp, Artificial
  CRISPR gRNA sequence
tgagagacagggtctcgctc

SEQ ID NO: 85472 - DNA, 20 bp, Artificial
  CRISPR gRNA sequence
gagagacagggtctcgctct

SEQ ID NO: 85473 - DNA, 20 bp, Artificial
  CRISPR gRNA sequence
agagacagggtctcgctctg

SEQ ID NO: 85474 - DNA, 20 bp, Artificial
  CRISPR gRNA sequence
gctctgttgcccacgctgga

SEQ ID NO: 85475 - DNA, 20 bp, Artificial
  CRISPR gRNA sequence
tgttgcccacgctggagtgc

SEQ ID NO: 85476 - DNA, 20 bp, Artificial
  CRISPR gRNA sequence
ttgcccacgctggagtgcac

SEQ ID NO: 85477 - DNA, 20 bp, Artificial
  CRISPR gRNA sequence
cccacgctggagtgcactgg

SEQ ID NO: 85478 - DNA, 20 bp, Artificial
  CRISPR gRNA sequence
gagtgcactggcgccatgat

SEQ ID NO: 85479 - DNA, 20 bp, Artificial
  CRISPR gRNA sequence
gcgccatgatagctcaaaag

SEQ ID NO: 85480 - DNA, 20 bp, Artificial
  CRISPR gRNA sequence
aaaagcctaagctcaagaga

SEQ ID NO: 85481 - DNA, 20 bp, Artificial
  CRISPR gRNA sequence
agctcaagagatcctcccgc

SEQ ID NO: 85482 - DNA, 20 bp, Artificial
  CRISPR gRNA sequence
aagagatcctcccgcctcag

SEQ ID NO: 85483 - DNA, 20 bp, Artificial
  CRISPR gRNA sequence
ccgcctcagccaccggagca

SEQ ID NO: 85484 - DNA, 20 bp, Artificial
  CRISPR gRNA sequence
agccaccggagcagctggga

SEQ ID NO: 85485 - DNA, 20 bp, Artificial
  CRISPR gRNA sequence
ggaccacaggcacgagccac

SEQ ID NO: 85486 - DNA, 20 bp, Artificial
  CRISPR gRNA sequence
atttttgttattattttttg

SEQ ID NO: 85487 - DNA, 20 bp, Artificial
  CRISPR gRNA sequence
ttgttattattttttgtaga

SEQ ID NO: 85488 - DNA, 20 bp, Artificial
  CRISPR gRNA sequence
tgttattattttttgtagag

SEQ ID NO: 85489 - DNA, 20 bp, Artificial
  CRISPR gRNA sequence
gttattattttttgtagaga

SEQ ID NO: 85490 - DNA, 20 bp, Artificial
  CRISPR gRNA sequence
ttattattttttgtagagac

SEQ ID NO: 85491 - DNA, 20 bp, Artificial
  CRISPR gRNA sequence
ttattttttgtagagaccag

SEQ ID NO: 85492 - DNA, 20 bp, Artificial
  CRISPR gRNA sequence
ttttttgtagagaccaggct

SEQ ID NO: 85493 - DNA, 20 bp, Artificial
  CRISPR gRNA sequence
tttgtagagaccaggcttca

SEQ ID NO: 85494 - DNA, 20 bp, Artificial
  CRISPR gRNA sequence
ttgtagagaccaggcttcac

SEQ ID NO: 85495 - DNA, 20 bp, Artificial
  CRISPR gRNA sequence
tgtagagaccaggcttcacc

SEQ ID NO: 85496 - DNA, 20 bp, Artificial
  CRISPR gRNA sequence
gtagagaccaggcttcacca

SEQ ID NO: 85497 - DNA, 20 bp, Artificial
  CRISPR gRNA sequence
tagagaccaggcttcaccat

SEQ ID NO: 85498 - DNA, 20 bp, Artificial
  CRISPR gRNA sequence
caccatgttggccaggctgg

SEQ ID NO: 85499 - DNA, 20 bp, Artificial
  CRISPR gRNA sequence
accatgttggccaggctggt

SEQ ID NO: 85500 - DNA, 20 bp, Artificial
  CRISPR gRNA sequence
gccaggctggtctcaactac

SEQ ID NO: 85501 - DNA, 20 bp, Artificial
  CRISPR gRNA sequence
gtctcaactacggacctcaa

SEQ ID NO: 85502 - DNA, 20 bp, Artificial
  CRISPR gRNA sequence
aactacggacctcaagccat

SEQ ID NO: 85503 - DNA, 20 bp, Artificial
  CRISPR gRNA sequence
cggacctcaagccatcctcc

SEQ ID NO: 85504 - DNA, 20 bp, Artificial
  CRISPR gRNA sequence
aagccatcctcccgcctcgg

SEQ ID NO: 85505 - DNA, 20 bp, Artificial
  CRISPR gRNA sequence
ccgcctcggcctccctaagt

SEQ ID NO: 85506 - DNA, 20 bp, Artificial
  CRISPR gRNA sequence
ggcctccctaagtgctggga

SEQ ID NO: 85507 - DNA, 20 bp, Artificial
  CRISPR gRNA sequence
cctaagtgctgggattacag

SEQ ID NO: 85508 - DNA, 20 bp, Artificial
  CRISPR gRNA sequence
agtgctgggattacaggcgt

SEQ ID NO: 85509 - DNA, 20 bp, Artificial
  CRISPR gRNA sequence
ggattacaggcgtaagctac

SEQ ID NO: 85510 - DNA, 20 bp, Artificial
  CRISPR gRNA sequence
caggcgtaagctaccacgcc

SEQ ID NO: 85511 - DNA, 20 bp, Artificial
  CRISPR gRNA sequence
ccacgcccaaccccctcatg

SEQ ID NO: 85512 - DNA, 20 bp, Artificial
  CRISPR gRNA sequence
atgttttcaaaaccgaaagt

SEQ ID NO: 85513 - DNA, 20 bp, Artificial
  CRISPR gRNA sequence
tcaaaaccgaaagtaagagg

SEQ ID NO: 85514 - DNA, 20 bp, Artificial
  CRISPR gRNA sequence
caaaaccgaaagtaagaggc

SEQ ID NO: 85515 - DNA, 20 bp, Artificial
  CRISPR gRNA sequence
aaaaccgaaagtaagaggca

SEQ ID NO: 85516 - DNA, 20 bp, Artificial
  CRISPR gRNA sequence
ggaaacaaccaggcaaagag

SEQ ID NO: 85517 - DNA, 20 bp, Artificial
  CRISPR gRNA sequence
gaaacaaccaggcaaagagc

SEQ ID NO: 85518 - DNA, 20 bp, Artificial
  CRISPR gRNA sequence
tgtacgaaaagaccacaggg

SEQ ID NO: 85519 - DNA, 20 bp, Artificial
  CRISPR gRNA sequence
tacgaaaagaccacagggcc

SEQ ID NO: 85520 - DNA, 20 bp, Artificial
  CRISPR gRNA sequence
gctctggagaatctcacgca

SEQ ID NO: 85521 - DNA, 20 bp, Artificial
  CRISPR gRNA sequence
ctctggagaatctcacgcag

SEQ ID NO: 85522 - DNA, 20 bp, Artificial
  CRISPR gRNA sequence
tggagaatctcacgcagaag

SEQ ID NO: 85523 - DNA, 20 bp, Artificial
  CRISPR gRNA sequence
gagaatctcacgcagaaggc

SEQ ID NO: 85524 - DNA, 20 bp, Artificial
  CRISPR gRNA sequence
acgcagaaggcaggcgtttt

SEQ ID NO: 85525 - DNA, 20 bp, Artificial
  CRISPR gRNA sequence
ttcttaaaaaaaaatgcacg

SEQ ID NO: 85526 - DNA, 20 bp, Artificial
  CRISPR gRNA sequence
tcttaaaaaaaaatgcacga

SEQ ID NO: 85527 - DNA, 20 bp, Artificial
  CRISPR gRNA sequence
cttaaaaaaaaatgcacgaa

SEQ ID NO: 85528 - DNA, 20 bp, Artificial
  CRISPR gRNA sequence
ttaaaaaaaaatgcacgaat

SEQ ID NO: 85529 - DNA, 20 bp, Artificial
  CRISPR gRNA sequence
aaaaaaaaatgcacgaatta

SEQ ID NO: 85530 - DNA, 20 bp, Artificial
  CRISPR gRNA sequence
aaaaaaaatgcacgaattac

SEQ ID NO: 85531 - DNA, 20 bp, Artificial
  CRISPR gRNA sequence
cagccaaaaggcatgcgctc

SEQ ID NO: 85532 - DNA, 20 bp, Artificial
  CRISPR gRNA sequence
ccgcaaaagccctggttagg

SEQ ID NO: 85533 - DNA, 20 bp, Artificial
  CRISPR gRNA sequence
gttaggcttgacttcaatct

SEQ ID NO: 85534 - DNA, 20 bp, Artificial
  CRISPR gRNA sequence
ggcttgacttcaatctcgat

SEQ ID NO: 85535 - DNA, 20 bp, Artificial
  CRISPR gRNA sequence
gacttcaatctcgattgctg

SEQ ID NO: 85536 - DNA, 20 bp, Artificial
  CRISPR gRNA sequence
acttcaatctcgattgctgc

SEQ ID NO: 85537 - DNA, 20 bp, Artificial
  CRISPR gRNA sequence
caatctcgattgctgccatt

SEQ ID NO: 85538 - DNA, 20 bp, Artificial
  CRISPR gRNA sequence
aatctcgattgctgccattt

SEQ ID NO: 85539 - DNA, 20 bp, Artificial
  CRISPR gRNA sequence
gattgctgccatttatcccc

SEQ ID NO: 85540 - DNA, 20 bp, Artificial
  CRISPR gRNA sequence
ctgccatttatcccctgtgt

SEQ ID NO: 85541 - DNA, 20 bp, Artificial
  CRISPR gRNA sequence
ccatttatcccctgtgtaat

SEQ ID NO: 85542 - DNA, 20 bp, Artificial
  CRISPR gRNA sequence
atcccctgtgtaattaagtt

SEQ ID NO: 85543 - DNA, 20 bp, Artificial
  CRISPR gRNA sequence
tcccctgtgtaattaagttt

SEQ ID NO: 85544 - DNA, 20 bp, Artificial
  CRISPR gRNA sequence
tgtaattaagtttcttaaaa

SEQ ID NO: 85545 - DNA, 20 bp, Artificial
  CRISPR gRNA sequence
agtttcttaaaatctcggtg

SEQ ID NO: 85546 - DNA, 20 bp, Artificial
  CRISPR gRNA sequence
cttaaaatctcggtgcctta

SEQ ID NO: 85547 - DNA, 20 bp, Artificial
  CRISPR gRNA sequence
ttaaaatctcggtgccttag

SEQ ID NO: 85548 - DNA, 20 bp, Artificial
  CRISPR gRNA sequence
aaaatctcggtgccttagtt

SEQ ID NO: 85549 - DNA, 20 bp, Artificial
  CRISPR gRNA sequence
aaatctcggtgccttagttt

SEQ ID NO: 85550 - DNA, 20 bp, Artificial
  CRISPR gRNA sequence
ggtgccttagtttcttcatc

SEQ ID NO: 85551 - DNA, 20 bp, Artificial
  CRISPR gRNA sequence
agtttcttcatctgtgagag

SEQ ID NO: 85552 - DNA, 20 bp, Artificial
  CRISPR gRNA sequence
gtttcttcatctgtgagagg

SEQ ID NO: 85553 - DNA, 20 bp, Artificial
  CRISPR gRNA sequence
cttcatctgtgagaggcaga

SEQ ID NO: 85554 - DNA, 20 bp, Artificial
  CRISPR gRNA sequence
ttcatctgtgagaggcagaa

SEQ ID NO: 85555 - DNA, 20 bp, Artificial
  CRISPR gRNA sequence
catctgtgagaggcagaaga

SEQ ID NO: 85556 - DNA, 20 bp, Artificial
  CRISPR gRNA sequence
atctgtgagaggcagaagat

SEQ ID NO: 85557 - DNA, 20 bp, Artificial
  CRISPR gRNA sequence
tgagaggcagaagataacca

SEQ ID NO: 85558 - DNA, 20 bp, Artificial
  CRISPR gRNA sequence
tctatggcggaagataactg

SEQ ID NO: 85559 - DNA, 20 bp, Artificial
  CRISPR gRNA sequence
tggcggaagataactgtttt

SEQ ID NO: 85560 - DNA, 20 bp, Artificial
  CRISPR gRNA sequence
ttttcaaaattaaatgacgc

SEQ ID NO: 85561 - DNA, 20 bp, Artificial
  CRISPR gRNA sequence
tcaaaattaaatgacgcaaa

SEQ ID NO: 85562 - DNA, 20 bp, Artificial
  CRISPR gRNA sequence
caaaattaaatgacgcaaag

SEQ ID NO: 85563 - DNA, 20 bp, Artificial
  CRISPR gRNA sequence
aaaattaaatgacgcaaagc

SEQ ID NO: 85564 - DNA, 20 bp, Artificial
  CRISPR gRNA sequence
aatgacgcaaagcacataaa

SEQ ID NO: 85565 - DNA, 20 bp, Artificial
  CRISPR gRNA sequence
ggcacacagaaagatgtcaa

SEQ ID NO: 85566 - DNA, 20 bp, Artificial
  CRISPR gRNA sequence
gcacacagaaagatgtcaat

SEQ ID NO: 85567 - DNA, 20 bp, Artificial
  CRISPR gRNA sequence
ttataattttttaaaagtga

SEQ ID NO: 85568 - DNA, 20 bp, Artificial
  CRISPR gRNA sequence
ataattttttaaaagtgaca

SEQ ID NO: 85569 - DNA, 20 bp, Artificial
  CRISPR gRNA sequence
taattttttaaaagtgacat

SEQ ID NO: 85570 - DNA, 20 bp, Artificial
  CRISPR gRNA sequence
tttaaaagtgacatgtgatg

SEQ ID NO: 85571 - DNA, 20 bp, Artificial
  CRISPR gRNA sequence
ttaaaagtgacatgtgatgg

SEQ ID NO: 85572 - DNA, 20 bp, Artificial
  CRISPR gRNA sequence
taaaagtgacatgtgatggg

SEQ ID NO: 85573 - DNA, 20 bp, Artificial
  CRISPR gRNA sequence
aaaagtgacatgtgatggga

SEQ ID NO: 85574 - DNA, 20 bp, Artificial
  CRISPR gRNA sequence
aaagtgacatgtgatgggaa

SEQ ID NO: 85575 - DNA, 20 bp, Artificial
  CRISPR gRNA sequence
attattcgaaaccgctttgt

SEQ ID NO: 85576 - DNA, 20 bp, Artificial
  CRISPR gRNA sequence
ttcgaaaccgctttgtatca

SEQ ID NO: 85577 - DNA, 20 bp, Artificial
  CRISPR gRNA sequence
gaaaccgctttgtatcacag

SEQ ID NO: 85578 - DNA, 20 bp, Artificial
  CRISPR gRNA sequence
tgtatcacagccaagcattc

SEQ ID NO: 85579 - DNA, 20 bp, Artificial
  CRISPR gRNA sequence
gtatcacagccaagcattct

SEQ ID NO: 85580 - DNA, 20 bp, Artificial
  CRISPR gRNA sequence
tatcacagccaagcattcta

SEQ ID NO: 85581 - DNA, 20 bp, Artificial
  CRISPR gRNA sequence
tacaaacgtcgcgtgctgtt

SEQ ID NO: 85582 - DNA, 20 bp, Artificial
  CRISPR gRNA sequence
caaacgtcgcgtgctgtttc

SEQ ID NO: 85583 - DNA, 20 bp, Artificial
  CRISPR gRNA sequence
tttcctccccacggtgtggc

SEQ ID NO: 85584 - DNA, 20 bp, Artificial
  CRISPR gRNA sequence
cctccccacggtgtggcccc

SEQ ID NO: 85585 - DNA, 20 bp, Artificial
  CRISPR gRNA sequence
ctccccacggtgtggcccca

SEQ ID NO: 85586 - DNA, 20 bp, Artificial
  CRISPR gRNA sequence
cccacggtgtggccccacat

SEQ ID NO: 85587 - DNA, 20 bp, Artificial
  CRISPR gRNA sequence
ggacatgcgaacttagcggg

SEQ ID NO: 85588 - DNA, 20 bp, Artificial
  CRISPR gRNA sequence
agcgggcgcctagacgaagt

SEQ ID NO: 85589 - DNA, 20 bp, Artificial
  CRISPR gRNA sequence
gcgggcgcctagacgaagtc

SEQ ID NO: 85590 - DNA, 20 bp, Artificial
  CRISPR gRNA sequence
gacgaagtccacagctctcc

SEQ ID NO: 85591 - DNA, 20 bp, Artificial
  CRISPR gRNA sequence
tccagtctaagggaagcaga

SEQ ID NO: 85592 - DNA, 20 bp, Artificial
  CRISPR gRNA sequence
cagtctaagggaagcagagc

SEQ ID NO: 85593 - DNA, 20 bp, Artificial
  CRISPR gRNA sequence
agggaagcagagccgcagca

SEQ ID NO: 85594 - DNA, 20 bp, Artificial
  CRISPR gRNA sequence
acccgggcgacgcctccccc

SEQ ID NO: 85595 - DNA, 20 bp, Artificial
  CRISPR gRNA sequence
cccgggcgacgcctccccca

SEQ ID NO: 85596 - DNA, 20 bp, Artificial
  CRISPR gRNA sequence
ccccagaccccaagcgcccc

SEQ ID NO: 85597 - DNA, 20 bp, Artificial
  CRISPR gRNA sequence
cacgcgttcacaaacctcag

SEQ ID NO: 85598 - DNA, 20 bp, Artificial
  CRISPR gRNA sequence
acaaacctcagcgccgcgcc

SEQ ID NO: 85599 - DNA, 20 bp, Artificial
  CRISPR gRNA sequence
agcgccgcgcctttgggacg

SEQ ID NO: 85600 - DNA, 20 bp, Artificial
  CRISPR gRNA sequence
tgggacgagcctacccgtcc

SEQ ID NO: 85601 - DNA, 20 bp, Artificial
  CRISPR gRNA sequence
gggacgagcctacccgtccc

SEQ ID NO: 85602 - DNA, 20 bp, Artificial
  CRISPR gRNA sequence
ggacgagcctacccgtcccc

SEQ ID NO: 85603 - DNA, 20 bp, Artificial
  CRISPR gRNA sequence
cccgtcccccactccagctg

SEQ ID NO: 85604 - DNA, 20 bp, Artificial
  CRISPR gRNA sequence
cagctgcgctgggggagcca

SEQ ID NO: 85605 - DNA, 20 bp, Artificial
  CRISPR gRNA sequence
cgctgggggagccagaggcc

SEQ ID NO: 85606 - DNA, 20 bp, Artificial
  CRISPR gRNA sequence
ggggagccagaggccccgcg

SEQ ID NO: 85607 - DNA, 20 bp, Artificial
  CRISPR gRNA sequence
ccccaacctcggcgctctga

SEQ ID NO: 85608 - DNA, 20 bp, Artificial
  CRISPR gRNA sequence
ggcgctctgacgcttatcga

SEQ ID NO: 85609 - DNA, 20 bp, Artificial
  CRISPR gRNA sequence
tgacgcttatcgacgcccta

SEQ ID NO: 85610 - DNA, 20 bp, Artificial
  CRISPR gRNA sequence
acgcttatcgacgccctaaa

SEQ ID NO: 85611 - DNA, 20 bp, Artificial
  CRISPR gRNA sequence
atcgacgccctaaactttgt

SEQ ID NO: 85612 - DNA, 20 bp, Artificial
  CRISPR gRNA sequence
tcgacgccctaaactttgtc

SEQ ID NO: 85613 - DNA, 20 bp, Artificial
  CRISPR gRNA sequence
aactttgtcccgaccctccc

SEQ ID NO: 85614 - DNA, 20 bp, Artificial
  CRISPR gRNA sequence
tgtcccgaccctcccgtcgc

SEQ ID NO: 85615 - DNA, 20 bp, Artificial
  CRISPR gRNA sequence
gtcccgaccctcccgtcgcc

SEQ ID NO: 85616 - DNA, 20 bp, Artificial
  CRISPR gRNA sequence
tcccgaccctcccgtcgccg

SEQ ID NO: 85617 - DNA, 20 bp, Artificial
  CRISPR gRNA sequence
ccgtcgccgtaggccaaagg

SEQ ID NO: 85618 - DNA, 20 bp, Artificial
  CRISPR gRNA sequence
ccctgctccccgccgaaagg

SEQ ID NO: 85619 - DNA, 20 bp, Artificial
  CRISPR gRNA sequence
ctccccgccgaaaggggcaa

SEQ ID NO: 85620 - DNA, 20 bp, Artificial
  CRISPR gRNA sequence
cccgccgaaaggggcaagta

SEQ ID NO: 85621 - DNA, 20 bp, Artificial
  CRISPR gRNA sequence
ccccactcccaggccacccc

SEQ ID NO: 85622 - DNA, 20 bp, Artificial
  CRISPR gRNA sequence
cccactcccaggccaccccg

SEQ ID NO: 85623 - DNA, 20 bp, Artificial
  CRISPR gRNA sequence
ccaggccaccccgccgcttc

SEQ ID NO: 85624 - DNA, 20 bp, Artificial
  CRISPR gRNA sequence
ccccgagatccagccctgga

SEQ ID NO: 85625 - DNA, 20 bp, Artificial
  CRISPR gRNA sequence
cccgagatccagccctggac

SEQ ID NO: 85626 - DNA, 20 bp, Artificial
  CRISPR gRNA sequence
gactagccccacggcgggcc

SEQ ID NO: 85627 - DNA, 20 bp, Artificial
  CRISPR gRNA sequence
gccccacggcgggccaccaa

SEQ ID NO: 85628 - DNA, 20 bp, Artificial
  CRISPR gRNA sequence
ggagaagggaagtcacggag

SEQ ID NO: 85629 - DNA, 20 bp, Artificial
  CRISPR gRNA sequence
gagaagggaagtcacggagc

SEQ ID NO: 85630 - DNA, 20 bp, Artificial
  CRISPR gRNA sequence
acgctggatagcctccaggc

SEQ ID NO: 85631 - DNA, 20 bp, Artificial
  CRISPR gRNA sequence
gatagcctccaggccagaaa

SEQ ID NO: 85632 - DNA, 20 bp, Artificial
  CRISPR gRNA sequence
caggccagaaagagagagta

SEQ ID NO: 85633 - DNA, 20 bp, Artificial
  CRISPR gRNA sequence
aggccacggagcgagacatc

SEQ ID NO: 85634 - DNA, 20 bp, Artificial
  CRISPR gRNA sequence
ggcccgaatgctgtcagctt

SEQ ID NO: 85635 - DNA, 20 bp, Artificial
  CRISPR gRNA sequence
tcagcttcaggaatgcccgc

SEQ ID NO: 85636 - DNA, 20 bp, Artificial
  CRISPR gRNA sequence
caggaatgcccgccagcgcg

SEQ ID NO: 85637 - DNA, 20 bp, Artificial
  CRISPR gRNA sequence
aggaatgcccgccagcgcga

SEQ ID NO: 85638 - DNA, 20 bp, Artificial
  CRISPR gRNA sequence
cacttatattaaacgcgtgc

SEQ ID NO: 85639 - DNA, 20 bp, Artificial
  CRISPR gRNA sequence
atattaaacgcgtgcccagc

SEQ ID NO: 85640 - DNA, 20 bp, Artificial
  CRISPR gRNA sequence
tattaaacgcgtgcccagcc

SEQ ID NO: 85641 - DNA, 20 bp, Artificial
  CRISPR gRNA sequence
aacgcgtgcccagccaatca

SEQ ID NO: 85642 - DNA, 20 bp, Artificial
  CRISPR gRNA sequence
tctccaagccagcgacgcag

SEQ ID NO: 85643 - DNA, 20 bp, Artificial
  CRISPR gRNA sequence
caagccagcgacgcagtgcc

SEQ ID NO: 85644 - DNA, 20 bp, Artificial
  CRISPR gRNA sequence
gagagagggactttcccgtt

SEQ ID NO: 85645 - DNA, 20 bp, Artificial
  CRISPR gRNA sequence
aaaatatctatagcagataa

SEQ ID NO: 85646 - DNA, 20 bp, Artificial
  CRISPR gRNA sequence
agataatagacacgaaaatt

SEQ ID NO: 85647 - DNA, 20 bp, Artificial
  CRISPR gRNA sequence
gataatagacacgaaaatta

SEQ ID NO: 85648 - DNA, 20 bp, Artificial
  CRISPR gRNA sequence
atagacacgaaaattaagga

SEQ ID NO: 85649 - DNA, 20 bp, Artificial
  CRISPR gRNA sequence
gacacgaaaattaaggacag

SEQ ID NO: 85650 - DNA, 20 bp, Artificial
  CRISPR gRNA sequence
taaggacagtggttaccgct

SEQ ID NO: 85651 - DNA, 20 bp, Artificial
  CRISPR gRNA sequence
ggacagtggttaccgctaag

SEQ ID NO: 85652 - DNA, 20 bp, Artificial
  CRISPR gRNA sequence
acagtggttaccgctaagaa

SEQ ID NO: 85653 - DNA, 20 bp, Artificial
  CRISPR gRNA sequence
cagtggttaccgctaagaag

SEQ ID NO: 85654 - DNA, 20 bp, Artificial
  CRISPR gRNA sequence
tggttaccgctaagaagagg

SEQ ID NO: 85655 - DNA, 20 bp, Artificial
  CRISPR gRNA sequence
ggttaccgctaagaagaggc

SEQ ID NO: 85656 - DNA, 20 bp, Artificial
  CRISPR gRNA sequence
gttaccgctaagaagaggcg

SEQ ID NO: 85657 - DNA, 20 bp, Artificial
  CRISPR gRNA sequence
ttaccgctaagaagaggcgg

SEQ ID NO: 85658 - DNA, 20 bp, Artificial
  CRISPR gRNA sequence
cgctaagaagaggcggggga

SEQ ID NO: 85659 - DNA, 20 bp, Artificial
  CRISPR gRNA sequence
gctaagaagaggcgggggac

SEQ ID NO: 85660 - DNA, 20 bp, Artificial
  CRISPR gRNA sequence
agaagaggcgggggacaggc

SEQ ID NO: 85661 - DNA, 20 bp, Artificial
  CRISPR gRNA sequence
gaagaggcgggggacaggct

SEQ ID NO: 85662 - DNA, 20 bp, Artificial
  CRISPR gRNA sequence
aagaggcgggggacaggcta

SEQ ID NO: 85663 - DNA, 20 bp, Artificial
  CRISPR gRNA sequence
gaggcgggggacaggctagg

SEQ ID NO: 85664 - DNA, 20 bp, Artificial
  CRISPR gRNA sequence
aggcgggggacaggctaggg

SEQ ID NO: 85665 - DNA, 20 bp, Artificial
  CRISPR gRNA sequence
agggaggaacacaaacacaa

SEQ ID NO: 85666 - DNA, 20 bp, Artificial
  CRISPR gRNA sequence
gttttaatgtatatgtgtta

SEQ ID NO: 85667 - DNA, 20 bp, Artificial
  CRISPR gRNA sequence
ttttaatgtatatgtgttat

SEQ ID NO: 85668 - DNA, 20 bp, Artificial
  CRISPR gRNA sequence
tgtatatgtgttatgggtca

SEQ ID NO: 85669 - DNA, 20 bp, Artificial
  CRISPR gRNA sequence
gtatatgtgttatgggtcat

SEQ ID NO: 85670 - DNA, 20 bp, Artificial
  CRISPR gRNA sequence
tatgggtcataggtactcat

SEQ ID NO: 85671 - DNA, 20 bp, Artificial
  CRISPR gRNA sequence
gcttcataatttattcacgt

SEQ ID NO: 85672 - DNA, 20 bp, Artificial
  CRISPR gRNA sequence
cacgttagatatactcttta

SEQ ID NO: 85673 - DNA, 20 bp, Artificial
  CRISPR gRNA sequence
taatttcttaaaatctgctg

SEQ ID NO: 85674 - DNA, 20 bp, Artificial
  CRISPR gRNA sequence
tttcttaaaatctgctgtgg

SEQ ID NO: 85675 - DNA, 20 bp, Artificial
  CRISPR gRNA sequence
tggaaataaatgaacacatg

SEQ ID NO: 85676 - DNA, 20 bp, Artificial
  CRISPR gRNA sequence
aacacatgaagtctccctga

SEQ ID NO: 85677 - DNA, 20 bp, Artificial
  CRISPR gRNA sequence
aagtctccctgaaagaaaat

SEQ ID NO: 85678 - DNA, 20 bp, Artificial
  CRISPR gRNA sequence
gaaagaaaatcagtgtttct

SEQ ID NO: 85679 - DNA, 20 bp, Artificial
  CRISPR gRNA sequence
aaagaaaatcagtgtttctt

SEQ ID NO: 85680 - DNA, 20 bp, Artificial
  CRISPR gRNA sequence
gaaaatcagtgtttcttggg

SEQ ID NO: 85681 - DNA, 20 bp, Artificial
  CRISPR gRNA sequence
agtgtttcttgggaagaacc

SEQ ID NO: 85682 - DNA, 20 bp, Artificial
  CRISPR gRNA sequence
gaagaaccaagattccctga

SEQ ID NO: 85683 - DNA, 20 bp, Artificial
  CRISPR gRNA sequence
gaaccaagattccctgacag

SEQ ID NO: 85684 - DNA, 20 bp, Artificial
  CRISPR gRNA sequence
ctgacagaagctaccctatg

SEQ ID NO: 85685 - DNA, 20 bp, Artificial
  CRISPR gRNA sequence
gacagaagctaccctatgta

SEQ ID NO: 85686 - DNA, 20 bp, Artificial
  CRISPR gRNA sequence
acagaagctaccctatgtag

SEQ ID NO: 85687 - DNA, 20 bp, Artificial
  CRISPR gRNA sequence
gctaccctatgtagaggaca

SEQ ID NO: 85688 - DNA, 20 bp, Artificial
  CRISPR gRNA sequence
accctatgtagaggacaaag

SEQ ID NO: 85689 - DNA, 20 bp, Artificial
  CRISPR gRNA sequence
ccctatgtagaggacaaagt

SEQ ID NO: 85690 - DNA, 20 bp, Artificial
  CRISPR gRNA sequence
agtaggtcttcaataaatat

SEQ ID NO: 85691 - DNA, 20 bp, Artificial
  CRISPR gRNA sequence
ggtcttcaataaatattagt

SEQ ID NO: 85692 - DNA, 20 bp, Artificial
  CRISPR gRNA sequence
gttggtttactgcttttccc

SEQ ID NO: 85693 - DNA, 20 bp, Artificial
  CRISPR gRNA sequence
ttggtttactgcttttccca

SEQ ID NO: 85694 - DNA, 20 bp, Artificial
  CRISPR gRNA sequence
gcttttcccaaggatacatc

SEQ ID NO: 85695 - DNA, 20 bp, Artificial
  CRISPR gRNA sequence
ttttcccaaggatacatctg

SEQ ID NO: 85696 - DNA, 20 bp, Artificial
  CRISPR gRNA sequence
tttcccaaggatacatctgg

SEQ ID NO: 85697 - DNA, 20 bp, Artificial
  CRISPR gRNA sequence
ttcccaaggatacatctgga

SEQ ID NO: 85698 - DNA, 20 bp, Artificial
  CRISPR gRNA sequence
ggtctgcattcctttctcat

SEQ ID NO: 85699 - DNA, 20 bp, Artificial
  CRISPR gRNA sequence
tcattggtgccgcctgacca

SEQ ID NO: 85700 - DNA, 20 bp, Artificial
  CRISPR gRNA sequence
gtgccgcctgaccacagaac

SEQ ID NO: 85701 - DNA, 20 bp, Artificial
  CRISPR gRNA sequence
gacatctaacctaaaccccg

SEQ ID NO: 85702 - DNA, 20 bp, Artificial
  CRISPR gRNA sequence
aacctaaaccccgcagtcct

SEQ ID NO: 85703 - DNA, 20 bp, Artificial
  CRISPR gRNA sequence
taagtcctgacacgtatgac

SEQ ID NO: 85704 - DNA, 20 bp, Artificial
  CRISPR gRNA sequence
tatgacaagatgctgccacc

SEQ ID NO: 85705 - DNA, 20 bp, Artificial
  CRISPR gRNA sequence
gacaagatgctgccacctgg

SEQ ID NO: 85706 - DNA, 20 bp, Artificial
  CRISPR gRNA sequence
atgctgccacctggtggata

SEQ ID NO: 85707 - DNA, 20 bp, Artificial
  CRISPR gRNA sequence
gccacctggtggatacagaa

SEQ ID NO: 85708 - DNA, 20 bp, Artificial
  CRISPR gRNA sequence
acagaatagatttaatgaaa

SEQ ID NO: 85709 - DNA, 20 bp, Artificial
  CRISPR gRNA sequence
aatagatttaatgaaatggc

SEQ ID NO: 85710 - DNA, 20 bp, Artificial
  CRISPR gRNA sequence
atagatttaatgaaatggct

SEQ ID NO: 85711 - DNA, 20 bp, Artificial
  CRISPR gRNA sequence
gatttaatgaaatggctagg

SEQ ID NO: 85712 - DNA, 20 bp, Artificial
  CRISPR gRNA sequence
ggctaggaagtctttcactc

SEQ ID NO: 85713 - DNA, 20 bp, Artificial
  CRISPR gRNA sequence
aggaagtctttcactctagt

SEQ ID NO: 85714 - DNA, 20 bp, Artificial
  CRISPR gRNA sequence
aagtctttcactctagttgg

SEQ ID NO: 85715 - DNA, 20 bp, Artificial
  CRISPR gRNA sequence
ttcactctagttggtggaac

SEQ ID NO: 85716 - DNA, 20 bp, Artificial
  CRISPR gRNA sequence
ctagttggtggaactggcaa

SEQ ID NO: 85717 - DNA, 20 bp, Artificial
  CRISPR gRNA sequence
tagttggtggaactggcaat

SEQ ID NO: 85718 - DNA, 20 bp, Artificial
  CRISPR gRNA sequence
agttggtggaactggcaata

SEQ ID NO: 85719 - DNA, 20 bp, Artificial
  CRISPR gRNA sequence
ggtggaactggcaatagggt

SEQ ID NO: 85720 - DNA, 20 bp, Artificial
  CRISPR gRNA sequence
tggaactggcaatagggtga

SEQ ID NO: 85721 - DNA, 20 bp, Artificial
  CRISPR gRNA sequence
ggaactggcaatagggtgag

SEQ ID NO: 85722 - DNA, 20 bp, Artificial
  CRISPR gRNA sequence
gaactggcaatagggtgaga

SEQ ID NO: 85723 - DNA, 20 bp, Artificial
  CRISPR gRNA sequence
ctggcaatagggtgagaggg

SEQ ID NO: 85724 - DNA, 20 bp, Artificial
  CRISPR gRNA sequence
gcaatagggtgagagggaag

SEQ ID NO: 85725 - DNA, 20 bp, Artificial
  CRISPR gRNA sequence
caatagggtgagagggaagc

SEQ ID NO: 85726 - DNA, 20 bp, Artificial
  CRISPR gRNA sequence
ggtgagagggaagcaggaat

SEQ ID NO: 85727 - DNA, 20 bp, Artificial
  CRISPR gRNA sequence
gagagggaagcaggaatgag

SEQ ID NO: 85728 - DNA, 20 bp, Artificial
  CRISPR gRNA sequence
ggaatgagaagacaaaaatt

SEQ ID NO: 85729 - DNA, 20 bp, Artificial
  CRISPR gRNA sequence
agaagacaaaaattaagaaa

SEQ ID NO: 85730 - DNA, 20 bp, Artificial
  CRISPR gRNA sequence
gaagacaaaaattaagaaac

SEQ ID NO: 85731 - DNA, 20 bp, Artificial
  CRISPR gRNA sequence
caaaaattaagaaacaggaa

SEQ ID NO: 85732 - DNA, 20 bp, Artificial
  CRISPR gRNA sequence
aaaaattaagaaacaggaaa

SEQ ID NO: 85733 - DNA, 20 bp, Artificial
  CRISPR gRNA sequence
aattaagaaacaggaaaagg

SEQ ID NO: 85734 - DNA, 20 bp, Artificial
  CRISPR gRNA sequence
attaagaaacaggaaaagga

SEQ ID NO: 85735 - DNA, 20 bp, Artificial
  CRISPR gRNA sequence
taagaaacaggaaaaggaag

SEQ ID NO: 85736 - DNA, 20 bp, Artificial
  CRISPR gRNA sequence
aaggagctccatctctaata

SEQ ID NO: 85737 - DNA, 20 bp, Artificial
  CRISPR gRNA sequence
ggagctccatctctaatatg

SEQ ID NO: 85738 - DNA, 20 bp, Artificial
  CRISPR gRNA sequence
gagctccatctctaatatgg

SEQ ID NO: 85739 - DNA, 20 bp, Artificial
  CRISPR gRNA sequence
ctccatctctaatatggagg

SEQ ID NO: 85740 - DNA, 20 bp, Artificial
  CRISPR gRNA sequence
ctaatatggaggtagaaaaa

SEQ ID NO: 85741 - DNA, 20 bp, Artificial
  CRISPR gRNA sequence
taatatggaggtagaaaaaa

SEQ ID NO: 85742 - DNA, 20 bp, Artificial
  CRISPR gRNA sequence
aatatggaggtagaaaaaaa

SEQ ID NO: 85743 - DNA, 20 bp, Artificial
  CRISPR gRNA sequence
aaagggactatcatctaaat

SEQ ID NO: 85744 - DNA, 20 bp, Artificial
  CRISPR gRNA sequence
ctatcatctaaatgagactg

SEQ ID NO: 85745 - DNA, 20 bp, Artificial
  CRISPR gRNA sequence
atcatctaaatgagactgaa

SEQ ID NO: 85746 - DNA, 20 bp, Artificial
  CRISPR gRNA sequence
aaatgagactgaagagtccc

SEQ ID NO: 85747 - DNA, 20 bp, Artificial
  CRISPR gRNA sequence
atgagactgaagagtcccta

SEQ ID NO: 85748 - DNA, 20 bp, Artificial
  CRISPR gRNA sequence
tgagactgaagagtccctag

SEQ ID NO: 85749 - DNA, 20 bp, Artificial
  CRISPR gRNA sequence
agactgaagagtccctagag

SEQ ID NO: 85750 - DNA, 20 bp, Artificial
  CRISPR gRNA sequence
gaagagtccctagaggagaa

SEQ ID NO: 85751 - DNA, 20 bp, Artificial
  CRISPR gRNA sequence
gcttccctctccttccttct

SEQ ID NO: 85752 - DNA, 20 bp, Artificial
  CRISPR gRNA sequence
cctctccttccttctgagac

SEQ ID NO: 85753 - DNA, 20 bp, Artificial
  CRISPR gRNA sequence
ttccttctgagactagaaac

SEQ ID NO: 85754 - DNA, 20 bp, Artificial
  CRISPR gRNA sequence
tccttctgagactagaaacg

SEQ ID NO: 85755 - DNA, 20 bp, Artificial
  CRISPR gRNA sequence
tctgagactagaaacgagga

SEQ ID NO: 85756 - DNA, 20 bp, Artificial
  CRISPR gRNA sequence
tgagactagaaacgaggaaa

SEQ ID NO: 85757 - DNA, 20 bp, Artificial
  CRISPR gRNA sequence
gagactagaaacgaggaaag

SEQ ID NO: 85758 - DNA, 20 bp, Artificial
  CRISPR gRNA sequence
agaaacgaggaaagaggcta

SEQ ID NO: 85759 - DNA, 20 bp, Artificial
  CRISPR gRNA sequence
aagaggctacagcttgtatt

SEQ ID NO: 85760 - DNA, 20 bp, Artificial
  CRISPR gRNA sequence
agaggctacagcttgtattg

SEQ ID NO: 85761 - DNA, 20 bp, Artificial
  CRISPR gRNA sequence
gaggctacagcttgtattga

SEQ ID NO: 85762 - DNA, 20 bp, Artificial
  CRISPR gRNA sequence
gcttgtattgagggaaatgc

SEQ ID NO: 85763 - DNA, 20 bp, Artificial
  CRISPR gRNA sequence
attgagggaaatgcaagact

SEQ ID NO: 85764 - DNA, 20 bp, Artificial
  CRISPR gRNA sequence
ttgagggaaatgcaagactg

SEQ ID NO: 85765 - DNA, 20 bp, Artificial
  CRISPR gRNA sequence
gagggaaatgcaagactgag

SEQ ID NO: 85766 - DNA, 20 bp, Artificial
  CRISPR gRNA sequence
aaatgcaagactgaggagaa

SEQ ID NO: 85767 - DNA, 20 bp, Artificial
  CRISPR gRNA sequence
gcaagactgaggagaaaaga

SEQ ID NO: 85768 - DNA, 20 bp, Artificial
  CRISPR gRNA sequence
agactgaggagaaaagaaag

SEQ ID NO: 85769 - DNA, 20 bp, Artificial
  CRISPR gRNA sequence
gactgaggagaaaagaaagc

SEQ ID NO: 85770 - DNA, 20 bp, Artificial
  CRISPR gRNA sequence
aggagaaaagaaagcaggtc

SEQ ID NO: 85771 - DNA, 20 bp, Artificial
  CRISPR gRNA sequence
aggtctagctgatctcaact

SEQ ID NO: 85772 - DNA, 20 bp, Artificial
  CRISPR gRNA sequence
ctagctgatctcaacttagc

SEQ ID NO: 85773 - DNA, 20 bp, Artificial
  CRISPR gRNA sequence
tcaacttagcaagctaaaat

SEQ ID NO: 85774 - DNA, 20 bp, Artificial
  CRISPR gRNA sequence
aacttagcaagctaaaataa

SEQ ID NO: 85775 - DNA, 20 bp, Artificial
  CRISPR gRNA sequence
ttagcaagctaaaataagag

SEQ ID NO: 85776 - DNA, 20 bp, Artificial
  CRISPR gRNA sequence
aagctaaaataagagtagcc

SEQ ID NO: 85777 - DNA, 20 bp, Artificial
  CRISPR gRNA sequence
aaataagagtagcctggtgt

SEQ ID NO: 85778 - DNA, 20 bp, Artificial
  CRISPR gRNA sequence
taagagtagcctggtgttag

SEQ ID NO: 85779 - DNA, 20 bp, Artificial
  CRISPR gRNA sequence
cctggtgttagcggccaccc

SEQ ID NO: 85780 - DNA, 20 bp, Artificial
  CRISPR gRNA sequence
cccaagcaactccctgctcc

SEQ ID NO: 85781 - DNA, 20 bp, Artificial
  CRISPR gRNA sequence
ccctgctcctagtttccact

SEQ ID NO: 85782 - DNA, 20 bp, Artificial
  CRISPR gRNA sequence
cctgctcctagtttccactt

SEQ ID NO: 85783 - DNA, 20 bp, Artificial
  CRISPR gRNA sequence
ctgctcctagtttccacttg

SEQ ID NO: 85784 - DNA, 20 bp, Artificial
  CRISPR gRNA sequence
ttggggaatccatgtgattt

SEQ ID NO: 85785 - DNA, 20 bp, Artificial
  CRISPR gRNA sequence
tggggaatccatgtgatttt

SEQ ID NO: 85786 - DNA, 20 bp, Artificial
  CRISPR gRNA sequence
ggggaatccatgtgattttg

SEQ ID NO: 85787 - DNA, 20 bp, Artificial
  CRISPR gRNA sequence
ggaatccatgtgattttggg

SEQ ID NO: 85788 - DNA, 20 bp, Artificial
  CRISPR gRNA sequence
gaatccatgtgattttgggg

SEQ ID NO: 85789 - DNA, 20 bp, Artificial
  CRISPR gRNA sequence
gacccccacccttttcccca

SEQ ID NO: 85790 - DNA, 20 bp, Artificial
  CRISPR gRNA sequence
acccccacccttttccccaa

SEQ ID NO: 85791 - DNA, 20 bp, Artificial
  CRISPR gRNA sequence
caaaggtgttgtccatgata

SEQ ID NO: 85792 - DNA, 20 bp, Artificial
  CRISPR gRNA sequence
tgttgtccatgatatagaat

SEQ ID NO: 85793 - DNA, 20 bp, Artificial
  CRISPR gRNA sequence
atgatatagaataagcaaat

SEQ ID NO: 85794 - DNA, 20 bp, Artificial
  CRISPR gRNA sequence
attagcatgtatcatcctcc

SEQ ID NO: 85795 - DNA, 20 bp, Artificial
  CRISPR gRNA sequence
atgtatcatcctcctggcca

SEQ ID NO: 85796 - DNA, 20 bp, Artificial
  CRISPR gRNA sequence
atcctcctggccacagtgat

SEQ ID NO: 85797 - DNA, 20 bp, Artificial
  CRISPR gRNA sequence
tcctggccacagtgattggt

SEQ ID NO: 85798 - DNA, 20 bp, Artificial
  CRISPR gRNA sequence
cctggccacagtgattggtc

SEQ ID NO: 85799 - DNA, 20 bp, Artificial
  CRISPR gRNA sequence
ctggccacagtgattggtca

SEQ ID NO: 85800 - DNA, 20 bp, Artificial
  CRISPR gRNA sequence
gccacagtgattggtcaggg

SEQ ID NO: 85801 - DNA, 20 bp, Artificial
  CRISPR gRNA sequence
gtcagggtggacatgtgacc

SEQ ID NO: 85802 - DNA, 20 bp, Artificial
  CRISPR gRNA sequence
tcagggtggacatgtgaccc

SEQ ID NO: 85803 - DNA, 20 bp, Artificial
  CRISPR gRNA sequence
acatgtgacccaggcctaat

SEQ ID NO: 85804 - DNA, 20 bp, Artificial
  CRISPR gRNA sequence
ggcctaatcagtgtgaatat

SEQ ID NO: 85805 - DNA, 20 bp, Artificial
  CRISPR gRNA sequence
gcctaatcagtgtgaatatt

SEQ ID NO: 85806 - DNA, 20 bp, Artificial
  CRISPR gRNA sequence
cctaatcagtgtgaatatta

SEQ ID NO: 85807 - DNA, 20 bp, Artificial
  CRISPR gRNA sequence
tgaatattagggcttttgct

SEQ ID NO: 85808 - DNA, 20 bp, Artificial
  CRISPR gRNA sequence
agggcttttgctgagatttc

SEQ ID NO: 85809 - DNA, 20 bp, Artificial
  CRISPR gRNA sequence
ttgctgagatttctggtaca

SEQ ID NO: 85810 - DNA, 20 bp, Artificial
  CRISPR gRNA sequence
agatgccttctttttctgat

SEQ ID NO: 85811 - DNA, 20 bp, Artificial
  CRISPR gRNA sequence
tttttctgattggacataaa

SEQ ID NO: 85812 - DNA, 20 bp, Artificial
  CRISPR gRNA sequence
ttttctgattggacataaat

SEQ ID NO: 85813 - DNA, 20 bp, Artificial
  CRISPR gRNA sequence
tttctgattggacataaatg

SEQ ID NO: 85814 - DNA, 20 bp, Artificial
  CRISPR gRNA sequence
gattggacataaatggggaa

SEQ ID NO: 85815 - DNA, 20 bp, Artificial
  CRISPR gRNA sequence
aatggggaaaagtgtaatct

SEQ ID NO: 85816 - DNA, 20 bp, Artificial
  CRISPR gRNA sequence
atggggaaaagtgtaatctt

SEQ ID NO: 85817 - DNA, 20 bp, Artificial
  CRISPR gRNA sequence
aagtgtaatcttaggaatgc

SEQ ID NO: 85818 - DNA, 20 bp, Artificial
  CRISPR gRNA sequence
tgtaatcttaggaatgctgg

SEQ ID NO: 85819 - DNA, 20 bp, Artificial
  CRISPR gRNA sequence
taggaatgctggcagccatt

SEQ ID NO: 85820 - DNA, 20 bp, Artificial
  CRISPR gRNA sequence
gaatgctggcagccattaag

SEQ ID NO: 85821 - DNA, 20 bp, Artificial
  CRISPR gRNA sequence
ctggcagccattaagtggcc

SEQ ID NO: 85822 - DNA, 20 bp, Artificial
  CRISPR gRNA sequence
ttaagtggcccagacttaaa

SEQ ID NO: 85823 - DNA, 20 bp, Artificial
  CRISPR gRNA sequence
cccagacttaaatggtccta

SEQ ID NO: 85824 - DNA, 20 bp, Artificial
  CRISPR gRNA sequence
agacttaaatggtcctacag

SEQ ID NO: 85825 - DNA, 20 bp, Artificial
  CRISPR gRNA sequence
tggtcctacagaagatgcaa

SEQ ID NO: 85826 - DNA, 20 bp, Artificial
  CRISPR gRNA sequence
cctacagaagatgcaacagt

SEQ ID NO: 85827 - DNA, 20 bp, Artificial
  CRISPR gRNA sequence
aagatgcaacagtgagaaaa

SEQ ID NO: 85828 - DNA, 20 bp, Artificial
  CRISPR gRNA sequence
tgcaacagtgagaaaaaagt

SEQ ID NO: 85829 - DNA, 20 bp, Artificial
  CRISPR gRNA sequence
cagtgagaaaaaagtcagtc

SEQ ID NO: 85830 - DNA, 20 bp, Artificial
  CRISPR gRNA sequence
aaaaaagtcagtccggtatt

SEQ ID NO: 85831 - DNA, 20 bp, Artificial
  CRISPR gRNA sequence
aaaagtcagtccggtattta

SEQ ID NO: 85832 - DNA, 20 bp, Artificial
  CRISPR gRNA sequence
ttagagacatactgaactac

SEQ ID NO: 85833 - DNA, 20 bp, Artificial
  CRISPR gRNA sequence
tagagacatactgaactact

SEQ ID NO: 85834 - DNA, 20 bp, Artificial
  CRISPR gRNA sequence
acatactgaactactgggtc

SEQ ID NO: 85835 - DNA, 20 bp, Artificial
  CRISPR gRNA sequence
tactgggtcaagtcttcacc

SEQ ID NO: 85836 - DNA, 20 bp, Artificial
  CRISPR gRNA sequence
ctgggtcaagtcttcacctg

SEQ ID NO: 85837 - DNA, 20 bp, Artificial
  CRISPR gRNA sequence
gtcaagtcttcacctggagc

SEQ ID NO: 85838 - DNA, 20 bp, Artificial
  CRISPR gRNA sequence
cctggagccagcactaccta

SEQ ID NO: 85839 - DNA, 20 bp, Artificial
  CRISPR gRNA sequence
agcactacctatggactttc

SEQ ID NO: 85840 - DNA, 20 bp, Artificial
  CRISPR gRNA sequence
caataaatcctttttatttt

SEQ ID NO: 85841 - DNA, 20 bp, Artificial
  CRISPR gRNA sequence
aaatcctttttattttaagc

SEQ ID NO: 85842 - DNA, 20 bp, Artificial
  CRISPR gRNA sequence
tattttaagccagtttgaat

SEQ ID NO: 85843 - DNA, 20 bp, Artificial
  CRISPR gRNA sequence
attttaagccagtttgaatt

SEQ ID NO: 85844 - DNA, 20 bp, Artificial
  CRISPR gRNA sequence
tttctgtgatttaaaaccaa

SEQ ID NO: 85845 - DNA, 20 bp, Artificial
  CRISPR gRNA sequence
acctatatattcatcatact

SEQ ID NO: 85846 - DNA, 20 bp, Artificial
  CRISPR gRNA sequence
agcccattcctaccttccca

SEQ ID NO: 85847 - DNA, 20 bp, Artificial
  CRISPR gRNA sequence
gcccattcctaccttcccac

SEQ ID NO: 85848 - DNA, 20 bp, Artificial
  CRISPR gRNA sequence
attcctaccttcccacagga

SEQ ID NO: 85849 - DNA, 20 bp, Artificial
  CRISPR gRNA sequence
taccttcccacaggatagca

SEQ ID NO: 85850 - DNA, 20 bp, Artificial
  CRISPR gRNA sequence
accttcccacaggatagcac

SEQ ID NO: 85851 - DNA, 20 bp, Artificial
  CRISPR gRNA sequence
ccttcccacaggatagcaca

SEQ ID NO: 85852 - DNA, 20 bp, Artificial
  CRISPR gRNA sequence
acaggatagcacagggaata

SEQ ID NO: 85853 - DNA, 20 bp, Artificial
  CRISPR gRNA sequence
caggatagcacagggaatac

SEQ ID NO: 85854 - DNA, 20 bp, Artificial
  CRISPR gRNA sequence
atagcacagggaatacaggt

SEQ ID NO: 85855 - DNA, 20 bp, Artificial
  CRISPR gRNA sequence
tagcacagggaatacaggta

SEQ ID NO: 85856 - DNA, 20 bp, Artificial
  CRISPR gRNA sequence
gaatacaggtaaggtcacta

SEQ ID NO: 85857 - DNA, 20 bp, Artificial
  CRISPR gRNA sequence
taaggtcactacagatttat

SEQ ID NO: 85858 - DNA, 20 bp, Artificial
  CRISPR gRNA sequence
cagatttattggttacacta

SEQ ID NO: 85859 - DNA, 20 bp, Artificial
  CRISPR gRNA sequence
ttattggttacactaaagcc

SEQ ID NO: 85860 - DNA, 20 bp, Artificial
  CRISPR gRNA sequence
tattggttacactaaagccc

SEQ ID NO: 85861 - DNA, 20 bp, Artificial
  CRISPR gRNA sequence
attggttacactaaagccca

SEQ ID NO: 85862 - DNA, 20 bp, Artificial
  CRISPR gRNA sequence
acactaaagcccagggtatc

SEQ ID NO: 85863 - DNA, 20 bp, Artificial
  CRISPR gRNA sequence
gcccagggtatcaagctgaa

SEQ ID NO: 85864 - DNA, 20 bp, Artificial
  CRISPR gRNA sequence
cccagggtatcaagctgaaa

SEQ ID NO: 85865 - DNA, 20 bp, Artificial
  CRISPR gRNA sequence
gggtatcaagctgaaaaggt

SEQ ID NO: 85866 - DNA, 20 bp, Artificial
  CRISPR gRNA sequence
gtatcaagctgaaaaggtca

SEQ ID NO: 85867 - DNA, 20 bp, Artificial
  CRISPR gRNA sequence
tatcaagctgaaaaggtcag

SEQ ID NO: 85868 - DNA, 20 bp, Artificial
  CRISPR gRNA sequence
caagctgaaaaggtcagagg

SEQ ID NO: 85869 - DNA, 20 bp, Artificial
  CRISPR gRNA sequence
aaaaggtcagaggcagcaac

SEQ ID NO: 85870 - DNA, 20 bp, Artificial
  CRISPR gRNA sequence
aaaggtcagaggcagcaacc

SEQ ID NO: 85871 - DNA, 20 bp, Artificial
  CRISPR gRNA sequence
agaggcagcaaccaggtact

SEQ ID NO: 85872 - DNA, 20 bp, Artificial
  CRISPR gRNA sequence
ggcagcaaccaggtactaag

SEQ ID NO: 85873 - DNA, 20 bp, Artificial
  CRISPR gRNA sequence
caaccaggtactaagtagac

SEQ ID NO: 85874 - DNA, 20 bp, Artificial
  CRISPR gRNA sequence
aaccaggtactaagtagact

SEQ ID NO: 85875 - DNA, 20 bp, Artificial
  CRISPR gRNA sequence
actaagtagactgggtgact

SEQ ID NO: 85876 - DNA, 20 bp, Artificial
  CRISPR gRNA sequence
gggtgactcagctgtctgta

SEQ ID NO: 85877 - DNA, 20 bp, Artificial
  CRISPR gRNA sequence
gtgactcagctgtctgtaca

SEQ ID NO: 85878 - DNA, 20 bp, Artificial
  CRISPR gRNA sequence
tgactcagctgtctgtacag

SEQ ID NO: 85879 - DNA, 20 bp, Artificial
  CRISPR gRNA sequence
actcagctgtctgtacagag

SEQ ID NO: 85880 - DNA, 20 bp, Artificial
  CRISPR gRNA sequence
gctgtctgtacagaggagaa

SEQ ID NO: 85881 - DNA, 20 bp, Artificial
  CRISPR gRNA sequence
cagaggagaatggacttcct

SEQ ID NO: 85882 - DNA, 20 bp, Artificial
  CRISPR gRNA sequence
agaggagaatggacttcctt

SEQ ID NO: 85883 - DNA, 20 bp, Artificial
  CRISPR gRNA sequence
agaatggacttccttaggaa

SEQ ID NO: 85884 - DNA, 20 bp, Artificial
  CRISPR gRNA sequence
ggacttccttaggaaaagaa

SEQ ID NO: 85885 - DNA, 20 bp, Artificial
  CRISPR gRNA sequence
taggaaaagaatagccaaat

SEQ ID NO: 85886 - DNA, 20 bp, Artificial
  CRISPR gRNA sequence
gaaaagaatagccaaatgag

SEQ ID NO: 85887 - DNA, 20 bp, Artificial
  CRISPR gRNA sequence
agaatagccaaatgagaagc

SEQ ID NO: 85888 - DNA, 20 bp, Artificial
  CRISPR gRNA sequence
ccaaatgagaagcaagtgca

SEQ ID NO: 85889 - DNA, 20 bp, Artificial
  CRISPR gRNA sequence
aatgagaagcaagtgcaaag

SEQ ID NO: 85890 - DNA, 20 bp, Artificial
  CRISPR gRNA sequence
atgagaagcaagtgcaaaga

SEQ ID NO: 85891 - DNA, 20 bp, Artificial
  CRISPR gRNA sequence
tgagaagcaagtgcaaagaa

SEQ ID NO: 85892 - DNA, 20 bp, Artificial
  CRISPR gRNA sequence
gtgcaaagaagggcctctac

SEQ ID NO: 85893 - DNA, 20 bp, Artificial
  CRISPR gRNA sequence
tgcaaagaagggcctctact

SEQ ID NO: 85894 - DNA, 20 bp, Artificial
  CRISPR gRNA sequence
agaagggcctctactaggca

SEQ ID NO: 85895 - DNA, 20 bp, Artificial
  CRISPR gRNA sequence
tctactaggcaaagttaacg

SEQ ID NO: 85896 - DNA, 20 bp, Artificial
  CRISPR gRNA sequence
ctactaggcaaagttaacgt

SEQ ID NO: 85897 - DNA, 20 bp, Artificial
  CRISPR gRNA sequence
tactaggcaaagttaacgta

SEQ ID NO: 85898 - DNA, 20 bp, Artificial
  CRISPR gRNA sequence
gatataaacactcttcccca

SEQ ID NO: 85899 - DNA, 20 bp, Artificial
  CRISPR gRNA sequence
ttccccacagacctgtatca

SEQ ID NO: 85900 - DNA, 20 bp, Artificial
  CRISPR gRNA sequence
tccccacagacctgtatcat

SEQ ID NO: 85901 - DNA, 20 bp, Artificial
  CRISPR gRNA sequence
ccccacagacctgtatcatg

SEQ ID NO: 85902 - DNA, 20 bp, Artificial
  CRISPR gRNA sequence
cccacagacctgtatcatgg

SEQ ID NO: 85903 - DNA, 20 bp, Artificial
  CRISPR gRNA sequence
tatcatgggggtgttgcttt

SEQ ID NO: 85904 - DNA, 20 bp, Artificial
  CRISPR gRNA sequence
atcatgggggtgttgctttt

SEQ ID NO: 85905 - DNA, 20 bp, Artificial
  CRISPR gRNA sequence
cttttgggtctttatgctcc

SEQ ID NO: 85906 - DNA, 20 bp, Artificial
  CRISPR gRNA sequence
ttttgggtctttatgctcct

SEQ ID NO: 85907 - DNA, 20 bp, Artificial
  CRISPR gRNA sequence
ggtctttatgctcctgggat

SEQ ID NO: 85908 - DNA, 20 bp, Artificial
  CRISPR gRNA sequence
gtctttatgctcctgggata

SEQ ID NO: 85909 - DNA, 20 bp, Artificial
  CRISPR gRNA sequence
tcctgggataaggaactttg

SEQ ID NO: 85910 - DNA, 20 bp, Artificial
  CRISPR gRNA sequence
tttgaagcacatgctccttt

SEQ ID NO: 85911 - DNA, 20 bp, Artificial
  CRISPR gRNA sequence
tttaagtctttattaccctg

SEQ ID NO: 85912 - DNA, 20 bp, Artificial
  CRISPR gRNA sequence
gtctttattaccctgtggtg

SEQ ID NO: 85913 - DNA, 20 bp, Artificial
  CRISPR gRNA sequence
gtctacctctccctttgcca

SEQ ID NO: 85914 - DNA, 20 bp, Artificial
  CRISPR gRNA sequence
tctacctctccctttgccaa

SEQ ID NO: 85915 - DNA, 20 bp, Artificial
  CRISPR gRNA sequence
ctctccctttgccaaaggaa

SEQ ID NO: 85916 - DNA, 20 bp, Artificial
  CRISPR gRNA sequence
ccaaaggaaaagcctccttt

SEQ ID NO: 85917 - DNA, 20 bp, Artificial
  CRISPR gRNA sequence
ccttgatgacactcactttt

SEQ ID NO: 85918 - DNA, 20 bp, Artificial
  CRISPR gRNA sequence
cttgatgacactcacttttg

SEQ ID NO: 85919 - DNA, 20 bp, Artificial
  CRISPR gRNA sequence
ttgatgacactcacttttga

SEQ ID NO: 85920 - DNA, 20 bp, Artificial
  CRISPR gRNA sequence
tgatgacactcacttttgag

SEQ ID NO: 85921 - DNA, 20 bp, Artificial
  CRISPR gRNA sequence
cactcacttttgaggggacc

SEQ ID NO: 85922 - DNA, 20 bp, Artificial
  CRISPR gRNA sequence
actcacttttgaggggacca

SEQ ID NO: 85923 - DNA, 20 bp, Artificial
  CRISPR gRNA sequence
ctcacttttgaggggaccaa

SEQ ID NO: 85924 - DNA, 20 bp, Artificial
  CRISPR gRNA sequence
aattttatcttctgcttctt

SEQ ID NO: 85925 - DNA, 20 bp, Artificial
  CRISPR gRNA sequence
cttctgcttctttggtatgc

SEQ ID NO: 85926 - DNA, 20 bp, Artificial
  CRISPR gRNA sequence
ttctgcttctttggtatgct

SEQ ID NO: 85927 - DNA, 20 bp, Artificial
  CRISPR gRNA sequence
ttctttggtatgctgggaac

SEQ ID NO: 85928 - DNA, 20 bp, Artificial
  CRISPR gRNA sequence
tctttggtatgctgggaacc

SEQ ID NO: 85929 - DNA, 20 bp, Artificial
  CRISPR gRNA sequence
ctttggtatgctgggaaccg

SEQ ID NO: 85930 - DNA, 20 bp, Artificial
  CRISPR gRNA sequence
accggggccccttcctcctt

SEQ ID NO: 85931 - DNA, 20 bp, Artificial
  CRISPR gRNA sequence
gccccttcctcctttggaaa

SEQ ID NO: 85932 - DNA, 20 bp, Artificial
  CRISPR gRNA sequence
cagtaccatctccctgaccc

SEQ ID NO: 85933 - DNA, 20 bp, Artificial
  CRISPR gRNA sequence
agtaccatctccctgaccct

SEQ ID NO: 85934 - DNA, 20 bp, Artificial
  CRISPR gRNA sequence
ccatctccctgaccctgggc

SEQ ID NO: 85935 - DNA, 20 bp, Artificial
  CRISPR gRNA sequence
ggcaagtactgccccctttt

SEQ ID NO: 85936 - DNA, 20 bp, Artificial
  CRISPR gRNA sequence
cccttttcagcctctcccat

SEQ ID NO: 85937 - DNA, 20 bp, Artificial
  CRISPR gRNA sequence
tcagcctctcccattggccc

SEQ ID NO: 85938 - DNA, 20 bp, Artificial
  CRISPR gRNA sequence
ccctggcctctctgcccctc

SEQ ID NO: 85939 - DNA, 20 bp, Artificial
  CRISPR gRNA sequence
gcctctctgcccctccagct

SEQ ID NO: 85940 - DNA, 20 bp, Artificial
  CRISPR gRNA sequence
ctgagttgccttcccctcct

SEQ ID NO: 85941 - DNA, 20 bp, Artificial
  CRISPR gRNA sequence
cctgagccccatgtctccca

SEQ ID NO: 85942 - DNA, 20 bp, Artificial
  CRISPR gRNA sequence
atgtctcccatggtaacctt

SEQ ID NO: 85943 - DNA, 20 bp, Artificial
  CRISPR gRNA sequence
tgtctcccatggtaaccttg

SEQ ID NO: 85944 - DNA, 20 bp, Artificial
  CRISPR gRNA sequence
cccatggtaaccttgaggac

SEQ ID NO: 85945 - DNA, 20 bp, Artificial
  CRISPR gRNA sequence
ccatggtaaccttgaggact

SEQ ID NO: 85946 - DNA, 20 bp, Artificial
  CRISPR gRNA sequence
tggtaaccttgaggactggg

SEQ ID NO: 85947 - DNA, 20 bp, Artificial
  CRISPR gRNA sequence
tgaggactgggcagattcca

SEQ ID NO: 85948 - DNA, 20 bp, Artificial
  CRISPR gRNA sequence
ggactgggcagattccatgg

SEQ ID NO: 85949 - DNA, 20 bp, Artificial
  CRISPR gRNA sequence
tccatggcagctgctgactt

SEQ ID NO: 85950 - DNA, 20 bp, Artificial
  CRISPR gRNA sequence
catggcagctgctgacttga

SEQ ID NO: 85951 - DNA, 20 bp, Artificial
  CRISPR gRNA sequence
atggcagctgctgacttgag

SEQ ID NO: 85952 - DNA, 20 bp, Artificial
  CRISPR gRNA sequence
tggcagctgctgacttgaga

SEQ ID NO: 85953 - DNA, 20 bp, Artificial
  CRISPR gRNA sequence
ggcagctgctgacttgagag

SEQ ID NO: 85954 - DNA, 20 bp, Artificial
  CRISPR gRNA sequence
agctgctgacttgagagggg

SEQ ID NO: 85955 - DNA, 20 bp, Artificial
  CRISPR gRNA sequence
acttccacctgacttttttc

SEQ ID NO: 85956 - DNA, 20 bp, Artificial
  CRISPR gRNA sequence
cttccacctgacttttttcg

SEQ ID NO: 85957 - DNA, 20 bp, Artificial
  CRISPR gRNA sequence
ttccacctgacttttttcga

SEQ ID NO: 85958 - DNA, 20 bp, Artificial
  CRISPR gRNA sequence
agggcgcccccgtttccttt

SEQ ID NO: 85959 - DNA, 20 bp, Artificial
  CRISPR gRNA sequence
tatatcctgctttgctgctt

SEQ ID NO: 85960 - DNA, 20 bp, Artificial
  CRISPR gRNA sequence
tcctgctttgctgctttagc

SEQ ID NO: 85961 - DNA, 20 bp, Artificial
  CRISPR gRNA sequence
tgctttgctgctttagctgg

SEQ ID NO: 85962 - DNA, 20 bp, Artificial
  CRISPR gRNA sequence
ctttgctgctttagctggtg

SEQ ID NO: 85963 - DNA, 20 bp, Artificial
  CRISPR gRNA sequence
agctggtggagcctgcccac

SEQ ID NO: 85964 - DNA, 20 bp, Artificial
  CRISPR gRNA sequence
ctgcccactggcctcactca

SEQ ID NO: 85965 - DNA, 20 bp, Artificial
  CRISPR gRNA sequence
tgcccactggcctcactcac

SEQ ID NO: 85966 - DNA, 20 bp, Artificial
  CRISPR gRNA sequence
ggcctcactcacaggtactt

SEQ ID NO: 85967 - DNA, 20 bp, Artificial
  CRISPR gRNA sequence
ctcttgacacccttgtcatg

SEQ ID NO: 85968 - DNA, 20 bp, Artificial
  CRISPR gRNA sequence
cacccttgtcatgtggtcct

SEQ ID NO: 85969 - DNA, 20 bp, Artificial
  CRISPR gRNA sequence
cctctctgttctctgtgccc

SEQ ID NO: 85970 - DNA, 20 bp, Artificial
  CRISPR gRNA sequence
ctctctgttctctgtgcccc

SEQ ID NO: 85971 - DNA, 20 bp, Artificial
  CRISPR gRNA sequence
tctctgttctctgtgccccg

SEQ ID NO: 85972 - DNA, 20 bp, Artificial
  CRISPR gRNA sequence
gttctctgtgccccggggct

SEQ ID NO: 85973 - DNA, 20 bp, Artificial
  CRISPR gRNA sequence
tctgtgccccggggctgagt

SEQ ID NO: 85974 - DNA, 20 bp, Artificial
  CRISPR gRNA sequence
ccggggctgagtgagtcccc

SEQ ID NO: 85975 - DNA, 20 bp, Artificial
  CRISPR gRNA sequence
cggggctgagtgagtccccc

SEQ ID NO: 85976 - DNA, 20 bp, Artificial
  CRISPR gRNA sequence
ggctgagtgagtcccccagg

SEQ ID NO: 85977 - DNA, 20 bp, Artificial
  CRISPR gRNA sequence
ctgagtgagtcccccaggtg

SEQ ID NO: 85978 - DNA, 20 bp, Artificial
  CRISPR gRNA sequence
tcccccaggtggagctcgcc

SEQ ID NO: 85979 - DNA, 20 bp, Artificial
  CRISPR gRNA sequence
cccccaggtggagctcgccc

SEQ ID NO: 85980 - DNA, 20 bp, Artificial
  CRISPR gRNA sequence
aggtggagctcgcccaggcc

SEQ ID NO: 85981 - DNA, 20 bp, Artificial
  CRISPR gRNA sequence
ggtggagctcgcccaggccc

SEQ ID NO: 85982 - DNA, 20 bp, Artificial
  CRISPR gRNA sequence
agctcgcccaggcccaggtc

SEQ ID NO: 85983 - DNA, 20 bp, Artificial
  CRISPR gRNA sequence
gctcgcccaggcccaggtcc

SEQ ID NO: 85984 - DNA, 20 bp, Artificial
  CRISPR gRNA sequence
cccaggcccaggtccaggtc

SEQ ID NO: 85985 - DNA, 20 bp, Artificial
  CRISPR gRNA sequence
ccaggcccaggtccaggtcc

SEQ ID NO: 85986 - DNA, 20 bp, Artificial
  CRISPR gRNA sequence
cccaggtccaggtccaggca

SEQ ID NO: 85987 - DNA, 20 bp, Artificial
  CRISPR gRNA sequence
aggtccaggtccaggcaaag

SEQ ID NO: 85988 - DNA, 20 bp, Artificial
  CRISPR gRNA sequence
ggtccaggtccaggcaaagc

SEQ ID NO: 85989 - DNA, 20 bp, Artificial
  CRISPR gRNA sequence
aggtccaggcaaagcaggaa

SEQ ID NO: 85990 - DNA, 20 bp, Artificial
  CRISPR gRNA sequence
ccaggcaaagcaggaacagt

SEQ ID NO: 85991 - DNA, 20 bp, Artificial
  CRISPR gRNA sequence
gcaaagcaggaacagttggt

SEQ ID NO: 85992 - DNA, 20 bp, Artificial
  CRISPR gRNA sequence
tggtaagatcatgttaatga

SEQ ID NO: 85993 - DNA, 20 bp, Artificial
  CRISPR gRNA sequence
ggtaagatcatgttaatgat

SEQ ID NO: 85994 - DNA, 20 bp, Artificial
  CRISPR gRNA sequence
gatcatgttaatgatgggca

SEQ ID NO: 85995 - DNA, 20 bp, Artificial
  CRISPR gRNA sequence
ttaatgatgggcacagctgc

SEQ ID NO: 85996 - DNA, 20 bp, Artificial
  CRISPR gRNA sequence
taatgatgggcacagctgct

SEQ ID NO: 85997 - DNA, 20 bp, Artificial
  CRISPR gRNA sequence
aatgatgggcacagctgctg

SEQ ID NO: 85998 - DNA, 20 bp, Artificial
  CRISPR gRNA sequence
atgatgggcacagctgctgg

SEQ ID NO: 85999 - DNA, 20 bp, Artificial
  CRISPR gRNA sequence
cacagctgctgggggtgccc

SEQ ID NO: 86000 - DNA, 20 bp, Artificial
  CRISPR gRNA sequence
tgggggtgccccggccctac

SEQ ID NO: 86001 - DNA, 20 bp, Artificial
  CRISPR gRNA sequence
ggtgccccggccctactaga

SEQ ID NO: 86002 - DNA, 20 bp, Artificial
  CRISPR gRNA sequence
tgccccggccctactagaca

SEQ ID NO: 86003 - DNA, 20 bp, Artificial
  CRISPR gRNA sequence
gccccggccctactagacag

SEQ ID NO: 86004 - DNA, 20 bp, Artificial
  CRISPR gRNA sequence
ccggccctactagacagagg

SEQ ID NO: 86005 - DNA, 20 bp, Artificial
  CRISPR gRNA sequence
cctactagacagaggcagtg

SEQ ID NO: 86006 - DNA, 20 bp, Artificial
  CRISPR gRNA sequence
agaggcagtgtagccacttt

SEQ ID NO: 86007 - DNA, 20 bp, Artificial
  CRISPR gRNA sequence
gaggcagtgtagccactttc

SEQ ID NO: 86008 - DNA, 20 bp, Artificial
  CRISPR gRNA sequence
aggcagtgtagccactttca

SEQ ID NO: 86009 - DNA, 20 bp, Artificial
  CRISPR gRNA sequence
agccactttcagggcacctg

SEQ ID NO: 86010 - DNA, 20 bp, Artificial
  CRISPR gRNA sequence
actttcagggcacctgaaga

SEQ ID NO: 86011 - DNA, 20 bp, Artificial
  CRISPR gRNA sequence
cagggcacctgaagaaagcc

SEQ ID NO: 86012 - DNA, 20 bp, Artificial
  CRISPR gRNA sequence
agggcacctgaagaaagcct

SEQ ID NO: 86013 - DNA, 20 bp, Artificial
  CRISPR gRNA sequence
gggcacctgaagaaagcctg

SEQ ID NO: 86014 - DNA, 20 bp, Artificial
  CRISPR gRNA sequence
ggcacctgaagaaagcctgg

SEQ ID NO: 86015 - DNA, 20 bp, Artificial
  CRISPR gRNA sequence
cctgaagaaagcctgggggc

SEQ ID NO: 86016 - DNA, 20 bp, Artificial
  CRISPR gRNA sequence
agaaagcctgggggccagaa

SEQ ID NO: 86017 - DNA, 20 bp, Artificial
  CRISPR gRNA sequence
gaaagcctgggggccagaat

SEQ ID NO: 86018 - DNA, 20 bp, Artificial
  CRISPR gRNA sequence
agcctgggggccagaatagg

SEQ ID NO: 86019 - DNA, 20 bp, Artificial
  CRISPR gRNA sequence
cctgggggccagaataggtg

SEQ ID NO: 86020 - DNA, 20 bp, Artificial
  CRISPR gRNA sequence
tgggggccagaataggtgga

SEQ ID NO: 86021 - DNA, 20 bp, Artificial
  CRISPR gRNA sequence
gccagaataggtggagagac

SEQ ID NO: 86022 - DNA, 20 bp, Artificial
  CRISPR gRNA sequence
ccagaataggtggagagact

SEQ ID NO: 86023 - DNA, 20 bp, Artificial
  CRISPR gRNA sequence
ataggtggagagactgggat

SEQ ID NO: 86024 - DNA, 20 bp, Artificial
  CRISPR gRNA sequence
ggtggagagactgggattgg

SEQ ID NO: 86025 - DNA, 20 bp, Artificial
  CRISPR gRNA sequence
gagactgggattggcggaat

SEQ ID NO: 86026 - DNA, 20 bp, Artificial
  CRISPR gRNA sequence
ctgggattggcggaattagt

SEQ ID NO: 86027 - DNA, 20 bp, Artificial
  CRISPR gRNA sequence
gattggcggaattagtgagc

SEQ ID NO: 86028 - DNA, 20 bp, Artificial
  CRISPR gRNA sequence
attggcggaattagtgagcg

SEQ ID NO: 86029 - DNA, 20 bp, Artificial
  CRISPR gRNA sequence
ttggcggaattagtgagcga

SEQ ID NO: 86030 - DNA, 20 bp, Artificial
  CRISPR gRNA sequence
tggcggaattagtgagcgag

SEQ ID NO: 86031 - DNA, 20 bp, Artificial
  CRISPR gRNA sequence
gaattagtgagcgaggggcc

SEQ ID NO: 86032 - DNA, 20 bp, Artificial
  CRISPR gRNA sequence
aattagtgagcgaggggccc

SEQ ID NO: 86033 - DNA, 20 bp, Artificial
  CRISPR gRNA sequence
attagtgagcgaggggcccg

SEQ ID NO: 86034 - DNA, 20 bp, Artificial
  CRISPR gRNA sequence
agtgagcgaggggcccgggg

SEQ ID NO: 86035 - DNA, 20 bp, Artificial
  CRISPR gRNA sequence
gtgagcgaggggcccgggga

SEQ ID NO: 86036 - DNA, 20 bp, Artificial
  CRISPR gRNA sequence
gagcgaggggcccggggaag

SEQ ID NO: 86037 - DNA, 20 bp, Artificial
  CRISPR gRNA sequence
cgaggggcccggggaaggag

SEQ ID NO: 86038 - DNA, 20 bp, Artificial
  CRISPR gRNA sequence
aggggcccggggaaggagca

SEQ ID NO: 86039 - DNA, 20 bp, Artificial
  CRISPR gRNA sequence
ggggcccggggaaggagcag

SEQ ID NO: 86040 - DNA, 20 bp, Artificial
  CRISPR gRNA sequence
gcccggggaaggagcagagg

SEQ ID NO: 86041 - DNA, 20 bp, Artificial
  CRISPR gRNA sequence
gggaaggagcagaggcagcc

SEQ ID NO: 86042 - DNA, 20 bp, Artificial
  CRISPR gRNA sequence
agcagaggcagccgagccac

SEQ ID NO: 86043 - DNA, 20 bp, Artificial
  CRISPR gRNA sequence
gcagaggcagccgagccact

SEQ ID NO: 86044 - DNA, 20 bp, Artificial
  CRISPR gRNA sequence
cagaggcagccgagccacta

SEQ ID NO: 86045 - DNA, 20 bp, Artificial
  CRISPR gRNA sequence
gccactagggcattaacctg

SEQ ID NO: 86046 - DNA, 20 bp, Artificial
  CRISPR gRNA sequence
ccactagggcattaacctgc

SEQ ID NO: 86047 - DNA, 20 bp, Artificial
  CRISPR gRNA sequence
ggcattaacctgcaggttat

SEQ ID NO: 86048 - DNA, 20 bp, Artificial
  CRISPR gRNA sequence
acctgcaggttattggctcc

SEQ ID NO: 86049 - DNA, 20 bp, Artificial
  CRISPR gRNA sequence
cctgcaggttattggctcct

SEQ ID NO: 86050 - DNA, 20 bp, Artificial
  CRISPR gRNA sequence
ctgcaggttattggctcctg

SEQ ID NO: 86051 - DNA, 20 bp, Artificial
  CRISPR gRNA sequence
ggttattggctcctggggcc

SEQ ID NO: 86052 - DNA, 20 bp, Artificial
  CRISPR gRNA sequence
ttcttccgctctccacgtgc

SEQ ID NO: 86053 - DNA, 20 bp, Artificial
  CRISPR gRNA sequence
cttccgctctccacgtgcga

SEQ ID NO: 86054 - DNA, 20 bp, Artificial
  CRISPR gRNA sequence
ttccgctctccacgtgcgag

SEQ ID NO: 86055 - DNA, 20 bp, Artificial
  CRISPR gRNA sequence
ctctccacgtgcgagaggac

SEQ ID NO: 86056 - DNA, 20 bp, Artificial
  CRISPR gRNA sequence
acgtgcgagaggaccggccc

SEQ ID NO: 86057 - DNA, 20 bp, Artificial
  CRISPR gRNA sequence
cgagaggaccggccccagtt

SEQ ID NO: 86058 - DNA, 20 bp, Artificial
  CRISPR gRNA sequence
gagaggaccggccccagttc

SEQ ID NO: 86059 - DNA, 20 bp, Artificial
  CRISPR gRNA sequence
ccggccccagttcgggcttc

SEQ ID NO: 86060 - DNA, 20 bp, Artificial
  CRISPR gRNA sequence
agttcgggcttccagatcct

SEQ ID NO: 86061 - DNA, 20 bp, Artificial
  CRISPR gRNA sequence
gttcgggcttccagatcctt

SEQ ID NO: 86062 - DNA, 20 bp, Artificial
  CRISPR gRNA sequence
tcgggcttccagatccttag

SEQ ID NO: 86063 - DNA, 20 bp, Artificial
  CRISPR gRNA sequence
cgggcttccagatccttagg

SEQ ID NO: 86064 - DNA, 20 bp, Artificial
  CRISPR gRNA sequence
cagatccttaggaggctaaa

SEQ ID NO: 86065 - DNA, 20 bp, Artificial
  CRISPR gRNA sequence
ccttaggaggctaaaaagta

SEQ ID NO: 86066 - DNA, 20 bp, Artificial
  CRISPR gRNA sequence
ttaggaggctaaaaagtaaa

SEQ ID NO: 86067 - DNA, 20 bp, Artificial
  CRISPR gRNA sequence
aggaggctaaaaagtaaaga

SEQ ID NO: 86068 - DNA, 20 bp, Artificial
  CRISPR gRNA sequence
ggaggctaaaaagtaaagag

SEQ ID NO: 86069 - DNA, 20 bp, Artificial
  CRISPR gRNA sequence
aaaaagtaaagagaggaaca

SEQ ID NO: 86070 - DNA, 20 bp, Artificial
  CRISPR gRNA sequence
agtaaagagaggaacacagt

SEQ ID NO: 86071 - DNA, 20 bp, Artificial
  CRISPR gRNA sequence
gtaaagagaggaacacagta

SEQ ID NO: 86072 - DNA, 20 bp, Artificial
  CRISPR gRNA sequence
gaggaacacagtaaggtgtg

SEQ ID NO: 86073 - DNA, 20 bp, Artificial
  CRISPR gRNA sequence
cacagtaaggtgtgaagaat

SEQ ID NO: 86074 - DNA, 20 bp, Artificial
  CRISPR gRNA sequence
aaggtgtgaagaatgagtat

SEQ ID NO: 86075 - DNA, 20 bp, Artificial
  CRISPR gRNA sequence
aggtgtgaagaatgagtatt

SEQ ID NO: 86076 - DNA, 20 bp, Artificial
  CRISPR gRNA sequence
ggtgtgaagaatgagtattg

SEQ ID NO: 86077 - DNA, 20 bp, Artificial
  CRISPR gRNA sequence
gtgtgaagaatgagtattgg

SEQ ID NO: 86078 - DNA, 20 bp, Artificial
  CRISPR gRNA sequence
aatgagtattgggggaaaca

SEQ ID NO: 86079 - DNA, 20 bp, Artificial
  CRISPR gRNA sequence
attgggggaaacatagacgc

SEQ ID NO: 86080 - DNA, 20 bp, Artificial
  CRISPR gRNA sequence
tgggggaaacatagacgcca

SEQ ID NO: 86081 - DNA, 20 bp, Artificial
  CRISPR gRNA sequence
gggggaaacatagacgccag

SEQ ID NO: 86082 - DNA, 20 bp, Artificial
  CRISPR gRNA sequence
aaacatagacgccagaggca

SEQ ID NO: 86083 - DNA, 20 bp, Artificial
  CRISPR gRNA sequence
aacatagacgccagaggcac

SEQ ID NO: 86084 - DNA, 20 bp, Artificial
  CRISPR gRNA sequence
catagacgccagaggcacag

SEQ ID NO: 86085 - DNA, 20 bp, Artificial
  CRISPR gRNA sequence
atagacgccagaggcacagg

SEQ ID NO: 86086 - DNA, 20 bp, Artificial
  CRISPR gRNA sequence
gacgccagaggcacaggagg

SEQ ID NO: 86087 - DNA, 20 bp, Artificial
  CRISPR gRNA sequence
cagaggcacaggaggtggaa

SEQ ID NO: 86088 - DNA, 20 bp, Artificial
  CRISPR gRNA sequence
ggcacaggaggtggaaaagc

SEQ ID NO: 86089 - DNA, 20 bp, Artificial
  CRISPR gRNA sequence
gcacaggaggtggaaaagca

SEQ ID NO: 86090 - DNA, 20 bp, Artificial
  CRISPR gRNA sequence
cacaggaggtggaaaagcaa

SEQ ID NO: 86091 - DNA, 20 bp, Artificial
  CRISPR gRNA sequence
ggaaaagcaagggacccaat

SEQ ID NO: 86092 - DNA, 20 bp, Artificial
  CRISPR gRNA sequence
aaaagcaagggacccaattg

SEQ ID NO: 86093 - DNA, 20 bp, Artificial
  CRISPR gRNA sequence
agcaagggacccaattggag

SEQ ID NO: 86094 - DNA, 20 bp, Artificial
  CRISPR gRNA sequence
gcaagggacccaattggaga

SEQ ID NO: 86095 - DNA, 20 bp, Artificial
  CRISPR gRNA sequence
caattggagaaggatatact

SEQ ID NO: 86096 - DNA, 20 bp, Artificial
  CRISPR gRNA sequence
agaaggatatactaagcccc

SEQ ID NO: 86097 - DNA, 20 bp, Artificial
  CRISPR gRNA sequence
gatatactaagcccccagcc

SEQ ID NO: 86098 - DNA, 20 bp, Artificial
  CRISPR gRNA sequence
atatactaagcccccagccc

SEQ ID NO: 86099 - DNA, 20 bp, Artificial
  CRISPR gRNA sequence
actaagcccccagcccagga

SEQ ID NO: 86100 - DNA, 20 bp, Artificial
  CRISPR gRNA sequence
gcccccagcccaggacagca

SEQ ID NO: 86101 - DNA, 20 bp, Artificial
  CRISPR gRNA sequence
ccagcccaggacagcaaagt

SEQ ID NO: 86102 - DNA, 20 bp, Artificial
  CRISPR gRNA sequence
cagcccaggacagcaaagtc

SEQ ID NO: 86103 - DNA, 20 bp, Artificial
  CRISPR gRNA sequence
agcccaggacagcaaagtca

SEQ ID NO: 86104 - DNA, 20 bp, Artificial
  CRISPR gRNA sequence
gggccactgacttccttacc

SEQ ID NO: 86105 - DNA, 20 bp, Artificial
  CRISPR gRNA sequence
ggccactgacttccttacct

SEQ ID NO: 86106 - DNA, 20 bp, Artificial
  CRISPR gRNA sequence
actgacttccttacctgggc

SEQ ID NO: 86107 - DNA, 20 bp, Artificial
  CRISPR gRNA sequence
cttacctgggccagtctctc

SEQ ID NO: 86108 - DNA, 20 bp, Artificial
  CRISPR gRNA sequence
ccagtctctctggcttcttg

SEQ ID NO: 86109 - DNA, 20 bp, Artificial
  CRISPR gRNA sequence
cagtctctctggcttcttgt

SEQ ID NO: 86110 - DNA, 20 bp, Artificial
  CRISPR gRNA sequence
ttcttgtgggctccaccctc

SEQ ID NO: 86111 - DNA, 20 bp, Artificial
  CRISPR gRNA sequence
tcttgtgggctccaccctct

SEQ ID NO: 86112 - DNA, 20 bp, Artificial
  CRISPR gRNA sequence
gggttctctaaaccattctt

SEQ ID NO: 86113 - DNA, 20 bp, Artificial
  CRISPR gRNA sequence
ctctaaaccattctttggtt

SEQ ID NO: 86114 - DNA, 20 bp, Artificial
  CRISPR gRNA sequence
tggtttagatgaccgttccc

SEQ ID NO: 86115 - DNA, 20 bp, Artificial
  CRISPR gRNA sequence
ggtttagatgaccgttcccg

SEQ ID NO: 86116 - DNA, 20 bp, Artificial
  CRISPR gRNA sequence
tgcatgttcgtcctcttctg

SEQ ID NO: 86117 - DNA, 20 bp, Artificial
  CRISPR gRNA sequence
catgttcgtcctcttctgca

SEQ ID NO: 86118 - DNA, 20 bp, Artificial
  CRISPR gRNA sequence
atgttcgtcctcttctgcag

SEQ ID NO: 86119 - DNA, 20 bp, Artificial
  CRISPR gRNA sequence
tcttctgcagaggtaccaaa

SEQ ID NO: 86120 - DNA, 20 bp, Artificial
  CRISPR gRNA sequence
cttctgcagaggtaccaaaa

SEQ ID NO: 86121 - DNA, 20 bp, Artificial
  CRISPR gRNA sequence
cagaggtaccaaaaaggtaa

SEQ ID NO: 86122 - DNA, 20 bp, Artificial
  CRISPR gRNA sequence
gaggtaccaaaaaggtaata

SEQ ID NO: 86123 - DNA, 20 bp, Artificial
  CRISPR gRNA sequence
accaaaaaggtaatagagtg

SEQ ID NO: 86124 - DNA, 20 bp, Artificial
  CRISPR gRNA sequence
ccaaaaaggtaatagagtga

SEQ ID NO: 86125 - DNA, 20 bp, Artificial
  CRISPR gRNA sequence
aaaggtaatagagtgaaggt

SEQ ID NO: 86126 - DNA, 20 bp, Artificial
  CRISPR gRNA sequence
aaggtaatagagtgaaggtg

SEQ ID NO: 86127 - DNA, 20 bp, Artificial
  CRISPR gRNA sequence
ggtaatagagtgaaggtgag

SEQ ID NO: 86128 - DNA, 20 bp, Artificial
  CRISPR gRNA sequence
gtaatagagtgaaggtgagg

SEQ ID NO: 86129 - DNA, 20 bp, Artificial
  CRISPR gRNA sequence
gtgaaggtgaggaggaaact

SEQ ID NO: 86130 - DNA, 20 bp, Artificial
  CRISPR gRNA sequence
tgaaggtgaggaggaaactg

SEQ ID NO: 86131 - DNA, 20 bp, Artificial
  CRISPR gRNA sequence
gtgaggaggaaactgaggaa

SEQ ID NO: 86132 - DNA, 20 bp, Artificial
  CRISPR gRNA sequence
tgaggaggaaactgaggaat

SEQ ID NO: 86133 - DNA, 20 bp, Artificial
  CRISPR gRNA sequence
gaggaggaaactgaggaata

SEQ ID NO: 86134 - DNA, 20 bp, Artificial
  CRISPR gRNA sequence
aggaggaaactgaggaatag

SEQ ID NO: 86135 - DNA, 20 bp, Artificial
  CRISPR gRNA sequence
gaggaaactgaggaataggg

SEQ ID NO: 86136 - DNA, 20 bp, Artificial
  CRISPR gRNA sequence
aaactgaggaataggggagt

SEQ ID NO: 86137 - DNA, 20 bp, Artificial
  CRISPR gRNA sequence
aactgaggaataggggagtg

SEQ ID NO: 86138 - DNA, 20 bp, Artificial
  CRISPR gRNA sequence
ggcaattctgattgactgac

SEQ ID NO: 86139 - DNA, 20 bp, Artificial
  CRISPR gRNA sequence
aattctgattgactgactgg

SEQ ID NO: 86140 - DNA, 20 bp, Artificial
  CRISPR gRNA sequence
ttctgattgactgactggta

SEQ ID NO: 86141 - DNA, 20 bp, Artificial
  CRISPR gRNA sequence
gattgactgactggtagaga

SEQ ID NO: 86142 - DNA, 20 bp, Artificial
  CRISPR gRNA sequence
attgactgactggtagagac

SEQ ID NO: 86143 - DNA, 20 bp, Artificial
  CRISPR gRNA sequence
tgactggtagagacaggaaa

SEQ ID NO: 86144 - DNA, 20 bp, Artificial
  CRISPR gRNA sequence
gactggtagagacaggaaat

SEQ ID NO: 86145 - DNA, 20 bp, Artificial
  CRISPR gRNA sequence
actggtagagacaggaaatg

SEQ ID NO: 86146 - DNA, 20 bp, Artificial
  CRISPR gRNA sequence
agacaggaaatggggtgcta

SEQ ID NO: 86147 - DNA, 20 bp, Artificial
  CRISPR gRNA sequence
tggggtgctaaagcatgtct

SEQ ID NO: 86148 - DNA, 20 bp, Artificial
  CRISPR gRNA sequence
ggtgctaaagcatgtcttag

SEQ ID NO: 86149 - DNA, 20 bp, Artificial
  CRISPR gRNA sequence
gtgctaaagcatgtcttaga

SEQ ID NO: 86150 - DNA, 20 bp, Artificial
  CRISPR gRNA sequence
tgctaaagcatgtcttagaa

SEQ ID NO: 86151 - DNA, 20 bp, Artificial
  CRISPR gRNA sequence
gcatgtcttagaagggtctc

SEQ ID NO: 86152 - DNA, 20 bp, Artificial
  CRISPR gRNA sequence
catgtcttagaagggtctcc

SEQ ID NO: 86153 - DNA, 20 bp, Artificial
  CRISPR gRNA sequence
gtcttagaagggtctccagg

SEQ ID NO: 86154 - DNA, 20 bp, Artificial
  CRISPR gRNA sequence
cttagaagggtctccaggaa

SEQ ID NO: 86155 - DNA, 20 bp, Artificial
  CRISPR gRNA sequence
ttagaagggtctccaggaag

SEQ ID NO: 86156 - DNA, 20 bp, Artificial
  CRISPR gRNA sequence
tagaagggtctccaggaaga

SEQ ID NO: 86157 - DNA, 20 bp, Artificial
  CRISPR gRNA sequence
agaagggtctccaggaagag

SEQ ID NO: 86158 - DNA, 20 bp, Artificial
  CRISPR gRNA sequence
gaagggtctccaggaagagg

SEQ ID NO: 86159 - DNA, 20 bp, Artificial
  CRISPR gRNA sequence
caggaagagggggcaaatcc

SEQ ID NO: 86160 - DNA, 20 bp, Artificial
  CRISPR gRNA sequence
aggaagagggggcaaatcca

SEQ ID NO: 86161 - DNA, 20 bp, Artificial
  CRISPR gRNA sequence
aatccaaggtgtctctattc

SEQ ID NO: 86162 - DNA, 20 bp, Artificial
  CRISPR gRNA sequence
ggtgtctctattctagtgtg

SEQ ID NO: 86163 - DNA, 20 bp, Artificial
  CRISPR gRNA sequence
gtgtctctattctagtgtgt

SEQ ID NO: 86164 - DNA, 20 bp, Artificial
  CRISPR gRNA sequence
gtctctattctagtgtgtgg

SEQ ID NO: 86165 - DNA, 20 bp, Artificial
  CRISPR gRNA sequence
tctctattctagtgtgtggg

SEQ ID NO: 86166 - DNA, 20 bp, Artificial
  CRISPR gRNA sequence
ctctattctagtgtgtggga

SEQ ID NO: 86167 - DNA, 20 bp, Artificial
  CRISPR gRNA sequence
agtgtgtgggagggccactg

SEQ ID NO: 86168 - DNA, 20 bp, Artificial
  CRISPR gRNA sequence
gggagggccactgaagctga

SEQ ID NO: 86169 - DNA, 20 bp, Artificial
  CRISPR gRNA sequence
agggccactgaagctgaaag

SEQ ID NO: 86170 - DNA, 20 bp, Artificial
  CRISPR gRNA sequence
cactgaagctgaaagtggct

SEQ ID NO: 86171 - DNA, 20 bp, Artificial
  CRISPR gRNA sequence
actgaagctgaaagtggctc

SEQ ID NO: 86172 - DNA, 20 bp, Artificial
  CRISPR gRNA sequence
ctgaagctgaaagtggctca

SEQ ID NO: 86173 - DNA, 20 bp, Artificial
  CRISPR gRNA sequence
gaaagtggctcagggttgct

SEQ ID NO: 86174 - DNA, 20 bp, Artificial
  CRISPR gRNA sequence
gctcagggttgctgagacat

SEQ ID NO: 86175 - DNA, 20 bp, Artificial
  CRISPR gRNA sequence
tcagggttgctgagacataa

SEQ ID NO: 86176 - DNA, 20 bp, Artificial
  CRISPR gRNA sequence
agggttgctgagacataaga

SEQ ID NO: 86177 - DNA, 20 bp, Artificial
  CRISPR gRNA sequence
gggttgctgagacataagag

SEQ ID NO: 86178 - DNA, 20 bp, Artificial
  CRISPR gRNA sequence
ggttgctgagacataagaga

SEQ ID NO: 86179 - DNA, 20 bp, Artificial
  CRISPR gRNA sequence
ataagagagggtcaacacac

SEQ ID NO: 86180 - DNA, 20 bp, Artificial
  CRISPR gRNA sequence
gagagggtcaacacaccagc

SEQ ID NO: 86181 - DNA, 20 bp, Artificial
  CRISPR gRNA sequence
caacacaccagcgagcccca

SEQ ID NO: 86182 - DNA, 20 bp, Artificial
  CRISPR gRNA sequence
ccagcgagccccatggcctt

SEQ ID NO: 86183 - DNA, 20 bp, Artificial
  CRISPR gRNA sequence
gccccatggccttaagcaca

SEQ ID NO: 86184 - DNA, 20 bp, Artificial
  CRISPR gRNA sequence
ccccatggccttaagcacat

SEQ ID NO: 86185 - DNA, 20 bp, Artificial
  CRISPR gRNA sequence
cttaagcacatgggcatgtg

SEQ ID NO: 86186 - DNA, 20 bp, Artificial
  CRISPR gRNA sequence
gcacatgggcatgtgcagat

SEQ ID NO: 86187 - DNA, 20 bp, Artificial
  CRISPR gRNA sequence
cacatgggcatgtgcagatc

SEQ ID NO: 86188 - DNA, 20 bp, Artificial
  CRISPR gRNA sequence
atgggcatgtgcagatcggg

SEQ ID NO: 86189 - DNA, 20 bp, Artificial
  CRISPR gRNA sequence
gggcatgtgcagatcgggca

SEQ ID NO: 86190 - DNA, 20 bp, Artificial
  CRISPR gRNA sequence
tgtgcagatcgggcagagat

SEQ ID NO: 86191 - DNA, 20 bp, Artificial
  CRISPR gRNA sequence
gcagagatgagatgctgctg

SEQ ID NO: 86192 - DNA, 20 bp, Artificial
  CRISPR gRNA sequence
gagatgagatgctgctgtag

SEQ ID NO: 86193 - DNA, 20 bp, Artificial
  CRISPR gRNA sequence
agatgagatgctgctgtagc

SEQ ID NO: 86194 - DNA, 20 bp, Artificial
  CRISPR gRNA sequence
tgagatgctgctgtagcagg

SEQ ID NO: 86195 - DNA, 20 bp, Artificial
  CRISPR gRNA sequence
gatgctgctgtagcaggaag

SEQ ID NO: 86196 - DNA, 20 bp, Artificial
  CRISPR gRNA sequence
atgctgctgtagcaggaagc

SEQ ID NO: 86197 - DNA, 20 bp, Artificial
  CRISPR gRNA sequence
gaagcgggcgacctcaacga

SEQ ID NO: 86198 - DNA, 20 bp, Artificial
  CRISPR gRNA sequence
cgacctcaacgatggaactg

SEQ ID NO: 86199 - DNA, 20 bp, Artificial
  CRISPR gRNA sequence
gacctcaacgatggaactga

SEQ ID NO: 86200 - DNA, 20 bp, Artificial
  CRISPR gRNA sequence
atggaactgaaggaccgttt

SEQ ID NO: 86201 - DNA, 20 bp, Artificial
  CRISPR gRNA sequence
tggaactgaaggaccgtttc

SEQ ID NO: 86202 - DNA, 20 bp, Artificial
  CRISPR gRNA sequence
gtttcaggatccgctctgcc

SEQ ID NO: 86203 - DNA, 20 bp, Artificial
  CRISPR gRNA sequence
ggatccgctctgcccagtca

SEQ ID NO: 86204 - DNA, 20 bp, Artificial
  CRISPR gRNA sequence
gatccgctctgcccagtcac

SEQ ID NO: 86205 - DNA, 20 bp, Artificial
  CRISPR gRNA sequence
cgctctgcccagtcacaggt

SEQ ID NO: 86206 - DNA, 20 bp, Artificial
  CRISPR gRNA sequence
gctctgcccagtcacaggtc

SEQ ID NO: 86207 - DNA, 20 bp, Artificial
  CRISPR gRNA sequence
ctctgcccagtcacaggtca

SEQ ID NO: 86208 - DNA, 20 bp, Artificial
  CRISPR gRNA sequence
agggcacacgctgcctccac

SEQ ID NO: 86209 - DNA, 20 bp, Artificial
  CRISPR gRNA sequence
tgcctccaccagttcatctc

SEQ ID NO: 86210 - DNA, 20 bp, Artificial
  CRISPR gRNA sequence
gcctccaccagttcatctcg

SEQ ID NO: 86211 - DNA, 20 bp, Artificial
  CRISPR gRNA sequence
accagttcatctcgaggtgc

SEQ ID NO: 86212 - DNA, 20 bp, Artificial
  CRISPR gRNA sequence
ccagttcatctcgaggtgct

SEQ ID NO: 86213 - DNA, 20 bp, Artificial
  CRISPR gRNA sequence
cagttcatctcgaggtgctg

SEQ ID NO: 86214 - DNA, 20 bp, Artificial
  CRISPR gRNA sequence
cgaggtgctggggttacttc

SEQ ID NO: 86215 - DNA, 20 bp, Artificial
  CRISPR gRNA sequence
gaggtgctggggttacttct

SEQ ID NO: 86216 - DNA, 20 bp, Artificial
  CRISPR gRNA sequence
gttacttctgggcccatttc

SEQ ID NO: 86217 - DNA, 20 bp, Artificial
  CRISPR gRNA sequence
tctgggcccatttctggctg

SEQ ID NO: 86218 - DNA, 20 bp, Artificial
  CRISPR gRNA sequence
gggcccatttctggctgaag

SEQ ID NO: 86219 - DNA, 20 bp, Artificial
  CRISPR gRNA sequence
ggcccatttctggctgaagt

SEQ ID NO: 86220 - DNA, 20 bp, Artificial
  CRISPR gRNA sequence
gcccatttctggctgaagtg

SEQ ID NO: 86221 - DNA, 20 bp, Artificial
  CRISPR gRNA sequence
catttctggctgaagtgggg

SEQ ID NO: 86222 - DNA, 20 bp, Artificial
  CRISPR gRNA sequence
atttctggctgaagtgggga

SEQ ID NO: 86223 - DNA, 20 bp, Artificial
  CRISPR gRNA sequence
cccaatcacactccaaatta

SEQ ID NO: 86224 - DNA, 20 bp, Artificial
  CRISPR gRNA sequence
acccttgcctcctctcttgt

SEQ ID NO: 86225 - DNA, 20 bp, Artificial
  CRISPR gRNA sequence
ccttgcctcctctcttgtca

SEQ ID NO: 86226 - DNA, 20 bp, Artificial
  CRISPR gRNA sequence
tcctctcttgtcagagatca

SEQ ID NO: 86227 - DNA, 20 bp, Artificial
  CRISPR gRNA sequence
agatcaaagactattgacca

SEQ ID NO: 86228 - DNA, 20 bp, Artificial
  CRISPR gRNA sequence
aaagactattgaccaaagct

SEQ ID NO: 86229 - DNA, 20 bp, Artificial
  CRISPR gRNA sequence
ctattgaccaaagctgagac

SEQ ID NO: 86230 - DNA, 20 bp, Artificial
  CRISPR gRNA sequence
gaccaaagctgagaccagac

SEQ ID NO: 86231 - DNA, 20 bp, Artificial
  CRISPR gRNA sequence
accaaagctgagaccagact

SEQ ID NO: 86232 - DNA, 20 bp, Artificial
  CRISPR gRNA sequence
ccaaagctgagaccagactg

SEQ ID NO: 86233 - DNA, 20 bp, Artificial
  CRISPR gRNA sequence
agctgagaccagactgggga

SEQ ID NO: 86234 - DNA, 20 bp, Artificial
  CRISPR gRNA sequence
gctgagaccagactggggat

SEQ ID NO: 86235 - DNA, 20 bp, Artificial
  CRISPR gRNA sequence
tgagaccagactggggatgg

SEQ ID NO: 86236 - DNA, 20 bp, Artificial
  CRISPR gRNA sequence
gaccagactggggatgggag

SEQ ID NO: 86237 - DNA, 20 bp, Artificial
  CRISPR gRNA sequence
agcctctacctatcccattg

SEQ ID NO: 86238 - DNA, 20 bp, Artificial
  CRISPR gRNA sequence
ctctacctatcccattgcag

SEQ ID NO: 86239 - DNA, 20 bp, Artificial
  CRISPR gRNA sequence
atcccattgcagaagcccac

SEQ ID NO: 86240 - DNA, 20 bp, Artificial
  CRISPR gRNA sequence
gttctcttcatcctctgcct

SEQ ID NO: 86241 - DNA, 20 bp, Artificial
  CRISPR gRNA sequence
ttcatcctctgcctcagcta

SEQ ID NO: 86242 - DNA, 20 bp, Artificial
  CRISPR gRNA sequence
tcatcctctgcctcagctac

SEQ ID NO: 86243 - DNA, 20 bp, Artificial
  CRISPR gRNA sequence
catcctctgcctcagctaca

SEQ ID NO: 86244 - DNA, 20 bp, Artificial
  CRISPR gRNA sequence
ctctgcctcagctacagggt

SEQ ID NO: 86245 - DNA, 20 bp, Artificial
  CRISPR gRNA sequence
tgcctcagctacagggttgg

SEQ ID NO: 86246 - DNA, 20 bp, Artificial
  CRISPR gRNA sequence
ctcagctacagggttggcag

SEQ ID NO: 86247 - DNA, 20 bp, Artificial
  CRISPR gRNA sequence
tcagctacagggttggcaga

SEQ ID NO: 86248 - DNA, 20 bp, Artificial
  CRISPR gRNA sequence
cagctacagggttggcagaa

SEQ ID NO: 86249 - DNA, 20 bp, Artificial
  CRISPR gRNA sequence
gcagaagggaacatcatacc

SEQ ID NO: 86250 - DNA, 20 bp, Artificial
  CRISPR gRNA sequence
gaagggaacatcatacctag

SEQ ID NO: 86251 - DNA, 20 bp, Artificial
  CRISPR gRNA sequence
aagctatgtacataatgact

SEQ ID NO: 86252 - DNA, 20 bp, Artificial
  CRISPR gRNA sequence
agctatgtacataatgactg

SEQ ID NO: 86253 - DNA, 20 bp, Artificial
  CRISPR gRNA sequence
tacataatgactgaggctgt

SEQ ID NO: 86254 - DNA, 20 bp, Artificial
  CRISPR gRNA sequence
agccctcaaaacatgcccca

SEQ ID NO: 86255 - DNA, 20 bp, Artificial
  CRISPR gRNA sequence
aaagacctctgacttttacc

SEQ ID NO: 86256 - DNA, 20 bp, Artificial
  CRISPR gRNA sequence
aagacctctgacttttacct

SEQ ID NO: 86257 - DNA, 20 bp, Artificial
  CRISPR gRNA sequence
gacctctgacttttacctgg

SEQ ID NO: 86258 - DNA, 20 bp, Artificial
  CRISPR gRNA sequence
cctctgacttttacctggga

SEQ ID NO: 86259 - DNA, 20 bp, Artificial
  CRISPR gRNA sequence
ctgacttttacctgggagag

SEQ ID NO: 86260 - DNA, 20 bp, Artificial
  CRISPR gRNA sequence
gacttttacctgggagagaa

SEQ ID NO: 86261 - DNA, 20 bp, Artificial
  CRISPR gRNA sequence
ttttacctgggagagaagag

SEQ ID NO: 86262 - DNA, 20 bp, Artificial
  CRISPR gRNA sequence
ctgggagagaagagtggaat

SEQ ID NO: 86263 - DNA, 20 bp, Artificial
  CRISPR gRNA sequence
ggagagaagagtggaattgg

SEQ ID NO: 86264 - DNA, 20 bp, Artificial
  CRISPR gRNA sequence
gagagaagagtggaattgga

SEQ ID NO: 86265 - DNA, 20 bp, Artificial
  CRISPR gRNA sequence
agtggaattggaaggtgatt

SEQ ID NO: 86266 - DNA, 20 bp, Artificial
  CRISPR gRNA sequence
tgatttggtacttacactct

SEQ ID NO: 86267 - DNA, 20 bp, Artificial
  CRISPR gRNA sequence
cttacactctcagaaccctt

SEQ ID NO: 86268 - DNA, 20 bp, Artificial
  CRISPR gRNA sequence
ttacactctcagaacccttt

SEQ ID NO: 86269 - DNA, 20 bp, Artificial
  CRISPR gRNA sequence
ctctcagaaccctttaggtc

SEQ ID NO: 86270 - DNA, 20 bp, Artificial
  CRISPR gRNA sequence
agaaccctttaggtcaagtc

SEQ ID NO: 86271 - DNA, 20 bp, Artificial
  CRISPR gRNA sequence
gaaccctttaggtcaagtcc

SEQ ID NO: 86272 - DNA, 20 bp, Artificial
  CRISPR gRNA sequence
ccctttaggtcaagtccagg

SEQ ID NO: 86273 - DNA, 20 bp, Artificial
  CRISPR gRNA sequence
cctttaggtcaagtccaggc

SEQ ID NO: 86274 - DNA, 20 bp, Artificial
  CRISPR gRNA sequence
ctttaggtcaagtccaggca

SEQ ID NO: 86275 - DNA, 20 bp, Artificial
  CRISPR gRNA sequence
tttaggtcaagtccaggcag

SEQ ID NO: 86276 - DNA, 20 bp, Artificial
  CRISPR gRNA sequence
aggtcaagtccaggcagggg

SEQ ID NO: 86277 - DNA, 20 bp, Artificial
  CRISPR gRNA sequence
aagtccaggcaggggtggca

SEQ ID NO: 86278 - DNA, 20 bp, Artificial
  CRISPR gRNA sequence
gcaggggtggcatagacacc

SEQ ID NO: 86279 - DNA, 20 bp, Artificial
  CRISPR gRNA sequence
caggggtggcatagacacca

SEQ ID NO: 86280 - DNA, 20 bp, Artificial
  CRISPR gRNA sequence
tcttcctccttatgccactg

SEQ ID NO: 86281 - DNA, 20 bp, Artificial
  CRISPR gRNA sequence
actgtagcaatatctgatgc

SEQ ID NO: 86282 - DNA, 20 bp, Artificial
  CRISPR gRNA sequence
gcaatatctgatgcaagtta

SEQ ID NO: 86283 - DNA, 20 bp, Artificial
  CRISPR gRNA sequence
aatatctgatgcaagttaaa

SEQ ID NO: 86284 - DNA, 20 bp, Artificial
  CRISPR gRNA sequence
atctgatgcaagttaaagag

SEQ ID NO: 86285 - DNA, 20 bp, Artificial
  CRISPR gRNA sequence
gttaaagagcagccaacaca

SEQ ID NO: 86286 - DNA, 20 bp, Artificial
  CRISPR gRNA sequence
gccaacacatggcgatctcc

SEQ ID NO: 86287 - DNA, 20 bp, Artificial
  CRISPR gRNA sequence
tggcgatctccaagcccctc

SEQ ID NO: 86288 - DNA, 20 bp, Artificial
  CRISPR gRNA sequence
gatctccaagcccctcgagc

SEQ ID NO: 86289 - DNA, 20 bp, Artificial
  CRISPR gRNA sequence
ccaagcccctcgagcaagtt

SEQ ID NO: 86290 - DNA, 20 bp, Artificial
  CRISPR gRNA sequence
ctccttgctctccacatcct

SEQ ID NO: 86291 - DNA, 20 bp, Artificial
  CRISPR gRNA sequence
cacatcctaagtcttcctcc

SEQ ID NO: 86292 - DNA, 20 bp, Artificial
  CRISPR gRNA sequence
acatcctaagtcttcctccc

SEQ ID NO: 86293 - DNA, 20 bp, Artificial
  CRISPR gRNA sequence
tcctccacccccaacctctc

SEQ ID NO: 86294 - DNA, 20 bp, Artificial
  CRISPR gRNA sequence
cacccccaacctctctagtc

SEQ ID NO: 86295 - DNA, 20 bp, Artificial
  CRISPR gRNA sequence
acccccaacctctctagtca

SEQ ID NO: 86296 - DNA, 20 bp, Artificial
  CRISPR gRNA sequence
cctctctagtcaaggatact

SEQ ID NO: 86297 - DNA, 20 bp, Artificial
  CRISPR gRNA sequence
ctagtcaaggatacttggac

SEQ ID NO: 86298 - DNA, 20 bp, Artificial
  CRISPR gRNA sequence
aaggatacttggactggccc

SEQ ID NO: 86299 - DNA, 20 bp, Artificial
  CRISPR gRNA sequence
ttggactggccccggccacc

SEQ ID NO: 86300 - DNA, 20 bp, Artificial
  CRISPR gRNA sequence
gccccggccaccaagccttc

SEQ ID NO: 86301 - DNA, 20 bp, Artificial
  CRISPR gRNA sequence
aagccttcgagctttgatgt

SEQ ID NO: 86302 - DNA, 20 bp, Artificial
  CRISPR gRNA sequence
agccttcgagctttgatgtc

SEQ ID NO: 86303 - DNA, 20 bp, Artificial
  CRISPR gRNA sequence
gccttcgagctttgatgtca

SEQ ID NO: 86304 - DNA, 20 bp, Artificial
  CRISPR gRNA sequence
ttcgagctttgatgtcaggg

SEQ ID NO: 86305 - DNA, 20 bp, Artificial
  CRISPR gRNA sequence
tctctctgatgatcttgcca

SEQ ID NO: 86306 - DNA, 20 bp, Artificial
  CRISPR gRNA sequence
tctgatgatcttgccaaagt

SEQ ID NO: 86307 - DNA, 20 bp, Artificial
  CRISPR gRNA sequence
ttgccaaagttggctgtgct

SEQ ID NO: 86308 - DNA, 20 bp, Artificial
  CRISPR gRNA sequence
ccaaagttggctgtgctgag

SEQ ID NO: 86309 - DNA, 20 bp, Artificial
  CRISPR gRNA sequence
caaagttggctgtgctgagt

SEQ ID NO: 86310 - DNA, 20 bp, Artificial
  CRISPR gRNA sequence
agttggctgtgctgagtggg

SEQ ID NO: 86311 - DNA, 20 bp, Artificial
  CRISPR gRNA sequence
ctgtgctgagtgggcggcaa

SEQ ID NO: 86312 - DNA, 20 bp, Artificial
  CRISPR gRNA sequence
tgtgctgagtgggcggcaac

SEQ ID NO: 86313 - DNA, 20 bp, Artificial
  CRISPR gRNA sequence
ctgagtgggcggcaacaggc

SEQ ID NO: 86314 - DNA, 20 bp, Artificial
  CRISPR gRNA sequence
ggcaacaggcaagactctca

SEQ ID NO: 86315 - DNA, 20 bp, Artificial
  CRISPR gRNA sequence
agactctcacagtacttcct

SEQ ID NO: 86316 - DNA, 20 bp, Artificial
  CRISPR gRNA sequence
tctcacagtacttcctgagt

SEQ ID NO: 86317 - DNA, 20 bp, Artificial
  CRISPR gRNA sequence
tcacagtacttcctgagtga

SEQ ID NO: 86318 - DNA, 20 bp, Artificial
  CRISPR gRNA sequence
cacagtacttcctgagtgag

SEQ ID NO: 86319 - DNA, 20 bp, Artificial
  CRISPR gRNA sequence
acagtacttcctgagtgaga

SEQ ID NO: 86320 - DNA, 20 bp, Artificial
  CRISPR gRNA sequence
cagtacttcctgagtgagag

SEQ ID NO: 86321 - DNA, 20 bp, Artificial
  CRISPR gRNA sequence
gtacttcctgagtgagaggg

SEQ ID NO: 86322 - DNA, 20 bp, Artificial
  CRISPR gRNA sequence
cttcctgagtgagaggggag

SEQ ID NO: 86323 - DNA, 20 bp, Artificial
  CRISPR gRNA sequence
tcctgagtgagaggggagca

SEQ ID NO: 86324 - DNA, 20 bp, Artificial
  CRISPR gRNA sequence
tgagtgagaggggagcagag

SEQ ID NO: 86325 - DNA, 20 bp, Artificial
  CRISPR gRNA sequence
gagtgagaggggagcagagt

SEQ ID NO: 86326 - DNA, 20 bp, Artificial
  CRISPR gRNA sequence
tgagaggggagcagagtggg

SEQ ID NO: 86327 - DNA, 20 bp, Artificial
  CRISPR gRNA sequence
gagcagagtgggaagatact

SEQ ID NO: 86328 - DNA, 20 bp, Artificial
  CRISPR gRNA sequence
gcagagtgggaagatactca

SEQ ID NO: 86329 - DNA, 20 bp, Artificial
  CRISPR gRNA sequence
gagtgggaagatactcagag

SEQ ID NO: 86330 - DNA, 20 bp, Artificial
  CRISPR gRNA sequence
agtgggaagatactcagaga

SEQ ID NO: 86331 - DNA, 20 bp, Artificial
  CRISPR gRNA sequence
tgggaagatactcagagaag

SEQ ID NO: 86332 - DNA, 20 bp, Artificial
  CRISPR gRNA sequence
gggaagatactcagagaagg

SEQ ID NO: 86333 - DNA, 20 bp, Artificial
  CRISPR gRNA sequence
atactcagagaaggaggcca

SEQ ID NO: 86334 - DNA, 20 bp, Artificial
  CRISPR gRNA sequence
tactcagagaaggaggccat

SEQ ID NO: 86335 - DNA, 20 bp, Artificial
  CRISPR gRNA sequence
tcagagaaggaggccatggg

SEQ ID NO: 86336 - DNA, 20 bp, Artificial
  CRISPR gRNA sequence
cagagaaggaggccatgggt

SEQ ID NO: 86337 - DNA, 20 bp, Artificial
  CRISPR gRNA sequence
ggaggccatgggtaggctcg

SEQ ID NO: 86338 - DNA, 20 bp, Artificial
  CRISPR gRNA sequence
aggccatgggtaggctcgaa

SEQ ID NO: 86339 - DNA, 20 bp, Artificial
  CRISPR gRNA sequence
gggtaggctcgaagagtccc

SEQ ID NO: 86340 - DNA, 20 bp, Artificial
  CRISPR gRNA sequence
ggtaggctcgaagagtccct

SEQ ID NO: 86341 - DNA, 20 bp, Artificial
  CRISPR gRNA sequence
gtaggctcgaagagtcccta

SEQ ID NO: 86342 - DNA, 20 bp, Artificial
  CRISPR gRNA sequence
tcgaagagtccctagggatc

SEQ ID NO: 86343 - DNA, 20 bp, Artificial
  CRISPR gRNA sequence
agtccctagggatcaagtgt

SEQ ID NO: 86344 - DNA, 20 bp, Artificial
  CRISPR gRNA sequence
gtccctagggatcaagtgtg

SEQ ID NO: 86345 - DNA, 20 bp, Artificial
  CRISPR gRNA sequence
tcaagtgtgaggaacccttt

SEQ ID NO: 86346 - DNA, 20 bp, Artificial
  CRISPR gRNA sequence
agtgtgaggaaccctttaag

SEQ ID NO: 86347 - DNA, 20 bp, Artificial
  CRISPR gRNA sequence
gtgtgaggaaccctttaaga

SEQ ID NO: 86348 - DNA, 20 bp, Artificial
  CRISPR gRNA sequence
tgaggaaccctttaagaagg

SEQ ID NO: 86349 - DNA, 20 bp, Artificial
  CRISPR gRNA sequence
gaggaaccctttaagaaggc

SEQ ID NO: 86350 - DNA, 20 bp, Artificial
  CRISPR gRNA sequence
ttaagaaggcaggctttatc

SEQ ID NO: 86351 - DNA, 20 bp, Artificial
  CRISPR gRNA sequence
taagaaggcaggctttatca

SEQ ID NO: 86352 - DNA, 20 bp, Artificial
  CRISPR gRNA sequence
gaaggcaggctttatcaagg

SEQ ID NO: 86353 - DNA, 20 bp, Artificial
  CRISPR gRNA sequence
aaggcaggctttatcaaggc

SEQ ID NO: 86354 - DNA, 20 bp, Artificial
  CRISPR gRNA sequence
gcaggctttatcaaggcagg

SEQ ID NO: 86355 - DNA, 20 bp, Artificial
  CRISPR gRNA sequence
tcaaggcaggaagctcttca

SEQ ID NO: 86356 - DNA, 20 bp, Artificial
  CRISPR gRNA sequence
caaggcaggaagctcttcat

SEQ ID NO: 86357 - DNA, 20 bp, Artificial
  CRISPR gRNA sequence
gcaggaagctcttcatgggt

SEQ ID NO: 86358 - DNA, 20 bp, Artificial
  CRISPR gRNA sequence
caggaagctcttcatgggtg

SEQ ID NO: 86359 - DNA, 20 bp, Artificial
  CRISPR gRNA sequence
aggaagctcttcatgggtga

SEQ ID NO: 86360 - DNA, 20 bp, Artificial
  CRISPR gRNA sequence
ggaagctcttcatgggtgag

SEQ ID NO: 86361 - DNA, 20 bp, Artificial
  CRISPR gRNA sequence
gaagctcttcatgggtgagg

SEQ ID NO: 86362 - DNA, 20 bp, Artificial
  CRISPR gRNA sequence
cccacccctccacccaccga

SEQ ID NO: 86363 - DNA, 20 bp, Artificial
  CRISPR gRNA sequence
ccacccctccacccaccgat

SEQ ID NO: 86364 - DNA, 20 bp, Artificial
  CRISPR gRNA sequence
gcatcataaacactttgctt

SEQ ID NO: 86365 - DNA, 20 bp, Artificial
  CRISPR gRNA sequence
tcataaacactttgctttgg

SEQ ID NO: 86366 - DNA, 20 bp, Artificial
  CRISPR gRNA sequence
aaacactttgctttggcaga

SEQ ID NO: 86367 - DNA, 20 bp, Artificial
  CRISPR gRNA sequence
aacactttgctttggcagac

SEQ ID NO: 86368 - DNA, 20 bp, Artificial
  CRISPR gRNA sequence
ttgctttggcagacaggtgt

SEQ ID NO: 86369 - DNA, 20 bp, Artificial
  CRISPR gRNA sequence
caggtgtcagtgtgctcttc

SEQ ID NO: 86370 - DNA, 20 bp, Artificial
  CRISPR gRNA sequence
aggtgtcagtgtgctcttcc

SEQ ID NO: 86371 - DNA, 20 bp, Artificial
  CRISPR gRNA sequence
tgtcagtgtgctcttccagg

SEQ ID NO: 86372 - DNA, 20 bp, Artificial
  CRISPR gRNA sequence
tgtgctcttccaggtggttg

SEQ ID NO: 86373 - DNA, 20 bp, Artificial
  CRISPR gRNA sequence
ggtggttgcggatccaccta

SEQ ID NO: 86374 - DNA, 20 bp, Artificial
  CRISPR gRNA sequence
gtggttgcggatccacctat

SEQ ID NO: 86375 - DNA, 20 bp, Artificial
  CRISPR gRNA sequence
tacatgtactcctcattgct

SEQ ID NO: 86376 - DNA, 20 bp, Artificial
  CRISPR gRNA sequence
tcctcattgctcagtgtact

SEQ ID NO: 86377 - DNA, 20 bp, Artificial
  CRISPR gRNA sequence
tgctcagtgtacttggctct

SEQ ID NO: 86378 - DNA, 20 bp, Artificial
  CRISPR gRNA sequence
gtgtacttggctctgagcta

SEQ ID NO: 86379 - DNA, 20 bp, Artificial
  CRISPR gRNA sequence
gctctgagctacagaaacaa

SEQ ID NO: 86380 - DNA, 20 bp, Artificial
  CRISPR gRNA sequence
ctctgagctacagaaacaaa

SEQ ID NO: 86381 - DNA, 20 bp, Artificial
  CRISPR gRNA sequence
gctacagaaacaaaaggaac

SEQ ID NO: 86382 - DNA, 20 bp, Artificial
  CRISPR gRNA sequence
caaaaggaacaagcattact

SEQ ID NO: 86383 - DNA, 20 bp, Artificial
  CRISPR gRNA sequence
aagcattactaagaccctaa

SEQ ID NO: 86384 - DNA, 20 bp, Artificial
  CRISPR gRNA sequence
taagaccctaacagttgtcc

SEQ ID NO: 86385 - DNA, 20 bp, Artificial
  CRISPR gRNA sequence
ttcttcccaaactaccactt

SEQ ID NO: 86386 - DNA, 20 bp, Artificial
  CRISPR gRNA sequence
ttcccaaactaccacttcag

SEQ ID NO: 86387 - DNA, 20 bp, Artificial
  CRISPR gRNA sequence
aactaccacttcagtagtgc

SEQ ID NO: 86388 - DNA, 20 bp, Artificial
  CRISPR gRNA sequence
cagtagtgctggaccaaatt

SEQ ID NO: 86389 - DNA, 20 bp, Artificial
  CRISPR gRNA sequence
tggaccaaatttagttcacc

SEQ ID NO: 86390 - DNA, 20 bp, Artificial
  CRISPR gRNA sequence
acccagaatctaactttccc

SEQ ID NO: 86391 - DNA, 20 bp, Artificial
  CRISPR gRNA sequence
ctaactttccctggtaaacc

SEQ ID NO: 86392 - DNA, 20 bp, Artificial
  CRISPR gRNA sequence
ctttccctggtaaaccaagt

SEQ ID NO: 86393 - DNA, 20 bp, Artificial
  CRISPR gRNA sequence
tttccctggtaaaccaagtc

SEQ ID NO: 86394 - DNA, 20 bp, Artificial
  CRISPR gRNA sequence
ttccctggtaaaccaagtca

SEQ ID NO: 86395 - DNA, 20 bp, Artificial
  CRISPR gRNA sequence
ctggtaaaccaagtcagggc

SEQ ID NO: 86396 - DNA, 20 bp, Artificial
  CRISPR gRNA sequence
tggtaaaccaagtcagggcg

SEQ ID NO: 86397 - DNA, 20 bp, Artificial
  CRISPR gRNA sequence
gaggacctttcctcttcatc

SEQ ID NO: 86398 - DNA, 20 bp, Artificial
  CRISPR gRNA sequence
aggacctttcctcttcatca

SEQ ID NO: 86399 - DNA, 20 bp, Artificial
  CRISPR gRNA sequence
cctttcctcttcatcaagga

SEQ ID NO: 86400 - DNA, 20 bp, Artificial
  CRISPR gRNA sequence
tcatcaaggacagcatttac

SEQ ID NO: 86401 - DNA, 20 bp, Artificial
  CRISPR gRNA sequence
ctattcacctcaccccttcc

SEQ ID NO: 86402 - DNA, 20 bp, Artificial
  CRISPR gRNA sequence
ttcccagtgaacctttctct

SEQ ID NO: 86403 - DNA, 20 bp, Artificial
  CRISPR gRNA sequence
gtgaacctttctctaagaat

SEQ ID NO: 86404 - DNA, 20 bp, Artificial
  CRISPR gRNA sequence
tcaaacctaccttttgtctc

SEQ ID NO: 86405 - DNA, 20 bp, Artificial
  CRISPR gRNA sequence
aacctaccttttgtctccag

SEQ ID NO: 86406 - DNA, 20 bp, Artificial
  CRISPR gRNA sequence
ctaccttttgtctccagtgg

SEQ ID NO: 86407 - DNA, 20 bp, Artificial
  CRISPR gRNA sequence
taccttttgtctccagtggt

SEQ ID NO: 86408 - DNA, 20 bp, Artificial
  CRISPR gRNA sequence
tgtctccagtggtgggtcct

SEQ ID NO: 86409 - DNA, 20 bp, Artificial
  CRISPR gRNA sequence
gtctccagtggtgggtcctg

SEQ ID NO: 86410 - DNA, 20 bp, Artificial
  CRISPR gRNA sequence
tctccagtggtgggtcctga

SEQ ID NO: 86411 - DNA, 20 bp, Artificial
  CRISPR gRNA sequence
ctccagtggtgggtcctgag

SEQ ID NO: 86412 - DNA, 20 bp, Artificial
  CRISPR gRNA sequence
ccagtggtgggtcctgaggg

SEQ ID NO: 86413 - DNA, 20 bp, Artificial
  CRISPR gRNA sequence
gtgggtcctgaggggagctg

SEQ ID NO: 86414 - DNA, 20 bp, Artificial
  CRISPR gRNA sequence
tgggtcctgaggggagctga

SEQ ID NO: 86415 - DNA, 20 bp, Artificial
  CRISPR gRNA sequence
gtcctgaggggagctgaagg

SEQ ID NO: 86416 - DNA, 20 bp, Artificial
  CRISPR gRNA sequence
cctgaggggagctgaaggta

SEQ ID NO: 86417 - DNA, 20 bp, Artificial
  CRISPR gRNA sequence
gggagctgaaggtagagata

SEQ ID NO: 86418 - DNA, 20 bp, Artificial
  CRISPR gRNA sequence
gagatacagcttgtcattgt

SEQ ID NO: 86419 - DNA, 20 bp, Artificial
  CRISPR gRNA sequence
aaatttctgtacatcttgct

SEQ ID NO: 86420 - DNA, 20 bp, Artificial
  CRISPR gRNA sequence
aatttctgtacatcttgctg

SEQ ID NO: 86421 - DNA, 20 bp, Artificial
  CRISPR gRNA sequence
ttctgtacatcttgctgagg

SEQ ID NO: 86422 - DNA, 20 bp, Artificial
  CRISPR gRNA sequence
tctgtacatcttgctgaggt

SEQ ID NO: 86423 - DNA, 20 bp, Artificial
  CRISPR gRNA sequence
tgtacatcttgctgaggtag

SEQ ID NO: 86424 - DNA, 20 bp, Artificial
  CRISPR gRNA sequence
tacatcttgctgaggtagga

SEQ ID NO: 86425 - DNA, 20 bp, Artificial
  CRISPR gRNA sequence
cttgctgaggtaggagagaa

SEQ ID NO: 86426 - DNA, 20 bp, Artificial
  CRISPR gRNA sequence
tgctgaggtaggagagaaca

SEQ ID NO: 86427 - DNA, 20 bp, Artificial
  CRISPR gRNA sequence
gctgaggtaggagagaacag

SEQ ID NO: 86428 - DNA, 20 bp, Artificial
  CRISPR gRNA sequence
gaggtaggagagaacagagg

SEQ ID NO: 86429 - DNA, 20 bp, Artificial
  CRISPR gRNA sequence
aggtaggagagaacagaggc

SEQ ID NO: 86430 - DNA, 20 bp, Artificial
  CRISPR gRNA sequence
gtaggagagaacagaggcag

SEQ ID NO: 86431 - DNA, 20 bp, Artificial
  CRISPR gRNA sequence
acagaggcaggagaaataat

SEQ ID NO: 86432 - DNA, 20 bp, Artificial
  CRISPR gRNA sequence
cagaggcaggagaaataata

SEQ ID NO: 86433 - DNA, 20 bp, Artificial
  CRISPR gRNA sequence
gcaggagaaataataaggcc

SEQ ID NO: 86434 - DNA, 20 bp, Artificial
  CRISPR gRNA sequence
ggagaaataataaggccaag

SEQ ID NO: 86435 - DNA, 20 bp, Artificial
  CRISPR gRNA sequence
gagaaataataaggccaaga

SEQ ID NO: 86436 - DNA, 20 bp, Artificial
  CRISPR gRNA sequence
aggccaagaaggacccaata

SEQ ID NO: 86437 - DNA, 20 bp, Artificial
  CRISPR gRNA sequence
ggccaagaaggacccaatat

SEQ ID NO: 86438 - DNA, 20 bp, Artificial
  CRISPR gRNA sequence
accctctgatccccacacca

SEQ ID NO: 86439 - DNA, 20 bp, Artificial
  CRISPR gRNA sequence
ctgatccccacaccaaagtc

SEQ ID NO: 86440 - DNA, 20 bp, Artificial
  CRISPR gRNA sequence
accaaagtctagctgactta

SEQ ID NO: 86441 - DNA, 20 bp, Artificial
  CRISPR gRNA sequence
ccaaagtctagctgacttac

SEQ ID NO: 86442 - DNA, 20 bp, Artificial
  CRISPR gRNA sequence
caaagtctagctgacttaca

SEQ ID NO: 86443 - DNA, 20 bp, Artificial
  CRISPR gRNA sequence
ctagctgacttacagggtgt

SEQ ID NO: 86444 - DNA, 20 bp, Artificial
  CRISPR gRNA sequence
tacagggtgtcagactgaaa

SEQ ID NO: 86445 - DNA, 20 bp, Artificial
  CRISPR gRNA sequence
acagggtgtcagactgaaaa

SEQ ID NO: 86446 - DNA, 20 bp, Artificial
  CRISPR gRNA sequence
gtcagactgaaaaaggacct

SEQ ID NO: 86447 - DNA, 20 bp, Artificial
  CRISPR gRNA sequence
gaccttagaaattatttgac

SEQ ID NO: 86448 - DNA, 20 bp, Artificial
  CRISPR gRNA sequence
accttagaaattatttgaca

SEQ ID NO: 86449 - DNA, 20 bp, Artificial
  CRISPR gRNA sequence
tagaaattatttgacaaggc

SEQ ID NO: 86450 - DNA, 20 bp, Artificial
  CRISPR gRNA sequence
agaaattatttgacaaggcc

SEQ ID NO: 86451 - DNA, 20 bp, Artificial
  CRISPR gRNA sequence
ttatttgacaaggccgggca

SEQ ID NO: 86452 - DNA, 20 bp, Artificial
  CRISPR gRNA sequence
tttgacaaggccgggcacgg

SEQ ID NO: 86453 - DNA, 20 bp, Artificial
  CRISPR gRNA sequence
gtggctcacgcctacaatcc

SEQ ID NO: 86454 - DNA, 20 bp, Artificial
  CRISPR gRNA sequence
cgcctacaatcccagcactt

SEQ ID NO: 86455 - DNA, 20 bp, Artificial
  CRISPR gRNA sequence
ctacaatcccagcactttgg

SEQ ID NO: 86456 - DNA, 20 bp, Artificial
  CRISPR gRNA sequence
tacaatcccagcactttgga

SEQ ID NO: 86457 - DNA, 20 bp, Artificial
  CRISPR gRNA sequence
tcccagcactttggaaggcc

SEQ ID NO: 86458 - DNA, 20 bp, Artificial
  CRISPR gRNA sequence
cccagcactttggaaggcca

SEQ ID NO: 86459 - DNA, 20 bp, Artificial
  CRISPR gRNA sequence
agcactttggaaggccaagg

SEQ ID NO: 86460 - DNA, 20 bp, Artificial
  CRISPR gRNA sequence
gcactttggaaggccaaggc

SEQ ID NO: 86461 - DNA, 20 bp, Artificial
  CRISPR gRNA sequence
ggccaaggcaggctgatcac

SEQ ID NO: 86462 - DNA, 20 bp, Artificial
  CRISPR gRNA sequence
gccaaggcaggctgatcaca

SEQ ID NO: 86463 - DNA, 20 bp, Artificial
  CRISPR gRNA sequence
aggcaggctgatcacaaggt

SEQ ID NO: 86464 - DNA, 20 bp, Artificial
  CRISPR gRNA sequence
ggcaggctgatcacaaggtc

SEQ ID NO: 86465 - DNA, 20 bp, Artificial
  CRISPR gRNA sequence
caggctgatcacaaggtcag

SEQ ID NO: 86466 - DNA, 20 bp, Artificial
  CRISPR gRNA sequence
gatcacaaggtcaggagatc

SEQ ID NO: 86467 - DNA, 20 bp, Artificial
  CRISPR gRNA sequence
tcaggagatcgagaccatcc

SEQ ID NO: 86468 - DNA, 20 bp, Artificial
  CRISPR gRNA sequence
cgagaccatcctggctaaca

SEQ ID NO: 86469 - DNA, 20 bp, Artificial
  CRISPR gRNA sequence
ctaaaaatacaaaaaaaaat

SEQ ID NO: 86470 - DNA, 20 bp, Artificial
  CRISPR gRNA sequence
aaatacaaaaaaaaattagc

SEQ ID NO: 86471 - DNA, 20 bp, Artificial
  CRISPR gRNA sequence
aatacaaaaaaaaattagct

SEQ ID NO: 86472 - DNA, 20 bp, Artificial
  CRISPR gRNA sequence
aaaaaaaaattagctgggtg

SEQ ID NO: 86473 - DNA, 20 bp, Artificial
  CRISPR gRNA sequence
aaattagctgggtgtggtga

SEQ ID NO: 86474 - DNA, 20 bp, Artificial
  CRISPR gRNA sequence
aattagctgggtgtggtgac

SEQ ID NO: 86475 - DNA, 20 bp, Artificial
  CRISPR gRNA sequence
ggtgtggtgacgggcgcctg

SEQ ID NO: 86476 - DNA, 20 bp, Artificial
  CRISPR gRNA sequence
gtgacgggcgcctgtagtcc

SEQ ID NO: 86477 - DNA, 20 bp, Artificial
  CRISPR gRNA sequence
cgcctgtagtcccagctact

SEQ ID NO: 86478 - DNA, 20 bp, Artificial
  CRISPR gRNA sequence
gcctgtagtcccagctactt

SEQ ID NO: 86479 - DNA, 20 bp, Artificial
  CRISPR gRNA sequence
ctgtagtcccagctacttgg

SEQ ID NO: 86480 - DNA, 20 bp, Artificial
  CRISPR gRNA sequence
tgtagtcccagctacttggg

SEQ ID NO: 86481 - DNA, 20 bp, Artificial
  CRISPR gRNA sequence
tcccagctacttgggaggct

SEQ ID NO: 86482 - DNA, 20 bp, Artificial
  CRISPR gRNA sequence
cccagctacttgggaggctg

SEQ ID NO: 86483 - DNA, 20 bp, Artificial
  CRISPR gRNA sequence
agctacttgggaggctgagg

SEQ ID NO: 86484 - DNA, 20 bp, Artificial
  CRISPR gRNA sequence
gctacttgggaggctgaggc

SEQ ID NO: 86485 - DNA, 20 bp, Artificial
  CRISPR gRNA sequence
tacttgggaggctgaggcag

SEQ ID NO: 86486 - DNA, 20 bp, Artificial
  CRISPR gRNA sequence
gggaggctgaggcaggagaa

SEQ ID NO: 86487 - DNA, 20 bp, Artificial
  CRISPR gRNA sequence
gcaggagaatggcgtgaacc

SEQ ID NO: 86488 - DNA, 20 bp, Artificial
  CRISPR gRNA sequence
caggagaatggcgtgaacct

SEQ ID NO: 86489 - DNA, 20 bp, Artificial
  CRISPR gRNA sequence
ggagaatggcgtgaacctgg

SEQ ID NO: 86490 - DNA, 20 bp, Artificial
  CRISPR gRNA sequence
gagaatggcgtgaacctggg

SEQ ID NO: 86491 - DNA, 20 bp, Artificial
  CRISPR gRNA sequence
aatggcgtgaacctgggagg

SEQ ID NO: 86492 - DNA, 20 bp, Artificial
  CRISPR gRNA sequence
tggcgtgaacctgggaggcg

SEQ ID NO: 86493 - DNA, 20 bp, Artificial
  CRISPR gRNA sequence
aacctgggaggcggagcttg

SEQ ID NO: 86494 - DNA, 20 bp, Artificial
  CRISPR gRNA sequence
tgggaggcggagcttgcagt

SEQ ID NO: 86495 - DNA, 20 bp, Artificial
  CRISPR gRNA sequence
ggcggagcttgcagtgagcc

SEQ ID NO: 86496 - DNA, 20 bp, Artificial
  CRISPR gRNA sequence
gagattgcgccactgcactc

SEQ ID NO: 86497 - DNA, 20 bp, Artificial
  CRISPR gRNA sequence
tgcgccactgcactccagcc

SEQ ID NO: 86498 - DNA, 20 bp, Artificial
  CRISPR gRNA sequence
gcgccactgcactccagcct

SEQ ID NO: 86499 - DNA, 20 bp, Artificial
  CRISPR gRNA sequence
ctgcactccagcctaggcga

SEQ ID NO: 86500 - DNA, 20 bp, Artificial
  CRISPR gRNA sequence
gcactccagcctaggcgaca

SEQ ID NO: 86501 - DNA, 20 bp, Artificial
  CRISPR gRNA sequence
tccagcctaggcgacagagt

SEQ ID NO: 86502 - DNA, 20 bp, Artificial
  CRISPR gRNA sequence
tctcaaaaaaaaaaaaaaaa

SEQ ID NO: 86503 - DNA, 20 bp, Artificial
  CRISPR gRNA sequence
aaaaaaaaaaaaaaaaaaga

SEQ ID NO: 86504 - DNA, 20 bp, Artificial
  CRISPR gRNA sequence
agaaagaaattatttgatgc

SEQ ID NO: 86505 - DNA, 20 bp, Artificial
  CRISPR gRNA sequence
gaaagaaattatttgatgct

SEQ ID NO: 86506 - DNA, 20 bp, Artificial
  CRISPR gRNA sequence
tatttgatgctaggtgctct

SEQ ID NO: 86507 - DNA, 20 bp, Artificial
  CRISPR gRNA sequence
atttgatgctaggtgctctg

SEQ ID NO: 86508 - DNA, 20 bp, Artificial
  CRISPR gRNA sequence
ttgatgctaggtgctctgag

SEQ ID NO: 86509 - DNA, 20 bp, Artificial
  CRISPR gRNA sequence
aggtgctctgaggagcccta

SEQ ID NO: 86510 - DNA, 20 bp, Artificial
  CRISPR gRNA sequence
ggtgctctgaggagccctat

SEQ ID NO: 86511 - DNA, 20 bp, Artificial
  CRISPR gRNA sequence
aggagccctataggctacca

SEQ ID NO: 86512 - DNA, 20 bp, Artificial
  CRISPR gRNA sequence
gagccctataggctaccatg

SEQ ID NO: 86513 - DNA, 20 bp, Artificial
  CRISPR gRNA sequence
gccctataggctaccatgga

SEQ ID NO: 86514 - DNA, 20 bp, Artificial
  CRISPR gRNA sequence
ccctataggctaccatggag

SEQ ID NO: 86515 - DNA, 20 bp, Artificial
  CRISPR gRNA sequence
ctataggctaccatggagag

SEQ ID NO: 86516 - DNA, 20 bp, Artificial
  CRISPR gRNA sequence
tataggctaccatggagagg

SEQ ID NO: 86517 - DNA, 20 bp, Artificial
  CRISPR gRNA sequence
ataggctaccatggagagga

SEQ ID NO: 86518 - DNA, 20 bp, Artificial
  CRISPR gRNA sequence
ggctaccatggagaggaggg

SEQ ID NO: 86519 - DNA, 20 bp, Artificial
  CRISPR gRNA sequence
taccatggagaggagggaag

SEQ ID NO: 86520 - DNA, 20 bp, Artificial
  CRISPR gRNA sequence
ccatggagaggagggaagta

SEQ ID NO: 86521 - DNA, 20 bp, Artificial
  CRISPR gRNA sequence
catggagaggagggaagtag

SEQ ID NO: 86522 - DNA, 20 bp, Artificial
  CRISPR gRNA sequence
atggagaggagggaagtaga

SEQ ID NO: 86523 - DNA, 20 bp, Artificial
  CRISPR gRNA sequence
tggagaggagggaagtagag

SEQ ID NO: 86524 - DNA, 20 bp, Artificial
  CRISPR gRNA sequence
aggagggaagtagaggggat

SEQ ID NO: 86525 - DNA, 20 bp, Artificial
  CRISPR gRNA sequence
agctctgacttcatctctgc

SEQ ID NO: 86526 - DNA, 20 bp, Artificial
  CRISPR gRNA sequence
gctctgacttcatctctgct

SEQ ID NO: 86527 - DNA, 20 bp, Artificial
  CRISPR gRNA sequence
tctctgctgggcttctatgc

SEQ ID NO: 86528 - DNA, 20 bp, Artificial
  CRISPR gRNA sequence
ggcttctatgcaagtgctca

SEQ ID NO: 86529 - DNA, 20 bp, Artificial
  CRISPR gRNA sequence
cttctatgcaagtgctcaca

SEQ ID NO: 86530 - DNA, 20 bp, Artificial
  CRISPR gRNA sequence
tgcaagtgctcacagagatc

SEQ ID NO: 86531 - DNA, 20 bp, Artificial
  CRISPR gRNA sequence
agtgctcacagagatcaagt

SEQ ID NO: 86532 - DNA, 20 bp, Artificial
  CRISPR gRNA sequence
tgctcacagagatcaagtga

SEQ ID NO: 86533 - DNA, 20 bp, Artificial
  CRISPR gRNA sequence
gctcacagagatcaagtgag

SEQ ID NO: 86534 - DNA, 20 bp, Artificial
  CRISPR gRNA sequence
gagatcaagtgagaggcaca

SEQ ID NO: 86535 - DNA, 20 bp, Artificial
  CRISPR gRNA sequence
tgagaggcacaaagtcaaac

SEQ ID NO: 86536 - DNA, 20 bp, Artificial
  CRISPR gRNA sequence
gaggcacaaagtcaaactgg

SEQ ID NO: 86537 - DNA, 20 bp, Artificial
  CRISPR gRNA sequence
cacaaagtcaaactggcagc

SEQ ID NO: 86538 - DNA, 20 bp, Artificial
  CRISPR gRNA sequence
aaactggcagcaagtttgca

SEQ ID NO: 86539 - DNA, 20 bp, Artificial
  CRISPR gRNA sequence
aaagccaactatcttctgac

SEQ ID NO: 86540 - DNA, 20 bp, Artificial
  CRISPR gRNA sequence
aagccaactatcttctgaca

SEQ ID NO: 86541 - DNA, 20 bp, Artificial
  CRISPR gRNA sequence
ccaactatcttctgacaagg

SEQ ID NO: 86542 - DNA, 20 bp, Artificial
  CRISPR gRNA sequence
aactatcttctgacaaggca

SEQ ID NO: 86543 - DNA, 20 bp, Artificial
  CRISPR gRNA sequence
actatcttctgacaaggcag

SEQ ID NO: 86544 - DNA, 20 bp, Artificial
  CRISPR gRNA sequence
atcctcacatcctcctccct

SEQ ID NO: 86545 - DNA, 20 bp, Artificial
  CRISPR gRNA sequence
ctcttccccaacacacttac

SEQ ID NO: 86546 - DNA, 20 bp, Artificial
  CRISPR gRNA sequence
tcttccccaacacacttacc

SEQ ID NO: 86547 - DNA, 20 bp, Artificial
  CRISPR gRNA sequence
cccctctactttgttctgca

SEQ ID NO: 86548 - DNA, 20 bp, Artificial
  CRISPR gRNA sequence
tgttctgcacggccttgctg

SEQ ID NO: 86549 - DNA, 20 bp, Artificial
  CRISPR gRNA sequence
gttctgcacggccttgctgt

SEQ ID NO: 86550 - DNA, 20 bp, Artificial
  CRISPR gRNA sequence
ttctgcacggccttgctgtg

SEQ ID NO: 86551 - DNA, 20 bp, Artificial
  CRISPR gRNA sequence
tgcacggccttgctgtgggg

SEQ ID NO: 86552 - DNA, 20 bp, Artificial
  CRISPR gRNA sequence
cacggccttgctgtggggaa

SEQ ID NO: 86553 - DNA, 20 bp, Artificial
  CRISPR gRNA sequence
acggccttgctgtggggaag

SEQ ID NO: 86554 - DNA, 20 bp, Artificial
  CRISPR gRNA sequence
ggccttgctgtggggaagag

SEQ ID NO: 86555 - DNA, 20 bp, Artificial
  CRISPR gRNA sequence
ttgctgtggggaagaggaga

SEQ ID NO: 86556 - DNA, 20 bp, Artificial
  CRISPR gRNA sequence
tgtggggaagaggagaaagc

SEQ ID NO: 86557 - DNA, 20 bp, Artificial
  CRISPR gRNA sequence
tggggaagaggagaaagctg

SEQ ID NO: 86558 - DNA, 20 bp, Artificial
  CRISPR gRNA sequence
ggggaagaggagaaagctgg

SEQ ID NO: 86559 - DNA, 20 bp, Artificial
  CRISPR gRNA sequence
gaaagctggaggtcacacac

SEQ ID NO: 86560 - DNA, 20 bp, Artificial
  CRISPR gRNA sequence
ctgtctctttatctgactgc

SEQ ID NO: 86561 - DNA, 20 bp, Artificial
  CRISPR gRNA sequence
tgtctctttatctgactgct

SEQ ID NO: 86562 - DNA, 20 bp, Artificial
  CRISPR gRNA sequence
gtctctttatctgactgcta

SEQ ID NO: 86563 - DNA, 20 bp, Artificial
  CRISPR gRNA sequence
ctctttatctgactgctagg

SEQ ID NO: 86564 - DNA, 20 bp, Artificial
  CRISPR gRNA sequence
tctttatctgactgctaggg

SEQ ID NO: 86565 - DNA, 20 bp, Artificial
  CRISPR gRNA sequence
ctttatctgactgctaggga

SEQ ID NO: 86566 - DNA, 20 bp, Artificial
  CRISPR gRNA sequence
tctgactgctagggagggaa

SEQ ID NO: 86567 - DNA, 20 bp, Artificial
  CRISPR gRNA sequence
ctgactgctagggagggaaa

SEQ ID NO: 86568 - DNA, 20 bp, Artificial
  CRISPR gRNA sequence
gggaaaaggactgaaatgcc

SEQ ID NO: 86569 - DNA, 20 bp, Artificial
  CRISPR gRNA sequence
aaaaggactgaaatgcccag

SEQ ID NO: 86570 - DNA, 20 bp, Artificial
  CRISPR gRNA sequence
aaaggactgaaatgcccagc

SEQ ID NO: 86571 - DNA, 20 bp, Artificial
  CRISPR gRNA sequence
gaaatgcccagcaggtgctc

SEQ ID NO: 86572 - DNA, 20 bp, Artificial
  CRISPR gRNA sequence
gtgctcaagaattgctacca

SEQ ID NO: 86573 - DNA, 20 bp, Artificial
  CRISPR gRNA sequence
tctgctcccatgcccttgct

SEQ ID NO: 86574 - DNA, 20 bp, Artificial
  CRISPR gRNA sequence
tgctcccatgcccttgctga

SEQ ID NO: 86575 - DNA, 20 bp, Artificial
  CRISPR gRNA sequence
gctcccatgcccttgctgag

SEQ ID NO: 86576 - DNA, 20 bp, Artificial
  CRISPR gRNA sequence
cccatgcccttgctgagagg

SEQ ID NO: 86577 - DNA, 20 bp, Artificial
  CRISPR gRNA sequence
gctgagaggcagttcatcta

SEQ ID NO: 86578 - DNA, 20 bp, Artificial
  CRISPR gRNA sequence
aggcagttcatctacagcca

SEQ ID NO: 86579 - DNA, 20 bp, Artificial
  CRISPR gRNA sequence
gttcatctacagccaaagtg

SEQ ID NO: 86580 - DNA, 20 bp, Artificial
  CRISPR gRNA sequence
acagccaaagtgaagtgctg

SEQ ID NO: 86581 - DNA, 20 bp, Artificial
  CRISPR gRNA sequence
cagccaaagtgaagtgctgc

SEQ ID NO: 86582 - DNA, 20 bp, Artificial
  CRISPR gRNA sequence
agccaaagtgaagtgctgca

SEQ ID NO: 86583 - DNA, 20 bp, Artificial
  CRISPR gRNA sequence
gtgctgcagggatctatact

SEQ ID NO: 86584 - DNA, 20 bp, Artificial
  CRISPR gRNA sequence
tgctgcagggatctatactc

SEQ ID NO: 86585 - DNA, 20 bp, Artificial
  CRISPR gRNA sequence
agggatctatactcaggtct

SEQ ID NO: 86586 - DNA, 20 bp, Artificial
  CRISPR gRNA sequence
atctatactcaggtcttgga

SEQ ID NO: 86587 - DNA, 20 bp, Artificial
  CRISPR gRNA sequence
tctatactcaggtcttggac

SEQ ID NO: 86588 - DNA, 20 bp, Artificial
  CRISPR gRNA sequence
ctcaggtcttggacaggact

SEQ ID NO: 86589 - DNA, 20 bp, Artificial
  CRISPR gRNA sequence
caggtcttggacaggacttg

SEQ ID NO: 86590 - DNA, 20 bp, Artificial
  CRISPR gRNA sequence
acaggacttggagatgtgat

SEQ ID NO: 86591 - DNA, 20 bp, Artificial
  CRISPR gRNA sequence
tgtgatgagtacttacgaaa

SEQ ID NO: 86592 - DNA, 20 bp, Artificial
  CRISPR gRNA sequence
gtacttacgaaatggtacct

SEQ ID NO: 86593 - DNA, 20 bp, Artificial
  CRISPR gRNA sequence
acttacgaaatggtacctcg

SEQ ID NO: 86594 - DNA, 20 bp, Artificial
  CRISPR gRNA sequence
atggtacctcggagcctctg

SEQ ID NO: 86595 - DNA, 20 bp, Artificial
  CRISPR gRNA sequence
gtacctcggagcctctgaag

SEQ ID NO: 86596 - DNA, 20 bp, Artificial
  CRISPR gRNA sequence
tacctcggagcctctgaaga

SEQ ID NO: 86597 - DNA, 20 bp, Artificial
  CRISPR gRNA sequence
acctcggagcctctgaagaa

SEQ ID NO: 86598 - DNA, 20 bp, Artificial
  CRISPR gRNA sequence
tcggagcctctgaagaaggg

SEQ ID NO: 86599 - DNA, 20 bp, Artificial
  CRISPR gRNA sequence
gagcctctgaagaagggtgg

SEQ ID NO: 86600 - DNA, 20 bp, Artificial
  CRISPR gRNA sequence
agcctctgaagaagggtggt

SEQ ID NO: 86601 - DNA, 20 bp, Artificial
  CRISPR gRNA sequence
aagaagggtggtaggttccc

SEQ ID NO: 86602 - DNA, 20 bp, Artificial
  CRISPR gRNA sequence
ggtggtaggttccccagcct

SEQ ID NO: 86603 - DNA, 20 bp, Artificial
  CRISPR gRNA sequence
tccccagcctcagcaccacc

SEQ ID NO: 86604 - DNA, 20 bp, Artificial
  CRISPR gRNA sequence
ccccagcctcagcaccacct

SEQ ID NO: 86605 - DNA, 20 bp, Artificial
  CRISPR gRNA sequence
cccagcctcagcaccacctg

SEQ ID NO: 86606 - DNA, 20 bp, Artificial
  CRISPR gRNA sequence
ccagcctcagcaccacctgg

SEQ ID NO: 86607 - DNA, 20 bp, Artificial
  CRISPR gRNA sequence
cagcctcagcaccacctggg

SEQ ID NO: 86608 - DNA, 20 bp, Artificial
  CRISPR gRNA sequence
agcctcagcaccacctgggg

SEQ ID NO: 86609 - DNA, 20 bp, Artificial
  CRISPR gRNA sequence
acctgggggggcccttcccc

SEQ ID NO: 86610 - DNA, 20 bp, Artificial
  CRISPR gRNA sequence
gggggcccttcccccagtct

SEQ ID NO: 86611 - DNA, 20 bp, Artificial
  CRISPR gRNA sequence
ggggcccttcccccagtctt

SEQ ID NO: 86612 - DNA, 20 bp, Artificial
  CRISPR gRNA sequence
gggcccttcccccagtcttg

SEQ ID NO: 86613 - DNA, 20 bp, Artificial
  CRISPR gRNA sequence
tcccccagtcttggggctct

SEQ ID NO: 86614 - DNA, 20 bp, Artificial
  CRISPR gRNA sequence
agtcttggggctcttagcat

SEQ ID NO: 86615 - DNA, 20 bp, Artificial
  CRISPR gRNA sequence
gtcttggggctcttagcatc

SEQ ID NO: 86616 - DNA, 20 bp, Artificial
  CRISPR gRNA sequence
aggctcatcttctgccatcc

SEQ ID NO: 86617 - DNA, 20 bp, Artificial
  CRISPR gRNA sequence
atcttctgccatcccggcat

SEQ ID NO: 86618 - DNA, 20 bp, Artificial
  CRISPR gRNA sequence
tcttctgccatcccggcatg

SEQ ID NO: 86619 - DNA, 20 bp, Artificial
  CRISPR gRNA sequence
cttctgccatcccggcatga

SEQ ID NO: 86620 - DNA, 20 bp, Artificial
  CRISPR gRNA sequence
tgccatcccggcatgagggc

SEQ ID NO: 86621 - DNA, 20 bp, Artificial
  CRISPR gRNA sequence
ccggcatgagggctagaatt

SEQ ID NO: 86622 - DNA, 20 bp, Artificial
  CRISPR gRNA sequence
ggcatgagggctagaattga

SEQ ID NO: 86623 - DNA, 20 bp, Artificial
  CRISPR gRNA sequence
gcatgagggctagaattgag

SEQ ID NO: 86624 - DNA, 20 bp, Artificial
  CRISPR gRNA sequence
catgagggctagaattgaga

SEQ ID NO: 86625 - DNA, 20 bp, Artificial
  CRISPR gRNA sequence
agggctagaattgagaggga

SEQ ID NO: 86626 - DNA, 20 bp, Artificial
  CRISPR gRNA sequence
gggctagaattgagagggac

SEQ ID NO: 86627 - DNA, 20 bp, Artificial
  CRISPR gRNA sequence
aattgagagggacaggcata

SEQ ID NO: 86628 - DNA, 20 bp, Artificial
  CRISPR gRNA sequence
cataaagatgtaactcacac

SEQ ID NO: 86629 - DNA, 20 bp, Artificial
  CRISPR gRNA sequence
cacactggccttcccttccc

SEQ ID NO: 86630 - DNA, 20 bp, Artificial
  CRISPR gRNA sequence
actggccttcccttccccag

SEQ ID NO: 86631 - DNA, 20 bp, Artificial
  CRISPR gRNA sequence
ctggccttcccttccccaga

SEQ ID NO: 86632 - DNA, 20 bp, Artificial
  CRISPR gRNA sequence
ttcccttccccagaaggccc

SEQ ID NO: 86633 - DNA, 20 bp, Artificial
  CRISPR gRNA sequence
tcccttccccagaaggcccc

SEQ ID NO: 86634 - DNA, 20 bp, Artificial
  CRISPR gRNA sequence
cccttccccagaaggcccca

SEQ ID NO: 86635 - DNA, 20 bp, Artificial
  CRISPR gRNA sequence
gcactcctcatctctttacc

SEQ ID NO: 86636 - DNA, 20 bp, Artificial
  CRISPR gRNA sequence
tcctcatctctttacccaga

SEQ ID NO: 86637 - DNA, 20 bp, Artificial
  CRISPR gRNA sequence
cctcatctctttacccagaa

SEQ ID NO: 86638 - DNA, 20 bp, Artificial
  CRISPR gRNA sequence
catctctttacccagaaagg

SEQ ID NO: 86639 - DNA, 20 bp, Artificial
  CRISPR gRNA sequence
tctctttacccagaaaggca

SEQ ID NO: 86640 - DNA, 20 bp, Artificial
  CRISPR gRNA sequence
tacccagaaaggcagagaaa

SEQ ID NO: 86641 - DNA, 20 bp, Artificial
  CRISPR gRNA sequence
aaggcagagaaacagaaaca

SEQ ID NO: 86642 - DNA, 20 bp, Artificial
  CRISPR gRNA sequence
acaaagcctccgaatttccc

SEQ ID NO: 86643 - DNA, 20 bp, Artificial
  CRISPR gRNA sequence
aagcctccgaatttccccgg

SEQ ID NO: 86644 - DNA, 20 bp, Artificial
  CRISPR gRNA sequence
cacttgccttctccgaaaat

SEQ ID NO: 86645 - DNA, 20 bp, Artificial
  CRISPR gRNA sequence
aaattattccattacttcgc

SEQ ID NO: 86646 - DNA, 20 bp, Artificial
  CRISPR gRNA sequence
aattattccattacttcgcc

SEQ ID NO: 86647 - DNA, 20 bp, Artificial
  CRISPR gRNA sequence
gccaggcccatatatgccca

SEQ ID NO: 86648 - DNA, 20 bp, Artificial
  CRISPR gRNA sequence
caggcccatatatgcccaaa

SEQ ID NO: 86649 - DNA, 20 bp, Artificial
  CRISPR gRNA sequence
ctatctgccccacctttctg

SEQ ID NO: 86650 - DNA, 20 bp, Artificial
  CRISPR gRNA sequence
tttctgaagtctcctaaatc

SEQ ID NO: 86651 - DNA, 20 bp, Artificial
  CRISPR gRNA sequence
cctaaatctggaaaactgta

SEQ ID NO: 86652 - DNA, 20 bp, Artificial
  CRISPR gRNA sequence
ctaaatctggaaaactgtaa

SEQ ID NO: 86653 - DNA, 20 bp, Artificial
  CRISPR gRNA sequence
aatctggaaaactgtaaagg

SEQ ID NO: 86654 - DNA, 20 bp, Artificial
  CRISPR gRNA sequence
tctggaaaactgtaaaggaa

SEQ ID NO: 86655 - DNA, 20 bp, Artificial
  CRISPR gRNA sequence
gaaaactgtaaaggaagaga

SEQ ID NO: 86656 - DNA, 20 bp, Artificial
  CRISPR gRNA sequence
aaaactgtaaaggaagagat

SEQ ID NO: 86657 - DNA, 20 bp, Artificial
  CRISPR gRNA sequence
aaactgtaaaggaagagata

SEQ ID NO: 86658 - DNA, 20 bp, Artificial
  CRISPR gRNA sequence
aactgtaaaggaagagatag

SEQ ID NO: 86659 - DNA, 20 bp, Artificial
  CRISPR gRNA sequence
actgtaaaggaagagatagg

SEQ ID NO: 86660 - DNA, 20 bp, Artificial
  CRISPR gRNA sequence
aaaggaagagatagggggat

SEQ ID NO: 86661 - DNA, 20 bp, Artificial
  CRISPR gRNA sequence
aaggaagagatagggggatt

SEQ ID NO: 86662 - DNA, 20 bp, Artificial
  CRISPR gRNA sequence
gggggattgggaatccatgt

SEQ ID NO: 86663 - DNA, 20 bp, Artificial
  CRISPR gRNA sequence
gattgggaatccatgttagc

SEQ ID NO: 86664 - DNA, 20 bp, Artificial
  CRISPR gRNA sequence
cccctcaaaaacaacaataa

SEQ ID NO: 86665 - DNA, 20 bp, Artificial
  CRISPR gRNA sequence
acaataacagccacaaaaca

SEQ ID NO: 86666 - DNA, 20 bp, Artificial
  CRISPR gRNA sequence
tcctcaccattgcatatgcc

SEQ ID NO: 86667 - DNA, 20 bp, Artificial
  CRISPR gRNA sequence
cctcaccattgcatatgcct

SEQ ID NO: 86668 - DNA, 20 bp, Artificial
  CRISPR gRNA sequence
tcaccattgcatatgcctgg

SEQ ID NO: 86669 - DNA, 20 bp, Artificial
  CRISPR gRNA sequence
caccattgcatatgcctggg

SEQ ID NO: 86670 - DNA, 20 bp, Artificial
  CRISPR gRNA sequence
attgcatatgcctgggaggt

SEQ ID NO: 86671 - DNA, 20 bp, Artificial
  CRISPR gRNA sequence
catatgcctgggaggtcaga

SEQ ID NO: 86672 - DNA, 20 bp, Artificial
  CRISPR gRNA sequence
atatgcctgggaggtcagaa

SEQ ID NO: 86673 - DNA, 20 bp, Artificial
  CRISPR gRNA sequence
acgaacatattctgcccttc

SEQ ID NO: 86674 - DNA, 20 bp, Artificial
  CRISPR gRNA sequence
cgaacatattctgcccttct

SEQ ID NO: 86675 - DNA, 20 bp, Artificial
  CRISPR gRNA sequence
atattctgcccttctaggct

SEQ ID NO: 86676 - DNA, 20 bp, Artificial
  CRISPR gRNA sequence
tctaggcttggaaaaaaaac

SEQ ID NO: 86677 - DNA, 20 bp, Artificial
  CRISPR gRNA sequence
ctaggcttggaaaaaaaact

SEQ ID NO: 86678 - DNA, 20 bp, Artificial
  CRISPR gRNA sequence
ttggaaaaaaaactgggccc

SEQ ID NO: 86679 - DNA, 20 bp, Artificial
  CRISPR gRNA sequence
gctccccctccccacgtcgc

SEQ ID NO: 86680 - DNA, 20 bp, Artificial
  CRISPR gRNA sequence
ccctacgtcatctcccacaa

SEQ ID NO: 86681 - DNA, 20 bp, Artificial
  CRISPR gRNA sequence
ctcccacaacagcccatcct

SEQ ID NO: 86682 - DNA, 20 bp, Artificial
  CRISPR gRNA sequence
tcccacaacagcccatcctg

SEQ ID NO: 86683 - DNA, 20 bp, Artificial
  CRISPR gRNA sequence
ttccccctccattcaatccc

SEQ ID NO: 86684 - DNA, 20 bp, Artificial
  CRISPR gRNA sequence
ttcaatccccggtttctgca

SEQ ID NO: 86685 - DNA, 20 bp, Artificial
  CRISPR gRNA sequence
aatccccggtttctgcaaag

SEQ ID NO: 86686 - DNA, 20 bp, Artificial
  CRISPR gRNA sequence
tccccggtttctgcaaagtg

SEQ ID NO: 86687 - DNA, 20 bp, Artificial
  CRISPR gRNA sequence
ccggtttctgcaaagtggag

SEQ ID NO: 86688 - DNA, 20 bp, Artificial
  CRISPR gRNA sequence
cggtttctgcaaagtggagc

SEQ ID NO: 86689 - DNA, 20 bp, Artificial
  CRISPR gRNA sequence
ggtttctgcaaagtggagcg

SEQ ID NO: 86690 - DNA, 20 bp, Artificial
  CRISPR gRNA sequence
gtttctgcaaagtggagcgg

SEQ ID NO: 86691 - DNA, 20 bp, Artificial
  CRISPR gRNA sequence
tctgcaaagtggagcggggg

SEQ ID NO: 86692 - DNA, 20 bp, Artificial
  CRISPR gRNA sequence
ctgcaaagtggagcgggggt

SEQ ID NO: 86693 - DNA, 20 bp, Artificial
  CRISPR gRNA sequence
tgcaaagtggagcgggggtg

SEQ ID NO: 86694 - DNA, 20 bp, Artificial
  CRISPR gRNA sequence
cccacccccgctccactttg

SEQ ID NO: 86695 - DNA, 20 bp, Artificial
  CRISPR gRNA sequence
ccgctccactttgcagaaac

SEQ ID NO: 86696 - DNA, 20 bp, Artificial
  CRISPR gRNA sequence
cgctccactttgcagaaacc

SEQ ID NO: 86697 - DNA, 20 bp, Artificial
  CRISPR gRNA sequence
gctccactttgcagaaaccg

SEQ ID NO: 86698 - DNA, 20 bp, Artificial
  CRISPR gRNA sequence
tgcagaaaccggggattgaa

SEQ ID NO: 86699 - DNA, 20 bp, Artificial
  CRISPR gRNA sequence
cagaaaccggggattgaatg

SEQ ID NO: 86700 - DNA, 20 bp, Artificial
  CRISPR gRNA sequence
agaaaccggggattgaatgg

SEQ ID NO: 86701 - DNA, 20 bp, Artificial
  CRISPR gRNA sequence
gaaaccggggattgaatgga

SEQ ID NO: 86702 - DNA, 20 bp, Artificial
  CRISPR gRNA sequence
aaaccggggattgaatggag

SEQ ID NO: 86703 - DNA, 20 bp, Artificial
  CRISPR gRNA sequence
aaccggggattgaatggagg

SEQ ID NO: 86704 - DNA, 20 bp, Artificial
  CRISPR gRNA sequence
cggggattgaatggaggggg

SEQ ID NO: 86705 - DNA, 20 bp, Artificial
  CRISPR gRNA sequence
ggggattgaatggaggggga

SEQ ID NO: 86706 - DNA, 20 bp, Artificial
  CRISPR gRNA sequence
gggattgaatggagggggaa

SEQ ID NO: 86707 - DNA, 20 bp, Artificial
  CRISPR gRNA sequence
attgaatggagggggaaggg

SEQ ID NO: 86708 - DNA, 20 bp, Artificial
  CRISPR gRNA sequence
ttgaatggagggggaaggga

SEQ ID NO: 86709 - DNA, 20 bp, Artificial
  CRISPR gRNA sequence
gaatggagggggaagggaag

SEQ ID NO: 86710 - DNA, 20 bp, Artificial
  CRISPR gRNA sequence
aatggagggggaagggaagg

SEQ ID NO: 86711 - DNA, 20 bp, Artificial
  CRISPR gRNA sequence
ggagggggaagggaaggagg

SEQ ID NO: 86712 - DNA, 20 bp, Artificial
  CRISPR gRNA sequence
gagggggaagggaaggaggt

SEQ ID NO: 86713 - DNA, 20 bp, Artificial
  CRISPR gRNA sequence
agggggaagggaaggaggtg

SEQ ID NO: 86714 - DNA, 20 bp, Artificial
  CRISPR gRNA sequence
gggggaagggaaggaggtgg

SEQ ID NO: 86715 - DNA, 20 bp, Artificial
  CRISPR gRNA sequence
aaggaggtgggggcgcgcct

SEQ ID NO: 86716 - DNA, 20 bp, Artificial
  CRISPR gRNA sequence
aggaggtgggggcgcgcctc

SEQ ID NO: 86717 - DNA, 20 bp, Artificial
  CRISPR gRNA sequence
ggtgggggcgcgcctcagga

SEQ ID NO: 86718 - DNA, 20 bp, Artificial
  CRISPR gRNA sequence
gtgggggcgcgcctcaggat

SEQ ID NO: 86719 - DNA, 20 bp, Artificial
  CRISPR gRNA sequence
cgcctcaggatgggctgttg

SEQ ID NO: 86720 - DNA, 20 bp, Artificial
  CRISPR gRNA sequence
gcctcaggatgggctgttgt

SEQ ID NO: 86721 - DNA, 20 bp, Artificial
  CRISPR gRNA sequence
ctcaggatgggctgttgtgg

SEQ ID NO: 86722 - DNA, 20 bp, Artificial
  CRISPR gRNA sequence
ggctgttgtgggagatgacg

SEQ ID NO: 86723 - DNA, 20 bp, Artificial
  CRISPR gRNA sequence
gctgttgtgggagatgacgt

SEQ ID NO: 86724 - DNA, 20 bp, Artificial
  CRISPR gRNA sequence
ctgttgtgggagatgacgta

SEQ ID NO: 86725 - DNA, 20 bp, Artificial
  CRISPR gRNA sequence
tgttgtgggagatgacgtag

SEQ ID NO: 86726 - DNA, 20 bp, Artificial
  CRISPR gRNA sequence
gtgggagatgacgtaggggc

SEQ ID NO: 86727 - DNA, 20 bp, Artificial
  CRISPR gRNA sequence
tgacgtaggggccggcgacg

SEQ ID NO: 86728 - DNA, 20 bp, Artificial
  CRISPR gRNA sequence
gacgtaggggccggcgacgt

SEQ ID NO: 86729 - DNA, 20 bp, Artificial
  CRISPR gRNA sequence
acgtaggggccggcgacgtg

SEQ ID NO: 86730 - DNA, 20 bp, Artificial
  CRISPR gRNA sequence
gtaggggccggcgacgtggg

SEQ ID NO: 86731 - DNA, 20 bp, Artificial
  CRISPR gRNA sequence
taggggccggcgacgtgggg

SEQ ID NO: 86732 - DNA, 20 bp, Artificial
  CRISPR gRNA sequence
aggggccggcgacgtgggga

SEQ ID NO: 86733 - DNA, 20 bp, Artificial
  CRISPR gRNA sequence
ggggccggcgacgtggggag

SEQ ID NO: 86734 - DNA, 20 bp, Artificial
  CRISPR gRNA sequence
gggccggcgacgtggggagg

SEQ ID NO: 86735 - DNA, 20 bp, Artificial
  CRISPR gRNA sequence
gccggcgacgtggggagggg

SEQ ID NO: 86736 - DNA, 20 bp, Artificial
  CRISPR gRNA sequence
ggcgacgtggggagggggag

SEQ ID NO: 86737 - DNA, 20 bp, Artificial
  CRISPR gRNA sequence
gacgtggggagggggagcag

SEQ ID NO: 86738 - DNA, 20 bp, Artificial
  CRISPR gRNA sequence
acgtggggagggggagcagc

SEQ ID NO: 86739 - DNA, 20 bp, Artificial
  CRISPR gRNA sequence
cgtggggagggggagcagcg

SEQ ID NO: 86740 - DNA, 20 bp, Artificial
  CRISPR gRNA sequence
gtggggagggggagcagcgg

SEQ ID NO: 86741 - DNA, 20 bp, Artificial
  CRISPR gRNA sequence
gggagggggagcagcggggg

SEQ ID NO: 86742 - DNA, 20 bp, Artificial
  CRISPR gRNA sequence
gggagcagcgggggaagtcg

SEQ ID NO: 86743 - DNA, 20 bp, Artificial
  CRISPR gRNA sequence
gcagcgggggaagtcgtggc

SEQ ID NO: 86744 - DNA, 20 bp, Artificial
  CRISPR gRNA sequence
ggggaagtcgtggcgagatt

SEQ ID NO: 86745 - DNA, 20 bp, Artificial
  CRISPR gRNA sequence
tcgtggcgagattaagtaat

SEQ ID NO: 86746 - DNA, 20 bp, Artificial
  CRISPR gRNA sequence
gagattaagtaatgagaact

SEQ ID NO: 86747 - DNA, 20 bp, Artificial
  CRISPR gRNA sequence
agattaagtaatgagaactt

SEQ ID NO: 86748 - DNA, 20 bp, Artificial
  CRISPR gRNA sequence
aagtaatgagaacttgggcc

SEQ ID NO: 86749 - DNA, 20 bp, Artificial
  CRISPR gRNA sequence
ttgggcccagttttttttcc

SEQ ID NO: 86750 - DNA, 20 bp, Artificial
  CRISPR gRNA sequence
cccagttttttttccaagcc

SEQ ID NO: 86751 - DNA, 20 bp, Artificial
  CRISPR gRNA sequence
agttttttttccaagcctag

SEQ ID NO: 86752 - DNA, 20 bp, Artificial
  CRISPR gRNA sequence
gttttttttccaagcctaga

SEQ ID NO: 86753 - DNA, 20 bp, Artificial
  CRISPR gRNA sequence
ttttttttccaagcctagaa

SEQ ID NO: 86754 - DNA, 20 bp, Artificial
  CRISPR gRNA sequence
tttttccaagcctagaaggg

SEQ ID NO: 86755 - DNA, 20 bp, Artificial
  CRISPR gRNA sequence
tcgtatcctttctgacctcc

SEQ ID NO: 86756 - DNA, 20 bp, Artificial
  CRISPR gRNA sequence
cgtatcctttctgacctccc

SEQ ID NO: 86757 - DNA, 20 bp, Artificial
  CRISPR gRNA sequence
gacctcccaggcatatgcaa

SEQ ID NO: 86758 - DNA, 20 bp, Artificial
  CRISPR gRNA sequence
tcccaggcatatgcaatggt

SEQ ID NO: 86759 - DNA, 20 bp, Artificial
  CRISPR gRNA sequence
cccaggcatatgcaatggtg

SEQ ID NO: 86760 - DNA, 20 bp, Artificial
  CRISPR gRNA sequence
caggcatatgcaatggtgag

SEQ ID NO: 86761 - DNA, 20 bp, Artificial
  CRISPR gRNA sequence
caatggtgaggagtattttt

SEQ ID NO: 86762 - DNA, 20 bp, Artificial
  CRISPR gRNA sequence
tgaggagtatttttgagaat

SEQ ID NO: 86763 - DNA, 20 bp, Artificial
  CRISPR gRNA sequence
aggagtatttttgagaatta

SEQ ID NO: 86764 - DNA, 20 bp, Artificial
  CRISPR gRNA sequence
aattagagaactttgttttg

SEQ ID NO: 86765 - DNA, 20 bp, Artificial
  CRISPR gRNA sequence
tggctgttattgttgttttt

SEQ ID NO: 86766 - DNA, 20 bp, Artificial
  CRISPR gRNA sequence
ggctgttattgttgtttttg

SEQ ID NO: 86767 - DNA, 20 bp, Artificial
  CRISPR gRNA sequence
gctgttattgttgtttttga

SEQ ID NO: 86768 - DNA, 20 bp, Artificial
  CRISPR gRNA sequence
ctgttattgttgtttttgag

SEQ ID NO: 86769 - DNA, 20 bp, Artificial
  CRISPR gRNA sequence
tgttattgttgtttttgagg

SEQ ID NO: 86770 - DNA, 20 bp, Artificial
  CRISPR gRNA sequence
ttattgttgtttttgagggg

SEQ ID NO: 86771 - DNA, 20 bp, Artificial
  CRISPR gRNA sequence
tattgttgtttttgaggggg

SEQ ID NO: 86772 - DNA, 20 bp, Artificial
  CRISPR gRNA sequence
ttgttgtttttgagggggag

SEQ ID NO: 86773 - DNA, 20 bp, Artificial
  CRISPR gRNA sequence
tgttgtttttgagggggagg

SEQ ID NO: 86774 - DNA, 20 bp, Artificial
  CRISPR gRNA sequence
gttgtttttgagggggagga

SEQ ID NO: 86775 - DNA, 20 bp, Artificial
  CRISPR gRNA sequence
gtttttgagggggaggaggg

SEQ ID NO: 86776 - DNA, 20 bp, Artificial
  CRISPR gRNA sequence
tgagggggaggagggcagta

SEQ ID NO: 86777 - DNA, 20 bp, Artificial
  CRISPR gRNA sequence
gagggggaggagggcagtat

SEQ ID NO: 86778 - DNA, 20 bp, Artificial
  CRISPR gRNA sequence
agggggaggagggcagtatg

SEQ ID NO: 86779 - DNA, 20 bp, Artificial
  CRISPR gRNA sequence
ggaggagggcagtatggggt

SEQ ID NO: 86780 - DNA, 20 bp, Artificial
  CRISPR gRNA sequence
aggagggcagtatggggtca

SEQ ID NO: 86781 - DNA, 20 bp, Artificial
  CRISPR gRNA sequence
ggagggcagtatggggtcag

SEQ ID NO: 86782 - DNA, 20 bp, Artificial
  CRISPR gRNA sequence
gggcagtatggggtcagagg

SEQ ID NO: 86783 - DNA, 20 bp, Artificial
  CRISPR gRNA sequence
atgaaaatttcttgctaaca

SEQ ID NO: 86784 - DNA, 20 bp, Artificial
  CRISPR gRNA sequence
tccccctatctcttccttta

SEQ ID NO: 86785 - DNA, 20 bp, Artificial
  CRISPR gRNA sequence
tctcttcctttacagttttc

SEQ ID NO: 86786 - DNA, 20 bp, Artificial
  CRISPR gRNA sequence
cctttacagttttccagatt

SEQ ID NO: 86787 - DNA, 20 bp, Artificial
  CRISPR gRNA sequence
ctttacagttttccagattt

SEQ ID NO: 86788 - DNA, 20 bp, Artificial
  CRISPR gRNA sequence
ttacagttttccagatttag

SEQ ID NO: 86789 - DNA, 20 bp, Artificial
  CRISPR gRNA sequence
tttccagatttaggagactt

SEQ ID NO: 86790 - DNA, 20 bp, Artificial
  CRISPR gRNA sequence
cagatttaggagacttcaga

SEQ ID NO: 86791 - DNA, 20 bp, Artificial
  CRISPR gRNA sequence
agatttaggagacttcagaa

SEQ ID NO: 86792 - DNA, 20 bp, Artificial
  CRISPR gRNA sequence
tttaggagacttcagaaagg

SEQ ID NO: 86793 - DNA, 20 bp, Artificial
  CRISPR gRNA sequence
ttaggagacttcagaaaggt

SEQ ID NO: 86794 - DNA, 20 bp, Artificial
  CRISPR gRNA sequence
taggagacttcagaaaggtg

SEQ ID NO: 86795 - DNA, 20 bp, Artificial
  CRISPR gRNA sequence
gagacttcagaaaggtgggg

SEQ ID NO: 86796 - DNA, 20 bp, Artificial
  CRISPR gRNA sequence
cttcagaaaggtggggcaga

SEQ ID NO: 86797 - DNA, 20 bp, Artificial
  CRISPR gRNA sequence
gaaaggtggggcagatagaa

SEQ ID NO: 86798 - DNA, 20 bp, Artificial
  CRISPR gRNA sequence
aaggtggggcagatagaatg

SEQ ID NO: 86799 - DNA, 20 bp, Artificial
  CRISPR gRNA sequence
tggggcagatagaatggaga

SEQ ID NO: 86800 - DNA, 20 bp, Artificial
  CRISPR gRNA sequence
cagatagaatggagatggca

SEQ ID NO: 86801 - DNA, 20 bp, Artificial
  CRISPR gRNA sequence
ggagatggcaaagatctctt

SEQ ID NO: 86802 - DNA, 20 bp, Artificial
  CRISPR gRNA sequence
gagatggcaaagatctcttt

SEQ ID NO: 86803 - DNA, 20 bp, Artificial
  CRISPR gRNA sequence
aagatctctttgggcatata

SEQ ID NO: 86804 - DNA, 20 bp, Artificial
  CRISPR gRNA sequence
agatctctttgggcatatat

SEQ ID NO: 86805 - DNA, 20 bp, Artificial
  CRISPR gRNA sequence
tctttgggcatatatgggcc

SEQ ID NO: 86806 - DNA, 20 bp, Artificial
  CRISPR gRNA sequence
gggcatatatgggcctggcg

SEQ ID NO: 86807 - DNA, 20 bp, Artificial
  CRISPR gRNA sequence
atatgggcctggcgaagtaa

SEQ ID NO: 86808 - DNA, 20 bp, Artificial
  CRISPR gRNA sequence
atggaataatttctaatttt

SEQ ID NO: 86809 - DNA, 20 bp, Artificial
  CRISPR gRNA sequence
ggaataatttctaattttcg

SEQ ID NO: 86810 - DNA, 20 bp, Artificial
  CRISPR gRNA sequence
ataatttctaattttcggag

SEQ ID NO: 86811 - DNA, 20 bp, Artificial
  CRISPR gRNA sequence
taatttctaattttcggaga

SEQ ID NO: 86812 - DNA, 20 bp, Artificial
  CRISPR gRNA sequence
ttctaattttcggagaaggc

SEQ ID NO: 86813 - DNA, 20 bp, Artificial
  CRISPR gRNA sequence
taattttcggagaaggcaag

SEQ ID NO: 86814 - DNA, 20 bp, Artificial
  CRISPR gRNA sequence
tttcggagaaggcaagtggt

SEQ ID NO: 86815 - DNA, 20 bp, Artificial
  CRISPR gRNA sequence
agaaggcaagtggtgagaaa

SEQ ID NO: 86816 - DNA, 20 bp, Artificial
  CRISPR gRNA sequence
agtggtgagaaaaagaccac

SEQ ID NO: 86817 - DNA, 20 bp, Artificial
  CRISPR gRNA sequence
gtggtgagaaaaagaccacc

SEQ ID NO: 86818 - DNA, 20 bp, Artificial
  CRISPR gRNA sequence
tggtgagaaaaagaccaccg

SEQ ID NO: 86819 - DNA, 20 bp, Artificial
  CRISPR gRNA sequence
aaaagaccaccggggaaatt

SEQ ID NO: 86820 - DNA, 20 bp, Artificial
  CRISPR gRNA sequence
aagaccaccggggaaattcg

SEQ ID NO: 86821 - DNA, 20 bp, Artificial
  CRISPR gRNA sequence
agaccaccggggaaattcgg

SEQ ID NO: 86822 - DNA, 20 bp, Artificial
  CRISPR gRNA sequence
tttctgtttctctgcctttc

SEQ ID NO: 86823 - DNA, 20 bp, Artificial
  CRISPR gRNA sequence
ttctgtttctctgcctttct

SEQ ID NO: 86824 - DNA, 20 bp, Artificial
  CRISPR gRNA sequence
tttctctgcctttctgggta

SEQ ID NO: 86825 - DNA, 20 bp, Artificial
  CRISPR gRNA sequence
tctctgcctttctgggtaaa

SEQ ID NO: 86826 - DNA, 20 bp, Artificial
  CRISPR gRNA sequence
gcctttctgggtaaagagat

SEQ ID NO: 86827 - DNA, 20 bp, Artificial
  CRISPR gRNA sequence
cctttctgggtaaagagatg

SEQ ID NO: 86828 - DNA, 20 bp, Artificial
  CRISPR gRNA sequence
tttctgggtaaagagatgag

SEQ ID NO: 86829 - DNA, 20 bp, Artificial
  CRISPR gRNA sequence
taaagagatgaggagtgccc

SEQ ID NO: 86830 - DNA, 20 bp, Artificial
  CRISPR gRNA sequence
aaagagatgaggagtgccct

SEQ ID NO: 86831 - DNA, 20 bp, Artificial
  CRISPR gRNA sequence
aagagatgaggagtgccctg

SEQ ID NO: 86832 - DNA, 20 bp, Artificial
  CRISPR gRNA sequence
aggagtgccctggggccttc

SEQ ID NO: 86833 - DNA, 20 bp, Artificial
  CRISPR gRNA sequence
ggagtgccctggggccttct

SEQ ID NO: 86834 - DNA, 20 bp, Artificial
  CRISPR gRNA sequence
gagtgccctggggccttctg

SEQ ID NO: 86835 - DNA, 20 bp, Artificial
  CRISPR gRNA sequence
tgccctggggccttctgggg

SEQ ID NO: 86836 - DNA, 20 bp, Artificial
  CRISPR gRNA sequence
gccctggggccttctgggga

SEQ ID NO: 86837 - DNA, 20 bp, Artificial
  CRISPR gRNA sequence
ccctggggccttctggggaa

SEQ ID NO: 86838 - DNA, 20 bp, Artificial
  CRISPR gRNA sequence
tggggccttctggggaaggg

SEQ ID NO: 86839 - DNA, 20 bp, Artificial
  CRISPR gRNA sequence
ggggccttctggggaaggga

SEQ ID NO: 86840 - DNA, 20 bp, Artificial
  CRISPR gRNA sequence
ccttctggggaagggaaggc

SEQ ID NO: 86841 - DNA, 20 bp, Artificial
  CRISPR gRNA sequence
ggggaagggaaggccagtgt

SEQ ID NO: 86842 - DNA, 20 bp, Artificial
  CRISPR gRNA sequence
atgcctgtccctctcaattc

SEQ ID NO: 86843 - DNA, 20 bp, Artificial
  CRISPR gRNA sequence
ctcaattctagccctcatgc

SEQ ID NO: 86844 - DNA, 20 bp, Artificial
  CRISPR gRNA sequence
tcaattctagccctcatgcc

SEQ ID NO: 86845 - DNA, 20 bp, Artificial
  CRISPR gRNA sequence
ttctagccctcatgccggga

SEQ ID NO: 86846 - DNA, 20 bp, Artificial
  CRISPR gRNA sequence
tagccctcatgccgggatgg

SEQ ID NO: 86847 - DNA, 20 bp, Artificial
  CRISPR gRNA sequence
ccctcatgccgggatggcag

SEQ ID NO: 86848 - DNA, 20 bp, Artificial
  CRISPR gRNA sequence
atgccgggatggcagaagat

SEQ ID NO: 86849 - DNA, 20 bp, Artificial
  CRISPR gRNA sequence
cagaagatgagcctgatgct

SEQ ID NO: 86850 - DNA, 20 bp, Artificial
  CRISPR gRNA sequence
gaagatgagcctgatgctaa

SEQ ID NO: 86851 - DNA, 20 bp, Artificial
  CRISPR gRNA sequence
agcctgatgctaagagcccc

SEQ ID NO: 86852 - DNA, 20 bp, Artificial
  CRISPR gRNA sequence
gatgctaagagccccaagac

SEQ ID NO: 86853 - DNA, 20 bp, Artificial
  CRISPR gRNA sequence
atgctaagagccccaagact

SEQ ID NO: 86854 - DNA, 20 bp, Artificial
  CRISPR gRNA sequence
tgctaagagccccaagactg

SEQ ID NO: 86855 - DNA, 20 bp, Artificial
  CRISPR gRNA sequence
gctaagagccccaagactgg

SEQ ID NO: 86856 - DNA, 20 bp, Artificial
  CRISPR gRNA sequence
aagagccccaagactggggg

SEQ ID NO: 86857 - DNA, 20 bp, Artificial
  CRISPR gRNA sequence
agagccccaagactggggga

SEQ ID NO: 86858 - DNA, 20 bp, Artificial
  CRISPR gRNA sequence
gagccccaagactgggggaa

SEQ ID NO: 86859 - DNA, 20 bp, Artificial
  CRISPR gRNA sequence
gactgggggaagggcccccc

SEQ ID NO: 86860 - DNA, 20 bp, Artificial
  CRISPR gRNA sequence
actgggggaagggccccccc

SEQ ID NO: 86861 - DNA, 20 bp, Artificial
  CRISPR gRNA sequence
gggggaagggcccccccagg

SEQ ID NO: 86862 - DNA, 20 bp, Artificial
  CRISPR gRNA sequence
gggcccccccaggtggtgct

SEQ ID NO: 86863 - DNA, 20 bp, Artificial
  CRISPR gRNA sequence
ggcccccccaggtggtgctg

SEQ ID NO: 86864 - DNA, 20 bp, Artificial
  CRISPR gRNA sequence
cccccaggtggtgctgaggc

SEQ ID NO: 86865 - DNA, 20 bp, Artificial
  CRISPR gRNA sequence
ccccaggtggtgctgaggct

SEQ ID NO: 86866 - DNA, 20 bp, Artificial
  CRISPR gRNA sequence
cccaggtggtgctgaggctg

SEQ ID NO: 86867 - DNA, 20 bp, Artificial
  CRISPR gRNA sequence
gggaacctaccacccttctt

SEQ ID NO: 86868 - DNA, 20 bp, Artificial
  CRISPR gRNA sequence
gaacctaccacccttcttca

SEQ ID NO: 86869 - DNA, 20 bp, Artificial
  CRISPR gRNA sequence
aacctaccacccttcttcag

SEQ ID NO: 86870 - DNA, 20 bp, Artificial
  CRISPR gRNA sequence
cacccttcttcagaggctcc

SEQ ID NO: 86871 - DNA, 20 bp, Artificial
  CRISPR gRNA sequence
acccttcttcagaggctccg

SEQ ID NO: 86872 - DNA, 20 bp, Artificial
  CRISPR gRNA sequence
gctccgaggtaccatttcgt

SEQ ID NO: 86873 - DNA, 20 bp, Artificial
  CRISPR gRNA sequence
taagtactcatcacatctcc

SEQ ID NO: 86874 - DNA, 20 bp, Artificial
  CRISPR gRNA sequence
cacatctccaagtcctgtcc

SEQ ID NO: 86875 - DNA, 20 bp, Artificial
  CRISPR gRNA sequence
ccaagtcctgtccaagacct

SEQ ID NO: 86876 - DNA, 20 bp, Artificial
  CRISPR gRNA sequence
tcctgtccaagacctgagta

SEQ ID NO: 86877 - DNA, 20 bp, Artificial
  CRISPR gRNA sequence
gacctgagtatagatccctg

SEQ ID NO: 86878 - DNA, 20 bp, Artificial
  CRISPR gRNA sequence
atccctgcagcacttcactt

SEQ ID NO: 86879 - DNA, 20 bp, Artificial
  CRISPR gRNA sequence
gcagcacttcactttggctg

SEQ ID NO: 86880 - DNA, 20 bp, Artificial
  CRISPR gRNA sequence
gctgtagatgaactgcctct

SEQ ID NO: 86881 - DNA, 20 bp, Artificial
  CRISPR gRNA sequence
tagatgaactgcctctcagc

SEQ ID NO: 86882 - DNA, 20 bp, Artificial
  CRISPR gRNA sequence
agatgaactgcctctcagca

SEQ ID NO: 86883 - DNA, 20 bp, Artificial
  CRISPR gRNA sequence
gatgaactgcctctcagcaa

SEQ ID NO: 86884 - DNA, 20 bp, Artificial
  CRISPR gRNA sequence
actgcctctcagcaagggca

SEQ ID NO: 86885 - DNA, 20 bp, Artificial
  CRISPR gRNA sequence
ctgcctctcagcaagggcat

SEQ ID NO: 86886 - DNA, 20 bp, Artificial
  CRISPR gRNA sequence
gcctctcagcaagggcatgg

SEQ ID NO: 86887 - DNA, 20 bp, Artificial
  CRISPR gRNA sequence
tctcagcaagggcatgggag

SEQ ID NO: 86888 - DNA, 20 bp, Artificial
  CRISPR gRNA sequence
tcagcaagggcatgggagca

SEQ ID NO: 86889 - DNA, 20 bp, Artificial
  CRISPR gRNA sequence
cagcaagggcatgggagcag

SEQ ID NO: 86890 - DNA, 20 bp, Artificial
  CRISPR gRNA sequence
agcaagggcatgggagcaga

SEQ ID NO: 86891 - DNA, 20 bp, Artificial
  CRISPR gRNA sequence
caagggcatgggagcagagg

SEQ ID NO: 86892 - DNA, 20 bp, Artificial
  CRISPR gRNA sequence
tgggagcagagggagatttt

SEQ ID NO: 86893 - DNA, 20 bp, Artificial
  CRISPR gRNA sequence
cagagggagatttttggcca

SEQ ID NO: 86894 - DNA, 20 bp, Artificial
  CRISPR gRNA sequence
agggagatttttggccatgg

SEQ ID NO: 86895 - DNA, 20 bp, Artificial
  CRISPR gRNA sequence
tggccatggtagcaattctt

SEQ ID NO: 86896 - DNA, 20 bp, Artificial
  CRISPR gRNA sequence
agcaattcttgagcacctgc

SEQ ID NO: 86897 - DNA, 20 bp, Artificial
  CRISPR gRNA sequence
gcaattcttgagcacctgct

SEQ ID NO: 86898 - DNA, 20 bp, Artificial
  CRISPR gRNA sequence
tgagcacctgctgggcattt

SEQ ID NO: 86899 - DNA, 20 bp, Artificial
  CRISPR gRNA sequence
tttcagtccttttccctccc

SEQ ID NO: 86900 - DNA, 20 bp, Artificial
  CRISPR gRNA sequence
cagtccttttccctccctag

SEQ ID NO: 86901 - DNA, 20 bp, Artificial
  CRISPR gRNA sequence
ccttttccctccctagcagt

SEQ ID NO: 86902 - DNA, 20 bp, Artificial
  CRISPR gRNA sequence
ccctccctagcagtcagata

SEQ ID NO: 86903 - DNA, 20 bp, Artificial
  CRISPR gRNA sequence
ctccctagcagtcagataaa

SEQ ID NO: 86904 - DNA, 20 bp, Artificial
  CRISPR gRNA sequence
ctagcagtcagataaagaga

SEQ ID NO: 86905 - DNA, 20 bp, Artificial
  CRISPR gRNA sequence
tagcagtcagataaagagac

SEQ ID NO: 86906 - DNA, 20 bp, Artificial
  CRISPR gRNA sequence
agcagtcagataaagagaca

SEQ ID NO: 86907 - DNA, 20 bp, Artificial
  CRISPR gRNA sequence
aaaatcttgtgtgtgacctc

SEQ ID NO: 86908 - DNA, 20 bp, Artificial
  CRISPR gRNA sequence
cagctttctcctcttcccca

SEQ ID NO: 86909 - DNA, 20 bp, Artificial
  CRISPR gRNA sequence
tttctcctcttccccacagc

SEQ ID NO: 86910 - DNA, 20 bp, Artificial
  CRISPR gRNA sequence
ttctcctcttccccacagca

SEQ ID NO: 86911 - DNA, 20 bp, Artificial
  CRISPR gRNA sequence
ttccccacagcaaggccgtg

SEQ ID NO: 86912 - DNA, 20 bp, Artificial
  CRISPR gRNA sequence
cagcaaggccgtgcagaaca

SEQ ID NO: 86913 - DNA, 20 bp, Artificial
  CRISPR gRNA sequence
caaggccgtgcagaacaaag

SEQ ID NO: 86914 - DNA, 20 bp, Artificial
  CRISPR gRNA sequence
aggccgtgcagaacaaagta

SEQ ID NO: 86915 - DNA, 20 bp, Artificial
  CRISPR gRNA sequence
ggccgtgcagaacaaagtag

SEQ ID NO: 86916 - DNA, 20 bp, Artificial
  CRISPR gRNA sequence
gccgtgcagaacaaagtaga

SEQ ID NO: 86917 - DNA, 20 bp, Artificial
  CRISPR gRNA sequence
ccgtgcagaacaaagtagag

SEQ ID NO: 86918 - DNA, 20 bp, Artificial
  CRISPR gRNA sequence
gaacaaagtagaggggatcc

SEQ ID NO: 86919 - DNA, 20 bp, Artificial
  CRISPR gRNA sequence
aaagtagaggggatcctggt

SEQ ID NO: 86920 - DNA, 20 bp, Artificial
  CRISPR gRNA sequence
ggggatcctggtaagtgtgt

SEQ ID NO: 86921 - DNA, 20 bp, Artificial
  CRISPR gRNA sequence
gggatcctggtaagtgtgtt

SEQ ID NO: 86922 - DNA, 20 bp, Artificial
  CRISPR gRNA sequence
ggatcctggtaagtgtgttg

SEQ ID NO: 86923 - DNA, 20 bp, Artificial
  CRISPR gRNA sequence
tcctggtaagtgtgttgggg

SEQ ID NO: 86924 - DNA, 20 bp, Artificial
  CRISPR gRNA sequence
ctggtaagtgtgttggggaa

SEQ ID NO: 86925 - DNA, 20 bp, Artificial
  CRISPR gRNA sequence
tggtaagtgtgttggggaag

SEQ ID NO: 86926 - DNA, 20 bp, Artificial
  CRISPR gRNA sequence
ggtaagtgtgttggggaaga

SEQ ID NO: 86927 - DNA, 20 bp, Artificial
  CRISPR gRNA sequence
agtgtgttggggaagagggc

SEQ ID NO: 86928 - DNA, 20 bp, Artificial
  CRISPR gRNA sequence
tgtgttggggaagagggcaa

SEQ ID NO: 86929 - DNA, 20 bp, Artificial
  CRISPR gRNA sequence
tgttggggaagagggcaaga

SEQ ID NO: 86930 - DNA, 20 bp, Artificial
  CRISPR gRNA sequence
gttggggaagagggcaagag

SEQ ID NO: 86931 - DNA, 20 bp, Artificial
  CRISPR gRNA sequence
ttggggaagagggcaagaga

SEQ ID NO: 86932 - DNA, 20 bp, Artificial
  CRISPR gRNA sequence
ggaagagggcaagagaggga

SEQ ID NO: 86933 - DNA, 20 bp, Artificial
  CRISPR gRNA sequence
aagagagggatggaaatgct

SEQ ID NO: 86934 - DNA, 20 bp, Artificial
  CRISPR gRNA sequence
agagagggatggaaatgctg

SEQ ID NO: 86935 - DNA, 20 bp, Artificial
  CRISPR gRNA sequence
gagagggatggaaatgctga

SEQ ID NO: 86936 - DNA, 20 bp, Artificial
  CRISPR gRNA sequence
gagggatggaaatgctgagg

SEQ ID NO: 86937 - DNA, 20 bp, Artificial
  CRISPR gRNA sequence
agggatggaaatgctgaggg

SEQ ID NO: 86938 - DNA, 20 bp, Artificial
  CRISPR gRNA sequence
ggatggaaatgctgagggag

SEQ ID NO: 86939 - DNA, 20 bp, Artificial
  CRISPR gRNA sequence
gatggaaatgctgagggagg

SEQ ID NO: 86940 - DNA, 20 bp, Artificial
  CRISPR gRNA sequence
atgctgagggaggaggatgt

SEQ ID NO: 86941 - DNA, 20 bp, Artificial
  CRISPR gRNA sequence
tgctgagggaggaggatgtg

SEQ ID NO: 86942 - DNA, 20 bp, Artificial
  CRISPR gRNA sequence
ggaggaggatgtgaggatga

SEQ ID NO: 86943 - DNA, 20 bp, Artificial
  CRISPR gRNA sequence
gaggaggatgtgaggatgat

SEQ ID NO: 86944 - DNA, 20 bp, Artificial
  CRISPR gRNA sequence
gcatcaacaaaacattgatg

SEQ ID NO: 86945 - DNA, 20 bp, Artificial
  CRISPR gRNA sequence
catcaacaaaacattgatgt

SEQ ID NO: 86946 - DNA, 20 bp, Artificial
  CRISPR gRNA sequence
tcaacaaaacattgatgtgg

SEQ ID NO: 86947 - DNA, 20 bp, Artificial
  CRISPR gRNA sequence
aacaaaacattgatgtggga

SEQ ID NO: 86948 - DNA, 20 bp, Artificial
  CRISPR gRNA sequence
acaaaacattgatgtgggag

SEQ ID NO: 86949 - DNA, 20 bp, Artificial
  CRISPR gRNA sequence
aaacattgatgtgggagagg

SEQ ID NO: 86950 - DNA, 20 bp, Artificial
  CRISPR gRNA sequence
aacattgatgtgggagaggt

SEQ ID NO: 86951 - DNA, 20 bp, Artificial
  CRISPR gRNA sequence
acattgatgtgggagaggta

SEQ ID NO: 86952 - DNA, 20 bp, Artificial
  CRISPR gRNA sequence
ggtagggtcctctgccttgt

SEQ ID NO: 86953 - DNA, 20 bp, Artificial
  CRISPR gRNA sequence
agggtcctctgccttgtcag

SEQ ID NO: 86954 - DNA, 20 bp, Artificial
  CRISPR gRNA sequence
tcctctgccttgtcagaaga

SEQ ID NO: 86955 - DNA, 20 bp, Artificial
  CRISPR gRNA sequence
ctgccttgtcagaagatagt

SEQ ID NO: 86956 - DNA, 20 bp, Artificial
  CRISPR gRNA sequence
tggctttgcaaacttgctgc

SEQ ID NO: 86957 - DNA, 20 bp, Artificial
  CRISPR gRNA sequence
gcctctcacttgatctctgt

SEQ ID NO: 86958 - DNA, 20 bp, Artificial
  CRISPR gRNA sequence
gatctctgtgagcacttgca

SEQ ID NO: 86959 - DNA, 20 bp, Artificial
  CRISPR gRNA sequence
ctctgtgagcacttgcatag

SEQ ID NO: 86960 - DNA, 20 bp, Artificial
  CRISPR gRNA sequence
tgagcacttgcatagaagcc

SEQ ID NO: 86961 - DNA, 20 bp, Artificial
  CRISPR gRNA sequence
gcacttgcatagaagcccag

SEQ ID NO: 86962 - DNA, 20 bp, Artificial
  CRISPR gRNA sequence
acttgcatagaagcccagca

SEQ ID NO: 86963 - DNA, 20 bp, Artificial
  CRISPR gRNA sequence
atagaagcccagcagagatg

SEQ ID NO: 86964 - DNA, 20 bp, Artificial
  CRISPR gRNA sequence
aagcccagcagagatgaagt

SEQ ID NO: 86965 - DNA, 20 bp, Artificial
  CRISPR gRNA sequence
gcccagcagagatgaagtca

SEQ ID NO: 86966 - DNA, 20 bp, Artificial
  CRISPR gRNA sequence
ctctacttccctcctctcca

SEQ ID NO: 86967 - DNA, 20 bp, Artificial
  CRISPR gRNA sequence
tacttccctcctctccatgg

SEQ ID NO: 86968 - DNA, 20 bp, Artificial
  CRISPR gRNA sequence
ctcctctccatggtagccta

SEQ ID NO: 86969 - DNA, 20 bp, Artificial
  CRISPR gRNA sequence
tcctctccatggtagcctat

SEQ ID NO: 86970 - DNA, 20 bp, Artificial
  CRISPR gRNA sequence
cctctccatggtagcctata

SEQ ID NO: 86971 - DNA, 20 bp, Artificial
  CRISPR gRNA sequence
tggtagcctatagggctcct

SEQ ID NO: 86972 - DNA, 20 bp, Artificial
  CRISPR gRNA sequence
gtagcctatagggctcctca

SEQ ID NO: 86973 - DNA, 20 bp, Artificial
  CRISPR gRNA sequence
atagggctcctcagagcacc

SEQ ID NO: 86974 - DNA, 20 bp, Artificial
  CRISPR gRNA sequence
tctttttttttttttttttt

SEQ ID NO: 86975 - DNA, 20 bp, Artificial
  CRISPR gRNA sequence
ttttttttttttttttgaga

SEQ ID NO: 86976 - DNA, 20 bp, Artificial
  CRISPR gRNA sequence
ttttttttttttttgagatg

SEQ ID NO: 86977 - DNA, 20 bp, Artificial
  CRISPR gRNA sequence
tggagtctcactctgtcgcc

SEQ ID NO: 86978 - DNA, 20 bp, Artificial
  CRISPR gRNA sequence
ggagtctcactctgtcgcct

SEQ ID NO: 86979 - DNA, 20 bp, Artificial
  CRISPR gRNA sequence
tctcactctgtcgcctaggc

SEQ ID NO: 86980 - DNA, 20 bp, Artificial
  CRISPR gRNA sequence
tcactctgtcgcctaggctg

SEQ ID NO: 86981 - DNA, 20 bp, Artificial
  CRISPR gRNA sequence
ctgtcgcctaggctggagtg

SEQ ID NO: 86982 - DNA, 20 bp, Artificial
  CRISPR gRNA sequence
tcgcctaggctggagtgcag

SEQ ID NO: 86983 - DNA, 20 bp, Artificial
  CRISPR gRNA sequence
ggagtgcagtggcgcaatct

SEQ ID NO: 86984 - DNA, 20 bp, Artificial
  CRISPR gRNA sequence
gcgcaatctcggctcactgc

SEQ ID NO: 86985 - DNA, 20 bp, Artificial
  CRISPR gRNA sequence
tcactgcaagctccgcctcc

SEQ ID NO: 86986 - DNA, 20 bp, Artificial
  CRISPR gRNA sequence
cactgcaagctccgcctccc

SEQ ID NO: 86987 - DNA, 20 bp, Artificial
  CRISPR gRNA sequence
ttcacgccattctcctgcct

SEQ ID NO: 86988 - DNA, 20 bp, Artificial
  CRISPR gRNA sequence
ttctcctgcctcagcctccc

SEQ ID NO: 86989 - DNA, 20 bp, Artificial
  CRISPR gRNA sequence
tcctgcctcagcctcccaag

SEQ ID NO: 86990 - DNA, 20 bp, Artificial
  CRISPR gRNA sequence
gcctcagcctcccaagtagc

SEQ ID NO: 86991 - DNA, 20 bp, Artificial
  CRISPR gRNA sequence
cctcagcctcccaagtagct

SEQ ID NO: 86992 - DNA, 20 bp, Artificial
  CRISPR gRNA sequence
ctcccaagtagctgggacta

SEQ ID NO: 86993 - DNA, 20 bp, Artificial
  CRISPR gRNA sequence
tcccaagtagctgggactac

SEQ ID NO: 86994 - DNA, 20 bp, Artificial
  CRISPR gRNA sequence
caggcgcccgtcaccacacc

SEQ ID NO: 86995 - DNA, 20 bp, Artificial
  CRISPR gRNA sequence
ctaatttttttttgtatttt

SEQ ID NO: 86996 - DNA, 20 bp, Artificial
  CRISPR gRNA sequence
atttttttttgtatttttag

SEQ ID NO: 86997 - DNA, 20 bp, Artificial
  CRISPR gRNA sequence
ttttgtatttttagtagaaa

SEQ ID NO: 86998 - DNA, 20 bp, Artificial
  CRISPR gRNA sequence
tttgtatttttagtagaaac

SEQ ID NO: 86999 - DNA, 20 bp, Artificial
  CRISPR gRNA sequence
ttgtatttttagtagaaacg

SEQ ID NO: 87000 - DNA, 20 bp, Artificial
  CRISPR gRNA sequence
gaaacggggtttcaccatgt

SEQ ID NO: 87001 - DNA, 20 bp, Artificial
  CRISPR gRNA sequence
cggggtttcaccatgttagc

SEQ ID NO: 87002 - DNA, 20 bp, Artificial
  CRISPR gRNA sequence
ggggtttcaccatgttagcc

SEQ ID NO: 87003 - DNA, 20 bp, Artificial
  CRISPR gRNA sequence
tttcaccatgttagccagga

SEQ ID NO: 87004 - DNA, 20 bp, Artificial
  CRISPR gRNA sequence
cgatctcctgaccttgtgat

SEQ ID NO: 87005 - DNA, 20 bp, Artificial
  CRISPR gRNA sequence
accttgtgatcagcctgcct

SEQ ID NO: 87006 - DNA, 20 bp, Artificial
  CRISPR gRNA sequence
cagcctgccttggccttcca

SEQ ID NO: 87007 - DNA, 20 bp, Artificial
  CRISPR gRNA sequence
gccttggccttccaaagtgc

SEQ ID NO: 87008 - DNA, 20 bp, Artificial
  CRISPR gRNA sequence
ccttggccttccaaagtgct

SEQ ID NO: 87009 - DNA, 20 bp, Artificial
  CRISPR gRNA sequence
cttccaaagtgctgggattg

SEQ ID NO: 87010 - DNA, 20 bp, Artificial
  CRISPR gRNA sequence
ttccaaagtgctgggattgt

SEQ ID NO: 87011 - DNA, 20 bp, Artificial
  CRISPR gRNA sequence
agtgctgggattgtaggcgt

SEQ ID NO: 87012 - DNA, 20 bp, Artificial
  CRISPR gRNA sequence
taggcgtgagccaccgtgcc

SEQ ID NO: 87013 - DNA, 20 bp, Artificial
  CRISPR gRNA sequence
ggccttgtcaaataatttct

SEQ ID NO: 87014 - DNA, 20 bp, Artificial
  CRISPR gRNA sequence
gccttgtcaaataatttcta

SEQ ID NO: 87015 - DNA, 20 bp, Artificial
  CRISPR gRNA sequence
taatttctaaggtccttttt

SEQ ID NO: 87016 - DNA, 20 bp, Artificial
  CRISPR gRNA sequence
ttttcagtctgacaccctgt

SEQ ID NO: 87017 - DNA, 20 bp, Artificial
  CRISPR gRNA sequence
cagtctgacaccctgtaagt

SEQ ID NO: 87018 - DNA, 20 bp, Artificial
  CRISPR gRNA sequence
ctgacaccctgtaagtcagc

SEQ ID NO: 87019 - DNA, 20 bp, Artificial
  CRISPR gRNA sequence
cctgtaagtcagctagactt

SEQ ID NO: 87020 - DNA, 20 bp, Artificial
  CRISPR gRNA sequence
aagtcagctagactttggtg

SEQ ID NO: 87021 - DNA, 20 bp, Artificial
  CRISPR gRNA sequence
agtcagctagactttggtgt

SEQ ID NO: 87022 - DNA, 20 bp, Artificial
  CRISPR gRNA sequence
gtcagctagactttggtgtg

SEQ ID NO: 87023 - DNA, 20 bp, Artificial
  CRISPR gRNA sequence
ctagactttggtgtggggat

SEQ ID NO: 87024 - DNA, 20 bp, Artificial
  CRISPR gRNA sequence
agactttggtgtggggatca

SEQ ID NO: 87025 - DNA, 20 bp, Artificial
  CRISPR gRNA sequence
gactttggtgtggggatcag

SEQ ID NO: 87026 - DNA, 20 bp, Artificial
  CRISPR gRNA sequence
actttggtgtggggatcaga

SEQ ID NO: 87027 - DNA, 20 bp, Artificial
  CRISPR gRNA sequence
gggatcagagggtcctatat

SEQ ID NO: 87028 - DNA, 20 bp, Artificial
  CRISPR gRNA sequence
ggatcagagggtcctatatt

SEQ ID NO: 87029 - DNA, 20 bp, Artificial
  CRISPR gRNA sequence
gtcctatattgggtccttct

SEQ ID NO: 87030 - DNA, 20 bp, Artificial
  CRISPR gRNA sequence
gcctctgttctctcctacct

SEQ ID NO: 87031 - DNA, 20 bp, Artificial
  CRISPR gRNA sequence
ctgttctctcctacctcagc

SEQ ID NO: 87032 - DNA, 20 bp, Artificial
  CRISPR gRNA sequence
tcctacctcagcaagatgta

SEQ ID NO: 87033 - DNA, 20 bp, Artificial
  CRISPR gRNA sequence
agaaattttctgacaatgac

SEQ ID NO: 87034 - DNA, 20 bp, Artificial
  CRISPR gRNA sequence
acaagctgtatctctacctt

SEQ ID NO: 87035 - DNA, 20 bp, Artificial
  CRISPR gRNA sequence
tctctaccttcagctcccct

SEQ ID NO: 87036 - DNA, 20 bp, Artificial
  CRISPR gRNA sequence
ctctaccttcagctcccctc

SEQ ID NO: 87037 - DNA, 20 bp, Artificial
  CRISPR gRNA sequence
ctcccctcaggacccaccac

SEQ ID NO: 87038 - DNA, 20 bp, Artificial
  CRISPR gRNA sequence
cccctcaggacccaccactg

SEQ ID NO: 87039 - DNA, 20 bp, Artificial
  CRISPR gRNA sequence
ggacccaccactggagacaa

SEQ ID NO: 87040 - DNA, 20 bp, Artificial
  CRISPR gRNA sequence
gacccaccactggagacaaa

SEQ ID NO: 87041 - DNA, 20 bp, Artificial
  CRISPR gRNA sequence
ccaccactggagacaaaagg

SEQ ID NO: 87042 - DNA, 20 bp, Artificial
  CRISPR gRNA sequence
caccactggagacaaaaggt

SEQ ID NO: 87043 - DNA, 20 bp, Artificial
  CRISPR gRNA sequence
gagacaaaaggtaggtttga

SEQ ID NO: 87044 - DNA, 20 bp, Artificial
  CRISPR gRNA sequence
acaaaaggtaggtttgatag

SEQ ID NO: 87045 - DNA, 20 bp, Artificial
  CRISPR gRNA sequence
ggtaggtttgatagtagttt

SEQ ID NO: 87046 - DNA, 20 bp, Artificial
  CRISPR gRNA sequence
ggtttgatagtagttttaga

SEQ ID NO: 87047 - DNA, 20 bp, Artificial
  CRISPR gRNA sequence
ttgatagtagttttagatgg

SEQ ID NO: 87048 - DNA, 20 bp, Artificial
  CRISPR gRNA sequence
gatagtagttttagatggca

SEQ ID NO: 87049 - DNA, 20 bp, Artificial
  CRISPR gRNA sequence
atagtagttttagatggcag

SEQ ID NO: 87050 - DNA, 20 bp, Artificial
  CRISPR gRNA sequence
atggcagaggttctgattct

SEQ ID NO: 87051 - DNA, 20 bp, Artificial
  CRISPR gRNA sequence
ggcagaggttctgattctta

SEQ ID NO: 87052 - DNA, 20 bp, Artificial
  CRISPR gRNA sequence
gaggttctgattcttagaga

SEQ ID NO: 87053 - DNA, 20 bp, Artificial
  CRISPR gRNA sequence
aggttctgattcttagagaa

SEQ ID NO: 87054 - DNA, 20 bp, Artificial
  CRISPR gRNA sequence
attcttagagaaaggttcac

SEQ ID NO: 87055 - DNA, 20 bp, Artificial
  CRISPR gRNA sequence
ttcttagagaaaggttcact

SEQ ID NO: 87056 - DNA, 20 bp, Artificial
  CRISPR gRNA sequence
ttagagaaaggttcactggg

SEQ ID NO: 87057 - DNA, 20 bp, Artificial
  CRISPR gRNA sequence
tagagaaaggttcactggga

SEQ ID NO: 87058 - DNA, 20 bp, Artificial
  CRISPR gRNA sequence
agagaaaggttcactgggaa

SEQ ID NO: 87059 - DNA, 20 bp, Artificial
  CRISPR gRNA sequence
gagaaaggttcactgggaag

SEQ ID NO: 87060 - DNA, 20 bp, Artificial
  CRISPR gRNA sequence
aaggttcactgggaaggggt

SEQ ID NO: 87061 - DNA, 20 bp, Artificial
  CRISPR gRNA sequence
aggttcactgggaaggggtg

SEQ ID NO: 87062 - DNA, 20 bp, Artificial
  CRISPR gRNA sequence
ctgggaaggggtgaggtgaa

SEQ ID NO: 87063 - DNA, 20 bp, Artificial
  CRISPR gRNA sequence
tgggaaggggtgaggtgaat

SEQ ID NO: 87064 - DNA, 20 bp, Artificial
  CRISPR gRNA sequence
cgtaaatgctgtccttgatg

SEQ ID NO: 87065 - DNA, 20 bp, Artificial
  CRISPR gRNA sequence
taaatgctgtccttgatgaa

SEQ ID NO: 87066 - DNA, 20 bp, Artificial
  CRISPR gRNA sequence
aaatgctgtccttgatgaag

SEQ ID NO: 87067 - DNA, 20 bp, Artificial
  CRISPR gRNA sequence
gctgtccttgatgaagagga

SEQ ID NO: 87068 - DNA, 20 bp, Artificial
  CRISPR gRNA sequence
ctgtccttgatgaagaggaa

SEQ ID NO: 87069 - DNA, 20 bp, Artificial
  CRISPR gRNA sequence
gaaaggtcctcgccctgact

SEQ ID NO: 87070 - DNA, 20 bp, Artificial
  CRISPR gRNA sequence
ctcgccctgacttggtttac

SEQ ID NO: 87071 - DNA, 20 bp, Artificial
  CRISPR gRNA sequence
tcgccctgacttggtttacc

SEQ ID NO: 87072 - DNA, 20 bp, Artificial
  CRISPR gRNA sequence
cgccctgacttggtttacca

SEQ ID NO: 87073 - DNA, 20 bp, Artificial
  CRISPR gRNA sequence
ctgacttggtttaccaggga

SEQ ID NO: 87074 - DNA, 20 bp, Artificial
  CRISPR gRNA sequence
cttggtttaccagggaaagt

SEQ ID NO: 87075 - DNA, 20 bp, Artificial
  CRISPR gRNA sequence
taccagggaaagttagattc

SEQ ID NO: 87076 - DNA, 20 bp, Artificial
  CRISPR gRNA sequence
accagggaaagttagattct

SEQ ID NO: 87077 - DNA, 20 bp, Artificial
  CRISPR gRNA sequence
gattctgggtgaactaaatt

SEQ ID NO: 87078 - DNA, 20 bp, Artificial
  CRISPR gRNA sequence
tgggtgaactaaatttggtc

SEQ ID NO: 87079 - DNA, 20 bp, Artificial
  CRISPR gRNA sequence
aatttggtccagcactactg

SEQ ID NO: 87080 - DNA, 20 bp, Artificial
  CRISPR gRNA sequence
ttggtccagcactactgaag

SEQ ID NO: 87081 - DNA, 20 bp, Artificial
  CRISPR gRNA sequence
gtccagcactactgaagtgg

SEQ ID NO: 87082 - DNA, 20 bp, Artificial
  CRISPR gRNA sequence
gcactactgaagtggtagtt

SEQ ID NO: 87083 - DNA, 20 bp, Artificial
  CRISPR gRNA sequence
cactactgaagtggtagttt

SEQ ID NO: 87084 - DNA, 20 bp, Artificial
  CRISPR gRNA sequence
tactgaagtggtagtttggg

SEQ ID NO: 87085 - DNA, 20 bp, Artificial
  CRISPR gRNA sequence
agtggtagtttgggaagaac

SEQ ID NO: 87086 - DNA, 20 bp, Artificial
  CRISPR gRNA sequence
gtggtagtttgggaagaacc

SEQ ID NO: 87087 - DNA, 20 bp, Artificial
  CRISPR gRNA sequence
ggaagaaccaggacaactgt

SEQ ID NO: 87088 - DNA, 20 bp, Artificial
  CRISPR gRNA sequence
gaagaaccaggacaactgtt

SEQ ID NO: 87089 - DNA, 20 bp, Artificial
  CRISPR gRNA sequence
aagaaccaggacaactgtta

SEQ ID NO: 87090 - DNA, 20 bp, Artificial
  CRISPR gRNA sequence
caggacaactgttagggtct

SEQ ID NO: 87091 - DNA, 20 bp, Artificial
  CRISPR gRNA sequence
gcttgttccttttgtttctg

SEQ ID NO: 87092 - DNA, 20 bp, Artificial
  CRISPR gRNA sequence
ttccttttgtttctgtagct

SEQ ID NO: 87093 - DNA, 20 bp, Artificial
  CRISPR gRNA sequence
ccttttgtttctgtagctca

SEQ ID NO: 87094 - DNA, 20 bp, Artificial
  CRISPR gRNA sequence
tgtttctgtagctcagagcc

SEQ ID NO: 87095 - DNA, 20 bp, Artificial
  CRISPR gRNA sequence
agctcagagccaagtacact

SEQ ID NO: 87096 - DNA, 20 bp, Artificial
  CRISPR gRNA sequence
agccaagtacactgagcaat

SEQ ID NO: 87097 - DNA, 20 bp, Artificial
  CRISPR gRNA sequence
gccaagtacactgagcaatg

SEQ ID NO: 87098 - DNA, 20 bp, Artificial
  CRISPR gRNA sequence
caagtacactgagcaatgag

SEQ ID NO: 87099 - DNA, 20 bp, Artificial
  CRISPR gRNA sequence
gaggagtacatgtatgccta

SEQ ID NO: 87100 - DNA, 20 bp, Artificial
  CRISPR gRNA sequence
aggagtacatgtatgcctat

SEQ ID NO: 87101 - DNA, 20 bp, Artificial
  CRISPR gRNA sequence
agtacatgtatgcctatagg

SEQ ID NO: 87102 - DNA, 20 bp, Artificial
  CRISPR gRNA sequence
taggtggatccgcaaccacc

SEQ ID NO: 87103 - DNA, 20 bp, Artificial
  CRISPR gRNA sequence
gtggatccgcaaccacctgg

SEQ ID NO: 87104 - DNA, 20 bp, Artificial
  CRISPR gRNA sequence
ggatccgcaaccacctggaa

SEQ ID NO: 87105 - DNA, 20 bp, Artificial
  CRISPR gRNA sequence
acactgacacctgtctgcca

SEQ ID NO: 87106 - DNA, 20 bp, Artificial
  CRISPR gRNA sequence
gacacctgtctgccaaagca

SEQ ID NO: 87107 - DNA, 20 bp, Artificial
  CRISPR gRNA sequence
aaagtgtttatgatgcctat

SEQ ID NO: 87108 - DNA, 20 bp, Artificial
  CRISPR gRNA sequence
gtgtttatgatgcctatcgg

SEQ ID NO: 87109 - DNA, 20 bp, Artificial
  CRISPR gRNA sequence
tgtttatgatgcctatcggt

SEQ ID NO: 87110 - DNA, 20 bp, Artificial
  CRISPR gRNA sequence
ttatgatgcctatcggtggg

SEQ ID NO: 87111 - DNA, 20 bp, Artificial
  CRISPR gRNA sequence
atgatgcctatcggtgggtg

SEQ ID NO: 87112 - DNA, 20 bp, Artificial
  CRISPR gRNA sequence
tgatgcctatcggtgggtgg

SEQ ID NO: 87113 - DNA, 20 bp, Artificial
  CRISPR gRNA sequence
gatgcctatcggtgggtgga

SEQ ID NO: 87114 - DNA, 20 bp, Artificial
  CRISPR gRNA sequence
atgcctatcggtgggtggag

SEQ ID NO: 87115 - DNA, 20 bp, Artificial
  CRISPR gRNA sequence
cctatcggtgggtggagggg

SEQ ID NO: 87116 - DNA, 20 bp, Artificial
  CRISPR gRNA sequence
ctatcggtgggtggaggggt

SEQ ID NO: 87117 - DNA, 20 bp, Artificial
  CRISPR gRNA sequence
tcggtgggtggaggggtggg

SEQ ID NO: 87118 - DNA, 20 bp, Artificial
  CRISPR gRNA sequence
gtgggtggaggggtgggtgg

SEQ ID NO: 87119 - DNA, 20 bp, Artificial
  CRISPR gRNA sequence
tgggtggaggggtgggtggt

SEQ ID NO: 87120 - DNA, 20 bp, Artificial
  CRISPR gRNA sequence
ggaggggtgggtggtgggat

SEQ ID NO: 87121 - DNA, 20 bp, Artificial
  CRISPR gRNA sequence
ggggtgggtggtgggatgag

SEQ ID NO: 87122 - DNA, 20 bp, Artificial
  CRISPR gRNA sequence
gggtggtgggatgagtggat

SEQ ID NO: 87123 - DNA, 20 bp, Artificial
  CRISPR gRNA sequence
tggtgggatgagtggattgg

SEQ ID NO: 87124 - DNA, 20 bp, Artificial
  CRISPR gRNA sequence
ggtgggatgagtggattggt

SEQ ID NO: 87125 - DNA, 20 bp, Artificial
  CRISPR gRNA sequence
gatgagtggattggtgggca

SEQ ID NO: 87126 - DNA, 20 bp, Artificial
  CRISPR gRNA sequence
atgagtggattggtgggcat

SEQ ID NO: 87127 - DNA, 20 bp, Artificial
  CRISPR gRNA sequence
ataggaccccctcacccatg

SEQ ID NO: 87128 - DNA, 20 bp, Artificial
  CRISPR gRNA sequence
aggaccccctcacccatgaa

SEQ ID NO: 87129 - DNA, 20 bp, Artificial
  CRISPR gRNA sequence
aagagcttcctgccttgata

SEQ ID NO: 87130 - DNA, 20 bp, Artificial
  CRISPR gRNA sequence
tgataaagcctgccttctta

SEQ ID NO: 87131 - DNA, 20 bp, Artificial
  CRISPR gRNA sequence
gataaagcctgccttcttaa

SEQ ID NO: 87132 - DNA, 20 bp, Artificial
  CRISPR gRNA sequence
ataaagcctgccttcttaaa

SEQ ID NO: 87133 - DNA, 20 bp, Artificial
  CRISPR gRNA sequence
ggttcctcacacttgatccc

SEQ ID NO: 87134 - DNA, 20 bp, Artificial
  CRISPR gRNA sequence
gttcctcacacttgatccct

SEQ ID NO: 87135 - DNA, 20 bp, Artificial
  CRISPR gRNA sequence
ttcctcacacttgatcccta

SEQ ID NO: 87136 - DNA, 20 bp, Artificial
  CRISPR gRNA sequence
ttgatccctagggactcttc

SEQ ID NO: 87137 - DNA, 20 bp, Artificial
  CRISPR gRNA sequence
ggactcttcgagcctaccca

SEQ ID NO: 87138 - DNA, 20 bp, Artificial
  CRISPR gRNA sequence
tacccatggcctccttctct

SEQ ID NO: 87139 - DNA, 20 bp, Artificial
  CRISPR gRNA sequence
cactctgctcccctctcact

SEQ ID NO: 87140 - DNA, 20 bp, Artificial
  CRISPR gRNA sequence
actctgctcccctctcactc

SEQ ID NO: 87141 - DNA, 20 bp, Artificial
  CRISPR gRNA sequence
ctgctcccctctcactcagg

SEQ ID NO: 87142 - DNA, 20 bp, Artificial
  CRISPR gRNA sequence
tctcactcaggaagtactgt

SEQ ID NO: 87143 - DNA, 20 bp, Artificial
  CRISPR gRNA sequence
tcactcaggaagtactgtga

SEQ ID NO: 87144 - DNA, 20 bp, Artificial
  CRISPR gRNA sequence
cttgcctgttgccgcccact

SEQ ID NO: 87145 - DNA, 20 bp, Artificial
  CRISPR gRNA sequence
ctgttgccgcccactcagca

SEQ ID NO: 87146 - DNA, 20 bp, Artificial
  CRISPR gRNA sequence
ccactcagcacagccaactt

SEQ ID NO: 87147 - DNA, 20 bp, Artificial
  CRISPR gRNA sequence
tcagcacagccaactttggc

SEQ ID NO: 87148 - DNA, 20 bp, Artificial
  CRISPR gRNA sequence
gccaactttggcaagatcat

SEQ ID NO: 87149 - DNA, 20 bp, Artificial
  CRISPR gRNA sequence
caactttggcaagatcatca

SEQ ID NO: 87150 - DNA, 20 bp, Artificial
  CRISPR gRNA sequence
actttggcaagatcatcaga

SEQ ID NO: 87151 - DNA, 20 bp, Artificial
  CRISPR gRNA sequence
agagatcttccctgacatca

SEQ ID NO: 87152 - DNA, 20 bp, Artificial
  CRISPR gRNA sequence
ttccctgacatcaaagctcg

SEQ ID NO: 87153 - DNA, 20 bp, Artificial
  CRISPR gRNA sequence
tccctgacatcaaagctcga

SEQ ID NO: 87154 - DNA, 20 bp, Artificial
  CRISPR gRNA sequence
gacatcaaagctcgaaggct

SEQ ID NO: 87155 - DNA, 20 bp, Artificial
  CRISPR gRNA sequence
atcaaagctcgaaggcttgg

SEQ ID NO: 87156 - DNA, 20 bp, Artificial
  CRISPR gRNA sequence
aagctcgaaggcttggtggc

SEQ ID NO: 87157 - DNA, 20 bp, Artificial
  CRISPR gRNA sequence
agctcgaaggcttggtggcc

SEQ ID NO: 87158 - DNA, 20 bp, Artificial
  CRISPR gRNA sequence
gctcgaaggcttggtggccg

SEQ ID NO: 87159 - DNA, 20 bp, Artificial
  CRISPR gRNA sequence
gaaggcttggtggccggggc

SEQ ID NO: 87160 - DNA, 20 bp, Artificial
  CRISPR gRNA sequence
ttggtggccggggccagtcc

SEQ ID NO: 87161 - DNA, 20 bp, Artificial
  CRISPR gRNA sequence
ccagtccaagtatccttgac

SEQ ID NO: 87162 - DNA, 20 bp, Artificial
  CRISPR gRNA sequence
agtccaagtatccttgacta

SEQ ID NO: 87163 - DNA, 20 bp, Artificial
  CRISPR gRNA sequence
tccaagtatccttgactaga

SEQ ID NO: 87164 - DNA, 20 bp, Artificial
  CRISPR gRNA sequence
ccaagtatccttgactagag

SEQ ID NO: 87165 - DNA, 20 bp, Artificial
  CRISPR gRNA sequence
gtatccttgactagagaggt

SEQ ID NO: 87166 - DNA, 20 bp, Artificial
  CRISPR gRNA sequence
tatccttgactagagaggtt

SEQ ID NO: 87167 - DNA, 20 bp, Artificial
  CRISPR gRNA sequence
atccttgactagagaggttg

SEQ ID NO: 87168 - DNA, 20 bp, Artificial
  CRISPR gRNA sequence
tccttgactagagaggttgg

SEQ ID NO: 87169 - DNA, 20 bp, Artificial
  CRISPR gRNA sequence
ttgactagagaggttggggg

SEQ ID NO: 87170 - DNA, 20 bp, Artificial
  CRISPR gRNA sequence
gactagagaggttgggggtg

SEQ ID NO: 87171 - DNA, 20 bp, Artificial
  CRISPR gRNA sequence
actagagaggttgggggtgg

SEQ ID NO: 87172 - DNA, 20 bp, Artificial
  CRISPR gRNA sequence
gaggttgggggtggaggacc

SEQ ID NO: 87173 - DNA, 20 bp, Artificial
  CRISPR gRNA sequence
aggttgggggtggaggacct

SEQ ID NO: 87174 - DNA, 20 bp, Artificial
  CRISPR gRNA sequence
gttgggggtggaggacctgg

SEQ ID NO: 87175 - DNA, 20 bp, Artificial
  CRISPR gRNA sequence
ttgggggtggaggacctggg

SEQ ID NO: 87176 - DNA, 20 bp, Artificial
  CRISPR gRNA sequence
ggggtggaggacctgggagg

SEQ ID NO: 87177 - DNA, 20 bp, Artificial
  CRISPR gRNA sequence
gaggacctgggaggaagact

SEQ ID NO: 87178 - DNA, 20 bp, Artificial
  CRISPR gRNA sequence
aggacctgggaggaagactt

SEQ ID NO: 87179 - DNA, 20 bp, Artificial
  CRISPR gRNA sequence
tgggaggaagacttaggatg

SEQ ID NO: 87180 - DNA, 20 bp, Artificial
  CRISPR gRNA sequence
ggaggaagacttaggatgtg

SEQ ID NO: 87181 - DNA, 20 bp, Artificial
  CRISPR gRNA sequence
aggaagacttaggatgtgga

SEQ ID NO: 87182 - DNA, 20 bp, Artificial
  CRISPR gRNA sequence
agacttaggatgtggagagc

SEQ ID NO: 87183 - DNA, 20 bp, Artificial
  CRISPR gRNA sequence
gacttaggatgtggagagca

SEQ ID NO: 87184 - DNA, 20 bp, Artificial
  CRISPR gRNA sequence
cttaggatgtggagagcaag

SEQ ID NO: 87185 - DNA, 20 bp, Artificial
  CRISPR gRNA sequence
aggatgtggagagcaaggag

SEQ ID NO: 87186 - DNA, 20 bp, Artificial
  CRISPR gRNA sequence
gtggagagcaaggagtggaa

SEQ ID NO: 87187 - DNA, 20 bp, Artificial
  CRISPR gRNA sequence
tggaacagcttaacttgctc

SEQ ID NO: 87188 - DNA, 20 bp, Artificial
  CRISPR gRNA sequence
ggaacagcttaacttgctcg

SEQ ID NO: 87189 - DNA, 20 bp, Artificial
  CRISPR gRNA sequence
gaacagcttaacttgctcga

SEQ ID NO: 87190 - DNA, 20 bp, Artificial
  CRISPR gRNA sequence
aacagcttaacttgctcgag

SEQ ID NO: 87191 - DNA, 20 bp, Artificial
  CRISPR gRNA sequence
cttaacttgctcgaggggct

SEQ ID NO: 87192 - DNA, 20 bp, Artificial
  CRISPR gRNA sequence
taacttgctcgaggggcttg

SEQ ID NO: 87193 - DNA, 20 bp, Artificial
  CRISPR gRNA sequence
gcttggagatcgccatgtgt

SEQ ID NO: 87194 - DNA, 20 bp, Artificial
  CRISPR gRNA sequence
ggctgctctttaacttgcat

SEQ ID NO: 87195 - DNA, 20 bp, Artificial
  CRISPR gRNA sequence
acttgcatcagatattgcta

SEQ ID NO: 87196 - DNA, 20 bp, Artificial
  CRISPR gRNA sequence
tgcatcagatattgctacag

SEQ ID NO: 87197 - DNA, 20 bp, Artificial
  CRISPR gRNA sequence
agatattgctacagtggcat

SEQ ID NO: 87198 - DNA, 20 bp, Artificial
  CRISPR gRNA sequence
gatattgctacagtggcata

SEQ ID NO: 87199 - DNA, 20 bp, Artificial
  CRISPR gRNA sequence
tattgctacagtggcataag

SEQ ID NO: 87200 - DNA, 20 bp, Artificial
  CRISPR gRNA sequence
attgctacagtggcataagg

SEQ ID NO: 87201 - DNA, 20 bp, Artificial
  CRISPR gRNA sequence
gctacagtggcataaggagg

SEQ ID NO: 87202 - DNA, 20 bp, Artificial
  CRISPR gRNA sequence
tggcataaggaggaagacct

SEQ ID NO: 87203 - DNA, 20 bp, Artificial
  CRISPR gRNA sequence
gtgtctatgccacccctgcc

SEQ ID NO: 87204 - DNA, 20 bp, Artificial
  CRISPR gRNA sequence
ccctgcctggacttgaccta

SEQ ID NO: 87205 - DNA, 20 bp, Artificial
  CRISPR gRNA sequence
cctgcctggacttgacctaa

SEQ ID NO: 87206 - DNA, 20 bp, Artificial
  CRISPR gRNA sequence
ctgcctggacttgacctaaa

SEQ ID NO: 87207 - DNA, 20 bp, Artificial
  CRISPR gRNA sequence
gacttgacctaaagggttct

SEQ ID NO: 87208 - DNA, 20 bp, Artificial
  CRISPR gRNA sequence
cttgacctaaagggttctga

SEQ ID NO: 87209 - DNA, 20 bp, Artificial
  CRISPR gRNA sequence
ctaaagggttctgagagtgt

SEQ ID NO: 87210 - DNA, 20 bp, Artificial
  CRISPR gRNA sequence
ccaattccactcttctctcc

SEQ ID NO: 87211 - DNA, 20 bp, Artificial
  CRISPR gRNA sequence
caattccactcttctctccc

SEQ ID NO: 87212 - DNA, 20 bp, Artificial
  CRISPR gRNA sequence
cactcttctctcccaggtaa

SEQ ID NO: 87213 - DNA, 20 bp, Artificial
  CRISPR gRNA sequence
cttctctcccaggtaaaagt

SEQ ID NO: 87214 - DNA, 20 bp, Artificial
  CRISPR gRNA sequence
tctctcccaggtaaaagtca

SEQ ID NO: 87215 - DNA, 20 bp, Artificial
  CRISPR gRNA sequence
ctctcccaggtaaaagtcag

SEQ ID NO: 87216 - DNA, 20 bp, Artificial
  CRISPR gRNA sequence
aggtaaaagtcagaggtctt

SEQ ID NO: 87217 - DNA, 20 bp, Artificial
  CRISPR gRNA sequence
ggtaaaagtcagaggtcttt

SEQ ID NO: 87218 - DNA, 20 bp, Artificial
  CRISPR gRNA sequence
gtaaaagtcagaggtctttg

SEQ ID NO: 87219 - DNA, 20 bp, Artificial
  CRISPR gRNA sequence
aggtctttggggcatgtttt

SEQ ID NO: 87220 - DNA, 20 bp, Artificial
  CRISPR gRNA sequence
ggtctttggggcatgttttg

SEQ ID NO: 87221 - DNA, 20 bp, Artificial
  CRISPR gRNA sequence
gtctttggggcatgttttga

SEQ ID NO: 87222 - DNA, 20 bp, Artificial
  CRISPR gRNA sequence
gggcatgttttgagggctaa

SEQ ID NO: 87223 - DNA, 20 bp, Artificial
  CRISPR gRNA sequence
gttttgagggctaacagcct

SEQ ID NO: 87224 - DNA, 20 bp, Artificial
  CRISPR gRNA sequence
agcctcagtcattatgtaca

SEQ ID NO: 87225 - DNA, 20 bp, Artificial
  CRISPR gRNA sequence
gtcattatgtacatagcttc

SEQ ID NO: 87226 - DNA, 20 bp, Artificial
  CRISPR gRNA sequence
tcattatgtacatagcttct

SEQ ID NO: 87227 - DNA, 20 bp, Artificial
  CRISPR gRNA sequence
gttcccttctgccaaccctg

SEQ ID NO: 87228 - DNA, 20 bp, Artificial
  CRISPR gRNA sequence
cttctgccaaccctgtagct

SEQ ID NO: 87229 - DNA, 20 bp, Artificial
  CRISPR gRNA sequence
ttctgccaaccctgtagctg

SEQ ID NO: 87230 - DNA, 20 bp, Artificial
  CRISPR gRNA sequence
tgccaaccctgtagctgagg

SEQ ID NO: 87231 - DNA, 20 bp, Artificial
  CRISPR gRNA sequence
ccaaccctgtagctgaggca

SEQ ID NO: 87232 - DNA, 20 bp, Artificial
  CRISPR gRNA sequence
caaccctgtagctgaggcag

SEQ ID NO: 87233 - DNA, 20 bp, Artificial
  CRISPR gRNA sequence
tgtagctgaggcagaggatg

SEQ ID NO: 87234 - DNA, 20 bp, Artificial
  CRISPR gRNA sequence
tagctgaggcagaggatgaa

SEQ ID NO: 87235 - DNA, 20 bp, Artificial
  CRISPR gRNA sequence
cagaggatgaagagaacttg

SEQ ID NO: 87236 - DNA, 20 bp, Artificial
  CRISPR gRNA sequence
agaggatgaagagaacttgt

SEQ ID NO: 87237 - DNA, 20 bp, Artificial
  CRISPR gRNA sequence
gaacttgtgggcttctgcaa

SEQ ID NO: 87238 - DNA, 20 bp, Artificial
  CRISPR gRNA sequence
aacttgtgggcttctgcaat

SEQ ID NO: 87239 - DNA, 20 bp, Artificial
  CRISPR gRNA sequence
tgtgggcttctgcaatggga

SEQ ID NO: 87240 - DNA, 20 bp, Artificial
  CRISPR gRNA sequence
gtgggcttctgcaatgggat

SEQ ID NO: 87241 - DNA, 20 bp, Artificial
  CRISPR gRNA sequence
ggcttctgcaatgggatagg

SEQ ID NO: 87242 - DNA, 20 bp, Artificial
  CRISPR gRNA sequence
cttctgcaatgggataggta

SEQ ID NO: 87243 - DNA, 20 bp, Artificial
  CRISPR gRNA sequence
ttctgcaatgggataggtag

SEQ ID NO: 87244 - DNA, 20 bp, Artificial
  CRISPR gRNA sequence
gtagaggctactcccatccc

SEQ ID NO: 87245 - DNA, 20 bp, Artificial
  CRISPR gRNA sequence
ggctactcccatccccagtc

SEQ ID NO: 87246 - DNA, 20 bp, Artificial
  CRISPR gRNA sequence
tcccatccccagtctggtct

SEQ ID NO: 87247 - DNA, 20 bp, Artificial
  CRISPR gRNA sequence
ccccagtctggtctcagctt

SEQ ID NO: 87248 - DNA, 20 bp, Artificial
  CRISPR gRNA sequence
ctggtctcagctttggtcaa

SEQ ID NO: 87249 - DNA, 20 bp, Artificial
  CRISPR gRNA sequence
aatagtctttgatctctgac

SEQ ID NO: 87250 - DNA, 20 bp, Artificial
  CRISPR gRNA sequence
tagtctttgatctctgacaa

SEQ ID NO: 87251 - DNA, 20 bp, Artificial
  CRISPR gRNA sequence
gtctttgatctctgacaaga

SEQ ID NO: 87252 - DNA, 20 bp, Artificial
  CRISPR gRNA sequence
tctttgatctctgacaagag

SEQ ID NO: 87253 - DNA, 20 bp, Artificial
  CRISPR gRNA sequence
tttgatctctgacaagagag

SEQ ID NO: 87254 - DNA, 20 bp, Artificial
  CRISPR gRNA sequence
ttgatctctgacaagagagg

SEQ ID NO: 87255 - DNA, 20 bp, Artificial
  CRISPR gRNA sequence
tctctgacaagagaggaggc

SEQ ID NO: 87256 - DNA, 20 bp, Artificial
  CRISPR gRNA sequence
ctctgacaagagaggaggca

SEQ ID NO: 87257 - DNA, 20 bp, Artificial
  CRISPR gRNA sequence
tctgacaagagaggaggcaa

SEQ ID NO: 87258 - DNA, 20 bp, Artificial
  CRISPR gRNA sequence
gaggcaagggttctttaatt

SEQ ID NO: 87259 - DNA, 20 bp, Artificial
  CRISPR gRNA sequence
ggcaagggttctttaatttg

SEQ ID NO: 87260 - DNA, 20 bp, Artificial
  CRISPR gRNA sequence
tctttaatttggagtgtgat

SEQ ID NO: 87261 - DNA, 20 bp, Artificial
  CRISPR gRNA sequence
ctttaatttggagtgtgatt

SEQ ID NO: 87262 - DNA, 20 bp, Artificial
  CRISPR gRNA sequence
gggcatgtccttccccactt

SEQ ID NO: 87263 - DNA, 20 bp, Artificial
  CRISPR gRNA sequence
atgtccttccccacttcagc

SEQ ID NO: 87264 - DNA, 20 bp, Artificial
  CRISPR gRNA sequence
ttccccacttcagccagaaa

SEQ ID NO: 87265 - DNA, 20 bp, Artificial
  CRISPR gRNA sequence
tccccacttcagccagaaat

SEQ ID NO: 87266 - DNA, 20 bp, Artificial
  CRISPR gRNA sequence
acttcagccagaaatgggcc

SEQ ID NO: 87267 - DNA, 20 bp, Artificial
  CRISPR gRNA sequence
tcagccagaaatgggcccag

SEQ ID NO: 87268 - DNA, 20 bp, Artificial
  CRISPR gRNA sequence
aatgggcccagaagtaaccc

SEQ ID NO: 87269 - DNA, 20 bp, Artificial
  CRISPR gRNA sequence
agaagtaaccccagcacctc

SEQ ID NO: 87270 - DNA, 20 bp, Artificial
  CRISPR gRNA sequence
cccagcacctcgagatgaac

SEQ ID NO: 87271 - DNA, 20 bp, Artificial
  CRISPR gRNA sequence
agcacctcgagatgaactgg

SEQ ID NO: 87272 - DNA, 20 bp, Artificial
  CRISPR gRNA sequence
cacctcgagatgaactggtg

SEQ ID NO: 87273 - DNA, 20 bp, Artificial
  CRISPR gRNA sequence
acctcgagatgaactggtgg

SEQ ID NO: 87274 - DNA, 20 bp, Artificial
  CRISPR gRNA sequence
tcgagatgaactggtggagg

SEQ ID NO: 87275 - DNA, 20 bp, Artificial
  CRISPR gRNA sequence
cgtgtgccctgacctgtgac

SEQ ID NO: 87276 - DNA, 20 bp, Artificial
  CRISPR gRNA sequence
gtgtgccctgacctgtgact

SEQ ID NO: 87277 - DNA, 20 bp, Artificial
  CRISPR gRNA sequence
tgccctgacctgtgactggg

SEQ ID NO: 87278 - DNA, 20 bp, Artificial
  CRISPR gRNA sequence
ccctgacctgtgactgggca

SEQ ID NO: 87279 - DNA, 20 bp, Artificial
  CRISPR gRNA sequence
tgacctgtgactgggcagag

SEQ ID NO: 87280 - DNA, 20 bp, Artificial
  CRISPR gRNA sequence
gggcagagcggatcctgaaa

SEQ ID NO: 87281 - DNA, 20 bp, Artificial
  CRISPR gRNA sequence
cggatcctgaaacggtcctt

SEQ ID NO: 87282 - DNA, 20 bp, Artificial
  CRISPR gRNA sequence
ggtccttcagttccatcgtt

SEQ ID NO: 87283 - DNA, 20 bp, Artificial
  CRISPR gRNA sequence
gtccttcagttccatcgttg

SEQ ID NO: 87284 - DNA, 20 bp, Artificial
  CRISPR gRNA sequence
aggtcgcccgcttcctgcta

SEQ ID NO: 87285 - DNA, 20 bp, Artificial
  CRISPR gRNA sequence
tcgcccgcttcctgctacag

SEQ ID NO: 87286 - DNA, 20 bp, Artificial
  CRISPR gRNA sequence
ctgcacatgcccatgtgctt

SEQ ID NO: 87287 - DNA, 20 bp, Artificial
  CRISPR gRNA sequence
tgcacatgcccatgtgctta

SEQ ID NO: 87288 - DNA, 20 bp, Artificial
  CRISPR gRNA sequence
tgcccatgtgcttaaggcca

SEQ ID NO: 87289 - DNA, 20 bp, Artificial
  CRISPR gRNA sequence
gcccatgtgcttaaggccat

SEQ ID NO: 87290 - DNA, 20 bp, Artificial
  CRISPR gRNA sequence
cccatgtgcttaaggccatg

SEQ ID NO: 87291 - DNA, 20 bp, Artificial
  CRISPR gRNA sequence
cttaaggccatggggctcgc

SEQ ID NO: 87292 - DNA, 20 bp, Artificial
  CRISPR gRNA sequence
gttgaccctctcttatgtct

SEQ ID NO: 87293 - DNA, 20 bp, Artificial
  CRISPR gRNA sequence
tcttatgtctcagcaaccct

SEQ ID NO: 87294 - DNA, 20 bp, Artificial
  CRISPR gRNA sequence
cagcaaccctgagccacttt

SEQ ID NO: 87295 - DNA, 20 bp, Artificial
  CRISPR gRNA sequence
ccctgagccactttcagctt

SEQ ID NO: 87296 - DNA, 20 bp, Artificial
  CRISPR gRNA sequence
tgagccactttcagcttcag

SEQ ID NO: 87297 - DNA, 20 bp, Artificial
  CRISPR gRNA sequence
tcagtggccctcccacacac

SEQ ID NO: 87298 - DNA, 20 bp, Artificial
  CRISPR gRNA sequence
ggccctcccacacactagaa

SEQ ID NO: 87299 - DNA, 20 bp, Artificial
  CRISPR gRNA sequence
ccctcccacacactagaata

SEQ ID NO: 87300 - DNA, 20 bp, Artificial
  CRISPR gRNA sequence
acactagaatagagacacct

SEQ ID NO: 87301 - DNA, 20 bp, Artificial
  CRISPR gRNA sequence
ttggatttgccccctcttcc

SEQ ID NO: 87302 - DNA, 20 bp, Artificial
  CRISPR gRNA sequence
ggatttgccccctcttcctg

SEQ ID NO: 87303 - DNA, 20 bp, Artificial
  CRISPR gRNA sequence
ctcttcctggagacccttct

SEQ ID NO: 87304 - DNA, 20 bp, Artificial
  CRISPR gRNA sequence
gacccttctaagacatgctt

SEQ ID NO: 87305 - DNA, 20 bp, Artificial
  CRISPR gRNA sequence
accccatttcctgtctctac

SEQ ID NO: 87306 - DNA, 20 bp, Artificial
  CRISPR gRNA sequence
catttcctgtctctaccagt

SEQ ID NO: 87307 - DNA, 20 bp, Artificial
  CRISPR gRNA sequence
gtctctaccagtcagtcaat

SEQ ID NO: 87308 - DNA, 20 bp, Artificial
  CRISPR gRNA sequence
tgcctcactcccctattcct

SEQ ID NO: 87309 - DNA, 20 bp, Artificial
  CRISPR gRNA sequence
ccttcactctattacctttt

SEQ ID NO: 87310 - DNA, 20 bp, Artificial
  CRISPR gRNA sequence
ttacctttttggtacctctg

SEQ ID NO: 87311 - DNA, 20 bp, Artificial
  CRISPR gRNA sequence
cctttttggtacctctgcag

SEQ ID NO: 87312 - DNA, 20 bp, Artificial
  CRISPR gRNA sequence
tttttggtacctctgcagaa

SEQ ID NO: 87313 - DNA, 20 bp, Artificial
  CRISPR gRNA sequence
ttttggtacctctgcagaag

SEQ ID NO: 87314 - DNA, 20 bp, Artificial
  CRISPR gRNA sequence
aagaggacgaacatgcacct

SEQ ID NO: 87315 - DNA, 20 bp, Artificial
  CRISPR gRNA sequence
agaggacgaacatgcacctc

SEQ ID NO: 87316 - DNA, 20 bp, Artificial
  CRISPR gRNA sequence
acgaacatgcacctcgggaa

SEQ ID NO: 87317 - DNA, 20 bp, Artificial
  CRISPR gRNA sequence
gggaacggtcatctaaacca

SEQ ID NO: 87318 - DNA, 20 bp, Artificial
  CRISPR gRNA sequence
cggtcatctaaaccaaagaa

SEQ ID NO: 87319 - DNA, 20 bp, Artificial
  CRISPR gRNA sequence
atctaaaccaaagaatggtt

SEQ ID NO: 87320 - DNA, 20 bp, Artificial
  CRISPR gRNA sequence
ctaaaccaaagaatggttta

SEQ ID NO: 87321 - DNA, 20 bp, Artificial
  CRISPR gRNA sequence
aaagaatggtttagagaacc

SEQ ID NO: 87322 - DNA, 20 bp, Artificial
  CRISPR gRNA sequence
agaatggtttagagaaccca

SEQ ID NO: 87323 - DNA, 20 bp, Artificial
  CRISPR gRNA sequence
gaatggtttagagaacccag

SEQ ID NO: 87324 - DNA, 20 bp, Artificial
  CRISPR gRNA sequence
aatggtttagagaacccaga

SEQ ID NO: 87325 - DNA, 20 bp, Artificial
  CRISPR gRNA sequence
ggtttagagaacccagaggg

SEQ ID NO: 87326 - DNA, 20 bp, Artificial
  CRISPR gRNA sequence
tttagagaacccagagggtg

SEQ ID NO: 87327 - DNA, 20 bp, Artificial
  CRISPR gRNA sequence
acccagagggtggagcccac

SEQ ID NO: 87328 - DNA, 20 bp, Artificial
  CRISPR gRNA sequence
cagagggtggagcccacaag

SEQ ID NO: 87329 - DNA, 20 bp, Artificial
  CRISPR gRNA sequence
gggtggagcccacaagaagc

SEQ ID NO: 87330 - DNA, 20 bp, Artificial
  CRISPR gRNA sequence
gtggagcccacaagaagcca

SEQ ID NO: 87331 - DNA, 20 bp, Artificial
  CRISPR gRNA sequence
ggagcccacaagaagccaga

SEQ ID NO: 87332 - DNA, 20 bp, Artificial
  CRISPR gRNA sequence
ccacaagaagccagagagac

SEQ ID NO: 87333 - DNA, 20 bp, Artificial
  CRISPR gRNA sequence
agaagccagagagactggcc

SEQ ID NO: 87334 - DNA, 20 bp, Artificial
  CRISPR gRNA sequence
gaagccagagagactggccc

SEQ ID NO: 87335 - DNA, 20 bp, Artificial
  CRISPR gRNA sequence
ccagagagactggcccaggt

SEQ ID NO: 87336 - DNA, 20 bp, Artificial
  CRISPR gRNA sequence
cagagagactggcccaggta

SEQ ID NO: 87337 - DNA, 20 bp, Artificial
  CRISPR gRNA sequence
agagactggcccaggtaagg

SEQ ID NO: 87338 - DNA, 20 bp, Artificial
  CRISPR gRNA sequence
actggcccaggtaaggaagt

SEQ ID NO: 87339 - DNA, 20 bp, Artificial
  CRISPR gRNA sequence
ggcccaggtaaggaagtcag

SEQ ID NO: 87340 - DNA, 20 bp, Artificial
  CRISPR gRNA sequence
tggccctgactttgctgtcc

SEQ ID NO: 87341 - DNA, 20 bp, Artificial
  CRISPR gRNA sequence
ggccctgactttgctgtcct

SEQ ID NO: 87342 - DNA, 20 bp, Artificial
  CRISPR gRNA sequence
ctgactttgctgtcctgggc

SEQ ID NO: 87343 - DNA, 20 bp, Artificial
  CRISPR gRNA sequence
tgactttgctgtcctgggct

SEQ ID NO: 87344 - DNA, 20 bp, Artificial
  CRISPR gRNA sequence
gactttgctgtcctgggctg

SEQ ID NO: 87345 - DNA, 20 bp, Artificial
  CRISPR gRNA sequence
actttgctgtcctgggctgg

SEQ ID NO: 87346 - DNA, 20 bp, Artificial
  CRISPR gRNA sequence
gctgtcctgggctgggggct

SEQ ID NO: 87347 - DNA, 20 bp, Artificial
  CRISPR gRNA sequence
ttagtatatccttctccaat

SEQ ID NO: 87348 - DNA, 20 bp, Artificial
  CRISPR gRNA sequence
tagtatatccttctccaatt

SEQ ID NO: 87349 - DNA, 20 bp, Artificial
  CRISPR gRNA sequence
ttttccacctcctgtgcctc

SEQ ID NO: 87350 - DNA, 20 bp, Artificial
  CRISPR gRNA sequence
gtgttcctctctttactttt

SEQ ID NO: 87351 - DNA, 20 bp, Artificial
  CRISPR gRNA sequence
tctttactttttagcctcct

SEQ ID NO: 87352 - DNA, 20 bp, Artificial
  CRISPR gRNA sequence
ctttactttttagcctccta

SEQ ID NO: 87353 - DNA, 20 bp, Artificial
  CRISPR gRNA sequence
tttttagcctcctaaggatc

SEQ ID NO: 87354 - DNA, 20 bp, Artificial
  CRISPR gRNA sequence
ttagcctcctaaggatctgg

SEQ ID NO: 87355 - DNA, 20 bp, Artificial
  CRISPR gRNA sequence
aaggatctggaagcccgaac

SEQ ID NO: 87356 - DNA, 20 bp, Artificial
  CRISPR gRNA sequence
aggatctggaagcccgaact

SEQ ID NO: 87357 - DNA, 20 bp, Artificial
  CRISPR gRNA sequence
ggatctggaagcccgaactg

SEQ ID NO: 87358 - DNA, 20 bp, Artificial
  CRISPR gRNA sequence
ctggaagcccgaactggggc

SEQ ID NO: 87359 - DNA, 20 bp, Artificial
  CRISPR gRNA sequence
ggggccggtcctctcgcacg

SEQ ID NO: 87360 - DNA, 20 bp, Artificial
  CRISPR gRNA sequence
ggccggtcctctcgcacgtg

SEQ ID NO: 87361 - DNA, 20 bp, Artificial
  CRISPR gRNA sequence
ccggtcctctcgcacgtgga

SEQ ID NO: 87362 - DNA, 20 bp, Artificial
  CRISPR gRNA sequence
gtcctctcgcacgtggagag

SEQ ID NO: 87363 - DNA, 20 bp, Artificial
  CRISPR gRNA sequence
ctctcgcacgtggagagcgg

SEQ ID NO: 87364 - DNA, 20 bp, Artificial
  CRISPR gRNA sequence
tcgcacgtggagagcggaag

SEQ ID NO: 87365 - DNA, 20 bp, Artificial
  CRISPR gRNA sequence
gcacgtggagagcggaagaa

SEQ ID NO: 87366 - DNA, 20 bp, Artificial
  CRISPR gRNA sequence
tggagagcggaagaagagtg

SEQ ID NO: 87367 - DNA, 20 bp, Artificial
  CRISPR gRNA sequence
agcggaagaagagtgtagtt

SEQ ID NO: 87368 - DNA, 20 bp, Artificial
  CRISPR gRNA sequence
cggaagaagagtgtagttga

SEQ ID NO: 87369 - DNA, 20 bp, Artificial
  CRISPR gRNA sequence
gaagagtgtagttgagagct

SEQ ID NO: 87370 - DNA, 20 bp, Artificial
  CRISPR gRNA sequence
tgtagttgagagctcggccc

SEQ ID NO: 87371 - DNA, 20 bp, Artificial
  CRISPR gRNA sequence
gtagttgagagctcggcccc

SEQ ID NO: 87372 - DNA, 20 bp, Artificial
  CRISPR gRNA sequence
agttgagagctcggccccag

SEQ ID NO: 87373 - DNA, 20 bp, Artificial
  CRISPR gRNA sequence
ccccaggagccaataacctg

SEQ ID NO: 87374 - DNA, 20 bp, Artificial
  CRISPR gRNA sequence
cccaggagccaataacctgc

SEQ ID NO: 87375 - DNA, 20 bp, Artificial
  CRISPR gRNA sequence
taacctgcaggttaatgccc

SEQ ID NO: 87376 - DNA, 20 bp, Artificial
  CRISPR gRNA sequence
cctgcaggttaatgccctag

SEQ ID NO: 87377 - DNA, 20 bp, Artificial
  CRISPR gRNA sequence
aggttaatgccctagtggct

SEQ ID NO: 87378 - DNA, 20 bp, Artificial
  CRISPR gRNA sequence
ggctgcctctgctccttccc

SEQ ID NO: 87379 - DNA, 20 bp, Artificial
  CRISPR gRNA sequence
gctgcctctgctccttcccc

SEQ ID NO: 87380 - DNA, 20 bp, Artificial
  CRISPR gRNA sequence
ctcactaattccgccaatcc

SEQ ID NO: 87381 - DNA, 20 bp, Artificial
  CRISPR gRNA sequence
cccagtctctccacctattc

SEQ ID NO: 87382 - DNA, 20 bp, Artificial
  CRISPR gRNA sequence
tctccacctattctggcccc

SEQ ID NO: 87383 - DNA, 20 bp, Artificial
  CRISPR gRNA sequence
ctccacctattctggccccc

SEQ ID NO: 87384 - DNA, 20 bp, Artificial
  CRISPR gRNA sequence
tctggcccccaggctttctt

SEQ ID NO: 87385 - DNA, 20 bp, Artificial
  CRISPR gRNA sequence
ctggcccccaggctttcttc

SEQ ID NO: 87386 - DNA, 20 bp, Artificial
  CRISPR gRNA sequence
gctttcttcaggtgccctga

SEQ ID NO: 87387 - DNA, 20 bp, Artificial
  CRISPR gRNA sequence
ttcttcaggtgccctgaaag

SEQ ID NO: 87388 - DNA, 20 bp, Artificial
  CRISPR gRNA sequence
gtggctacactgcctctgtc

SEQ ID NO: 87389 - DNA, 20 bp, Artificial
  CRISPR gRNA sequence
gctacactgcctctgtctag

SEQ ID NO: 87390 - DNA, 20 bp, Artificial
  CRISPR gRNA sequence
ctacactgcctctgtctagt

SEQ ID NO: 87391 - DNA, 20 bp, Artificial
  CRISPR gRNA sequence
tacactgcctctgtctagta

SEQ ID NO: 87392 - DNA, 20 bp, Artificial
  CRISPR gRNA sequence
ctgcctctgtctagtagggc

SEQ ID NO: 87393 - DNA, 20 bp, Artificial
  CRISPR gRNA sequence
tgcctctgtctagtagggcc

SEQ ID NO: 87394 - DNA, 20 bp, Artificial
  CRISPR gRNA sequence
gcctctgtctagtagggccg

SEQ ID NO: 87395 - DNA, 20 bp, Artificial
  CRISPR gRNA sequence
tagtagggccggggcacccc

SEQ ID NO: 87396 - DNA, 20 bp, Artificial
  CRISPR gRNA sequence
tagggccggggcacccccag

SEQ ID NO: 87397 - DNA, 20 bp, Artificial
  CRISPR gRNA sequence
ccaactgttcctgctttgcc

SEQ ID NO: 87398 - DNA, 20 bp, Artificial
  CRISPR gRNA sequence
gttcctgctttgcctggacc

SEQ ID NO: 87399 - DNA, 20 bp, Artificial
  CRISPR gRNA sequence
gctttgcctggacctggacc

SEQ ID NO: 87400 - DNA, 20 bp, Artificial
  CRISPR gRNA sequence
ctttgcctggacctggacct

SEQ ID NO: 87401 - DNA, 20 bp, Artificial
  CRISPR gRNA sequence
cctggacctggacctgggcc

SEQ ID NO: 87402 - DNA, 20 bp, Artificial
  CRISPR gRNA sequence
ctggacctggacctgggcct

SEQ ID NO: 87403 - DNA, 20 bp, Artificial
  CRISPR gRNA sequence
acctggacctgggcctgggc

SEQ ID NO: 87404 - DNA, 20 bp, Artificial
  CRISPR gRNA sequence
gggcctgggcgagctccacc

SEQ ID NO: 87405 - DNA, 20 bp, Artificial
  CRISPR gRNA sequence
ggcctgggcgagctccacct

SEQ ID NO: 87406 - DNA, 20 bp, Artificial
  CRISPR gRNA sequence
gcctgggcgagctccacctg

SEQ ID NO: 87407 - DNA, 20 bp, Artificial
  CRISPR gRNA sequence
cctgggcgagctccacctgg

SEQ ID NO: 87408 - DNA, 20 bp, Artificial
  CRISPR gRNA sequence
ctccacctgggggactcact

SEQ ID NO: 87409 - DNA, 20 bp, Artificial
  CRISPR gRNA sequence
ctgggggactcactcagccc

SEQ ID NO: 87410 - DNA, 20 bp, Artificial
  CRISPR gRNA sequence
tgggggactcactcagcccc

SEQ ID NO: 87411 - DNA, 20 bp, Artificial
  CRISPR gRNA sequence
gggggactcactcagccccg

SEQ ID NO: 87412 - DNA, 20 bp, Artificial
  CRISPR gRNA sequence
actcactcagccccggggca

SEQ ID NO: 87413 - DNA, 20 bp, Artificial
  CRISPR gRNA sequence
tcactcagccccggggcaca

SEQ ID NO: 87414 - DNA, 20 bp, Artificial
  CRISPR gRNA sequence
cagccccggggcacagagaa

SEQ ID NO: 87415 - DNA, 20 bp, Artificial
  CRISPR gRNA sequence
gccccggggcacagagaaca

SEQ ID NO: 87416 - DNA, 20 bp, Artificial
  CRISPR gRNA sequence
cccggggcacagagaacaga

SEQ ID NO: 87417 - DNA, 20 bp, Artificial
  CRISPR gRNA sequence
ccggggcacagagaacagag

SEQ ID NO: 87418 - DNA, 20 bp, Artificial
  CRISPR gRNA sequence
gggcacagagaacagagagg

SEQ ID NO: 87419 - DNA, 20 bp, Artificial
  CRISPR gRNA sequence
ggcacagagaacagagaggt

SEQ ID NO: 87420 - DNA, 20 bp, Artificial
  CRISPR gRNA sequence
agagaacagagaggtaggca

SEQ ID NO: 87421 - DNA, 20 bp, Artificial
  CRISPR gRNA sequence
gagaacagagaggtaggcat

SEQ ID NO: 87422 - DNA, 20 bp, Artificial
  CRISPR gRNA sequence
aacagagaggtaggcatagg

SEQ ID NO: 87423 - DNA, 20 bp, Artificial
  CRISPR gRNA sequence
ggtaggcataggtggtgacc

SEQ ID NO: 87424 - DNA, 20 bp, Artificial
  CRISPR gRNA sequence
gtaggcataggtggtgacca

SEQ ID NO: 87425 - DNA, 20 bp, Artificial
  CRISPR gRNA sequence
gtgaccaaggaccacatgac

SEQ ID NO: 87426 - DNA, 20 bp, Artificial
  CRISPR gRNA sequence
tgaccaaggaccacatgaca

SEQ ID NO: 87427 - DNA, 20 bp, Artificial
  CRISPR gRNA sequence
gaccaaggaccacatgacaa

SEQ ID NO: 87428 - DNA, 20 bp, Artificial
  CRISPR gRNA sequence
gaccacatgacaagggtgtc

SEQ ID NO: 87429 - DNA, 20 bp, Artificial
  CRISPR gRNA sequence
ccacatgacaagggtgtcaa

SEQ ID NO: 87430 - DNA, 20 bp, Artificial
  CRISPR gRNA sequence
cacatgacaagggtgtcaag

SEQ ID NO: 87431 - DNA, 20 bp, Artificial
  CRISPR gRNA sequence
tgacaagggtgtcaagagga

SEQ ID NO: 87432 - DNA, 20 bp, Artificial
  CRISPR gRNA sequence
gggtgtcaagaggacagctg

SEQ ID NO: 87433 - DNA, 20 bp, Artificial
  CRISPR gRNA sequence
aggacagctgaagtacctgt

SEQ ID NO: 87434 - DNA, 20 bp, Artificial
  CRISPR gRNA sequence
cagctgaagtacctgtgagt

SEQ ID NO: 87435 - DNA, 20 bp, Artificial
  CRISPR gRNA sequence
agctgaagtacctgtgagtg

SEQ ID NO: 87436 - DNA, 20 bp, Artificial
  CRISPR gRNA sequence
gaagtacctgtgagtgaggc

SEQ ID NO: 87437 - DNA, 20 bp, Artificial
  CRISPR gRNA sequence
gtacctgtgagtgaggccag

SEQ ID NO: 87438 - DNA, 20 bp, Artificial
  CRISPR gRNA sequence
tacctgtgagtgaggccagt

SEQ ID NO: 87439 - DNA, 20 bp, Artificial
  CRISPR gRNA sequence
ctgtgagtgaggccagtggg

SEQ ID NO: 87440 - DNA, 20 bp, Artificial
  CRISPR gRNA sequence
tgtgagtgaggccagtgggc

SEQ ID NO: 87441 - DNA, 20 bp, Artificial
  CRISPR gRNA sequence
ggccagtgggcaggctccac

SEQ ID NO: 87442 - DNA, 20 bp, Artificial
  CRISPR gRNA sequence
tgggcaggctccaccagcta

SEQ ID NO: 87443 - DNA, 20 bp, Artificial
  CRISPR gRNA sequence
gcaggctccaccagctaaag

SEQ ID NO: 87444 - DNA, 20 bp, Artificial
  CRISPR gRNA sequence
ctccaccagctaaagcagca

SEQ ID NO: 87445 - DNA, 20 bp, Artificial
  CRISPR gRNA sequence
caccagctaaagcagcaaag

SEQ ID NO: 87446 - DNA, 20 bp, Artificial
  CRISPR gRNA sequence
accagctaaagcagcaaagc

SEQ ID NO: 87447 - DNA, 20 bp, Artificial
  CRISPR gRNA sequence
taaagcagcaaagcaggata

SEQ ID NO: 87448 - DNA, 20 bp, Artificial
  CRISPR gRNA sequence
aagcagcaaagcaggatata

SEQ ID NO: 87449 - DNA, 20 bp, Artificial
  CRISPR gRNA sequence
agcagcaaagcaggatatag

SEQ ID NO: 87450 - DNA, 20 bp, Artificial
  CRISPR gRNA sequence
aaagcaggatatagaggata

SEQ ID NO: 87451 - DNA, 20 bp, Artificial
  CRISPR gRNA sequence
caggatatagaggatacagc

SEQ ID NO: 87452 - DNA, 20 bp, Artificial
  CRISPR gRNA sequence
gatacagcaagtgatgccaa

SEQ ID NO: 87453 - DNA, 20 bp, Artificial
  CRISPR gRNA sequence
atacagcaagtgatgccaaa

SEQ ID NO: 87454 - DNA, 20 bp, Artificial
  CRISPR gRNA sequence
caagtgatgccaaaaggaaa

SEQ ID NO: 87455 - DNA, 20 bp, Artificial
  CRISPR gRNA sequence
aagtgatgccaaaaggaaac

SEQ ID NO: 87456 - DNA, 20 bp, Artificial
  CRISPR gRNA sequence
agtgatgccaaaaggaaacg

SEQ ID NO: 87457 - DNA, 20 bp, Artificial
  CRISPR gRNA sequence
gtgatgccaaaaggaaacgg

SEQ ID NO: 87458 - DNA, 20 bp, Artificial
  CRISPR gRNA sequence
aacgggggcgccctcgaaaa

SEQ ID NO: 87459 - DNA, 20 bp, Artificial
  CRISPR gRNA sequence
ggggcgccctcgaaaaaagt

SEQ ID NO: 87460 - DNA, 20 bp, Artificial
  CRISPR gRNA sequence
gggcgccctcgaaaaaagtc

SEQ ID NO: 87461 - DNA, 20 bp, Artificial
  CRISPR gRNA sequence
cgccctcgaaaaaagtcagg

SEQ ID NO: 87462 - DNA, 20 bp, Artificial
  CRISPR gRNA sequence
cctcgaaaaaagtcaggtgg

SEQ ID NO: 87463 - DNA, 20 bp, Artificial
  CRISPR gRNA sequence
cgaaaaaagtcaggtggaag

SEQ ID NO: 87464 - DNA, 20 bp, Artificial
  CRISPR gRNA sequence
gaaaaaagtcaggtggaagt

SEQ ID NO: 87465 - DNA, 20 bp, Artificial
  CRISPR gRNA sequence
aaaaaagtcaggtggaagtg

SEQ ID NO: 87466 - DNA, 20 bp, Artificial
  CRISPR gRNA sequence
aagtcaggtggaagtgggga

SEQ ID NO: 87467 - DNA, 20 bp, Artificial
  CRISPR gRNA sequence
agtcaggtggaagtggggaa

SEQ ID NO: 87468 - DNA, 20 bp, Artificial
  CRISPR gRNA sequence
aaaggaattctacccctctc

SEQ ID NO: 87469 - DNA, 20 bp, Artificial
  CRISPR gRNA sequence
gaattctacccctctcaagt

SEQ ID NO: 87470 - DNA, 20 bp, Artificial
  CRISPR gRNA sequence
ttctacccctctcaagtcag

SEQ ID NO: 87471 - DNA, 20 bp, Artificial
  CRISPR gRNA sequence
tctcaagtcagcagctgcca

SEQ ID NO: 87472 - DNA, 20 bp, Artificial
  CRISPR gRNA sequence
cagctgccatggaatctgcc

SEQ ID NO: 87473 - DNA, 20 bp, Artificial
  CRISPR gRNA sequence
atggaatctgcccagtcctc

SEQ ID NO: 87474 - DNA, 20 bp, Artificial
  CRISPR gRNA sequence
tggaatctgcccagtcctca

SEQ ID NO: 87475 - DNA, 20 bp, Artificial
  CRISPR gRNA sequence
cccagtcctcaaggttacca

SEQ ID NO: 87476 - DNA, 20 bp, Artificial
  CRISPR gRNA sequence
ccagtcctcaaggttaccat

SEQ ID NO: 87477 - DNA, 20 bp, Artificial
  CRISPR gRNA sequence
agtcctcaaggttaccatgg

SEQ ID NO: 87478 - DNA, 20 bp, Artificial
  CRISPR gRNA sequence
caaggttaccatgggagaca

SEQ ID NO: 87479 - DNA, 20 bp, Artificial
  CRISPR gRNA sequence
aaggttaccatgggagacat

SEQ ID NO: 87480 - DNA, 20 bp, Artificial
  CRISPR gRNA sequence
aggttaccatgggagacatg

SEQ ID NO: 87481 - DNA, 20 bp, Artificial
  CRISPR gRNA sequence
accatgggagacatggggct

SEQ ID NO: 87482 - DNA, 20 bp, Artificial
  CRISPR gRNA sequence
ccatgggagacatggggctc

SEQ ID NO: 87483 - DNA, 20 bp, Artificial
  CRISPR gRNA sequence
atgggagacatggggctcag

SEQ ID NO: 87484 - DNA, 20 bp, Artificial
  CRISPR gRNA sequence
tgggagacatggggctcagg

SEQ ID NO: 87485 - DNA, 20 bp, Artificial
  CRISPR gRNA sequence
gggagacatggggctcagga

SEQ ID NO: 87486 - DNA, 20 bp, Artificial
  CRISPR gRNA sequence
ggagacatggggctcaggag

SEQ ID NO: 87487 - DNA, 20 bp, Artificial
  CRISPR gRNA sequence
gacatggggctcaggagggg

SEQ ID NO: 87488 - DNA, 20 bp, Artificial
  CRISPR gRNA sequence
acatggggctcaggagggga

SEQ ID NO: 87489 - DNA, 20 bp, Artificial
  CRISPR gRNA sequence
ctcaggaggggaaggcaact

SEQ ID NO: 87490 - DNA, 20 bp, Artificial
  CRISPR gRNA sequence
ggaggggaaggcaactcagc

SEQ ID NO: 87491 - DNA, 20 bp, Artificial
  CRISPR gRNA sequence
aggggaaggcaactcagctg

SEQ ID NO: 87492 - DNA, 20 bp, Artificial
  CRISPR gRNA sequence
ggggaaggcaactcagctgg

SEQ ID NO: 87493 - DNA, 20 bp, Artificial
  CRISPR gRNA sequence
gggaaggcaactcagctgga

SEQ ID NO: 87494 - DNA, 20 bp, Artificial
  CRISPR gRNA sequence
ggaaggcaactcagctggag

SEQ ID NO: 87495 - DNA, 20 bp, Artificial
  CRISPR gRNA sequence
aggcaactcagctggagggg

SEQ ID NO: 87496 - DNA, 20 bp, Artificial
  CRISPR gRNA sequence
gcaactcagctggaggggca

SEQ ID NO: 87497 - DNA, 20 bp, Artificial
  CRISPR gRNA sequence
aactcagctggaggggcaga

SEQ ID NO: 87498 - DNA, 20 bp, Artificial
  CRISPR gRNA sequence
actcagctggaggggcagag

SEQ ID NO: 87499 - DNA, 20 bp, Artificial
  CRISPR gRNA sequence
agctggaggggcagagaggc

SEQ ID NO: 87500 - DNA, 20 bp, Artificial
  CRISPR gRNA sequence
gctggaggggcagagaggcc

SEQ ID NO: 87501 - DNA, 20 bp, Artificial
  CRISPR gRNA sequence
ctggaggggcagagaggcca

SEQ ID NO: 87502 - DNA, 20 bp, Artificial
  CRISPR gRNA sequence
ggcagagaggccagggccaa

SEQ ID NO: 87503 - DNA, 20 bp, Artificial
  CRISPR gRNA sequence
gcagagaggccagggccaat

SEQ ID NO: 87504 - DNA, 20 bp, Artificial
  CRISPR gRNA sequence
agagaggccagggccaatgg

SEQ ID NO: 87505 - DNA, 20 bp, Artificial
  CRISPR gRNA sequence
agaggccagggccaatggga

SEQ ID NO: 87506 - DNA, 20 bp, Artificial
  CRISPR gRNA sequence
gaggccagggccaatgggag

SEQ ID NO: 87507 - DNA, 20 bp, Artificial
  CRISPR gRNA sequence
ggccaatgggagaggctgaa

SEQ ID NO: 87508 - DNA, 20 bp, Artificial
  CRISPR gRNA sequence
gccaatgggagaggctgaaa

SEQ ID NO: 87509 - DNA, 20 bp, Artificial
  CRISPR gRNA sequence
ccaatgggagaggctgaaaa

SEQ ID NO: 87510 - DNA, 20 bp, Artificial
  CRISPR gRNA sequence
caatgggagaggctgaaaag

SEQ ID NO: 87511 - DNA, 20 bp, Artificial
  CRISPR gRNA sequence
aatgggagaggctgaaaagg

SEQ ID NO: 87512 - DNA, 20 bp, Artificial
  CRISPR gRNA sequence
gggagaggctgaaaaggggg

SEQ ID NO: 87513 - DNA, 20 bp, Artificial
  CRISPR gRNA sequence
aaaagggggcagtacttgcc

SEQ ID NO: 87514 - DNA, 20 bp, Artificial
  CRISPR gRNA sequence
aaagggggcagtacttgccc

SEQ ID NO: 87515 - DNA, 20 bp, Artificial
  CRISPR gRNA sequence
aagggggcagtacttgccca

SEQ ID NO: 87516 - DNA, 20 bp, Artificial
  CRISPR gRNA sequence
gggcagtacttgcccagggt

SEQ ID NO: 87517 - DNA, 20 bp, Artificial
  CRISPR gRNA sequence
ggcagtacttgcccagggtc

SEQ ID NO: 87518 - DNA, 20 bp, Artificial
  CRISPR gRNA sequence
gcagtacttgcccagggtca

SEQ ID NO: 87519 - DNA, 20 bp, Artificial
  CRISPR gRNA sequence
agtacttgcccagggtcagg

SEQ ID NO: 87520 - DNA, 20 bp, Artificial
  CRISPR gRNA sequence
cttgcccagggtcagggaga

SEQ ID NO: 87521 - DNA, 20 bp, Artificial
  CRISPR gRNA sequence
gggagatggtactgtttcca

SEQ ID NO: 87522 - DNA, 20 bp, Artificial
  CRISPR gRNA sequence
ggagatggtactgtttccaa

SEQ ID NO: 87523 - DNA, 20 bp, Artificial
  CRISPR gRNA sequence
agatggtactgtttccaaag

SEQ ID NO: 87524 - DNA, 20 bp, Artificial
  CRISPR gRNA sequence
gatggtactgtttccaaagg

SEQ ID NO: 87525 - DNA, 20 bp, Artificial
  CRISPR gRNA sequence
ggtactgtttccaaaggagg

SEQ ID NO: 87526 - DNA, 20 bp, Artificial
  CRISPR gRNA sequence
gtactgtttccaaaggagga

SEQ ID NO: 87527 - DNA, 20 bp, Artificial
  CRISPR gRNA sequence
tactgtttccaaaggaggaa

SEQ ID NO: 87528 - DNA, 20 bp, Artificial
  CRISPR gRNA sequence
actgtttccaaaggaggaag

SEQ ID NO: 87529 - DNA, 20 bp, Artificial
  CRISPR gRNA sequence
tccaaaggaggaaggggccc

SEQ ID NO: 87530 - DNA, 20 bp, Artificial
  CRISPR gRNA sequence
gaggaaggggccccggttcc

SEQ ID NO: 87531 - DNA, 20 bp, Artificial
  CRISPR gRNA sequence
ccccggttcccagcatacca

SEQ ID NO: 87532 - DNA, 20 bp, Artificial
  CRISPR gRNA sequence
cggttcccagcataccaaag

SEQ ID NO: 87533 - DNA, 20 bp, Artificial
  CRISPR gRNA sequence
ttcccagcataccaaagaag

SEQ ID NO: 87534 - DNA, 20 bp, Artificial
  CRISPR gRNA sequence
ccagcataccaaagaagcag

SEQ ID NO: 87535 - DNA, 20 bp, Artificial
  CRISPR gRNA sequence
agcagaagataaaattccct

SEQ ID NO: 87536 - DNA, 20 bp, Artificial
  CRISPR gRNA sequence
aattcccttggtcccctcaa

SEQ ID NO: 87537 - DNA, 20 bp, Artificial
  CRISPR gRNA sequence
cccttggtcccctcaaaagt

SEQ ID NO: 87538 - DNA, 20 bp, Artificial
  CRISPR gRNA sequence
cctcaaaagtgagtgtcatc

SEQ ID NO: 87539 - DNA, 20 bp, Artificial
  CRISPR gRNA sequence
ctcaaaagtgagtgtcatca

SEQ ID NO: 87540 - DNA, 20 bp, Artificial
  CRISPR gRNA sequence
tcaaaagtgagtgtcatcaa

SEQ ID NO: 87541 - DNA, 20 bp, Artificial
  CRISPR gRNA sequence
aaagtgagtgtcatcaaggg

SEQ ID NO: 87542 - DNA, 20 bp, Artificial
  CRISPR gRNA sequence
gtgagtgtcatcaagggcag

SEQ ID NO: 87543 - DNA, 20 bp, Artificial
  CRISPR gRNA sequence
agtgtcatcaagggcagcag

SEQ ID NO: 87544 - DNA, 20 bp, Artificial
  CRISPR gRNA sequence
tcaagggcagcagaagccaa

SEQ ID NO: 87545 - DNA, 20 bp, Artificial
  CRISPR gRNA sequence
caagggcagcagaagccaaa

SEQ ID NO: 87546 - DNA, 20 bp, Artificial
  CRISPR gRNA sequence
agggcagcagaagccaaaag

SEQ ID NO: 87547 - DNA, 20 bp, Artificial
  CRISPR gRNA sequence
gggcagcagaagccaaaagg

SEQ ID NO: 87548 - DNA, 20 bp, Artificial
  CRISPR gRNA sequence
ccaaaaggaggcttttcctt

SEQ ID NO: 87549 - DNA, 20 bp, Artificial
  CRISPR gRNA sequence
aggaggcttttcctttggca

SEQ ID NO: 87550 - DNA, 20 bp, Artificial
  CRISPR gRNA sequence
ggaggcttttcctttggcaa

SEQ ID NO: 87551 - DNA, 20 bp, Artificial
  CRISPR gRNA sequence
gaggcttttcctttggcaaa

SEQ ID NO: 87552 - DNA, 20 bp, Artificial
  CRISPR gRNA sequence
ggcttttcctttggcaaagg

SEQ ID NO: 87553 - DNA, 20 bp, Artificial
  CRISPR gRNA sequence
cttttcctttggcaaaggga

SEQ ID NO: 87554 - DNA, 20 bp, Artificial
  CRISPR gRNA sequence
ttttcctttggcaaagggag

SEQ ID NO: 87555 - DNA, 20 bp, Artificial
  CRISPR gRNA sequence
tcctttggcaaagggagagg

SEQ ID NO: 87556 - DNA, 20 bp, Artificial
  CRISPR gRNA sequence
gagaggtagacactgcacca

SEQ ID NO: 87557 - DNA, 20 bp, Artificial
  CRISPR gRNA sequence
agaggtagacactgcaccac

SEQ ID NO: 87558 - DNA, 20 bp, Artificial
  CRISPR gRNA sequence
gaggtagacactgcaccaca

SEQ ID NO: 87559 - DNA, 20 bp, Artificial
  CRISPR gRNA sequence
cactgcaccacagggtaata

SEQ ID NO: 87560 - DNA, 20 bp, Artificial
  CRISPR gRNA sequence
cacagggtaataaagactta

SEQ ID NO: 87561 - DNA, 20 bp, Artificial
  CRISPR gRNA sequence
acagggtaataaagacttaa

SEQ ID NO: 87562 - DNA, 20 bp, Artificial
  CRISPR gRNA sequence
agggtaataaagacttaaag

SEQ ID NO: 87563 - DNA, 20 bp, Artificial
  CRISPR gRNA sequence
ttaaaggagcatgtgcttca

SEQ ID NO: 87564 - DNA, 20 bp, Artificial
  CRISPR gRNA sequence
tgcttcaaagttccttatcc

SEQ ID NO: 87565 - DNA, 20 bp, Artificial
  CRISPR gRNA sequence
gcttcaaagttccttatccc

SEQ ID NO: 87566 - DNA, 20 bp, Artificial
  CRISPR gRNA sequence
ttcaaagttccttatcccag

SEQ ID NO: 87567 - DNA, 20 bp, Artificial
  CRISPR gRNA sequence
ttccttatcccaggagcata

SEQ ID NO: 87568 - DNA, 20 bp, Artificial
  CRISPR gRNA sequence
ccaggagcataaagacccaa

SEQ ID NO: 87569 - DNA, 20 bp, Artificial
  CRISPR gRNA sequence
aaagcaacacccccatgata

SEQ ID NO: 87570 - DNA, 20 bp, Artificial
  CRISPR gRNA sequence
aagcaacacccccatgatac

SEQ ID NO: 87571 - DNA, 20 bp, Artificial
  CRISPR gRNA sequence
acccccatgatacaggtctg

SEQ ID NO: 87572 - DNA, 20 bp, Artificial
  CRISPR gRNA sequence
cccccatgatacaggtctgt

SEQ ID NO: 87573 - DNA, 20 bp, Artificial
  CRISPR gRNA sequence
ccccatgatacaggtctgtg

SEQ ID NO: 87574 - DNA, 20 bp, Artificial
  CRISPR gRNA sequence
catgatacaggtctgtgggg

SEQ ID NO: 87575 - DNA, 20 bp, Artificial
  CRISPR gRNA sequence
tgatacaggtctgtggggaa

SEQ ID NO: 87576 - DNA, 20 bp, Artificial
  CRISPR gRNA sequence
atccctacgttaactttgcc

SEQ ID NO: 87577 - DNA, 20 bp, Artificial
  CRISPR gRNA sequence
cctacgttaactttgcctag

SEQ ID NO: 87578 - DNA, 20 bp, Artificial
  CRISPR gRNA sequence
tacgttaactttgcctagta

SEQ ID NO: 87579 - DNA, 20 bp, Artificial
  CRISPR gRNA sequence
acgttaactttgcctagtag

SEQ ID NO: 87580 - DNA, 20 bp, Artificial
  CRISPR gRNA sequence
ctttgcacttgcttctcatt

SEQ ID NO: 87581 - DNA, 20 bp, Artificial
  CRISPR gRNA sequence
catttggctattcttttcct

SEQ ID NO: 87582 - DNA, 20 bp, Artificial
  CRISPR gRNA sequence
atttggctattcttttccta

SEQ ID NO: 87583 - DNA, 20 bp, Artificial
  CRISPR gRNA sequence
tggctattcttttcctaagg

SEQ ID NO: 87584 - DNA, 20 bp, Artificial
  CRISPR gRNA sequence
gaagtccattctcctctgta

SEQ ID NO: 87585 - DNA, 20 bp, Artificial
  CRISPR gRNA sequence
tccattctcctctgtacaga

SEQ ID NO: 87586 - DNA, 20 bp, Artificial
  CRISPR gRNA sequence
tctcctctgtacagacagct

SEQ ID NO: 87587 - DNA, 20 bp, Artificial
  CRISPR gRNA sequence
gtacagacagctgagtcacc

SEQ ID NO: 87588 - DNA, 20 bp, Artificial
  CRISPR gRNA sequence
gctgagtcacccagtctact

SEQ ID NO: 87589 - DNA, 20 bp, Artificial
  CRISPR gRNA sequence
cacccagtctacttagtacc

SEQ ID NO: 87590 - DNA, 20 bp, Artificial
  CRISPR gRNA sequence
gttgctgcctctgacctttt

SEQ ID NO: 87591 - DNA, 20 bp, Artificial
  CRISPR gRNA sequence
accttttcagcttgataccc

SEQ ID NO: 87592 - DNA, 20 bp, Artificial
  CRISPR gRNA sequence
ccttttcagcttgataccct

SEQ ID NO: 87593 - DNA, 20 bp, Artificial
  CRISPR gRNA sequence
cagcttgataccctgggctt

SEQ ID NO: 87594 - DNA, 20 bp, Artificial
  CRISPR gRNA sequence
tagtgtaaccaataaatctg

SEQ ID NO: 87595 - DNA, 20 bp, Artificial
  CRISPR gRNA sequence
gtattccctgtgctatcctg

SEQ ID NO: 87596 - DNA, 20 bp, Artificial
  CRISPR gRNA sequence
tattccctgtgctatcctgt

SEQ ID NO: 87597 - DNA, 20 bp, Artificial
  CRISPR gRNA sequence
tccctgtgctatcctgtggg

SEQ ID NO: 87598 - DNA, 20 bp, Artificial
  CRISPR gRNA sequence
ccctgtgctatcctgtggga

SEQ ID NO: 87599 - DNA, 20 bp, Artificial
  CRISPR gRNA sequence
tgtgctatcctgtgggaagg

SEQ ID NO: 87600 - DNA, 20 bp, Artificial
  CRISPR gRNA sequence
gtgctatcctgtgggaaggt

SEQ ID NO: 87601 - DNA, 20 bp, Artificial
  CRISPR gRNA sequence
atcctgtgggaaggtaggaa

SEQ ID NO: 87602 - DNA, 20 bp, Artificial
  CRISPR gRNA sequence
tcctgtgggaaggtaggaat

SEQ ID NO: 87603 - DNA, 20 bp, Artificial
  CRISPR gRNA sequence
tgggaaggtaggaatgggct

SEQ ID NO: 87604 - DNA, 20 bp, Artificial
  CRISPR gRNA sequence
ggctaagtatgatgaatata

SEQ ID NO: 87605 - DNA, 20 bp, Artificial
  CRISPR gRNA sequence
gctaagtatgatgaatatat

SEQ ID NO: 87606 - DNA, 20 bp, Artificial
  CRISPR gRNA sequence
agtatgatgaatatataggt

SEQ ID NO: 87607 - DNA, 20 bp, Artificial
  CRISPR gRNA sequence
gtatgatgaatatataggtt

SEQ ID NO: 87608 - DNA, 20 bp, Artificial
  CRISPR gRNA sequence
tatgatgaatatataggtta

SEQ ID NO: 87609 - DNA, 20 bp, Artificial
  CRISPR gRNA sequence
tatataggttagggatcttt

SEQ ID NO: 87610 - DNA, 20 bp, Artificial
  CRISPR gRNA sequence
gatcttttggttttaaatca

SEQ ID NO: 87611 - DNA, 20 bp, Artificial
  CRISPR gRNA sequence
acagaaaacctaattcaaac

SEQ ID NO: 87612 - DNA, 20 bp, Artificial
  CRISPR gRNA sequence
tcaaactggcttaaaataaa

SEQ ID NO: 87613 - DNA, 20 bp, Artificial
  CRISPR gRNA sequence
caaactggcttaaaataaaa

SEQ ID NO: 87614 - DNA, 20 bp, Artificial
  CRISPR gRNA sequence
ttaaaataaaaaggatttat

SEQ ID NO: 87615 - DNA, 20 bp, Artificial
  CRISPR gRNA sequence
gatttattggttcatgtaac

SEQ ID NO: 87616 - DNA, 20 bp, Artificial
  CRISPR gRNA sequence
tattggttcatgtaactaga

SEQ ID NO: 87617 - DNA, 20 bp, Artificial
  CRISPR gRNA sequence
tcatgtaactagaaagtcca

SEQ ID NO: 87618 - DNA, 20 bp, Artificial
  CRISPR gRNA sequence
catgtaactagaaagtccat

SEQ ID NO: 87619 - DNA, 20 bp, Artificial
  CRISPR gRNA sequence
gtaactagaaagtccatagg

SEQ ID NO: 87620 - DNA, 20 bp, Artificial
  CRISPR gRNA sequence
agaaagtccataggtagtgc

SEQ ID NO: 87621 - DNA, 20 bp, Artificial
  CRISPR gRNA sequence
tccataggtagtgctggctc

SEQ ID NO: 87622 - DNA, 20 bp, Artificial
  CRISPR gRNA sequence
ccataggtagtgctggctcc

SEQ ID NO: 87623 - DNA, 20 bp, Artificial
  CRISPR gRNA sequence
ggtagtgctggctccaggtg

SEQ ID NO: 87624 - DNA, 20 bp, Artificial
  CRISPR gRNA sequence
ctccaggtgaagacttgacc

SEQ ID NO: 87625 - DNA, 20 bp, Artificial
  CRISPR gRNA sequence
caggtgaagacttgacccag

SEQ ID NO: 87626 - DNA, 20 bp, Artificial
  CRISPR gRNA sequence
gaagacttgacccagtagtt

SEQ ID NO: 87627 - DNA, 20 bp, Artificial
  CRISPR gRNA sequence
ttcagtatgtctctaaatac

SEQ ID NO: 87628 - DNA, 20 bp, Artificial
  CRISPR gRNA sequence
tctcactgttgcatcttctg

SEQ ID NO: 87629 - DNA, 20 bp, Artificial
  CRISPR gRNA sequence
ctcactgttgcatcttctgt

SEQ ID NO: 87630 - DNA, 20 bp, Artificial
  CRISPR gRNA sequence
catcttctgtaggaccattt

SEQ ID NO: 87631 - DNA, 20 bp, Artificial
  CRISPR gRNA sequence
tctgtaggaccatttaagtc

SEQ ID NO: 87632 - DNA, 20 bp, Artificial
  CRISPR gRNA sequence
ctgtaggaccatttaagtct

SEQ ID NO: 87633 - DNA, 20 bp, Artificial
  CRISPR gRNA sequence
tttaagtctgggccacttaa

SEQ ID NO: 87634 - DNA, 20 bp, Artificial
  CRISPR gRNA sequence
ctgggccacttaatggctgc

SEQ ID NO: 87635 - DNA, 20 bp, Artificial
  CRISPR gRNA sequence
taatggctgccagcattcct

SEQ ID NO: 87636 - DNA, 20 bp, Artificial
  CRISPR gRNA sequence
tttccccatttatgtccaat

SEQ ID NO: 87637 - DNA, 20 bp, Artificial
  CRISPR gRNA sequence
catttatgtccaatcagaaa

SEQ ID NO: 87638 - DNA, 20 bp, Artificial
  CRISPR gRNA sequence
ttatgtccaatcagaaaaag

SEQ ID NO: 87639 - DNA, 20 bp, Artificial
  CRISPR gRNA sequence
tatgtccaatcagaaaaaga

SEQ ID NO: 87640 - DNA, 20 bp, Artificial
  CRISPR gRNA sequence
aaaagaaggcatctttgtac

SEQ ID NO: 87641 - DNA, 20 bp, Artificial
  CRISPR gRNA sequence
catctttgtaccagaaatct

SEQ ID NO: 87642 - DNA, 20 bp, Artificial
  CRISPR gRNA sequence
tgtaccagaaatctcagcaa

SEQ ID NO: 87643 - DNA, 20 bp, Artificial
  CRISPR gRNA sequence
gccctaatattcacactgat

SEQ ID NO: 87644 - DNA, 20 bp, Artificial
  CRISPR gRNA sequence
ccctaatattcacactgatt

SEQ ID NO: 87645 - DNA, 20 bp, Artificial
  CRISPR gRNA sequence
atattcacactgattaggcc

SEQ ID NO: 87646 - DNA, 20 bp, Artificial
  CRISPR gRNA sequence
tattcacactgattaggcct

SEQ ID NO: 87647 - DNA, 20 bp, Artificial
  CRISPR gRNA sequence
tccaccctgaccaatcactg

SEQ ID NO: 87648 - DNA, 20 bp, Artificial
  CRISPR gRNA sequence
ccctgaccaatcactgtggc

SEQ ID NO: 87649 - DNA, 20 bp, Artificial
  CRISPR gRNA sequence
cctgaccaatcactgtggcc

SEQ ID NO: 87650 - DNA, 20 bp, Artificial
  CRISPR gRNA sequence
tgaccaatcactgtggccag

SEQ ID NO: 87651 - DNA, 20 bp, Artificial
  CRISPR gRNA sequence
gaccaatcactgtggccagg

SEQ ID NO: 87652 - DNA, 20 bp, Artificial
  CRISPR gRNA sequence
aatttgcttattctatatca

SEQ ID NO: 87653 - DNA, 20 bp, Artificial
  CRISPR gRNA sequence
tatatcatggacaacacctt

SEQ ID NO: 87654 - DNA, 20 bp, Artificial
  CRISPR gRNA sequence
atatcatggacaacaccttt

SEQ ID NO: 87655 - DNA, 20 bp, Artificial
  CRISPR gRNA sequence
tatcatggacaacacctttg

SEQ ID NO: 87656 - DNA, 20 bp, Artificial
  CRISPR gRNA sequence
tggacaacacctttggggaa

SEQ ID NO: 87657 - DNA, 20 bp, Artificial
  CRISPR gRNA sequence
ggacaacacctttggggaaa

SEQ ID NO: 87658 - DNA, 20 bp, Artificial
  CRISPR gRNA sequence
gacaacacctttggggaaaa

SEQ ID NO: 87659 - DNA, 20 bp, Artificial
  CRISPR gRNA sequence
aacacctttggggaaaaggg

SEQ ID NO: 87660 - DNA, 20 bp, Artificial
  CRISPR gRNA sequence
acacctttggggaaaagggt

SEQ ID NO: 87661 - DNA, 20 bp, Artificial
  CRISPR gRNA sequence
cacctttggggaaaagggtg

SEQ ID NO: 87662 - DNA, 20 bp, Artificial
  CRISPR gRNA sequence
acctttggggaaaagggtgg

SEQ ID NO: 87663 - DNA, 20 bp, Artificial
  CRISPR gRNA sequence
ttggggaaaagggtgggggt

SEQ ID NO: 87664 - DNA, 20 bp, Artificial
  CRISPR gRNA sequence
tcagcctccccaaaatcaca

SEQ ID NO: 87665 - DNA, 20 bp, Artificial
  CRISPR gRNA sequence
caaaatcacatggattcccc

SEQ ID NO: 87666 - DNA, 20 bp, Artificial
  CRISPR gRNA sequence
aatcacatggattccccaag

SEQ ID NO: 87667 - DNA, 20 bp, Artificial
  CRISPR gRNA sequence
tggattccccaagtggaaac

SEQ ID NO: 87668 - DNA, 20 bp, Artificial
  CRISPR gRNA sequence
ggattccccaagtggaaact

SEQ ID NO: 87669 - DNA, 20 bp, Artificial
  CRISPR gRNA sequence
attccccaagtggaaactag

SEQ ID NO: 87670 - DNA, 20 bp, Artificial
  CRISPR gRNA sequence
ccccaagtggaaactaggag

SEQ ID NO: 87671 - DNA, 20 bp, Artificial
  CRISPR gRNA sequence
cccaagtggaaactaggagc

SEQ ID NO: 87672 - DNA, 20 bp, Artificial
  CRISPR gRNA sequence
ccaagtggaaactaggagca

SEQ ID NO: 87673 - DNA, 20 bp, Artificial
  CRISPR gRNA sequence
aagtggaaactaggagcagg

SEQ ID NO: 87674 - DNA, 20 bp, Artificial
  CRISPR gRNA sequence
actaggagcagggagttgct

SEQ ID NO: 87675 - DNA, 20 bp, Artificial
  CRISPR gRNA sequence
ctaggagcagggagttgctt

SEQ ID NO: 87676 - DNA, 20 bp, Artificial
  CRISPR gRNA sequence
ggagcagggagttgcttggg

SEQ ID NO: 87677 - DNA, 20 bp, Artificial
  CRISPR gRNA sequence
gcttgggtggccgctaacac

SEQ ID NO: 87678 - DNA, 20 bp, Artificial
  CRISPR gRNA sequence
cttgggtggccgctaacacc

SEQ ID NO: 87679 - DNA, 20 bp, Artificial
  CRISPR gRNA sequence
acaccaggctactcttattt

SEQ ID NO: 87680 - DNA, 20 bp, Artificial
  CRISPR gRNA sequence
tactcttattttagcttgct

SEQ ID NO: 87681 - DNA, 20 bp, Artificial
  CRISPR gRNA sequence
ttattttagcttgctaagtt

SEQ ID NO: 87682 - DNA, 20 bp, Artificial
  CRISPR gRNA sequence
ttagcttgctaagttgagat

SEQ ID NO: 87683 - DNA, 20 bp, Artificial
  CRISPR gRNA sequence
cttgctaagttgagatcagc

SEQ ID NO: 87684 - DNA, 20 bp, Artificial
  CRISPR gRNA sequence
gacctgctttcttttctcct

SEQ ID NO: 87685 - DNA, 20 bp, Artificial
  CRISPR gRNA sequence
tcttgcatttccctcaatac

SEQ ID NO: 87686 - DNA, 20 bp, Artificial
  CRISPR gRNA sequence
atttccctcaatacaagctg

SEQ ID NO: 87687 - DNA, 20 bp, Artificial
  CRISPR gRNA sequence
gtagcctctttcctcgtttc

SEQ ID NO: 87688 - DNA, 20 bp, Artificial
  CRISPR gRNA sequence
tctttcctcgtttctagtct

SEQ ID NO: 87689 - DNA, 20 bp, Artificial
  CRISPR gRNA sequence
ttcctcgtttctagtctcag

SEQ ID NO: 87690 - DNA, 20 bp, Artificial
  CRISPR gRNA sequence
tcctcgtttctagtctcaga

SEQ ID NO: 87691 - DNA, 20 bp, Artificial
  CRISPR gRNA sequence
tcgtttctagtctcagaagg

SEQ ID NO: 87692 - DNA, 20 bp, Artificial
  CRISPR gRNA sequence
cgtttctagtctcagaagga

SEQ ID NO: 87693 - DNA, 20 bp, Artificial
  CRISPR gRNA sequence
tttctagtctcagaaggaag

SEQ ID NO: 87694 - DNA, 20 bp, Artificial
  CRISPR gRNA sequence
tctagtctcagaaggaagga

SEQ ID NO: 87695 - DNA, 20 bp, Artificial
  CRISPR gRNA sequence
ctagtctcagaaggaaggag

SEQ ID NO: 87696 - DNA, 20 bp, Artificial
  CRISPR gRNA sequence
tagtctcagaaggaaggaga

SEQ ID NO: 87697 - DNA, 20 bp, Artificial
  CRISPR gRNA sequence
tctcagaaggaaggagaggg

SEQ ID NO: 87698 - DNA, 20 bp, Artificial
  CRISPR gRNA sequence
agagggaagccattctcctc

SEQ ID NO: 87699 - DNA, 20 bp, Artificial
  CRISPR gRNA sequence
gagggaagccattctcctct

SEQ ID NO: 87700 - DNA, 20 bp, Artificial
  CRISPR gRNA sequence
agggaagccattctcctcta

SEQ ID NO: 87701 - DNA, 20 bp, Artificial
  CRISPR gRNA sequence
attctcctctagggactctt

SEQ ID NO: 87702 - DNA, 20 bp, Artificial
  CRISPR gRNA sequence
agggactcttcagtctcatt

SEQ ID NO: 87703 - DNA, 20 bp, Artificial
  CRISPR gRNA sequence
cttcagtctcatttagatga

SEQ ID NO: 87704 - DNA, 20 bp, Artificial
  CRISPR gRNA sequence
ctttttttctacctccatat

SEQ ID NO: 87705 - DNA, 20 bp, Artificial
  CRISPR gRNA sequence
ttttttctacctccatatta

SEQ ID NO: 87706 - DNA, 20 bp, Artificial
  CRISPR gRNA sequence
ttctacctccatattagaga

SEQ ID NO: 87707 - DNA, 20 bp, Artificial
  CRISPR gRNA sequence
ctacctccatattagagatg

SEQ ID NO: 87708 - DNA, 20 bp, Artificial
  CRISPR gRNA sequence
cttccctctcaccctattgc

SEQ ID NO: 87709 - DNA, 20 bp, Artificial
  CRISPR gRNA sequence
ctattgccagttccaccaac

SEQ ID NO: 87710 - DNA, 20 bp, Artificial
  CRISPR gRNA sequence
attgccagttccaccaacta

SEQ ID NO: 87711 - DNA, 20 bp, Artificial
  CRISPR gRNA sequence
agttccaccaactagagtga

SEQ ID NO: 87712 - DNA, 20 bp, Artificial
  CRISPR gRNA sequence
aactagagtgaaagacttcc

SEQ ID NO: 87713 - DNA, 20 bp, Artificial
  CRISPR gRNA sequence
taaatctattctgtatccac

SEQ ID NO: 87714 - DNA, 20 bp, Artificial
  CRISPR gRNA sequence
aaatctattctgtatccacc

SEQ ID NO: 87715 - DNA, 20 bp, Artificial
  CRISPR gRNA sequence
tctattctgtatccaccagg

SEQ ID NO: 87716 - DNA, 20 bp, Artificial
  CRISPR gRNA sequence
attctgtatccaccaggtgg

SEQ ID NO: 87717 - DNA, 20 bp, Artificial
  CRISPR gRNA sequence
cagcatcttgtcatacgtgt

SEQ ID NO: 87718 - DNA, 20 bp, Artificial
  CRISPR gRNA sequence
agcatcttgtcatacgtgtc

SEQ ID NO: 87719 - DNA, 20 bp, Artificial
  CRISPR gRNA sequence
ttgtcatacgtgtcaggact

SEQ ID NO: 87720 - DNA, 20 bp, Artificial
  CRISPR gRNA sequence
tgtcatacgtgtcaggactt

SEQ ID NO: 87721 - DNA, 20 bp, Artificial
  CRISPR gRNA sequence
cgtgtcaggacttaggactg

SEQ ID NO: 87722 - DNA, 20 bp, Artificial
  CRISPR gRNA sequence
gtgtcaggacttaggactgc

SEQ ID NO: 87723 - DNA, 20 bp, Artificial
  CRISPR gRNA sequence
tgtcaggacttaggactgcg

SEQ ID NO: 87724 - DNA, 20 bp, Artificial
  CRISPR gRNA sequence
ggacttaggactgcggggtt

SEQ ID NO: 87725 - DNA, 20 bp, Artificial
  CRISPR gRNA sequence
gacttaggactgcggggttt

SEQ ID NO: 87726 - DNA, 20 bp, Artificial
  CRISPR gRNA sequence
taggactgcggggtttaggt

SEQ ID NO: 87727 - DNA, 20 bp, Artificial
  CRISPR gRNA sequence
ggggtttaggttagatgtca

SEQ ID NO: 87728 - DNA, 20 bp, Artificial
  CRISPR gRNA sequence
taggttagatgtcacggaaa

SEQ ID NO: 87729 - DNA, 20 bp, Artificial
  CRISPR gRNA sequence
ttagatgtcacggaaaaagc

SEQ ID NO: 87730 - DNA, 20 bp, Artificial
  CRISPR gRNA sequence
cacggaaaaagctagttctg

SEQ ID NO: 87731 - DNA, 20 bp, Artificial
  CRISPR gRNA sequence
gaaaaagctagttctgtggt

SEQ ID NO: 87732 - DNA, 20 bp, Artificial
  CRISPR gRNA sequence
aaaaagctagttctgtggtc

SEQ ID NO: 87733 - DNA, 20 bp, Artificial
  CRISPR gRNA sequence
aagctagttctgtggtcagg

SEQ ID NO: 87734 - DNA, 20 bp, Artificial
  CRISPR gRNA sequence
tgtggtcaggcggcaccaat

SEQ ID NO: 87735 - DNA, 20 bp, Artificial
  CRISPR gRNA sequence
gtcaggcggcaccaatgaga

SEQ ID NO: 87736 - DNA, 20 bp, Artificial
  CRISPR gRNA sequence
tcaggcggcaccaatgagaa

SEQ ID NO: 87737 - DNA, 20 bp, Artificial
  CRISPR gRNA sequence
gcaccaatgagaaaggaatg

SEQ ID NO: 87738 - DNA, 20 bp, Artificial
  CRISPR gRNA sequence
agaaaggaatgcagaccctc

SEQ ID NO: 87739 - DNA, 20 bp, Artificial
  CRISPR gRNA sequence
agaccctccagatgtatcct

SEQ ID NO: 87740 - DNA, 20 bp, Artificial
  CRISPR gRNA sequence
gaccctccagatgtatcctt

SEQ ID NO: 87741 - DNA, 20 bp, Artificial
  CRISPR gRNA sequence
tccagatgtatccttgggaa

SEQ ID NO: 87742 - DNA, 20 bp, Artificial
  CRISPR gRNA sequence
agatgtatccttgggaaaag

SEQ ID NO: 87743 - DNA, 20 bp, Artificial
  CRISPR gRNA sequence
aaaccaactaatatttattg

SEQ ID NO: 87744 - DNA, 20 bp, Artificial
  CRISPR gRNA sequence
gacctactttgtcctctaca

SEQ ID NO: 87745 - DNA, 20 bp, Artificial
  CRISPR gRNA sequence
acctactttgtcctctacat

SEQ ID NO: 87746 - DNA, 20 bp, Artificial
  CRISPR gRNA sequence
cctactttgtcctctacata

SEQ ID NO: 87747 - DNA, 20 bp, Artificial
  CRISPR gRNA sequence
actttgtcctctacataggg

SEQ ID NO: 87748 - DNA, 20 bp, Artificial
  CRISPR gRNA sequence
ctacatagggtagcttctgt

SEQ ID NO: 87749 - DNA, 20 bp, Artificial
  CRISPR gRNA sequence
tacatagggtagcttctgtc

SEQ ID NO: 87750 - DNA, 20 bp, Artificial
  CRISPR gRNA sequence
acatagggtagcttctgtca

SEQ ID NO: 87751 - DNA, 20 bp, Artificial
  CRISPR gRNA sequence
tagcttctgtcagggaatct

SEQ ID NO: 87752 - DNA, 20 bp, Artificial
  CRISPR gRNA sequence
agggaatcttggttcttccc

SEQ ID NO: 87753 - DNA, 20 bp, Artificial
  CRISPR gRNA sequence
aagaaacactgattttcttt

SEQ ID NO: 87754 - DNA, 20 bp, Artificial
  CRISPR gRNA sequence
agaaacactgattttctttc

SEQ ID NO: 87755 - DNA, 20 bp, Artificial
  CRISPR gRNA sequence
gaaacactgattttctttca

SEQ ID NO: 87756 - DNA, 20 bp, Artificial
  CRISPR gRNA sequence
aacactgattttctttcagg

SEQ ID NO: 87757 - DNA, 20 bp, Artificial
  CRISPR gRNA sequence
gtgttcatttatttccacca

SEQ ID NO: 87758 - DNA, 20 bp, Artificial
  CRISPR gRNA sequence
ttcatttatttccaccacag

SEQ ID NO: 87759 - DNA, 20 bp, Artificial
  CRISPR gRNA sequence
tttccaccacagcagatttt

SEQ ID NO: 87760 - DNA, 20 bp, Artificial
  CRISPR gRNA sequence
tgtaatatttgatatctata

SEQ ID NO: 87761 - DNA, 20 bp, Artificial
  CRISPR gRNA sequence
taatatttgatatctataaa

SEQ ID NO: 87762 - DNA, 20 bp, Artificial
  CRISPR gRNA sequence
tctaacgtgaataaattatg

SEQ ID NO: 87763 - DNA, 20 bp, Artificial
  CRISPR gRNA sequence
aaattatgaagcatactaat

SEQ ID NO: 87764 - DNA, 20 bp, Artificial
  CRISPR gRNA sequence
attgtgtttgtgttcctccc

SEQ ID NO: 87765 - DNA, 20 bp, Artificial
  CRISPR gRNA sequence
gcctgtcccccgcctcttct

SEQ ID NO: 87766 - DNA, 20 bp, Artificial
  CRISPR gRNA sequence
tgtcccccgcctcttcttag

SEQ ID NO: 87767 - DNA, 20 bp, Artificial
  CRISPR gRNA sequence
ttcgtgtctattatctgcta

SEQ ID NO: 87768 - DNA, 20 bp, Artificial
  CRISPR gRNA sequence
tgttttaatgtatatgtgtt

SEQ ID NO: 87769 - DNA, 20 bp, Artificial
  CRISPR gRNA sequence
gttggtttactgcttttccc

SEQ ID NO: 87770 - DNA, 20 bp, Artificial
  CRISPR gRNA sequence
ttttcccaaggatacatctg

SEQ ID NO: 87771 - DNA, 20 bp, Artificial
  CRISPR gRNA sequence
tgacaagatgctgccacctg

SEQ ID NO: 87772 - DNA, 20 bp, Artificial
  CRISPR gRNA sequence
atgctgccacctggtggata

SEQ ID NO: 87773 - DNA, 20 bp, Artificial
  CRISPR gRNA sequence
ctagttggtggaactggcaa

SEQ ID NO: 87774 - DNA, 20 bp, Artificial
  CRISPR gRNA sequence
caatagggtgagagggaagc

SEQ ID NO: 87775 - DNA, 20 bp, Artificial
  CRISPR gRNA sequence
ctatcatctaaatgagactg

SEQ ID NO: 87776 - DNA, 20 bp, Artificial
  CRISPR gRNA sequence
agactgaagagtccctagag

SEQ ID NO: 87777 - DNA, 20 bp, Artificial
  CRISPR gRNA sequence
tcaacttagcaagctaaaat

SEQ ID NO: 87778 - DNA, 20 bp, Artificial
  CRISPR gRNA sequence
ctgctcctagtttccacttg

SEQ ID NO: 87779 - DNA, 20 bp, Artificial
  CRISPR gRNA sequence
caaaggtgttgtccatgata

SEQ ID NO: 87780 - DNA, 20 bp, Artificial
  CRISPR gRNA sequence
tcctggccacagtgattggt

SEQ ID NO: 87781 - DNA, 20 bp, Artificial
  CRISPR gRNA sequence
gtgacccaggcctaatcagt

SEQ ID NO: 87782 - DNA, 20 bp, Artificial
  CRISPR gRNA sequence
atggggaaaagtgtaatctt

SEQ ID NO: 87783 - DNA, 20 bp, Artificial
  CRISPR gRNA sequence
tttagagacatactgaacta

SEQ ID NO: 87784 - DNA, 20 bp, Artificial
  CRISPR gRNA sequence
cctttttattttaagccagt

SEQ ID NO: 87785 - DNA, 20 bp, Artificial
  CRISPR gRNA sequence
agcccattcctaccttccca

SEQ ID NO: 87786 - DNA, 20 bp, Artificial
  CRISPR gRNA sequence
ccttcccacaggatagcaca

SEQ ID NO: 87787 - DNA, 20 bp, Artificial
  CRISPR gRNA sequence
ttattggttacactaaagcc

SEQ ID NO: 87788 - DNA, 20 bp, Artificial
  CRISPR gRNA sequence
gcaaccaggtactaagtaga

SEQ ID NO: 87789 - DNA, 20 bp, Artificial
  CRISPR gRNA sequence
actcagctgtctgtacagag

SEQ ID NO: 87790 - DNA, 20 bp, Artificial
  CRISPR gRNA sequence
agaatggacttccttaggaa

SEQ ID NO: 87791 - DNA, 20 bp, Artificial
  CRISPR gRNA sequence
ctactaggcaaagttaacgt

SEQ ID NO: 87792 - DNA, 20 bp, Artificial
  CRISPR gRNA sequence
tccccacagacctgtatcat

SEQ ID NO: 87793 - DNA, 20 bp, Artificial
  CRISPR gRNA sequence
gtatcatgggggtgttgctt

SEQ ID NO: 87794 - DNA, 20 bp, Artificial
  CRISPR gRNA sequence
cttttgggtctttatgctcc

SEQ ID NO: 87795 - DNA, 20 bp, Artificial
  CRISPR gRNA sequence
ctcacttttgaggggaccaa

SEQ ID NO: 87796 - DNA, 20 bp, Artificial
  CRISPR gRNA sequence
tggcctctctgcccctccag

SEQ ID NO: 87797 - DNA, 20 bp, Artificial
  CRISPR gRNA sequence
atggcagctgctgacttgag

SEQ ID NO: 87798 - DNA, 20 bp, Artificial
  CRISPR gRNA sequence
agctgctgacttgagagggg

SEQ ID NO: 87799 - DNA, 20 bp, Artificial
  CRISPR gRNA sequence
ctgttctctgtgccccgggg

SEQ ID NO: 87800 - DNA, 20 bp, Artificial
  CRISPR gRNA sequence
tctctgtgccccggggctga

SEQ ID NO: 87801 - DNA, 20 bp, Artificial
  CRISPR gRNA sequence
taatgatgggcacagctgct

SEQ ID NO: 87802 - DNA, 20 bp, Artificial
  CRISPR gRNA sequence
cctgaagaaagcctgggggc

SEQ ID NO: 87803 - DNA, 20 bp, Artificial
  CRISPR gRNA sequence
gccagaataggtggagagac

SEQ ID NO: 87804 - DNA, 20 bp, Artificial
  CRISPR gRNA sequence
ggtggagagactgggattgg

SEQ ID NO: 87805 - DNA, 20 bp, Artificial
  CRISPR gRNA sequence
gaggaacacagtaaggtgtg

SEQ ID NO: 87806 - DNA, 20 bp, Artificial
  CRISPR gRNA sequence
aacacagtaaggtgtgaaga

SEQ ID NO: 87807 - DNA, 20 bp, Artificial
  CRISPR gRNA sequence
agcaagggacccaattggag

SEQ ID NO: 87808 - DNA, 20 bp, Artificial
  CRISPR gRNA sequence
cttcttgtgggctccaccct

SEQ ID NO: 87809 - DNA, 20 bp, Artificial
  CRISPR gRNA sequence
cagaggtaccaaaaaggtaa

SEQ ID NO: 87810 - DNA, 20 bp, Artificial
  CRISPR gRNA sequence
tgaaggtgaggaggaaactg

SEQ ID NO: 87811 - DNA, 20 bp, Artificial
  CRISPR gRNA sequence
aggaggaaactgaggaatag

SEQ ID NO: 87812 - DNA, 20 bp, Artificial
  CRISPR gRNA sequence
tgactggtagagacaggaaa

SEQ ID NO: 87813 - DNA, 20 bp, Artificial
  CRISPR gRNA sequence
ggtgctaaagcatgtcttag

SEQ ID NO: 87814 - DNA, 20 bp, Artificial
  CRISPR gRNA sequence
cactgaagctgaaagtggct

SEQ ID NO: 87815 - DNA, 20 bp, Artificial
  CRISPR gRNA sequence
agggttgctgagacataaga

SEQ ID NO: 87816 - DNA, 20 bp, Artificial
  CRISPR gRNA sequence
atggaactgaaggaccgttt

SEQ ID NO: 87817 - DNA, 20 bp, Artificial
  CRISPR gRNA sequence
accagttcatctcgaggtgc

SEQ ID NO: 87818 - DNA, 20 bp, Artificial
  CRISPR gRNA sequence
accaaagctgagaccagact

SEQ ID NO: 87819 - DNA, 20 bp, Artificial
  CRISPR gRNA sequence
gctgagaccagactggggat

SEQ ID NO: 87820 - DNA, 20 bp, Artificial
  CRISPR gRNA sequence
ttcatcctctgcctcagcta

SEQ ID NO: 87821 - DNA, 20 bp, Artificial
  CRISPR gRNA sequence
ctgacttttacctgggagag

SEQ ID NO: 87822 - DNA, 20 bp, Artificial
  CRISPR gRNA sequence
ttttacctgggagagaagag

SEQ ID NO: 87823 - DNA, 20 bp, Artificial
  CRISPR gRNA sequence
cctttaggtcaagtccaggc

SEQ ID NO: 87824 - DNA, 20 bp, Artificial
  CRISPR gRNA sequence
cacccccaacctctctagtc

SEQ ID NO: 87825 - DNA, 20 bp, Artificial
  CRISPR gRNA sequence
tcttgccaaagttggctgtg

SEQ ID NO: 87826 - DNA, 20 bp, Artificial
  CRISPR gRNA sequence
caagactctcacagtacttc

SEQ ID NO: 87827 - DNA, 20 bp, Artificial
  CRISPR gRNA sequence
cttcctgagtgagaggggag

SEQ ID NO: 87828 - DNA, 20 bp, Artificial
  CRISPR gRNA sequence
gatactcagagaaggaggcc

SEQ ID NO: 87829 - DNA, 20 bp, Artificial
  CRISPR gRNA sequence
ggaggccatgggtaggctcg

SEQ ID NO: 87830 - DNA, 20 bp, Artificial
  CRISPR gRNA sequence
ggtaggctcgaagagtccct

SEQ ID NO: 87831 - DNA, 20 bp, Artificial
  CRISPR gRNA sequence
atcaaggcaggaagctcttc

SEQ ID NO: 87832 - DNA, 20 bp, Artificial
  CRISPR gRNA sequence
aggaagctcttcatgggtga

SEQ ID NO: 87833 - DNA, 20 bp, Artificial
  CRISPR gRNA sequence
gtgtgctcttccaggtggtt

SEQ ID NO: 87834 - DNA, 20 bp, Artificial
  CRISPR gRNA sequence
tggaccaaatttagttcacc

SEQ ID NO: 87835 - DNA, 20 bp, Artificial
  CRISPR gRNA sequence
cttcatcaaggacagcattt

SEQ ID NO: 87836 - DNA, 20 bp, Artificial
  CRISPR gRNA sequence
ttcccagtgaacctttctct

SEQ ID NO: 87837 - DNA, 20 bp, Artificial
  CRISPR gRNA sequence
cctaccttttgtctccagtg

SEQ ID NO: 87838 - DNA, 20 bp, Artificial
  CRISPR gRNA sequence
accaaagtctagctgactta

SEQ ID NO: 87839 - DNA, 20 bp, Artificial
  CRISPR gRNA sequence
aaaatacaaaaaaaaattag

SEQ ID NO: 87840 - DNA, 20 bp, Artificial
  CRISPR gRNA sequence
tacttgggaggctgaggcag

SEQ ID NO: 87841 - DNA, 20 bp, Artificial
  CRISPR gRNA sequence
ctgcactccagcctaggcga

SEQ ID NO: 87842 - DNA, 20 bp, Artificial
  CRISPR gRNA sequence
atggagaggagggaagtaga

SEQ ID NO: 87843 - DNA, 20 bp, Artificial
  CRISPR gRNA sequence
ctcttccccaacacacttac

SEQ ID NO: 87844 - DNA, 20 bp, Artificial
  CRISPR gRNA sequence
gaaatgcccagcaggtgctc

SEQ ID NO: 87845 - DNA, 20 bp, Artificial
  CRISPR gRNA sequence
cagccaaagtgaagtgctgc

SEQ ID NO: 87846 - DNA, 20 bp, Artificial
  CRISPR gRNA sequence
ggacaggacttggagatgtg

SEQ ID NO: 87847 - DNA, 20 bp, Artificial
  CRISPR gRNA sequence
gtacctcggagcctctgaag

SEQ ID NO: 87848 - DNA, 20 bp, Artificial
  CRISPR gRNA sequence
tgccatcccggcatgagggc

SEQ ID NO: 87849 - DNA, 20 bp, Artificial
  CRISPR gRNA sequence
gagaaacagaaacaaagcct

SEQ ID NO: 87850 - DNA, 20 bp, Artificial
  CRISPR gRNA sequence
aactgtaaaggaagagatag

SEQ ID NO: 87851 - DNA, 20 bp, Artificial
  CRISPR gRNA sequence
aaggaagagatagggggatt

SEQ ID NO: 87852 - DNA, 20 bp, Artificial
  CRISPR gRNA sequence
catatgcctgggaggtcaga

SEQ ID NO: 87853 - DNA, 20 bp, Artificial
  CRISPR gRNA sequence
cggtttctgcaaagtggagc

SEQ ID NO: 87854 - DNA, 20 bp, Artificial
  CRISPR gRNA sequence
cgctccactttgcagaaacc

SEQ ID NO: 87855 - DNA, 20 bp, Artificial
  CRISPR gRNA sequence
cactttgcagaaaccgggga

SEQ ID NO: 87856 - DNA, 20 bp, Artificial
  CRISPR gRNA sequence
aaggaggtgggggcgcgcct

SEQ ID NO: 87857 - DNA, 20 bp, Artificial
  CRISPR gRNA sequence
tttttccaagcctagaaggg

SEQ ID NO: 87858 - DNA, 20 bp, Artificial
  CRISPR gRNA sequence
cccaggcatatgcaatggtg

SEQ ID NO: 87859 - DNA, 20 bp, Artificial
  CRISPR gRNA sequence
caatggtgaggagtattttt

SEQ ID NO: 87860 - DNA, 20 bp, Artificial
  CRISPR gRNA sequence
tgagggggaggagggcagta

SEQ ID NO: 87861 - DNA, 20 bp, Artificial
  CRISPR gRNA sequence
aatgaaaatttcttgctaac

SEQ ID NO: 87862 - DNA, 20 bp, Artificial
  CRISPR gRNA sequence
cttcagaaaggtggggcaga

SEQ ID NO: 87863 - DNA, 20 bp, Artificial
  CRISPR gRNA sequence
atatgggcctggcgaagtaa

SEQ ID NO: 87864 - DNA, 20 bp, Artificial
  CRISPR gRNA sequence
gtttctgtttctctgccttt

SEQ ID NO: 87865 - DNA, 20 bp, Artificial
  CRISPR gRNA sequence
cctttctgggtaaagagatg

SEQ ID NO: 87866 - DNA, 20 bp, Artificial
  CRISPR gRNA sequence
ctggggaagggaaggccagt

SEQ ID NO: 87867 - DNA, 20 bp, Artificial
  CRISPR gRNA sequence
ctcaattctagccctcatgc

SEQ ID NO: 87868 - DNA, 20 bp, Artificial
  CRISPR gRNA sequence
ctccaagtcctgtccaagac

SEQ ID NO: 87869 - DNA, 20 bp, Artificial
  CRISPR gRNA sequence
gccgtgcagaacaaagtaga

SEQ ID NO: 87870 - DNA, 20 bp, Artificial
  CRISPR gRNA sequence
gttggggaagagggcaagag

SEQ ID NO: 87871 - DNA, 20 bp, Artificial
  CRISPR gRNA sequence
ggatggaaatgctgagggag

SEQ ID NO: 87872 - DNA, 20 bp, Artificial
  CRISPR gRNA sequence
atgctgagggaggaggatgt

SEQ ID NO: 87873 - DNA, 20 bp, Artificial
  CRISPR gRNA sequence
aaacattgatgtgggagagg

SEQ ID NO: 87874 - DNA, 20 bp, Artificial
  CRISPR gRNA sequence
ttttttttttttttttgaga

SEQ ID NO: 87875 - DNA, 20 bp, Artificial
  CRISPR gRNA sequence
tctcactctgtcgcctaggc

SEQ ID NO: 87876 - DNA, 20 bp, Artificial
  CRISPR gRNA sequence
ttttgtatttttagtagaaa

SEQ ID NO: 87877 - DNA, 20 bp, Artificial
  CRISPR gRNA sequence
cggggtttcaccatgttagc

SEQ ID NO: 87878 - DNA, 20 bp, Artificial
  CRISPR gRNA sequence
gccttggccttccaaagtgc

SEQ ID NO: 87879 - DNA, 20 bp, Artificial
  CRISPR gRNA sequence
agtcagctagactttggtgt

SEQ ID NO: 87880 - DNA, 20 bp, Artificial
  CRISPR gRNA sequence
agactttggtgtggggatca

SEQ ID NO: 87881 - DNA, 20 bp, Artificial
  CRISPR gRNA sequence
ggggatcagagggtcctata

SEQ ID NO: 87882 - DNA, 20 bp, Artificial
  CRISPR gRNA sequence
tagagaaaggttcactggga

SEQ ID NO: 87883 - DNA, 20 bp, Artificial
  CRISPR gRNA sequence
gttcactgggaaggggtgag

SEQ ID NO: 87884 - DNA, 20 bp, Artificial
  CRISPR gRNA sequence
tgggaaggggtgaggtgaat

SEQ ID NO: 87885 - DNA, 20 bp, Artificial
  CRISPR gRNA sequence
ttaccagggaaagttagatt

SEQ ID NO: 87886 - DNA, 20 bp, Artificial
  CRISPR gRNA sequence
ggaagaaccaggacaactgt

SEQ ID NO: 87887 - DNA, 20 bp, Artificial
  CRISPR gRNA sequence
gccaagtacactgagcaatg

SEQ ID NO: 87888 - DNA, 20 bp, Artificial
  CRISPR gRNA sequence
gagtacatgtatgcctatag

SEQ ID NO: 87889 - DNA, 20 bp, Artificial
  CRISPR gRNA sequence
agtgtttatgatgcctatcg

SEQ ID NO: 87890 - DNA, 20 bp, Artificial
  CRISPR gRNA sequence
tgatgcctatcggtgggtgg

SEQ ID NO: 87891 - DNA, 20 bp, Artificial
  CRISPR gRNA sequence
gcctatcggtgggtggaggg

SEQ ID NO: 87892 - DNA, 20 bp, Artificial
  CRISPR gRNA sequence
gtgggtggaggggtgggtgg

SEQ ID NO: 87893 - DNA, 20 bp, Artificial
  CRISPR gRNA sequence
gtggaggggtgggtggtggg

SEQ ID NO: 87894 - DNA, 20 bp, Artificial
  CRISPR gRNA sequence
aggggtgggtggtgggatga

SEQ ID NO: 87895 - DNA, 20 bp, Artificial
  CRISPR gRNA sequence
tgataaagcctgccttctta

SEQ ID NO: 87896 - DNA, 20 bp, Artificial
  CRISPR gRNA sequence
cctacccatggcctccttct

SEQ ID NO: 87897 - DNA, 20 bp, Artificial
  CRISPR gRNA sequence
tctcactcaggaagtactgt

SEQ ID NO: 87898 - DNA, 20 bp, Artificial
  CRISPR gRNA sequence
tatccttgactagagaggtt

SEQ ID NO: 87899 - DNA, 20 bp, Artificial
  CRISPR gRNA sequence
gaggacctgggaggaagact

SEQ ID NO: 87900 - DNA, 20 bp, Artificial
  CRISPR gRNA sequence
gacttaggatgtggagagca

SEQ ID NO: 87901 - DNA, 20 bp, Artificial
  CRISPR gRNA sequence
ccctgcctggacttgaccta

SEQ ID NO: 87902 - DNA, 20 bp, Artificial
  CRISPR gRNA sequence
gacttgacctaaagggttct

SEQ ID NO: 87903 - DNA, 20 bp, Artificial
  CRISPR gRNA sequence
ccaaccctgtagctgaggca

SEQ ID NO: 87904 - DNA, 20 bp, Artificial
  CRISPR gRNA sequence
gaacttgtgggcttctgcaa

SEQ ID NO: 87905 - DNA, 20 bp, Artificial
  CRISPR gRNA sequence
tctctgacaagagaggaggc

SEQ ID NO: 87906 - DNA, 20 bp, Artificial
  CRISPR gRNA sequence
gaggcaagggttctttaatt

SEQ ID NO: 87907 - DNA, 20 bp, Artificial
  CRISPR gRNA sequence
ctgacctgtgactgggcaga

SEQ ID NO: 87908 - DNA, 20 bp, Artificial
  CRISPR gRNA sequence
tcagtggccctcccacacac

SEQ ID NO: 87909 - DNA, 20 bp, Artificial
  CRISPR gRNA sequence
cacactagaatagagacacc

SEQ ID NO: 87910 - DNA, 20 bp, Artificial
  CRISPR gRNA sequence
gtctctaccagtcagtcaat

SEQ ID NO: 87911 - DNA, 20 bp, Artificial
  CRISPR gRNA sequence
gggaacggtcatctaaacca

SEQ ID NO: 87912 - DNA, 20 bp, Artificial
  CRISPR gRNA sequence
agaatggtttagagaaccca

SEQ ID NO: 87913 - DNA, 20 bp, Artificial
  CRISPR gRNA sequence
cttagtatatccttctccaa

SEQ ID NO: 87914 - DNA, 20 bp, Artificial
  CRISPR gRNA sequence
tctttactttttagcctcct

SEQ ID NO: 87915 - DNA, 20 bp, Artificial
  CRISPR gRNA sequence
tcgcacgtggagagcggaag

SEQ ID NO: 87916 - DNA, 20 bp, Artificial
  CRISPR gRNA sequence
gtgaccaaggaccacatgac

SEQ ID NO: 87917 - DNA, 20 bp, Artificial
  CRISPR gRNA sequence
agaggacagctgaagtacct

SEQ ID NO: 87918 - DNA, 20 bp, Artificial
  CRISPR gRNA sequence
caccagctaaagcagcaaag

SEQ ID NO: 87919 - DNA, 20 bp, Artificial
  CRISPR gRNA sequence
aagcagcaaagcaggatata

SEQ ID NO: 87920 - DNA, 20 bp, Artificial
  CRISPR gRNA sequence
agtcaggtggaagtggggaa

SEQ ID NO: 87921 - DNA, 20 bp, Artificial
  CRISPR gRNA sequence
tctcaagtcagcagctgcca

SEQ ID NO: 87922 - DNA, 20 bp, Artificial
  CRISPR gRNA sequence
aaaagggggcagtacttgcc

SEQ ID NO: 87923 - DNA, 20 bp, Artificial
  CRISPR gRNA sequence
ttcccttggtcccctcaaaa

SEQ ID NO: 87924 - DNA, 20 bp, Artificial
  CRISPR gRNA sequence
gagaggtagacactgcacca

SEQ ID NO: 87925 - DNA, 20 bp, Artificial
  CRISPR gRNA sequence
catgatacaggtctgtgggg

SEQ ID NO: 87926 - DNA, 20 bp, Artificial
  CRISPR gRNA sequence
attctcctctgtacagacag

SEQ ID NO: 87927 - DNA, 20 bp, Artificial
  CRISPR gRNA sequence
gtgctatcctgtgggaaggt

SEQ ID NO: 87928 - DNA, 20 bp, Artificial
  CRISPR gRNA sequence
gtaggaatgggctaagtatg

SEQ ID NO: 87929 - DNA, 20 bp, Artificial
  CRISPR gRNA sequence
gtatgatgaatatataggtt

SEQ ID NO: 87930 - DNA, 20 bp, Artificial
  CRISPR gRNA sequence
tcaaactggcttaaaataaa

SEQ ID NO: 87931 - DNA, 20 bp, Artificial
  CRISPR gRNA sequence
aatattcacactgattaggc

SEQ ID NO: 87932 - DNA, 20 bp, Artificial
  CRISPR gRNA sequence
tgaccaatcactgtggccag

SEQ ID NO: 87933 - DNA, 20 bp, Artificial
  CRISPR gRNA sequence
tggacaacacctttggggaa

SEQ ID NO: 87934 - DNA, 20 bp, Artificial
  CRISPR gRNA sequence
acacctttggggaaaagggt

SEQ ID NO: 87935 - DNA, 20 bp, Artificial
  CRISPR gRNA sequence
gtcagcctccccaaaatcac

SEQ ID NO: 87936 - DNA, 20 bp, Artificial
  CRISPR gRNA sequence
ccaagtggaaactaggagca

SEQ ID NO: 87937 - DNA, 20 bp, Artificial
  CRISPR gRNA sequence
aactaggagcagggagttgc

SEQ ID NO: 87938 - DNA, 20 bp, Artificial
  CRISPR gRNA sequence
ctattgccagttccaccaac

SEQ ID NO: 87939 - DNA, 20 bp, Artificial
  CRISPR gRNA sequence
cgtgtcaggacttaggactg

SEQ ID NO: 87940 - DNA, 20 bp, Artificial
  CRISPR gRNA sequence
tcaggcggcaccaatgagaa

SEQ ID NO: 87941 - DNA, 20 bp, Artificial
  CRISPR gRNA sequence
gacctactttgtcctctaca

SEQ ID NO: 87942 - DNA, 20 bp, Artificial
  CRISPR gRNA sequence
acatagggtagcttctgtca

SEQ ID NO: 87943 - DNA, 20 bp, Artificial
  CRISPR gRNA sequence
tgtaatatttgatatctata

SEQ ID NO: 87944 - DNA, 20 bp, Artificial
  CRISPR gRNA sequence
ctataaagagtatatctaac

SEQ ID NO: 87945 - DNA, 20 bp, Artificial
  CRISPR gRNA sequence
ataaattatgaagcatacta

SEQ ID NO: 87946 - DNA, 20 bp, Artificial
  CRISPR gRNA sequence
cacaaacacaatggtattta

SEQ ID NO: 87947 - DNA, 20 bp, Artificial
  CRISPR gRNA sequence
tgggtcataggtactcatta

SEQ ID NO: 87948 - DNA, 20 bp, Artificial
  CRISPR gRNA sequence
aagtctccctgaaagaaaat

SEQ ID NO: 87949 - DNA, 20 bp, Artificial
  CRISPR gRNA sequence
tcagtgtttcttgggaagaa

SEQ ID NO: 87950 - DNA, 20 bp, Artificial
  CRISPR gRNA sequence
taggtcttcaataaatatta

SEQ ID NO: 87951 - DNA, 20 bp, Artificial
  CRISPR gRNA sequence
tcaataaatattagttggtt

SEQ ID NO: 87952 - DNA, 20 bp, Artificial
  CRISPR gRNA sequence
tggtgccgcctgaccacaga

SEQ ID NO: 87953 - DNA, 20 bp, Artificial
  CRISPR gRNA sequence
ctgccacctggtggatacag

SEQ ID NO: 87954 - DNA, 20 bp, Artificial
  CRISPR gRNA sequence
ctgaagagtccctagaggag

SEQ ID NO: 87955 - DNA, 20 bp, Artificial
  CRISPR gRNA sequence
ctagaaacgaggaaagaggc

SEQ ID NO: 87956 - DNA, 20 bp, Artificial
  CRISPR gRNA sequence
cacccaagcaactccctgct

SEQ ID NO: 87957 - DNA, 20 bp, Artificial
  CRISPR gRNA sequence
agtttccacttggggaatcc

SEQ ID NO: 87958 - DNA, 20 bp, Artificial
  CRISPR gRNA sequence
atgtatcatcctcctggcca

SEQ ID NO: 87959 - DNA, 20 bp, Artificial
  CRISPR gRNA sequence
ggcctaatcagtgtgaatat

SEQ ID NO: 87960 - DNA, 20 bp, Artificial
  CRISPR gRNA sequence
tgtgaatattagggcttttg

SEQ ID NO: 87961 - DNA, 20 bp, Artificial
  CRISPR gRNA sequence
ggtacaaagatgccttcttt

SEQ ID NO: 87962 - DNA, 20 bp, Artificial
  CRISPR gRNA sequence
ataaatcctttttattttaa

SEQ ID NO: 87963 - DNA, 20 bp, Artificial
  CRISPR gRNA sequence
ttattttaagccagtttgaa

SEQ ID NO: 87964 - DNA, 20 bp, Artificial
  CRISPR gRNA sequence
gccagtttgaattaggtttt

SEQ ID NO: 87965 - DNA, 20 bp, Artificial
  CRISPR gRNA sequence
gggaatacaggtaaggtcac

SEQ ID NO: 87966 - DNA, 20 bp, Artificial
  CRISPR gRNA sequence
acagacctgtatcatggggg

SEQ ID NO: 87967 - DNA, 20 bp, Artificial
  CRISPR gRNA sequence
tgccaaaggaaaagcctcct

SEQ ID NO: 87968 - DNA, 20 bp, Artificial
  CRISPR gRNA sequence
gggaccaagggaattttatc

SEQ ID NO: 87969 - DNA, 20 bp, Artificial
  CRISPR gRNA sequence
catggtaaccttgaggactg

SEQ ID NO: 87970 - DNA, 20 bp, Artificial
  CRISPR gRNA sequence
ctgacttttttcgagggcgc

SEQ ID NO: 87971 - DNA, 20 bp, Artificial
  CRISPR gRNA sequence
cacttgctgtatcctctata

SEQ ID NO: 87972 - DNA, 20 bp, Artificial
  CRISPR gRNA sequence
gtatcctctatatcctgctt

SEQ ID NO: 87973 - DNA, 20 bp, Artificial
  CRISPR gRNA sequence
ggccagaataggtggagaga

SEQ ID NO: 87974 - DNA, 20 bp, Artificial
  CRISPR gRNA sequence
gcgagaggaccggccccagt

SEQ ID NO: 87975 - DNA, 20 bp, Artificial
  CRISPR gRNA sequence
tccttacctgggccagtctc

SEQ ID NO: 87976 - DNA, 20 bp, Artificial
  CRISPR gRNA sequence
ctgggttctctaaaccattc

SEQ ID NO: 87977 - DNA, 20 bp, Artificial
  CRISPR gRNA sequence
ggaataggggagtgaggcaa

SEQ ID NO: 87978 - DNA, 20 bp, Artificial
  CRISPR gRNA sequence
cctcaacgatggaactgaag

SEQ ID NO: 87979 - DNA, 20 bp, Artificial
  CRISPR gRNA sequence
gagagaagagtggaattgga

SEQ ID NO: 87980 - DNA, 20 bp, Artificial
  CRISPR gRNA sequence
tggccccggccaccaagcct

SEQ ID NO: 87981 - DNA, 20 bp, Artificial
  CRISPR gRNA sequence
gtgaggaaccctttaagaag

SEQ ID NO: 87982 - DNA, 20 bp, Artificial
  CRISPR gRNA sequence
accgataggcatcataaaca

SEQ ID NO: 87983 - DNA, 20 bp, Artificial
  CRISPR gRNA sequence
aggggagctgaaggtagaga

SEQ ID NO: 87984 - DNA, 20 bp, Artificial
  CRISPR gRNA sequence
tcctggctaacatggtgaaa

SEQ ID NO: 87985 - DNA, 20 bp, Artificial
  CRISPR gRNA sequence
aatggcgtgaacctgggagg

SEQ ID NO: 87986 - DNA, 20 bp, Artificial
  CRISPR gRNA sequence
gaggcggagcttgcagtgag

SEQ ID NO: 87987 - DNA, 20 bp, Artificial
  CRISPR gRNA sequence
cagctctgacttcatctctg

SEQ ID NO: 87988 - DNA, 20 bp, Artificial
  CRISPR gRNA sequence
ggcacaaagtcaaactggca

SEQ ID NO: 87989 - DNA, 20 bp, Artificial
  CRISPR gRNA sequence
ggaccctacctctcccacat

SEQ ID NO: 87990 - DNA, 20 bp, Artificial
  CRISPR gRNA sequence
gagaaagctggaggtcacac

SEQ ID NO: 87991 - DNA, 20 bp, Artificial
  CRISPR gRNA sequence
aaactgtaaaggaagagata

SEQ ID NO: 87992 - DNA, 20 bp, Artificial
  CRISPR gRNA sequence
tacgaacatattctgccctt

SEQ ID NO: 87993 - DNA, 20 bp, Artificial
  CRISPR gRNA sequence
ccttccccctccattcaatc

SEQ ID NO: 87994 - DNA, 20 bp, Artificial
  CRISPR gRNA sequence
ccgctccactttgcagaaac

SEQ ID NO: 87995 - DNA, 20 bp, Artificial
  CRISPR gRNA sequence
gagcagcgggggaagtcgtg

SEQ ID NO: 87996 - DNA, 20 bp, Artificial
  CRISPR gRNA sequence
ttaagtaatgagaacttggg

SEQ ID NO: 87997 - DNA, 20 bp, Artificial
  CRISPR gRNA sequence
tatttttgagaattagagaa

SEQ ID NO: 87998 - DNA, 20 bp, Artificial
  CRISPR gRNA sequence
ctttgttttgtggctgttat

SEQ ID NO: 87999 - DNA, 20 bp, Artificial
  CRISPR gRNA sequence
aaatgaaaatttcttgctaa

SEQ ID NO: 88000 - DNA, 20 bp, Artificial
  CRISPR gRNA sequence
aatccccctatctcttcctt

SEQ ID NO: 88001 - DNA, 20 bp, Artificial
  CRISPR gRNA sequence
tatctcttcctttacagttt

SEQ ID NO: 88002 - DNA, 20 bp, Artificial
  CRISPR gRNA sequence
aaagaccaccggggaaattc

SEQ ID NO: 88003 - DNA, 20 bp, Artificial
  CRISPR gRNA sequence
ccaccggggaaattcggagg

SEQ ID NO: 88004 - DNA, 20 bp, Artificial
  CRISPR gRNA sequence
gggaaattcggaggctttgt

SEQ ID NO: 88005 - DNA, 20 bp, Artificial
  CRISPR gRNA sequence
agcaagggcatgggagcaga

SEQ ID NO: 88006 - DNA, 20 bp, Artificial
  CRISPR gRNA sequence
ggaaaatcttgtgtgtgacc

SEQ ID NO: 88007 - DNA, 20 bp, Artificial
  CRISPR gRNA sequence
ctctgccttgtcagaagata

SEQ ID NO: 88008 - DNA, 20 bp, Artificial
  CRISPR gRNA sequence
gttggctttgcaaacttgct

SEQ ID NO: 88009 - DNA, 20 bp, Artificial
  CRISPR gRNA sequence
ttttgtatttttagtagaaa

SEQ ID NO: 88010 - DNA, 20 bp, Artificial
  CRISPR gRNA sequence
tgccttggccttccaaagtg

SEQ ID NO: 88011 - DNA, 20 bp, Artificial
  CRISPR gRNA sequence
cccaccactggagacaaaag

SEQ ID NO: 88012 - DNA, 20 bp, Artificial
  CRISPR gRNA sequence
agacaaaaggtaggtttgat

SEQ ID NO: 88013 - DNA, 20 bp, Artificial
  CRISPR gRNA sequence
gtagttttagatggcagagg

SEQ ID NO: 88014 - DNA, 20 bp, Artificial
  CRISPR gRNA sequence
aggaaaggtcctcgccctga

SEQ ID NO: 88015 - DNA, 20 bp, Artificial
  CRISPR gRNA sequence
gacttggtttaccagggaaa

SEQ ID NO: 88016 - DNA, 20 bp, Artificial
  CRISPR gRNA sequence
tggtccagcactactgaagt

SEQ ID NO: 88017 - DNA, 20 bp, Artificial
  CRISPR gRNA sequence
gacaactgttagggtcttag

SEQ ID NO: 88018 - DNA, 20 bp, Artificial
  CRISPR gRNA sequence
gtcttagtaatgcttgttcc

SEQ ID NO: 88019 - DNA, 20 bp, Artificial
  CRISPR gRNA sequence
gacacctgtctgccaaagca

SEQ ID NO: 88020 - DNA, 20 bp, Artificial
  CRISPR gRNA sequence
gaggggtgggtggtgggatg

SEQ ID NO: 88021 - DNA, 20 bp, Artificial
  CRISPR gRNA sequence
ataggaccccctcacccatg

SEQ ID NO: 88022 - DNA, 20 bp, Artificial
  CRISPR gRNA sequence
cttccctgacatcaaagctc

SEQ ID NO: 88023 - DNA, 20 bp, Artificial
  CRISPR gRNA sequence
atgtggagagcaaggagtgg

SEQ ID NO: 88024 - DNA, 20 bp, Artificial
  CRISPR gRNA sequence
ggaacagcttaacttgctcg

SEQ ID NO: 88025 - DNA, 20 bp, Artificial
  CRISPR gRNA sequence
aaaagtcagaggtctttggg

SEQ ID NO: 88026 - DNA, 20 bp, Artificial
  CRISPR gRNA sequence
acagcctcagtcattatgta

SEQ ID NO: 88027 - DNA, 20 bp, Artificial
  CRISPR gRNA sequence
gcagaggatgaagagaactt

SEQ ID NO: 88028 - DNA, 20 bp, Artificial
  CRISPR gRNA sequence
actcccatccccagtctggt

SEQ ID NO: 88029 - DNA, 20 bp, Artificial
  CRISPR gRNA sequence
caagggttctttaatttgga

SEQ ID NO: 88030 - DNA, 20 bp, Artificial
  CRISPR gRNA sequence
tcagttccatcgttgaggtc

SEQ ID NO: 88031 - DNA, 20 bp, Artificial
  CRISPR gRNA sequence
tgcccgatctgcacatgccc

SEQ ID NO: 88032 - DNA, 20 bp, Artificial
  CRISPR gRNA sequence
ctcagcaaccctgagccact

SEQ ID NO: 88033 - DNA, 20 bp, Artificial
  CRISPR gRNA sequence
acacactagaatagagacac

SEQ ID NO: 88034 - DNA, 20 bp, Artificial
  CRISPR gRNA sequence
ttcctggagacccttctaag

SEQ ID NO: 88035 - DNA, 20 bp, Artificial
  CRISPR gRNA sequence
attgcctcactcccctattc

SEQ ID NO: 88036 - DNA, 20 bp, Artificial
  CRISPR gRNA sequence
aacggtcatctaaaccaaag

SEQ ID NO: 88037 - DNA, 20 bp, Artificial
  CRISPR gRNA sequence
tgactttgctgtcctgggct

SEQ ID NO: 88038 - DNA, 20 bp, Artificial
  CRISPR gRNA sequence
tatccttctccaattgggtc

SEQ ID NO: 88039 - DNA, 20 bp, Artificial
  CRISPR gRNA sequence
acctcctgtgcctctggcgt

SEQ ID NO: 88040 - DNA, 20 bp, Artificial
  CRISPR gRNA sequence
ctctccacctattctggccc

SEQ ID NO: 88041 - DNA, 20 bp, Artificial
  CRISPR gRNA sequence
aacatgatcttaccaactgt

SEQ ID NO: 88042 - DNA, 20 bp, Artificial
  CRISPR gRNA sequence
gcccagggtcagggagatgg

SEQ ID NO: 88043 - DNA, 20 bp, Artificial
  CRISPR gRNA sequence
aagggcagcagaagccaaaa

SEQ ID NO: 88044 - DNA, 20 bp, Artificial
  CRISPR gRNA sequence
taataaagacttaaaggagc

SEQ ID NO: 88045 - DNA, 20 bp, Artificial
  CRISPR gRNA sequence
tgatacaggtctgtggggaa

SEQ ID NO: 88046 - DNA, 20 bp, Artificial
  CRISPR gRNA sequence
tagtagaggcccttctttgc

SEQ ID NO: 88047 - DNA, 20 bp, Artificial
  CRISPR gRNA sequence
tggttgctgcctctgacctt

SEQ ID NO: 88048 - DNA, 20 bp, Artificial
  CRISPR gRNA sequence
gaccttttcagcttgatacc

SEQ ID NO: 88049 - DNA, 20 bp, Artificial
  CRISPR gRNA sequence
aatatataggttagggatct

SEQ ID NO: 88050 - DNA, 20 bp, Artificial
  CRISPR gRNA sequence
tcacagaaaacctaattcaa

SEQ ID NO: 88051 - DNA, 20 bp, Artificial
  CRISPR gRNA sequence
ttcaaactggcttaaaataa

SEQ ID NO: 88052 - DNA, 20 bp, Artificial
  CRISPR gRNA sequence
cttaatggctgccagcattc

SEQ ID NO: 88053 - DNA, 20 bp, Artificial
  CRISPR gRNA sequence
agcaaaagccctaatattca

SEQ ID NO: 88054 - DNA, 20 bp, Artificial
  CRISPR gRNA sequence
caggaggatgatacatgcta

SEQ ID NO: 88055 - DNA, 20 bp, Artificial
  CRISPR gRNA sequence
ggtcagcctccccaaaatca

SEQ ID NO: 88056 - DNA, 20 bp, Artificial
  CRISPR gRNA sequence
agtggaaactaggagcaggg

SEQ ID NO: 88057 - DNA, 20 bp, Artificial
  CRISPR gRNA sequence
taacaccaggctactcttat

SEQ ID NO: 88058 - DNA, 20 bp, Artificial
  CRISPR gRNA sequence
gctaagttgagatcagctag

SEQ ID NO: 88059 - DNA, 20 bp, Artificial
  CRISPR gRNA sequence
atacaagctgtagcctcttt

SEQ ID NO: 88060 - DNA, 20 bp, Artificial
  CRISPR gRNA sequence
gagatggagctccttccttt

SEQ ID NO: 88061 - DNA, 20 bp, Artificial
  CRISPR gRNA sequence
cttaatttttgtcttctcat

SEQ ID NO: 88062 - DNA, 20 bp, Artificial
  CRISPR gRNA sequence
cgtgtcaggacttaggactg

SEQ ID NO: 88063 - DNA, 20 bp, Artificial
  CRISPR gRNA sequence
ctactttgtcctctacatag

SEQ ID NO: 88064 - DNA, 20 bp, Artificial
  CRISPR gRNA sequence
tcttggttcttcccaagaaa

SEQ ID NO: 88065 - DNA, 20 bp, Artificial
  CRISPR gRNA sequence
tgttcatttatttccaccac

SEQ ID NO: 88066 - DNA, 20 bp, Artificial
  CRISPR gRNA sequence
ttaaaacattttaaatacca

SEQ ID NO: 88067 - DNA, 20 bp, Artificial
  CRISPR gRNA sequence
gaacacatgaagtctccctg

SEQ ID NO: 88068 - DNA, 20 bp, Artificial
  CRISPR gRNA sequence
gatgctgccacctggtggat

SEQ ID NO: 88069 - DNA, 20 bp, Artificial
  CRISPR gRNA sequence
aggaatgagaagacaaaaat

SEQ ID NO: 88070 - DNA, 20 bp, Artificial
  CRISPR gRNA sequence
gctccatctctaatatggag

SEQ ID NO: 88071 - DNA, 20 bp, Artificial
  CRISPR gRNA sequence
gagactgaagagtccctaga

SEQ ID NO: 88072 - DNA, 20 bp, Artificial
  CRISPR gRNA sequence
ccctctccttccttctgaga

SEQ ID NO: 88073 - DNA, 20 bp, Artificial
  CRISPR gRNA sequence
tgagggaaatgcaagactga

SEQ ID NO: 88074 - DNA, 20 bp, Artificial
  CRISPR gRNA sequence
gaaatgcaagactgaggaga

SEQ ID NO: 88075 - DNA, 20 bp, Artificial
  CRISPR gRNA sequence
ccaaaggtgttgtccatgat

SEQ ID NO: 88076 - DNA, 20 bp, Artificial
  CRISPR gRNA sequence
tcctacagaagatgcaacag

SEQ ID NO: 88077 - DNA, 20 bp, Artificial
  CRISPR gRNA sequence
gactcagctgtctgtacaga

SEQ ID NO: 88078 - DNA, 20 bp, Artificial
  CRISPR gRNA sequence
gagaatggacttccttagga

SEQ ID NO: 88079 - DNA, 20 bp, Artificial
  CRISPR gRNA sequence
cagctgctgacttgagaggg

SEQ ID NO: 88080 - DNA, 20 bp, Artificial
  CRISPR gRNA sequence
tagccactttcagggcacct

SEQ ID NO: 88081 - DNA, 20 bp, Artificial
  CRISPR gRNA sequence
acctgaagaaagcctggggg

SEQ ID NO: 88082 - DNA, 20 bp, Artificial
  CRISPR gRNA sequence
agaggaacacagtaaggtgt

SEQ ID NO: 88083 - DNA, 20 bp, Artificial
  CRISPR gRNA sequence
agtgtacttggctctgagct

SEQ ID NO: 88084 - DNA, 20 bp, Artificial
  CRISPR gRNA sequence
ctggaccaaatttagttcac

SEQ ID NO: 88085 - DNA, 20 bp, Artificial
  CRISPR gRNA sequence
cttcccagtgaacctttctc

SEQ ID NO: 88086 - DNA, 20 bp, Artificial
  CRISPR gRNA sequence
agagatacagcttgtcattg

SEQ ID NO: 88087 - DNA, 20 bp, Artificial
  CRISPR gRNA sequence
ggtaggagagaacagaggca

SEQ ID NO: 88088 - DNA, 20 bp, Artificial
  CRISPR gRNA sequence
tgtcagactgaaaaaggacc

SEQ ID NO: 88089 - DNA, 20 bp, Artificial
  CRISPR gRNA sequence
ctacttgggaggctgaggca

SEQ ID NO: 88090 - DNA, 20 bp, Artificial
  CRISPR gRNA sequence
atctcaaaaaaaaaaaaaaa

SEQ ID NO: 88091 - DNA, 20 bp, Artificial
  CRISPR gRNA sequence
caaaaaaaaaaaaaaaaaag

SEQ ID NO: 88092 - DNA, 20 bp, Artificial
  CRISPR gRNA sequence
cggccttgctgtggggaaga

SEQ ID NO: 88093 - DNA, 20 bp, Artificial
  CRISPR gRNA sequence
tgaaatgcccagcaggtgct

SEQ ID NO: 88094 - DNA, 20 bp, Artificial
  CRISPR gRNA sequence
ctgccatcccggcatgaggg

SEQ ID NO: 88095 - DNA, 20 bp, Artificial
  CRISPR gRNA sequence
ggcactcctcatctctttac

SEQ ID NO: 88096 - DNA, 20 bp, Artificial
  CRISPR gRNA sequence
atctctttacccagaaaggc

SEQ ID NO: 88097 - DNA, 20 bp, Artificial
  CRISPR gRNA sequence
ttacccagaaaggcagagaa

SEQ ID NO: 88098 - DNA, 20 bp, Artificial
  CRISPR gRNA sequence
ccacttgccttctccgaaaa

SEQ ID NO: 88099 - DNA, 20 bp, Artificial
  CRISPR gRNA sequence
ggattgggaatccatgttag

SEQ ID NO: 88100 - DNA, 20 bp, Artificial
  CRISPR gRNA sequence
cattgcatatgcctgggagg

SEQ ID NO: 88101 - DNA, 20 bp, Artificial
  CRISPR gRNA sequence
ccccacccccgctccacttt

SEQ ID NO: 88102 - DNA, 20 bp, Artificial
  CRISPR gRNA sequence
ttttttccaagcctagaagg

SEQ ID NO: 88103 - DNA, 20 bp, Artificial
  CRISPR gRNA sequence
gcaatggtgaggagtatttt

SEQ ID NO: 88104 - DNA, 20 bp, Artificial
  CRISPR gRNA sequence
agggcagtatggggtcagag

SEQ ID NO: 88105 - DNA, 20 bp, Artificial
  CRISPR gRNA sequence
ttttccagatttaggagact

SEQ ID NO: 88106 - DNA, 20 bp, Artificial
  CRISPR gRNA sequence
acttcagaaaggtggggcag

SEQ ID NO: 88107 - DNA, 20 bp, Artificial
  CRISPR gRNA sequence
ttttcggagaaggcaagtgg

SEQ ID NO: 88108 - DNA, 20 bp, Artificial
  CRISPR gRNA sequence
aatttttttttgtattttta

SEQ ID NO: 88109 - DNA, 20 bp, Artificial
  CRISPR gRNA sequence
ctcctacctcagcaagatgt

SEQ ID NO: 88110 - DNA, 20 bp, Artificial
  CRISPR gRNA sequence
tggcagaggttctgattctt

SEQ ID NO: 88111 - DNA, 20 bp, Artificial
  CRISPR gRNA sequence
catgtccttccccacttcag

SEQ ID NO: 88112 - DNA, 20 bp, Artificial
  CRISPR gRNA sequence
ttcagtggccctcccacaca

SEQ ID NO: 88113 - DNA, 20 bp, Artificial
  CRISPR gRNA sequence
tgtctctaccagtcagtcaa

SEQ ID NO: 88114 - DNA, 20 bp, Artificial
  CRISPR gRNA sequence
cgggaacggtcatctaaacc

SEQ ID NO: 88115 - DNA, 20 bp, Artificial
  CRISPR gRNA sequence
ggatcttttggttttaaatc

SEQ ID NO: 88116 - DNA, 20 bp, Artificial
  CRISPR gRNA sequence
ggatttattggttcatgtaa

SEQ ID NO: 88117 - DNA, 20 bp, Artificial
  CRISPR gRNA sequence
ttttccccatttatgtccaa

SEQ ID NO: 88118 - DNA, 20 bp, Artificial
  CRISPR gRNA sequence
aaaaagaaggcatctttgta

SEQ ID NO: 88119 - DNA, 20 bp, Artificial
  CRISPR gRNA sequence
ctgtggtcaggcggcaccaa

SEQ ID NO: 88120 - DNA, 20 bp, Artificial
  CRISPR gRNA sequence
cagggaatcttggttcttcc

SEQ ID NO: 88121 - DNA, 20 bp, Artificial
  CRISPR gRNA sequence
atttccaccacagcagattt

SEQ ID NO: 88122 - DNA, 20 bp, Artificial
  CRISPR gRNA sequence
gaattaggttttctgtgatt

SEQ ID NO: 88123 - DNA, 20 bp, Artificial
  CRISPR gRNA sequence
tgactgaggctgttagccct

SEQ ID NO: 88124 - DNA, 20 bp, Artificial
  CRISPR gRNA sequence
gaatcagaacctctgccatc

SEQ ID NO: 88125 - DNA, 20 bp, Artificial
  CRISPR gRNA sequence
tctgaagtctcctaaatctg

SEQ ID NO: 88126 - DNA, 20 bp, Artificial
  CRISPR gRNA sequence
atactgccctcctccccctc

SEQ ID NO: 88127 - DNA, 20 bp, Artificial
  CRISPR gRNA sequence
aaaaacaacaataacagcca

SEQ ID NO: 88128 - DNA, 20 bp, Artificial
  CRISPR gRNA sequence
tgcccttctaggcttggaaa

SEQ ID NO: 88129 - DNA, 20 bp, Artificial
  CRISPR gRNA sequence
gtgaggatgatgggcatcaa

SEQ ID NO: 88130 - DNA, 20 bp, Artificial
  CRISPR gRNA sequence
tcttttggttttaaatcaca

SEQ ID NO: 88131 - DNA, 20 bp, Artificial
  CRISPR gRNA sequence
gacccataacacatatacat

SEQ ID NO: 88132 - DNA, 20 bp, Artificial
  CRISPR gRNA sequence
aaaaatatctatagcagata

SEQ ID NO: 88133 - DNA, 20 bp, Artificial
  CRISPR gRNA sequence
tagcagataatagacacgaa

SEQ ID NO: 88134 - DNA, 20 bp, Artificial
  CRISPR gRNA sequence
aggacagtggttaccgctaa

SEQ ID NO: 88135 - DNA, 20 bp, Artificial
  CRISPR gRNA sequence
ccgctaagaagaggcggggg

SEQ ID NO: 88136 - DNA, 20 bp, Artificial
  CRISPR gRNA sequence
agaagaggcgggggacaggc

SEQ ID NO: 88137 - DNA, 20 bp, Artificial
  CRISPR gRNA sequence
gggaggaacacaaacacaat

SEQ ID NO: 88138 - DNA, 20 bp, Artificial
  CRISPR gRNA sequence
aaaatgttttaatgtatatg

SEQ ID NO: 88139 - DNA, 20 bp, Artificial
  CRISPR gRNA sequence
aaatgttttaatgtatatgt

SEQ ID NO: 88140 - DNA, 20 bp, Artificial
  CRISPR gRNA sequence
taatgtatatgtgttatggg

SEQ ID NO: 88141 - DNA, 20 bp, Artificial
  CRISPR gRNA sequence
aatgtatatgtgttatgggt

SEQ ID NO: 88142 - DNA, 20 bp, Artificial
  CRISPR gRNA sequence
atgtatatgtgttatgggtc

SEQ ID NO: 88143 - DNA, 20 bp, Artificial
  CRISPR gRNA sequence
tgggtcataggtactcatta

SEQ ID NO: 88144 - DNA, 20 bp, Artificial
  CRISPR gRNA sequence
attagtatgcttcataattt

SEQ ID NO: 88145 - DNA, 20 bp, Artificial
  CRISPR gRNA sequence
gtatgcttcataatttattc

SEQ ID NO: 88146 - DNA, 20 bp, Artificial
  CRISPR gRNA sequence
cataatttattcacgttaga

SEQ ID NO: 88147 - DNA, 20 bp, Artificial
  CRISPR gRNA sequence
ataatttattcacgttagat

SEQ ID NO: 88148 - DNA, 20 bp, Artificial
  CRISPR gRNA sequence
attcacgttagatatactct

SEQ ID NO: 88149 - DNA, 20 bp, Artificial
  CRISPR gRNA sequence
ttcacgttagatatactctt

SEQ ID NO: 88150 - DNA, 20 bp, Artificial
  CRISPR gRNA sequence
acgttagatatactctttat

SEQ ID NO: 88151 - DNA, 20 bp, Artificial
  CRISPR gRNA sequence
gatatactctttatagatat

SEQ ID NO: 88152 - DNA, 20 bp, Artificial
  CRISPR gRNA sequence
tttatagatatcaaatatta

SEQ ID NO: 88153 - DNA, 20 bp, Artificial
  CRISPR gRNA sequence
tatagatatcaaatattaca

SEQ ID NO: 88154 - DNA, 20 bp, Artificial
  CRISPR gRNA sequence
atagatatcaaatattacat

SEQ ID NO: 88155 - DNA, 20 bp, Artificial
  CRISPR gRNA sequence
tagatatcaaatattacata

SEQ ID NO: 88156 - DNA, 20 bp, Artificial
  CRISPR gRNA sequence
catattataatttcttaaaa

SEQ ID NO: 88157 - DNA, 20 bp, Artificial
  CRISPR gRNA sequence
taatttcttaaaatctgctg

SEQ ID NO: 88158 - DNA, 20 bp, Artificial
  CRISPR gRNA sequence
cttaaaatctgctgtggtgg

SEQ ID NO: 88159 - DNA, 20 bp, Artificial
  CRISPR gRNA sequence
ttaaaatctgctgtggtgga

SEQ ID NO: 88160 - DNA, 20 bp, Artificial
  CRISPR gRNA sequence
aaaatctgctgtggtggaaa

SEQ ID NO: 88161 - DNA, 20 bp, Artificial
  CRISPR gRNA sequence
aaatctgctgtggtggaaat

SEQ ID NO: 88162 - DNA, 20 bp, Artificial
  CRISPR gRNA sequence
ctgtggtggaaataaatgaa

SEQ ID NO: 88163 - DNA, 20 bp, Artificial
  CRISPR gRNA sequence
tggtggaaataaatgaacac

SEQ ID NO: 88164 - DNA, 20 bp, Artificial
  CRISPR gRNA sequence
cctgaaagaaaatcagtgtt

SEQ ID NO: 88165 - DNA, 20 bp, Artificial
  CRISPR gRNA sequence
aaagaaaatcagtgtttctt

SEQ ID NO: 88166 - DNA, 20 bp, Artificial
  CRISPR gRNA sequence
cttgggaagaaccaagattc

SEQ ID NO: 88167 - DNA, 20 bp, Artificial
  CRISPR gRNA sequence
ttgggaagaaccaagattcc

SEQ ID NO: 88168 - DNA, 20 bp, Artificial
  CRISPR gRNA sequence
gggaagaaccaagattccct

SEQ ID NO: 88169 - DNA, 20 bp, Artificial
  CRISPR gRNA sequence
ggaagaaccaagattccctg

SEQ ID NO: 88170 - DNA, 20 bp, Artificial
  CRISPR gRNA sequence
cctgacagaagctaccctat

SEQ ID NO: 88171 - DNA, 20 bp, Artificial
  CRISPR gRNA sequence
acagaagctaccctatgtag

SEQ ID NO: 88172 - DNA, 20 bp, Artificial
  CRISPR gRNA sequence
ccctatgtagaggacaaagt

SEQ ID NO: 88173 - DNA, 20 bp, Artificial
  CRISPR gRNA sequence
tgtagaggacaaagtaggtc

SEQ ID NO: 88174 - DNA, 20 bp, Artificial
  CRISPR gRNA sequence
caataaatattagttggttt

SEQ ID NO: 88175 - DNA, 20 bp, Artificial
  CRISPR gRNA sequence
aataaatattagttggttta

SEQ ID NO: 88176 - DNA, 20 bp, Artificial
  CRISPR gRNA sequence
gttggtttactgcttttccc

SEQ ID NO: 88177 - DNA, 20 bp, Artificial
  CRISPR gRNA sequence
gtttactgcttttcccaagg

SEQ ID NO: 88178 - DNA, 20 bp, Artificial
  CRISPR gRNA sequence
actgcttttcccaaggatac

SEQ ID NO: 88179 - DNA, 20 bp, Artificial
  CRISPR gRNA sequence
ctgcttttcccaaggataca

SEQ ID NO: 88180 - DNA, 20 bp, Artificial
  CRISPR gRNA sequence
cttttcccaaggatacatct

SEQ ID NO: 88181 - DNA, 20 bp, Artificial
  CRISPR gRNA sequence
ttcccaaggatacatctgga

SEQ ID NO: 88182 - DNA, 20 bp, Artificial
  CRISPR gRNA sequence
tcccaaggatacatctggag

SEQ ID NO: 88183 - DNA, 20 bp, Artificial
  CRISPR gRNA sequence
cccaaggatacatctggagg

SEQ ID NO: 88184 - DNA, 20 bp, Artificial
  CRISPR gRNA sequence
ccaaggatacatctggaggg

SEQ ID NO: 88185 - DNA, 20 bp, Artificial
  CRISPR gRNA sequence
gagggtctgcattcctttct

SEQ ID NO: 88186 - DNA, 20 bp, Artificial
  CRISPR gRNA sequence
cattcctttctcattggtgc

SEQ ID NO: 88187 - DNA, 20 bp, Artificial
  CRISPR gRNA sequence
ctttctcattggtgccgcct

SEQ ID NO: 88188 - DNA, 20 bp, Artificial
  CRISPR gRNA sequence
tctcattggtgccgcctgac

SEQ ID NO: 88189 - DNA, 20 bp, Artificial
  CRISPR gRNA sequence
ctcattggtgccgcctgacc

SEQ ID NO: 88190 - DNA, 20 bp, Artificial
  CRISPR gRNA sequence
tcattggtgccgcctgacca

SEQ ID NO: 88191 - DNA, 20 bp, Artificial
  CRISPR gRNA sequence
attggtgccgcctgaccaca

SEQ ID NO: 88192 - DNA, 20 bp, Artificial
  CRISPR gRNA sequence
gtgccgcctgaccacagaac

SEQ ID NO: 88193 - DNA, 20 bp, Artificial
  CRISPR gRNA sequence
accacagaactagctttttc

SEQ ID NO: 88194 - DNA, 20 bp, Artificial
  CRISPR gRNA sequence
gctttttccgtgacatctaa

SEQ ID NO: 88195 - DNA, 20 bp, Artificial
  CRISPR gRNA sequence
tttccgtgacatctaaccta

SEQ ID NO: 88196 - DNA, 20 bp, Artificial
  CRISPR gRNA sequence
ttccgtgacatctaacctaa

SEQ ID NO: 88197 - DNA, 20 bp, Artificial
  CRISPR gRNA sequence
tccgtgacatctaacctaaa

SEQ ID NO: 88198 - DNA, 20 bp, Artificial
  CRISPR gRNA sequence
ccgtgacatctaacctaaac

SEQ ID NO: 88199 - DNA, 20 bp, Artificial
  CRISPR gRNA sequence
cgtgacatctaacctaaacc

SEQ ID NO: 88200 - DNA, 20 bp, Artificial
  CRISPR gRNA sequence
acctaaaccccgcagtccta

SEQ ID NO: 88201 - DNA, 20 bp, Artificial
  CRISPR gRNA sequence
aaccccgcagtcctaagtcc

SEQ ID NO: 88202 - DNA, 20 bp, Artificial
  CRISPR gRNA sequence
agtcctgacacgtatgacaa

SEQ ID NO: 88203 - DNA, 20 bp, Artificial
  CRISPR gRNA sequence
acacgtatgacaagatgctg

SEQ ID NO: 88204 - DNA, 20 bp, Artificial
  CRISPR gRNA sequence
ccacctggtggatacagaat

SEQ ID NO: 88205 - DNA, 20 bp, Artificial
  CRISPR gRNA sequence
gtggatacagaatagattta

SEQ ID NO: 88206 - DNA, 20 bp, Artificial
  CRISPR gRNA sequence
aatgaaatggctaggaagtc

SEQ ID NO: 88207 - DNA, 20 bp, Artificial
  CRISPR gRNA sequence
atgaaatggctaggaagtct

SEQ ID NO: 88208 - DNA, 20 bp, Artificial
  CRISPR gRNA sequence
ggaagtctttcactctagtt

SEQ ID NO: 88209 - DNA, 20 bp, Artificial
  CRISPR gRNA sequence
tcactctagttggtggaact

SEQ ID NO: 88210 - DNA, 20 bp, Artificial
  CRISPR gRNA sequence
cactctagttggtggaactg

SEQ ID NO: 88211 - DNA, 20 bp, Artificial
  CRISPR gRNA sequence
actctagttggtggaactgg

SEQ ID NO: 88212 - DNA, 20 bp, Artificial
  CRISPR gRNA sequence
tagttggtggaactggcaat

SEQ ID NO: 88213 - DNA, 20 bp, Artificial
  CRISPR gRNA sequence
gttggtggaactggcaatag

SEQ ID NO: 88214 - DNA, 20 bp, Artificial
  CRISPR gRNA sequence
gtggaactggcaatagggtg

SEQ ID NO: 88215 - DNA, 20 bp, Artificial
  CRISPR gRNA sequence
gcaatagggtgagagggaag

SEQ ID NO: 88216 - DNA, 20 bp, Artificial
  CRISPR gRNA sequence
agaaacaggaaaaggaagga

SEQ ID NO: 88217 - DNA, 20 bp, Artificial
  CRISPR gRNA sequence
catctctaatatggaggtag

SEQ ID NO: 88218 - DNA, 20 bp, Artificial
  CRISPR gRNA sequence
taatatggaggtagaaaaaa

SEQ ID NO: 88219 - DNA, 20 bp, Artificial
  CRISPR gRNA sequence
atatggaggtagaaaaaaag

SEQ ID NO: 88220 - DNA, 20 bp, Artificial
  CRISPR gRNA sequence
tcatctaaatgagactgaag

SEQ ID NO: 88221 - DNA, 20 bp, Artificial
  CRISPR gRNA sequence
aatgagactgaagagtccct

SEQ ID NO: 88222 - DNA, 20 bp, Artificial
  CRISPR gRNA sequence
aagagtccctagaggagaat

SEQ ID NO: 88223 - DNA, 20 bp, Artificial
  CRISPR gRNA sequence
gaggagaatggcttccctct

SEQ ID NO: 88224 - DNA, 20 bp, Artificial
  CRISPR gRNA sequence
ccctctccttccttctgaga

SEQ ID NO: 88225 - DNA, 20 bp, Artificial
  CRISPR gRNA sequence
cctctccttccttctgagac

SEQ ID NO: 88226 - DNA, 20 bp, Artificial
  CRISPR gRNA sequence
tccttccttctgagactaga

SEQ ID NO: 88227 - DNA, 20 bp, Artificial
  CRISPR gRNA sequence
cttccttctgagactagaaa

SEQ ID NO: 88228 - DNA, 20 bp, Artificial
  CRISPR gRNA sequence
ccttctgagactagaaacga

SEQ ID NO: 88229 - DNA, 20 bp, Artificial
  CRISPR gRNA sequence
cttctgagactagaaacgag

SEQ ID NO: 88230 - DNA, 20 bp, Artificial
  CRISPR gRNA sequence
ctgagactagaaacgaggaa

SEQ ID NO: 88231 - DNA, 20 bp, Artificial
  CRISPR gRNA sequence
tgagactagaaacgaggaaa

SEQ ID NO: 88232 - DNA, 20 bp, Artificial
  CRISPR gRNA sequence
agactagaaacgaggaaaga

SEQ ID NO: 88233 - DNA, 20 bp, Artificial
  CRISPR gRNA sequence
gaaacgaggaaagaggctac

SEQ ID NO: 88234 - DNA, 20 bp, Artificial
  CRISPR gRNA sequence
cagcttgtattgagggaaat

SEQ ID NO: 88235 - DNA, 20 bp, Artificial
  CRISPR gRNA sequence
gtattgagggaaatgcaaga

SEQ ID NO: 88236 - DNA, 20 bp, Artificial
  CRISPR gRNA sequence
tattgagggaaatgcaagac

SEQ ID NO: 88237 - DNA, 20 bp, Artificial
  CRISPR gRNA sequence
agggaaatgcaagactgagg

SEQ ID NO: 88238 - DNA, 20 bp, Artificial
  CRISPR gRNA sequence
aggagaaaagaaagcaggtc

SEQ ID NO: 88239 - DNA, 20 bp, Artificial
  CRISPR gRNA sequence
gctgatctcaacttagcaag

SEQ ID NO: 88240 - DNA, 20 bp, Artificial
  CRISPR gRNA sequence
atctcaacttagcaagctaa

SEQ ID NO: 88241 - DNA, 20 bp, Artificial
  CRISPR gRNA sequence
aacttagcaagctaaaataa

SEQ ID NO: 88242 - DNA, 20 bp, Artificial
  CRISPR gRNA sequence
agcaagctaaaataagagta

SEQ ID NO: 88243 - DNA, 20 bp, Artificial
  CRISPR gRNA sequence
gcaagctaaaataagagtag

SEQ ID NO: 88244 - DNA, 20 bp, Artificial
  CRISPR gRNA sequence
aaataagagtagcctggtgt

SEQ ID NO: 88245 - DNA, 20 bp, Artificial
  CRISPR gRNA sequence
gtgttagcggccacccaagc

SEQ ID NO: 88246 - DNA, 20 bp, Artificial
  CRISPR gRNA sequence
gcggccacccaagcaactcc

SEQ ID NO: 88247 - DNA, 20 bp, Artificial
  CRISPR gRNA sequence
cctgctcctagtttccactt

SEQ ID NO: 88248 - DNA, 20 bp, Artificial
  CRISPR gRNA sequence
ctcctagtttccacttgggg

SEQ ID NO: 88249 - DNA, 20 bp, Artificial
  CRISPR gRNA sequence
ctagtttccacttggggaat

SEQ ID NO: 88250 - DNA, 20 bp, Artificial
  CRISPR gRNA sequence
gtttccacttggggaatcca

SEQ ID NO: 88251 - DNA, 20 bp, Artificial
  CRISPR gRNA sequence
ccacttggggaatccatgtg

SEQ ID NO: 88252 - DNA, 20 bp, Artificial
  CRISPR gRNA sequence
cacttggggaatccatgtga

SEQ ID NO: 88253 - DNA, 20 bp, Artificial
  CRISPR gRNA sequence
ggggaatccatgtgattttg

SEQ ID NO: 88254 - DNA, 20 bp, Artificial
  CRISPR gRNA sequence
gggaatccatgtgattttgg

SEQ ID NO: 88255 - DNA, 20 bp, Artificial
  CRISPR gRNA sequence
tggggaggctgacccccacc

SEQ ID NO: 88256 - DNA, 20 bp, Artificial
  CRISPR gRNA sequence
ggggaggctgacccccaccc

SEQ ID NO: 88257 - DNA, 20 bp, Artificial
  CRISPR gRNA sequence
gggaggctgacccccaccct

SEQ ID NO: 88258 - DNA, 20 bp, Artificial
  CRISPR gRNA sequence
acccccacccttttccccaa

SEQ ID NO: 88259 - DNA, 20 bp, Artificial
  CRISPR gRNA sequence
ttccccaaaggtgttgtcca

SEQ ID NO: 88260 - DNA, 20 bp, Artificial
  CRISPR gRNA sequence
tccccaaaggtgttgtccat

SEQ ID NO: 88261 - DNA, 20 bp, Artificial
  CRISPR gRNA sequence
ccccaaaggtgttgtccatg

SEQ ID NO: 88262 - DNA, 20 bp, Artificial
  CRISPR gRNA sequence
cccaaaggtgttgtccatga

SEQ ID NO: 88263 - DNA, 20 bp, Artificial
  CRISPR gRNA sequence
tccatgatatagaataagca

SEQ ID NO: 88264 - DNA, 20 bp, Artificial
  CRISPR gRNA sequence
gcatgtatcatcctcctggc

SEQ ID NO: 88265 - DNA, 20 bp, Artificial
  CRISPR gRNA sequence
ctggccacagtgattggtca

SEQ ID NO: 88266 - DNA, 20 bp, Artificial
  CRISPR gRNA sequence
gccacagtgattggtcaggg

SEQ ID NO: 88267 - DNA, 20 bp, Artificial
  CRISPR gRNA sequence
gtcagggtggacatgtgacc

SEQ ID NO: 88268 - DNA, 20 bp, Artificial
  CRISPR gRNA sequence
atcagtgtgaatattagggc

SEQ ID NO: 88269 - DNA, 20 bp, Artificial
  CRISPR gRNA sequence
gggcttttgctgagatttct

SEQ ID NO: 88270 - DNA, 20 bp, Artificial
  CRISPR gRNA sequence
ttgctgagatttctggtaca

SEQ ID NO: 88271 - DNA, 20 bp, Artificial
  CRISPR gRNA sequence
tgctgagatttctggtacaa

SEQ ID NO: 88272 - DNA, 20 bp, Artificial
  CRISPR gRNA sequence
gctgagatttctggtacaaa

SEQ ID NO: 88273 - DNA, 20 bp, Artificial
  CRISPR gRNA sequence
ctgagatttctggtacaaag

SEQ ID NO: 88274 - DNA, 20 bp, Artificial
  CRISPR gRNA sequence
agatttctggtacaaagatg

SEQ ID NO: 88275 - DNA, 20 bp, Artificial
  CRISPR gRNA sequence
ctggtacaaagatgccttct

SEQ ID NO: 88276 - DNA, 20 bp, Artificial
  CRISPR gRNA sequence
tggtacaaagatgccttctt

SEQ ID NO: 88277 - DNA, 20 bp, Artificial
  CRISPR gRNA sequence
gtacaaagatgccttctttt

SEQ ID NO: 88278 - DNA, 20 bp, Artificial
  CRISPR gRNA sequence
ctttttctgattggacataa

SEQ ID NO: 88279 - DNA, 20 bp, Artificial
  CRISPR gRNA sequence
tttttctgattggacataaa

SEQ ID NO: 88280 - DNA, 20 bp, Artificial
  CRISPR gRNA sequence
tttctgattggacataaatg

SEQ ID NO: 88281 - DNA, 20 bp, Artificial
  CRISPR gRNA sequence
ttctgattggacataaatgg

SEQ ID NO: 88282 - DNA, 20 bp, Artificial
  CRISPR gRNA sequence
tctgattggacataaatggg

SEQ ID NO: 88283 - DNA, 20 bp, Artificial
  CRISPR gRNA sequence
ctgattggacataaatgggg

SEQ ID NO: 88284 - DNA, 20 bp, Artificial
  CRISPR gRNA sequence
tgattggacataaatgggga

SEQ ID NO: 88285 - DNA, 20 bp, Artificial
  CRISPR gRNA sequence
attggacataaatggggaaa

SEQ ID NO: 88286 - DNA, 20 bp, Artificial
  CRISPR gRNA sequence
gacataaatggggaaaagtg

SEQ ID NO: 88287 - DNA, 20 bp, Artificial
  CRISPR gRNA sequence
aggaatgctggcagccatta

SEQ ID NO: 88288 - DNA, 20 bp, Artificial
  CRISPR gRNA sequence
ggaatgctggcagccattaa

SEQ ID NO: 88289 - DNA, 20 bp, Artificial
  CRISPR gRNA sequence
gcagccattaagtggcccag

SEQ ID NO: 88290 - DNA, 20 bp, Artificial
  CRISPR gRNA sequence
agtggcccagacttaaatgg

SEQ ID NO: 88291 - DNA, 20 bp, Artificial
  CRISPR gRNA sequence
aaatggtcctacagaagatg

SEQ ID NO: 88292 - DNA, 20 bp, Artificial
  CRISPR gRNA sequence
aatggtcctacagaagatgc

SEQ ID NO: 88293 - DNA, 20 bp, Artificial
  CRISPR gRNA sequence
cagaagatgcaacagtgaga

SEQ ID NO: 88294 - DNA, 20 bp, Artificial
  CRISPR gRNA sequence
agagacatactgaactactg

SEQ ID NO: 88295 - DNA, 20 bp, Artificial
  CRISPR gRNA sequence
gagacatactgaactactgg

SEQ ID NO: 88296 - DNA, 20 bp, Artificial
  CRISPR gRNA sequence
aactactgggtcaagtcttc

SEQ ID NO: 88297 - DNA, 20 bp, Artificial
  CRISPR gRNA sequence
ctgggtcaagtcttcacctg

SEQ ID NO: 88298 - DNA, 20 bp, Artificial
  CRISPR gRNA sequence
ggtcaagtcttcacctggag

SEQ ID NO: 88299 - DNA, 20 bp, Artificial
  CRISPR gRNA sequence
cacctggagccagcactacc

SEQ ID NO: 88300 - DNA, 20 bp, Artificial
  CRISPR gRNA sequence
acctggagccagcactacct

SEQ ID NO: 88301 - DNA, 20 bp, Artificial
  CRISPR gRNA sequence
gagccagcactacctatgga

SEQ ID NO: 88302 - DNA, 20 bp, Artificial
  CRISPR gRNA sequence
cctatggactttctagttac

SEQ ID NO: 88303 - DNA, 20 bp, Artificial
  CRISPR gRNA sequence
tggactttctagttacatga

SEQ ID NO: 88304 - DNA, 20 bp, Artificial
  CRISPR gRNA sequence
tctagttacatgaaccaata

SEQ ID NO: 88305 - DNA, 20 bp, Artificial
  CRISPR gRNA sequence
ctagttacatgaaccaataa

SEQ ID NO: 88306 - DNA, 20 bp, Artificial
  CRISPR gRNA sequence
tagttacatgaaccaataaa

SEQ ID NO: 88307 - DNA, 20 bp, Artificial
  CRISPR gRNA sequence
gttacatgaaccaataaatc

SEQ ID NO: 88308 - DNA, 20 bp, Artificial
  CRISPR gRNA sequence
catgaaccaataaatccttt

SEQ ID NO: 88309 - DNA, 20 bp, Artificial
  CRISPR gRNA sequence
tttattttaagccagtttga

SEQ ID NO: 88310 - DNA, 20 bp, Artificial
  CRISPR gRNA sequence
ttattttaagccagtttgaa

SEQ ID NO: 88311 - DNA, 20 bp, Artificial
  CRISPR gRNA sequence
tattttaagccagtttgaat

SEQ ID NO: 88312 - DNA, 20 bp, Artificial
  CRISPR gRNA sequence
attttaagccagtttgaatt

SEQ ID NO: 88313 - DNA, 20 bp, Artificial
  CRISPR gRNA sequence
ttttaagccagtttgaatta

SEQ ID NO: 88314 - DNA, 20 bp, Artificial
  CRISPR gRNA sequence
taagccagtttgaattaggt

SEQ ID NO: 88315 - DNA, 20 bp, Artificial
  CRISPR gRNA sequence
aagccagtttgaattaggtt

SEQ ID NO: 88316 - DNA, 20 bp, Artificial
  CRISPR gRNA sequence
agccagtttgaattaggttt

SEQ ID NO: 88317 - DNA, 20 bp, Artificial
  CRISPR gRNA sequence
gaattaggttttctgtgatt

SEQ ID NO: 88318 - DNA, 20 bp, Artificial
  CRISPR gRNA sequence
aattaggttttctgtgattt

SEQ ID NO: 88319 - DNA, 20 bp, Artificial
  CRISPR gRNA sequence
ggttttctgtgatttaaaac

SEQ ID NO: 88320 - DNA, 20 bp, Artificial
  CRISPR gRNA sequence
tctgtgatttaaaaccaaaa

SEQ ID NO: 88321 - DNA, 20 bp, Artificial
  CRISPR gRNA sequence
ctgtgatttaaaaccaaaag

SEQ ID NO: 88322 - DNA, 20 bp, Artificial
  CRISPR gRNA sequence
tgtgatttaaaaccaaaaga

SEQ ID NO: 88323 - DNA, 20 bp, Artificial
  CRISPR gRNA sequence
tgatttaaaaccaaaagatc

SEQ ID NO: 88324 - DNA, 20 bp, Artificial
  CRISPR gRNA sequence
aaaaccaaaagatccctaac

SEQ ID NO: 88325 - DNA, 20 bp, Artificial
  CRISPR gRNA sequence
aaaccaaaagatccctaacc

SEQ ID NO: 88326 - DNA, 20 bp, Artificial
  CRISPR gRNA sequence
acctatatattcatcatact

SEQ ID NO: 88327 - DNA, 20 bp, Artificial
  CRISPR gRNA sequence
tatattcatcatacttagcc

SEQ ID NO: 88328 - DNA, 20 bp, Artificial
  CRISPR gRNA sequence
atcatacttagcccattcct

SEQ ID NO: 88329 - DNA, 20 bp, Artificial
  CRISPR gRNA sequence
agcccattcctaccttccca

SEQ ID NO: 88330 - DNA, 20 bp, Artificial
  CRISPR gRNA sequence
gcccattcctaccttcccac

SEQ ID NO: 88331 - DNA, 20 bp, Artificial
  CRISPR gRNA sequence
ctaccttcccacaggatagc

SEQ ID NO: 88332 - DNA, 20 bp, Artificial
  CRISPR gRNA sequence
ccttcccacaggatagcaca

SEQ ID NO: 88333 - DNA, 20 bp, Artificial
  CRISPR gRNA sequence
cccacaggatagcacaggga

SEQ ID NO: 88334 - DNA, 20 bp, Artificial
  CRISPR gRNA sequence
ccacaggatagcacagggaa

SEQ ID NO: 88335 - DNA, 20 bp, Artificial
  CRISPR gRNA sequence
cagatttattggttacacta

SEQ ID NO: 88336 - DNA, 20 bp, Artificial
  CRISPR gRNA sequence
attggttacactaaagccca

SEQ ID NO: 88337 - DNA, 20 bp, Artificial
  CRISPR gRNA sequence
ttggttacactaaagcccag

SEQ ID NO: 88338 - DNA, 20 bp, Artificial
  CRISPR gRNA sequence
gttacactaaagcccagggt

SEQ ID NO: 88339 - DNA, 20 bp, Artificial
  CRISPR gRNA sequence
cactaaagcccagggtatca

SEQ ID NO: 88340 - DNA, 20 bp, Artificial
  CRISPR gRNA sequence
aagcccagggtatcaagctg

SEQ ID NO: 88341 - DNA, 20 bp, Artificial
  CRISPR gRNA sequence
aaaaggtcagaggcagcaac

SEQ ID NO: 88342 - DNA, 20 bp, Artificial
  CRISPR gRNA sequence
agtagactgggtgactcagc

SEQ ID NO: 88343 - DNA, 20 bp, Artificial
  CRISPR gRNA sequence
ggtgactcagctgtctgtac

SEQ ID NO: 88344 - DNA, 20 bp, Artificial
  CRISPR gRNA sequence
agctgtctgtacagaggaga

SEQ ID NO: 88345 - DNA, 20 bp, Artificial
  CRISPR gRNA sequence
tctgtacagaggagaatgga

SEQ ID NO: 88346 - DNA, 20 bp, Artificial
  CRISPR gRNA sequence
tacagaggagaatggacttc

SEQ ID NO: 88347 - DNA, 20 bp, Artificial
  CRISPR gRNA sequence
ccttaggaaaagaatagcca

SEQ ID NO: 88348 - DNA, 20 bp, Artificial
  CRISPR gRNA sequence
cttaggaaaagaatagccaa

SEQ ID NO: 88349 - DNA, 20 bp, Artificial
  CRISPR gRNA sequence
aggaaaagaatagccaaatg

SEQ ID NO: 88350 - DNA, 20 bp, Artificial
  CRISPR gRNA sequence
ggaaaagaatagccaaatga

SEQ ID NO: 88351 - DNA, 20 bp, Artificial
  CRISPR gRNA sequence
tactaggcaaagttaacgta

SEQ ID NO: 88352 - DNA, 20 bp, Artificial
  CRISPR gRNA sequence
ctaggcaaagttaacgtagg

SEQ ID NO: 88353 - DNA, 20 bp, Artificial
  CRISPR gRNA sequence
ggcaaagttaacgtagggat

SEQ ID NO: 88354 - DNA, 20 bp, Artificial
  CRISPR gRNA sequence
acgtagggatataaacactc

SEQ ID NO: 88355 - DNA, 20 bp, Artificial
  CRISPR gRNA sequence
ttccccacagacctgtatca

SEQ ID NO: 88356 - DNA, 20 bp, Artificial
  CRISPR gRNA sequence
ccccacagacctgtatcatg

SEQ ID NO: 88357 - DNA, 20 bp, Artificial
  CRISPR gRNA sequence
cccacagacctgtatcatgg

SEQ ID NO: 88358 - DNA, 20 bp, Artificial
  CRISPR gRNA sequence
tatcatgggggtgttgcttt

SEQ ID NO: 88359 - DNA, 20 bp, Artificial
  CRISPR gRNA sequence
cttttgggtctttatgctcc

SEQ ID NO: 88360 - DNA, 20 bp, Artificial
  CRISPR gRNA sequence
ttgggtctttatgctcctgg

SEQ ID NO: 88361 - DNA, 20 bp, Artificial
  CRISPR gRNA sequence
tgggtctttatgctcctggg

SEQ ID NO: 88362 - DNA, 20 bp, Artificial
  CRISPR gRNA sequence
gggtctttatgctcctggga

SEQ ID NO: 88363 - DNA, 20 bp, Artificial
  CRISPR gRNA sequence
ggtctttatgctcctgggat

SEQ ID NO: 88364 - DNA, 20 bp, Artificial
  CRISPR gRNA sequence
tatgctcctgggataaggaa

SEQ ID NO: 88365 - DNA, 20 bp, Artificial
  CRISPR gRNA sequence
atgctcctgggataaggaac

SEQ ID NO: 88366 - DNA, 20 bp, Artificial
  CRISPR gRNA sequence
tgctcctgggataaggaact

SEQ ID NO: 88367 - DNA, 20 bp, Artificial
  CRISPR gRNA sequence
ctgggataaggaactttgaa

SEQ ID NO: 88368 - DNA, 20 bp, Artificial
  CRISPR gRNA sequence
ggataaggaactttgaagca

SEQ ID NO: 88369 - DNA, 20 bp, Artificial
  CRISPR gRNA sequence
tgaagcacatgctcctttaa

SEQ ID NO: 88370 - DNA, 20 bp, Artificial
  CRISPR gRNA sequence
gaagcacatgctcctttaag

SEQ ID NO: 88371 - DNA, 20 bp, Artificial
  CRISPR gRNA sequence
aagcacatgctcctttaagt

SEQ ID NO: 88372 - DNA, 20 bp, Artificial
  CRISPR gRNA sequence
ctttaagtctttattaccct

SEQ ID NO: 88373 - DNA, 20 bp, Artificial
  CRISPR gRNA sequence
taagtctttattaccctgtg

SEQ ID NO: 88374 - DNA, 20 bp, Artificial
  CRISPR gRNA sequence
aagtctttattaccctgtgg

SEQ ID NO: 88375 - DNA, 20 bp, Artificial
  CRISPR gRNA sequence
agtctttattaccctgtggt

SEQ ID NO: 88376 - DNA, 20 bp, Artificial
  CRISPR gRNA sequence
tattaccctgtggtgcagtg

SEQ ID NO: 88377 - DNA, 20 bp, Artificial
  CRISPR gRNA sequence
attaccctgtggtgcagtgt

SEQ ID NO: 88378 - DNA, 20 bp, Artificial
  CRISPR gRNA sequence
ttaccctgtggtgcagtgtc

SEQ ID NO: 88379 - DNA, 20 bp, Artificial
  CRISPR gRNA sequence
ccctgtggtgcagtgtctac

SEQ ID NO: 88380 - DNA, 20 bp, Artificial
  CRISPR gRNA sequence
tggtgcagtgtctacctctc

SEQ ID NO: 88381 - DNA, 20 bp, Artificial
  CRISPR gRNA sequence
cctctccctttgccaaagga

SEQ ID NO: 88382 - DNA, 20 bp, Artificial
  CRISPR gRNA sequence
tccctttgccaaaggaaaag

SEQ ID NO: 88383 - DNA, 20 bp, Artificial
  CRISPR gRNA sequence
cctttgccaaaggaaaagcc

SEQ ID NO: 88384 - DNA, 20 bp, Artificial
  CRISPR gRNA sequence
tgccaaaggaaaagcctcct

SEQ ID NO: 88385 - DNA, 20 bp, Artificial
  CRISPR gRNA sequence
gccaaaggaaaagcctcctt

SEQ ID NO: 88386 - DNA, 20 bp, Artificial
  CRISPR gRNA sequence
ccaaaggaaaagcctccttt

SEQ ID NO: 88387 - DNA, 20 bp, Artificial
  CRISPR gRNA sequence
cttttggcttctgctgccct

SEQ ID NO: 88388 - DNA, 20 bp, Artificial
  CRISPR gRNA sequence
ttggcttctgctgcccttga

SEQ ID NO: 88389 - DNA, 20 bp, Artificial
  CRISPR gRNA sequence
tggcttctgctgcccttgat

SEQ ID NO: 88390 - DNA, 20 bp, Artificial
  CRISPR gRNA sequence
ggcttctgctgcccttgatg

SEQ ID NO: 88391 - DNA, 20 bp, Artificial
  CRISPR gRNA sequence
gcttctgctgcccttgatga

SEQ ID NO: 88392 - DNA, 20 bp, Artificial
  CRISPR gRNA sequence
ctgctgcccttgatgacact

SEQ ID NO: 88393 - DNA, 20 bp, Artificial
  CRISPR gRNA sequence
tgctgcccttgatgacactc

SEQ ID NO: 88394 - DNA, 20 bp, Artificial
  CRISPR gRNA sequence
ctgcccttgatgacactcac

SEQ ID NO: 88395 - DNA, 20 bp, Artificial
  CRISPR gRNA sequence
cccttgatgacactcacttt

SEQ ID NO: 88396 - DNA, 20 bp, Artificial
  CRISPR gRNA sequence
gatgacactcacttttgagg

SEQ ID NO: 88397 - DNA, 20 bp, Artificial
  CRISPR gRNA sequence
atgacactcacttttgaggg

SEQ ID NO: 88398 - DNA, 20 bp, Artificial
  CRISPR gRNA sequence
acttttgaggggaccaaggg

SEQ ID NO: 88399 - DNA, 20 bp, Artificial
  CRISPR gRNA sequence
ttgaggggaccaagggaatt

SEQ ID NO: 88400 - DNA, 20 bp, Artificial
  CRISPR gRNA sequence
tgaggggaccaagggaattt

SEQ ID NO: 88401 - DNA, 20 bp, Artificial
  CRISPR gRNA sequence
gaggggaccaagggaatttt

SEQ ID NO: 88402 - DNA, 20 bp, Artificial
  CRISPR gRNA sequence
aggggaccaagggaatttta

SEQ ID NO: 88403 - DNA, 20 bp, Artificial
  CRISPR gRNA sequence
tatcttctgcttctttggta

SEQ ID NO: 88404 - DNA, 20 bp, Artificial
  CRISPR gRNA sequence
atcttctgcttctttggtat

SEQ ID NO: 88405 - DNA, 20 bp, Artificial
  CRISPR gRNA sequence
tcttctgcttctttggtatg

SEQ ID NO: 88406 - DNA, 20 bp, Artificial
  CRISPR gRNA sequence
ctgcttctttggtatgctgg

SEQ ID NO: 88407 - DNA, 20 bp, Artificial
  CRISPR gRNA sequence
tgcttctttggtatgctggg

SEQ ID NO: 88408 - DNA, 20 bp, Artificial
  CRISPR gRNA sequence
cttctttggtatgctgggaa

SEQ ID NO: 88409 - DNA, 20 bp, Artificial
  CRISPR gRNA sequence
ctttggtatgctgggaaccg

SEQ ID NO: 88410 - DNA, 20 bp, Artificial
  CRISPR gRNA sequence
tttggtatgctgggaaccgg

SEQ ID NO: 88411 - DNA, 20 bp, Artificial
  CRISPR gRNA sequence
tggtatgctgggaaccgggg

SEQ ID NO: 88412 - DNA, 20 bp, Artificial
  CRISPR gRNA sequence
ggtatgctgggaaccggggc

SEQ ID NO: 88413 - DNA, 20 bp, Artificial
  CRISPR gRNA sequence
gtatgctgggaaccggggcc

SEQ ID NO: 88414 - DNA, 20 bp, Artificial
  CRISPR gRNA sequence
ggaaccggggccccttcctc

SEQ ID NO: 88415 - DNA, 20 bp, Artificial
  CRISPR gRNA sequence
cctcctttggaaacagtacc

SEQ ID NO: 88416 - DNA, 20 bp, Artificial
  CRISPR gRNA sequence
ctcctttggaaacagtacca

SEQ ID NO: 88417 - DNA, 20 bp, Artificial
  CRISPR gRNA sequence
ctttggaaacagtaccatct

SEQ ID NO: 88418 - DNA, 20 bp, Artificial
  CRISPR gRNA sequence
tggaaacagtaccatctccc

SEQ ID NO: 88419 - DNA, 20 bp, Artificial
  CRISPR gRNA sequence
ggaaacagtaccatctccct

SEQ ID NO: 88420 - DNA, 20 bp, Artificial
  CRISPR gRNA sequence
gaaacagtaccatctccctg

SEQ ID NO: 88421 - DNA, 20 bp, Artificial
  CRISPR gRNA sequence
cctgaccctgggcaagtact

SEQ ID NO: 88422 - DNA, 20 bp, Artificial
  CRISPR gRNA sequence
accctgggcaagtactgccc

SEQ ID NO: 88423 - DNA, 20 bp, Artificial
  CRISPR gRNA sequence
ggcaagtactgccccctttt

SEQ ID NO: 88424 - DNA, 20 bp, Artificial
  CRISPR gRNA sequence
cccccttttcagcctctccc

SEQ ID NO: 88425 - DNA, 20 bp, Artificial
  CRISPR gRNA sequence
ttcagcctctcccattggcc

SEQ ID NO: 88426 - DNA, 20 bp, Artificial
  CRISPR gRNA sequence
tcagcctctcccattggccc

SEQ ID NO: 88427 - DNA, 20 bp, Artificial
  CRISPR gRNA sequence
cagcctctcccattggccct

SEQ ID NO: 88428 - DNA, 20 bp, Artificial
  CRISPR gRNA sequence
agcctctcccattggccctg

SEQ ID NO: 88429 - DNA, 20 bp, Artificial
  CRISPR gRNA sequence
tcccattggccctggcctct

SEQ ID NO: 88430 - DNA, 20 bp, Artificial
  CRISPR gRNA sequence
ccattggccctggcctctct

SEQ ID NO: 88431 - DNA, 20 bp, Artificial
  CRISPR gRNA sequence
gccctggcctctctgcccct

SEQ ID NO: 88432 - DNA, 20 bp, Artificial
  CRISPR gRNA sequence
gcctctctgcccctccagct

SEQ ID NO: 88433 - DNA, 20 bp, Artificial
  CRISPR gRNA sequence
tctgcccctccagctgagtt

SEQ ID NO: 88434 - DNA, 20 bp, Artificial
  CRISPR gRNA sequence
tgcccctccagctgagttgc

SEQ ID NO: 88435 - DNA, 20 bp, Artificial
  CRISPR gRNA sequence
cccctccagctgagttgcct

SEQ ID NO: 88436 - DNA, 20 bp, Artificial
  CRISPR gRNA sequence
cagctgagttgccttcccct

SEQ ID NO: 88437 - DNA, 20 bp, Artificial
  CRISPR gRNA sequence
agttgccttcccctcctgag

SEQ ID NO: 88438 - DNA, 20 bp, Artificial
  CRISPR gRNA sequence
ccttcccctcctgagcccca

SEQ ID NO: 88439 - DNA, 20 bp, Artificial
  CRISPR gRNA sequence
cccctcctgagccccatgtc

SEQ ID NO: 88440 - DNA, 20 bp, Artificial
  CRISPR gRNA sequence
ccctcctgagccccatgtct

SEQ ID NO: 88441 - DNA, 20 bp, Artificial
  CRISPR gRNA sequence
ctgagccccatgtctcccat

SEQ ID NO: 88442 - DNA, 20 bp, Artificial
  CRISPR gRNA sequence
agccccatgtctcccatggt

SEQ ID NO: 88443 - DNA, 20 bp, Artificial
  CRISPR gRNA sequence
ccatggtaaccttgaggact

SEQ ID NO: 88444 - DNA, 20 bp, Artificial
  CRISPR gRNA sequence
gaggactgggcagattccat

SEQ ID NO: 88445 - DNA, 20 bp, Artificial
  CRISPR gRNA sequence
aggactgggcagattccatg

SEQ ID NO: 88446 - DNA, 20 bp, Artificial
  CRISPR gRNA sequence
ggcagattccatggcagctg

SEQ ID NO: 88447 - DNA, 20 bp, Artificial
  CRISPR gRNA sequence
catggcagctgctgacttga

SEQ ID NO: 88448 - DNA, 20 bp, Artificial
  CRISPR gRNA sequence
ctgacttgagaggggtagaa

SEQ ID NO: 88449 - DNA, 20 bp, Artificial
  CRISPR gRNA sequence
acttgagaggggtagaattc

SEQ ID NO: 88450 - DNA, 20 bp, Artificial
  CRISPR gRNA sequence
gagaggggtagaattccttt

SEQ ID NO: 88451 - DNA, 20 bp, Artificial
  CRISPR gRNA sequence
agaggggtagaattcctttc

SEQ ID NO: 88452 - DNA, 20 bp, Artificial
  CRISPR gRNA sequence
ctttccccacttccacctga

SEQ ID NO: 88453 - DNA, 20 bp, Artificial
  CRISPR gRNA sequence
tccccacttccacctgactt

SEQ ID NO: 88454 - DNA, 20 bp, Artificial
  CRISPR gRNA sequence
ccccacttccacctgacttt

SEQ ID NO: 88455 - DNA, 20 bp, Artificial
  CRISPR gRNA sequence
cccacttccacctgactttt

SEQ ID NO: 88456 - DNA, 20 bp, Artificial
  CRISPR gRNA sequence
ccacctgacttttttcgagg

SEQ ID NO: 88457 - DNA, 20 bp, Artificial
  CRISPR gRNA sequence
cacctgacttttttcgaggg

SEQ ID NO: 88458 - DNA, 20 bp, Artificial
  CRISPR gRNA sequence
acttttttcgagggcgcccc

SEQ ID NO: 88459 - DNA, 20 bp, Artificial
  CRISPR gRNA sequence
ttttcgagggcgcccccgtt

SEQ ID NO: 88460 - DNA, 20 bp, Artificial
  CRISPR gRNA sequence
tttcgagggcgcccccgttt

SEQ ID NO: 88461 - DNA, 20 bp, Artificial
  CRISPR gRNA sequence
ttcgagggcgcccccgtttc

SEQ ID NO: 88462 - DNA, 20 bp, Artificial
  CRISPR gRNA sequence
tcgagggcgcccccgtttcc

SEQ ID NO: 88463 - DNA, 20 bp, Artificial
  CRISPR gRNA sequence
cgagggcgcccccgtttcct

SEQ ID NO: 88464 - DNA, 20 bp, Artificial
  CRISPR gRNA sequence
gagggcgcccccgtttcctt

SEQ ID NO: 88465 - DNA, 20 bp, Artificial
  CRISPR gRNA sequence
ccttttggcatcacttgctg

SEQ ID NO: 88466 - DNA, 20 bp, Artificial
  CRISPR gRNA sequence
cttttggcatcacttgctgt

SEQ ID NO: 88467 - DNA, 20 bp, Artificial
  CRISPR gRNA sequence
ttggcatcacttgctgtatc

SEQ ID NO: 88468 - DNA, 20 bp, Artificial
  CRISPR gRNA sequence
tggcatcacttgctgtatcc

SEQ ID NO: 88469 - DNA, 20 bp, Artificial
  CRISPR gRNA sequence
ggcatcacttgctgtatcct

SEQ ID NO: 88470 - DNA, 20 bp, Artificial
  CRISPR gRNA sequence
gcatcacttgctgtatcctc

SEQ ID NO: 88471 - DNA, 20 bp, Artificial
  CRISPR gRNA sequence
gctgtatcctctatatcctg

SEQ ID NO: 88472 - DNA, 20 bp, Artificial
  CRISPR gRNA sequence
ctgtatcctctatatcctgc

SEQ ID NO: 88473 - DNA, 20 bp, Artificial
  CRISPR gRNA sequence
tatcctctatatcctgcttt

SEQ ID NO: 88474 - DNA, 20 bp, Artificial
  CRISPR gRNA sequence
tatatcctgctttgctgctt

SEQ ID NO: 88475 - DNA, 20 bp, Artificial
  CRISPR gRNA sequence
tatcctgctttgctgcttta

SEQ ID NO: 88476 - DNA, 20 bp, Artificial
  CRISPR gRNA sequence
ctttgctgctttagctggtg

SEQ ID NO: 88477 - DNA, 20 bp, Artificial
  CRISPR gRNA sequence
tgctgctttagctggtggag

SEQ ID NO: 88478 - DNA, 20 bp, Artificial
  CRISPR gRNA sequence
gctgctttagctggtggagc

SEQ ID NO: 88479 - DNA, 20 bp, Artificial
  CRISPR gRNA sequence
ctgctttagctggtggagcc

SEQ ID NO: 88480 - DNA, 20 bp, Artificial
  CRISPR gRNA sequence
ctttagctggtggagcctgc

SEQ ID NO: 88481 - DNA, 20 bp, Artificial
  CRISPR gRNA sequence
tagctggtggagcctgccca

SEQ ID NO: 88482 - DNA, 20 bp, Artificial
  CRISPR gRNA sequence
agctggtggagcctgcccac

SEQ ID NO: 88483 - DNA, 20 bp, Artificial
  CRISPR gRNA sequence
gctggtggagcctgcccact

SEQ ID NO: 88484 - DNA, 20 bp, Artificial
  CRISPR gRNA sequence
gtggagcctgcccactggcc

SEQ ID NO: 88485 - DNA, 20 bp, Artificial
  CRISPR gRNA sequence
cccactggcctcactcacag

SEQ ID NO: 88486 - DNA, 20 bp, Artificial
  CRISPR gRNA sequence
gcctcactcacaggtacttc

SEQ ID NO: 88487 - DNA, 20 bp, Artificial
  CRISPR gRNA sequence
actcacaggtacttcagctg

SEQ ID NO: 88488 - DNA, 20 bp, Artificial
  CRISPR gRNA sequence
acaggtacttcagctgtcct

SEQ ID NO: 88489 - DNA, 20 bp, Artificial
  CRISPR gRNA sequence
cagctgtcctcttgacaccc

SEQ ID NO: 88490 - DNA, 20 bp, Artificial
  CRISPR gRNA sequence
agctgtcctcttgacaccct

SEQ ID NO: 88491 - DNA, 20 bp, Artificial
  CRISPR gRNA sequence
tcctcttgacacccttgtca

SEQ ID NO: 88492 - DNA, 20 bp, Artificial
  CRISPR gRNA sequence
ttgacacccttgtcatgtgg

SEQ ID NO: 88493 - DNA, 20 bp, Artificial
  CRISPR gRNA sequence
gacacccttgtcatgtggtc

SEQ ID NO: 88494 - DNA, 20 bp, Artificial
  CRISPR gRNA sequence
acacccttgtcatgtggtcc

SEQ ID NO: 88495 - DNA, 20 bp, Artificial
  CRISPR gRNA sequence
gtcatgtggtccttggtcac

SEQ ID NO: 88496 - DNA, 20 bp, Artificial
  CRISPR gRNA sequence
tcatgtggtccttggtcacc

SEQ ID NO: 88497 - DNA, 20 bp, Artificial
  CRISPR gRNA sequence
ggtcaccacctatgcctacc

SEQ ID NO: 88498 - DNA, 20 bp, Artificial
  CRISPR gRNA sequence
gtcaccacctatgcctacct

SEQ ID NO: 88499 - DNA, 20 bp, Artificial
  CRISPR gRNA sequence
tgcctacctctctgttctct

SEQ ID NO: 88500 - DNA, 20 bp, Artificial
  CRISPR gRNA sequence
cctctctgttctctgtgccc

SEQ ID NO: 88501 - DNA, 20 bp, Artificial
  CRISPR gRNA sequence
tctgttctctgtgccccggg

SEQ ID NO: 88502 - DNA, 20 bp, Artificial
  CRISPR gRNA sequence
tgttctctgtgccccggggc

SEQ ID NO: 88503 - DNA, 20 bp, Artificial
  CRISPR gRNA sequence
ttctctgtgccccggggctg

SEQ ID NO: 88504 - DNA, 20 bp, Artificial
  CRISPR gRNA sequence
tctgtgccccggggctgagt

SEQ ID NO: 88505 - DNA, 20 bp, Artificial
  CRISPR gRNA sequence
tgtgccccggggctgagtga

SEQ ID NO: 88506 - DNA, 20 bp, Artificial
  CRISPR gRNA sequence
tgccccggggctgagtgagt

SEQ ID NO: 88507 - DNA, 20 bp, Artificial
  CRISPR gRNA sequence
agtgagtcccccaggtggag

SEQ ID NO: 88508 - DNA, 20 bp, Artificial
  CRISPR gRNA sequence
gcccaggcccaggtccaggt

SEQ ID NO: 88509 - DNA, 20 bp, Artificial
  CRISPR gRNA sequence
gtaagatcatgttaatgatg

SEQ ID NO: 88510 - DNA, 20 bp, Artificial
  CRISPR gRNA sequence
atgatgggcacagctgctgg

SEQ ID NO: 88511 - DNA, 20 bp, Artificial
  CRISPR gRNA sequence
ctgggggtgccccggcccta

SEQ ID NO: 88512 - DNA, 20 bp, Artificial
  CRISPR gRNA sequence
ggggtgccccggccctacta

SEQ ID NO: 88513 - DNA, 20 bp, Artificial
  CRISPR gRNA sequence
ctagacagaggcagtgtagc

SEQ ID NO: 88514 - DNA, 20 bp, Artificial
  CRISPR gRNA sequence
gacagaggcagtgtagccac

SEQ ID NO: 88515 - DNA, 20 bp, Artificial
  CRISPR gRNA sequence
tcagggcacctgaagaaagc

SEQ ID NO: 88516 - DNA, 20 bp, Artificial
  CRISPR gRNA sequence
cagggcacctgaagaaagcc

SEQ ID NO: 88517 - DNA, 20 bp, Artificial
  CRISPR gRNA sequence
agggcacctgaagaaagcct

SEQ ID NO: 88518 - DNA, 20 bp, Artificial
  CRISPR gRNA sequence
aagaaagcctgggggccaga

SEQ ID NO: 88519 - DNA, 20 bp, Artificial
  CRISPR gRNA sequence
ggggccagaataggtggaga

SEQ ID NO: 88520 - DNA, 20 bp, Artificial
  CRISPR gRNA sequence
ggattggcggaattagtgag

SEQ ID NO: 88521 - DNA, 20 bp, Artificial
  CRISPR gRNA sequence
gcggaattagtgagcgaggg

SEQ ID NO: 88522 - DNA, 20 bp, Artificial
  CRISPR gRNA sequence
gtgagcgaggggcccgggga

SEQ ID NO: 88523 - DNA, 20 bp, Artificial
  CRISPR gRNA sequence
gggcattaacctgcaggtta

SEQ ID NO: 88524 - DNA, 20 bp, Artificial
  CRISPR gRNA sequence
acctgcaggttattggctcc

SEQ ID NO: 88525 - DNA, 20 bp, Artificial
  CRISPR gRNA sequence
caggttattggctcctgggg

SEQ ID NO: 88526 - DNA, 20 bp, Artificial
  CRISPR gRNA sequence
ttggctcctggggccgagct

SEQ ID NO: 88527 - DNA, 20 bp, Artificial
  CRISPR gRNA sequence
gctcctggggccgagctctc

SEQ ID NO: 88528 - DNA, 20 bp, Artificial
  CRISPR gRNA sequence
ctggggccgagctctcaact

SEQ ID NO: 88529 - DNA, 20 bp, Artificial
  CRISPR gRNA sequence
gggccgagctctcaactaca

SEQ ID NO: 88530 - DNA, 20 bp, Artificial
  CRISPR gRNA sequence
tcaactacactcttcttccg

SEQ ID NO: 88531 - DNA, 20 bp, Artificial
  CRISPR gRNA sequence
aactacactcttcttccgct

SEQ ID NO: 88532 - DNA, 20 bp, Artificial
  CRISPR gRNA sequence
cactcttcttccgctctcca

SEQ ID NO: 88533 - DNA, 20 bp, Artificial
  CRISPR gRNA sequence
ttcttccgctctccacgtgc

SEQ ID NO: 88534 - DNA, 20 bp, Artificial
  CRISPR gRNA sequence
cttccgctctccacgtgcga

SEQ ID NO: 88535 - DNA, 20 bp, Artificial
  CRISPR gRNA sequence
ttccgctctccacgtgcgag

SEQ ID NO: 88536 - DNA, 20 bp, Artificial
  CRISPR gRNA sequence
ccgctctccacgtgcgagag

SEQ ID NO: 88537 - DNA, 20 bp, Artificial
  CRISPR gRNA sequence
cgctctccacgtgcgagagg

SEQ ID NO: 88538 - DNA, 20 bp, Artificial
  CRISPR gRNA sequence
tccacgtgcgagaggaccgg

SEQ ID NO: 88539 - DNA, 20 bp, Artificial
  CRISPR gRNA sequence
cacgtgcgagaggaccggcc

SEQ ID NO: 88540 - DNA, 20 bp, Artificial
  CRISPR gRNA sequence
gggcttccagatccttagga

SEQ ID NO: 88541 - DNA, 20 bp, Artificial
  CRISPR gRNA sequence
ccagatccttaggaggctaa

SEQ ID NO: 88542 - DNA, 20 bp, Artificial
  CRISPR gRNA sequence
cagatccttaggaggctaaa

SEQ ID NO: 88543 - DNA, 20 bp, Artificial
  CRISPR gRNA sequence
aggaggctaaaaagtaaaga

SEQ ID NO: 88544 - DNA, 20 bp, Artificial
  CRISPR gRNA sequence
ggaggctaaaaagtaaagag

SEQ ID NO: 88545 - DNA, 20 bp, Artificial
  CRISPR gRNA sequence
aaaagtaaagagaggaacac

SEQ ID NO: 88546 - DNA, 20 bp, Artificial
  CRISPR gRNA sequence
ggggaaacatagacgccaga

SEQ ID NO: 88547 - DNA, 20 bp, Artificial
  CRISPR gRNA sequence
gagaaggatatactaagccc

SEQ ID NO: 88548 - DNA, 20 bp, Artificial
  CRISPR gRNA sequence
agcccccagcccaggacagc

SEQ ID NO: 88549 - DNA, 20 bp, Artificial
  CRISPR gRNA sequence
acttccttacctgggccagt

SEQ ID NO: 88550 - DNA, 20 bp, Artificial
  CRISPR gRNA sequence
ccttacctgggccagtctct

SEQ ID NO: 88551 - DNA, 20 bp, Artificial
  CRISPR gRNA sequence
cttacctgggccagtctctc

SEQ ID NO: 88552 - DNA, 20 bp, Artificial
  CRISPR gRNA sequence
acctgggccagtctctctgg

SEQ ID NO: 88553 - DNA, 20 bp, Artificial
  CRISPR gRNA sequence
cctgggccagtctctctggc

SEQ ID NO: 88554 - DNA, 20 bp, Artificial
  CRISPR gRNA sequence
ggccagtctctctggcttct

SEQ ID NO: 88555 - DNA, 20 bp, Artificial
  CRISPR gRNA sequence
tctggcttcttgtgggctcc

SEQ ID NO: 88556 - DNA, 20 bp, Artificial
  CRISPR gRNA sequence
tggcttcttgtgggctccac

SEQ ID NO: 88557 - DNA, 20 bp, Artificial
  CRISPR gRNA sequence
gcttcttgtgggctccaccc

SEQ ID NO: 88558 - DNA, 20 bp, Artificial
  CRISPR gRNA sequence
cttgtgggctccaccctctg

SEQ ID NO: 88559 - DNA, 20 bp, Artificial
  CRISPR gRNA sequence
ttgtgggctccaccctctgg

SEQ ID NO: 88560 - DNA, 20 bp, Artificial
  CRISPR gRNA sequence
gtgggctccaccctctgggt

SEQ ID NO: 88561 - DNA, 20 bp, Artificial
  CRISPR gRNA sequence
tgggctccaccctctgggtt

SEQ ID NO: 88562 - DNA, 20 bp, Artificial
  CRISPR gRNA sequence
caccctctgggttctctaaa

SEQ ID NO: 88563 - DNA, 20 bp, Artificial
  CRISPR gRNA sequence
tgggttctctaaaccattct

SEQ ID NO: 88564 - DNA, 20 bp, Artificial
  CRISPR gRNA sequence
ggttctctaaaccattcttt

SEQ ID NO: 88565 - DNA, 20 bp, Artificial
  CRISPR gRNA sequence
tctaaaccattctttggttt

SEQ ID NO: 88566 - DNA, 20 bp, Artificial
  CRISPR gRNA sequence
taaaccattctttggtttag

SEQ ID NO: 88567 - DNA, 20 bp, Artificial
  CRISPR gRNA sequence
aaccattctttggtttagat

SEQ ID NO: 88568 - DNA, 20 bp, Artificial
  CRISPR gRNA sequence
tttggtttagatgaccgttc

SEQ ID NO: 88569 - DNA, 20 bp, Artificial
  CRISPR gRNA sequence
tggtttagatgaccgttccc

SEQ ID NO: 88570 - DNA, 20 bp, Artificial
  CRISPR gRNA sequence
ggtttagatgaccgttcccg

SEQ ID NO: 88571 - DNA, 20 bp, Artificial
  CRISPR gRNA sequence
gtttagatgaccgttcccga

SEQ ID NO: 88572 - DNA, 20 bp, Artificial
  CRISPR gRNA sequence
agatgaccgttcccgaggtg

SEQ ID NO: 88573 - DNA, 20 bp, Artificial
  CRISPR gRNA sequence
gatgaccgttcccgaggtgc

SEQ ID NO: 88574 - DNA, 20 bp, Artificial
  CRISPR gRNA sequence
ccgaggtgcatgttcgtcct

SEQ ID NO: 88575 - DNA, 20 bp, Artificial
  CRISPR gRNA sequence
gtcctcttctgcagaggtac

SEQ ID NO: 88576 - DNA, 20 bp, Artificial
  CRISPR gRNA sequence
ttctgcagaggtaccaaaaa

SEQ ID NO: 88577 - DNA, 20 bp, Artificial
  CRISPR gRNA sequence
ctgcagaggtaccaaaaagg

SEQ ID NO: 88578 - DNA, 20 bp, Artificial
  CRISPR gRNA sequence
tgcagaggtaccaaaaaggt

SEQ ID NO: 88579 - DNA, 20 bp, Artificial
  CRISPR gRNA sequence
cagaggtaccaaaaaggtaa

SEQ ID NO: 88580 - DNA, 20 bp, Artificial
  CRISPR gRNA sequence
aggaataggggagtgaggca

SEQ ID NO: 88581 - DNA, 20 bp, Artificial
  CRISPR gRNA sequence
tgattgactgactggtagag

SEQ ID NO: 88582 - DNA, 20 bp, Artificial
  CRISPR gRNA sequence
attgactgactggtagagac

SEQ ID NO: 88583 - DNA, 20 bp, Artificial
  CRISPR gRNA sequence
actgactggtagagacagga

SEQ ID NO: 88584 - DNA, 20 bp, Artificial
  CRISPR gRNA sequence
actggtagagacaggaaatg

SEQ ID NO: 88585 - DNA, 20 bp, Artificial
  CRISPR gRNA sequence
gtagagacaggaaatggggt

SEQ ID NO: 88586 - DNA, 20 bp, Artificial
  CRISPR gRNA sequence
aagcatgtcttagaagggtc

SEQ ID NO: 88587 - DNA, 20 bp, Artificial
  CRISPR gRNA sequence
agaagggtctccaggaagag

SEQ ID NO: 88588 - DNA, 20 bp, Artificial
  CRISPR gRNA sequence
gaagggtctccaggaagagg

SEQ ID NO: 88589 - DNA, 20 bp, Artificial
  CRISPR gRNA sequence
caggaagagggggcaaatcc

SEQ ID NO: 88590 - DNA, 20 bp, Artificial
  CRISPR gRNA sequence
tattctagtgtgtgggaggg

SEQ ID NO: 88591 - DNA, 20 bp, Artificial
  CRISPR gRNA sequence
ttctagtgtgtgggagggcc

SEQ ID NO: 88592 - DNA, 20 bp, Artificial
  CRISPR gRNA sequence
tagtgtgtgggagggccact

SEQ ID NO: 88593 - DNA, 20 bp, Artificial
  CRISPR gRNA sequence
gtgtgtgggagggccactga

SEQ ID NO: 88594 - DNA, 20 bp, Artificial
  CRISPR gRNA sequence
aagctgaaagtggctcaggg

SEQ ID NO: 88595 - DNA, 20 bp, Artificial
  CRISPR gRNA sequence
aaagtggctcagggttgctg

SEQ ID NO: 88596 - DNA, 20 bp, Artificial
  CRISPR gRNA sequence
agggttgctgagacataaga

SEQ ID NO: 88597 - DNA, 20 bp, Artificial
  CRISPR gRNA sequence
ctgagacataagagagggtc

SEQ ID NO: 88598 - DNA, 20 bp, Artificial
  CRISPR gRNA sequence
agacataagagagggtcaac

SEQ ID NO: 88599 - DNA, 20 bp, Artificial
  CRISPR gRNA sequence
aagcacatgggcatgtgcag

SEQ ID NO: 88600 - DNA, 20 bp, Artificial
  CRISPR gRNA sequence
agcacatgggcatgtgcaga

SEQ ID NO: 88601 - DNA, 20 bp, Artificial
  CRISPR gRNA sequence
ctgtagcaggaagcgggcga

SEQ ID NO: 88602 - DNA, 20 bp, Artificial
  CRISPR gRNA sequence
tagcaggaagcgggcgacct

SEQ ID NO: 88603 - DNA, 20 bp, Artificial
  CRISPR gRNA sequence
aacgatggaactgaaggacc

SEQ ID NO: 88604 - DNA, 20 bp, Artificial
  CRISPR gRNA sequence
aaggaccgtttcaggatccg

SEQ ID NO: 88605 - DNA, 20 bp, Artificial
  CRISPR gRNA sequence
caggatccgctctgcccagt

SEQ ID NO: 88606 - DNA, 20 bp, Artificial
  CRISPR gRNA sequence
aggatccgctctgcccagtc

SEQ ID NO: 88607 - DNA, 20 bp, Artificial
  CRISPR gRNA sequence
tgcccagtcacaggtcaggg

SEQ ID NO: 88608 - DNA, 20 bp, Artificial
  CRISPR gRNA sequence
cccagtcacaggtcagggca

SEQ ID NO: 88609 - DNA, 20 bp, Artificial
  CRISPR gRNA sequence
cctccaccagttcatctcga

SEQ ID NO: 88610 - DNA, 20 bp, Artificial
  CRISPR gRNA sequence
caccagttcatctcgaggtg

SEQ ID NO: 88611 - DNA, 20 bp, Artificial
  CRISPR gRNA sequence
atctcgaggtgctggggtta

SEQ ID NO: 88612 - DNA, 20 bp, Artificial
  CRISPR gRNA sequence
gaggtgctggggttacttct

SEQ ID NO: 88613 - DNA, 20 bp, Artificial
  CRISPR gRNA sequence
gggttacttctgggcccatt

SEQ ID NO: 88614 - DNA, 20 bp, Artificial
  CRISPR gRNA sequence
cttctgggcccatttctggc

SEQ ID NO: 88615 - DNA, 20 bp, Artificial
  CRISPR gRNA sequence
ctgggcccatttctggctga

SEQ ID NO: 88616 - DNA, 20 bp, Artificial
  CRISPR gRNA sequence
tgggcccatttctggctgaa

SEQ ID NO: 88617 - DNA, 20 bp, Artificial
  CRISPR gRNA sequence
ggcccatttctggctgaagt

SEQ ID NO: 88618 - DNA, 20 bp, Artificial
  CRISPR gRNA sequence
ctggctgaagtggggaagga

SEQ ID NO: 88619 - DNA, 20 bp, Artificial
  CRISPR gRNA sequence
tggctgaagtggggaaggac

SEQ ID NO: 88620 - DNA, 20 bp, Artificial
  CRISPR gRNA sequence
gctgaagtggggaaggacat

SEQ ID NO: 88621 - DNA, 20 bp, Artificial
  CRISPR gRNA sequence
aagtggggaaggacatgccc

SEQ ID NO: 88622 - DNA, 20 bp, Artificial
  CRISPR gRNA sequence
caaattaaagaacccttgcc

SEQ ID NO: 88623 - DNA, 20 bp, Artificial
  CRISPR gRNA sequence
aagaacccttgcctcctctc

SEQ ID NO: 88624 - DNA, 20 bp, Artificial
  CRISPR gRNA sequence
gcctcctctcttgtcagaga

SEQ ID NO: 88625 - DNA, 20 bp, Artificial
  CRISPR gRNA sequence
cctcctctcttgtcagagat

SEQ ID NO: 88626 - DNA, 20 bp, Artificial
  CRISPR gRNA sequence
ctctcttgtcagagatcaaa

SEQ ID NO: 88627 - DNA, 20 bp, Artificial
  CRISPR gRNA sequence
tcttgtcagagatcaaagac

SEQ ID NO: 88628 - DNA, 20 bp, Artificial
  CRISPR gRNA sequence
ttgtcagagatcaaagacta

SEQ ID NO: 88629 - DNA, 20 bp, Artificial
  CRISPR gRNA sequence
gtcagagatcaaagactatt

SEQ ID NO: 88630 - DNA, 20 bp, Artificial
  CRISPR gRNA sequence
tcagagatcaaagactattg

SEQ ID NO: 88631 - DNA, 20 bp, Artificial
  CRISPR gRNA sequence
ttgaccaaagctgagaccag

SEQ ID NO: 88632 - DNA, 20 bp, Artificial
  CRISPR gRNA sequence
accaaagctgagaccagact

SEQ ID NO: 88633 - DNA, 20 bp, Artificial
  CRISPR gRNA sequence
agaccagactggggatggga

SEQ ID NO: 88634 - DNA, 20 bp, Artificial
  CRISPR gRNA sequence
gggatgggagtagcctctac

SEQ ID NO: 88635 - DNA, 20 bp, Artificial
  CRISPR gRNA sequence
tacctatcccattgcagaag

SEQ ID NO: 88636 - DNA, 20 bp, Artificial
  CRISPR gRNA sequence
cctatcccattgcagaagcc

SEQ ID NO: 88637 - DNA, 20 bp, Artificial
  CRISPR gRNA sequence
tcccattgcagaagcccaca

SEQ ID NO: 88638 - DNA, 20 bp, Artificial
  CRISPR gRNA sequence
cagaagcccacaagttctct

SEQ ID NO: 88639 - DNA, 20 bp, Artificial
  CRISPR gRNA sequence
tcttcatcctctgcctcagc

SEQ ID NO: 88640 - DNA, 20 bp, Artificial
  CRISPR gRNA sequence
ttcatcctctgcctcagcta

SEQ ID NO: 88641 - DNA, 20 bp, Artificial
  CRISPR gRNA sequence
catcctctgcctcagctaca

SEQ ID NO: 88642 - DNA, 20 bp, Artificial
  CRISPR gRNA sequence
atcctctgcctcagctacag

SEQ ID NO: 88643 - DNA, 20 bp, Artificial
  CRISPR gRNA sequence
tgcctcagctacagggttgg

SEQ ID NO: 88644 - DNA, 20 bp, Artificial
  CRISPR gRNA sequence
cctcagctacagggttggca

SEQ ID NO: 88645 - DNA, 20 bp, Artificial
  CRISPR gRNA sequence
agctacagggttggcagaag

SEQ ID NO: 88646 - DNA, 20 bp, Artificial
  CRISPR gRNA sequence
cagggttggcagaagggaac

SEQ ID NO: 88647 - DNA, 20 bp, Artificial
  CRISPR gRNA sequence
gcagaagggaacatcatacc

SEQ ID NO: 88648 - DNA, 20 bp, Artificial
  CRISPR gRNA sequence
gaagctatgtacataatgac

SEQ ID NO: 88649 - DNA, 20 bp, Artificial
  CRISPR gRNA sequence
tgtacataatgactgaggct

SEQ ID NO: 88650 - DNA, 20 bp, Artificial
  CRISPR gRNA sequence
aggctgttagccctcaaaac

SEQ ID NO: 88651 - DNA, 20 bp, Artificial
  CRISPR gRNA sequence
ttagccctcaaaacatgccc

SEQ ID NO: 88652 - DNA, 20 bp, Artificial
  CRISPR gRNA sequence
gccctcaaaacatgccccaa

SEQ ID NO: 88653 - DNA, 20 bp, Artificial
  CRISPR gRNA sequence
aaaacatgccccaaagacct

SEQ ID NO: 88654 - DNA, 20 bp, Artificial
  CRISPR gRNA sequence
tgacttttacctgggagaga

SEQ ID NO: 88655 - DNA, 20 bp, Artificial
  CRISPR gRNA sequence
acttttacctgggagagaag

SEQ ID NO: 88656 - DNA, 20 bp, Artificial
  CRISPR gRNA sequence
ttacctgggagagaagagtg

SEQ ID NO: 88657 - DNA, 20 bp, Artificial
  CRISPR gRNA sequence
tacctgggagagaagagtgg

SEQ ID NO: 88658 - DNA, 20 bp, Artificial
  CRISPR gRNA sequence
acctgggagagaagagtgga

SEQ ID NO: 88659 - DNA, 20 bp, Artificial
  CRISPR gRNA sequence
cctgggagagaagagtggaa

SEQ ID NO: 88660 - DNA, 20 bp, Artificial
  CRISPR gRNA sequence
ggagagaagagtggaattgg

SEQ ID NO: 88661 - DNA, 20 bp, Artificial
  CRISPR gRNA sequence
gaaggtgatttggtacttac

SEQ ID NO: 88662 - DNA, 20 bp, Artificial
  CRISPR gRNA sequence
ggtacttacactctcagaac

SEQ ID NO: 88663 - DNA, 20 bp, Artificial
  CRISPR gRNA sequence
gtacttacactctcagaacc

SEQ ID NO: 88664 - DNA, 20 bp, Artificial
  CRISPR gRNA sequence
acactctcagaaccctttag

SEQ ID NO: 88665 - DNA, 20 bp, Artificial
  CRISPR gRNA sequence
cactctcagaaccctttagg

SEQ ID NO: 88666 - DNA, 20 bp, Artificial
  CRISPR gRNA sequence
tcagaaccctttaggtcaag

SEQ ID NO: 88667 - DNA, 20 bp, Artificial
  CRISPR gRNA sequence
agaaccctttaggtcaagtc

SEQ ID NO: 88668 - DNA, 20 bp, Artificial
  CRISPR gRNA sequence
taggtcaagtccaggcaggg

SEQ ID NO: 88669 - DNA, 20 bp, Artificial
  CRISPR gRNA sequence
aggtcaagtccaggcagggg

SEQ ID NO: 88670 - DNA, 20 bp, Artificial
  CRISPR gRNA sequence
ggtcaagtccaggcaggggt

SEQ ID NO: 88671 - DNA, 20 bp, Artificial
  CRISPR gRNA sequence
cctccttatgccactgtagc

SEQ ID NO: 88672 - DNA, 20 bp, Artificial
  CRISPR gRNA sequence
ctccttatgccactgtagca

SEQ ID NO: 88673 - DNA, 20 bp, Artificial
  CRISPR gRNA sequence
cttatgccactgtagcaata

SEQ ID NO: 88674 - DNA, 20 bp, Artificial
  CRISPR gRNA sequence
atgccactgtagcaatatct

SEQ ID NO: 88675 - DNA, 20 bp, Artificial
  CRISPR gRNA sequence
tgccactgtagcaatatctg

SEQ ID NO: 88676 - DNA, 20 bp, Artificial
  CRISPR gRNA sequence
tagcaatatctgatgcaagt

SEQ ID NO: 88677 - DNA, 20 bp, Artificial
  CRISPR gRNA sequence
atgcaagttaaagagcagcc

SEQ ID NO: 88678 - DNA, 20 bp, Artificial
  CRISPR gRNA sequence
aagagcagccaacacatggc

SEQ ID NO: 88679 - DNA, 20 bp, Artificial
  CRISPR gRNA sequence
caagcccctcgagcaagtta

SEQ ID NO: 88680 - DNA, 20 bp, Artificial
  CRISPR gRNA sequence
gagcaagttaagctgttcca

SEQ ID NO: 88681 - DNA, 20 bp, Artificial
  CRISPR gRNA sequence
agctgttccactccttgctc

SEQ ID NO: 88682 - DNA, 20 bp, Artificial
  CRISPR gRNA sequence
ttccactccttgctctccac

SEQ ID NO: 88683 - DNA, 20 bp, Artificial
  CRISPR gRNA sequence
cactccttgctctccacatc

SEQ ID NO: 88684 - DNA, 20 bp, Artificial
  CRISPR gRNA sequence
cttgctctccacatcctaag

SEQ ID NO: 88685 - DNA, 20 bp, Artificial
  CRISPR gRNA sequence
gctctccacatcctaagtct

SEQ ID NO: 88686 - DNA, 20 bp, Artificial
  CRISPR gRNA sequence
ctctccacatcctaagtctt

SEQ ID NO: 88687 - DNA, 20 bp, Artificial
  CRISPR gRNA sequence
tccacatcctaagtcttcct

SEQ ID NO: 88688 - DNA, 20 bp, Artificial
  CRISPR gRNA sequence
cacatcctaagtcttcctcc

SEQ ID NO: 88689 - DNA, 20 bp, Artificial
  CRISPR gRNA sequence
agtcttcctcccaggtcctc

SEQ ID NO: 88690 - DNA, 20 bp, Artificial
  CRISPR gRNA sequence
cctcccaggtcctccacccc

SEQ ID NO: 88691 - DNA, 20 bp, Artificial
  CRISPR gRNA sequence
ctcccaggtcctccaccccc

SEQ ID NO: 88692 - DNA, 20 bp, Artificial
  CRISPR gRNA sequence
ccaggtcctccacccccaac

SEQ ID NO: 88693 - DNA, 20 bp, Artificial
  CRISPR gRNA sequence
cacccccaacctctctagtc

SEQ ID NO: 88694 - DNA, 20 bp, Artificial
  CRISPR gRNA sequence
tctagtcaaggatacttgga

SEQ ID NO: 88695 - DNA, 20 bp, Artificial
  CRISPR gRNA sequence
tagtcaaggatacttggact

SEQ ID NO: 88696 - DNA, 20 bp, Artificial
  CRISPR gRNA sequence
gtcaaggatacttggactgg

SEQ ID NO: 88697 - DNA, 20 bp, Artificial
  CRISPR gRNA sequence
ggactggccccggccaccaa

SEQ ID NO: 88698 - DNA, 20 bp, Artificial
  CRISPR gRNA sequence
gactggccccggccaccaag

SEQ ID NO: 88699 - DNA, 20 bp, Artificial
  CRISPR gRNA sequence
gccccggccaccaagccttc

SEQ ID NO: 88700 - DNA, 20 bp, Artificial
  CRISPR gRNA sequence
cgagctttgatgtcagggaa

SEQ ID NO: 88701 - DNA, 20 bp, Artificial
  CRISPR gRNA sequence
gagctttgatgtcagggaag

SEQ ID NO: 88702 - DNA, 20 bp, Artificial
  CRISPR gRNA sequence
tgatgtcagggaagatctct

SEQ ID NO: 88703 - DNA, 20 bp, Artificial
  CRISPR gRNA sequence
gatgtcagggaagatctctc

SEQ ID NO: 88704 - DNA, 20 bp, Artificial
  CRISPR gRNA sequence
atgtcagggaagatctctct

SEQ ID NO: 88705 - DNA, 20 bp, Artificial
  CRISPR gRNA sequence
tctgatgatcttgccaaagt

SEQ ID NO: 88706 - DNA, 20 bp, Artificial
  CRISPR gRNA sequence
tgatgatcttgccaaagttg

SEQ ID NO: 88707 - DNA, 20 bp, Artificial
  CRISPR gRNA sequence
atgatcttgccaaagttggc

SEQ ID NO: 88708 - DNA, 20 bp, Artificial
  CRISPR gRNA sequence
gccaaagttggctgtgctga

SEQ ID NO: 88709 - DNA, 20 bp, Artificial
  CRISPR gRNA sequence
ccaaagttggctgtgctgag

SEQ ID NO: 88710 - DNA, 20 bp, Artificial
  CRISPR gRNA sequence
gctgtgctgagtgggcggca

SEQ ID NO: 88711 - DNA, 20 bp, Artificial
  CRISPR gRNA sequence
tgctgagtgggcggcaacag

SEQ ID NO: 88712 - DNA, 20 bp, Artificial
  CRISPR gRNA sequence
agtgggcggcaacaggcaag

SEQ ID NO: 88713 - DNA, 20 bp, Artificial
  CRISPR gRNA sequence
tcacagtacttcctgagtga

SEQ ID NO: 88714 - DNA, 20 bp, Artificial
  CRISPR gRNA sequence
acagtacttcctgagtgaga

SEQ ID NO: 88715 - DNA, 20 bp, Artificial
  CRISPR gRNA sequence
cctgagtgagaggggagcag

SEQ ID NO: 88716 - DNA, 20 bp, Artificial
  CRISPR gRNA sequence
ctgagtgagaggggagcaga

SEQ ID NO: 88717 - DNA, 20 bp, Artificial
  CRISPR gRNA sequence
agtgagaggggagcagagtg

SEQ ID NO: 88718 - DNA, 20 bp, Artificial
  CRISPR gRNA sequence
agagaaggaggccatgggta

SEQ ID NO: 88719 - DNA, 20 bp, Artificial
  CRISPR gRNA sequence
gaagagtccctagggatcaa

SEQ ID NO: 88720 - DNA, 20 bp, Artificial
  CRISPR gRNA sequence
gggatcaagtgtgaggaacc

SEQ ID NO: 88721 - DNA, 20 bp, Artificial
  CRISPR gRNA sequence
taagaaggcaggctttatca

SEQ ID NO: 88722 - DNA, 20 bp, Artificial
  CRISPR gRNA sequence
aagaaggcaggctttatcaa

SEQ ID NO: 88723 - DNA, 20 bp, Artificial
  CRISPR gRNA sequence
agaaggcaggctttatcaag

SEQ ID NO: 88724 - DNA, 20 bp, Artificial
  CRISPR gRNA sequence
tatcaaggcaggaagctctt

SEQ ID NO: 88725 - DNA, 20 bp, Artificial
  CRISPR gRNA sequence
atcaaggcaggaagctcttc

SEQ ID NO: 88726 - DNA, 20 bp, Artificial
  CRISPR gRNA sequence
tcaaggcaggaagctcttca

SEQ ID NO: 88727 - DNA, 20 bp, Artificial
  CRISPR gRNA sequence
ttcatgggtgagggggtcct

SEQ ID NO: 88728 - DNA, 20 bp, Artificial
  CRISPR gRNA sequence
catgggtgagggggtcctat

SEQ ID NO: 88729 - DNA, 20 bp, Artificial
  CRISPR gRNA sequence
atgggtgagggggtcctatg

SEQ ID NO: 88730 - DNA, 20 bp, Artificial
  CRISPR gRNA sequence
tgcccaccaatccactcatc

SEQ ID NO: 88731 - DNA, 20 bp, Artificial
  CRISPR gRNA sequence
atcccaccacccacccctcc

SEQ ID NO: 88732 - DNA, 20 bp, Artificial
  CRISPR gRNA sequence
cacccaccgataggcatcat

SEQ ID NO: 88733 - DNA, 20 bp, Artificial
  CRISPR gRNA sequence
tgctttggcagacaggtgtc

SEQ ID NO: 88734 - DNA, 20 bp, Artificial
  CRISPR gRNA sequence
gctttggcagacaggtgtca

SEQ ID NO: 88735 - DNA, 20 bp, Artificial
  CRISPR gRNA sequence
ctttggcagacaggtgtcag

SEQ ID NO: 88736 - DNA, 20 bp, Artificial
  CRISPR gRNA sequence
tggcagacaggtgtcagtgt

SEQ ID NO: 88737 - DNA, 20 bp, Artificial
  CRISPR gRNA sequence
ggcagacaggtgtcagtgtg

SEQ ID NO: 88738 - DNA, 20 bp, Artificial
  CRISPR gRNA sequence
gcagacaggtgtcagtgtgc

SEQ ID NO: 88739 - DNA, 20 bp, Artificial
  CRISPR gRNA sequence
ttccaggtggttgcggatcc

SEQ ID NO: 88740 - DNA, 20 bp, Artificial
  CRISPR gRNA sequence
ccaggtggttgcggatccac

SEQ ID NO: 88741 - DNA, 20 bp, Artificial
  CRISPR gRNA sequence
caggtggttgcggatccacc

SEQ ID NO: 88742 - DNA, 20 bp, Artificial
  CRISPR gRNA sequence
cggatccacctataggcata

SEQ ID NO: 88743 - DNA, 20 bp, Artificial
  CRISPR gRNA sequence
taggcatacatgtactcctc

SEQ ID NO: 88744 - DNA, 20 bp, Artificial
  CRISPR gRNA sequence
ctcattgctcagtgtacttg

SEQ ID NO: 88745 - DNA, 20 bp, Artificial
  CRISPR gRNA sequence
attgctcagtgtacttggct

SEQ ID NO: 88746 - DNA, 20 bp, Artificial
  CRISPR gRNA sequence
ctcagtgtacttggctctga

SEQ ID NO: 88747 - DNA, 20 bp, Artificial
  CRISPR gRNA sequence
agtgtacttggctctgagct

SEQ ID NO: 88748 - DNA, 20 bp, Artificial
  CRISPR gRNA sequence
ggctctgagctacagaaaca

SEQ ID NO: 88749 - DNA, 20 bp, Artificial
  CRISPR gRNA sequence
gctctgagctacagaaacaa

SEQ ID NO: 88750 - DNA, 20 bp, Artificial
  CRISPR gRNA sequence
tgagctacagaaacaaaagg

SEQ ID NO: 88751 - DNA, 20 bp, Artificial
  CRISPR gRNA sequence
agctacagaaacaaaaggaa

SEQ ID NO: 88752 - DNA, 20 bp, Artificial
  CRISPR gRNA sequence
cagaaacaaaaggaacaagc

SEQ ID NO: 88753 - DNA, 20 bp, Artificial
  CRISPR gRNA sequence
ctaagaccctaacagttgtc

SEQ ID NO: 88754 - DNA, 20 bp, Artificial
  CRISPR gRNA sequence
agaccctaacagttgtcctg

SEQ ID NO: 88755 - DNA, 20 bp, Artificial
  CRISPR gRNA sequence
acagttgtcctggttcttcc

SEQ ID NO: 88756 - DNA, 20 bp, Artificial
  CRISPR gRNA sequence
tcctggttcttcccaaacta

SEQ ID NO: 88757 - DNA, 20 bp, Artificial
  CRISPR gRNA sequence
gttcttcccaaactaccact

SEQ ID NO: 88758 - DNA, 20 bp, Artificial
  CRISPR gRNA sequence
ttcccaaactaccacttcag

SEQ ID NO: 88759 - DNA, 20 bp, Artificial
  CRISPR gRNA sequence
cccaaactaccacttcagta

SEQ ID NO: 88760 - DNA, 20 bp, Artificial
  CRISPR gRNA sequence
ccaaactaccacttcagtag

SEQ ID NO: 88761 - DNA, 20 bp, Artificial
  CRISPR gRNA sequence
ccacttcagtagtgctggac

SEQ ID NO: 88762 - DNA, 20 bp, Artificial
  CRISPR gRNA sequence
cagtagtgctggaccaaatt

SEQ ID NO: 88763 - DNA, 20 bp, Artificial
  CRISPR gRNA sequence
agtagtgctggaccaaattt

SEQ ID NO: 88764 - DNA, 20 bp, Artificial
  CRISPR gRNA sequence
gaccaaatttagttcaccca

SEQ ID NO: 88765 - DNA, 20 bp, Artificial
  CRISPR gRNA sequence
agttcacccagaatctaact

SEQ ID NO: 88766 - DNA, 20 bp, Artificial
  CRISPR gRNA sequence
gttcacccagaatctaactt

SEQ ID NO: 88767 - DNA, 20 bp, Artificial
  CRISPR gRNA sequence
acccagaatctaactttccc

SEQ ID NO: 88768 - DNA, 20 bp, Artificial
  CRISPR gRNA sequence
actttccctggtaaaccaag

SEQ ID NO: 88769 - DNA, 20 bp, Artificial
  CRISPR gRNA sequence
tccctggtaaaccaagtcag

SEQ ID NO: 88770 - DNA, 20 bp, Artificial
  CRISPR gRNA sequence
ccctggtaaaccaagtcagg

SEQ ID NO: 88771 - DNA, 20 bp, Artificial
  CRISPR gRNA sequence
cctggtaaaccaagtcaggg

SEQ ID NO: 88772 - DNA, 20 bp, Artificial
  CRISPR gRNA sequence
gtaaaccaagtcagggcgag

SEQ ID NO: 88773 - DNA, 20 bp, Artificial
  CRISPR gRNA sequence
tcctcttcatcaaggacagc

SEQ ID NO: 88774 - DNA, 20 bp, Artificial
  CRISPR gRNA sequence
cctcttcatcaaggacagca

SEQ ID NO: 88775 - DNA, 20 bp, Artificial
  CRISPR gRNA sequence
ctcttcatcaaggacagcat

SEQ ID NO: 88776 - DNA, 20 bp, Artificial
  CRISPR gRNA sequence
ttcatcaaggacagcattta

SEQ ID NO: 88777 - DNA, 20 bp, Artificial
  CRISPR gRNA sequence
catcaaggacagcatttacg

SEQ ID NO: 88778 - DNA, 20 bp, Artificial
  CRISPR gRNA sequence
atcaaggacagcatttacga

SEQ ID NO: 88779 - DNA, 20 bp, Artificial
  CRISPR gRNA sequence
acgagtattcctattcacct

SEQ ID NO: 88780 - DNA, 20 bp, Artificial
  CRISPR gRNA sequence
cgagtattcctattcacctc

SEQ ID NO: 88781 - DNA, 20 bp, Artificial
  CRISPR gRNA sequence
ctattcacctcaccccttcc

SEQ ID NO: 88782 - DNA, 20 bp, Artificial
  CRISPR gRNA sequence
ttcacctcaccccttcccag

SEQ ID NO: 88783 - DNA, 20 bp, Artificial
  CRISPR gRNA sequence
acctcaccccttcccagtga

SEQ ID NO: 88784 - DNA, 20 bp, Artificial
  CRISPR gRNA sequence
accccttcccagtgaacctt

SEQ ID NO: 88785 - DNA, 20 bp, Artificial
  CRISPR gRNA sequence
cccagtgaacctttctctaa

SEQ ID NO: 88786 - DNA, 20 bp, Artificial
  CRISPR gRNA sequence
ccagtgaacctttctctaag

SEQ ID NO: 88787 - DNA, 20 bp, Artificial
  CRISPR gRNA sequence
tctctaagaatcagaacctc

SEQ ID NO: 88788 - DNA, 20 bp, Artificial
  CRISPR gRNA sequence
ctctaagaatcagaacctct

SEQ ID NO: 88789 - DNA, 20 bp, Artificial
  CRISPR gRNA sequence
tctaagaatcagaacctctg

SEQ ID NO: 88790 - DNA, 20 bp, Artificial
  CRISPR gRNA sequence
taagaatcagaacctctgcc

SEQ ID NO: 88791 - DNA, 20 bp, Artificial
  CRISPR gRNA sequence
agaatcagaacctctgccat

SEQ ID NO: 88792 - DNA, 20 bp, Artificial
  CRISPR gRNA sequence
tgccatctaaaactactatc

SEQ ID NO: 88793 - DNA, 20 bp, Artificial
  CRISPR gRNA sequence
ccatctaaaactactatcaa

SEQ ID NO: 88794 - DNA, 20 bp, Artificial
  CRISPR gRNA sequence
aaactactatcaaacctacc

SEQ ID NO: 88795 - DNA, 20 bp, Artificial
  CRISPR gRNA sequence
ctatcaaacctaccttttgt

SEQ ID NO: 88796 - DNA, 20 bp, Artificial
  CRISPR gRNA sequence
tcaaacctaccttttgtctc

SEQ ID NO: 88797 - DNA, 20 bp, Artificial
  CRISPR gRNA sequence
ccttttgtctccagtggtgg

SEQ ID NO: 88798 - DNA, 20 bp, Artificial
  CRISPR gRNA sequence
ttgtctccagtggtgggtcc

SEQ ID NO: 88799 - DNA, 20 bp, Artificial
  CRISPR gRNA sequence
tgtctccagtggtgggtcct

SEQ ID NO: 88800 - DNA, 20 bp, Artificial
  CRISPR gRNA sequence
gtctccagtggtgggtcctg

SEQ ID NO: 88801 - DNA, 20 bp, Artificial
  CRISPR gRNA sequence
tctccagtggtgggtcctga

SEQ ID NO: 88802 - DNA, 20 bp, Artificial
  CRISPR gRNA sequence
cagtggtgggtcctgagggg

SEQ ID NO: 88803 - DNA, 20 bp, Artificial
  CRISPR gRNA sequence
aggggagctgaaggtagaga

SEQ ID NO: 88804 - DNA, 20 bp, Artificial
  CRISPR gRNA sequence
aaggtagagatacagcttgt

SEQ ID NO: 88805 - DNA, 20 bp, Artificial
  CRISPR gRNA sequence
gtcattgtcagaaaatttct

SEQ ID NO: 88806 - DNA, 20 bp, Artificial
  CRISPR gRNA sequence
tcattgtcagaaaatttctg

SEQ ID NO: 88807 - DNA, 20 bp, Artificial
  CRISPR gRNA sequence
tcagaaaatttctgtacatc

SEQ ID NO: 88808 - DNA, 20 bp, Artificial
  CRISPR gRNA sequence
ctgtacatcttgctgaggta

SEQ ID NO: 88809 - DNA, 20 bp, Artificial
  CRISPR gRNA sequence
tgtacatcttgctgaggtag

SEQ ID NO: 88810 - DNA, 20 bp, Artificial
  CRISPR gRNA sequence
tacatcttgctgaggtagga

SEQ ID NO: 88811 - DNA, 20 bp, Artificial
  CRISPR gRNA sequence
gctgaggtaggagagaacag

SEQ ID NO: 88812 - DNA, 20 bp, Artificial
  CRISPR gRNA sequence
ctgaggtaggagagaacaga

SEQ ID NO: 88813 - DNA, 20 bp, Artificial
  CRISPR gRNA sequence
aggtaggagagaacagaggc

SEQ ID NO: 88814 - DNA, 20 bp, Artificial
  CRISPR gRNA sequence
tgatccccacaccaaagtct

SEQ ID NO: 88815 - DNA, 20 bp, Artificial
  CRISPR gRNA sequence
atccccacaccaaagtctag

SEQ ID NO: 88816 - DNA, 20 bp, Artificial
  CRISPR gRNA sequence
gctgacttacagggtgtcag

SEQ ID NO: 88817 - DNA, 20 bp, Artificial
  CRISPR gRNA sequence
acttacagggtgtcagactg

SEQ ID NO: 88818 - DNA, 20 bp, Artificial
  CRISPR gRNA sequence
acagggtgtcagactgaaaa

SEQ ID NO: 88819 - DNA, 20 bp, Artificial
  CRISPR gRNA sequence
cagggtgtcagactgaaaaa

SEQ ID NO: 88820 - DNA, 20 bp, Artificial
  CRISPR gRNA sequence
aaaaaggaccttagaaatta

SEQ ID NO: 88821 - DNA, 20 bp, Artificial
  CRISPR gRNA sequence
agaaattatttgacaaggcc

SEQ ID NO: 88822 - DNA, 20 bp, Artificial
  CRISPR gRNA sequence
gaaattatttgacaaggccg

SEQ ID NO: 88823 - DNA, 20 bp, Artificial
  CRISPR gRNA sequence
tttgacaaggccgggcacgg

SEQ ID NO: 88824 - DNA, 20 bp, Artificial
  CRISPR gRNA sequence
gacaaggccgggcacggtgg

SEQ ID NO: 88825 - DNA, 20 bp, Artificial
  CRISPR gRNA sequence
acaaggccgggcacggtggc

SEQ ID NO: 88826 - DNA, 20 bp, Artificial
  CRISPR gRNA sequence
acgcctacaatcccagcact

SEQ ID NO: 88827 - DNA, 20 bp, Artificial
  CRISPR gRNA sequence
caatcccagcactttggaag

SEQ ID NO: 88828 - DNA, 20 bp, Artificial
  CRISPR gRNA sequence
tggaaggccaaggcaggctg

SEQ ID NO: 88829 - DNA, 20 bp, Artificial
  CRISPR gRNA sequence
ggaaggccaaggcaggctga

SEQ ID NO: 88830 - DNA, 20 bp, Artificial
  CRISPR gRNA sequence
gaaggccaaggcaggctgat

SEQ ID NO: 88831 - DNA, 20 bp, Artificial
  CRISPR gRNA sequence
atcacaaggtcaggagatcg

SEQ ID NO: 88832 - DNA, 20 bp, Artificial
  CRISPR gRNA sequence
gctaacatggtgaaaccccg

SEQ ID NO: 88833 - DNA, 20 bp, Artificial
  CRISPR gRNA sequence
acatggtgaaaccccgtttc

SEQ ID NO: 88834 - DNA, 20 bp, Artificial
  CRISPR gRNA sequence
ctactaaaaatacaaaaaaa

SEQ ID NO: 88835 - DNA, 20 bp, Artificial
  CRISPR gRNA sequence
tactaaaaatacaaaaaaaa

SEQ ID NO: 88836 - DNA, 20 bp, Artificial
  CRISPR gRNA sequence
ctaaaaatacaaaaaaaaat

SEQ ID NO: 88837 - DNA, 20 bp, Artificial
  CRISPR gRNA sequence
aaaatacaaaaaaaaattag

SEQ ID NO: 88838 - DNA, 20 bp, Artificial
  CRISPR gRNA sequence
gctgggtgtggtgacgggcg

SEQ ID NO: 88839 - DNA, 20 bp, Artificial
  CRISPR gRNA sequence
ggtgtggtgacgggcgcctg

SEQ ID NO: 88840 - DNA, 20 bp, Artificial
  CRISPR gRNA sequence
tagtcccagctacttgggag

SEQ ID NO: 88841 - DNA, 20 bp, Artificial
  CRISPR gRNA sequence
cttgggaggctgaggcagga

SEQ ID NO: 88842 - DNA, 20 bp, Artificial
  CRISPR gRNA sequence
gggaggctgaggcaggagaa

SEQ ID NO: 88843 - DNA, 20 bp, Artificial
  CRISPR gRNA sequence
ggaggctgaggcaggagaat

SEQ ID NO: 88844 - DNA, 20 bp, Artificial
  CRISPR gRNA sequence
aggcaggagaatggcgtgaa

SEQ ID NO: 88845 - DNA, 20 bp, Artificial
  CRISPR gRNA sequence
ggaggcggagcttgcagtga

SEQ ID NO: 88846 - DNA, 20 bp, Artificial
  CRISPR gRNA sequence
gcagtgagccgagattgcgc

SEQ ID NO: 88847 - DNA, 20 bp, Artificial
  CRISPR gRNA sequence
cagtgagccgagattgcgcc

SEQ ID NO: 88848 - DNA, 20 bp, Artificial
  CRISPR gRNA sequence
cgccactgcactccagccta

SEQ ID NO: 88849 - DNA, 20 bp, Artificial
  CRISPR gRNA sequence
cactccagcctaggcgacag

SEQ ID NO: 88850 - DNA, 20 bp, Artificial
  CRISPR gRNA sequence
cagcctaggcgacagagtga

SEQ ID NO: 88851 - DNA, 20 bp, Artificial
  CRISPR gRNA sequence
ggcgacagagtgagactcca

SEQ ID NO: 88852 - DNA, 20 bp, Artificial
  CRISPR gRNA sequence
catctcaaaaaaaaaaaaaa

SEQ ID NO: 88853 - DNA, 20 bp, Artificial
  CRISPR gRNA sequence
aaaaaaaaaaaaaaaaaaga

SEQ ID NO: 88854 - DNA, 20 bp, Artificial
  CRISPR gRNA sequence
tttgatgctaggtgctctga

SEQ ID NO: 88855 - DNA, 20 bp, Artificial
  CRISPR gRNA sequence
gatgctaggtgctctgagga

SEQ ID NO: 88856 - DNA, 20 bp, Artificial
  CRISPR gRNA sequence
atgctaggtgctctgaggag

SEQ ID NO: 88857 - DNA, 20 bp, Artificial
  CRISPR gRNA sequence
ggtgctctgaggagccctat

SEQ ID NO: 88858 - DNA, 20 bp, Artificial
  CRISPR gRNA sequence
tgaggagccctataggctac

SEQ ID NO: 88859 - DNA, 20 bp, Artificial
  CRISPR gRNA sequence
aggagccctataggctacca

SEQ ID NO: 88860 - DNA, 20 bp, Artificial
  CRISPR gRNA sequence
taggctaccatggagaggag

SEQ ID NO: 88861 - DNA, 20 bp, Artificial
  CRISPR gRNA sequence
ccatggagaggagggaagta

SEQ ID NO: 88862 - DNA, 20 bp, Artificial
  CRISPR gRNA sequence
tgacttcatctctgctgggc

SEQ ID NO: 88863 - DNA, 20 bp, Artificial
  CRISPR gRNA sequence
acttcatctctgctgggctt

SEQ ID NO: 88864 - DNA, 20 bp, Artificial
  CRISPR gRNA sequence
catctctgctgggcttctat

SEQ ID NO: 88865 - DNA, 20 bp, Artificial
  CRISPR gRNA sequence
atctctgctgggcttctatg

SEQ ID NO: 88866 - DNA, 20 bp, Artificial
  CRISPR gRNA sequence
tgctgggcttctatgcaagt

SEQ ID NO: 88867 - DNA, 20 bp, Artificial
  CRISPR gRNA sequence
ctgggcttctatgcaagtgc

SEQ ID NO: 88868 - DNA, 20 bp, Artificial
  CRISPR gRNA sequence
ggcttctatgcaagtgctca

SEQ ID NO: 88869 - DNA, 20 bp, Artificial
  CRISPR gRNA sequence
ctatgcaagtgctcacagag

SEQ ID NO: 88870 - DNA, 20 bp, Artificial
  CRISPR gRNA sequence
tatgcaagtgctcacagaga

SEQ ID NO: 88871 - DNA, 20 bp, Artificial
  CRISPR gRNA sequence
tgcaagtgctcacagagatc

SEQ ID NO: 88872 - DNA, 20 bp, Artificial
  CRISPR gRNA sequence
acagagatcaagtgagaggc

SEQ ID NO: 88873 - DNA, 20 bp, Artificial
  CRISPR gRNA sequence
gcagcaagtttgcaaagcca

SEQ ID NO: 88874 - DNA, 20 bp, Artificial
  CRISPR gRNA sequence
gcaaagccaactatcttctg

SEQ ID NO: 88875 - DNA, 20 bp, Artificial
  CRISPR gRNA sequence
caaagccaactatcttctga

SEQ ID NO: 88876 - DNA, 20 bp, Artificial
  CRISPR gRNA sequence
tcttctgacaaggcagagga

SEQ ID NO: 88877 - DNA, 20 bp, Artificial
  CRISPR gRNA sequence
ctgacaaggcagaggaccct

SEQ ID NO: 88878 - DNA, 20 bp, Artificial
  CRISPR gRNA sequence
tgacaaggcagaggacccta

SEQ ID NO: 88879 - DNA, 20 bp, Artificial
  CRISPR gRNA sequence
acaaggcagaggaccctacc

SEQ ID NO: 88880 - DNA, 20 bp, Artificial
  CRISPR gRNA sequence
cctctcccacatcaatgttt

SEQ ID NO: 88881 - DNA, 20 bp, Artificial
  CRISPR gRNA sequence
tcccacatcaatgttttgtt

SEQ ID NO: 88882 - DNA, 20 bp, Artificial
  CRISPR gRNA sequence
ccacatcaatgttttgttga

SEQ ID NO: 88883 - DNA, 20 bp, Artificial
  CRISPR gRNA sequence
tgttgatgcccatcatcctc

SEQ ID NO: 88884 - DNA, 20 bp, Artificial
  CRISPR gRNA sequence
gttgatgcccatcatcctca

SEQ ID NO: 88885 - DNA, 20 bp, Artificial
  CRISPR gRNA sequence
ttgatgcccatcatcctcac

SEQ ID NO: 88886 - DNA, 20 bp, Artificial
  CRISPR gRNA sequence
atgcccatcatcctcacatc

SEQ ID NO: 88887 - DNA, 20 bp, Artificial
  CRISPR gRNA sequence
acatcctcctccctcagcat

SEQ ID NO: 88888 - DNA, 20 bp, Artificial
  CRISPR gRNA sequence
ctccctcagcatttccatcc

SEQ ID NO: 88889 - DNA, 20 bp, Artificial
  CRISPR gRNA sequence
cctcagcatttccatccctc

SEQ ID NO: 88890 - DNA, 20 bp, Artificial
  CRISPR gRNA sequence
agcatttccatccctctctt

SEQ ID NO: 88891 - DNA, 20 bp, Artificial
  CRISPR gRNA sequence
ccatccctctcttgccctct

SEQ ID NO: 88892 - DNA, 20 bp, Artificial
  CRISPR gRNA sequence
catccctctcttgccctctt

SEQ ID NO: 88893 - DNA, 20 bp, Artificial
  CRISPR gRNA sequence
tcttgccctcttccccaaca

SEQ ID NO: 88894 - DNA, 20 bp, Artificial
  CRISPR gRNA sequence
ttgccctcttccccaacaca

SEQ ID NO: 88895 - DNA, 20 bp, Artificial
  CRISPR gRNA sequence
gccctcttccccaacacact

SEQ ID NO: 88896 - DNA, 20 bp, Artificial
  CRISPR gRNA sequence
ccctcttccccaacacactt

SEQ ID NO: 88897 - DNA, 20 bp, Artificial
  CRISPR gRNA sequence
ttccccaacacacttaccag

SEQ ID NO: 88898 - DNA, 20 bp, Artificial
  CRISPR gRNA sequence
ccccaacacacttaccagga

SEQ ID NO: 88899 - DNA, 20 bp, Artificial
  CRISPR gRNA sequence
cccaacacacttaccaggat

SEQ ID NO: 88900 - DNA, 20 bp, Artificial
  CRISPR gRNA sequence
accaggatcccctctacttt

SEQ ID NO: 88901 - DNA, 20 bp, Artificial
  CRISPR gRNA sequence
ccaggatcccctctactttg

SEQ ID NO: 88902 - DNA, 20 bp, Artificial
  CRISPR gRNA sequence
tactttgttctgcacggcct

SEQ ID NO: 88903 - DNA, 20 bp, Artificial
  CRISPR gRNA sequence
ctttgttctgcacggccttg

SEQ ID NO: 88904 - DNA, 20 bp, Artificial
  CRISPR gRNA sequence
tgttctgcacggccttgctg

SEQ ID NO: 88905 - DNA, 20 bp, Artificial
  CRISPR gRNA sequence
gttctgcacggccttgctgt

SEQ ID NO: 88906 - DNA, 20 bp, Artificial
  CRISPR gRNA sequence
ttctgcacggccttgctgtg

SEQ ID NO: 88907 - DNA, 20 bp, Artificial
  CRISPR gRNA sequence
tgcacggccttgctgtgggg

SEQ ID NO: 88908 - DNA, 20 bp, Artificial
  CRISPR gRNA sequence
cacggccttgctgtggggaa

SEQ ID NO: 88909 - DNA, 20 bp, Artificial
  CRISPR gRNA sequence
gctgtggggaagaggagaaa

SEQ ID NO: 88910 - DNA, 20 bp, Artificial
  CRISPR gRNA sequence
ctgtggggaagaggagaaag

SEQ ID NO: 88911 - DNA, 20 bp, Artificial
  CRISPR gRNA sequence
tggggaagaggagaaagctg

SEQ ID NO: 88912 - DNA, 20 bp, Artificial
  CRISPR gRNA sequence
gaggtcacacacaagatttt

SEQ ID NO: 88913 - DNA, 20 bp, Artificial
  CRISPR gRNA sequence
tccctgtctctttatctgac

SEQ ID NO: 88914 - DNA, 20 bp, Artificial
  CRISPR gRNA sequence
ccctgtctctttatctgact

SEQ ID NO: 88915 - DNA, 20 bp, Artificial
  CRISPR gRNA sequence
cctgtctctttatctgactg

SEQ ID NO: 88916 - DNA, 20 bp, Artificial
  CRISPR gRNA sequence
tctctttatctgactgctag

SEQ ID NO: 88917 - DNA, 20 bp, Artificial
  CRISPR gRNA sequence
tttatctgactgctagggag

SEQ ID NO: 88918 - DNA, 20 bp, Artificial
  CRISPR gRNA sequence
tatctgactgctagggaggg

SEQ ID NO: 88919 - DNA, 20 bp, Artificial
  CRISPR gRNA sequence
atctgactgctagggaggga

SEQ ID NO: 88920 - DNA, 20 bp, Artificial
  CRISPR gRNA sequence
tctgactgctagggagggaa

SEQ ID NO: 88921 - DNA, 20 bp, Artificial
  CRISPR gRNA sequence
actgctagggagggaaaagg

SEQ ID NO: 88922 - DNA, 20 bp, Artificial
  CRISPR gRNA sequence
ctagggagggaaaaggactg

SEQ ID NO: 88923 - DNA, 20 bp, Artificial
  CRISPR gRNA sequence
gggagggaaaaggactgaaa

SEQ ID NO: 88924 - DNA, 20 bp, Artificial
  CRISPR gRNA sequence
aaatgcccagcaggtgctca

SEQ ID NO: 88925 - DNA, 20 bp, Artificial
  CRISPR gRNA sequence
aagaattgctaccatggcca

SEQ ID NO: 88926 - DNA, 20 bp, Artificial
  CRISPR gRNA sequence
ctaccatggccaaaaatctc

SEQ ID NO: 88927 - DNA, 20 bp, Artificial
  CRISPR gRNA sequence
ccatggccaaaaatctccct

SEQ ID NO: 88928 - DNA, 20 bp, Artificial
  CRISPR gRNA sequence
cctctgctcccatgcccttg

SEQ ID NO: 88929 - DNA, 20 bp, Artificial
  CRISPR gRNA sequence
tgctcccatgcccttgctga

SEQ ID NO: 88930 - DNA, 20 bp, Artificial
  CRISPR gRNA sequence
ctcccatgcccttgctgaga

SEQ ID NO: 88931 - DNA, 20 bp, Artificial
  CRISPR gRNA sequence
ccatgcccttgctgagaggc

SEQ ID NO: 88932 - DNA, 20 bp, Artificial
  CRISPR gRNA sequence
gctgagaggcagttcatcta

SEQ ID NO: 88933 - DNA, 20 bp, Artificial
  CRISPR gRNA sequence
ctgagaggcagttcatctac

SEQ ID NO: 88934 - DNA, 20 bp, Artificial
  CRISPR gRNA sequence
agaggcagttcatctacagc

SEQ ID NO: 88935 - DNA, 20 bp, Artificial
  CRISPR gRNA sequence
atctacagccaaagtgaagt

SEQ ID NO: 88936 - DNA, 20 bp, Artificial
  CRISPR gRNA sequence
cagccaaagtgaagtgctgc

SEQ ID NO: 88937 - DNA, 20 bp, Artificial
  CRISPR gRNA sequence
cagggatctatactcaggtc

SEQ ID NO: 88938 - DNA, 20 bp, Artificial
  CRISPR gRNA sequence
tactcaggtcttggacagga

SEQ ID NO: 88939 - DNA, 20 bp, Artificial
  CRISPR gRNA sequence
aggtcttggacaggacttgg

SEQ ID NO: 88940 - DNA, 20 bp, Artificial
  CRISPR gRNA sequence
ggacaggacttggagatgtg

SEQ ID NO: 88941 - DNA, 20 bp, Artificial
  CRISPR gRNA sequence
gacaggacttggagatgtga

SEQ ID NO: 88942 - DNA, 20 bp, Artificial
  CRISPR gRNA sequence
ggagatgtgatgagtactta

SEQ ID NO: 88943 - DNA, 20 bp, Artificial
  CRISPR gRNA sequence
gagatgtgatgagtacttac

SEQ ID NO: 88944 - DNA, 20 bp, Artificial
  CRISPR gRNA sequence
acgaaatggtacctcggagc

SEQ ID NO: 88945 - DNA, 20 bp, Artificial
  CRISPR gRNA sequence
cgaaatggtacctcggagcc

SEQ ID NO: 88946 - DNA, 20 bp, Artificial
  CRISPR gRNA sequence
ggagcctctgaagaagggtg

SEQ ID NO: 88947 - DNA, 20 bp, Artificial
  CRISPR gRNA sequence
tgaagaagggtggtaggttc

SEQ ID NO: 88948 - DNA, 20 bp, Artificial
  CRISPR gRNA sequence
aagaagggtggtaggttccc

SEQ ID NO: 88949 - DNA, 20 bp, Artificial
  CRISPR gRNA sequence
cccagcctcagcaccacctg

SEQ ID NO: 88950 - DNA, 20 bp, Artificial
  CRISPR gRNA sequence
agcaccacctgggggggccc

SEQ ID NO: 88951 - DNA, 20 bp, Artificial
  CRISPR gRNA sequence
ggggggcccttcccccagtc

SEQ ID NO: 88952 - DNA, 20 bp, Artificial
  CRISPR gRNA sequence
cccccagtcttggggctctt

SEQ ID NO: 88953 - DNA, 20 bp, Artificial
  CRISPR gRNA sequence
ccccagtcttggggctctta

SEQ ID NO: 88954 - DNA, 20 bp, Artificial
  CRISPR gRNA sequence
ggggctcttagcatcaggct

SEQ ID NO: 88955 - DNA, 20 bp, Artificial
  CRISPR gRNA sequence
gggctcttagcatcaggctc

SEQ ID NO: 88956 - DNA, 20 bp, Artificial
  CRISPR gRNA sequence
ttagcatcaggctcatcttc

SEQ ID NO: 88957 - DNA, 20 bp, Artificial
  CRISPR gRNA sequence
agcatcaggctcatcttctg

SEQ ID NO: 88958 - DNA, 20 bp, Artificial
  CRISPR gRNA sequence
gcatcaggctcatcttctgc

SEQ ID NO: 88959 - DNA, 20 bp, Artificial
  CRISPR gRNA sequence
atcttctgccatcccggcat

SEQ ID NO: 88960 - DNA, 20 bp, Artificial
  CRISPR gRNA sequence
ctgccatcccggcatgaggg

SEQ ID NO: 88961 - DNA, 20 bp, Artificial
  CRISPR gRNA sequence
tgccatcccggcatgagggc

SEQ ID NO: 88962 - DNA, 20 bp, Artificial
  CRISPR gRNA sequence
ccatcccggcatgagggcta

SEQ ID NO: 88963 - DNA, 20 bp, Artificial
  CRISPR gRNA sequence
gaattgagagggacaggcat

SEQ ID NO: 88964 - DNA, 20 bp, Artificial
  CRISPR gRNA sequence
agagggacaggcataaagat

SEQ ID NO: 88965 - DNA, 20 bp, Artificial
  CRISPR gRNA sequence
acactggccttcccttcccc

SEQ ID NO: 88966 - DNA, 20 bp, Artificial
  CRISPR gRNA sequence
gccttcccttccccagaagg

SEQ ID NO: 88967 - DNA, 20 bp, Artificial
  CRISPR gRNA sequence
cccttccccagaaggcccca

SEQ ID NO: 88968 - DNA, 20 bp, Artificial
  CRISPR gRNA sequence
ccttccccagaaggccccag

SEQ ID NO: 88969 - DNA, 20 bp, Artificial
  CRISPR gRNA sequence
ccccagaaggccccagggca

SEQ ID NO: 88970 - DNA, 20 bp, Artificial
  CRISPR gRNA sequence
cccagaaggccccagggcac

SEQ ID NO: 88971 - DNA, 20 bp, Artificial
  CRISPR gRNA sequence
ctcatctctttacccagaaa

SEQ ID NO: 88972 - DNA, 20 bp, Artificial
  CRISPR gRNA sequence
atctctttacccagaaaggc

SEQ ID NO: 88973 - DNA, 20 bp, Artificial
  CRISPR gRNA sequence
tttacccagaaaggcagaga

SEQ ID NO: 88974 - DNA, 20 bp, Artificial
  CRISPR gRNA sequence
tacccagaaaggcagagaaa

SEQ ID NO: 88975 - DNA, 20 bp, Artificial
  CRISPR gRNA sequence
acccagaaaggcagagaaac

SEQ ID NO: 88976 - DNA, 20 bp, Artificial
  CRISPR gRNA sequence
cccagaaaggcagagaaaca

SEQ ID NO: 88977 - DNA, 20 bp, Artificial
  CRISPR gRNA sequence
cgaatttccccggtggtctt

SEQ ID NO: 88978 - DNA, 20 bp, Artificial
  CRISPR gRNA sequence
ccccggtggtctttttctca

SEQ ID NO: 88979 - DNA, 20 bp, Artificial
  CRISPR gRNA sequence
cccggtggtctttttctcac

SEQ ID NO: 88980 - DNA, 20 bp, Artificial
  CRISPR gRNA sequence
tttctcaccacttgccttct

SEQ ID NO: 88981 - DNA, 20 bp, Artificial
  CRISPR gRNA sequence
ttctcaccacttgccttctc

SEQ ID NO: 88982 - DNA, 20 bp, Artificial
  CRISPR gRNA sequence
tctcaccacttgccttctcc

SEQ ID NO: 88983 - DNA, 20 bp, Artificial
  CRISPR gRNA sequence
ctcaccacttgccttctccg

SEQ ID NO: 88984 - DNA, 20 bp, Artificial
  CRISPR gRNA sequence
tcaccacttgccttctccga

SEQ ID NO: 88985 - DNA, 20 bp, Artificial
  CRISPR gRNA sequence
accacttgccttctccgaaa

SEQ ID NO: 88986 - DNA, 20 bp, Artificial
  CRISPR gRNA sequence
gccttctccgaaaattagaa

SEQ ID NO: 88987 - DNA, 20 bp, Artificial
  CRISPR gRNA sequence
ccttctccgaaaattagaaa

SEQ ID NO: 88988 - DNA, 20 bp, Artificial
  CRISPR gRNA sequence
ctccgaaaattagaaattat

SEQ ID NO: 88989 - DNA, 20 bp, Artificial
  CRISPR gRNA sequence
tccgaaaattagaaattatt

SEQ ID NO: 88990 - DNA, 20 bp, Artificial
  CRISPR gRNA sequence
cgaaaattagaaattattcc

SEQ ID NO: 88991 - DNA, 20 bp, Artificial
  CRISPR gRNA sequence
gaaattattccattacttcg

SEQ ID NO: 88992 - DNA, 20 bp, Artificial
  CRISPR gRNA sequence
ttccattacttcgccaggcc

SEQ ID NO: 88993 - DNA, 20 bp, Artificial
  CRISPR gRNA sequence
cattacttcgccaggcccat

SEQ ID NO: 88994 - DNA, 20 bp, Artificial
  CRISPR gRNA sequence
cttcgccaggcccatatatg

SEQ ID NO: 88995 - DNA, 20 bp, Artificial
  CRISPR gRNA sequence
cgccaggcccatatatgccc

SEQ ID NO: 88996 - DNA, 20 bp, Artificial
  CRISPR gRNA sequence
gccaggcccatatatgccca

SEQ ID NO: 88997 - DNA, 20 bp, Artificial
  CRISPR gRNA sequence
tgccatctccattctatctg

SEQ ID NO: 88998 - DNA, 20 bp, Artificial
  CRISPR gRNA sequence
gccatctccattctatctgc

SEQ ID NO: 88999 - DNA, 20 bp, Artificial
  CRISPR gRNA sequence
ccatctccattctatctgcc

SEQ ID NO: 89000 - DNA, 20 bp, Artificial
  CRISPR gRNA sequence
cattctatctgccccacctt

SEQ ID NO: 89001 - DNA, 20 bp, Artificial
  CRISPR gRNA sequence
tatctgccccacctttctga

SEQ ID NO: 89002 - DNA, 20 bp, Artificial
  CRISPR gRNA sequence
tctgccccacctttctgaag

SEQ ID NO: 89003 - DNA, 20 bp, Artificial
  CRISPR gRNA sequence
ccccacctttctgaagtctc

SEQ ID NO: 89004 - DNA, 20 bp, Artificial
  CRISPR gRNA sequence
tctgaagtctcctaaatctg

SEQ ID NO: 89005 - DNA, 20 bp, Artificial
  CRISPR gRNA sequence
ctgaagtctcctaaatctgg

SEQ ID NO: 89006 - DNA, 20 bp, Artificial
  CRISPR gRNA sequence
tgaagtctcctaaatctgga

SEQ ID NO: 89007 - DNA, 20 bp, Artificial
  CRISPR gRNA sequence
aagtctcctaaatctggaaa

SEQ ID NO: 89008 - DNA, 20 bp, Artificial
  CRISPR gRNA sequence
ctaaatctggaaaactgtaa

SEQ ID NO: 89009 - DNA, 20 bp, Artificial
  CRISPR gRNA sequence
aatctggaaaactgtaaagg

SEQ ID NO: 89010 - DNA, 20 bp, Artificial
  CRISPR gRNA sequence
gaaaactgtaaaggaagaga

SEQ ID NO: 89011 - DNA, 20 bp, Artificial
  CRISPR gRNA sequence
taaaggaagagataggggga

SEQ ID NO: 89012 - DNA, 20 bp, Artificial
  CRISPR gRNA sequence
ggaatccatgttagcaagaa

SEQ ID NO: 89013 - DNA, 20 bp, Artificial
  CRISPR gRNA sequence
gcaagaaattttcatttctg

SEQ ID NO: 89014 - DNA, 20 bp, Artificial
  CRISPR gRNA sequence
tcatttctgcctctgacccc

SEQ ID NO: 89015 - DNA, 20 bp, Artificial
  CRISPR gRNA sequence
catttctgcctctgacccca

SEQ ID NO: 89016 - DNA, 20 bp, Artificial
  CRISPR gRNA sequence
atttctgcctctgaccccat

SEQ ID NO: 89017 - DNA, 20 bp, Artificial
  CRISPR gRNA sequence
ctgcctctgaccccatactg

SEQ ID NO: 89018 - DNA, 20 bp, Artificial
  CRISPR gRNA sequence
tgcctctgaccccatactgc

SEQ ID NO: 89019 - DNA, 20 bp, Artificial
  CRISPR gRNA sequence
cctctgaccccatactgccc

SEQ ID NO: 89020 - DNA, 20 bp, Artificial
  CRISPR gRNA sequence
tgaccccatactgccctcct

SEQ ID NO: 89021 - DNA, 20 bp, Artificial
  CRISPR gRNA sequence
accccatactgccctcctcc

SEQ ID NO: 89022 - DNA, 20 bp, Artificial
  CRISPR gRNA sequence
ccctcctccccctcaaaaac

SEQ ID NO: 89023 - DNA, 20 bp, Artificial
  CRISPR gRNA sequence
ctccccctcaaaaacaacaa

SEQ ID NO: 89024 - DNA, 20 bp, Artificial
  CRISPR gRNA sequence
cccctcaaaaacaacaataa

SEQ ID NO: 89025 - DNA, 20 bp, Artificial
  CRISPR gRNA sequence
aaaaacaacaataacagcca

SEQ ID NO: 89026 - DNA, 20 bp, Artificial
  CRISPR gRNA sequence
tctaattctcaaaaatactc

SEQ ID NO: 89027 - DNA, 20 bp, Artificial
  CRISPR gRNA sequence
taattctcaaaaatactcct

SEQ ID NO: 89028 - DNA, 20 bp, Artificial
  CRISPR gRNA sequence
attctcaaaaatactcctca

SEQ ID NO: 89029 - DNA, 20 bp, Artificial
  CRISPR gRNA sequence
tcaaaaatactcctcaccat

SEQ ID NO: 89030 - DNA, 20 bp, Artificial
  CRISPR gRNA sequence
aaaaatactcctcaccattg

SEQ ID NO: 89031 - DNA, 20 bp, Artificial
  CRISPR gRNA sequence
ctcaccattgcatatgcctg

SEQ ID NO: 89032 - DNA, 20 bp, Artificial
  CRISPR gRNA sequence
accattgcatatgcctggga

SEQ ID NO: 89033 - DNA, 20 bp, Artificial
  CRISPR gRNA sequence
catatgcctgggaggtcaga

SEQ ID NO: 89034 - DNA, 20 bp, Artificial
  CRISPR gRNA sequence
ggaggtcagaaaggatacga

SEQ ID NO: 89035 - DNA, 20 bp, Artificial
  CRISPR gRNA sequence
tgcccttctaggcttggaaa

SEQ ID NO: 89036 - DNA, 20 bp, Artificial
  CRISPR gRNA sequence
cccttctaggcttggaaaaa

SEQ ID NO: 89037 - DNA, 20 bp, Artificial
  CRISPR gRNA sequence
ctaggcttggaaaaaaaact

SEQ ID NO: 89038 - DNA, 20 bp, Artificial
  CRISPR gRNA sequence
taggcttggaaaaaaaactg

SEQ ID NO: 89039 - DNA, 20 bp, Artificial
  CRISPR gRNA sequence
ggcttggaaaaaaaactggg

SEQ ID NO: 89040 - DNA, 20 bp, Artificial
  CRISPR gRNA sequence
ggaaaaaaaactgggcccaa

SEQ ID NO: 89041 - DNA, 20 bp, Artificial
  CRISPR gRNA sequence
gaaaaaaaactgggcccaag

SEQ ID NO: 89042 - DNA, 20 bp, Artificial
  CRISPR gRNA sequence
ggcccaagttctcattactt

SEQ ID NO: 89043 - DNA, 20 bp, Artificial
  CRISPR gRNA sequence
tcattacttaatctcgccac

SEQ ID NO: 89044 - DNA, 20 bp, Artificial
  CRISPR gRNA sequence
attacttaatctcgccacga

SEQ ID NO: 89045 - DNA, 20 bp, Artificial
  CRISPR gRNA sequence
cttaatctcgccacgacttc

SEQ ID NO: 89046 - DNA, 20 bp, Artificial
  CRISPR gRNA sequence
aatctcgccacgacttcccc

SEQ ID NO: 89047 - DNA, 20 bp, Artificial
  CRISPR gRNA sequence
atctcgccacgacttccccc

SEQ ID NO: 89048 - DNA, 20 bp, Artificial
  CRISPR gRNA sequence
gccacgacttcccccgctgc

SEQ ID NO: 89049 - DNA, 20 bp, Artificial
  CRISPR gRNA sequence
cccccgctgctccccctccc

SEQ ID NO: 89050 - DNA, 20 bp, Artificial
  CRISPR gRNA sequence
ccccgctgctccccctcccc

SEQ ID NO: 89051 - DNA, 20 bp, Artificial
  CRISPR gRNA sequence
ctccccctccccacgtcgcc

SEQ ID NO: 89052 - DNA, 20 bp, Artificial
  CRISPR gRNA sequence
cccctccccacgtcgccggc

SEQ ID NO: 89053 - DNA, 20 bp, Artificial
  CRISPR gRNA sequence
cccacgtcgccggcccctac

SEQ ID NO: 89054 - DNA, 20 bp, Artificial
  CRISPR gRNA sequence
cgtcatctcccacaacagcc

SEQ ID NO: 89055 - DNA, 20 bp, Artificial
  CRISPR gRNA sequence
ccacaacagcccatcctgag

SEQ ID NO: 89056 - DNA, 20 bp, Artificial
  CRISPR gRNA sequence
aggcgcgcccccacctcctt

SEQ ID NO: 89057 - DNA, 20 bp, Artificial
  CRISPR gRNA sequence
cttcccttccccctccattc

SEQ ID NO: 89058 - DNA, 20 bp, Artificial
  CRISPR gRNA sequence
cccttccccctccattcaat

SEQ ID NO: 89059 - DNA, 20 bp, Artificial
  CRISPR gRNA sequence
ccttccccctccattcaatc

SEQ ID NO: 89060 - DNA, 20 bp, Artificial
  CRISPR gRNA sequence
ccccctccattcaatccccg

SEQ ID NO: 89061 - DNA, 20 bp, Artificial
  CRISPR gRNA sequence
cccctccattcaatccccgg

SEQ ID NO: 89062 - DNA, 20 bp, Artificial
  CRISPR gRNA sequence
cattcaatccccggtttctg

SEQ ID NO: 89063 - DNA, 20 bp, Artificial
  CRISPR gRNA sequence
aatccccggtttctgcaaag

SEQ ID NO: 89064 - DNA, 20 bp, Artificial
  CRISPR gRNA sequence
ctgcaaagtggagcgggggt

SEQ ID NO: 89065 - DNA, 20 bp, Artificial
  CRISPR gRNA sequence
tgcaaagtggagcgggggtg

SEQ ID NO: 89066 - DNA, 20 bp, Artificial
  CRISPR gRNA sequence
caaagtggagcgggggtggg

SEQ ID NO: 89067 - DNA, 20 bp, Artificial
  CRISPR gRNA sequence
cactttgcagaaaccgggga

SEQ ID NO: 89068 - DNA, 20 bp, Artificial
  CRISPR gRNA sequence
tgcagaaaccggggattgaa

SEQ ID NO: 89069 - DNA, 20 bp, Artificial
  CRISPR gRNA sequence
gcagaaaccggggattgaat

SEQ ID NO: 89070 - DNA, 20 bp, Artificial
  CRISPR gRNA sequence
cagaaaccggggattgaatg

SEQ ID NO: 89071 - DNA, 20 bp, Artificial
  CRISPR gRNA sequence
aatggagggggaagggaagg

SEQ ID NO: 89072 - DNA, 20 bp, Artificial
  CRISPR gRNA sequence
aggatgggctgttgtgggag

SEQ ID NO: 89073 - DNA, 20 bp, Artificial
  CRISPR gRNA sequence
ttgtgggagatgacgtaggg

SEQ ID NO: 89074 - DNA, 20 bp, Artificial
  CRISPR gRNA sequence
tgggagatgacgtaggggcc

SEQ ID NO: 89075 - DNA, 20 bp, Artificial
  CRISPR gRNA sequence
agtaatgagaacttgggccc

SEQ ID NO: 89076 - DNA, 20 bp, Artificial
  CRISPR gRNA sequence
gggcccagttttttttccaa

SEQ ID NO: 89077 - DNA, 20 bp, Artificial
  CRISPR gRNA sequence
ggcccagttttttttccaag

SEQ ID NO: 89078 - DNA, 20 bp, Artificial
  CRISPR gRNA sequence
tttttccaagcctagaaggg

SEQ ID NO: 89079 - DNA, 20 bp, Artificial
  CRISPR gRNA sequence
ttttccaagcctagaagggc

SEQ ID NO: 89080 - DNA, 20 bp, Artificial
  CRISPR gRNA sequence
tttccaagcctagaagggca

SEQ ID NO: 89081 - DNA, 20 bp, Artificial
  CRISPR gRNA sequence
ttccaagcctagaagggcag

SEQ ID NO: 89082 - DNA, 20 bp, Artificial
  CRISPR gRNA sequence
tccaagcctagaagggcaga

SEQ ID NO: 89083 - DNA, 20 bp, Artificial
  CRISPR gRNA sequence
ccaagcctagaagggcagaa

SEQ ID NO: 89084 - DNA, 20 bp, Artificial
  CRISPR gRNA sequence
caagcctagaagggcagaat

SEQ ID NO: 89085 - DNA, 20 bp, Artificial
  CRISPR gRNA sequence
gaagggcagaatatgttcgt

SEQ ID NO: 89086 - DNA, 20 bp, Artificial
  CRISPR gRNA sequence
gtatcctttctgacctccca

SEQ ID NO: 89087 - DNA, 20 bp, Artificial
  CRISPR gRNA sequence
tctgacctcccaggcatatg

SEQ ID NO: 89088 - DNA, 20 bp, Artificial
  CRISPR gRNA sequence
ctgacctcccaggcatatgc

SEQ ID NO: 89089 - DNA, 20 bp, Artificial
  CRISPR gRNA sequence
tgacctcccaggcatatgca

SEQ ID NO: 89090 - DNA, 20 bp, Artificial
  CRISPR gRNA sequence
acctcccaggcatatgcaat

SEQ ID NO: 89091 - DNA, 20 bp, Artificial
  CRISPR gRNA sequence
ccaggcatatgcaatggtga

SEQ ID NO: 89092 - DNA, 20 bp, Artificial
  CRISPR gRNA sequence
ttgagaattagagaactttg

SEQ ID NO: 89093 - DNA, 20 bp, Artificial
  CRISPR gRNA sequence
tgagaattagagaactttgt

SEQ ID NO: 89094 - DNA, 20 bp, Artificial
  CRISPR gRNA sequence
gagaattagagaactttgtt

SEQ ID NO: 89095 - DNA, 20 bp, Artificial
  CRISPR gRNA sequence
agaattagagaactttgttt

SEQ ID NO: 89096 - DNA, 20 bp, Artificial
  CRISPR gRNA sequence
gagaactttgttttgtggct

SEQ ID NO: 89097 - DNA, 20 bp, Artificial
  CRISPR gRNA sequence
tgttttgtggctgttattgt

SEQ ID NO: 89098 - DNA, 20 bp, Artificial
  CRISPR gRNA sequence
gttttgtggctgttattgtt

SEQ ID NO: 89099 - DNA, 20 bp, Artificial
  CRISPR gRNA sequence
ttttgtggctgttattgttg

SEQ ID NO: 89100 - DNA, 20 bp, Artificial
  CRISPR gRNA sequence
tgtggctgttattgttgttt

SEQ ID NO: 89101 - DNA, 20 bp, Artificial
  CRISPR gRNA sequence
gtggctgttattgttgtttt

SEQ ID NO: 89102 - DNA, 20 bp, Artificial
  CRISPR gRNA sequence
tggctgttattgttgttttt

SEQ ID NO: 89103 - DNA, 20 bp, Artificial
  CRISPR gRNA sequence
ttattgttgtttttgagggg

SEQ ID NO: 89104 - DNA, 20 bp, Artificial
  CRISPR gRNA sequence
ttgttgtttttgagggggag

SEQ ID NO: 89105 - DNA, 20 bp, Artificial
  CRISPR gRNA sequence
ttgtttttgagggggaggag

SEQ ID NO: 89106 - DNA, 20 bp, Artificial
  CRISPR gRNA sequence
tttttgagggggaggagggc

SEQ ID NO: 89107 - DNA, 20 bp, Artificial
  CRISPR gRNA sequence
ttgagggggaggagggcagt

SEQ ID NO: 89108 - DNA, 20 bp, Artificial
  CRISPR gRNA sequence
tgagggggaggagggcagta

SEQ ID NO: 89109 - DNA, 20 bp, Artificial
  CRISPR gRNA sequence
gagggggaggagggcagtat

SEQ ID NO: 89110 - DNA, 20 bp, Artificial
  CRISPR gRNA sequence
agggggaggagggcagtatg

SEQ ID NO: 89111 - DNA, 20 bp, Artificial
  CRISPR gRNA sequence
cttgctaacatggattccca

SEQ ID NO: 89112 - DNA, 20 bp, Artificial
  CRISPR gRNA sequence
ttgctaacatggattcccaa

SEQ ID NO: 89113 - DNA, 20 bp, Artificial
  CRISPR gRNA sequence
gctaacatggattcccaatc

SEQ ID NO: 89114 - DNA, 20 bp, Artificial
  CRISPR gRNA sequence
ctaacatggattcccaatcc

SEQ ID NO: 89115 - DNA, 20 bp, Artificial
  CRISPR gRNA sequence
acatggattcccaatccccc

SEQ ID NO: 89116 - DNA, 20 bp, Artificial
  CRISPR gRNA sequence
ccaatccccctatctcttcc

SEQ ID NO: 89117 - DNA, 20 bp, Artificial
  CRISPR gRNA sequence
tctcttcctttacagttttc

SEQ ID NO: 89118 - DNA, 20 bp, Artificial
  CRISPR gRNA sequence
ttcctttacagttttccaga

SEQ ID NO: 89119 - DNA, 20 bp, Artificial
  CRISPR gRNA sequence
cctttacagttttccagatt

SEQ ID NO: 89120 - DNA, 20 bp, Artificial
  CRISPR gRNA sequence
ctttacagttttccagattt

SEQ ID NO: 89121 - DNA, 20 bp, Artificial
  CRISPR gRNA sequence
tacagttttccagatttagg

SEQ ID NO: 89122 - DNA, 20 bp, Artificial
  CRISPR gRNA sequence
acagttttccagatttagga

SEQ ID NO: 89123 - DNA, 20 bp, Artificial
  CRISPR gRNA sequence
cagttttccagatttaggag

SEQ ID NO: 89124 - DNA, 20 bp, Artificial
  CRISPR gRNA sequence
tccagatttaggagacttca

SEQ ID NO: 89125 - DNA, 20 bp, Artificial
  CRISPR gRNA sequence
ccagatttaggagacttcag

SEQ ID NO: 89126 - DNA, 20 bp, Artificial
  CRISPR gRNA sequence
cagatttaggagacttcaga

SEQ ID NO: 89127 - DNA, 20 bp, Artificial
  CRISPR gRNA sequence
aggagacttcagaaaggtgg

SEQ ID NO: 89128 - DNA, 20 bp, Artificial
  CRISPR gRNA sequence
ggagacttcagaaaggtggg

SEQ ID NO: 89129 - DNA, 20 bp, Artificial
  CRISPR gRNA sequence
cagaaaggtggggcagatag

SEQ ID NO: 89130 - DNA, 20 bp, Artificial
  CRISPR gRNA sequence
agaaaggtggggcagataga

SEQ ID NO: 89131 - DNA, 20 bp, Artificial
  CRISPR gRNA sequence
tttgggcatatatgggcctg

SEQ ID NO: 89132 - DNA, 20 bp, Artificial
  CRISPR gRNA sequence
tgggcatatatgggcctggc

SEQ ID NO: 89133 - DNA, 20 bp, Artificial
  CRISPR gRNA sequence
gggcatatatgggcctggcg

SEQ ID NO: 89134 - DNA, 20 bp, Artificial
  CRISPR gRNA sequence
ggcatatatgggcctggcga

SEQ ID NO: 89135 - DNA, 20 bp, Artificial
  CRISPR gRNA sequence
gcgaagtaatggaataattt

SEQ ID NO: 89136 - DNA, 20 bp, Artificial
  CRISPR gRNA sequence
ctaattttcggagaaggcaa

SEQ ID NO: 89137 - DNA, 20 bp, Artificial
  CRISPR gRNA sequence
taattttcggagaaggcaag

SEQ ID NO: 89138 - DNA, 20 bp, Artificial
  CRISPR gRNA sequence
attttcggagaaggcaagtg

SEQ ID NO: 89139 - DNA, 20 bp, Artificial
  CRISPR gRNA sequence
tcggagaaggcaagtggtga

SEQ ID NO: 89140 - DNA, 20 bp, Artificial
  CRISPR gRNA sequence
cggagaaggcaagtggtgag

SEQ ID NO: 89141 - DNA, 20 bp, Artificial
  CRISPR gRNA sequence
ggagaaggcaagtggtgaga

SEQ ID NO: 89142 - DNA, 20 bp, Artificial
  CRISPR gRNA sequence
ggaggctttgtttctgtttc

SEQ ID NO: 89143 - DNA, 20 bp, Artificial
  CRISPR gRNA sequence
tgtttctgtttctctgcctt

SEQ ID NO: 89144 - DNA, 20 bp, Artificial
  CRISPR gRNA sequence
gtttctgtttctctgccttt

SEQ ID NO: 89145 - DNA, 20 bp, Artificial
  CRISPR gRNA sequence
tttctgtttctctgcctttc

SEQ ID NO: 89146 - DNA, 20 bp, Artificial
  CRISPR gRNA sequence
ctgtttctctgcctttctgg

SEQ ID NO: 89147 - DNA, 20 bp, Artificial
  CRISPR gRNA sequence
tgtttctctgcctttctggg

SEQ ID NO: 89148 - DNA, 20 bp, Artificial
  CRISPR gRNA sequence
tttctctgcctttctgggta

SEQ ID NO: 89149 - DNA, 20 bp, Artificial
  CRISPR gRNA sequence
ctctgcctttctgggtaaag

SEQ ID NO: 89150 - DNA, 20 bp, Artificial
  CRISPR gRNA sequence
tctgcctttctgggtaaaga

SEQ ID NO: 89151 - DNA, 20 bp, Artificial
  CRISPR gRNA sequence
tgcctttctgggtaaagaga

SEQ ID NO: 89152 - DNA, 20 bp, Artificial
  CRISPR gRNA sequence
cctttctgggtaaagagatg

SEQ ID NO: 89153 - DNA, 20 bp, Artificial
  CRISPR gRNA sequence
tctgggtaaagagatgagga

SEQ ID NO: 89154 - DNA, 20 bp, Artificial
  CRISPR gRNA sequence
ctgggtaaagagatgaggag

SEQ ID NO: 89155 - DNA, 20 bp, Artificial
  CRISPR gRNA sequence
tgggtaaagagatgaggagt

SEQ ID NO: 89156 - DNA, 20 bp, Artificial
  CRISPR gRNA sequence
ggtaaagagatgaggagtgc

SEQ ID NO: 89157 - DNA, 20 bp, Artificial
  CRISPR gRNA sequence
gggccttctggggaagggaa

SEQ ID NO: 89158 - DNA, 20 bp, Artificial
  CRISPR gRNA sequence
ctggggaagggaaggccagt

SEQ ID NO: 89159 - DNA, 20 bp, Artificial
  CRISPR gRNA sequence
tggggaagggaaggccagtg

SEQ ID NO: 89160 - DNA, 20 bp, Artificial
  CRISPR gRNA sequence
gggaagggaaggccagtgtg

SEQ ID NO: 89161 - DNA, 20 bp, Artificial
  CRISPR gRNA sequence
catctttatgcctgtccctc

SEQ ID NO: 89162 - DNA, 20 bp, Artificial
  CRISPR gRNA sequence
tatgcctgtccctctcaatt

SEQ ID NO: 89163 - DNA, 20 bp, Artificial
  CRISPR gRNA sequence
atgcctgtccctctcaattc

SEQ ID NO: 89164 - DNA, 20 bp, Artificial
  CRISPR gRNA sequence
tgcctgtccctctcaattct

SEQ ID NO: 89165 - DNA, 20 bp, Artificial
  CRISPR gRNA sequence
tccctctcaattctagccct

SEQ ID NO: 89166 - DNA, 20 bp, Artificial
  CRISPR gRNA sequence
tcaattctagccctcatgcc

SEQ ID NO: 89167 - DNA, 20 bp, Artificial
  CRISPR gRNA sequence
aattctagccctcatgccgg

SEQ ID NO: 89168 - DNA, 20 bp, Artificial
  CRISPR gRNA sequence
tagccctcatgccgggatgg

SEQ ID NO: 89169 - DNA, 20 bp, Artificial
  CRISPR gRNA sequence
gccctcatgccgggatggca

SEQ ID NO: 89170 - DNA, 20 bp, Artificial
  CRISPR gRNA sequence
atgccgggatggcagaagat

SEQ ID NO: 89171 - DNA, 20 bp, Artificial
  CRISPR gRNA sequence
atgctaagagccccaagact

SEQ ID NO: 89172 - DNA, 20 bp, Artificial
  CRISPR gRNA sequence
agagccccaagactggggga

SEQ ID NO: 89173 - DNA, 20 bp, Artificial
  CRISPR gRNA sequence
ggggaagggcccccccaggt

SEQ ID NO: 89174 - DNA, 20 bp, Artificial
  CRISPR gRNA sequence
aggctggggaacctaccacc

SEQ ID NO: 89175 - DNA, 20 bp, Artificial
  CRISPR gRNA sequence
gggaacctaccacccttctt

SEQ ID NO: 89176 - DNA, 20 bp, Artificial
  CRISPR gRNA sequence
ccacccttcttcagaggctc

SEQ ID NO: 89177 - DNA, 20 bp, Artificial
  CRISPR gRNA sequence
cttcagaggctccgaggtac

SEQ ID NO: 89178 - DNA, 20 bp, Artificial
  CRISPR gRNA sequence
ttcagaggctccgaggtacc

SEQ ID NO: 89179 - DNA, 20 bp, Artificial
  CRISPR gRNA sequence
cagaggctccgaggtaccat

SEQ ID NO: 89180 - DNA, 20 bp, Artificial
  CRISPR gRNA sequence
agaggctccgaggtaccatt

SEQ ID NO: 89181 - DNA, 20 bp, Artificial
  CRISPR gRNA sequence
cgaggtaccatttcgtaagt

SEQ ID NO: 89182 - DNA, 20 bp, Artificial
  CRISPR gRNA sequence
cgtaagtactcatcacatct

SEQ ID NO: 89183 - DNA, 20 bp, Artificial
  CRISPR gRNA sequence
gtaagtactcatcacatctc

SEQ ID NO: 89184 - DNA, 20 bp, Artificial
  CRISPR gRNA sequence
atcacatctccaagtcctgt

SEQ ID NO: 89185 - DNA, 20 bp, Artificial
  CRISPR gRNA sequence
caagtcctgtccaagacctg

SEQ ID NO: 89186 - DNA, 20 bp, Artificial
  CRISPR gRNA sequence
tccaagacctgagtatagat

SEQ ID NO: 89187 - DNA, 20 bp, Artificial
  CRISPR gRNA sequence
agtatagatccctgcagcac

SEQ ID NO: 89188 - DNA, 20 bp, Artificial
  CRISPR gRNA sequence
cagcacttcactttggctgt

SEQ ID NO: 89189 - DNA, 20 bp, Artificial
  CRISPR gRNA sequence
cactttggctgtagatgaac

SEQ ID NO: 89190 - DNA, 20 bp, Artificial
  CRISPR gRNA sequence
actttggctgtagatgaact

SEQ ID NO: 89191 - DNA, 20 bp, Artificial
  CRISPR gRNA sequence
tggctgtagatgaactgcct

SEQ ID NO: 89192 - DNA, 20 bp, Artificial
  CRISPR gRNA sequence
ggctgtagatgaactgcctc

SEQ ID NO: 89193 - DNA, 20 bp, Artificial
  CRISPR gRNA sequence
gctgtagatgaactgcctct

SEQ ID NO: 89194 - DNA, 20 bp, Artificial
  CRISPR gRNA sequence
tagatgaactgcctctcagc

SEQ ID NO: 89195 - DNA, 20 bp, Artificial
  CRISPR gRNA sequence
cctctcagcaagggcatggg

SEQ ID NO: 89196 - DNA, 20 bp, Artificial
  CRISPR gRNA sequence
tcagcaagggcatgggagca

SEQ ID NO: 89197 - DNA, 20 bp, Artificial
  CRISPR gRNA sequence
agcaagggcatgggagcaga

SEQ ID NO: 89198 - DNA, 20 bp, Artificial
  CRISPR gRNA sequence
ttggccatggtagcaattct

SEQ ID NO: 89199 - DNA, 20 bp, Artificial
  CRISPR gRNA sequence
tggccatggtagcaattctt

SEQ ID NO: 89200 - DNA, 20 bp, Artificial
  CRISPR gRNA sequence
ggccatggtagcaattcttg

SEQ ID NO: 89201 - DNA, 20 bp, Artificial
  CRISPR gRNA sequence
gccatggtagcaattcttga

SEQ ID NO: 89202 - DNA, 20 bp, Artificial
  CRISPR gRNA sequence
ttgagcacctgctgggcatt

SEQ ID NO: 89203 - DNA, 20 bp, Artificial
  CRISPR gRNA sequence
gagcacctgctgggcatttc

SEQ ID NO: 89204 - DNA, 20 bp, Artificial
  CRISPR gRNA sequence
agcacctgctgggcatttca

SEQ ID NO: 89205 - DNA, 20 bp, Artificial
  CRISPR gRNA sequence
ctgggcatttcagtcctttt

SEQ ID NO: 89206 - DNA, 20 bp, Artificial
  CRISPR gRNA sequence
ggcatttcagtccttttccc

SEQ ID NO: 89207 - DNA, 20 bp, Artificial
  CRISPR gRNA sequence
cagtccttttccctccctag

SEQ ID NO: 89208 - DNA, 20 bp, Artificial
  CRISPR gRNA sequence
agtccttttccctccctagc

SEQ ID NO: 89209 - DNA, 20 bp, Artificial
  CRISPR gRNA sequence
ttccctccctagcagtcaga

SEQ ID NO: 89210 - DNA, 20 bp, Artificial
  CRISPR gRNA sequence
tccctccctagcagtcagat

SEQ ID NO: 89211 - DNA, 20 bp, Artificial
  CRISPR gRNA sequence
ccctccctagcagtcagata

SEQ ID NO: 89212 - DNA, 20 bp, Artificial
  CRISPR gRNA sequence
cctccctagcagtcagataa

SEQ ID NO: 89213 - DNA, 20 bp, Artificial
  CRISPR gRNA sequence
cctagcagtcagataaagag

SEQ ID NO: 89214 - DNA, 20 bp, Artificial
  CRISPR gRNA sequence
gcagtcagataaagagacag

SEQ ID NO: 89215 - DNA, 20 bp, Artificial
  CRISPR gRNA sequence
gtgtgtgacctccagctttc

SEQ ID NO: 89216 - DNA, 20 bp, Artificial
  CRISPR gRNA sequence
tgtgtgacctccagctttct

SEQ ID NO: 89217 - DNA, 20 bp, Artificial
  CRISPR gRNA sequence
cagctttctcctcttcccca

SEQ ID NO: 89218 - DNA, 20 bp, Artificial
  CRISPR gRNA sequence
tctcctcttccccacagcaa

SEQ ID NO: 89219 - DNA, 20 bp, Artificial
  CRISPR gRNA sequence
ctcctcttccccacagcaag

SEQ ID NO: 89220 - DNA, 20 bp, Artificial
  CRISPR gRNA sequence
tcctcttccccacagcaagg

SEQ ID NO: 89221 - DNA, 20 bp, Artificial
  CRISPR gRNA sequence
ctcttccccacagcaaggcc

SEQ ID NO: 89222 - DNA, 20 bp, Artificial
  CRISPR gRNA sequence
ttccccacagcaaggccgtg

SEQ ID NO: 89223 - DNA, 20 bp, Artificial
  CRISPR gRNA sequence
ccccacagcaaggccgtgca

SEQ ID NO: 89224 - DNA, 20 bp, Artificial
  CRISPR gRNA sequence
cccacagcaaggccgtgcag

SEQ ID NO: 89225 - DNA, 20 bp, Artificial
  CRISPR gRNA sequence
gtaagtgtgttggggaagag

SEQ ID NO: 89226 - DNA, 20 bp, Artificial
  CRISPR gRNA sequence
gggaagagggcaagagaggg

SEQ ID NO: 89227 - DNA, 20 bp, Artificial
  CRISPR gRNA sequence
agggaggaggatgtgaggat

SEQ ID NO: 89228 - DNA, 20 bp, Artificial
  CRISPR gRNA sequence
atgtgggagaggtagggtcc

SEQ ID NO: 89229 - DNA, 20 bp, Artificial
  CRISPR gRNA sequence
tgccttgtcagaagatagtt

SEQ ID NO: 89230 - DNA, 20 bp, Artificial
  CRISPR gRNA sequence
ccttgtcagaagatagttgg

SEQ ID NO: 89231 - DNA, 20 bp, Artificial
  CRISPR gRNA sequence
gtcagaagatagttggcttt

SEQ ID NO: 89232 - DNA, 20 bp, Artificial
  CRISPR gRNA sequence
tcagaagatagttggctttg

SEQ ID NO: 89233 - DNA, 20 bp, Artificial
  CRISPR gRNA sequence
gctttgcaaacttgctgcca

SEQ ID NO: 89234 - DNA, 20 bp, Artificial
  CRISPR gRNA sequence
tgcaaacttgctgccagttt

SEQ ID NO: 89235 - DNA, 20 bp, Artificial
  CRISPR gRNA sequence
gcaaacttgctgccagtttg

SEQ ID NO: 89236 - DNA, 20 bp, Artificial
  CRISPR gRNA sequence
caaacttgctgccagtttga

SEQ ID NO: 89237 - DNA, 20 bp, Artificial
  CRISPR gRNA sequence
gctgccagtttgactttgtg

SEQ ID NO: 89238 - DNA, 20 bp, Artificial
  CRISPR gRNA sequence
ctgccagtttgactttgtgc

SEQ ID NO: 89239 - DNA, 20 bp, Artificial
  CRISPR gRNA sequence
ccagtttgactttgtgcctc

SEQ ID NO: 89240 - DNA, 20 bp, Artificial
  CRISPR gRNA sequence
gactttgtgcctctcacttg

SEQ ID NO: 89241 - DNA, 20 bp, Artificial
  CRISPR gRNA sequence
actttgtgcctctcacttga

SEQ ID NO: 89242 - DNA, 20 bp, Artificial
  CRISPR gRNA sequence
tgtgcctctcacttgatctc

SEQ ID NO: 89243 - DNA, 20 bp, Artificial
  CRISPR gRNA sequence
gtgcctctcacttgatctct

SEQ ID NO: 89244 - DNA, 20 bp, Artificial
  CRISPR gRNA sequence
tgcctctcacttgatctctg

SEQ ID NO: 89245 - DNA, 20 bp, Artificial
  CRISPR gRNA sequence
tcacttgatctctgtgagca

SEQ ID NO: 89246 - DNA, 20 bp, Artificial
  CRISPR gRNA sequence
acttgatctctgtgagcact

SEQ ID NO: 89247 - DNA, 20 bp, Artificial
  CRISPR gRNA sequence
gatctctgtgagcacttgca

SEQ ID NO: 89248 - DNA, 20 bp, Artificial
  CRISPR gRNA sequence
atctctgtgagcacttgcat

SEQ ID NO: 89249 - DNA, 20 bp, Artificial
  CRISPR gRNA sequence
tgtgagcacttgcatagaag

SEQ ID NO: 89250 - DNA, 20 bp, Artificial
  CRISPR gRNA sequence
tgagcacttgcatagaagcc

SEQ ID NO: 89251 - DNA, 20 bp, Artificial
  CRISPR gRNA sequence
gcatagaagcccagcagaga

SEQ ID NO: 89252 - DNA, 20 bp, Artificial
  CRISPR gRNA sequence
catagaagcccagcagagat

SEQ ID NO: 89253 - DNA, 20 bp, Artificial
  CRISPR gRNA sequence
atcccctctacttccctcct

SEQ ID NO: 89254 - DNA, 20 bp, Artificial
  CRISPR gRNA sequence
tacttccctcctctccatgg

SEQ ID NO: 89255 - DNA, 20 bp, Artificial
  CRISPR gRNA sequence
cttccctcctctccatggta

SEQ ID NO: 89256 - DNA, 20 bp, Artificial
  CRISPR gRNA sequence
ccctcctctccatggtagcc

SEQ ID NO: 89257 - DNA, 20 bp, Artificial
  CRISPR gRNA sequence
cctcctctccatggtagcct

SEQ ID NO: 89258 - DNA, 20 bp, Artificial
  CRISPR gRNA sequence
ctctccatggtagcctatag

SEQ ID NO: 89259 - DNA, 20 bp, Artificial
  CRISPR gRNA sequence
tccatggtagcctatagggc

SEQ ID NO: 89260 - DNA, 20 bp, Artificial
  CRISPR gRNA sequence
catggtagcctatagggctc

SEQ ID NO: 89261 - DNA, 20 bp, Artificial
  CRISPR gRNA sequence
tagggctcctcagagcacct

SEQ ID NO: 89262 - DNA, 20 bp, Artificial
  CRISPR gRNA sequence
ctcagagcacctagcatcaa

SEQ ID NO: 89263 - DNA, 20 bp, Artificial
  CRISPR gRNA sequence
agagcacctagcatcaaata

SEQ ID NO: 89264 - DNA, 20 bp, Artificial
  CRISPR gRNA sequence
gcatcaaataatttctttct

SEQ ID NO: 89265 - DNA, 20 bp, Artificial
  CRISPR gRNA sequence
ctttcttttttttttttttt

SEQ ID NO: 89266 - DNA, 20 bp, Artificial
  CRISPR gRNA sequence
tttctttttttttttttttt

SEQ ID NO: 89267 - DNA, 20 bp, Artificial
  CRISPR gRNA sequence
tctttttttttttttttttt

SEQ ID NO: 89268 - DNA, 20 bp, Artificial
  CRISPR gRNA sequence
cttttttttttttttttttg

SEQ ID NO: 89269 - DNA, 20 bp, Artificial
  CRISPR gRNA sequence
ttttttttttttttttttga

SEQ ID NO: 89270 - DNA, 20 bp, Artificial
  CRISPR gRNA sequence
ttttttttttttttttgaga

SEQ ID NO: 89271 - DNA, 20 bp, Artificial
  CRISPR gRNA sequence
tttttttttttttttgagat

SEQ ID NO: 89272 - DNA, 20 bp, Artificial
  CRISPR gRNA sequence
ttttttttttttttgagatg

SEQ ID NO: 89273 - DNA, 20 bp, Artificial
  CRISPR gRNA sequence
tttttttttttttgagatgg

SEQ ID NO: 89274 - DNA, 20 bp, Artificial
  CRISPR gRNA sequence
ttttttttttttgagatgga

SEQ ID NO: 89275 - DNA, 20 bp, Artificial
  CRISPR gRNA sequence
tttttttttttgagatggag

SEQ ID NO: 89276 - DNA, 20 bp, Artificial
  CRISPR gRNA sequence
ttttttttttgagatggagt

SEQ ID NO: 89277 - DNA, 20 bp, Artificial
  CRISPR gRNA sequence
tttttttttgagatggagtc

SEQ ID NO: 89278 - DNA, 20 bp, Artificial
  CRISPR gRNA sequence
ttttttttgagatggagtct

SEQ ID NO: 89279 - DNA, 20 bp, Artificial
  CRISPR gRNA sequence
tttttttgagatggagtctc

SEQ ID NO: 89280 - DNA, 20 bp, Artificial
  CRISPR gRNA sequence
ttttttgagatggagtctca

SEQ ID NO: 89281 - DNA, 20 bp, Artificial
  CRISPR gRNA sequence
tttttgagatggagtctcac

SEQ ID NO: 89282 - DNA, 20 bp, Artificial
  CRISPR gRNA sequence
ttttgagatggagtctcact

SEQ ID NO: 89283 - DNA, 20 bp, Artificial
  CRISPR gRNA sequence
tttgagatggagtctcactc

SEQ ID NO: 89284 - DNA, 20 bp, Artificial
  CRISPR gRNA sequence
ttgagatggagtctcactct

SEQ ID NO: 89285 - DNA, 20 bp, Artificial
  CRISPR gRNA sequence
tgagatggagtctcactctg

SEQ ID NO: 89286 - DNA, 20 bp, Artificial
  CRISPR gRNA sequence
gagatggagtctcactctgt

SEQ ID NO: 89287 - DNA, 20 bp, Artificial
  CRISPR gRNA sequence
agatggagtctcactctgtc

SEQ ID NO: 89288 - DNA, 20 bp, Artificial
  CRISPR gRNA sequence
actctgtcgcctaggctgga

SEQ ID NO: 89289 - DNA, 20 bp, Artificial
  CRISPR gRNA sequence
tgtcgcctaggctggagtgc

SEQ ID NO: 89290 - DNA, 20 bp, Artificial
  CRISPR gRNA sequence
tcgcctaggctggagtgcag

SEQ ID NO: 89291 - DNA, 20 bp, Artificial
  CRISPR gRNA sequence
ggctggagtgcagtggcgca

SEQ ID NO: 89292 - DNA, 20 bp, Artificial
  CRISPR gRNA sequence
gagtgcagtggcgcaatctc

SEQ ID NO: 89293 - DNA, 20 bp, Artificial
  CRISPR gRNA sequence
ggctcactgcaagctccgcc

SEQ ID NO: 89294 - DNA, 20 bp, Artificial
  CRISPR gRNA sequence
actgcaagctccgcctccca

SEQ ID NO: 89295 - DNA, 20 bp, Artificial
  CRISPR gRNA sequence
caagctccgcctcccaggtt

SEQ ID NO: 89296 - DNA, 20 bp, Artificial
  CRISPR gRNA sequence
cgcctcccaggttcacgcca

SEQ ID NO: 89297 - DNA, 20 bp, Artificial
  CRISPR gRNA sequence
ccaggttcacgccattctcc

SEQ ID NO: 89298 - DNA, 20 bp, Artificial
  CRISPR gRNA sequence
acgccattctcctgcctcag

SEQ ID NO: 89299 - DNA, 20 bp, Artificial
  CRISPR gRNA sequence
tcctgcctcagcctcccaag

SEQ ID NO: 89300 - DNA, 20 bp, Artificial
  CRISPR gRNA sequence
ctgcctcagcctcccaagta

SEQ ID NO: 89301 - DNA, 20 bp, Artificial
  CRISPR gRNA sequence
cctcagcctcccaagtagct

SEQ ID NO: 89302 - DNA, 20 bp, Artificial
  CRISPR gRNA sequence
agcctcccaagtagctggga

SEQ ID NO: 89303 - DNA, 20 bp, Artificial
  CRISPR gRNA sequence
ccaagtagctgggactacag

SEQ ID NO: 89304 - DNA, 20 bp, Artificial
  CRISPR gRNA sequence
ggactacaggcgcccgtcac

SEQ ID NO: 89305 - DNA, 20 bp, Artificial
  CRISPR gRNA sequence
caggcgcccgtcaccacacc

SEQ ID NO: 89306 - DNA, 20 bp, Artificial
  CRISPR gRNA sequence
atttttttttgtatttttag

SEQ ID NO: 89307 - DNA, 20 bp, Artificial
  CRISPR gRNA sequence
ttttttgtatttttagtaga

SEQ ID NO: 89308 - DNA, 20 bp, Artificial
  CRISPR gRNA sequence
tttttgtatttttagtagaa

SEQ ID NO: 89309 - DNA, 20 bp, Artificial
  CRISPR gRNA sequence
ttttgtatttttagtagaaa

SEQ ID NO: 89310 - DNA, 20 bp, Artificial
  CRISPR gRNA sequence
tttgtatttttagtagaaac

SEQ ID NO: 89311 - DNA, 20 bp, Artificial
  CRISPR gRNA sequence
ttgtatttttagtagaaacg

SEQ ID NO: 89312 - DNA, 20 bp, Artificial
  CRISPR gRNA sequence
tgtatttttagtagaaacgg

SEQ ID NO: 89313 - DNA, 20 bp, Artificial
  CRISPR gRNA sequence
gtatttttagtagaaacggg

SEQ ID NO: 89314 - DNA, 20 bp, Artificial
  CRISPR gRNA sequence
tatttttagtagaaacgggg

SEQ ID NO: 89315 - DNA, 20 bp, Artificial
  CRISPR gRNA sequence
ttagtagaaacggggtttca

SEQ ID NO: 89316 - DNA, 20 bp, Artificial
  CRISPR gRNA sequence
tagtagaaacggggtttcac

SEQ ID NO: 89317 - DNA, 20 bp, Artificial
  CRISPR gRNA sequence
agtagaaacggggtttcacc

SEQ ID NO: 89318 - DNA, 20 bp, Artificial
  CRISPR gRNA sequence
gtagaaacggggtttcacca

SEQ ID NO: 89319 - DNA, 20 bp, Artificial
  CRISPR gRNA sequence
caccatgttagccaggatgg

SEQ ID NO: 89320 - DNA, 20 bp, Artificial
  CRISPR gRNA sequence
accatgttagccaggatggt

SEQ ID NO: 89321 - DNA, 20 bp, Artificial
  CRISPR gRNA sequence
gccaggatggtctcgatctc

SEQ ID NO: 89322 - DNA, 20 bp, Artificial
  CRISPR gRNA sequence
gatctcctgaccttgtgatc

SEQ ID NO: 89323 - DNA, 20 bp, Artificial
  CRISPR gRNA sequence
ctgaccttgtgatcagcctg

SEQ ID NO: 89324 - DNA, 20 bp, Artificial
  CRISPR gRNA sequence
accttgtgatcagcctgcct

SEQ ID NO: 89325 - DNA, 20 bp, Artificial
  CRISPR gRNA sequence
gtgatcagcctgccttggcc

SEQ ID NO: 89326 - DNA, 20 bp, Artificial
  CRISPR gRNA sequence
tgatcagcctgccttggcct

SEQ ID NO: 89327 - DNA, 20 bp, Artificial
  CRISPR gRNA sequence
ccttggccttccaaagtgct

SEQ ID NO: 89328 - DNA, 20 bp, Artificial
  CRISPR gRNA sequence
ggccttccaaagtgctggga

SEQ ID NO: 89329 - DNA, 20 bp, Artificial
  CRISPR gRNA sequence
gccttccaaagtgctgggat

SEQ ID NO: 89330 - DNA, 20 bp, Artificial
  CRISPR gRNA sequence
ccaaagtgctgggattgtag

SEQ ID NO: 89331 - DNA, 20 bp, Artificial
  CRISPR gRNA sequence
caaagtgctgggattgtagg

SEQ ID NO: 89332 - DNA, 20 bp, Artificial
  CRISPR gRNA sequence
ggattgtaggcgtgagccac

SEQ ID NO: 89333 - DNA, 20 bp, Artificial
  CRISPR gRNA sequence
taggcgtgagccaccgtgcc

SEQ ID NO: 89334 - DNA, 20 bp, Artificial
  CRISPR gRNA sequence
gtcaaataatttctaaggtc

SEQ ID NO: 89335 - DNA, 20 bp, Artificial
  CRISPR gRNA sequence
tcaaataatttctaaggtcc

SEQ ID NO: 89336 - DNA, 20 bp, Artificial
  CRISPR gRNA sequence
ctaaggtcctttttcagtct

SEQ ID NO: 89337 - DNA, 20 bp, Artificial
  CRISPR gRNA sequence
taaggtcctttttcagtctg

SEQ ID NO: 89338 - DNA, 20 bp, Artificial
  CRISPR gRNA sequence
aggtcctttttcagtctgac

SEQ ID NO: 89339 - DNA, 20 bp, Artificial
  CRISPR gRNA sequence
tttcagtctgacaccctgta

SEQ ID NO: 89340 - DNA, 20 bp, Artificial
  CRISPR gRNA sequence
ttcagtctgacaccctgtaa

SEQ ID NO: 89341 - DNA, 20 bp, Artificial
  CRISPR gRNA sequence
tcagtctgacaccctgtaag

SEQ ID NO: 89342 - DNA, 20 bp, Artificial
  CRISPR gRNA sequence
cagtctgacaccctgtaagt

SEQ ID NO: 89343 - DNA, 20 bp, Artificial
  CRISPR gRNA sequence
agtctgacaccctgtaagtc

SEQ ID NO: 89344 - DNA, 20 bp, Artificial
  CRISPR gRNA sequence
acaccctgtaagtcagctag

SEQ ID NO: 89345 - DNA, 20 bp, Artificial
  CRISPR gRNA sequence
taagtcagctagactttggt

SEQ ID NO: 89346 - DNA, 20 bp, Artificial
  CRISPR gRNA sequence
gactttggtgtggggatcag

SEQ ID NO: 89347 - DNA, 20 bp, Artificial
  CRISPR gRNA sequence
tggtgtggggatcagagggt

SEQ ID NO: 89348 - DNA, 20 bp, Artificial
  CRISPR gRNA sequence
ggtgtggggatcagagggtc

SEQ ID NO: 89349 - DNA, 20 bp, Artificial
  CRISPR gRNA sequence
gtgtggggatcagagggtcc

SEQ ID NO: 89350 - DNA, 20 bp, Artificial
  CRISPR gRNA sequence
tattgggtccttcttggcct

SEQ ID NO: 89351 - DNA, 20 bp, Artificial
  CRISPR gRNA sequence
ggtccttcttggccttatta

SEQ ID NO: 89352 - DNA, 20 bp, Artificial
  CRISPR gRNA sequence
cttggccttattatttctcc

SEQ ID NO: 89353 - DNA, 20 bp, Artificial
  CRISPR gRNA sequence
ttggccttattatttctcct

SEQ ID NO: 89354 - DNA, 20 bp, Artificial
  CRISPR gRNA sequence
ggccttattatttctcctgc

SEQ ID NO: 89355 - DNA, 20 bp, Artificial
  CRISPR gRNA sequence
gccttattatttctcctgcc

SEQ ID NO: 89356 - DNA, 20 bp, Artificial
  CRISPR gRNA sequence
attatttctcctgcctctgt

SEQ ID NO: 89357 - DNA, 20 bp, Artificial
  CRISPR gRNA sequence
ttatttctcctgcctctgtt

SEQ ID NO: 89358 - DNA, 20 bp, Artificial
  CRISPR gRNA sequence
tttctcctgcctctgttctc

SEQ ID NO: 89359 - DNA, 20 bp, Artificial
  CRISPR gRNA sequence
ctcctgcctctgttctctcc

SEQ ID NO: 89360 - DNA, 20 bp, Artificial
  CRISPR gRNA sequence
tcctgcctctgttctctcct

SEQ ID NO: 89361 - DNA, 20 bp, Artificial
  CRISPR gRNA sequence
ctgcctctgttctctcctac

SEQ ID NO: 89362 - DNA, 20 bp, Artificial
  CRISPR gRNA sequence
cctctgttctctcctacctc

SEQ ID NO: 89363 - DNA, 20 bp, Artificial
  CRISPR gRNA sequence
tgttctctcctacctcagca

SEQ ID NO: 89364 - DNA, 20 bp, Artificial
  CRISPR gRNA sequence
ttctctcctacctcagcaag

SEQ ID NO: 89365 - DNA, 20 bp, Artificial
  CRISPR gRNA sequence
tctcctacctcagcaagatg

SEQ ID NO: 89366 - DNA, 20 bp, Artificial
  CRISPR gRNA sequence
tcctacctcagcaagatgta

SEQ ID NO: 89367 - DNA, 20 bp, Artificial
  CRISPR gRNA sequence
ctacctcagcaagatgtaca

SEQ ID NO: 89368 - DNA, 20 bp, Artificial
  CRISPR gRNA sequence
cctcagcaagatgtacagaa

SEQ ID NO: 89369 - DNA, 20 bp, Artificial
  CRISPR gRNA sequence
agcaagatgtacagaaattt

SEQ ID NO: 89370 - DNA, 20 bp, Artificial
  CRISPR gRNA sequence
tctgacaatgacaagctgta

SEQ ID NO: 89371 - DNA, 20 bp, Artificial
  CRISPR gRNA sequence
ctgacaatgacaagctgtat

SEQ ID NO: 89372 - DNA, 20 bp, Artificial
  CRISPR gRNA sequence
tgacaatgacaagctgtatc

SEQ ID NO: 89373 - DNA, 20 bp, Artificial
  CRISPR gRNA sequence
acaatgacaagctgtatctc

SEQ ID NO: 89374 - DNA, 20 bp, Artificial
  CRISPR gRNA sequence
tatctctaccttcagctccc

SEQ ID NO: 89375 - DNA, 20 bp, Artificial
  CRISPR gRNA sequence
taccttcagctcccctcagg

SEQ ID NO: 89376 - DNA, 20 bp, Artificial
  CRISPR gRNA sequence
ccttcagctcccctcaggac

SEQ ID NO: 89377 - DNA, 20 bp, Artificial
  CRISPR gRNA sequence
cagctcccctcaggacccac

SEQ ID NO: 89378 - DNA, 20 bp, Artificial
  CRISPR gRNA sequence
agctcccctcaggacccacc

SEQ ID NO: 89379 - DNA, 20 bp, Artificial
  CRISPR gRNA sequence
ccctcaggacccaccactgg

SEQ ID NO: 89380 - DNA, 20 bp, Artificial
  CRISPR gRNA sequence
aggacccaccactggagaca

SEQ ID NO: 89381 - DNA, 20 bp, Artificial
  CRISPR gRNA sequence
gagacaaaaggtaggtttga

SEQ ID NO: 89382 - DNA, 20 bp, Artificial
  CRISPR gRNA sequence
gatagtagttttagatggca

SEQ ID NO: 89383 - DNA, 20 bp, Artificial
  CRISPR gRNA sequence
atagtagttttagatggcag

SEQ ID NO: 89384 - DNA, 20 bp, Artificial
  CRISPR gRNA sequence
tagatggcagaggttctgat

SEQ ID NO: 89385 - DNA, 20 bp, Artificial
  CRISPR gRNA sequence
agatggcagaggttctgatt

SEQ ID NO: 89386 - DNA, 20 bp, Artificial
  CRISPR gRNA sequence
gatggcagaggttctgattc

SEQ ID NO: 89387 - DNA, 20 bp, Artificial
  CRISPR gRNA sequence
tgattcttagagaaaggttc

SEQ ID NO: 89388 - DNA, 20 bp, Artificial
  CRISPR gRNA sequence
attcttagagaaaggttcac

SEQ ID NO: 89389 - DNA, 20 bp, Artificial
  CRISPR gRNA sequence
ttagagaaaggttcactggg

SEQ ID NO: 89390 - DNA, 20 bp, Artificial
  CRISPR gRNA sequence
agagaaaggttcactgggaa

SEQ ID NO: 89391 - DNA, 20 bp, Artificial
  CRISPR gRNA sequence
gagaaaggttcactgggaag

SEQ ID NO: 89392 - DNA, 20 bp, Artificial
  CRISPR gRNA sequence
actgggaaggggtgaggtga

SEQ ID NO: 89393 - DNA, 20 bp, Artificial
  CRISPR gRNA sequence
ggaaggggtgaggtgaatag

SEQ ID NO: 89394 - DNA, 20 bp, Artificial
  CRISPR gRNA sequence
gtaaatgctgtccttgatga

SEQ ID NO: 89395 - DNA, 20 bp, Artificial
  CRISPR gRNA sequence
tccttgatgaagaggaaagg

SEQ ID NO: 89396 - DNA, 20 bp, Artificial
  CRISPR gRNA sequence
gatgaagaggaaaggtcctc

SEQ ID NO: 89397 - DNA, 20 bp, Artificial
  CRISPR gRNA sequence
atgaagaggaaaggtcctcg

SEQ ID NO: 89398 - DNA, 20 bp, Artificial
  CRISPR gRNA sequence
gccctgacttggtttaccag

SEQ ID NO: 89399 - DNA, 20 bp, Artificial
  CRISPR gRNA sequence
acttggtttaccagggaaag

SEQ ID NO: 89400 - DNA, 20 bp, Artificial
  CRISPR gRNA sequence
ggtttaccagggaaagttag

SEQ ID NO: 89401 - DNA, 20 bp, Artificial
  CRISPR gRNA sequence
gtttaccagggaaagttaga

SEQ ID NO: 89402 - DNA, 20 bp, Artificial
  CRISPR gRNA sequence
accagggaaagttagattct

SEQ ID NO: 89403 - DNA, 20 bp, Artificial
  CRISPR gRNA sequence
ccagggaaagttagattctg

SEQ ID NO: 89404 - DNA, 20 bp, Artificial
  CRISPR gRNA sequence
gattctgggtgaactaaatt

SEQ ID NO: 89405 - DNA, 20 bp, Artificial
  CRISPR gRNA sequence
tgggtgaactaaatttggtc

SEQ ID NO: 89406 - DNA, 20 bp, Artificial
  CRISPR gRNA sequence
ggtgaactaaatttggtcca

SEQ ID NO: 89407 - DNA, 20 bp, Artificial
  CRISPR gRNA sequence
aatttggtccagcactactg

SEQ ID NO: 89408 - DNA, 20 bp, Artificial
  CRISPR gRNA sequence
ggtccagcactactgaagtg

SEQ ID NO: 89409 - DNA, 20 bp, Artificial
  CRISPR gRNA sequence
gtccagcactactgaagtgg

SEQ ID NO: 89410 - DNA, 20 bp, Artificial
  CRISPR gRNA sequence
ctgaagtggtagtttgggaa

SEQ ID NO: 89411 - DNA, 20 bp, Artificial
  CRISPR gRNA sequence
aagtggtagtttgggaagaa

SEQ ID NO: 89412 - DNA, 20 bp, Artificial
  CRISPR gRNA sequence
gggaagaaccaggacaactg

SEQ ID NO: 89413 - DNA, 20 bp, Artificial
  CRISPR gRNA sequence
ggaagaaccaggacaactgt

SEQ ID NO: 89414 - DNA, 20 bp, Artificial
  CRISPR gRNA sequence
ttagggtcttagtaatgctt

SEQ ID NO: 89415 - DNA, 20 bp, Artificial
  CRISPR gRNA sequence
gggtcttagtaatgcttgtt

SEQ ID NO: 89416 - DNA, 20 bp, Artificial
  CRISPR gRNA sequence
agtaatgcttgttccttttg

SEQ ID NO: 89417 - DNA, 20 bp, Artificial
  CRISPR gRNA sequence
gtaatgcttgttccttttgt

SEQ ID NO: 89418 - DNA, 20 bp, Artificial
  CRISPR gRNA sequence
gttccttttgtttctgtagc

SEQ ID NO: 89419 - DNA, 20 bp, Artificial
  CRISPR gRNA sequence
ttccttttgtttctgtagct

SEQ ID NO: 89420 - DNA, 20 bp, Artificial
  CRISPR gRNA sequence
cttttgtttctgtagctcag

SEQ ID NO: 89421 - DNA, 20 bp, Artificial
  CRISPR gRNA sequence
ttgtttctgtagctcagagc

SEQ ID NO: 89422 - DNA, 20 bp, Artificial
  CRISPR gRNA sequence
tgtttctgtagctcagagcc

SEQ ID NO: 89423 - DNA, 20 bp, Artificial
  CRISPR gRNA sequence
gtttctgtagctcagagcca

SEQ ID NO: 89424 - DNA, 20 bp, Artificial
  CRISPR gRNA sequence
tttctgtagctcagagccaa

SEQ ID NO: 89425 - DNA, 20 bp, Artificial
  CRISPR gRNA sequence
ctgtagctcagagccaagta

SEQ ID NO: 89426 - DNA, 20 bp, Artificial
  CRISPR gRNA sequence
tgtagctcagagccaagtac

SEQ ID NO: 89427 - DNA, 20 bp, Artificial
  CRISPR gRNA sequence
tagctcagagccaagtacac

SEQ ID NO: 89428 - DNA, 20 bp, Artificial
  CRISPR gRNA sequence
agagccaagtacactgagca

SEQ ID NO: 89429 - DNA, 20 bp, Artificial
  CRISPR gRNA sequence
agcaatgaggagtacatgta

SEQ ID NO: 89430 - DNA, 20 bp, Artificial
  CRISPR gRNA sequence
taggtggatccgcaaccacc

SEQ ID NO: 89431 - DNA, 20 bp, Artificial
  CRISPR gRNA sequence
gaagagcacactgacacctg

SEQ ID NO: 89432 - DNA, 20 bp, Artificial
  CRISPR gRNA sequence
acacctgtctgccaaagcaa

SEQ ID NO: 89433 - DNA, 20 bp, Artificial
  CRISPR gRNA sequence
tctgccaaagcaaagtgttt

SEQ ID NO: 89434 - DNA, 20 bp, Artificial
  CRISPR gRNA sequence
ccaaagcaaagtgtttatga

SEQ ID NO: 89435 - DNA, 20 bp, Artificial
  CRISPR gRNA sequence
atgatgcctatcggtgggtg

SEQ ID NO: 89436 - DNA, 20 bp, Artificial
  CRISPR gRNA sequence
tgatgcctatcggtgggtgg

SEQ ID NO: 89437 - DNA, 20 bp, Artificial
  CRISPR gRNA sequence
tcggtgggtggaggggtggg

SEQ ID NO: 89438 - DNA, 20 bp, Artificial
  CRISPR gRNA sequence
gtgggcataggaccccctca

SEQ ID NO: 89439 - DNA, 20 bp, Artificial
  CRISPR gRNA sequence
acccatgaagagcttcctgc

SEQ ID NO: 89440 - DNA, 20 bp, Artificial
  CRISPR gRNA sequence
cctgccttgataaagcctgc

SEQ ID NO: 89441 - DNA, 20 bp, Artificial
  CRISPR gRNA sequence
ctgccttgataaagcctgcc

SEQ ID NO: 89442 - DNA, 20 bp, Artificial
  CRISPR gRNA sequence
ccttgataaagcctgccttc

SEQ ID NO: 89443 - DNA, 20 bp, Artificial
  CRISPR gRNA sequence
gataaagcctgccttcttaa

SEQ ID NO: 89444 - DNA, 20 bp, Artificial
  CRISPR gRNA sequence
ataaagcctgccttcttaaa

SEQ ID NO: 89445 - DNA, 20 bp, Artificial
  CRISPR gRNA sequence
ccttcttaaagggttcctca

SEQ ID NO: 89446 - DNA, 20 bp, Artificial
  CRISPR gRNA sequence
cttaaagggttcctcacact

SEQ ID NO: 89447 - DNA, 20 bp, Artificial
  CRISPR gRNA sequence
ttaaagggttcctcacactt

SEQ ID NO: 89448 - DNA, 20 bp, Artificial
  CRISPR gRNA sequence
aaagggttcctcacacttga

SEQ ID NO: 89449 - DNA, 20 bp, Artificial
  CRISPR gRNA sequence
aagggttcctcacacttgat

SEQ ID NO: 89450 - DNA, 20 bp, Artificial
  CRISPR gRNA sequence
ctcacacttgatccctaggg

SEQ ID NO: 89451 - DNA, 20 bp, Artificial
  CRISPR gRNA sequence
acacttgatccctagggact

SEQ ID NO: 89452 - DNA, 20 bp, Artificial
  CRISPR gRNA sequence
gatccctagggactcttcga

SEQ ID NO: 89453 - DNA, 20 bp, Artificial
  CRISPR gRNA sequence
atccctagggactcttcgag

SEQ ID NO: 89454 - DNA, 20 bp, Artificial
  CRISPR gRNA sequence
gggactcttcgagcctaccc

SEQ ID NO: 89455 - DNA, 20 bp, Artificial
  CRISPR gRNA sequence
ttcgagcctacccatggcct

SEQ ID NO: 89456 - DNA, 20 bp, Artificial
  CRISPR gRNA sequence
cgagcctacccatggcctcc

SEQ ID NO: 89457 - DNA, 20 bp, Artificial
  CRISPR gRNA sequence
gagcctacccatggcctcct

SEQ ID NO: 89458 - DNA, 20 bp, Artificial
  CRISPR gRNA sequence
cccatggcctccttctctga

SEQ ID NO: 89459 - DNA, 20 bp, Artificial
  CRISPR gRNA sequence
cttctctgagtatcttccca

SEQ ID NO: 89460 - DNA, 20 bp, Artificial
  CRISPR gRNA sequence
ctctgagtatcttcccactc

SEQ ID NO: 89461 - DNA, 20 bp, Artificial
  CRISPR gRNA sequence
tctgagtatcttcccactct

SEQ ID NO: 89462 - DNA, 20 bp, Artificial
  CRISPR gRNA sequence
tgagtatcttcccactctgc

SEQ ID NO: 89463 - DNA, 20 bp, Artificial
  CRISPR gRNA sequence
agtatcttcccactctgctc

SEQ ID NO: 89464 - DNA, 20 bp, Artificial
  CRISPR gRNA sequence
cccactctgctcccctctca

SEQ ID NO: 89465 - DNA, 20 bp, Artificial
  CRISPR gRNA sequence
ccactctgctcccctctcac

SEQ ID NO: 89466 - DNA, 20 bp, Artificial
  CRISPR gRNA sequence
tgctcccctctcactcagga

SEQ ID NO: 89467 - DNA, 20 bp, Artificial
  CRISPR gRNA sequence
ctcccctctcactcaggaag

SEQ ID NO: 89468 - DNA, 20 bp, Artificial
  CRISPR gRNA sequence
ccctctcactcaggaagtac

SEQ ID NO: 89469 - DNA, 20 bp, Artificial
  CRISPR gRNA sequence
tcactcaggaagtactgtga

SEQ ID NO: 89470 - DNA, 20 bp, Artificial
  CRISPR gRNA sequence
actcaggaagtactgtgaga

SEQ ID NO: 89471 - DNA, 20 bp, Artificial
  CRISPR gRNA sequence
aggaagtactgtgagagtct

SEQ ID NO: 89472 - DNA, 20 bp, Artificial
  CRISPR gRNA sequence
tgagagtcttgcctgttgcc

SEQ ID NO: 89473 - DNA, 20 bp, Artificial
  CRISPR gRNA sequence
gcctgttgccgcccactcag

SEQ ID NO: 89474 - DNA, 20 bp, Artificial
  CRISPR gRNA sequence
cctgttgccgcccactcagc

SEQ ID NO: 89475 - DNA, 20 bp, Artificial
  CRISPR gRNA sequence
ttgccgcccactcagcacag

SEQ ID NO: 89476 - DNA, 20 bp, Artificial
  CRISPR gRNA sequence
ccgcccactcagcacagcca

SEQ ID NO: 89477 - DNA, 20 bp, Artificial
  CRISPR gRNA sequence
agcacagccaactttggcaa

SEQ ID NO: 89478 - DNA, 20 bp, Artificial
  CRISPR gRNA sequence
tggcaagatcatcagagaga

SEQ ID NO: 89479 - DNA, 20 bp, Artificial
  CRISPR gRNA sequence
ggcaagatcatcagagagat

SEQ ID NO: 89480 - DNA, 20 bp, Artificial
  CRISPR gRNA sequence
gcaagatcatcagagagatc

SEQ ID NO: 89481 - DNA, 20 bp, Artificial
  CRISPR gRNA sequence
ccctgacatcaaagctcgaa

SEQ ID NO: 89482 - DNA, 20 bp, Artificial
  CRISPR gRNA sequence
cctgacatcaaagctcgaag

SEQ ID NO: 89483 - DNA, 20 bp, Artificial
  CRISPR gRNA sequence
acatcaaagctcgaaggctt

SEQ ID NO: 89484 - DNA, 20 bp, Artificial
  CRISPR gRNA sequence
gaaggcttggtggccggggc

SEQ ID NO: 89485 - DNA, 20 bp, Artificial
  CRISPR gRNA sequence
ggtggccggggccagtccaa

SEQ ID NO: 89486 - DNA, 20 bp, Artificial
  CRISPR gRNA sequence
gtggccggggccagtccaag

SEQ ID NO: 89487 - DNA, 20 bp, Artificial
  CRISPR gRNA sequence
gactagagaggttgggggtg

SEQ ID NO: 89488 - DNA, 20 bp, Artificial
  CRISPR gRNA sequence
actagagaggttgggggtgg

SEQ ID NO: 89489 - DNA, 20 bp, Artificial
  CRISPR gRNA sequence
gagaggttgggggtggagga

SEQ ID NO: 89490 - DNA, 20 bp, Artificial
  CRISPR gRNA sequence
ggggtggaggacctgggagg

SEQ ID NO: 89491 - DNA, 20 bp, Artificial
  CRISPR gRNA sequence
ggaggaagacttaggatgtg

SEQ ID NO: 89492 - DNA, 20 bp, Artificial
  CRISPR gRNA sequence
aggatgtggagagcaaggag

SEQ ID NO: 89493 - DNA, 20 bp, Artificial
  CRISPR gRNA sequence
ggatgtggagagcaaggagt

SEQ ID NO: 89494 - DNA, 20 bp, Artificial
  CRISPR gRNA sequence
aacttgctcgaggggcttgg

SEQ ID NO: 89495 - DNA, 20 bp, Artificial
  CRISPR gRNA sequence
acttgctcgaggggcttgga

SEQ ID NO: 89496 - DNA, 20 bp, Artificial
  CRISPR gRNA sequence
gctcgaggggcttggagatc

SEQ ID NO: 89497 - DNA, 20 bp, Artificial
  CRISPR gRNA sequence
ctcgaggggcttggagatcg

SEQ ID NO: 89498 - DNA, 20 bp, Artificial
  CRISPR gRNA sequence
gaggggcttggagatcgcca

SEQ ID NO: 89499 - DNA, 20 bp, Artificial
  CRISPR gRNA sequence
ggagatcgccatgtgttggc

SEQ ID NO: 89500 - DNA, 20 bp, Artificial
  CRISPR gRNA sequence
gagatcgccatgtgttggct

SEQ ID NO: 89501 - DNA, 20 bp, Artificial
  CRISPR gRNA sequence
gctgctctttaacttgcatc

SEQ ID NO: 89502 - DNA, 20 bp, Artificial
  CRISPR gRNA sequence
ctctttaacttgcatcagat

SEQ ID NO: 89503 - DNA, 20 bp, Artificial
  CRISPR gRNA sequence
tttaacttgcatcagatatt

SEQ ID NO: 89504 - DNA, 20 bp, Artificial
  CRISPR gRNA sequence
taacttgcatcagatattgc

SEQ ID NO: 89505 - DNA, 20 bp, Artificial
  CRISPR gRNA sequence
aacttgcatcagatattgct

SEQ ID NO: 89506 - DNA, 20 bp, Artificial
  CRISPR gRNA sequence
acttgcatcagatattgcta

SEQ ID NO: 89507 - DNA, 20 bp, Artificial
  CRISPR gRNA sequence
gcatcagatattgctacagt

SEQ ID NO: 89508 - DNA, 20 bp, Artificial
  CRISPR gRNA sequence
catcagatattgctacagtg

SEQ ID NO: 89509 - DNA, 20 bp, Artificial
  CRISPR gRNA sequence
ctacagtggcataaggagga

SEQ ID NO: 89510 - DNA, 20 bp, Artificial
  CRISPR gRNA sequence
cagtggcataaggaggaaga

SEQ ID NO: 89511 - DNA, 20 bp, Artificial
  CRISPR gRNA sequence
ggtgtctatgccacccctgc

SEQ ID NO: 89512 - DNA, 20 bp, Artificial
  CRISPR gRNA sequence
gtgtctatgccacccctgcc

SEQ ID NO: 89513 - DNA, 20 bp, Artificial
  CRISPR gRNA sequence
tgccacccctgcctggactt

SEQ ID NO: 89514 - DNA, 20 bp, Artificial
  CRISPR gRNA sequence
cctggacttgacctaaaggg

SEQ ID NO: 89515 - DNA, 20 bp, Artificial
  CRISPR gRNA sequence
gacttgacctaaagggttct

SEQ ID NO: 89516 - DNA, 20 bp, Artificial
  CRISPR gRNA sequence
gacctaaagggttctgagag

SEQ ID NO: 89517 - DNA, 20 bp, Artificial
  CRISPR gRNA sequence
acctaaagggttctgagagt

SEQ ID NO: 89518 - DNA, 20 bp, Artificial
  CRISPR gRNA sequence
aagggttctgagagtgtaag

SEQ ID NO: 89519 - DNA, 20 bp, Artificial
  CRISPR gRNA sequence
tgagagtgtaagtaccaaat

SEQ ID NO: 89520 - DNA, 20 bp, Artificial
  CRISPR gRNA sequence
agagtgtaagtaccaaatca

SEQ ID NO: 89521 - DNA, 20 bp, Artificial
  CRISPR gRNA sequence
ccaattccactcttctctcc

SEQ ID NO: 89522 - DNA, 20 bp, Artificial
  CRISPR gRNA sequence
caattccactcttctctccc

SEQ ID NO: 89523 - DNA, 20 bp, Artificial
  CRISPR gRNA sequence
cactcttctctcccaggtaa

SEQ ID NO: 89524 - DNA, 20 bp, Artificial
  CRISPR gRNA sequence
ttctctcccaggtaaaagtc

SEQ ID NO: 89525 - DNA, 20 bp, Artificial
  CRISPR gRNA sequence
ctctcccaggtaaaagtcag

SEQ ID NO: 89526 - DNA, 20 bp, Artificial
  CRISPR gRNA sequence
tctcccaggtaaaagtcaga

SEQ ID NO: 89527 - DNA, 20 bp, Artificial
  CRISPR gRNA sequence
tcccaggtaaaagtcagagg

SEQ ID NO: 89528 - DNA, 20 bp, Artificial
  CRISPR gRNA sequence
ccaggtaaaagtcagaggtc

SEQ ID NO: 89529 - DNA, 20 bp, Artificial
  CRISPR gRNA sequence
tggggcatgttttgagggct

SEQ ID NO: 89530 - DNA, 20 bp, Artificial
  CRISPR gRNA sequence
ggggcatgttttgagggcta

SEQ ID NO: 89531 - DNA, 20 bp, Artificial
  CRISPR gRNA sequence
gggcatgttttgagggctaa

SEQ ID NO: 89532 - DNA, 20 bp, Artificial
  CRISPR gRNA sequence
tgagggctaacagcctcagt

SEQ ID NO: 89533 - DNA, 20 bp, Artificial
  CRISPR gRNA sequence
gagggctaacagcctcagtc

SEQ ID NO: 89534 - DNA, 20 bp, Artificial
  CRISPR gRNA sequence
agggctaacagcctcagtca

SEQ ID NO: 89535 - DNA, 20 bp, Artificial
  CRISPR gRNA sequence
acagcctcagtcattatgta

SEQ ID NO: 89536 - DNA, 20 bp, Artificial
  CRISPR gRNA sequence
agtcattatgtacatagctt

SEQ ID NO: 89537 - DNA, 20 bp, Artificial
  CRISPR gRNA sequence
tgtacatagcttctaggtat

SEQ ID NO: 89538 - DNA, 20 bp, Artificial
  CRISPR gRNA sequence
ctaggtatgatgttcccttc

SEQ ID NO: 89539 - DNA, 20 bp, Artificial
  CRISPR gRNA sequence
taggtatgatgttcccttct

SEQ ID NO: 89540 - DNA, 20 bp, Artificial
  CRISPR gRNA sequence
ggtatgatgttcccttctgc

SEQ ID NO: 89541 - DNA, 20 bp, Artificial
  CRISPR gRNA sequence
ccttctgccaaccctgtagc

SEQ ID NO: 89542 - DNA, 20 bp, Artificial
  CRISPR gRNA sequence
ctgccaaccctgtagctgag

SEQ ID NO: 89543 - DNA, 20 bp, Artificial
  CRISPR gRNA sequence
tgccaaccctgtagctgagg

SEQ ID NO: 89544 - DNA, 20 bp, Artificial
  CRISPR gRNA sequence
ccaaccctgtagctgaggca

SEQ ID NO: 89545 - DNA, 20 bp, Artificial
  CRISPR gRNA sequence
tagctgaggcagaggatgaa

SEQ ID NO: 89546 - DNA, 20 bp, Artificial
  CRISPR gRNA sequence
aggcagaggatgaagagaac

SEQ ID NO: 89547 - DNA, 20 bp, Artificial
  CRISPR gRNA sequence
gtgggcttctgcaatgggat

SEQ ID NO: 89548 - DNA, 20 bp, Artificial
  CRISPR gRNA sequence
tgggcttctgcaatgggata

SEQ ID NO: 89549 - DNA, 20 bp, Artificial
  CRISPR gRNA sequence
ctgcaatgggataggtagag

SEQ ID NO: 89550 - DNA, 20 bp, Artificial
  CRISPR gRNA sequence
tgcaatgggataggtagagg

SEQ ID NO: 89551 - DNA, 20 bp, Artificial
  CRISPR gRNA sequence
caatgggataggtagaggct

SEQ ID NO: 89552 - DNA, 20 bp, Artificial
  CRISPR gRNA sequence
ctcccatccccagtctggtc

SEQ ID NO: 89553 - DNA, 20 bp, Artificial
  CRISPR gRNA sequence
ccatccccagtctggtctca

SEQ ID NO: 89554 - DNA, 20 bp, Artificial
  CRISPR gRNA sequence
gtctcagctttggtcaatag

SEQ ID NO: 89555 - DNA, 20 bp, Artificial
  CRISPR gRNA sequence
agctttggtcaatagtcttt

SEQ ID NO: 89556 - DNA, 20 bp, Artificial
  CRISPR gRNA sequence
tggtcaatagtctttgatct

SEQ ID NO: 89557 - DNA, 20 bp, Artificial
  CRISPR gRNA sequence
ggtcaatagtctttgatctc

SEQ ID NO: 89558 - DNA, 20 bp, Artificial
  CRISPR gRNA sequence
gtcaatagtctttgatctct

SEQ ID NO: 89559 - DNA, 20 bp, Artificial
  CRISPR gRNA sequence
tgatctctgacaagagagga

SEQ ID NO: 89560 - DNA, 20 bp, Artificial
  CRISPR gRNA sequence
gatctctgacaagagaggag

SEQ ID NO: 89561 - DNA, 20 bp, Artificial
  CRISPR gRNA sequence
atctctgacaagagaggagg

SEQ ID NO: 89562 - DNA, 20 bp, Artificial
  CRISPR gRNA sequence
tgacaagagaggaggcaagg

SEQ ID NO: 89563 - DNA, 20 bp, Artificial
  CRISPR gRNA sequence
acaagagaggaggcaagggt

SEQ ID NO: 89564 - DNA, 20 bp, Artificial
  CRISPR gRNA sequence
tttaatttggagtgtgattg

SEQ ID NO: 89565 - DNA, 20 bp, Artificial
  CRISPR gRNA sequence
taatttggagtgtgattggg

SEQ ID NO: 89566 - DNA, 20 bp, Artificial
  CRISPR gRNA sequence
aatttggagtgtgattgggc

SEQ ID NO: 89567 - DNA, 20 bp, Artificial
  CRISPR gRNA sequence
atttggagtgtgattgggca

SEQ ID NO: 89568 - DNA, 20 bp, Artificial
  CRISPR gRNA sequence
ggagtgtgattgggcatgtc

SEQ ID NO: 89569 - DNA, 20 bp, Artificial
  CRISPR gRNA sequence
gagtgtgattgggcatgtcc

SEQ ID NO: 89570 - DNA, 20 bp, Artificial
  CRISPR gRNA sequence
ggcatgtccttccccacttc

SEQ ID NO: 89571 - DNA, 20 bp, Artificial
  CRISPR gRNA sequence
ccccacttcagccagaaatg

SEQ ID NO: 89572 - DNA, 20 bp, Artificial
  CRISPR gRNA sequence
cccacttcagccagaaatgg

SEQ ID NO: 89573 - DNA, 20 bp, Artificial
  CRISPR gRNA sequence
cagccagaaatgggcccaga

SEQ ID NO: 89574 - DNA, 20 bp, Artificial
  CRISPR gRNA sequence
agccagaaatgggcccagaa

SEQ ID NO: 89575 - DNA, 20 bp, Artificial
  CRISPR gRNA sequence
gagatgaactggtggaggca

SEQ ID NO: 89576 - DNA, 20 bp, Artificial
  CRISPR gRNA sequence
gtggaggcagcgtgtgccct

SEQ ID NO: 89577 - DNA, 20 bp, Artificial
  CRISPR gRNA sequence
acctgtgactgggcagagcg

SEQ ID NO: 89578 - DNA, 20 bp, Artificial
  CRISPR gRNA sequence
tgactgggcagagcggatcc

SEQ ID NO: 89579 - DNA, 20 bp, Artificial
  CRISPR gRNA sequence
ggcagagcggatcctgaaac

SEQ ID NO: 89580 - DNA, 20 bp, Artificial
  CRISPR gRNA sequence
aaacggtccttcagttccat

SEQ ID NO: 89581 - DNA, 20 bp, Artificial
  CRISPR gRNA sequence
cagttccatcgttgaggtcg

SEQ ID NO: 89582 - DNA, 20 bp, Artificial
  CRISPR gRNA sequence
agttccatcgttgaggtcgc

SEQ ID NO: 89583 - DNA, 20 bp, Artificial
  CRISPR gRNA sequence
catcgttgaggtcgcccgct

SEQ ID NO: 89584 - DNA, 20 bp, Artificial
  CRISPR gRNA sequence
aggtcgcccgcttcctgcta

SEQ ID NO: 89585 - DNA, 20 bp, Artificial
  CRISPR gRNA sequence
cctgctacagcagcatctca

SEQ ID NO: 89586 - DNA, 20 bp, Artificial
  CRISPR gRNA sequence
ctgctacagcagcatctcat

SEQ ID NO: 89587 - DNA, 20 bp, Artificial
  CRISPR gRNA sequence
ctacagcagcatctcatctc

SEQ ID NO: 89588 - DNA, 20 bp, Artificial
  CRISPR gRNA sequence
cagcagcatctcatctctgc

SEQ ID NO: 89589 - DNA, 20 bp, Artificial
  CRISPR gRNA sequence
atctctgcccgatctgcaca

SEQ ID NO: 89590 - DNA, 20 bp, Artificial
  CRISPR gRNA sequence
tgcccgatctgcacatgccc

SEQ ID NO: 89591 - DNA, 20 bp, Artificial
  CRISPR gRNA sequence
cccgatctgcacatgcccat

SEQ ID NO: 89592 - DNA, 20 bp, Artificial
  CRISPR gRNA sequence
cacatgcccatgtgcttaag

SEQ ID NO: 89593 - DNA, 20 bp, Artificial
  CRISPR gRNA sequence
aaggccatggggctcgctgg

SEQ ID NO: 89594 - DNA, 20 bp, Artificial
  CRISPR gRNA sequence
aggccatggggctcgctggt

SEQ ID NO: 89595 - DNA, 20 bp, Artificial
  CRISPR gRNA sequence
gctggtgtgttgaccctctc

SEQ ID NO: 89596 - DNA, 20 bp, Artificial
  CRISPR gRNA sequence
gtgtgttgaccctctcttat

SEQ ID NO: 89597 - DNA, 20 bp, Artificial
  CRISPR gRNA sequence
accctctcttatgtctcagc

SEQ ID NO: 89598 - DNA, 20 bp, Artificial
  CRISPR gRNA sequence
tcttatgtctcagcaaccct

SEQ ID NO: 89599 - DNA, 20 bp, Artificial
  CRISPR gRNA sequence
ttatgtctcagcaaccctga

SEQ ID NO: 89600 - DNA, 20 bp, Artificial
  CRISPR gRNA sequence
atgtctcagcaaccctgagc

SEQ ID NO: 89601 - DNA, 20 bp, Artificial
  CRISPR gRNA sequence
tgtctcagcaaccctgagcc

SEQ ID NO: 89602 - DNA, 20 bp, Artificial
  CRISPR gRNA sequence
agcaaccctgagccactttc

SEQ ID NO: 89603 - DNA, 20 bp, Artificial
  CRISPR gRNA sequence
agccactttcagcttcagtg

SEQ ID NO: 89604 - DNA, 20 bp, Artificial
  CRISPR gRNA sequence
tcagcttcagtggccctccc

SEQ ID NO: 89605 - DNA, 20 bp, Artificial
  CRISPR gRNA sequence
cagcttcagtggccctccca

SEQ ID NO: 89606 - DNA, 20 bp, Artificial
  CRISPR gRNA sequence
agcttcagtggccctcccac

SEQ ID NO: 89607 - DNA, 20 bp, Artificial
  CRISPR gRNA sequence
cagtggccctcccacacact

SEQ ID NO: 89608 - DNA, 20 bp, Artificial
  CRISPR gRNA sequence
agtggccctcccacacacta

SEQ ID NO: 89609 - DNA, 20 bp, Artificial
  CRISPR gRNA sequence
ccacacactagaatagagac

SEQ ID NO: 89610 - DNA, 20 bp, Artificial
  CRISPR gRNA sequence
gaatagagacaccttggatt

SEQ ID NO: 89611 - DNA, 20 bp, Artificial
  CRISPR gRNA sequence
ggatttgccccctcttcctg

SEQ ID NO: 89612 - DNA, 20 bp, Artificial
  CRISPR gRNA sequence
gatttgccccctcttcctgg

SEQ ID NO: 89613 - DNA, 20 bp, Artificial
  CRISPR gRNA sequence
gccccctcttcctggagacc

SEQ ID NO: 89614 - DNA, 20 bp, Artificial
  CRISPR gRNA sequence
ccccctcttcctggagaccc

SEQ ID NO: 89615 - DNA, 20 bp, Artificial
  CRISPR gRNA sequence
ttcctggagacccttctaag

SEQ ID NO: 89616 - DNA, 20 bp, Artificial
  CRISPR gRNA sequence
cctggagacccttctaagac

SEQ ID NO: 89617 - DNA, 20 bp, Artificial
  CRISPR gRNA sequence
ctggagacccttctaagaca

SEQ ID NO: 89618 - DNA, 20 bp, Artificial
  CRISPR gRNA sequence
gagacccttctaagacatgc

SEQ ID NO: 89619 - DNA, 20 bp, Artificial
  CRISPR gRNA sequence
ctaagacatgctttagcacc

SEQ ID NO: 89620 - DNA, 20 bp, Artificial
  CRISPR gRNA sequence
taagacatgctttagcaccc

SEQ ID NO: 89621 - DNA, 20 bp, Artificial
  CRISPR gRNA sequence
agacatgctttagcacccca

SEQ ID NO: 89622 - DNA, 20 bp, Artificial
  CRISPR gRNA sequence
tagcaccccatttcctgtct

SEQ ID NO: 89623 - DNA, 20 bp, Artificial
  CRISPR gRNA sequence
agcaccccatttcctgtctc

SEQ ID NO: 89624 - DNA, 20 bp, Artificial
  CRISPR gRNA sequence
gcaccccatttcctgtctct

SEQ ID NO: 89625 - DNA, 20 bp, Artificial
  CRISPR gRNA sequence
cctgtctctaccagtcagtc

SEQ ID NO: 89626 - DNA, 20 bp, Artificial
  CRISPR gRNA sequence
ctgtctctaccagtcagtca

SEQ ID NO: 89627 - DNA, 20 bp, Artificial
  CRISPR gRNA sequence
tctctaccagtcagtcaatc

SEQ ID NO: 89628 - DNA, 20 bp, Artificial
  CRISPR gRNA sequence
taccagtcagtcaatcagaa

SEQ ID NO: 89629 - DNA, 20 bp, Artificial
  CRISPR gRNA sequence
ccagtcagtcaatcagaatt

SEQ ID NO: 89630 - DNA, 20 bp, Artificial
  CRISPR gRNA sequence
cctcactcccctattcctca

SEQ ID NO: 89631 - DNA, 20 bp, Artificial
  CRISPR gRNA sequence
actcccctattcctcagttt

SEQ ID NO: 89632 - DNA, 20 bp, Artificial
  CRISPR gRNA sequence
ccctattcctcagtttcctc

SEQ ID NO: 89633 - DNA, 20 bp, Artificial
  CRISPR gRNA sequence
ttcctcagtttcctcctcac

SEQ ID NO: 89634 - DNA, 20 bp, Artificial
  CRISPR gRNA sequence
ctcagtttcctcctcacctt

SEQ ID NO: 89635 - DNA, 20 bp, Artificial
  CRISPR gRNA sequence
agtttcctcctcaccttcac

SEQ ID NO: 89636 - DNA, 20 bp, Artificial
  CRISPR gRNA sequence
cctcctcaccttcactctat

SEQ ID NO: 89637 - DNA, 20 bp, Artificial
  CRISPR gRNA sequence
ctcctcaccttcactctatt

SEQ ID NO: 89638 - DNA, 20 bp, Artificial
  CRISPR gRNA sequence
ctcaccttcactctattacc

SEQ ID NO: 89639 - DNA, 20 bp, Artificial
  CRISPR gRNA sequence
accttcactctattaccttt

SEQ ID NO: 89640 - DNA, 20 bp, Artificial
  CRISPR gRNA sequence
cactctattacctttttggt

SEQ ID NO: 89641 - DNA, 20 bp, Artificial
  CRISPR gRNA sequence
actctattacctttttggta

SEQ ID NO: 89642 - DNA, 20 bp, Artificial
  CRISPR gRNA sequence
tattacctttttggtacctc

SEQ ID NO: 89643 - DNA, 20 bp, Artificial
  CRISPR gRNA sequence
ttacctttttggtacctctg

SEQ ID NO: 89644 - DNA, 20 bp, Artificial
  CRISPR gRNA sequence
cctttttggtacctctgcag

SEQ ID NO: 89645 - DNA, 20 bp, Artificial
  CRISPR gRNA sequence
tttggtacctctgcagaaga

SEQ ID NO: 89646 - DNA, 20 bp, Artificial
  CRISPR gRNA sequence
ttggtacctctgcagaagag

SEQ ID NO: 89647 - DNA, 20 bp, Artificial
  CRISPR gRNA sequence
tggtacctctgcagaagagg

SEQ ID NO: 89648 - DNA, 20 bp, Artificial
  CRISPR gRNA sequence
ggtacctctgcagaagagga

SEQ ID NO: 89649 - DNA, 20 bp, Artificial
  CRISPR gRNA sequence
gtacctctgcagaagaggac

SEQ ID NO: 89650 - DNA, 20 bp, Artificial
  CRISPR gRNA sequence
tgcagaagaggacgaacatg

SEQ ID NO: 89651 - DNA, 20 bp, Artificial
  CRISPR gRNA sequence
cagaagaggacgaacatgca

SEQ ID NO: 89652 - DNA, 20 bp, Artificial
  CRISPR gRNA sequence
gggaacggtcatctaaacca

SEQ ID NO: 89653 - DNA, 20 bp, Artificial
  CRISPR gRNA sequence
aaccaaagaatggtttagag

SEQ ID NO: 89654 - DNA, 20 bp, Artificial
  CRISPR gRNA sequence
agagaacccagagggtggag

SEQ ID NO: 89655 - DNA, 20 bp, Artificial
  CRISPR gRNA sequence
gagaacccagagggtggagc

SEQ ID NO: 89656 - DNA, 20 bp, Artificial
  CRISPR gRNA sequence
gcccaggtaaggaagtcagt

SEQ ID NO: 89657 - DNA, 20 bp, Artificial
  CRISPR gRNA sequence
actttgctgtcctgggctgg

SEQ ID NO: 89658 - DNA, 20 bp, Artificial
  CRISPR gRNA sequence
tgctgtcctgggctgggggc

SEQ ID NO: 89659 - DNA, 20 bp, Artificial
  CRISPR gRNA sequence
gctgtcctgggctgggggct

SEQ ID NO: 89660 - DNA, 20 bp, Artificial
  CRISPR gRNA sequence
ctgtcctgggctgggggctt

SEQ ID NO: 89661 - DNA, 20 bp, Artificial
  CRISPR gRNA sequence
tcctgggctgggggcttagt

SEQ ID NO: 89662 - DNA, 20 bp, Artificial
  CRISPR gRNA sequence
ggctgggggcttagtatatc

SEQ ID NO: 89663 - DNA, 20 bp, Artificial
  CRISPR gRNA sequence
ggggcttagtatatccttct

SEQ ID NO: 89664 - DNA, 20 bp, Artificial
  CRISPR gRNA sequence
agtatatccttctccaattg

SEQ ID NO: 89665 - DNA, 20 bp, Artificial
  CRISPR gRNA sequence
gtatatccttctccaattgg

SEQ ID NO: 89666 - DNA, 20 bp, Artificial
  CRISPR gRNA sequence
ctccaattgggtcccttgct

SEQ ID NO: 89667 - DNA, 20 bp, Artificial
  CRISPR gRNA sequence
tccaattgggtcccttgctt

SEQ ID NO: 89668 - DNA, 20 bp, Artificial
  CRISPR gRNA sequence
caattgggtcccttgctttt

SEQ ID NO: 89669 - DNA, 20 bp, Artificial
  CRISPR gRNA sequence
ggtcccttgcttttccacct

SEQ ID NO: 89670 - DNA, 20 bp, Artificial
  CRISPR gRNA sequence
gcttttccacctcctgtgcc

SEQ ID NO: 89671 - DNA, 20 bp, Artificial
  CRISPR gRNA sequence
cttttccacctcctgtgcct

SEQ ID NO: 89672 - DNA, 20 bp, Artificial
  CRISPR gRNA sequence
ttccacctcctgtgcctctg

SEQ ID NO: 89673 - DNA, 20 bp, Artificial
  CRISPR gRNA sequence
tccacctcctgtgcctctgg

SEQ ID NO: 89674 - DNA, 20 bp, Artificial
  CRISPR gRNA sequence
ccacctcctgtgcctctggc

SEQ ID NO: 89675 - DNA, 20 bp, Artificial
  CRISPR gRNA sequence
cacctcctgtgcctctggcg

SEQ ID NO: 89676 - DNA, 20 bp, Artificial
  CRISPR gRNA sequence
ctgtgcctctggcgtctatg

SEQ ID NO: 89677 - DNA, 20 bp, Artificial
  CRISPR gRNA sequence
tgcctctggcgtctatgttt

SEQ ID NO: 89678 - DNA, 20 bp, Artificial
  CRISPR gRNA sequence
tggcgtctatgtttccccca

SEQ ID NO: 89679 - DNA, 20 bp, Artificial
  CRISPR gRNA sequence
gcgtctatgtttcccccaat

SEQ ID NO: 89680 - DNA, 20 bp, Artificial
  CRISPR gRNA sequence
tgtttcccccaatactcatt

SEQ ID NO: 89681 - DNA, 20 bp, Artificial
  CRISPR gRNA sequence
cccccaatactcattcttca

SEQ ID NO: 89682 - DNA, 20 bp, Artificial
  CRISPR gRNA sequence
ccccaatactcattcttcac

SEQ ID NO: 89683 - DNA, 20 bp, Artificial
  CRISPR gRNA sequence
attcttcacaccttactgtg

SEQ ID NO: 89684 - DNA, 20 bp, Artificial
  CRISPR gRNA sequence
ttcacaccttactgtgttcc

SEQ ID NO: 89685 - DNA, 20 bp, Artificial
  CRISPR gRNA sequence
cacaccttactgtgttcctc

SEQ ID NO: 89686 - DNA, 20 bp, Artificial
  CRISPR gRNA sequence
acaccttactgtgttcctct

SEQ ID NO: 89687 - DNA, 20 bp, Artificial
  CRISPR gRNA sequence
actgtgttcctctctttact

SEQ ID NO: 89688 - DNA, 20 bp, Artificial
  CRISPR gRNA sequence
ctgtgttcctctctttactt

SEQ ID NO: 89689 - DNA, 20 bp, Artificial
  CRISPR gRNA sequence
tgttcctctctttacttttt

SEQ ID NO: 89690 - DNA, 20 bp, Artificial
  CRISPR gRNA sequence
ctctctttactttttagcct

SEQ ID NO: 89691 - DNA, 20 bp, Artificial
  CRISPR gRNA sequence
tctttactttttagcctcct

SEQ ID NO: 89692 - DNA, 20 bp, Artificial
  CRISPR gRNA sequence
tttactttttagcctcctaa

SEQ ID NO: 89693 - DNA, 20 bp, Artificial
  CRISPR gRNA sequence
tactttttagcctcctaagg

SEQ ID NO: 89694 - DNA, 20 bp, Artificial
  CRISPR gRNA sequence
actttttagcctcctaagga

SEQ ID NO: 89695 - DNA, 20 bp, Artificial
  CRISPR gRNA sequence
ctttttagcctcctaaggat

SEQ ID NO: 89696 - DNA, 20 bp, Artificial
  CRISPR gRNA sequence
tttagcctcctaaggatctg

SEQ ID NO: 89697 - DNA, 20 bp, Artificial
  CRISPR gRNA sequence
ttagcctcctaaggatctgg

SEQ ID NO: 89698 - DNA, 20 bp, Artificial
  CRISPR gRNA sequence
tagcctcctaaggatctgga

SEQ ID NO: 89699 - DNA, 20 bp, Artificial
  CRISPR gRNA sequence
agcctcctaaggatctggaa

SEQ ID NO: 89700 - DNA, 20 bp, Artificial
  CRISPR gRNA sequence
gcctcctaaggatctggaag

SEQ ID NO: 89701 - DNA, 20 bp, Artificial
  CRISPR gRNA sequence
ctaaggatctggaagcccga

SEQ ID NO: 89702 - DNA, 20 bp, Artificial
  CRISPR gRNA sequence
aggatctggaagcccgaact

SEQ ID NO: 89703 - DNA, 20 bp, Artificial
  CRISPR gRNA sequence
gaagcccgaactggggccgg

SEQ ID NO: 89704 - DNA, 20 bp, Artificial
  CRISPR gRNA sequence
gggccggtcctctcgcacgt

SEQ ID NO: 89705 - DNA, 20 bp, Artificial
  CRISPR gRNA sequence
tcgcacgtggagagcggaag

SEQ ID NO: 89706 - DNA, 20 bp, Artificial
  CRISPR gRNA sequence
gcacgtggagagcggaagaa

SEQ ID NO: 89707 - DNA, 20 bp, Artificial
  CRISPR gRNA sequence
agagctcggccccaggagcc

SEQ ID NO: 89708 - DNA, 20 bp, Artificial
  CRISPR gRNA sequence
ggccccaggagccaataacc

SEQ ID NO: 89709 - DNA, 20 bp, Artificial
  CRISPR gRNA sequence
caggttaatgccctagtggc

SEQ ID NO: 89710 - DNA, 20 bp, Artificial
  CRISPR gRNA sequence
atgccctagtggctcggctg

SEQ ID NO: 89711 - DNA, 20 bp, Artificial
  CRISPR gRNA sequence
gtggctcggctgcctctgct

SEQ ID NO: 89712 - DNA, 20 bp, Artificial
  CRISPR gRNA sequence
ggctgcctctgctccttccc

SEQ ID NO: 89713 - DNA, 20 bp, Artificial
  CRISPR gRNA sequence
cctctgctccttccccgggc

SEQ ID NO: 89714 - DNA, 20 bp, Artificial
  CRISPR gRNA sequence
tgctccttccccgggcccct

SEQ ID NO: 89715 - DNA, 20 bp, Artificial
  CRISPR gRNA sequence
ctccttccccgggcccctcg

SEQ ID NO: 89716 - DNA, 20 bp, Artificial
  CRISPR gRNA sequence
cttccccgggcccctcgctc

SEQ ID NO: 89717 - DNA, 20 bp, Artificial
  CRISPR gRNA sequence
ccccgggcccctcgctcact

SEQ ID NO: 89718 - DNA, 20 bp, Artificial
  CRISPR gRNA sequence
cccgggcccctcgctcacta

SEQ ID NO: 89719 - DNA, 20 bp, Artificial
  CRISPR gRNA sequence
gctcactaattccgccaatc

SEQ ID NO: 89720 - DNA, 20 bp, Artificial
  CRISPR gRNA sequence
actaattccgccaatcccag

SEQ ID NO: 89721 - DNA, 20 bp, Artificial
  CRISPR gRNA sequence
attccgccaatcccagtctc

SEQ ID NO: 89722 - DNA, 20 bp, Artificial
  CRISPR gRNA sequence
cgccaatcccagtctctcca

SEQ ID NO: 89723 - DNA, 20 bp, Artificial
  CRISPR gRNA sequence
tccacctattctggccccca

SEQ ID NO: 89724 - DNA, 20 bp, Artificial
  CRISPR gRNA sequence
cacctattctggcccccagg

SEQ ID NO: 89725 - DNA, 20 bp, Artificial
  CRISPR gRNA sequence
ttctggcccccaggctttct

SEQ ID NO: 89726 - DNA, 20 bp, Artificial
  CRISPR gRNA sequence
tggcccccaggctttcttca

SEQ ID NO: 89727 - DNA, 20 bp, Artificial
  CRISPR gRNA sequence
gcccccaggctttcttcagg

SEQ ID NO: 89728 - DNA, 20 bp, Artificial
  CRISPR gRNA sequence
tcttcaggtgccctgaaagt

SEQ ID NO: 89729 - DNA, 20 bp, Artificial
  CRISPR gRNA sequence
cttcaggtgccctgaaagtg

SEQ ID NO: 89730 - DNA, 20 bp, Artificial
  CRISPR gRNA sequence
ttcaggtgccctgaaagtgg

SEQ ID NO: 89731 - DNA, 20 bp, Artificial
  CRISPR gRNA sequence
caggtgccctgaaagtggct

SEQ ID NO: 89732 - DNA, 20 bp, Artificial
  CRISPR gRNA sequence
aggtgccctgaaagtggcta

SEQ ID NO: 89733 - DNA, 20 bp, Artificial
  CRISPR gRNA sequence
aaagtggctacactgcctct

SEQ ID NO: 89734 - DNA, 20 bp, Artificial
  CRISPR gRNA sequence
cactgcctctgtctagtagg

SEQ ID NO: 89735 - DNA, 20 bp, Artificial
  CRISPR gRNA sequence
cctctgtctagtagggccgg

SEQ ID NO: 89736 - DNA, 20 bp, Artificial
  CRISPR gRNA sequence
tgtctagtagggccggggca

SEQ ID NO: 89737 - DNA, 20 bp, Artificial
  CRISPR gRNA sequence
tctagtagggccggggcacc

SEQ ID NO: 89738 - DNA, 20 bp, Artificial
  CRISPR gRNA sequence
gtagggccggggcaccccca

SEQ ID NO: 89739 - DNA, 20 bp, Artificial
  CRISPR gRNA sequence
tgcccatcattaacatgatc

SEQ ID NO: 89740 - DNA, 20 bp, Artificial
  CRISPR gRNA sequence
acatgatcttaccaactgtt

SEQ ID NO: 89741 - DNA, 20 bp, Artificial
  CRISPR gRNA sequence
accaactgttcctgctttgc

SEQ ID NO: 89742 - DNA, 20 bp, Artificial
  CRISPR gRNA sequence
ccaactgttcctgctttgcc

SEQ ID NO: 89743 - DNA, 20 bp, Artificial
  CRISPR gRNA sequence
ttcctgctttgcctggacct

SEQ ID NO: 89744 - DNA, 20 bp, Artificial
  CRISPR gRNA sequence
ctgctttgcctggacctgga

SEQ ID NO: 89745 - DNA, 20 bp, Artificial
  CRISPR gRNA sequence
ctttgcctggacctggacct

SEQ ID NO: 89746 - DNA, 20 bp, Artificial
  CRISPR gRNA sequence
tgcctggacctggacctggg

SEQ ID NO: 89747 - DNA, 20 bp, Artificial
  CRISPR gRNA sequence
gcctggacctggacctgggc

SEQ ID NO: 89748 - DNA, 20 bp, Artificial
  CRISPR gRNA sequence
cctggacctggacctgggcc

SEQ ID NO: 89749 - DNA, 20 bp, Artificial
  CRISPR gRNA sequence
gacctggacctgggcctggg

SEQ ID NO: 89750 - DNA, 20 bp, Artificial
  CRISPR gRNA sequence
gacctgggcctgggcgagct

SEQ ID NO: 89751 - DNA, 20 bp, Artificial
  CRISPR gRNA sequence
ggcctgggcgagctccacct

SEQ ID NO: 89752 - DNA, 20 bp, Artificial
  CRISPR gRNA sequence
ggcgagctccacctggggga

SEQ ID NO: 89753 - DNA, 20 bp, Artificial
  CRISPR gRNA sequence
cacctgggggactcactcag

SEQ ID NO: 89754 - DNA, 20 bp, Artificial
  CRISPR gRNA sequence
ggggactcactcagccccgg

SEQ ID NO: 89755 - DNA, 20 bp, Artificial
  CRISPR gRNA sequence
actcagccccggggcacaga

SEQ ID NO: 89756 - DNA, 20 bp, Artificial
  CRISPR gRNA sequence
agccccggggcacagagaac

SEQ ID NO: 89757 - DNA, 20 bp, Artificial
  CRISPR gRNA sequence
aagtacctgtgagtgaggcc

SEQ ID NO: 89758 - DNA, 20 bp, Artificial
  CRISPR gRNA sequence
tgagtgaggccagtgggcag

SEQ ID NO: 89759 - DNA, 20 bp, Artificial
  CRISPR gRNA sequence
caccagctaaagcagcaaag

SEQ ID NO: 89760 - DNA, 20 bp, Artificial
  CRISPR gRNA sequence
aagcagcaaagcaggatata

SEQ ID NO: 89761 - DNA, 20 bp, Artificial
  CRISPR gRNA sequence
gaaaaaagtcaggtggaagt

SEQ ID NO: 89762 - DNA, 20 bp, Artificial
  CRISPR gRNA sequence
tacccctctcaagtcagcag

SEQ ID NO: 89763 - DNA, 20 bp, Artificial
  CRISPR gRNA sequence
cccctctcaagtcagcagct

SEQ ID NO: 89764 - DNA, 20 bp, Artificial
  CRISPR gRNA sequence
tcaagtcagcagctgccatg

SEQ ID NO: 89765 - DNA, 20 bp, Artificial
  CRISPR gRNA sequence
aagtcagcagctgccatgga

SEQ ID NO: 89766 - DNA, 20 bp, Artificial
  CRISPR gRNA sequence
ccatggaatctgcccagtcc

SEQ ID NO: 89767 - DNA, 20 bp, Artificial
  CRISPR gRNA sequence
cccagtcctcaaggttacca

SEQ ID NO: 89768 - DNA, 20 bp, Artificial
  CRISPR gRNA sequence
aaggttaccatgggagacat

SEQ ID NO: 89769 - DNA, 20 bp, Artificial
  CRISPR gRNA sequence
ccatgggagacatggggctc

SEQ ID NO: 89770 - DNA, 20 bp, Artificial
  CRISPR gRNA sequence
aggaggggaaggcaactcag

SEQ ID NO: 89771 - DNA, 20 bp, Artificial
  CRISPR gRNA sequence
agctggaggggcagagaggc

SEQ ID NO: 89772 - DNA, 20 bp, Artificial
  CRISPR gRNA sequence
gaggggcagagaggccaggg

SEQ ID NO: 89773 - DNA, 20 bp, Artificial
  CRISPR gRNA sequence
aaaagggggcagtacttgcc

SEQ ID NO: 89774 - DNA, 20 bp, Artificial
  CRISPR gRNA sequence
gcccagggtcagggagatgg

SEQ ID NO: 89775 - DNA, 20 bp, Artificial
  CRISPR gRNA sequence
cccagggtcagggagatggt

SEQ ID NO: 89776 - DNA, 20 bp, Artificial
  CRISPR gRNA sequence
tttccaaaggaggaaggggc

SEQ ID NO: 89777 - DNA, 20 bp, Artificial
  CRISPR gRNA sequence
ccaaaggaggaaggggcccc

SEQ ID NO: 89778 - DNA, 20 bp, Artificial
  CRISPR gRNA sequence
caaaggaggaaggggccccg

SEQ ID NO: 89779 - DNA, 20 bp, Artificial
  CRISPR gRNA sequence
ccagcataccaaagaagcag

SEQ ID NO: 89780 - DNA, 20 bp, Artificial
  CRISPR gRNA sequence
ccttggtcccctcaaaagtg

SEQ ID NO: 89781 - DNA, 20 bp, Artificial
  CRISPR gRNA sequence
ggtcccctcaaaagtgagtg

SEQ ID NO: 89782 - DNA, 20 bp, Artificial
  CRISPR gRNA sequence
gtcccctcaaaagtgagtgt

SEQ ID NO: 89783 - DNA, 20 bp, Artificial
  CRISPR gRNA sequence
aaaagtgagtgtcatcaagg

SEQ ID NO: 89784 - DNA, 20 bp, Artificial
  CRISPR gRNA sequence
ttcctttggcaaagggagag

SEQ ID NO: 89785 - DNA, 20 bp, Artificial
  CRISPR gRNA sequence
tcctttggcaaagggagagg

SEQ ID NO: 89786 - DNA, 20 bp, Artificial
  CRISPR gRNA sequence
cctttggcaaagggagaggt

SEQ ID NO: 89787 - DNA, 20 bp, Artificial
  CRISPR gRNA sequence
ctttggcaaagggagaggta

SEQ ID NO: 89788 - DNA, 20 bp, Artificial
  CRISPR gRNA sequence
tggcaaagggagaggtagac

SEQ ID NO: 89789 - DNA, 20 bp, Artificial
  CRISPR gRNA sequence
ggcaaagggagaggtagaca

SEQ ID NO: 89790 - DNA, 20 bp, Artificial
  CRISPR gRNA sequence
gcaaagggagaggtagacac

SEQ ID NO: 89791 - DNA, 20 bp, Artificial
  CRISPR gRNA sequence
caccacagggtaataaagac

SEQ ID NO: 89792 - DNA, 20 bp, Artificial
  CRISPR gRNA sequence
aaaggagcatgtgcttcaaa

SEQ ID NO: 89793 - DNA, 20 bp, Artificial
  CRISPR gRNA sequence
aaggagcatgtgcttcaaag

SEQ ID NO: 89794 - DNA, 20 bp, Artificial
  CRISPR gRNA sequence
caaagttccttatcccagga

SEQ ID NO: 89795 - DNA, 20 bp, Artificial
  CRISPR gRNA sequence
aaagttccttatcccaggag

SEQ ID NO: 89796 - DNA, 20 bp, Artificial
  CRISPR gRNA sequence
cttatcccaggagcataaag

SEQ ID NO: 89797 - DNA, 20 bp, Artificial
  CRISPR gRNA sequence
atcccaggagcataaagacc

SEQ ID NO: 89798 - DNA, 20 bp, Artificial
  CRISPR gRNA sequence
tcccaggagcataaagaccc

SEQ ID NO: 89799 - DNA, 20 bp, Artificial
  CRISPR gRNA sequence
tggggaagagtgtttatatc

SEQ ID NO: 89800 - DNA, 20 bp, Artificial
  CRISPR gRNA sequence
atatccctacgttaactttg

SEQ ID NO: 89801 - DNA, 20 bp, Artificial
  CRISPR gRNA sequence
tatccctacgttaactttgc

SEQ ID NO: 89802 - DNA, 20 bp, Artificial
  CRISPR gRNA sequence
cgttaactttgcctagtaga

SEQ ID NO: 89803 - DNA, 20 bp, Artificial
  CRISPR gRNA sequence
actttgcctagtagaggccc

SEQ ID NO: 89804 - DNA, 20 bp, Artificial
  CRISPR gRNA sequence
tgcctagtagaggcccttct

SEQ ID NO: 89805 - DNA, 20 bp, Artificial
  CRISPR gRNA sequence
gcctagtagaggcccttctt

SEQ ID NO: 89806 - DNA, 20 bp, Artificial
  CRISPR gRNA sequence
cctagtagaggcccttcttt

SEQ ID NO: 89807 - DNA, 20 bp, Artificial
  CRISPR gRNA sequence
gtagaggcccttctttgcac

SEQ ID NO: 89808 - DNA, 20 bp, Artificial
  CRISPR gRNA sequence
ctttgcacttgcttctcatt

SEQ ID NO: 89809 - DNA, 20 bp, Artificial
  CRISPR gRNA sequence
tttgcacttgcttctcattt

SEQ ID NO: 89810 - DNA, 20 bp, Artificial
  CRISPR gRNA sequence
tgcacttgcttctcatttgg

SEQ ID NO: 89811 - DNA, 20 bp, Artificial
  CRISPR gRNA sequence
gcacttgcttctcatttggc

SEQ ID NO: 89812 - DNA, 20 bp, Artificial
  CRISPR gRNA sequence
cacttgcttctcatttggct

SEQ ID NO: 89813 - DNA, 20 bp, Artificial
  CRISPR gRNA sequence
gcttctcatttggctattct

SEQ ID NO: 89814 - DNA, 20 bp, Artificial
  CRISPR gRNA sequence
cttctcatttggctattctt

SEQ ID NO: 89815 - DNA, 20 bp, Artificial
  CRISPR gRNA sequence
ctcatttggctattcttttc

SEQ ID NO: 89816 - DNA, 20 bp, Artificial
  CRISPR gRNA sequence
tcatttggctattcttttcc

SEQ ID NO: 89817 - DNA, 20 bp, Artificial
  CRISPR gRNA sequence
atttggctattcttttccta

SEQ ID NO: 89818 - DNA, 20 bp, Artificial
  CRISPR gRNA sequence
ggctattcttttcctaagga

SEQ ID NO: 89819 - DNA, 20 bp, Artificial
  CRISPR gRNA sequence
gctattcttttcctaaggaa

SEQ ID NO: 89820 - DNA, 20 bp, Artificial
  CRISPR gRNA sequence
ttcttttcctaaggaagtcc

SEQ ID NO: 89821 - DNA, 20 bp, Artificial
  CRISPR gRNA sequence
ttttcctaaggaagtccatt

SEQ ID NO: 89822 - DNA, 20 bp, Artificial
  CRISPR gRNA sequence
ttcctaaggaagtccattct

SEQ ID NO: 89823 - DNA, 20 bp, Artificial
  CRISPR gRNA sequence
tcctaaggaagtccattctc

SEQ ID NO: 89824 - DNA, 20 bp, Artificial
  CRISPR gRNA sequence
cctaaggaagtccattctcc

SEQ ID NO: 89825 - DNA, 20 bp, Artificial
  CRISPR gRNA sequence
ctaaggaagtccattctcct

SEQ ID NO: 89826 - DNA, 20 bp, Artificial
  CRISPR gRNA sequence
aggaagtccattctcctctg

SEQ ID NO: 89827 - DNA, 20 bp, Artificial
  CRISPR gRNA sequence
tcctctgtacagacagctga

SEQ ID NO: 89828 - DNA, 20 bp, Artificial
  CRISPR gRNA sequence
ctctgtacagacagctgagt

SEQ ID NO: 89829 - DNA, 20 bp, Artificial
  CRISPR gRNA sequence
tgtacagacagctgagtcac

SEQ ID NO: 89830 - DNA, 20 bp, Artificial
  CRISPR gRNA sequence
tacagacagctgagtcaccc

SEQ ID NO: 89831 - DNA, 20 bp, Artificial
  CRISPR gRNA sequence
agtcacccagtctacttagt

SEQ ID NO: 89832 - DNA, 20 bp, Artificial
  CRISPR gRNA sequence
cttagtacctggttgctgcc

SEQ ID NO: 89833 - DNA, 20 bp, Artificial
  CRISPR gRNA sequence
agtacctggttgctgcctct

SEQ ID NO: 89834 - DNA, 20 bp, Artificial
  CRISPR gRNA sequence
gtacctggttgctgcctctg

SEQ ID NO: 89835 - DNA, 20 bp, Artificial
  CRISPR gRNA sequence
gttgctgcctctgacctttt

SEQ ID NO: 89836 - DNA, 20 bp, Artificial
  CRISPR gRNA sequence
ctgcctctgaccttttcagc

SEQ ID NO: 89837 - DNA, 20 bp, Artificial
  CRISPR gRNA sequence
cctctgaccttttcagcttg

SEQ ID NO: 89838 - DNA, 20 bp, Artificial
  CRISPR gRNA sequence
tgaccttttcagcttgatac

SEQ ID NO: 89839 - DNA, 20 bp, Artificial
  CRISPR gRNA sequence
accttttcagcttgataccc

SEQ ID NO: 89840 - DNA, 20 bp, Artificial
  CRISPR gRNA sequence
ttcagcttgataccctgggc

SEQ ID NO: 89841 - DNA, 20 bp, Artificial
  CRISPR gRNA sequence
tcagcttgataccctgggct

SEQ ID NO: 89842 - DNA, 20 bp, Artificial
  CRISPR gRNA sequence
cagcttgataccctgggctt

SEQ ID NO: 89843 - DNA, 20 bp, Artificial
  CRISPR gRNA sequence
agcttgataccctgggcttt

SEQ ID NO: 89844 - DNA, 20 bp, Artificial
  CRISPR gRNA sequence
gataccctgggctttagtgt

SEQ ID NO: 89845 - DNA, 20 bp, Artificial
  CRISPR gRNA sequence
ataccctgggctttagtgta

SEQ ID NO: 89846 - DNA, 20 bp, Artificial
  CRISPR gRNA sequence
ggctttagtgtaaccaataa

SEQ ID NO: 89847 - DNA, 20 bp, Artificial
  CRISPR gRNA sequence
tagtgtaaccaataaatctg

SEQ ID NO: 89848 - DNA, 20 bp, Artificial
  CRISPR gRNA sequence
agtgtaaccaataaatctgt

SEQ ID NO: 89849 - DNA, 20 bp, Artificial
  CRISPR gRNA sequence
gtgtaaccaataaatctgta

SEQ ID NO: 89850 - DNA, 20 bp, Artificial
  CRISPR gRNA sequence
tagtgaccttacctgtattc

SEQ ID NO: 89851 - DNA, 20 bp, Artificial
  CRISPR gRNA sequence
acctgtattccctgtgctat

SEQ ID NO: 89852 - DNA, 20 bp, Artificial
  CRISPR gRNA sequence
cctgtattccctgtgctatc

SEQ ID NO: 89853 - DNA, 20 bp, Artificial
  CRISPR gRNA sequence
tattccctgtgctatcctgt

SEQ ID NO: 89854 - DNA, 20 bp, Artificial
  CRISPR gRNA sequence
cctgtgctatcctgtgggaa

SEQ ID NO: 89855 - DNA, 20 bp, Artificial
  CRISPR gRNA sequence
tgctatcctgtgggaaggta

SEQ ID NO: 89856 - DNA, 20 bp, Artificial
  CRISPR gRNA sequence
tcctgtgggaaggtaggaat

SEQ ID NO: 89857 - DNA, 20 bp, Artificial
  CRISPR gRNA sequence
tgggaaggtaggaatgggct

SEQ ID NO: 89858 - DNA, 20 bp, Artificial
  CRISPR gRNA sequence
agtatgatgaatatataggt

SEQ ID NO: 89859 - DNA, 20 bp, Artificial
  CRISPR gRNA sequence
gggatcttttggttttaaat

SEQ ID NO: 89860 - DNA, 20 bp, Artificial
  CRISPR gRNA sequence
ttggttttaaatcacagaaa

SEQ ID NO: 89861 - DNA, 20 bp, Artificial
  CRISPR gRNA sequence
tggttttaaatcacagaaaa

SEQ ID NO: 89862 - DNA, 20 bp, Artificial
  CRISPR gRNA sequence
ggttttaaatcacagaaaac

SEQ ID NO: 89863 - DNA, 20 bp, Artificial
  CRISPR gRNA sequence
gttttaaatcacagaaaacc

SEQ ID NO: 89864 - DNA, 20 bp, Artificial
  CRISPR gRNA sequence
taaatcacagaaaacctaat

SEQ ID NO: 89865 - DNA, 20 bp, Artificial
  CRISPR gRNA sequence
aaatcacagaaaacctaatt

SEQ ID NO: 89866 - DNA, 20 bp, Artificial
  CRISPR gRNA sequence
aatcacagaaaacctaattc

SEQ ID NO: 89867 - DNA, 20 bp, Artificial
  CRISPR gRNA sequence
attcaaactggcttaaaata

SEQ ID NO: 89868 - DNA, 20 bp, Artificial
  CRISPR gRNA sequence
aaactggcttaaaataaaaa

SEQ ID NO: 89869 - DNA, 20 bp, Artificial
  CRISPR gRNA sequence
gcttaaaataaaaaggattt

SEQ ID NO: 89870 - DNA, 20 bp, Artificial
  CRISPR gRNA sequence
aaaataaaaaggatttattg

SEQ ID NO: 89871 - DNA, 20 bp, Artificial
  CRISPR gRNA sequence
aaataaaaaggatttattgg

SEQ ID NO: 89872 - DNA, 20 bp, Artificial
  CRISPR gRNA sequence
attggttcatgtaactagaa

SEQ ID NO: 89873 - DNA, 20 bp, Artificial
  CRISPR gRNA sequence
ttggttcatgtaactagaaa

SEQ ID NO: 89874 - DNA, 20 bp, Artificial
  CRISPR gRNA sequence
gttcatgtaactagaaagtc

SEQ ID NO: 89875 - DNA, 20 bp, Artificial
  CRISPR gRNA sequence
atgtaactagaaagtccata

SEQ ID NO: 89876 - DNA, 20 bp, Artificial
  CRISPR gRNA sequence
gaaagtccataggtagtgct

SEQ ID NO: 89877 - DNA, 20 bp, Artificial
  CRISPR gRNA sequence
gctccaggtgaagacttgac

SEQ ID NO: 89878 - DNA, 20 bp, Artificial
  CRISPR gRNA sequence
caggtgaagacttgacccag

SEQ ID NO: 89879 - DNA, 20 bp, Artificial
  CRISPR gRNA sequence
gacccagtagttcagtatgt

SEQ ID NO: 89880 - DNA, 20 bp, Artificial
  CRISPR gRNA sequence
acccagtagttcagtatgtc

SEQ ID NO: 89881 - DNA, 20 bp, Artificial
  CRISPR gRNA sequence
agtatgtctctaaataccgg

SEQ ID NO: 89882 - DNA, 20 bp, Artificial
  CRISPR gRNA sequence
taaataccggactgactttt

SEQ ID NO: 89883 - DNA, 20 bp, Artificial
  CRISPR gRNA sequence
aataccggactgactttttt

SEQ ID NO: 89884 - DNA, 20 bp, Artificial
  CRISPR gRNA sequence
acttttttctcactgttgca

SEQ ID NO: 89885 - DNA, 20 bp, Artificial
  CRISPR gRNA sequence
ttttctcactgttgcatctt

SEQ ID NO: 89886 - DNA, 20 bp, Artificial
  CRISPR gRNA sequence
tttctcactgttgcatcttc

SEQ ID NO: 89887 - DNA, 20 bp, Artificial
  CRISPR gRNA sequence
ttctcactgttgcatcttct

SEQ ID NO: 89888 - DNA, 20 bp, Artificial
  CRISPR gRNA sequence
tctcactgttgcatcttctg

SEQ ID NO: 89889 - DNA, 20 bp, Artificial
  CRISPR gRNA sequence
ctcactgttgcatcttctgt

SEQ ID NO: 89890 - DNA, 20 bp, Artificial
  CRISPR gRNA sequence
tcactgttgcatcttctgta

SEQ ID NO: 89891 - DNA, 20 bp, Artificial
  CRISPR gRNA sequence
actgttgcatcttctgtagg

SEQ ID NO: 89892 - DNA, 20 bp, Artificial
  CRISPR gRNA sequence
ttgcatcttctgtaggacca

SEQ ID NO: 89893 - DNA, 20 bp, Artificial
  CRISPR gRNA sequence
catcttctgtaggaccattt

SEQ ID NO: 89894 - DNA, 20 bp, Artificial
  CRISPR gRNA sequence
ctgtaggaccatttaagtct

SEQ ID NO: 89895 - DNA, 20 bp, Artificial
  CRISPR gRNA sequence
tgtaggaccatttaagtctg

SEQ ID NO: 89896 - DNA, 20 bp, Artificial
  CRISPR gRNA sequence
taggaccatttaagtctggg

SEQ ID NO: 89897 - DNA, 20 bp, Artificial
  CRISPR gRNA sequence
aagtctgggccacttaatgg

SEQ ID NO: 89898 - DNA, 20 bp, Artificial
  CRISPR gRNA sequence
agtctgggccacttaatggc

SEQ ID NO: 89899 - DNA, 20 bp, Artificial
  CRISPR gRNA sequence
ggccacttaatggctgccag

SEQ ID NO: 89900 - DNA, 20 bp, Artificial
  CRISPR gRNA sequence
aatggctgccagcattccta

SEQ ID NO: 89901 - DNA, 20 bp, Artificial
  CRISPR gRNA sequence
atggctgccagcattcctaa

SEQ ID NO: 89902 - DNA, 20 bp, Artificial
  CRISPR gRNA sequence
ccagcattcctaagattaca

SEQ ID NO: 89903 - DNA, 20 bp, Artificial
  CRISPR gRNA sequence
ctaagattacacttttcccc

SEQ ID NO: 89904 - DNA, 20 bp, Artificial
  CRISPR gRNA sequence
agattacacttttccccatt

SEQ ID NO: 89905 - DNA, 20 bp, Artificial
  CRISPR gRNA sequence
cacttttccccatttatgtc

SEQ ID NO: 89906 - DNA, 20 bp, Artificial
  CRISPR gRNA sequence
ttccccatttatgtccaatc

SEQ ID NO: 89907 - DNA, 20 bp, Artificial
  CRISPR gRNA sequence
tccccatttatgtccaatca

SEQ ID NO: 89908 - DNA, 20 bp, Artificial
  CRISPR gRNA sequence
ccccatttatgtccaatcag

SEQ ID NO: 89909 - DNA, 20 bp, Artificial
  CRISPR gRNA sequence
cccatttatgtccaatcaga

SEQ ID NO: 89910 - DNA, 20 bp, Artificial
  CRISPR gRNA sequence
atgtccaatcagaaaaagaa

SEQ ID NO: 89911 - DNA, 20 bp, Artificial
  CRISPR gRNA sequence
tgtccaatcagaaaaagaag

SEQ ID NO: 89912 - DNA, 20 bp, Artificial
  CRISPR gRNA sequence
tgtaccagaaatctcagcaa

SEQ ID NO: 89913 - DNA, 20 bp, Artificial
  CRISPR gRNA sequence
gtaccagaaatctcagcaaa

SEQ ID NO: 89914 - DNA, 20 bp, Artificial
  CRISPR gRNA sequence
taccagaaatctcagcaaaa

SEQ ID NO: 89915 - DNA, 20 bp, Artificial
  CRISPR gRNA sequence
agcaaaagccctaatattca

SEQ ID NO: 89916 - DNA, 20 bp, Artificial
  CRISPR gRNA sequence
atattcacactgattaggcc

SEQ ID NO: 89917 - DNA, 20 bp, Artificial
  CRISPR gRNA sequence
acactgattaggcctgggtc

SEQ ID NO: 89918 - DNA, 20 bp, Artificial
  CRISPR gRNA sequence
attaggcctgggtcacatgt

SEQ ID NO: 89919 - DNA, 20 bp, Artificial
  CRISPR gRNA sequence
ggcctgggtcacatgtccac

SEQ ID NO: 89920 - DNA, 20 bp, Artificial
  CRISPR gRNA sequence
ggtcacatgtccaccctgac

SEQ ID NO: 89921 - DNA, 20 bp, Artificial
  CRISPR gRNA sequence
accaatcactgtggccagga

SEQ ID NO: 89922 - DNA, 20 bp, Artificial
  CRISPR gRNA sequence
tggccaggaggatgatacat

SEQ ID NO: 89923 - DNA, 20 bp, Artificial
  CRISPR gRNA sequence
atttgcttattctatatcat

SEQ ID NO: 89924 - DNA, 20 bp, Artificial
  CRISPR gRNA sequence
gcttattctatatcatggac

SEQ ID NO: 89925 - DNA, 20 bp, Artificial
  CRISPR gRNA sequence
cttattctatatcatggaca

SEQ ID NO: 89926 - DNA, 20 bp, Artificial
  CRISPR gRNA sequence
attctatatcatggacaaca

SEQ ID NO: 89927 - DNA, 20 bp, Artificial
  CRISPR gRNA sequence
ttctatatcatggacaacac

SEQ ID NO: 89928 - DNA, 20 bp, Artificial
  CRISPR gRNA sequence
tatatcatggacaacacctt

SEQ ID NO: 89929 - DNA, 20 bp, Artificial
  CRISPR gRNA sequence
tatcatggacaacacctttg

SEQ ID NO: 89930 - DNA, 20 bp, Artificial
  CRISPR gRNA sequence
tggggaaaagggtgggggtc

SEQ ID NO: 89931 - DNA, 20 bp, Artificial
  CRISPR gRNA sequence
ggggaaaagggtgggggtca

SEQ ID NO: 89932 - DNA, 20 bp, Artificial
  CRISPR gRNA sequence
gggaaaagggtgggggtcag

SEQ ID NO: 89933 - DNA, 20 bp, Artificial
  CRISPR gRNA sequence
cccaaaatcacatggattcc

SEQ ID NO: 89934 - DNA, 20 bp, Artificial
  CRISPR gRNA sequence
cccaagtggaaactaggagc

SEQ ID NO: 89935 - DNA, 20 bp, Artificial
  CRISPR gRNA sequence
ggagcagggagttgcttggg

SEQ ID NO: 89936 - DNA, 20 bp, Artificial
  CRISPR gRNA sequence
cttgggtggccgctaacacc

SEQ ID NO: 89937 - DNA, 20 bp, Artificial
  CRISPR gRNA sequence
gggtggccgctaacaccagg

SEQ ID NO: 89938 - DNA, 20 bp, Artificial
  CRISPR gRNA sequence
ggtggccgctaacaccaggc

SEQ ID NO: 89939 - DNA, 20 bp, Artificial
  CRISPR gRNA sequence
acaccaggctactcttattt

SEQ ID NO: 89940 - DNA, 20 bp, Artificial
  CRISPR gRNA sequence
ctcttattttagcttgctaa

SEQ ID NO: 89941 - DNA, 20 bp, Artificial
  CRISPR gRNA sequence
ttattttagcttgctaagtt

SEQ ID NO: 89942 - DNA, 20 bp, Artificial
  CRISPR gRNA sequence
attttagcttgctaagttga

SEQ ID NO: 89943 - DNA, 20 bp, Artificial
  CRISPR gRNA sequence
ttttagcttgctaagttgag

SEQ ID NO: 89944 - DNA, 20 bp, Artificial
  CRISPR gRNA sequence
tagcttgctaagttgagatc

SEQ ID NO: 89945 - DNA, 20 bp, Artificial
  CRISPR gRNA sequence
agcttgctaagttgagatca

SEQ ID NO: 89946 - DNA, 20 bp, Artificial
  CRISPR gRNA sequence
gcttgctaagttgagatcag

SEQ ID NO: 89947 - DNA, 20 bp, Artificial
  CRISPR gRNA sequence
gctaagttgagatcagctag

SEQ ID NO: 89948 - DNA, 20 bp, Artificial
  CRISPR gRNA sequence
ctaagttgagatcagctaga

SEQ ID NO: 89949 - DNA, 20 bp, Artificial
  CRISPR gRNA sequence
agttgagatcagctagacct

SEQ ID NO: 89950 - DNA, 20 bp, Artificial
  CRISPR gRNA sequence
agatcagctagacctgcttt

SEQ ID NO: 89951 - DNA, 20 bp, Artificial
  CRISPR gRNA sequence
gacctgctttcttttctcct

SEQ ID NO: 89952 - DNA, 20 bp, Artificial
  CRISPR gRNA sequence
ctttcttttctcctcagtct

SEQ ID NO: 89953 - DNA, 20 bp, Artificial
  CRISPR gRNA sequence
tcttttctcctcagtcttgc

SEQ ID NO: 89954 - DNA, 20 bp, Artificial
  CRISPR gRNA sequence
cttttctcctcagtcttgca

SEQ ID NO: 89955 - DNA, 20 bp, Artificial
  CRISPR gRNA sequence
ttttctcctcagtcttgcat

SEQ ID NO: 89956 - DNA, 20 bp, Artificial
  CRISPR gRNA sequence
ttctcctcagtcttgcattt

SEQ ID NO: 89957 - DNA, 20 bp, Artificial
  CRISPR gRNA sequence
tctcctcagtcttgcatttc

SEQ ID NO: 89958 - DNA, 20 bp, Artificial
  CRISPR gRNA sequence
ctcctcagtcttgcatttcc

SEQ ID NO: 89959 - DNA, 20 bp, Artificial
  CRISPR gRNA sequence
tcctcagtcttgcatttccc

SEQ ID NO: 89960 - DNA, 20 bp, Artificial
  CRISPR gRNA sequence
ctcagtcttgcatttccctc

SEQ ID NO: 89961 - DNA, 20 bp, Artificial
  CRISPR gRNA sequence
agtcttgcatttccctcaat

SEQ ID NO: 89962 - DNA, 20 bp, Artificial
  CRISPR gRNA sequence
gcatttccctcaatacaagc

SEQ ID NO: 89963 - DNA, 20 bp, Artificial
  CRISPR gRNA sequence
catttccctcaatacaagct

SEQ ID NO: 89964 - DNA, 20 bp, Artificial
  CRISPR gRNA sequence
ccctcaatacaagctgtagc

SEQ ID NO: 89965 - DNA, 20 bp, Artificial
  CRISPR gRNA sequence
cctcaatacaagctgtagcc

SEQ ID NO: 89966 - DNA, 20 bp, Artificial
  CRISPR gRNA sequence
aatacaagctgtagcctctt

SEQ ID NO: 89967 - DNA, 20 bp, Artificial
  CRISPR gRNA sequence
tagcctctttcctcgtttct

SEQ ID NO: 89968 - DNA, 20 bp, Artificial
  CRISPR gRNA sequence
tttcctcgtttctagtctca

SEQ ID NO: 89969 - DNA, 20 bp, Artificial
  CRISPR gRNA sequence
tcctcgtttctagtctcaga

SEQ ID NO: 89970 - DNA, 20 bp, Artificial
  CRISPR gRNA sequence
cctcgtttctagtctcagaa

SEQ ID NO: 89971 - DNA, 20 bp, Artificial
  CRISPR gRNA sequence
ctcgtttctagtctcagaag

SEQ ID NO: 89972 - DNA, 20 bp, Artificial
  CRISPR gRNA sequence
gtttctagtctcagaaggaa

SEQ ID NO: 89973 - DNA, 20 bp, Artificial
  CRISPR gRNA sequence
ctagtctcagaaggaaggag

SEQ ID NO: 89974 - DNA, 20 bp, Artificial
  CRISPR gRNA sequence
tagtctcagaaggaaggaga

SEQ ID NO: 89975 - DNA, 20 bp, Artificial
  CRISPR gRNA sequence
gtctcagaaggaaggagagg

SEQ ID NO: 89976 - DNA, 20 bp, Artificial
  CRISPR gRNA sequence
agaaggaaggagagggaagc

SEQ ID NO: 89977 - DNA, 20 bp, Artificial
  CRISPR gRNA sequence
tcctctagggactcttcagt

SEQ ID NO: 89978 - DNA, 20 bp, Artificial
  CRISPR gRNA sequence
ctctagggactcttcagtct

SEQ ID NO: 89979 - DNA, 20 bp, Artificial
  CRISPR gRNA sequence
tagggactcttcagtctcat

SEQ ID NO: 89980 - DNA, 20 bp, Artificial
  CRISPR gRNA sequence
gggactcttcagtctcattt

SEQ ID NO: 89981 - DNA, 20 bp, Artificial
  CRISPR gRNA sequence
ttcagtctcatttagatgat

SEQ ID NO: 89982 - DNA, 20 bp, Artificial
  CRISPR gRNA sequence
cagtctcatttagatgatag

SEQ ID NO: 89983 - DNA, 20 bp, Artificial
  CRISPR gRNA sequence
agtctcatttagatgatagt

SEQ ID NO: 89984 - DNA, 20 bp, Artificial
  CRISPR gRNA sequence
atttagatgatagtcccttt

SEQ ID NO: 89985 - DNA, 20 bp, Artificial
  CRISPR gRNA sequence
agatgatagtcccttttttt

SEQ ID NO: 89986 - DNA, 20 bp, Artificial
  CRISPR gRNA sequence
gatgatagtccctttttttc

SEQ ID NO: 89987 - DNA, 20 bp, Artificial
  CRISPR gRNA sequence
tttttctacctccatattag

SEQ ID NO: 89988 - DNA, 20 bp, Artificial
  CRISPR gRNA sequence
ttttctacctccatattaga

SEQ ID NO: 89989 - DNA, 20 bp, Artificial
  CRISPR gRNA sequence
tttctacctccatattagag

SEQ ID NO: 89990 - DNA, 20 bp, Artificial
  CRISPR gRNA sequence
ttctacctccatattagaga

SEQ ID NO: 89991 - DNA, 20 bp, Artificial
  CRISPR gRNA sequence
tctacctccatattagagat

SEQ ID NO: 89992 - DNA, 20 bp, Artificial
  CRISPR gRNA sequence
ctacctccatattagagatg

SEQ ID NO: 89993 - DNA, 20 bp, Artificial
  CRISPR gRNA sequence
tacctccatattagagatgg

SEQ ID NO: 89994 - DNA, 20 bp, Artificial
  CRISPR gRNA sequence
cctccatattagagatggag

SEQ ID NO: 89995 - DNA, 20 bp, Artificial
  CRISPR gRNA sequence
catattagagatggagctcc

SEQ ID NO: 89996 - DNA, 20 bp, Artificial
  CRISPR gRNA sequence
gagatggagctccttccttt

SEQ ID NO: 89997 - DNA, 20 bp, Artificial
  CRISPR gRNA sequence
cttccttttcctgtttctta

SEQ ID NO: 89998 - DNA, 20 bp, Artificial
  CRISPR gRNA sequence
ccttttcctgtttcttaatt

SEQ ID NO: 89999 - DNA, 20 bp, Artificial
  CRISPR gRNA sequence
cttttcctgtttcttaattt

SEQ ID NO: 90000 - DNA, 20 bp, Artificial
  CRISPR gRNA sequence
ttcctgtttcttaatttttg

SEQ ID NO: 90001 - DNA, 20 bp, Artificial
  CRISPR gRNA sequence
tcctgtttcttaatttttgt

SEQ ID NO: 90002 - DNA, 20 bp, Artificial
  CRISPR gRNA sequence
cctgtttcttaatttttgtc

SEQ ID NO: 90003 - DNA, 20 bp, Artificial
  CRISPR gRNA sequence
ctgtttcttaatttttgtct

SEQ ID NO: 90004 - DNA, 20 bp, Artificial
  CRISPR gRNA sequence
tttcttaatttttgtcttct

SEQ ID NO: 90005 - DNA, 20 bp, Artificial
  CRISPR gRNA sequence
cttaatttttgtcttctcat

SEQ ID NO: 90006 - DNA, 20 bp, Artificial
  CRISPR gRNA sequence
ttaatttttgtcttctcatt

SEQ ID NO: 90007 - DNA, 20 bp, Artificial
  CRISPR gRNA sequence
aatttttgtcttctcattcc

SEQ ID NO: 90008 - DNA, 20 bp, Artificial
  CRISPR gRNA sequence
atttttgtcttctcattcct

SEQ ID NO: 90009 - DNA, 20 bp, Artificial
  CRISPR gRNA sequence
ttgtcttctcattcctgctt

SEQ ID NO: 90010 - DNA, 20 bp, Artificial
  CRISPR gRNA sequence
tgtcttctcattcctgcttc

SEQ ID NO: 90011 - DNA, 20 bp, Artificial
  CRISPR gRNA sequence
gtcttctcattcctgcttcc

SEQ ID NO: 90012 - DNA, 20 bp, Artificial
  CRISPR gRNA sequence
tcttctcattcctgcttccc

SEQ ID NO: 90013 - DNA, 20 bp, Artificial
  CRISPR gRNA sequence
ctcattcctgcttccctctc

SEQ ID NO: 90014 - DNA, 20 bp, Artificial
  CRISPR gRNA sequence
tcattcctgcttccctctca

SEQ ID NO: 90015 - DNA, 20 bp, Artificial
  CRISPR gRNA sequence
attcctgcttccctctcacc

SEQ ID NO: 90016 - DNA, 20 bp, Artificial
  CRISPR gRNA sequence
ctgcttccctctcaccctat

SEQ ID NO: 90017 - DNA, 20 bp, Artificial
  CRISPR gRNA sequence
cttccctctcaccctattgc

SEQ ID NO: 90018 - DNA, 20 bp, Artificial
  CRISPR gRNA sequence
ccctctcaccctattgccag

SEQ ID NO: 90019 - DNA, 20 bp, Artificial
  CRISPR gRNA sequence
cctctcaccctattgccagt

SEQ ID NO: 90020 - DNA, 20 bp, Artificial
  CRISPR gRNA sequence
tcaccctattgccagttcca

SEQ ID NO: 90021 - DNA, 20 bp, Artificial
  CRISPR gRNA sequence
accctattgccagttccacc

SEQ ID NO: 90022 - DNA, 20 bp, Artificial
  CRISPR gRNA sequence
ttgccagttccaccaactag

SEQ ID NO: 90023 - DNA, 20 bp, Artificial
  CRISPR gRNA sequence
ccagttccaccaactagagt

SEQ ID NO: 90024 - DNA, 20 bp, Artificial
  CRISPR gRNA sequence
caccaactagagtgaaagac

SEQ ID NO: 90025 - DNA, 20 bp, Artificial
  CRISPR gRNA sequence
gagtgaaagacttcctagcc

SEQ ID NO: 90026 - DNA, 20 bp, Artificial
  CRISPR gRNA sequence
cctagccatttcattaaatc

SEQ ID NO: 90027 - DNA, 20 bp, Artificial
  CRISPR gRNA sequence
ctagccatttcattaaatct

SEQ ID NO: 90028 - DNA, 20 bp, Artificial
  CRISPR gRNA sequence
gccatttcattaaatctatt

SEQ ID NO: 90029 - DNA, 20 bp, Artificial
  CRISPR gRNA sequence
cattaaatctattctgtatc

SEQ ID NO: 90030 - DNA, 20 bp, Artificial
  CRISPR gRNA sequence
attaaatctattctgtatcc

SEQ ID NO: 90031 - DNA, 20 bp, Artificial
  CRISPR gRNA sequence
aatctattctgtatccacca

SEQ ID NO: 90032 - DNA, 20 bp, Artificial
  CRISPR gRNA sequence
ttctgtatccaccaggtggc

SEQ ID NO: 90033 - DNA, 20 bp, Artificial
  CRISPR gRNA sequence
tgtatccaccaggtggcagc

SEQ ID NO: 90034 - DNA, 20 bp, Artificial
  CRISPR gRNA sequence
tatccaccaggtggcagcat

SEQ ID NO: 90035 - DNA, 20 bp, Artificial
  CRISPR gRNA sequence
gtcatacgtgtcaggactta

SEQ ID NO: 90036 - DNA, 20 bp, Artificial
  CRISPR gRNA sequence
tcatacgtgtcaggacttag

SEQ ID NO: 90037 - DNA, 20 bp, Artificial
  CRISPR gRNA sequence
aggactgcggggtttaggtt

SEQ ID NO: 90038 - DNA, 20 bp, Artificial
  CRISPR gRNA sequence
ggactgcggggtttaggtta

SEQ ID NO: 90039 - DNA, 20 bp, Artificial
  CRISPR gRNA sequence
cggggtttaggttagatgtc

SEQ ID NO: 90040 - DNA, 20 bp, Artificial
  CRISPR gRNA sequence
aggttagatgtcacggaaaa

SEQ ID NO: 90041 - DNA, 20 bp, Artificial
  CRISPR gRNA sequence
ggttagatgtcacggaaaaa

SEQ ID NO: 90042 - DNA, 20 bp, Artificial
  CRISPR gRNA sequence
gatgtcacggaaaaagctag

SEQ ID NO: 90043 - DNA, 20 bp, Artificial
  CRISPR gRNA sequence
gttctgtggtcaggcggcac

SEQ ID NO: 90044 - DNA, 20 bp, Artificial
  CRISPR gRNA sequence
tgtggtcaggcggcaccaat

SEQ ID NO: 90045 - DNA, 20 bp, Artificial
  CRISPR gRNA sequence
tggtcaggcggcaccaatga

SEQ ID NO: 90046 - DNA, 20 bp, Artificial
  CRISPR gRNA sequence
cagatgtatccttgggaaaa

SEQ ID NO: 90047 - DNA, 20 bp, Artificial
  CRISPR gRNA sequence
gggaaaagcagtaaaccaac

SEQ ID NO: 90048 - DNA, 20 bp, Artificial
  CRISPR gRNA sequence
ggaaaagcagtaaaccaact

SEQ ID NO: 90049 - DNA, 20 bp, Artificial
  CRISPR gRNA sequence
atatttattgaagacctact

SEQ ID NO: 90050 - DNA, 20 bp, Artificial
  CRISPR gRNA sequence
attgaagacctactttgtcc

SEQ ID NO: 90051 - DNA, 20 bp, Artificial
  CRISPR gRNA sequence
ttgaagacctactttgtcct

SEQ ID NO: 90052 - DNA, 20 bp, Artificial
  CRISPR gRNA sequence
aagacctactttgtcctcta

SEQ ID NO: 90053 - DNA, 20 bp, Artificial
  CRISPR gRNA sequence
ctttgtcctctacatagggt

SEQ ID NO: 90054 - DNA, 20 bp, Artificial
  CRISPR gRNA sequence
tgtcctctacatagggtagc

SEQ ID NO: 90055 - DNA, 20 bp, Artificial
  CRISPR gRNA sequence
gtcctctacatagggtagct

SEQ ID NO: 90056 - DNA, 20 bp, Artificial
  CRISPR gRNA sequence
tcctctacatagggtagctt

SEQ ID NO: 90057 - DNA, 20 bp, Artificial
  CRISPR gRNA sequence
tacatagggtagcttctgtc

SEQ ID NO: 90058 - DNA, 20 bp, Artificial
  CRISPR gRNA sequence
catagggtagcttctgtcag

SEQ ID NO: 90059 - DNA, 20 bp, Artificial
  CRISPR gRNA sequence
ctgtcagggaatcttggttc

SEQ ID NO: 90060 - DNA, 20 bp, Artificial
  CRISPR gRNA sequence
tgtcagggaatcttggttct

SEQ ID NO: 90061 - DNA, 20 bp, Artificial
  CRISPR gRNA sequence
tcagggaatcttggttcttc

SEQ ID NO: 90062 - DNA, 20 bp, Artificial
  CRISPR gRNA sequence
ggttcttcccaagaaacact

SEQ ID NO: 90063 - DNA, 20 bp, Artificial
  CRISPR gRNA sequence
gttcttcccaagaaacactg

SEQ ID NO: 90064 - DNA, 20 bp, Artificial
  CRISPR gRNA sequence
ttcccaagaaacactgattt

SEQ ID NO: 90065 - DNA, 20 bp, Artificial
  CRISPR gRNA sequence
cccaagaaacactgattttc

SEQ ID NO: 90066 - DNA, 20 bp, Artificial
  CRISPR gRNA sequence
ccaagaaacactgattttct

SEQ ID NO: 90067 - DNA, 20 bp, Artificial
  CRISPR gRNA sequence
attttctttcagggagactt

SEQ ID NO: 90068 - DNA, 20 bp, Artificial
  CRISPR gRNA sequence
tctttcagggagacttcatg

SEQ ID NO: 90069 - DNA, 20 bp, Artificial
  CRISPR gRNA sequence
ctttcagggagacttcatgt

SEQ ID NO: 90070 - DNA, 20 bp, Artificial
  CRISPR gRNA sequence
tttcagggagacttcatgtg

SEQ ID NO: 90071 - DNA, 20 bp, Artificial
  CRISPR gRNA sequence
tcagggagacttcatgtgtt

SEQ ID NO: 90072 - DNA, 20 bp, Artificial
  CRISPR gRNA sequence
cagggagacttcatgtgttc

SEQ ID NO: 90073 - DNA, 20 bp, Artificial
  CRISPR gRNA sequence
agggagacttcatgtgttca

SEQ ID NO: 90074 - DNA, 20 bp, Artificial
  CRISPR gRNA sequence
catgtgttcatttatttcca

SEQ ID NO: 90075 - DNA, 20 bp, Artificial
  CRISPR gRNA sequence
atgtgttcatttatttccac

SEQ ID NO: 90076 - DNA, 20 bp, Artificial
  CRISPR gRNA sequence
atttatttccaccacagcag

SEQ ID NO: 90077 - DNA, 20 bp, Artificial
  CRISPR gRNA sequence
atttccaccacagcagattt

SEQ ID NO: 90078 - DNA, 20 bp, Artificial
  CRISPR gRNA sequence
tttccaccacagcagatttt

SEQ ID NO: 90079 - DNA, 20 bp, Artificial
  CRISPR gRNA sequence
ccaccacagcagattttaag

SEQ ID NO: 90080 - DNA, 20 bp, Artificial
  CRISPR gRNA sequence
caccacagcagattttaaga

SEQ ID NO: 90081 - DNA, 20 bp, Artificial
  CRISPR gRNA sequence
taagaaattataatatgtaa

SEQ ID NO: 90082 - DNA, 20 bp, Artificial
  CRISPR gRNA sequence
aagaaattataatatgtaat

SEQ ID NO: 90083 - DNA, 20 bp, Artificial
  CRISPR gRNA sequence
agaaattataatatgtaata

SEQ ID NO: 90084 - DNA, 20 bp, Artificial
  CRISPR gRNA sequence
taatatgtaatatttgatat

SEQ ID NO: 90085 - DNA, 20 bp, Artificial
  CRISPR gRNA sequence
gatatctataaagagtatat

SEQ ID NO: 90086 - DNA, 20 bp, Artificial
  CRISPR gRNA sequence
atatctataaagagtatatc

SEQ ID NO: 90087 - DNA, 20 bp, Artificial
  CRISPR gRNA sequence
taaagagtatatctaacgtg

SEQ ID NO: 90088 - DNA, 20 bp, Artificial
  CRISPR gRNA sequence
acgtgaataaattatgaagc

SEQ ID NO: 90089 - DNA, 20 bp, Artificial
  CRISPR gRNA sequence
tgaagcatactaatgagtac

SEQ ID NO: 90090 - DNA, 20 bp, Artificial
  CRISPR gRNA sequence
atgagtacctatgacccata

SEQ ID NO: 90091 - DNA, 20 bp, Artificial
  CRISPR gRNA sequence
tgacccataacacatataca

SEQ ID NO: 90092 - DNA, 20 bp, Artificial
  CRISPR gRNA sequence
aaacattttaaataccattg

SEQ ID NO: 90093 - DNA, 20 bp, Artificial
  CRISPR gRNA sequence
taaataccattgtgtttgtg

SEQ ID NO: 90094 - DNA, 20 bp, Artificial
  CRISPR gRNA sequence
aaataccattgtgtttgtgt

SEQ ID NO: 90095 - DNA, 20 bp, Artificial
  CRISPR gRNA sequence
aataccattgtgtttgtgtt

SEQ ID NO: 90096 - DNA, 20 bp, Artificial
  CRISPR gRNA sequence
tgtttgtgttcctccctagc

SEQ ID NO: 90097 - DNA, 20 bp, Artificial
  CRISPR gRNA sequence
gtgttcctccctagcctgtc

SEQ ID NO: 90098 - DNA, 20 bp, Artificial
  CRISPR gRNA sequence
tgttcctccctagcctgtcc

SEQ ID NO: 90099 - DNA, 20 bp, Artificial
  CRISPR gRNA sequence
ctccctagcctgtcccccgc

SEQ ID NO: 90100 - DNA, 20 bp, Artificial
  CRISPR gRNA sequence
cctagcctgtcccccgcctc

SEQ ID NO: 90101 - DNA, 20 bp, Artificial
  CRISPR gRNA sequence
gcctgtcccccgcctcttct

SEQ ID NO: 90102 - DNA, 20 bp, Artificial
  CRISPR gRNA sequence
tcccccgcctcttcttagcg

SEQ ID NO: 90103 - DNA, 20 bp, Artificial
  CRISPR gRNA sequence
ttcttagcggtaaccactgt

SEQ ID NO: 90104 - DNA, 20 bp, Artificial
  CRISPR gRNA sequence
cttagcggtaaccactgtcc

SEQ ID NO: 90105 - DNA, 20 bp, Artificial
  CRISPR gRNA sequence
ttagcggtaaccactgtcct

SEQ ID NO: 90106 - DNA, 20 bp, Artificial
  CRISPR gRNA sequence
agcggtaaccactgtcctta

SEQ ID NO: 90107 - DNA, 20 bp, Artificial
  CRISPR gRNA sequence
gcggtaaccactgtccttaa

SEQ ID NO: 90108 - DNA, 20 bp, Artificial
  CRISPR gRNA sequence
tccttaattttcgtgtctat

SEQ ID NO: 90109 - DNA, 20 bp, Artificial
  CRISPR gRNA sequence
aattttcgtgtctattatct

SEQ ID NO: 90110 - DNA, 20 bp, Artificial
  CRISPR gRNA sequence
attttcgtgtctattatctg

SEQ ID NO: 90111 - DNA, 20 bp, Artificial
  CRISPR gRNA sequence
tcgtgtctattatctgctat

SEQ ID NO: 90112 - DNA, 20 bp, Artificial
  CRISPR gRNA sequence
cgtgtctattatctgctata

SEQ ID NO: 90113 - DNA, 20 bp, Artificial
  CRISPR gRNA sequence
gtgtctattatctgctatag

SEQ ID NO: 90114 - DNA, 20 bp, Artificial
  CRISPR gRNA sequence
ttatctgctatagatatttt

SEQ ID NO: 90115 - DNA, 20 bp, Artificial
  CRISPR gRNA sequence
tctgctatagatatttttta

SEQ ID NO: 90116 - DNA, 20 bp, Artificial
  CRISPR gRNA sequence
cccagcgtgtcctgagtctt

SEQ ID NO: 90117 - DNA, 20 bp, Artificial
  CRISPR gRNA sequence
tcctgagtctttggttcgcg

SEQ ID NO: 90118 - DNA, 20 bp, Artificial
  CRISPR gRNA sequence
tttggttcgcgaagtgccgt

SEQ ID NO: 90119 - DNA, 20 bp, Artificial
  CRISPR gRNA sequence
ttggttcgcgaagtgccgtt

SEQ ID NO: 90120 - DNA, 20 bp, Artificial
  CRISPR gRNA sequence
tcgcgaagtgccgttaggcc

SEQ ID NO: 90121 - DNA, 20 bp, Artificial
  CRISPR gRNA sequence
cgaagtgccgttaggccaag

SEQ ID NO: 90122 - DNA, 20 bp, Artificial
  CRISPR gRNA sequence
gaagtgccgttaggccaagc

SEQ ID NO: 90123 - DNA, 20 bp, Artificial
  CRISPR gRNA sequence
ttaggccaagcaggtgctaa

SEQ ID NO: 90124 - DNA, 20 bp, Artificial
  CRISPR gRNA sequence
ccaagcaggtgctaaaagcc

SEQ ID NO: 90125 - DNA, 20 bp, Artificial
  CRISPR gRNA sequence
caagcaggtgctaaaagccc

SEQ ID NO: 90126 - DNA, 20 bp, Artificial
  CRISPR gRNA sequence
aagcaggtgctaaaagcccg

SEQ ID NO: 90127 - DNA, 20 bp, Artificial
  CRISPR gRNA sequence
gtgctaaaagcccggggtcg

SEQ ID NO: 90128 - DNA, 20 bp, Artificial
  CRISPR gRNA sequence
aagcccggggtcgtggaccc

SEQ ID NO: 90129 - DNA, 20 bp, Artificial
  CRISPR gRNA sequence
ccggggtcgtggaccccggc

SEQ ID NO: 90130 - DNA, 20 bp, Artificial
  CRISPR gRNA sequence
cggggtcgtggaccccggcc

SEQ ID NO: 90131 - DNA, 20 bp, Artificial
  CRISPR gRNA sequence
cgtggaccccggccaggtct

SEQ ID NO: 90132 - DNA, 20 bp, Artificial
  CRISPR gRNA sequence
ggaccccggccaggtcttag

SEQ ID NO: 90133 - DNA, 20 bp, Artificial
  CRISPR gRNA sequence
ccggccaggtcttagcagca

SEQ ID NO: 90134 - DNA, 20 bp, Artificial
  CRISPR gRNA sequence
ggccaggtcttagcagcatg

SEQ ID NO: 90135 - DNA, 20 bp, Artificial
  CRISPR gRNA sequence
gccaggtcttagcagcatgg

SEQ ID NO: 90136 - DNA, 20 bp, Artificial
  CRISPR gRNA sequence
gtcttagcagcatggaggcg

SEQ ID NO: 90137 - DNA, 20 bp, Artificial
  CRISPR gRNA sequence
tcttagcagcatggaggcgc

SEQ ID NO: 90138 - DNA, 20 bp, Artificial
  CRISPR gRNA sequence
cttagcagcatggaggcgca

SEQ ID NO: 90139 - DNA, 20 bp, Artificial
  CRISPR gRNA sequence
cagcatggaggcgcagggtg

SEQ ID NO: 90140 - DNA, 20 bp, Artificial
  CRISPR gRNA sequence
catggaggcgcagggtgtag

SEQ ID NO: 90141 - DNA, 20 bp, Artificial
  CRISPR gRNA sequence
tggaggcgcagggtgtagcg

SEQ ID NO: 90142 - DNA, 20 bp, Artificial
  CRISPR gRNA sequence
ggaggcgcagggtgtagcgg

SEQ ID NO: 90143 - DNA, 20 bp, Artificial
  CRISPR gRNA sequence
gaggcgcagggtgtagcgga

SEQ ID NO: 90144 - DNA, 20 bp, Artificial
  CRISPR gRNA sequence
gcagggtgtagcggagggcg

SEQ ID NO: 90145 - DNA, 20 bp, Artificial
  CRISPR gRNA sequence
cagggtgtagcggagggcgc

SEQ ID NO: 90146 - DNA, 20 bp, Artificial
  CRISPR gRNA sequence
agggtgtagcggagggcgcg

SEQ ID NO: 90147 - DNA, 20 bp, Artificial
  CRISPR gRNA sequence
tgtagcggagggcgcggggc

SEQ ID NO: 90148 - DNA, 20 bp, Artificial
  CRISPR gRNA sequence
gtagcggagggcgcggggcc

SEQ ID NO: 90149 - DNA, 20 bp, Artificial
  CRISPR gRNA sequence
ggcgcggggccgggcgccgc

SEQ ID NO: 90150 - DNA, 20 bp, Artificial
  CRISPR gRNA sequence
gcggggccgggcgccgccag

SEQ ID NO: 90151 - DNA, 20 bp, Artificial
  CRISPR gRNA sequence
cagcggcgtgccccaccccg

SEQ ID NO: 90152 - DNA, 20 bp, Artificial
  CRISPR gRNA sequence
cgtgccccaccccgcggccc

SEQ ID NO: 90153 - DNA, 20 bp, Artificial
  CRISPR gRNA sequence
ccaccccgcggccctagccc

SEQ ID NO: 90154 - DNA, 20 bp, Artificial
  CRISPR gRNA sequence
cgcggccctagccccggctg

SEQ ID NO: 90155 - DNA, 20 bp, Artificial
  CRISPR gRNA sequence
cccggctgcggctcccacct

SEQ ID NO: 90156 - DNA, 20 bp, Artificial
  CRISPR gRNA sequence
tgcggctcccaccttggcgc

SEQ ID NO: 90157 - DNA, 20 bp, Artificial
  CRISPR gRNA sequence
tcccaccttggcgccagcct

SEQ ID NO: 90158 - DNA, 20 bp, Artificial
  CRISPR gRNA sequence
caccttggcgccagcctcgg

SEQ ID NO: 90159 - DNA, 20 bp, Artificial
  CRISPR gRNA sequence
cttggcgccagcctcggtgg

SEQ ID NO: 90160 - DNA, 20 bp, Artificial
  CRISPR gRNA sequence
gccagcctcggtggcggccg

SEQ ID NO: 90161 - DNA, 20 bp, Artificial
  CRISPR gRNA sequence
ggcctctcaattcaccctgc

SEQ ID NO: 90162 - DNA, 20 bp, Artificial
  CRISPR gRNA sequence
ctagtgatgcaaccctgtgc

SEQ ID NO: 90163 - DNA, 20 bp, Artificial
  CRISPR gRNA sequence
tagtgatgcaaccctgtgct

SEQ ID NO: 90164 - DNA, 20 bp, Artificial
  CRISPR gRNA sequence
tgatgcaaccctgtgctggg

SEQ ID NO: 90165 - DNA, 20 bp, Artificial
  CRISPR gRNA sequence
gatgcaaccctgtgctgggc

SEQ ID NO: 90166 - DNA, 20 bp, Artificial
  CRISPR gRNA sequence
aaccctgtgctgggcaggac

SEQ ID NO: 90167 - DNA, 20 bp, Artificial
  CRISPR gRNA sequence
accctgtgctgggcaggacg

SEQ ID NO: 90168 - DNA, 20 bp, Artificial
  CRISPR gRNA sequence
tgctgggcaggacgaggctg

SEQ ID NO: 90169 - DNA, 20 bp, Artificial
  CRISPR gRNA sequence
caggacgaggctgcggcccc

SEQ ID NO: 90170 - DNA, 20 bp, Artificial
  CRISPR gRNA sequence
aggacgaggctgcggccccc

SEQ ID NO: 90171 - DNA, 20 bp, Artificial
  CRISPR gRNA sequence
ggacgaggctgcggcccccg

SEQ ID NO: 90172 - DNA, 20 bp, Artificial
  CRISPR gRNA sequence
gacgaggctgcggcccccgg

SEQ ID NO: 90173 - DNA, 20 bp, Artificial
  CRISPR gRNA sequence
gaggctgcggcccccggggg

SEQ ID NO: 90174 - DNA, 20 bp, Artificial
  CRISPR gRNA sequence
gcggcccccgggggcagcgt

SEQ ID NO: 90175 - DNA, 20 bp, Artificial
  CRISPR gRNA sequence
cggcccccgggggcagcgtt

SEQ ID NO: 90176 - DNA, 20 bp, Artificial
  CRISPR gRNA sequence
ggcccccgggggcagcgttg

SEQ ID NO: 90177 - DNA, 20 bp, Artificial
  CRISPR gRNA sequence
ccccgggggcagcgttgggg

SEQ ID NO: 90178 - DNA, 20 bp, Artificial
  CRISPR gRNA sequence
cccgggggcagcgttggggc

SEQ ID NO: 90179 - DNA, 20 bp, Artificial
  CRISPR gRNA sequence
ggggcagcgttggggcgggc

SEQ ID NO: 90180 - DNA, 20 bp, Artificial
  CRISPR gRNA sequence
gttggggcgggcaagcccgt

SEQ ID NO: 90181 - DNA, 20 bp, Artificial
  CRISPR gRNA sequence
ttggggcgggcaagcccgtt

SEQ ID NO: 90182 - DNA, 20 bp, Artificial
  CRISPR gRNA sequence
gcccgttaggtacctgtgcg

SEQ ID NO: 90183 - DNA, 20 bp, Artificial
  CRISPR gRNA sequence
cccgttaggtacctgtgcga

SEQ ID NO: 90184 - DNA, 20 bp, Artificial
  CRISPR gRNA sequence
ccgttaggtacctgtgcgaa

SEQ ID NO: 90185 - DNA, 20 bp, Artificial
  CRISPR gRNA sequence
cgttaggtacctgtgcgaag

SEQ ID NO: 90186 - DNA, 20 bp, Artificial
  CRISPR gRNA sequence
aggtacctgtgcgaaggggc

SEQ ID NO: 90187 - DNA, 20 bp, Artificial
  CRISPR gRNA sequence
ggtacctgtgcgaaggggcc

SEQ ID NO: 90188 - DNA, 20 bp, Artificial
  CRISPR gRNA sequence
gtacctgtgcgaaggggccg

SEQ ID NO: 90189 - DNA, 20 bp, Artificial
  CRISPR gRNA sequence
ctgtgcgaaggggccgggga

SEQ ID NO: 90190 - DNA, 20 bp, Artificial
  CRISPR gRNA sequence
cgaaggggccggggatggcg

SEQ ID NO: 90191 - DNA, 20 bp, Artificial
  CRISPR gRNA sequence
aaggggccggggatggcgaa

SEQ ID NO: 90192 - DNA, 20 bp, Artificial
  CRISPR gRNA sequence
aggggccggggatggcgaag

SEQ ID NO: 90193 - DNA, 20 bp, Artificial
  CRISPR gRNA sequence
gggccggggatggcgaagag

SEQ ID NO: 90194 - DNA, 20 bp, Artificial
  CRISPR gRNA sequence
ggccggggatggcgaagagg

SEQ ID NO: 90195 - DNA, 20 bp, Artificial
  CRISPR gRNA sequence
ggggatggcgaagaggaggc

SEQ ID NO: 90196 - DNA, 20 bp, Artificial
  CRISPR gRNA sequence
gggatggcgaagaggaggct

SEQ ID NO: 90197 - DNA, 20 bp, Artificial
  CRISPR gRNA sequence
ggatggcgaagaggaggctg

SEQ ID NO: 90198 - DNA, 20 bp, Artificial
  CRISPR gRNA sequence
atggcgaagaggaggctggg

SEQ ID NO: 90199 - DNA, 20 bp, Artificial
  CRISPR gRNA sequence
tggcgaagaggaggctgggg

SEQ ID NO: 90200 - DNA, 20 bp, Artificial
  CRISPR gRNA sequence
aagaggaggctggggaggac

SEQ ID NO: 90201 - DNA, 20 bp, Artificial
  CRISPR gRNA sequence
agaggaggctggggaggacg

SEQ ID NO: 90202 - DNA, 20 bp, Artificial
  CRISPR gRNA sequence
ggaggctggggaggacgagg

SEQ ID NO: 90203 - DNA, 20 bp, Artificial
  CRISPR gRNA sequence
ggaggacgaggcggacctgt

SEQ ID NO: 90204 - DNA, 20 bp, Artificial
  CRISPR gRNA sequence
ggcggacctgttagacactt

SEQ ID NO: 90205 - DNA, 20 bp, Artificial
  CRISPR gRNA sequence
gttagacacttcggaccctc

SEQ ID NO: 90206 - DNA, 20 bp, Artificial
  CRISPR gRNA sequence
ttagacacttcggaccctcc

SEQ ID NO: 90207 - DNA, 20 bp, Artificial
  CRISPR gRNA sequence
tagacacttcggaccctccg

SEQ ID NO: 90208 - DNA, 20 bp, Artificial
  CRISPR gRNA sequence
agacacttcggaccctccgg

SEQ ID NO: 90209 - DNA, 20 bp, Artificial
  CRISPR gRNA sequence
gacacttcggaccctccggg

SEQ ID NO: 90210 - DNA, 20 bp, Artificial
  CRISPR gRNA sequence
cacttcggaccctccggggg

SEQ ID NO: 90211 - DNA, 20 bp, Artificial
  CRISPR gRNA sequence
acttcggaccctccgggggg

SEQ ID NO: 90212 - DNA, 20 bp, Artificial
  CRISPR gRNA sequence
cggaccctccggggggaggc

SEQ ID NO: 90213 - DNA, 20 bp, Artificial
  CRISPR gRNA sequence
gaccctccggggggaggcga

SEQ ID NO: 90214 - DNA, 20 bp, Artificial
  CRISPR gRNA sequence
tccggggggaggcgagagcg

SEQ ID NO: 90215 - DNA, 20 bp, Artificial
  CRISPR gRNA sequence
gggggaggcgagagcgcggc

SEQ ID NO: 90216 - DNA, 20 bp, Artificial
  CRISPR gRNA sequence
aggcgagagcgcggctagtt

SEQ ID NO: 90217 - DNA, 20 bp, Artificial
  CRISPR gRNA sequence
gcgagagcgcggctagtttg

SEQ ID NO: 90218 - DNA, 20 bp, Artificial
  CRISPR gRNA sequence
cgagagcgcggctagtttgg

SEQ ID NO: 90219 - DNA, 20 bp, Artificial
  CRISPR gRNA sequence
cgcggctagtttggaggatc

SEQ ID NO: 90220 - DNA, 20 bp, Artificial
  CRISPR gRNA sequence
cggctagtttggaggatcta

SEQ ID NO: 90221 - DNA, 20 bp, Artificial
  CRISPR gRNA sequence
ggctagtttggaggatctag

SEQ ID NO: 90222 - DNA, 20 bp, Artificial
  CRISPR gRNA sequence
gtttggaggatctagaggac

SEQ ID NO: 90223 - DNA, 20 bp, Artificial
  CRISPR gRNA sequence
tttggaggatctagaggacg

SEQ ID NO: 90224 - DNA, 20 bp, Artificial
  CRISPR gRNA sequence
tggaggatctagaggacgag

SEQ ID NO: 90225 - DNA, 20 bp, Artificial
  CRISPR gRNA sequence
agaggacgaggagactcact

SEQ ID NO: 90226 - DNA, 20 bp, Artificial
  CRISPR gRNA sequence
gaggacgaggagactcactc

SEQ ID NO: 90227 - DNA, 20 bp, Artificial
  CRISPR gRNA sequence
aggacgaggagactcactcg

SEQ ID NO: 90228 - DNA, 20 bp, Artificial
  CRISPR gRNA sequence
ggacgaggagactcactcgg

SEQ ID NO: 90229 - DNA, 20 bp, Artificial
  CRISPR gRNA sequence
gacgaggagactcactcggg

SEQ ID NO: 90230 - DNA, 20 bp, Artificial
  CRISPR gRNA sequence
aggagactcactcggggggc

SEQ ID NO: 90231 - DNA, 20 bp, Artificial
  CRISPR gRNA sequence
ggagactcactcggggggcg

SEQ ID NO: 90232 - DNA, 20 bp, Artificial
  CRISPR gRNA sequence
gagactcactcggggggcga

SEQ ID NO: 90233 - DNA, 20 bp, Artificial
  CRISPR gRNA sequence
actcactcggggggcgaggg

SEQ ID NO: 90234 - DNA, 20 bp, Artificial
  CRISPR gRNA sequence
cactcggggggcgagggcag

SEQ ID NO: 90235 - DNA, 20 bp, Artificial
  CRISPR gRNA sequence
tcggggggcgagggcagcag

SEQ ID NO: 90236 - DNA, 20 bp, Artificial
  CRISPR gRNA sequence
cggggggcgagggcagcagc

SEQ ID NO: 90237 - DNA, 20 bp, Artificial
  CRISPR gRNA sequence
ggggggcgagggcagcagcg

SEQ ID NO: 90238 - DNA, 20 bp, Artificial
  CRISPR gRNA sequence
gggggcgagggcagcagcgg

SEQ ID NO: 90239 - DNA, 20 bp, Artificial
  CRISPR gRNA sequence
agggcagcagcgggggcgcc

SEQ ID NO: 90240 - DNA, 20 bp, Artificial
  CRISPR gRNA sequence
ggcagcagcgggggcgcccg

SEQ ID NO: 90241 - DNA, 20 bp, Artificial
  CRISPR gRNA sequence
gcagcagcgggggcgcccgg

SEQ ID NO: 90242 - DNA, 20 bp, Artificial
  CRISPR gRNA sequence
gcagcgggggcgcccggagg

SEQ ID NO: 90243 - DNA, 20 bp, Artificial
  CRISPR gRNA sequence
cagcgggggcgcccggaggc

SEQ ID NO: 90244 - DNA, 20 bp, Artificial
  CRISPR gRNA sequence
agcgggggcgcccggaggcg

SEQ ID NO: 90245 - DNA, 20 bp, Artificial
  CRISPR gRNA sequence
gggggcgcccggaggcgggg

SEQ ID NO: 90246 - DNA, 20 bp, Artificial
  CRISPR gRNA sequence
ggcgcccggaggcggggcag

SEQ ID NO: 90247 - DNA, 20 bp, Artificial
  CRISPR gRNA sequence
gcccggaggcggggcagcgg

SEQ ID NO: 90248 - DNA, 20 bp, Artificial
  CRISPR gRNA sequence
cccggaggcggggcagcggt

SEQ ID NO: 90249 - DNA, 20 bp, Artificial
  CRISPR gRNA sequence
ccggaggcggggcagcggtg

SEQ ID NO: 90250 - DNA, 20 bp, Artificial
  CRISPR gRNA sequence
cggaggcggggcagcggtgg

SEQ ID NO: 90251 - DNA, 20 bp, Artificial
  CRISPR gRNA sequence
aggcggggcagcggtggggg

SEQ ID NO: 90252 - DNA, 20 bp, Artificial
  CRISPR gRNA sequence
ggcagcggtgggggcagcat

SEQ ID NO: 90253 - DNA, 20 bp, Artificial
  CRISPR gRNA sequence
gcggtgggggcagcatgagc

SEQ ID NO: 90254 - DNA, 20 bp, Artificial
  CRISPR gRNA sequence
gagcaagacctgcacctacg

SEQ ID NO: 90255 - DNA, 20 bp, Artificial
  CRISPR gRNA sequence
agcaagacctgcacctacga

SEQ ID NO: 90256 - DNA, 20 bp, Artificial
  CRISPR gRNA sequence
acctgcacctacgaaggctg

SEQ ID NO: 90257 - DNA, 20 bp, Artificial
  CRISPR gRNA sequence
gcacctacgaaggctgcagc

SEQ ID NO: 90258 - DNA, 20 bp, Artificial
  CRISPR gRNA sequence
gaaggctgcagcgagaccac

SEQ ID NO: 90259 - DNA, 20 bp, Artificial
  CRISPR gRNA sequence
gctgcagcgagaccacgagc

SEQ ID NO: 90260 - DNA, 20 bp, Artificial
  CRISPR gRNA sequence
ctgcagcgagaccacgagcc

SEQ ID NO: 90261 - DNA, 20 bp, Artificial
  CRISPR gRNA sequence
cagcgagaccacgagccagg

SEQ ID NO: 90262 - DNA, 20 bp, Artificial
  CRISPR gRNA sequence
agaccacgagccaggtggcc

SEQ ID NO: 90263 - DNA, 20 bp, Artificial
  CRISPR gRNA sequence
ccacgagccaggtggccaag

SEQ ID NO: 90264 - DNA, 20 bp, Artificial
  CRISPR gRNA sequence
tggccaagcagcgcaaaccg

SEQ ID NO: 90265 - DNA, 20 bp, Artificial
  CRISPR gRNA sequence
agcgcaaaccgtggatgtgc

SEQ ID NO: 90266 - DNA, 20 bp, Artificial
  CRISPR gRNA sequence
tgtgcaagaaacaccgcaac

SEQ ID NO: 90267 - DNA, 20 bp, Artificial
  CRISPR gRNA sequence
aacaccgcaacaagatgtac

SEQ ID NO: 90268 - DNA, 20 bp, Artificial
  CRISPR gRNA sequence
acaccgcaacaagatgtaca

SEQ ID NO: 90269 - DNA, 20 bp, Artificial
  CRISPR gRNA sequence
gcaacaagatgtacaaggac

SEQ ID NO: 90270 - DNA, 20 bp, Artificial
  CRISPR gRNA sequence
tgtacaaggacaagtataaa

SEQ ID NO: 90271 - DNA, 20 bp, Artificial
  CRISPR gRNA sequence
acaaggacaagtataaaaag

SEQ ID NO: 90272 - DNA, 20 bp, Artificial
  CRISPR gRNA sequence
aggacaagtataaaaagaag

SEQ ID NO: 90273 - DNA, 20 bp, Artificial
  CRISPR gRNA sequence
gacaagtataaaaagaagaa

SEQ ID NO: 90274 - DNA, 20 bp, Artificial
  CRISPR gRNA sequence
ataaaaagaagaagagcgac

SEQ ID NO: 90275 - DNA, 20 bp, Artificial
  CRISPR gRNA sequence
taaaaagaagaagagcgacc

SEQ ID NO: 90276 - DNA, 20 bp, Artificial
  CRISPR gRNA sequence
agcgaccaggccctgaactg

SEQ ID NO: 90277 - DNA, 20 bp, Artificial
  CRISPR gRNA sequence
gaccaggccctgaactgcgg

SEQ ID NO: 90278 - DNA, 20 bp, Artificial
  CRISPR gRNA sequence
accaggccctgaactgcggt

SEQ ID NO: 90279 - DNA, 20 bp, Artificial
  CRISPR gRNA sequence
tgcggtgggactgcctcgac

SEQ ID NO: 90280 - DNA, 20 bp, Artificial
  CRISPR gRNA sequence
ggtgggactgcctcgactgg

SEQ ID NO: 90281 - DNA, 20 bp, Artificial
  CRISPR gRNA sequence
gactgcctcgactggcagcg

SEQ ID NO: 90282 - DNA, 20 bp, Artificial
  CRISPR gRNA sequence
actgcctcgactggcagcgc

SEQ ID NO: 90283 - DNA, 20 bp, Artificial
  CRISPR gRNA sequence
gcgcgggaaacgtcaaactc

SEQ ID NO: 90284 - DNA, 20 bp, Artificial
  CRISPR gRNA sequence
cgcgggaaacgtcaaactcg

SEQ ID NO: 90285 - DNA, 20 bp, Artificial
  CRISPR gRNA sequence
aaacgtcaaactcgaggtat

SEQ ID NO: 90286 - DNA, 20 bp, Artificial
  CRISPR gRNA sequence
caaactcgaggtatcagact

SEQ ID NO: 90287 - DNA, 20 bp, Artificial
  CRISPR gRNA sequence
tcgaggtatcagacttagct

SEQ ID NO: 90288 - DNA, 20 bp, Artificial
  CRISPR gRNA sequence
cgaggtatcagacttagctg

SEQ ID NO: 90289 - DNA, 20 bp, Artificial
  CRISPR gRNA sequence
tatcagacttagctgaggcc

SEQ ID NO: 90290 - DNA, 20 bp, Artificial
  CRISPR gRNA sequence
atcagacttagctgaggcct

SEQ ID NO: 90291 - DNA, 20 bp, Artificial
  CRISPR gRNA sequence
tcagacttagctgaggcctg

SEQ ID NO: 90292 - DNA, 20 bp, Artificial
  CRISPR gRNA sequence
acttagctgaggcctgggga

SEQ ID NO: 90293 - DNA, 20 bp, Artificial
  CRISPR gRNA sequence
cttagctgaggcctggggat

SEQ ID NO: 90294 - DNA, 20 bp, Artificial
  CRISPR gRNA sequence
tagctgaggcctggggatgg

SEQ ID NO: 90295 - DNA, 20 bp, Artificial
  CRISPR gRNA sequence
agctgaggcctggggatggg

SEQ ID NO: 90296 - DNA, 20 bp, Artificial
  CRISPR gRNA sequence
tgaggcctggggatgggagg

SEQ ID NO: 90297 - DNA, 20 bp, Artificial
  CRISPR gRNA sequence
ggcctggggatgggaggtgg

SEQ ID NO: 90298 - DNA, 20 bp, Artificial
  CRISPR gRNA sequence
ctggggatgggaggtggaag

SEQ ID NO: 90299 - DNA, 20 bp, Artificial
  CRISPR gRNA sequence
cttaacgcaaaccgcatctg

SEQ ID NO: 90300 - DNA, 20 bp, Artificial
  CRISPR gRNA sequence
ttaacgcaaaccgcatctgc

SEQ ID NO: 90301 - DNA, 20 bp, Artificial
  CRISPR gRNA sequence
taacgcaaaccgcatctgca

SEQ ID NO: 90302 - DNA, 20 bp, Artificial
  CRISPR gRNA sequence
cctgcctccccacttccaaa

SEQ ID NO: 90303 - DNA, 20 bp, Artificial
  CRISPR gRNA sequence
ctgcctccccacttccaaat

SEQ ID NO: 90304 - DNA, 20 bp, Artificial
  CRISPR gRNA sequence
ctccccacttccaaatgggc

SEQ ID NO: 90305 - DNA, 20 bp, Artificial
  CRISPR gRNA sequence
cttccaaatgggccggtttg

SEQ ID NO: 90306 - DNA, 20 bp, Artificial
  CRISPR gRNA sequence
atgggccggtttgcagtgac

SEQ ID NO: 90307 - DNA, 20 bp, Artificial
  CRISPR gRNA sequence
tgggccggtttgcagtgact

SEQ ID NO: 90308 - DNA, 20 bp, Artificial
  CRISPR gRNA sequence
ccggtttgcagtgactgggt

SEQ ID NO: 90309 - DNA, 20 bp, Artificial
  CRISPR gRNA sequence
gtttgcagtgactgggttag

SEQ ID NO: 90310 - DNA, 20 bp, Artificial
  CRISPR gRNA sequence
cagtgactgggttagtggtt

SEQ ID NO: 90311 - DNA, 20 bp, Artificial
  CRISPR gRNA sequence
ctgggttagtggttgagaat

SEQ ID NO: 90312 - DNA, 20 bp, Artificial
  CRISPR gRNA sequence
gggttagtggttgagaatta

SEQ ID NO: 90313 - DNA, 20 bp, Artificial
  CRISPR gRNA sequence
agagtgtttgccctaaatta

SEQ ID NO: 90314 - DNA, 20 bp, Artificial
  CRISPR gRNA sequence
agtttataccaacatgtgca

SEQ ID NO: 90315 - DNA, 20 bp, Artificial
  CRISPR gRNA sequence
caacatgtgcaaagcaataa

SEQ ID NO: 90316 - DNA, 20 bp, Artificial
  CRISPR gRNA sequence
cagttctgttgaactcatga

SEQ ID NO: 90317 - DNA, 20 bp, Artificial
  CRISPR gRNA sequence
agttctgttgaactcatgat

SEQ ID NO: 90318 - DNA, 20 bp, Artificial
  CRISPR gRNA sequence
tgttgaactcatgataggtg

SEQ ID NO: 90319 - DNA, 20 bp, Artificial
  CRISPR gRNA sequence
catgataggtgcagaaattt

SEQ ID NO: 90320 - DNA, 20 bp, Artificial
  CRISPR gRNA sequence
cagtaaaaataatgtgacat

SEQ ID NO: 90321 - DNA, 20 bp, Artificial
  CRISPR gRNA sequence
taaaaataatgtgacatcgg

SEQ ID NO: 90322 - DNA, 20 bp, Artificial
  CRISPR gRNA sequence
aaaataatgtgacatcggca

SEQ ID NO: 90323 - DNA, 20 bp, Artificial
  CRISPR gRNA sequence
tgacatcggcagagctgtca

SEQ ID NO: 90324 - DNA, 20 bp, Artificial
  CRISPR gRNA sequence
cggcagagctgtcatagatc

SEQ ID NO: 90325 - DNA, 20 bp, Artificial
  CRISPR gRNA sequence
ggcagagctgtcatagatct

SEQ ID NO: 90326 - DNA, 20 bp, Artificial
  CRISPR gRNA sequence
gctgtcatagatctgggata

SEQ ID NO: 90327 - DNA, 20 bp, Artificial
  CRISPR gRNA sequence
tcatagatctgggatatggc

SEQ ID NO: 90328 - DNA, 20 bp, Artificial
  CRISPR gRNA sequence
tagatctgggatatggctgg

SEQ ID NO: 90329 - DNA, 20 bp, Artificial
  CRISPR gRNA sequence
agatctgggatatggctgga

SEQ ID NO: 90330 - DNA, 20 bp, Artificial
  CRISPR gRNA sequence
gggatatggctggaaggaca

SEQ ID NO: 90331 - DNA, 20 bp, Artificial
  CRISPR gRNA sequence
gatatggctggaaggacata

SEQ ID NO: 90332 - DNA, 20 bp, Artificial
  CRISPR gRNA sequence
aaggacatagagtaaatgat

SEQ ID NO: 90333 - DNA, 20 bp, Artificial
  CRISPR gRNA sequence
catagagtaaatgatcggtc

SEQ ID NO: 90334 - DNA, 20 bp, Artificial
  CRISPR gRNA sequence
atcggtctggttcatcgcta

SEQ ID NO: 90335 - DNA, 20 bp, Artificial
  CRISPR gRNA sequence
tcggtctggttcatcgctaa

SEQ ID NO: 90336 - DNA, 20 bp, Artificial
  CRISPR gRNA sequence
ggtctggttcatcgctaaag

SEQ ID NO: 90337 - DNA, 20 bp, Artificial
  CRISPR gRNA sequence
gttcatcgctaaaggagact

SEQ ID NO: 90338 - DNA, 20 bp, Artificial
  CRISPR gRNA sequence
ttcatcgctaaaggagactt

SEQ ID NO: 90339 - DNA, 20 bp, Artificial
  CRISPR gRNA sequence
ctaaaggagacttaggaacc

SEQ ID NO: 90340 - DNA, 20 bp, Artificial
  CRISPR gRNA sequence
gagacttaggaacctagatg

SEQ ID NO: 90341 - DNA, 20 bp, Artificial
  CRISPR gRNA sequence
cttaggaacctagatgaagt

SEQ ID NO: 90342 - DNA, 20 bp, Artificial
  CRISPR gRNA sequence
tagatgaagttggtacttct

SEQ ID NO: 90343 - DNA, 20 bp, Artificial
  CRISPR gRNA sequence
tgaagttggtacttctgaga

SEQ ID NO: 90344 - DNA, 20 bp, Artificial
  CRISPR gRNA sequence
tgttttcactactctattct

SEQ ID NO: 90345 - DNA, 20 bp, Artificial
  CRISPR gRNA sequence
actactctattctcagtatc

SEQ ID NO: 90346 - DNA, 20 bp, Artificial
  CRISPR gRNA sequence
tattctcagtatccagttct

SEQ ID NO: 90347 - DNA, 20 bp, Artificial
  CRISPR gRNA sequence
agtatccagttctcagtacc

SEQ ID NO: 90348 - DNA, 20 bp, Artificial
  CRISPR gRNA sequence
agttctcagtacccagttct

SEQ ID NO: 90349 - DNA, 20 bp, Artificial
  CRISPR gRNA sequence
atttgtaatactcctgtatt

SEQ ID NO: 90350 - DNA, 20 bp, Artificial
  CRISPR gRNA sequence
tgtatttagtactttgtttt

SEQ ID NO: 90351 - DNA, 20 bp, Artificial
  CRISPR gRNA sequence
tgttctgttaaccctcttcc

SEQ ID NO: 90352 - DNA, 20 bp, Artificial
  CRISPR gRNA sequence
tcttcctagtaccgtatttt

SEQ ID NO: 90353 - DNA, 20 bp, Artificial
  CRISPR gRNA sequence
atttttagtactgctatact

SEQ ID NO: 90354 - DNA, 20 bp, Artificial
  CRISPR gRNA sequence
tatactcagttgcctgtctg

SEQ ID NO: 90355 - DNA, 20 bp, Artificial
  CRISPR gRNA sequence
gtctgtagtacccctgtacg

SEQ ID NO: 90356 - DNA, 20 bp, Artificial
  CRISPR gRNA sequence
ttttcttacaactctgttcc

SEQ ID NO: 90357 - DNA, 20 bp, Artificial
  CRISPR gRNA sequence
gttcccagtacccctatgtt

SEQ ID NO: 90358 - DNA, 20 bp, Artificial
  CRISPR gRNA sequence
tacttaatatactttgttct

SEQ ID NO: 90359 - DNA, 20 bp, Artificial
  CRISPR gRNA sequence
gttctcagtatccttgttgt

SEQ ID NO: 90360 - DNA, 20 bp, Artificial
  CRISPR gRNA sequence
gttctcactaccccttttct

SEQ ID NO: 90361 - DNA, 20 bp, Artificial
  CRISPR gRNA sequence
ccccttttcttagtacccct

SEQ ID NO: 90362 - DNA, 20 bp, Artificial
  CRISPR gRNA sequence
cccttttcttagtacccctg

SEQ ID NO: 90363 - DNA, 20 bp, Artificial
  CRISPR gRNA sequence
ccttttcttagtacccctga

SEQ ID NO: 90364 - DNA, 20 bp, Artificial
  CRISPR gRNA sequence
cttttcttagtacccctgag

SEQ ID NO: 90365 - DNA, 20 bp, Artificial
  CRISPR gRNA sequence
ttttcttagtacccctgagg

SEQ ID NO: 90366 - DNA, 20 bp, Artificial
  CRISPR gRNA sequence
tttcttagtacccctgaggg

SEQ ID NO: 90367 - DNA, 20 bp, Artificial
  CRISPR gRNA sequence
tacccctgaggggggaaaaa

SEQ ID NO: 90368 - DNA, 20 bp, Artificial
  CRISPR gRNA sequence
acccctgaggggggaaaaaa

SEQ ID NO: 90369 - DNA, 20 bp, Artificial
  CRISPR gRNA sequence
ggggaaaaaaaggatgataa

SEQ ID NO: 90370 - DNA, 20 bp, Artificial
  CRISPR gRNA sequence
gggaaaaaaaggatgataat

SEQ ID NO: 90371 - DNA, 20 bp, Artificial
  CRISPR gRNA sequence
ggaaaaaaaggatgataatg

SEQ ID NO: 90372 - DNA, 20 bp, Artificial
  CRISPR gRNA sequence
aaaggatgataatggggtat

SEQ ID NO: 90373 - DNA, 20 bp, Artificial
  CRISPR gRNA sequence
tataagtctcaaaaaacttt

SEQ ID NO: 90374 - DNA, 20 bp, Artificial
  CRISPR gRNA sequence
tggattgtttgatttgaact

SEQ ID NO: 90375 - DNA, 20 bp, Artificial
  CRISPR gRNA sequence
gtttgatttgaactgagtca

SEQ ID NO: 90376 - DNA, 20 bp, Artificial
  CRISPR gRNA sequence
tttgatttgaactgagtcaa

SEQ ID NO: 90377 - DNA, 20 bp, Artificial
  CRISPR gRNA sequence
aactgagtcaaaggtaaaac

SEQ ID NO: 90378 - DNA, 20 bp, Artificial
  CRISPR gRNA sequence
caaaggtaaaaccagtgttc

SEQ ID NO: 90379 - DNA, 20 bp, Artificial
  CRISPR gRNA sequence
aaggtaaaaccagtgttctg

SEQ ID NO: 90380 - DNA, 20 bp, Artificial
  CRISPR gRNA sequence
gtgttctggagttcgacttc

SEQ ID NO: 90381 - DNA, 20 bp, Artificial
  CRISPR gRNA sequence
tgttctggagttcgacttct

SEQ ID NO: 90382 - DNA, 20 bp, Artificial
  CRISPR gRNA sequence
atccctgttgcatcatttac

SEQ ID NO: 90383 - DNA, 20 bp, Artificial
  CRISPR gRNA sequence
tgcatcatttactggccttg

SEQ ID NO: 90384 - DNA, 20 bp, Artificial
  CRISPR gRNA sequence
tactggccttgtggcttgaa

SEQ ID NO: 90385 - DNA, 20 bp, Artificial
  CRISPR gRNA sequence
actggccttgtggcttgaat

SEQ ID NO: 90386 - DNA, 20 bp, Artificial
  CRISPR gRNA sequence
ggttattaaactctgtaaaa

SEQ ID NO: 90387 - DNA, 20 bp, Artificial
  CRISPR gRNA sequence
gttattaaactctgtaaaat

SEQ ID NO: 90388 - DNA, 20 bp, Artificial
  CRISPR gRNA sequence
ttaaaatcgtgtgtcattca

SEQ ID NO: 90389 - DNA, 20 bp, Artificial
  CRISPR gRNA sequence
tagtgttgctgtgaatatgt

SEQ ID NO: 90390 - DNA, 20 bp, Artificial
  CRISPR gRNA sequence
tatgtgagccattccatatt

SEQ ID NO: 90391 - DNA, 20 bp, Artificial
  CRISPR gRNA sequence
atgtgagccattccatattg

SEQ ID NO: 90392 - DNA, 20 bp, Artificial
  CRISPR gRNA sequence
tgtgagccattccatattga

SEQ ID NO: 90393 - DNA, 20 bp, Artificial
  CRISPR gRNA sequence
ttccatattgagggttcaca

SEQ ID NO: 90394 - DNA, 20 bp, Artificial
  CRISPR gRNA sequence
ttgagggttcacacagtgtc

SEQ ID NO: 90395 - DNA, 20 bp, Artificial
  CRISPR gRNA sequence
ttcacacagtgtccagcaac

SEQ ID NO: 90396 - DNA, 20 bp, Artificial
  CRISPR gRNA sequence
cagtgtccagcaactggcta

SEQ ID NO: 90397 - DNA, 20 bp, Artificial
  CRISPR gRNA sequence
cccattattattgtcattgt

SEQ ID NO: 90398 - DNA, 20 bp, Artificial
  CRISPR gRNA sequence
attattattgtcattgttag

SEQ ID NO: 90399 - DNA, 20 bp, Artificial
  CRISPR gRNA sequence
cattgttagtggtatacttt

SEQ ID NO: 90400 - DNA, 20 bp, Artificial
  CRISPR gRNA sequence
attgttagtggtatactttg

SEQ ID NO: 90401 - DNA, 20 bp, Artificial
  CRISPR gRNA sequence
actttgaggctgtcacaaat

SEQ ID NO: 90402 - DNA, 20 bp, Artificial
  CRISPR gRNA sequence
ttgaggctgtcacaaataag

SEQ ID NO: 90403 - DNA, 20 bp, Artificial
  CRISPR gRNA sequence
aagcagatatttcttcttgt

SEQ ID NO: 90404 - DNA, 20 bp, Artificial
  CRISPR gRNA sequence
gcagatatttcttcttgtga

SEQ ID NO: 90405 - DNA, 20 bp, Artificial
  CRISPR gRNA sequence
gtgagagctatataatccct

SEQ ID NO: 90406 - DNA, 20 bp, Artificial
  CRISPR gRNA sequence
agctatataatcccttagtg

SEQ ID NO: 90407 - DNA, 20 bp, Artificial
  CRISPR gRNA sequence
ctatataatcccttagtgta

SEQ ID NO: 90408 - DNA, 20 bp, Artificial
  CRISPR gRNA sequence
gaaaaatttaattttgttac

SEQ ID NO: 90409 - DNA, 20 bp, Artificial
  CRISPR gRNA sequence
aattttgttacaagtgatcc

SEQ ID NO: 90410 - DNA, 20 bp, Artificial
  CRISPR gRNA sequence
ttgttacaagtgatccaagc

SEQ ID NO: 90411 - DNA, 20 bp, Artificial
  CRISPR gRNA sequence
tgttacaagtgatccaagcc

SEQ ID NO: 90412 - DNA, 20 bp, Artificial
  CRISPR gRNA sequence
caagtgatccaagccaggta

SEQ ID NO: 90413 - DNA, 20 bp, Artificial
  CRISPR gRNA sequence
gtgatccaagccaggtatgg

SEQ ID NO: 90414 - DNA, 20 bp, Artificial
  CRISPR gRNA sequence
tccaagccaggtatggtggc

SEQ ID NO: 90415 - DNA, 20 bp, Artificial
  CRISPR gRNA sequence
gtggcaagtgcctgtatacc

SEQ ID NO: 90416 - DNA, 20 bp, Artificial
  CRISPR gRNA sequence
cctgtatacccagctgtact

SEQ ID NO: 90417 - DNA, 20 bp, Artificial
  CRISPR gRNA sequence
ctgtatacccagctgtactt

SEQ ID NO: 90418 - DNA, 20 bp, Artificial
  CRISPR gRNA sequence
gtatacccagctgtacttgg

SEQ ID NO: 90419 - DNA, 20 bp, Artificial
  CRISPR gRNA sequence
tatacccagctgtacttggg

SEQ ID NO: 90420 - DNA, 20 bp, Artificial
  CRISPR gRNA sequence
atacccagctgtacttggga

SEQ ID NO: 90421 - DNA, 20 bp, Artificial
  CRISPR gRNA sequence
cagctgtacttgggagggtg

SEQ ID NO: 90422 - DNA, 20 bp, Artificial
  CRISPR gRNA sequence
ctgtacttgggagggtgaag

SEQ ID NO: 90423 - DNA, 20 bp, Artificial
  CRISPR gRNA sequence
tgtacttgggagggtgaagt

SEQ ID NO: 90424 - DNA, 20 bp, Artificial
  CRISPR gRNA sequence
acttgggagggtgaagtggg

SEQ ID NO: 90425 - DNA, 20 bp, Artificial
  CRISPR gRNA sequence
gtgaagtgggaagattgctt

SEQ ID NO: 90426 - DNA, 20 bp, Artificial
  CRISPR gRNA sequence
gtgggaagattgcttgagac

SEQ ID NO: 90427 - DNA, 20 bp, Artificial
  CRISPR gRNA sequence
tgggaagattgcttgagacc

SEQ ID NO: 90428 - DNA, 20 bp, Artificial
  CRISPR gRNA sequence
gggaagattgcttgagacca

SEQ ID NO: 90429 - DNA, 20 bp, Artificial
  CRISPR gRNA sequence
ggaagattgcttgagaccag

SEQ ID NO: 90430 - DNA, 20 bp, Artificial
  CRISPR gRNA sequence
ttgcttgagaccaggggttc

SEQ ID NO: 90431 - DNA, 20 bp, Artificial
  CRISPR gRNA sequence
tgcttgagaccaggggttcg

SEQ ID NO: 90432 - DNA, 20 bp, Artificial
  CRISPR gRNA sequence
caggggttcgaggctgccgt

SEQ ID NO: 90433 - DNA, 20 bp, Artificial
  CRISPR gRNA sequence
ttgtttgcatcactgcattc

SEQ ID NO: 90434 - DNA, 20 bp, Artificial
  CRISPR gRNA sequence
tgcatcactgcattccagcc

SEQ ID NO: 90435 - DNA, 20 bp, Artificial
  CRISPR gRNA sequence
gcattccagcctggatgaca

SEQ ID NO: 90436 - DNA, 20 bp, Artificial
  CRISPR gRNA sequence
tccagcctggatgacatagc

SEQ ID NO: 90437 - DNA, 20 bp, Artificial
  CRISPR gRNA sequence
aaaaaattttttttaactgc

SEQ ID NO: 90438 - DNA, 20 bp, Artificial
  CRISPR gRNA sequence
tttttaactgcaagctgtct

SEQ ID NO: 90439 - DNA, 20 bp, Artificial
  CRISPR gRNA sequence
ttttaactgcaagctgtctt

SEQ ID NO: 90440 - DNA, 20 bp, Artificial
  CRISPR gRNA sequence
tttaactgcaagctgtctta

SEQ ID NO: 90441 - DNA, 20 bp, Artificial
  CRISPR gRNA sequence
tgcaagctgtcttagggtcc

SEQ ID NO: 90442 - DNA, 20 bp, Artificial
  CRISPR gRNA sequence
gcaagctgtcttagggtcct

SEQ ID NO: 90443 - DNA, 20 bp, Artificial
  CRISPR gRNA sequence
agggtcctaggatgtattct

SEQ ID NO: 90444 - DNA, 20 bp, Artificial
  CRISPR gRNA sequence
ttctaagtctttaaatttct

SEQ ID NO: 90445 - DNA, 20 bp, Artificial
  CRISPR gRNA sequence
gtctttaaatttcttagttt

SEQ ID NO: 90446 - DNA, 20 bp, Artificial
  CRISPR gRNA sequence
tctttaaatttcttagtttc

SEQ ID NO: 90447 - DNA, 20 bp, Artificial
  CRISPR gRNA sequence
ttagtttcaggctgaacttg

SEQ ID NO: 90448 - DNA, 20 bp, Artificial
  CRISPR gRNA sequence
gtgctccatcactaaaatat

SEQ ID NO: 90449 - DNA, 20 bp, Artificial
  CRISPR gRNA sequence
tgtttacaaatgtaatgttc

SEQ ID NO: 90450 - DNA, 20 bp, Artificial
  CRISPR gRNA sequence
gtttacaaatgtaatgttct

SEQ ID NO: 90451 - DNA, 20 bp, Artificial
  CRISPR gRNA sequence
acaaatgtaatgttctaggc

SEQ ID NO: 90452 - DNA, 20 bp, Artificial
  CRISPR gRNA sequence
caaatgtaatgttctaggcc

SEQ ID NO: 90453 - DNA, 20 bp, Artificial
  CRISPR gRNA sequence
gtaatgttctaggccaggct

SEQ ID NO: 90454 - DNA, 20 bp, Artificial
  CRISPR gRNA sequence
atgttctaggccaggctcag

SEQ ID NO: 90455 - DNA, 20 bp, Artificial
  CRISPR gRNA sequence
gctcagtggctaatacctgt

SEQ ID NO: 90456 - DNA, 20 bp, Artificial
  CRISPR gRNA sequence
gtggctaatacctgtaagcc

SEQ ID NO: 90457 - DNA, 20 bp, Artificial
  CRISPR gRNA sequence
atacctgtaagcccagaact

SEQ ID NO: 90458 - DNA, 20 bp, Artificial
  CRISPR gRNA sequence
tacctgtaagcccagaactt

SEQ ID NO: 90459 - DNA, 20 bp, Artificial
  CRISPR gRNA sequence
acctgtaagcccagaacttg

SEQ ID NO: 90460 - DNA, 20 bp, Artificial
  CRISPR gRNA sequence
ctgtaagcccagaacttggg

SEQ ID NO: 90461 - DNA, 20 bp, Artificial
  CRISPR gRNA sequence
tgtaagcccagaacttgggg

SEQ ID NO: 90462 - DNA, 20 bp, Artificial
  CRISPR gRNA sequence
gcccagaacttggggaggcc

SEQ ID NO: 90463 - DNA, 20 bp, Artificial
  CRISPR gRNA sequence
cccagaacttggggaggcct

SEQ ID NO: 90464 - DNA, 20 bp, Artificial
  CRISPR gRNA sequence
cagaacttggggaggcctag

SEQ ID NO: 90465 - DNA, 20 bp, Artificial
  CRISPR gRNA sequence
agaacttggggaggcctagg

SEQ ID NO: 90466 - DNA, 20 bp, Artificial
  CRISPR gRNA sequence
gaacttggggaggcctagga

SEQ ID NO: 90467 - DNA, 20 bp, Artificial
  CRISPR gRNA sequence
acttggggaggcctaggagg

SEQ ID NO: 90468 - DNA, 20 bp, Artificial
  CRISPR gRNA sequence
cttggggaggcctaggaggg

SEQ ID NO: 90469 - DNA, 20 bp, Artificial
  CRISPR gRNA sequence
cctaggagggaggatcgctt

SEQ ID NO: 90470 - DNA, 20 bp, Artificial
  CRISPR gRNA sequence
gagggaggatcgcttgagcc

SEQ ID NO: 90471 - DNA, 20 bp, Artificial
  CRISPR gRNA sequence
ggaggatcgcttgagcccgg

SEQ ID NO: 90472 - DNA, 20 bp, Artificial
  CRISPR gRNA sequence
tcgcttgagcccggaagttt

SEQ ID NO: 90473 - DNA, 20 bp, Artificial
  CRISPR gRNA sequence
tgagcccggaagtttgagac

SEQ ID NO: 90474 - DNA, 20 bp, Artificial
  CRISPR gRNA sequence
ccggaagtttgagaccagcc

SEQ ID NO: 90475 - DNA, 20 bp, Artificial
  CRISPR gRNA sequence
cggaagtttgagaccagcct

SEQ ID NO: 90476 - DNA, 20 bp, Artificial
  CRISPR gRNA sequence
tgagaccagcctgggtaaca

SEQ ID NO: 90477 - DNA, 20 bp, Artificial
  CRISPR gRNA sequence
gagaccagcctgggtaacat

SEQ ID NO: 90478 - DNA, 20 bp, Artificial
  CRISPR gRNA sequence
agaccagcctgggtaacata

SEQ ID NO: 90479 - DNA, 20 bp, Artificial
  CRISPR gRNA sequence
accagcctgggtaacatagg

SEQ ID NO: 90480 - DNA, 20 bp, Artificial
  CRISPR gRNA sequence
aacaaaaaaattttaaaaat

SEQ ID NO: 90481 - DNA, 20 bp, Artificial
  CRISPR gRNA sequence
aaaaaattttaaaaattagc

SEQ ID NO: 90482 - DNA, 20 bp, Artificial
  CRISPR gRNA sequence
aaaaattttaaaaattagcc

SEQ ID NO: 90483 - DNA, 20 bp, Artificial
  CRISPR gRNA sequence
taaaaattagccaggtatgt

SEQ ID NO: 90484 - DNA, 20 bp, Artificial
  CRISPR gRNA sequence
ggtatgttggcacatgcctg

SEQ ID NO: 90485 - DNA, 20 bp, Artificial
  CRISPR gRNA sequence
ttggcacatgcctgtggtcc

SEQ ID NO: 90486 - DNA, 20 bp, Artificial
  CRISPR gRNA sequence
tgcctgtggtcctagctact

SEQ ID NO: 90487 - DNA, 20 bp, Artificial
  CRISPR gRNA sequence
gcctgtggtcctagctactc

SEQ ID NO: 90488 - DNA, 20 bp, Artificial
  CRISPR gRNA sequence
ctgtggtcctagctactcgg

SEQ ID NO: 90489 - DNA, 20 bp, Artificial
  CRISPR gRNA sequence
tgtggtcctagctactcggg

SEQ ID NO: 90490 - DNA, 20 bp, Artificial
  CRISPR gRNA sequence
tcctagctactcgggaggct

SEQ ID NO: 90491 - DNA, 20 bp, Artificial
  CRISPR gRNA sequence
cctagctactcgggaggctg

SEQ ID NO: 90492 - DNA, 20 bp, Artificial
  CRISPR gRNA sequence
agctactcgggaggctgagg

SEQ ID NO: 90493 - DNA, 20 bp, Artificial
  CRISPR gRNA sequence
tactcgggaggctgaggtgg

SEQ ID NO: 90494 - DNA, 20 bp, Artificial
  CRISPR gRNA sequence
actcgggaggctgaggtgga

SEQ ID NO: 90495 - DNA, 20 bp, Artificial
  CRISPR gRNA sequence
gctgaggtggaaggatcatt

SEQ ID NO: 90496 - DNA, 20 bp, Artificial
  CRISPR gRNA sequence
ggtggaaggatcattgagcc

SEQ ID NO: 90497 - DNA, 20 bp, Artificial
  CRISPR gRNA sequence
gtggaaggatcattgagccc

SEQ ID NO: 90498 - DNA, 20 bp, Artificial
  CRISPR gRNA sequence
ggaaggatcattgagcccag

SEQ ID NO: 90499 - DNA, 20 bp, Artificial
  CRISPR gRNA sequence
atcattgagcccaggagatt

SEQ ID NO: 90500 - DNA, 20 bp, Artificial
  CRISPR gRNA sequence
tcattgagcccaggagattg

SEQ ID NO: 90501 - DNA, 20 bp, Artificial
  CRISPR gRNA sequence
agcccaggagattgaggctg

SEQ ID NO: 90502 - DNA, 20 bp, Artificial
  CRISPR gRNA sequence
caggagattgaggctgcagt

SEQ ID NO: 90503 - DNA, 20 bp, Artificial
  CRISPR gRNA sequence
attgaggctgcagtgagcca

SEQ ID NO: 90504 - DNA, 20 bp, Artificial
  CRISPR gRNA sequence
atggttgtgctacttcactc

SEQ ID NO: 90505 - DNA, 20 bp, Artificial
  CRISPR gRNA sequence
tgtgctacttcactccagcc

SEQ ID NO: 90506 - DNA, 20 bp, Artificial
  CRISPR gRNA sequence
gtgctacttcactccagcct

SEQ ID NO: 90507 - DNA, 20 bp, Artificial
  CRISPR gRNA sequence
cttcactccagcctgggtga

SEQ ID NO: 90508 - DNA, 20 bp, Artificial
  CRISPR gRNA sequence
tcactccagcctgggtgaca

SEQ ID NO: 90509 - DNA, 20 bp, Artificial
  CRISPR gRNA sequence
tccagcctgggtgacagagc

SEQ ID NO: 90510 - DNA, 20 bp, Artificial
  CRISPR gRNA sequence
gactttgtctcaaaaacaaa

SEQ ID NO: 90511 - DNA, 20 bp, Artificial
  CRISPR gRNA sequence
ctaaatatttctaaaatttg

SEQ ID NO: 90512 - DNA, 20 bp, Artificial
  CRISPR gRNA sequence
tttctaaaatttgcagttgc

SEQ ID NO: 90513 - DNA, 20 bp, Artificial
  CRISPR gRNA sequence
gtgtcatacttaattcacac

SEQ ID NO: 90514 - DNA, 20 bp, Artificial
  CRISPR gRNA sequence
catacttaattcacactggt

SEQ ID NO: 90515 - DNA, 20 bp, Artificial
  CRISPR gRNA sequence
atacttaattcacactggtt

SEQ ID NO: 90516 - DNA, 20 bp, Artificial
  CRISPR gRNA sequence
aattcacactggttaggact

SEQ ID NO: 90517 - DNA, 20 bp, Artificial
  CRISPR gRNA sequence
gagtgacttctctttccctt

SEQ ID NO: 90518 - DNA, 20 bp, Artificial
  CRISPR gRNA sequence
tcccttaagttttactcttt

SEQ ID NO: 90519 - DNA, 20 bp, Artificial
  CRISPR gRNA sequence
ccttaagttttactcttttg

SEQ ID NO: 90520 - DNA, 20 bp, Artificial
  CRISPR gRNA sequence
aagttttactcttttggagt

SEQ ID NO: 90521 - DNA, 20 bp, Artificial
  CRISPR gRNA sequence
gttttactcttttggagtaa

SEQ ID NO: 90522 - DNA, 20 bp, Artificial
  CRISPR gRNA sequence
ttttactcttttggagtaag

SEQ ID NO: 90523 - DNA, 20 bp, Artificial
  CRISPR gRNA sequence
tggagtaagaggacttcttt

SEQ ID NO: 90524 - DNA, 20 bp, Artificial
  CRISPR gRNA sequence
ggagtaagaggacttctttg

SEQ ID NO: 90525 - DNA, 20 bp, Artificial
  CRISPR gRNA sequence
gagtaagaggacttctttga

SEQ ID NO: 90526 - DNA, 20 bp, Artificial
  CRISPR gRNA sequence
agaggacttctttgagggtc

SEQ ID NO: 90527 - DNA, 20 bp, Artificial
  CRISPR gRNA sequence
gagggtctggtgacttaatg

SEQ ID NO: 90528 - DNA, 20 bp, Artificial
  CRISPR gRNA sequence
gacttaatgaagactcttcc

SEQ ID NO: 90529 - DNA, 20 bp, Artificial
  CRISPR gRNA sequence
taattttgcatactaattaa

SEQ ID NO: 90530 - DNA, 20 bp, Artificial
  CRISPR gRNA sequence
aattttgcatactaattaat

SEQ ID NO: 90531 - DNA, 20 bp, Artificial
  CRISPR gRNA sequence
tgcatactaattaatgggct

SEQ ID NO: 90532 - DNA, 20 bp, Artificial
  CRISPR gRNA sequence
gcatactaattaatgggctc

SEQ ID NO: 90533 - DNA, 20 bp, Artificial
  CRISPR gRNA sequence
gctcaggacttctgtaatct

SEQ ID NO: 90534 - DNA, 20 bp, Artificial
  CRISPR gRNA sequence
cccctcaatccatattctta

SEQ ID NO: 90535 - DNA, 20 bp, Artificial
  CRISPR gRNA sequence
ttttaccaaatctctgatta

SEQ ID NO: 90536 - DNA, 20 bp, Artificial
  CRISPR gRNA sequence
tttaccaaatctctgattac

SEQ ID NO: 90537 - DNA, 20 bp, Artificial
  CRISPR gRNA sequence
ttaccaaatctctgattacg

SEQ ID NO: 90538 - DNA, 20 bp, Artificial
  CRISPR gRNA sequence
aatctctgattacggggatt

SEQ ID NO: 90539 - DNA, 20 bp, Artificial
  CRISPR gRNA sequence
atctctgattacggggattt

SEQ ID NO: 90540 - DNA, 20 bp, Artificial
  CRISPR gRNA sequence
tctctgattacggggattta

SEQ ID NO: 90541 - DNA, 20 bp, Artificial
  CRISPR gRNA sequence
ttacggggatttagggaaat

SEQ ID NO: 90542 - DNA, 20 bp, Artificial
  CRISPR gRNA sequence
gatttagggaaataagcatc

SEQ ID NO: 90543 - DNA, 20 bp, Artificial
  CRISPR gRNA sequence
agggaaataagcatctggaa

SEQ ID NO: 90544 - DNA, 20 bp, Artificial
  CRISPR gRNA sequence
aagcatctggaaaagaatga

SEQ ID NO: 90545 - DNA, 20 bp, Artificial
  CRISPR gRNA sequence
atctggaaaagaatgaaagt

SEQ ID NO: 90546 - DNA, 20 bp, Artificial
  CRISPR gRNA sequence
gaaaagaatgaaagttagta

SEQ ID NO: 90547 - DNA, 20 bp, Artificial
  CRISPR gRNA sequence
aaaagaatgaaagttagtaa

SEQ ID NO: 90548 - DNA, 20 bp, Artificial
  CRISPR gRNA sequence
gaaagttagtaaaggtgatc

SEQ ID NO: 90549 - DNA, 20 bp, Artificial
  CRISPR gRNA sequence
aggtgatcaagtttcttcct

SEQ ID NO: 90550 - DNA, 20 bp, Artificial
  CRISPR gRNA sequence
ttcttcctcagtatgttcca

SEQ ID NO: 90551 - DNA, 20 bp, Artificial
  CRISPR gRNA sequence
tcttcctcagtatgttccac

SEQ ID NO: 90552 - DNA, 20 bp, Artificial
  CRISPR gRNA sequence
ccacaggtgcccattcactt

SEQ ID NO: 90553 - DNA, 20 bp, Artificial
  CRISPR gRNA sequence
ccattcacttcagaattctt

SEQ ID NO: 90554 - DNA, 20 bp, Artificial
  CRISPR gRNA sequence
attcacttcagaattcttta

SEQ ID NO: 90555 - DNA, 20 bp, Artificial
  CRISPR gRNA sequence
tcacttcagaattctttaga

SEQ ID NO: 90556 - DNA, 20 bp, Artificial
  CRISPR gRNA sequence
cacttcagaattctttagag

SEQ ID NO: 90557 - DNA, 20 bp, Artificial
  CRISPR gRNA sequence
acttcagaattctttagaga

SEQ ID NO: 90558 - DNA, 20 bp, Artificial
  CRISPR gRNA sequence
ttcagaattctttagagagg

SEQ ID NO: 90559 - DNA, 20 bp, Artificial
  CRISPR gRNA sequence
tttctttctttttttttttt

SEQ ID NO: 90560 - DNA, 20 bp, Artificial
  CRISPR gRNA sequence
tttcttttttttttttgaga

SEQ ID NO: 90561 - DNA, 20 bp, Artificial
  CRISPR gRNA sequence
tcttttttttttttgagaca

SEQ ID NO: 90562 - DNA, 20 bp, Artificial
  CRISPR gRNA sequence
gagtcttactctgtgtcgct

SEQ ID NO: 90563 - DNA, 20 bp, Artificial
  CRISPR gRNA sequence
agtcttactctgtgtcgctc

SEQ ID NO: 90564 - DNA, 20 bp, Artificial
  CRISPR gRNA sequence
ttactctgtgtcgctcaggc

SEQ ID NO: 90565 - DNA, 20 bp, Artificial
  CRISPR gRNA sequence
actctgtgtcgctcaggctg

SEQ ID NO: 90566 - DNA, 20 bp, Artificial
  CRISPR gRNA sequence
gtgtcgctcaggctggagtg

SEQ ID NO: 90567 - DNA, 20 bp, Artificial
  CRISPR gRNA sequence
tcgctcaggctggagtgcag

SEQ ID NO: 90568 - DNA, 20 bp, Artificial
  CRISPR gRNA sequence
ggagtgcagtggtgcgatct

SEQ ID NO: 90569 - DNA, 20 bp, Artificial
  CRISPR gRNA sequence
ccactacaacctccacctcc

SEQ ID NO: 90570 - DNA, 20 bp, Artificial
  CRISPR gRNA sequence
cactacaacctccacctcct

SEQ ID NO: 90571 - DNA, 20 bp, Artificial
  CRISPR gRNA sequence
aacctccacctcctgggttc

SEQ ID NO: 90572 - DNA, 20 bp, Artificial
  CRISPR gRNA sequence
ctccacctcctgggttcaag

SEQ ID NO: 90573 - DNA, 20 bp, Artificial
  CRISPR gRNA sequence
ttcaagcagttcttgtgcct

SEQ ID NO: 90574 - DNA, 20 bp, Artificial
  CRISPR gRNA sequence
ttcttgtgcctcagcctcct

SEQ ID NO: 90575 - DNA, 20 bp, Artificial
  CRISPR gRNA sequence
ttgtgcctcagcctcctgag

SEQ ID NO: 90576 - DNA, 20 bp, Artificial
  CRISPR gRNA sequence
gcctcagcctcctgagtagc

SEQ ID NO: 90577 - DNA, 20 bp, Artificial
  CRISPR gRNA sequence
cctcagcctcctgagtagct

SEQ ID NO: 90578 - DNA, 20 bp, Artificial
  CRISPR gRNA sequence
ctcctgagtagctgggatta

SEQ ID NO: 90579 - DNA, 20 bp, Artificial
  CRISPR gRNA sequence
tcctgagtagctgggattac

SEQ ID NO: 90580 - DNA, 20 bp, Artificial
  CRISPR gRNA sequence
caggcatgcaccaccacgcc

SEQ ID NO: 90581 - DNA, 20 bp, Artificial
  CRISPR gRNA sequence
ccggctaatttttgtatttt

SEQ ID NO: 90582 - DNA, 20 bp, Artificial
  CRISPR gRNA sequence
gctaatttttgtatttttag

SEQ ID NO: 90583 - DNA, 20 bp, Artificial
  CRISPR gRNA sequence
taatttttgtatttttagta

SEQ ID NO: 90584 - DNA, 20 bp, Artificial
  CRISPR gRNA sequence
ttgtatttttagtagagacg

SEQ ID NO: 90585 - DNA, 20 bp, Artificial
  CRISPR gRNA sequence
gagacgcggttttgccatgt

SEQ ID NO: 90586 - DNA, 20 bp, Artificial
  CRISPR gRNA sequence
cgcggttttgccatgttggc

SEQ ID NO: 90587 - DNA, 20 bp, Artificial
  CRISPR gRNA sequence
ttttgccatgttggccagtc

SEQ ID NO: 90588 - DNA, 20 bp, Artificial
  CRISPR gRNA sequence
aactcctgatcctcccacct

SEQ ID NO: 90589 - DNA, 20 bp, Artificial
  CRISPR gRNA sequence
cctcccacctcagcctcctg

SEQ ID NO: 90590 - DNA, 20 bp, Artificial
  CRISPR gRNA sequence
acctcagcctcctgaagtgc

SEQ ID NO: 90591 - DNA, 20 bp, Artificial
  CRISPR gRNA sequence
cctcagcctcctgaagtgct

SEQ ID NO: 90592 - DNA, 20 bp, Artificial
  CRISPR gRNA sequence
ctcctgaagtgctgggatta

SEQ ID NO: 90593 - DNA, 20 bp, Artificial
  CRISPR gRNA sequence
tcctgaagtgctgggattac

SEQ ID NO: 90594 - DNA, 20 bp, Artificial
  CRISPR gRNA sequence
gaagtgctgggattacgggt

SEQ ID NO: 90595 - DNA, 20 bp, Artificial
  CRISPR gRNA sequence
acgggtgagacccaccacgc

SEQ ID NO: 90596 - DNA, 20 bp, Artificial
  CRISPR gRNA sequence
gcctaataatacttattttc

SEQ ID NO: 90597 - DNA, 20 bp, Artificial
  CRISPR gRNA sequence
aataatacttattttcaaga

SEQ ID NO: 90598 - DNA, 20 bp, Artificial
  CRISPR gRNA sequence
aatacttattttcaagaaag

SEQ ID NO: 90599 - DNA, 20 bp, Artificial
  CRISPR gRNA sequence
acttattttcaagaaagaag

SEQ ID NO: 90600 - DNA, 20 bp, Artificial
  CRISPR gRNA sequence
agaaagaagtagttaaccta

SEQ ID NO: 90601 - DNA, 20 bp, Artificial
  CRISPR gRNA sequence
ctacctaacatttacatcta

SEQ ID NO: 90602 - DNA, 20 bp, Artificial
  CRISPR gRNA sequence
ctaacatttacatctacagt

SEQ ID NO: 90603 - DNA, 20 bp, Artificial
  CRISPR gRNA sequence
taacatttacatctacagtg

SEQ ID NO: 90604 - DNA, 20 bp, Artificial
  CRISPR gRNA sequence
acagtgaggaaaatgtataa

SEQ ID NO: 90605 - DNA, 20 bp, Artificial
  CRISPR gRNA sequence
cagtgaggaaaatgtataaa

SEQ ID NO: 90606 - DNA, 20 bp, Artificial
  CRISPR gRNA sequence
tgaggaaaatgtataaaagg

SEQ ID NO: 90607 - DNA, 20 bp, Artificial
  CRISPR gRNA sequence
gaaaatgtataaaaggcaga

SEQ ID NO: 90608 - DNA, 20 bp, Artificial
  CRISPR gRNA sequence
aaggcagatagatactgaat

SEQ ID NO: 90609 - DNA, 20 bp, Artificial
  CRISPR gRNA sequence
ccctctgcacctcccacaaa

SEQ ID NO: 90610 - DNA, 20 bp, Artificial
  CRISPR gRNA sequence
tatttacttatctaattttt

SEQ ID NO: 90611 - DNA, 20 bp, Artificial
  CRISPR gRNA sequence
tttacttatctaatttttta

SEQ ID NO: 90612 - DNA, 20 bp, Artificial
  CRISPR gRNA sequence
cttatctaattttttagaga

SEQ ID NO: 90613 - DNA, 20 bp, Artificial
  CRISPR gRNA sequence
ttatctaattttttagagat

SEQ ID NO: 90614 - DNA, 20 bp, Artificial
  CRISPR gRNA sequence
ttttttagagatgggtctca

SEQ ID NO: 90615 - DNA, 20 bp, Artificial
  CRISPR gRNA sequence
atgggtctcacagtgttgcc

SEQ ID NO: 90616 - DNA, 20 bp, Artificial
  CRISPR gRNA sequence
tgggtctcacagtgttgccc

SEQ ID NO: 90617 - DNA, 20 bp, Artificial
  CRISPR gRNA sequence
tctcacagtgttgcccaggc

SEQ ID NO: 90618 - DNA, 20 bp, Artificial
  CRISPR gRNA sequence
ccaggctggcctcgaattcc

SEQ ID NO: 90619 - DNA, 20 bp, Artificial
  CRISPR gRNA sequence
caggctggcctcgaattcct

SEQ ID NO: 90620 - DNA, 20 bp, Artificial
  CRISPR gRNA sequence
ggcctcgaattcctgggctc

SEQ ID NO: 90621 - DNA, 20 bp, Artificial
  CRISPR gRNA sequence
ctcaagtgatcctcctgcct

SEQ ID NO: 90622 - DNA, 20 bp, Artificial
  CRISPR gRNA sequence
gatcctcctgcctcagcctt

SEQ ID NO: 90623 - DNA, 20 bp, Artificial
  CRISPR gRNA sequence
tcctcctgcctcagccttca

SEQ ID NO: 90624 - DNA, 20 bp, Artificial
  CRISPR gRNA sequence
gcctcagccttcagagtaac

SEQ ID NO: 90625 - DNA, 20 bp, Artificial
  CRISPR gRNA sequence
cctcagccttcagagtaact

SEQ ID NO: 90626 - DNA, 20 bp, Artificial
  CRISPR gRNA sequence
gattatttcaccactgcacc

SEQ ID NO: 90627 - DNA, 20 bp, Artificial
  CRISPR gRNA sequence
ataatttgcatgacttttta

SEQ ID NO: 90628 - DNA, 20 bp, Artificial
  CRISPR gRNA sequence
atttgcatgactttttatgg

SEQ ID NO: 90629 - DNA, 20 bp, Artificial
  CRISPR gRNA sequence
tttgcatgactttttatgga

SEQ ID NO: 90630 - DNA, 20 bp, Artificial
  CRISPR gRNA sequence
ttgcatgactttttatggaa

SEQ ID NO: 90631 - DNA, 20 bp, Artificial
  CRISPR gRNA sequence
ggaagggaattaattgctat

SEQ ID NO: 90632 - DNA, 20 bp, Artificial
  CRISPR gRNA sequence
taagcaacaaataatactaa

SEQ ID NO: 90633 - DNA, 20 bp, Artificial
  CRISPR gRNA sequence
aatactaatagtttactatc

SEQ ID NO: 90634 - DNA, 20 bp, Artificial
  CRISPR gRNA sequence
atccagtttgtcttatattt

SEQ ID NO: 90635 - DNA, 20 bp, Artificial
  CRISPR gRNA sequence
tccagtttgtcttatatttt

SEQ ID NO: 90636 - DNA, 20 bp, Artificial
  CRISPR gRNA sequence
tatattttgggatactttat

SEQ ID NO: 90637 - DNA, 20 bp, Artificial
  CRISPR gRNA sequence
tgggatactttatcagttct

SEQ ID NO: 90638 - DNA, 20 bp, Artificial
  CRISPR gRNA sequence
gggatactttatcagttctg

SEQ ID NO: 90639 - DNA, 20 bp, Artificial
  CRISPR gRNA sequence
gatactttatcagttctgag

SEQ ID NO: 90640 - DNA, 20 bp, Artificial
  CRISPR gRNA sequence
atactttatcagttctgagg

SEQ ID NO: 90641 - DNA, 20 bp, Artificial
  CRISPR gRNA sequence
atcagttctgaggaggtaac

SEQ ID NO: 90642 - DNA, 20 bp, Artificial
  CRISPR gRNA sequence
atctttatctttgttaaact

SEQ ID NO: 90643 - DNA, 20 bp, Artificial
  CRISPR gRNA sequence
tctttgttaaactgagtgta

SEQ ID NO: 90644 - DNA, 20 bp, Artificial
  CRISPR gRNA sequence
actgagtgtaaagaaaataa

SEQ ID NO: 90645 - DNA, 20 bp, Artificial
  CRISPR gRNA sequence
tgtaaagaaaataacagtgc

SEQ ID NO: 90646 - DNA, 20 bp, Artificial
  CRISPR gRNA sequence
aagaaaataacagtgccagc

SEQ ID NO: 90647 - DNA, 20 bp, Artificial
  CRISPR gRNA sequence
agaaaataacagtgccagcc

SEQ ID NO: 90648 - DNA, 20 bp, Artificial
  CRISPR gRNA sequence
agtgccagccaggatataat

SEQ ID NO: 90649 - DNA, 20 bp, Artificial
  CRISPR gRNA sequence
tgccagccaggatataataa

SEQ ID NO: 90650 - DNA, 20 bp, Artificial
  CRISPR gRNA sequence
tataataagagccaactgta

SEQ ID NO: 90651 - DNA, 20 bp, Artificial
  CRISPR gRNA sequence
taagagccaactgtatagtc

SEQ ID NO: 90652 - DNA, 20 bp, Artificial
  CRISPR gRNA sequence
ccaactgtatagtccggttt

SEQ ID NO: 90653 - DNA, 20 bp, Artificial
  CRISPR gRNA sequence
actgtatagtccggttttag

SEQ ID NO: 90654 - DNA, 20 bp, Artificial
  CRISPR gRNA sequence
atagtccggttttagtagtt

SEQ ID NO: 90655 - DNA, 20 bp, Artificial
  CRISPR gRNA sequence
agtccggttttagtagttca

SEQ ID NO: 90656 - DNA, 20 bp, Artificial
  CRISPR gRNA sequence
gtccggttttagtagttcag

SEQ ID NO: 90657 - DNA, 20 bp, Artificial
  CRISPR gRNA sequence
ccggttttagtagttcagag

SEQ ID NO: 90658 - DNA, 20 bp, Artificial
  CRISPR gRNA sequence
cggttttagtagttcagagg

SEQ ID NO: 90659 - DNA, 20 bp, Artificial
  CRISPR gRNA sequence
tttagtagttcagaggagga

SEQ ID NO: 90660 - DNA, 20 bp, Artificial
  CRISPR gRNA sequence
cagaggaggatagatcattg

SEQ ID NO: 90661 - DNA, 20 bp, Artificial
  CRISPR gRNA sequence
agaggaggatagatcattgt

SEQ ID NO: 90662 - DNA, 20 bp, Artificial
  CRISPR gRNA sequence
aggatagatcattgtaggct

SEQ ID NO: 90663 - DNA, 20 bp, Artificial
  CRISPR gRNA sequence
cattgtaggctgagatactc

SEQ ID NO: 90664 - DNA, 20 bp, Artificial
  CRISPR gRNA sequence
gtaggctgagatactccaga

SEQ ID NO: 90665 - DNA, 20 bp, Artificial
  CRISPR gRNA sequence
taggctgagatactccagaa

SEQ ID NO: 90666 - DNA, 20 bp, Artificial
  CRISPR gRNA sequence
gatactccagaaaggctttg

SEQ ID NO: 90667 - DNA, 20 bp, Artificial
  CRISPR gRNA sequence
tactccagaaaggctttgca

SEQ ID NO: 90668 - DNA, 20 bp, Artificial
  CRISPR gRNA sequence
actccagaaaggctttgcag

SEQ ID NO: 90669 - DNA, 20 bp, Artificial
  CRISPR gRNA sequence
tttgcagaggaaacgtgact

SEQ ID NO: 90670 - DNA, 20 bp, Artificial
  CRISPR gRNA sequence
aaacgtgactcagtataaac

SEQ ID NO: 90671 - DNA, 20 bp, Artificial
  CRISPR gRNA sequence
gtgactcagtataaaccaga

SEQ ID NO: 90672 - DNA, 20 bp, Artificial
  CRISPR gRNA sequence
tgactcagtataaaccagaa

SEQ ID NO: 90673 - DNA, 20 bp, Artificial
  CRISPR gRNA sequence
tcagtataaaccagaaagga

SEQ ID NO: 90674 - DNA, 20 bp, Artificial
  CRISPR gRNA sequence
cagtataaaccagaaaggat

SEQ ID NO: 90675 - DNA, 20 bp, Artificial
  CRISPR gRNA sequence
aaaccagaaaggatgggcaa

SEQ ID NO: 90676 - DNA, 20 bp, Artificial
  CRISPR gRNA sequence
ggcaatagtttacgcttaat

SEQ ID NO: 90677 - DNA, 20 bp, Artificial
  CRISPR gRNA sequence
tagtttacgcttaatgagct

SEQ ID NO: 90678 - DNA, 20 bp, Artificial
  CRISPR gRNA sequence
agctgagtttcttatgtgtc

SEQ ID NO: 90679 - DNA, 20 bp, Artificial
  CRISPR gRNA sequence
tatgtgtcaagcactgtgtt

SEQ ID NO: 90680 - DNA, 20 bp, Artificial
  CRISPR gRNA sequence
gcactgtgttaagctataaa

SEQ ID NO: 90681 - DNA, 20 bp, Artificial
  CRISPR gRNA sequence
actgtgttaagctataaatg

SEQ ID NO: 90682 - DNA, 20 bp, Artificial
  CRISPR gRNA sequence
aatggagtctcacaaccctt

SEQ ID NO: 90683 - DNA, 20 bp, Artificial
  CRISPR gRNA sequence
gtctcacaacccttcagcaa

SEQ ID NO: 90684 - DNA, 20 bp, Artificial
  CRISPR gRNA sequence
tctcacaacccttcagcaat

SEQ ID NO: 90685 - DNA, 20 bp, Artificial
  CRISPR gRNA sequence
acaacccttcagcaatggga

SEQ ID NO: 90686 - DNA, 20 bp, Artificial
  CRISPR gRNA sequence
gatactatattttacataca

SEQ ID NO: 90687 - DNA, 20 bp, Artificial
  CRISPR gRNA sequence
attttacatacatggaaact

SEQ ID NO: 90688 - DNA, 20 bp, Artificial
  CRISPR gRNA sequence
ttttacatacatggaaactg

SEQ ID NO: 90689 - DNA, 20 bp, Artificial
  CRISPR gRNA sequence
catacatggaaactgaggca

SEQ ID NO: 90690 - DNA, 20 bp, Artificial
  CRISPR gRNA sequence
tacatggaaactgaggcaca

SEQ ID NO: 90691 - DNA, 20 bp, Artificial
  CRISPR gRNA sequence
catggaaactgaggcacaga

SEQ ID NO: 90692 - DNA, 20 bp, Artificial
  CRISPR gRNA sequence
atggaaactgaggcacagag

SEQ ID NO: 90693 - DNA, 20 bp, Artificial
  CRISPR gRNA sequence
actgaggcacagagaggcta

SEQ ID NO: 90694 - DNA, 20 bp, Artificial
  CRISPR gRNA sequence
cacagagaggctaaagaatt

SEQ ID NO: 90695 - DNA, 20 bp, Artificial
  CRISPR gRNA sequence
agaggctaaagaatttggcc

SEQ ID NO: 90696 - DNA, 20 bp, Artificial
  CRISPR gRNA sequence
gaggctaaagaatttggcct

SEQ ID NO: 90697 - DNA, 20 bp, Artificial
  CRISPR gRNA sequence
agaatttggcctaggtcata

SEQ ID NO: 90698 - DNA, 20 bp, Artificial
  CRISPR gRNA sequence
tttggcctaggtcatacagc

SEQ ID NO: 90699 - DNA, 20 bp, Artificial
  CRISPR gRNA sequence
gcctaggtcatacagccagc

SEQ ID NO: 90700 - DNA, 20 bp, Artificial
  CRISPR gRNA sequence
caagtattgtactcaaacgc

SEQ ID NO: 90701 - DNA, 20 bp, Artificial
  CRISPR gRNA sequence
gtattgtactcaaacgcaag

SEQ ID NO: 90702 - DNA, 20 bp, Artificial
  CRISPR gRNA sequence
aaacgcaagcagtcttattc

SEQ ID NO: 90703 - DNA, 20 bp, Artificial
  CRISPR gRNA sequence
acgcaagcagtcttattcta

SEQ ID NO: 90704 - DNA, 20 bp, Artificial
  CRISPR gRNA sequence
tccttactatactgcttccc

SEQ ID NO: 90705 - DNA, 20 bp, Artificial
  CRISPR gRNA sequence
atactgcttccctagaattc

SEQ ID NO: 90706 - DNA, 20 bp, Artificial
  CRISPR gRNA sequence
ctgcttccctagaattctgg

SEQ ID NO: 90707 - DNA, 20 bp, Artificial
  CRISPR gRNA sequence
cctagaattctggtagataa

SEQ ID NO: 90708 - DNA, 20 bp, Artificial
  CRISPR gRNA sequence
ctagaattctggtagataaa

SEQ ID NO: 90709 - DNA, 20 bp, Artificial
  CRISPR gRNA sequence
aattctggtagataaaagga

SEQ ID NO: 90710 - DNA, 20 bp, Artificial
  CRISPR gRNA sequence
ttctggtagataaaaggaaa

SEQ ID NO: 90711 - DNA, 20 bp, Artificial
  CRISPR gRNA sequence
tggtagataaaaggaaagag

SEQ ID NO: 90712 - DNA, 20 bp, Artificial
  CRISPR gRNA sequence
aaggaaagagaagcacattt

SEQ ID NO: 90713 - DNA, 20 bp, Artificial
  CRISPR gRNA sequence
aagagaagcacattttagta

SEQ ID NO: 90714 - DNA, 20 bp, Artificial
  CRISPR gRNA sequence
gaagcacattttagtaaaga

SEQ ID NO: 90715 - DNA, 20 bp, Artificial
  CRISPR gRNA sequence
agcacattttagtaaagaaa

SEQ ID NO: 90716 - DNA, 20 bp, Artificial
  CRISPR gRNA sequence
acattttagtaaagaaagag

SEQ ID NO: 90717 - DNA, 20 bp, Artificial
  CRISPR gRNA sequence
ttttagtaaagaaagagaag

SEQ ID NO: 90718 - DNA, 20 bp, Artificial
  CRISPR gRNA sequence
tttagtaaagaaagagaagt

SEQ ID NO: 90719 - DNA, 20 bp, Artificial
  CRISPR gRNA sequence
aagaaagagaagtaggaata

SEQ ID NO: 90720 - DNA, 20 bp, Artificial
  CRISPR gRNA sequence
atacagaaaacacttttgtg

SEQ ID NO: 90721 - DNA, 20 bp, Artificial
  CRISPR gRNA sequence
agaaaacacttttgtgaaga

SEQ ID NO: 90722 - DNA, 20 bp, Artificial
  CRISPR gRNA sequence
aacacttttgtgaagatagc

SEQ ID NO: 90723 - DNA, 20 bp, Artificial
  CRISPR gRNA sequence
acttttgtgaagatagcaag

SEQ ID NO: 90724 - DNA, 20 bp, Artificial
  CRISPR gRNA sequence
agatagcaagtggactattc

SEQ ID NO: 90725 - DNA, 20 bp, Artificial
  CRISPR gRNA sequence
gtggactattctagctaaaa

SEQ ID NO: 90726 - DNA, 20 bp, Artificial
  CRISPR gRNA sequence
ctattctagctaaaatagtt

SEQ ID NO: 90727 - DNA, 20 bp, Artificial
  CRISPR gRNA sequence
ttctagctaaaatagttgag

SEQ ID NO: 90728 - DNA, 20 bp, Artificial
  CRISPR gRNA sequence
tagttgagtggaaaattcat

SEQ ID NO: 90729 - DNA, 20 bp, Artificial
  CRISPR gRNA sequence
gttgagtggaaaattcatga

SEQ ID NO: 90730 - DNA, 20 bp, Artificial
  CRISPR gRNA sequence
tgagtggaaaattcatgaga

SEQ ID NO: 90731 - DNA, 20 bp, Artificial
  CRISPR gRNA sequence
aaattcatgagagagaaatt

SEQ ID NO: 90732 - DNA, 20 bp, Artificial
  CRISPR gRNA sequence
tcatgagagagaaatttgga

SEQ ID NO: 90733 - DNA, 20 bp, Artificial
  CRISPR gRNA sequence
gagagagaaatttggaaaga

SEQ ID NO: 90734 - DNA, 20 bp, Artificial
  CRISPR gRNA sequence
agagagaaatttggaaagat

SEQ ID NO: 90735 - DNA, 20 bp, Artificial
  CRISPR gRNA sequence
aaatttggaaagataggttg

SEQ ID NO: 90736 - DNA, 20 bp, Artificial
  CRISPR gRNA sequence
ttggaaagataggttgaagc

SEQ ID NO: 90737 - DNA, 20 bp, Artificial
  CRISPR gRNA sequence
aggttgaagccagtttttta

SEQ ID NO: 90738 - DNA, 20 bp, Artificial
  CRISPR gRNA sequence
ttttttatagtattgaatgc

SEQ ID NO: 90739 - DNA, 20 bp, Artificial
  CRISPR gRNA sequence
tttttatagtattgaatgcc

SEQ ID NO: 90740 - DNA, 20 bp, Artificial
  CRISPR gRNA sequence
tagtattgaatgccaggcta

SEQ ID NO: 90741 - DNA, 20 bp, Artificial
  CRISPR gRNA sequence
agtattgaatgccaggctat

SEQ ID NO: 90742 - DNA, 20 bp, Artificial
  CRISPR gRNA sequence
gaatgccaggctatgggatt

SEQ ID NO: 90743 - DNA, 20 bp, Artificial
  CRISPR gRNA sequence
caggctatgggatttggatt

SEQ ID NO: 90744 - DNA, 20 bp, Artificial
  CRISPR gRNA sequence
ggctatgggatttggatttg

SEQ ID NO: 90745 - DNA, 20 bp, Artificial
  CRISPR gRNA sequence
tttaaatgaaatgatctaat

SEQ ID NO: 90746 - DNA, 20 bp, Artificial
  CRISPR gRNA sequence
ttaaatgaaatgatctaatt

SEQ ID NO: 90747 - DNA, 20 bp, Artificial
  CRISPR gRNA sequence
aatgaaatgatctaattagg

SEQ ID NO: 90748 - DNA, 20 bp, Artificial
  CRISPR gRNA sequence
gaaatgatctaattaggaag

SEQ ID NO: 90749 - DNA, 20 bp, Artificial
  CRISPR gRNA sequence
atgatctaattaggaagtag

SEQ ID NO: 90750 - DNA, 20 bp, Artificial
  CRISPR gRNA sequence
gatctaattaggaagtagca

SEQ ID NO: 90751 - DNA, 20 bp, Artificial
  CRISPR gRNA sequence
atctaattaggaagtagcag

SEQ ID NO: 90752 - DNA, 20 bp, Artificial
  CRISPR gRNA sequence
agcagaggatcctaccctga

SEQ ID NO: 90753 - DNA, 20 bp, Artificial
  CRISPR gRNA sequence
cagaggatcctaccctgatg

SEQ ID NO: 90754 - DNA, 20 bp, Artificial
  CRISPR gRNA sequence
aggatcctaccctgatggag

SEQ ID NO: 90755 - DNA, 20 bp, Artificial
  CRISPR gRNA sequence
ggatcctaccctgatggagt

SEQ ID NO: 90756 - DNA, 20 bp, Artificial
  CRISPR gRNA sequence
taccctgatggagtgggtta

SEQ ID NO: 90757 - DNA, 20 bp, Artificial
  CRISPR gRNA sequence
tgatggagtgggttaaagtt

SEQ ID NO: 90758 - DNA, 20 bp, Artificial
  CRISPR gRNA sequence
atggagtgggttaaagttga

SEQ ID NO: 90759 - DNA, 20 bp, Artificial
  CRISPR gRNA sequence
gggttaaagttgagagccta

SEQ ID NO: 90760 - DNA, 20 bp, Artificial
  CRISPR gRNA sequence
gttgagagcctatagatttt

SEQ ID NO: 90761 - DNA, 20 bp, Artificial
  CRISPR gRNA sequence
tagattttgagactctttcg

SEQ ID NO: 90762 - DNA, 20 bp, Artificial
  CRISPR gRNA sequence
gactctttcgaagattatta

SEQ ID NO: 90763 - DNA, 20 bp, Artificial
  CRISPR gRNA sequence
tctttcgaagattattatag

SEQ ID NO: 90764 - DNA, 20 bp, Artificial
  CRISPR gRNA sequence
ctttcgaagattattatagt

SEQ ID NO: 90765 - DNA, 20 bp, Artificial
  CRISPR gRNA sequence
gattattatagtaggactga

SEQ ID NO: 90766 - DNA, 20 bp, Artificial
  CRISPR gRNA sequence
attattatagtaggactgac

SEQ ID NO: 90767 - DNA, 20 bp, Artificial
  CRISPR gRNA sequence
gtaggactgacaggtgatga

SEQ ID NO: 90768 - DNA, 20 bp, Artificial
  CRISPR gRNA sequence
ggtgtcttctgctatgttgt

SEQ ID NO: 90769 - DNA, 20 bp, Artificial
  CRISPR gRNA sequence
gtcttctgctatgttgtgag

SEQ ID NO: 90770 - DNA, 20 bp, Artificial
  CRISPR gRNA sequence
tctgctatgttgtgagcagc

SEQ ID NO: 90771 - DNA, 20 bp, Artificial
  CRISPR gRNA sequence
tatgttgtgagcagcaagat

SEQ ID NO: 90772 - DNA, 20 bp, Artificial
  CRISPR gRNA sequence
gagcagcaagattagaaatt

SEQ ID NO: 90773 - DNA, 20 bp, Artificial
  CRISPR gRNA sequence
ttaagttctctattccaatg

SEQ ID NO: 90774 - DNA, 20 bp, Artificial
  CRISPR gRNA sequence
attccaatgaagaatttatt

SEQ ID NO: 90775 - DNA, 20 bp, Artificial
  CRISPR gRNA sequence
ttccaatgaagaatttatta

SEQ ID NO: 90776 - DNA, 20 bp, Artificial
  CRISPR gRNA sequence
ttattaaggtaaaaaaatta

SEQ ID NO: 90777 - DNA, 20 bp, Artificial
  CRISPR gRNA sequence
gtaaaaaaattaaagaaatt

SEQ ID NO: 90778 - DNA, 20 bp, Artificial
  CRISPR gRNA sequence
taaaaaaattaaagaaatta

SEQ ID NO: 90779 - DNA, 20 bp, Artificial
  CRISPR gRNA sequence
aaaattaatatttcttacac

SEQ ID NO: 90780 - DNA, 20 bp, Artificial
  CRISPR gRNA sequence
taatatttcttacacaagtc

SEQ ID NO: 90781 - DNA, 20 bp, Artificial
  CRISPR gRNA sequence
aatatttcttacacaagtca

SEQ ID NO: 90782 - DNA, 20 bp, Artificial
  CRISPR gRNA sequence
tacacaagtcaaggttaaat

SEQ ID NO: 90783 - DNA, 20 bp, Artificial
  CRISPR gRNA sequence
acacaagtcaaggttaaatg

SEQ ID NO: 90784 - DNA, 20 bp, Artificial
  CRISPR gRNA sequence
aatgtctactccaccaatct

SEQ ID NO: 90785 - DNA, 20 bp, Artificial
  CRISPR gRNA sequence
atctaagaactatgctatat

SEQ ID NO: 90786 - DNA, 20 bp, Artificial
  CRISPR gRNA sequence
ctaagaactatgctatatga

SEQ ID NO: 90787 - DNA, 20 bp, Artificial
  CRISPR gRNA sequence
tgctatatgagagacacata

SEQ ID NO: 90788 - DNA, 20 bp, Artificial
  CRISPR gRNA sequence
gctatatgagagacacataa

SEQ ID NO: 90789 - DNA, 20 bp, Artificial
  CRISPR gRNA sequence
ctatatgagagacacataaa

SEQ ID NO: 90790 - DNA, 20 bp, Artificial
  CRISPR gRNA sequence
tgagagacacataaagggac

SEQ ID NO: 90791 - DNA, 20 bp, Artificial
  CRISPR gRNA sequence
gagagacacataaagggact

SEQ ID NO: 90792 - DNA, 20 bp, Artificial
  CRISPR gRNA sequence
agagacacataaagggacta

SEQ ID NO: 90793 - DNA, 20 bp, Artificial
  CRISPR gRNA sequence
ataaatgaattgacctctgc

SEQ ID NO: 90794 - DNA, 20 bp, Artificial
  CRISPR gRNA sequence
aatgaattgacctctgctgg

SEQ ID NO: 90795 - DNA, 20 bp, Artificial
  CRISPR gRNA sequence
atgaattgacctctgctggt

SEQ ID NO: 90796 - DNA, 20 bp, Artificial
  CRISPR gRNA sequence
gttcttattaaatatctaaa

SEQ ID NO: 90797 - DNA, 20 bp, Artificial
  CRISPR gRNA sequence
tatctaaaaagctatcattt

SEQ ID NO: 90798 - DNA, 20 bp, Artificial
  CRISPR gRNA sequence
tctaaaaagctatcatttaa

SEQ ID NO: 90799 - DNA, 20 bp, Artificial
  CRISPR gRNA sequence
aaaaagctatcatttaagag

SEQ ID NO: 90800 - DNA, 20 bp, Artificial
  CRISPR gRNA sequence
aagctatcatttaagagaag

SEQ ID NO: 90801 - DNA, 20 bp, Artificial
  CRISPR gRNA sequence
ctatcatttaagagaagcag

SEQ ID NO: 90802 - DNA, 20 bp, Artificial
  CRISPR gRNA sequence
agagaagcagtagacttata

SEQ ID NO: 90803 - DNA, 20 bp, Artificial
  CRISPR gRNA sequence
gacttatatggcatgattct

SEQ ID NO: 90804 - DNA, 20 bp, Artificial
  CRISPR gRNA sequence
acttatatggcatgattctg

SEQ ID NO: 90805 - DNA, 20 bp, Artificial
  CRISPR gRNA sequence
tggcatgattctgaggtaac

SEQ ID NO: 90806 - DNA, 20 bp, Artificial
  CRISPR gRNA sequence
ggcatgattctgaggtaact

SEQ ID NO: 90807 - DNA, 20 bp, Artificial
  CRISPR gRNA sequence
tctgaggtaactaggactct

SEQ ID NO: 90808 - DNA, 20 bp, Artificial
  CRISPR gRNA sequence
ctgaggtaactaggactctt

SEQ ID NO: 90809 - DNA, 20 bp, Artificial
  CRISPR gRNA sequence
gactcttaggcataaatcac

SEQ ID NO: 90810 - DNA, 20 bp, Artificial
  CRISPR gRNA sequence
actcttaggcataaatcaca

SEQ ID NO: 90811 - DNA, 20 bp, Artificial
  CRISPR gRNA sequence
tcttaggcataaatcacaag

SEQ ID NO: 90812 - DNA, 20 bp, Artificial
  CRISPR gRNA sequence
atcacaaggagtatgtattt

SEQ ID NO: 90813 - DNA, 20 bp, Artificial
  CRISPR gRNA sequence
aaggagtatgtatttcagct

SEQ ID NO: 90814 - DNA, 20 bp, Artificial
  CRISPR gRNA sequence
tatgtatttcagctcagctt

SEQ ID NO: 90815 - DNA, 20 bp, Artificial
  CRISPR gRNA sequence
atttcagctcagcttaagta

SEQ ID NO: 90816 - DNA, 20 bp, Artificial
  CRISPR gRNA sequence
ctaacattctaccgaaatgt

SEQ ID NO: 90817 - DNA, 20 bp, Artificial
  CRISPR gRNA sequence
aacattctaccgaaatgtta

SEQ ID NO: 90818 - DNA, 20 bp, Artificial
  CRISPR gRNA sequence
attcaaaaccaaatgaaatg

SEQ ID NO: 90819 - DNA, 20 bp, Artificial
  CRISPR gRNA sequence
aaccaaatgaaatgtggcaa

SEQ ID NO: 90820 - DNA, 20 bp, Artificial
  CRISPR gRNA sequence
aaatgaaatgtggcaaaagt

SEQ ID NO: 90821 - DNA, 20 bp, Artificial
  CRISPR gRNA sequence
gcaaaagttggtaaactctg

SEQ ID NO: 90822 - DNA, 20 bp, Artificial
  CRISPR gRNA sequence
caaaagttggtaaactctgt

SEQ ID NO: 90823 - DNA, 20 bp, Artificial
  CRISPR gRNA sequence
ggtaaactctgtaggacaaa

SEQ ID NO: 90824 - DNA, 20 bp, Artificial
  CRISPR gRNA sequence
ctgtaggacaaaaagcattg

SEQ ID NO: 90825 - DNA, 20 bp, Artificial
  CRISPR gRNA sequence
tgtaggacaaaaagcattgc

SEQ ID NO: 90826 - DNA, 20 bp, Artificial
  CRISPR gRNA sequence
agcattgcaggtttttgaaa

SEQ ID NO: 90827 - DNA, 20 bp, Artificial
  CRISPR gRNA sequence
aagaattccaacatctgtac

SEQ ID NO: 90828 - DNA, 20 bp, Artificial
  CRISPR gRNA sequence
ttccaacatctgtacaagtt

SEQ ID NO: 90829 - DNA, 20 bp, Artificial
  CRISPR gRNA sequence
acatctgtacaagtttggac

SEQ ID NO: 90830 - DNA, 20 bp, Artificial
  CRISPR gRNA sequence
aagtttggactagatgacta

SEQ ID NO: 90831 - DNA, 20 bp, Artificial
  CRISPR gRNA sequence
agtttggactagatgactaa

SEQ ID NO: 90832 - DNA, 20 bp, Artificial
  CRISPR gRNA sequence
ctaaaggttattttcactac

SEQ ID NO: 90833 - DNA, 20 bp, Artificial
  CRISPR gRNA sequence
acaagcttctttatctaatt

SEQ ID NO: 90834 - DNA, 20 bp, Artificial
  CRISPR gRNA sequence
attaaccttttgaatttcca

SEQ ID NO: 90835 - DNA, 20 bp, Artificial
  CRISPR gRNA sequence
aaccttttgaatttccatag

SEQ ID NO: 90836 - DNA, 20 bp, Artificial
  CRISPR gRNA sequence
accttttgaatttccatagt

SEQ ID NO: 90837 - DNA, 20 bp, Artificial
  CRISPR gRNA sequence
ccttttgaatttccatagtg

SEQ ID NO: 90838 - DNA, 20 bp, Artificial
  CRISPR gRNA sequence
aatttccatagtggggttgt

SEQ ID NO: 90839 - DNA, 20 bp, Artificial
  CRISPR gRNA sequence
atttccatagtggggttgtg

SEQ ID NO: 90840 - DNA, 20 bp, Artificial
  CRISPR gRNA sequence
tttccatagtggggttgtga

SEQ ID NO: 90841 - DNA, 20 bp, Artificial
  CRISPR gRNA sequence
ccatagtggggttgtgaggg

SEQ ID NO: 90842 - DNA, 20 bp, Artificial
  CRISPR gRNA sequence
atagtggggttgtgagggca

SEQ ID NO: 90843 - DNA, 20 bp, Artificial
  CRISPR gRNA sequence
tagtggggttgtgagggcag

SEQ ID NO: 90844 - DNA, 20 bp, Artificial
  CRISPR gRNA sequence
agtggggttgtgagggcaga

SEQ ID NO: 90845 - DNA, 20 bp, Artificial
  CRISPR gRNA sequence
gcagagggtactgtaccatc

SEQ ID NO: 90846 - DNA, 20 bp, Artificial
  CRISPR gRNA sequence
ctgtaccatcaagtcaattt

SEQ ID NO: 90847 - DNA, 20 bp, Artificial
  CRISPR gRNA sequence
tatcttgcacataaaaatga

SEQ ID NO: 90848 - DNA, 20 bp, Artificial
  CRISPR gRNA sequence
tctcataaataaaatcaact

SEQ ID NO: 90849 - DNA, 20 bp, Artificial
  CRISPR gRNA sequence
ctcataaataaaatcaactt

SEQ ID NO: 90850 - DNA, 20 bp, Artificial
  CRISPR gRNA sequence
tcataaataaaatcaacttg

SEQ ID NO: 90851 - DNA, 20 bp, Artificial
  CRISPR gRNA sequence
cataaataaaatcaacttgg

SEQ ID NO: 90852 - DNA, 20 bp, Artificial
  CRISPR gRNA sequence
aaaatcaacttgggggttgc

SEQ ID NO: 90853 - DNA, 20 bp, Artificial
  CRISPR gRNA sequence
aatcaacttgggggttgctg

SEQ ID NO: 90854 - DNA, 20 bp, Artificial
  CRISPR gRNA sequence
atcaacttgggggttgctgg

SEQ ID NO: 90855 - DNA, 20 bp, Artificial
  CRISPR gRNA sequence
caacttgggggttgctggag

SEQ ID NO: 90856 - DNA, 20 bp, Artificial
  CRISPR gRNA sequence
aacttgggggttgctggagg

SEQ ID NO: 90857 - DNA, 20 bp, Artificial
  CRISPR gRNA sequence
ttgggggttgctggaggagg

SEQ ID NO: 90858 - DNA, 20 bp, Artificial
  CRISPR gRNA sequence
gaaattatttttgtttcctc

SEQ ID NO: 90859 - DNA, 20 bp, Artificial
  CRISPR gRNA sequence
aaattatttttgtttcctct

SEQ ID NO: 90860 - DNA, 20 bp, Artificial
  CRISPR gRNA sequence
tttttgtttcctctgggtat

SEQ ID NO: 90861 - DNA, 20 bp, Artificial
  CRISPR gRNA sequence
gtattagaattttcttttta

SEQ ID NO: 90862 - DNA, 20 bp, Artificial
  CRISPR gRNA sequence
ttttacagtttttatatgtt

SEQ ID NO: 90863 - DNA, 20 bp, Artificial
  CRISPR gRNA sequence
tttacagtttttatatgttg

SEQ ID NO: 90864 - DNA, 20 bp, Artificial
  CRISPR gRNA sequence
atgttgaggcctaaaatgtt

SEQ ID NO: 90865 - DNA, 20 bp, Artificial
  CRISPR gRNA sequence
tgttgaggcctaaaatgttt

SEQ ID NO: 90866 - DNA, 20 bp, Artificial
  CRISPR gRNA sequence
gttgaggcctaaaatgttta

SEQ ID NO: 90867 - DNA, 20 bp, Artificial
  CRISPR gRNA sequence
ttgaggcctaaaatgtttag

SEQ ID NO: 90868 - DNA, 20 bp, Artificial
  CRISPR gRNA sequence
gtgaaatatttttgtaatat

SEQ ID NO: 90869 - DNA, 20 bp, Artificial
  CRISPR gRNA sequence
tgaaatatttttgtaatatc

SEQ ID NO: 90870 - DNA, 20 bp, Artificial
  CRISPR gRNA sequence
atatttttgtaatatcaggt

SEQ ID NO: 90871 - DNA, 20 bp, Artificial
  CRISPR gRNA sequence
tggtaaacttctcataatga

SEQ ID NO: 90872 - DNA, 20 bp, Artificial
  CRISPR gRNA sequence
ttctcataatgaaagaaatt

SEQ ID NO: 90873 - DNA, 20 bp, Artificial
  CRISPR gRNA sequence
tctcataatgaaagaaatta

SEQ ID NO: 90874 - DNA, 20 bp, Artificial
  CRISPR gRNA sequence
ctcataatgaaagaaattaa

SEQ ID NO: 90875 - DNA, 20 bp, Artificial
  CRISPR gRNA sequence
tcataatgaaagaaattaag

SEQ ID NO: 90876 - DNA, 20 bp, Artificial
  CRISPR gRNA sequence
aaattaaggggatattctca

SEQ ID NO: 90877 - DNA, 20 bp, Artificial
  CRISPR gRNA sequence
ggatattctcatagataact

SEQ ID NO: 90878 - DNA, 20 bp, Artificial
  CRISPR gRNA sequence
atattctcatagataactca

SEQ ID NO: 90879 - DNA, 20 bp, Artificial
  CRISPR gRNA sequence
tattctcatagataactcag

SEQ ID NO: 90880 - DNA, 20 bp, Artificial
  CRISPR gRNA sequence
ctcatagataactcagaggc

SEQ ID NO: 90881 - DNA, 20 bp, Artificial
  CRISPR gRNA sequence
atagataactcagaggccag

SEQ ID NO: 90882 - DNA, 20 bp, Artificial
  CRISPR gRNA sequence
ataactcagaggccagtaga

SEQ ID NO: 90883 - DNA, 20 bp, Artificial
  CRISPR gRNA sequence
actcagaggccagtagaaag

SEQ ID NO: 90884 - DNA, 20 bp, Artificial
  CRISPR gRNA sequence
aggccagtagaaagaagccc

SEQ ID NO: 90885 - DNA, 20 bp, Artificial
  CRISPR gRNA sequence
gccagtagaaagaagcccaa

SEQ ID NO: 90886 - DNA, 20 bp, Artificial
  CRISPR gRNA sequence
aagaagcccaagagaaaaaa

SEQ ID NO: 90887 - DNA, 20 bp, Artificial
  CRISPR gRNA sequence
gcccaagagaaaaaacagca

SEQ ID NO: 90888 - DNA, 20 bp, Artificial
  CRISPR gRNA sequence
aacagcatagataatattct

SEQ ID NO: 90889 - DNA, 20 bp, Artificial
  CRISPR gRNA sequence
catagataatattctaagta

SEQ ID NO: 90890 - DNA, 20 bp, Artificial
  CRISPR gRNA sequence
aatattctaagtaaagaaca

SEQ ID NO: 90891 - DNA, 20 bp, Artificial
  CRISPR gRNA sequence
tattctaagtaaagaacaaa

SEQ ID NO: 90892 - DNA, 20 bp, Artificial
  CRISPR gRNA sequence
attctaagtaaagaacaaag

SEQ ID NO: 90893 - DNA, 20 bp, Artificial
  CRISPR gRNA sequence
caaagaggttaaattcatgt

SEQ ID NO: 90894 - DNA, 20 bp, Artificial
  CRISPR gRNA sequence
aaagaggttaaattcatgta

SEQ ID NO: 90895 - DNA, 20 bp, Artificial
  CRISPR gRNA sequence
ggttaaattcatgtaaggta

SEQ ID NO: 90896 - DNA, 20 bp, Artificial
  CRISPR gRNA sequence
tcatgtaaggtatggctttc

SEQ ID NO: 90897 - DNA, 20 bp, Artificial
  CRISPR gRNA sequence
taattttatatttgctactt

SEQ ID NO: 90898 - DNA, 20 bp, Artificial
  CRISPR gRNA sequence
tttatatttgctactttagt

SEQ ID NO: 90899 - DNA, 20 bp, Artificial
  CRISPR gRNA sequence
tgctactttagtaagaattt

SEQ ID NO: 90900 - DNA, 20 bp, Artificial
  CRISPR gRNA sequence
tttagtaagaattttggatg

SEQ ID NO: 90901 - DNA, 20 bp, Artificial
  CRISPR gRNA sequence
gaattttggatgtggtattg

SEQ ID NO: 90902 - DNA, 20 bp, Artificial
  CRISPR gRNA sequence
ttggatgtggtattgtggca

SEQ ID NO: 90903 - DNA, 20 bp, Artificial
  CRISPR gRNA sequence
gtattgtggcatagttttgt

SEQ ID NO: 90904 - DNA, 20 bp, Artificial
  CRISPR gRNA sequence
attgtggcatagttttgtaa

SEQ ID NO: 90905 - DNA, 20 bp, Artificial
  CRISPR gRNA sequence
tggcatagttttgtaagagt

SEQ ID NO: 90906 - DNA, 20 bp, Artificial
  CRISPR gRNA sequence
ttgtaagagtcagaatattt

SEQ ID NO: 90907 - DNA, 20 bp, Artificial
  CRISPR gRNA sequence
taaacaatattttgttatgc

SEQ ID NO: 90908 - DNA, 20 bp, Artificial
  CRISPR gRNA sequence
tgttatgccagcaaaattac

SEQ ID NO: 90909 - DNA, 20 bp, Artificial
  CRISPR gRNA sequence
cagcaaaattacaagtattt

SEQ ID NO: 90910 - DNA, 20 bp, Artificial
  CRISPR gRNA sequence
acaagtatttaagatgctgt

SEQ ID NO: 90911 - DNA, 20 bp, Artificial
  CRISPR gRNA sequence
caagtatttaagatgctgtc

SEQ ID NO: 90912 - DNA, 20 bp, Artificial
  CRISPR gRNA sequence
ttaagatgctgtcaggtaac

SEQ ID NO: 90913 - DNA, 20 bp, Artificial
  CRISPR gRNA sequence
taagatgctgtcaggtaact

SEQ ID NO: 90914 - DNA, 20 bp, Artificial
  CRISPR gRNA sequence
aagatgctgtcaggtaactg

SEQ ID NO: 90915 - DNA, 20 bp, Artificial
  CRISPR gRNA sequence
agatgctgtcaggtaactgg

SEQ ID NO: 90916 - DNA, 20 bp, Artificial
  CRISPR gRNA sequence
ggtaactgggggtacatatt

SEQ ID NO: 90917 - DNA, 20 bp, Artificial
  CRISPR gRNA sequence
gggggtacatatttggtaat

SEQ ID NO: 90918 - DNA, 20 bp, Artificial
  CRISPR gRNA sequence
agtgctgctgattttgtttt

SEQ ID NO: 90919 - DNA, 20 bp, Artificial
  CRISPR gRNA sequence
gtgctgctgattttgttttt

SEQ ID NO: 90920 - DNA, 20 bp, Artificial
  CRISPR gRNA sequence
ctgctgattttgtttttggg

SEQ ID NO: 90921 - DNA, 20 bp, Artificial
  CRISPR gRNA sequence
gtttttgggcagtgaaatct

SEQ ID NO: 90922 - DNA, 20 bp, Artificial
  CRISPR gRNA sequence
tttttgggcagtgaaatctc

SEQ ID NO: 90923 - DNA, 20 bp, Artificial
  CRISPR gRNA sequence
ttttgggcagtgaaatctca

SEQ ID NO: 90924 - DNA, 20 bp, Artificial
  CRISPR gRNA sequence
gcagtgaaatctcagggtaa

SEQ ID NO: 90925 - DNA, 20 bp, Artificial
  CRISPR gRNA sequence
tcagggtaatggtatcattt

SEQ ID NO: 90926 - DNA, 20 bp, Artificial
  CRISPR gRNA sequence
cagggtaatggtatcatttt

SEQ ID NO: 90927 - DNA, 20 bp, Artificial
  CRISPR gRNA sequence
acttacctgttttgttcata

SEQ ID NO: 90928 - DNA, 20 bp, Artificial
  CRISPR gRNA sequence
acctgttttgttcatacagt

SEQ ID NO: 90929 - DNA, 20 bp, Artificial
  CRISPR gRNA sequence
tgttttgttcatacagttgg

SEQ ID NO: 90930 - DNA, 20 bp, Artificial
  CRISPR gRNA sequence
gttttgttcatacagttggc

SEQ ID NO: 90931 - DNA, 20 bp, Artificial
  CRISPR gRNA sequence
tttgttcatacagttggcag

SEQ ID NO: 90932 - DNA, 20 bp, Artificial
  CRISPR gRNA sequence
tggcaggagactatttatac

SEQ ID NO: 90933 - DNA, 20 bp, Artificial
  CRISPR gRNA sequence
atttatactagtgctttttc

SEQ ID NO: 90934 - DNA, 20 bp, Artificial
  CRISPR gRNA sequence
atactagtgctttttcaagc

SEQ ID NO: 90935 - DNA, 20 bp, Artificial
  CRISPR gRNA sequence
caagtttatctaaattttga

SEQ ID NO: 90936 - DNA, 20 bp, Artificial
  CRISPR gRNA sequence
tatctaaattttgaaagctt

SEQ ID NO: 90937 - DNA, 20 bp, Artificial
  CRISPR gRNA sequence
attttgaaagctttggttat

SEQ ID NO: 90938 - DNA, 20 bp, Artificial
  CRISPR gRNA sequence
tactactcccccatttgttt

SEQ ID NO: 90939 - DNA, 20 bp, Artificial
  CRISPR gRNA sequence
catttgttttggttgccaac

SEQ ID NO: 90940 - DNA, 20 bp, Artificial
  CRISPR gRNA sequence
atttgttttggttgccaact

SEQ ID NO: 90941 - DNA, 20 bp, Artificial
  CRISPR gRNA sequence
ttggttgccaactgggtaaa

SEQ ID NO: 90942 - DNA, 20 bp, Artificial
  CRISPR gRNA sequence
ccaactgggtaaaaagctat

SEQ ID NO: 90943 - DNA, 20 bp, Artificial
  CRISPR gRNA sequence
aagctatcagatatcttatt

SEQ ID NO: 90944 - DNA, 20 bp, Artificial
  CRISPR gRNA sequence
ctatcagatatcttattgag

SEQ ID NO: 90945 - DNA, 20 bp, Artificial
  CRISPR gRNA sequence
gcagtatataatttgcctct

SEQ ID NO: 90946 - DNA, 20 bp, Artificial
  CRISPR gRNA sequence
gagttcatatatttcatcca

SEQ ID NO: 90947 - DNA, 20 bp, Artificial
  CRISPR gRNA sequence
agttcatatatttcatccaa

SEQ ID NO: 90948 - DNA, 20 bp, Artificial
  CRISPR gRNA sequence
catatatttcatccaaaggc

SEQ ID NO: 90949 - DNA, 20 bp, Artificial
  CRISPR gRNA sequence
atatttcatccaaaggcaag

SEQ ID NO: 90950 - DNA, 20 bp, Artificial
  CRISPR gRNA sequence
aaggcaagcagattatgttt

SEQ ID NO: 90951 - DNA, 20 bp, Artificial
  CRISPR gRNA sequence
aagcagattatgtttcggcc

SEQ ID NO: 90952 - DNA, 20 bp, Artificial
  CRISPR gRNA sequence
agattatgtttcggcctgga

SEQ ID NO: 90953 - DNA, 20 bp, Artificial
  CRISPR gRNA sequence
ggcctggatagcattatata

SEQ ID NO: 90954 - DNA, 20 bp, Artificial
  CRISPR gRNA sequence
cctggatagcattatataaa

SEQ ID NO: 90955 - DNA, 20 bp, Artificial
  CRISPR gRNA sequence
atagcattatataaagagaa

SEQ ID NO: 90956 - DNA, 20 bp, Artificial
  CRISPR gRNA sequence
agagaatggtcaattccact

SEQ ID NO: 90957 - DNA, 20 bp, Artificial
  CRISPR gRNA sequence
attttttgtaatattgaaaa

SEQ ID NO: 90958 - DNA, 20 bp, Artificial
  CRISPR gRNA sequence
taatattgaaaatagctcac

SEQ ID NO: 90959 - DNA, 20 bp, Artificial
  CRISPR gRNA sequence
aagtaactctgcctcaatct

SEQ ID NO: 90960 - DNA, 20 bp, Artificial
  CRISPR gRNA sequence
taactctgcctcaatcttag

SEQ ID NO: 90961 - DNA, 20 bp, Artificial
  CRISPR gRNA sequence
tcttagtggcccacctctca

SEQ ID NO: 90962 - DNA, 20 bp, Artificial
  CRISPR gRNA sequence
tcacacacactattaatttt

SEQ ID NO: 90963 - DNA, 20 bp, Artificial
  CRISPR gRNA sequence
tattaattttgagacctgcc

SEQ ID NO: 90964 - DNA, 20 bp, Artificial
  CRISPR gRNA sequence
ttaattttgagacctgccaa

SEQ ID NO: 90965 - DNA, 20 bp, Artificial
  CRISPR gRNA sequence
tgagacctgccaagagacta

SEQ ID NO: 90966 - DNA, 20 bp, Artificial
  CRISPR gRNA sequence
tgccaagagactaaagaacc

SEQ ID NO: 90967 - DNA, 20 bp, Artificial
  CRISPR gRNA sequence
gccaagagactaaagaaccc

SEQ ID NO: 90968 - DNA, 20 bp, Artificial
  CRISPR gRNA sequence
aagaacccaggttgaaaatc

SEQ ID NO: 90969 - DNA, 20 bp, Artificial
  CRISPR gRNA sequence
agaacccaggttgaaaatct

SEQ ID NO: 90970 - DNA, 20 bp, Artificial
  CRISPR gRNA sequence
gaacccaggttgaaaatctg

SEQ ID NO: 90971 - DNA, 20 bp, Artificial
  CRISPR gRNA sequence
aacccaggttgaaaatctgg

SEQ ID NO: 90972 - DNA, 20 bp, Artificial
  CRISPR gRNA sequence
acccaggttgaaaatctggg

SEQ ID NO: 90973 - DNA, 20 bp, Artificial
  CRISPR gRNA sequence
ccaggttgaaaatctggggg

SEQ ID NO: 90974 - DNA, 20 bp, Artificial
  CRISPR gRNA sequence
aggttgaaaatctgggggga

SEQ ID NO: 90975 - DNA, 20 bp, Artificial
  CRISPR gRNA sequence
ggttgaaaatctggggggag

SEQ ID NO: 90976 - DNA, 20 bp, Artificial
  CRISPR gRNA sequence
gttgaaaatctggggggaga

SEQ ID NO: 90977 - DNA, 20 bp, Artificial
  CRISPR gRNA sequence
tgaaaatctggggggagagg

SEQ ID NO: 90978 - DNA, 20 bp, Artificial
  CRISPR gRNA sequence
aatctggggggagagggagc

SEQ ID NO: 90979 - DNA, 20 bp, Artificial
  CRISPR gRNA sequence
atctggggggagagggagcg

SEQ ID NO: 90980 - DNA, 20 bp, Artificial
  CRISPR gRNA sequence
ctggggggagagggagcgag

SEQ ID NO: 90981 - DNA, 20 bp, Artificial
  CRISPR gRNA sequence
tggggggagagggagcgagg

SEQ ID NO: 90982 - DNA, 20 bp, Artificial
  CRISPR gRNA sequence
atactttgcctatgataatg

SEQ ID NO: 90983 - DNA, 20 bp, Artificial
  CRISPR gRNA sequence
atgataatgaagaactttcc

SEQ ID NO: 90984 - DNA, 20 bp, Artificial
  CRISPR gRNA sequence
gataatgaagaactttccca

SEQ ID NO: 90985 - DNA, 20 bp, Artificial
  CRISPR gRNA sequence
agaactttcccagagttgcc

SEQ ID NO: 90986 - DNA, 20 bp, Artificial
  CRISPR gRNA sequence
aactttcccagagttgccca

SEQ ID NO: 90987 - DNA, 20 bp, Artificial
  CRISPR gRNA sequence
tcccagagttgcccagagac

SEQ ID NO: 90988 - DNA, 20 bp, Artificial
  CRISPR gRNA sequence
cccagagttgcccagagact

SEQ ID NO: 90989 - DNA, 20 bp, Artificial
  CRISPR gRNA sequence
gagttgcccagagactgggc

SEQ ID NO: 90990 - DNA, 20 bp, Artificial
  CRISPR gRNA sequence
ttgcccagagactgggcaag

SEQ ID NO: 90991 - DNA, 20 bp, Artificial
  CRISPR gRNA sequence
cccagagactgggcaagaag

SEQ ID NO: 90992 - DNA, 20 bp, Artificial
  CRISPR gRNA sequence
ccagagactgggcaagaaga

SEQ ID NO: 90993 - DNA, 20 bp, Artificial
  CRISPR gRNA sequence
gagactgggcaagaagaagg

SEQ ID NO: 90994 - DNA, 20 bp, Artificial
  CRISPR gRNA sequence
aagaagaaggaagaaatgca

SEQ ID NO: 90995 - DNA, 20 bp, Artificial
  CRISPR gRNA sequence
tgcatttttatcatttatcc

SEQ ID NO: 90996 - DNA, 20 bp, Artificial
  CRISPR gRNA sequence
gcatttttatcatttatccc

SEQ ID NO: 90997 - DNA, 20 bp, Artificial
  CRISPR gRNA sequence
ttttatcatttatcccagga

SEQ ID NO: 90998 - DNA, 20 bp, Artificial
  CRISPR gRNA sequence
tcatttatcccaggaaagtg

SEQ ID NO: 90999 - DNA, 20 bp, Artificial
  CRISPR gRNA sequence
atactctccattgttaaaca

SEQ ID NO: 91000 - DNA, 20 bp, Artificial
  CRISPR gRNA sequence
ctccattgttaaacaaagaa

SEQ ID NO: 91001 - DNA, 20 bp, Artificial
  CRISPR gRNA sequence
tccattgttaaacaaagaac

SEQ ID NO: 91002 - DNA, 20 bp, Artificial
  CRISPR gRNA sequence
aaacaaagaacaggatcttt

SEQ ID NO: 91003 - DNA, 20 bp, Artificial
  CRISPR gRNA sequence
aacaaagaacaggatctttt

SEQ ID NO: 91004 - DNA, 20 bp, Artificial
  CRISPR gRNA sequence
acaaagaacaggatcttttg

SEQ ID NO: 91005 - DNA, 20 bp, Artificial
  CRISPR gRNA sequence
tcttttggggatcgtcctgc

SEQ ID NO: 91006 - DNA, 20 bp, Artificial
  CRISPR gRNA sequence
tcctgcaagacctactcttt

SEQ ID NO: 91007 - DNA, 20 bp, Artificial
  CRISPR gRNA sequence
aagacctactcttttagaac

SEQ ID NO: 91008 - DNA, 20 bp, Artificial
  CRISPR gRNA sequence
gaacaagtgttaaatcaaaa

SEQ ID NO: 91009 - DNA, 20 bp, Artificial
  CRISPR gRNA sequence
agtgttaaatcaaaaaagac

SEQ ID NO: 91010 - DNA, 20 bp, Artificial
  CRISPR gRNA sequence
gtaaatatctgtttgtaaat

SEQ ID NO: 91011 - DNA, 20 bp, Artificial
  CRISPR gRNA sequence
taacaaacgtttgttataaa

SEQ ID NO: 91012 - DNA, 20 bp, Artificial
  CRISPR gRNA sequence
ttgttataaatggaacaatt

SEQ ID NO: 91013 - DNA, 20 bp, Artificial
  CRISPR gRNA sequence
atggaacaattgagattttt

SEQ ID NO: 91014 - DNA, 20 bp, Artificial
  CRISPR gRNA sequence
attgagatttttgagatttt

SEQ ID NO: 91015 - DNA, 20 bp, Artificial
  CRISPR gRNA sequence
catcaaaataaattcctaat

SEQ ID NO: 91016 - DNA, 20 bp, Artificial
  CRISPR gRNA sequence
ataagtcaaaattttaaaaa

SEQ ID NO: 91017 - DNA, 20 bp, Artificial
  CRISPR gRNA sequence
caaaattttaaaaaaagaat

SEQ ID NO: 91018 - DNA, 20 bp, Artificial
  CRISPR gRNA sequence
ctttacctcaaaaatgtaat

SEQ ID NO: 91019 - DNA, 20 bp, Artificial
  CRISPR gRNA sequence
aaatgtaatgagattttttt

SEQ ID NO: 91020 - DNA, 20 bp, Artificial
  CRISPR gRNA sequence
gagattttttttagcttata

SEQ ID NO: 91021 - DNA, 20 bp, Artificial
  CRISPR gRNA sequence
agcttatatagacaaaatca

SEQ ID NO: 91022 - DNA, 20 bp, Artificial
  CRISPR gRNA sequence
cttatatagacaaaatcaca

SEQ ID NO: 91023 - DNA, 20 bp, Artificial
  CRISPR gRNA sequence
atagacaaaatcacagagaa

SEQ ID NO: 91024 - DNA, 20 bp, Artificial
  CRISPR gRNA sequence
ctacataaaaatgaatgcta

SEQ ID NO: 91025 - DNA, 20 bp, Artificial
  CRISPR gRNA sequence
atgaatgctatagtcaaaaa

SEQ ID NO: 91026 - DNA, 20 bp, Artificial
  CRISPR gRNA sequence
aatgctatagtcaaaaatgg

SEQ ID NO: 91027 - DNA, 20 bp, Artificial
  CRISPR gRNA sequence
tggcaaattgcacaatgacc

SEQ ID NO: 91028 - DNA, 20 bp, Artificial
  CRISPR gRNA sequence
gcaaattgcacaatgaccta

SEQ ID NO: 91029 - DNA, 20 bp, Artificial
  CRISPR gRNA sequence
aatatgtacaacaaatataa

SEQ ID NO: 91030 - DNA, 20 bp, Artificial
  CRISPR gRNA sequence
acaacaaatataaaagacta

SEQ ID NO: 91031 - DNA, 20 bp, Artificial
  CRISPR gRNA sequence
aagactatggttaacgtgtc

SEQ ID NO: 91032 - DNA, 20 bp, Artificial
  CRISPR gRNA sequence
tttatcacataaaatattcc

SEQ ID NO: 91033 - DNA, 20 bp, Artificial
  CRISPR gRNA sequence
tcacataaaatattcctggt

SEQ ID NO: 91034 - DNA, 20 bp, Artificial
  CRISPR gRNA sequence
cacataaaatattcctggtt

SEQ ID NO: 91035 - DNA, 20 bp, Artificial
  CRISPR gRNA sequence
atattcctggttgggcattg

SEQ ID NO: 91036 - DNA, 20 bp, Artificial
  CRISPR gRNA sequence
gtggttcatgcctgtaatcc

SEQ ID NO: 91037 - DNA, 20 bp, Artificial
  CRISPR gRNA sequence
tgcctgtaatcctagcactt

SEQ ID NO: 91038 - DNA, 20 bp, Artificial
  CRISPR gRNA sequence
gcctgtaatcctagcacttt

SEQ ID NO: 91039 - DNA, 20 bp, Artificial
  CRISPR gRNA sequence
ctgtaatcctagcactttgg

SEQ ID NO: 91040 - DNA, 20 bp, Artificial
  CRISPR gRNA sequence
tgtaatcctagcactttggg

SEQ ID NO: 91041 - DNA, 20 bp, Artificial
  CRISPR gRNA sequence
atcctagcactttgggaggc

SEQ ID NO: 91042 - DNA, 20 bp, Artificial
  CRISPR gRNA sequence
tcctagcactttgggaggcc

SEQ ID NO: 91043 - DNA, 20 bp, Artificial
  CRISPR gRNA sequence
tagcactttgggaggccagg

SEQ ID NO: 91044 - DNA, 20 bp, Artificial
  CRISPR gRNA sequence
agcactttgggaggccaggt

SEQ ID NO: 91045 - DNA, 20 bp, Artificial
  CRISPR gRNA sequence
cactttgggaggccaggtgg

SEQ ID NO: 91046 - DNA, 20 bp, Artificial
  CRISPR gRNA sequence
actttgggaggccaggtggg

SEQ ID NO: 91047 - DNA, 20 bp, Artificial
  CRISPR gRNA sequence
gccaggtgggaggatcactt

SEQ ID NO: 91048 - DNA, 20 bp, Artificial
  CRISPR gRNA sequence
ccaggtgggaggatcacttg

SEQ ID NO: 91049 - DNA, 20 bp, Artificial
  CRISPR gRNA sequence
gtgggaggatcacttgaggc

SEQ ID NO: 91050 - DNA, 20 bp, Artificial
  CRISPR gRNA sequence
tgggaggatcacttgaggct

SEQ ID NO: 91051 - DNA, 20 bp, Artificial
  CRISPR gRNA sequence
tcacttgaggctgggaattt

SEQ ID NO: 91052 - DNA, 20 bp, Artificial
  CRISPR gRNA sequence
ctgggaatttgagaccattc

SEQ ID NO: 91053 - DNA, 20 bp, Artificial
  CRISPR gRNA sequence
tgggaatttgagaccattct

SEQ ID NO: 91054 - DNA, 20 bp, Artificial
  CRISPR gRNA sequence
tgagaccattctgggcaacg

SEQ ID NO: 91055 - DNA, 20 bp, Artificial
  CRISPR gRNA sequence
accattctgggcaacgtagc

SEQ ID NO: 91056 - DNA, 20 bp, Artificial
  CRISPR gRNA sequence
ctacaaaaaaatttaaaaat

SEQ ID NO: 91057 - DNA, 20 bp, Artificial
  CRISPR gRNA sequence
aaaaaatttaaaaattagcc

SEQ ID NO: 91058 - DNA, 20 bp, Artificial
  CRISPR gRNA sequence
taaaaattagccgagtgtga

SEQ ID NO: 91059 - DNA, 20 bp, Artificial
  CRISPR gRNA sequence
tagccgagtgtgatggtatg

SEQ ID NO: 91060 - DNA, 20 bp, Artificial
  CRISPR gRNA sequence
agtgtgatggtatgtagctg

SEQ ID NO: 91061 - DNA, 20 bp, Artificial
  CRISPR gRNA sequence
atggtatgtagctgtagtcc

SEQ ID NO: 91062 - DNA, 20 bp, Artificial
  CRISPR gRNA sequence
agctgtagtcctggctactc

SEQ ID NO: 91063 - DNA, 20 bp, Artificial
  CRISPR gRNA sequence
ctgtagtcctggctactcaa

SEQ ID NO: 91064 - DNA, 20 bp, Artificial
  CRISPR gRNA sequence
tgtagtcctggctactcaag

SEQ ID NO: 91065 - DNA, 20 bp, Artificial
  CRISPR gRNA sequence
ggctactcaagaggctgaaa

SEQ ID NO: 91066 - DNA, 20 bp, Artificial
  CRISPR gRNA sequence
gctactcaagaggctgaaac

SEQ ID NO: 91067 - DNA, 20 bp, Artificial
  CRISPR gRNA sequence
tactcaagaggctgaaacag

SEQ ID NO: 91068 - DNA, 20 bp, Artificial
  CRISPR gRNA sequence
actcaagaggctgaaacagg

SEQ ID NO: 91069 - DNA, 20 bp, Artificial
  CRISPR gRNA sequence
ctgaaacaggaggattgctt

SEQ ID NO: 91070 - DNA, 20 bp, Artificial
  CRISPR gRNA sequence
acaggaggattgcttgagtc

SEQ ID NO: 91071 - DNA, 20 bp, Artificial
  CRISPR gRNA sequence
caggaggattgcttgagtcc

SEQ ID NO: 91072 - DNA, 20 bp, Artificial
  CRISPR gRNA sequence
ttgcttgagtccaggaattc

SEQ ID NO: 91073 - DNA, 20 bp, Artificial
  CRISPR gRNA sequence
tgcttgagtccaggaattcg

SEQ ID NO: 91074 - DNA, 20 bp, Artificial
  CRISPR gRNA sequence
caggaattcgaggctgcaat

SEQ ID NO: 91075 - DNA, 20 bp, Artificial
  CRISPR gRNA sequence
atgatcataccactgtactc

SEQ ID NO: 91076 - DNA, 20 bp, Artificial
  CRISPR gRNA sequence
cataccactgtactccagcc

SEQ ID NO: 91077 - DNA, 20 bp, Artificial
  CRISPR gRNA sequence
ataccactgtactccagcct

SEQ ID NO: 91078 - DNA, 20 bp, Artificial
  CRISPR gRNA sequence
ctgtactccagcctaggcaa

SEQ ID NO: 91079 - DNA, 20 bp, Artificial
  CRISPR gRNA sequence
gtactccagcctaggcaaca

SEQ ID NO: 91080 - DNA, 20 bp, Artificial
  CRISPR gRNA sequence
tataaatcattaaacatgat

SEQ ID NO: 91081 - DNA, 20 bp, Artificial
  CRISPR gRNA sequence
aaatatgtttgcctctttga

SEQ ID NO: 91082 - DNA, 20 bp, Artificial
  CRISPR gRNA sequence
gtttgcctctttgacagctt

SEQ ID NO: 91083 - DNA, 20 bp, Artificial
  CRISPR gRNA sequence
cagcttcagtcttaactgca

SEQ ID NO: 91084 - DNA, 20 bp, Artificial
  CRISPR gRNA sequence
ttcagtcttaactgcaaaga

SEQ ID NO: 91085 - DNA, 20 bp, Artificial
  CRISPR gRNA sequence
aaaaattcctgtaatttgat

SEQ ID NO: 91086 - DNA, 20 bp, Artificial
  CRISPR gRNA sequence
aaaattcctgtaatttgatg

SEQ ID NO: 91087 - DNA, 20 bp, Artificial
  CRISPR gRNA sequence
aatttgatgaggaaaacctt

SEQ ID NO: 91088 - DNA, 20 bp, Artificial
  CRISPR gRNA sequence
ttggcttcaatacattgcaa

SEQ ID NO: 91089 - DNA, 20 bp, Artificial
  CRISPR gRNA sequence
cttcaatacattgcaaaaga

SEQ ID NO: 91090 - DNA, 20 bp, Artificial
  CRISPR gRNA sequence
tacattgcaaaagatagaaa

SEQ ID NO: 91091 - DNA, 20 bp, Artificial
  CRISPR gRNA sequence
aaagatagaaacagaaaaaa

SEQ ID NO: 91092 - DNA, 20 bp, Artificial
  CRISPR gRNA sequence
aagatagaaacagaaaaaaa

SEQ ID NO: 91093 - DNA, 20 bp, Artificial
  CRISPR gRNA sequence
atagaaacagaaaaaaaagg

SEQ ID NO: 91094 - DNA, 20 bp, Artificial
  CRISPR gRNA sequence
cagaataccattaaatgata

SEQ ID NO: 91095 - DNA, 20 bp, Artificial
  CRISPR gRNA sequence
ataccattaaatgatatgga

SEQ ID NO: 91096 - DNA, 20 bp, Artificial
  CRISPR gRNA sequence
taccattaaatgatatggaa

SEQ ID NO: 91097 - DNA, 20 bp, Artificial
  CRISPR gRNA sequence
tatggaaaggtattcaatat

SEQ ID NO: 91098 - DNA, 20 bp, Artificial
  CRISPR gRNA sequence
tatcagtaaaaataaacaaa

SEQ ID NO: 91099 - DNA, 20 bp, Artificial
  CRISPR gRNA sequence
aacgattacgcacaatgatg

SEQ ID NO: 91100 - DNA, 20 bp, Artificial
  CRISPR gRNA sequence
cgcacaatgatgcagtgatg

SEQ ID NO: 91101 - DNA, 20 bp, Artificial
  CRISPR gRNA sequence
cacaatgatgcagtgatgtg

SEQ ID NO: 91102 - DNA, 20 bp, Artificial
  CRISPR gRNA sequence
atgtggagactttcatgaaa

SEQ ID NO: 91103 - DNA, 20 bp, Artificial
  CRISPR gRNA sequence
ttcatgaaatggacattctc

SEQ ID NO: 91104 - DNA, 20 bp, Artificial
  CRISPR gRNA sequence
atgaaatggacattctcaag

SEQ ID NO: 91105 - DNA, 20 bp, Artificial
  CRISPR gRNA sequence
ggacattctcaagtagttaa

SEQ ID NO: 91106 - DNA, 20 bp, Artificial
  CRISPR gRNA sequence
tagttaatggcattatatat

SEQ ID NO: 91107 - DNA, 20 bp, Artificial
  CRISPR gRNA sequence
aatggcattatatattggta

SEQ ID NO: 91108 - DNA, 20 bp, Artificial
  CRISPR gRNA sequence
atatattggtatggcacttt

SEQ ID NO: 91109 - DNA, 20 bp, Artificial
  CRISPR gRNA sequence
attggtatggcactttcaga

SEQ ID NO: 91110 - DNA, 20 bp, Artificial
  CRISPR gRNA sequence
ggtatggcactttcagaaag

SEQ ID NO: 91111 - DNA, 20 bp, Artificial
  CRISPR gRNA sequence
tggcactttcagaaagcagt

SEQ ID NO: 91112 - DNA, 20 bp, Artificial
  CRISPR gRNA sequence
ggcactttcagaaagcagtt

SEQ ID NO: 91113 - DNA, 20 bp, Artificial
  CRISPR gRNA sequence
agcagttgggcaatatgtac

SEQ ID NO: 91114 - DNA, 20 bp, Artificial
  CRISPR gRNA sequence
gcagttgggcaatatgtacc

SEQ ID NO: 91115 - DNA, 20 bp, Artificial
  CRISPR gRNA sequence
agttgggcaatatgtaccag

SEQ ID NO: 91116 - DNA, 20 bp, Artificial
  CRISPR gRNA sequence
aggagtcatccctttcaact

SEQ ID NO: 91117 - DNA, 20 bp, Artificial
  CRISPR gRNA sequence
cagacatcacatttaatatg

SEQ ID NO: 91118 - DNA, 20 bp, Artificial
  CRISPR gRNA sequence
atttaatatgaagacattta

SEQ ID NO: 91119 - DNA, 20 bp, Artificial
  CRISPR gRNA sequence
cagaatgtaaatcctaaata

SEQ ID NO: 91120 - DNA, 20 bp, Artificial
  CRISPR gRNA sequence
atgtaaatcctaaatatgga

SEQ ID NO: 91121 - DNA, 20 bp, Artificial
  CRISPR gRNA sequence
gtaaatcctaaatatggata

SEQ ID NO: 91122 - DNA, 20 bp, Artificial
  CRISPR gRNA sequence
tatggatagagttaaacata

SEQ ID NO: 91123 - DNA, 20 bp, Artificial
  CRISPR gRNA sequence
atggatagagttaaacataa

SEQ ID NO: 91124 - DNA, 20 bp, Artificial
  CRISPR gRNA sequence
gttaaacataaaggtattgc

SEQ ID NO: 91125 - DNA, 20 bp, Artificial
  CRISPR gRNA sequence
ttaaacataaaggtattgcc

SEQ ID NO: 91126 - DNA, 20 bp, Artificial
  CRISPR gRNA sequence
aggaatatatttctcataaa

SEQ ID NO: 91127 - DNA, 20 bp, Artificial
  CRISPR gRNA sequence
atttctcataaatagtaaaa

SEQ ID NO: 91128 - DNA, 20 bp, Artificial
  CRISPR gRNA sequence
tttctcataaatagtaaaaa

SEQ ID NO: 91129 - DNA, 20 bp, Artificial
  CRISPR gRNA sequence
ctcataaatagtaaaaaagg

SEQ ID NO: 91130 - DNA, 20 bp, Artificial
  CRISPR gRNA sequence
agtaaaaaaggtagttgaaa

SEQ ID NO: 91131 - DNA, 20 bp, Artificial
  CRISPR gRNA sequence
gaaacagcctaaatgtccaa

SEQ ID NO: 91132 - DNA, 20 bp, Artificial
  CRISPR gRNA sequence
aatgtccaacagtgtcataa

SEQ ID NO: 91133 - DNA, 20 bp, Artificial
  CRISPR gRNA sequence
ccaacagtgtcataacagct

SEQ ID NO: 91134 - DNA, 20 bp, Artificial
  CRISPR gRNA sequence
aaataaaactgtttaataaa

SEQ ID NO: 91135 - DNA, 20 bp, Artificial
  CRISPR gRNA sequence
taataaatagaaaatgtact

SEQ ID NO: 91136 - DNA, 20 bp, Artificial
  CRISPR gRNA sequence
atataatacatataatctga

SEQ ID NO: 91137 - DNA, 20 bp, Artificial
  CRISPR gRNA sequence
aatacatataatctgaaagt

SEQ ID NO: 91138 - DNA, 20 bp, Artificial
  CRISPR gRNA sequence
tgaaagtcagtatttaatga

SEQ ID NO: 91139 - DNA, 20 bp, Artificial
  CRISPR gRNA sequence
gatagtatgttcactttatt

SEQ ID NO: 91140 - DNA, 20 bp, Artificial
  CRISPR gRNA sequence
ttattcagtttatctttttg

SEQ ID NO: 91141 - DNA, 20 bp, Artificial
  CRISPR gRNA sequence
tttatctttttgcagcttat

SEQ ID NO: 91142 - DNA, 20 bp, Artificial
  CRISPR gRNA sequence
ttatctttttgcagcttatt

SEQ ID NO: 91143 - DNA, 20 bp, Artificial
  CRISPR gRNA sequence
tatctttttgcagcttattg

SEQ ID NO: 91144 - DNA, 20 bp, Artificial
  CRISPR gRNA sequence
tttgcagcttattggggcca

SEQ ID NO: 91145 - DNA, 20 bp, Artificial
  CRISPR gRNA sequence
ttttctctataaatttatgt

SEQ ID NO: 91146 - DNA, 20 bp, Artificial
  CRISPR gRNA sequence
tttattataaaaacctatta

SEQ ID NO: 91147 - DNA, 20 bp, Artificial
  CRISPR gRNA sequence
ttattataaaaacctattac

SEQ ID NO: 91148 - DNA, 20 bp, Artificial
  CRISPR gRNA sequence
attataaaaacctattacag

SEQ ID NO: 91149 - DNA, 20 bp, Artificial
  CRISPR gRNA sequence
aaacctattacaggagactg

SEQ ID NO: 91150 - DNA, 20 bp, Artificial
  CRISPR gRNA sequence
cctattacaggagactgtgg

SEQ ID NO: 91151 - DNA, 20 bp, Artificial
  CRISPR gRNA sequence
ctattacaggagactgtggc

SEQ ID NO: 91152 - DNA, 20 bp, Artificial
  CRISPR gRNA sequence
ctgtggcaggatgattgctt

SEQ ID NO: 91153 - DNA, 20 bp, Artificial
  CRISPR gRNA sequence
gcaggatgattgcttgagcc

SEQ ID NO: 91154 - DNA, 20 bp, Artificial
  CRISPR gRNA sequence
caggatgattgcttgagccg

SEQ ID NO: 91155 - DNA, 20 bp, Artificial
  CRISPR gRNA sequence
ggatgattgcttgagccgag

SEQ ID NO: 91156 - DNA, 20 bp, Artificial
  CRISPR gRNA sequence
ttgcttgagccgaggagttc

SEQ ID NO: 91157 - DNA, 20 bp, Artificial
  CRISPR gRNA sequence
agccgaggagttcaagactg

SEQ ID NO: 91158 - DNA, 20 bp, Artificial
  CRISPR gRNA sequence
gaggagttcaagactgcagt

SEQ ID NO: 91159 - DNA, 20 bp, Artificial
  CRISPR gRNA sequence
atgctcacgccactgcactc

SEQ ID NO: 91160 - DNA, 20 bp, Artificial
  CRISPR gRNA sequence
cacgccactgcactccagcg

SEQ ID NO: 91161 - DNA, 20 bp, Artificial
  CRISPR gRNA sequence
acgccactgcactccagcgt

SEQ ID NO: 91162 - DNA, 20 bp, Artificial
  CRISPR gRNA sequence
cgccactgcactccagcgtg

SEQ ID NO: 91163 - DNA, 20 bp, Artificial
  CRISPR gRNA sequence
ctgcactccagcgtggggaa

SEQ ID NO: 91164 - DNA, 20 bp, Artificial
  CRISPR gRNA sequence
gcactccagcgtggggaaca

SEQ ID NO: 91165 - DNA, 20 bp, Artificial
  CRISPR gRNA sequence
tccagcgtggggaacagagt

SEQ ID NO: 91166 - DNA, 20 bp, Artificial
  CRISPR gRNA sequence
taataataatatgttaatca

SEQ ID NO: 91167 - DNA, 20 bp, Artificial
  CRISPR gRNA sequence
attattacaactatatttta

SEQ ID NO: 91168 - DNA, 20 bp, Artificial
  CRISPR gRNA sequence
caactatattttaaagtgat

SEQ ID NO: 91169 - DNA, 20 bp, Artificial
  CRISPR gRNA sequence
taaagtgatgagtgtacaaa

SEQ ID NO: 91170 - DNA, 20 bp, Artificial
  CRISPR gRNA sequence
aaagtgatgagtgtacaaaa

SEQ ID NO: 91171 - DNA, 20 bp, Artificial
  CRISPR gRNA sequence
atgagtgtacaaaaaggtat

SEQ ID NO: 91172 - DNA, 20 bp, Artificial
  CRISPR gRNA sequence
caaaaaggtattggatgttt

SEQ ID NO: 91173 - DNA, 20 bp, Artificial
  CRISPR gRNA sequence
aaaaggtattggatgtttta

SEQ ID NO: 91174 - DNA, 20 bp, Artificial
  CRISPR gRNA sequence
aggtattggatgttttagag

SEQ ID NO: 91175 - DNA, 20 bp, Artificial
  CRISPR gRNA sequence
tatattttttcctgaaattt

SEQ ID NO: 91176 - DNA, 20 bp, Artificial
  CRISPR gRNA sequence
caatttttaatttctttatg

SEQ ID NO: 91177 - DNA, 20 bp, Artificial
  CRISPR gRNA sequence
ttaatttctttatgaagact

SEQ ID NO: 91178 - DNA, 20 bp, Artificial
  CRISPR gRNA sequence
tgaagacttagttgcctaat

SEQ ID NO: 91179 - DNA, 20 bp, Artificial
  CRISPR gRNA sequence
ctaatgagaaacttgacttc

SEQ ID NO: 91180 - DNA, 20 bp, Artificial
  CRISPR gRNA sequence
agaaacttgacttctagcac

SEQ ID NO: 91181 - DNA, 20 bp, Artificial
  CRISPR gRNA sequence
gtttgtatgtatgtacaaac

SEQ ID NO: 91182 - DNA, 20 bp, Artificial
  CRISPR gRNA sequence
tgtatgtacaaactggcatt

SEQ ID NO: 91183 - DNA, 20 bp, Artificial
  CRISPR gRNA sequence
ttagctgctattttcacatg

SEQ ID NO: 91184 - DNA, 20 bp, Artificial
  CRISPR gRNA sequence
tttttttcttgctataatcc

SEQ ID NO: 91185 - DNA, 20 bp, Artificial
  CRISPR gRNA sequence
ttttttcttgctataatcct

SEQ ID NO: 91186 - DNA, 20 bp, Artificial
  CRISPR gRNA sequence
ttcttgctataatcctgggt

SEQ ID NO: 91187 - DNA, 20 bp, Artificial
  CRISPR gRNA sequence
tcctgggtcagtgctacttt

SEQ ID NO: 91188 - DNA, 20 bp, Artificial
  CRISPR gRNA sequence
tctttgttcttacatatttc

SEQ ID NO: 91189 - DNA, 20 bp, Artificial
  CRISPR gRNA sequence
tttgttcttacatatttcaa

SEQ ID NO: 91190 - DNA, 20 bp, Artificial
  CRISPR gRNA sequence
tgttcttacatatttcaaga

SEQ ID NO: 91191 - DNA, 20 bp, Artificial
  CRISPR gRNA sequence
tttcaagagagtatatttgc

SEQ ID NO: 91192 - DNA, 20 bp, Artificial
  CRISPR gRNA sequence
gagtatatttgctggcatat

SEQ ID NO: 91193 - DNA, 20 bp, Artificial
  CRISPR gRNA sequence
gtatatttgctggcatatta

SEQ ID NO: 91194 - DNA, 20 bp, Artificial
  CRISPR gRNA sequence
tatttgctggcatattagag

SEQ ID NO: 91195 - DNA, 20 bp, Artificial
  CRISPR gRNA sequence
atttgctggcatattagaga

SEQ ID NO: 91196 - DNA, 20 bp, Artificial
  CRISPR gRNA sequence
aggtgtttcctttttacaca

SEQ ID NO: 91197 - DNA, 20 bp, Artificial
  CRISPR gRNA sequence
ttacacaaagtcaccaataa

SEQ ID NO: 91198 - DNA, 20 bp, Artificial
  CRISPR gRNA sequence
cagacttcacccgttatttt

SEQ ID NO: 91199 - DNA, 20 bp, Artificial
  CRISPR gRNA sequence
agacttcacccgttattttt

SEQ ID NO: 91200 - DNA, 20 bp, Artificial
  CRISPR gRNA sequence
cacccgttatttttaggttt

SEQ ID NO: 91201 - DNA, 20 bp, Artificial
  CRISPR gRNA sequence
gtgtgacatcacattatttt

SEQ ID NO: 91202 - DNA, 20 bp, Artificial
  CRISPR gRNA sequence
atcacattatttttagtttg

SEQ ID NO: 91203 - DNA, 20 bp, Artificial
  CRISPR gRNA sequence
attatttttagtttgcagct

SEQ ID NO: 91204 - DNA, 20 bp, Artificial
  CRISPR gRNA sequence
tttagtttgcagcttagttg

SEQ ID NO: 91205 - DNA, 20 bp, Artificial
  CRISPR gRNA sequence
ttgcagtgcatccgatgtaa

SEQ ID NO: 91206 - DNA, 20 bp, Artificial
  CRISPR gRNA sequence
atgtaaaagtgcttttgatt

SEQ ID NO: 91207 - DNA, 20 bp, Artificial
  CRISPR gRNA sequence
tgtaaaagtgcttttgattc

SEQ ID NO: 91208 - DNA, 20 bp, Artificial
  CRISPR gRNA sequence
tgaacatattgtatcatatg

SEQ ID NO: 91209 - DNA, 20 bp, Artificial
  CRISPR gRNA sequence
gaacatattgtatcatatgt

SEQ ID NO: 91210 - DNA, 20 bp, Artificial
  CRISPR gRNA sequence
aacatattgtatcatatgta

SEQ ID NO: 91211 - DNA, 20 bp, Artificial
  CRISPR gRNA sequence
tatcatatgtagggacacat

SEQ ID NO: 91212 - DNA, 20 bp, Artificial
  CRISPR gRNA sequence
tcatatgtagggacacatca

SEQ ID NO: 91213 - DNA, 20 bp, Artificial
  CRISPR gRNA sequence
tagggacacatcagagtaat

SEQ ID NO: 91214 - DNA, 20 bp, Artificial
  CRISPR gRNA sequence
cagagtaattagcatgaaaa

SEQ ID NO: 91215 - DNA, 20 bp, Artificial
  CRISPR gRNA sequence
atgaaaacagtctaatgaca

SEQ ID NO: 91216 - DNA, 20 bp, Artificial
  CRISPR gRNA sequence
aatttttttcttttctttct

SEQ ID NO: 91217 - DNA, 20 bp, Artificial
  CRISPR gRNA sequence
tttctttctaagtcgttact

SEQ ID NO: 91218 - DNA, 20 bp, Artificial
  CRISPR gRNA sequence
ctttctaagtcgttactaag

SEQ ID NO: 91219 - DNA, 20 bp, Artificial
  CRISPR gRNA sequence
taagtcgttactaagaagtc

SEQ ID NO: 91220 - DNA, 20 bp, Artificial
  CRISPR gRNA sequence
gtcgttactaagaagtccag

SEQ ID NO: 91221 - DNA, 20 bp, Artificial
  CRISPR gRNA sequence
gttactaagaagtccagaag

SEQ ID NO: 91222 - DNA, 20 bp, Artificial
  CRISPR gRNA sequence
cagaagtagtgcaattttta

SEQ ID NO: 91223 - DNA, 20 bp, Artificial
  CRISPR gRNA sequence
tagtgcaatttttacagaaa

SEQ ID NO: 91224 - DNA, 20 bp, Artificial
  CRISPR gRNA sequence
aatttttacagaaacagcaa

SEQ ID NO: 91225 - DNA, 20 bp, Artificial
  CRISPR gRNA sequence
aacagcaacagctattaaat

SEQ ID NO: 91226 - DNA, 20 bp, Artificial
  CRISPR gRNA sequence
gcaacagctattaaatcagc

SEQ ID NO: 91227 - DNA, 20 bp, Artificial
  CRISPR gRNA sequence
gctattaaatcagcaagttt

SEQ ID NO: 91228 - DNA, 20 bp, Artificial
  CRISPR gRNA sequence
tattaaatcagcaagttttg

SEQ ID NO: 91229 - DNA, 20 bp, Artificial
  CRISPR gRNA sequence
aatcagcaagttttggagca

SEQ ID NO: 91230 - DNA, 20 bp, Artificial
  CRISPR gRNA sequence
aagttttggagcaaagacaa

SEQ ID NO: 91231 - DNA, 20 bp, Artificial
  CRISPR gRNA sequence
ttttggagcaaagacaacag

SEQ ID NO: 91232 - DNA, 20 bp, Artificial
  CRISPR gRNA sequence
gcaaagacaacagcagtttc

SEQ ID NO: 91233 - DNA, 20 bp, Artificial
  CRISPR gRNA sequence
caaagacaacagcagtttcc

SEQ ID NO: 91234 - DNA, 20 bp, Artificial
  CRISPR gRNA sequence
gtttccaggaacatcaatgt

SEQ ID NO: 91235 - DNA, 20 bp, Artificial
  CRISPR gRNA sequence
tttccaggaacatcaatgtg

SEQ ID NO: 91236 - DNA, 20 bp, Artificial
  CRISPR gRNA sequence
ttccaggaacatcaatgtga

SEQ ID NO: 91237 - DNA, 20 bp, Artificial
  CRISPR gRNA sequence
tcaatgtgagggaacttacc

SEQ ID NO: 91238 - DNA, 20 bp, Artificial
  CRISPR gRNA sequence
acttaccaagaacatctaca

SEQ ID NO: 91239 - DNA, 20 bp, Artificial
  CRISPR gRNA sequence
ggttttttatcttattgtaa

SEQ ID NO: 91240 - DNA, 20 bp, Artificial
  CRISPR gRNA sequence
tttatcttattgtaatagat

SEQ ID NO: 91241 - DNA, 20 bp, Artificial
  CRISPR gRNA sequence
agatgagcatatttttttac

SEQ ID NO: 91242 - DNA, 20 bp, Artificial
  CRISPR gRNA sequence
atttttttaccagacataaa

SEQ ID NO: 91243 - DNA, 20 bp, Artificial
  CRISPR gRNA sequence
tttttttaccagacataaat

SEQ ID NO: 91244 - DNA, 20 bp, Artificial
  CRISPR gRNA sequence
ttttttaccagacataaatg

SEQ ID NO: 91245 - DNA, 20 bp, Artificial
  CRISPR gRNA sequence
ggggtaataatctatgcctg

SEQ ID NO: 91246 - DNA, 20 bp, Artificial
  CRISPR gRNA sequence
attattaccccatttatgtc

SEQ ID NO: 91247 - DNA, 20 bp, Artificial
  CRISPR gRNA sequence
atatgctcatctattacaat

SEQ ID NO: 91248 - DNA, 20 bp, Artificial
  CRISPR gRNA sequence
caataagataaaaaaccatg

SEQ ID NO: 91249 - DNA, 20 bp, Artificial
  CRISPR gRNA sequence
aaaaaccatgtagatgttct

SEQ ID NO: 91250 - DNA, 20 bp, Artificial
  CRISPR gRNA sequence
accatgtagatgttcttggt

SEQ ID NO: 91251 - DNA, 20 bp, Artificial
  CRISPR gRNA sequence
ttccctcacattgatgttcc

SEQ ID NO: 91252 - DNA, 20 bp, Artificial
  CRISPR gRNA sequence
tccaaaacttgctgatttaa

SEQ ID NO: 91253 - DNA, 20 bp, Artificial
  CRISPR gRNA sequence
tgtaaaaattgcactacttc

SEQ ID NO: 91254 - DNA, 20 bp, Artificial
  CRISPR gRNA sequence
tgcactacttctggacttct

SEQ ID NO: 91255 - DNA, 20 bp, Artificial
  CRISPR gRNA sequence
tggacttcttagtaacgact

SEQ ID NO: 91256 - DNA, 20 bp, Artificial
  CRISPR gRNA sequence
cttcttagtaacgacttaga

SEQ ID NO: 91257 - DNA, 20 bp, Artificial
  CRISPR gRNA sequence
tagtaacgacttagaaagaa

SEQ ID NO: 91258 - DNA, 20 bp, Artificial
  CRISPR gRNA sequence
gaaaagaaaaaaattattaa

SEQ ID NO: 91259 - DNA, 20 bp, Artificial
  CRISPR gRNA sequence
atagcattaatctatgtcat

SEQ ID NO: 91260 - DNA, 20 bp, Artificial
  CRISPR gRNA sequence
atatgatacaatatgttcac

SEQ ID NO: 91261 - DNA, 20 bp, Artificial
  CRISPR gRNA sequence
caagaatatgcctgaatcaa

SEQ ID NO: 91262 - DNA, 20 bp, Artificial
  CRISPR gRNA sequence
aatcaaaagcacttttacat

SEQ ID NO: 91263 - DNA, 20 bp, Artificial
  CRISPR gRNA sequence
acatcggatgcactgcaact

SEQ ID NO: 91264 - DNA, 20 bp, Artificial
  CRISPR gRNA sequence
atactaaaacctaaaaataa

SEQ ID NO: 91265 - DNA, 20 bp, Artificial
  CRISPR gRNA sequence
tactaaaacctaaaaataac

SEQ ID NO: 91266 - DNA, 20 bp, Artificial
  CRISPR gRNA sequence
aaacctaaaaataacgggtg

SEQ ID NO: 91267 - DNA, 20 bp, Artificial
  CRISPR gRNA sequence
taacgggtgaagtctgttat

SEQ ID NO: 91268 - DNA, 20 bp, Artificial
  CRISPR gRNA sequence
tattggtgactttgtgtaaa

SEQ ID NO: 91269 - DNA, 20 bp, Artificial
  CRISPR gRNA sequence
attggtgactttgtgtaaaa

SEQ ID NO: 91270 - DNA, 20 bp, Artificial
  CRISPR gRNA sequence
aaacaccttctctaatatgc

SEQ ID NO: 91271 - DNA, 20 bp, Artificial
  CRISPR gRNA sequence
tatactctcttgaaatatgt

SEQ ID NO: 91272 - DNA, 20 bp, Artificial
  CRISPR gRNA sequence
tcttgaaatatgtaagaaca

SEQ ID NO: 91273 - DNA, 20 bp, Artificial
  CRISPR gRNA sequence
ttgaaatatgtaagaacaaa

SEQ ID NO: 91274 - DNA, 20 bp, Artificial
  CRISPR gRNA sequence
atgtaagaacaaagagctaa

SEQ ID NO: 91275 - DNA, 20 bp, Artificial
  CRISPR gRNA sequence
taagaacaaagagctaaaag

SEQ ID NO: 91276 - DNA, 20 bp, Artificial
  CRISPR gRNA sequence
agctaaaagtagcactgacc

SEQ ID NO: 91277 - DNA, 20 bp, Artificial
  CRISPR gRNA sequence
gctaaaagtagcactgaccc

SEQ ID NO: 91278 - DNA, 20 bp, Artificial
  CRISPR gRNA sequence
gtagcactgacccaggatta

SEQ ID NO: 91279 - DNA, 20 bp, Artificial
  CRISPR gRNA sequence
cactgacccaggattatagc

SEQ ID NO: 91280 - DNA, 20 bp, Artificial
  CRISPR gRNA sequence
gattatagcaagaaaaaaaa

SEQ ID NO: 91281 - DNA, 20 bp, Artificial
  CRISPR gRNA sequence
ttatagcaagaaaaaaaatg

SEQ ID NO: 91282 - DNA, 20 bp, Artificial
  CRISPR gRNA sequence
aagaaaaaaaatggagatga

SEQ ID NO: 91283 - DNA, 20 bp, Artificial
  CRISPR gRNA sequence
agaaaaaaaatggagatgaa

SEQ ID NO: 91284 - DNA, 20 bp, Artificial
  CRISPR gRNA sequence
gaaaaaaaatggagatgaaa

SEQ ID NO: 91285 - DNA, 20 bp, Artificial
  CRISPR gRNA sequence
aaaaaaaatggagatgaaag

SEQ ID NO: 91286 - DNA, 20 bp, Artificial
  CRISPR gRNA sequence
aaaaaaatggagatgaaagg

SEQ ID NO: 91287 - DNA, 20 bp, Artificial
  CRISPR gRNA sequence
aagggggccacatgtgaaaa

SEQ ID NO: 91288 - DNA, 20 bp, Artificial
  CRISPR gRNA sequence
ggggccacatgtgaaaatag

SEQ ID NO: 91289 - DNA, 20 bp, Artificial
  CRISPR gRNA sequence
tgaaaatagcagctaaatgc

SEQ ID NO: 91290 - DNA, 20 bp, Artificial
  CRISPR gRNA sequence
gtttgtacatacatacaaac

SEQ ID NO: 91291 - DNA, 20 bp, Artificial
  CRISPR gRNA sequence
acatacatacaaactagtgc

SEQ ID NO: 91292 - DNA, 20 bp, Artificial
  CRISPR gRNA sequence
tacatacaaactagtgctag

SEQ ID NO: 91293 - DNA, 20 bp, Artificial
  CRISPR gRNA sequence
acaaactagtgctagaagtc

SEQ ID NO: 91294 - DNA, 20 bp, Artificial
  CRISPR gRNA sequence
ctagaagtcaagtttctcat

SEQ ID NO: 91295 - DNA, 20 bp, Artificial
  CRISPR gRNA sequence
tagaagtcaagtttctcatt

SEQ ID NO: 91296 - DNA, 20 bp, Artificial
  CRISPR gRNA sequence
aagtttctcattaggcaact

SEQ ID NO: 91297 - DNA, 20 bp, Artificial
  CRISPR gRNA sequence
taggcaactaagtcttcata

SEQ ID NO: 91298 - DNA, 20 bp, Artificial
  CRISPR gRNA sequence
gaaattaaaaattgtgtgta

SEQ ID NO: 91299 - DNA, 20 bp, Artificial
  CRISPR gRNA sequence
aaattaaaaattgtgtgtat

SEQ ID NO: 91300 - DNA, 20 bp, Artificial
  CRISPR gRNA sequence
atatatatgtacatatatat

SEQ ID NO: 91301 - DNA, 20 bp, Artificial
  CRISPR gRNA sequence
atcggtatataccaaaattt

SEQ ID NO: 91302 - DNA, 20 bp, Artificial
  CRISPR gRNA sequence
tcggtatataccaaaatttc

SEQ ID NO: 91303 - DNA, 20 bp, Artificial
  CRISPR gRNA sequence
acactcatcactttaaaata

SEQ ID NO: 91304 - DNA, 20 bp, Artificial
  CRISPR gRNA sequence
taataatataacaaatataa

SEQ ID NO: 91305 - DNA, 20 bp, Artificial
  CRISPR gRNA sequence
tatgattaacatattattat

SEQ ID NO: 91306 - DNA, 20 bp, Artificial
  CRISPR gRNA sequence
tgattaacatattattatta

SEQ ID NO: 91307 - DNA, 20 bp, Artificial
  CRISPR gRNA sequence
taacatattattattagaga

SEQ ID NO: 91308 - DNA, 20 bp, Artificial
  CRISPR gRNA sequence
aacatattattattagagac

SEQ ID NO: 91309 - DNA, 20 bp, Artificial
  CRISPR gRNA sequence
acatattattattagagaca

SEQ ID NO: 91310 - DNA, 20 bp, Artificial
  CRISPR gRNA sequence
tctcactctgttccccacgc

SEQ ID NO: 91311 - DNA, 20 bp, Artificial
  CRISPR gRNA sequence
tcactctgttccccacgctg

SEQ ID NO: 91312 - DNA, 20 bp, Artificial
  CRISPR gRNA sequence
ctgttccccacgctggagtg

SEQ ID NO: 91313 - DNA, 20 bp, Artificial
  CRISPR gRNA sequence
ttccccacgctggagtgcag

SEQ ID NO: 91314 - DNA, 20 bp, Artificial
  CRISPR gRNA sequence
acgctggagtgcagtggcgt

SEQ ID NO: 91315 - DNA, 20 bp, Artificial
  CRISPR gRNA sequence
ggagtgcagtggcgtgagca

SEQ ID NO: 91316 - DNA, 20 bp, Artificial
  CRISPR gRNA sequence
ggcgtgagcatagctcactg

SEQ ID NO: 91317 - DNA, 20 bp, Artificial
  CRISPR gRNA sequence
cactgcagtcttgaactcct

SEQ ID NO: 91318 - DNA, 20 bp, Artificial
  CRISPR gRNA sequence
agtcttgaactcctcggctc

SEQ ID NO: 91319 - DNA, 20 bp, Artificial
  CRISPR gRNA sequence
ctcaagcaatcatcctgcca

SEQ ID NO: 91320 - DNA, 20 bp, Artificial
  CRISPR gRNA sequence
cctgccacagtctcctgtaa

SEQ ID NO: 91321 - DNA, 20 bp, Artificial
  CRISPR gRNA sequence
ctgccacagtctcctgtaat

SEQ ID NO: 91322 - DNA, 20 bp, Artificial
  CRISPR gRNA sequence
aaaatacttacataaattta

SEQ ID NO: 91323 - DNA, 20 bp, Artificial
  CRISPR gRNA sequence
aatacttacataaatttata

SEQ ID NO: 91324 - DNA, 20 bp, Artificial
  CRISPR gRNA sequence
tttatagagaaaaaaatctt

SEQ ID NO: 91325 - DNA, 20 bp, Artificial
  CRISPR gRNA sequence
aaaaaatctttggccccaat

SEQ ID NO: 91326 - DNA, 20 bp, Artificial
  CRISPR gRNA sequence
tggccccaataagctgcaaa

SEQ ID NO: 91327 - DNA, 20 bp, Artificial
  CRISPR gRNA sequence
gcaaaaagataaactgaata

SEQ ID NO: 91328 - DNA, 20 bp, Artificial
  CRISPR gRNA sequence
tatcattaaatactgacttt

SEQ ID NO: 91329 - DNA, 20 bp, Artificial
  CRISPR gRNA sequence
agattatatgtattatatct

SEQ ID NO: 91330 - DNA, 20 bp, Artificial
  CRISPR gRNA sequence
tacattttctatttattaaa

SEQ ID NO: 91331 - DNA, 20 bp, Artificial
  CRISPR gRNA sequence
gttttatttaaaaatcatct

SEQ ID NO: 91332 - DNA, 20 bp, Artificial
  CRISPR gRNA sequence
cttagctgttatgacactgt

SEQ ID NO: 91333 - DNA, 20 bp, Artificial
  CRISPR gRNA sequence
ttatgacactgttggacatt

SEQ ID NO: 91334 - DNA, 20 bp, Artificial
  CRISPR gRNA sequence
tatgacactgttggacattt

SEQ ID NO: 91335 - DNA, 20 bp, Artificial
  CRISPR gRNA sequence
ctaccttttttactatttat

SEQ ID NO: 91336 - DNA, 20 bp, Artificial
  CRISPR gRNA sequence
atttatgagaaatatattcc

SEQ ID NO: 91337 - DNA, 20 bp, Artificial
  CRISPR gRNA sequence
tgtttaactctatccatatt

SEQ ID NO: 91338 - DNA, 20 bp, Artificial
  CRISPR gRNA sequence
gtttaactctatccatattt

SEQ ID NO: 91339 - DNA, 20 bp, Artificial
  CRISPR gRNA sequence
tcatattaaatgtgatgtct

SEQ ID NO: 91340 - DNA, 20 bp, Artificial
  CRISPR gRNA sequence
aaatgtgatgtctgagttga

SEQ ID NO: 91341 - DNA, 20 bp, Artificial
  CRISPR gRNA sequence
aatgtgatgtctgagttgaa

SEQ ID NO: 91342 - DNA, 20 bp, Artificial
  CRISPR gRNA sequence
atgtgatgtctgagttgaaa

SEQ ID NO: 91343 - DNA, 20 bp, Artificial
  CRISPR gRNA sequence
gagttgaaagggatgactcc

SEQ ID NO: 91344 - DNA, 20 bp, Artificial
  CRISPR gRNA sequence
attgcccaactgctttctga

SEQ ID NO: 91345 - DNA, 20 bp, Artificial
  CRISPR gRNA sequence
tataatgccattaactactt

SEQ ID NO: 91346 - DNA, 20 bp, Artificial
  CRISPR gRNA sequence
tgagaatgtccatttcatga

SEQ ID NO: 91347 - DNA, 20 bp, Artificial
  CRISPR gRNA sequence
tacctttccatatcatttaa

SEQ ID NO: 91348 - DNA, 20 bp, Artificial
  CRISPR gRNA sequence
ctatcttttgcaatgtattg

SEQ ID NO: 91349 - DNA, 20 bp, Artificial
  CRISPR gRNA sequence
tttgcaatgtattgaagcca

SEQ ID NO: 91350 - DNA, 20 bp, Artificial
  CRISPR gRNA sequence
ttgcaatgtattgaagccaa

SEQ ID NO: 91351 - DNA, 20 bp, Artificial
  CRISPR gRNA sequence
aggttttcctcatcaaatta

SEQ ID NO: 91352 - DNA, 20 bp, Artificial
  CRISPR gRNA sequence
ggttttcctcatcaaattac

SEQ ID NO: 91353 - DNA, 20 bp, Artificial
  CRISPR gRNA sequence
tttgtaataaactttctttg

SEQ ID NO: 91354 - DNA, 20 bp, Artificial
  CRISPR gRNA sequence
aataaactttctttgcagtt

SEQ ID NO: 91355 - DNA, 20 bp, Artificial
  CRISPR gRNA sequence
tttctttgcagttaagactg

SEQ ID NO: 91356 - DNA, 20 bp, Artificial
  CRISPR gRNA sequence
agttaagactgaagctgtca

SEQ ID NO: 91357 - DNA, 20 bp, Artificial
  CRISPR gRNA sequence
ttaagactgaagctgtcaaa

SEQ ID NO: 91358 - DNA, 20 bp, Artificial
  CRISPR gRNA sequence
taagactgaagctgtcaaag

SEQ ID NO: 91359 - DNA, 20 bp, Artificial
  CRISPR gRNA sequence
aacatattttatatatatgt

SEQ ID NO: 91360 - DNA, 20 bp, Artificial
  CRISPR gRNA sequence
acatattttatatatatgta

SEQ ID NO: 91361 - DNA, 20 bp, Artificial
  CRISPR gRNA sequence
tgatcatgtttaatgattta

SEQ ID NO: 91362 - DNA, 20 bp, Artificial
  CRISPR gRNA sequence
gatcatgtttaatgatttat

SEQ ID NO: 91363 - DNA, 20 bp, Artificial
  CRISPR gRNA sequence
atcatgtttaatgatttata

SEQ ID NO: 91364 - DNA, 20 bp, Artificial
  CRISPR gRNA sequence
ttatagggtgctctgttgcc

SEQ ID NO: 91365 - DNA, 20 bp, Artificial
  CRISPR gRNA sequence
tatagggtgctctgttgcct

SEQ ID NO: 91366 - DNA, 20 bp, Artificial
  CRISPR gRNA sequence
gggtgctctgttgcctaggc

SEQ ID NO: 91367 - DNA, 20 bp, Artificial
  CRISPR gRNA sequence
gtgctctgttgcctaggctg

SEQ ID NO: 91368 - DNA, 20 bp, Artificial
  CRISPR gRNA sequence
ctgttgcctaggctggagta

SEQ ID NO: 91369 - DNA, 20 bp, Artificial
  CRISPR gRNA sequence
ttgcctaggctggagtacag

SEQ ID NO: 91370 - DNA, 20 bp, Artificial
  CRISPR gRNA sequence
ggagtacagtggtatgatca

SEQ ID NO: 91371 - DNA, 20 bp, Artificial
  CRISPR gRNA sequence
ggtatgatcatagctcattg

SEQ ID NO: 91372 - DNA, 20 bp, Artificial
  CRISPR gRNA sequence
tcattgcagcctcgaattcc

SEQ ID NO: 91373 - DNA, 20 bp, Artificial
  CRISPR gRNA sequence
agcctcgaattcctggactc

SEQ ID NO: 91374 - DNA, 20 bp, Artificial
  CRISPR gRNA sequence
ctcaagcaatcctcctgttt

SEQ ID NO: 91375 - DNA, 20 bp, Artificial
  CRISPR gRNA sequence
tcctcctgtttcagcctctt

SEQ ID NO: 91376 - DNA, 20 bp, Artificial
  CRISPR gRNA sequence
tcctgtttcagcctcttgag

SEQ ID NO: 91377 - DNA, 20 bp, Artificial
  CRISPR gRNA sequence
gtttcagcctcttgagtagc

SEQ ID NO: 91378 - DNA, 20 bp, Artificial
  CRISPR gRNA sequence
tttcagcctcttgagtagcc

SEQ ID NO: 91379 - DNA, 20 bp, Artificial
  CRISPR gRNA sequence
ctcttgagtagccaggacta

SEQ ID NO: 91380 - DNA, 20 bp, Artificial
  CRISPR gRNA sequence
cagctacataccatcacact

SEQ ID NO: 91381 - DNA, 20 bp, Artificial
  CRISPR gRNA sequence
ctaatttttaaatttttttg

SEQ ID NO: 91382 - DNA, 20 bp, Artificial
  CRISPR gRNA sequence
tttttaaatttttttgtaga

SEQ ID NO: 91383 - DNA, 20 bp, Artificial
  CRISPR gRNA sequence
ttttaaatttttttgtagat

SEQ ID NO: 91384 - DNA, 20 bp, Artificial
  CRISPR gRNA sequence
tttaaatttttttgtagatg

SEQ ID NO: 91385 - DNA, 20 bp, Artificial
  CRISPR gRNA sequence
tggggtctcgctacgttgcc

SEQ ID NO: 91386 - DNA, 20 bp, Artificial
  CRISPR gRNA sequence
tctcgctacgttgcccagaa

SEQ ID NO: 91387 - DNA, 20 bp, Artificial
  CRISPR gRNA sequence
ccagaatggtctcaaattcc

SEQ ID NO: 91388 - DNA, 20 bp, Artificial
  CRISPR gRNA sequence
ggtctcaaattcccagcctc

SEQ ID NO: 91389 - DNA, 20 bp, Artificial
  CRISPR gRNA sequence
cctcaagtgatcctcccacc

SEQ ID NO: 91390 - DNA, 20 bp, Artificial
  CRISPR gRNA sequence
tcctcccacctggcctccca

SEQ ID NO: 91391 - DNA, 20 bp, Artificial
  CRISPR gRNA sequence
cacctggcctcccaaagtgc

SEQ ID NO: 91392 - DNA, 20 bp, Artificial
  CRISPR gRNA sequence
acctggcctcccaaagtgct

SEQ ID NO: 91393 - DNA, 20 bp, Artificial
  CRISPR gRNA sequence
ctcccaaagtgctaggatta

SEQ ID NO: 91394 - DNA, 20 bp, Artificial
  CRISPR gRNA sequence
tcccaaagtgctaggattac

SEQ ID NO: 91395 - DNA, 20 bp, Artificial
  CRISPR gRNA sequence
catgaaccacaatgcccaac

SEQ ID NO: 91396 - DNA, 20 bp, Artificial
  CRISPR gRNA sequence
atgaaccacaatgcccaacc

SEQ ID NO: 91397 - DNA, 20 bp, Artificial
  CRISPR gRNA sequence
tattttatgtgataaaatac

SEQ ID NO: 91398 - DNA, 20 bp, Artificial
  CRISPR gRNA sequence
aataccagacacgttaacca

SEQ ID NO: 91399 - DNA, 20 bp, Artificial
  CRISPR gRNA sequence
tgttgtacatatttttgctc

SEQ ID NO: 91400 - DNA, 20 bp, Artificial
  CRISPR gRNA sequence
gttgtacatatttttgctct

SEQ ID NO: 91401 - DNA, 20 bp, Artificial
  CRISPR gRNA sequence
tttgccaccatttttgacta

SEQ ID NO: 91402 - DNA, 20 bp, Artificial
  CRISPR gRNA sequence
ctatagcattcatttttatg

SEQ ID NO: 91403 - DNA, 20 bp, Artificial
  CRISPR gRNA sequence
gcattcatttttatgtagtc

SEQ ID NO: 91404 - DNA, 20 bp, Artificial
  CRISPR gRNA sequence
ctctgtgattttgtctatat

SEQ ID NO: 91405 - DNA, 20 bp, Artificial
  CRISPR gRNA sequence
aaaaatctcattacattttt

SEQ ID NO: 91406 - DNA, 20 bp, Artificial
  CRISPR gRNA sequence
aaaatctcattacatttttg

SEQ ID NO: 91407 - DNA, 20 bp, Artificial
  CRISPR gRNA sequence
ctcattacatttttgaggta

SEQ ID NO: 91408 - DNA, 20 bp, Artificial
  CRISPR gRNA sequence
tttttaaaattttgacttat

SEQ ID NO: 91409 - DNA, 20 bp, Artificial
  CRISPR gRNA sequence
ttttaaaattttgacttatt

SEQ ID NO: 91410 - DNA, 20 bp, Artificial
  CRISPR gRNA sequence
taggaatttattttgatgta

SEQ ID NO: 91411 - DNA, 20 bp, Artificial
  CRISPR gRNA sequence
gatgtatagtgtgatgtcat

SEQ ID NO: 91412 - DNA, 20 bp, Artificial
  CRISPR gRNA sequence
atttataactgatttacaaa

SEQ ID NO: 91413 - DNA, 20 bp, Artificial
  CRISPR gRNA sequence
atttacaaacagatatttac

SEQ ID NO: 91414 - DNA, 20 bp, Artificial
  CRISPR gRNA sequence
tgatttaacacttgttctaa

SEQ ID NO: 91415 - DNA, 20 bp, Artificial
  CRISPR gRNA sequence
atttaacacttgttctaaaa

SEQ ID NO: 91416 - DNA, 20 bp, Artificial
  CRISPR gRNA sequence
taacacttgttctaaaagag

SEQ ID NO: 91417 - DNA, 20 bp, Artificial
  CRISPR gRNA sequence
aacacttgttctaaaagagt

SEQ ID NO: 91418 - DNA, 20 bp, Artificial
  CRISPR gRNA sequence
ttctaaaagagtaggtcttg

SEQ ID NO: 91419 - DNA, 20 bp, Artificial
  CRISPR gRNA sequence
tctaaaagagtaggtcttgc

SEQ ID NO: 91420 - DNA, 20 bp, Artificial
  CRISPR gRNA sequence
tcttgcaggacgatccccaa

SEQ ID NO: 91421 - DNA, 20 bp, Artificial
  CRISPR gRNA sequence
tcctgttctttgtttaacaa

SEQ ID NO: 91422 - DNA, 20 bp, Artificial
  CRISPR gRNA sequence
ctgttctttgtttaacaatg

SEQ ID NO: 91423 - DNA, 20 bp, Artificial
  CRISPR gRNA sequence
gttctttgtttaacaatgga

SEQ ID NO: 91424 - DNA, 20 bp, Artificial
  CRISPR gRNA sequence
gtatgttatctgcactttcc

SEQ ID NO: 91425 - DNA, 20 bp, Artificial
  CRISPR gRNA sequence
tatgttatctgcactttcct

SEQ ID NO: 91426 - DNA, 20 bp, Artificial
  CRISPR gRNA sequence
ataaatgataaaaatgcaaa

SEQ ID NO: 91427 - DNA, 20 bp, Artificial
  CRISPR gRNA sequence
taaaaatgcaaatagataaa

SEQ ID NO: 91428 - DNA, 20 bp, Artificial
  CRISPR gRNA sequence
agataaacagttaacgtaat

SEQ ID NO: 91429 - DNA, 20 bp, Artificial
  CRISPR gRNA sequence
aacgtaataagtcatgatta

SEQ ID NO: 91430 - DNA, 20 bp, Artificial
  CRISPR gRNA sequence
acgtaataagtcatgattac

SEQ ID NO: 91431 - DNA, 20 bp, Artificial
  CRISPR gRNA sequence
tcatgattacaggtatttca

SEQ ID NO: 91432 - DNA, 20 bp, Artificial
  CRISPR gRNA sequence
tatttcaaagatgtaatgaa

SEQ ID NO: 91433 - DNA, 20 bp, Artificial
  CRISPR gRNA sequence
atttcaaagatgtaatgaac

SEQ ID NO: 91434 - DNA, 20 bp, Artificial
  CRISPR gRNA sequence
atttcttccttcttcttgcc

SEQ ID NO: 91435 - DNA, 20 bp, Artificial
  CRISPR gRNA sequence
ccttcttcttgcccagtctc

SEQ ID NO: 91436 - DNA, 20 bp, Artificial
  CRISPR gRNA sequence
cttcttcttgcccagtctct

SEQ ID NO: 91437 - DNA, 20 bp, Artificial
  CRISPR gRNA sequence
gcccagtctctgggcaactc

SEQ ID NO: 91438 - DNA, 20 bp, Artificial
  CRISPR gRNA sequence
cccagtctctgggcaactct

SEQ ID NO: 91439 - DNA, 20 bp, Artificial
  CRISPR gRNA sequence
gtctctgggcaactctggga

SEQ ID NO: 91440 - DNA, 20 bp, Artificial
  CRISPR gRNA sequence
gggaaagttcttcattatca

SEQ ID NO: 91441 - DNA, 20 bp, Artificial
  CRISPR gRNA sequence
ggaaagttcttcattatcat

SEQ ID NO: 91442 - DNA, 20 bp, Artificial
  CRISPR gRNA sequence
gttcttcattatcataggca

SEQ ID NO: 91443 - DNA, 20 bp, Artificial
  CRISPR gRNA sequence
cattatcataggcaaagtat

SEQ ID NO: 91444 - DNA, 20 bp, Artificial
  CRISPR gRNA sequence
tatcataggcaaagtattgg

SEQ ID NO: 91445 - DNA, 20 bp, Artificial
  CRISPR gRNA sequence
ctcctcgctccctctccccc

SEQ ID NO: 91446 - DNA, 20 bp, Artificial
  CRISPR gRNA sequence
ctccccccagattttcaacc

SEQ ID NO: 91447 - DNA, 20 bp, Artificial
  CRISPR gRNA sequence
tccccccagattttcaacct

SEQ ID NO: 91448 - DNA, 20 bp, Artificial
  CRISPR gRNA sequence
gattttcaacctgggttctt

SEQ ID NO: 91449 - DNA, 20 bp, Artificial
  CRISPR gRNA sequence
acctgggttctttagtctct

SEQ ID NO: 91450 - DNA, 20 bp, Artificial
  CRISPR gRNA sequence
tgggttctttagtctcttgg

SEQ ID NO: 91451 - DNA, 20 bp, Artificial
  CRISPR gRNA sequence
gggttctttagtctcttggc

SEQ ID NO: 91452 - DNA, 20 bp, Artificial
  CRISPR gRNA sequence
ttggcaggtctcaaaattaa

SEQ ID NO: 91453 - DNA, 20 bp, Artificial
  CRISPR gRNA sequence
aaaattaatagtgtgtgtga

SEQ ID NO: 91454 - DNA, 20 bp, Artificial
  CRISPR gRNA sequence
aattaatagtgtgtgtgata

SEQ ID NO: 91455 - DNA, 20 bp, Artificial
  CRISPR gRNA sequence
gtgtgtgatagagtgtgata

SEQ ID NO: 91456 - DNA, 20 bp, Artificial
  CRISPR gRNA sequence
gtgtgatatagtaatactgt

SEQ ID NO: 91457 - DNA, 20 bp, Artificial
  CRISPR gRNA sequence
gtgatatagtaatactgtga

SEQ ID NO: 91458 - DNA, 20 bp, Artificial
  CRISPR gRNA sequence
tgatatagtaatactgtgag

SEQ ID NO: 91459 - DNA, 20 bp, Artificial
  CRISPR gRNA sequence
tatagtaatactgtgagagg

SEQ ID NO: 91460 - DNA, 20 bp, Artificial
  CRISPR gRNA sequence
atagtaatactgtgagaggt

SEQ ID NO: 91461 - DNA, 20 bp, Artificial
  CRISPR gRNA sequence
actgtgagaggtgggccact

SEQ ID NO: 91462 - DNA, 20 bp, Artificial
  CRISPR gRNA sequence
agaggtgggccactaagatt

SEQ ID NO: 91463 - DNA, 20 bp, Artificial
  CRISPR gRNA sequence
gaggtgggccactaagattg

SEQ ID NO: 91464 - DNA, 20 bp, Artificial
  CRISPR gRNA sequence
gtgggccactaagattgagg

SEQ ID NO: 91465 - DNA, 20 bp, Artificial
  CRISPR gRNA sequence
gggccactaagattgaggca

SEQ ID NO: 91466 - DNA, 20 bp, Artificial
  CRISPR gRNA sequence
attgaggcagagttacttgt

SEQ ID NO: 91467 - DNA, 20 bp, Artificial
  CRISPR gRNA sequence
tcaatattacaaaaaatgcc

SEQ ID NO: 91468 - DNA, 20 bp, Artificial
  CRISPR gRNA sequence
atattacaaaaaatgccaag

SEQ ID NO: 91469 - DNA, 20 bp, Artificial
  CRISPR gRNA sequence
tctctttatataatgctatc

SEQ ID NO: 91470 - DNA, 20 bp, Artificial
  CRISPR gRNA sequence
ctctttatataatgctatcc

SEQ ID NO: 91471 - DNA, 20 bp, Artificial
  CRISPR gRNA sequence
aaacataatctgcttgcctt

SEQ ID NO: 91472 - DNA, 20 bp, Artificial
  CRISPR gRNA sequence
ttggatgaaatatatgaact

SEQ ID NO: 91473 - DNA, 20 bp, Artificial
  CRISPR gRNA sequence
ggatgaaatatatgaactca

SEQ ID NO: 91474 - DNA, 20 bp, Artificial
  CRISPR gRNA sequence
gatgaaatatatgaactcag

SEQ ID NO: 91475 - DNA, 20 bp, Artificial
  CRISPR gRNA sequence
caaattatatactgctcaat

SEQ ID NO: 91476 - DNA, 20 bp, Artificial
  CRISPR gRNA sequence
ctgctcaataagatatctga

SEQ ID NO: 91477 - DNA, 20 bp, Artificial
  CRISPR gRNA sequence
atatctgatagctttttacc

SEQ ID NO: 91478 - DNA, 20 bp, Artificial
  CRISPR gRNA sequence
ctgatagctttttacccagt

SEQ ID NO: 91479 - DNA, 20 bp, Artificial
  CRISPR gRNA sequence
cagttggcaaccaaaacaaa

SEQ ID NO: 91480 - DNA, 20 bp, Artificial
  CRISPR gRNA sequence
agttggcaaccaaaacaaat

SEQ ID NO: 91481 - DNA, 20 bp, Artificial
  CRISPR gRNA sequence
gttggcaaccaaaacaaatg

SEQ ID NO: 91482 - DNA, 20 bp, Artificial
  CRISPR gRNA sequence
ttggcaaccaaaacaaatgg

SEQ ID NO: 91483 - DNA, 20 bp, Artificial
  CRISPR gRNA sequence
ggcaaccaaaacaaatgggg

SEQ ID NO: 91484 - DNA, 20 bp, Artificial
  CRISPR gRNA sequence
aaccaaaacaaatgggggag

SEQ ID NO: 91485 - DNA, 20 bp, Artificial
  CRISPR gRNA sequence
gagtagtaaaatattgttta

SEQ ID NO: 91486 - DNA, 20 bp, Artificial
  CRISPR gRNA sequence
tagtaaaatattgtttaaag

SEQ ID NO: 91487 - DNA, 20 bp, Artificial
  CRISPR gRNA sequence
aaagaagcaactgataacca

SEQ ID NO: 91488 - DNA, 20 bp, Artificial
  CRISPR gRNA sequence
taaccaaagctttcaaaatt

SEQ ID NO: 91489 - DNA, 20 bp, Artificial
  CRISPR gRNA sequence
ttagataaacttgcttgaaa

SEQ ID NO: 91490 - DNA, 20 bp, Artificial
  CRISPR gRNA sequence
aaacttgcttgaaaaagcac

SEQ ID NO: 91491 - DNA, 20 bp, Artificial
  CRISPR gRNA sequence
tgaaaaagcactagtataaa

SEQ ID NO: 91492 - DNA, 20 bp, Artificial
  CRISPR gRNA sequence
tgccaactgtatgaacaaaa

SEQ ID NO: 91493 - DNA, 20 bp, Artificial
  CRISPR gRNA sequence
gccaactgtatgaacaaaac

SEQ ID NO: 91494 - DNA, 20 bp, Artificial
  CRISPR gRNA sequence
actgtatgaacaaaacaggt

SEQ ID NO: 91495 - DNA, 20 bp, Artificial
  CRISPR gRNA sequence
taaaatgataccattaccct

SEQ ID NO: 91496 - DNA, 20 bp, Artificial
  CRISPR gRNA sequence
tcactgcccaaaaacaaaat

SEQ ID NO: 91497 - DNA, 20 bp, Artificial
  CRISPR gRNA sequence
ctgcccaaaaacaaaatcag

SEQ ID NO: 91498 - DNA, 20 bp, Artificial
  CRISPR gRNA sequence
tattaccaaatatgtacccc

SEQ ID NO: 91499 - DNA, 20 bp, Artificial
  CRISPR gRNA sequence
atgtacccccagttacctga

SEQ ID NO: 91500 - DNA, 20 bp, Artificial
  CRISPR gRNA sequence
ttaaatacttgtaattttgc

SEQ ID NO: 91501 - DNA, 20 bp, Artificial
  CRISPR gRNA sequence
tggcataacaaaatattgtt

SEQ ID NO: 91502 - DNA, 20 bp, Artificial
  CRISPR gRNA sequence
cacatccaaaattcttacta

SEQ ID NO: 91503 - DNA, 20 bp, Artificial
  CRISPR gRNA sequence
atccaaaattcttactaaag

SEQ ID NO: 91504 - DNA, 20 bp, Artificial
  CRISPR gRNA sequence
taaaattataaatgttttac

SEQ ID NO: 91505 - DNA, 20 bp, Artificial
  CRISPR gRNA sequence
attataaatgttttaccgga

SEQ ID NO: 91506 - DNA, 20 bp, Artificial
  CRISPR gRNA sequence
taacctctttgttctttact

SEQ ID NO: 91507 - DNA, 20 bp, Artificial
  CRISPR gRNA sequence
atctatgctgttttttctct

SEQ ID NO: 91508 - DNA, 20 bp, Artificial
  CRISPR gRNA sequence
tctatgctgttttttctctt

SEQ ID NO: 91509 - DNA, 20 bp, Artificial
  CRISPR gRNA sequence
tctcttgggcttctttctac

SEQ ID NO: 91510 - DNA, 20 bp, Artificial
  CRISPR gRNA sequence
gcttctttctactggcctct

SEQ ID NO: 91511 - DNA, 20 bp, Artificial
  CRISPR gRNA sequence
ctggcctctgagttatctat

SEQ ID NO: 91512 - DNA, 20 bp, Artificial
  CRISPR gRNA sequence
cccttaatttctttcattat

SEQ ID NO: 91513 - DNA, 20 bp, Artificial
  CRISPR gRNA sequence
ttaatttctttcattatgag

SEQ ID NO: 91514 - DNA, 20 bp, Artificial
  CRISPR gRNA sequence
tatttcacccctaaacattt

SEQ ID NO: 91515 - DNA, 20 bp, Artificial
  CRISPR gRNA sequence
atttcacccctaaacatttt

SEQ ID NO: 91516 - DNA, 20 bp, Artificial
  CRISPR gRNA sequence
caacatataaaaactgtaaa

SEQ ID NO: 91517 - DNA, 20 bp, Artificial
  CRISPR gRNA sequence
aaaaagaaaattctaatacc

SEQ ID NO: 91518 - DNA, 20 bp, Artificial
  CRISPR gRNA sequence
aaagaaaattctaataccca

SEQ ID NO: 91519 - DNA, 20 bp, Artificial
  CRISPR gRNA sequence
aagaaaattctaatacccag

SEQ ID NO: 91520 - DNA, 20 bp, Artificial
  CRISPR gRNA sequence
aaaataatttcttcctcctc

SEQ ID NO: 91521 - DNA, 20 bp, Artificial
  CRISPR gRNA sequence
ttcctcctccagcaaccccc

SEQ ID NO: 91522 - DNA, 20 bp, Artificial
  CRISPR gRNA sequence
cccaagttgattttatttat

SEQ ID NO: 91523 - DNA, 20 bp, Artificial
  CRISPR gRNA sequence
attctttcatttttatgtgc

SEQ ID NO: 91524 - DNA, 20 bp, Artificial
  CRISPR gRNA sequence
catttttatgtgcaagataa

SEQ ID NO: 91525 - DNA, 20 bp, Artificial
  CRISPR gRNA sequence
gaatgctgaaattgacttga

SEQ ID NO: 91526 - DNA, 20 bp, Artificial
  CRISPR gRNA sequence
ctgaaattgacttgatggta

SEQ ID NO: 91527 - DNA, 20 bp, Artificial
  CRISPR gRNA sequence
ctgccctcacaaccccacta

SEQ ID NO: 91528 - DNA, 20 bp, Artificial
  CRISPR gRNA sequence
accccactatggaaattcaa

SEQ ID NO: 91529 - DNA, 20 bp, Artificial
  CRISPR gRNA sequence
ccccactatggaaattcaaa

SEQ ID NO: 91530 - DNA, 20 bp, Artificial
  CRISPR gRNA sequence
aaggttaattcacaaaatat

SEQ ID NO: 91531 - DNA, 20 bp, Artificial
  CRISPR gRNA sequence
caaaatattagatactgaat

SEQ ID NO: 91532 - DNA, 20 bp, Artificial
  CRISPR gRNA sequence
attagatactgaattagata

SEQ ID NO: 91533 - DNA, 20 bp, Artificial
  CRISPR gRNA sequence
agatactgaattagataaag

SEQ ID NO: 91534 - DNA, 20 bp, Artificial
  CRISPR gRNA sequence
gaattagataaagaagcttg

SEQ ID NO: 91535 - DNA, 20 bp, Artificial
  CRISPR gRNA sequence
cttgtagtgaaaataacctt

SEQ ID NO: 91536 - DNA, 20 bp, Artificial
  CRISPR gRNA sequence
gaaaataacctttagtcatc

SEQ ID NO: 91537 - DNA, 20 bp, Artificial
  CRISPR gRNA sequence
tcatctagtccaaacttgta

SEQ ID NO: 91538 - DNA, 20 bp, Artificial
  CRISPR gRNA sequence
gtccaaacttgtacagatgt

SEQ ID NO: 91539 - DNA, 20 bp, Artificial
  CRISPR gRNA sequence
ctgcaatgctttttgtccta

SEQ ID NO: 91540 - DNA, 20 bp, Artificial
  CRISPR gRNA sequence
gcaatgctttttgtcctaca

SEQ ID NO: 91541 - DNA, 20 bp, Artificial
  CRISPR gRNA sequence
aacttttgccacatttcatt

SEQ ID NO: 91542 - DNA, 20 bp, Artificial
  CRISPR gRNA sequence
acatttcatttggttttgaa

SEQ ID NO: 91543 - DNA, 20 bp, Artificial
  CRISPR gRNA sequence
tttgaatagctctaacattt

SEQ ID NO: 91544 - DNA, 20 bp, Artificial
  CRISPR gRNA sequence
gaatagctctaacatttcgg

SEQ ID NO: 91545 - DNA, 20 bp, Artificial
  CRISPR gRNA sequence
ctaacatttcggtagaatgt

SEQ ID NO: 91546 - DNA, 20 bp, Artificial
  CRISPR gRNA sequence
taacatttcggtagaatgtt

SEQ ID NO: 91547 - DNA, 20 bp, Artificial
  CRISPR gRNA sequence
catttcggtagaatgttagg

SEQ ID NO: 91548 - DNA, 20 bp, Artificial
  CRISPR gRNA sequence
aatgttaggtagctttactt

SEQ ID NO: 91549 - DNA, 20 bp, Artificial
  CRISPR gRNA sequence
taggtagctttacttaagct

SEQ ID NO: 91550 - DNA, 20 bp, Artificial
  CRISPR gRNA sequence
actccttgtgatttatgcct

SEQ ID NO: 91551 - DNA, 20 bp, Artificial
  CRISPR gRNA sequence
tccttgtgatttatgcctaa

SEQ ID NO: 91552 - DNA, 20 bp, Artificial
  CRISPR gRNA sequence
tgatttatgcctaagagtcc

SEQ ID NO: 91553 - DNA, 20 bp, Artificial
  CRISPR gRNA sequence
cctaagagtcctagttacct

SEQ ID NO: 91554 - DNA, 20 bp, Artificial
  CRISPR gRNA sequence
acctcagaatcatgccatat

SEQ ID NO: 91555 - DNA, 20 bp, Artificial
  CRISPR gRNA sequence
ctactgcttctcttaaatga

SEQ ID NO: 91556 - DNA, 20 bp, Artificial
  CRISPR gRNA sequence
tctcttaaatgatagctttt

SEQ ID NO: 91557 - DNA, 20 bp, Artificial
  CRISPR gRNA sequence
tagctttttagatatttaat

SEQ ID NO: 91558 - DNA, 20 bp, Artificial
  CRISPR gRNA sequence
tttaataagaacaatcccac

SEQ ID NO: 91559 - DNA, 20 bp, Artificial
  CRISPR gRNA sequence
aataagaacaatcccaccag

SEQ ID NO: 91560 - DNA, 20 bp, Artificial
  CRISPR gRNA sequence
taagaacaatcccaccagca

SEQ ID NO: 91561 - DNA, 20 bp, Artificial
  CRISPR gRNA sequence
aagaacaatcccaccagcag

SEQ ID NO: 91562 - DNA, 20 bp, Artificial
  CRISPR gRNA sequence
gaggtcaattcatttatccc

SEQ ID NO: 91563 - DNA, 20 bp, Artificial
  CRISPR gRNA sequence
ccctttatgtgtctctcata

SEQ ID NO: 91564 - DNA, 20 bp, Artificial
  CRISPR gRNA sequence
tatgtgtctctcatatagca

SEQ ID NO: 91565 - DNA, 20 bp, Artificial
  CRISPR gRNA sequence
ctctcatatagcatagttct

SEQ ID NO: 91566 - DNA, 20 bp, Artificial
  CRISPR gRNA sequence
atatagcatagttcttagat

SEQ ID NO: 91567 - DNA, 20 bp, Artificial
  CRISPR gRNA sequence
tagcatagttcttagattgg

SEQ ID NO: 91568 - DNA, 20 bp, Artificial
  CRISPR gRNA sequence
gcatagttcttagattggtg

SEQ ID NO: 91569 - DNA, 20 bp, Artificial
  CRISPR gRNA sequence
tagttcttagattggtggag

SEQ ID NO: 91570 - DNA, 20 bp, Artificial
  CRISPR gRNA sequence
catttaaccttgacttgtgt

SEQ ID NO: 91571 - DNA, 20 bp, Artificial
  CRISPR gRNA sequence
tgtgtaagaaatattaattt

SEQ ID NO: 91572 - DNA, 20 bp, Artificial
  CRISPR gRNA sequence
taccttaataaattcttcat

SEQ ID NO: 91573 - DNA, 20 bp, Artificial
  CRISPR gRNA sequence
taataaattcttcattggaa

SEQ ID NO: 91574 - DNA, 20 bp, Artificial
  CRISPR gRNA sequence
ataaattcttcattggaata

SEQ ID NO: 91575 - DNA, 20 bp, Artificial
  CRISPR gRNA sequence
taatcttgctgctcacaaca

SEQ ID NO: 91576 - DNA, 20 bp, Artificial
  CRISPR gRNA sequence
tcttgctgctcacaacatag

SEQ ID NO: 91577 - DNA, 20 bp, Artificial
  CRISPR gRNA sequence
tgctgctcacaacatagcag

SEQ ID NO: 91578 - DNA, 20 bp, Artificial
  CRISPR gRNA sequence
aagacaccatcatcacctgt

SEQ ID NO: 91579 - DNA, 20 bp, Artificial
  CRISPR gRNA sequence
cctactataataatcttcga

SEQ ID NO: 91580 - DNA, 20 bp, Artificial
  CRISPR gRNA sequence
tactataataatcttcgaaa

SEQ ID NO: 91581 - DNA, 20 bp, Artificial
  CRISPR gRNA sequence
cgaaagagtctcaaaatcta

SEQ ID NO: 91582 - DNA, 20 bp, Artificial
  CRISPR gRNA sequence
gaaagagtctcaaaatctat

SEQ ID NO: 91583 - DNA, 20 bp, Artificial
  CRISPR gRNA sequence
tcaactttaacccactccat

SEQ ID NO: 91584 - DNA, 20 bp, Artificial
  CRISPR gRNA sequence
caactttaacccactccatc

SEQ ID NO: 91585 - DNA, 20 bp, Artificial
  CRISPR gRNA sequence
aactttaacccactccatca

SEQ ID NO: 91586 - DNA, 20 bp, Artificial
  CRISPR gRNA sequence
tttaacccactccatcaggg

SEQ ID NO: 91587 - DNA, 20 bp, Artificial
  CRISPR gRNA sequence
ttaacccactccatcagggt

SEQ ID NO: 91588 - DNA, 20 bp, Artificial
  CRISPR gRNA sequence
atcctctgctacttcctaat

SEQ ID NO: 91589 - DNA, 20 bp, Artificial
  CRISPR gRNA sequence
taattagatcatttcattta

SEQ ID NO: 91590 - DNA, 20 bp, Artificial
  CRISPR gRNA sequence
gactccaaatccaaatccca

SEQ ID NO: 91591 - DNA, 20 bp, Artificial
  CRISPR gRNA sequence
caaatccaaatcccatagcc

SEQ ID NO: 91592 - DNA, 20 bp, Artificial
  CRISPR gRNA sequence
cattcaatactataaaaaac

SEQ ID NO: 91593 - DNA, 20 bp, Artificial
  CRISPR gRNA sequence
aattttccactcaactattt

SEQ ID NO: 91594 - DNA, 20 bp, Artificial
  CRISPR gRNA sequence
ttccactcaactattttagc

SEQ ID NO: 91595 - DNA, 20 bp, Artificial
  CRISPR gRNA sequence
ctcaactattttagctagaa

SEQ ID NO: 91596 - DNA, 20 bp, Artificial
  CRISPR gRNA sequence
tccacttgctatcttcacaa

SEQ ID NO: 91597 - DNA, 20 bp, Artificial
  CRISPR gRNA sequence
ttctctttccttttatctac

SEQ ID NO: 91598 - DNA, 20 bp, Artificial
  CRISPR gRNA sequence
ccttttatctaccagaattc

SEQ ID NO: 91599 - DNA, 20 bp, Artificial
  CRISPR gRNA sequence
cttttatctaccagaattct

SEQ ID NO: 91600 - DNA, 20 bp, Artificial
  CRISPR gRNA sequence
ttttatctaccagaattcta

SEQ ID NO: 91601 - DNA, 20 bp, Artificial
  CRISPR gRNA sequence
tatctaccagaattctaggg

SEQ ID NO: 91602 - DNA, 20 bp, Artificial
  CRISPR gRNA sequence
ctaccagaattctagggaag

SEQ ID NO: 91603 - DNA, 20 bp, Artificial
  CRISPR gRNA sequence
agaattctagggaagcagta

SEQ ID NO: 91604 - DNA, 20 bp, Artificial
  CRISPR gRNA sequence
ttctagggaagcagtatagt

SEQ ID NO: 91605 - DNA, 20 bp, Artificial
  CRISPR gRNA sequence
tctagggaagcagtatagta

SEQ ID NO: 91606 - DNA, 20 bp, Artificial
  CRISPR gRNA sequence
tagggaagcagtatagtaag

SEQ ID NO: 91607 - DNA, 20 bp, Artificial
  CRISPR gRNA sequence
agggaagcagtatagtaagg

SEQ ID NO: 91608 - DNA, 20 bp, Artificial
  CRISPR gRNA sequence
gcagtatagtaaggaggtaa

SEQ ID NO: 91609 - DNA, 20 bp, Artificial
  CRISPR gRNA sequence
tagtaaggaggtaaaagtga

SEQ ID NO: 91610 - DNA, 20 bp, Artificial
  CRISPR gRNA sequence
ggaggtaaaagtgaaagctc

SEQ ID NO: 91611 - DNA, 20 bp, Artificial
  CRISPR gRNA sequence
aaaagtgaaagctctagaat

SEQ ID NO: 91612 - DNA, 20 bp, Artificial
  CRISPR gRNA sequence
gaataagactgcttgcgttt

SEQ ID NO: 91613 - DNA, 20 bp, Artificial
  CRISPR gRNA sequence
cgtttgagtacaatacttgc

SEQ ID NO: 91614 - DNA, 20 bp, Artificial
  CRISPR gRNA sequence
tacttgctggctgtatgacc

SEQ ID NO: 91615 - DNA, 20 bp, Artificial
  CRISPR gRNA sequence
acttgctggctgtatgacct

SEQ ID NO: 91616 - DNA, 20 bp, Artificial
  CRISPR gRNA sequence
atgacctaggccaaattctt

SEQ ID NO: 91617 - DNA, 20 bp, Artificial
  CRISPR gRNA sequence
tctttagcctctctgtgcct

SEQ ID NO: 91618 - DNA, 20 bp, Artificial
  CRISPR gRNA sequence
gtttccatgtatgtaaaata

SEQ ID NO: 91619 - DNA, 20 bp, Artificial
  CRISPR gRNA sequence
tagtatctatcccattgctg

SEQ ID NO: 91620 - DNA, 20 bp, Artificial
  CRISPR gRNA sequence
agtatctatcccattgctga

SEQ ID NO: 91621 - DNA, 20 bp, Artificial
  CRISPR gRNA sequence
gtatctatcccattgctgaa

SEQ ID NO: 91622 - DNA, 20 bp, Artificial
  CRISPR gRNA sequence
tcccattgctgaagggttgt

SEQ ID NO: 91623 - DNA, 20 bp, Artificial
  CRISPR gRNA sequence
gggttgtgagactccattta

SEQ ID NO: 91624 - DNA, 20 bp, Artificial
  CRISPR gRNA sequence
actccatttatagcttaaca

SEQ ID NO: 91625 - DNA, 20 bp, Artificial
  CRISPR gRNA sequence
taacacagtgcttgacacat

SEQ ID NO: 91626 - DNA, 20 bp, Artificial
  CRISPR gRNA sequence
tgcttgacacataagaaact

SEQ ID NO: 91627 - DNA, 20 bp, Artificial
  CRISPR gRNA sequence
cataagaaactcagctcatt

SEQ ID NO: 91628 - DNA, 20 bp, Artificial
  CRISPR gRNA sequence
aaactattgcccatcctttc

SEQ ID NO: 91629 - DNA, 20 bp, Artificial
  CRISPR gRNA sequence
catcctttctggtttatact

SEQ ID NO: 91630 - DNA, 20 bp, Artificial
  CRISPR gRNA sequence
tgagtcacgtttcctctgca

SEQ ID NO: 91631 - DNA, 20 bp, Artificial
  CRISPR gRNA sequence
tttcctctgcaaagcctttc

SEQ ID NO: 91632 - DNA, 20 bp, Artificial
  CRISPR gRNA sequence
tcctctgcaaagcctttctg

SEQ ID NO: 91633 - DNA, 20 bp, Artificial
  CRISPR gRNA sequence
aaagcctttctggagtatct

SEQ ID NO: 91634 - DNA, 20 bp, Artificial
  CRISPR gRNA sequence
ctcctctgaactactaaaac

SEQ ID NO: 91635 - DNA, 20 bp, Artificial
  CRISPR gRNA sequence
actactaaaaccggactata

SEQ ID NO: 91636 - DNA, 20 bp, Artificial
  CRISPR gRNA sequence
ctaaaaccggactatacagt

SEQ ID NO: 91637 - DNA, 20 bp, Artificial
  CRISPR gRNA sequence
agttggctcttattatatcc

SEQ ID NO: 91638 - DNA, 20 bp, Artificial
  CRISPR gRNA sequence
ggctcttattatatcctggc

SEQ ID NO: 91639 - DNA, 20 bp, Artificial
  CRISPR gRNA sequence
actgttattttctttacact

SEQ ID NO: 91640 - DNA, 20 bp, Artificial
  CRISPR gRNA sequence
tctttacactcagtttaaca

SEQ ID NO: 91641 - DNA, 20 bp, Artificial
  CRISPR gRNA sequence
cactcagtttaacaaagata

SEQ ID NO: 91642 - DNA, 20 bp, Artificial
  CRISPR gRNA sequence
ttaacaaagataaagattta

SEQ ID NO: 91643 - DNA, 20 bp, Artificial
  CRISPR gRNA sequence
tacagatcttgttacctcct

SEQ ID NO: 91644 - DNA, 20 bp, Artificial
  CRISPR gRNA sequence
ttacctcctcagaactgata

SEQ ID NO: 91645 - DNA, 20 bp, Artificial
  CRISPR gRNA sequence
gataaagtatcccaaaatat

SEQ ID NO: 91646 - DNA, 20 bp, Artificial
  CRISPR gRNA sequence
tcccaaaatataagacaaac

SEQ ID NO: 91647 - DNA, 20 bp, Artificial
  CRISPR gRNA sequence
aaaatataagacaaactgga

SEQ ID NO: 91648 - DNA, 20 bp, Artificial
  CRISPR gRNA sequence
caaactggatagtaaactat

SEQ ID NO: 91649 - DNA, 20 bp, Artificial
  CRISPR gRNA sequence
ttagtattatttgttgctta

SEQ ID NO: 91650 - DNA, 20 bp, Artificial
  CRISPR gRNA sequence
aattaattcccttccataaa

SEQ ID NO: 91651 - DNA, 20 bp, Artificial
  CRISPR gRNA sequence
tcatgcaaattattttaaaa

SEQ ID NO: 91652 - DNA, 20 bp, Artificial
  CRISPR gRNA sequence
caaattattttaaaatagtg

SEQ ID NO: 91653 - DNA, 20 bp, Artificial
  CRISPR gRNA sequence
ttattttaaaatagtgaagc

SEQ ID NO: 91654 - DNA, 20 bp, Artificial
  CRISPR gRNA sequence
tattttaaaatagtgaagct

SEQ ID NO: 91655 - DNA, 20 bp, Artificial
  CRISPR gRNA sequence
taaaatagtgaagctaggtg

SEQ ID NO: 91656 - DNA, 20 bp, Artificial
  CRISPR gRNA sequence
aatagtgaagctaggtgcag

SEQ ID NO: 91657 - DNA, 20 bp, Artificial
  CRISPR gRNA sequence
gtgcagtggtgaaataatcc

SEQ ID NO: 91658 - DNA, 20 bp, Artificial
  CRISPR gRNA sequence
aaataatcccagttactctg

SEQ ID NO: 91659 - DNA, 20 bp, Artificial
  CRISPR gRNA sequence
aataatcccagttactctga

SEQ ID NO: 91660 - DNA, 20 bp, Artificial
  CRISPR gRNA sequence
tcccagttactctgaaggct

SEQ ID NO: 91661 - DNA, 20 bp, Artificial
  CRISPR gRNA sequence
cccagttactctgaaggctg

SEQ ID NO: 91662 - DNA, 20 bp, Artificial
  CRISPR gRNA sequence
agttactctgaaggctgagg

SEQ ID NO: 91663 - DNA, 20 bp, Artificial
  CRISPR gRNA sequence
gttactctgaaggctgaggc

SEQ ID NO: 91664 - DNA, 20 bp, Artificial
  CRISPR gRNA sequence
tactctgaaggctgaggcag

SEQ ID NO: 91665 - DNA, 20 bp, Artificial
  CRISPR gRNA sequence
actctgaaggctgaggcagg

SEQ ID NO: 91666 - DNA, 20 bp, Artificial
  CRISPR gRNA sequence
ctgaggcaggaggatcactt

SEQ ID NO: 91667 - DNA, 20 bp, Artificial
  CRISPR gRNA sequence
gcaggaggatcacttgagcc

SEQ ID NO: 91668 - DNA, 20 bp, Artificial
  CRISPR gRNA sequence
caggaggatcacttgagccc

SEQ ID NO: 91669 - DNA, 20 bp, Artificial
  CRISPR gRNA sequence
tcacttgagcccaggaattc

SEQ ID NO: 91670 - DNA, 20 bp, Artificial
  CRISPR gRNA sequence
cacttgagcccaggaattcg

SEQ ID NO: 91671 - DNA, 20 bp, Artificial
  CRISPR gRNA sequence
tgagcccaggaattcgaggc

SEQ ID NO: 91672 - DNA, 20 bp, Artificial
  CRISPR gRNA sequence
ccaggaattcgaggccagcc

SEQ ID NO: 91673 - DNA, 20 bp, Artificial
  CRISPR gRNA sequence
caggaattcgaggccagcct

SEQ ID NO: 91674 - DNA, 20 bp, Artificial
  CRISPR gRNA sequence
gccagcctgggcaacactgt

SEQ ID NO: 91675 - DNA, 20 bp, Artificial
  CRISPR gRNA sequence
gagacccatctctaaaaaat

SEQ ID NO: 91676 - DNA, 20 bp, Artificial
  CRISPR gRNA sequence
ccatctctaaaaaattagat

SEQ ID NO: 91677 - DNA, 20 bp, Artificial
  CRISPR gRNA sequence
taagtaaataaataacaaaa

SEQ ID NO: 91678 - DNA, 20 bp, Artificial
  CRISPR gRNA sequence
ataaataacaaaatagtaat

SEQ ID NO: 91679 - DNA, 20 bp, Artificial
  CRISPR gRNA sequence
taaataacaaaatagtaata

SEQ ID NO: 91680 - DNA, 20 bp, Artificial
  CRISPR gRNA sequence
tagtaataaggttctttttg

SEQ ID NO: 91681 - DNA, 20 bp, Artificial
  CRISPR gRNA sequence
agtaataaggttctttttgt

SEQ ID NO: 91682 - DNA, 20 bp, Artificial
  CRISPR gRNA sequence
taataaggttctttttgtgg

SEQ ID NO: 91683 - DNA, 20 bp, Artificial
  CRISPR gRNA sequence
aataaggttctttttgtggg

SEQ ID NO: 91684 - DNA, 20 bp, Artificial
  CRISPR gRNA sequence
ggttctttttgtgggaggtg

SEQ ID NO: 91685 - DNA, 20 bp, Artificial
  CRISPR gRNA sequence
ttctttttgtgggaggtgca

SEQ ID NO: 91686 - DNA, 20 bp, Artificial
  CRISPR gRNA sequence
tctttttgtgggaggtgcag

SEQ ID NO: 91687 - DNA, 20 bp, Artificial
  CRISPR gRNA sequence
ctttttgtgggaggtgcaga

SEQ ID NO: 91688 - DNA, 20 bp, Artificial
  CRISPR gRNA sequence
ttttgtgggaggtgcagagg

SEQ ID NO: 91689 - DNA, 20 bp, Artificial
  CRISPR gRNA sequence
tgcagagggagacgctaatt

SEQ ID NO: 91690 - DNA, 20 bp, Artificial
  CRISPR gRNA sequence
tttatacattttcctcactg

SEQ ID NO: 91691 - DNA, 20 bp, Artificial
  CRISPR gRNA sequence
ctcactgtagatgtaaatgt

SEQ ID NO: 91692 - DNA, 20 bp, Artificial
  CRISPR gRNA sequence
tcactgtagatgtaaatgtt

SEQ ID NO: 91693 - DNA, 20 bp, Artificial
  CRISPR gRNA sequence
ctgtagatgtaaatgttagg

SEQ ID NO: 91694 - DNA, 20 bp, Artificial
  CRISPR gRNA sequence
taggtagtttaaaaaaaaaa

SEQ ID NO: 91695 - DNA, 20 bp, Artificial
  CRISPR gRNA sequence
tagtttaaaaaaaaaaaagt

SEQ ID NO: 91696 - DNA, 20 bp, Artificial
  CRISPR gRNA sequence
tttaaaaaaaaaaaagtaag

SEQ ID NO: 91697 - DNA, 20 bp, Artificial
  CRISPR gRNA sequence
aaaaaaaaagtaagcagcca

SEQ ID NO: 91698 - DNA, 20 bp, Artificial
  CRISPR gRNA sequence
aaaaaaaagtaagcagccat

SEQ ID NO: 91699 - DNA, 20 bp, Artificial
  CRISPR gRNA sequence
actacttctttcttgaaaat

SEQ ID NO: 91700 - DNA, 20 bp, Artificial
  CRISPR gRNA sequence
ttcttgaaaataagtattat

SEQ ID NO: 91701 - DNA, 20 bp, Artificial
  CRISPR gRNA sequence
tcttgaaaataagtattatt

SEQ ID NO: 91702 - DNA, 20 bp, Artificial
  CRISPR gRNA sequence
gaaaataagtattattaggc

SEQ ID NO: 91703 - DNA, 20 bp, Artificial
  CRISPR gRNA sequence
taagtattattaggccggcg

SEQ ID NO: 91704 - DNA, 20 bp, Artificial
  CRISPR gRNA sequence
gtattattaggccggcgtgg

SEQ ID NO: 91705 - DNA, 20 bp, Artificial
  CRISPR gRNA sequence
tattattaggccggcgtggt

SEQ ID NO: 91706 - DNA, 20 bp, Artificial
  CRISPR gRNA sequence
gtgggtctcacccgtaatcc

SEQ ID NO: 91707 - DNA, 20 bp, Artificial
  CRISPR gRNA sequence
cacccgtaatcccagcactt

SEQ ID NO: 91708 - DNA, 20 bp, Artificial
  CRISPR gRNA sequence
acccgtaatcccagcacttc

SEQ ID NO: 91709 - DNA, 20 bp, Artificial
  CRISPR gRNA sequence
ccgtaatcccagcacttcag

SEQ ID NO: 91710 - DNA, 20 bp, Artificial
  CRISPR gRNA sequence
cgtaatcccagcacttcagg

SEQ ID NO: 91711 - DNA, 20 bp, Artificial
  CRISPR gRNA sequence
tcccagcacttcaggaggct

SEQ ID NO: 91712 - DNA, 20 bp, Artificial
  CRISPR gRNA sequence
cccagcacttcaggaggctg

SEQ ID NO: 91713 - DNA, 20 bp, Artificial
  CRISPR gRNA sequence
agcacttcaggaggctgagg

SEQ ID NO: 91714 - DNA, 20 bp, Artificial
  CRISPR gRNA sequence
gcacttcaggaggctgaggt

SEQ ID NO: 91715 - DNA, 20 bp, Artificial
  CRISPR gRNA sequence
acttcaggaggctgaggtgg

SEQ ID NO: 91716 - DNA, 20 bp, Artificial
  CRISPR gRNA sequence
cttcaggaggctgaggtggg

SEQ ID NO: 91717 - DNA, 20 bp, Artificial
  CRISPR gRNA sequence
ggaggctgaggtgggaggat

SEQ ID NO: 91718 - DNA, 20 bp, Artificial
  CRISPR gRNA sequence
gaggctgaggtgggaggatc

SEQ ID NO: 91719 - DNA, 20 bp, Artificial
  CRISPR gRNA sequence
ggctgaggtgggaggatcag

SEQ ID NO: 91720 - DNA, 20 bp, Artificial
  CRISPR gRNA sequence
ggtgggaggatcaggagttc

SEQ ID NO: 91721 - DNA, 20 bp, Artificial
  CRISPR gRNA sequence
gaggatcaggagttcgagac

SEQ ID NO: 91722 - DNA, 20 bp, Artificial
  CRISPR gRNA sequence
tcaggagttcgagaccagac

SEQ ID NO: 91723 - DNA, 20 bp, Artificial
  CRISPR gRNA sequence
cgagaccagactggccaaca

SEQ ID NO: 91724 - DNA, 20 bp, Artificial
  CRISPR gRNA sequence
tctactaaaaatacaaaaat

SEQ ID NO: 91725 - DNA, 20 bp, Artificial
  CRISPR gRNA sequence
ctaaaaatacaaaaattagc

SEQ ID NO: 91726 - DNA, 20 bp, Artificial
  CRISPR gRNA sequence
taaaaatacaaaaattagcc

SEQ ID NO: 91727 - DNA, 20 bp, Artificial
  CRISPR gRNA sequence
atacaaaaattagccgggcg

SEQ ID NO: 91728 - DNA, 20 bp, Artificial
  CRISPR gRNA sequence
caaaaattagccgggcgtgg

SEQ ID NO: 91729 - DNA, 20 bp, Artificial
  CRISPR gRNA sequence
gtggtgcatgcctgtaatcc

SEQ ID NO: 91730 - DNA, 20 bp, Artificial
  CRISPR gRNA sequence
tgcctgtaatcccagctact

SEQ ID NO: 91731 - DNA, 20 bp, Artificial
  CRISPR gRNA sequence
gcctgtaatcccagctactc

SEQ ID NO: 91732 - DNA, 20 bp, Artificial
  CRISPR gRNA sequence
ctgtaatcccagctactcag

SEQ ID NO: 91733 - DNA, 20 bp, Artificial
  CRISPR gRNA sequence
tgtaatcccagctactcagg

SEQ ID NO: 91734 - DNA, 20 bp, Artificial
  CRISPR gRNA sequence
tcccagctactcaggaggct

SEQ ID NO: 91735 - DNA, 20 bp, Artificial
  CRISPR gRNA sequence
cccagctactcaggaggctg

SEQ ID NO: 91736 - DNA, 20 bp, Artificial
  CRISPR gRNA sequence
tactcaggaggctgaggcac

SEQ ID NO: 91737 - DNA, 20 bp, Artificial
  CRISPR gRNA sequence
gcacaagaactgcttgaacc

SEQ ID NO: 91738 - DNA, 20 bp, Artificial
  CRISPR gRNA sequence
cacaagaactgcttgaaccc

SEQ ID NO: 91739 - DNA, 20 bp, Artificial
  CRISPR gRNA sequence
caagaactgcttgaacccag

SEQ ID NO: 91740 - DNA, 20 bp, Artificial
  CRISPR gRNA sequence
aagaactgcttgaacccagg

SEQ ID NO: 91741 - DNA, 20 bp, Artificial
  CRISPR gRNA sequence
aactgcttgaacccaggagg

SEQ ID NO: 91742 - DNA, 20 bp, Artificial
  CRISPR gRNA sequence
ctgcttgaacccaggaggtg

SEQ ID NO: 91743 - DNA, 20 bp, Artificial
  CRISPR gRNA sequence
tgcttgaacccaggaggtgg

SEQ ID NO: 91744 - DNA, 20 bp, Artificial
  CRISPR gRNA sequence
aacccaggaggtggaggttg

SEQ ID NO: 91745 - DNA, 20 bp, Artificial
  CRISPR gRNA sequence
ccaggaggtggaggttgtag

SEQ ID NO: 91746 - DNA, 20 bp, Artificial
  CRISPR gRNA sequence
caggaggtggaggttgtagt

SEQ ID NO: 91747 - DNA, 20 bp, Artificial
  CRISPR gRNA sequence
ggtggaggttgtagtgggcc

SEQ ID NO: 91748 - DNA, 20 bp, Artificial
  CRISPR gRNA sequence
gagatcgcaccactgcactc

SEQ ID NO: 91749 - DNA, 20 bp, Artificial
  CRISPR gRNA sequence
gcaccactgcactccagcct

SEQ ID NO: 91750 - DNA, 20 bp, Artificial
  CRISPR gRNA sequence
gcactccagcctgagcgaca

SEQ ID NO: 91751 - DNA, 20 bp, Artificial
  CRISPR gRNA sequence
actccagcctgagcgacaca

SEQ ID NO: 91752 - DNA, 20 bp, Artificial
  CRISPR gRNA sequence
cagcctgagcgacacagagt

SEQ ID NO: 91753 - DNA, 20 bp, Artificial
  CRISPR gRNA sequence
actctgtctcaaaaaaaaaa

SEQ ID NO: 91754 - DNA, 20 bp, Artificial
  CRISPR gRNA sequence
tgtctcaaaaaaaaaaaaga

SEQ ID NO: 91755 - DNA, 20 bp, Artificial
  CRISPR gRNA sequence
aaaaaaaaaagaaagaaaaa

SEQ ID NO: 91756 - DNA, 20 bp, Artificial
  CRISPR gRNA sequence
attatttttctccctctcta

SEQ ID NO: 91757 - DNA, 20 bp, Artificial
  CRISPR gRNA sequence
tccctctctaaagaattctg

SEQ ID NO: 91758 - DNA, 20 bp, Artificial
  CRISPR gRNA sequence
ctaaagaattctgaagtgaa

SEQ ID NO: 91759 - DNA, 20 bp, Artificial
  CRISPR gRNA sequence
taaagaattctgaagtgaat

SEQ ID NO: 91760 - DNA, 20 bp, Artificial
  CRISPR gRNA sequence
ctgaagtgaatgggcacctg

SEQ ID NO: 91761 - DNA, 20 bp, Artificial
  CRISPR gRNA sequence
gggcacctgtggaacatact

SEQ ID NO: 91762 - DNA, 20 bp, Artificial
  CRISPR gRNA sequence
ggcacctgtggaacatactg

SEQ ID NO: 91763 - DNA, 20 bp, Artificial
  CRISPR gRNA sequence
acctgtggaacatactgagg

SEQ ID NO: 91764 - DNA, 20 bp, Artificial
  CRISPR gRNA sequence
tactaactttcattcttttc

SEQ ID NO: 91765 - DNA, 20 bp, Artificial
  CRISPR gRNA sequence
tttccctaaatccccgtaat

SEQ ID NO: 91766 - DNA, 20 bp, Artificial
  CRISPR gRNA sequence
tccctaaatccccgtaatca

SEQ ID NO: 91767 - DNA, 20 bp, Artificial
  CRISPR gRNA sequence
aatccccgtaatcagagatt

SEQ ID NO: 91768 - DNA, 20 bp, Artificial
  CRISPR gRNA sequence
gatttggtaaaacatactat

SEQ ID NO: 91769 - DNA, 20 bp, Artificial
  CRISPR gRNA sequence
taaaacatactataagaata

SEQ ID NO: 91770 - DNA, 20 bp, Artificial
  CRISPR gRNA sequence
atactataagaatatggatt

SEQ ID NO: 91771 - DNA, 20 bp, Artificial
  CRISPR gRNA sequence
tactataagaatatggattg

SEQ ID NO: 91772 - DNA, 20 bp, Artificial
  CRISPR gRNA sequence
actataagaatatggattga

SEQ ID NO: 91773 - DNA, 20 bp, Artificial
  CRISPR gRNA sequence
ctataagaatatggattgag

SEQ ID NO: 91774 - DNA, 20 bp, Artificial
  CRISPR gRNA sequence
tataagaatatggattgagg

SEQ ID NO: 91775 - DNA, 20 bp, Artificial
  CRISPR gRNA sequence
attgagggggtttttaaact

SEQ ID NO: 91776 - DNA, 20 bp, Artificial
  CRISPR gRNA sequence
gggtttttaaactaagatta

SEQ ID NO: 91777 - DNA, 20 bp, Artificial
  CRISPR gRNA sequence
tttttaaactaagattacag

SEQ ID NO: 91778 - DNA, 20 bp, Artificial
  CRISPR gRNA sequence
actaagattacagaagtcct

SEQ ID NO: 91779 - DNA, 20 bp, Artificial
  CRISPR gRNA sequence
gaagtcctgagcccattaat

SEQ ID NO: 91780 - DNA, 20 bp, Artificial
  CRISPR gRNA sequence
ttaattagtatgcaaaatta

SEQ ID NO: 91781 - DNA, 20 bp, Artificial
  CRISPR gRNA sequence
tatgcaaaattaaagttaca

SEQ ID NO: 91782 - DNA, 20 bp, Artificial
  CRISPR gRNA sequence
gcaaaattaaagttacatag

SEQ ID NO: 91783 - DNA, 20 bp, Artificial
  CRISPR gRNA sequence
agttacatagtggatttttc

SEQ ID NO: 91784 - DNA, 20 bp, Artificial
  CRISPR gRNA sequence
gttacatagtggatttttct

SEQ ID NO: 91785 - DNA, 20 bp, Artificial
  CRISPR gRNA sequence
acatagtggatttttctagg

SEQ ID NO: 91786 - DNA, 20 bp, Artificial
  CRISPR gRNA sequence
atagtggatttttctaggaa

SEQ ID NO: 91787 - DNA, 20 bp, Artificial
  CRISPR gRNA sequence
ttctaggaagagtcttcatt

SEQ ID NO: 91788 - DNA, 20 bp, Artificial
  CRISPR gRNA sequence
aagagtcttcattaagtcac

SEQ ID NO: 91789 - DNA, 20 bp, Artificial
  CRISPR gRNA sequence
attaagtcaccagaccctca

SEQ ID NO: 91790 - DNA, 20 bp, Artificial
  CRISPR gRNA sequence
aagtcaccagaccctcaaag

SEQ ID NO: 91791 - DNA, 20 bp, Artificial
  CRISPR gRNA sequence
aagaagtcctcttactccaa

SEQ ID NO: 91792 - DNA, 20 bp, Artificial
  CRISPR gRNA sequence
gaagtcctcttactccaaaa

SEQ ID NO: 91793 - DNA, 20 bp, Artificial
  CRISPR gRNA sequence
actccaaaagagtaaaactt

SEQ ID NO: 91794 - DNA, 20 bp, Artificial
  CRISPR gRNA sequence
ctccaaaagagtaaaactta

SEQ ID NO: 91795 - DNA, 20 bp, Artificial
  CRISPR gRNA sequence
tccaaaagagtaaaacttaa

SEQ ID NO: 91796 - DNA, 20 bp, Artificial
  CRISPR gRNA sequence
aaagagtaaaacttaaggga

SEQ ID NO: 91797 - DNA, 20 bp, Artificial
  CRISPR gRNA sequence
agagtaaaacttaagggaaa

SEQ ID NO: 91798 - DNA, 20 bp, Artificial
  CRISPR gRNA sequence
gtaaaacttaagggaaagag

SEQ ID NO: 91799 - DNA, 20 bp, Artificial
  CRISPR gRNA sequence
taagggaaagagaagtcact

SEQ ID NO: 91800 - DNA, 20 bp, Artificial
  CRISPR gRNA sequence
agaagtcactcagtcctaac

SEQ ID NO: 91801 - DNA, 20 bp, Artificial
  CRISPR gRNA sequence
agtcctaaccagtgtgaatt

SEQ ID NO: 91802 - DNA, 20 bp, Artificial
  CRISPR gRNA sequence
gtgaattaagtatgacacac

SEQ ID NO: 91803 - DNA, 20 bp, Artificial
  CRISPR gRNA sequence
acactggcaactgcaaattt

SEQ ID NO: 91804 - DNA, 20 bp, Artificial
  CRISPR gRNA sequence
ctgcaaattttagaaatatt

SEQ ID NO: 91805 - DNA, 20 bp, Artificial
  CRISPR gRNA sequence
atattatactttttgttttt

SEQ ID NO: 91806 - DNA, 20 bp, Artificial
  CRISPR gRNA sequence
tactttttgtttttgagaca

SEQ ID NO: 91807 - DNA, 20 bp, Artificial
  CRISPR gRNA sequence
caaagtcttgctctgtcacc

SEQ ID NO: 91808 - DNA, 20 bp, Artificial
  CRISPR gRNA sequence
aaagtcttgctctgtcaccc

SEQ ID NO: 91809 - DNA, 20 bp, Artificial
  CRISPR gRNA sequence
tcttgctctgtcacccaggc

SEQ ID NO: 91810 - DNA, 20 bp, Artificial
  CRISPR gRNA sequence
ttgctctgtcacccaggctg

SEQ ID NO: 91811 - DNA, 20 bp, Artificial
  CRISPR gRNA sequence
ctgtcacccaggctggagtg

SEQ ID NO: 91812 - DNA, 20 bp, Artificial
  CRISPR gRNA sequence
tcacccaggctggagtgaag

SEQ ID NO: 91813 - DNA, 20 bp, Artificial
  CRISPR gRNA sequence
ggagtgaagtagcacaacca

SEQ ID NO: 91814 - DNA, 20 bp, Artificial
  CRISPR gRNA sequence
agcacaaccatggctcactg

SEQ ID NO: 91815 - DNA, 20 bp, Artificial
  CRISPR gRNA sequence
tcactgcagcctcaatctcc

SEQ ID NO: 91816 - DNA, 20 bp, Artificial
  CRISPR gRNA sequence
cactgcagcctcaatctcct

SEQ ID NO: 91817 - DNA, 20 bp, Artificial
  CRISPR gRNA sequence
gctcaatgatccttccacct

SEQ ID NO: 91818 - DNA, 20 bp, Artificial
  CRISPR gRNA sequence
tccttccacctcagcctccc

SEQ ID NO: 91819 - DNA, 20 bp, Artificial
  CRISPR gRNA sequence
ttccacctcagcctcccgag

SEQ ID NO: 91820 - DNA, 20 bp, Artificial
  CRISPR gRNA sequence
acctcagcctcccgagtagc

SEQ ID NO: 91821 - DNA, 20 bp, Artificial
  CRISPR gRNA sequence
cctcagcctcccgagtagct

SEQ ID NO: 91822 - DNA, 20 bp, Artificial
  CRISPR gRNA sequence
ctcccgagtagctaggacca

SEQ ID NO: 91823 - DNA, 20 bp, Artificial
  CRISPR gRNA sequence
tcccgagtagctaggaccac

SEQ ID NO: 91824 - DNA, 20 bp, Artificial
  CRISPR gRNA sequence
caggcatgtgccaacatacc

SEQ ID NO: 91825 - DNA, 20 bp, Artificial
  CRISPR gRNA sequence
atttttaaaatttttttgtt

SEQ ID NO: 91826 - DNA, 20 bp, Artificial
  CRISPR gRNA sequence
ttaaaatttttttgttgaga

SEQ ID NO: 91827 - DNA, 20 bp, Artificial
  CRISPR gRNA sequence
taaaatttttttgttgagat

SEQ ID NO: 91828 - DNA, 20 bp, Artificial
  CRISPR gRNA sequence
aaaatttttttgttgagatg

SEQ ID NO: 91829 - DNA, 20 bp, Artificial
  CRISPR gRNA sequence
tggggtctccctatgttacc

SEQ ID NO: 91830 - DNA, 20 bp, Artificial
  CRISPR gRNA sequence
ggggtctccctatgttaccc

SEQ ID NO: 91831 - DNA, 20 bp, Artificial
  CRISPR gRNA sequence
tctccctatgttacccaggc

SEQ ID NO: 91832 - DNA, 20 bp, Artificial
  CRISPR gRNA sequence
ccaggctggtctcaaacttc

SEQ ID NO: 91833 - DNA, 20 bp, Artificial
  CRISPR gRNA sequence
caggctggtctcaaacttcc

SEQ ID NO: 91834 - DNA, 20 bp, Artificial
  CRISPR gRNA sequence
ggtctcaaacttccgggctc

SEQ ID NO: 91835 - DNA, 20 bp, Artificial
  CRISPR gRNA sequence
gctcaagcgatcctccctcc

SEQ ID NO: 91836 - DNA, 20 bp, Artificial
  CRISPR gRNA sequence
ctcaagcgatcctccctcct

SEQ ID NO: 91837 - DNA, 20 bp, Artificial
  CRISPR gRNA sequence
cctccctcctaggcctcccc

SEQ ID NO: 91838 - DNA, 20 bp, Artificial
  CRISPR gRNA sequence
tcctaggcctccccaagttc

SEQ ID NO: 91839 - DNA, 20 bp, Artificial
  CRISPR gRNA sequence
cctaggcctccccaagttct

SEQ ID NO: 91840 - DNA, 20 bp, Artificial
  CRISPR gRNA sequence
ctccccaagttctgggctta

SEQ ID NO: 91841 - DNA, 20 bp, Artificial
  CRISPR gRNA sequence
tccccaagttctgggcttac

SEQ ID NO: 91842 - DNA, 20 bp, Artificial
  CRISPR gRNA sequence
agttctgggcttacaggtat

SEQ ID NO: 91843 - DNA, 20 bp, Artificial
  CRISPR gRNA sequence
gcttacaggtattagccact

SEQ ID NO: 91844 - DNA, 20 bp, Artificial
  CRISPR gRNA sequence
caggtattagccactgagcc

SEQ ID NO: 91845 - DNA, 20 bp, Artificial
  CRISPR gRNA sequence
attagccactgagcctggcc

SEQ ID NO: 91846 - DNA, 20 bp, Artificial
  CRISPR gRNA sequence
ttacatttgtaaacaattac

SEQ ID NO: 91847 - DNA, 20 bp, Artificial
  CRISPR gRNA sequence
tacatttgtaaacaattaca

SEQ ID NO: 91848 - DNA, 20 bp, Artificial
  CRISPR gRNA sequence
aattacaaggtctaatattt

SEQ ID NO: 91849 - DNA, 20 bp, Artificial
  CRISPR gRNA sequence
aaggtctaatattttagtga

SEQ ID NO: 91850 - DNA, 20 bp, Artificial
  CRISPR gRNA sequence
ggtctaatattttagtgatg

SEQ ID NO: 91851 - DNA, 20 bp, Artificial
  CRISPR gRNA sequence
ttttagtgatggagcacttc

SEQ ID NO: 91852 - DNA, 20 bp, Artificial
  CRISPR gRNA sequence
gtgatggagcacttcaagtt

SEQ ID NO: 91853 - DNA, 20 bp, Artificial
  CRISPR gRNA sequence
ttcaagttcagcctgaaact

SEQ ID NO: 91854 - DNA, 20 bp, Artificial
  CRISPR gRNA sequence
gcctgaaactaagaaattta

SEQ ID NO: 91855 - DNA, 20 bp, Artificial
  CRISPR gRNA sequence
aactaagaaatttaaagact

SEQ ID NO: 91856 - DNA, 20 bp, Artificial
  CRISPR gRNA sequence
taaagacttagaatacatcc

SEQ ID NO: 91857 - DNA, 20 bp, Artificial
  CRISPR gRNA sequence
aaagacttagaatacatcct

SEQ ID NO: 91858 - DNA, 20 bp, Artificial
  CRISPR gRNA sequence
agaatacatcctaggaccct

SEQ ID NO: 91859 - DNA, 20 bp, Artificial
  CRISPR gRNA sequence
tacatcctaggaccctaaga

SEQ ID NO: 91860 - DNA, 20 bp, Artificial
  CRISPR gRNA sequence
taggaccctaagacagcttg

SEQ ID NO: 91861 - DNA, 20 bp, Artificial
  CRISPR gRNA sequence
tttttttttttttttttttt

SEQ ID NO: 91862 - DNA, 20 bp, Artificial
  CRISPR gRNA sequence
ttttttttttttttttttta

SEQ ID NO: 91863 - DNA, 20 bp, Artificial
  CRISPR gRNA sequence
tttttttttttttttttaag

SEQ ID NO: 91864 - DNA, 20 bp, Artificial
  CRISPR gRNA sequence
tttttttttttttaaggaga

SEQ ID NO: 91865 - DNA, 20 bp, Artificial
  CRISPR gRNA sequence
ttttttttttttaaggagac

SEQ ID NO: 91866 - DNA, 20 bp, Artificial
  CRISPR gRNA sequence
tttttttttttaaggagaca

SEQ ID NO: 91867 - DNA, 20 bp, Artificial
  CRISPR gRNA sequence
cagggtcttgctatgtcatc

SEQ ID NO: 91868 - DNA, 20 bp, Artificial
  CRISPR gRNA sequence
agggtcttgctatgtcatcc

SEQ ID NO: 91869 - DNA, 20 bp, Artificial
  CRISPR gRNA sequence
tcttgctatgtcatccaggc

SEQ ID NO: 91870 - DNA, 20 bp, Artificial
  CRISPR gRNA sequence
atgtcatccaggctggaatg

SEQ ID NO: 91871 - DNA, 20 bp, Artificial
  CRISPR gRNA sequence
tggaatgcagtgatgcaaac

SEQ ID NO: 91872 - DNA, 20 bp, Artificial
  CRISPR gRNA sequence
ggaatgcagtgatgcaaaca

SEQ ID NO: 91873 - DNA, 20 bp, Artificial
  CRISPR gRNA sequence
agtgatgcaaacaaggctca

SEQ ID NO: 91874 - DNA, 20 bp, Artificial
  CRISPR gRNA sequence
gatgcaaacaaggctcacgg

SEQ ID NO: 91875 - DNA, 20 bp, Artificial
  CRISPR gRNA sequence
tcacggcagcctcgaacccc

SEQ ID NO: 91876 - DNA, 20 bp, Artificial
  CRISPR gRNA sequence
agcctcgaacccctggtctc

SEQ ID NO: 91877 - DNA, 20 bp, Artificial
  CRISPR gRNA sequence
tcttcccacttcaccctccc

SEQ ID NO: 91878 - DNA, 20 bp, Artificial
  CRISPR gRNA sequence
ccacttcaccctcccaagta

SEQ ID NO: 91879 - DNA, 20 bp, Artificial
  CRISPR gRNA sequence
ttcaccctcccaagtacagc

SEQ ID NO: 91880 - DNA, 20 bp, Artificial
  CRISPR gRNA sequence
tcaccctcccaagtacagct

SEQ ID NO: 91881 - DNA, 20 bp, Artificial
  CRISPR gRNA sequence
cccaagtacagctgggtata

SEQ ID NO: 91882 - DNA, 20 bp, Artificial
  CRISPR gRNA sequence
ccaagtacagctgggtatac

SEQ ID NO: 91883 - DNA, 20 bp, Artificial
  CRISPR gRNA sequence
caggcacttgccaccatacc

SEQ ID NO: 91884 - DNA, 20 bp, Artificial
  CRISPR gRNA sequence
acttgccaccatacctggct

SEQ ID NO: 91885 - DNA, 20 bp, Artificial
  CRISPR gRNA sequence
attaaatttttctctacact

SEQ ID NO: 91886 - DNA, 20 bp, Artificial
  CRISPR gRNA sequence
ttaaatttttctctacacta

SEQ ID NO: 91887 - DNA, 20 bp, Artificial
  CRISPR gRNA sequence
taaatttttctctacactaa

SEQ ID NO: 91888 - DNA, 20 bp, Artificial
  CRISPR gRNA sequence
ctctacactaagggattata

SEQ ID NO: 91889 - DNA, 20 bp, Artificial
  CRISPR gRNA sequence
agggattatatagctctcac

SEQ ID NO: 91890 - DNA, 20 bp, Artificial
  CRISPR gRNA sequence
gattatatagctctcacaag

SEQ ID NO: 91891 - DNA, 20 bp, Artificial
  CRISPR gRNA sequence
aaatatctgcttatttgtga

SEQ ID NO: 91892 - DNA, 20 bp, Artificial
  CRISPR gRNA sequence
gcttatttgtgacagcctca

SEQ ID NO: 91893 - DNA, 20 bp, Artificial
  CRISPR gRNA sequence
actaacaatgacaataataa

SEQ ID NO: 91894 - DNA, 20 bp, Artificial
  CRISPR gRNA sequence
ctaacaatgacaataataat

SEQ ID NO: 91895 - DNA, 20 bp, Artificial
  CRISPR gRNA sequence
caatgacaataataatgggt

SEQ ID NO: 91896 - DNA, 20 bp, Artificial
  CRISPR gRNA sequence
aatgacaataataatgggta

SEQ ID NO: 91897 - DNA, 20 bp, Artificial
  CRISPR gRNA sequence
tgggtaaggtttgcaaactt

SEQ ID NO: 91898 - DNA, 20 bp, Artificial
  CRISPR gRNA sequence
taaggtttgcaaactttagc

SEQ ID NO: 91899 - DNA, 20 bp, Artificial
  CRISPR gRNA sequence
tgcaaactttagccagttgc

SEQ ID NO: 91900 - DNA, 20 bp, Artificial
  CRISPR gRNA sequence
cactgtgtgaaccctcaata

SEQ ID NO: 91901 - DNA, 20 bp, Artificial
  CRISPR gRNA sequence
tgtgaaccctcaatatggaa

SEQ ID NO: 91902 - DNA, 20 bp, Artificial
  CRISPR gRNA sequence
tggaatggctcacatattca

SEQ ID NO: 91903 - DNA, 20 bp, Artificial
  CRISPR gRNA sequence
cgattttaatgcccatttta

SEQ ID NO: 91904 - DNA, 20 bp, Artificial
  CRISPR gRNA sequence
attttaatgcccattttaca

SEQ ID NO: 91905 - DNA, 20 bp, Artificial
  CRISPR gRNA sequence
cagagtttaataacctattc

SEQ ID NO: 91906 - DNA, 20 bp, Artificial
  CRISPR gRNA sequence
taataacctattcaagccac

SEQ ID NO: 91907 - DNA, 20 bp, Artificial
  CRISPR gRNA sequence
aataacctattcaagccaca

SEQ ID NO: 91908 - DNA, 20 bp, Artificial
  CRISPR gRNA sequence
acctattcaagccacaaggc

SEQ ID NO: 91909 - DNA, 20 bp, Artificial
  CRISPR gRNA sequence
aaggccagtaaatgatgcaa

SEQ ID NO: 91910 - DNA, 20 bp, Artificial
  CRISPR gRNA sequence
aggccagtaaatgatgcaac

SEQ ID NO: 91911 - DNA, 20 bp, Artificial
  CRISPR gRNA sequence
ggccagtaaatgatgcaaca

SEQ ID NO: 91912 - DNA, 20 bp, Artificial
  CRISPR gRNA sequence
atgcaacagggatttgcacc

SEQ ID NO: 91913 - DNA, 20 bp, Artificial
  CRISPR gRNA sequence
caacagggatttgcacccag

SEQ ID NO: 91914 - DNA, 20 bp, Artificial
  CRISPR gRNA sequence
tgcacccagaagtcgaactc

SEQ ID NO: 91915 - DNA, 20 bp, Artificial
  CRISPR gRNA sequence
gaagtcgaactccagaacac

SEQ ID NO: 91916 - DNA, 20 bp, Artificial
  CRISPR gRNA sequence
cactggttttacctttgact

SEQ ID NO: 91917 - DNA, 20 bp, Artificial
  CRISPR gRNA sequence
gttcaaatcaaacaatccaa

SEQ ID NO: 91918 - DNA, 20 bp, Artificial
  CRISPR gRNA sequence
aaacaatccaaaagtttttt

SEQ ID NO: 91919 - DNA, 20 bp, Artificial
  CRISPR gRNA sequence
tcatcctttttttcccccct

SEQ ID NO: 91920 - DNA, 20 bp, Artificial
  CRISPR gRNA sequence
catcctttttttcccccctc

SEQ ID NO: 91921 - DNA, 20 bp, Artificial
  CRISPR gRNA sequence
atcctttttttcccccctca

SEQ ID NO: 91922 - DNA, 20 bp, Artificial
  CRISPR gRNA sequence
tcctttttttcccccctcag

SEQ ID NO: 91923 - DNA, 20 bp, Artificial
  CRISPR gRNA sequence
tttcccccctcaggggtact

SEQ ID NO: 91924 - DNA, 20 bp, Artificial
  CRISPR gRNA sequence
cccctcaggggtactaagaa

SEQ ID NO: 91925 - DNA, 20 bp, Artificial
  CRISPR gRNA sequence
ccctcaggggtactaagaaa

SEQ ID NO: 91926 - DNA, 20 bp, Artificial
  CRISPR gRNA sequence
cctcaggggtactaagaaaa

SEQ ID NO: 91927 - DNA, 20 bp, Artificial
  CRISPR gRNA sequence
ctcaggggtactaagaaaag

SEQ ID NO: 91928 - DNA, 20 bp, Artificial
  CRISPR gRNA sequence
aggggtactaagaaaagggg

SEQ ID NO: 91929 - DNA, 20 bp, Artificial
  CRISPR gRNA sequence
gtactaagaaaaggggtagt

SEQ ID NO: 91930 - DNA, 20 bp, Artificial
  CRISPR gRNA sequence
aagaaaaggggtagtgagaa

SEQ ID NO: 91931 - DNA, 20 bp, Artificial
  CRISPR gRNA sequence
agaaaaggggtagtgagaac

SEQ ID NO: 91932 - DNA, 20 bp, Artificial
  CRISPR gRNA sequence
gaaaaggggtagtgagaaca

SEQ ID NO: 91933 - DNA, 20 bp, Artificial
  CRISPR gRNA sequence
gagaacagggtactaacaac

SEQ ID NO: 91934 - DNA, 20 bp, Artificial
  CRISPR gRNA sequence
agaacagggtactaacaaca

SEQ ID NO: 91935 - DNA, 20 bp, Artificial
  CRISPR gRNA sequence
gtactaacaacaaggatact

SEQ ID NO: 91936 - DNA, 20 bp, Artificial
  CRISPR gRNA sequence
caacaaggatactgagaaca

SEQ ID NO: 91937 - DNA, 20 bp, Artificial
  CRISPR gRNA sequence
tactgagaacaaagtatatt

SEQ ID NO: 91938 - DNA, 20 bp, Artificial
  CRISPR gRNA sequence
gaacaaagtatattaagtat

SEQ ID NO: 91939 - DNA, 20 bp, Artificial
  CRISPR gRNA sequence
aacaaagtatattaagtatt

SEQ ID NO: 91940 - DNA, 20 bp, Artificial
  CRISPR gRNA sequence
acaaagtatattaagtattg

SEQ ID NO: 91941 - DNA, 20 bp, Artificial
  CRISPR gRNA sequence
aagtatattaagtattgggg

SEQ ID NO: 91942 - DNA, 20 bp, Artificial
  CRISPR gRNA sequence
atattaagtattggggtagt

SEQ ID NO: 91943 - DNA, 20 bp, Artificial
  CRISPR gRNA sequence
tattggggtagtgagaacat

SEQ ID NO: 91944 - DNA, 20 bp, Artificial
  CRISPR gRNA sequence
ggtagtgagaacatgagaac

SEQ ID NO: 91945 - DNA, 20 bp, Artificial
  CRISPR gRNA sequence
gtagtgagaacatgagaaca

SEQ ID NO: 91946 - DNA, 20 bp, Artificial
  CRISPR gRNA sequence
tagtgagaacatgagaacaa

SEQ ID NO: 91947 - DNA, 20 bp, Artificial
  CRISPR gRNA sequence
tgagaacaagggactaaaca

SEQ ID NO: 91948 - DNA, 20 bp, Artificial
  CRISPR gRNA sequence
gagaacaagggactaaacat

SEQ ID NO: 91949 - DNA, 20 bp, Artificial
  CRISPR gRNA sequence
agaacaagggactaaacata

SEQ ID NO: 91950 - DNA, 20 bp, Artificial
  CRISPR gRNA sequence
gaacaagggactaaacatag

SEQ ID NO: 91951 - DNA, 20 bp, Artificial
  CRISPR gRNA sequence
gggactaaacataggggtac

SEQ ID NO: 91952 - DNA, 20 bp, Artificial
  CRISPR gRNA sequence
ggactaaacataggggtact

SEQ ID NO: 91953 - DNA, 20 bp, Artificial
  CRISPR gRNA sequence
aaacataggggtactgggaa

SEQ ID NO: 91954 - DNA, 20 bp, Artificial
  CRISPR gRNA sequence
acataggggtactgggaaca

SEQ ID NO: 91955 - DNA, 20 bp, Artificial
  CRISPR gRNA sequence
ggtactgggaacagagttgt

SEQ ID NO: 91956 - DNA, 20 bp, Artificial
  CRISPR gRNA sequence
tgggaacagagttgtaagaa

SEQ ID NO: 91957 - DNA, 20 bp, Artificial
  CRISPR gRNA sequence
ggaacagagttgtaagaaaa

SEQ ID NO: 91958 - DNA, 20 bp, Artificial
  CRISPR gRNA sequence
taagaaaagagtactacgta

SEQ ID NO: 91959 - DNA, 20 bp, Artificial
  CRISPR gRNA sequence
aagaaaagagtactacgtac

SEQ ID NO: 91960 - DNA, 20 bp, Artificial
  CRISPR gRNA sequence
agaaaagagtactacgtaca

SEQ ID NO: 91961 - DNA, 20 bp, Artificial
  CRISPR gRNA sequence
gaaaagagtactacgtacag

SEQ ID NO: 91962 - DNA, 20 bp, Artificial
  CRISPR gRNA sequence
tactacgtacaggggtacta

SEQ ID NO: 91963 - DNA, 20 bp, Artificial
  CRISPR gRNA sequence
acgtacaggggtactacaga

SEQ ID NO: 91964 - DNA, 20 bp, Artificial
  CRISPR gRNA sequence
cgtacaggggtactacagac

SEQ ID NO: 91965 - DNA, 20 bp, Artificial
  CRISPR gRNA sequence
ggtactacagacaggcaact

SEQ ID NO: 91966 - DNA, 20 bp, Artificial
  CRISPR gRNA sequence
tacagacaggcaactgagta

SEQ ID NO: 91967 - DNA, 20 bp, Artificial
  CRISPR gRNA sequence
agacaggcaactgagtatag

SEQ ID NO: 91968 - DNA, 20 bp, Artificial
  CRISPR gRNA sequence
gtatagcagtactaaaaata

SEQ ID NO: 91969 - DNA, 20 bp, Artificial
  CRISPR gRNA sequence
cagtactaaaaatacggtac

SEQ ID NO: 91970 - DNA, 20 bp, Artificial
  CRISPR gRNA sequence
agtactaaaaatacggtact

SEQ ID NO: 91971 - DNA, 20 bp, Artificial
  CRISPR gRNA sequence
actaaaaatacggtactagg

SEQ ID NO: 91972 - DNA, 20 bp, Artificial
  CRISPR gRNA sequence
taaaaatacggtactaggaa

SEQ ID NO: 91973 - DNA, 20 bp, Artificial
  CRISPR gRNA sequence
aaaaatacggtactaggaag

SEQ ID NO: 91974 - DNA, 20 bp, Artificial
  CRISPR gRNA sequence
aaaatacggtactaggaaga

SEQ ID NO: 91975 - DNA, 20 bp, Artificial
  CRISPR gRNA sequence
ggtactaggaagagggttaa

SEQ ID NO: 91976 - DNA, 20 bp, Artificial
  CRISPR gRNA sequence
taggaagagggttaacagaa

SEQ ID NO: 91977 - DNA, 20 bp, Artificial
  CRISPR gRNA sequence
aggaagagggttaacagaac

SEQ ID NO: 91978 - DNA, 20 bp, Artificial
  CRISPR gRNA sequence
agaacaggacactaaaaaca

SEQ ID NO: 91979 - DNA, 20 bp, Artificial
  CRISPR gRNA sequence
taaaaacaaagtactaaata

SEQ ID NO: 91980 - DNA, 20 bp, Artificial
  CRISPR gRNA sequence
aaaaacaaagtactaaatac

SEQ ID NO: 91981 - DNA, 20 bp, Artificial
  CRISPR gRNA sequence
aaacaaagtactaaatacag

SEQ ID NO: 91982 - DNA, 20 bp, Artificial
  CRISPR gRNA sequence
aaatacaggagtattacaaa

SEQ ID NO: 91983 - DNA, 20 bp, Artificial
  CRISPR gRNA sequence
atacaggagtattacaaata

SEQ ID NO: 91984 - DNA, 20 bp, Artificial
  CRISPR gRNA sequence
tacaggagtattacaaatag

SEQ ID NO: 91985 - DNA, 20 bp, Artificial
  CRISPR gRNA sequence
gtattacaaatagaggtact

SEQ ID NO: 91986 - DNA, 20 bp, Artificial
  CRISPR gRNA sequence
caaatagaggtactgagaac

SEQ ID NO: 91987 - DNA, 20 bp, Artificial
  CRISPR gRNA sequence
aaatagaggtactgagaact

SEQ ID NO: 91988 - DNA, 20 bp, Artificial
  CRISPR gRNA sequence
ggtactgagaactgggtact

SEQ ID NO: 91989 - DNA, 20 bp, Artificial
  CRISPR gRNA sequence
gagaactgggtactgagaac

SEQ ID NO: 91990 - DNA, 20 bp, Artificial
  CRISPR gRNA sequence
ggtactgagaactggatact

SEQ ID NO: 91991 - DNA, 20 bp, Artificial
  CRISPR gRNA sequence
tgagaactggatactgagaa

SEQ ID NO: 91992 - DNA, 20 bp, Artificial
  CRISPR gRNA sequence
agaactggatactgagaata

SEQ ID NO: 91993 - DNA, 20 bp, Artificial
  CRISPR gRNA sequence
actggatactgagaatagag

SEQ ID NO: 91994 - DNA, 20 bp, Artificial
  CRISPR gRNA sequence
tgagaatagagtagtgaaaa

SEQ ID NO: 91995 - DNA, 20 bp, Artificial
  CRISPR gRNA sequence
aatagagtagtgaaaacaga

SEQ ID NO: 91996 - DNA, 20 bp, Artificial
  CRISPR gRNA sequence
tagagtagtgaaaacagaaa

SEQ ID NO: 91997 - DNA, 20 bp, Artificial
  CRISPR gRNA sequence
acagaaagagatgactttct

SEQ ID NO: 91998 - DNA, 20 bp, Artificial
  CRISPR gRNA sequence
gaaagagatgactttctcag

SEQ ID NO: 91999 - DNA, 20 bp, Artificial
  CRISPR gRNA sequence
tcagaagtaccaacttcatc

SEQ ID NO: 92000 - DNA, 20 bp, Artificial
  CRISPR gRNA sequence
cagaagtaccaacttcatct

SEQ ID NO: 92001 - DNA, 20 bp, Artificial
  CRISPR gRNA sequence
ccaacttcatctaggttcct

SEQ ID NO: 92002 - DNA, 20 bp, Artificial
  CRISPR gRNA sequence
ctaggttcctaagtctcctt

SEQ ID NO: 92003 - DNA, 20 bp, Artificial
  CRISPR gRNA sequence
agtctcctttagcgatgaac

SEQ ID NO: 92004 - DNA, 20 bp, Artificial
  CRISPR gRNA sequence
tcatttactctatgtccttc

SEQ ID NO: 92005 - DNA, 20 bp, Artificial
  CRISPR gRNA sequence
atgtccttccagccatatcc

SEQ ID NO: 92006 - DNA, 20 bp, Artificial
  CRISPR gRNA sequence
gccatatcccagatctatga

SEQ ID NO: 92007 - DNA, 20 bp, Artificial
  CRISPR gRNA sequence
gaaatttctgcacctatcat

SEQ ID NO: 92008 - DNA, 20 bp, Artificial
  CRISPR gRNA sequence
tgcacctatcatgagttcaa

SEQ ID NO: 92009 - DNA, 20 bp, Artificial
  CRISPR gRNA sequence
tgttattgctttgcacatgt

SEQ ID NO: 92010 - DNA, 20 bp, Artificial
  CRISPR gRNA sequence
tgttggtataaactttaatt

SEQ ID NO: 92011 - DNA, 20 bp, Artificial
  CRISPR gRNA sequence
gttggtataaactttaattt

SEQ ID NO: 92012 - DNA, 20 bp, Artificial
  CRISPR gRNA sequence
ttggtataaactttaattta

SEQ ID NO: 92013 - DNA, 20 bp, Artificial
  CRISPR gRNA sequence
ctaattctcaaccactaacc

SEQ ID NO: 92014 - DNA, 20 bp, Artificial
  CRISPR gRNA sequence
ctaacccagtcactgcaaac

SEQ ID NO: 92015 - DNA, 20 bp, Artificial
  CRISPR gRNA sequence
tcactgcaaaccggcccatt

SEQ ID NO: 92016 - DNA, 20 bp, Artificial
  CRISPR gRNA sequence
ctgcaaaccggcccatttgg

SEQ ID NO: 92017 - DNA, 20 bp, Artificial
  CRISPR gRNA sequence
caaaccggcccatttggaag

SEQ ID NO: 92018 - DNA, 20 bp, Artificial
  CRISPR gRNA sequence
aaaccggcccatttggaagt

SEQ ID NO: 92019 - DNA, 20 bp, Artificial
  CRISPR gRNA sequence
aaccggcccatttggaagtg

SEQ ID NO: 92020 - DNA, 20 bp, Artificial
  CRISPR gRNA sequence
ccggcccatttggaagtggg

SEQ ID NO: 92021 - DNA, 20 bp, Artificial
  CRISPR gRNA sequence
cggcccatttggaagtgggg

SEQ ID NO: 92022 - DNA, 20 bp, Artificial
  CRISPR gRNA sequence
cccatttggaagtggggagg

SEQ ID NO: 92023 - DNA, 20 bp, Artificial
  CRISPR gRNA sequence
ccatttggaagtggggaggc

SEQ ID NO: 92024 - DNA, 20 bp, Artificial
  CRISPR gRNA sequence
aagtggggaggcaggccctg

SEQ ID NO: 92025 - DNA, 20 bp, Artificial
  CRISPR gRNA sequence
ggaggcaggccctgcagatg

SEQ ID NO: 92026 - DNA, 20 bp, Artificial
  CRISPR gRNA sequence
ctgcagatgcggtttgcgtt

SEQ ID NO: 92027 - DNA, 20 bp, Artificial
  CRISPR gRNA sequence
gatgcggtttgcgttaagat

SEQ ID NO: 92028 - DNA, 20 bp, Artificial
  CRISPR gRNA sequence
atgcggtttgcgttaagatc

SEQ ID NO: 92029 - DNA, 20 bp, Artificial
  CRISPR gRNA sequence
cttcttccacctcccatccc

SEQ ID NO: 92030 - DNA, 20 bp, Artificial
  CRISPR gRNA sequence
ttcttccacctcccatcccc

SEQ ID NO: 92031 - DNA, 20 bp, Artificial
  CRISPR gRNA sequence
cacctcccatccccaggcct

SEQ ID NO: 92032 - DNA, 20 bp, Artificial
  CRISPR gRNA sequence
cccatccccaggcctcagct

SEQ ID NO: 92033 - DNA, 20 bp, Artificial
  CRISPR gRNA sequence
tcagctaagtctgatacctc

SEQ ID NO: 92034 - DNA, 20 bp, Artificial
  CRISPR gRNA sequence
tttgacgtttcccgcgctgc

SEQ ID NO: 92035 - DNA, 20 bp, Artificial
  CRISPR gRNA sequence
cgtttcccgcgctgccagtc

SEQ ID NO: 92036 - DNA, 20 bp, Artificial
  CRISPR gRNA sequence
gtttcccgcgctgccagtcg

SEQ ID NO: 92037 - DNA, 20 bp, Artificial
  CRISPR gRNA sequence
tcccgcgctgccagtcgagg

SEQ ID NO: 92038 - DNA, 20 bp, Artificial
  CRISPR gRNA sequence
cagtcgaggcagtcccaccg

SEQ ID NO: 92039 - DNA, 20 bp, Artificial
  CRISPR gRNA sequence
gaggcagtcccaccgcagtt

SEQ ID NO: 92040 - DNA, 20 bp, Artificial
  CRISPR gRNA sequence
aggcagtcccaccgcagttc

SEQ ID NO: 92041 - DNA, 20 bp, Artificial
  CRISPR gRNA sequence
ggcagtcccaccgcagttca

SEQ ID NO: 92042 - DNA, 20 bp, Artificial
  CRISPR gRNA sequence
tcccaccgcagttcagggcc

SEQ ID NO: 92043 - DNA, 20 bp, Artificial
  CRISPR gRNA sequence
tgtccttgtacatcttgttg

SEQ ID NO: 92044 - DNA, 20 bp, Artificial
  CRISPR gRNA sequence
cggtgtttcttgcacatcca

SEQ ID NO: 92045 - DNA, 20 bp, Artificial
  CRISPR gRNA sequence
catccacggtttgcgctgct

SEQ ID NO: 92046 - DNA, 20 bp, Artificial
  CRISPR gRNA sequence
gtttgcgctgcttggccacc

SEQ ID NO: 92047 - DNA, 20 bp, Artificial
  CRISPR gRNA sequence
ctgcttggccacctggctcg

SEQ ID NO: 92048 - DNA, 20 bp, Artificial
  CRISPR gRNA sequence
cctggctcgtggtctcgctg

SEQ ID NO: 92049 - DNA, 20 bp, Artificial
  CRISPR gRNA sequence
tggtctcgctgcagccttcg

SEQ ID NO: 92050 - DNA, 20 bp, Artificial
  CRISPR gRNA sequence
ggtctcgctgcagccttcgt

SEQ ID NO: 92051 - DNA, 20 bp, Artificial
  CRISPR gRNA sequence
cgctgcagccttcgtaggtg

SEQ ID NO: 92052 - DNA, 20 bp, Artificial
  CRISPR gRNA sequence
gctgcagccttcgtaggtgc

SEQ ID NO: 92053 - DNA, 20 bp, Artificial
  CRISPR gRNA sequence
ccccaccgctgccccgcctc

SEQ ID NO: 92054 - DNA, 20 bp, Artificial
  CRISPR gRNA sequence
cccaccgctgccccgcctcc

SEQ ID NO: 92055 - DNA, 20 bp, Artificial
  CRISPR gRNA sequence
cgctgctgccctcgcccccc

SEQ ID NO: 92056 - DNA, 20 bp, Artificial
  CRISPR gRNA sequence
gctgccctcgccccccgagt

SEQ ID NO: 92057 - DNA, 20 bp, Artificial
  CRISPR gRNA sequence
gagtgagtctcctcgtcctc

SEQ ID NO: 92058 - DNA, 20 bp, Artificial
  CRISPR gRNA sequence
gtcctctagatcctccaaac

SEQ ID NO: 92059 - DNA, 20 bp, Artificial
  CRISPR gRNA sequence
gccgcgctctcgcctccccc

SEQ ID NO: 92060 - DNA, 20 bp, Artificial
  CRISPR gRNA sequence
cgcgctctcgcctccccccg

SEQ ID NO: 92061 - DNA, 20 bp, Artificial
  CRISPR gRNA sequence
gcgctctcgcctccccccgg

SEQ ID NO: 92062 - DNA, 20 bp, Artificial
  CRISPR gRNA sequence
cgctctcgcctccccccgga

SEQ ID NO: 92063 - DNA, 20 bp, Artificial
  CRISPR gRNA sequence
gcctccccccggagggtccg

SEQ ID NO: 92064 - DNA, 20 bp, Artificial
  CRISPR gRNA sequence
ggagggtccgaagtgtctaa

SEQ ID NO: 92065 - DNA, 20 bp, Artificial
  CRISPR gRNA sequence
gagggtccgaagtgtctaac

SEQ ID NO: 92066 - DNA, 20 bp, Artificial
  CRISPR gRNA sequence
caggtccgcctcgtcctccc

SEQ ID NO: 92067 - DNA, 20 bp, Artificial
  CRISPR gRNA sequence
agcctcctcttcgccatccc

SEQ ID NO: 92068 - DNA, 20 bp, Artificial
  CRISPR gRNA sequence
ccatccccggccccttcgca

SEQ ID NO: 92069 - DNA, 20 bp, Artificial
  CRISPR gRNA sequence
catccccggccccttcgcac

SEQ ID NO: 92070 - DNA, 20 bp, Artificial
  CRISPR gRNA sequence
cccttcgcacaggtacctaa

SEQ ID NO: 92071 - DNA, 20 bp, Artificial
  CRISPR gRNA sequence
ccttcgcacaggtacctaac

SEQ ID NO: 92072 - DNA, 20 bp, Artificial
  CRISPR gRNA sequence
gcccgccccaacgctgcccc

SEQ ID NO: 92073 - DNA, 20 bp, Artificial
  CRISPR gRNA sequence
cccgccccaacgctgccccc

SEQ ID NO: 92074 - DNA, 20 bp, Artificial
  CRISPR gRNA sequence
ccgccccaacgctgcccccg

SEQ ID NO: 92075 - DNA, 20 bp, Artificial
  CRISPR gRNA sequence
cgccccaacgctgcccccgg

SEQ ID NO: 92076 - DNA, 20 bp, Artificial
  CRISPR gRNA sequence
aacgctgcccccgggggccg

SEQ ID NO: 92077 - DNA, 20 bp, Artificial
  CRISPR gRNA sequence
ggccgcagcctcgtcctgcc

SEQ ID NO: 92078 - DNA, 20 bp, Artificial
  CRISPR gRNA sequence
cagcctcgtcctgcccagca

SEQ ID NO: 92079 - DNA, 20 bp, Artificial
  CRISPR gRNA sequence
agcctcgtcctgcccagcac

SEQ ID NO: 92080 - DNA, 20 bp, Artificial
  CRISPR gRNA sequence
gcctcgtcctgcccagcaca

SEQ ID NO: 92081 - DNA, 20 bp, Artificial
  CRISPR gRNA sequence
ccagcacagggttgcatcac

SEQ ID NO: 92082 - DNA, 20 bp, Artificial
  CRISPR gRNA sequence
gcacagggttgcatcactag

SEQ ID NO: 92083 - DNA, 20 bp, Artificial
  CRISPR gRNA sequence
cacagggttgcatcactagc

SEQ ID NO: 92084 - DNA, 20 bp, Artificial
  CRISPR gRNA sequence
acagggttgcatcactagca

SEQ ID NO: 92085 - DNA, 20 bp, Artificial
  CRISPR gRNA sequence
catcactagcagggtgaatt

SEQ ID NO: 92086 - DNA, 20 bp, Artificial
  CRISPR gRNA sequence
tcactagcagggtgaattga

SEQ ID NO: 92087 - DNA, 20 bp, Artificial
  CRISPR gRNA sequence
cactagcagggtgaattgag

SEQ ID NO: 92088 - DNA, 20 bp, Artificial
  CRISPR gRNA sequence
cagggtgaattgagaggccg

SEQ ID NO: 92089 - DNA, 20 bp, Artificial
  CRISPR gRNA sequence
gagaggccgcggccgccacc

SEQ ID NO: 92090 - DNA, 20 bp, Artificial
  CRISPR gRNA sequence
agaggccgcggccgccaccg

SEQ ID NO: 92091 - DNA, 20 bp, Artificial
  CRISPR gRNA sequence
gccgcggccgccaccgaggc

SEQ ID NO: 92092 - DNA, 20 bp, Artificial
  CRISPR gRNA sequence
ccgccaccgaggctggcgcc

SEQ ID NO: 92093 - DNA, 20 bp, Artificial
  CRISPR gRNA sequence
cgccaccgaggctggcgcca

SEQ ID NO: 92094 - DNA, 20 bp, Artificial
  CRISPR gRNA sequence
caccgaggctggcgccaagg

SEQ ID NO: 92095 - DNA, 20 bp, Artificial
  CRISPR gRNA sequence
accgaggctggcgccaaggt

SEQ ID NO: 92096 - DNA, 20 bp, Artificial
  CRISPR gRNA sequence
cgaggctggcgccaaggtgg

SEQ ID NO: 92097 - DNA, 20 bp, Artificial
  CRISPR gRNA sequence
tggcgccaaggtgggagccg

SEQ ID NO: 92098 - DNA, 20 bp, Artificial
  CRISPR gRNA sequence
gccaaggtgggagccgcagc

SEQ ID NO: 92099 - DNA, 20 bp, Artificial
  CRISPR gRNA sequence
ccaaggtgggagccgcagcc

SEQ ID NO: 92100 - DNA, 20 bp, Artificial
  CRISPR gRNA sequence
caaggtgggagccgcagccg

SEQ ID NO: 92101 - DNA, 20 bp, Artificial
  CRISPR gRNA sequence
gtgggagccgcagccggggc

SEQ ID NO: 92102 - DNA, 20 bp, Artificial
  CRISPR gRNA sequence
tgggagccgcagccggggct

SEQ ID NO: 92103 - DNA, 20 bp, Artificial
  CRISPR gRNA sequence
gggagccgcagccggggcta

SEQ ID NO: 92104 - DNA, 20 bp, Artificial
  CRISPR gRNA sequence
cgcagccggggctagggccg

SEQ ID NO: 92105 - DNA, 20 bp, Artificial
  CRISPR gRNA sequence
gcagccggggctagggccgc

SEQ ID NO: 92106 - DNA, 20 bp, Artificial
  CRISPR gRNA sequence
cagccggggctagggccgcg

SEQ ID NO: 92107 - DNA, 20 bp, Artificial
  CRISPR gRNA sequence
ccggggctagggccgcgggg

SEQ ID NO: 92108 - DNA, 20 bp, Artificial
  CRISPR gRNA sequence
cggggctagggccgcggggt

SEQ ID NO: 92109 - DNA, 20 bp, Artificial
  CRISPR gRNA sequence
ggggctagggccgcggggtg

SEQ ID NO: 92110 - DNA, 20 bp, Artificial
  CRISPR gRNA sequence
cgcggggtggggcacgccgc

SEQ ID NO: 92111 - DNA, 20 bp, Artificial
  CRISPR gRNA sequence
ggggtggggcacgccgctgg

SEQ ID NO: 92112 - DNA, 20 bp, Artificial
  CRISPR gRNA sequence
ggcacgccgctggcggcgcc

SEQ ID NO: 92113 - DNA, 20 bp, Artificial
  CRISPR gRNA sequence
ccctgcgcctccatgctgct

SEQ ID NO: 92114 - DNA, 20 bp, Artificial
  CRISPR gRNA sequence
gcctccatgctgctaagacc

SEQ ID NO: 92115 - DNA, 20 bp, Artificial
  CRISPR gRNA sequence
ccatgctgctaagacctggc

SEQ ID NO: 92116 - DNA, 20 bp, Artificial
  CRISPR gRNA sequence
catgctgctaagacctggcc

SEQ ID NO: 92117 - DNA, 20 bp, Artificial
  CRISPR gRNA sequence
atgctgctaagacctggccg

SEQ ID NO: 92118 - DNA, 20 bp, Artificial
  CRISPR gRNA sequence
ctggccggggtccacgaccc

SEQ ID NO: 92119 - DNA, 20 bp, Artificial
  CRISPR gRNA sequence
tggccggggtccacgacccc

SEQ ID NO: 92120 - DNA, 20 bp, Artificial
  CRISPR gRNA sequence
ggtccacgaccccgggcttt

SEQ ID NO: 92121 - DNA, 20 bp, Artificial
  CRISPR gRNA sequence
ccgggcttttagcacctgct

SEQ ID NO: 92122 - DNA, 20 bp, Artificial
  CRISPR gRNA sequence
ttagcacctgcttggcctaa

SEQ ID NO: 92123 - DNA, 20 bp, Artificial
  CRISPR gRNA sequence
taacggcacttcgcgaacca

SEQ ID NO: 92124 - DNA, 20 bp, Artificial
  CRISPR gRNA sequence
cacttcgcgaaccaaagact

SEQ ID NO: 92125 - DNA, 20 bp, Artificial
  CRISPR gRNA sequence
acttcgcgaaccaaagactc

SEQ ID NO: 92126 - DNA, 20 bp, Artificial
  CRISPR gRNA sequence
accaaagactcaggacacgc

SEQ ID NO: 92127 - DNA, 20 bp, Artificial
  CRISPR gRNA sequence
ccaaagactcaggacacgct

SEQ ID NO: 92128 - DNA, 20 bp, Artificial
  CRISPR gRNA sequence
caaagactcaggacacgctg

SEQ ID NO: 92129 - DNA, 20 bp, Artificial
  CRISPR gRNA sequence
ccaagcaggtgctaaaagcc

SEQ ID NO: 92130 - DNA, 20 bp, Artificial
  CRISPR gRNA sequence
gtcttagcagcatggaggcg

SEQ ID NO: 92131 - DNA, 20 bp, Artificial
  CRISPR gRNA sequence
ggtacctgtgcgaaggggcc

SEQ ID NO: 92132 - DNA, 20 bp, Artificial
  CRISPR gRNA sequence
gcgagagcgcggctagtttg

SEQ ID NO: 92133 - DNA, 20 bp, Artificial
  CRISPR gRNA sequence
gtggccaagcagcgcaaacc

SEQ ID NO: 92134 - DNA, 20 bp, Artificial
  CRISPR gRNA sequence
atcagacttagctgaggcct

SEQ ID NO: 92135 - DNA, 20 bp, Artificial
  CRISPR gRNA sequence
aatgggccggtttgcagtga

SEQ ID NO: 92136 - DNA, 20 bp, Artificial
  CRISPR gRNA sequence
cagtgactgggttagtggtt

SEQ ID NO: 92137 - DNA, 20 bp, Artificial
  CRISPR gRNA sequence
ctgggttagtggttgagaat

SEQ ID NO: 92138 - DNA, 20 bp, Artificial
  CRISPR gRNA sequence
cggcagagctgtcatagatc

SEQ ID NO: 92139 - DNA, 20 bp, Artificial
  CRISPR gRNA sequence
gggatatggctggaaggaca

SEQ ID NO: 92140 - DNA, 20 bp, Artificial
  CRISPR gRNA sequence
tacccctgaggggggaaaaa

SEQ ID NO: 92141 - DNA, 20 bp, Artificial
  CRISPR gRNA sequence
ggggaaaaaaaggatgataa

SEQ ID NO: 92142 - DNA, 20 bp, Artificial
  CRISPR gRNA sequence
gtataagtctcaaaaaactt

SEQ ID NO: 92143 - DNA, 20 bp, Artificial
  CRISPR gRNA sequence
tttggattgtttgatttgaa

SEQ ID NO: 92144 - DNA, 20 bp, Artificial
  CRISPR gRNA sequence
caaaggtaaaaccagtgttc

SEQ ID NO: 92145 - DNA, 20 bp, Artificial
  CRISPR gRNA sequence
agtgttctggagttcgactt

SEQ ID NO: 92146 - DNA, 20 bp, Artificial
  CRISPR gRNA sequence
tcatttactggccttgtggc

SEQ ID NO: 92147 - DNA, 20 bp, Artificial
  CRISPR gRNA sequence
gtgtcattcatagtgttgct

SEQ ID NO: 92148 - DNA, 20 bp, Artificial
  CRISPR gRNA sequence
tatgtgagccattccatatt

SEQ ID NO: 92149 - DNA, 20 bp, Artificial
  CRISPR gRNA sequence
gtatacccagctgtacttgg

SEQ ID NO: 92150 - DNA, 20 bp, Artificial
  CRISPR gRNA sequence
tgggaagattgcttgagacc

SEQ ID NO: 92151 - DNA, 20 bp, Artificial
  CRISPR gRNA sequence
ttgcatcactgcattccagc

SEQ ID NO: 92152 - DNA, 20 bp, Artificial
  CRISPR gRNA sequence
tttttaactgcaagctgtct

SEQ ID NO: 92153 - DNA, 20 bp, Artificial
  CRISPR gRNA sequence
tgcaagctgtcttagggtcc

SEQ ID NO: 92154 - DNA, 20 bp, Artificial
  CRISPR gRNA sequence
acttggggaggcctaggagg

SEQ ID NO: 92155 - DNA, 20 bp, Artificial
  CRISPR gRNA sequence
cccggaagtttgagaccagc

SEQ ID NO: 92156 - DNA, 20 bp, Artificial
  CRISPR gRNA sequence
tactcgggaggctgaggtgg

SEQ ID NO: 92157 - DNA, 20 bp, Artificial
  CRISPR gRNA sequence
ttgtgctacttcactccagc

SEQ ID NO: 92158 - DNA, 20 bp, Artificial
  CRISPR gRNA sequence
ttaattcacactggttagga

SEQ ID NO: 92159 - DNA, 20 bp, Artificial
  CRISPR gRNA sequence
tcccttaagttttactcttt

SEQ ID NO: 92160 - DNA, 20 bp, Artificial
  CRISPR gRNA sequence
tggagtaagaggacttcttt

SEQ ID NO: 92161 - DNA, 20 bp, Artificial
  CRISPR gRNA sequence
tttaccaaatctctgattac

SEQ ID NO: 92162 - DNA, 20 bp, Artificial
  CRISPR gRNA sequence
agggaaataagcatctggaa

SEQ ID NO: 92163 - DNA, 20 bp, Artificial
  CRISPR gRNA sequence
ccacaggtgcccattcactt

SEQ ID NO: 92164 - DNA, 20 bp, Artificial
  CRISPR gRNA sequence
tttcttttttttttttgaga

SEQ ID NO: 92165 - DNA, 20 bp, Artificial
  CRISPR gRNA sequence
ttactctgtgtcgctcaggc

SEQ ID NO: 92166 - DNA, 20 bp, Artificial
  CRISPR gRNA sequence
cccactacaacctccacctc

SEQ ID NO: 92167 - DNA, 20 bp, Artificial
  CRISPR gRNA sequence
agttcttgtgcctcagcctc

SEQ ID NO: 92168 - DNA, 20 bp, Artificial
  CRISPR gRNA sequence
gcctcagcctcctgagtagc

SEQ ID NO: 92169 - DNA, 20 bp, Artificial
  CRISPR gRNA sequence
acctcagcctcctgaagtgc

SEQ ID NO: 92170 - DNA, 20 bp, Artificial
  CRISPR gRNA sequence
cctcctgaagtgctgggatt

SEQ ID NO: 92171 - DNA, 20 bp, Artificial
  CRISPR gRNA sequence
gtataaaaggcagatagata

SEQ ID NO: 92172 - DNA, 20 bp, Artificial
  CRISPR gRNA sequence
acttatctaattttttagag

SEQ ID NO: 92173 - DNA, 20 bp, Artificial
  CRISPR gRNA sequence
cagtgttgcccaggctggcc

SEQ ID NO: 92174 - DNA, 20 bp, Artificial
  CRISPR gRNA sequence
gatcctcctgcctcagcctt

SEQ ID NO: 92175 - DNA, 20 bp, Artificial
  CRISPR gRNA sequence
gcctcagccttcagagtaac

SEQ ID NO: 92176 - DNA, 20 bp, Artificial
  CRISPR gRNA sequence
ttgcatgactttttatggaa

SEQ ID NO: 92177 - DNA, 20 bp, Artificial
  CRISPR gRNA sequence
atccagtttgtcttatattt

SEQ ID NO: 92178 - DNA, 20 bp, Artificial
  CRISPR gRNA sequence
aaatctttatctttgttaaa

SEQ ID NO: 92179 - DNA, 20 bp, Artificial
  CRISPR gRNA sequence
aagaaaataacagtgccagc

SEQ ID NO: 92180 - DNA, 20 bp, Artificial
  CRISPR gRNA sequence
ccggttttagtagttcagag

SEQ ID NO: 92181 - DNA, 20 bp, Artificial
  CRISPR gRNA sequence
gtgactcagtataaaccaga

SEQ ID NO: 92182 - DNA, 20 bp, Artificial
  CRISPR gRNA sequence
aatagtttacgcttaatgag

SEQ ID NO: 92183 - DNA, 20 bp, Artificial
  CRISPR gRNA sequence
gcactgtgttaagctataaa

SEQ ID NO: 92184 - DNA, 20 bp, Artificial
  CRISPR gRNA sequence
gtctcacaacccttcagcaa

SEQ ID NO: 92185 - DNA, 20 bp, Artificial
  CRISPR gRNA sequence
actgaggcacagagaggcta

SEQ ID NO: 92186 - DNA, 20 bp, Artificial
  CRISPR gRNA sequence
tccttactatactgcttccc

SEQ ID NO: 92187 - DNA, 20 bp, Artificial
  CRISPR gRNA sequence
tttagtaaagaaagagaagt

SEQ ID NO: 92188 - DNA, 20 bp, Artificial
  CRISPR gRNA sequence
gactattctagctaaaatag

SEQ ID NO: 92189 - DNA, 20 bp, Artificial
  CRISPR gRNA sequence
gaagccagttttttatagta

SEQ ID NO: 92190 - DNA, 20 bp, Artificial
  CRISPR gRNA sequence
tagtattgaatgccaggcta

SEQ ID NO: 92191 - DNA, 20 bp, Artificial
  CRISPR gRNA sequence
tgaatgccaggctatgggat

SEQ ID NO: 92192 - DNA, 20 bp, Artificial
  CRISPR gRNA sequence
caggctatgggatttggatt

SEQ ID NO: 92193 - DNA, 20 bp, Artificial
  CRISPR gRNA sequence
gatctaattaggaagtagca

SEQ ID NO: 92194 - DNA, 20 bp, Artificial
  CRISPR gRNA sequence
agcagaggatcctaccctga

SEQ ID NO: 92195 - DNA, 20 bp, Artificial
  CRISPR gRNA sequence
gaggatcctaccctgatgga

SEQ ID NO: 92196 - DNA, 20 bp, Artificial
  CRISPR gRNA sequence
ttaagttctctattccaatg

SEQ ID NO: 92197 - DNA, 20 bp, Artificial
  CRISPR gRNA sequence
gagagacacataaagggact

SEQ ID NO: 92198 - DNA, 20 bp, Artificial
  CRISPR gRNA sequence
cataaagggactagggataa

SEQ ID NO: 92199 - DNA, 20 bp, Artificial
  CRISPR gRNA sequence
aatgaattgacctctgctgg

SEQ ID NO: 92200 - DNA, 20 bp, Artificial
  CRISPR gRNA sequence
actcttaggcataaatcaca

SEQ ID NO: 92201 - DNA, 20 bp, Artificial
  CRISPR gRNA sequence
agcattgcaggtttttgaaa

SEQ ID NO: 92202 - DNA, 20 bp, Artificial
  CRISPR gRNA sequence
aattcagtatctaatatttt

SEQ ID NO: 92203 - DNA, 20 bp, Artificial
  CRISPR gRNA sequence
atattttgtgaattaacctt

SEQ ID NO: 92204 - DNA, 20 bp, Artificial
  CRISPR gRNA sequence
aaccttttgaatttccatag

SEQ ID NO: 92205 - DNA, 20 bp, Artificial
  CRISPR gRNA sequence
atagtggggttgtgagggca

SEQ ID NO: 92206 - DNA, 20 bp, Artificial
  CRISPR gRNA sequence
tatcttgcacataaaaatga

SEQ ID NO: 92207 - DNA, 20 bp, Artificial
  CRISPR gRNA sequence
ctcataaataaaatcaactt

SEQ ID NO: 92208 - DNA, 20 bp, Artificial
  CRISPR gRNA sequence
agaaattatttttgtttcct

SEQ ID NO: 92209 - DNA, 20 bp, Artificial
  CRISPR gRNA sequence
tttttgtttcctctgggtat

SEQ ID NO: 92210 - DNA, 20 bp, Artificial
  CRISPR gRNA sequence
tgttgaggcctaaaatgttt

SEQ ID NO: 92211 - DNA, 20 bp, Artificial
  CRISPR gRNA sequence
ctcataatgaaagaaattaa

SEQ ID NO: 92212 - DNA, 20 bp, Artificial
  CRISPR gRNA sequence
tttatatttgctactttagt

SEQ ID NO: 92213 - DNA, 20 bp, Artificial
  CRISPR gRNA sequence
ttgctactttagtaagaatt

SEQ ID NO: 92214 - DNA, 20 bp, Artificial
  CRISPR gRNA sequence
gtattgtggcatagttttgt

SEQ ID NO: 92215 - DNA, 20 bp, Artificial
  CRISPR gRNA sequence
tggcatagttttgtaagagt

SEQ ID NO: 92216 - DNA, 20 bp, Artificial
  CRISPR gRNA sequence
taagatgctgtcaggtaact

SEQ ID NO: 92217 - DNA, 20 bp, Artificial
  CRISPR gRNA sequence
gtttttgggcagtgaaatct

SEQ ID NO: 92218 - DNA, 20 bp, Artificial
  CRISPR gRNA sequence
ccatttgttttggttgccaa

SEQ ID NO: 92219 - DNA, 20 bp, Artificial
  CRISPR gRNA sequence
gagcagtatataatttgcct

SEQ ID NO: 92220 - DNA, 20 bp, Artificial
  CRISPR gRNA sequence
caagcagattatgtttcggc

SEQ ID NO: 92221 - DNA, 20 bp, Artificial
  CRISPR gRNA sequence
cctggatagcattatataaa

SEQ ID NO: 92222 - DNA, 20 bp, Artificial
  CRISPR gRNA sequence
tggggggagagggagcgagg

SEQ ID NO: 92223 - DNA, 20 bp, Artificial
  CRISPR gRNA sequence
atgataatgaagaactttcc

SEQ ID NO: 92224 - DNA, 20 bp, Artificial
  CRISPR gRNA sequence
ctccattgttaaacaaagaa

SEQ ID NO: 92225 - DNA, 20 bp, Artificial
  CRISPR gRNA sequence
aacaaagaacaggatctttt

SEQ ID NO: 92226 - DNA, 20 bp, Artificial
  CRISPR gRNA sequence
ataagtcaaaattttaaaaa

SEQ ID NO: 92227 - DNA, 20 bp, Artificial
  CRISPR gRNA sequence
ataaacttgactacataaaa

SEQ ID NO: 92228 - DNA, 20 bp, Artificial
  CRISPR gRNA sequence
cactttgggaggccaggtgg

SEQ ID NO: 92229 - DNA, 20 bp, Artificial
  CRISPR gRNA sequence
tgggaggatcacttgaggct

SEQ ID NO: 92230 - DNA, 20 bp, Artificial
  CRISPR gRNA sequence
caaaaaaatttaaaaattag

SEQ ID NO: 92231 - DNA, 20 bp, Artificial
  CRISPR gRNA sequence
tactcaagaggctgaaacag

SEQ ID NO: 92232 - DNA, 20 bp, Artificial
  CRISPR gRNA sequence
ggctgaaacaggaggattgc

SEQ ID NO: 92233 - DNA, 20 bp, Artificial
  CRISPR gRNA sequence
caggaggattgcttgagtcc

SEQ ID NO: 92234 - DNA, 20 bp, Artificial
  CRISPR gRNA sequence
atagaaacagaaaaaaaagg

SEQ ID NO: 92235 - DNA, 20 bp, Artificial
  CRISPR gRNA sequence
gcagttgggcaatatgtacc

SEQ ID NO: 92236 - DNA, 20 bp, Artificial
  CRISPR gRNA sequence
atttaatatgaagacattta

SEQ ID NO: 92237 - DNA, 20 bp, Artificial
  CRISPR gRNA sequence
acagaatgtaaatcctaaat

SEQ ID NO: 92238 - DNA, 20 bp, Artificial
  CRISPR gRNA sequence
atgtaaatcctaaatatgga

SEQ ID NO: 92239 - DNA, 20 bp, Artificial
  CRISPR gRNA sequence
ttaaacataaaggtattgcc

SEQ ID NO: 92240 - DNA, 20 bp, Artificial
  CRISPR gRNA sequence
cctattacaggagactgtgg

SEQ ID NO: 92241 - DNA, 20 bp, Artificial
  CRISPR gRNA sequence
caggatgattgcttgagccg

SEQ ID NO: 92242 - DNA, 20 bp, Artificial
  CRISPR gRNA sequence
ctgcactccagcgtggggaa

SEQ ID NO: 92243 - DNA, 20 bp, Artificial
  CRISPR gRNA sequence
tacaactatattttaaagtg

SEQ ID NO: 92244 - DNA, 20 bp, Artificial
  CRISPR gRNA sequence
gatgagtgtacaaaaaggta

SEQ ID NO: 92245 - DNA, 20 bp, Artificial
  CRISPR gRNA sequence
ttttttttcttgctataatc

SEQ ID NO: 92246 - DNA, 20 bp, Artificial
  CRISPR gRNA sequence
tttgttcttacatatttcaa

SEQ ID NO: 92247 - DNA, 20 bp, Artificial
  CRISPR gRNA sequence
tatcatatgtagggacacat

SEQ ID NO: 92248 - DNA, 20 bp, Artificial
  CRISPR gRNA sequence
atttttttaccagacataaa

SEQ ID NO: 92249 - DNA, 20 bp, Artificial
  CRISPR gRNA sequence
atatgatacaatatgttcac

SEQ ID NO: 92250 - DNA, 20 bp, Artificial
  CRISPR gRNA sequence
atatgttcacaagaatatgc

SEQ ID NO: 92251 - DNA, 20 bp, Artificial
  CRISPR gRNA sequence
gaatcaaaagcacttttaca

SEQ ID NO: 92252 - DNA, 20 bp, Artificial
  CRISPR gRNA sequence
aatactaaaacctaaaaata

SEQ ID NO: 92253 - DNA, 20 bp, Artificial
  CRISPR gRNA sequence
agctaaaagtagcactgacc

SEQ ID NO: 92254 - DNA, 20 bp, Artificial
  CRISPR gRNA sequence
taacatattattattagaga

SEQ ID NO: 92255 - DNA, 20 bp, Artificial
  CRISPR gRNA sequence
tctcactctgttccccacgc

SEQ ID NO: 92256 - DNA, 20 bp, Artificial
  CRISPR gRNA sequence
ataagctgcaaaaagataaa

SEQ ID NO: 92257 - DNA, 20 bp, Artificial
  CRISPR gRNA sequence
tgtttaactctatccatatt

SEQ ID NO: 92258 - DNA, 20 bp, Artificial
  CRISPR gRNA sequence
cttcatattaaatgtgatgt

SEQ ID NO: 92259 - DNA, 20 bp, Artificial
  CRISPR gRNA sequence
aatgtgatgtctgagttgaa

SEQ ID NO: 92260 - DNA, 20 bp, Artificial
  CRISPR gRNA sequence
tataatgccattaactactt

SEQ ID NO: 92261 - DNA, 20 bp, Artificial
  CRISPR gRNA sequence
tttgtttatttttactgata

SEQ ID NO: 92262 - DNA, 20 bp, Artificial
  CRISPR gRNA sequence
ggttttcctcatcaaattac

SEQ ID NO: 92263 - DNA, 20 bp, Artificial
  CRISPR gRNA sequence
tgatcatgtttaatgattta

SEQ ID NO: 92264 - DNA, 20 bp, Artificial
  CRISPR gRNA sequence
gggtgctctgttgcctaggc

SEQ ID NO: 92265 - DNA, 20 bp, Artificial
  CRISPR gRNA sequence
gatcatagctcattgcagcc

SEQ ID NO: 92266 - DNA, 20 bp, Artificial
  CRISPR gRNA sequence
aatcctcctgtttcagcctc

SEQ ID NO: 92267 - DNA, 20 bp, Artificial
  CRISPR gRNA sequence
tttttaaatttttttgtaga

SEQ ID NO: 92268 - DNA, 20 bp, Artificial
  CRISPR gRNA sequence
tggggtctcgctacgttgcc

SEQ ID NO: 92269 - DNA, 20 bp, Artificial
  CRISPR gRNA sequence
cacctggcctcccaaagtgc

SEQ ID NO: 92270 - DNA, 20 bp, Artificial
  CRISPR gRNA sequence
atgaaccacaatgcccaacc

SEQ ID NO: 92271 - DNA, 20 bp, Artificial
  CRISPR gRNA sequence
ttttaaaattttgacttatt

SEQ ID NO: 92272 - DNA, 20 bp, Artificial
  CRISPR gRNA sequence
tgatttaacacttgttctaa

SEQ ID NO: 92273 - DNA, 20 bp, Artificial
  CRISPR gRNA sequence
ctgttctttgtttaacaatg

SEQ ID NO: 92274 - DNA, 20 bp, Artificial
  CRISPR gRNA sequence
gtatgttatctgcactttcc

SEQ ID NO: 92275 - DNA, 20 bp, Artificial
  CRISPR gRNA sequence
tctccccccagattttcaac

SEQ ID NO: 92276 - DNA, 20 bp, Artificial
  CRISPR gRNA sequence
aaaattaatagtgtgtgtga

SEQ ID NO: 92277 - DNA, 20 bp, Artificial
  CRISPR gRNA sequence
gtgggccactaagattgagg

SEQ ID NO: 92278 - DNA, 20 bp, Artificial
  CRISPR gRNA sequence
atattacaaaaaatgccaag

SEQ ID NO: 92279 - DNA, 20 bp, Artificial
  CRISPR gRNA sequence
gaaacataatctgcttgcct

SEQ ID NO: 92280 - DNA, 20 bp, Artificial
  CRISPR gRNA sequence
ttggcaaccaaaacaaatgg

SEQ ID NO: 92281 - DNA, 20 bp, Artificial
  CRISPR gRNA sequence
accggaaagccataccttac

SEQ ID NO: 92282 - DNA, 20 bp, Artificial
  CRISPR gRNA sequence
taacctctttgttctttact

SEQ ID NO: 92283 - DNA, 20 bp, Artificial
  CRISPR gRNA sequence
gggcttctttctactggcct

SEQ ID NO: 92284 - DNA, 20 bp, Artificial
  CRISPR gRNA sequence
ctggcctctgagttatctat

SEQ ID NO: 92285 - DNA, 20 bp, Artificial
  CRISPR gRNA sequence
catttttatgtgcaagataa

SEQ ID NO: 92286 - DNA, 20 bp, Artificial
  CRISPR gRNA sequence
aattcacaaaatattagata

SEQ ID NO: 92287 - DNA, 20 bp, Artificial
  CRISPR gRNA sequence
gtccaaacttgtacagatgt

SEQ ID NO: 92288 - DNA, 20 bp, Artificial
  CRISPR gRNA sequence
ctgcaatgctttttgtccta

SEQ ID NO: 92289 - DNA, 20 bp, Artificial
  CRISPR gRNA sequence
ttgccacatttcatttggtt

SEQ ID NO: 92290 - DNA, 20 bp, Artificial
  CRISPR gRNA sequence
gaatagctctaacatttcgg

SEQ ID NO: 92291 - DNA, 20 bp, Artificial
  CRISPR gRNA sequence
actccttgtgatttatgcct

SEQ ID NO: 92292 - DNA, 20 bp, Artificial
  CRISPR gRNA sequence
cctaagagtcctagttacct

SEQ ID NO: 92293 - DNA, 20 bp, Artificial
  CRISPR gRNA sequence
tagcatagttcttagattgg

SEQ ID NO: 92294 - DNA, 20 bp, Artificial
  CRISPR gRNA sequence
taccttaataaattcttcat

SEQ ID NO: 92295 - DNA, 20 bp, Artificial
  CRISPR gRNA sequence
cctactataataatcttcga

SEQ ID NO: 92296 - DNA, 20 bp, Artificial
  CRISPR gRNA sequence
tcaactttaacccactccat

SEQ ID NO: 92297 - DNA, 20 bp, Artificial
  CRISPR gRNA sequence
tttaacccactccatcaggg

SEQ ID NO: 92298 - DNA, 20 bp, Artificial
  CRISPR gRNA sequence
tctttccaaatttctctctc

SEQ ID NO: 92299 - DNA, 20 bp, Artificial
  CRISPR gRNA sequence
ttccactcaactattttagc

SEQ ID NO: 92300 - DNA, 20 bp, Artificial
  CRISPR gRNA sequence
ttctctttccttttatctac

SEQ ID NO: 92301 - DNA, 20 bp, Artificial
  CRISPR gRNA sequence
ggaggtaaaagtgaaagctc

SEQ ID NO: 92302 - DNA, 20 bp, Artificial
  CRISPR gRNA sequence
tagaataagactgcttgcgt

SEQ ID NO: 92303 - DNA, 20 bp, Artificial
  CRISPR gRNA sequence
tagtatctatcccattgctg

SEQ ID NO: 92304 - DNA, 20 bp, Artificial
  CRISPR gRNA sequence
cccatcctttctggtttata

SEQ ID NO: 92305 - DNA, 20 bp, Artificial
  CRISPR gRNA sequence
tttcctctgcaaagcctttc

SEQ ID NO: 92306 - DNA, 20 bp, Artificial
  CRISPR gRNA sequence
atcccaaaatataagacaaa

SEQ ID NO: 92307 - DNA, 20 bp, Artificial
  CRISPR gRNA sequence
tactctgaaggctgaggcag

SEQ ID NO: 92308 - DNA, 20 bp, Artificial
  CRISPR gRNA sequence
caggaggatcacttgagccc

SEQ ID NO: 92309 - DNA, 20 bp, Artificial
  CRISPR gRNA sequence
agtattattaggccggcgtg

SEQ ID NO: 92310 - DNA, 20 bp, Artificial
  CRISPR gRNA sequence
acttcaggaggctgaggtgg

SEQ ID NO: 92311 - DNA, 20 bp, Artificial
  CRISPR gRNA sequence
gaggctgaggtgggaggatc

SEQ ID NO: 92312 - DNA, 20 bp, Artificial
  CRISPR gRNA sequence
gcactccagcctgagcgaca

SEQ ID NO: 92313 - DNA, 20 bp, Artificial
  CRISPR gRNA sequence
attatttttctccctctcta

SEQ ID NO: 92314 - DNA, 20 bp, Artificial
  CRISPR gRNA sequence
cctctctaaagaattctgaa

SEQ ID NO: 92315 - DNA, 20 bp, Artificial
  CRISPR gRNA sequence
gatttggtaaaacatactat

SEQ ID NO: 92316 - DNA, 20 bp, Artificial
  CRISPR gRNA sequence
gtaaaacatactataagaat

SEQ ID NO: 92317 - DNA, 20 bp, Artificial
  CRISPR gRNA sequence
actataagaatatggattga

SEQ ID NO: 92318 - DNA, 20 bp, Artificial
  CRISPR gRNA sequence
tgcaaaattaaagttacata

SEQ ID NO: 92319 - DNA, 20 bp, Artificial
  CRISPR gRNA sequence
acatagtggatttttctagg

SEQ ID NO: 92320 - DNA, 20 bp, Artificial
  CRISPR gRNA sequence
aagaagtcctcttactccaa

SEQ ID NO: 92321 - DNA, 20 bp, Artificial
  CRISPR gRNA sequence
gtcactcagtcctaaccagt

SEQ ID NO: 92322 - DNA, 20 bp, Artificial
  CRISPR gRNA sequence
ctgcaaattttagaaatatt

SEQ ID NO: 92323 - DNA, 20 bp, Artificial
  CRISPR gRNA sequence
tcttgctctgtcacccaggc

SEQ ID NO: 92324 - DNA, 20 bp, Artificial
  CRISPR gRNA sequence
gatccttccacctcagcctc

SEQ ID NO: 92325 - DNA, 20 bp, Artificial
  CRISPR gRNA sequence
ttaaaatttttttgttgaga

SEQ ID NO: 92326 - DNA, 20 bp, Artificial
  CRISPR gRNA sequence
aactaagaaatttaaagact

SEQ ID NO: 92327 - DNA, 20 bp, Artificial
  CRISPR gRNA sequence
tttttttttttttaaggaga

SEQ ID NO: 92328 - DNA, 20 bp, Artificial
  CRISPR gRNA sequence
tcttgctatgtcatccaggc

SEQ ID NO: 92329 - DNA, 20 bp, Artificial
  CRISPR gRNA sequence
cttcaccctcccaagtacag

SEQ ID NO: 92330 - DNA, 20 bp, Artificial
  CRISPR gRNA sequence
cacttgccaccatacctggc

SEQ ID NO: 92331 - DNA, 20 bp, Artificial
  CRISPR gRNA sequence
ttaaatttttctctacacta

SEQ ID NO: 92332 - DNA, 20 bp, Artificial
  CRISPR gRNA sequence
cactaacaatgacaataata

SEQ ID NO: 92333 - DNA, 20 bp, Artificial
  CRISPR gRNA sequence
cactgtgtgaaccctcaata

SEQ ID NO: 92334 - DNA, 20 bp, Artificial
  CRISPR gRNA sequence
cacatattcacagcaacact

SEQ ID NO: 92335 - DNA, 20 bp, Artificial
  CRISPR gRNA sequence
cgattttaatgcccatttta

SEQ ID NO: 92336 - DNA, 20 bp, Artificial
  CRISPR gRNA sequence
aggccagtaaatgatgcaac

SEQ ID NO: 92337 - DNA, 20 bp, Artificial
  CRISPR gRNA sequence
catcctttttttcccccctc

SEQ ID NO: 92338 - DNA, 20 bp, Artificial
  CRISPR gRNA sequence
ccctcaggggtactaagaaa

SEQ ID NO: 92339 - DNA, 20 bp, Artificial
  CRISPR gRNA sequence
aagaaaaggggtagtgagaa

SEQ ID NO: 92340 - DNA, 20 bp, Artificial
  CRISPR gRNA sequence
gagaacagggtactaacaac

SEQ ID NO: 92341 - DNA, 20 bp, Artificial
  CRISPR gRNA sequence
gaacaaagtatattaagtat

SEQ ID NO: 92342 - DNA, 20 bp, Artificial
  CRISPR gRNA sequence
gagaacaagggactaaacat

SEQ ID NO: 92343 - DNA, 20 bp, Artificial
  CRISPR gRNA sequence
aaacataggggtactgggaa

SEQ ID NO: 92344 - DNA, 20 bp, Artificial
  CRISPR gRNA sequence
tgggaacagagttgtaagaa

SEQ ID NO: 92345 - DNA, 20 bp, Artificial
  CRISPR gRNA sequence
aagaaaagagtactacgtac

SEQ ID NO: 92346 - DNA, 20 bp, Artificial
  CRISPR gRNA sequence
ggggtactacagacaggcaa

SEQ ID NO: 92347 - DNA, 20 bp, Artificial
  CRISPR gRNA sequence
taaaaatacggtactaggaa

SEQ ID NO: 92348 - DNA, 20 bp, Artificial
  CRISPR gRNA sequence
aaaaacaaagtactaaatac

SEQ ID NO: 92349 - DNA, 20 bp, Artificial
  CRISPR gRNA sequence
acaaatagaggtactgagaa

SEQ ID NO: 92350 - DNA, 20 bp, Artificial
  CRISPR gRNA sequence
tgagaactgggtactgagaa

SEQ ID NO: 92351 - DNA, 20 bp, Artificial
  CRISPR gRNA sequence
ggtactgagaactggatact

SEQ ID NO: 92352 - DNA, 20 bp, Artificial
  CRISPR gRNA sequence
tgagaactggatactgagaa

SEQ ID NO: 92353 - DNA, 20 bp, Artificial
  CRISPR gRNA sequence
ctgaaatttctgcacctatc

SEQ ID NO: 92354 - DNA, 20 bp, Artificial
  CRISPR gRNA sequence
agatgcggtttgcgttaaga

SEQ ID NO: 92355 - DNA, 20 bp, Artificial
  CRISPR gRNA sequence
cctcagctaagtctgatacc

SEQ ID NO: 92356 - DNA, 20 bp, Artificial
  CRISPR gRNA sequence
cccgctgctgccctcgcccc

SEQ ID NO: 92357 - DNA, 20 bp, Artificial
  CRISPR gRNA sequence
ctgctgccctcgccccccga

SEQ ID NO: 92358 - DNA, 20 bp, Artificial
  CRISPR gRNA sequence
cgcgctctcgcctccccccg

SEQ ID NO: 92359 - DNA, 20 bp, Artificial
  CRISPR gRNA sequence
cagcctcgtcctgcccagca

SEQ ID NO: 92360 - DNA, 20 bp, Artificial
  CRISPR gRNA sequence
gcacagggttgcatcactag

SEQ ID NO: 92361 - DNA, 20 bp, Artificial
  CRISPR gRNA sequence
agggttgcatcactagcagg

SEQ ID NO: 92362 - DNA, 20 bp, Artificial
  CRISPR gRNA sequence
cgcagccggggctagggccg

SEQ ID NO: 92363 - DNA, 20 bp, Artificial
  CRISPR gRNA sequence
ccatgctgctaagacctggc

SEQ ID NO: 92364 - DNA, 20 bp, Artificial
  CRISPR gRNA sequence
accaaagactcaggacacgc

SEQ ID NO: 92365 - DNA, 20 bp, Artificial
  CRISPR gRNA sequence
cggggggaggcgagagcgcg

SEQ ID NO: 92366 - DNA, 20 bp, Artificial
  CRISPR gRNA sequence
gcctccccacttccaaatgg

SEQ ID NO: 92367 - DNA, 20 bp, Artificial
  CRISPR gRNA sequence
gggttagtggttgagaatta

SEQ ID NO: 92368 - DNA, 20 bp, Artificial
  CRISPR gRNA sequence
ttagagtgtttgccctaaat

SEQ ID NO: 92369 - DNA, 20 bp, Artificial
  CRISPR gRNA sequence
cttctgagaaagtcatctct

SEQ ID NO: 92370 - DNA, 20 bp, Artificial
  CRISPR gRNA sequence
taatactcctgtatttagta

SEQ ID NO: 92371 - DNA, 20 bp, Artificial
  CRISPR gRNA sequence
caactctgttcccagtaccc

SEQ ID NO: 92372 - DNA, 20 bp, Artificial
  CRISPR gRNA sequence
ggtataagtctcaaaaaact

SEQ ID NO: 92373 - DNA, 20 bp, Artificial
  CRISPR gRNA sequence
taagtctcaaaaaacttttg

SEQ ID NO: 92374 - DNA, 20 bp, Artificial
  CRISPR gRNA sequence
tctcaaaaaacttttggatt

SEQ ID NO: 92375 - DNA, 20 bp, Artificial
  CRISPR gRNA sequence
gttgcatcatttactggcct

SEQ ID NO: 92376 - DNA, 20 bp, Artificial
  CRISPR gRNA sequence
cacagtgtccagcaactggc

SEQ ID NO: 92377 - DNA, 20 bp, Artificial
  CRISPR gRNA sequence
gtacttgggagggtgaagtg

SEQ ID NO: 92378 - DNA, 20 bp, Artificial
  CRISPR gRNA sequence
ttgggagggtgaagtgggaa

SEQ ID NO: 92379 - DNA, 20 bp, Artificial
  CRISPR gRNA sequence
gggttcgaggctgccgtgag

SEQ ID NO: 92380 - DNA, 20 bp, Artificial
  CRISPR gRNA sequence
tattctaagtctttaaattt

SEQ ID NO: 92381 - DNA, 20 bp, Artificial
  CRISPR gRNA sequence
actaaaatattagaccttgt

SEQ ID NO: 92382 - DNA, 20 bp, Artificial
  CRISPR gRNA sequence
tggggaggcctaggagggag

SEQ ID NO: 92383 - DNA, 20 bp, Artificial
  CRISPR gRNA sequence
agggaggatcgcttgagccc

SEQ ID NO: 92384 - DNA, 20 bp, Artificial
  CRISPR gRNA sequence
gtggaaggatcattgagccc

SEQ ID NO: 92385 - DNA, 20 bp, Artificial
  CRISPR gRNA sequence
ctgagtgacttctctttccc

SEQ ID NO: 92386 - DNA, 20 bp, Artificial
  CRISPR gRNA sequence
gggctcaggacttctgtaat

SEQ ID NO: 92387 - DNA, 20 bp, Artificial
  CRISPR gRNA sequence
cctcaatccatattcttata

SEQ ID NO: 92388 - DNA, 20 bp, Artificial
  CRISPR gRNA sequence
tatagtatgttttaccaaat

SEQ ID NO: 92389 - DNA, 20 bp, Artificial
  CRISPR gRNA sequence
ttttaccaaatctctgatta

SEQ ID NO: 92390 - DNA, 20 bp, Artificial
  CRISPR gRNA sequence
atgaaagttagtaaaggtga

SEQ ID NO: 92391 - DNA, 20 bp, Artificial
  CRISPR gRNA sequence
tgcctcagcctcctgagtag

SEQ ID NO: 92392 - DNA, 20 bp, Artificial
  CRISPR gRNA sequence
ttttgtatttttagtagaga

SEQ ID NO: 92393 - DNA, 20 bp, Artificial
  CRISPR gRNA sequence
cacctcagcctcctgaagtg

SEQ ID NO: 92394 - DNA, 20 bp, Artificial
  CRISPR gRNA sequence
gaaagaagtagttaacctat

SEQ ID NO: 92395 - DNA, 20 bp, Artificial
  CRISPR gRNA sequence
tgcctcagccttcagagtaa

SEQ ID NO: 92396 - DNA, 20 bp, Artificial
  CRISPR gRNA sequence
gggattatttcaccactgca

SEQ ID NO: 92397 - DNA, 20 bp, Artificial
  CRISPR gRNA sequence
tataagcaacaaataatact

SEQ ID NO: 92398 - DNA, 20 bp, Artificial
  CRISPR gRNA sequence
ataatactaatagtttacta

SEQ ID NO: 92399 - DNA, 20 bp, Artificial
  CRISPR gRNA sequence
aataagagccaactgtatag

SEQ ID NO: 92400 - DNA, 20 bp, Artificial
  CRISPR gRNA sequence
tgtaggctgagatactccag

SEQ ID NO: 92401 - DNA, 20 bp, Artificial
  CRISPR gRNA sequence
ataaaccagaaaggatgggc

SEQ ID NO: 92402 - DNA, 20 bp, Artificial
  CRISPR gRNA sequence
cagaaaggatgggcaatagt

SEQ ID NO: 92403 - DNA, 20 bp, Artificial
  CRISPR gRNA sequence
aatagtttacgcttaatgag

SEQ ID NO: 92404 - DNA, 20 bp, Artificial
  CRISPR gRNA sequence
aaacgcaagcagtcttattc

SEQ ID NO: 92405 - DNA, 20 bp, Artificial
  CRISPR gRNA sequence
tcacttttacctccttacta

SEQ ID NO: 92406 - DNA, 20 bp, Artificial
  CRISPR gRNA sequence
atttggaaagataggttgaa

SEQ ID NO: 92407 - DNA, 20 bp, Artificial
  CRISPR gRNA sequence
atagtattgaatgccaggct

SEQ ID NO: 92408 - DNA, 20 bp, Artificial
  CRISPR gRNA sequence
ttgaatgccaggctatggga

SEQ ID NO: 92409 - DNA, 20 bp, Artificial
  CRISPR gRNA sequence
gtgggttaaagttgagagcc

SEQ ID NO: 92410 - DNA, 20 bp, Artificial
  CRISPR gRNA sequence
tatagattttgagactcttt

SEQ ID NO: 92411 - DNA, 20 bp, Artificial
  CRISPR gRNA sequence
cttctgctatgttgtgagca

SEQ ID NO: 92412 - DNA, 20 bp, Artificial
  CRISPR gRNA sequence
aaatgaattgacctctgctg

SEQ ID NO: 92413 - DNA, 20 bp, Artificial
  CRISPR gRNA sequence
agaagcagtagacttatatg

SEQ ID NO: 92414 - DNA, 20 bp, Artificial
  CRISPR gRNA sequence
acaaggagtatgtatttcag

SEQ ID NO: 92415 - DNA, 20 bp, Artificial
  CRISPR gRNA sequence
tctgtaggacaaaaagcatt

SEQ ID NO: 92416 - DNA, 20 bp, Artificial
  CRISPR gRNA sequence
aaaagaattccaacatctgt

SEQ ID NO: 92417 - DNA, 20 bp, Artificial
  CRISPR gRNA sequence
gactaaaggttattttcact

SEQ ID NO: 92418 - DNA, 20 bp, Artificial
  CRISPR gRNA sequence
ctggaggaggaagaaattat

SEQ ID NO: 92419 - DNA, 20 bp, Artificial
  CRISPR gRNA sequence
gggtattagaattttctttt

SEQ ID NO: 92420 - DNA, 20 bp, Artificial
  CRISPR gRNA sequence
tttttatatgttgaggccta

SEQ ID NO: 92421 - DNA, 20 bp, Artificial
  CRISPR gRNA sequence
gaggttaaattcatgtaagg

SEQ ID NO: 92422 - DNA, 20 bp, Artificial
  CRISPR gRNA sequence
ttttggatgtggtattgtgg

SEQ ID NO: 92423 - DNA, 20 bp, Artificial
  CRISPR gRNA sequence
acatatttggtaataagtgc

SEQ ID NO: 92424 - DNA, 20 bp, Artificial
  CRISPR gRNA sequence
ttggtaataagtgctgctga

SEQ ID NO: 92425 - DNA, 20 bp, Artificial
  CRISPR gRNA sequence
atggtatcattttaggactt

SEQ ID NO: 92426 - DNA, 20 bp, Artificial
  CRISPR gRNA sequence
tggcaggagactatttatac

SEQ ID NO: 92427 - DNA, 20 bp, Artificial
  CRISPR gRNA sequence
ttatactagtgctttttcaa

SEQ ID NO: 92428 - DNA, 20 bp, Artificial
  CRISPR gRNA sequence
agcaagtttatctaaatttt

SEQ ID NO: 92429 - DNA, 20 bp, Artificial
  CRISPR gRNA sequence
ttttgaaagctttggttatc

SEQ ID NO: 92430 - DNA, 20 bp, Artificial
  CRISPR gRNA sequence
caatattttactactccccc

SEQ ID NO: 92431 - DNA, 20 bp, Artificial
  CRISPR gRNA sequence
atatatttcatccaaaggca

SEQ ID NO: 92432 - DNA, 20 bp, Artificial
  CRISPR gRNA sequence
ttcatccaaaggcaagcaga

SEQ ID NO: 92433 - DNA, 20 bp, Artificial
  CRISPR gRNA sequence
taatcatgacttattacgtt

SEQ ID NO: 92434 - DNA, 20 bp, Artificial
  CRISPR gRNA sequence
atcaaaaaagactggtaaat

SEQ ID NO: 92435 - DNA, 20 bp, Artificial
  CRISPR gRNA sequence
tcagttataaatgtgttaac

SEQ ID NO: 92436 - DNA, 20 bp, Artificial
  CRISPR gRNA sequence
gtttgttataaatggaacaa

SEQ ID NO: 92437 - DNA, 20 bp, Artificial
  CRISPR gRNA sequence
aaatggaacaattgagattt

SEQ ID NO: 92438 - DNA, 20 bp, Artificial
  CRISPR gRNA sequence
aactttacctcaaaaatgta

SEQ ID NO: 92439 - DNA, 20 bp, Artificial
  CRISPR gRNA sequence
aaaaatgtaatgagattttt

SEQ ID NO: 92440 - DNA, 20 bp, Artificial
  CRISPR gRNA sequence
atatagacaaaatcacagag

SEQ ID NO: 92441 - DNA, 20 bp, Artificial
  CRISPR gRNA sequence
ctactcaagaggctgaaaca

SEQ ID NO: 92442 - DNA, 20 bp, Artificial
  CRISPR gRNA sequence
tcaagaggctgaaacaggag

SEQ ID NO: 92443 - DNA, 20 bp, Artificial
  CRISPR gRNA sequence
cctataaatcattaaacatg

SEQ ID NO: 92444 - DNA, 20 bp, Artificial
  CRISPR gRNA sequence
tttccttacatatatataaa

SEQ ID NO: 92445 - DNA, 20 bp, Artificial
  CRISPR gRNA sequence
taaaatatgtttgcctcttt

SEQ ID NO: 92446 - DNA, 20 bp, Artificial
  CRISPR gRNA sequence
gcttcagtcttaactgcaaa

SEQ ID NO: 92447 - DNA, 20 bp, Artificial
  CRISPR gRNA sequence
gtaatttgatgaggaaaacc

SEQ ID NO: 92448 - DNA, 20 bp, Artificial
  CRISPR gRNA sequence
acaaaaagtgaaaattattt

SEQ ID NO: 92449 - DNA, 20 bp, Artificial
  CRISPR gRNA sequence
caacagtgtcataacagcta

SEQ ID NO: 92450 - DNA, 20 bp, Artificial
  CRISPR gRNA sequence
ctaagatgatttttaaataa

SEQ ID NO: 92451 - DNA, 20 bp, Artificial
  CRISPR gRNA sequence
atgatagtatgttcacttta

SEQ ID NO: 92452 - DNA, 20 bp, Artificial
  CRISPR gRNA sequence
ctttattcagtttatctttt

SEQ ID NO: 92453 - DNA, 20 bp, Artificial
  CRISPR gRNA sequence
tttttgcagcttattggggc

SEQ ID NO: 92454 - DNA, 20 bp, Artificial
  CRISPR gRNA sequence
tattacaggagactgtggca

SEQ ID NO: 92455 - DNA, 20 bp, Artificial
  CRISPR gRNA sequence
acaggagactgtggcaggat

SEQ ID NO: 92456 - DNA, 20 bp, Artificial
  CRISPR gRNA sequence
tgagtgtacaaaaaggtatt

SEQ ID NO: 92457 - DNA, 20 bp, Artificial
  CRISPR gRNA sequence
tgagaaacttgacttctagc

SEQ ID NO: 92458 - DNA, 20 bp, Artificial
  CRISPR gRNA sequence
atttgctggcatattagaga

SEQ ID NO: 92459 - DNA, 20 bp, Artificial
  CRISPR gRNA sequence
acagacttcacccgttattt

SEQ ID NO: 92460 - DNA, 20 bp, Artificial
  CRISPR gRNA sequence
atgtgtgacatcacattatt

SEQ ID NO: 92461 - DNA, 20 bp, Artificial
  CRISPR gRNA sequence
acatcacattatttttagtt

SEQ ID NO: 92462 - DNA, 20 bp, Artificial
  CRISPR gRNA sequence
ttgcagtgcatccgatgtaa

SEQ ID NO: 92463 - DNA, 20 bp, Artificial
  CRISPR gRNA sequence
tgcatccgatgtaaaagtgc

SEQ ID NO: 92464 - DNA, 20 bp, Artificial
  CRISPR gRNA sequence
gcatgaaaacagtctaatga

SEQ ID NO: 92465 - DNA, 20 bp, Artificial
  CRISPR gRNA sequence
cagcaacagctattaaatca

SEQ ID NO: 92466 - DNA, 20 bp, Artificial
  CRISPR gRNA sequence
agttttggagcaaagacaac

SEQ ID NO: 92467 - DNA, 20 bp, Artificial
  CRISPR gRNA sequence
gaacttaccaagaacatcta

SEQ ID NO: 92468 - DNA, 20 bp, Artificial
  CRISPR gRNA sequence
gttgtctttgctccaaaact

SEQ ID NO: 92469 - DNA, 20 bp, Artificial
  CRISPR gRNA sequence
cttgctgatttaatagctgt

SEQ ID NO: 92470 - DNA, 20 bp, Artificial
  CRISPR gRNA sequence
agcattaatctatgtcatta

SEQ ID NO: 92471 - DNA, 20 bp, Artificial
  CRISPR gRNA sequence
gagctaaaagtagcactgac

SEQ ID NO: 92472 - DNA, 20 bp, Artificial
  CRISPR gRNA sequence
tgtgaaaatagcagctaaat

SEQ ID NO: 92473 - DNA, 20 bp, Artificial
  CRISPR gRNA sequence
atacaaactagtgctagaag

SEQ ID NO: 92474 - DNA, 20 bp, Artificial
  CRISPR gRNA sequence
aatataacaaatataacaga

SEQ ID NO: 92475 - DNA, 20 bp, Artificial
  CRISPR gRNA sequence
tcctgccacagtctcctgta

SEQ ID NO: 92476 - DNA, 20 bp, Artificial
  CRISPR gRNA sequence
actatcattaaatactgact

SEQ ID NO: 92477 - DNA, 20 bp, Artificial
  CRISPR gRNA sequence
agtacattttctatttatta

SEQ ID NO: 92478 - DNA, 20 bp, Artificial
  CRISPR gRNA sequence
atgacactgttggacattta

SEQ ID NO: 92479 - DNA, 20 bp, Artificial
  CRISPR gRNA sequence
atatattcctggcaatacct

SEQ ID NO: 92480 - DNA, 20 bp, Artificial
  CRISPR gRNA sequence
atgtttaactctatccatat

SEQ ID NO: 92481 - DNA, 20 bp, Artificial
  CRISPR gRNA sequence
actcctggtacatattgccc

SEQ ID NO: 92482 - DNA, 20 bp, Artificial
  CRISPR gRNA sequence
atcactgcatcattgtgcgt

SEQ ID NO: 92483 - DNA, 20 bp, Artificial
  CRISPR gRNA sequence
tcgtttaaataattttcact

SEQ ID NO: 92484 - DNA, 20 bp, Artificial
  CRISPR gRNA sequence
aatggtattctgcctttttt

SEQ ID NO: 92485 - DNA, 20 bp, Artificial
  CRISPR gRNA sequence
ttttgcaatgtattgaagcc

SEQ ID NO: 92486 - DNA, 20 bp, Artificial
  CRISPR gRNA sequence
tatatatgtaaggaaactga

SEQ ID NO: 92487 - DNA, 20 bp, Artificial
  CRISPR gRNA sequence
gtaaggaaactgatcatgtt

SEQ ID NO: 92488 - DNA, 20 bp, Artificial
  CRISPR gRNA sequence
ttcctggactcaagcaatcc

SEQ ID NO: 92489 - DNA, 20 bp, Artificial
  CRISPR gRNA sequence
ccacctggcctcccaaagtg

SEQ ID NO: 92490 - DNA, 20 bp, Artificial
  CRISPR gRNA sequence
tagcattcatttttatgtag

SEQ ID NO: 92491 - DNA, 20 bp, Artificial
  CRISPR gRNA sequence
tcaagtttataatcttttct

SEQ ID NO: 92492 - DNA, 20 bp, Artificial
  CRISPR gRNA sequence
attacatttttgaggtaaag

SEQ ID NO: 92493 - DNA, 20 bp, Artificial
  CRISPR gRNA sequence
tcaattgttccatttataac

SEQ ID NO: 92494 - DNA, 20 bp, Artificial
  CRISPR gRNA sequence
acgtttgttaacacatttat

SEQ ID NO: 92495 - DNA, 20 bp, Artificial
  CRISPR gRNA sequence
aacagatatttaccagtctt

SEQ ID NO: 92496 - DNA, 20 bp, Artificial
  CRISPR gRNA sequence
gatccccaaaagatcctgtt

SEQ ID NO: 92497 - DNA, 20 bp, Artificial
  CRISPR gRNA sequence
taaacagttaacgtaataag

SEQ ID NO: 92498 - DNA, 20 bp, Artificial
  CRISPR gRNA sequence
tcctcctcgctccctctccc

SEQ ID NO: 92499 - DNA, 20 bp, Artificial
  CRISPR gRNA sequence
atactgtgagaggtgggcca

SEQ ID NO: 92500 - DNA, 20 bp, Artificial
  CRISPR gRNA sequence
gctatccaggccgaaacata

SEQ ID NO: 92501 - DNA, 20 bp, Artificial
  CRISPR gRNA sequence
tactgctcaataagatatct

SEQ ID NO: 92502 - DNA, 20 bp, Artificial
  CRISPR gRNA sequence
caaatgggggagtagtaaaa

SEQ ID NO: 92503 - DNA, 20 bp, Artificial
  CRISPR gRNA sequence
ttaaagaagcaactgataac

SEQ ID NO: 92504 - DNA, 20 bp, Artificial
  CRISPR gRNA sequence
agctttcaaaatttagataa

SEQ ID NO: 92505 - DNA, 20 bp, Artificial
  CRISPR gRNA sequence
cctaaaatgataccattacc

SEQ ID NO: 92506 - DNA, 20 bp, Artificial
  CRISPR gRNA sequence
attttgctggcataacaaaa

SEQ ID NO: 92507 - DNA, 20 bp, Artificial
  CRISPR gRNA sequence
agtagcaaatataaaattat

SEQ ID NO: 92508 - DNA, 20 bp, Artificial
  CRISPR gRNA sequence
tttacttagaatattatcta

SEQ ID NO: 92509 - DNA, 20 bp, Artificial
  CRISPR gRNA sequence
tatctatgctgttttttctc

SEQ ID NO: 92510 - DNA, 20 bp, Artificial
  CRISPR gRNA sequence
ccttaatttctttcattatg

SEQ ID NO: 92511 - DNA, 20 bp, Artificial
  CRISPR gRNA sequence
tcctcctccagcaaccccca

SEQ ID NO: 92512 - DNA, 20 bp, Artificial
  CRISPR gRNA sequence
cccccaagttgattttattt

SEQ ID NO: 92513 - DNA, 20 bp, Artificial
  CRISPR gRNA sequence
ttagatactgaattagataa

SEQ ID NO: 92514 - DNA, 20 bp, Artificial
  CRISPR gRNA sequence
aattctttttcaaaaacctg

SEQ ID NO: 92515 - DNA, 20 bp, Artificial
  CRISPR gRNA sequence
ctgcaatgctttttgtccta

SEQ ID NO: 92516 - DNA, 20 bp, Artificial
  CRISPR gRNA sequence
ccaacttttgccacatttca

SEQ ID NO: 92517 - DNA, 20 bp, Artificial
  CRISPR gRNA sequence
aacatttcggtagaatgtta

SEQ ID NO: 92518 - DNA, 20 bp, Artificial
  CRISPR gRNA sequence
tgagctgaaatacatactcc

SEQ ID NO: 92519 - DNA, 20 bp, Artificial
  CRISPR gRNA sequence
agaatcatgccatataagtc

SEQ ID NO: 92520 - DNA, 20 bp, Artificial
  CRISPR gRNA sequence
gtctactgcttctcttaaat

SEQ ID NO: 92521 - DNA, 20 bp, Artificial
  CRISPR gRNA sequence
gtctctcatatagcatagtt

SEQ ID NO: 92522 - DNA, 20 bp, Artificial
  CRISPR gRNA sequence
ggcattcaatactataaaaa

SEQ ID NO: 92523 - DNA, 20 bp, Artificial
  CRISPR gRNA sequence
tccacttgctatcttcacaa

SEQ ID NO: 92524 - DNA, 20 bp, Artificial
  CRISPR gRNA sequence
acttctctttctttactaaa

SEQ ID NO: 92525 - DNA, 20 bp, Artificial
  CRISPR gRNA sequence
aagtgaaagctctagaataa

SEQ ID NO: 92526 - DNA, 20 bp, Artificial
  CRISPR gRNA sequence
aagctctagaataagactgc

SEQ ID NO: 92527 - DNA, 20 bp, Artificial
  CRISPR gRNA sequence
attctttagcctctctgtgc

SEQ ID NO: 92528 - DNA, 20 bp, Artificial
  CRISPR gRNA sequence
aagggttgtgagactccatt

SEQ ID NO: 92529 - DNA, 20 bp, Artificial
  CRISPR gRNA sequence
actccatttatagcttaaca

SEQ ID NO: 92530 - DNA, 20 bp, Artificial
  CRISPR gRNA sequence
gtaaactattgcccatcctt

SEQ ID NO: 92531 - DNA, 20 bp, Artificial
  CRISPR gRNA sequence
cctttctggtttatactgag

SEQ ID NO: 92532 - DNA, 20 bp, Artificial
  CRISPR gRNA sequence
gcactgttattttctttaca

SEQ ID NO: 92533 - DNA, 20 bp, Artificial
  CRISPR gRNA sequence
tacactcagtttaacaaaga

SEQ ID NO: 92534 - DNA, 20 bp, Artificial
  CRISPR gRNA sequence
agtaaactattagtattatt

SEQ ID NO: 92535 - DNA, 20 bp, Artificial
  CRISPR gRNA sequence
cactgtagatgtaaatgtta

SEQ ID NO: 92536 - DNA, 20 bp, Artificial
  CRISPR gRNA sequence
tcaggaggctgaggcacaag

SEQ ID NO: 92537 - DNA, 20 bp, Artificial
  CRISPR gRNA sequence
actaactttcattcttttcc

SEQ ID NO: 92538 - DNA, 20 bp, Artificial
  CRISPR gRNA sequence
tttccctaaatccccgtaat

SEQ ID NO: 92539 - DNA, 20 bp, Artificial
  CRISPR gRNA sequence
ggtaaaacatactataagaa

SEQ ID NO: 92540 - DNA, 20 bp, Artificial
  CRISPR gRNA sequence
actataagaatatggattga

SEQ ID NO: 92541 - DNA, 20 bp, Artificial
  CRISPR gRNA sequence
ggattgagggggtttttaaa

SEQ ID NO: 92542 - DNA, 20 bp, Artificial
  CRISPR gRNA sequence
atgcaaaattaaagttacat

SEQ ID NO: 92543 - DNA, 20 bp, Artificial
  CRISPR gRNA sequence
aatatttagaatattatact

SEQ ID NO: 92544 - DNA, 20 bp, Artificial
  CRISPR gRNA sequence
ctcctaggcctccccaagtt

SEQ ID NO: 92545 - DNA, 20 bp, Artificial
  CRISPR gRNA sequence
aatacatcctaggaccctaa

SEQ ID NO: 92546 - DNA, 20 bp, Artificial
  CRISPR gRNA sequence
tacaggcacttgccaccata

SEQ ID NO: 92547 - DNA, 20 bp, Artificial
  CRISPR gRNA sequence
attaaatttttctctacact

SEQ ID NO: 92548 - DNA, 20 bp, Artificial
  CRISPR gRNA sequence
tagctctcacaagaagaaat

SEQ ID NO: 92549 - DNA, 20 bp, Artificial
  CRISPR gRNA sequence
acaatgacaataataatggg

SEQ ID NO: 92550 - DNA, 20 bp, Artificial
  CRISPR gRNA sequence
acagcaacactatgaatgac

SEQ ID NO: 92551 - DNA, 20 bp, Artificial
  CRISPR gRNA sequence
cgattttaatgcccatttta

SEQ ID NO: 92552 - DNA, 20 bp, Artificial
  CRISPR gRNA sequence
aaggccagtaaatgatgcaa

SEQ ID NO: 92553 - DNA, 20 bp, Artificial
  CRISPR gRNA sequence
cagaagtcgaactccagaac

SEQ ID NO: 92554 - DNA, 20 bp, Artificial
  CRISPR gRNA sequence
cagttcaaatcaaacaatcc

SEQ ID NO: 92555 - DNA, 20 bp, Artificial
  CRISPR gRNA sequence
catgagttcaacagaactgt

SEQ ID NO: 92556 - DNA, 20 bp, Artificial
  CRISPR gRNA sequence
ggggaggcaggccctgcaga

SEQ ID NO: 92557 - DNA, 20 bp, Artificial
  CRISPR gRNA sequence
agatgcggtttgcgttaaga

SEQ ID NO: 92558 - DNA, 20 bp, Artificial
  CRISPR gRNA sequence
cctcagctaagtctgatacc

SEQ ID NO: 92559 - DNA, 20 bp, Artificial
  CRISPR gRNA sequence
taagtctgatacctcgagtt

SEQ ID NO: 92560 - DNA, 20 bp, Artificial
  CRISPR gRNA sequence
tgtccttgtacatcttgttg

SEQ ID NO: 92561 - DNA, 20 bp, Artificial
  CRISPR gRNA sequence
tgcggtgtttcttgcacatc

SEQ ID NO: 92562 - DNA, 20 bp, Artificial
  CRISPR gRNA sequence
tcttgcacatccacggtttg

SEQ ID NO: 92563 - DNA, 20 bp, Artificial
  CRISPR gRNA sequence
ccccttcgcacaggtaccta

SEQ ID NO: 92564 - DNA, 20 bp, Artificial
  CRISPR gRNA sequence
cctggccggggtccacgacc

SEQ ID NO: 92565 - DNA, 20 bp, Artificial
  CRISPR gRNA sequence
cacgaccccgggcttttagc

SEQ ID NO: 92566 - DNA, 20 bp, Artificial
  CRISPR gRNA sequence
cagcgcaaaccgtggatgtg

SEQ ID NO: 92567 - DNA, 20 bp, Artificial
  CRISPR gRNA sequence
cctggggatgggaggtggaa

SEQ ID NO: 92568 - DNA, 20 bp, Artificial
  CRISPR gRNA sequence
gcagtgactgggttagtggt

SEQ ID NO: 92569 - DNA, 20 bp, Artificial
  CRISPR gRNA sequence
ctgttgaactcatgataggt

SEQ ID NO: 92570 - DNA, 20 bp, Artificial
  CRISPR gRNA sequence
ctagatgaagttggtacttc

SEQ ID NO: 92571 - DNA, 20 bp, Artificial
  CRISPR gRNA sequence
gctatataatcccttagtgt

SEQ ID NO: 92572 - DNA, 20 bp, Artificial
  CRISPR gRNA sequence
tgacttaatgaagactcttc

SEQ ID NO: 92573 - DNA, 20 bp, Artificial
  CRISPR gRNA sequence
tagggaaataagcatctgga

SEQ ID NO: 92574 - DNA, 20 bp, Artificial
  CRISPR gRNA sequence
tccacaggtgcccattcact

SEQ ID NO: 92575 - DNA, 20 bp, Artificial
  CRISPR gRNA sequence
cttcagaattctttagagag

SEQ ID NO: 92576 - DNA, 20 bp, Artificial
  CRISPR gRNA sequence
ggcctaataatacttatttt

SEQ ID NO: 92577 - DNA, 20 bp, Artificial
  CRISPR gRNA sequence
atctttgttaaactgagtgt

SEQ ID NO: 92578 - DNA, 20 bp, Artificial
  CRISPR gRNA sequence
tcattgtaggctgagatact

SEQ ID NO: 92579 - DNA, 20 bp, Artificial
  CRISPR gRNA sequence
gaaacgtgactcagtataaa

SEQ ID NO: 92580 - DNA, 20 bp, Artificial
  CRISPR gRNA sequence
aactgaggcacagagaggct

SEQ ID NO: 92581 - DNA, 20 bp, Artificial
  CRISPR gRNA sequence
ctccttactatactgcttcc

SEQ ID NO: 92582 - DNA, 20 bp, Artificial
  CRISPR gRNA sequence
aaagagaagcacattttagt

SEQ ID NO: 92583 - DNA, 20 bp, Artificial
  CRISPR gRNA sequence
aaagaaagagaagtaggaat

SEQ ID NO: 92584 - DNA, 20 bp, Artificial
  CRISPR gRNA sequence
ttgagtggaaaattcatgag

SEQ ID NO: 92585 - DNA, 20 bp, Artificial
  CRISPR gRNA sequence
ctatgttgtgagcagcaaga

SEQ ID NO: 92586 - DNA, 20 bp, Artificial
  CRISPR gRNA sequence
attaagttctctattccaat

SEQ ID NO: 92587 - DNA, 20 bp, Artificial
  CRISPR gRNA sequence
tttattaaggtaaaaaaatt

SEQ ID NO: 92588 - DNA, 20 bp, Artificial
  CRISPR gRNA sequence
aagcattgcaggtttttgaa

SEQ ID NO: 92589 - DNA, 20 bp, Artificial
  CRISPR gRNA sequence
ttatcttgcacataaaaatg

SEQ ID NO: 92590 - DNA, 20 bp, Artificial
  CRISPR gRNA sequence
cttgggggttgctggaggag

SEQ ID NO: 92591 - DNA, 20 bp, Artificial
  CRISPR gRNA sequence
atttttgtttcctctgggta

SEQ ID NO: 92592 - DNA, 20 bp, Artificial
  CRISPR gRNA sequence
ttggtaaacttctcataatg

SEQ ID NO: 92593 - DNA, 20 bp, Artificial
  CRISPR gRNA sequence
catagataactcagaggcca

SEQ ID NO: 92594 - DNA, 20 bp, Artificial
  CRISPR gRNA sequence
ggccagtagaaagaagccca

SEQ ID NO: 92595 - DNA, 20 bp, Artificial
  CRISPR gRNA sequence
ttttatatttgctactttag

SEQ ID NO: 92596 - DNA, 20 bp, Artificial
  CRISPR gRNA sequence
gtggcatagttttgtaagag

SEQ ID NO: 92597 - DNA, 20 bp, Artificial
  CRISPR gRNA sequence
gcctggatagcattatataa

SEQ ID NO: 92598 - DNA, 20 bp, Artificial
  CRISPR gRNA sequence
agagactgggcaagaagaag

SEQ ID NO: 92599 - DNA, 20 bp, Artificial
  CRISPR gRNA sequence
aataagtcaaaattttaaaa

SEQ ID NO: 92600 - DNA, 20 bp, Artificial
  CRISPR gRNA sequence
gcttatatagacaaaatcac

SEQ ID NO: 92601 - DNA, 20 bp, Artificial
  CRISPR gRNA sequence
acagcttcagtcttaactgc

SEQ ID NO: 92602 - DNA, 20 bp, Artificial
  CRISPR gRNA sequence
gcttcaatacattgcaaaag

SEQ ID NO: 92603 - DNA, 20 bp, Artificial
  CRISPR gRNA sequence
atacattgcaaaagatagaa

SEQ ID NO: 92604 - DNA, 20 bp, Artificial
  CRISPR gRNA sequence
gatagaaacagaaaaaaaag

SEQ ID NO: 92605 - DNA, 20 bp, Artificial
  CRISPR gRNA sequence
tatatattggtatggcactt

SEQ ID NO: 92606 - DNA, 20 bp, Artificial
  CRISPR gRNA sequence
catttaatatgaagacattt

SEQ ID NO: 92607 - DNA, 20 bp, Artificial
  CRISPR gRNA sequence
taaataaaactgtttaataa

SEQ ID NO: 92608 - DNA, 20 bp, Artificial
  CRISPR gRNA sequence
atgaagacttagttgcctaa

SEQ ID NO: 92609 - DNA, 20 bp, Artificial
  CRISPR gRNA sequence
ccagaagtagtgcaattttt

SEQ ID NO: 92610 - DNA, 20 bp, Artificial
  CRISPR gRNA sequence
ctggacttcttagtaacgac

SEQ ID NO: 92611 - DNA, 20 bp, Artificial
  CRISPR gRNA sequence
acttcttagtaacgacttag

SEQ ID NO: 92612 - DNA, 20 bp, Artificial
  CRISPR gRNA sequence
ttagtaacgacttagaaaga

SEQ ID NO: 92613 - DNA, 20 bp, Artificial
  CRISPR gRNA sequence
catatgatacaatatgttca

SEQ ID NO: 92614 - DNA, 20 bp, Artificial
  CRISPR gRNA sequence
gcactgacccaggattatag

SEQ ID NO: 92615 - DNA, 20 bp, Artificial
  CRISPR gRNA sequence
ttaggcaactaagtcttcat

SEQ ID NO: 92616 - DNA, 20 bp, Artificial
  CRISPR gRNA sequence
aaatacttacataaatttat

SEQ ID NO: 92617 - DNA, 20 bp, Artificial
  CRISPR gRNA sequence
actaccttttttactattta

SEQ ID NO: 92618 - DNA, 20 bp, Artificial
  CRISPR gRNA sequence
atataatgccattaactact

SEQ ID NO: 92619 - DNA, 20 bp, Artificial
  CRISPR gRNA sequence
atggggtctcgctacgttgc

SEQ ID NO: 92620 - DNA, 20 bp, Artificial
  CRISPR gRNA sequence
ttaacctctttgttctttac

SEQ ID NO: 92621 - DNA, 20 bp, Artificial
  CRISPR gRNA sequence
actggcctctgagttatcta

SEQ ID NO: 92622 - DNA, 20 bp, Artificial
  CRISPR gRNA sequence
tcaacatataaaaactgtaa

SEQ ID NO: 92623 - DNA, 20 bp, Artificial
  CRISPR gRNA sequence
tgaatagctctaacatttcg

SEQ ID NO: 92624 - DNA, 20 bp, Artificial
  CRISPR gRNA sequence
gcctaagagtcctagttacc

SEQ ID NO: 92625 - DNA, 20 bp, Artificial
  CRISPR gRNA sequence
tcatttaaccttgacttgtg

SEQ ID NO: 92626 - DNA, 20 bp, Artificial
  CRISPR gRNA sequence
tttccactcaactattttag

SEQ ID NO: 92627 - DNA, 20 bp, Artificial
  CRISPR gRNA sequence
cttctctttccttttatcta

SEQ ID NO: 92628 - DNA, 20 bp, Artificial
  CRISPR gRNA sequence
aggaggtaaaagtgaaagct

SEQ ID NO: 92629 - DNA, 20 bp, Artificial
  CRISPR gRNA sequence
ttaacacagtgcttgacaca

SEQ ID NO: 92630 - DNA, 20 bp, Artificial
  CRISPR gRNA sequence
gactctgtctcaaaaaaaaa

SEQ ID NO: 92631 - DNA, 20 bp, Artificial
  CRISPR gRNA sequence
ctgtctcaaaaaaaaaaaag

SEQ ID NO: 92632 - DNA, 20 bp, Artificial
  CRISPR gRNA sequence
tattatttttctccctctct

SEQ ID NO: 92633 - DNA, 20 bp, Artificial
  CRISPR gRNA sequence
cacctgtggaacatactgag

SEQ ID NO: 92634 - DNA, 20 bp, Artificial
  CRISPR gRNA sequence
agatttggtaaaacatacta

SEQ ID NO: 92635 - DNA, 20 bp, Artificial
  CRISPR gRNA sequence
cacactggcaactgcaaatt

SEQ ID NO: 92636 - DNA, 20 bp, Artificial
  CRISPR gRNA sequence
actgcaaattttagaaatat

SEQ ID NO: 92637 - DNA, 20 bp, Artificial
  CRISPR gRNA sequence
cttcaagttcagcctgaaac

SEQ ID NO: 92638 - DNA, 20 bp, Artificial
  CRISPR gRNA sequence
aaactaagaaatttaaagac

SEQ ID NO: 92639 - DNA, 20 bp, Artificial
  CRISPR gRNA sequence
ggattatatagctctcacaa

SEQ ID NO: 92640 - DNA, 20 bp, Artificial
  CRISPR gRNA sequence
ttttcccccctcaggggtac

SEQ ID NO: 92641 - DNA, 20 bp, Artificial
  CRISPR gRNA sequence
gggtactgggaacagagttg

SEQ ID NO: 92642 - DNA, 20 bp, Artificial
  CRISPR gRNA sequence
gggtactgagaactggatac

SEQ ID NO: 92643 - DNA, 20 bp, Artificial
  CRISPR gRNA sequence
ctgagaatagagtagtgaaa

SEQ ID NO: 92644 - DNA, 20 bp, Artificial
  CRISPR gRNA sequence
ataatggggtataagtctca

SEQ ID NO: 92645 - DNA, 20 bp, Artificial
  CRISPR gRNA sequence
gatttgaactgagtcaaagg

SEQ ID NO: 92646 - DNA, 20 bp, Artificial
  CRISPR gRNA sequence
acagagcaagactttgtctc

SEQ ID NO: 92647 - DNA, 20 bp, Artificial
  CRISPR gRNA sequence
gacttctgtaatcttagttt

SEQ ID NO: 92648 - DNA, 20 bp, Artificial
  CRISPR gRNA sequence
gaaagagaagtaggaataca

SEQ ID NO: 92649 - DNA, 20 bp, Artificial
  CRISPR gRNA sequence
accgaaatgttagagctatt

SEQ ID NO: 92650 - DNA, 20 bp, Artificial
  CRISPR gRNA sequence
gtagaaagaagcccaagaga

SEQ ID NO: 92651 - DNA, 20 bp, Artificial
  CRISPR gRNA sequence
tgtaaggtatggctttccgg

SEQ ID NO: 92652 - DNA, 20 bp, Artificial
  CRISPR gRNA sequence
aattcctgtaatttgatgag

SEQ ID NO: 92653 - DNA, 20 bp, Artificial
  CRISPR gRNA sequence
cagctaagatgatttttaaa

SEQ ID NO: 92654 - DNA, 20 bp, Artificial
  CRISPR gRNA sequence
ttatgtaagtattttattat

SEQ ID NO: 92655 - DNA, 20 bp, Artificial
  CRISPR gRNA sequence
cacatcagagtaattagcat

SEQ ID NO: 92656 - DNA, 20 bp, Artificial
  CRISPR gRNA sequence
tcatctattacaataagata

SEQ ID NO: 92657 - DNA, 20 bp, Artificial
  CRISPR gRNA sequence
aactgctgttgtctttgctc

SEQ ID NO: 92658 - DNA, 20 bp, Artificial
  CRISPR gRNA sequence
gatgtcacacatcaaaatac

SEQ ID NO: 92659 - DNA, 20 bp, Artificial
  CRISPR gRNA sequence
aggaaaaaatataactgctc

SEQ ID NO: 92660 - DNA, 20 bp, Artificial
  CRISPR gRNA sequence
ctttttacccagttggcaac

SEQ ID NO: 92661 - DNA, 20 bp, Artificial
  CRISPR gRNA sequence
tctcctgccaactgtatgaa

SEQ ID NO: 92662 - DNA, 20 bp, Artificial
  CRISPR gRNA sequence
accctgagatttcactgccc

SEQ ID NO: 92663 - DNA, 20 bp, Artificial
  CRISPR gRNA sequence
ctgaaatattctgactctta

SEQ ID NO: 92664 - DNA, 20 bp, Artificial
  CRISPR gRNA sequence
cattttaggcctcaacatat

SEQ ID NO: 92665 - DNA, 20 bp, Artificial
  CRISPR gRNA sequence
agatgttggaattctttttc

SEQ ID NO: 92666 - DNA, 20 bp, Artificial
  CRISPR gRNA sequence
gcctggcattcaatactata

SEQ ID NO: 92667 - DNA, 20 bp, Artificial
  CRISPR gRNA sequence
tctatcctcctctgaactac

SEQ ID NO: 92668 - DNA, 20 bp, Artificial
  CRISPR gRNA sequence
gaccagactggccaacatgg

SEQ ID NO: 92669 - DNA, 20 bp, Artificial
  CRISPR gRNA sequence
ccccgtaatcagagatttgg

SEQ ID NO: 92670 - DNA, 20 bp, Artificial
  CRISPR gRNA sequence
gtcctcttactccaaaagag

SEQ ID NO: 92671 - DNA, 20 bp, Artificial
  CRISPR gRNA sequence
ggttaacagaacaggacact

SEQ ID NO: 92672 - DNA, 20 bp, Artificial
  CRISPR gRNA sequence
gatactgagaatagagtagt

SEQ ID NO: 92673 - DNA, 20 bp, Artificial
  CRISPR gRNA sequence
accccagcgtgtcctgagtc

SEQ ID NO: 92674 - DNA, 20 bp, Artificial
  CRISPR gRNA sequence
ccccagcgtgtcctgagtct

SEQ ID NO: 92675 - DNA, 20 bp, Artificial
  CRISPR gRNA sequence
agtctttggttcgcgaagtg

SEQ ID NO: 92676 - DNA, 20 bp, Artificial
  CRISPR gRNA sequence
tggttcgcgaagtgccgtta

SEQ ID NO: 92677 - DNA, 20 bp, Artificial
  CRISPR gRNA sequence
ggttcgcgaagtgccgttag

SEQ ID NO: 92678 - DNA, 20 bp, Artificial
  CRISPR gRNA sequence
gttcgcgaagtgccgttagg

SEQ ID NO: 92679 - DNA, 20 bp, Artificial
  CRISPR gRNA sequence
gcgaagtgccgttaggccaa

SEQ ID NO: 92680 - DNA, 20 bp, Artificial
  CRISPR gRNA sequence
ggccaagcaggtgctaaaag

SEQ ID NO: 92681 - DNA, 20 bp, Artificial
  CRISPR gRNA sequence
aaagcccggggtcgtggacc

SEQ ID NO: 92682 - DNA, 20 bp, Artificial
  CRISPR gRNA sequence
agcagcatggaggcgcaggg

SEQ ID NO: 92683 - DNA, 20 bp, Artificial
  CRISPR gRNA sequence
gcagcatggaggcgcagggt

SEQ ID NO: 92684 - DNA, 20 bp, Artificial
  CRISPR gRNA sequence
gccccggctgcggctcccac

SEQ ID NO: 92685 - DNA, 20 bp, Artificial
  CRISPR gRNA sequence
cggctcccaccttggcgcca

SEQ ID NO: 92686 - DNA, 20 bp, Artificial
  CRISPR gRNA sequence
ccaccttggcgccagcctcg

SEQ ID NO: 92687 - DNA, 20 bp, Artificial
  CRISPR gRNA sequence
ggcgccagcctcggtggcgg

SEQ ID NO: 92688 - DNA, 20 bp, Artificial
  CRISPR gRNA sequence
gcgccagcctcggtggcggc

SEQ ID NO: 92689 - DNA, 20 bp, Artificial
  CRISPR gRNA sequence
ggtggcggccgcggcctctc

SEQ ID NO: 92690 - DNA, 20 bp, Artificial
  CRISPR gRNA sequence
tcaattcaccctgctagtga

SEQ ID NO: 92691 - DNA, 20 bp, Artificial
  CRISPR gRNA sequence
aattcaccctgctagtgatg

SEQ ID NO: 92692 - DNA, 20 bp, Artificial
  CRISPR gRNA sequence
accctgctagtgatgcaacc

SEQ ID NO: 92693 - DNA, 20 bp, Artificial
  CRISPR gRNA sequence
ctagtgatgcaaccctgtgc

SEQ ID NO: 92694 - DNA, 20 bp, Artificial
  CRISPR gRNA sequence
gtgatgcaaccctgtgctgg

SEQ ID NO: 92695 - DNA, 20 bp, Artificial
  CRISPR gRNA sequence
tgctgggcaggacgaggctg

SEQ ID NO: 92696 - DNA, 20 bp, Artificial
  CRISPR gRNA sequence
ggcaggacgaggctgcggcc

SEQ ID NO: 92697 - DNA, 20 bp, Artificial
  CRISPR gRNA sequence
cggcccccgggggcagcgtt

SEQ ID NO: 92698 - DNA, 20 bp, Artificial
  CRISPR gRNA sequence
gggcgggcaagcccgttagg

SEQ ID NO: 92699 - DNA, 20 bp, Artificial
  CRISPR gRNA sequence
ggtacctgtgcgaaggggcc

SEQ ID NO: 92700 - DNA, 20 bp, Artificial
  CRISPR gRNA sequence
tgcgaaggggccggggatgg

SEQ ID NO: 92701 - DNA, 20 bp, Artificial
  CRISPR gRNA sequence
gggaggacgaggcggacctg

SEQ ID NO: 92702 - DNA, 20 bp, Artificial
  CRISPR gRNA sequence
ttagacacttcggaccctcc

SEQ ID NO: 92703 - DNA, 20 bp, Artificial
  CRISPR gRNA sequence
gacacttcggaccctccggg

SEQ ID NO: 92704 - DNA, 20 bp, Artificial
  CRISPR gRNA sequence
cggaccctccggggggaggc

SEQ ID NO: 92705 - DNA, 20 bp, Artificial
  CRISPR gRNA sequence
ggaccctccggggggaggcg

SEQ ID NO: 92706 - DNA, 20 bp, Artificial
  CRISPR gRNA sequence
cggggggaggcgagagcgcg

SEQ ID NO: 92707 - DNA, 20 bp, Artificial
  CRISPR gRNA sequence
gtttggaggatctagaggac

SEQ ID NO: 92708 - DNA, 20 bp, Artificial
  CRISPR gRNA sequence
ggaggatctagaggacgagg

SEQ ID NO: 92709 - DNA, 20 bp, Artificial
  CRISPR gRNA sequence
gaggatctagaggacgagga

SEQ ID NO: 92710 - DNA, 20 bp, Artificial
  CRISPR gRNA sequence
gaggacgaggagactcactc

SEQ ID NO: 92711 - DNA, 20 bp, Artificial
  CRISPR gRNA sequence
actcggggggcgagggcagc

SEQ ID NO: 92712 - DNA, 20 bp, Artificial
  CRISPR gRNA sequence
ggggggcgagggcagcagcg

SEQ ID NO: 92713 - DNA, 20 bp, Artificial
  CRISPR gRNA sequence
cacctacgaaggctgcagcg

SEQ ID NO: 92714 - DNA, 20 bp, Artificial
  CRISPR gRNA sequence
cgaaggctgcagcgagacca

SEQ ID NO: 92715 - DNA, 20 bp, Artificial
  CRISPR gRNA sequence
cagcgagaccacgagccagg

SEQ ID NO: 92716 - DNA, 20 bp, Artificial
  CRISPR gRNA sequence
aactgcggtgggactgcctc

SEQ ID NO: 92717 - DNA, 20 bp, Artificial
  CRISPR gRNA sequence
cggtgggactgcctcgactg

SEQ ID NO: 92718 - DNA, 20 bp, Artificial
  CRISPR gRNA sequence
cctcgactggcagcgcggga

SEQ ID NO: 92719 - DNA, 20 bp, Artificial
  CRISPR gRNA sequence
gactggcagcgcgggaaacg

SEQ ID NO: 92720 - DNA, 20 bp, Artificial
  CRISPR gRNA sequence
gcagcgcgggaaacgtcaaa

SEQ ID NO: 92721 - DNA, 20 bp, Artificial
  CRISPR gRNA sequence
gaggtatcagacttagctga

SEQ ID NO: 92722 - DNA, 20 bp, Artificial
  CRISPR gRNA sequence
agctgaggcctggggatggg

SEQ ID NO: 92723 - DNA, 20 bp, Artificial
  CRISPR gRNA sequence
gctgaggcctggggatggga

SEQ ID NO: 92724 - DNA, 20 bp, Artificial
  CRISPR gRNA sequence
aggcctggggatgggaggtg

SEQ ID NO: 92725 - DNA, 20 bp, Artificial
  CRISPR gRNA sequence
gggatgggaggtggaagaag

SEQ ID NO: 92726 - DNA, 20 bp, Artificial
  CRISPR gRNA sequence
aacgcaaaccgcatctgcag

SEQ ID NO: 92727 - DNA, 20 bp, Artificial
  CRISPR gRNA sequence
acgcaaaccgcatctgcagg

SEQ ID NO: 92728 - DNA, 20 bp, Artificial
  CRISPR gRNA sequence
cagggcctgcctccccactt

SEQ ID NO: 92729 - DNA, 20 bp, Artificial
  CRISPR gRNA sequence
cctccccacttccaaatggg

SEQ ID NO: 92730 - DNA, 20 bp, Artificial
  CRISPR gRNA sequence
cccacttccaaatgggccgg

SEQ ID NO: 92731 - DNA, 20 bp, Artificial
  CRISPR gRNA sequence
ccaaatgggccggtttgcag

SEQ ID NO: 92732 - DNA, 20 bp, Artificial
  CRISPR gRNA sequence
caaatgggccggtttgcagt

SEQ ID NO: 92733 - DNA, 20 bp, Artificial
  CRISPR gRNA sequence
gcagtgactgggttagtggt

SEQ ID NO: 92734 - DNA, 20 bp, Artificial
  CRISPR gRNA sequence
cagtgactgggttagtggtt

SEQ ID NO: 92735 - DNA, 20 bp, Artificial
  CRISPR gRNA sequence
ggttagtggttgagaattag

SEQ ID NO: 92736 - DNA, 20 bp, Artificial
  CRISPR gRNA sequence
gtggttgagaattagagtgt

SEQ ID NO: 92737 - DNA, 20 bp, Artificial
  CRISPR gRNA sequence
agaattagagtgtttgccct

SEQ ID NO: 92738 - DNA, 20 bp, Artificial
  CRISPR gRNA sequence
gagtgtttgccctaaattaa

SEQ ID NO: 92739 - DNA, 20 bp, Artificial
  CRISPR gRNA sequence
gccctaaattaaagtttata

SEQ ID NO: 92740 - DNA, 20 bp, Artificial
  CRISPR gRNA sequence
ccctaaattaaagtttatac

SEQ ID NO: 92741 - DNA, 20 bp, Artificial
  CRISPR gRNA sequence
aattaaagtttataccaaca

SEQ ID NO: 92742 - DNA, 20 bp, Artificial
  CRISPR gRNA sequence
aagtttataccaacatgtgc

SEQ ID NO: 92743 - DNA, 20 bp, Artificial
  CRISPR gRNA sequence
ataccaacatgtgcaaagca

SEQ ID NO: 92744 - DNA, 20 bp, Artificial
  CRISPR gRNA sequence
taccaacatgtgcaaagcaa

SEQ ID NO: 92745 - DNA, 20 bp, Artificial
  CRISPR gRNA sequence
tgttgaactcatgataggtg

SEQ ID NO: 92746 - DNA, 20 bp, Artificial
  CRISPR gRNA sequence
ttgaactcatgataggtgca

SEQ ID NO: 92747 - DNA, 20 bp, Artificial
  CRISPR gRNA sequence
aactcatgataggtgcagaa

SEQ ID NO: 92748 - DNA, 20 bp, Artificial
  CRISPR gRNA sequence
atgataggtgcagaaatttc

SEQ ID NO: 92749 - DNA, 20 bp, Artificial
  CRISPR gRNA sequence
cagtaaaaataatgtgacat

SEQ ID NO: 92750 - DNA, 20 bp, Artificial
  CRISPR gRNA sequence
agtaaaaataatgtgacatc

SEQ ID NO: 92751 - DNA, 20 bp, Artificial
  CRISPR gRNA sequence
tcatagatctgggatatggc

SEQ ID NO: 92752 - DNA, 20 bp, Artificial
  CRISPR gRNA sequence
ggatatggctggaaggacat

SEQ ID NO: 92753 - DNA, 20 bp, Artificial
  CRISPR gRNA sequence
gaaggacatagagtaaatga

SEQ ID NO: 92754 - DNA, 20 bp, Artificial
  CRISPR gRNA sequence
gttcatcgctaaaggagact

SEQ ID NO: 92755 - DNA, 20 bp, Artificial
  CRISPR gRNA sequence
atcgctaaaggagacttagg

SEQ ID NO: 92756 - DNA, 20 bp, Artificial
  CRISPR gRNA sequence
aaggagacttaggaacctag

SEQ ID NO: 92757 - DNA, 20 bp, Artificial
  CRISPR gRNA sequence
aggaacctagatgaagttgg

SEQ ID NO: 92758 - DNA, 20 bp, Artificial
  CRISPR gRNA sequence
ggaacctagatgaagttggt

SEQ ID NO: 92759 - DNA, 20 bp, Artificial
  CRISPR gRNA sequence
gatgaagttggtacttctga

SEQ ID NO: 92760 - DNA, 20 bp, Artificial
  CRISPR gRNA sequence
gtacttctgagaaagtcatc

SEQ ID NO: 92761 - DNA, 20 bp, Artificial
  CRISPR gRNA sequence
ctgagaaagtcatctctttc

SEQ ID NO: 92762 - DNA, 20 bp, Artificial
  CRISPR gRNA sequence
tgagaaagtcatctctttct

SEQ ID NO: 92763 - DNA, 20 bp, Artificial
  CRISPR gRNA sequence
agaaagtcatctctttctgt

SEQ ID NO: 92764 - DNA, 20 bp, Artificial
  CRISPR gRNA sequence
tttctgttttcactactcta

SEQ ID NO: 92765 - DNA, 20 bp, Artificial
  CRISPR gRNA sequence
tctgttttcactactctatt

SEQ ID NO: 92766 - DNA, 20 bp, Artificial
  CRISPR gRNA sequence
ctgttttcactactctattc

SEQ ID NO: 92767 - DNA, 20 bp, Artificial
  CRISPR gRNA sequence
tgttttcactactctattct

SEQ ID NO: 92768 - DNA, 20 bp, Artificial
  CRISPR gRNA sequence
ttttcactactctattctca

SEQ ID NO: 92769 - DNA, 20 bp, Artificial
  CRISPR gRNA sequence
tcactactctattctcagta

SEQ ID NO: 92770 - DNA, 20 bp, Artificial
  CRISPR gRNA sequence
cactactctattctcagtat

SEQ ID NO: 92771 - DNA, 20 bp, Artificial
  CRISPR gRNA sequence
actactctattctcagtatc

SEQ ID NO: 92772 - DNA, 20 bp, Artificial
  CRISPR gRNA sequence
ctctattctcagtatccagt

SEQ ID NO: 92773 - DNA, 20 bp, Artificial
  CRISPR gRNA sequence
tattctcagtatccagttct

SEQ ID NO: 92774 - DNA, 20 bp, Artificial
  CRISPR gRNA sequence
ttctcagtatccagttctca

SEQ ID NO: 92775 - DNA, 20 bp, Artificial
  CRISPR gRNA sequence
tcagtatccagttctcagta

SEQ ID NO: 92776 - DNA, 20 bp, Artificial
  CRISPR gRNA sequence
agtatccagttctcagtacc

SEQ ID NO: 92777 - DNA, 20 bp, Artificial
  CRISPR gRNA sequence
tcagtacccagttctcagta

SEQ ID NO: 92778 - DNA, 20 bp, Artificial
  CRISPR gRNA sequence
agtacccagttctcagtacc

SEQ ID NO: 92779 - DNA, 20 bp, Artificial
  CRISPR gRNA sequence
tcagtacctctatttgtaat

SEQ ID NO: 92780 - DNA, 20 bp, Artificial
  CRISPR gRNA sequence
agtacctctatttgtaatac

SEQ ID NO: 92781 - DNA, 20 bp, Artificial
  CRISPR gRNA sequence
tatttgtaatactcctgtat

SEQ ID NO: 92782 - DNA, 20 bp, Artificial
  CRISPR gRNA sequence
tttgtaatactcctgtattt

SEQ ID NO: 92783 - DNA, 20 bp, Artificial
  CRISPR gRNA sequence
gtaatactcctgtatttagt

SEQ ID NO: 92784 - DNA, 20 bp, Artificial
  CRISPR gRNA sequence
taatactcctgtatttagta

SEQ ID NO: 92785 - DNA, 20 bp, Artificial
  CRISPR gRNA sequence
ctgtatttagtactttgttt

SEQ ID NO: 92786 - DNA, 20 bp, Artificial
  CRISPR gRNA sequence
tatttagtactttgttttta

SEQ ID NO: 92787 - DNA, 20 bp, Artificial
  CRISPR gRNA sequence
agtactttgtttttagtgtc

SEQ ID NO: 92788 - DNA, 20 bp, Artificial
  CRISPR gRNA sequence
gtactttgtttttagtgtcc

SEQ ID NO: 92789 - DNA, 20 bp, Artificial
  CRISPR gRNA sequence
tgtttttagtgtcctgttct

SEQ ID NO: 92790 - DNA, 20 bp, Artificial
  CRISPR gRNA sequence
gtttttagtgtcctgttctg

SEQ ID NO: 92791 - DNA, 20 bp, Artificial
  CRISPR gRNA sequence
tttttagtgtcctgttctgt

SEQ ID NO: 92792 - DNA, 20 bp, Artificial
  CRISPR gRNA sequence
ttagtgtcctgttctgttaa

SEQ ID NO: 92793 - DNA, 20 bp, Artificial
  CRISPR gRNA sequence
tagtgtcctgttctgttaac

SEQ ID NO: 92794 - DNA, 20 bp, Artificial
  CRISPR gRNA sequence
agtgtcctgttctgttaacc

SEQ ID NO: 92795 - DNA, 20 bp, Artificial
  CRISPR gRNA sequence
gtgtcctgttctgttaaccc

SEQ ID NO: 92796 - DNA, 20 bp, Artificial
  CRISPR gRNA sequence
ttctgttaaccctcttccta

SEQ ID NO: 92797 - DNA, 20 bp, Artificial
  CRISPR gRNA sequence
tgttaaccctcttcctagta

SEQ ID NO: 92798 - DNA, 20 bp, Artificial
  CRISPR gRNA sequence
ttaaccctcttcctagtacc

SEQ ID NO: 92799 - DNA, 20 bp, Artificial
  CRISPR gRNA sequence
accctcttcctagtaccgta

SEQ ID NO: 92800 - DNA, 20 bp, Artificial
  CRISPR gRNA sequence
ttcctagtaccgtattttta

SEQ ID NO: 92801 - DNA, 20 bp, Artificial
  CRISPR gRNA sequence
cctagtaccgtatttttagt

SEQ ID NO: 92802 - DNA, 20 bp, Artificial
  CRISPR gRNA sequence
ctagtaccgtatttttagta

SEQ ID NO: 92803 - DNA, 20 bp, Artificial
  CRISPR gRNA sequence
gtaccgtatttttagtactg

SEQ ID NO: 92804 - DNA, 20 bp, Artificial
  CRISPR gRNA sequence
ttagtactgctatactcagt

SEQ ID NO: 92805 - DNA, 20 bp, Artificial
  CRISPR gRNA sequence
tagtactgctatactcagtt

SEQ ID NO: 92806 - DNA, 20 bp, Artificial
  CRISPR gRNA sequence
agtactgctatactcagttg

SEQ ID NO: 92807 - DNA, 20 bp, Artificial
  CRISPR gRNA sequence
gtactgctatactcagttgc

SEQ ID NO: 92808 - DNA, 20 bp, Artificial
  CRISPR gRNA sequence
ctatactcagttgcctgtct

SEQ ID NO: 92809 - DNA, 20 bp, Artificial
  CRISPR gRNA sequence
tactcagttgcctgtctgta

SEQ ID NO: 92810 - DNA, 20 bp, Artificial
  CRISPR gRNA sequence
agttgcctgtctgtagtacc

SEQ ID NO: 92811 - DNA, 20 bp, Artificial
  CRISPR gRNA sequence
cctgtctgtagtacccctgt

SEQ ID NO: 92812 - DNA, 20 bp, Artificial
  CRISPR gRNA sequence
tctgtagtacccctgtacgt

SEQ ID NO: 92813 - DNA, 20 bp, Artificial
  CRISPR gRNA sequence
tagtacccctgtacgtagta

SEQ ID NO: 92814 - DNA, 20 bp, Artificial
  CRISPR gRNA sequence
tacgtagtactcttttctta

SEQ ID NO: 92815 - DNA, 20 bp, Artificial
  CRISPR gRNA sequence
ttttcttacaactctgttcc

SEQ ID NO: 92816 - DNA, 20 bp, Artificial
  CRISPR gRNA sequence
ttcttacaactctgttccca

SEQ ID NO: 92817 - DNA, 20 bp, Artificial
  CRISPR gRNA sequence
tcttacaactctgttcccag

SEQ ID NO: 92818 - DNA, 20 bp, Artificial
  CRISPR gRNA sequence
cttacaactctgttcccagt

SEQ ID NO: 92819 - DNA, 20 bp, Artificial
  CRISPR gRNA sequence
ttacaactctgttcccagta

SEQ ID NO: 92820 - DNA, 20 bp, Artificial
  CRISPR gRNA sequence
acaactctgttcccagtacc

SEQ ID NO: 92821 - DNA, 20 bp, Artificial
  CRISPR gRNA sequence
caactctgttcccagtaccc

SEQ ID NO: 92822 - DNA, 20 bp, Artificial
  CRISPR gRNA sequence
tgttcccagtacccctatgt

SEQ ID NO: 92823 - DNA, 20 bp, Artificial
  CRISPR gRNA sequence
ttcccagtacccctatgttt

SEQ ID NO: 92824 - DNA, 20 bp, Artificial
  CRISPR gRNA sequence
ccagtacccctatgtttagt

SEQ ID NO: 92825 - DNA, 20 bp, Artificial
  CRISPR gRNA sequence
tgtttagtcccttgttctca

SEQ ID NO: 92826 - DNA, 20 bp, Artificial
  CRISPR gRNA sequence
agtcccttgttctcatgttc

SEQ ID NO: 92827 - DNA, 20 bp, Artificial
  CRISPR gRNA sequence
gtcccttgttctcatgttct

SEQ ID NO: 92828 - DNA, 20 bp, Artificial
  CRISPR gRNA sequence
gttctcatgttctcactacc

SEQ ID NO: 92829 - DNA, 20 bp, Artificial
  CRISPR gRNA sequence
ttctcatgttctcactaccc

SEQ ID NO: 92830 - DNA, 20 bp, Artificial
  CRISPR gRNA sequence
tcatgttctcactaccccaa

SEQ ID NO: 92831 - DNA, 20 bp, Artificial
  CRISPR gRNA sequence
atgttctcactaccccaata

SEQ ID NO: 92832 - DNA, 20 bp, Artificial
  CRISPR gRNA sequence
tcactaccccaatacttaat

SEQ ID NO: 92833 - DNA, 20 bp, Artificial
  CRISPR gRNA sequence
actaccccaatacttaatat

SEQ ID NO: 92834 - DNA, 20 bp, Artificial
  CRISPR gRNA sequence
ccccaatacttaatatactt

SEQ ID NO: 92835 - DNA, 20 bp, Artificial
  CRISPR gRNA sequence
aatatactttgttctcagta

SEQ ID NO: 92836 - DNA, 20 bp, Artificial
  CRISPR gRNA sequence
atatactttgttctcagtat

SEQ ID NO: 92837 - DNA, 20 bp, Artificial
  CRISPR gRNA sequence
tgttctcagtatccttgttg

SEQ ID NO: 92838 - DNA, 20 bp, Artificial
  CRISPR gRNA sequence
gttctcagtatccttgttgt

SEQ ID NO: 92839 - DNA, 20 bp, Artificial
  CRISPR gRNA sequence
ttctcagtatccttgttgtt

SEQ ID NO: 92840 - DNA, 20 bp, Artificial
  CRISPR gRNA sequence
tcagtatccttgttgttagt

SEQ ID NO: 92841 - DNA, 20 bp, Artificial
  CRISPR gRNA sequence
agtatccttgttgttagtac

SEQ ID NO: 92842 - DNA, 20 bp, Artificial
  CRISPR gRNA sequence
gttgttagtaccctgttctc

SEQ ID NO: 92843 - DNA, 20 bp, Artificial
  CRISPR gRNA sequence
ttgttagtaccctgttctca

SEQ ID NO: 92844 - DNA, 20 bp, Artificial
  CRISPR gRNA sequence
ttagtaccctgttctcacta

SEQ ID NO: 92845 - DNA, 20 bp, Artificial
  CRISPR gRNA sequence
gtaccctgttctcactaccc

SEQ ID NO: 92846 - DNA, 20 bp, Artificial
  CRISPR gRNA sequence
ttctcactaccccttttctt

SEQ ID NO: 92847 - DNA, 20 bp, Artificial
  CRISPR gRNA sequence
tcactaccccttttcttagt

SEQ ID NO: 92848 - DNA, 20 bp, Artificial
  CRISPR gRNA sequence
actaccccttttcttagtac

SEQ ID NO: 92849 - DNA, 20 bp, Artificial
  CRISPR gRNA sequence
ccccttttcttagtacccct

SEQ ID NO: 92850 - DNA, 20 bp, Artificial
  CRISPR gRNA sequence
ttcttagtacccctgagggg

SEQ ID NO: 92851 - DNA, 20 bp, Artificial
  CRISPR gRNA sequence
tcttagtacccctgaggggg

SEQ ID NO: 92852 - DNA, 20 bp, Artificial
  CRISPR gRNA sequence
cttagtacccctgagggggg

SEQ ID NO: 92853 - DNA, 20 bp, Artificial
  CRISPR gRNA sequence
ttagtacccctgagggggga

SEQ ID NO: 92854 - DNA, 20 bp, Artificial
  CRISPR gRNA sequence
agtacccctgaggggggaaa

SEQ ID NO: 92855 - DNA, 20 bp, Artificial
  CRISPR gRNA sequence
gtacccctgaggggggaaaa

SEQ ID NO: 92856 - DNA, 20 bp, Artificial
  CRISPR gRNA sequence
aggggggaaaaaaaggatga

SEQ ID NO: 92857 - DNA, 20 bp, Artificial
  CRISPR gRNA sequence
aaaaaacttttggattgttt

SEQ ID NO: 92858 - DNA, 20 bp, Artificial
  CRISPR gRNA sequence
ttggattgtttgatttgaac

SEQ ID NO: 92859 - DNA, 20 bp, Artificial
  CRISPR gRNA sequence
tggattgtttgatttgaact

SEQ ID NO: 92860 - DNA, 20 bp, Artificial
  CRISPR gRNA sequence
ggattgtttgatttgaactg

SEQ ID NO: 92861 - DNA, 20 bp, Artificial
  CRISPR gRNA sequence
gattgtttgatttgaactga

SEQ ID NO: 92862 - DNA, 20 bp, Artificial
  CRISPR gRNA sequence
tttgatttgaactgagtcaa

SEQ ID NO: 92863 - DNA, 20 bp, Artificial
  CRISPR gRNA sequence
gatttgaactgagtcaaagg

SEQ ID NO: 92864 - DNA, 20 bp, Artificial
  CRISPR gRNA sequence
atttgaactgagtcaaaggt

SEQ ID NO: 92865 - DNA, 20 bp, Artificial
  CRISPR gRNA sequence
gaactgagtcaaaggtaaaa

SEQ ID NO: 92866 - DNA, 20 bp, Artificial
  CRISPR gRNA sequence
aactgagtcaaaggtaaaac

SEQ ID NO: 92867 - DNA, 20 bp, Artificial
  CRISPR gRNA sequence
agtcaaaggtaaaaccagtg

SEQ ID NO: 92868 - DNA, 20 bp, Artificial
  CRISPR gRNA sequence
tggagttcgacttctgggtg

SEQ ID NO: 92869 - DNA, 20 bp, Artificial
  CRISPR gRNA sequence
gagttcgacttctgggtgca

SEQ ID NO: 92870 - DNA, 20 bp, Artificial
  CRISPR gRNA sequence
gacttctgggtgcaaatccc

SEQ ID NO: 92871 - DNA, 20 bp, Artificial
  CRISPR gRNA sequence
ctgggtgcaaatccctgttg

SEQ ID NO: 92872 - DNA, 20 bp, Artificial
  CRISPR gRNA sequence
tgggtgcaaatccctgttgc

SEQ ID NO: 92873 - DNA, 20 bp, Artificial
  CRISPR gRNA sequence
ggtgcaaatccctgttgcat

SEQ ID NO: 92874 - DNA, 20 bp, Artificial
  CRISPR gRNA sequence
ttgcatcatttactggcctt

SEQ ID NO: 92875 - DNA, 20 bp, Artificial
  CRISPR gRNA sequence
catcatttactggccttgtg

SEQ ID NO: 92876 - DNA, 20 bp, Artificial
  CRISPR gRNA sequence
actggccttgtggcttgaat

SEQ ID NO: 92877 - DNA, 20 bp, Artificial
  CRISPR gRNA sequence
ctggccttgtggcttgaata

SEQ ID NO: 92878 - DNA, 20 bp, Artificial
  CRISPR gRNA sequence
gccttgtggcttgaataggt

SEQ ID NO: 92879 - DNA, 20 bp, Artificial
  CRISPR gRNA sequence
gtggcttgaataggttatta

SEQ ID NO: 92880 - DNA, 20 bp, Artificial
  CRISPR gRNA sequence
tggcttgaataggttattaa

SEQ ID NO: 92881 - DNA, 20 bp, Artificial
  CRISPR gRNA sequence
gaataggttattaaactctg

SEQ ID NO: 92882 - DNA, 20 bp, Artificial
  CRISPR gRNA sequence
aataggttattaaactctgt

SEQ ID NO: 92883 - DNA, 20 bp, Artificial
  CRISPR gRNA sequence
ttaaactctgtaaaatgggc

SEQ ID NO: 92884 - DNA, 20 bp, Artificial
  CRISPR gRNA sequence
aactctgtaaaatgggcatt

SEQ ID NO: 92885 - DNA, 20 bp, Artificial
  CRISPR gRNA sequence
tgtaaaatgggcattaaaat

SEQ ID NO: 92886 - DNA, 20 bp, Artificial
  CRISPR gRNA sequence
taaaatgggcattaaaatcg

SEQ ID NO: 92887 - DNA, 20 bp, Artificial
  CRISPR gRNA sequence
aaatcgtgtgtcattcatag

SEQ ID NO: 92888 - DNA, 20 bp, Artificial
  CRISPR gRNA sequence
atagtgttgctgtgaatatg

SEQ ID NO: 92889 - DNA, 20 bp, Artificial
  CRISPR gRNA sequence
ctgtgaatatgtgagccatt

SEQ ID NO: 92890 - DNA, 20 bp, Artificial
  CRISPR gRNA sequence
tgaatatgtgagccattcca

SEQ ID NO: 92891 - DNA, 20 bp, Artificial
  CRISPR gRNA sequence
catattgagggttcacacag

SEQ ID NO: 92892 - DNA, 20 bp, Artificial
  CRISPR gRNA sequence
agggttcacacagtgtccag

SEQ ID NO: 92893 - DNA, 20 bp, Artificial
  CRISPR gRNA sequence
acacagtgtccagcaactgg

SEQ ID NO: 92894 - DNA, 20 bp, Artificial
  CRISPR gRNA sequence
gctaaagtttgcaaacctta

SEQ ID NO: 92895 - DNA, 20 bp, Artificial
  CRISPR gRNA sequence
aagtttgcaaaccttaccca

SEQ ID NO: 92896 - DNA, 20 bp, Artificial
  CRISPR gRNA sequence
gcaaaccttacccattatta

SEQ ID NO: 92897 - DNA, 20 bp, Artificial
  CRISPR gRNA sequence
caaaccttacccattattat

SEQ ID NO: 92898 - DNA, 20 bp, Artificial
  CRISPR gRNA sequence
acccattattattgtcattg

SEQ ID NO: 92899 - DNA, 20 bp, Artificial
  CRISPR gRNA sequence
cccattattattgtcattgt

SEQ ID NO: 92900 - DNA, 20 bp, Artificial
  CRISPR gRNA sequence
ttattgtcattgttagtggt

SEQ ID NO: 92901 - DNA, 20 bp, Artificial
  CRISPR gRNA sequence
ttgtcattgttagtggtata

SEQ ID NO: 92902 - DNA, 20 bp, Artificial
  CRISPR gRNA sequence
tcattgttagtggtatactt

SEQ ID NO: 92903 - DNA, 20 bp, Artificial
  CRISPR gRNA sequence
ttagtggtatactttgaggc

SEQ ID NO: 92904 - DNA, 20 bp, Artificial
  CRISPR gRNA sequence
gtggtatactttgaggctgt

SEQ ID NO: 92905 - DNA, 20 bp, Artificial
  CRISPR gRNA sequence
tgaggctgtcacaaataagc

SEQ ID NO: 92906 - DNA, 20 bp, Artificial
  CRISPR gRNA sequence
gaggctgtcacaaataagca

SEQ ID NO: 92907 - DNA, 20 bp, Artificial
  CRISPR gRNA sequence
aggctgtcacaaataagcag

SEQ ID NO: 92908 - DNA, 20 bp, Artificial
  CRISPR gRNA sequence
tcacaaataagcagatattt

SEQ ID NO: 92909 - DNA, 20 bp, Artificial
  CRISPR gRNA sequence
cttcttgtgagagctatata

SEQ ID NO: 92910 - DNA, 20 bp, Artificial
  CRISPR gRNA sequence
ttcttgtgagagctatataa

SEQ ID NO: 92911 - DNA, 20 bp, Artificial
  CRISPR gRNA sequence
cttgtgagagctatataatc

SEQ ID NO: 92912 - DNA, 20 bp, Artificial
  CRISPR gRNA sequence
ttgtgagagctatataatcc

SEQ ID NO: 92913 - DNA, 20 bp, Artificial
  CRISPR gRNA sequence
gtgagagctatataatccct

SEQ ID NO: 92914 - DNA, 20 bp, Artificial
  CRISPR gRNA sequence
tgagagctatataatccctt

SEQ ID NO: 92915 - DNA, 20 bp, Artificial
  CRISPR gRNA sequence
tataatcccttagtgtagag

SEQ ID NO: 92916 - DNA, 20 bp, Artificial
  CRISPR gRNA sequence
agtgtagagaaaaatttaat

SEQ ID NO: 92917 - DNA, 20 bp, Artificial
  CRISPR gRNA sequence
gtgtagagaaaaatttaatt

SEQ ID NO: 92918 - DNA, 20 bp, Artificial
  CRISPR gRNA sequence
aattttgttacaagtgatcc

SEQ ID NO: 92919 - DNA, 20 bp, Artificial
  CRISPR gRNA sequence
attttgttacaagtgatcca

SEQ ID NO: 92920 - DNA, 20 bp, Artificial
  CRISPR gRNA sequence
tgttacaagtgatccaagcc

SEQ ID NO: 92921 - DNA, 20 bp, Artificial
  CRISPR gRNA sequence
gttacaagtgatccaagcca

SEQ ID NO: 92922 - DNA, 20 bp, Artificial
  CRISPR gRNA sequence
ttacaagtgatccaagccag

SEQ ID NO: 92923 - DNA, 20 bp, Artificial
  CRISPR gRNA sequence
caagtgatccaagccaggta

SEQ ID NO: 92924 - DNA, 20 bp, Artificial
  CRISPR gRNA sequence
tatacccagctgtacttggg

SEQ ID NO: 92925 - DNA, 20 bp, Artificial
  CRISPR gRNA sequence
tacttgggagggtgaagtgg

SEQ ID NO: 92926 - DNA, 20 bp, Artificial
  CRISPR gRNA sequence
gggagggtgaagtgggaaga

SEQ ID NO: 92927 - DNA, 20 bp, Artificial
  CRISPR gRNA sequence
ggagggtgaagtgggaagat

SEQ ID NO: 92928 - DNA, 20 bp, Artificial
  CRISPR gRNA sequence
cttgagaccaggggttcgag

SEQ ID NO: 92929 - DNA, 20 bp, Artificial
  CRISPR gRNA sequence
gagaccaggggttcgaggct

SEQ ID NO: 92930 - DNA, 20 bp, Artificial
  CRISPR gRNA sequence
agaccaggggttcgaggctg

SEQ ID NO: 92931 - DNA, 20 bp, Artificial
  CRISPR gRNA sequence
gaggctgccgtgagccttgt

SEQ ID NO: 92932 - DNA, 20 bp, Artificial
  CRISPR gRNA sequence
ccgtgagccttgtttgcatc

SEQ ID NO: 92933 - DNA, 20 bp, Artificial
  CRISPR gRNA sequence
gtttgcatcactgcattcca

SEQ ID NO: 92934 - DNA, 20 bp, Artificial
  CRISPR gRNA sequence
tttgcatcactgcattccag

SEQ ID NO: 92935 - DNA, 20 bp, Artificial
  CRISPR gRNA sequence
gcatcactgcattccagcct

SEQ ID NO: 92936 - DNA, 20 bp, Artificial
  CRISPR gRNA sequence
catcactgcattccagcctg

SEQ ID NO: 92937 - DNA, 20 bp, Artificial
  CRISPR gRNA sequence
cattccagcctggatgacat

SEQ ID NO: 92938 - DNA, 20 bp, Artificial
  CRISPR gRNA sequence
cagcctggatgacatagcaa

SEQ ID NO: 92939 - DNA, 20 bp, Artificial
  CRISPR gRNA sequence
gatgacatagcaagaccctg

SEQ ID NO: 92940 - DNA, 20 bp, Artificial
  CRISPR gRNA sequence
tctccttaaaaaaaaaaaaa

SEQ ID NO: 92941 - DNA, 20 bp, Artificial
  CRISPR gRNA sequence
cttaaaaaaaaaaaaaaaaa

SEQ ID NO: 92942 - DNA, 20 bp, Artificial
  CRISPR gRNA sequence
aaaaaaaaaaaaaaaaaaaa

SEQ ID NO: 92943 - DNA, 20 bp, Artificial
  CRISPR gRNA sequence
aaaaaaaaaaaaaaaaaaaa

SEQ ID NO: 92944 - DNA, 20 bp, Artificial
  CRISPR gRNA sequence
tttttaactgcaagctgtct

SEQ ID NO: 92945 - DNA, 20 bp, Artificial
  CRISPR gRNA sequence
ttttaactgcaagctgtctt

SEQ ID NO: 92946 - DNA, 20 bp, Artificial
  CRISPR gRNA sequence
tttaactgcaagctgtctta

SEQ ID NO: 92947 - DNA, 20 bp, Artificial
  CRISPR gRNA sequence
ttaactgcaagctgtcttag

SEQ ID NO: 92948 - DNA, 20 bp, Artificial
  CRISPR gRNA sequence
taactgcaagctgtcttagg

SEQ ID NO: 92949 - DNA, 20 bp, Artificial
  CRISPR gRNA sequence
aactgcaagctgtcttaggg

SEQ ID NO: 92950 - DNA, 20 bp, Artificial
  CRISPR gRNA sequence
actgcaagctgtcttagggt

SEQ ID NO: 92951 - DNA, 20 bp, Artificial
  CRISPR gRNA sequence
caagctgtcttagggtccta

SEQ ID NO: 92952 - DNA, 20 bp, Artificial
  CRISPR gRNA sequence
tcttagggtcctaggatgta

SEQ ID NO: 92953 - DNA, 20 bp, Artificial
  CRISPR gRNA sequence
agggtcctaggatgtattct

SEQ ID NO: 92954 - DNA, 20 bp, Artificial
  CRISPR gRNA sequence
gggtcctaggatgtattcta

SEQ ID NO: 92955 - DNA, 20 bp, Artificial
  CRISPR gRNA sequence
ggatgtattctaagtcttta

SEQ ID NO: 92956 - DNA, 20 bp, Artificial
  CRISPR gRNA sequence
taagtctttaaatttcttag

SEQ ID NO: 92957 - DNA, 20 bp, Artificial
  CRISPR gRNA sequence
agtctttaaatttcttagtt

SEQ ID NO: 92958 - DNA, 20 bp, Artificial
  CRISPR gRNA sequence
taaatttcttagtttcaggc

SEQ ID NO: 92959 - DNA, 20 bp, Artificial
  CRISPR gRNA sequence
aaatttcttagtttcaggct

SEQ ID NO: 92960 - DNA, 20 bp, Artificial
  CRISPR gRNA sequence
aatttcttagtttcaggctg

SEQ ID NO: 92961 - DNA, 20 bp, Artificial
  CRISPR gRNA sequence
cttagtttcaggctgaactt

SEQ ID NO: 92962 - DNA, 20 bp, Artificial
  CRISPR gRNA sequence
ttagtttcaggctgaacttg

SEQ ID NO: 92963 - DNA, 20 bp, Artificial
  CRISPR gRNA sequence
agtttcaggctgaacttgaa

SEQ ID NO: 92964 - DNA, 20 bp, Artificial
  CRISPR gRNA sequence
gtttcaggctgaacttgaag

SEQ ID NO: 92965 - DNA, 20 bp, Artificial
  CRISPR gRNA sequence
caggctgaacttgaagtgct

SEQ ID NO: 92966 - DNA, 20 bp, Artificial
  CRISPR gRNA sequence
aggctgaacttgaagtgctc

SEQ ID NO: 92967 - DNA, 20 bp, Artificial
  CRISPR gRNA sequence
aacttgaagtgctccatcac

SEQ ID NO: 92968 - DNA, 20 bp, Artificial
  CRISPR gRNA sequence
gaagtgctccatcactaaaa

SEQ ID NO: 92969 - DNA, 20 bp, Artificial
  CRISPR gRNA sequence
aagtgctccatcactaaaat

SEQ ID NO: 92970 - DNA, 20 bp, Artificial
  CRISPR gRNA sequence
catcactaaaatattagacc

SEQ ID NO: 92971 - DNA, 20 bp, Artificial
  CRISPR gRNA sequence
aaatattagaccttgtaatt

SEQ ID NO: 92972 - DNA, 20 bp, Artificial
  CRISPR gRNA sequence
gaccttgtaattgtttacaa

SEQ ID NO: 92973 - DNA, 20 bp, Artificial
  CRISPR gRNA sequence
gtaattgtttacaaatgtaa

SEQ ID NO: 92974 - DNA, 20 bp, Artificial
  CRISPR gRNA sequence
taattgtttacaaatgtaat

SEQ ID NO: 92975 - DNA, 20 bp, Artificial
  CRISPR gRNA sequence
tttacaaatgtaatgttcta

SEQ ID NO: 92976 - DNA, 20 bp, Artificial
  CRISPR gRNA sequence
acaaatgtaatgttctaggc

SEQ ID NO: 92977 - DNA, 20 bp, Artificial
  CRISPR gRNA sequence
caaatgtaatgttctaggcc

SEQ ID NO: 92978 - DNA, 20 bp, Artificial
  CRISPR gRNA sequence
taggccaggctcagtggcta

SEQ ID NO: 92979 - DNA, 20 bp, Artificial
  CRISPR gRNA sequence
ggccaggctcagtggctaat

SEQ ID NO: 92980 - DNA, 20 bp, Artificial
  CRISPR gRNA sequence
agtggctaatacctgtaagc

SEQ ID NO: 92981 - DNA, 20 bp, Artificial
  CRISPR gRNA sequence
atacctgtaagcccagaact

SEQ ID NO: 92982 - DNA, 20 bp, Artificial
  CRISPR gRNA sequence
taagcccagaacttggggag

SEQ ID NO: 92983 - DNA, 20 bp, Artificial
  CRISPR gRNA sequence
ggggaggcctaggagggagg

SEQ ID NO: 92984 - DNA, 20 bp, Artificial
  CRISPR gRNA sequence
gggaggcctaggagggagga

SEQ ID NO: 92985 - DNA, 20 bp, Artificial
  CRISPR gRNA sequence
ggagggaggatcgcttgagc

SEQ ID NO: 92986 - DNA, 20 bp, Artificial
  CRISPR gRNA sequence
gagcccggaagtttgagacc

SEQ ID NO: 92987 - DNA, 20 bp, Artificial
  CRISPR gRNA sequence
agcccggaagtttgagacca

SEQ ID NO: 92988 - DNA, 20 bp, Artificial
  CRISPR gRNA sequence
gagaccagcctgggtaacat

SEQ ID NO: 92989 - DNA, 20 bp, Artificial
  CRISPR gRNA sequence
agaccagcctgggtaacata

SEQ ID NO: 92990 - DNA, 20 bp, Artificial
  CRISPR gRNA sequence
ggtaacatagggagacccca

SEQ ID NO: 92991 - DNA, 20 bp, Artificial
  CRISPR gRNA sequence
aacaaaaaaattttaaaaat

SEQ ID NO: 92992 - DNA, 20 bp, Artificial
  CRISPR gRNA sequence
taaaaattagccaggtatgt

SEQ ID NO: 92993 - DNA, 20 bp, Artificial
  CRISPR gRNA sequence
aaaaattagccaggtatgtt

SEQ ID NO: 92994 - DNA, 20 bp, Artificial
  CRISPR gRNA sequence
aaaattagccaggtatgttg

SEQ ID NO: 92995 - DNA, 20 bp, Artificial
  CRISPR gRNA sequence
gccaggtatgttggcacatg

SEQ ID NO: 92996 - DNA, 20 bp, Artificial
  CRISPR gRNA sequence
gcacatgcctgtggtcctag

SEQ ID NO: 92997 - DNA, 20 bp, Artificial
  CRISPR gRNA sequence
tggtcctagctactcgggag

SEQ ID NO: 92998 - DNA, 20 bp, Artificial
  CRISPR gRNA sequence
gctactcgggaggctgaggt

SEQ ID NO: 92999 - DNA, 20 bp, Artificial
  CRISPR gRNA sequence
ctcgggaggctgaggtggaa

SEQ ID NO: 93000 - DNA, 20 bp, Artificial
  CRISPR gRNA sequence
gggaggctgaggtggaagga

SEQ ID NO: 93001 - DNA, 20 bp, Artificial
  CRISPR gRNA sequence
aggtggaaggatcattgagc

SEQ ID NO: 93002 - DNA, 20 bp, Artificial
  CRISPR gRNA sequence
agcccaggagattgaggctg

SEQ ID NO: 93003 - DNA, 20 bp, Artificial
  CRISPR gRNA sequence
aggctgcagtgagccatggt

SEQ ID NO: 93004 - DNA, 20 bp, Artificial
  CRISPR gRNA sequence
cagtgagccatggttgtgct

SEQ ID NO: 93005 - DNA, 20 bp, Artificial
  CRISPR gRNA sequence
tgctacttcactccagcctg

SEQ ID NO: 93006 - DNA, 20 bp, Artificial
  CRISPR gRNA sequence
cttcactccagcctgggtga

SEQ ID NO: 93007 - DNA, 20 bp, Artificial
  CRISPR gRNA sequence
cactccagcctgggtgacag

SEQ ID NO: 93008 - DNA, 20 bp, Artificial
  CRISPR gRNA sequence
actccagcctgggtgacaga

SEQ ID NO: 93009 - DNA, 20 bp, Artificial
  CRISPR gRNA sequence
cagcctgggtgacagagcaa

SEQ ID NO: 93010 - DNA, 20 bp, Artificial
  CRISPR gRNA sequence
ggtgacagagcaagactttg

SEQ ID NO: 93011 - DNA, 20 bp, Artificial
  CRISPR gRNA sequence
tgtctcaaaaacaaaaagta

SEQ ID NO: 93012 - DNA, 20 bp, Artificial
  CRISPR gRNA sequence
gtctcaaaaacaaaaagtat

SEQ ID NO: 93013 - DNA, 20 bp, Artificial
  CRISPR gRNA sequence
tctcaaaaacaaaaagtata

SEQ ID NO: 93014 - DNA, 20 bp, Artificial
  CRISPR gRNA sequence
aaaaacaaaaagtataatat

SEQ ID NO: 93015 - DNA, 20 bp, Artificial
  CRISPR gRNA sequence
taaatatttctaaaatttgc

SEQ ID NO: 93016 - DNA, 20 bp, Artificial
  CRISPR gRNA sequence
aatatttctaaaatttgcag

SEQ ID NO: 93017 - DNA, 20 bp, Artificial
  CRISPR gRNA sequence
ctaaaatttgcagttgccag

SEQ ID NO: 93018 - DNA, 20 bp, Artificial
  CRISPR gRNA sequence
taaaatttgcagttgccagt

SEQ ID NO: 93019 - DNA, 20 bp, Artificial
  CRISPR gRNA sequence
aaatttgcagttgccagtgt

SEQ ID NO: 93020 - DNA, 20 bp, Artificial
  CRISPR gRNA sequence
gcagttgccagtgtgtcata

SEQ ID NO: 93021 - DNA, 20 bp, Artificial
  CRISPR gRNA sequence
cagttgccagtgtgtcatac

SEQ ID NO: 93022 - DNA, 20 bp, Artificial
  CRISPR gRNA sequence
ccagtgtgtcatacttaatt

SEQ ID NO: 93023 - DNA, 20 bp, Artificial
  CRISPR gRNA sequence
aattcacactggttaggact

SEQ ID NO: 93024 - DNA, 20 bp, Artificial
  CRISPR gRNA sequence
attcacactggttaggactg

SEQ ID NO: 93025 - DNA, 20 bp, Artificial
  CRISPR gRNA sequence
acactggttaggactgagtg

SEQ ID NO: 93026 - DNA, 20 bp, Artificial
  CRISPR gRNA sequence
gttaggactgagtgacttct

SEQ ID NO: 93027 - DNA, 20 bp, Artificial
  CRISPR gRNA sequence
ggactgagtgacttctcttt

SEQ ID NO: 93028 - DNA, 20 bp, Artificial
  CRISPR gRNA sequence
agtgacttctctttccctta

SEQ ID NO: 93029 - DNA, 20 bp, Artificial
  CRISPR gRNA sequence
ctctttcccttaagttttac

SEQ ID NO: 93030 - DNA, 20 bp, Artificial
  CRISPR gRNA sequence
tctttcccttaagttttact

SEQ ID NO: 93031 - DNA, 20 bp, Artificial
  CRISPR gRNA sequence
tttcccttaagttttactct

SEQ ID NO: 93032 - DNA, 20 bp, Artificial
  CRISPR gRNA sequence
tcccttaagttttactcttt

SEQ ID NO: 93033 - DNA, 20 bp, Artificial
  CRISPR gRNA sequence
cccttaagttttactctttt

SEQ ID NO: 93034 - DNA, 20 bp, Artificial
  CRISPR gRNA sequence
ccttaagttttactcttttg

SEQ ID NO: 93035 - DNA, 20 bp, Artificial
  CRISPR gRNA sequence
aagttttactcttttggagt

SEQ ID NO: 93036 - DNA, 20 bp, Artificial
  CRISPR gRNA sequence
agttttactcttttggagta

SEQ ID NO: 93037 - DNA, 20 bp, Artificial
  CRISPR gRNA sequence
tactcttttggagtaagagg

SEQ ID NO: 93038 - DNA, 20 bp, Artificial
  CRISPR gRNA sequence
actcttttggagtaagagga

SEQ ID NO: 93039 - DNA, 20 bp, Artificial
  CRISPR gRNA sequence
ctcttttggagtaagaggac

SEQ ID NO: 93040 - DNA, 20 bp, Artificial
  CRISPR gRNA sequence
ttttggagtaagaggacttc

SEQ ID NO: 93041 - DNA, 20 bp, Artificial
  CRISPR gRNA sequence
ttggagtaagaggacttctt

SEQ ID NO: 93042 - DNA, 20 bp, Artificial
  CRISPR gRNA sequence
tggagtaagaggacttcttt

SEQ ID NO: 93043 - DNA, 20 bp, Artificial
  CRISPR gRNA sequence
ggagtaagaggacttctttg

SEQ ID NO: 93044 - DNA, 20 bp, Artificial
  CRISPR gRNA sequence
gagtaagaggacttctttga

SEQ ID NO: 93045 - DNA, 20 bp, Artificial
  CRISPR gRNA sequence
ctttgagggtctggtgactt

SEQ ID NO: 93046 - DNA, 20 bp, Artificial
  CRISPR gRNA sequence
tttgagggtctggtgactta

SEQ ID NO: 93047 - DNA, 20 bp, Artificial
  CRISPR gRNA sequence
tgagggtctggtgacttaat

SEQ ID NO: 93048 - DNA, 20 bp, Artificial
  CRISPR gRNA sequence
gagggtctggtgacttaatg

SEQ ID NO: 93049 - DNA, 20 bp, Artificial
  CRISPR gRNA sequence
agggtctggtgacttaatga

SEQ ID NO: 93050 - DNA, 20 bp, Artificial
  CRISPR gRNA sequence
gtgacttaatgaagactctt

SEQ ID NO: 93051 - DNA, 20 bp, Artificial
  CRISPR gRNA sequence
aatgaagactcttcctagaa

SEQ ID NO: 93052 - DNA, 20 bp, Artificial
  CRISPR gRNA sequence
atgaagactcttcctagaaa

SEQ ID NO: 93053 - DNA, 20 bp, Artificial
  CRISPR gRNA sequence
ttcctagaaaaatccactat

SEQ ID NO: 93054 - DNA, 20 bp, Artificial
  CRISPR gRNA sequence
cctagaaaaatccactatgt

SEQ ID NO: 93055 - DNA, 20 bp, Artificial
  CRISPR gRNA sequence
ctagaaaaatccactatgta

SEQ ID NO: 93056 - DNA, 20 bp, Artificial
  CRISPR gRNA sequence
gaaaaatccactatgtaact

SEQ ID NO: 93057 - DNA, 20 bp, Artificial
  CRISPR gRNA sequence
tgtaactttaattttgcata

SEQ ID NO: 93058 - DNA, 20 bp, Artificial
  CRISPR gRNA sequence
taattttgcatactaattaa

SEQ ID NO: 93059 - DNA, 20 bp, Artificial
  CRISPR gRNA sequence
aattttgcatactaattaat

SEQ ID NO: 93060 - DNA, 20 bp, Artificial
  CRISPR gRNA sequence
attttgcatactaattaatg

SEQ ID NO: 93061 - DNA, 20 bp, Artificial
  CRISPR gRNA sequence
tgcatactaattaatgggct

SEQ ID NO: 93062 - DNA, 20 bp, Artificial
  CRISPR gRNA sequence
gcatactaattaatgggctc

SEQ ID NO: 93063 - DNA, 20 bp, Artificial
  CRISPR gRNA sequence
catactaattaatgggctca

SEQ ID NO: 93064 - DNA, 20 bp, Artificial
  CRISPR gRNA sequence
attaatgggctcaggacttc

SEQ ID NO: 93065 - DNA, 20 bp, Artificial
  CRISPR gRNA sequence
atgggctcaggacttctgta

SEQ ID NO: 93066 - DNA, 20 bp, Artificial
  CRISPR gRNA sequence
aggacttctgtaatcttagt

SEQ ID NO: 93067 - DNA, 20 bp, Artificial
  CRISPR gRNA sequence
ctgtaatcttagtttaaaaa

SEQ ID NO: 93068 - DNA, 20 bp, Artificial
  CRISPR gRNA sequence
tgtaatcttagtttaaaaac

SEQ ID NO: 93069 - DNA, 20 bp, Artificial
  CRISPR gRNA sequence
taatcttagtttaaaaaccc

SEQ ID NO: 93070 - DNA, 20 bp, Artificial
  CRISPR gRNA sequence
agtttaaaaaccccctcaat

SEQ ID NO: 93071 - DNA, 20 bp, Artificial
  CRISPR gRNA sequence
gtttaaaaaccccctcaatc

SEQ ID NO: 93072 - DNA, 20 bp, Artificial
  CRISPR gRNA sequence
aaaaaccccctcaatccata

SEQ ID NO: 93073 - DNA, 20 bp, Artificial
  CRISPR gRNA sequence
aaaaccccctcaatccatat

SEQ ID NO: 93074 - DNA, 20 bp, Artificial
  CRISPR gRNA sequence
aatccatattcttatagtat

SEQ ID NO: 93075 - DNA, 20 bp, Artificial
  CRISPR gRNA sequence
ttatagtatgttttaccaaa

SEQ ID NO: 93076 - DNA, 20 bp, Artificial
  CRISPR gRNA sequence
atagtatgttttaccaaatc

SEQ ID NO: 93077 - DNA, 20 bp, Artificial
  CRISPR gRNA sequence
tagtatgttttaccaaatct

SEQ ID NO: 93078 - DNA, 20 bp, Artificial
  CRISPR gRNA sequence
taccaaatctctgattacgg

SEQ ID NO: 93079 - DNA, 20 bp, Artificial
  CRISPR gRNA sequence
accaaatctctgattacggg

SEQ ID NO: 93080 - DNA, 20 bp, Artificial
  CRISPR gRNA sequence
ccaaatctctgattacgggg

SEQ ID NO: 93081 - DNA, 20 bp, Artificial
  CRISPR gRNA sequence
tgattacggggatttaggga

SEQ ID NO: 93082 - DNA, 20 bp, Artificial
  CRISPR gRNA sequence
attacggggatttagggaaa

SEQ ID NO: 93083 - DNA, 20 bp, Artificial
  CRISPR gRNA sequence
cggggatttagggaaataag

SEQ ID NO: 93084 - DNA, 20 bp, Artificial
  CRISPR gRNA sequence
agggaaataagcatctggaa

SEQ ID NO: 93085 - DNA, 20 bp, Artificial
  CRISPR gRNA sequence
gggaaataagcatctggaaa

SEQ ID NO: 93086 - DNA, 20 bp, Artificial
  CRISPR gRNA sequence
gaaaagaatgaaagttagta

SEQ ID NO: 93087 - DNA, 20 bp, Artificial
  CRISPR gRNA sequence
gtaaaggtgatcaagtttct

SEQ ID NO: 93088 - DNA, 20 bp, Artificial
  CRISPR gRNA sequence
cttcctcagtatgttccaca

SEQ ID NO: 93089 - DNA, 20 bp, Artificial
  CRISPR gRNA sequence
ttcctcagtatgttccacag

SEQ ID NO: 93090 - DNA, 20 bp, Artificial
  CRISPR gRNA sequence
cctcagtatgttccacaggt

SEQ ID NO: 93091 - DNA, 20 bp, Artificial
  CRISPR gRNA sequence
ctcagtatgttccacaggtg

SEQ ID NO: 93092 - DNA, 20 bp, Artificial
  CRISPR gRNA sequence
agtatgttccacaggtgccc

SEQ ID NO: 93093 - DNA, 20 bp, Artificial
  CRISPR gRNA sequence
cacaggtgcccattcacttc

SEQ ID NO: 93094 - DNA, 20 bp, Artificial
  CRISPR gRNA sequence
acttcagaattctttagaga

SEQ ID NO: 93095 - DNA, 20 bp, Artificial
  CRISPR gRNA sequence
cagaattctttagagaggga

SEQ ID NO: 93096 - DNA, 20 bp, Artificial
  CRISPR gRNA sequence
agaattctttagagagggag

SEQ ID NO: 93097 - DNA, 20 bp, Artificial
  CRISPR gRNA sequence
tttagagagggagaaaaata

SEQ ID NO: 93098 - DNA, 20 bp, Artificial
  CRISPR gRNA sequence
tagagagggagaaaaataat

SEQ ID NO: 93099 - DNA, 20 bp, Artificial
  CRISPR gRNA sequence
agagagggagaaaaataata

SEQ ID NO: 93100 - DNA, 20 bp, Artificial
  CRISPR gRNA sequence
gagagggagaaaaataatac

SEQ ID NO: 93101 - DNA, 20 bp, Artificial
  CRISPR gRNA sequence
tttttctttctttttttttt

SEQ ID NO: 93102 - DNA, 20 bp, Artificial
  CRISPR gRNA sequence
ttttctttcttttttttttt

SEQ ID NO: 93103 - DNA, 20 bp, Artificial
  CRISPR gRNA sequence
tttctttctttttttttttt

SEQ ID NO: 93104 - DNA, 20 bp, Artificial
  CRISPR gRNA sequence
ttctttcttttttttttttg

SEQ ID NO: 93105 - DNA, 20 bp, Artificial
  CRISPR gRNA sequence
tctttcttttttttttttga

SEQ ID NO: 93106 - DNA, 20 bp, Artificial
  CRISPR gRNA sequence
ctttcttttttttttttgag

SEQ ID NO: 93107 - DNA, 20 bp, Artificial
  CRISPR gRNA sequence
tttcttttttttttttgaga

SEQ ID NO: 93108 - DNA, 20 bp, Artificial
  CRISPR gRNA sequence
tcttttttttttttgagaca

SEQ ID NO: 93109 - DNA, 20 bp, Artificial
  CRISPR gRNA sequence
cttttttttttttgagacag

SEQ ID NO: 93110 - DNA, 20 bp, Artificial
  CRISPR gRNA sequence
ttttttttttttgagacaga

SEQ ID NO: 93111 - DNA, 20 bp, Artificial
  CRISPR gRNA sequence
ttttttttttgagacagagt

SEQ ID NO: 93112 - DNA, 20 bp, Artificial
  CRISPR gRNA sequence
tttttttttgagacagagtc

SEQ ID NO: 93113 - DNA, 20 bp, Artificial
  CRISPR gRNA sequence
ttttttttgagacagagtct

SEQ ID NO: 93114 - DNA, 20 bp, Artificial
  CRISPR gRNA sequence
tttttttgagacagagtctt

SEQ ID NO: 93115 - DNA, 20 bp, Artificial
  CRISPR gRNA sequence
ttttttgagacagagtctta

SEQ ID NO: 93116 - DNA, 20 bp, Artificial
  CRISPR gRNA sequence
tttttgagacagagtcttac

SEQ ID NO: 93117 - DNA, 20 bp, Artificial
  CRISPR gRNA sequence
ttttgagacagagtcttact

SEQ ID NO: 93118 - DNA, 20 bp, Artificial
  CRISPR gRNA sequence
tttgagacagagtcttactc

SEQ ID NO: 93119 - DNA, 20 bp, Artificial
  CRISPR gRNA sequence
ttgagacagagtcttactct

SEQ ID NO: 93120 - DNA, 20 bp, Artificial
  CRISPR gRNA sequence
tgagacagagtcttactctg

SEQ ID NO: 93121 - DNA, 20 bp, Artificial
  CRISPR gRNA sequence
gagacagagtcttactctgt

SEQ ID NO: 93122 - DNA, 20 bp, Artificial
  CRISPR gRNA sequence
agacagagtcttactctgtg

SEQ ID NO: 93123 - DNA, 20 bp, Artificial
  CRISPR gRNA sequence
actctgtgtcgctcaggctg

SEQ ID NO: 93124 - DNA, 20 bp, Artificial
  CRISPR gRNA sequence
ctctgtgtcgctcaggctgg

SEQ ID NO: 93125 - DNA, 20 bp, Artificial
  CRISPR gRNA sequence
tgtgtcgctcaggctggagt

SEQ ID NO: 93126 - DNA, 20 bp, Artificial
  CRISPR gRNA sequence
tgtcgctcaggctggagtgc

SEQ ID NO: 93127 - DNA, 20 bp, Artificial
  CRISPR gRNA sequence
aggctggagtgcagtggtgc

SEQ ID NO: 93128 - DNA, 20 bp, Artificial
  CRISPR gRNA sequence
gagtgcagtggtgcgatctc

SEQ ID NO: 93129 - DNA, 20 bp, Artificial
  CRISPR gRNA sequence
ggcccactacaacctccacc

SEQ ID NO: 93130 - DNA, 20 bp, Artificial
  CRISPR gRNA sequence
caacctccacctcctgggtt

SEQ ID NO: 93131 - DNA, 20 bp, Artificial
  CRISPR gRNA sequence
cacctcctgggttcaagcag

SEQ ID NO: 93132 - DNA, 20 bp, Artificial
  CRISPR gRNA sequence
ctgggttcaagcagttcttg

SEQ ID NO: 93133 - DNA, 20 bp, Artificial
  CRISPR gRNA sequence
ggttcaagcagttcttgtgc

SEQ ID NO: 93134 - DNA, 20 bp, Artificial
  CRISPR gRNA sequence
aagcagttcttgtgcctcag

SEQ ID NO: 93135 - DNA, 20 bp, Artificial
  CRISPR gRNA sequence
ttgtgcctcagcctcctgag

SEQ ID NO: 93136 - DNA, 20 bp, Artificial
  CRISPR gRNA sequence
gtgcctcagcctcctgagta

SEQ ID NO: 93137 - DNA, 20 bp, Artificial
  CRISPR gRNA sequence
tgcctcagcctcctgagtag

SEQ ID NO: 93138 - DNA, 20 bp, Artificial
  CRISPR gRNA sequence
agcctcctgagtagctggga

SEQ ID NO: 93139 - DNA, 20 bp, Artificial
  CRISPR gRNA sequence
ctgagtagctgggattacag

SEQ ID NO: 93140 - DNA, 20 bp, Artificial
  CRISPR gRNA sequence
agtagctgggattacaggca

SEQ ID NO: 93141 - DNA, 20 bp, Artificial
  CRISPR gRNA sequence
ggattacaggcatgcaccac

SEQ ID NO: 93142 - DNA, 20 bp, Artificial
  CRISPR gRNA sequence
caggcatgcaccaccacgcc

SEQ ID NO: 93143 - DNA, 20 bp, Artificial
  CRISPR gRNA sequence
atttttgtatttttagtaga

SEQ ID NO: 93144 - DNA, 20 bp, Artificial
  CRISPR gRNA sequence
ttgtatttttagtagagacg

SEQ ID NO: 93145 - DNA, 20 bp, Artificial
  CRISPR gRNA sequence
tgtatttttagtagagacgc

SEQ ID NO: 93146 - DNA, 20 bp, Artificial
  CRISPR gRNA sequence
gtatttttagtagagacgcg

SEQ ID NO: 93147 - DNA, 20 bp, Artificial
  CRISPR gRNA sequence
tatttttagtagagacgcgg

SEQ ID NO: 93148 - DNA, 20 bp, Artificial
  CRISPR gRNA sequence
ttagtagagacgcggttttg

SEQ ID NO: 93149 - DNA, 20 bp, Artificial
  CRISPR gRNA sequence
tagtagagacgcggttttgc

SEQ ID NO: 93150 - DNA, 20 bp, Artificial
  CRISPR gRNA sequence
agtagagacgcggttttgcc

SEQ ID NO: 93151 - DNA, 20 bp, Artificial
  CRISPR gRNA sequence
gtagagacgcggttttgcca

SEQ ID NO: 93152 - DNA, 20 bp, Artificial
  CRISPR gRNA sequence
tgccatgttggccagtctgg

SEQ ID NO: 93153 - DNA, 20 bp, Artificial
  CRISPR gRNA sequence
gccatgttggccagtctggt

SEQ ID NO: 93154 - DNA, 20 bp, Artificial
  CRISPR gRNA sequence
ccatgttggccagtctggtc

SEQ ID NO: 93155 - DNA, 20 bp, Artificial
  CRISPR gRNA sequence
gccagtctggtctcgaactc

SEQ ID NO: 93156 - DNA, 20 bp, Artificial
  CRISPR gRNA sequence
gtctcgaactcctgatcctc

SEQ ID NO: 93157 - DNA, 20 bp, Artificial
  CRISPR gRNA sequence
gaactcctgatcctcccacc

SEQ ID NO: 93158 - DNA, 20 bp, Artificial
  CRISPR gRNA sequence
ctgatcctcccacctcagcc

SEQ ID NO: 93159 - DNA, 20 bp, Artificial
  CRISPR gRNA sequence
atcctcccacctcagcctcc

SEQ ID NO: 93160 - DNA, 20 bp, Artificial
  CRISPR gRNA sequence
ccacctcagcctcctgaagt

SEQ ID NO: 93161 - DNA, 20 bp, Artificial
  CRISPR gRNA sequence
agcctcctgaagtgctggga

SEQ ID NO: 93162 - DNA, 20 bp, Artificial
  CRISPR gRNA sequence
ctgaagtgctgggattacgg

SEQ ID NO: 93163 - DNA, 20 bp, Artificial
  CRISPR gRNA sequence
aagtgctgggattacgggtg

SEQ ID NO: 93164 - DNA, 20 bp, Artificial
  CRISPR gRNA sequence
ggattacgggtgagacccac

SEQ ID NO: 93165 - DNA, 20 bp, Artificial
  CRISPR gRNA sequence
cgggtgagacccaccacgcc

SEQ ID NO: 93166 - DNA, 20 bp, Artificial
  CRISPR gRNA sequence
ataatacttattttcaagaa

SEQ ID NO: 93167 - DNA, 20 bp, Artificial
  CRISPR gRNA sequence
attttcaagaaagaagtagt

SEQ ID NO: 93168 - DNA, 20 bp, Artificial
  CRISPR gRNA sequence
ttttcaagaaagaagtagtt

SEQ ID NO: 93169 - DNA, 20 bp, Artificial
  CRISPR gRNA sequence
tcaagaaagaagtagttaac

SEQ ID NO: 93170 - DNA, 20 bp, Artificial
  CRISPR gRNA sequence
caagaaagaagtagttaacc

SEQ ID NO: 93171 - DNA, 20 bp, Artificial
  CRISPR gRNA sequence
aagaaagaagtagttaacct

SEQ ID NO: 93172 - DNA, 20 bp, Artificial
  CRISPR gRNA sequence
acctatggctgcttactttt

SEQ ID NO: 93173 - DNA, 20 bp, Artificial
  CRISPR gRNA sequence
tggctgcttacttttttttt

SEQ ID NO: 93174 - DNA, 20 bp, Artificial
  CRISPR gRNA sequence
cttacttttttttttttaaa

SEQ ID NO: 93175 - DNA, 20 bp, Artificial
  CRISPR gRNA sequence
acttttttttttttaaacta

SEQ ID NO: 93176 - DNA, 20 bp, Artificial
  CRISPR gRNA sequence
cttttttttttttaaactac

SEQ ID NO: 93177 - DNA, 20 bp, Artificial
  CRISPR gRNA sequence
ttttttttttaaactaccta

SEQ ID NO: 93178 - DNA, 20 bp, Artificial
  CRISPR gRNA sequence
tttttttttaaactacctaa

SEQ ID NO: 93179 - DNA, 20 bp, Artificial
  CRISPR gRNA sequence
ttttttttaaactacctaac

SEQ ID NO: 93180 - DNA, 20 bp, Artificial
  CRISPR gRNA sequence
tttttttaaactacctaaca

SEQ ID NO: 93181 - DNA, 20 bp, Artificial
  CRISPR gRNA sequence
ttttttaaactacctaacat

SEQ ID NO: 93182 - DNA, 20 bp, Artificial
  CRISPR gRNA sequence
tttttaaactacctaacatt

SEQ ID NO: 93183 - DNA, 20 bp, Artificial
  CRISPR gRNA sequence
ttttaaactacctaacattt

SEQ ID NO: 93184 - DNA, 20 bp, Artificial
  CRISPR gRNA sequence
tttaaactacctaacattta

SEQ ID NO: 93185 - DNA, 20 bp, Artificial
  CRISPR gRNA sequence
ttaaactacctaacatttac

SEQ ID NO: 93186 - DNA, 20 bp, Artificial
  CRISPR gRNA sequence
taaactacctaacatttaca

SEQ ID NO: 93187 - DNA, 20 bp, Artificial
  CRISPR gRNA sequence
aaactacctaacatttacat

SEQ ID NO: 93188 - DNA, 20 bp, Artificial
  CRISPR gRNA sequence
aactacctaacatttacatc

SEQ ID NO: 93189 - DNA, 20 bp, Artificial
  CRISPR gRNA sequence
cctaacatttacatctacag

SEQ ID NO: 93190 - DNA, 20 bp, Artificial
  CRISPR gRNA sequence
acatttacatctacagtgag

SEQ ID NO: 93191 - DNA, 20 bp, Artificial
  CRISPR gRNA sequence
acatctacagtgaggaaaat

SEQ ID NO: 93192 - DNA, 20 bp, Artificial
  CRISPR gRNA sequence
catctacagtgaggaaaatg

SEQ ID NO: 93193 - DNA, 20 bp, Artificial
  CRISPR gRNA sequence
cagtgaggaaaatgtataaa

SEQ ID NO: 93194 - DNA, 20 bp, Artificial
  CRISPR gRNA sequence
aattagcgtctccctctgca

SEQ ID NO: 93195 - DNA, 20 bp, Artificial
  CRISPR gRNA sequence
gcgtctccctctgcacctcc

SEQ ID NO: 93196 - DNA, 20 bp, Artificial
  CRISPR gRNA sequence
cctctgcacctcccacaaaa

SEQ ID NO: 93197 - DNA, 20 bp, Artificial
  CRISPR gRNA sequence
tgcacctcccacaaaaagaa

SEQ ID NO: 93198 - DNA, 20 bp, Artificial
  CRISPR gRNA sequence
cacctcccacaaaaagaacc

SEQ ID NO: 93199 - DNA, 20 bp, Artificial
  CRISPR gRNA sequence
ccacaaaaagaaccttatta

SEQ ID NO: 93200 - DNA, 20 bp, Artificial
  CRISPR gRNA sequence
attactattttgttatttat

SEQ ID NO: 93201 - DNA, 20 bp, Artificial
  CRISPR gRNA sequence
ttactattttgttatttatt

SEQ ID NO: 93202 - DNA, 20 bp, Artificial
  CRISPR gRNA sequence
ctattttgttatttatttac

SEQ ID NO: 93203 - DNA, 20 bp, Artificial
  CRISPR gRNA sequence
ttttgttatttatttactta

SEQ ID NO: 93204 - DNA, 20 bp, Artificial
  CRISPR gRNA sequence
tgttatttatttacttatct

SEQ ID NO: 93205 - DNA, 20 bp, Artificial
  CRISPR gRNA sequence
gttatttatttacttatcta

SEQ ID NO: 93206 - DNA, 20 bp, Artificial
  CRISPR gRNA sequence
ttatttatttacttatctaa

SEQ ID NO: 93207 - DNA, 20 bp, Artificial
  CRISPR gRNA sequence
tttatttacttatctaattt

SEQ ID NO: 93208 - DNA, 20 bp, Artificial
  CRISPR gRNA sequence
atttacttatctaatttttt

SEQ ID NO: 93209 - DNA, 20 bp, Artificial
  CRISPR gRNA sequence
tttacttatctaatttttta

SEQ ID NO: 93210 - DNA, 20 bp, Artificial
  CRISPR gRNA sequence
acttatctaattttttagag

SEQ ID NO: 93211 - DNA, 20 bp, Artificial
  CRISPR gRNA sequence
cttatctaattttttagaga

SEQ ID NO: 93212 - DNA, 20 bp, Artificial
  CRISPR gRNA sequence
atctaattttttagagatgg

SEQ ID NO: 93213 - DNA, 20 bp, Artificial
  CRISPR gRNA sequence
tctaattttttagagatggg

SEQ ID NO: 93214 - DNA, 20 bp, Artificial
  CRISPR gRNA sequence
attttttagagatgggtctc

SEQ ID NO: 93215 - DNA, 20 bp, Artificial
  CRISPR gRNA sequence
tttagagatgggtctcacag

SEQ ID NO: 93216 - DNA, 20 bp, Artificial
  CRISPR gRNA sequence
ttagagatgggtctcacagt

SEQ ID NO: 93217 - DNA, 20 bp, Artificial
  CRISPR gRNA sequence
tagagatgggtctcacagtg

SEQ ID NO: 93218 - DNA, 20 bp, Artificial
  CRISPR gRNA sequence
agagatgggtctcacagtgt

SEQ ID NO: 93219 - DNA, 20 bp, Artificial
  CRISPR gRNA sequence
gagatgggtctcacagtgtt

SEQ ID NO: 93220 - DNA, 20 bp, Artificial
  CRISPR gRNA sequence
acagtgttgcccaggctggc

SEQ ID NO: 93221 - DNA, 20 bp, Artificial
  CRISPR gRNA sequence
cccaggctggcctcgaattc

SEQ ID NO: 93222 - DNA, 20 bp, Artificial
  CRISPR gRNA sequence
gcctcgaattcctgggctca

SEQ ID NO: 93223 - DNA, 20 bp, Artificial
  CRISPR gRNA sequence
gaattcctgggctcaagtga

SEQ ID NO: 93224 - DNA, 20 bp, Artificial
  CRISPR gRNA sequence
ctgggctcaagtgatcctcc

SEQ ID NO: 93225 - DNA, 20 bp, Artificial
  CRISPR gRNA sequence
ggctcaagtgatcctcctgc

SEQ ID NO: 93226 - DNA, 20 bp, Artificial
  CRISPR gRNA sequence
aagtgatcctcctgcctcag

SEQ ID NO: 93227 - DNA, 20 bp, Artificial
  CRISPR gRNA sequence
ctgcctcagccttcagagta

SEQ ID NO: 93228 - DNA, 20 bp, Artificial
  CRISPR gRNA sequence
cctcagccttcagagtaact

SEQ ID NO: 93229 - DNA, 20 bp, Artificial
  CRISPR gRNA sequence
agccttcagagtaactggga

SEQ ID NO: 93230 - DNA, 20 bp, Artificial
  CRISPR gRNA sequence
cagagtaactgggattattt

SEQ ID NO: 93231 - DNA, 20 bp, Artificial
  CRISPR gRNA sequence
agagtaactgggattatttc

SEQ ID NO: 93232 - DNA, 20 bp, Artificial
  CRISPR gRNA sequence
ggattatttcaccactgcac

SEQ ID NO: 93233 - DNA, 20 bp, Artificial
  CRISPR gRNA sequence
tttcaccactgcacctagct

SEQ ID NO: 93234 - DNA, 20 bp, Artificial
  CRISPR gRNA sequence
caccactgcacctagcttca

SEQ ID NO: 93235 - DNA, 20 bp, Artificial
  CRISPR gRNA sequence
accactgcacctagcttcac

SEQ ID NO: 93236 - DNA, 20 bp, Artificial
  CRISPR gRNA sequence
cacctagcttcactatttta

SEQ ID NO: 93237 - DNA, 20 bp, Artificial
  CRISPR gRNA sequence
gcttcactattttaaaataa

SEQ ID NO: 93238 - DNA, 20 bp, Artificial
  CRISPR gRNA sequence
cactattttaaaataatttg

SEQ ID NO: 93239 - DNA, 20 bp, Artificial
  CRISPR gRNA sequence
actattttaaaataatttgc

SEQ ID NO: 93240 - DNA, 20 bp, Artificial
  CRISPR gRNA sequence
ttttaaaataatttgcatga

SEQ ID NO: 93241 - DNA, 20 bp, Artificial
  CRISPR gRNA sequence
taaaataatttgcatgactt

SEQ ID NO: 93242 - DNA, 20 bp, Artificial
  CRISPR gRNA sequence
aaaataatttgcatgacttt

SEQ ID NO: 93243 - DNA, 20 bp, Artificial
  CRISPR gRNA sequence
aaataatttgcatgactttt

SEQ ID NO: 93244 - DNA, 20 bp, Artificial
  CRISPR gRNA sequence
gcatgactttttatggaagg

SEQ ID NO: 93245 - DNA, 20 bp, Artificial
  CRISPR gRNA sequence
catgactttttatggaaggg

SEQ ID NO: 93246 - DNA, 20 bp, Artificial
  CRISPR gRNA sequence
tttatggaagggaattaatt

SEQ ID NO: 93247 - DNA, 20 bp, Artificial
  CRISPR gRNA sequence
ttatggaagggaattaattg

SEQ ID NO: 93248 - DNA, 20 bp, Artificial
  CRISPR gRNA sequence
tatggaagggaattaattgc

SEQ ID NO: 93249 - DNA, 20 bp, Artificial
  CRISPR gRNA sequence
atggaagggaattaattgct

SEQ ID NO: 93250 - DNA, 20 bp, Artificial
  CRISPR gRNA sequence
tggaagggaattaattgcta

SEQ ID NO: 93251 - DNA, 20 bp, Artificial
  CRISPR gRNA sequence
attgctataagcaacaaata

SEQ ID NO: 93252 - DNA, 20 bp, Artificial
  CRISPR gRNA sequence
ctataagcaacaaataatac

SEQ ID NO: 93253 - DNA, 20 bp, Artificial
  CRISPR gRNA sequence
taagcaacaaataatactaa

SEQ ID NO: 93254 - DNA, 20 bp, Artificial
  CRISPR gRNA sequence
atagtttactatccagtttg

SEQ ID NO: 93255 - DNA, 20 bp, Artificial
  CRISPR gRNA sequence
actatccagtttgtcttata

SEQ ID NO: 93256 - DNA, 20 bp, Artificial
  CRISPR gRNA sequence
ctatccagtttgtcttatat

SEQ ID NO: 93257 - DNA, 20 bp, Artificial
  CRISPR gRNA sequence
tccagtttgtcttatatttt

SEQ ID NO: 93258 - DNA, 20 bp, Artificial
  CRISPR gRNA sequence
gtcttatattttgggatact

SEQ ID NO: 93259 - DNA, 20 bp, Artificial
  CRISPR gRNA sequence
tcttatattttgggatactt

SEQ ID NO: 93260 - DNA, 20 bp, Artificial
  CRISPR gRNA sequence
atattttgggatactttatc

SEQ ID NO: 93261 - DNA, 20 bp, Artificial
  CRISPR gRNA sequence
tattttgggatactttatca

SEQ ID NO: 93262 - DNA, 20 bp, Artificial
  CRISPR gRNA sequence
tgggatactttatcagttct

SEQ ID NO: 93263 - DNA, 20 bp, Artificial
  CRISPR gRNA sequence
gggatactttatcagttctg

SEQ ID NO: 93264 - DNA, 20 bp, Artificial
  CRISPR gRNA sequence
ggatactttatcagttctga

SEQ ID NO: 93265 - DNA, 20 bp, Artificial
  CRISPR gRNA sequence
tatcagttctgaggaggtaa

SEQ ID NO: 93266 - DNA, 20 bp, Artificial
  CRISPR gRNA sequence
atcagttctgaggaggtaac

SEQ ID NO: 93267 - DNA, 20 bp, Artificial
  CRISPR gRNA sequence
tcagttctgaggaggtaaca

SEQ ID NO: 93268 - DNA, 20 bp, Artificial
  CRISPR gRNA sequence
tgaggaggtaacaagatctg

SEQ ID NO: 93269 - DNA, 20 bp, Artificial
  CRISPR gRNA sequence
aggaggtaacaagatctgta

SEQ ID NO: 93270 - DNA, 20 bp, Artificial
  CRISPR gRNA sequence
taaatctttatctttgttaa

SEQ ID NO: 93271 - DNA, 20 bp, Artificial
  CRISPR gRNA sequence
tatctttgttaaactgagtg

SEQ ID NO: 93272 - DNA, 20 bp, Artificial
  CRISPR gRNA sequence
atctttgttaaactgagtgt

SEQ ID NO: 93273 - DNA, 20 bp, Artificial
  CRISPR gRNA sequence
tctttgttaaactgagtgta

SEQ ID NO: 93274 - DNA, 20 bp, Artificial
  CRISPR gRNA sequence
tgttaaactgagtgtaaaga

SEQ ID NO: 93275 - DNA, 20 bp, Artificial
  CRISPR gRNA sequence
gttaaactgagtgtaaagaa

SEQ ID NO: 93276 - DNA, 20 bp, Artificial
  CRISPR gRNA sequence
ttaaactgagtgtaaagaaa

SEQ ID NO: 93277 - DNA, 20 bp, Artificial
  CRISPR gRNA sequence
aactgagtgtaaagaaaata

SEQ ID NO: 93278 - DNA, 20 bp, Artificial
  CRISPR gRNA sequence
agtgtaaagaaaataacagt

SEQ ID NO: 93279 - DNA, 20 bp, Artificial
  CRISPR gRNA sequence
tatagtccggttttagtagt

SEQ ID NO: 93280 - DNA, 20 bp, Artificial
  CRISPR gRNA sequence
tagtagttcagaggaggata

SEQ ID NO: 93281 - DNA, 20 bp, Artificial
  CRISPR gRNA sequence
agtagttcagaggaggatag

SEQ ID NO: 93282 - DNA, 20 bp, Artificial
  CRISPR gRNA sequence
gtagttcagaggaggataga

SEQ ID NO: 93283 - DNA, 20 bp, Artificial
  CRISPR gRNA sequence
agaggaggatagatcattgt

SEQ ID NO: 93284 - DNA, 20 bp, Artificial
  CRISPR gRNA sequence
taggctgagatactccagaa

SEQ ID NO: 93285 - DNA, 20 bp, Artificial
  CRISPR gRNA sequence
agatactccagaaaggcttt

SEQ ID NO: 93286 - DNA, 20 bp, Artificial
  CRISPR gRNA sequence
cagaaaggctttgcagagga

SEQ ID NO: 93287 - DNA, 20 bp, Artificial
  CRISPR gRNA sequence
tgcagaggaaacgtgactca

SEQ ID NO: 93288 - DNA, 20 bp, Artificial
  CRISPR gRNA sequence
gcagaggaaacgtgactcag

SEQ ID NO: 93289 - DNA, 20 bp, Artificial
  CRISPR gRNA sequence
cagaggaaacgtgactcagt

SEQ ID NO: 93290 - DNA, 20 bp, Artificial
  CRISPR gRNA sequence
agtataaaccagaaaggatg

SEQ ID NO: 93291 - DNA, 20 bp, Artificial
  CRISPR gRNA sequence
acgcttaatgagctgagttt

SEQ ID NO: 93292 - DNA, 20 bp, Artificial
  CRISPR gRNA sequence
cgcttaatgagctgagtttc

SEQ ID NO: 93293 - DNA, 20 bp, Artificial
  CRISPR gRNA sequence
aatgagctgagtttcttatg

SEQ ID NO: 93294 - DNA, 20 bp, Artificial
  CRISPR gRNA sequence
atgagctgagtttcttatgt

SEQ ID NO: 93295 - DNA, 20 bp, Artificial
  CRISPR gRNA sequence
agtttcttatgtgtcaagca

SEQ ID NO: 93296 - DNA, 20 bp, Artificial
  CRISPR gRNA sequence
cttatgtgtcaagcactgtg

SEQ ID NO: 93297 - DNA, 20 bp, Artificial
  CRISPR gRNA sequence
ttatgtgtcaagcactgtgt

SEQ ID NO: 93298 - DNA, 20 bp, Artificial
  CRISPR gRNA sequence
atgtgtcaagcactgtgtta

SEQ ID NO: 93299 - DNA, 20 bp, Artificial
  CRISPR gRNA sequence
tgtgtcaagcactgtgttaa

SEQ ID NO: 93300 - DNA, 20 bp, Artificial
  CRISPR gRNA sequence
tgttaagctataaatggagt

SEQ ID NO: 93301 - DNA, 20 bp, Artificial
  CRISPR gRNA sequence
agctataaatggagtctcac

SEQ ID NO: 93302 - DNA, 20 bp, Artificial
  CRISPR gRNA sequence
taaatggagtctcacaaccc

SEQ ID NO: 93303 - DNA, 20 bp, Artificial
  CRISPR gRNA sequence
acaacccttcagcaatggga

SEQ ID NO: 93304 - DNA, 20 bp, Artificial
  CRISPR gRNA sequence
cagcaatgggatagatacta

SEQ ID NO: 93305 - DNA, 20 bp, Artificial
  CRISPR gRNA sequence
agcaatgggatagatactat

SEQ ID NO: 93306 - DNA, 20 bp, Artificial
  CRISPR gRNA sequence
tattttacatacatggaaac

SEQ ID NO: 93307 - DNA, 20 bp, Artificial
  CRISPR gRNA sequence
tacatacatggaaactgagg

SEQ ID NO: 93308 - DNA, 20 bp, Artificial
  CRISPR gRNA sequence
acatacatggaaactgaggc

SEQ ID NO: 93309 - DNA, 20 bp, Artificial
  CRISPR gRNA sequence
catacatggaaactgaggca

SEQ ID NO: 93310 - DNA, 20 bp, Artificial
  CRISPR gRNA sequence
aggcacagagaggctaaaga

SEQ ID NO: 93311 - DNA, 20 bp, Artificial
  CRISPR gRNA sequence
aagaatttggcctaggtcat

SEQ ID NO: 93312 - DNA, 20 bp, Artificial
  CRISPR gRNA sequence
ggcctaggtcatacagccag

SEQ ID NO: 93313 - DNA, 20 bp, Artificial
  CRISPR gRNA sequence
gcctaggtcatacagccagc

SEQ ID NO: 93314 - DNA, 20 bp, Artificial
  CRISPR gRNA sequence
ggtcatacagccagcaagta

SEQ ID NO: 93315 - DNA, 20 bp, Artificial
  CRISPR gRNA sequence
tactcaaacgcaagcagtct

SEQ ID NO: 93316 - DNA, 20 bp, Artificial
  CRISPR gRNA sequence
aaacgcaagcagtcttattc

SEQ ID NO: 93317 - DNA, 20 bp, Artificial
  CRISPR gRNA sequence
attctagagctttcactttt

SEQ ID NO: 93318 - DNA, 20 bp, Artificial
  CRISPR gRNA sequence
ttctagagctttcactttta

SEQ ID NO: 93319 - DNA, 20 bp, Artificial
  CRISPR gRNA sequence
tagagctttcacttttacct

SEQ ID NO: 93320 - DNA, 20 bp, Artificial
  CRISPR gRNA sequence
gagctttcacttttacctcc

SEQ ID NO: 93321 - DNA, 20 bp, Artificial
  CRISPR gRNA sequence
tcacttttacctccttacta

SEQ ID NO: 93322 - DNA, 20 bp, Artificial
  CRISPR gRNA sequence
cacttttacctccttactat

SEQ ID NO: 93323 - DNA, 20 bp, Artificial
  CRISPR gRNA sequence
acttttacctccttactata

SEQ ID NO: 93324 - DNA, 20 bp, Artificial
  CRISPR gRNA sequence
ttacctccttactatactgc

SEQ ID NO: 93325 - DNA, 20 bp, Artificial
  CRISPR gRNA sequence
tacctccttactatactgct

SEQ ID NO: 93326 - DNA, 20 bp, Artificial
  CRISPR gRNA sequence
acctccttactatactgctt

SEQ ID NO: 93327 - DNA, 20 bp, Artificial
  CRISPR gRNA sequence
cctccttactatactgcttc

SEQ ID NO: 93328 - DNA, 20 bp, Artificial
  CRISPR gRNA sequence
cttactatactgcttcccta

SEQ ID NO: 93329 - DNA, 20 bp, Artificial
  CRISPR gRNA sequence
actatactgcttccctagaa

SEQ ID NO: 93330 - DNA, 20 bp, Artificial
  CRISPR gRNA sequence
ctatactgcttccctagaat

SEQ ID NO: 93331 - DNA, 20 bp, Artificial
  CRISPR gRNA sequence
tactgcttccctagaattct

SEQ ID NO: 93332 - DNA, 20 bp, Artificial
  CRISPR gRNA sequence
cttccctagaattctggtag

SEQ ID NO: 93333 - DNA, 20 bp, Artificial
  CRISPR gRNA sequence
ccctagaattctggtagata

SEQ ID NO: 93334 - DNA, 20 bp, Artificial
  CRISPR gRNA sequence
cctagaattctggtagataa

SEQ ID NO: 93335 - DNA, 20 bp, Artificial
  CRISPR gRNA sequence
gaattctggtagataaaagg

SEQ ID NO: 93336 - DNA, 20 bp, Artificial
  CRISPR gRNA sequence
tggtagataaaaggaaagag

SEQ ID NO: 93337 - DNA, 20 bp, Artificial
  CRISPR gRNA sequence
gtagataaaaggaaagagaa

SEQ ID NO: 93338 - DNA, 20 bp, Artificial
  CRISPR gRNA sequence
tagtaaagaaagagaagtag

SEQ ID NO: 93339 - DNA, 20 bp, Artificial
  CRISPR gRNA sequence
agtaaagaaagagaagtagg

SEQ ID NO: 93340 - DNA, 20 bp, Artificial
  CRISPR gRNA sequence
gtaaagaaagagaagtagga

SEQ ID NO: 93341 - DNA, 20 bp, Artificial
  CRISPR gRNA sequence
ttgtgaagatagcaagtgga

SEQ ID NO: 93342 - DNA, 20 bp, Artificial
  CRISPR gRNA sequence
tgtgaagatagcaagtggac

SEQ ID NO: 93343 - DNA, 20 bp, Artificial
  CRISPR gRNA sequence
gtgaagatagcaagtggact

SEQ ID NO: 93344 - DNA, 20 bp, Artificial
  CRISPR gRNA sequence
tgaagatagcaagtggacta

SEQ ID NO: 93345 - DNA, 20 bp, Artificial
  CRISPR gRNA sequence
ttctagctaaaatagttgag

SEQ ID NO: 93346 - DNA, 20 bp, Artificial
  CRISPR gRNA sequence
tagctaaaatagttgagtgg

SEQ ID NO: 93347 - DNA, 20 bp, Artificial
  CRISPR gRNA sequence
gctaaaatagttgagtggaa

SEQ ID NO: 93348 - DNA, 20 bp, Artificial
  CRISPR gRNA sequence
aaatagttgagtggaaaatt

SEQ ID NO: 93349 - DNA, 20 bp, Artificial
  CRISPR gRNA sequence
agtggaaaattcatgagaga

SEQ ID NO: 93350 - DNA, 20 bp, Artificial
  CRISPR gRNA sequence
atgagagagaaatttggaaa

SEQ ID NO: 93351 - DNA, 20 bp, Artificial
  CRISPR gRNA sequence
ggaaagataggttgaagcca

SEQ ID NO: 93352 - DNA, 20 bp, Artificial
  CRISPR gRNA sequence
gaaagataggttgaagccag

SEQ ID NO: 93353 - DNA, 20 bp, Artificial
  CRISPR gRNA sequence
aagccagttttttatagtat

SEQ ID NO: 93354 - DNA, 20 bp, Artificial
  CRISPR gRNA sequence
tttatagtattgaatgccag

SEQ ID NO: 93355 - DNA, 20 bp, Artificial
  CRISPR gRNA sequence
ttatagtattgaatgccagg

SEQ ID NO: 93356 - DNA, 20 bp, Artificial
  CRISPR gRNA sequence
tatagtattgaatgccaggc

SEQ ID NO: 93357 - DNA, 20 bp, Artificial
  CRISPR gRNA sequence
atagtattgaatgccaggct

SEQ ID NO: 93358 - DNA, 20 bp, Artificial
  CRISPR gRNA sequence
tagtattgaatgccaggcta

SEQ ID NO: 93359 - DNA, 20 bp, Artificial
  CRISPR gRNA sequence
aatgccaggctatgggattt

SEQ ID NO: 93360 - DNA, 20 bp, Artificial
  CRISPR gRNA sequence
tgggatttggatttggagtc

SEQ ID NO: 93361 - DNA, 20 bp, Artificial
  CRISPR gRNA sequence
ggatttggagtctttaaatg

SEQ ID NO: 93362 - DNA, 20 bp, Artificial
  CRISPR gRNA sequence
gatttggagtctttaaatga

SEQ ID NO: 93363 - DNA, 20 bp, Artificial
  CRISPR gRNA sequence
ggagtctttaaatgaaatga

SEQ ID NO: 93364 - DNA, 20 bp, Artificial
  CRISPR gRNA sequence
gagtctttaaatgaaatgat

SEQ ID NO: 93365 - DNA, 20 bp, Artificial
  CRISPR gRNA sequence
taaatgaaatgatctaatta

SEQ ID NO: 93366 - DNA, 20 bp, Artificial
  CRISPR gRNA sequence
aaatgaaatgatctaattag

SEQ ID NO: 93367 - DNA, 20 bp, Artificial
  CRISPR gRNA sequence
aatgaaatgatctaattagg

SEQ ID NO: 93368 - DNA, 20 bp, Artificial
  CRISPR gRNA sequence
attaggaagtagcagaggat

SEQ ID NO: 93369 - DNA, 20 bp, Artificial
  CRISPR gRNA sequence
ggaagtagcagaggatccta

SEQ ID NO: 93370 - DNA, 20 bp, Artificial
  CRISPR gRNA sequence
ccctgatggagtgggttaaa

SEQ ID NO: 93371 - DNA, 20 bp, Artificial
  CRISPR gRNA sequence
atggagtgggttaaagttga

SEQ ID NO: 93372 - DNA, 20 bp, Artificial
  CRISPR gRNA sequence
aagttgagagcctatagatt

SEQ ID NO: 93373 - DNA, 20 bp, Artificial
  CRISPR gRNA sequence
agagcctatagattttgaga

SEQ ID NO: 93374 - DNA, 20 bp, Artificial
  CRISPR gRNA sequence
tagattttgagactctttcg

SEQ ID NO: 93375 - DNA, 20 bp, Artificial
  CRISPR gRNA sequence
tgagactctttcgaagatta

SEQ ID NO: 93376 - DNA, 20 bp, Artificial
  CRISPR gRNA sequence
gagactctttcgaagattat

SEQ ID NO: 93377 - DNA, 20 bp, Artificial
  CRISPR gRNA sequence
agactctttcgaagattatt

SEQ ID NO: 93378 - DNA, 20 bp, Artificial
  CRISPR gRNA sequence
tttcgaagattattatagta

SEQ ID NO: 93379 - DNA, 20 bp, Artificial
  CRISPR gRNA sequence
tcgaagattattatagtagg

SEQ ID NO: 93380 - DNA, 20 bp, Artificial
  CRISPR gRNA sequence
cgaagattattatagtagga

SEQ ID NO: 93381 - DNA, 20 bp, Artificial
  CRISPR gRNA sequence
gaagattattatagtaggac

SEQ ID NO: 93382 - DNA, 20 bp, Artificial
  CRISPR gRNA sequence
ttatagtaggactgacaggt

SEQ ID NO: 93383 - DNA, 20 bp, Artificial
  CRISPR gRNA sequence
tagtaggactgacaggtgat

SEQ ID NO: 93384 - DNA, 20 bp, Artificial
  CRISPR gRNA sequence
acaggtgatgatggtgtctt

SEQ ID NO: 93385 - DNA, 20 bp, Artificial
  CRISPR gRNA sequence
ctgctatgttgtgagcagca

SEQ ID NO: 93386 - DNA, 20 bp, Artificial
  CRISPR gRNA sequence
tgctatgttgtgagcagcaa

SEQ ID NO: 93387 - DNA, 20 bp, Artificial
  CRISPR gRNA sequence
ctatgttgtgagcagcaaga

SEQ ID NO: 93388 - DNA, 20 bp, Artificial
  CRISPR gRNA sequence
tgttgtgagcagcaagatta

SEQ ID NO: 93389 - DNA, 20 bp, Artificial
  CRISPR gRNA sequence
tgagcagcaagattagaaat

SEQ ID NO: 93390 - DNA, 20 bp, Artificial
  CRISPR gRNA sequence
gaaattaagttctctattcc

SEQ ID NO: 93391 - DNA, 20 bp, Artificial
  CRISPR gRNA sequence
agttctctattccaatgaag

SEQ ID NO: 93392 - DNA, 20 bp, Artificial
  CRISPR gRNA sequence
tctattccaatgaagaattt

SEQ ID NO: 93393 - DNA, 20 bp, Artificial
  CRISPR gRNA sequence
tattccaatgaagaatttat

SEQ ID NO: 93394 - DNA, 20 bp, Artificial
  CRISPR gRNA sequence
ttccaatgaagaatttatta

SEQ ID NO: 93395 - DNA, 20 bp, Artificial
  CRISPR gRNA sequence
caatgaagaatttattaagg

SEQ ID NO: 93396 - DNA, 20 bp, Artificial
  CRISPR gRNA sequence
attaaggtaaaaaaattaaa

SEQ ID NO: 93397 - DNA, 20 bp, Artificial
  CRISPR gRNA sequence
ttaaggtaaaaaaattaaag

SEQ ID NO: 93398 - DNA, 20 bp, Artificial
  CRISPR gRNA sequence
aggtaaaaaaattaaagaaa

SEQ ID NO: 93399 - DNA, 20 bp, Artificial
  CRISPR gRNA sequence
aagaaattaaggtatctaaa

SEQ ID NO: 93400 - DNA, 20 bp, Artificial
  CRISPR gRNA sequence
aggtatctaaaattaatatt

SEQ ID NO: 93401 - DNA, 20 bp, Artificial
  CRISPR gRNA sequence
aaattaatatttcttacaca

SEQ ID NO: 93402 - DNA, 20 bp, Artificial
  CRISPR gRNA sequence
atatttcttacacaagtcaa

SEQ ID NO: 93403 - DNA, 20 bp, Artificial
  CRISPR gRNA sequence
cttacacaagtcaaggttaa

SEQ ID NO: 93404 - DNA, 20 bp, Artificial
  CRISPR gRNA sequence
ttacacaagtcaaggttaaa

SEQ ID NO: 93405 - DNA, 20 bp, Artificial
  CRISPR gRNA sequence
acacaagtcaaggttaaatg

SEQ ID NO: 93406 - DNA, 20 bp, Artificial
  CRISPR gRNA sequence
cacaagtcaaggttaaatga

SEQ ID NO: 93407 - DNA, 20 bp, Artificial
  CRISPR gRNA sequence
aatgaggaacaaatgtgtat

SEQ ID NO: 93408 - DNA, 20 bp, Artificial
  CRISPR gRNA sequence
ctccaccaatctaagaacta

SEQ ID NO: 93409 - DNA, 20 bp, Artificial
  CRISPR gRNA sequence
caccaatctaagaactatgc

SEQ ID NO: 93410 - DNA, 20 bp, Artificial
  CRISPR gRNA sequence
agaactatgctatatgagag

SEQ ID NO: 93411 - DNA, 20 bp, Artificial
  CRISPR gRNA sequence
tgctatatgagagacacata

SEQ ID NO: 93412 - DNA, 20 bp, Artificial
  CRISPR gRNA sequence
tatgagagacacataaaggg

SEQ ID NO: 93413 - DNA, 20 bp, Artificial
  CRISPR gRNA sequence
gggataaatgaattgacctc

SEQ ID NO: 93414 - DNA, 20 bp, Artificial
  CRISPR gRNA sequence
acctctgctggtgggattgt

SEQ ID NO: 93415 - DNA, 20 bp, Artificial
  CRISPR gRNA sequence
tgctggtgggattgttctta

SEQ ID NO: 93416 - DNA, 20 bp, Artificial
  CRISPR gRNA sequence
ctggtgggattgttcttatt

SEQ ID NO: 93417 - DNA, 20 bp, Artificial
  CRISPR gRNA sequence
gtgggattgttcttattaaa

SEQ ID NO: 93418 - DNA, 20 bp, Artificial
  CRISPR gRNA sequence
ttcttattaaatatctaaaa

SEQ ID NO: 93419 - DNA, 20 bp, Artificial
  CRISPR gRNA sequence
ttattaaatatctaaaaagc

SEQ ID NO: 93420 - DNA, 20 bp, Artificial
  CRISPR gRNA sequence
attaaatatctaaaaagcta

SEQ ID NO: 93421 - DNA, 20 bp, Artificial
  CRISPR gRNA sequence
ttaaatatctaaaaagctat

SEQ ID NO: 93422 - DNA, 20 bp, Artificial
  CRISPR gRNA sequence
aatatctaaaaagctatcat

SEQ ID NO: 93423 - DNA, 20 bp, Artificial
  CRISPR gRNA sequence
aaaagctatcatttaagaga

SEQ ID NO: 93424 - DNA, 20 bp, Artificial
  CRISPR gRNA sequence
tcatttaagagaagcagtag

SEQ ID NO: 93425 - DNA, 20 bp, Artificial
  CRISPR gRNA sequence
aagagaagcagtagacttat

SEQ ID NO: 93426 - DNA, 20 bp, Artificial
  CRISPR gRNA sequence
agagaagcagtagacttata

SEQ ID NO: 93427 - DNA, 20 bp, Artificial
  CRISPR gRNA sequence
atatggcatgattctgaggt

SEQ ID NO: 93428 - DNA, 20 bp, Artificial
  CRISPR gRNA sequence
tatggcatgattctgaggta

SEQ ID NO: 93429 - DNA, 20 bp, Artificial
  CRISPR gRNA sequence
tgaggtaactaggactctta

SEQ ID NO: 93430 - DNA, 20 bp, Artificial
  CRISPR gRNA sequence
aggtaactaggactcttagg

SEQ ID NO: 93431 - DNA, 20 bp, Artificial
  CRISPR gRNA sequence
ggactcttaggcataaatca

SEQ ID NO: 93432 - DNA, 20 bp, Artificial
  CRISPR gRNA sequence
ttaggcataaatcacaagga

SEQ ID NO: 93433 - DNA, 20 bp, Artificial
  CRISPR gRNA sequence
aggcataaatcacaaggagt

SEQ ID NO: 93434 - DNA, 20 bp, Artificial
  CRISPR gRNA sequence
ggcataaatcacaaggagta

SEQ ID NO: 93435 - DNA, 20 bp, Artificial
  CRISPR gRNA sequence
cagctcagcttaagtaaagc

SEQ ID NO: 93436 - DNA, 20 bp, Artificial
  CRISPR gRNA sequence
agctcagcttaagtaaagct

SEQ ID NO: 93437 - DNA, 20 bp, Artificial
  CRISPR gRNA sequence
agcttaagtaaagctaccta

SEQ ID NO: 93438 - DNA, 20 bp, Artificial
  CRISPR gRNA sequence
aagtaaagctacctaacatt

SEQ ID NO: 93439 - DNA, 20 bp, Artificial
  CRISPR gRNA sequence
agtaaagctacctaacattc

SEQ ID NO: 93440 - DNA, 20 bp, Artificial
  CRISPR gRNA sequence
cctaacattctaccgaaatg

SEQ ID NO: 93441 - DNA, 20 bp, Artificial
  CRISPR gRNA sequence
acattctaccgaaatgttag

SEQ ID NO: 93442 - DNA, 20 bp, Artificial
  CRISPR gRNA sequence
taccgaaatgttagagctat

SEQ ID NO: 93443 - DNA, 20 bp, Artificial
  CRISPR gRNA sequence
ccgaaatgttagagctattc

SEQ ID NO: 93444 - DNA, 20 bp, Artificial
  CRISPR gRNA sequence
gagctattcaaaaccaaatg

SEQ ID NO: 93445 - DNA, 20 bp, Artificial
  CRISPR gRNA sequence
ttcaaaaccaaatgaaatgt

SEQ ID NO: 93446 - DNA, 20 bp, Artificial
  CRISPR gRNA sequence
aaaaccaaatgaaatgtggc

SEQ ID NO: 93447 - DNA, 20 bp, Artificial
  CRISPR gRNA sequence
gtaaactctgtaggacaaaa

SEQ ID NO: 93448 - DNA, 20 bp, Artificial
  CRISPR gRNA sequence
tgtaggacaaaaagcattgc

SEQ ID NO: 93449 - DNA, 20 bp, Artificial
  CRISPR gRNA sequence
taggacaaaaagcattgcag

SEQ ID NO: 93450 - DNA, 20 bp, Artificial
  CRISPR gRNA sequence
caggtttttgaaaaagaatt

SEQ ID NO: 93451 - DNA, 20 bp, Artificial
  CRISPR gRNA sequence
ttgaaaaagaattccaacat

SEQ ID NO: 93452 - DNA, 20 bp, Artificial
  CRISPR gRNA sequence
tgaaaaagaattccaacatc

SEQ ID NO: 93453 - DNA, 20 bp, Artificial
  CRISPR gRNA sequence
gaaaaagaattccaacatct

SEQ ID NO: 93454 - DNA, 20 bp, Artificial
  CRISPR gRNA sequence
aaaaagaattccaacatctg

SEQ ID NO: 93455 - DNA, 20 bp, Artificial
  CRISPR gRNA sequence
caacatctgtacaagtttgg

SEQ ID NO: 93456 - DNA, 20 bp, Artificial
  CRISPR gRNA sequence
tacaagtttggactagatga

SEQ ID NO: 93457 - DNA, 20 bp, Artificial
  CRISPR gRNA sequence
ggactagatgactaaaggtt

SEQ ID NO: 93458 - DNA, 20 bp, Artificial
  CRISPR gRNA sequence
gactagatgactaaaggtta

SEQ ID NO: 93459 - DNA, 20 bp, Artificial
  CRISPR gRNA sequence
gatgactaaaggttattttc

SEQ ID NO: 93460 - DNA, 20 bp, Artificial
  CRISPR gRNA sequence
aaggttattttcactacaag

SEQ ID NO: 93461 - DNA, 20 bp, Artificial
  CRISPR gRNA sequence
ttttcactacaagcttcttt

SEQ ID NO: 93462 - DNA, 20 bp, Artificial
  CRISPR gRNA sequence
tcactacaagcttctttatc

SEQ ID NO: 93463 - DNA, 20 bp, Artificial
  CRISPR gRNA sequence
cactacaagcttctttatct

SEQ ID NO: 93464 - DNA, 20 bp, Artificial
  CRISPR gRNA sequence
actacaagcttctttatcta

SEQ ID NO: 93465 - DNA, 20 bp, Artificial
  CRISPR gRNA sequence
caagcttctttatctaattc

SEQ ID NO: 93466 - DNA, 20 bp, Artificial
  CRISPR gRNA sequence
ctttatctaattcagtatct

SEQ ID NO: 93467 - DNA, 20 bp, Artificial
  CRISPR gRNA sequence
tttatctaattcagtatcta

SEQ ID NO: 93468 - DNA, 20 bp, Artificial
  CRISPR gRNA sequence
tatctaattcagtatctaat

SEQ ID NO: 93469 - DNA, 20 bp, Artificial
  CRISPR gRNA sequence
atctaattcagtatctaata

SEQ ID NO: 93470 - DNA, 20 bp, Artificial
  CRISPR gRNA sequence
tctaattcagtatctaatat

SEQ ID NO: 93471 - DNA, 20 bp, Artificial
  CRISPR gRNA sequence
attcagtatctaatattttg

SEQ ID NO: 93472 - DNA, 20 bp, Artificial
  CRISPR gRNA sequence
agtatctaatattttgtgaa

SEQ ID NO: 93473 - DNA, 20 bp, Artificial
  CRISPR gRNA sequence
atattttgtgaattaacctt

SEQ ID NO: 93474 - DNA, 20 bp, Artificial
  CRISPR gRNA sequence
tgtgaattaaccttttgaat

SEQ ID NO: 93475 - DNA, 20 bp, Artificial
  CRISPR gRNA sequence
gtgaattaaccttttgaatt

SEQ ID NO: 93476 - DNA, 20 bp, Artificial
  CRISPR gRNA sequence
tgaattaaccttttgaattt

SEQ ID NO: 93477 - DNA, 20 bp, Artificial
  CRISPR gRNA sequence
accttttgaatttccatagt

SEQ ID NO: 93478 - DNA, 20 bp, Artificial
  CRISPR gRNA sequence
ttgaatttccatagtggggt

SEQ ID NO: 93479 - DNA, 20 bp, Artificial
  CRISPR gRNA sequence
tgaatttccatagtggggtt

SEQ ID NO: 93480 - DNA, 20 bp, Artificial
  CRISPR gRNA sequence
gaatttccatagtggggttg

SEQ ID NO: 93481 - DNA, 20 bp, Artificial
  CRISPR gRNA sequence
aatttccatagtggggttgt

SEQ ID NO: 93482 - DNA, 20 bp, Artificial
  CRISPR gRNA sequence
ccatagtggggttgtgaggg

SEQ ID NO: 93483 - DNA, 20 bp, Artificial
  CRISPR gRNA sequence
catagtggggttgtgagggc

SEQ ID NO: 93484 - DNA, 20 bp, Artificial
  CRISPR gRNA sequence
tgagggcagagggtactgta

SEQ ID NO: 93485 - DNA, 20 bp, Artificial
  CRISPR gRNA sequence
taccatcaagtcaatttcag

SEQ ID NO: 93486 - DNA, 20 bp, Artificial
  CRISPR gRNA sequence
cagcattccattatcttgca

SEQ ID NO: 93487 - DNA, 20 bp, Artificial
  CRISPR gRNA sequence
agcattccattatcttgcac

SEQ ID NO: 93488 - DNA, 20 bp, Artificial
  CRISPR gRNA sequence
cattatcttgcacataaaaa

SEQ ID NO: 93489 - DNA, 20 bp, Artificial
  CRISPR gRNA sequence
tcttgcacataaaaatgaaa

SEQ ID NO: 93490 - DNA, 20 bp, Artificial
  CRISPR gRNA sequence
gcacataaaaatgaaagaat

SEQ ID NO: 93491 - DNA, 20 bp, Artificial
  CRISPR gRNA sequence
cacataaaaatgaaagaatc

SEQ ID NO: 93492 - DNA, 20 bp, Artificial
  CRISPR gRNA sequence
ataaataaaatcaacttggg

SEQ ID NO: 93493 - DNA, 20 bp, Artificial
  CRISPR gRNA sequence
gggggttgctggaggaggaa

SEQ ID NO: 93494 - DNA, 20 bp, Artificial
  CRISPR gRNA sequence
ggggttgctggaggaggaag

SEQ ID NO: 93495 - DNA, 20 bp, Artificial
  CRISPR gRNA sequence
ctggaggaggaagaaattat

SEQ ID NO: 93496 - DNA, 20 bp, Artificial
  CRISPR gRNA sequence
gaggaggaagaaattatttt

SEQ ID NO: 93497 - DNA, 20 bp, Artificial
  CRISPR gRNA sequence
tttttgtttcctctgggtat

SEQ ID NO: 93498 - DNA, 20 bp, Artificial
  CRISPR gRNA sequence
ttgtttcctctgggtattag

SEQ ID NO: 93499 - DNA, 20 bp, Artificial
  CRISPR gRNA sequence
tgtttcctctgggtattaga

SEQ ID NO: 93500 - DNA, 20 bp, Artificial
  CRISPR gRNA sequence
gtttcctctgggtattagaa

SEQ ID NO: 93501 - DNA, 20 bp, Artificial
  CRISPR gRNA sequence
tttcctctgggtattagaat

SEQ ID NO: 93502 - DNA, 20 bp, Artificial
  CRISPR gRNA sequence
cctctgggtattagaatttt

SEQ ID NO: 93503 - DNA, 20 bp, Artificial
  CRISPR gRNA sequence
ctctgggtattagaattttc

SEQ ID NO: 93504 - DNA, 20 bp, Artificial
  CRISPR gRNA sequence
tgggtattagaattttcttt

SEQ ID NO: 93505 - DNA, 20 bp, Artificial
  CRISPR gRNA sequence
ggtattagaattttcttttt

SEQ ID NO: 93506 - DNA, 20 bp, Artificial
  CRISPR gRNA sequence
gaattttctttttacagttt

SEQ ID NO: 93507 - DNA, 20 bp, Artificial
  CRISPR gRNA sequence
tctttttacagtttttatat

SEQ ID NO: 93508 - DNA, 20 bp, Artificial
  CRISPR gRNA sequence
ctttttacagtttttatatg

SEQ ID NO: 93509 - DNA, 20 bp, Artificial
  CRISPR gRNA sequence
tttttacagtttttatatgt

SEQ ID NO: 93510 - DNA, 20 bp, Artificial
  CRISPR gRNA sequence
tttacagtttttatatgttg

SEQ ID NO: 93511 - DNA, 20 bp, Artificial
  CRISPR gRNA sequence
ttacagtttttatatgttga

SEQ ID NO: 93512 - DNA, 20 bp, Artificial
  CRISPR gRNA sequence
tacagtttttatatgttgag

SEQ ID NO: 93513 - DNA, 20 bp, Artificial
  CRISPR gRNA sequence
acagtttttatatgttgagg

SEQ ID NO: 93514 - DNA, 20 bp, Artificial
  CRISPR gRNA sequence
cagtttttatatgttgaggc

SEQ ID NO: 93515 - DNA, 20 bp, Artificial
  CRISPR gRNA sequence
ttatatgttgaggcctaaaa

SEQ ID NO: 93516 - DNA, 20 bp, Artificial
  CRISPR gRNA sequence
tatatgttgaggcctaaaat

SEQ ID NO: 93517 - DNA, 20 bp, Artificial
  CRISPR gRNA sequence
atatgttgaggcctaaaatg

SEQ ID NO: 93518 - DNA, 20 bp, Artificial
  CRISPR gRNA sequence
tatgttgaggcctaaaatgt

SEQ ID NO: 93519 - DNA, 20 bp, Artificial
  CRISPR gRNA sequence
aggcctaaaatgtttagggg

SEQ ID NO: 93520 - DNA, 20 bp, Artificial
  CRISPR gRNA sequence
aaatgtttaggggtgaaata

SEQ ID NO: 93521 - DNA, 20 bp, Artificial
  CRISPR gRNA sequence
aggggtgaaatatttttgta

SEQ ID NO: 93522 - DNA, 20 bp, Artificial
  CRISPR gRNA sequence
ggggtgaaatatttttgtaa

SEQ ID NO: 93523 - DNA, 20 bp, Artificial
  CRISPR gRNA sequence
ttgtaatatcaggttggtaa

SEQ ID NO: 93524 - DNA, 20 bp, Artificial
  CRISPR gRNA sequence
tgtaatatcaggttggtaaa

SEQ ID NO: 93525 - DNA, 20 bp, Artificial
  CRISPR gRNA sequence
gtaatatcaggttggtaaac

SEQ ID NO: 93526 - DNA, 20 bp, Artificial
  CRISPR gRNA sequence
taatatcaggttggtaaact

SEQ ID NO: 93527 - DNA, 20 bp, Artificial
  CRISPR gRNA sequence
gtaaacttctcataatgaaa

SEQ ID NO: 93528 - DNA, 20 bp, Artificial
  CRISPR gRNA sequence
ctcataatgaaagaaattaa

SEQ ID NO: 93529 - DNA, 20 bp, Artificial
  CRISPR gRNA sequence
tcataatgaaagaaattaag

SEQ ID NO: 93530 - DNA, 20 bp, Artificial
  CRISPR gRNA sequence
ataatgaaagaaattaaggg

SEQ ID NO: 93531 - DNA, 20 bp, Artificial
  CRISPR gRNA sequence
aggggatattctcatagata

SEQ ID NO: 93532 - DNA, 20 bp, Artificial
  CRISPR gRNA sequence
tcatagataactcagaggcc

SEQ ID NO: 93533 - DNA, 20 bp, Artificial
  CRISPR gRNA sequence
atagataactcagaggccag

SEQ ID NO: 93534 - DNA, 20 bp, Artificial
  CRISPR gRNA sequence
agaggccagtagaaagaagc

SEQ ID NO: 93535 - DNA, 20 bp, Artificial
  CRISPR gRNA sequence
taagtaaagaacaaagaggt

SEQ ID NO: 93536 - DNA, 20 bp, Artificial
  CRISPR gRNA sequence
agtaaagaacaaagaggtta

SEQ ID NO: 93537 - DNA, 20 bp, Artificial
  CRISPR gRNA sequence
aattcatgtaaggtatggct

SEQ ID NO: 93538 - DNA, 20 bp, Artificial
  CRISPR gRNA sequence
atgtaaggtatggctttccg

SEQ ID NO: 93539 - DNA, 20 bp, Artificial
  CRISPR gRNA sequence
tccggtaaaacatttataat

SEQ ID NO: 93540 - DNA, 20 bp, Artificial
  CRISPR gRNA sequence
ccggtaaaacatttataatt

SEQ ID NO: 93541 - DNA, 20 bp, Artificial
  CRISPR gRNA sequence
cggtaaaacatttataattt

SEQ ID NO: 93542 - DNA, 20 bp, Artificial
  CRISPR gRNA sequence
ataattttatatttgctact

SEQ ID NO: 93543 - DNA, 20 bp, Artificial
  CRISPR gRNA sequence
taattttatatttgctactt

SEQ ID NO: 93544 - DNA, 20 bp, Artificial
  CRISPR gRNA sequence
tatatttgctactttagtaa

SEQ ID NO: 93545 - DNA, 20 bp, Artificial
  CRISPR gRNA sequence
atatttgctactttagtaag

SEQ ID NO: 93546 - DNA, 20 bp, Artificial
  CRISPR gRNA sequence
tatttgctactttagtaaga

SEQ ID NO: 93547 - DNA, 20 bp, Artificial
  CRISPR gRNA sequence
gctactttagtaagaatttt

SEQ ID NO: 93548 - DNA, 20 bp, Artificial
  CRISPR gRNA sequence
ctactttagtaagaattttg

SEQ ID NO: 93549 - DNA, 20 bp, Artificial
  CRISPR gRNA sequence
ctttagtaagaattttggat

SEQ ID NO: 93550 - DNA, 20 bp, Artificial
  CRISPR gRNA sequence
tagtaagaattttggatgtg

SEQ ID NO: 93551 - DNA, 20 bp, Artificial
  CRISPR gRNA sequence
agtaagaattttggatgtgg

SEQ ID NO: 93552 - DNA, 20 bp, Artificial
  CRISPR gRNA sequence
gtaagaattttggatgtggt

SEQ ID NO: 93553 - DNA, 20 bp, Artificial
  CRISPR gRNA sequence
tggatgtggtattgtggcat

SEQ ID NO: 93554 - DNA, 20 bp, Artificial
  CRISPR gRNA sequence
ggatgtggtattgtggcata

SEQ ID NO: 93555 - DNA, 20 bp, Artificial
  CRISPR gRNA sequence
gatgtggtattgtggcatag

SEQ ID NO: 93556 - DNA, 20 bp, Artificial
  CRISPR gRNA sequence
tggcatagttttgtaagagt

SEQ ID NO: 93557 - DNA, 20 bp, Artificial
  CRISPR gRNA sequence
tgtaagagtcagaatatttc

SEQ ID NO: 93558 - DNA, 20 bp, Artificial
  CRISPR gRNA sequence
gtaagagtcagaatatttca

SEQ ID NO: 93559 - DNA, 20 bp, Artificial
  CRISPR gRNA sequence
taagagtcagaatatttcag

SEQ ID NO: 93560 - DNA, 20 bp, Artificial
  CRISPR gRNA sequence
cagtcaactaaacaatattt

SEQ ID NO: 93561 - DNA, 20 bp, Artificial
  CRISPR gRNA sequence
agtcaactaaacaatatttt

SEQ ID NO: 93562 - DNA, 20 bp, Artificial
  CRISPR gRNA sequence
aacaatattttgttatgcca

SEQ ID NO: 93563 - DNA, 20 bp, Artificial
  CRISPR gRNA sequence
tgttatgccagcaaaattac

SEQ ID NO: 93564 - DNA, 20 bp, Artificial
  CRISPR gRNA sequence
gttatgccagcaaaattaca

SEQ ID NO: 93565 - DNA, 20 bp, Artificial
  CRISPR gRNA sequence
ttatgccagcaaaattacaa

SEQ ID NO: 93566 - DNA, 20 bp, Artificial
  CRISPR gRNA sequence
tgccagcaaaattacaagta

SEQ ID NO: 93567 - DNA, 20 bp, Artificial
  CRISPR gRNA sequence
caagtatttaagatgctgtc

SEQ ID NO: 93568 - DNA, 20 bp, Artificial
  CRISPR gRNA sequence
aagatgctgtcaggtaactg

SEQ ID NO: 93569 - DNA, 20 bp, Artificial
  CRISPR gRNA sequence
agatgctgtcaggtaactgg

SEQ ID NO: 93570 - DNA, 20 bp, Artificial
  CRISPR gRNA sequence
tcaggtaactgggggtacat

SEQ ID NO: 93571 - DNA, 20 bp, Artificial
  CRISPR gRNA sequence
ggggtacatatttggtaata

SEQ ID NO: 93572 - DNA, 20 bp, Artificial
  CRISPR gRNA sequence
ggtaataagtgctgctgatt

SEQ ID NO: 93573 - DNA, 20 bp, Artificial
  CRISPR gRNA sequence
gtaataagtgctgctgattt

SEQ ID NO: 93574 - DNA, 20 bp, Artificial
  CRISPR gRNA sequence
ctgattttgtttttgggcag

SEQ ID NO: 93575 - DNA, 20 bp, Artificial
  CRISPR gRNA sequence
attttgtttttgggcagtga

SEQ ID NO: 93576 - DNA, 20 bp, Artificial
  CRISPR gRNA sequence
tgtttttgggcagtgaaatc

SEQ ID NO: 93577 - DNA, 20 bp, Artificial
  CRISPR gRNA sequence
gtttttgggcagtgaaatct

SEQ ID NO: 93578 - DNA, 20 bp, Artificial
  CRISPR gRNA sequence
tttttgggcagtgaaatctc

SEQ ID NO: 93579 - DNA, 20 bp, Artificial
  CRISPR gRNA sequence
ttgggcagtgaaatctcagg

SEQ ID NO: 93580 - DNA, 20 bp, Artificial
  CRISPR gRNA sequence
tgggcagtgaaatctcaggg

SEQ ID NO: 93581 - DNA, 20 bp, Artificial
  CRISPR gRNA sequence
gggcagtgaaatctcagggt

SEQ ID NO: 93582 - DNA, 20 bp, Artificial
  CRISPR gRNA sequence
ggcagtgaaatctcagggta

SEQ ID NO: 93583 - DNA, 20 bp, Artificial
  CRISPR gRNA sequence
agggtaatggtatcatttta

SEQ ID NO: 93584 - DNA, 20 bp, Artificial
  CRISPR gRNA sequence
taggacttacctgttttgtt

SEQ ID NO: 93585 - DNA, 20 bp, Artificial
  CRISPR gRNA sequence
aggacttacctgttttgttc

SEQ ID NO: 93586 - DNA, 20 bp, Artificial
  CRISPR gRNA sequence
ggacttacctgttttgttca

SEQ ID NO: 93587 - DNA, 20 bp, Artificial
  CRISPR gRNA sequence
acctgttttgttcatacagt

SEQ ID NO: 93588 - DNA, 20 bp, Artificial
  CRISPR gRNA sequence
cctgttttgttcatacagtt

SEQ ID NO: 93589 - DNA, 20 bp, Artificial
  CRISPR gRNA sequence
ttttgttcatacagttggca

SEQ ID NO: 93590 - DNA, 20 bp, Artificial
  CRISPR gRNA sequence
tgttcatacagttggcagga

SEQ ID NO: 93591 - DNA, 20 bp, Artificial
  CRISPR gRNA sequence
gttcatacagttggcaggag

SEQ ID NO: 93592 - DNA, 20 bp, Artificial
  CRISPR gRNA sequence
ttcatacagttggcaggaga

SEQ ID NO: 93593 - DNA, 20 bp, Artificial
  CRISPR gRNA sequence
atacagttggcaggagacta

SEQ ID NO: 93594 - DNA, 20 bp, Artificial
  CRISPR gRNA sequence
gcaggagactatttatacta

SEQ ID NO: 93595 - DNA, 20 bp, Artificial
  CRISPR gRNA sequence
tttatactagtgctttttca

SEQ ID NO: 93596 - DNA, 20 bp, Artificial
  CRISPR gRNA sequence
atactagtgctttttcaagc

SEQ ID NO: 93597 - DNA, 20 bp, Artificial
  CRISPR gRNA sequence
tactagtgctttttcaagca

SEQ ID NO: 93598 - DNA, 20 bp, Artificial
  CRISPR gRNA sequence
gtgctttttcaagcaagttt

SEQ ID NO: 93599 - DNA, 20 bp, Artificial
  CRISPR gRNA sequence
tttcaagcaagtttatctaa

SEQ ID NO: 93600 - DNA, 20 bp, Artificial
  CRISPR gRNA sequence
ttcaagcaagtttatctaaa

SEQ ID NO: 93601 - DNA, 20 bp, Artificial
  CRISPR gRNA sequence
tcaagcaagtttatctaaat

SEQ ID NO: 93602 - DNA, 20 bp, Artificial
  CRISPR gRNA sequence
caagcaagtttatctaaatt

SEQ ID NO: 93603 - DNA, 20 bp, Artificial
  CRISPR gRNA sequence
aagcaagtttatctaaattt

SEQ ID NO: 93604 - DNA, 20 bp, Artificial
  CRISPR gRNA sequence
atctaaattttgaaagcttt

SEQ ID NO: 93605 - DNA, 20 bp, Artificial
  CRISPR gRNA sequence
tctaaattttgaaagctttg

SEQ ID NO: 93606 - DNA, 20 bp, Artificial
  CRISPR gRNA sequence
aattttgaaagctttggtta

SEQ ID NO: 93607 - DNA, 20 bp, Artificial
  CRISPR gRNA sequence
tgaaagctttggttatcagt

SEQ ID NO: 93608 - DNA, 20 bp, Artificial
  CRISPR gRNA sequence
gaaagctttggttatcagtt

SEQ ID NO: 93609 - DNA, 20 bp, Artificial
  CRISPR gRNA sequence
aaagctttggttatcagttg

SEQ ID NO: 93610 - DNA, 20 bp, Artificial
  CRISPR gRNA sequence
tggttatcagttgcttcttt

SEQ ID NO: 93611 - DNA, 20 bp, Artificial
  CRISPR gRNA sequence
ggttatcagttgcttcttta

SEQ ID NO: 93612 - DNA, 20 bp, Artificial
  CRISPR gRNA sequence
gttatcagttgcttctttaa

SEQ ID NO: 93613 - DNA, 20 bp, Artificial
  CRISPR gRNA sequence
tcagttgcttctttaaacaa

SEQ ID NO: 93614 - DNA, 20 bp, Artificial
  CRISPR gRNA sequence
cttctttaaacaatatttta

SEQ ID NO: 93615 - DNA, 20 bp, Artificial
  CRISPR gRNA sequence
ctttaaacaatattttacta

SEQ ID NO: 93616 - DNA, 20 bp, Artificial
  CRISPR gRNA sequence
tttaaacaatattttactac

SEQ ID NO: 93617 - DNA, 20 bp, Artificial
  CRISPR gRNA sequence
taaacaatattttactactc

SEQ ID NO: 93618 - DNA, 20 bp, Artificial
  CRISPR gRNA sequence
aaacaatattttactactcc

SEQ ID NO: 93619 - DNA, 20 bp, Artificial
  CRISPR gRNA sequence
aacaatattttactactccc

SEQ ID NO: 93620 - DNA, 20 bp, Artificial
  CRISPR gRNA sequence
tactactcccccatttgttt

SEQ ID NO: 93621 - DNA, 20 bp, Artificial
  CRISPR gRNA sequence
actactcccccatttgtttt

SEQ ID NO: 93622 - DNA, 20 bp, Artificial
  CRISPR gRNA sequence
ctactcccccatttgttttg

SEQ ID NO: 93623 - DNA, 20 bp, Artificial
  CRISPR gRNA sequence
ctcccccatttgttttggtt

SEQ ID NO: 93624 - DNA, 20 bp, Artificial
  CRISPR gRNA sequence
ccccatttgttttggttgcc

SEQ ID NO: 93625 - DNA, 20 bp, Artificial
  CRISPR gRNA sequence
gttttggttgccaactgggt

SEQ ID NO: 93626 - DNA, 20 bp, Artificial
  CRISPR gRNA sequence
ttttggttgccaactgggta

SEQ ID NO: 93627 - DNA, 20 bp, Artificial
  CRISPR gRNA sequence
tggttgccaactgggtaaaa

SEQ ID NO: 93628 - DNA, 20 bp, Artificial
  CRISPR gRNA sequence
ggttgccaactgggtaaaaa

SEQ ID NO: 93629 - DNA, 20 bp, Artificial
  CRISPR gRNA sequence
gttgccaactgggtaaaaag

SEQ ID NO: 93630 - DNA, 20 bp, Artificial
  CRISPR gRNA sequence
ccaactgggtaaaaagctat

SEQ ID NO: 93631 - DNA, 20 bp, Artificial
  CRISPR gRNA sequence
ggtaaaaagctatcagatat

SEQ ID NO: 93632 - DNA, 20 bp, Artificial
  CRISPR gRNA sequence
tcagatatcttattgagcag

SEQ ID NO: 93633 - DNA, 20 bp, Artificial
  CRISPR gRNA sequence
attgagcagtatataatttg

SEQ ID NO: 93634 - DNA, 20 bp, Artificial
  CRISPR gRNA sequence
ttgagcagtatataatttgc

SEQ ID NO: 93635 - DNA, 20 bp, Artificial
  CRISPR gRNA sequence
agcagtatataatttgcctc

SEQ ID NO: 93636 - DNA, 20 bp, Artificial
  CRISPR gRNA sequence
gcctctgagttcatatattt

SEQ ID NO: 93637 - DNA, 20 bp, Artificial
  CRISPR gRNA sequence
cctctgagttcatatatttc

SEQ ID NO: 93638 - DNA, 20 bp, Artificial
  CRISPR gRNA sequence
tgagttcatatatttcatcc

SEQ ID NO: 93639 - DNA, 20 bp, Artificial
  CRISPR gRNA sequence
agttcatatatttcatccaa

SEQ ID NO: 93640 - DNA, 20 bp, Artificial
  CRISPR gRNA sequence
atatatttcatccaaaggca

SEQ ID NO: 93641 - DNA, 20 bp, Artificial
  CRISPR gRNA sequence
catccaaaggcaagcagatt

SEQ ID NO: 93642 - DNA, 20 bp, Artificial
  CRISPR gRNA sequence
atccaaaggcaagcagatta

SEQ ID NO: 93643 - DNA, 20 bp, Artificial
  CRISPR gRNA sequence
tgtttcggcctggatagcat

SEQ ID NO: 93644 - DNA, 20 bp, Artificial
  CRISPR gRNA sequence
cggcctggatagcattatat

SEQ ID NO: 93645 - DNA, 20 bp, Artificial
  CRISPR gRNA sequence
ggcctggatagcattatata

SEQ ID NO: 93646 - DNA, 20 bp, Artificial
  CRISPR gRNA sequence
gatagcattatataaagaga

SEQ ID NO: 93647 - DNA, 20 bp, Artificial
  CRISPR gRNA sequence
tataaagagaatggtcaatt

SEQ ID NO: 93648 - DNA, 20 bp, Artificial
  CRISPR gRNA sequence
cacttggcattttttgtaat

SEQ ID NO: 93649 - DNA, 20 bp, Artificial
  CRISPR gRNA sequence
ggcattttttgtaatattga

SEQ ID NO: 93650 - DNA, 20 bp, Artificial
  CRISPR gRNA sequence
gcattttttgtaatattgaa

SEQ ID NO: 93651 - DNA, 20 bp, Artificial
  CRISPR gRNA sequence
tttgtaatattgaaaatagc

SEQ ID NO: 93652 - DNA, 20 bp, Artificial
  CRISPR gRNA sequence
ttgtaatattgaaaatagct

SEQ ID NO: 93653 - DNA, 20 bp, Artificial
  CRISPR gRNA sequence
tgtaatattgaaaatagctc

SEQ ID NO: 93654 - DNA, 20 bp, Artificial
  CRISPR gRNA sequence
gtaatattgaaaatagctca

SEQ ID NO: 93655 - DNA, 20 bp, Artificial
  CRISPR gRNA sequence
taatattgaaaatagctcac

SEQ ID NO: 93656 - DNA, 20 bp, Artificial
  CRISPR gRNA sequence
aaaatagctcacaagtaact

SEQ ID NO: 93657 - DNA, 20 bp, Artificial
  CRISPR gRNA sequence
acaagtaactctgcctcaat

SEQ ID NO: 93658 - DNA, 20 bp, Artificial
  CRISPR gRNA sequence
tgcctcaatcttagtggccc

SEQ ID NO: 93659 - DNA, 20 bp, Artificial
  CRISPR gRNA sequence
cctcaatcttagtggcccac

SEQ ID NO: 93660 - DNA, 20 bp, Artificial
  CRISPR gRNA sequence
aatcttagtggcccacctct

SEQ ID NO: 93661 - DNA, 20 bp, Artificial
  CRISPR gRNA sequence
agtggcccacctctcacagt

SEQ ID NO: 93662 - DNA, 20 bp, Artificial
  CRISPR gRNA sequence
gtggcccacctctcacagta

SEQ ID NO: 93663 - DNA, 20 bp, Artificial
  CRISPR gRNA sequence
tcacagtattactatatcac

SEQ ID NO: 93664 - DNA, 20 bp, Artificial
  CRISPR gRNA sequence
acagtattactatatcacac

SEQ ID NO: 93665 - DNA, 20 bp, Artificial
  CRISPR gRNA sequence
ctatatcacactctatcaca

SEQ ID NO: 93666 - DNA, 20 bp, Artificial
  CRISPR gRNA sequence
tatcacactctatcacacac

SEQ ID NO: 93667 - DNA, 20 bp, Artificial
  CRISPR gRNA sequence
tatcacacacactattaatt

SEQ ID NO: 93668 - DNA, 20 bp, Artificial
  CRISPR gRNA sequence
tcacacacactattaatttt

SEQ ID NO: 93669 - DNA, 20 bp, Artificial
  CRISPR gRNA sequence
ttaattttgagacctgccaa

SEQ ID NO: 93670 - DNA, 20 bp, Artificial
  CRISPR gRNA sequence
attttgagacctgccaagag

SEQ ID NO: 93671 - DNA, 20 bp, Artificial
  CRISPR gRNA sequence
tgagacctgccaagagacta

SEQ ID NO: 93672 - DNA, 20 bp, Artificial
  CRISPR gRNA sequence
gagacctgccaagagactaa

SEQ ID NO: 93673 - DNA, 20 bp, Artificial
  CRISPR gRNA sequence
agacctgccaagagactaaa

SEQ ID NO: 93674 - DNA, 20 bp, Artificial
  CRISPR gRNA sequence
ccaagagactaaagaaccca

SEQ ID NO: 93675 - DNA, 20 bp, Artificial
  CRISPR gRNA sequence
aagaacccaggttgaaaatc

SEQ ID NO: 93676 - DNA, 20 bp, Artificial
  CRISPR gRNA sequence
aaaatctggggggagaggga

SEQ ID NO: 93677 - DNA, 20 bp, Artificial
  CRISPR gRNA sequence
gggggagagggagcgaggag

SEQ ID NO: 93678 - DNA, 20 bp, Artificial
  CRISPR gRNA sequence
cattaaattaactgccaata

SEQ ID NO: 93679 - DNA, 20 bp, Artificial
  CRISPR gRNA sequence
aattaactgccaatactttg

SEQ ID NO: 93680 - DNA, 20 bp, Artificial
  CRISPR gRNA sequence
actgccaatactttgcctat

SEQ ID NO: 93681 - DNA, 20 bp, Artificial
  CRISPR gRNA sequence
ccaatactttgcctatgata

SEQ ID NO: 93682 - DNA, 20 bp, Artificial
  CRISPR gRNA sequence
tgcctatgataatgaagaac

SEQ ID NO: 93683 - DNA, 20 bp, Artificial
  CRISPR gRNA sequence
gcctatgataatgaagaact

SEQ ID NO: 93684 - DNA, 20 bp, Artificial
  CRISPR gRNA sequence
cctatgataatgaagaactt

SEQ ID NO: 93685 - DNA, 20 bp, Artificial
  CRISPR gRNA sequence
tgataatgaagaactttccc

SEQ ID NO: 93686 - DNA, 20 bp, Artificial
  CRISPR gRNA sequence
tcccagagttgcccagagac

SEQ ID NO: 93687 - DNA, 20 bp, Artificial
  CRISPR gRNA sequence
cccagagttgcccagagact

SEQ ID NO: 93688 - DNA, 20 bp, Artificial
  CRISPR gRNA sequence
ccagagttgcccagagactg

SEQ ID NO: 93689 - DNA, 20 bp, Artificial
  CRISPR gRNA sequence
cccagagactgggcaagaag

SEQ ID NO: 93690 - DNA, 20 bp, Artificial
  CRISPR gRNA sequence
ggcaagaagaaggaagaaat

SEQ ID NO: 93691 - DNA, 20 bp, Artificial
  CRISPR gRNA sequence
ttcattacatctttgaaata

SEQ ID NO: 93692 - DNA, 20 bp, Artificial
  CRISPR gRNA sequence
attacatctttgaaatacct

SEQ ID NO: 93693 - DNA, 20 bp, Artificial
  CRISPR gRNA sequence
catctttgaaatacctgtaa

SEQ ID NO: 93694 - DNA, 20 bp, Artificial
  CRISPR gRNA sequence
tgaaatacctgtaatcatga

SEQ ID NO: 93695 - DNA, 20 bp, Artificial
  CRISPR gRNA sequence
gaaatacctgtaatcatgac

SEQ ID NO: 93696 - DNA, 20 bp, Artificial
  CRISPR gRNA sequence
aaatacctgtaatcatgact

SEQ ID NO: 93697 - DNA, 20 bp, Artificial
  CRISPR gRNA sequence
taatcatgacttattacgtt

SEQ ID NO: 93698 - DNA, 20 bp, Artificial
  CRISPR gRNA sequence
attacgttaactgtttatct

SEQ ID NO: 93699 - DNA, 20 bp, Artificial
  CRISPR gRNA sequence
ttacgttaactgtttatcta

SEQ ID NO: 93700 - DNA, 20 bp, Artificial
  CRISPR gRNA sequence
cgttaactgtttatctattt

SEQ ID NO: 93701 - DNA, 20 bp, Artificial
  CRISPR gRNA sequence
actgtttatctatttgcatt

SEQ ID NO: 93702 - DNA, 20 bp, Artificial
  CRISPR gRNA sequence
tttatctatttgcattttta

SEQ ID NO: 93703 - DNA, 20 bp, Artificial
  CRISPR gRNA sequence
atctatttgcatttttatca

SEQ ID NO: 93704 - DNA, 20 bp, Artificial
  CRISPR gRNA sequence
tctatttgcatttttatcat

SEQ ID NO: 93705 - DNA, 20 bp, Artificial
  CRISPR gRNA sequence
tttgcatttttatcatttat

SEQ ID NO: 93706 - DNA, 20 bp, Artificial
  CRISPR gRNA sequence
gcatttttatcatttatccc

SEQ ID NO: 93707 - DNA, 20 bp, Artificial
  CRISPR gRNA sequence
catttttatcatttatccca

SEQ ID NO: 93708 - DNA, 20 bp, Artificial
  CRISPR gRNA sequence
ttatcatttatcccaggaaa

SEQ ID NO: 93709 - DNA, 20 bp, Artificial
  CRISPR gRNA sequence
tatcatttatcccaggaaag

SEQ ID NO: 93710 - DNA, 20 bp, Artificial
  CRISPR gRNA sequence
atcatttatcccaggaaagt

SEQ ID NO: 93711 - DNA, 20 bp, Artificial
  CRISPR gRNA sequence
tcatttatcccaggaaagtg

SEQ ID NO: 93712 - DNA, 20 bp, Artificial
  CRISPR gRNA sequence
atcccaggaaagtgcagata

SEQ ID NO: 93713 - DNA, 20 bp, Artificial
  CRISPR gRNA sequence
tcccaggaaagtgcagataa

SEQ ID NO: 93714 - DNA, 20 bp, Artificial
  CRISPR gRNA sequence
tccattgttaaacaaagaac

SEQ ID NO: 93715 - DNA, 20 bp, Artificial
  CRISPR gRNA sequence
cattgttaaacaaagaacag

SEQ ID NO: 93716 - DNA, 20 bp, Artificial
  CRISPR gRNA sequence
ttaaacaaagaacaggatct

SEQ ID NO: 93717 - DNA, 20 bp, Artificial
  CRISPR gRNA sequence
aacaaagaacaggatctttt

SEQ ID NO: 93718 - DNA, 20 bp, Artificial
  CRISPR gRNA sequence
ttggggatcgtcctgcaaga

SEQ ID NO: 93719 - DNA, 20 bp, Artificial
  CRISPR gRNA sequence
tggggatcgtcctgcaagac

SEQ ID NO: 93720 - DNA, 20 bp, Artificial
  CRISPR gRNA sequence
ggggatcgtcctgcaagacc

SEQ ID NO: 93721 - DNA, 20 bp, Artificial
  CRISPR gRNA sequence
gggatcgtcctgcaagacct

SEQ ID NO: 93722 - DNA, 20 bp, Artificial
  CRISPR gRNA sequence
caagacctactcttttagaa

SEQ ID NO: 93723 - DNA, 20 bp, Artificial
  CRISPR gRNA sequence
ctcttttagaacaagtgtta

SEQ ID NO: 93724 - DNA, 20 bp, Artificial
  CRISPR gRNA sequence
ttttagaacaagtgttaaat

SEQ ID NO: 93725 - DNA, 20 bp, Artificial
  CRISPR gRNA sequence
ttagaacaagtgttaaatca

SEQ ID NO: 93726 - DNA, 20 bp, Artificial
  CRISPR gRNA sequence
tagaacaagtgttaaatcaa

SEQ ID NO: 93727 - DNA, 20 bp, Artificial
  CRISPR gRNA sequence
agaacaagtgttaaatcaaa

SEQ ID NO: 93728 - DNA, 20 bp, Artificial
  CRISPR gRNA sequence
gaacaagtgttaaatcaaaa

SEQ ID NO: 93729 - DNA, 20 bp, Artificial
  CRISPR gRNA sequence
aatcaaaaaagactggtaaa

SEQ ID NO: 93730 - DNA, 20 bp, Artificial
  CRISPR gRNA sequence
gtaaatatctgtttgtaaat

SEQ ID NO: 93731 - DNA, 20 bp, Artificial
  CRISPR gRNA sequence
tttgtaaatcagttataaat

SEQ ID NO: 93732 - DNA, 20 bp, Artificial
  CRISPR gRNA sequence
gtaaatcagttataaatgtg

SEQ ID NO: 93733 - DNA, 20 bp, Artificial
  CRISPR gRNA sequence
taaatcagttataaatgtgt

SEQ ID NO: 93734 - DNA, 20 bp, Artificial
  CRISPR gRNA sequence
taaatgtgttaacaaacgtt

SEQ ID NO: 93735 - DNA, 20 bp, Artificial
  CRISPR gRNA sequence
acaaacgtttgttataaatg

SEQ ID NO: 93736 - DNA, 20 bp, Artificial
  CRISPR gRNA sequence
gttataaatggaacaattga

SEQ ID NO: 93737 - DNA, 20 bp, Artificial
  CRISPR gRNA sequence
ttataaatggaacaattgag

SEQ ID NO: 93738 - DNA, 20 bp, Artificial
  CRISPR gRNA sequence
taaatggaacaattgagatt

SEQ ID NO: 93739 - DNA, 20 bp, Artificial
  CRISPR gRNA sequence
agatttttgagatttttagc

SEQ ID NO: 93740 - DNA, 20 bp, Artificial
  CRISPR gRNA sequence
ttgagatttttagctcatga

SEQ ID NO: 93741 - DNA, 20 bp, Artificial
  CRISPR gRNA sequence
tgagatttttagctcatgac

SEQ ID NO: 93742 - DNA, 20 bp, Artificial
  CRISPR gRNA sequence
gagatttttagctcatgaca

SEQ ID NO: 93743 - DNA, 20 bp, Artificial
  CRISPR gRNA sequence
agatttttagctcatgacat

SEQ ID NO: 93744 - DNA, 20 bp, Artificial
  CRISPR gRNA sequence
ttagctcatgacatcacact

SEQ ID NO: 93745 - DNA, 20 bp, Artificial
  CRISPR gRNA sequence
tagctcatgacatcacacta

SEQ ID NO: 93746 - DNA, 20 bp, Artificial
  CRISPR gRNA sequence
agctcatgacatcacactat

SEQ ID NO: 93747 - DNA, 20 bp, Artificial
  CRISPR gRNA sequence
gctcatgacatcacactata

SEQ ID NO: 93748 - DNA, 20 bp, Artificial
  CRISPR gRNA sequence
atgacatcacactatacatc

SEQ ID NO: 93749 - DNA, 20 bp, Artificial
  CRISPR gRNA sequence
tacatcaaaataaattccta

SEQ ID NO: 93750 - DNA, 20 bp, Artificial
  CRISPR gRNA sequence
ctaataagtcaaaattttaa

SEQ ID NO: 93751 - DNA, 20 bp, Artificial
  CRISPR gRNA sequence
ataagtcaaaattttaaaaa

SEQ ID NO: 93752 - DNA, 20 bp, Artificial
  CRISPR gRNA sequence
taaaaaaagaatcggaactt

SEQ ID NO: 93753 - DNA, 20 bp, Artificial
  CRISPR gRNA sequence
aaaaaaagaatcggaacttt

SEQ ID NO: 93754 - DNA, 20 bp, Artificial
  CRISPR gRNA sequence
aaaaaagaatcggaacttta

SEQ ID NO: 93755 - DNA, 20 bp, Artificial
  CRISPR gRNA sequence
tacctcaaaaatgtaatgag

SEQ ID NO: 93756 - DNA, 20 bp, Artificial
  CRISPR gRNA sequence
acctcaaaaatgtaatgaga

SEQ ID NO: 93757 - DNA, 20 bp, Artificial
  CRISPR gRNA sequence
cctcaaaaatgtaatgagat

SEQ ID NO: 93758 - DNA, 20 bp, Artificial
  CRISPR gRNA sequence
aaaaatgtaatgagattttt

SEQ ID NO: 93759 - DNA, 20 bp, Artificial
  CRISPR gRNA sequence
tttttagcttatatagacaa

SEQ ID NO: 93760 - DNA, 20 bp, Artificial
  CRISPR gRNA sequence
ttttagcttatatagacaaa

SEQ ID NO: 93761 - DNA, 20 bp, Artificial
  CRISPR gRNA sequence
tttagcttatatagacaaaa

SEQ ID NO: 93762 - DNA, 20 bp, Artificial
  CRISPR gRNA sequence
ttagcttatatagacaaaat

SEQ ID NO: 93763 - DNA, 20 bp, Artificial
  CRISPR gRNA sequence
tagcttatatagacaaaatc

SEQ ID NO: 93764 - DNA, 20 bp, Artificial
  CRISPR gRNA sequence
agcttatatagacaaaatca

SEQ ID NO: 93765 - DNA, 20 bp, Artificial
  CRISPR gRNA sequence
gcttatatagacaaaatcac

SEQ ID NO: 93766 - DNA, 20 bp, Artificial
  CRISPR gRNA sequence
atatagacaaaatcacagag

SEQ ID NO: 93767 - DNA, 20 bp, Artificial
  CRISPR gRNA sequence
tatagacaaaatcacagaga

SEQ ID NO: 93768 - DNA, 20 bp, Artificial
  CRISPR gRNA sequence
taaacttgactacataaaaa

SEQ ID NO: 93769 - DNA, 20 bp, Artificial
  CRISPR gRNA sequence
gactacataaaaatgaatgc

SEQ ID NO: 93770 - DNA, 20 bp, Artificial
  CRISPR gRNA sequence
actacataaaaatgaatgct

SEQ ID NO: 93771 - DNA, 20 bp, Artificial
  CRISPR gRNA sequence
cataaaaatgaatgctatag

SEQ ID NO: 93772 - DNA, 20 bp, Artificial
  CRISPR gRNA sequence
tagtcaaaaatggtggcaaa

SEQ ID NO: 93773 - DNA, 20 bp, Artificial
  CRISPR gRNA sequence
cacaatgacctagagcaaaa

SEQ ID NO: 93774 - DNA, 20 bp, Artificial
  CRISPR gRNA sequence
gagcaaaaatatgtacaaca

SEQ ID NO: 93775 - DNA, 20 bp, Artificial
  CRISPR gRNA sequence
tggttaacgtgtctggtatt

SEQ ID NO: 93776 - DNA, 20 bp, Artificial
  CRISPR gRNA sequence
acgtgtctggtattttatca

SEQ ID NO: 93777 - DNA, 20 bp, Artificial
  CRISPR gRNA sequence
gtattttatcacataaaata

SEQ ID NO: 93778 - DNA, 20 bp, Artificial
  CRISPR gRNA sequence
tatcacataaaatattcctg

SEQ ID NO: 93779 - DNA, 20 bp, Artificial
  CRISPR gRNA sequence
atcacataaaatattcctgg

SEQ ID NO: 93780 - DNA, 20 bp, Artificial
  CRISPR gRNA sequence
tcacataaaatattcctggt

SEQ ID NO: 93781 - DNA, 20 bp, Artificial
  CRISPR gRNA sequence
ctggttgggcattgtggttc

SEQ ID NO: 93782 - DNA, 20 bp, Artificial
  CRISPR gRNA sequence
gttgggcattgtggttcatg

SEQ ID NO: 93783 - DNA, 20 bp, Artificial
  CRISPR gRNA sequence
ggcattgtggttcatgcctg

SEQ ID NO: 93784 - DNA, 20 bp, Artificial
  CRISPR gRNA sequence
tggttcatgcctgtaatcct

SEQ ID NO: 93785 - DNA, 20 bp, Artificial
  CRISPR gRNA sequence
atgcctgtaatcctagcact

SEQ ID NO: 93786 - DNA, 20 bp, Artificial
  CRISPR gRNA sequence
taatcctagcactttgggag

SEQ ID NO: 93787 - DNA, 20 bp, Artificial
  CRISPR gRNA sequence
gcactttgggaggccaggtg

SEQ ID NO: 93788 - DNA, 20 bp, Artificial
  CRISPR gRNA sequence
tgggaggccaggtgggagga

SEQ ID NO: 93789 - DNA, 20 bp, Artificial
  CRISPR gRNA sequence
gggaggccaggtgggaggat

SEQ ID NO: 93790 - DNA, 20 bp, Artificial
  CRISPR gRNA sequence
ggaggccaggtgggaggatc

SEQ ID NO: 93791 - DNA, 20 bp, Artificial
  CRISPR gRNA sequence
gaggctgggaatttgagacc

SEQ ID NO: 93792 - DNA, 20 bp, Artificial
  CRISPR gRNA sequence
aggctgggaatttgagacca

SEQ ID NO: 93793 - DNA, 20 bp, Artificial
  CRISPR gRNA sequence
ggaatttgagaccattctgg

SEQ ID NO: 93794 - DNA, 20 bp, Artificial
  CRISPR gRNA sequence
gagaccattctgggcaacgt

SEQ ID NO: 93795 - DNA, 20 bp, Artificial
  CRISPR gRNA sequence
agaccattctgggcaacgta

SEQ ID NO: 93796 - DNA, 20 bp, Artificial
  CRISPR gRNA sequence
tgggcaacgtagcgagaccc

SEQ ID NO: 93797 - DNA, 20 bp, Artificial
  CRISPR gRNA sequence
ggcaacgtagcgagacccca

SEQ ID NO: 93798 - DNA, 20 bp, Artificial
  CRISPR gRNA sequence
caaaaaaatttaaaaattag

SEQ ID NO: 93799 - DNA, 20 bp, Artificial
  CRISPR gRNA sequence
aaaaattagccgagtgtgat

SEQ ID NO: 93800 - DNA, 20 bp, Artificial
  CRISPR gRNA sequence
aaaattagccgagtgtgatg

SEQ ID NO: 93801 - DNA, 20 bp, Artificial
  CRISPR gRNA sequence
gccgagtgtgatggtatgta

SEQ ID NO: 93802 - DNA, 20 bp, Artificial
  CRISPR gRNA sequence
tagtcctggctactcaagag

SEQ ID NO: 93803 - DNA, 20 bp, Artificial
  CRISPR gRNA sequence
gctactcaagaggctgaaac

SEQ ID NO: 93804 - DNA, 20 bp, Artificial
  CRISPR gRNA sequence
ctcaagaggctgaaacagga

SEQ ID NO: 93805 - DNA, 20 bp, Artificial
  CRISPR gRNA sequence
aagaggctgaaacaggagga

SEQ ID NO: 93806 - DNA, 20 bp, Artificial
  CRISPR gRNA sequence
aaacaggaggattgcttgag

SEQ ID NO: 93807 - DNA, 20 bp, Artificial
  CRISPR gRNA sequence
cttgagtccaggaattcgag

SEQ ID NO: 93808 - DNA, 20 bp, Artificial
  CRISPR gRNA sequence
gagtccaggaattcgaggct

SEQ ID NO: 93809 - DNA, 20 bp, Artificial
  CRISPR gRNA sequence
agtccaggaattcgaggctg

SEQ ID NO: 93810 - DNA, 20 bp, Artificial
  CRISPR gRNA sequence
gaggctgcaatgagctatga

SEQ ID NO: 93811 - DNA, 20 bp, Artificial
  CRISPR gRNA sequence
caatgagctatgatcatacc

SEQ ID NO: 93812 - DNA, 20 bp, Artificial
  CRISPR gRNA sequence
tgatcataccactgtactcc

SEQ ID NO: 93813 - DNA, 20 bp, Artificial
  CRISPR gRNA sequence
tactccagcctaggcaacag

SEQ ID NO: 93814 - DNA, 20 bp, Artificial
  CRISPR gRNA sequence
cagcctaggcaacagagcac

SEQ ID NO: 93815 - DNA, 20 bp, Artificial
  CRISPR gRNA sequence
ggcaacagagcaccctataa

SEQ ID NO: 93816 - DNA, 20 bp, Artificial
  CRISPR gRNA sequence
taaatcattaaacatgatca

SEQ ID NO: 93817 - DNA, 20 bp, Artificial
  CRISPR gRNA sequence
aacatgatcagtttccttac

SEQ ID NO: 93818 - DNA, 20 bp, Artificial
  CRISPR gRNA sequence
ccttacatatatataaaata

SEQ ID NO: 93819 - DNA, 20 bp, Artificial
  CRISPR gRNA sequence
cttacatatatataaaatat

SEQ ID NO: 93820 - DNA, 20 bp, Artificial
  CRISPR gRNA sequence
acatatatataaaatatgtt

SEQ ID NO: 93821 - DNA, 20 bp, Artificial
  CRISPR gRNA sequence
catatatataaaatatgttt

SEQ ID NO: 93822 - DNA, 20 bp, Artificial
  CRISPR gRNA sequence
gcctctttgacagcttcagt

SEQ ID NO: 93823 - DNA, 20 bp, Artificial
  CRISPR gRNA sequence
cctctttgacagcttcagtc

SEQ ID NO: 93824 - DNA, 20 bp, Artificial
  CRISPR gRNA sequence
tttgacagcttcagtcttaa

SEQ ID NO: 93825 - DNA, 20 bp, Artificial
  CRISPR gRNA sequence
tgacagcttcagtcttaact

SEQ ID NO: 93826 - DNA, 20 bp, Artificial
  CRISPR gRNA sequence
gacagcttcagtcttaactg

SEQ ID NO: 93827 - DNA, 20 bp, Artificial
  CRISPR gRNA sequence
acagcttcagtcttaactgc

SEQ ID NO: 93828 - DNA, 20 bp, Artificial
  CRISPR gRNA sequence
cagtcttaactgcaaagaaa

SEQ ID NO: 93829 - DNA, 20 bp, Artificial
  CRISPR gRNA sequence
agtcttaactgcaaagaaag

SEQ ID NO: 93830 - DNA, 20 bp, Artificial
  CRISPR gRNA sequence
aactgcaaagaaagtttatt

SEQ ID NO: 93831 - DNA, 20 bp, Artificial
  CRISPR gRNA sequence
actgcaaagaaagtttatta

SEQ ID NO: 93832 - DNA, 20 bp, Artificial
  CRISPR gRNA sequence
caaagaaagtttattacaaa

SEQ ID NO: 93833 - DNA, 20 bp, Artificial
  CRISPR gRNA sequence
attacaaaaattcctgtaat

SEQ ID NO: 93834 - DNA, 20 bp, Artificial
  CRISPR gRNA sequence
ttacaaaaattcctgtaatt

SEQ ID NO: 93835 - DNA, 20 bp, Artificial
  CRISPR gRNA sequence
caaaaattcctgtaatttga

SEQ ID NO: 93836 - DNA, 20 bp, Artificial
  CRISPR gRNA sequence
ctgtaatttgatgaggaaaa

SEQ ID NO: 93837 - DNA, 20 bp, Artificial
  CRISPR gRNA sequence
taatttgatgaggaaaacct

SEQ ID NO: 93838 - DNA, 20 bp, Artificial
  CRISPR gRNA sequence
gatgaggaaaacctttggct

SEQ ID NO: 93839 - DNA, 20 bp, Artificial
  CRISPR gRNA sequence
atgaggaaaacctttggctt

SEQ ID NO: 93840 - DNA, 20 bp, Artificial
  CRISPR gRNA sequence
tggcttcaatacattgcaaa

SEQ ID NO: 93841 - DNA, 20 bp, Artificial
  CRISPR gRNA sequence
ggcttcaatacattgcaaaa

SEQ ID NO: 93842 - DNA, 20 bp, Artificial
  CRISPR gRNA sequence
gcttcaatacattgcaaaag

SEQ ID NO: 93843 - DNA, 20 bp, Artificial
  CRISPR gRNA sequence
caatacattgcaaaagatag

SEQ ID NO: 93844 - DNA, 20 bp, Artificial
  CRISPR gRNA sequence
aatacattgcaaaagataga

SEQ ID NO: 93845 - DNA, 20 bp, Artificial
  CRISPR gRNA sequence
caaaagatagaaacagaaaa

SEQ ID NO: 93846 - DNA, 20 bp, Artificial
  CRISPR gRNA sequence
aatgatatggaaaggtattc

SEQ ID NO: 93847 - DNA, 20 bp, Artificial
  CRISPR gRNA sequence
aatatcagtaaaaataaaca

SEQ ID NO: 93848 - DNA, 20 bp, Artificial
  CRISPR gRNA sequence
tttaaacgattacgcacaat

SEQ ID NO: 93849 - DNA, 20 bp, Artificial
  CRISPR gRNA sequence
aaacgattacgcacaatgat

SEQ ID NO: 93850 - DNA, 20 bp, Artificial
  CRISPR gRNA sequence
aacgattacgcacaatgatg

SEQ ID NO: 93851 - DNA, 20 bp, Artificial
  CRISPR gRNA sequence
cgcacaatgatgcagtgatg

SEQ ID NO: 93852 - DNA, 20 bp, Artificial
  CRISPR gRNA sequence
tcatgaaatggacattctca

SEQ ID NO: 93853 - DNA, 20 bp, Artificial
  CRISPR gRNA sequence
catgaaatggacattctcaa

SEQ ID NO: 93854 - DNA, 20 bp, Artificial
  CRISPR gRNA sequence
atgaaatggacattctcaag

SEQ ID NO: 93855 - DNA, 20 bp, Artificial
  CRISPR gRNA sequence
tcaagtagttaatggcatta

SEQ ID NO: 93856 - DNA, 20 bp, Artificial
  CRISPR gRNA sequence
aagtagttaatggcattata

SEQ ID NO: 93857 - DNA, 20 bp, Artificial
  CRISPR gRNA sequence
atggcattatatattggtat

SEQ ID NO: 93858 - DNA, 20 bp, Artificial
  CRISPR gRNA sequence
tatattggtatggcactttc

SEQ ID NO: 93859 - DNA, 20 bp, Artificial
  CRISPR gRNA sequence
gtatggcactttcagaaagc

SEQ ID NO: 93860 - DNA, 20 bp, Artificial
  CRISPR gRNA sequence
tcagaaagcagttgggcaat

SEQ ID NO: 93861 - DNA, 20 bp, Artificial
  CRISPR gRNA sequence
cagaaagcagttgggcaata

SEQ ID NO: 93862 - DNA, 20 bp, Artificial
  CRISPR gRNA sequence
agaaagcagttgggcaatat

SEQ ID NO: 93863 - DNA, 20 bp, Artificial
  CRISPR gRNA sequence
ggcaatatgtaccaggagtc

SEQ ID NO: 93864 - DNA, 20 bp, Artificial
  CRISPR gRNA sequence
tcaactcagacatcacattt

SEQ ID NO: 93865 - DNA, 20 bp, Artificial
  CRISPR gRNA sequence
caactcagacatcacattta

SEQ ID NO: 93866 - DNA, 20 bp, Artificial
  CRISPR gRNA sequence
aactcagacatcacatttaa

SEQ ID NO: 93867 - DNA, 20 bp, Artificial
  CRISPR gRNA sequence
agacatcacatttaatatga

SEQ ID NO: 93868 - DNA, 20 bp, Artificial
  CRISPR gRNA sequence
aatatgaagacatttacaga

SEQ ID NO: 93869 - DNA, 20 bp, Artificial
  CRISPR gRNA sequence
atatgaagacatttacagaa

SEQ ID NO: 93870 - DNA, 20 bp, Artificial
  CRISPR gRNA sequence
acagaatgtaaatcctaaat

SEQ ID NO: 93871 - DNA, 20 bp, Artificial
  CRISPR gRNA sequence
cagaatgtaaatcctaaata

SEQ ID NO: 93872 - DNA, 20 bp, Artificial
  CRISPR gRNA sequence
aatatggatagagttaaaca

SEQ ID NO: 93873 - DNA, 20 bp, Artificial
  CRISPR gRNA sequence
aacataaaggtattgccagg

SEQ ID NO: 93874 - DNA, 20 bp, Artificial
  CRISPR gRNA sequence
ccaggaatatatttctcata

SEQ ID NO: 93875 - DNA, 20 bp, Artificial
  CRISPR gRNA sequence
ctcataaatagtaaaaaagg

SEQ ID NO: 93876 - DNA, 20 bp, Artificial
  CRISPR gRNA sequence
tcataaatagtaaaaaaggt

SEQ ID NO: 93877 - DNA, 20 bp, Artificial
  CRISPR gRNA sequence
ataaatagtaaaaaaggtag

SEQ ID NO: 93878 - DNA, 20 bp, Artificial
  CRISPR gRNA sequence
aaacagcctaaatgtccaac

SEQ ID NO: 93879 - DNA, 20 bp, Artificial
  CRISPR gRNA sequence
aatgtccaacagtgtcataa

SEQ ID NO: 93880 - DNA, 20 bp, Artificial
  CRISPR gRNA sequence
agatgatttttaaataaaac

SEQ ID NO: 93881 - DNA, 20 bp, Artificial
  CRISPR gRNA sequence
ttaaataaaactgtttaata

SEQ ID NO: 93882 - DNA, 20 bp, Artificial
  CRISPR gRNA sequence
taaataaaactgtttaataa

SEQ ID NO: 93883 - DNA, 20 bp, Artificial
  CRISPR gRNA sequence
aaataaaactgtttaataaa

SEQ ID NO: 93884 - DNA, 20 bp, Artificial
  CRISPR gRNA sequence
aataaaactgtttaataaat

SEQ ID NO: 93885 - DNA, 20 bp, Artificial
  CRISPR gRNA sequence
tttaataaatagaaaatgta

SEQ ID NO: 93886 - DNA, 20 bp, Artificial
  CRISPR gRNA sequence
aataaatagaaaatgtacta

SEQ ID NO: 93887 - DNA, 20 bp, Artificial
  CRISPR gRNA sequence
ataaatagaaaatgtactaa

SEQ ID NO: 93888 - DNA, 20 bp, Artificial
  CRISPR gRNA sequence
agatataatacatataatct

SEQ ID NO: 93889 - DNA, 20 bp, Artificial
  CRISPR gRNA sequence
aaagtcagtatttaatgata

SEQ ID NO: 93890 - DNA, 20 bp, Artificial
  CRISPR gRNA sequence
aatgatagtatgttcacttt

SEQ ID NO: 93891 - DNA, 20 bp, Artificial
  CRISPR gRNA sequence
atgatagtatgttcacttta

SEQ ID NO: 93892 - DNA, 20 bp, Artificial
  CRISPR gRNA sequence
actttattcagtttatcttt

SEQ ID NO: 93893 - DNA, 20 bp, Artificial
  CRISPR gRNA sequence
tattcagtttatctttttgc

SEQ ID NO: 93894 - DNA, 20 bp, Artificial
  CRISPR gRNA sequence
attcagtttatctttttgca

SEQ ID NO: 93895 - DNA, 20 bp, Artificial
  CRISPR gRNA sequence
ttcagtttatctttttgcag

SEQ ID NO: 93896 - DNA, 20 bp, Artificial
  CRISPR gRNA sequence
agtttatctttttgcagctt

SEQ ID NO: 93897 - DNA, 20 bp, Artificial
  CRISPR gRNA sequence
atctttttgcagcttattgg

SEQ ID NO: 93898 - DNA, 20 bp, Artificial
  CRISPR gRNA sequence
tctttttgcagcttattggg

SEQ ID NO: 93899 - DNA, 20 bp, Artificial
  CRISPR gRNA sequence
tttgcagcttattggggcca

SEQ ID NO: 93900 - DNA, 20 bp, Artificial
  CRISPR gRNA sequence
ttgcagcttattggggccaa

SEQ ID NO: 93901 - DNA, 20 bp, Artificial
  CRISPR gRNA sequence
tgcagcttattggggccaaa

SEQ ID NO: 93902 - DNA, 20 bp, Artificial
  CRISPR gRNA sequence
gcagcttattggggccaaag

SEQ ID NO: 93903 - DNA, 20 bp, Artificial
  CRISPR gRNA sequence
cagcttattggggccaaaga

SEQ ID NO: 93904 - DNA, 20 bp, Artificial
  CRISPR gRNA sequence
attggggccaaagatttttt

SEQ ID NO: 93905 - DNA, 20 bp, Artificial
  CRISPR gRNA sequence
ttggggccaaagattttttt

SEQ ID NO: 93906 - DNA, 20 bp, Artificial
  CRISPR gRNA sequence
gggccaaagatttttttctc

SEQ ID NO: 93907 - DNA, 20 bp, Artificial
  CRISPR gRNA sequence
ttttctctataaatttatgt

SEQ ID NO: 93908 - DNA, 20 bp, Artificial
  CRISPR gRNA sequence
tttctctataaatttatgta

SEQ ID NO: 93909 - DNA, 20 bp, Artificial
  CRISPR gRNA sequence
ttctctataaatttatgtaa

SEQ ID NO: 93910 - DNA, 20 bp, Artificial
  CRISPR gRNA sequence
tctctataaatttatgtaag

SEQ ID NO: 93911 - DNA, 20 bp, Artificial
  CRISPR gRNA sequence
ctctataaatttatgtaagt

SEQ ID NO: 93912 - DNA, 20 bp, Artificial
  CRISPR gRNA sequence
tctataaatttatgtaagta

SEQ ID NO: 93913 - DNA, 20 bp, Artificial
  CRISPR gRNA sequence
tataaatttatgtaagtatt

SEQ ID NO: 93914 - DNA, 20 bp, Artificial
  CRISPR gRNA sequence
taaatttatgtaagtatttt

SEQ ID NO: 93915 - DNA, 20 bp, Artificial
  CRISPR gRNA sequence
atgtaagtattttattataa

SEQ ID NO: 93916 - DNA, 20 bp, Artificial
  CRISPR gRNA sequence
tgtaagtattttattataaa

SEQ ID NO: 93917 - DNA, 20 bp, Artificial
  CRISPR gRNA sequence
tattataaaaacctattaca

SEQ ID NO: 93918 - DNA, 20 bp, Artificial
  CRISPR gRNA sequence
attataaaaacctattacag

SEQ ID NO: 93919 - DNA, 20 bp, Artificial
  CRISPR gRNA sequence
ttataaaaacctattacagg

SEQ ID NO: 93920 - DNA, 20 bp, Artificial
  CRISPR gRNA sequence
taaaaacctattacaggaga

SEQ ID NO: 93921 - DNA, 20 bp, Artificial
  CRISPR gRNA sequence
ttacaggagactgtggcagg

SEQ ID NO: 93922 - DNA, 20 bp, Artificial
  CRISPR gRNA sequence
caggagactgtggcaggatg

SEQ ID NO: 93923 - DNA, 20 bp, Artificial
  CRISPR gRNA sequence
tggcaggatgattgcttgag

SEQ ID NO: 93924 - DNA, 20 bp, Artificial
  CRISPR gRNA sequence
cttgagccgaggagttcaag

SEQ ID NO: 93925 - DNA, 20 bp, Artificial
  CRISPR gRNA sequence
gagccgaggagttcaagact

SEQ ID NO: 93926 - DNA, 20 bp, Artificial
  CRISPR gRNA sequence
agccgaggagttcaagactg

SEQ ID NO: 93927 - DNA, 20 bp, Artificial
  CRISPR gRNA sequence
aagactgcagtgagctatgc

SEQ ID NO: 93928 - DNA, 20 bp, Artificial
  CRISPR gRNA sequence
cagtgagctatgctcacgcc

SEQ ID NO: 93929 - DNA, 20 bp, Artificial
  CRISPR gRNA sequence
tgctcacgccactgcactcc

SEQ ID NO: 93930 - DNA, 20 bp, Artificial
  CRISPR gRNA sequence
acgccactgcactccagcgt

SEQ ID NO: 93931 - DNA, 20 bp, Artificial
  CRISPR gRNA sequence
cactccagcgtggggaacag

SEQ ID NO: 93932 - DNA, 20 bp, Artificial
  CRISPR gRNA sequence
cagcgtggggaacagagtga

SEQ ID NO: 93933 - DNA, 20 bp, Artificial
  CRISPR gRNA sequence
tctctaataataatatgtta

SEQ ID NO: 93934 - DNA, 20 bp, Artificial
  CRISPR gRNA sequence
taataataatatgttaatca

SEQ ID NO: 93935 - DNA, 20 bp, Artificial
  CRISPR gRNA sequence
ataataatatgttaatcata

SEQ ID NO: 93936 - DNA, 20 bp, Artificial
  CRISPR gRNA sequence
atcatagtctgttatatttg

SEQ ID NO: 93937 - DNA, 20 bp, Artificial
  CRISPR gRNA sequence
ttatatttgttatattatta

SEQ ID NO: 93938 - DNA, 20 bp, Artificial
  CRISPR gRNA sequence
tatttgttatattattacaa

SEQ ID NO: 93939 - DNA, 20 bp, Artificial
  CRISPR gRNA sequence
gttatattattacaactata

SEQ ID NO: 93940 - DNA, 20 bp, Artificial
  CRISPR gRNA sequence
ttatattattacaactatat

SEQ ID NO: 93941 - DNA, 20 bp, Artificial
  CRISPR gRNA sequence
tattattacaactatatttt

SEQ ID NO: 93942 - DNA, 20 bp, Artificial
  CRISPR gRNA sequence
ttacaactatattttaaagt

SEQ ID NO: 93943 - DNA, 20 bp, Artificial
  CRISPR gRNA sequence
caactatattttaaagtgat

SEQ ID NO: 93944 - DNA, 20 bp, Artificial
  CRISPR gRNA sequence
tattttaaagtgatgagtgt

SEQ ID NO: 93945 - DNA, 20 bp, Artificial
  CRISPR gRNA sequence
taaagtgatgagtgtacaaa

SEQ ID NO: 93946 - DNA, 20 bp, Artificial
  CRISPR gRNA sequence
aaagtgatgagtgtacaaaa

SEQ ID NO: 93947 - DNA, 20 bp, Artificial
  CRISPR gRNA sequence
aagtgatgagtgtacaaaaa

SEQ ID NO: 93948 - DNA, 20 bp, Artificial
  CRISPR gRNA sequence
gatgttttagagcagttata

SEQ ID NO: 93949 - DNA, 20 bp, Artificial
  CRISPR gRNA sequence
tagagcagttatattttttc

SEQ ID NO: 93950 - DNA, 20 bp, Artificial
  CRISPR gRNA sequence
agagcagttatattttttcc

SEQ ID NO: 93951 - DNA, 20 bp, Artificial
  CRISPR gRNA sequence
gagcagttatattttttcct

SEQ ID NO: 93952 - DNA, 20 bp, Artificial
  CRISPR gRNA sequence
tattttttcctgaaattttg

SEQ ID NO: 93953 - DNA, 20 bp, Artificial
  CRISPR gRNA sequence
tttcctgaaattttggtata

SEQ ID NO: 93954 - DNA, 20 bp, Artificial
  CRISPR gRNA sequence
ttcctgaaattttggtatat

SEQ ID NO: 93955 - DNA, 20 bp, Artificial
  CRISPR gRNA sequence
tcctgaaattttggtatata

SEQ ID NO: 93956 - DNA, 20 bp, Artificial
  CRISPR gRNA sequence
cctgaaattttggtatatac

SEQ ID NO: 93957 - DNA, 20 bp, Artificial
  CRISPR gRNA sequence
ctgaaattttggtatatacc

SEQ ID NO: 93958 - DNA, 20 bp, Artificial
  CRISPR gRNA sequence
aaattttggtatataccgat

SEQ ID NO: 93959 - DNA, 20 bp, Artificial
  CRISPR gRNA sequence
tggtatataccgatatatat

SEQ ID NO: 93960 - DNA, 20 bp, Artificial
  CRISPR gRNA sequence
ggtatataccgatatatatg

SEQ ID NO: 93961 - DNA, 20 bp, Artificial
  CRISPR gRNA sequence
gtatataccgatatatatgt

SEQ ID NO: 93962 - DNA, 20 bp, Artificial
  CRISPR gRNA sequence
tacacacaatttttaatttc

SEQ ID NO: 93963 - DNA, 20 bp, Artificial
  CRISPR gRNA sequence
ttaatttctttatgaagact

SEQ ID NO: 93964 - DNA, 20 bp, Artificial
  CRISPR gRNA sequence
taatttctttatgaagactt

SEQ ID NO: 93965 - DNA, 20 bp, Artificial
  CRISPR gRNA sequence
aatttctttatgaagactta

SEQ ID NO: 93966 - DNA, 20 bp, Artificial
  CRISPR gRNA sequence
atttctttatgaagacttag

SEQ ID NO: 93967 - DNA, 20 bp, Artificial
  CRISPR gRNA sequence
ctttatgaagacttagttgc

SEQ ID NO: 93968 - DNA, 20 bp, Artificial
  CRISPR gRNA sequence
tttatgaagacttagttgcc

SEQ ID NO: 93969 - DNA, 20 bp, Artificial
  CRISPR gRNA sequence
tatgaagacttagttgccta

SEQ ID NO: 93970 - DNA, 20 bp, Artificial
  CRISPR gRNA sequence
atgaagacttagttgcctaa

SEQ ID NO: 93971 - DNA, 20 bp, Artificial
  CRISPR gRNA sequence
tgaagacttagttgcctaat

SEQ ID NO: 93972 - DNA, 20 bp, Artificial
  CRISPR gRNA sequence
agttgcctaatgagaaactt

SEQ ID NO: 93973 - DNA, 20 bp, Artificial
  CRISPR gRNA sequence
gttgcctaatgagaaacttg

SEQ ID NO: 93974 - DNA, 20 bp, Artificial
  CRISPR gRNA sequence
cctaatgagaaacttgactt

SEQ ID NO: 93975 - DNA, 20 bp, Artificial
  CRISPR gRNA sequence
atgagaaacttgacttctag

SEQ ID NO: 93976 - DNA, 20 bp, Artificial
  CRISPR gRNA sequence
gacttctagcactagtttgt

SEQ ID NO: 93977 - DNA, 20 bp, Artificial
  CRISPR gRNA sequence
acttctagcactagtttgta

SEQ ID NO: 93978 - DNA, 20 bp, Artificial
  CRISPR gRNA sequence
ctagcactagtttgtatgta

SEQ ID NO: 93979 - DNA, 20 bp, Artificial
  CRISPR gRNA sequence
tagcactagtttgtatgtat

SEQ ID NO: 93980 - DNA, 20 bp, Artificial
  CRISPR gRNA sequence
gcactagtttgtatgtatgt

SEQ ID NO: 93981 - DNA, 20 bp, Artificial
  CRISPR gRNA sequence
gtttgtatgtatgtacaaac

SEQ ID NO: 93982 - DNA, 20 bp, Artificial
  CRISPR gRNA sequence
gtatgtatgtacaaactggc

SEQ ID NO: 93983 - DNA, 20 bp, Artificial
  CRISPR gRNA sequence
tatgtatgtacaaactggca

SEQ ID NO: 93984 - DNA, 20 bp, Artificial
  CRISPR gRNA sequence
gcatttagctgctattttca

SEQ ID NO: 93985 - DNA, 20 bp, Artificial
  CRISPR gRNA sequence
agctgctattttcacatgtg

SEQ ID NO: 93986 - DNA, 20 bp, Artificial
  CRISPR gRNA sequence
gctgctattttcacatgtgg

SEQ ID NO: 93987 - DNA, 20 bp, Artificial
  CRISPR gRNA sequence
ctattttcacatgtggcccc

SEQ ID NO: 93988 - DNA, 20 bp, Artificial
  CRISPR gRNA sequence
ttttcacatgtggccccctt

SEQ ID NO: 93989 - DNA, 20 bp, Artificial
  CRISPR gRNA sequence
tcacatgtggccccctttca

SEQ ID NO: 93990 - DNA, 20 bp, Artificial
  CRISPR gRNA sequence
cacatgtggccccctttcat

SEQ ID NO: 93991 - DNA, 20 bp, Artificial
  CRISPR gRNA sequence
acatgtggccccctttcatc

SEQ ID NO: 93992 - DNA, 20 bp, Artificial
  CRISPR gRNA sequence
tcatctccattttttttctt

SEQ ID NO: 93993 - DNA, 20 bp, Artificial
  CRISPR gRNA sequence
catctccattttttttcttg

SEQ ID NO: 93994 - DNA, 20 bp, Artificial
  CRISPR gRNA sequence
atctccattttttttcttgc

SEQ ID NO: 93995 - DNA, 20 bp, Artificial
  CRISPR gRNA sequence
cattttttttcttgctataa

SEQ ID NO: 93996 - DNA, 20 bp, Artificial
  CRISPR gRNA sequence
tttttcttgctataatcctg

SEQ ID NO: 93997 - DNA, 20 bp, Artificial
  CRISPR gRNA sequence
ttttcttgctataatcctgg

SEQ ID NO: 93998 - DNA, 20 bp, Artificial
  CRISPR gRNA sequence
tttcttgctataatcctggg

SEQ ID NO: 93999 - DNA, 20 bp, Artificial
  CRISPR gRNA sequence
ttcttgctataatcctgggt

SEQ ID NO: 94000 - DNA, 20 bp, Artificial
  CRISPR gRNA sequence
tcttgctataatcctgggtc

SEQ ID NO: 94001 - DNA, 20 bp, Artificial
  CRISPR gRNA sequence
cttgctataatcctgggtca

SEQ ID NO: 94002 - DNA, 20 bp, Artificial
  CRISPR gRNA sequence
ttgctataatcctgggtcag

SEQ ID NO: 94003 - DNA, 20 bp, Artificial
  CRISPR gRNA sequence
gctataatcctgggtcagtg

SEQ ID NO: 94004 - DNA, 20 bp, Artificial
  CRISPR gRNA sequence
ctataatcctgggtcagtgc

SEQ ID NO: 94005 - DNA, 20 bp, Artificial
  CRISPR gRNA sequence
taatcctgggtcagtgctac

SEQ ID NO: 94006 - DNA, 20 bp, Artificial
  CRISPR gRNA sequence
ggtcagtgctacttttagct

SEQ ID NO: 94007 - DNA, 20 bp, Artificial
  CRISPR gRNA sequence
cttttagctctttgttctta

SEQ ID NO: 94008 - DNA, 20 bp, Artificial
  CRISPR gRNA sequence
ttagctctttgttcttacat

SEQ ID NO: 94009 - DNA, 20 bp, Artificial
  CRISPR gRNA sequence
tagctctttgttcttacata

SEQ ID NO: 94010 - DNA, 20 bp, Artificial
  CRISPR gRNA sequence
agctctttgttcttacatat

SEQ ID NO: 94011 - DNA, 20 bp, Artificial
  CRISPR gRNA sequence
gctctttgttcttacatatt

SEQ ID NO: 94012 - DNA, 20 bp, Artificial
  CRISPR gRNA sequence
tttgttcttacatatttcaa

SEQ ID NO: 94013 - DNA, 20 bp, Artificial
  CRISPR gRNA sequence
tgttcttacatatttcaaga

SEQ ID NO: 94014 - DNA, 20 bp, Artificial
  CRISPR gRNA sequence
gttcttacatatttcaagag

SEQ ID NO: 94015 - DNA, 20 bp, Artificial
  CRISPR gRNA sequence
ttcttacatatttcaagaga

SEQ ID NO: 94016 - DNA, 20 bp, Artificial
  CRISPR gRNA sequence
ttacatatttcaagagagta

SEQ ID NO: 94017 - DNA, 20 bp, Artificial
  CRISPR gRNA sequence
acatatttcaagagagtata

SEQ ID NO: 94018 - DNA, 20 bp, Artificial
  CRISPR gRNA sequence
catatttcaagagagtatat

SEQ ID NO: 94019 - DNA, 20 bp, Artificial
  CRISPR gRNA sequence
caagagagtatatttgctgg

SEQ ID NO: 94020 - DNA, 20 bp, Artificial
  CRISPR gRNA sequence
aagagagtatatttgctggc

SEQ ID NO: 94021 - DNA, 20 bp, Artificial
  CRISPR gRNA sequence
gctggcatattagagaaggt

SEQ ID NO: 94022 - DNA, 20 bp, Artificial
  CRISPR gRNA sequence
ctggcatattagagaaggtg

SEQ ID NO: 94023 - DNA, 20 bp, Artificial
  CRISPR gRNA sequence
gcatattagagaaggtgttt

SEQ ID NO: 94024 - DNA, 20 bp, Artificial
  CRISPR gRNA sequence
gagaaggtgtttccttttta

SEQ ID NO: 94025 - DNA, 20 bp, Artificial
  CRISPR gRNA sequence
cctttttacacaaagtcacc

SEQ ID NO: 94026 - DNA, 20 bp, Artificial
  CRISPR gRNA sequence
ctttttacacaaagtcacca

SEQ ID NO: 94027 - DNA, 20 bp, Artificial
  CRISPR gRNA sequence
tttacacaaagtcaccaata

SEQ ID NO: 94028 - DNA, 20 bp, Artificial
  CRISPR gRNA sequence
ttacacaaagtcaccaataa

SEQ ID NO: 94029 - DNA, 20 bp, Artificial
  CRISPR gRNA sequence
tacacaaagtcaccaataac

SEQ ID NO: 94030 - DNA, 20 bp, Artificial
  CRISPR gRNA sequence
acacaaagtcaccaataaca

SEQ ID NO: 94031 - DNA, 20 bp, Artificial
  CRISPR gRNA sequence
cacaaagtcaccaataacag

SEQ ID NO: 94032 - DNA, 20 bp, Artificial
  CRISPR gRNA sequence
cacccgttatttttaggttt

SEQ ID NO: 94033 - DNA, 20 bp, Artificial
  CRISPR gRNA sequence
acccgttatttttaggtttt

SEQ ID NO: 94034 - DNA, 20 bp, Artificial
  CRISPR gRNA sequence
tttttaggttttagtatttt

SEQ ID NO: 94035 - DNA, 20 bp, Artificial
  CRISPR gRNA sequence
ttaggttttagtattttgat

SEQ ID NO: 94036 - DNA, 20 bp, Artificial
  CRISPR gRNA sequence
taggttttagtattttgatg

SEQ ID NO: 94037 - DNA, 20 bp, Artificial
  CRISPR gRNA sequence
aggttttagtattttgatgt

SEQ ID NO: 94038 - DNA, 20 bp, Artificial
  CRISPR gRNA sequence
ggttttagtattttgatgtg

SEQ ID NO: 94039 - DNA, 20 bp, Artificial
  CRISPR gRNA sequence
tagtattttgatgtgtgaca

SEQ ID NO: 94040 - DNA, 20 bp, Artificial
  CRISPR gRNA sequence
agtattttgatgtgtgacat

SEQ ID NO: 94041 - DNA, 20 bp, Artificial
  CRISPR gRNA sequence
gtattttgatgtgtgacatc

SEQ ID NO: 94042 - DNA, 20 bp, Artificial
  CRISPR gRNA sequence
tgatgtgtgacatcacatta

SEQ ID NO: 94043 - DNA, 20 bp, Artificial
  CRISPR gRNA sequence
gatgtgtgacatcacattat

SEQ ID NO: 94044 - DNA, 20 bp, Artificial
  CRISPR gRNA sequence
atgtgtgacatcacattatt

SEQ ID NO: 94045 - DNA, 20 bp, Artificial
  CRISPR gRNA sequence
tttttagtttgcagcttagt

SEQ ID NO: 94046 - DNA, 20 bp, Artificial
  CRISPR gRNA sequence
ttagtttgcagcttagttgc

SEQ ID NO: 94047 - DNA, 20 bp, Artificial
  CRISPR gRNA sequence
tagtttgcagcttagttgca

SEQ ID NO: 94048 - DNA, 20 bp, Artificial
  CRISPR gRNA sequence
agtttgcagcttagttgcag

SEQ ID NO: 94049 - DNA, 20 bp, Artificial
  CRISPR gRNA sequence
gtttgcagcttagttgcagt

SEQ ID NO: 94050 - DNA, 20 bp, Artificial
  CRISPR gRNA sequence
gcagcttagttgcagtgcat

SEQ ID NO: 94051 - DNA, 20 bp, Artificial
  CRISPR gRNA sequence
cagcttagttgcagtgcatc

SEQ ID NO: 94052 - DNA, 20 bp, Artificial
  CRISPR gRNA sequence
agttgcagtgcatccgatgt

SEQ ID NO: 94053 - DNA, 20 bp, Artificial
  CRISPR gRNA sequence
gttgcagtgcatccgatgta

SEQ ID NO: 94054 - DNA, 20 bp, Artificial
  CRISPR gRNA sequence
cagtgcatccgatgtaaaag

SEQ ID NO: 94055 - DNA, 20 bp, Artificial
  CRISPR gRNA sequence
ttgattcaggcatattcttg

SEQ ID NO: 94056 - DNA, 20 bp, Artificial
  CRISPR gRNA sequence
tgattcaggcatattcttgt

SEQ ID NO: 94057 - DNA, 20 bp, Artificial
  CRISPR gRNA sequence
gattcaggcatattcttgtg

SEQ ID NO: 94058 - DNA, 20 bp, Artificial
  CRISPR gRNA sequence
attcaggcatattcttgtga

SEQ ID NO: 94059 - DNA, 20 bp, Artificial
  CRISPR gRNA sequence
aggcatattcttgtgaacat

SEQ ID NO: 94060 - DNA, 20 bp, Artificial
  CRISPR gRNA sequence
ttgtgaacatattgtatcat

SEQ ID NO: 94061 - DNA, 20 bp, Artificial
  CRISPR gRNA sequence
gtgaacatattgtatcatat

SEQ ID NO: 94062 - DNA, 20 bp, Artificial
  CRISPR gRNA sequence
tgaacatattgtatcatatg

SEQ ID NO: 94063 - DNA, 20 bp, Artificial
  CRISPR gRNA sequence
tatcatatgtagggacacat

SEQ ID NO: 94064 - DNA, 20 bp, Artificial
  CRISPR gRNA sequence
gcatgaaaacagtctaatga

SEQ ID NO: 94065 - DNA, 20 bp, Artificial
  CRISPR gRNA sequence
atgacatagattaatgctat

SEQ ID NO: 94066 - DNA, 20 bp, Artificial
  CRISPR gRNA sequence
atgctattaataattttttt

SEQ ID NO: 94067 - DNA, 20 bp, Artificial
  CRISPR gRNA sequence
ttaataatttttttcttttc

SEQ ID NO: 94068 - DNA, 20 bp, Artificial
  CRISPR gRNA sequence
ataatttttttcttttcttt

SEQ ID NO: 94069 - DNA, 20 bp, Artificial
  CRISPR gRNA sequence
ttttcttttctttctaagtc

SEQ ID NO: 94070 - DNA, 20 bp, Artificial
  CRISPR gRNA sequence
tttcttttctttctaagtcg

SEQ ID NO: 94071 - DNA, 20 bp, Artificial
  CRISPR gRNA sequence
ttcttttctttctaagtcgt

SEQ ID NO: 94072 - DNA, 20 bp, Artificial
  CRISPR gRNA sequence
tcttttctttctaagtcgtt

SEQ ID NO: 94073 - DNA, 20 bp, Artificial
  CRISPR gRNA sequence
cttttctttctaagtcgtta

SEQ ID NO: 94074 - DNA, 20 bp, Artificial
  CRISPR gRNA sequence
ttttctttctaagtcgttac

SEQ ID NO: 94075 - DNA, 20 bp, Artificial
  CRISPR gRNA sequence
ttctttctaagtcgttacta

SEQ ID NO: 94076 - DNA, 20 bp, Artificial
  CRISPR gRNA sequence
tctttctaagtcgttactaa

SEQ ID NO: 94077 - DNA, 20 bp, Artificial
  CRISPR gRNA sequence
ctttctaagtcgttactaag

SEQ ID NO: 94078 - DNA, 20 bp, Artificial
  CRISPR gRNA sequence
tttctaagtcgttactaaga

SEQ ID NO: 94079 - DNA, 20 bp, Artificial
  CRISPR gRNA sequence
tctaagtcgttactaagaag

SEQ ID NO: 94080 - DNA, 20 bp, Artificial
  CRISPR gRNA sequence
ctaagtcgttactaagaagt

SEQ ID NO: 94081 - DNA, 20 bp, Artificial
  CRISPR gRNA sequence
taagtcgttactaagaagtc

SEQ ID NO: 94082 - DNA, 20 bp, Artificial
  CRISPR gRNA sequence
agtcgttactaagaagtcca

SEQ ID NO: 94083 - DNA, 20 bp, Artificial
  CRISPR gRNA sequence
ctaagaagtccagaagtagt

SEQ ID NO: 94084 - DNA, 20 bp, Artificial
  CRISPR gRNA sequence
agaagtccagaagtagtgca

SEQ ID NO: 94085 - DNA, 20 bp, Artificial
  CRISPR gRNA sequence
ttacagaaacagcaacagct

SEQ ID NO: 94086 - DNA, 20 bp, Artificial
  CRISPR gRNA sequence
tacagaaacagcaacagcta

SEQ ID NO: 94087 - DNA, 20 bp, Artificial
  CRISPR gRNA sequence
acagaaacagcaacagctat

SEQ ID NO: 94088 - DNA, 20 bp, Artificial
  CRISPR gRNA sequence
cagaaacagcaacagctatt

SEQ ID NO: 94089 - DNA, 20 bp, Artificial
  CRISPR gRNA sequence
ttaaatcagcaagttttgga

SEQ ID NO: 94090 - DNA, 20 bp, Artificial
  CRISPR gRNA sequence
aatcagcaagttttggagca

SEQ ID NO: 94091 - DNA, 20 bp, Artificial
  CRISPR gRNA sequence
tggagcaaagacaacagcag

SEQ ID NO: 94092 - DNA, 20 bp, Artificial
  CRISPR gRNA sequence
ggagcaaagacaacagcagt

SEQ ID NO: 94093 - DNA, 20 bp, Artificial
  CRISPR gRNA sequence
gagcaaagacaacagcagtt

SEQ ID NO: 94094 - DNA, 20 bp, Artificial
  CRISPR gRNA sequence
ccaggaacatcaatgtgagg

SEQ ID NO: 94095 - DNA, 20 bp, Artificial
  CRISPR gRNA sequence
caggaacatcaatgtgaggg

SEQ ID NO: 94096 - DNA, 20 bp, Artificial
  CRISPR gRNA sequence
accaagaacatctacatggt

SEQ ID NO: 94097 - DNA, 20 bp, Artificial
  CRISPR gRNA sequence
ccaagaacatctacatggtt

SEQ ID NO: 94098 - DNA, 20 bp, Artificial
  CRISPR gRNA sequence
catggttttttatcttattg

SEQ ID NO: 94099 - DNA, 20 bp, Artificial
  CRISPR gRNA sequence
tttatcttattgtaatagat

SEQ ID NO: 94100 - DNA, 20 bp, Artificial
  CRISPR gRNA sequence
ttatcttattgtaatagatg

SEQ ID NO: 94101 - DNA, 20 bp, Artificial
  CRISPR gRNA sequence
tatcttattgtaatagatga

SEQ ID NO: 94102 - DNA, 20 bp, Artificial
  CRISPR gRNA sequence
atcttattgtaatagatgag

SEQ ID NO: 94103 - DNA, 20 bp, Artificial
  CRISPR gRNA sequence
tcttattgtaatagatgagc

SEQ ID NO: 94104 - DNA, 20 bp, Artificial
  CRISPR gRNA sequence
attgtaatagatgagcatat

SEQ ID NO: 94105 - DNA, 20 bp, Artificial
  CRISPR gRNA sequence
ttgtaatagatgagcatatt

SEQ ID NO: 94106 - DNA, 20 bp, Artificial
  CRISPR gRNA sequence
taatagatgagcatattttt

SEQ ID NO: 94107 - DNA, 20 bp, Artificial
  CRISPR gRNA sequence
ttttaccagacataaatggg

SEQ ID NO: 94108 - DNA, 20 bp, Artificial
  CRISPR gRNA sequence
tttaccagacataaatgggg

SEQ ID NO: 94109 - DNA, 20 bp, Artificial
  CRISPR gRNA sequence
ttaccagacataaatggggt

SEQ ID NO: 94110 - DNA, 20 bp, Artificial
  CRISPR gRNA sequence
taccagacataaatggggta

SEQ ID NO: 94111 - DNA, 20 bp, Artificial
  CRISPR gRNA sequence
accagacataaatggggtaa

SEQ ID NO: 94112 - DNA, 20 bp, Artificial
  CRISPR gRNA sequence
ccagacataaatggggtaat

SEQ ID NO: 94113 - DNA, 20 bp, Artificial
  CRISPR gRNA sequence
caggcatagattattacccc

SEQ ID NO: 94114 - DNA, 20 bp, Artificial
  CRISPR gRNA sequence
ttaccccatttatgtctggt

SEQ ID NO: 94115 - DNA, 20 bp, Artificial
  CRISPR gRNA sequence
ccccatttatgtctggtaaa

SEQ ID NO: 94116 - DNA, 20 bp, Artificial
  CRISPR gRNA sequence
atgtctggtaaaaaaatatg

SEQ ID NO: 94117 - DNA, 20 bp, Artificial
  CRISPR gRNA sequence
tgtctggtaaaaaaatatgc

SEQ ID NO: 94118 - DNA, 20 bp, Artificial
  CRISPR gRNA sequence
gtaaaaaaatatgctcatct

SEQ ID NO: 94119 - DNA, 20 bp, Artificial
  CRISPR gRNA sequence
atctattacaataagataaa

SEQ ID NO: 94120 - DNA, 20 bp, Artificial
  CRISPR gRNA sequence
ttacaataagataaaaaacc

SEQ ID NO: 94121 - DNA, 20 bp, Artificial
  CRISPR gRNA sequence
caataagataaaaaaccatg

SEQ ID NO: 94122 - DNA, 20 bp, Artificial
  CRISPR gRNA sequence
ttggtaagttccctcacatt

SEQ ID NO: 94123 - DNA, 20 bp, Artificial
  CRISPR gRNA sequence
ggtaagttccctcacattga

SEQ ID NO: 94124 - DNA, 20 bp, Artificial
  CRISPR gRNA sequence
gtaagttccctcacattgat

SEQ ID NO: 94125 - DNA, 20 bp, Artificial
  CRISPR gRNA sequence
cctcacattgatgttcctgg

SEQ ID NO: 94126 - DNA, 20 bp, Artificial
  CRISPR gRNA sequence
acattgatgttcctggaaac

SEQ ID NO: 94127 - DNA, 20 bp, Artificial
  CRISPR gRNA sequence
atgttcctggaaactgctgt

SEQ ID NO: 94128 - DNA, 20 bp, Artificial
  CRISPR gRNA sequence
ctggaaactgctgttgtctt

SEQ ID NO: 94129 - DNA, 20 bp, Artificial
  CRISPR gRNA sequence
gaaactgctgttgtctttgc

SEQ ID NO: 94130 - DNA, 20 bp, Artificial
  CRISPR gRNA sequence
ctgttgtctttgctccaaaa

SEQ ID NO: 94131 - DNA, 20 bp, Artificial
  CRISPR gRNA sequence
ttgtctttgctccaaaactt

SEQ ID NO: 94132 - DNA, 20 bp, Artificial
  CRISPR gRNA sequence
tctttgctccaaaacttgct

SEQ ID NO: 94133 - DNA, 20 bp, Artificial
  CRISPR gRNA sequence
tgctccaaaacttgctgatt

SEQ ID NO: 94134 - DNA, 20 bp, Artificial
  CRISPR gRNA sequence
gctccaaaacttgctgattt

SEQ ID NO: 94135 - DNA, 20 bp, Artificial
  CRISPR gRNA sequence
ctccaaaacttgctgattta

SEQ ID NO: 94136 - DNA, 20 bp, Artificial
  CRISPR gRNA sequence
caaaacttgctgatttaata

SEQ ID NO: 94137 - DNA, 20 bp, Artificial
  CRISPR gRNA sequence
gctgatttaatagctgttgc

SEQ ID NO: 94138 - DNA, 20 bp, Artificial
  CRISPR gRNA sequence
ctgatttaatagctgttgct

SEQ ID NO: 94139 - DNA, 20 bp, Artificial
  CRISPR gRNA sequence
atttaatagctgttgctgtt

SEQ ID NO: 94140 - DNA, 20 bp, Artificial
  CRISPR gRNA sequence
aatagctgttgctgtttctg

SEQ ID NO: 94141 - DNA, 20 bp, Artificial
  CRISPR gRNA sequence
atagctgttgctgtttctgt

SEQ ID NO: 94142 - DNA, 20 bp, Artificial
  CRISPR gRNA sequence
ttgctgtttctgtaaaaatt

SEQ ID NO: 94143 - DNA, 20 bp, Artificial
  CRISPR gRNA sequence
ctgtttctgtaaaaattgca

SEQ ID NO: 94144 - DNA, 20 bp, Artificial
  CRISPR gRNA sequence
tttctgtaaaaattgcacta

SEQ ID NO: 94145 - DNA, 20 bp, Artificial
  CRISPR gRNA sequence
ctgtaaaaattgcactactt

SEQ ID NO: 94146 - DNA, 20 bp, Artificial
  CRISPR gRNA sequence
tgtaaaaattgcactacttc

SEQ ID NO: 94147 - DNA, 20 bp, Artificial
  CRISPR gRNA sequence
taaaaattgcactacttctg

SEQ ID NO: 94148 - DNA, 20 bp, Artificial
  CRISPR gRNA sequence
cactacttctggacttctta

SEQ ID NO: 94149 - DNA, 20 bp, Artificial
  CRISPR gRNA sequence
cttctggacttcttagtaac

SEQ ID NO: 94150 - DNA, 20 bp, Artificial
  CRISPR gRNA sequence
ctggacttcttagtaacgac

SEQ ID NO: 94151 - DNA, 20 bp, Artificial
  CRISPR gRNA sequence
tggacttcttagtaacgact

SEQ ID NO: 94152 - DNA, 20 bp, Artificial
  CRISPR gRNA sequence
gacttcttagtaacgactta

SEQ ID NO: 94153 - DNA, 20 bp, Artificial
  CRISPR gRNA sequence
cttagtaacgacttagaaag

SEQ ID NO: 94154 - DNA, 20 bp, Artificial
  CRISPR gRNA sequence
ttagtaacgacttagaaaga

SEQ ID NO: 94155 - DNA, 20 bp, Artificial
  CRISPR gRNA sequence
agtaacgacttagaaagaaa

SEQ ID NO: 94156 - DNA, 20 bp, Artificial
  CRISPR gRNA sequence
gtaacgacttagaaagaaaa

SEQ ID NO: 94157 - DNA, 20 bp, Artificial
  CRISPR gRNA sequence
agaaagaaaagaaaaaaatt

SEQ ID NO: 94158 - DNA, 20 bp, Artificial
  CRISPR gRNA sequence
gaaagaaaagaaaaaaatta

SEQ ID NO: 94159 - DNA, 20 bp, Artificial
  CRISPR gRNA sequence
ttaatagcattaatctatgt

SEQ ID NO: 94160 - DNA, 20 bp, Artificial
  CRISPR gRNA sequence
atagcattaatctatgtcat

SEQ ID NO: 94161 - DNA, 20 bp, Artificial
  CRISPR gRNA sequence
atctatgtcattagactgtt

SEQ ID NO: 94162 - DNA, 20 bp, Artificial
  CRISPR gRNA sequence
tgtcattagactgttttcat

SEQ ID NO: 94163 - DNA, 20 bp, Artificial
  CRISPR gRNA sequence
gactgttttcatgctaatta

SEQ ID NO: 94164 - DNA, 20 bp, Artificial
  CRISPR gRNA sequence
ttttcatgctaattactctg

SEQ ID NO: 94165 - DNA, 20 bp, Artificial
  CRISPR gRNA sequence
tcatgctaattactctgatg

SEQ ID NO: 94166 - DNA, 20 bp, Artificial
  CRISPR gRNA sequence
catgctaattactctgatgt

SEQ ID NO: 94167 - DNA, 20 bp, Artificial
  CRISPR gRNA sequence
atgctaattactctgatgtg

SEQ ID NO: 94168 - DNA, 20 bp, Artificial
  CRISPR gRNA sequence
attactctgatgtgtcccta

SEQ ID NO: 94169 - DNA, 20 bp, Artificial
  CRISPR gRNA sequence
ctctgatgtgtccctacata

SEQ ID NO: 94170 - DNA, 20 bp, Artificial
  CRISPR gRNA sequence
tgatgtgtccctacatatga

SEQ ID NO: 94171 - DNA, 20 bp, Artificial
  CRISPR gRNA sequence
atgtgtccctacatatgata

SEQ ID NO: 94172 - DNA, 20 bp, Artificial
  CRISPR gRNA sequence
catatgatacaatatgttca

SEQ ID NO: 94173 - DNA, 20 bp, Artificial
  CRISPR gRNA sequence
acaagaatatgcctgaatca

SEQ ID NO: 94174 - DNA, 20 bp, Artificial
  CRISPR gRNA sequence
aatcaaaagcacttttacat

SEQ ID NO: 94175 - DNA, 20 bp, Artificial
  CRISPR gRNA sequence
ttacatcggatgcactgcaa

SEQ ID NO: 94176 - DNA, 20 bp, Artificial
  CRISPR gRNA sequence
tacatcggatgcactgcaac

SEQ ID NO: 94177 - DNA, 20 bp, Artificial
  CRISPR gRNA sequence
acatcggatgcactgcaact

SEQ ID NO: 94178 - DNA, 20 bp, Artificial
  CRISPR gRNA sequence
catcggatgcactgcaacta

SEQ ID NO: 94179 - DNA, 20 bp, Artificial
  CRISPR gRNA sequence
caactaagctgcaaactaaa

SEQ ID NO: 94180 - DNA, 20 bp, Artificial
  CRISPR gRNA sequence
agctgcaaactaaaaataat

SEQ ID NO: 94181 - DNA, 20 bp, Artificial
  CRISPR gRNA sequence
caaactaaaaataatgtgat

SEQ ID NO: 94182 - DNA, 20 bp, Artificial
  CRISPR gRNA sequence
aaaataatgtgatgtcacac

SEQ ID NO: 94183 - DNA, 20 bp, Artificial
  CRISPR gRNA sequence
aaacctaaaaataacgggtg

SEQ ID NO: 94184 - DNA, 20 bp, Artificial
  CRISPR gRNA sequence
aaaataacgggtgaagtctg

SEQ ID NO: 94185 - DNA, 20 bp, Artificial
  CRISPR gRNA sequence
ttattggtgactttgtgtaa

SEQ ID NO: 94186 - DNA, 20 bp, Artificial
  CRISPR gRNA sequence
ttggtgactttgtgtaaaaa

SEQ ID NO: 94187 - DNA, 20 bp, Artificial
  CRISPR gRNA sequence
gtgactttgtgtaaaaagga

SEQ ID NO: 94188 - DNA, 20 bp, Artificial
  CRISPR gRNA sequence
tgtgtaaaaaggaaacacct

SEQ ID NO: 94189 - DNA, 20 bp, Artificial
  CRISPR gRNA sequence
gtgtaaaaaggaaacacctt

SEQ ID NO: 94190 - DNA, 20 bp, Artificial
  CRISPR gRNA sequence
tgtaaaaaggaaacaccttc

SEQ ID NO: 94191 - DNA, 20 bp, Artificial
  CRISPR gRNA sequence
ctctaatatgccagcaaata

SEQ ID NO: 94192 - DNA, 20 bp, Artificial
  CRISPR gRNA sequence
tctaatatgccagcaaatat

SEQ ID NO: 94193 - DNA, 20 bp, Artificial
  CRISPR gRNA sequence
taatatgccagcaaatatac

SEQ ID NO: 94194 - DNA, 20 bp, Artificial
  CRISPR gRNA sequence
atatgccagcaaatatactc

SEQ ID NO: 94195 - DNA, 20 bp, Artificial
  CRISPR gRNA sequence
tcttgaaatatgtaagaaca

SEQ ID NO: 94196 - DNA, 20 bp, Artificial
  CRISPR gRNA sequence
ttgaaatatgtaagaacaaa

SEQ ID NO: 94197 - DNA, 20 bp, Artificial
  CRISPR gRNA sequence
gaaatatgtaagaacaaaga

SEQ ID NO: 94198 - DNA, 20 bp, Artificial
  CRISPR gRNA sequence
aaatatgtaagaacaaagag

SEQ ID NO: 94199 - DNA, 20 bp, Artificial
  CRISPR gRNA sequence
aaagtagcactgacccagga

SEQ ID NO: 94200 - DNA, 20 bp, Artificial
  CRISPR gRNA sequence
acccaggattatagcaagaa

SEQ ID NO: 94201 - DNA, 20 bp, Artificial
  CRISPR gRNA sequence
tagcaagaaaaaaaatggag

SEQ ID NO: 94202 - DNA, 20 bp, Artificial
  CRISPR gRNA sequence
aatgccagtttgtacataca

SEQ ID NO: 94203 - DNA, 20 bp, Artificial
  CRISPR gRNA sequence
gtacatacatacaaactagt

SEQ ID NO: 94204 - DNA, 20 bp, Artificial
  CRISPR gRNA sequence
tacatacatacaaactagtg

SEQ ID NO: 94205 - DNA, 20 bp, Artificial
  CRISPR gRNA sequence
gtgctagaagtcaagtttct

SEQ ID NO: 94206 - DNA, 20 bp, Artificial
  CRISPR gRNA sequence
gaagtcaagtttctcattag

SEQ ID NO: 94207 - DNA, 20 bp, Artificial
  CRISPR gRNA sequence
ctcattaggcaactaagtct

SEQ ID NO: 94208 - DNA, 20 bp, Artificial
  CRISPR gRNA sequence
tcattaggcaactaagtctt

SEQ ID NO: 94209 - DNA, 20 bp, Artificial
  CRISPR gRNA sequence
attaggcaactaagtcttca

SEQ ID NO: 94210 - DNA, 20 bp, Artificial
  CRISPR gRNA sequence
ggcaactaagtcttcataaa

SEQ ID NO: 94211 - DNA, 20 bp, Artificial
  CRISPR gRNA sequence
agtcttcataaagaaattaa

SEQ ID NO: 94212 - DNA, 20 bp, Artificial
  CRISPR gRNA sequence
cataaagaaattaaaaattg

SEQ ID NO: 94213 - DNA, 20 bp, Artificial
  CRISPR gRNA sequence
ataaagaaattaaaaattgt

SEQ ID NO: 94214 - DNA, 20 bp, Artificial
  CRISPR gRNA sequence
aaaattgtgtgtataggtgt

SEQ ID NO: 94215 - DNA, 20 bp, Artificial
  CRISPR gRNA sequence
tgtgtataggtgtgtatata

SEQ ID NO: 94216 - DNA, 20 bp, Artificial
  CRISPR gRNA sequence
caggaaaaaatataactgct

SEQ ID NO: 94217 - DNA, 20 bp, Artificial
  CRISPR gRNA sequence
aggaaaaaatataactgctc

SEQ ID NO: 94218 - DNA, 20 bp, Artificial
  CRISPR gRNA sequence
ctctaaaacatccaatacct

SEQ ID NO: 94219 - DNA, 20 bp, Artificial
  CRISPR gRNA sequence
taaaacatccaatacctttt

SEQ ID NO: 94220 - DNA, 20 bp, Artificial
  CRISPR gRNA sequence
aaacatccaatacctttttg

SEQ ID NO: 94221 - DNA, 20 bp, Artificial
  CRISPR gRNA sequence
tttgtacactcatcacttta

SEQ ID NO: 94222 - DNA, 20 bp, Artificial
  CRISPR gRNA sequence
ttgtacactcatcactttaa

SEQ ID NO: 94223 - DNA, 20 bp, Artificial
  CRISPR gRNA sequence
tgtacactcatcactttaaa

SEQ ID NO: 94224 - DNA, 20 bp, Artificial
  CRISPR gRNA sequence
gtacactcatcactttaaaa

SEQ ID NO: 94225 - DNA, 20 bp, Artificial
  CRISPR gRNA sequence
tacactcatcactttaaaat

SEQ ID NO: 94226 - DNA, 20 bp, Artificial
  CRISPR gRNA sequence
atcactttaaaatatagttg

SEQ ID NO: 94227 - DNA, 20 bp, Artificial
  CRISPR gRNA sequence
taaaatatagttgtaataat

SEQ ID NO: 94228 - DNA, 20 bp, Artificial
  CRISPR gRNA sequence
aaaatatagttgtaataata

SEQ ID NO: 94229 - DNA, 20 bp, Artificial
  CRISPR gRNA sequence
aaatatagttgtaataatat

SEQ ID NO: 94230 - DNA, 20 bp, Artificial
  CRISPR gRNA sequence
taataatataacaaatataa

SEQ ID NO: 94231 - DNA, 20 bp, Artificial
  CRISPR gRNA sequence
tgattaacatattattatta

SEQ ID NO: 94232 - DNA, 20 bp, Artificial
  CRISPR gRNA sequence
acatattattattagagaca

SEQ ID NO: 94233 - DNA, 20 bp, Artificial
  CRISPR gRNA sequence
ttattagagacagggtctca

SEQ ID NO: 94234 - DNA, 20 bp, Artificial
  CRISPR gRNA sequence
ttagagacagggtctcactc

SEQ ID NO: 94235 - DNA, 20 bp, Artificial
  CRISPR gRNA sequence
gagacagggtctcactctgt

SEQ ID NO: 94236 - DNA, 20 bp, Artificial
  CRISPR gRNA sequence
actctgttccccacgctgga

SEQ ID NO: 94237 - DNA, 20 bp, Artificial
  CRISPR gRNA sequence
tgttccccacgctggagtgc

SEQ ID NO: 94238 - DNA, 20 bp, Artificial
  CRISPR gRNA sequence
ttccccacgctggagtgcag

SEQ ID NO: 94239 - DNA, 20 bp, Artificial
  CRISPR gRNA sequence
cccacgctggagtgcagtgg

SEQ ID NO: 94240 - DNA, 20 bp, Artificial
  CRISPR gRNA sequence
gagtgcagtggcgtgagcat

SEQ ID NO: 94241 - DNA, 20 bp, Artificial
  CRISPR gRNA sequence
actgcagtcttgaactcctc

SEQ ID NO: 94242 - DNA, 20 bp, Artificial
  CRISPR gRNA sequence
cagtcttgaactcctcggct

SEQ ID NO: 94243 - DNA, 20 bp, Artificial
  CRISPR gRNA sequence
gaactcctcggctcaagcaa

SEQ ID NO: 94244 - DNA, 20 bp, Artificial
  CRISPR gRNA sequence
aactcctcggctcaagcaat

SEQ ID NO: 94245 - DNA, 20 bp, Artificial
  CRISPR gRNA sequence
ctcggctcaagcaatcatcc

SEQ ID NO: 94246 - DNA, 20 bp, Artificial
  CRISPR gRNA sequence
ggctcaagcaatcatcctgc

SEQ ID NO: 94247 - DNA, 20 bp, Artificial
  CRISPR gRNA sequence
aagcaatcatcctgccacag

SEQ ID NO: 94248 - DNA, 20 bp, Artificial
  CRISPR gRNA sequence
ccacagtctcctgtaatagg

SEQ ID NO: 94249 - DNA, 20 bp, Artificial
  CRISPR gRNA sequence
ctgtaataggtttttataat

SEQ ID NO: 94250 - DNA, 20 bp, Artificial
  CRISPR gRNA sequence
taataggtttttataataaa

SEQ ID NO: 94251 - DNA, 20 bp, Artificial
  CRISPR gRNA sequence
ttataataaaatacttacat

SEQ ID NO: 94252 - DNA, 20 bp, Artificial
  CRISPR gRNA sequence
tataataaaatacttacata

SEQ ID NO: 94253 - DNA, 20 bp, Artificial
  CRISPR gRNA sequence
ataataaaatacttacataa

SEQ ID NO: 94254 - DNA, 20 bp, Artificial
  CRISPR gRNA sequence
taataaaatacttacataaa

SEQ ID NO: 94255 - DNA, 20 bp, Artificial
  CRISPR gRNA sequence
acataaatttatagagaaaa

SEQ ID NO: 94256 - DNA, 20 bp, Artificial
  CRISPR gRNA sequence
cataaatttatagagaaaaa

SEQ ID NO: 94257 - DNA, 20 bp, Artificial
  CRISPR gRNA sequence
atagagaaaaaaatctttgg

SEQ ID NO: 94258 - DNA, 20 bp, Artificial
  CRISPR gRNA sequence
tagagaaaaaaatctttggc

SEQ ID NO: 94259 - DNA, 20 bp, Artificial
  CRISPR gRNA sequence
tggccccaataagctgcaaa

SEQ ID NO: 94260 - DNA, 20 bp, Artificial
  CRISPR gRNA sequence
ggccccaataagctgcaaaa

SEQ ID NO: 94261 - DNA, 20 bp, Artificial
  CRISPR gRNA sequence
gccccaataagctgcaaaaa

SEQ ID NO: 94262 - DNA, 20 bp, Artificial
  CRISPR gRNA sequence
caaaaagataaactgaataa

SEQ ID NO: 94263 - DNA, 20 bp, Artificial
  CRISPR gRNA sequence
aataaagtgaacatactatc

SEQ ID NO: 94264 - DNA, 20 bp, Artificial
  CRISPR gRNA sequence
tcattaaatactgactttca

SEQ ID NO: 94265 - DNA, 20 bp, Artificial
  CRISPR gRNA sequence
aatactgactttcagattat

SEQ ID NO: 94266 - DNA, 20 bp, Artificial
  CRISPR gRNA sequence
actttcagattatatgtatt

SEQ ID NO: 94267 - DNA, 20 bp, Artificial
  CRISPR gRNA sequence
tcagattatatgtattatat

SEQ ID NO: 94268 - DNA, 20 bp, Artificial
  CRISPR gRNA sequence
cagattatatgtattatatc

SEQ ID NO: 94269 - DNA, 20 bp, Artificial
  CRISPR gRNA sequence
agattatatgtattatatct

SEQ ID NO: 94270 - DNA, 20 bp, Artificial
  CRISPR gRNA sequence
tatgtattatatcttagtac

SEQ ID NO: 94271 - DNA, 20 bp, Artificial
  CRISPR gRNA sequence
tatcttagtacattttctat

SEQ ID NO: 94272 - DNA, 20 bp, Artificial
  CRISPR gRNA sequence
agtacattttctatttatta

SEQ ID NO: 94273 - DNA, 20 bp, Artificial
  CRISPR gRNA sequence
gtacattttctatttattaa

SEQ ID NO: 94274 - DNA, 20 bp, Artificial
  CRISPR gRNA sequence
tctatttattaaacagtttt

SEQ ID NO: 94275 - DNA, 20 bp, Artificial
  CRISPR gRNA sequence
ctatttattaaacagtttta

SEQ ID NO: 94276 - DNA, 20 bp, Artificial
  CRISPR gRNA sequence
tatttattaaacagttttat

SEQ ID NO: 94277 - DNA, 20 bp, Artificial
  CRISPR gRNA sequence
tttattaaacagttttattt

SEQ ID NO: 94278 - DNA, 20 bp, Artificial
  CRISPR gRNA sequence
attaaacagttttatttaaa

SEQ ID NO: 94279 - DNA, 20 bp, Artificial
  CRISPR gRNA sequence
ttaaacagttttatttaaaa

SEQ ID NO: 94280 - DNA, 20 bp, Artificial
  CRISPR gRNA sequence
aacagttttatttaaaaatc

SEQ ID NO: 94281 - DNA, 20 bp, Artificial
  CRISPR gRNA sequence
tatttaaaaatcatcttagc

SEQ ID NO: 94282 - DNA, 20 bp, Artificial
  CRISPR gRNA sequence
atttaaaaatcatcttagct

SEQ ID NO: 94283 - DNA, 20 bp, Artificial
  CRISPR gRNA sequence
tttaaaaatcatcttagctg

SEQ ID NO: 94284 - DNA, 20 bp, Artificial
  CRISPR gRNA sequence
aaaaatcatcttagctgtta

SEQ ID NO: 94285 - DNA, 20 bp, Artificial
  CRISPR gRNA sequence
aaaatcatcttagctgttat

SEQ ID NO: 94286 - DNA, 20 bp, Artificial
  CRISPR gRNA sequence
agctgttatgacactgttgg

SEQ ID NO: 94287 - DNA, 20 bp, Artificial
  CRISPR gRNA sequence
gctgttatgacactgttgga

SEQ ID NO: 94288 - DNA, 20 bp, Artificial
  CRISPR gRNA sequence
ttatgacactgttggacatt

SEQ ID NO: 94289 - DNA, 20 bp, Artificial
  CRISPR gRNA sequence
tgacactgttggacatttag

SEQ ID NO: 94290 - DNA, 20 bp, Artificial
  CRISPR gRNA sequence
ttggacatttaggctgtttc

SEQ ID NO: 94291 - DNA, 20 bp, Artificial
  CRISPR gRNA sequence
gacatttaggctgtttcaac

SEQ ID NO: 94292 - DNA, 20 bp, Artificial
  CRISPR gRNA sequence
aggctgtttcaactaccttt

SEQ ID NO: 94293 - DNA, 20 bp, Artificial
  CRISPR gRNA sequence
ggctgtttcaactacctttt

SEQ ID NO: 94294 - DNA, 20 bp, Artificial
  CRISPR gRNA sequence
tttcaactaccttttttact

SEQ ID NO: 94295 - DNA, 20 bp, Artificial
  CRISPR gRNA sequence
caactaccttttttactatt

SEQ ID NO: 94296 - DNA, 20 bp, Artificial
  CRISPR gRNA sequence
aactaccttttttactattt

SEQ ID NO: 94297 - DNA, 20 bp, Artificial
  CRISPR gRNA sequence
ccttttttactatttatgag

SEQ ID NO: 94298 - DNA, 20 bp, Artificial
  CRISPR gRNA sequence
ttttactatttatgagaaat

SEQ ID NO: 94299 - DNA, 20 bp, Artificial
  CRISPR gRNA sequence
tttactatttatgagaaata

SEQ ID NO: 94300 - DNA, 20 bp, Artificial
  CRISPR gRNA sequence
ttactatttatgagaaatat

SEQ ID NO: 94301 - DNA, 20 bp, Artificial
  CRISPR gRNA sequence
tactatttatgagaaatata

SEQ ID NO: 94302 - DNA, 20 bp, Artificial
  CRISPR gRNA sequence
actatttatgagaaatatat

SEQ ID NO: 94303 - DNA, 20 bp, Artificial
  CRISPR gRNA sequence
ctatttatgagaaatatatt

SEQ ID NO: 94304 - DNA, 20 bp, Artificial
  CRISPR gRNA sequence
tttatgagaaatatattcct

SEQ ID NO: 94305 - DNA, 20 bp, Artificial
  CRISPR gRNA sequence
atgagaaatatattcctggc

SEQ ID NO: 94306 - DNA, 20 bp, Artificial
  CRISPR gRNA sequence
tgagaaatatattcctggca

SEQ ID NO: 94307 - DNA, 20 bp, Artificial
  CRISPR gRNA sequence
ctggcaatacctttatgttt

SEQ ID NO: 94308 - DNA, 20 bp, Artificial
  CRISPR gRNA sequence
gcaatacctttatgtttaac

SEQ ID NO: 94309 - DNA, 20 bp, Artificial
  CRISPR gRNA sequence
tatgtttaactctatccata

SEQ ID NO: 94310 - DNA, 20 bp, Artificial
  CRISPR gRNA sequence
atgtttaactctatccatat

SEQ ID NO: 94311 - DNA, 20 bp, Artificial
  CRISPR gRNA sequence
tgtttaactctatccatatt

SEQ ID NO: 94312 - DNA, 20 bp, Artificial
  CRISPR gRNA sequence
aactctatccatatttagga

SEQ ID NO: 94313 - DNA, 20 bp, Artificial
  CRISPR gRNA sequence
actctatccatatttaggat

SEQ ID NO: 94314 - DNA, 20 bp, Artificial
  CRISPR gRNA sequence
tatccatatttaggatttac

SEQ ID NO: 94315 - DNA, 20 bp, Artificial
  CRISPR gRNA sequence
tccatatttaggatttacat

SEQ ID NO: 94316 - DNA, 20 bp, Artificial
  CRISPR gRNA sequence
aggatttacattctgtaaat

SEQ ID NO: 94317 - DNA, 20 bp, Artificial
  CRISPR gRNA sequence
ggatttacattctgtaaatg

SEQ ID NO: 94318 - DNA, 20 bp, Artificial
  CRISPR gRNA sequence
acattctgtaaatgtcttca

SEQ ID NO: 94319 - DNA, 20 bp, Artificial
  CRISPR gRNA sequence
cattctgtaaatgtcttcat

SEQ ID NO: 94320 - DNA, 20 bp, Artificial
  CRISPR gRNA sequence
tgtaaatgtcttcatattaa

SEQ ID NO: 94321 - DNA, 20 bp, Artificial
  CRISPR gRNA sequence
taaatgtcttcatattaaat

SEQ ID NO: 94322 - DNA, 20 bp, Artificial
  CRISPR gRNA sequence
catattaaatgtgatgtctg

SEQ ID NO: 94323 - DNA, 20 bp, Artificial
  CRISPR gRNA sequence
atattaaatgtgatgtctga

SEQ ID NO: 94324 - DNA, 20 bp, Artificial
  CRISPR gRNA sequence
aatgtgatgtctgagttgaa

SEQ ID NO: 94325 - DNA, 20 bp, Artificial
  CRISPR gRNA sequence
agttgaaagggatgactcct

SEQ ID NO: 94326 - DNA, 20 bp, Artificial
  CRISPR gRNA sequence
aaagggatgactcctggtac

SEQ ID NO: 94327 - DNA, 20 bp, Artificial
  CRISPR gRNA sequence
ctggtacatattgcccaact

SEQ ID NO: 94328 - DNA, 20 bp, Artificial
  CRISPR gRNA sequence
gtacatattgcccaactgct

SEQ ID NO: 94329 - DNA, 20 bp, Artificial
  CRISPR gRNA sequence
cccaactgctttctgaaagt

SEQ ID NO: 94330 - DNA, 20 bp, Artificial
  CRISPR gRNA sequence
ctttctgaaagtgccatacc

SEQ ID NO: 94331 - DNA, 20 bp, Artificial
  CRISPR gRNA sequence
tctgaaagtgccataccaat

SEQ ID NO: 94332 - DNA, 20 bp, Artificial
  CRISPR gRNA sequence
ctgaaagtgccataccaata

SEQ ID NO: 94333 - DNA, 20 bp, Artificial
  CRISPR gRNA sequence
tgaaagtgccataccaatat

SEQ ID NO: 94334 - DNA, 20 bp, Artificial
  CRISPR gRNA sequence
aaagtgccataccaatatat

SEQ ID NO: 94335 - DNA, 20 bp, Artificial
  CRISPR gRNA sequence
actacttgagaatgtccatt

SEQ ID NO: 94336 - DNA, 20 bp, Artificial
  CRISPR gRNA sequence
cttgagaatgtccatttcat

SEQ ID NO: 94337 - DNA, 20 bp, Artificial
  CRISPR gRNA sequence
gagaatgtccatttcatgaa

SEQ ID NO: 94338 - DNA, 20 bp, Artificial
  CRISPR gRNA sequence
agaatgtccatttcatgaaa

SEQ ID NO: 94339 - DNA, 20 bp, Artificial
  CRISPR gRNA sequence
catgaaagtctccacatcac

SEQ ID NO: 94340 - DNA, 20 bp, Artificial
  CRISPR gRNA sequence
atgaaagtctccacatcact

SEQ ID NO: 94341 - DNA, 20 bp, Artificial
  CRISPR gRNA sequence
cacatcactgcatcattgtg

SEQ ID NO: 94342 - DNA, 20 bp, Artificial
  CRISPR gRNA sequence
catcattgtgcgtaatcgtt

SEQ ID NO: 94343 - DNA, 20 bp, Artificial
  CRISPR gRNA sequence
tgcgtaatcgtttaaataat

SEQ ID NO: 94344 - DNA, 20 bp, Artificial
  CRISPR gRNA sequence
aaataattttcactttttgt

SEQ ID NO: 94345 - DNA, 20 bp, Artificial
  CRISPR gRNA sequence
aataattttcactttttgtt

SEQ ID NO: 94346 - DNA, 20 bp, Artificial
  CRISPR gRNA sequence
tcactttttgtttattttta

SEQ ID NO: 94347 - DNA, 20 bp, Artificial
  CRISPR gRNA sequence
cactttttgtttatttttac

SEQ ID NO: 94348 - DNA, 20 bp, Artificial
  CRISPR gRNA sequence
actttttgtttatttttact

SEQ ID NO: 94349 - DNA, 20 bp, Artificial
  CRISPR gRNA sequence
tttgtttatttttactgata

SEQ ID NO: 94350 - DNA, 20 bp, Artificial
  CRISPR gRNA sequence
ttgtttatttttactgatat

SEQ ID NO: 94351 - DNA, 20 bp, Artificial
  CRISPR gRNA sequence
tgtttatttttactgatatt

SEQ ID NO: 94352 - DNA, 20 bp, Artificial
  CRISPR gRNA sequence
gtttatttttactgatattg

SEQ ID NO: 94353 - DNA, 20 bp, Artificial
  CRISPR gRNA sequence
tttatttttactgatattga

SEQ ID NO: 94354 - DNA, 20 bp, Artificial
  CRISPR gRNA sequence
atttttactgatattgaata

SEQ ID NO: 94355 - DNA, 20 bp, Artificial
  CRISPR gRNA sequence
tttttactgatattgaatac

SEQ ID NO: 94356 - DNA, 20 bp, Artificial
  CRISPR gRNA sequence
ttactgatattgaatacctt

SEQ ID NO: 94357 - DNA, 20 bp, Artificial
  CRISPR gRNA sequence
tactgatattgaataccttt

SEQ ID NO: 94358 - DNA, 20 bp, Artificial
  CRISPR gRNA sequence
actgatattgaatacctttc

SEQ ID NO: 94359 - DNA, 20 bp, Artificial
  CRISPR gRNA sequence
ctgatattgaatacctttcc

SEQ ID NO: 94360 - DNA, 20 bp, Artificial
  CRISPR gRNA sequence
atattgaatacctttccata

SEQ ID NO: 94361 - DNA, 20 bp, Artificial
  CRISPR gRNA sequence
aatacctttccatatcattt

SEQ ID NO: 94362 - DNA, 20 bp, Artificial
  CRISPR gRNA sequence
tccatatcatttaatggtat

SEQ ID NO: 94363 - DNA, 20 bp, Artificial
  CRISPR gRNA sequence
ccatatcatttaatggtatt

SEQ ID NO: 94364 - DNA, 20 bp, Artificial
  CRISPR gRNA sequence
catatcatttaatggtattc

SEQ ID NO: 94365 - DNA, 20 bp, Artificial
  CRISPR gRNA sequence
aatggtattctgcctttttt

SEQ ID NO: 94366 - DNA, 20 bp, Artificial
  CRISPR gRNA sequence
atggtattctgccttttttt

SEQ ID NO: 94367 - DNA, 20 bp, Artificial
  CRISPR gRNA sequence
tgccttttttttctgtttct

SEQ ID NO: 94368 - DNA, 20 bp, Artificial
  CRISPR gRNA sequence
ccttttttttctgtttctat

SEQ ID NO: 94369 - DNA, 20 bp, Artificial
  CRISPR gRNA sequence
ttttttctgtttctatcttt

SEQ ID NO: 94370 - DNA, 20 bp, Artificial
  CRISPR gRNA sequence
tttttctgtttctatctttt

SEQ ID NO: 94371 - DNA, 20 bp, Artificial
  CRISPR gRNA sequence
ttttctgtttctatcttttg

SEQ ID NO: 94372 - DNA, 20 bp, Artificial
  CRISPR gRNA sequence
tttctgtttctatcttttgc

SEQ ID NO: 94373 - DNA, 20 bp, Artificial
  CRISPR gRNA sequence
ttctgtttctatcttttgca

SEQ ID NO: 94374 - DNA, 20 bp, Artificial
  CRISPR gRNA sequence
tctgtttctatcttttgcaa

SEQ ID NO: 94375 - DNA, 20 bp, Artificial
  CRISPR gRNA sequence
ctgtttctatcttttgcaat

SEQ ID NO: 94376 - DNA, 20 bp, Artificial
  CRISPR gRNA sequence
tgtttctatcttttgcaatg

SEQ ID NO: 94377 - DNA, 20 bp, Artificial
  CRISPR gRNA sequence
tttctatcttttgcaatgta

SEQ ID NO: 94378 - DNA, 20 bp, Artificial
  CRISPR gRNA sequence
ctatcttttgcaatgtattg

SEQ ID NO: 94379 - DNA, 20 bp, Artificial
  CRISPR gRNA sequence
tatcttttgcaatgtattga

SEQ ID NO: 94380 - DNA, 20 bp, Artificial
  CRISPR gRNA sequence
tcttttgcaatgtattgaag

SEQ ID NO: 94381 - DNA, 20 bp, Artificial
  CRISPR gRNA sequence
ttgcaatgtattgaagccaa

SEQ ID NO: 94382 - DNA, 20 bp, Artificial
  CRISPR gRNA sequence
tgcaatgtattgaagccaaa

SEQ ID NO: 94383 - DNA, 20 bp, Artificial
  CRISPR gRNA sequence
gcaatgtattgaagccaaag

SEQ ID NO: 94384 - DNA, 20 bp, Artificial
  CRISPR gRNA sequence
caatgtattgaagccaaagg

SEQ ID NO: 94385 - DNA, 20 bp, Artificial
  CRISPR gRNA sequence
aagccaaaggttttcctcat

SEQ ID NO: 94386 - DNA, 20 bp, Artificial
  CRISPR gRNA sequence
tcctcatcaaattacaggaa

SEQ ID NO: 94387 - DNA, 20 bp, Artificial
  CRISPR gRNA sequence
cctcatcaaattacaggaat

SEQ ID NO: 94388 - DNA, 20 bp, Artificial
  CRISPR gRNA sequence
ctcatcaaattacaggaatt

SEQ ID NO: 94389 - DNA, 20 bp, Artificial
  CRISPR gRNA sequence
atcaaattacaggaattttt

SEQ ID NO: 94390 - DNA, 20 bp, Artificial
  CRISPR gRNA sequence
caggaatttttgtaataaac

SEQ ID NO: 94391 - DNA, 20 bp, Artificial
  CRISPR gRNA sequence
ttgtaataaactttctttgc

SEQ ID NO: 94392 - DNA, 20 bp, Artificial
  CRISPR gRNA sequence
tgtaataaactttctttgca

SEQ ID NO: 94393 - DNA, 20 bp, Artificial
  CRISPR gRNA sequence
gtaataaactttctttgcag

SEQ ID NO: 94394 - DNA, 20 bp, Artificial
  CRISPR gRNA sequence
taataaactttctttgcagt

SEQ ID NO: 94395 - DNA, 20 bp, Artificial
  CRISPR gRNA sequence
tctttgcagttaagactgaa

SEQ ID NO: 94396 - DNA, 20 bp, Artificial
  CRISPR gRNA sequence
ctttgcagttaagactgaag

SEQ ID NO: 94397 - DNA, 20 bp, Artificial
  CRISPR gRNA sequence
tttgcagttaagactgaagc

SEQ ID NO: 94398 - DNA, 20 bp, Artificial
  CRISPR gRNA sequence
tgcagttaagactgaagctg

SEQ ID NO: 94399 - DNA, 20 bp, Artificial
  CRISPR gRNA sequence
gcagttaagactgaagctgt

SEQ ID NO: 94400 - DNA, 20 bp, Artificial
  CRISPR gRNA sequence
cagttaagactgaagctgtc

SEQ ID NO: 94401 - DNA, 20 bp, Artificial
  CRISPR gRNA sequence
agactgaagctgtcaaagag

SEQ ID NO: 94402 - DNA, 20 bp, Artificial
  CRISPR gRNA sequence
aagctgtcaaagaggcaaac

SEQ ID NO: 94403 - DNA, 20 bp, Artificial
  CRISPR gRNA sequence
tcaaagaggcaaacatattt

SEQ ID NO: 94404 - DNA, 20 bp, Artificial
  CRISPR gRNA sequence
tatatatatgtaaggaaact

SEQ ID NO: 94405 - DNA, 20 bp, Artificial
  CRISPR gRNA sequence
atatatatgtaaggaaactg

SEQ ID NO: 94406 - DNA, 20 bp, Artificial
  CRISPR gRNA sequence
tatatatgtaaggaaactga

SEQ ID NO: 94407 - DNA, 20 bp, Artificial
  CRISPR gRNA sequence
atcatgtttaatgatttata

SEQ ID NO: 94408 - DNA, 20 bp, Artificial
  CRISPR gRNA sequence
aatgatttatagggtgctct

SEQ ID NO: 94409 - DNA, 20 bp, Artificial
  CRISPR gRNA sequence
atgatttatagggtgctctg

SEQ ID NO: 94410 - DNA, 20 bp, Artificial
  CRISPR gRNA sequence
atagggtgctctgttgccta

SEQ ID NO: 94411 - DNA, 20 bp, Artificial
  CRISPR gRNA sequence
tagggtgctctgttgcctag

SEQ ID NO: 94412 - DNA, 20 bp, Artificial
  CRISPR gRNA sequence
tgttgcctaggctggagtac

SEQ ID NO: 94413 - DNA, 20 bp, Artificial
  CRISPR gRNA sequence
ttgcctaggctggagtacag

SEQ ID NO: 94414 - DNA, 20 bp, Artificial
  CRISPR gRNA sequence
cctaggctggagtacagtgg

SEQ ID NO: 94415 - DNA, 20 bp, Artificial
  CRISPR gRNA sequence
ggctggagtacagtggtatg

SEQ ID NO: 94416 - DNA, 20 bp, Artificial
  CRISPR gRNA sequence
gagtacagtggtatgatcat

SEQ ID NO: 94417 - DNA, 20 bp, Artificial
  CRISPR gRNA sequence
attgcagcctcgaattcctg

SEQ ID NO: 94418 - DNA, 20 bp, Artificial
  CRISPR gRNA sequence
cagcctcgaattcctggact

SEQ ID NO: 94419 - DNA, 20 bp, Artificial
  CRISPR gRNA sequence
gaattcctggactcaagcaa

SEQ ID NO: 94420 - DNA, 20 bp, Artificial
  CRISPR gRNA sequence
ctggactcaagcaatcctcc

SEQ ID NO: 94421 - DNA, 20 bp, Artificial
  CRISPR gRNA sequence
gactcaagcaatcctcctgt

SEQ ID NO: 94422 - DNA, 20 bp, Artificial
  CRISPR gRNA sequence
aagcaatcctcctgtttcag

SEQ ID NO: 94423 - DNA, 20 bp, Artificial
  CRISPR gRNA sequence
ctgtttcagcctcttgagta

SEQ ID NO: 94424 - DNA, 20 bp, Artificial
  CRISPR gRNA sequence
tttcagcctcttgagtagcc

SEQ ID NO: 94425 - DNA, 20 bp, Artificial
  CRISPR gRNA sequence
cagcctcttgagtagccagg

SEQ ID NO: 94426 - DNA, 20 bp, Artificial
  CRISPR gRNA sequence
agcctcttgagtagccagga

SEQ ID NO: 94427 - DNA, 20 bp, Artificial
  CRISPR gRNA sequence
ttgagtagccaggactacag

SEQ ID NO: 94428 - DNA, 20 bp, Artificial
  CRISPR gRNA sequence
gagtagccaggactacagct

SEQ ID NO: 94429 - DNA, 20 bp, Artificial
  CRISPR gRNA sequence
agtagccaggactacagcta

SEQ ID NO: 94430 - DNA, 20 bp, Artificial
  CRISPR gRNA sequence
cagctacataccatcacact

SEQ ID NO: 94431 - DNA, 20 bp, Artificial
  CRISPR gRNA sequence
cataccatcacactcggcta

SEQ ID NO: 94432 - DNA, 20 bp, Artificial
  CRISPR gRNA sequence
ggctaatttttaaatttttt

SEQ ID NO: 94433 - DNA, 20 bp, Artificial
  CRISPR gRNA sequence
atttttaaatttttttgtag

SEQ ID NO: 94434 - DNA, 20 bp, Artificial
  CRISPR gRNA sequence
ttaaatttttttgtagatgg

SEQ ID NO: 94435 - DNA, 20 bp, Artificial
  CRISPR gRNA sequence
taaatttttttgtagatggg

SEQ ID NO: 94436 - DNA, 20 bp, Artificial
  CRISPR gRNA sequence
aaatttttttgtagatgggg

SEQ ID NO: 94437 - DNA, 20 bp, Artificial
  CRISPR gRNA sequence
aatttttttgtagatggggt

SEQ ID NO: 94438 - DNA, 20 bp, Artificial
  CRISPR gRNA sequence
ttttgtagatggggtctcgc

SEQ ID NO: 94439 - DNA, 20 bp, Artificial
  CRISPR gRNA sequence
tttgtagatggggtctcgct

SEQ ID NO: 94440 - DNA, 20 bp, Artificial
  CRISPR gRNA sequence
ttgtagatggggtctcgcta

SEQ ID NO: 94441 - DNA, 20 bp, Artificial
  CRISPR gRNA sequence
tgtagatggggtctcgctac

SEQ ID NO: 94442 - DNA, 20 bp, Artificial
  CRISPR gRNA sequence
gtagatggggtctcgctacg

SEQ ID NO: 94443 - DNA, 20 bp, Artificial
  CRISPR gRNA sequence
tagatggggtctcgctacgt

SEQ ID NO: 94444 - DNA, 20 bp, Artificial
  CRISPR gRNA sequence
gctacgttgcccagaatggt

SEQ ID NO: 94445 - DNA, 20 bp, Artificial
  CRISPR gRNA sequence
cgttgcccagaatggtctca

SEQ ID NO: 94446 - DNA, 20 bp, Artificial
  CRISPR gRNA sequence
cccagaatggtctcaaattc

SEQ ID NO: 94447 - DNA, 20 bp, Artificial
  CRISPR gRNA sequence
aaattcccagcctcaagtga

SEQ ID NO: 94448 - DNA, 20 bp, Artificial
  CRISPR gRNA sequence
ccagcctcaagtgatcctcc

SEQ ID NO: 94449 - DNA, 20 bp, Artificial
  CRISPR gRNA sequence
aagtgatcctcccacctggc

SEQ ID NO: 94450 - DNA, 20 bp, Artificial
  CRISPR gRNA sequence
ccacctggcctcccaaagtg

SEQ ID NO: 94451 - DNA, 20 bp, Artificial
  CRISPR gRNA sequence
gcctcccaaagtgctaggat

SEQ ID NO: 94452 - DNA, 20 bp, Artificial
  CRISPR gRNA sequence
ccaaagtgctaggattacag

SEQ ID NO: 94453 - DNA, 20 bp, Artificial
  CRISPR gRNA sequence
ggattacaggcatgaaccac

SEQ ID NO: 94454 - DNA, 20 bp, Artificial
  CRISPR gRNA sequence
caggcatgaaccacaatgcc

SEQ ID NO: 94455 - DNA, 20 bp, Artificial
  CRISPR gRNA sequence
tatgtgataaaataccagac

SEQ ID NO: 94456 - DNA, 20 bp, Artificial
  CRISPR gRNA sequence
atgtgataaaataccagaca

SEQ ID NO: 94457 - DNA, 20 bp, Artificial
  CRISPR gRNA sequence
tgtgataaaataccagacac

SEQ ID NO: 94458 - DNA, 20 bp, Artificial
  CRISPR gRNA sequence
accatagtcttttatatttg

SEQ ID NO: 94459 - DNA, 20 bp, Artificial
  CRISPR gRNA sequence
ttatatttgttgtacatatt

SEQ ID NO: 94460 - DNA, 20 bp, Artificial
  CRISPR gRNA sequence
tatatttgttgtacatattt

SEQ ID NO: 94461 - DNA, 20 bp, Artificial
  CRISPR gRNA sequence
atatttgttgtacatatttt

SEQ ID NO: 94462 - DNA, 20 bp, Artificial
  CRISPR gRNA sequence
tatttgttgtacatattttt

SEQ ID NO: 94463 - DNA, 20 bp, Artificial
  CRISPR gRNA sequence
gttgtacatatttttgctct

SEQ ID NO: 94464 - DNA, 20 bp, Artificial
  CRISPR gRNA sequence
ttgtacatatttttgctcta

SEQ ID NO: 94465 - DNA, 20 bp, Artificial
  CRISPR gRNA sequence
tacatatttttgctctaggt

SEQ ID NO: 94466 - DNA, 20 bp, Artificial
  CRISPR gRNA sequence
ttgctctaggtcattgtgca

SEQ ID NO: 94467 - DNA, 20 bp, Artificial
  CRISPR gRNA sequence
tgctctaggtcattgtgcaa

SEQ ID NO: 94468 - DNA, 20 bp, Artificial
  CRISPR gRNA sequence
gctctaggtcattgtgcaat

SEQ ID NO: 94469 - DNA, 20 bp, Artificial
  CRISPR gRNA sequence
ctctaggtcattgtgcaatt

SEQ ID NO: 94470 - DNA, 20 bp, Artificial
  CRISPR gRNA sequence
taggtcattgtgcaatttgc

SEQ ID NO: 94471 - DNA, 20 bp, Artificial
  CRISPR gRNA sequence
ggtcattgtgcaatttgcca

SEQ ID NO: 94472 - DNA, 20 bp, Artificial
  CRISPR gRNA sequence
tgcaatttgccaccattttt

SEQ ID NO: 94473 - DNA, 20 bp, Artificial
  CRISPR gRNA sequence
gccaccatttttgactatag

SEQ ID NO: 94474 - DNA, 20 bp, Artificial
  CRISPR gRNA sequence
ccaccatttttgactatagc

SEQ ID NO: 94475 - DNA, 20 bp, Artificial
  CRISPR gRNA sequence
ttgactatagcattcatttt

SEQ ID NO: 94476 - DNA, 20 bp, Artificial
  CRISPR gRNA sequence
tgactatagcattcattttt

SEQ ID NO: 94477 - DNA, 20 bp, Artificial
  CRISPR gRNA sequence
gactatagcattcattttta

SEQ ID NO: 94478 - DNA, 20 bp, Artificial
  CRISPR gRNA sequence
actatagcattcatttttat

SEQ ID NO: 94479 - DNA, 20 bp, Artificial
  CRISPR gRNA sequence
tagcattcatttttatgtag

SEQ ID NO: 94480 - DNA, 20 bp, Artificial
  CRISPR gRNA sequence
atttttatgtagtcaagttt

SEQ ID NO: 94481 - DNA, 20 bp, Artificial
  CRISPR gRNA sequence
ttatgtagtcaagtttataa

SEQ ID NO: 94482 - DNA, 20 bp, Artificial
  CRISPR gRNA sequence
tatgtagtcaagtttataat

SEQ ID NO: 94483 - DNA, 20 bp, Artificial
  CRISPR gRNA sequence
atgtagtcaagtttataatc

SEQ ID NO: 94484 - DNA, 20 bp, Artificial
  CRISPR gRNA sequence
tgtagtcaagtttataatct

SEQ ID NO: 94485 - DNA, 20 bp, Artificial
  CRISPR gRNA sequence
ataatcttttctctgtgatt

SEQ ID NO: 94486 - DNA, 20 bp, Artificial
  CRISPR gRNA sequence
taatcttttctctgtgattt

SEQ ID NO: 94487 - DNA, 20 bp, Artificial
  CRISPR gRNA sequence
ttctctgtgattttgtctat

SEQ ID NO: 94488 - DNA, 20 bp, Artificial
  CRISPR gRNA sequence
tctctgtgattttgtctata

SEQ ID NO: 94489 - DNA, 20 bp, Artificial
  CRISPR gRNA sequence
ctctgtgattttgtctatat

SEQ ID NO: 94490 - DNA, 20 bp, Artificial
  CRISPR gRNA sequence
tctgtgattttgtctatata

SEQ ID NO: 94491 - DNA, 20 bp, Artificial
  CRISPR gRNA sequence
tgtgattttgtctatataag

SEQ ID NO: 94492 - DNA, 20 bp, Artificial
  CRISPR gRNA sequence
tgattttgtctatataagct

SEQ ID NO: 94493 - DNA, 20 bp, Artificial
  CRISPR gRNA sequence
tgtctatataagctaaaaaa

SEQ ID NO: 94494 - DNA, 20 bp, Artificial
  CRISPR gRNA sequence
gtctatataagctaaaaaaa

SEQ ID NO: 94495 - DNA, 20 bp, Artificial
  CRISPR gRNA sequence
tctatataagctaaaaaaaa

SEQ ID NO: 94496 - DNA, 20 bp, Artificial
  CRISPR gRNA sequence
tataagctaaaaaaaatctc

SEQ ID NO: 94497 - DNA, 20 bp, Artificial
  CRISPR gRNA sequence
aaaaaaatctcattacattt

SEQ ID NO: 94498 - DNA, 20 bp, Artificial
  CRISPR gRNA sequence
attacatttttgaggtaaag

SEQ ID NO: 94499 - DNA, 20 bp, Artificial
  CRISPR gRNA sequence
catttttgaggtaaagttcc

SEQ ID NO: 94500 - DNA, 20 bp, Artificial
  CRISPR gRNA sequence
ttgaggtaaagttccgattc

SEQ ID NO: 94501 - DNA, 20 bp, Artificial
  CRISPR gRNA sequence
tgaggtaaagttccgattct

SEQ ID NO: 94502 - DNA, 20 bp, Artificial
  CRISPR gRNA sequence
gaggtaaagttccgattctt

SEQ ID NO: 94503 - DNA, 20 bp, Artificial
  CRISPR gRNA sequence
aggtaaagttccgattcttt

SEQ ID NO: 94504 - DNA, 20 bp, Artificial
  CRISPR gRNA sequence
cgattctttttttaaaattt

SEQ ID NO: 94505 - DNA, 20 bp, Artificial
  CRISPR gRNA sequence
tttttttaaaattttgactt

SEQ ID NO: 94506 - DNA, 20 bp, Artificial
  CRISPR gRNA sequence
tttttaaaattttgacttat

SEQ ID NO: 94507 - DNA, 20 bp, Artificial
  CRISPR gRNA sequence
ttttaaaattttgacttatt

SEQ ID NO: 94508 - DNA, 20 bp, Artificial
  CRISPR gRNA sequence
tttaaaattttgacttatta

SEQ ID NO: 94509 - DNA, 20 bp, Artificial
  CRISPR gRNA sequence
ttaaaattttgacttattag

SEQ ID NO: 94510 - DNA, 20 bp, Artificial
  CRISPR gRNA sequence
taaaattttgacttattagg

SEQ ID NO: 94511 - DNA, 20 bp, Artificial
  CRISPR gRNA sequence
aaaattttgacttattagga

SEQ ID NO: 94512 - DNA, 20 bp, Artificial
  CRISPR gRNA sequence
aaattttgacttattaggaa

SEQ ID NO: 94513 - DNA, 20 bp, Artificial
  CRISPR gRNA sequence
tgacttattaggaatttatt

SEQ ID NO: 94514 - DNA, 20 bp, Artificial
  CRISPR gRNA sequence
gacttattaggaatttattt

SEQ ID NO: 94515 - DNA, 20 bp, Artificial
  CRISPR gRNA sequence
acttattaggaatttatttt

SEQ ID NO: 94516 - DNA, 20 bp, Artificial
  CRISPR gRNA sequence
attaggaatttattttgatg

SEQ ID NO: 94517 - DNA, 20 bp, Artificial
  CRISPR gRNA sequence
ttaggaatttattttgatgt

SEQ ID NO: 94518 - DNA, 20 bp, Artificial
  CRISPR gRNA sequence
ggaatttattttgatgtata

SEQ ID NO: 94519 - DNA, 20 bp, Artificial
  CRISPR gRNA sequence
attttgatgtatagtgtgat

SEQ ID NO: 94520 - DNA, 20 bp, Artificial
  CRISPR gRNA sequence
ttttgatgtatagtgtgatg

SEQ ID NO: 94521 - DNA, 20 bp, Artificial
  CRISPR gRNA sequence
tgatgtatagtgtgatgtca

SEQ ID NO: 94522 - DNA, 20 bp, Artificial
  CRISPR gRNA sequence
gatgtatagtgtgatgtcat

SEQ ID NO: 94523 - DNA, 20 bp, Artificial
  CRISPR gRNA sequence
atgtatagtgtgatgtcatg

SEQ ID NO: 94524 - DNA, 20 bp, Artificial
  CRISPR gRNA sequence
aaaatctcaaaaatctcaat

SEQ ID NO: 94525 - DNA, 20 bp, Artificial
  CRISPR gRNA sequence
aaaaatctcaattgttccat

SEQ ID NO: 94526 - DNA, 20 bp, Artificial
  CRISPR gRNA sequence
aattgttccatttataacaa

SEQ ID NO: 94527 - DNA, 20 bp, Artificial
  CRISPR gRNA sequence
ttccatttataacaaacgtt

SEQ ID NO: 94528 - DNA, 20 bp, Artificial
  CRISPR gRNA sequence
catttataacaaacgtttgt

SEQ ID NO: 94529 - DNA, 20 bp, Artificial
  CRISPR gRNA sequence
ataacaaacgtttgttaaca

SEQ ID NO: 94530 - DNA, 20 bp, Artificial
  CRISPR gRNA sequence
taacaaacgtttgttaacac

SEQ ID NO: 94531 - DNA, 20 bp, Artificial
  CRISPR gRNA sequence
gttaacacatttataactga

SEQ ID NO: 94532 - DNA, 20 bp, Artificial
  CRISPR gRNA sequence
ttaacacatttataactgat

SEQ ID NO: 94533 - DNA, 20 bp, Artificial
  CRISPR gRNA sequence
acacatttataactgattta

SEQ ID NO: 94534 - DNA, 20 bp, Artificial
  CRISPR gRNA sequence
ataactgatttacaaacaga

SEQ ID NO: 94535 - DNA, 20 bp, Artificial
  CRISPR gRNA sequence
taactgatttacaaacagat

SEQ ID NO: 94536 - DNA, 20 bp, Artificial
  CRISPR gRNA sequence
atttacaaacagatatttac

SEQ ID NO: 94537 - DNA, 20 bp, Artificial
  CRISPR gRNA sequence
acaaacagatatttaccagt

SEQ ID NO: 94538 - DNA, 20 bp, Artificial
  CRISPR gRNA sequence
caaacagatatttaccagtc

SEQ ID NO: 94539 - DNA, 20 bp, Artificial
  CRISPR gRNA sequence
accagtcttttttgatttaa

SEQ ID NO: 94540 - DNA, 20 bp, Artificial
  CRISPR gRNA sequence
ccagtcttttttgatttaac

SEQ ID NO: 94541 - DNA, 20 bp, Artificial
  CRISPR gRNA sequence
ttttgatttaacacttgttc

SEQ ID NO: 94542 - DNA, 20 bp, Artificial
  CRISPR gRNA sequence
tttgatttaacacttgttct

SEQ ID NO: 94543 - DNA, 20 bp, Artificial
  CRISPR gRNA sequence
ttgatttaacacttgttcta

SEQ ID NO: 94544 - DNA, 20 bp, Artificial
  CRISPR gRNA sequence
tgatttaacacttgttctaa

SEQ ID NO: 94545 - DNA, 20 bp, Artificial
  CRISPR gRNA sequence
gatttaacacttgttctaaa

SEQ ID NO: 94546 - DNA, 20 bp, Artificial
  CRISPR gRNA sequence
atttaacacttgttctaaaa

SEQ ID NO: 94547 - DNA, 20 bp, Artificial
  CRISPR gRNA sequence
aacacttgttctaaaagagt

SEQ ID NO: 94548 - DNA, 20 bp, Artificial
  CRISPR gRNA sequence
acacttgttctaaaagagta

SEQ ID NO: 94549 - DNA, 20 bp, Artificial
  CRISPR gRNA sequence
gttctaaaagagtaggtctt

SEQ ID NO: 94550 - DNA, 20 bp, Artificial
  CRISPR gRNA sequence
ttctaaaagagtaggtcttg

SEQ ID NO: 94551 - DNA, 20 bp, Artificial
  CRISPR gRNA sequence
taaaagagtaggtcttgcag

SEQ ID NO: 94552 - DNA, 20 bp, Artificial
  CRISPR gRNA sequence
aaagagtaggtcttgcagga

SEQ ID NO: 94553 - DNA, 20 bp, Artificial
  CRISPR gRNA sequence
gcaggacgatccccaaaaga

SEQ ID NO: 94554 - DNA, 20 bp, Artificial
  CRISPR gRNA sequence
caggacgatccccaaaagat

SEQ ID NO: 94555 - DNA, 20 bp, Artificial
  CRISPR gRNA sequence
ttctttgtttaacaatggag

SEQ ID NO: 94556 - DNA, 20 bp, Artificial
  CRISPR gRNA sequence
tttgtttaacaatggagagt

SEQ ID NO: 94557 - DNA, 20 bp, Artificial
  CRISPR gRNA sequence
tgtttaacaatggagagtat

SEQ ID NO: 94558 - DNA, 20 bp, Artificial
  CRISPR gRNA sequence
gtttaacaatggagagtatg

SEQ ID NO: 94559 - DNA, 20 bp, Artificial
  CRISPR gRNA sequence
tttaacaatggagagtatgt

SEQ ID NO: 94560 - DNA, 20 bp, Artificial
  CRISPR gRNA sequence
aacaatggagagtatgttat

SEQ ID NO: 94561 - DNA, 20 bp, Artificial
  CRISPR gRNA sequence
acaatggagagtatgttatc

SEQ ID NO: 94562 - DNA, 20 bp, Artificial
  CRISPR gRNA sequence
tctgcactttcctgggataa

SEQ ID NO: 94563 - DNA, 20 bp, Artificial
  CRISPR gRNA sequence
cactttcctgggataaatga

SEQ ID NO: 94564 - DNA, 20 bp, Artificial
  CRISPR gRNA sequence
tcctgggataaatgataaaa

SEQ ID NO: 94565 - DNA, 20 bp, Artificial
  CRISPR gRNA sequence
cctgggataaatgataaaaa

SEQ ID NO: 94566 - DNA, 20 bp, Artificial
  CRISPR gRNA sequence
ctgggataaatgataaaaat

SEQ ID NO: 94567 - DNA, 20 bp, Artificial
  CRISPR gRNA sequence
ggataaatgataaaaatgca

SEQ ID NO: 94568 - DNA, 20 bp, Artificial
  CRISPR gRNA sequence
acgtaataagtcatgattac

SEQ ID NO: 94569 - DNA, 20 bp, Artificial
  CRISPR gRNA sequence
caggtatttcaaagatgtaa

SEQ ID NO: 94570 - DNA, 20 bp, Artificial
  CRISPR gRNA sequence
caaagatgtaatgaacaggt

SEQ ID NO: 94571 - DNA, 20 bp, Artificial
  CRISPR gRNA sequence
aaagatgtaatgaacaggtc

SEQ ID NO: 94572 - DNA, 20 bp, Artificial
  CRISPR gRNA sequence
tgcatttcttccttcttctt

SEQ ID NO: 94573 - DNA, 20 bp, Artificial
  CRISPR gRNA sequence
gcatttcttccttcttcttg

SEQ ID NO: 94574 - DNA, 20 bp, Artificial
  CRISPR gRNA sequence
catttcttccttcttcttgc

SEQ ID NO: 94575 - DNA, 20 bp, Artificial
  CRISPR gRNA sequence
cttccttcttcttgcccagt

SEQ ID NO: 94576 - DNA, 20 bp, Artificial
  CRISPR gRNA sequence
ttccttcttcttgcccagtc

SEQ ID NO: 94577 - DNA, 20 bp, Artificial
  CRISPR gRNA sequence
ccttcttcttgcccagtctc

SEQ ID NO: 94578 - DNA, 20 bp, Artificial
  CRISPR gRNA sequence
cttcttcttgcccagtctct

SEQ ID NO: 94579 - DNA, 20 bp, Artificial
  CRISPR gRNA sequence
cttcttgcccagtctctggg

SEQ ID NO: 94580 - DNA, 20 bp, Artificial
  CRISPR gRNA sequence
ttcttgcccagtctctgggc

SEQ ID NO: 94581 - DNA, 20 bp, Artificial
  CRISPR gRNA sequence
cttgcccagtctctgggcaa

SEQ ID NO: 94582 - DNA, 20 bp, Artificial
  CRISPR gRNA sequence
ttgcccagtctctgggcaac

SEQ ID NO: 94583 - DNA, 20 bp, Artificial
  CRISPR gRNA sequence
gcccagtctctgggcaactc

SEQ ID NO: 94584 - DNA, 20 bp, Artificial
  CRISPR gRNA sequence
cccagtctctgggcaactct

SEQ ID NO: 94585 - DNA, 20 bp, Artificial
  CRISPR gRNA sequence
tgggcaactctgggaaagtt

SEQ ID NO: 94586 - DNA, 20 bp, Artificial
  CRISPR gRNA sequence
ggcaactctgggaaagttct

SEQ ID NO: 94587 - DNA, 20 bp, Artificial
  CRISPR gRNA sequence
tgggaaagttcttcattatc

SEQ ID NO: 94588 - DNA, 20 bp, Artificial
  CRISPR gRNA sequence
ggaaagttcttcattatcat

SEQ ID NO: 94589 - DNA, 20 bp, Artificial
  CRISPR gRNA sequence
ttcattatcataggcaaagt

SEQ ID NO: 94590 - DNA, 20 bp, Artificial
  CRISPR gRNA sequence
cattatcataggcaaagtat

SEQ ID NO: 94591 - DNA, 20 bp, Artificial
  CRISPR gRNA sequence
attatcataggcaaagtatt

SEQ ID NO: 94592 - DNA, 20 bp, Artificial
  CRISPR gRNA sequence
tcataggcaaagtattggca

SEQ ID NO: 94593 - DNA, 20 bp, Artificial
  CRISPR gRNA sequence
gcagttaatttaatgtaaca

SEQ ID NO: 94594 - DNA, 20 bp, Artificial
  CRISPR gRNA sequence
atttaatgtaacattcctcc

SEQ ID NO: 94595 - DNA, 20 bp, Artificial
  CRISPR gRNA sequence
aatgtaacattcctcctcgc

SEQ ID NO: 94596 - DNA, 20 bp, Artificial
  CRISPR gRNA sequence
atgtaacattcctcctcgct

SEQ ID NO: 94597 - DNA, 20 bp, Artificial
  CRISPR gRNA sequence
ctcctcgctccctctccccc

SEQ ID NO: 94598 - DNA, 20 bp, Artificial
  CRISPR gRNA sequence
ctcgctccctctccccccag

SEQ ID NO: 94599 - DNA, 20 bp, Artificial
  CRISPR gRNA sequence
gctccctctccccccagatt

SEQ ID NO: 94600 - DNA, 20 bp, Artificial
  CRISPR gRNA sequence
cctctccccccagattttca

SEQ ID NO: 94601 - DNA, 20 bp, Artificial
  CRISPR gRNA sequence
tccccccagattttcaacct

SEQ ID NO: 94602 - DNA, 20 bp, Artificial
  CRISPR gRNA sequence
cccccagattttcaacctgg

SEQ ID NO: 94603 - DNA, 20 bp, Artificial
  CRISPR gRNA sequence
tcaacctgggttctttagtc

SEQ ID NO: 94604 - DNA, 20 bp, Artificial
  CRISPR gRNA sequence
caacctgggttctttagtct

SEQ ID NO: 94605 - DNA, 20 bp, Artificial
  CRISPR gRNA sequence
aacctgggttctttagtctc

SEQ ID NO: 94606 - DNA, 20 bp, Artificial
  CRISPR gRNA sequence
ggttctttagtctcttggca

SEQ ID NO: 94607 - DNA, 20 bp, Artificial
  CRISPR gRNA sequence
tttagtctcttggcaggtct

SEQ ID NO: 94608 - DNA, 20 bp, Artificial
  CRISPR gRNA sequence
tagtctcttggcaggtctca

SEQ ID NO: 94609 - DNA, 20 bp, Artificial
  CRISPR gRNA sequence
agtctcttggcaggtctcaa

SEQ ID NO: 94610 - DNA, 20 bp, Artificial
  CRISPR gRNA sequence
gtctcttggcaggtctcaaa

SEQ ID NO: 94611 - DNA, 20 bp, Artificial
  CRISPR gRNA sequence
ttggcaggtctcaaaattaa

SEQ ID NO: 94612 - DNA, 20 bp, Artificial
  CRISPR gRNA sequence
ggcaggtctcaaaattaata

SEQ ID NO: 94613 - DNA, 20 bp, Artificial
  CRISPR gRNA sequence
gcaggtctcaaaattaatag

SEQ ID NO: 94614 - DNA, 20 bp, Artificial
  CRISPR gRNA sequence
aaaattaatagtgtgtgtga

SEQ ID NO: 94615 - DNA, 20 bp, Artificial
  CRISPR gRNA sequence
atagtgtgtgtgatagagtg

SEQ ID NO: 94616 - DNA, 20 bp, Artificial
  CRISPR gRNA sequence
tgagaggtgggccactaaga

SEQ ID NO: 94617 - DNA, 20 bp, Artificial
  CRISPR gRNA sequence
agattgaggcagagttactt

SEQ ID NO: 94618 - DNA, 20 bp, Artificial
  CRISPR gRNA sequence
aggcagagttacttgtgagc

SEQ ID NO: 94619 - DNA, 20 bp, Artificial
  CRISPR gRNA sequence
cttgtgagctattttcaata

SEQ ID NO: 94620 - DNA, 20 bp, Artificial
  CRISPR gRNA sequence
gtgagctattttcaatatta

SEQ ID NO: 94621 - DNA, 20 bp, Artificial
  CRISPR gRNA sequence
tgagctattttcaatattac

SEQ ID NO: 94622 - DNA, 20 bp, Artificial
  CRISPR gRNA sequence
ttttcaatattacaaaaaat

SEQ ID NO: 94623 - DNA, 20 bp, Artificial
  CRISPR gRNA sequence
tcaatattacaaaaaatgcc

SEQ ID NO: 94624 - DNA, 20 bp, Artificial
  CRISPR gRNA sequence
caatattacaaaaaatgcca

SEQ ID NO: 94625 - DNA, 20 bp, Artificial
  CRISPR gRNA sequence
aatattacaaaaaatgccaa

SEQ ID NO: 94626 - DNA, 20 bp, Artificial
  CRISPR gRNA sequence
caaaaaatgccaagtggaat

SEQ ID NO: 94627 - DNA, 20 bp, Artificial
  CRISPR gRNA sequence
accattctctttatataatg

SEQ ID NO: 94628 - DNA, 20 bp, Artificial
  CRISPR gRNA sequence
tctttatataatgctatcca

SEQ ID NO: 94629 - DNA, 20 bp, Artificial
  CRISPR gRNA sequence
tttatataatgctatccagg

SEQ ID NO: 94630 - DNA, 20 bp, Artificial
  CRISPR gRNA sequence
tatataatgctatccaggcc

SEQ ID NO: 94631 - DNA, 20 bp, Artificial
  CRISPR gRNA sequence
atataatgctatccaggccg

SEQ ID NO: 94632 - DNA, 20 bp, Artificial
  CRISPR gRNA sequence
tataatgctatccaggccga

SEQ ID NO: 94633 - DNA, 20 bp, Artificial
  CRISPR gRNA sequence
tccaggccgaaacataatct

SEQ ID NO: 94634 - DNA, 20 bp, Artificial
  CRISPR gRNA sequence
cttgcctttggatgaaatat

SEQ ID NO: 94635 - DNA, 20 bp, Artificial
  CRISPR gRNA sequence
gcctttggatgaaatatatg

SEQ ID NO: 94636 - DNA, 20 bp, Artificial
  CRISPR gRNA sequence
cctttggatgaaatatatga

SEQ ID NO: 94637 - DNA, 20 bp, Artificial
  CRISPR gRNA sequence
tggatgaaatatatgaactc

SEQ ID NO: 94638 - DNA, 20 bp, Artificial
  CRISPR gRNA sequence
ggatgaaatatatgaactca

SEQ ID NO: 94639 - DNA, 20 bp, Artificial
  CRISPR gRNA sequence
gatgaaatatatgaactcag

SEQ ID NO: 94640 - DNA, 20 bp, Artificial
  CRISPR gRNA sequence
agaggcaaattatatactgc

SEQ ID NO: 94641 - DNA, 20 bp, Artificial
  CRISPR gRNA sequence
tatactgctcaataagatat

SEQ ID NO: 94642 - DNA, 20 bp, Artificial
  CRISPR gRNA sequence
ctcaataagatatctgatag

SEQ ID NO: 94643 - DNA, 20 bp, Artificial
  CRISPR gRNA sequence
aataagatatctgatagctt

SEQ ID NO: 94644 - DNA, 20 bp, Artificial
  CRISPR gRNA sequence
atagctttttacccagttgg

SEQ ID NO: 94645 - DNA, 20 bp, Artificial
  CRISPR gRNA sequence
tttacccagttggcaaccaa

SEQ ID NO: 94646 - DNA, 20 bp, Artificial
  CRISPR gRNA sequence
ttacccagttggcaaccaaa

SEQ ID NO: 94647 - DNA, 20 bp, Artificial
  CRISPR gRNA sequence
tacccagttggcaaccaaaa

SEQ ID NO: 94648 - DNA, 20 bp, Artificial
  CRISPR gRNA sequence
acccagttggcaaccaaaac

SEQ ID NO: 94649 - DNA, 20 bp, Artificial
  CRISPR gRNA sequence
cccagttggcaaccaaaaca

SEQ ID NO: 94650 - DNA, 20 bp, Artificial
  CRISPR gRNA sequence
gcaaccaaaacaaatggggg

SEQ ID NO: 94651 - DNA, 20 bp, Artificial
  CRISPR gRNA sequence
tttaaagaagcaactgataa

SEQ ID NO: 94652 - DNA, 20 bp, Artificial
  CRISPR gRNA sequence
aaagaagcaactgataacca

SEQ ID NO: 94653 - DNA, 20 bp, Artificial
  CRISPR gRNA sequence
aagaagcaactgataaccaa

SEQ ID NO: 94654 - DNA, 20 bp, Artificial
  CRISPR gRNA sequence
ataaccaaagctttcaaaat

SEQ ID NO: 94655 - DNA, 20 bp, Artificial
  CRISPR gRNA sequence
tcaaaatttagataaacttg

SEQ ID NO: 94656 - DNA, 20 bp, Artificial
  CRISPR gRNA sequence
caaaatttagataaacttgc

SEQ ID NO: 94657 - DNA, 20 bp, Artificial
  CRISPR gRNA sequence
aaaatttagataaacttgct

SEQ ID NO: 94658 - DNA, 20 bp, Artificial
  CRISPR gRNA sequence
agataaacttgcttgaaaaa

SEQ ID NO: 94659 - DNA, 20 bp, Artificial
  CRISPR gRNA sequence
gataaacttgcttgaaaaag

SEQ ID NO: 94660 - DNA, 20 bp, Artificial
  CRISPR gRNA sequence
gcttgaaaaagcactagtat

SEQ ID NO: 94661 - DNA, 20 bp, Artificial
  CRISPR gRNA sequence
cttgaaaaagcactagtata

SEQ ID NO: 94662 - DNA, 20 bp, Artificial
  CRISPR gRNA sequence
gaaaaagcactagtataaat

SEQ ID NO: 94663 - DNA, 20 bp, Artificial
  CRISPR gRNA sequence
aaaaagcactagtataaata

SEQ ID NO: 94664 - DNA, 20 bp, Artificial
  CRISPR gRNA sequence
gtataaatagtctcctgcca

SEQ ID NO: 94665 - DNA, 20 bp, Artificial
  CRISPR gRNA sequence
ctgccaactgtatgaacaaa

SEQ ID NO: 94666 - DNA, 20 bp, Artificial
  CRISPR gRNA sequence
ccaactgtatgaacaaaaca

SEQ ID NO: 94667 - DNA, 20 bp, Artificial
  CRISPR gRNA sequence
tatgaacaaaacaggtaagt

SEQ ID NO: 94668 - DNA, 20 bp, Artificial
  CRISPR gRNA sequence
aaatgataccattaccctga

SEQ ID NO: 94669 - DNA, 20 bp, Artificial
  CRISPR gRNA sequence
ccctgagatttcactgccca

SEQ ID NO: 94670 - DNA, 20 bp, Artificial
  CRISPR gRNA sequence
agatttcactgcccaaaaac

SEQ ID NO: 94671 - DNA, 20 bp, Artificial
  CRISPR gRNA sequence
cactgcccaaaaacaaaatc

SEQ ID NO: 94672 - DNA, 20 bp, Artificial
  CRISPR gRNA sequence
actgcccaaaaacaaaatca

SEQ ID NO: 94673 - DNA, 20 bp, Artificial
  CRISPR gRNA sequence
cccaaaaacaaaatcagcag

SEQ ID NO: 94674 - DNA, 20 bp, Artificial
  CRISPR gRNA sequence
attaccaaatatgtaccccc

SEQ ID NO: 94675 - DNA, 20 bp, Artificial
  CRISPR gRNA sequence
ttaccaaatatgtaccccca

SEQ ID NO: 94676 - DNA, 20 bp, Artificial
  CRISPR gRNA sequence
ccaaatatgtacccccagtt

SEQ ID NO: 94677 - DNA, 20 bp, Artificial
  CRISPR gRNA sequence
cctgacagcatcttaaatac

SEQ ID NO: 94678 - DNA, 20 bp, Artificial
  CRISPR gRNA sequence
acagcatcttaaatacttgt

SEQ ID NO: 94679 - DNA, 20 bp, Artificial
  CRISPR gRNA sequence
aaatacttgtaattttgctg

SEQ ID NO: 94680 - DNA, 20 bp, Artificial
  CRISPR gRNA sequence
aatacttgtaattttgctgg

SEQ ID NO: 94681 - DNA, 20 bp, Artificial
  CRISPR gRNA sequence
gtaattttgctggcataaca

SEQ ID NO: 94682 - DNA, 20 bp, Artificial
  CRISPR gRNA sequence
taattttgctggcataacaa

SEQ ID NO: 94683 - DNA, 20 bp, Artificial
  CRISPR gRNA sequence
tgctggcataacaaaatatt

SEQ ID NO: 94684 - DNA, 20 bp, Artificial
  CRISPR gRNA sequence
gctggcataacaaaatattg

SEQ ID NO: 94685 - DNA, 20 bp, Artificial
  CRISPR gRNA sequence
ctggcataacaaaatattgt

SEQ ID NO: 94686 - DNA, 20 bp, Artificial
  CRISPR gRNA sequence
gcataacaaaatattgttta

SEQ ID NO: 94687 - DNA, 20 bp, Artificial
  CRISPR gRNA sequence
tttagttgactgaaatattc

SEQ ID NO: 94688 - DNA, 20 bp, Artificial
  CRISPR gRNA sequence
agttgactgaaatattctga

SEQ ID NO: 94689 - DNA, 20 bp, Artificial
  CRISPR gRNA sequence
gttgactgaaatattctgac

SEQ ID NO: 94690 - DNA, 20 bp, Artificial
  CRISPR gRNA sequence
actgaaatattctgactctt

SEQ ID NO: 94691 - DNA, 20 bp, Artificial
  CRISPR gRNA sequence
aaatattctgactcttacaa

SEQ ID NO: 94692 - DNA, 20 bp, Artificial
  CRISPR gRNA sequence
tgactcttacaaaactatgc

SEQ ID NO: 94693 - DNA, 20 bp, Artificial
  CRISPR gRNA sequence
actcttacaaaactatgcca

SEQ ID NO: 94694 - DNA, 20 bp, Artificial
  CRISPR gRNA sequence
ttacaaaactatgccacaat

SEQ ID NO: 94695 - DNA, 20 bp, Artificial
  CRISPR gRNA sequence
acaaaactatgccacaatac

SEQ ID NO: 94696 - DNA, 20 bp, Artificial
  CRISPR gRNA sequence
caaaactatgccacaatacc

SEQ ID NO: 94697 - DNA, 20 bp, Artificial
  CRISPR gRNA sequence
tgccacaataccacatccaa

SEQ ID NO: 94698 - DNA, 20 bp, Artificial
  CRISPR gRNA sequence
ttactaaagtagcaaatata

SEQ ID NO: 94699 - DNA, 20 bp, Artificial
  CRISPR gRNA sequence
actaaagtagcaaatataaa

SEQ ID NO: 94700 - DNA, 20 bp, Artificial
  CRISPR gRNA sequence
ctaaagtagcaaatataaaa

SEQ ID NO: 94701 - DNA, 20 bp, Artificial
  CRISPR gRNA sequence
aagtagcaaatataaaatta

SEQ ID NO: 94702 - DNA, 20 bp, Artificial
  CRISPR gRNA sequence
taaatgttttaccggaaagc

SEQ ID NO: 94703 - DNA, 20 bp, Artificial
  CRISPR gRNA sequence
taccggaaagccatacctta

SEQ ID NO: 94704 - DNA, 20 bp, Artificial
  CRISPR gRNA sequence
accggaaagccataccttac

SEQ ID NO: 94705 - DNA, 20 bp, Artificial
  CRISPR gRNA sequence
ccggaaagccataccttaca

SEQ ID NO: 94706 - DNA, 20 bp, Artificial
  CRISPR gRNA sequence
acatgaatttaacctctttg

SEQ ID NO: 94707 - DNA, 20 bp, Artificial
  CRISPR gRNA sequence
catgaatttaacctctttgt

SEQ ID NO: 94708 - DNA, 20 bp, Artificial
  CRISPR gRNA sequence
aacctctttgttctttactt

SEQ ID NO: 94709 - DNA, 20 bp, Artificial
  CRISPR gRNA sequence
acctctttgttctttactta

SEQ ID NO: 94710 - DNA, 20 bp, Artificial
  CRISPR gRNA sequence
tttgttctttacttagaata

SEQ ID NO: 94711 - DNA, 20 bp, Artificial
  CRISPR gRNA sequence
tgttctttacttagaatatt

SEQ ID NO: 94712 - DNA, 20 bp, Artificial
  CRISPR gRNA sequence
gttctttacttagaatatta

SEQ ID NO: 94713 - DNA, 20 bp, Artificial
  CRISPR gRNA sequence
ttctttacttagaatattat

SEQ ID NO: 94714 - DNA, 20 bp, Artificial
  CRISPR gRNA sequence
tttacttagaatattatcta

SEQ ID NO: 94715 - DNA, 20 bp, Artificial
  CRISPR gRNA sequence
tacttagaatattatctatg

SEQ ID NO: 94716 - DNA, 20 bp, Artificial
  CRISPR gRNA sequence
acttagaatattatctatgc

SEQ ID NO: 94717 - DNA, 20 bp, Artificial
  CRISPR gRNA sequence
cttagaatattatctatgct

SEQ ID NO: 94718 - DNA, 20 bp, Artificial
  CRISPR gRNA sequence
agaatattatctatgctgtt

SEQ ID NO: 94719 - DNA, 20 bp, Artificial
  CRISPR gRNA sequence
gaatattatctatgctgttt

SEQ ID NO: 94720 - DNA, 20 bp, Artificial
  CRISPR gRNA sequence
tctatgctgttttttctctt

SEQ ID NO: 94721 - DNA, 20 bp, Artificial
  CRISPR gRNA sequence
tgctgttttttctcttgggc

SEQ ID NO: 94722 - DNA, 20 bp, Artificial
  CRISPR gRNA sequence
ttttttctcttgggcttctt

SEQ ID NO: 94723 - DNA, 20 bp, Artificial
  CRISPR gRNA sequence
tttctcttgggcttctttct

SEQ ID NO: 94724 - DNA, 20 bp, Artificial
  CRISPR gRNA sequence
ttctcttgggcttctttcta

SEQ ID NO: 94725 - DNA, 20 bp, Artificial
  CRISPR gRNA sequence
tctcttgggcttctttctac

SEQ ID NO: 94726 - DNA, 20 bp, Artificial
  CRISPR gRNA sequence
ctcttgggcttctttctact

SEQ ID NO: 94727 - DNA, 20 bp, Artificial
  CRISPR gRNA sequence
tcttgggcttctttctactg

SEQ ID NO: 94728 - DNA, 20 bp, Artificial
  CRISPR gRNA sequence
ttgggcttctttctactggc

SEQ ID NO: 94729 - DNA, 20 bp, Artificial
  CRISPR gRNA sequence
gggcttctttctactggcct

SEQ ID NO: 94730 - DNA, 20 bp, Artificial
  CRISPR gRNA sequence
ggcttctttctactggcctc

SEQ ID NO: 94731 - DNA, 20 bp, Artificial
  CRISPR gRNA sequence
ctttctactggcctctgagt

SEQ ID NO: 94732 - DNA, 20 bp, Artificial
  CRISPR gRNA sequence
tttctactggcctctgagtt

SEQ ID NO: 94733 - DNA, 20 bp, Artificial
  CRISPR gRNA sequence
tctactggcctctgagttat

SEQ ID NO: 94734 - DNA, 20 bp, Artificial
  CRISPR gRNA sequence
ctactggcctctgagttatc

SEQ ID NO: 94735 - DNA, 20 bp, Artificial
  CRISPR gRNA sequence
tactggcctctgagttatct

SEQ ID NO: 94736 - DNA, 20 bp, Artificial
  CRISPR gRNA sequence
ctggcctctgagttatctat

SEQ ID NO: 94737 - DNA, 20 bp, Artificial
  CRISPR gRNA sequence
gcctctgagttatctatgag

SEQ ID NO: 94738 - DNA, 20 bp, Artificial
  CRISPR gRNA sequence
tgagttatctatgagaatat

SEQ ID NO: 94739 - DNA, 20 bp, Artificial
  CRISPR gRNA sequence
agttatctatgagaatatcc

SEQ ID NO: 94740 - DNA, 20 bp, Artificial
  CRISPR gRNA sequence
tctatgagaatatcccctta

SEQ ID NO: 94741 - DNA, 20 bp, Artificial
  CRISPR gRNA sequence
tgagaatatccccttaattt

SEQ ID NO: 94742 - DNA, 20 bp, Artificial
  CRISPR gRNA sequence
aatttctttcattatgagaa

SEQ ID NO: 94743 - DNA, 20 bp, Artificial
  CRISPR gRNA sequence
atttctttcattatgagaag

SEQ ID NO: 94744 - DNA, 20 bp, Artificial
  CRISPR gRNA sequence
ctttcattatgagaagttta

SEQ ID NO: 94745 - DNA, 20 bp, Artificial
  CRISPR gRNA sequence
tttcattatgagaagtttac

SEQ ID NO: 94746 - DNA, 20 bp, Artificial
  CRISPR gRNA sequence
tcattatgagaagtttacca

SEQ ID NO: 94747 - DNA, 20 bp, Artificial
  CRISPR gRNA sequence
cattatgagaagtttaccaa

SEQ ID NO: 94748 - DNA, 20 bp, Artificial
  CRISPR gRNA sequence
attatgagaagtttaccaac

SEQ ID NO: 94749 - DNA, 20 bp, Artificial
  CRISPR gRNA sequence
tgagaagtttaccaacctga

SEQ ID NO: 94750 - DNA, 20 bp, Artificial
  CRISPR gRNA sequence
accaacctgatattacaaaa

SEQ ID NO: 94751 - DNA, 20 bp, Artificial
  CRISPR gRNA sequence
ccaacctgatattacaaaaa

SEQ ID NO: 94752 - DNA, 20 bp, Artificial
  CRISPR gRNA sequence
atattacaaaaatatttcac

SEQ ID NO: 94753 - DNA, 20 bp, Artificial
  CRISPR gRNA sequence
caaaaatatttcacccctaa

SEQ ID NO: 94754 - DNA, 20 bp, Artificial
  CRISPR gRNA sequence
cacccctaaacattttaggc

SEQ ID NO: 94755 - DNA, 20 bp, Artificial
  CRISPR gRNA sequence
acccctaaacattttaggcc

SEQ ID NO: 94756 - DNA, 20 bp, Artificial
  CRISPR gRNA sequence
aacattttaggcctcaacat

SEQ ID NO: 94757 - DNA, 20 bp, Artificial
  CRISPR gRNA sequence
taggcctcaacatataaaaa

SEQ ID NO: 94758 - DNA, 20 bp, Artificial
  CRISPR gRNA sequence
aggcctcaacatataaaaac

SEQ ID NO: 94759 - DNA, 20 bp, Artificial
  CRISPR gRNA sequence
ggcctcaacatataaaaact

SEQ ID NO: 94760 - DNA, 20 bp, Artificial
  CRISPR gRNA sequence
aacatataaaaactgtaaaa

SEQ ID NO: 94761 - DNA, 20 bp, Artificial
  CRISPR gRNA sequence
taaaaagaaaattctaatac

SEQ ID NO: 94762 - DNA, 20 bp, Artificial
  CRISPR gRNA sequence
taatacccagaggaaacaaa

SEQ ID NO: 94763 - DNA, 20 bp, Artificial
  CRISPR gRNA sequence
atacccagaggaaacaaaaa

SEQ ID NO: 94764 - DNA, 20 bp, Artificial
  CRISPR gRNA sequence
cttcctcctccagcaacccc

SEQ ID NO: 94765 - DNA, 20 bp, Artificial
  CRISPR gRNA sequence
ttcctcctccagcaaccccc

SEQ ID NO: 94766 - DNA, 20 bp, Artificial
  CRISPR gRNA sequence
cctcctccagcaacccccaa

SEQ ID NO: 94767 - DNA, 20 bp, Artificial
  CRISPR gRNA sequence
ctcctccagcaacccccaag

SEQ ID NO: 94768 - DNA, 20 bp, Artificial
  CRISPR gRNA sequence
ctccagcaacccccaagttg

SEQ ID NO: 94769 - DNA, 20 bp, Artificial
  CRISPR gRNA sequence
cagcaacccccaagttgatt

SEQ ID NO: 94770 - DNA, 20 bp, Artificial
  CRISPR gRNA sequence
attttatttatgagattctt

SEQ ID NO: 94771 - DNA, 20 bp, Artificial
  CRISPR gRNA sequence
tatttatgagattctttcat

SEQ ID NO: 94772 - DNA, 20 bp, Artificial
  CRISPR gRNA sequence
atttatgagattctttcatt

SEQ ID NO: 94773 - DNA, 20 bp, Artificial
  CRISPR gRNA sequence
tttatgagattctttcattt

SEQ ID NO: 94774 - DNA, 20 bp, Artificial
  CRISPR gRNA sequence
atgagattctttcattttta

SEQ ID NO: 94775 - DNA, 20 bp, Artificial
  CRISPR gRNA sequence
tgagattctttcatttttat

SEQ ID NO: 94776 - DNA, 20 bp, Artificial
  CRISPR gRNA sequence
tttcatttttatgtgcaaga

SEQ ID NO: 94777 - DNA, 20 bp, Artificial
  CRISPR gRNA sequence
tcatttttatgtgcaagata

SEQ ID NO: 94778 - DNA, 20 bp, Artificial
  CRISPR gRNA sequence
catttttatgtgcaagataa

SEQ ID NO: 94779 - DNA, 20 bp, Artificial
  CRISPR gRNA sequence
atttttatgtgcaagataat

SEQ ID NO: 94780 - DNA, 20 bp, Artificial
  CRISPR gRNA sequence
ttatgtgcaagataatggaa

SEQ ID NO: 94781 - DNA, 20 bp, Artificial
  CRISPR gRNA sequence
tatgtgcaagataatggaat

SEQ ID NO: 94782 - DNA, 20 bp, Artificial
  CRISPR gRNA sequence
atgtgcaagataatggaatg

SEQ ID NO: 94783 - DNA, 20 bp, Artificial
  CRISPR gRNA sequence
tgtgcaagataatggaatgc

SEQ ID NO: 94784 - DNA, 20 bp, Artificial
  CRISPR gRNA sequence
aaattgacttgatggtacag

SEQ ID NO: 94785 - DNA, 20 bp, Artificial
  CRISPR gRNA sequence
acttgatggtacagtaccct

SEQ ID NO: 94786 - DNA, 20 bp, Artificial
  CRISPR gRNA sequence
gatggtacagtaccctctgc

SEQ ID NO: 94787 - DNA, 20 bp, Artificial
  CRISPR gRNA sequence
atggtacagtaccctctgcc

SEQ ID NO: 94788 - DNA, 20 bp, Artificial
  CRISPR gRNA sequence
tgccctcacaaccccactat

SEQ ID NO: 94789 - DNA, 20 bp, Artificial
  CRISPR gRNA sequence
ccctcacaaccccactatgg

SEQ ID NO: 94790 - DNA, 20 bp, Artificial
  CRISPR gRNA sequence
acaaccccactatggaaatt

SEQ ID NO: 94791 - DNA, 20 bp, Artificial
  CRISPR gRNA sequence
tggaaattcaaaaggttaat

SEQ ID NO: 94792 - DNA, 20 bp, Artificial
  CRISPR gRNA sequence
aaaaggttaattcacaaaat

SEQ ID NO: 94793 - DNA, 20 bp, Artificial
  CRISPR gRNA sequence
attcacaaaatattagatac

SEQ ID NO: 94794 - DNA, 20 bp, Artificial
  CRISPR gRNA sequence
acaaaatattagatactgaa

SEQ ID NO: 94795 - DNA, 20 bp, Artificial
  CRISPR gRNA sequence
gatactgaattagataaaga

SEQ ID NO: 94796 - DNA, 20 bp, Artificial
  CRISPR gRNA sequence
aattagataaagaagcttgt

SEQ ID NO: 94797 - DNA, 20 bp, Artificial
  CRISPR gRNA sequence
gataaagaagcttgtagtga

SEQ ID NO: 94798 - DNA, 20 bp, Artificial
  CRISPR gRNA sequence
gtagtgaaaataacctttag

SEQ ID NO: 94799 - DNA, 20 bp, Artificial
  CRISPR gRNA sequence
tagtgaaaataacctttagt

SEQ ID NO: 94800 - DNA, 20 bp, Artificial
  CRISPR gRNA sequence
tagtcatctagtccaaactt

SEQ ID NO: 94801 - DNA, 20 bp, Artificial
  CRISPR gRNA sequence
agtcatctagtccaaacttg

SEQ ID NO: 94802 - DNA, 20 bp, Artificial
  CRISPR gRNA sequence
gtcatctagtccaaacttgt

SEQ ID NO: 94803 - DNA, 20 bp, Artificial
  CRISPR gRNA sequence
gtccaaacttgtacagatgt

SEQ ID NO: 94804 - DNA, 20 bp, Artificial
  CRISPR gRNA sequence
gtacagatgttggaattctt

SEQ ID NO: 94805 - DNA, 20 bp, Artificial
  CRISPR gRNA sequence
tacagatgttggaattcttt

SEQ ID NO: 94806 - DNA, 20 bp, Artificial
  CRISPR gRNA sequence
gaattctttttcaaaaacct

SEQ ID NO: 94807 - DNA, 20 bp, Artificial
  CRISPR gRNA sequence
tttttcaaaaacctgcaatg

SEQ ID NO: 94808 - DNA, 20 bp, Artificial
  CRISPR gRNA sequence
tttcaaaaacctgcaatgct

SEQ ID NO: 94809 - DNA, 20 bp, Artificial
  CRISPR gRNA sequence
ttcaaaaacctgcaatgctt

SEQ ID NO: 94810 - DNA, 20 bp, Artificial
  CRISPR gRNA sequence
tcaaaaacctgcaatgcttt

SEQ ID NO: 94811 - DNA, 20 bp, Artificial
  CRISPR gRNA sequence
caaaaacctgcaatgctttt

SEQ ID NO: 94812 - DNA, 20 bp, Artificial
  CRISPR gRNA sequence
aaaaacctgcaatgcttttt

SEQ ID NO: 94813 - DNA, 20 bp, Artificial
  CRISPR gRNA sequence
caatgctttttgtcctacag

SEQ ID NO: 94814 - DNA, 20 bp, Artificial
  CRISPR gRNA sequence
tttgtcctacagagtttacc

SEQ ID NO: 94815 - DNA, 20 bp, Artificial
  CRISPR gRNA sequence
ttgtcctacagagtttacca

SEQ ID NO: 94816 - DNA, 20 bp, Artificial
  CRISPR gRNA sequence
tgtcctacagagtttaccaa

SEQ ID NO: 94817 - DNA, 20 bp, Artificial
  CRISPR gRNA sequence
gtcctacagagtttaccaac

SEQ ID NO: 94818 - DNA, 20 bp, Artificial
  CRISPR gRNA sequence
tcctacagagtttaccaact

SEQ ID NO: 94819 - DNA, 20 bp, Artificial
  CRISPR gRNA sequence
cagagtttaccaacttttgc

SEQ ID NO: 94820 - DNA, 20 bp, Artificial
  CRISPR gRNA sequence
accaacttttgccacatttc

SEQ ID NO: 94821 - DNA, 20 bp, Artificial
  CRISPR gRNA sequence
ccaacttttgccacatttca

SEQ ID NO: 94822 - DNA, 20 bp, Artificial
  CRISPR gRNA sequence
ttgccacatttcatttggtt

SEQ ID NO: 94823 - DNA, 20 bp, Artificial
  CRISPR gRNA sequence
tgccacatttcatttggttt

SEQ ID NO: 94824 - DNA, 20 bp, Artificial
  CRISPR gRNA sequence
gccacatttcatttggtttt

SEQ ID NO: 94825 - DNA, 20 bp, Artificial
  CRISPR gRNA sequence
ccacatttcatttggttttg

SEQ ID NO: 94826 - DNA, 20 bp, Artificial
  CRISPR gRNA sequence
catttggttttgaatagctc

SEQ ID NO: 94827 - DNA, 20 bp, Artificial
  CRISPR gRNA sequence
atttggttttgaatagctct

SEQ ID NO: 94828 - DNA, 20 bp, Artificial
  CRISPR gRNA sequence
ggttttgaatagctctaaca

SEQ ID NO: 94829 - DNA, 20 bp, Artificial
  CRISPR gRNA sequence
gttttgaatagctctaacat

SEQ ID NO: 94830 - DNA, 20 bp, Artificial
  CRISPR gRNA sequence
tgaatagctctaacatttcg

SEQ ID NO: 94831 - DNA, 20 bp, Artificial
  CRISPR gRNA sequence
gaatagctctaacatttcgg

SEQ ID NO: 94832 - DNA, 20 bp, Artificial
  CRISPR gRNA sequence
aatagctctaacatttcggt

SEQ ID NO: 94833 - DNA, 20 bp, Artificial
  CRISPR gRNA sequence
taacatttcggtagaatgtt

SEQ ID NO: 94834 - DNA, 20 bp, Artificial
  CRISPR gRNA sequence
acatttcggtagaatgttag

SEQ ID NO: 94835 - DNA, 20 bp, Artificial
  CRISPR gRNA sequence
cggtagaatgttaggtagct

SEQ ID NO: 94836 - DNA, 20 bp, Artificial
  CRISPR gRNA sequence
ggtagaatgttaggtagctt

SEQ ID NO: 94837 - DNA, 20 bp, Artificial
  CRISPR gRNA sequence
ggtagctttacttaagctga

SEQ ID NO: 94838 - DNA, 20 bp, Artificial
  CRISPR gRNA sequence
tacttaagctgagctgaaat

SEQ ID NO: 94839 - DNA, 20 bp, Artificial
  CRISPR gRNA sequence
acttaagctgagctgaaata

SEQ ID NO: 94840 - DNA, 20 bp, Artificial
  CRISPR gRNA sequence
cttaagctgagctgaaatac

SEQ ID NO: 94841 - DNA, 20 bp, Artificial
  CRISPR gRNA sequence
aagctgagctgaaatacata

SEQ ID NO: 94842 - DNA, 20 bp, Artificial
  CRISPR gRNA sequence
agctgagctgaaatacatac

SEQ ID NO: 94843 - DNA, 20 bp, Artificial
  CRISPR gRNA sequence
agctgaaatacatactcctt

SEQ ID NO: 94844 - DNA, 20 bp, Artificial
  CRISPR gRNA sequence
aaatacatactccttgtgat

SEQ ID NO: 94845 - DNA, 20 bp, Artificial
  CRISPR gRNA sequence
cttgtgatttatgcctaaga

SEQ ID NO: 94846 - DNA, 20 bp, Artificial
  CRISPR gRNA sequence
gtgatttatgcctaagagtc

SEQ ID NO: 94847 - DNA, 20 bp, Artificial
  CRISPR gRNA sequence
tgatttatgcctaagagtcc

SEQ ID NO: 94848 - DNA, 20 bp, Artificial
  CRISPR gRNA sequence
atgcctaagagtcctagtta

SEQ ID NO: 94849 - DNA, 20 bp, Artificial
  CRISPR gRNA sequence
tgcctaagagtcctagttac

SEQ ID NO: 94850 - DNA, 20 bp, Artificial
  CRISPR gRNA sequence
agagtcctagttacctcaga

SEQ ID NO: 94851 - DNA, 20 bp, Artificial
  CRISPR gRNA sequence
gttacctcagaatcatgcca

SEQ ID NO: 94852 - DNA, 20 bp, Artificial
  CRISPR gRNA sequence
cctcagaatcatgccatata

SEQ ID NO: 94853 - DNA, 20 bp, Artificial
  CRISPR gRNA sequence
agaatcatgccatataagtc

SEQ ID NO: 94854 - DNA, 20 bp, Artificial
  CRISPR gRNA sequence
ctgcttctcttaaatgatag

SEQ ID NO: 94855 - DNA, 20 bp, Artificial
  CRISPR gRNA sequence
cttctcttaaatgatagctt

SEQ ID NO: 94856 - DNA, 20 bp, Artificial
  CRISPR gRNA sequence
ctcttaaatgatagcttttt

SEQ ID NO: 94857 - DNA, 20 bp, Artificial
  CRISPR gRNA sequence
tcttaaatgatagcttttta

SEQ ID NO: 94858 - DNA, 20 bp, Artificial
  CRISPR gRNA sequence
ttaaatgatagctttttaga

SEQ ID NO: 94859 - DNA, 20 bp, Artificial
  CRISPR gRNA sequence
aaatgatagctttttagata

SEQ ID NO: 94860 - DNA, 20 bp, Artificial
  CRISPR gRNA sequence
aatgatagctttttagatat

SEQ ID NO: 94861 - DNA, 20 bp, Artificial
  CRISPR gRNA sequence
tttagatatttaataagaac

SEQ ID NO: 94862 - DNA, 20 bp, Artificial
  CRISPR gRNA sequence
ttagatatttaataagaaca

SEQ ID NO: 94863 - DNA, 20 bp, Artificial
  CRISPR gRNA sequence
tagatatttaataagaacaa

SEQ ID NO: 94864 - DNA, 20 bp, Artificial
  CRISPR gRNA sequence
agatatttaataagaacaat

SEQ ID NO: 94865 - DNA, 20 bp, Artificial
  CRISPR gRNA sequence
gatatttaataagaacaatc

SEQ ID NO: 94866 - DNA, 20 bp, Artificial
  CRISPR gRNA sequence
aataagaacaatcccaccag

SEQ ID NO: 94867 - DNA, 20 bp, Artificial
  CRISPR gRNA sequence
ataagaacaatcccaccagc

SEQ ID NO: 94868 - DNA, 20 bp, Artificial
  CRISPR gRNA sequence
atttatccctagtcccttta

SEQ ID NO: 94869 - DNA, 20 bp, Artificial
  CRISPR gRNA sequence
atccctagtccctttatgtg

SEQ ID NO: 94870 - DNA, 20 bp, Artificial
  CRISPR gRNA sequence
tccctagtccctttatgtgt

SEQ ID NO: 94871 - DNA, 20 bp, Artificial
  CRISPR gRNA sequence
gtccctttatgtgtctctca

SEQ ID NO: 94872 - DNA, 20 bp, Artificial
  CRISPR gRNA sequence
tatgtgtctctcatatagca

SEQ ID NO: 94873 - DNA, 20 bp, Artificial
  CRISPR gRNA sequence
atgtgtctctcatatagcat

SEQ ID NO: 94874 - DNA, 20 bp, Artificial
  CRISPR gRNA sequence
tgtgtctctcatatagcata

SEQ ID NO: 94875 - DNA, 20 bp, Artificial
  CRISPR gRNA sequence
tcatatagcatagttcttag

SEQ ID NO: 94876 - DNA, 20 bp, Artificial
  CRISPR gRNA sequence
atatagcatagttcttagat

SEQ ID NO: 94877 - DNA, 20 bp, Artificial
  CRISPR gRNA sequence
ttagattggtggagtagaca

SEQ ID NO: 94878 - DNA, 20 bp, Artificial
  CRISPR gRNA sequence
agattggtggagtagacatt

SEQ ID NO: 94879 - DNA, 20 bp, Artificial
  CRISPR gRNA sequence
gattggtggagtagacatta

SEQ ID NO: 94880 - DNA, 20 bp, Artificial
  CRISPR gRNA sequence
gtggagtagacattatacac

SEQ ID NO: 94881 - DNA, 20 bp, Artificial
  CRISPR gRNA sequence
tacacatttgttcctcattt

SEQ ID NO: 94882 - DNA, 20 bp, Artificial
  CRISPR gRNA sequence
gttcctcatttaaccttgac

SEQ ID NO: 94883 - DNA, 20 bp, Artificial
  CRISPR gRNA sequence
ttcctcatttaaccttgact

SEQ ID NO: 94884 - DNA, 20 bp, Artificial
  CRISPR gRNA sequence
ctcatttaaccttgacttgt

SEQ ID NO: 94885 - DNA, 20 bp, Artificial
  CRISPR gRNA sequence
atttaaccttgacttgtgta

SEQ ID NO: 94886 - DNA, 20 bp, Artificial
  CRISPR gRNA sequence
aaccttgacttgtgtaagaa

SEQ ID NO: 94887 - DNA, 20 bp, Artificial
  CRISPR gRNA sequence
accttgacttgtgtaagaaa

SEQ ID NO: 94888 - DNA, 20 bp, Artificial
  CRISPR gRNA sequence
gacttgtgtaagaaatatta

SEQ ID NO: 94889 - DNA, 20 bp, Artificial
  CRISPR gRNA sequence
acttgtgtaagaaatattaa

SEQ ID NO: 94890 - DNA, 20 bp, Artificial
  CRISPR gRNA sequence
gtgtaagaaatattaatttt

SEQ ID NO: 94891 - DNA, 20 bp, Artificial
  CRISPR gRNA sequence
tgtaagaaatattaatttta

SEQ ID NO: 94892 - DNA, 20 bp, Artificial
  CRISPR gRNA sequence
attttagataccttaatttc

SEQ ID NO: 94893 - DNA, 20 bp, Artificial
  CRISPR gRNA sequence
tagataccttaatttcttta

SEQ ID NO: 94894 - DNA, 20 bp, Artificial
  CRISPR gRNA sequence
agataccttaatttctttaa

SEQ ID NO: 94895 - DNA, 20 bp, Artificial
  CRISPR gRNA sequence
gataccttaatttctttaat

SEQ ID NO: 94896 - DNA, 20 bp, Artificial
  CRISPR gRNA sequence
aatttctttaatttttttac

SEQ ID NO: 94897 - DNA, 20 bp, Artificial
  CRISPR gRNA sequence
atttctttaatttttttacc

SEQ ID NO: 94898 - DNA, 20 bp, Artificial
  CRISPR gRNA sequence
ctttaatttttttaccttaa

SEQ ID NO: 94899 - DNA, 20 bp, Artificial
  CRISPR gRNA sequence
tttaatttttttaccttaat

SEQ ID NO: 94900 - DNA, 20 bp, Artificial
  CRISPR gRNA sequence
taatttttttaccttaataa

SEQ ID NO: 94901 - DNA, 20 bp, Artificial
  CRISPR gRNA sequence
aatttttttaccttaataaa

SEQ ID NO: 94902 - DNA, 20 bp, Artificial
  CRISPR gRNA sequence
atttttttaccttaataaat

SEQ ID NO: 94903 - DNA, 20 bp, Artificial
  CRISPR gRNA sequence
ttttaccttaataaattctt

SEQ ID NO: 94904 - DNA, 20 bp, Artificial
  CRISPR gRNA sequence
tttaccttaataaattcttc

SEQ ID NO: 94905 - DNA, 20 bp, Artificial
  CRISPR gRNA sequence
ttaccttaataaattcttca

SEQ ID NO: 94906 - DNA, 20 bp, Artificial
  CRISPR gRNA sequence
taccttaataaattcttcat

SEQ ID NO: 94907 - DNA, 20 bp, Artificial
  CRISPR gRNA sequence
accttaataaattcttcatt

SEQ ID NO: 94908 - DNA, 20 bp, Artificial
  CRISPR gRNA sequence
ccttaataaattcttcattg

SEQ ID NO: 94909 - DNA, 20 bp, Artificial
  CRISPR gRNA sequence
aataaattcttcattggaat

SEQ ID NO: 94910 - DNA, 20 bp, Artificial
  CRISPR gRNA sequence
ataaattcttcattggaata

SEQ ID NO: 94911 - DNA, 20 bp, Artificial
  CRISPR gRNA sequence
ttcattggaatagagaactt

SEQ ID NO: 94912 - DNA, 20 bp, Artificial
  CRISPR gRNA sequence
cattggaatagagaacttaa

SEQ ID NO: 94913 - DNA, 20 bp, Artificial
  CRISPR gRNA sequence
attggaatagagaacttaat

SEQ ID NO: 94914 - DNA, 20 bp, Artificial
  CRISPR gRNA sequence
gaatagagaacttaatttct

SEQ ID NO: 94915 - DNA, 20 bp, Artificial
  CRISPR gRNA sequence
aatttctaatcttgctgctc

SEQ ID NO: 94916 - DNA, 20 bp, Artificial
  CRISPR gRNA sequence
atttctaatcttgctgctca

SEQ ID NO: 94917 - DNA, 20 bp, Artificial
  CRISPR gRNA sequence
ctaatcttgctgctcacaac

SEQ ID NO: 94918 - DNA, 20 bp, Artificial
  CRISPR gRNA sequence
taatcttgctgctcacaaca

SEQ ID NO: 94919 - DNA, 20 bp, Artificial
  CRISPR gRNA sequence
atcttgctgctcacaacata

SEQ ID NO: 94920 - DNA, 20 bp, Artificial
  CRISPR gRNA sequence
gctgctcacaacatagcaga

SEQ ID NO: 94921 - DNA, 20 bp, Artificial
  CRISPR gRNA sequence
ctgctcacaacatagcagaa

SEQ ID NO: 94922 - DNA, 20 bp, Artificial
  CRISPR gRNA sequence
ctcacaacatagcagaagac

SEQ ID NO: 94923 - DNA, 20 bp, Artificial
  CRISPR gRNA sequence
acaacatagcagaagacacc

SEQ ID NO: 94924 - DNA, 20 bp, Artificial
  CRISPR gRNA sequence
tcagtcctactataataatc

SEQ ID NO: 94925 - DNA, 20 bp, Artificial
  CRISPR gRNA sequence
ctataataatcttcgaaaga

SEQ ID NO: 94926 - DNA, 20 bp, Artificial
  CRISPR gRNA sequence
taataatcttcgaaagagtc

SEQ ID NO: 94927 - DNA, 20 bp, Artificial
  CRISPR gRNA sequence
cgaaagagtctcaaaatcta

SEQ ID NO: 94928 - DNA, 20 bp, Artificial
  CRISPR gRNA sequence
gaaagagtctcaaaatctat

SEQ ID NO: 94929 - DNA, 20 bp, Artificial
  CRISPR gRNA sequence
aaaatctataggctctcaac

SEQ ID NO: 94930 - DNA, 20 bp, Artificial
  CRISPR gRNA sequence
taggctctcaactttaaccc

SEQ ID NO: 94931 - DNA, 20 bp, Artificial
  CRISPR gRNA sequence
tcaactttaacccactccat

SEQ ID NO: 94932 - DNA, 20 bp, Artificial
  CRISPR gRNA sequence
aactttaacccactccatca

SEQ ID NO: 94933 - DNA, 20 bp, Artificial
  CRISPR gRNA sequence
taacccactccatcagggta

SEQ ID NO: 94934 - DNA, 20 bp, Artificial
  CRISPR gRNA sequence
aacccactccatcagggtag

SEQ ID NO: 94935 - DNA, 20 bp, Artificial
  CRISPR gRNA sequence
acccactccatcagggtagg

SEQ ID NO: 94936 - DNA, 20 bp, Artificial
  CRISPR gRNA sequence
catcagggtaggatcctctg

SEQ ID NO: 94937 - DNA, 20 bp, Artificial
  CRISPR gRNA sequence
tgctacttcctaattagatc

SEQ ID NO: 94938 - DNA, 20 bp, Artificial
  CRISPR gRNA sequence
ctacttcctaattagatcat

SEQ ID NO: 94939 - DNA, 20 bp, Artificial
  CRISPR gRNA sequence
cttcctaattagatcatttc

SEQ ID NO: 94940 - DNA, 20 bp, Artificial
  CRISPR gRNA sequence
cctaattagatcatttcatt

SEQ ID NO: 94941 - DNA, 20 bp, Artificial
  CRISPR gRNA sequence
ctaattagatcatttcattt

SEQ ID NO: 94942 - DNA, 20 bp, Artificial
  CRISPR gRNA sequence
attagatcatttcatttaaa

SEQ ID NO: 94943 - DNA, 20 bp, Artificial
  CRISPR gRNA sequence
gatcatttcatttaaagact

SEQ ID NO: 94944 - DNA, 20 bp, Artificial
  CRISPR gRNA sequence
catttaaagactccaaatcc

SEQ ID NO: 94945 - DNA, 20 bp, Artificial
  CRISPR gRNA sequence
atttaaagactccaaatcca

SEQ ID NO: 94946 - DNA, 20 bp, Artificial
  CRISPR gRNA sequence
aaagactccaaatccaaatc

SEQ ID NO: 94947 - DNA, 20 bp, Artificial
  CRISPR gRNA sequence
aagactccaaatccaaatcc

SEQ ID NO: 94948 - DNA, 20 bp, Artificial
  CRISPR gRNA sequence
caaatccaaatcccatagcc

SEQ ID NO: 94949 - DNA, 20 bp, Artificial
  CRISPR gRNA sequence
gcattcaatactataaaaaa

SEQ ID NO: 94950 - DNA, 20 bp, Artificial
  CRISPR gRNA sequence
aatactataaaaaactggct

SEQ ID NO: 94951 - DNA, 20 bp, Artificial
  CRISPR gRNA sequence
taaaaaactggcttcaacct

SEQ ID NO: 94952 - DNA, 20 bp, Artificial
  CRISPR gRNA sequence
gcttcaacctatctttccaa

SEQ ID NO: 94953 - DNA, 20 bp, Artificial
  CRISPR gRNA sequence
caacctatctttccaaattt

SEQ ID NO: 94954 - DNA, 20 bp, Artificial
  CRISPR gRNA sequence
aacctatctttccaaatttc

SEQ ID NO: 94955 - DNA, 20 bp, Artificial
  CRISPR gRNA sequence
tctttccaaatttctctctc

SEQ ID NO: 94956 - DNA, 20 bp, Artificial
  CRISPR gRNA sequence
tccaaatttctctctcatga

SEQ ID NO: 94957 - DNA, 20 bp, Artificial
  CRISPR gRNA sequence
ccaaatttctctctcatgaa

SEQ ID NO: 94958 - DNA, 20 bp, Artificial
  CRISPR gRNA sequence
caaatttctctctcatgaat

SEQ ID NO: 94959 - DNA, 20 bp, Artificial
  CRISPR gRNA sequence
ctctctcatgaattttccac

SEQ ID NO: 94960 - DNA, 20 bp, Artificial
  CRISPR gRNA sequence
tctctcatgaattttccact

SEQ ID NO: 94961 - DNA, 20 bp, Artificial
  CRISPR gRNA sequence
tctcatgaattttccactca

SEQ ID NO: 94962 - DNA, 20 bp, Artificial
  CRISPR gRNA sequence
tcatgaattttccactcaac

SEQ ID NO: 94963 - DNA, 20 bp, Artificial
  CRISPR gRNA sequence
atgaattttccactcaacta

SEQ ID NO: 94964 - DNA, 20 bp, Artificial
  CRISPR gRNA sequence
tccactcaactattttagct

SEQ ID NO: 94965 - DNA, 20 bp, Artificial
  CRISPR gRNA sequence
ccactcaactattttagcta

SEQ ID NO: 94966 - DNA, 20 bp, Artificial
  CRISPR gRNA sequence
cactcaactattttagctag

SEQ ID NO: 94967 - DNA, 20 bp, Artificial
  CRISPR gRNA sequence
aactattttagctagaatag

SEQ ID NO: 94968 - DNA, 20 bp, Artificial
  CRISPR gRNA sequence
ttttagctagaatagtccac

SEQ ID NO: 94969 - DNA, 20 bp, Artificial
  CRISPR gRNA sequence
tagctagaatagtccacttg

SEQ ID NO: 94970 - DNA, 20 bp, Artificial
  CRISPR gRNA sequence
agctagaatagtccacttgc

SEQ ID NO: 94971 - DNA, 20 bp, Artificial
  CRISPR gRNA sequence
gctagaatagtccacttgct

SEQ ID NO: 94972 - DNA, 20 bp, Artificial
  CRISPR gRNA sequence
gaatagtccacttgctatct

SEQ ID NO: 94973 - DNA, 20 bp, Artificial
  CRISPR gRNA sequence
gctatcttcacaaaagtgtt

SEQ ID NO: 94974 - DNA, 20 bp, Artificial
  CRISPR gRNA sequence
ctatcttcacaaaagtgttt

SEQ ID NO: 94975 - DNA, 20 bp, Artificial
  CRISPR gRNA sequence
tcttcacaaaagtgttttct

SEQ ID NO: 94976 - DNA, 20 bp, Artificial
  CRISPR gRNA sequence
cacaaaagtgttttctgtat

SEQ ID NO: 94977 - DNA, 20 bp, Artificial
  CRISPR gRNA sequence
acaaaagtgttttctgtatt

SEQ ID NO: 94978 - DNA, 20 bp, Artificial
  CRISPR gRNA sequence
tctgtattcctacttctctt

SEQ ID NO: 94979 - DNA, 20 bp, Artificial
  CRISPR gRNA sequence
ctgtattcctacttctcttt

SEQ ID NO: 94980 - DNA, 20 bp, Artificial
  CRISPR gRNA sequence
tgtattcctacttctctttc

SEQ ID NO: 94981 - DNA, 20 bp, Artificial
  CRISPR gRNA sequence
tattcctacttctctttctt

SEQ ID NO: 94982 - DNA, 20 bp, Artificial
  CRISPR gRNA sequence
ctacttctctttctttacta

SEQ ID NO: 94983 - DNA, 20 bp, Artificial
  CRISPR gRNA sequence
cttctctttctttactaaaa

SEQ ID NO: 94984 - DNA, 20 bp, Artificial
  CRISPR gRNA sequence
ctctttctttactaaaatgt

SEQ ID NO: 94985 - DNA, 20 bp, Artificial
  CRISPR gRNA sequence
tctttctttactaaaatgtg

SEQ ID NO: 94986 - DNA, 20 bp, Artificial
  CRISPR gRNA sequence
tttctttactaaaatgtgct

SEQ ID NO: 94987 - DNA, 20 bp, Artificial
  CRISPR gRNA sequence
tctttactaaaatgtgcttc

SEQ ID NO: 94988 - DNA, 20 bp, Artificial
  CRISPR gRNA sequence
ctttactaaaatgtgcttct

SEQ ID NO: 94989 - DNA, 20 bp, Artificial
  CRISPR gRNA sequence
tttactaaaatgtgcttctc

SEQ ID NO: 94990 - DNA, 20 bp, Artificial
  CRISPR gRNA sequence
tactaaaatgtgcttctctt

SEQ ID NO: 94991 - DNA, 20 bp, Artificial
  CRISPR gRNA sequence
actaaaatgtgcttctcttt

SEQ ID NO: 94992 - DNA, 20 bp, Artificial
  CRISPR gRNA sequence
ctaaaatgtgcttctctttc

SEQ ID NO: 94993 - DNA, 20 bp, Artificial
  CRISPR gRNA sequence
aaatgtgcttctctttcctt

SEQ ID NO: 94994 - DNA, 20 bp, Artificial
  CRISPR gRNA sequence
ctctttccttttatctacca

SEQ ID NO: 94995 - DNA, 20 bp, Artificial
  CRISPR gRNA sequence
tctttccttttatctaccag

SEQ ID NO: 94996 - DNA, 20 bp, Artificial
  CRISPR gRNA sequence
tttccttttatctaccagaa

SEQ ID NO: 94997 - DNA, 20 bp, Artificial
  CRISPR gRNA sequence
tccttttatctaccagaatt

SEQ ID NO: 94998 - DNA, 20 bp, Artificial
  CRISPR gRNA sequence
ccttttatctaccagaattc

SEQ ID NO: 94999 - DNA, 20 bp, Artificial
  CRISPR gRNA sequence
cttttatctaccagaattct

SEQ ID NO: 95000 - DNA, 20 bp, Artificial
  CRISPR gRNA sequence
ttatctaccagaattctagg

SEQ ID NO: 95001 - DNA, 20 bp, Artificial
  CRISPR gRNA sequence
tatctaccagaattctaggg

SEQ ID NO: 95002 - DNA, 20 bp, Artificial
  CRISPR gRNA sequence
atctaccagaattctaggga

SEQ ID NO: 95003 - DNA, 20 bp, Artificial
  CRISPR gRNA sequence
tctaccagaattctagggaa

SEQ ID NO: 95004 - DNA, 20 bp, Artificial
  CRISPR gRNA sequence
ccagaattctagggaagcag

SEQ ID NO: 95005 - DNA, 20 bp, Artificial
  CRISPR gRNA sequence
tagggaagcagtatagtaag

SEQ ID NO: 95006 - DNA, 20 bp, Artificial
  CRISPR gRNA sequence
gggaagcagtatagtaagga

SEQ ID NO: 95007 - DNA, 20 bp, Artificial
  CRISPR gRNA sequence
tagaataagactgcttgcgt

SEQ ID NO: 95008 - DNA, 20 bp, Artificial
  CRISPR gRNA sequence
gaataagactgcttgcgttt

SEQ ID NO: 95009 - DNA, 20 bp, Artificial
  CRISPR gRNA sequence
cttgcgtttgagtacaatac

SEQ ID NO: 95010 - DNA, 20 bp, Artificial
  CRISPR gRNA sequence
gcgtttgagtacaatacttg

SEQ ID NO: 95011 - DNA, 20 bp, Artificial
  CRISPR gRNA sequence
cgtttgagtacaatacttgc

SEQ ID NO: 95012 - DNA, 20 bp, Artificial
  CRISPR gRNA sequence
gagtacaatacttgctggct

SEQ ID NO: 95013 - DNA, 20 bp, Artificial
  CRISPR gRNA sequence
agtacaatacttgctggctg

SEQ ID NO: 95014 - DNA, 20 bp, Artificial
  CRISPR gRNA sequence
gctggctgtatgacctaggc

SEQ ID NO: 95015 - DNA, 20 bp, Artificial
  CRISPR gRNA sequence
ctggctgtatgacctaggcc

SEQ ID NO: 95016 - DNA, 20 bp, Artificial
  CRISPR gRNA sequence
gctgtatgacctaggccaaa

SEQ ID NO: 95017 - DNA, 20 bp, Artificial
  CRISPR gRNA sequence
tatgacctaggccaaattct

SEQ ID NO: 95018 - DNA, 20 bp, Artificial
  CRISPR gRNA sequence
ggccaaattctttagcctct

SEQ ID NO: 95019 - DNA, 20 bp, Artificial
  CRISPR gRNA sequence
tttagcctctctgtgcctca

SEQ ID NO: 95020 - DNA, 20 bp, Artificial
  CRISPR gRNA sequence
tagcctctctgtgcctcagt

SEQ ID NO: 95021 - DNA, 20 bp, Artificial
  CRISPR gRNA sequence
agcctctctgtgcctcagtt

SEQ ID NO: 95022 - DNA, 20 bp, Artificial
  CRISPR gRNA sequence
gcctctctgtgcctcagttt

SEQ ID NO: 95023 - DNA, 20 bp, Artificial
  CRISPR gRNA sequence
tctgtgcctcagtttccatg

SEQ ID NO: 95024 - DNA, 20 bp, Artificial
  CRISPR gRNA sequence
tgtgcctcagtttccatgta

SEQ ID NO: 95025 - DNA, 20 bp, Artificial
  CRISPR gRNA sequence
tgcctcagtttccatgtatg

SEQ ID NO: 95026 - DNA, 20 bp, Artificial
  CRISPR gRNA sequence
agtttccatgtatgtaaaat

SEQ ID NO: 95027 - DNA, 20 bp, Artificial
  CRISPR gRNA sequence
ccatgtatgtaaaatatagt

SEQ ID NO: 95028 - DNA, 20 bp, Artificial
  CRISPR gRNA sequence
catgtatgtaaaatatagta

SEQ ID NO: 95029 - DNA, 20 bp, Artificial
  CRISPR gRNA sequence
tcccattgctgaagggttgt

SEQ ID NO: 95030 - DNA, 20 bp, Artificial
  CRISPR gRNA sequence
ctgaagggttgtgagactcc

SEQ ID NO: 95031 - DNA, 20 bp, Artificial
  CRISPR gRNA sequence
aagggttgtgagactccatt

SEQ ID NO: 95032 - DNA, 20 bp, Artificial
  CRISPR gRNA sequence
tgagactccatttatagctt

SEQ ID NO: 95033 - DNA, 20 bp, Artificial
  CRISPR gRNA sequence
catttatagcttaacacagt

SEQ ID NO: 95034 - DNA, 20 bp, Artificial
  CRISPR gRNA sequence
atagcttaacacagtgcttg

SEQ ID NO: 95035 - DNA, 20 bp, Artificial
  CRISPR gRNA sequence
tagcttaacacagtgcttga

SEQ ID NO: 95036 - DNA, 20 bp, Artificial
  CRISPR gRNA sequence
aacacagtgcttgacacata

SEQ ID NO: 95037 - DNA, 20 bp, Artificial
  CRISPR gRNA sequence
acacagtgcttgacacataa

SEQ ID NO: 95038 - DNA, 20 bp, Artificial
  CRISPR gRNA sequence
gacacataagaaactcagct

SEQ ID NO: 95039 - DNA, 20 bp, Artificial
  CRISPR gRNA sequence
acacataagaaactcagctc

SEQ ID NO: 95040 - DNA, 20 bp, Artificial
  CRISPR gRNA sequence
agctcattaagcgtaaacta

SEQ ID NO: 95041 - DNA, 20 bp, Artificial
  CRISPR gRNA sequence
attaagcgtaaactattgcc

SEQ ID NO: 95042 - DNA, 20 bp, Artificial
  CRISPR gRNA sequence
agcgtaaactattgcccatc

SEQ ID NO: 95043 - DNA, 20 bp, Artificial
  CRISPR gRNA sequence
ttgcccatcctttctggttt

SEQ ID NO: 95044 - DNA, 20 bp, Artificial
  CRISPR gRNA sequence
cccatcctttctggtttata

SEQ ID NO: 95045 - DNA, 20 bp, Artificial
  CRISPR gRNA sequence
tctggtttatactgagtcac

SEQ ID NO: 95046 - DNA, 20 bp, Artificial
  CRISPR gRNA sequence
ctggtttatactgagtcacg

SEQ ID NO: 95047 - DNA, 20 bp, Artificial
  CRISPR gRNA sequence
tggtttatactgagtcacgt

SEQ ID NO: 95048 - DNA, 20 bp, Artificial
  CRISPR gRNA sequence
gtttatactgagtcacgttt

SEQ ID NO: 95049 - DNA, 20 bp, Artificial
  CRISPR gRNA sequence
atactgagtcacgtttcctc

SEQ ID NO: 95050 - DNA, 20 bp, Artificial
  CRISPR gRNA sequence
tactgagtcacgtttcctct

SEQ ID NO: 95051 - DNA, 20 bp, Artificial
  CRISPR gRNA sequence
agtcacgtttcctctgcaaa

SEQ ID NO: 95052 - DNA, 20 bp, Artificial
  CRISPR gRNA sequence
cctctgcaaagcctttctgg

SEQ ID NO: 95053 - DNA, 20 bp, Artificial
  CRISPR gRNA sequence
ctctgcaaagcctttctgga

SEQ ID NO: 95054 - DNA, 20 bp, Artificial
  CRISPR gRNA sequence
tgcaaagcctttctggagta

SEQ ID NO: 95055 - DNA, 20 bp, Artificial
  CRISPR gRNA sequence
caaagcctttctggagtatc

SEQ ID NO: 95056 - DNA, 20 bp, Artificial
  CRISPR gRNA sequence
tctggagtatctcagcctac

SEQ ID NO: 95057 - DNA, 20 bp, Artificial
  CRISPR gRNA sequence
ctggagtatctcagcctaca

SEQ ID NO: 95058 - DNA, 20 bp, Artificial
  CRISPR gRNA sequence
tggagtatctcagcctacaa

SEQ ID NO: 95059 - DNA, 20 bp, Artificial
  CRISPR gRNA sequence
gagtatctcagcctacaatg

SEQ ID NO: 95060 - DNA, 20 bp, Artificial
  CRISPR gRNA sequence
agcctacaatgatctatcct

SEQ ID NO: 95061 - DNA, 20 bp, Artificial
  CRISPR gRNA sequence
caatgatctatcctcctctg

SEQ ID NO: 95062 - DNA, 20 bp, Artificial
  CRISPR gRNA sequence
tcctcctctgaactactaaa

SEQ ID NO: 95063 - DNA, 20 bp, Artificial
  CRISPR gRNA sequence
ctctgaactactaaaaccgg

SEQ ID NO: 95064 - DNA, 20 bp, Artificial
  CRISPR gRNA sequence
tgaactactaaaaccggact

SEQ ID NO: 95065 - DNA, 20 bp, Artificial
  CRISPR gRNA sequence
aactactaaaaccggactat

SEQ ID NO: 95066 - DNA, 20 bp, Artificial
  CRISPR gRNA sequence
ctaaaaccggactatacagt

SEQ ID NO: 95067 - DNA, 20 bp, Artificial
  CRISPR gRNA sequence
aaaccggactatacagttgg

SEQ ID NO: 95068 - DNA, 20 bp, Artificial
  CRISPR gRNA sequence
tacagttggctcttattata

SEQ ID NO: 95069 - DNA, 20 bp, Artificial
  CRISPR gRNA sequence
gctcttattatatcctggct

SEQ ID NO: 95070 - DNA, 20 bp, Artificial
  CRISPR gRNA sequence
ttattatatcctggctggca

SEQ ID NO: 95071 - DNA, 20 bp, Artificial
  CRISPR gRNA sequence
attatatcctggctggcact

SEQ ID NO: 95072 - DNA, 20 bp, Artificial
  CRISPR gRNA sequence
ttatatcctggctggcactg

SEQ ID NO: 95073 - DNA, 20 bp, Artificial
  CRISPR gRNA sequence
tatcctggctggcactgtta

SEQ ID NO: 95074 - DNA, 20 bp, Artificial
  CRISPR gRNA sequence
gctggcactgttattttctt

SEQ ID NO: 95075 - DNA, 20 bp, Artificial
  CRISPR gRNA sequence
gcactgttattttctttaca

SEQ ID NO: 95076 - DNA, 20 bp, Artificial
  CRISPR gRNA sequence
ttattttctttacactcagt

SEQ ID NO: 95077 - DNA, 20 bp, Artificial
  CRISPR gRNA sequence
ttttctttacactcagttta

SEQ ID NO: 95078 - DNA, 20 bp, Artificial
  CRISPR gRNA sequence
tctttacactcagtttaaca

SEQ ID NO: 95079 - DNA, 20 bp, Artificial
  CRISPR gRNA sequence
ctttacactcagtttaacaa

SEQ ID NO: 95080 - DNA, 20 bp, Artificial
  CRISPR gRNA sequence
tttacactcagtttaacaaa

SEQ ID NO: 95081 - DNA, 20 bp, Artificial
  CRISPR gRNA sequence
tacactcagtttaacaaaga

SEQ ID NO: 95082 - DNA, 20 bp, Artificial
  CRISPR gRNA sequence
acactcagtttaacaaagat

SEQ ID NO: 95083 - DNA, 20 bp, Artificial
  CRISPR gRNA sequence
cactcagtttaacaaagata

SEQ ID NO: 95084 - DNA, 20 bp, Artificial
  CRISPR gRNA sequence
agtttaacaaagataaagat

SEQ ID NO: 95085 - DNA, 20 bp, Artificial
  CRISPR gRNA sequence
aacaaagataaagatttaca

SEQ ID NO: 95086 - DNA, 20 bp, Artificial
  CRISPR gRNA sequence
acaaagataaagatttacag

SEQ ID NO: 95087 - DNA, 20 bp, Artificial
  CRISPR gRNA sequence
acagatcttgttacctcctc

SEQ ID NO: 95088 - DNA, 20 bp, Artificial
  CRISPR gRNA sequence
cagatcttgttacctcctca

SEQ ID NO: 95089 - DNA, 20 bp, Artificial
  CRISPR gRNA sequence
gttacctcctcagaactgat

SEQ ID NO: 95090 - DNA, 20 bp, Artificial
  CRISPR gRNA sequence
ttacctcctcagaactgata

SEQ ID NO: 95091 - DNA, 20 bp, Artificial
  CRISPR gRNA sequence
cctcctcagaactgataaag

SEQ ID NO: 95092 - DNA, 20 bp, Artificial
  CRISPR gRNA sequence
ctcagaactgataaagtatc

SEQ ID NO: 95093 - DNA, 20 bp, Artificial
  CRISPR gRNA sequence
agaactgataaagtatccca

SEQ ID NO: 95094 - DNA, 20 bp, Artificial
  CRISPR gRNA sequence
ataaagtatcccaaaatata

SEQ ID NO: 95095 - DNA, 20 bp, Artificial
  CRISPR gRNA sequence
gatagtaaactattagtatt

SEQ ID NO: 95096 - DNA, 20 bp, Artificial
  CRISPR gRNA sequence
ttagtattatttgttgctta

SEQ ID NO: 95097 - DNA, 20 bp, Artificial
  CRISPR gRNA sequence
gtattatttgttgcttatag

SEQ ID NO: 95098 - DNA, 20 bp, Artificial
  CRISPR gRNA sequence
tttgttgcttatagcaatta

SEQ ID NO: 95099 - DNA, 20 bp, Artificial
  CRISPR gRNA sequence
gttgcttatagcaattaatt

SEQ ID NO: 95100 - DNA, 20 bp, Artificial
  CRISPR gRNA sequence
ttgcttatagcaattaattc

SEQ ID NO: 95101 - DNA, 20 bp, Artificial
  CRISPR gRNA sequence
cttatagcaattaattccct

SEQ ID NO: 95102 - DNA, 20 bp, Artificial
  CRISPR gRNA sequence
atagcaattaattcccttcc

SEQ ID NO: 95103 - DNA, 20 bp, Artificial
  CRISPR gRNA sequence
tagcaattaattcccttcca

SEQ ID NO: 95104 - DNA, 20 bp, Artificial
  CRISPR gRNA sequence
attcccttccataaaaagtc

SEQ ID NO: 95105 - DNA, 20 bp, Artificial
  CRISPR gRNA sequence
ccttccataaaaagtcatgc

SEQ ID NO: 95106 - DNA, 20 bp, Artificial
  CRISPR gRNA sequence
ccataaaaagtcatgcaaat

SEQ ID NO: 95107 - DNA, 20 bp, Artificial
  CRISPR gRNA sequence
cataaaaagtcatgcaaatt

SEQ ID NO: 95108 - DNA, 20 bp, Artificial
  CRISPR gRNA sequence
ttttaaaatagtgaagctag

SEQ ID NO: 95109 - DNA, 20 bp, Artificial
  CRISPR gRNA sequence
taaaatagtgaagctaggtg

SEQ ID NO: 95110 - DNA, 20 bp, Artificial
  CRISPR gRNA sequence
aaaatagtgaagctaggtgc

SEQ ID NO: 95111 - DNA, 20 bp, Artificial
  CRISPR gRNA sequence
aaatagtgaagctaggtgca

SEQ ID NO: 95112 - DNA, 20 bp, Artificial
  CRISPR gRNA sequence
ggtgcagtggtgaaataatc

SEQ ID NO: 95113 - DNA, 20 bp, Artificial
  CRISPR gRNA sequence
ctctgaaggctgaggcagga

SEQ ID NO: 95114 - DNA, 20 bp, Artificial
  CRISPR gRNA sequence
tgaaggctgaggcaggagga

SEQ ID NO: 95115 - DNA, 20 bp, Artificial
  CRISPR gRNA sequence
aaggctgaggcaggaggatc

SEQ ID NO: 95116 - DNA, 20 bp, Artificial
  CRISPR gRNA sequence
aggcaggaggatcacttgag

SEQ ID NO: 95117 - DNA, 20 bp, Artificial
  CRISPR gRNA sequence
gagcccaggaattcgaggcc

SEQ ID NO: 95118 - DNA, 20 bp, Artificial
  CRISPR gRNA sequence
agcccaggaattcgaggcca

SEQ ID NO: 95119 - DNA, 20 bp, Artificial
  CRISPR gRNA sequence
gaggccagcctgggcaacac

SEQ ID NO: 95120 - DNA, 20 bp, Artificial
  CRISPR gRNA sequence
ggcaacactgtgagacccat

SEQ ID NO: 95121 - DNA, 20 bp, Artificial
  CRISPR gRNA sequence
tgagacccatctctaaaaaa

SEQ ID NO: 95122 - DNA, 20 bp, Artificial
  CRISPR gRNA sequence
taaaaaattagataagtaaa

SEQ ID NO: 95123 - DNA, 20 bp, Artificial
  CRISPR gRNA sequence
aaaaattagataagtaaata

SEQ ID NO: 95124 - DNA, 20 bp, Artificial
  CRISPR gRNA sequence
gataagtaaataaataacaa

SEQ ID NO: 95125 - DNA, 20 bp, Artificial
  CRISPR gRNA sequence
tttttgtgggaggtgcagag

SEQ ID NO: 95126 - DNA, 20 bp, Artificial
  CRISPR gRNA sequence
tttgtgggaggtgcagaggg

SEQ ID NO: 95127 - DNA, 20 bp, Artificial
  CRISPR gRNA sequence
ttgtgggaggtgcagaggga

SEQ ID NO: 95128 - DNA, 20 bp, Artificial
  CRISPR gRNA sequence
tgtgggaggtgcagagggag

SEQ ID NO: 95129 - DNA, 20 bp, Artificial
  CRISPR gRNA sequence
gtgggaggtgcagagggaga

SEQ ID NO: 95130 - DNA, 20 bp, Artificial
  CRISPR gRNA sequence
tgggaggtgcagagggagac

SEQ ID NO: 95131 - DNA, 20 bp, Artificial
  CRISPR gRNA sequence
attcagtatctatctgcctt

SEQ ID NO: 95132 - DNA, 20 bp, Artificial
  CRISPR gRNA sequence
agtatctatctgccttttat

SEQ ID NO: 95133 - DNA, 20 bp, Artificial
  CRISPR gRNA sequence
tctgccttttatacattttc

SEQ ID NO: 95134 - DNA, 20 bp, Artificial
  CRISPR gRNA sequence
ccttttatacattttcctca

SEQ ID NO: 95135 - DNA, 20 bp, Artificial
  CRISPR gRNA sequence
ttatacattttcctcactgt

SEQ ID NO: 95136 - DNA, 20 bp, Artificial
  CRISPR gRNA sequence
tatacattttcctcactgta

SEQ ID NO: 95137 - DNA, 20 bp, Artificial
  CRISPR gRNA sequence
atacattttcctcactgtag

SEQ ID NO: 95138 - DNA, 20 bp, Artificial
  CRISPR gRNA sequence
tacattttcctcactgtaga

SEQ ID NO: 95139 - DNA, 20 bp, Artificial
  CRISPR gRNA sequence
tcctcactgtagatgtaaat

SEQ ID NO: 95140 - DNA, 20 bp, Artificial
  CRISPR gRNA sequence
cctcactgtagatgtaaatg

SEQ ID NO: 95141 - DNA, 20 bp, Artificial
  CRISPR gRNA sequence
ctcactgtagatgtaaatgt

SEQ ID NO: 95142 - DNA, 20 bp, Artificial
  CRISPR gRNA sequence
actgtagatgtaaatgttag

SEQ ID NO: 95143 - DNA, 20 bp, Artificial
  CRISPR gRNA sequence
tagatgtaaatgttaggtag

SEQ ID NO: 95144 - DNA, 20 bp, Artificial
  CRISPR gRNA sequence
ggtagtttaaaaaaaaaaaa

SEQ ID NO: 95145 - DNA, 20 bp, Artificial
  CRISPR gRNA sequence
aaaaaaaaaaaagtaagcag

SEQ ID NO: 95146 - DNA, 20 bp, Artificial
  CRISPR gRNA sequence
aaaaaaaaaaagtaagcagc

SEQ ID NO: 95147 - DNA, 20 bp, Artificial
  CRISPR gRNA sequence
actacttctttcttgaaaat

SEQ ID NO: 95148 - DNA, 20 bp, Artificial
  CRISPR gRNA sequence
cttctttcttgaaaataagt

SEQ ID NO: 95149 - DNA, 20 bp, Artificial
  CRISPR gRNA sequence
ctttcttgaaaataagtatt

SEQ ID NO: 95150 - DNA, 20 bp, Artificial
  CRISPR gRNA sequence
tttcttgaaaataagtatta

SEQ ID NO: 95151 - DNA, 20 bp, Artificial
  CRISPR gRNA sequence
tcttgaaaataagtattatt

SEQ ID NO: 95152 - DNA, 20 bp, Artificial
  CRISPR gRNA sequence
cttgaaaataagtattatta

SEQ ID NO: 95153 - DNA, 20 bp, Artificial
  CRISPR gRNA sequence
ttgaaaataagtattattag

SEQ ID NO: 95154 - DNA, 20 bp, Artificial
  CRISPR gRNA sequence
gaaaataagtattattaggc

SEQ ID NO: 95155 - DNA, 20 bp, Artificial
  CRISPR gRNA sequence
aaaataagtattattaggcc

SEQ ID NO: 95156 - DNA, 20 bp, Artificial
  CRISPR gRNA sequence
ttaggccggcgtggtgggtc

SEQ ID NO: 95157 - DNA, 20 bp, Artificial
  CRISPR gRNA sequence
ggccggcgtggtgggtctca

SEQ ID NO: 95158 - DNA, 20 bp, Artificial
  CRISPR gRNA sequence
acccgtaatcccagcacttc

SEQ ID NO: 95159 - DNA, 20 bp, Artificial
  CRISPR gRNA sequence
caggaggctgaggtgggagg

SEQ ID NO: 95160 - DNA, 20 bp, Artificial
  CRISPR gRNA sequence
aggaggctgaggtgggagga

SEQ ID NO: 95161 - DNA, 20 bp, Artificial
  CRISPR gRNA sequence
aggtgggaggatcaggagtt

SEQ ID NO: 95162 - DNA, 20 bp, Artificial
  CRISPR gRNA sequence
gagaccagactggccaacat

SEQ ID NO: 95163 - DNA, 20 bp, Artificial
  CRISPR gRNA sequence
gccaacatggcaaaaccgcg

SEQ ID NO: 95164 - DNA, 20 bp, Artificial
  CRISPR gRNA sequence
tactaaaaatacaaaaatta

SEQ ID NO: 95165 - DNA, 20 bp, Artificial
  CRISPR gRNA sequence
ctaaaaatacaaaaattagc

SEQ ID NO: 95166 - DNA, 20 bp, Artificial
  CRISPR gRNA sequence
aaaatacaaaaattagccgg

SEQ ID NO: 95167 - DNA, 20 bp, Artificial
  CRISPR gRNA sequence
gccgggcgtggtggtgcatg

SEQ ID NO: 95168 - DNA, 20 bp, Artificial
  CRISPR gRNA sequence
taatcccagctactcaggag

SEQ ID NO: 95169 - DNA, 20 bp, Artificial
  CRISPR gRNA sequence
ctcaggaggctgaggcacaa

SEQ ID NO: 95170 - DNA, 20 bp, Artificial
  CRISPR gRNA sequence
aggaggctgaggcacaagaa

SEQ ID NO: 95171 - DNA, 20 bp, Artificial
  CRISPR gRNA sequence
aggcacaagaactgcttgaa

SEQ ID NO: 95172 - DNA, 20 bp, Artificial
  CRISPR gRNA sequence
cttgaacccaggaggtggag

SEQ ID NO: 95173 - DNA, 20 bp, Artificial
  CRISPR gRNA sequence
gaacccaggaggtggaggtt

SEQ ID NO: 95174 - DNA, 20 bp, Artificial
  CRISPR gRNA sequence
aacccaggaggtggaggttg

SEQ ID NO: 95175 - DNA, 20 bp, Artificial
  CRISPR gRNA sequence
tagtgggccgagatcgcacc

SEQ ID NO: 95176 - DNA, 20 bp, Artificial
  CRISPR gRNA sequence
cactccagcctgagcgacac

SEQ ID NO: 95177 - DNA, 20 bp, Artificial
  CRISPR gRNA sequence
cagcctgagcgacacagagt

SEQ ID NO: 95178 - DNA, 20 bp, Artificial
  CRISPR gRNA sequence
agcgacacagagtaagactc

SEQ ID NO: 95179 - DNA, 20 bp, Artificial
  CRISPR gRNA sequence
tgtctcaaaaaaaaaaaaga

SEQ ID NO: 95180 - DNA, 20 bp, Artificial
  CRISPR gRNA sequence
tctcaaaaaaaaaaaagaaa

SEQ ID NO: 95181 - DNA, 20 bp, Artificial
  CRISPR gRNA sequence
aaaaaaaaaaaagaaagaaa

SEQ ID NO: 95182 - DNA, 20 bp, Artificial
  CRISPR gRNA sequence
tttttctccctctctaaaga

SEQ ID NO: 95183 - DNA, 20 bp, Artificial
  CRISPR gRNA sequence
ttctccctctctaaagaatt

SEQ ID NO: 95184 - DNA, 20 bp, Artificial
  CRISPR gRNA sequence
tctccctctctaaagaattc

SEQ ID NO: 95185 - DNA, 20 bp, Artificial
  CRISPR gRNA sequence
ctccctctctaaagaattct

SEQ ID NO: 95186 - DNA, 20 bp, Artificial
  CRISPR gRNA sequence
tccctctctaaagaattctg

SEQ ID NO: 95187 - DNA, 20 bp, Artificial
  CRISPR gRNA sequence
cctctctaaagaattctgaa

SEQ ID NO: 95188 - DNA, 20 bp, Artificial
  CRISPR gRNA sequence
tctaaagaattctgaagtga

SEQ ID NO: 95189 - DNA, 20 bp, Artificial
  CRISPR gRNA sequence
taaagaattctgaagtgaat

SEQ ID NO: 95190 - DNA, 20 bp, Artificial
  CRISPR gRNA sequence
aagaattctgaagtgaatgg

SEQ ID NO: 95191 - DNA, 20 bp, Artificial
  CRISPR gRNA sequence
tgaagtgaatgggcacctgt

SEQ ID NO: 95192 - DNA, 20 bp, Artificial
  CRISPR gRNA sequence
aagtgaatgggcacctgtgg

SEQ ID NO: 95193 - DNA, 20 bp, Artificial
  CRISPR gRNA sequence
tggaacatactgaggaagaa

SEQ ID NO: 95194 - DNA, 20 bp, Artificial
  CRISPR gRNA sequence
aggaagaaacttgatcacct

SEQ ID NO: 95195 - DNA, 20 bp, Artificial
  CRISPR gRNA sequence
gatcacctttactaactttc

SEQ ID NO: 95196 - DNA, 20 bp, Artificial
  CRISPR gRNA sequence
atcacctttactaactttca

SEQ ID NO: 95197 - DNA, 20 bp, Artificial
  CRISPR gRNA sequence
tactaactttcattcttttc

SEQ ID NO: 95198 - DNA, 20 bp, Artificial
  CRISPR gRNA sequence
actaactttcattcttttcc

SEQ ID NO: 95199 - DNA, 20 bp, Artificial
  CRISPR gRNA sequence
ctaactttcattcttttcca

SEQ ID NO: 95200 - DNA, 20 bp, Artificial
  CRISPR gRNA sequence
actttcattcttttccagat

SEQ ID NO: 95201 - DNA, 20 bp, Artificial
  CRISPR gRNA sequence
tcattcttttccagatgctt

SEQ ID NO: 95202 - DNA, 20 bp, Artificial
  CRISPR gRNA sequence
cattcttttccagatgctta

SEQ ID NO: 95203 - DNA, 20 bp, Artificial
  CRISPR gRNA sequence
attcttttccagatgcttat

SEQ ID NO: 95204 - DNA, 20 bp, Artificial
  CRISPR gRNA sequence
ttttccagatgcttatttcc

SEQ ID NO: 95205 - DNA, 20 bp, Artificial
  CRISPR gRNA sequence
ttccagatgcttatttccct

SEQ ID NO: 95206 - DNA, 20 bp, Artificial
  CRISPR gRNA sequence
tccagatgcttatttcccta

SEQ ID NO: 95207 - DNA, 20 bp, Artificial
  CRISPR gRNA sequence
ccagatgcttatttccctaa

SEQ ID NO: 95208 - DNA, 20 bp, Artificial
  CRISPR gRNA sequence
cagatgcttatttccctaaa

SEQ ID NO: 95209 - DNA, 20 bp, Artificial
  CRISPR gRNA sequence
atttccctaaatccccgtaa

SEQ ID NO: 95210 - DNA, 20 bp, Artificial
  CRISPR gRNA sequence
tttccctaaatccccgtaat

SEQ ID NO: 95211 - DNA, 20 bp, Artificial
  CRISPR gRNA sequence
ccctaaatccccgtaatcag

SEQ ID NO: 95212 - DNA, 20 bp, Artificial
  CRISPR gRNA sequence
cctaaatccccgtaatcaga

SEQ ID NO: 95213 - DNA, 20 bp, Artificial
  CRISPR gRNA sequence
aatccccgtaatcagagatt

SEQ ID NO: 95214 - DNA, 20 bp, Artificial
  CRISPR gRNA sequence
ggtaaaacatactataagaa

SEQ ID NO: 95215 - DNA, 20 bp, Artificial
  CRISPR gRNA sequence
gtaaaacatactataagaat

SEQ ID NO: 95216 - DNA, 20 bp, Artificial
  CRISPR gRNA sequence
taagaatatggattgagggg

SEQ ID NO: 95217 - DNA, 20 bp, Artificial
  CRISPR gRNA sequence
agggggtttttaaactaaga

SEQ ID NO: 95218 - DNA, 20 bp, Artificial
  CRISPR gRNA sequence
ttaaactaagattacagaag

SEQ ID NO: 95219 - DNA, 20 bp, Artificial
  CRISPR gRNA sequence
taaactaagattacagaagt

SEQ ID NO: 95220 - DNA, 20 bp, Artificial
  CRISPR gRNA sequence
aaactaagattacagaagtc

SEQ ID NO: 95221 - DNA, 20 bp, Artificial
  CRISPR gRNA sequence
aactaagattacagaagtcc

SEQ ID NO: 95222 - DNA, 20 bp, Artificial
  CRISPR gRNA sequence
agattacagaagtcctgagc

SEQ ID NO: 95223 - DNA, 20 bp, Artificial
  CRISPR gRNA sequence
cagaagtcctgagcccatta

SEQ ID NO: 95224 - DNA, 20 bp, Artificial
  CRISPR gRNA sequence
agcccattaattagtatgca

SEQ ID NO: 95225 - DNA, 20 bp, Artificial
  CRISPR gRNA sequence
attagtatgcaaaattaaag

SEQ ID NO: 95226 - DNA, 20 bp, Artificial
  CRISPR gRNA sequence
gtatgcaaaattaaagttac

SEQ ID NO: 95227 - DNA, 20 bp, Artificial
  CRISPR gRNA sequence
aagttacatagtggattttt

SEQ ID NO: 95228 - DNA, 20 bp, Artificial
  CRISPR gRNA sequence
catagtggatttttctagga

SEQ ID NO: 95229 - DNA, 20 bp, Artificial
  CRISPR gRNA sequence
ttctaggaagagtcttcatt

SEQ ID NO: 95230 - DNA, 20 bp, Artificial
  CRISPR gRNA sequence
tctaggaagagtcttcatta

SEQ ID NO: 95231 - DNA, 20 bp, Artificial
  CRISPR gRNA sequence
ctaggaagagtcttcattaa

SEQ ID NO: 95232 - DNA, 20 bp, Artificial
  CRISPR gRNA sequence
taggaagagtcttcattaag

SEQ ID NO: 95233 - DNA, 20 bp, Artificial
  CRISPR gRNA sequence
ggaagagtcttcattaagtc

SEQ ID NO: 95234 - DNA, 20 bp, Artificial
  CRISPR gRNA sequence
cattaagtcaccagaccctc

SEQ ID NO: 95235 - DNA, 20 bp, Artificial
  CRISPR gRNA sequence
attaagtcaccagaccctca

SEQ ID NO: 95236 - DNA, 20 bp, Artificial
  CRISPR gRNA sequence
agtcaccagaccctcaaaga

SEQ ID NO: 95237 - DNA, 20 bp, Artificial
  CRISPR gRNA sequence
aaagaagtcctcttactcca

SEQ ID NO: 95238 - DNA, 20 bp, Artificial
  CRISPR gRNA sequence
ttactccaaaagagtaaaac

SEQ ID NO: 95239 - DNA, 20 bp, Artificial
  CRISPR gRNA sequence
actccaaaagagtaaaactt

SEQ ID NO: 95240 - DNA, 20 bp, Artificial
  CRISPR gRNA sequence
ctccaaaagagtaaaactta

SEQ ID NO: 95241 - DNA, 20 bp, Artificial
  CRISPR gRNA sequence
caaaagagtaaaacttaagg

SEQ ID NO: 95242 - DNA, 20 bp, Artificial
  CRISPR gRNA sequence
aagggaaagagaagtcactc

SEQ ID NO: 95243 - DNA, 20 bp, Artificial
  CRISPR gRNA sequence
agggaaagagaagtcactca

SEQ ID NO: 95244 - DNA, 20 bp, Artificial
  CRISPR gRNA sequence
agtcctaaccagtgtgaatt

SEQ ID NO: 95245 - DNA, 20 bp, Artificial
  CRISPR gRNA sequence
accagtgtgaattaagtatg

SEQ ID NO: 95246 - DNA, 20 bp, Artificial
  CRISPR gRNA sequence
agtatgacacactggcaact

SEQ ID NO: 95247 - DNA, 20 bp, Artificial
  CRISPR gRNA sequence
gcaactgcaaattttagaaa

SEQ ID NO: 95248 - DNA, 20 bp, Artificial
  CRISPR gRNA sequence
caaattttagaaatatttag

SEQ ID NO: 95249 - DNA, 20 bp, Artificial
  CRISPR gRNA sequence
tagaaatatttagaatatta

SEQ ID NO: 95250 - DNA, 20 bp, Artificial
  CRISPR gRNA sequence
agaaatatttagaatattat

SEQ ID NO: 95251 - DNA, 20 bp, Artificial
  CRISPR gRNA sequence
gaaatatttagaatattata

SEQ ID NO: 95252 - DNA, 20 bp, Artificial
  CRISPR gRNA sequence
agaatattatactttttgtt

SEQ ID NO: 95253 - DNA, 20 bp, Artificial
  CRISPR gRNA sequence
gaatattatactttttgttt

SEQ ID NO: 95254 - DNA, 20 bp, Artificial
  CRISPR gRNA sequence
tactttttgtttttgagaca

SEQ ID NO: 95255 - DNA, 20 bp, Artificial
  CRISPR gRNA sequence
tttgtttttgagacaaagtc

SEQ ID NO: 95256 - DNA, 20 bp, Artificial
  CRISPR gRNA sequence
ttgtttttgagacaaagtct

SEQ ID NO: 95257 - DNA, 20 bp, Artificial
  CRISPR gRNA sequence
tgtttttgagacaaagtctt

SEQ ID NO: 95258 - DNA, 20 bp, Artificial
  CRISPR gRNA sequence
gtttttgagacaaagtcttg

SEQ ID NO: 95259 - DNA, 20 bp, Artificial
  CRISPR gRNA sequence
tttttgagacaaagtcttgc

SEQ ID NO: 95260 - DNA, 20 bp, Artificial
  CRISPR gRNA sequence
ttgagacaaagtcttgctct

SEQ ID NO: 95261 - DNA, 20 bp, Artificial
  CRISPR gRNA sequence
tgagacaaagtcttgctctg

SEQ ID NO: 95262 - DNA, 20 bp, Artificial
  CRISPR gRNA sequence
gagacaaagtcttgctctgt

SEQ ID NO: 95263 - DNA, 20 bp, Artificial
  CRISPR gRNA sequence
agacaaagtcttgctctgtc

SEQ ID NO: 95264 - DNA, 20 bp, Artificial
  CRISPR gRNA sequence
gctctgtcacccaggctgga

SEQ ID NO: 95265 - DNA, 20 bp, Artificial
  CRISPR gRNA sequence
ctctgtcacccaggctggag

SEQ ID NO: 95266 - DNA, 20 bp, Artificial
  CRISPR gRNA sequence
tgtcacccaggctggagtga

SEQ ID NO: 95267 - DNA, 20 bp, Artificial
  CRISPR gRNA sequence
tcacccaggctggagtgaag

SEQ ID NO: 95268 - DNA, 20 bp, Artificial
  CRISPR gRNA sequence
gagtgaagtagcacaaccat

SEQ ID NO: 95269 - DNA, 20 bp, Artificial
  CRISPR gRNA sequence
actgcagcctcaatctcctg

SEQ ID NO: 95270 - DNA, 20 bp, Artificial
  CRISPR gRNA sequence
cagcctcaatctcctgggct

SEQ ID NO: 95271 - DNA, 20 bp, Artificial
  CRISPR gRNA sequence
aatctcctgggctcaatgat

SEQ ID NO: 95272 - DNA, 20 bp, Artificial
  CRISPR gRNA sequence
ctgggctcaatgatccttcc

SEQ ID NO: 95273 - DNA, 20 bp, Artificial
  CRISPR gRNA sequence
ggctcaatgatccttccacc

SEQ ID NO: 95274 - DNA, 20 bp, Artificial
  CRISPR gRNA sequence
aatgatccttccacctcagc

SEQ ID NO: 95275 - DNA, 20 bp, Artificial
  CRISPR gRNA sequence
ccacctcagcctcccgagta

SEQ ID NO: 95276 - DNA, 20 bp, Artificial
  CRISPR gRNA sequence
cacctcagcctcccgagtag

SEQ ID NO: 95277 - DNA, 20 bp, Artificial
  CRISPR gRNA sequence
agcctcccgagtagctagga

SEQ ID NO: 95278 - DNA, 20 bp, Artificial
  CRISPR gRNA sequence
ccgagtagctaggaccacag

SEQ ID NO: 95279 - DNA, 20 bp, Artificial
  CRISPR gRNA sequence
ggaccacaggcatgtgccaa

SEQ ID NO: 95280 - DNA, 20 bp, Artificial
  CRISPR gRNA sequence
gctaatttttaaaatttttt

SEQ ID NO: 95281 - DNA, 20 bp, Artificial
  CRISPR gRNA sequence
atttttaaaatttttttgtt

SEQ ID NO: 95282 - DNA, 20 bp, Artificial
  CRISPR gRNA sequence
ttaaaatttttttgttgaga

SEQ ID NO: 95283 - DNA, 20 bp, Artificial
  CRISPR gRNA sequence
taaaatttttttgttgagat

SEQ ID NO: 95284 - DNA, 20 bp, Artificial
  CRISPR gRNA sequence
aaaatttttttgttgagatg

SEQ ID NO: 95285 - DNA, 20 bp, Artificial
  CRISPR gRNA sequence
aaatttttttgttgagatgg

SEQ ID NO: 95286 - DNA, 20 bp, Artificial
  CRISPR gRNA sequence
ttttgttgagatggggtctc

SEQ ID NO: 95287 - DNA, 20 bp, Artificial
  CRISPR gRNA sequence
tttgttgagatggggtctcc

SEQ ID NO: 95288 - DNA, 20 bp, Artificial
  CRISPR gRNA sequence
ttgttgagatggggtctccc

SEQ ID NO: 95289 - DNA, 20 bp, Artificial
  CRISPR gRNA sequence
tgttgagatggggtctccct

SEQ ID NO: 95290 - DNA, 20 bp, Artificial
  CRISPR gRNA sequence
gttgagatggggtctcccta

SEQ ID NO: 95291 - DNA, 20 bp, Artificial
  CRISPR gRNA sequence
ttgagatggggtctccctat

SEQ ID NO: 95292 - DNA, 20 bp, Artificial
  CRISPR gRNA sequence
agatggggtctccctatgtt

SEQ ID NO: 95293 - DNA, 20 bp, Artificial
  CRISPR gRNA sequence
cctatgttacccaggctggt

SEQ ID NO: 95294 - DNA, 20 bp, Artificial
  CRISPR gRNA sequence
tgttacccaggctggtctca

SEQ ID NO: 95295 - DNA, 20 bp, Artificial
  CRISPR gRNA sequence
cccaggctggtctcaaactt

SEQ ID NO: 95296 - DNA, 20 bp, Artificial
  CRISPR gRNA sequence
gtctcaaacttccgggctca

SEQ ID NO: 95297 - DNA, 20 bp, Artificial
  CRISPR gRNA sequence
aaacttccgggctcaagcga

SEQ ID NO: 95298 - DNA, 20 bp, Artificial
  CRISPR gRNA sequence
ccgggctcaagcgatcctcc

SEQ ID NO: 95299 - DNA, 20 bp, Artificial
  CRISPR gRNA sequence
cgggctcaagcgatcctccc

SEQ ID NO: 95300 - DNA, 20 bp, Artificial
  CRISPR gRNA sequence
aagcgatcctccctcctagg

SEQ ID NO: 95301 - DNA, 20 bp, Artificial
  CRISPR gRNA sequence
cctcctaggcctccccaagt

SEQ ID NO: 95302 - DNA, 20 bp, Artificial
  CRISPR gRNA sequence
ctaggcctccccaagttctg

SEQ ID NO: 95303 - DNA, 20 bp, Artificial
  CRISPR gRNA sequence
ggcctccccaagttctgggc

SEQ ID NO: 95304 - DNA, 20 bp, Artificial
  CRISPR gRNA sequence
cccaagttctgggcttacag

SEQ ID NO: 95305 - DNA, 20 bp, Artificial
  CRISPR gRNA sequence
tgggcttacaggtattagcc

SEQ ID NO: 95306 - DNA, 20 bp, Artificial
  CRISPR gRNA sequence
ggcttacaggtattagccac

SEQ ID NO: 95307 - DNA, 20 bp, Artificial
  CRISPR gRNA sequence
acaggtattagccactgagc

SEQ ID NO: 95308 - DNA, 20 bp, Artificial
  CRISPR gRNA sequence
caggtattagccactgagcc

SEQ ID NO: 95309 - DNA, 20 bp, Artificial
  CRISPR gRNA sequence
gccactgagcctggcctaga

SEQ ID NO: 95310 - DNA, 20 bp, Artificial
  CRISPR gRNA sequence
agcctggcctagaacattac

SEQ ID NO: 95311 - DNA, 20 bp, Artificial
  CRISPR gRNA sequence
gcctagaacattacatttgt

SEQ ID NO: 95312 - DNA, 20 bp, Artificial
  CRISPR gRNA sequence
gaacattacatttgtaaaca

SEQ ID NO: 95313 - DNA, 20 bp, Artificial
  CRISPR gRNA sequence
catttgtaaacaattacaag

SEQ ID NO: 95314 - DNA, 20 bp, Artificial
  CRISPR gRNA sequence
gtaaacaattacaaggtcta

SEQ ID NO: 95315 - DNA, 20 bp, Artificial
  CRISPR gRNA sequence
taaacaattacaaggtctaa

SEQ ID NO: 95316 - DNA, 20 bp, Artificial
  CRISPR gRNA sequence
caaggtctaatattttagtg

SEQ ID NO: 95317 - DNA, 20 bp, Artificial
  CRISPR gRNA sequence
atattttagtgatggagcac

SEQ ID NO: 95318 - DNA, 20 bp, Artificial
  CRISPR gRNA sequence
tagtgatggagcacttcaag

SEQ ID NO: 95319 - DNA, 20 bp, Artificial
  CRISPR gRNA sequence
agtgatggagcacttcaagt

SEQ ID NO: 95320 - DNA, 20 bp, Artificial
  CRISPR gRNA sequence
gtgatggagcacttcaagtt

SEQ ID NO: 95321 - DNA, 20 bp, Artificial
  CRISPR gRNA sequence
caagttcagcctgaaactaa

SEQ ID NO: 95322 - DNA, 20 bp, Artificial
  CRISPR gRNA sequence
aagttcagcctgaaactaag

SEQ ID NO: 95323 - DNA, 20 bp, Artificial
  CRISPR gRNA sequence
agcctgaaactaagaaattt

SEQ ID NO: 95324 - DNA, 20 bp, Artificial
  CRISPR gRNA sequence
aaactaagaaatttaaagac

SEQ ID NO: 95325 - DNA, 20 bp, Artificial
  CRISPR gRNA sequence
agaaatttaaagacttagaa

SEQ ID NO: 95326 - DNA, 20 bp, Artificial
  CRISPR gRNA sequence
aaagacttagaatacatcct

SEQ ID NO: 95327 - DNA, 20 bp, Artificial
  CRISPR gRNA sequence
aagacttagaatacatccta

SEQ ID NO: 95328 - DNA, 20 bp, Artificial
  CRISPR gRNA sequence
agaatacatcctaggaccct

SEQ ID NO: 95329 - DNA, 20 bp, Artificial
  CRISPR gRNA sequence
gaatacatcctaggacccta

SEQ ID NO: 95330 - DNA, 20 bp, Artificial
  CRISPR gRNA sequence
ggaccctaagacagcttgca

SEQ ID NO: 95331 - DNA, 20 bp, Artificial
  CRISPR gRNA sequence
agacagcttgcagttaaaaa

SEQ ID NO: 95332 - DNA, 20 bp, Artificial
  CRISPR gRNA sequence
gcagttaaaaaaaatttttt

SEQ ID NO: 95333 - DNA, 20 bp, Artificial
  CRISPR gRNA sequence
cagttaaaaaaaattttttt

SEQ ID NO: 95334 - DNA, 20 bp, Artificial
  CRISPR gRNA sequence
aaaaaaattttttttttttt

SEQ ID NO: 95335 - DNA, 20 bp, Artificial
  CRISPR gRNA sequence
tttttttttttttttttttt

SEQ ID NO: 95336 - DNA, 20 bp, Artificial
  CRISPR gRNA sequence
tttttttttttttttttttt

SEQ ID NO: 95337 - DNA, 20 bp, Artificial
  CRISPR gRNA sequence
tttttttttttttttttttt

SEQ ID NO: 95338 - DNA, 20 bp, Artificial
  CRISPR gRNA sequence
tttttttttttttttttttt

SEQ ID NO: 95339 - DNA, 20 bp, Artificial
  CRISPR gRNA sequence
tttttttttttttttttttt

SEQ ID NO: 95340 - DNA, 20 bp, Artificial
  CRISPR gRNA sequence
tttttttttttttttttttt

SEQ ID NO: 95341 - DNA, 20 bp, Artificial
  CRISPR gRNA sequence
ttttttttttttttttttta

SEQ ID NO: 95342 - DNA, 20 bp, Artificial
  CRISPR gRNA sequence
ttttttttttttttttttaa

SEQ ID NO: 95343 - DNA, 20 bp, Artificial
  CRISPR gRNA sequence
tttttttttttttttttaag

SEQ ID NO: 95344 - DNA, 20 bp, Artificial
  CRISPR gRNA sequence
ttttttttttttttttaagg

SEQ ID NO: 95345 - DNA, 20 bp, Artificial
  CRISPR gRNA sequence
tttttttttttttttaagga

SEQ ID NO: 95346 - DNA, 20 bp, Artificial
  CRISPR gRNA sequence
ttttttttttttttaaggag

SEQ ID NO: 95347 - DNA, 20 bp, Artificial
  CRISPR gRNA sequence
tttttttttttttaaggaga

SEQ ID NO: 95348 - DNA, 20 bp, Artificial
  CRISPR gRNA sequence
ttttttttttttaaggagac

SEQ ID NO: 95349 - DNA, 20 bp, Artificial
  CRISPR gRNA sequence
tttttttttttaaggagaca

SEQ ID NO: 95350 - DNA, 20 bp, Artificial
  CRISPR gRNA sequence
ttttttttttaaggagacag

SEQ ID NO: 95351 - DNA, 20 bp, Artificial
  CRISPR gRNA sequence
tttttttttaaggagacagg

SEQ ID NO: 95352 - DNA, 20 bp, Artificial
  CRISPR gRNA sequence
ttttttttaaggagacaggg

SEQ ID NO: 95353 - DNA, 20 bp, Artificial
  CRISPR gRNA sequence
tttttttaaggagacagggt

SEQ ID NO: 95354 - DNA, 20 bp, Artificial
  CRISPR gRNA sequence
ttttttaaggagacagggtc

SEQ ID NO: 95355 - DNA, 20 bp, Artificial
  CRISPR gRNA sequence
tttttaaggagacagggtct

SEQ ID NO: 95356 - DNA, 20 bp, Artificial
  CRISPR gRNA sequence
ttttaaggagacagggtctt

SEQ ID NO: 95357 - DNA, 20 bp, Artificial
  CRISPR gRNA sequence
tttaaggagacagggtcttg

SEQ ID NO: 95358 - DNA, 20 bp, Artificial
  CRISPR gRNA sequence
ttaaggagacagggtcttgc

SEQ ID NO: 95359 - DNA, 20 bp, Artificial
  CRISPR gRNA sequence
taaggagacagggtcttgct

SEQ ID NO: 95360 - DNA, 20 bp, Artificial
  CRISPR gRNA sequence
aaggagacagggtcttgcta

SEQ ID NO: 95361 - DNA, 20 bp, Artificial
  CRISPR gRNA sequence
aggagacagggtcttgctat

SEQ ID NO: 95362 - DNA, 20 bp, Artificial
  CRISPR gRNA sequence
gctatgtcatccaggctgga

SEQ ID NO: 95363 - DNA, 20 bp, Artificial
  CRISPR gRNA sequence
ctatgtcatccaggctggaa

SEQ ID NO: 95364 - DNA, 20 bp, Artificial
  CRISPR gRNA sequence
tgtcatccaggctggaatgc

SEQ ID NO: 95365 - DNA, 20 bp, Artificial
  CRISPR gRNA sequence
gaatgcagtgatgcaaacaa

SEQ ID NO: 95366 - DNA, 20 bp, Artificial
  CRISPR gRNA sequence
acggcagcctcgaacccctg

SEQ ID NO: 95367 - DNA, 20 bp, Artificial
  CRISPR gRNA sequence
gaacccctggtctcaagcaa

SEQ ID NO: 95368 - DNA, 20 bp, Artificial
  CRISPR gRNA sequence
gtctcaagcaatcttcccac

SEQ ID NO: 95369 - DNA, 20 bp, Artificial
  CRISPR gRNA sequence
aagcaatcttcccacttcac

SEQ ID NO: 95370 - DNA, 20 bp, Artificial
  CRISPR gRNA sequence
cccacttcaccctcccaagt

SEQ ID NO: 95371 - DNA, 20 bp, Artificial
  CRISPR gRNA sequence
ccacttcaccctcccaagta

SEQ ID NO: 95372 - DNA, 20 bp, Artificial
  CRISPR gRNA sequence
caccctcccaagtacagctg

SEQ ID NO: 95373 - DNA, 20 bp, Artificial
  CRISPR gRNA sequence
accctcccaagtacagctgg

SEQ ID NO: 95374 - DNA, 20 bp, Artificial
  CRISPR gRNA sequence
ccaagtacagctgggtatac

SEQ ID NO: 95375 - DNA, 20 bp, Artificial
  CRISPR gRNA sequence
ggtatacaggcacttgccac

SEQ ID NO: 95376 - DNA, 20 bp, Artificial
  CRISPR gRNA sequence
gccaccatacctggcttgga

SEQ ID NO: 95377 - DNA, 20 bp, Artificial
  CRISPR gRNA sequence
ccaccatacctggcttggat

SEQ ID NO: 95378 - DNA, 20 bp, Artificial
  CRISPR gRNA sequence
gcttggatcacttgtaacaa

SEQ ID NO: 95379 - DNA, 20 bp, Artificial
  CRISPR gRNA sequence
ggatcacttgtaacaaaatt

SEQ ID NO: 95380 - DNA, 20 bp, Artificial
  CRISPR gRNA sequence
gatcacttgtaacaaaatta

SEQ ID NO: 95381 - DNA, 20 bp, Artificial
  CRISPR gRNA sequence
gtaacaaaattaaatttttc

SEQ ID NO: 95382 - DNA, 20 bp, Artificial
  CRISPR gRNA sequence
taacaaaattaaatttttct

SEQ ID NO: 95383 - DNA, 20 bp, Artificial
  CRISPR gRNA sequence
aatttttctctacactaagg

SEQ ID NO: 95384 - DNA, 20 bp, Artificial
  CRISPR gRNA sequence
ttctctacactaagggatta

SEQ ID NO: 95385 - DNA, 20 bp, Artificial
  CRISPR gRNA sequence
tctctacactaagggattat

SEQ ID NO: 95386 - DNA, 20 bp, Artificial
  CRISPR gRNA sequence
ctctacactaagggattata

SEQ ID NO: 95387 - DNA, 20 bp, Artificial
  CRISPR gRNA sequence
tctacactaagggattatat

SEQ ID NO: 95388 - DNA, 20 bp, Artificial
  CRISPR gRNA sequence
tacactaagggattatatag

SEQ ID NO: 95389 - DNA, 20 bp, Artificial
  CRISPR gRNA sequence
cactaagggattatatagct

SEQ ID NO: 95390 - DNA, 20 bp, Artificial
  CRISPR gRNA sequence
agggattatatagctctcac

SEQ ID NO: 95391 - DNA, 20 bp, Artificial
  CRISPR gRNA sequence
tatagctctcacaagaagaa

SEQ ID NO: 95392 - DNA, 20 bp, Artificial
  CRISPR gRNA sequence
tcacaagaagaaatatctgc

SEQ ID NO: 95393 - DNA, 20 bp, Artificial
  CRISPR gRNA sequence
acaagaagaaatatctgctt

SEQ ID NO: 95394 - DNA, 20 bp, Artificial
  CRISPR gRNA sequence
cttatttgtgacagcctcaa

SEQ ID NO: 95395 - DNA, 20 bp, Artificial
  CRISPR gRNA sequence
atttgtgacagcctcaaagt

SEQ ID NO: 95396 - DNA, 20 bp, Artificial
  CRISPR gRNA sequence
tttgtgacagcctcaaagta

SEQ ID NO: 95397 - DNA, 20 bp, Artificial
  CRISPR gRNA sequence
gtgacagcctcaaagtatac

SEQ ID NO: 95398 - DNA, 20 bp, Artificial
  CRISPR gRNA sequence
tgacagcctcaaagtatacc

SEQ ID NO: 95399 - DNA, 20 bp, Artificial
  CRISPR gRNA sequence
aaagtataccactaacaatg

SEQ ID NO: 95400 - DNA, 20 bp, Artificial
  CRISPR gRNA sequence
acaatgacaataataatggg

SEQ ID NO: 95401 - DNA, 20 bp, Artificial
  CRISPR gRNA sequence
gcaaactttagccagttgct

SEQ ID NO: 95402 - DNA, 20 bp, Artificial
  CRISPR gRNA sequence
caaactttagccagttgctg

SEQ ID NO: 95403 - DNA, 20 bp, Artificial
  CRISPR gRNA sequence
tagccagttgctggacactg

SEQ ID NO: 95404 - DNA, 20 bp, Artificial
  CRISPR gRNA sequence
agccagttgctggacactgt

SEQ ID NO: 95405 - DNA, 20 bp, Artificial
  CRISPR gRNA sequence
gccagttgctggacactgtg

SEQ ID NO: 95406 - DNA, 20 bp, Artificial
  CRISPR gRNA sequence
ctggacactgtgtgaaccct

SEQ ID NO: 95407 - DNA, 20 bp, Artificial
  CRISPR gRNA sequence
gacactgtgtgaaccctcaa

SEQ ID NO: 95408 - DNA, 20 bp, Artificial
  CRISPR gRNA sequence
tgtgaaccctcaatatggaa

SEQ ID NO: 95409 - DNA, 20 bp, Artificial
  CRISPR gRNA sequence
aatatggaatggctcacata

SEQ ID NO: 95410 - DNA, 20 bp, Artificial
  CRISPR gRNA sequence
acatattcacagcaacacta

SEQ ID NO: 95411 - DNA, 20 bp, Artificial
  CRISPR gRNA sequence
acagcaacactatgaatgac

SEQ ID NO: 95412 - DNA, 20 bp, Artificial
  CRISPR gRNA sequence
tgaatgacacacgattttaa

SEQ ID NO: 95413 - DNA, 20 bp, Artificial
  CRISPR gRNA sequence
taatgcccattttacagagt

SEQ ID NO: 95414 - DNA, 20 bp, Artificial
  CRISPR gRNA sequence
aatgcccattttacagagtt

SEQ ID NO: 95415 - DNA, 20 bp, Artificial
  CRISPR gRNA sequence
atgcccattttacagagttt

SEQ ID NO: 95416 - DNA, 20 bp, Artificial
  CRISPR gRNA sequence
tacagagtttaataacctat

SEQ ID NO: 95417 - DNA, 20 bp, Artificial
  CRISPR gRNA sequence
acagagtttaataacctatt

SEQ ID NO: 95418 - DNA, 20 bp, Artificial
  CRISPR gRNA sequence
cagagtttaataacctattc

SEQ ID NO: 95419 - DNA, 20 bp, Artificial
  CRISPR gRNA sequence
aataacctattcaagccaca

SEQ ID NO: 95420 - DNA, 20 bp, Artificial
  CRISPR gRNA sequence
ataacctattcaagccacaa

SEQ ID NO: 95421 - DNA, 20 bp, Artificial
  CRISPR gRNA sequence
ttcaagccacaaggccagta

SEQ ID NO: 95422 - DNA, 20 bp, Artificial
  CRISPR gRNA sequence
aagccacaaggccagtaaat

SEQ ID NO: 95423 - DNA, 20 bp, Artificial
  CRISPR gRNA sequence
gcacccagaagtcgaactcc

SEQ ID NO: 95424 - DNA, 20 bp, Artificial
  CRISPR gRNA sequence
cacccagaagtcgaactcca

SEQ ID NO: 95425 - DNA, 20 bp, Artificial
  CRISPR gRNA sequence
cagaacactggttttacctt

SEQ ID NO: 95426 - DNA, 20 bp, Artificial
  CRISPR gRNA sequence
gttttacctttgactcagtt

SEQ ID NO: 95427 - DNA, 20 bp, Artificial
  CRISPR gRNA sequence
tacctttgactcagttcaaa

SEQ ID NO: 95428 - DNA, 20 bp, Artificial
  CRISPR gRNA sequence
acctttgactcagttcaaat

SEQ ID NO: 95429 - DNA, 20 bp, Artificial
  CRISPR gRNA sequence
cctttgactcagttcaaatc

SEQ ID NO: 95430 - DNA, 20 bp, Artificial
  CRISPR gRNA sequence
tgactcagttcaaatcaaac

SEQ ID NO: 95431 - DNA, 20 bp, Artificial
  CRISPR gRNA sequence
gactcagttcaaatcaaaca

SEQ ID NO: 95432 - DNA, 20 bp, Artificial
  CRISPR gRNA sequence
actcagttcaaatcaaacaa

SEQ ID NO: 95433 - DNA, 20 bp, Artificial
  CRISPR gRNA sequence
agttcaaatcaaacaatcca

SEQ ID NO: 95434 - DNA, 20 bp, Artificial
  CRISPR gRNA sequence
aaatcaaacaatccaaaagt

SEQ ID NO: 95435 - DNA, 20 bp, Artificial
  CRISPR gRNA sequence
tttgagacttataccccatt

SEQ ID NO: 95436 - DNA, 20 bp, Artificial
  CRISPR gRNA sequence
ttgagacttataccccatta

SEQ ID NO: 95437 - DNA, 20 bp, Artificial
  CRISPR gRNA sequence
tgagacttataccccattat

SEQ ID NO: 95438 - DNA, 20 bp, Artificial
  CRISPR gRNA sequence
gagacttataccccattatc

SEQ ID NO: 95439 - DNA, 20 bp, Artificial
  CRISPR gRNA sequence
agacttataccccattatca

SEQ ID NO: 95440 - DNA, 20 bp, Artificial
  CRISPR gRNA sequence
ataccccattatcatccttt

SEQ ID NO: 95441 - DNA, 20 bp, Artificial
  CRISPR gRNA sequence
taccccattatcatcctttt

SEQ ID NO: 95442 - DNA, 20 bp, Artificial
  CRISPR gRNA sequence
tcatcctttttttcccccct

SEQ ID NO: 95443 - DNA, 20 bp, Artificial
  CRISPR gRNA sequence
tttttcccccctcaggggta

SEQ ID NO: 95444 - DNA, 20 bp, Artificial
  CRISPR gRNA sequence
ttttcccccctcaggggtac

SEQ ID NO: 95445 - DNA, 20 bp, Artificial
  CRISPR gRNA sequence
tttcccccctcaggggtact

SEQ ID NO: 95446 - DNA, 20 bp, Artificial
  CRISPR gRNA sequence
ttcccccctcaggggtacta

SEQ ID NO: 95447 - DNA, 20 bp, Artificial
  CRISPR gRNA sequence
tcccccctcaggggtactaa

SEQ ID NO: 95448 - DNA, 20 bp, Artificial
  CRISPR gRNA sequence
cccccctcaggggtactaag

SEQ ID NO: 95449 - DNA, 20 bp, Artificial
  CRISPR gRNA sequence
ccccctcaggggtactaaga

SEQ ID NO: 95450 - DNA, 20 bp, Artificial
  CRISPR gRNA sequence
aggggtactaagaaaagggg

SEQ ID NO: 95451 - DNA, 20 bp, Artificial
  CRISPR gRNA sequence
agaaaaggggtagtgagaac

SEQ ID NO: 95452 - DNA, 20 bp, Artificial
  CRISPR gRNA sequence
acaacaaggatactgagaac

SEQ ID NO: 95453 - DNA, 20 bp, Artificial
  CRISPR gRNA sequence
agaacaaagtatattaagta

SEQ ID NO: 95454 - DNA, 20 bp, Artificial
  CRISPR gRNA sequence
agtattggggtagtgagaac

SEQ ID NO: 95455 - DNA, 20 bp, Artificial
  CRISPR gRNA sequence
gggtagtgagaacatgagaa

SEQ ID NO: 95456 - DNA, 20 bp, Artificial
  CRISPR gRNA sequence
aacataggggtactgggaac

SEQ ID NO: 95457 - DNA, 20 bp, Artificial
  CRISPR gRNA sequence
ggaacagagttgtaagaaaa

SEQ ID NO: 95458 - DNA, 20 bp, Artificial
  CRISPR gRNA sequence
taagaaaagagtactacgta

SEQ ID NO: 95459 - DNA, 20 bp, Artificial
  CRISPR gRNA sequence
cgtacaggggtactacagac

SEQ ID NO: 95460 - DNA, 20 bp, Artificial
  CRISPR gRNA sequence
cagacaggcaactgagtata

SEQ ID NO: 95461 - DNA, 20 bp, Artificial
  CRISPR gRNA sequence
agtatagcagtactaaaaat

SEQ ID NO: 95462 - DNA, 20 bp, Artificial
  CRISPR gRNA sequence
aaaatacggtactaggaaga

SEQ ID NO: 95463 - DNA, 20 bp, Artificial
  CRISPR gRNA sequence
ggaagagggttaacagaaca

SEQ ID NO: 95464 - DNA, 20 bp, Artificial
  CRISPR gRNA sequence
acagaacaggacactaaaaa

SEQ ID NO: 95465 - DNA, 20 bp, Artificial
  CRISPR gRNA sequence
aaaacaaagtactaaataca

SEQ ID NO: 95466 - DNA, 20 bp, Artificial
  CRISPR gRNA sequence
aatacaggagtattacaaat

SEQ ID NO: 95467 - DNA, 20 bp, Artificial
  CRISPR gRNA sequence
caaatagaggtactgagaac

SEQ ID NO: 95468 - DNA, 20 bp, Artificial
  CRISPR gRNA sequence
agaactgggtactgagaact

SEQ ID NO: 95469 - DNA, 20 bp, Artificial
  CRISPR gRNA sequence
ggtactgagaactggatact

SEQ ID NO: 95470 - DNA, 20 bp, Artificial
  CRISPR gRNA sequence
agaactggatactgagaata

SEQ ID NO: 95471 - DNA, 20 bp, Artificial
  CRISPR gRNA sequence
gatactgagaatagagtagt

SEQ ID NO: 95472 - DNA, 20 bp, Artificial
  CRISPR gRNA sequence
agaatagagtagtgaaaaca

SEQ ID NO: 95473 - DNA, 20 bp, Artificial
  CRISPR gRNA sequence
tctcagaagtaccaacttca

SEQ ID NO: 95474 - DNA, 20 bp, Artificial
  CRISPR gRNA sequence
ctcagaagtaccaacttcat

SEQ ID NO: 95475 - DNA, 20 bp, Artificial
  CRISPR gRNA sequence
tcagaagtaccaacttcatc

SEQ ID NO: 95476 - DNA, 20 bp, Artificial
  CRISPR gRNA sequence
agaagtaccaacttcatcta

SEQ ID NO: 95477 - DNA, 20 bp, Artificial
  CRISPR gRNA sequence
catctaggttcctaagtctc

SEQ ID NO: 95478 - DNA, 20 bp, Artificial
  CRISPR gRNA sequence
atctaggttcctaagtctcc

SEQ ID NO: 95479 - DNA, 20 bp, Artificial
  CRISPR gRNA sequence
ggttcctaagtctcctttag

SEQ ID NO: 95480 - DNA, 20 bp, Artificial
  CRISPR gRNA sequence
ctaagtctcctttagcgatg

SEQ ID NO: 95481 - DNA, 20 bp, Artificial
  CRISPR gRNA sequence
agtctcctttagcgatgaac

SEQ ID NO: 95482 - DNA, 20 bp, Artificial
  CRISPR gRNA sequence
ctttagcgatgaaccagacc

SEQ ID NO: 95483 - DNA, 20 bp, Artificial
  CRISPR gRNA sequence
tagcgatgaaccagaccgat

SEQ ID NO: 95484 - DNA, 20 bp, Artificial
  CRISPR gRNA sequence
agcgatgaaccagaccgatc

SEQ ID NO: 95485 - DNA, 20 bp, Artificial
  CRISPR gRNA sequence
gcgatgaaccagaccgatca

SEQ ID NO: 95486 - DNA, 20 bp, Artificial
  CRISPR gRNA sequence
actctatgtccttccagcca

SEQ ID NO: 95487 - DNA, 20 bp, Artificial
  CRISPR gRNA sequence
ctctatgtccttccagccat

SEQ ID NO: 95488 - DNA, 20 bp, Artificial
  CRISPR gRNA sequence
tatgtccttccagccatatc

SEQ ID NO: 95489 - DNA, 20 bp, Artificial
  CRISPR gRNA sequence
tgtccttccagccatatccc

SEQ ID NO: 95490 - DNA, 20 bp, Artificial
  CRISPR gRNA sequence
ccagccatatcccagatcta

SEQ ID NO: 95491 - DNA, 20 bp, Artificial
  CRISPR gRNA sequence
cagccatatcccagatctat

SEQ ID NO: 95492 - DNA, 20 bp, Artificial
  CRISPR gRNA sequence
tgacagctctgccgatgtca

SEQ ID NO: 95493 - DNA, 20 bp, Artificial
  CRISPR gRNA sequence
tgccgatgtcacattatttt

SEQ ID NO: 95494 - DNA, 20 bp, Artificial
  CRISPR gRNA sequence
ccgatgtcacattattttta

SEQ ID NO: 95495 - DNA, 20 bp, Artificial
  CRISPR gRNA sequence
tttttactgaaatttctgca

SEQ ID NO: 95496 - DNA, 20 bp, Artificial
  CRISPR gRNA sequence
ttactgaaatttctgcacct

SEQ ID NO: 95497 - DNA, 20 bp, Artificial
  CRISPR gRNA sequence
tactgaaatttctgcaccta

SEQ ID NO: 95498 - DNA, 20 bp, Artificial
  CRISPR gRNA sequence
actgaaatttctgcacctat

SEQ ID NO: 95499 - DNA, 20 bp, Artificial
  CRISPR gRNA sequence
ctgaaatttctgcacctatc

SEQ ID NO: 95500 - DNA, 20 bp, Artificial
  CRISPR gRNA sequence
aaatttctgcacctatcatg

SEQ ID NO: 95501 - DNA, 20 bp, Artificial
  CRISPR gRNA sequence
ctgcacctatcatgagttca

SEQ ID NO: 95502 - DNA, 20 bp, Artificial
  CRISPR gRNA sequence
tgcacctatcatgagttcaa

SEQ ID NO: 95503 - DNA, 20 bp, Artificial
  CRISPR gRNA sequence
cacctatcatgagttcaaca

SEQ ID NO: 95504 - DNA, 20 bp, Artificial
  CRISPR gRNA sequence
tcatgagttcaacagaactg

SEQ ID NO: 95505 - DNA, 20 bp, Artificial
  CRISPR gRNA sequence
aacagaactgttattgcttt

SEQ ID NO: 95506 - DNA, 20 bp, Artificial
  CRISPR gRNA sequence
ttattgctttgcacatgttg

SEQ ID NO: 95507 - DNA, 20 bp, Artificial
  CRISPR gRNA sequence
ttgctttgcacatgttggta

SEQ ID NO: 95508 - DNA, 20 bp, Artificial
  CRISPR gRNA sequence
ctttgcacatgttggtataa

SEQ ID NO: 95509 - DNA, 20 bp, Artificial
  CRISPR gRNA sequence
tgcacatgttggtataaact

SEQ ID NO: 95510 - DNA, 20 bp, Artificial
  CRISPR gRNA sequence
gcacatgttggtataaactt

SEQ ID NO: 95511 - DNA, 20 bp, Artificial
  CRISPR gRNA sequence
cacatgttggtataaacttt

SEQ ID NO: 95512 - DNA, 20 bp, Artificial
  CRISPR gRNA sequence
gtataaactttaatttaggg

SEQ ID NO: 95513 - DNA, 20 bp, Artificial
  CRISPR gRNA sequence
taatttagggcaaacactct

SEQ ID NO: 95514 - DNA, 20 bp, Artificial
  CRISPR gRNA sequence
aatttagggcaaacactcta

SEQ ID NO: 95515 - DNA, 20 bp, Artificial
  CRISPR gRNA sequence
atttagggcaaacactctaa

SEQ ID NO: 95516 - DNA, 20 bp, Artificial
  CRISPR gRNA sequence
agggcaaacactctaattct

SEQ ID NO: 95517 - DNA, 20 bp, Artificial
  CRISPR gRNA sequence
gggcaaacactctaattctc

SEQ ID NO: 95518 - DNA, 20 bp, Artificial
  CRISPR gRNA sequence
taattctcaaccactaaccc

SEQ ID NO: 95519 - DNA, 20 bp, Artificial
  CRISPR gRNA sequence
attctcaaccactaacccag

SEQ ID NO: 95520 - DNA, 20 bp, Artificial
  CRISPR gRNA sequence
tcaaccactaacccagtcac

SEQ ID NO: 95521 - DNA, 20 bp, Artificial
  CRISPR gRNA sequence
aaccactaacccagtcactg

SEQ ID NO: 95522 - DNA, 20 bp, Artificial
  CRISPR gRNA sequence
acccagtcactgcaaaccgg

SEQ ID NO: 95523 - DNA, 20 bp, Artificial
  CRISPR gRNA sequence
caaaccggcccatttggaag

SEQ ID NO: 95524 - DNA, 20 bp, Artificial
  CRISPR gRNA sequence
ggaagtggggaggcaggccc

SEQ ID NO: 95525 - DNA, 20 bp, Artificial
  CRISPR gRNA sequence
gaagtggggaggcaggccct

SEQ ID NO: 95526 - DNA, 20 bp, Artificial
  CRISPR gRNA sequence
cagatgcggtttgcgttaag

SEQ ID NO: 95527 - DNA, 20 bp, Artificial
  CRISPR gRNA sequence
gcgttaagatcgggtttctt

SEQ ID NO: 95528 - DNA, 20 bp, Artificial
  CRISPR gRNA sequence
cgttaagatcgggtttcttc

SEQ ID NO: 95529 - DNA, 20 bp, Artificial
  CRISPR gRNA sequence
agatcgggtttcttcttcca

SEQ ID NO: 95530 - DNA, 20 bp, Artificial
  CRISPR gRNA sequence
cttcttccacctcccatccc

SEQ ID NO: 95531 - DNA, 20 bp, Artificial
  CRISPR gRNA sequence
ttcttccacctcccatcccc

SEQ ID NO: 95532 - DNA, 20 bp, Artificial
  CRISPR gRNA sequence
cttccacctcccatccccag

SEQ ID NO: 95533 - DNA, 20 bp, Artificial
  CRISPR gRNA sequence
ttccacctcccatccccagg

SEQ ID NO: 95534 - DNA, 20 bp, Artificial
  CRISPR gRNA sequence
ccacctcccatccccaggcc

SEQ ID NO: 95535 - DNA, 20 bp, Artificial
  CRISPR gRNA sequence
cacctcccatccccaggcct

SEQ ID NO: 95536 - DNA, 20 bp, Artificial
  CRISPR gRNA sequence
ccatccccaggcctcagcta

SEQ ID NO: 95537 - DNA, 20 bp, Artificial
  CRISPR gRNA sequence
agctaagtctgatacctcga

SEQ ID NO: 95538 - DNA, 20 bp, Artificial
  CRISPR gRNA sequence
agtctgatacctcgagtttg

SEQ ID NO: 95539 - DNA, 20 bp, Artificial
  CRISPR gRNA sequence
atacctcgagtttgacgttt

SEQ ID NO: 95540 - DNA, 20 bp, Artificial
  CRISPR gRNA sequence
gagtttgacgtttcccgcgc

SEQ ID NO: 95541 - DNA, 20 bp, Artificial
  CRISPR gRNA sequence
gacgtttcccgcgctgccag

SEQ ID NO: 95542 - DNA, 20 bp, Artificial
  CRISPR gRNA sequence
acgtttcccgcgctgccagt

SEQ ID NO: 95543 - DNA, 20 bp, Artificial
  CRISPR gRNA sequence
cccgcgctgccagtcgaggc

SEQ ID NO: 95544 - DNA, 20 bp, Artificial
  CRISPR gRNA sequence
ccgcgctgccagtcgaggca

SEQ ID NO: 95545 - DNA, 20 bp, Artificial
  CRISPR gRNA sequence
ccagtcgaggcagtcccacc

SEQ ID NO: 95546 - DNA, 20 bp, Artificial
  CRISPR gRNA sequence
agggcctggtcgctcttctt

SEQ ID NO: 95547 - DNA, 20 bp, Artificial
  CRISPR gRNA sequence
gtcgctcttcttctttttat

SEQ ID NO: 95548 - DNA, 20 bp, Artificial
  CRISPR gRNA sequence
ttcttctttttatacttgtc

SEQ ID NO: 95549 - DNA, 20 bp, Artificial
  CRISPR gRNA sequence
cttctttttatacttgtcct

SEQ ID NO: 95550 - DNA, 20 bp, Artificial
  CRISPR gRNA sequence
ttctttttatacttgtcctt

SEQ ID NO: 95551 - DNA, 20 bp, Artificial
  CRISPR gRNA sequence
ctttttatacttgtccttgt

SEQ ID NO: 95552 - DNA, 20 bp, Artificial
  CRISPR gRNA sequence
tttttatacttgtccttgta

SEQ ID NO: 95553 - DNA, 20 bp, Artificial
  CRISPR gRNA sequence
tttatacttgtccttgtaca

SEQ ID NO: 95554 - DNA, 20 bp, Artificial
  CRISPR gRNA sequence
ttatacttgtccttgtacat

SEQ ID NO: 95555 - DNA, 20 bp, Artificial
  CRISPR gRNA sequence
tatacttgtccttgtacatc

SEQ ID NO: 95556 - DNA, 20 bp, Artificial
  CRISPR gRNA sequence
atacttgtccttgtacatct

SEQ ID NO: 95557 - DNA, 20 bp, Artificial
  CRISPR gRNA sequence
tacttgtccttgtacatctt

SEQ ID NO: 95558 - DNA, 20 bp, Artificial
  CRISPR gRNA sequence
gtccttgtacatcttgttgc

SEQ ID NO: 95559 - DNA, 20 bp, Artificial
  CRISPR gRNA sequence
tccttgtacatcttgttgcg

SEQ ID NO: 95560 - DNA, 20 bp, Artificial
  CRISPR gRNA sequence
gtacatcttgttgcggtgtt

SEQ ID NO: 95561 - DNA, 20 bp, Artificial
  CRISPR gRNA sequence
tacatcttgttgcggtgttt

SEQ ID NO: 95562 - DNA, 20 bp, Artificial
  CRISPR gRNA sequence
gttgcggtgtttcttgcaca

SEQ ID NO: 95563 - DNA, 20 bp, Artificial
  CRISPR gRNA sequence
ttgcggtgtttcttgcacat

SEQ ID NO: 95564 - DNA, 20 bp, Artificial
  CRISPR gRNA sequence
cggtgtttcttgcacatcca

SEQ ID NO: 95565 - DNA, 20 bp, Artificial
  CRISPR gRNA sequence
cttgcacatccacggtttgc

SEQ ID NO: 95566 - DNA, 20 bp, Artificial
  CRISPR gRNA sequence
ttgcacatccacggtttgcg

SEQ ID NO: 95567 - DNA, 20 bp, Artificial
  CRISPR gRNA sequence
gcacatccacggtttgcgct

SEQ ID NO: 95568 - DNA, 20 bp, Artificial
  CRISPR gRNA sequence
cacatccacggtttgcgctg

SEQ ID NO: 95569 - DNA, 20 bp, Artificial
  CRISPR gRNA sequence
gcgctgcttggccacctggc

SEQ ID NO: 95570 - DNA, 20 bp, Artificial
  CRISPR gRNA sequence
cgctgcttggccacctggct

SEQ ID NO: 95571 - DNA, 20 bp, Artificial
  CRISPR gRNA sequence
cttggccacctggctcgtgg

SEQ ID NO: 95572 - DNA, 20 bp, Artificial
  CRISPR gRNA sequence
ggccacctggctcgtggtct

SEQ ID NO: 95573 - DNA, 20 bp, Artificial
  CRISPR gRNA sequence
gccacctggctcgtggtctc

SEQ ID NO: 95574 - DNA, 20 bp, Artificial
  CRISPR gRNA sequence
gctcgtggtctcgctgcagc

SEQ ID NO: 95575 - DNA, 20 bp, Artificial
  CRISPR gRNA sequence
gtggtctcgctgcagccttc

SEQ ID NO: 95576 - DNA, 20 bp, Artificial
  CRISPR gRNA sequence
gctgcagccttcgtaggtgc

SEQ ID NO: 95577 - DNA, 20 bp, Artificial
  CRISPR gRNA sequence
cagccttcgtaggtgcaggt

SEQ ID NO: 95578 - DNA, 20 bp, Artificial
  CRISPR gRNA sequence
cgtaggtgcaggtcttgctc

SEQ ID NO: 95579 - DNA, 20 bp, Artificial
  CRISPR gRNA sequence
gtaggtgcaggtcttgctca

SEQ ID NO: 95580 - DNA, 20 bp, Artificial
  CRISPR gRNA sequence
gctcatgctgcccccaccgc

SEQ ID NO: 95581 - DNA, 20 bp, Artificial
  CRISPR gRNA sequence
ctcatgctgcccccaccgct

SEQ ID NO: 95582 - DNA, 20 bp, Artificial
  CRISPR gRNA sequence
atgctgcccccaccgctgcc

SEQ ID NO: 95583 - DNA, 20 bp, Artificial
  CRISPR gRNA sequence
cccccaccgctgccccgcct

SEQ ID NO: 95584 - DNA, 20 bp, Artificial
  CRISPR gRNA sequence
ccccgcctccgggcgccccc

SEQ ID NO: 95585 - DNA, 20 bp, Artificial
  CRISPR gRNA sequence
cgggcgcccccgctgctgcc

SEQ ID NO: 95586 - DNA, 20 bp, Artificial
  CRISPR gRNA sequence
ctgccctcgccccccgagtg

SEQ ID NO: 95587 - DNA, 20 bp, Artificial
  CRISPR gRNA sequence
ccctcgccccccgagtgagt

SEQ ID NO: 95588 - DNA, 20 bp, Artificial
  CRISPR gRNA sequence
gccccccgagtgagtctcct

SEQ ID NO: 95589 - DNA, 20 bp, Artificial
  CRISPR gRNA sequence
ctcgtcctctagatcctcca

SEQ ID NO: 95590 - DNA, 20 bp, Artificial
  CRISPR gRNA sequence
gtcctctagatcctccaaac

SEQ ID NO: 95591 - DNA, 20 bp, Artificial
  CRISPR gRNA sequence
tagatcctccaaactagccg

SEQ ID NO: 95592 - DNA, 20 bp, Artificial
  CRISPR gRNA sequence
gatcctccaaactagccgcg

SEQ ID NO: 95593 - DNA, 20 bp, Artificial
  CRISPR gRNA sequence
caaactagccgcgctctcgc

SEQ ID NO: 95594 - DNA, 20 bp, Artificial
  CRISPR gRNA sequence
gccgcgctctcgcctccccc

SEQ ID NO: 95595 - DNA, 20 bp, Artificial
  CRISPR gRNA sequence
tcgcctccccccggagggtc

SEQ ID NO: 95596 - DNA, 20 bp, Artificial
  CRISPR gRNA sequence
gcctccccccggagggtccg

SEQ ID NO: 95597 - DNA, 20 bp, Artificial
  CRISPR gRNA sequence
cccccggagggtccgaagtg

SEQ ID NO: 95598 - DNA, 20 bp, Artificial
  CRISPR gRNA sequence
acaggtccgcctcgtcctcc

SEQ ID NO: 95599 - DNA, 20 bp, Artificial
  CRISPR gRNA sequence
gtcctccccagcctcctctt

SEQ ID NO: 95600 - DNA, 20 bp, Artificial
  CRISPR gRNA sequence
cccagcctcctcttcgccat

SEQ ID NO: 95601 - DNA, 20 bp, Artificial
  CRISPR gRNA sequence
ctcttcgccatccccggccc

SEQ ID NO: 95602 - DNA, 20 bp, Artificial
  CRISPR gRNA sequence
ttcgccatccccggcccctt

SEQ ID NO: 95603 - DNA, 20 bp, Artificial
  CRISPR gRNA sequence
cgccatccccggccccttcg

SEQ ID NO: 95604 - DNA, 20 bp, Artificial
  CRISPR gRNA sequence
gccatccccggccccttcgc

SEQ ID NO: 95605 - DNA, 20 bp, Artificial
  CRISPR gRNA sequence
cgcacaggtacctaacgggc

SEQ ID NO: 95606 - DNA, 20 bp, Artificial
  CRISPR gRNA sequence
gcacaggtacctaacgggct

SEQ ID NO: 95607 - DNA, 20 bp, Artificial
  CRISPR gRNA sequence
acgggcttgcccgccccaac

SEQ ID NO: 95608 - DNA, 20 bp, Artificial
  CRISPR gRNA sequence
gcccgccccaacgctgcccc

SEQ ID NO: 95609 - DNA, 20 bp, Artificial
  CRISPR gRNA sequence
cccgccccaacgctgccccc

SEQ ID NO: 95610 - DNA, 20 bp, Artificial
  CRISPR gRNA sequence
cccccgggggccgcagcctc

SEQ ID NO: 95611 - DNA, 20 bp, Artificial
  CRISPR gRNA sequence
gtcctgcccagcacagggtt

SEQ ID NO: 95612 - DNA, 20 bp, Artificial
  CRISPR gRNA sequence
cccagcacagggttgcatca

SEQ ID NO: 95613 - DNA, 20 bp, Artificial
  CRISPR gRNA sequence
catcactagcagggtgaatt

SEQ ID NO: 95614 - DNA, 20 bp, Artificial
  CRISPR gRNA sequence
gcagggtgaattgagaggcc

SEQ ID NO: 95615 - DNA, 20 bp, Artificial
  CRISPR gRNA sequence
agaggccgcggccgccaccg

SEQ ID NO: 95616 - DNA, 20 bp, Artificial
  CRISPR gRNA sequence
gcgccaaggtgggagccgca

SEQ ID NO: 95617 - DNA, 20 bp, Artificial
  CRISPR gRNA sequence
gggccgcggggtggggcacg

SEQ ID NO: 95618 - DNA, 20 bp, Artificial
  CRISPR gRNA sequence
gcggcgcccggccccgcgcc

SEQ ID NO: 95619 - DNA, 20 bp, Artificial
  CRISPR gRNA sequence
cgctacaccctgcgcctcca

SEQ ID NO: 95620 - DNA, 20 bp, Artificial
  CRISPR gRNA sequence
caccctgcgcctccatgctg

SEQ ID NO: 95621 - DNA, 20 bp, Artificial
  CRISPR gRNA sequence
cgcctccatgctgctaagac

SEQ ID NO: 95622 - DNA, 20 bp, Artificial
  CRISPR gRNA sequence
catgctgctaagacctggcc

SEQ ID NO: 95623 - DNA, 20 bp, Artificial
  CRISPR gRNA sequence
ctaagacctggccggggtcc

SEQ ID NO: 95624 - DNA, 20 bp, Artificial
  CRISPR gRNA sequence
agacctggccggggtccacg

SEQ ID NO: 95625 - DNA, 20 bp, Artificial
  CRISPR gRNA sequence
gccggggtccacgaccccgg

SEQ ID NO: 95626 - DNA, 20 bp, Artificial
  CRISPR gRNA sequence
ttagcacctgcttggcctaa

SEQ ID NO: 95627 - DNA, 20 bp, Artificial
  CRISPR gRNA sequence
tagcacctgcttggcctaac

SEQ ID NO: 95628 - DNA, 20 bp, Artificial
  CRISPR gRNA sequence
agcacctgcttggcctaacg

SEQ ID NO: 95629 - DNA, 20 bp, Artificial
  CRISPR gRNA sequence
gcacctgcttggcctaacgg

SEQ ID NO: 95630 - DNA, 20 bp, Artificial
  CRISPR gRNA sequence
cttggcctaacggcacttcg

SEQ ID NO: 95631 - DNA, 20 bp, Artificial
  CRISPR gRNA sequence
ggcctaacggcacttcgcga

SEQ ID NO: 95632 - DNA, 20 bp, Artificial
  CRISPR gRNA sequence
gcctaacggcacttcgcgaa

SEQ ID NO: 95633 - DNA, 20 bp, Artificial
  CRISPR gRNA sequence
acggcacttcgcgaaccaaa

SEQ ID NO: 95634 - DNA, 20 bp, Artificial
  CRISPR gRNA sequence
cgcgaaccaaagactcagga

SEQ ID NO: 95635 - DNA, 20 bp, Artificial
  CRISPR gRNA sequence
gcgaaccaaagactcaggac

SEQ ID NO: 95636 - DNA, 20 bp, Artificial
  CRISPR gRNA sequence
cggctcctccatagcgaccg

SEQ ID NO: 95637 - DNA, 20 bp, Artificial
  CRISPR gRNA sequence
cctccatagcgaccgcggcc

SEQ ID NO: 95638 - DNA, 20 bp, Artificial
  CRISPR gRNA sequence
gcgaccgcggccgagcgaac

SEQ ID NO: 95639 - DNA, 20 bp, Artificial
  CRISPR gRNA sequence
cgaccgcggccgagcgaacc

SEQ ID NO: 95640 - DNA, 20 bp, Artificial
  CRISPR gRNA sequence
cggccgagcgaaccgggaaa

SEQ ID NO: 95641 - DNA, 20 bp, Artificial
  CRISPR gRNA sequence
agcgaaccgggaaacggcac

SEQ ID NO: 95642 - DNA, 20 bp, Artificial
  CRISPR gRNA sequence
gaaccgggaaacggcaccgg

SEQ ID NO: 95643 - DNA, 20 bp, Artificial
  CRISPR gRNA sequence
gggaaacggcaccggaagcc

SEQ ID NO: 95644 - DNA, 20 bp, Artificial
  CRISPR gRNA sequence
gaaacggcaccggaagcccg

SEQ ID NO: 95645 - DNA, 20 bp, Artificial
  CRISPR gRNA sequence
aaacggcaccggaagcccgg

SEQ ID NO: 95646 - DNA, 20 bp, Artificial
  CRISPR gRNA sequence
ggcaccggaagcccggaggt

SEQ ID NO: 95647 - DNA, 20 bp, Artificial
  CRISPR gRNA sequence
gcaccggaagcccggaggtt

SEQ ID NO: 95648 - DNA, 20 bp, Artificial
  CRISPR gRNA sequence
ggaggttgggacgcccgcct

SEQ ID NO: 95649 - DNA, 20 bp, Artificial
  CRISPR gRNA sequence
taagccttccctgctgaaac

SEQ ID NO: 95650 - DNA, 20 bp, Artificial
  CRISPR gRNA sequence
tgctgaaaccggacgccgca

SEQ ID NO: 95651 - DNA, 20 bp, Artificial
  CRISPR gRNA sequence
acgccgcacggctcctgttc

SEQ ID NO: 95652 - DNA, 20 bp, Artificial
  CRISPR gRNA sequence
cacggctcctgttccggtgt

SEQ ID NO: 95653 - DNA, 20 bp, Artificial
  CRISPR gRNA sequence
cggctcctgttccggtgtca

SEQ ID NO: 95654 - DNA, 20 bp, Artificial
  CRISPR gRNA sequence
ggctcctgttccggtgtcag

SEQ ID NO: 95655 - DNA, 20 bp, Artificial
  CRISPR gRNA sequence
gctcctgttccggtgtcaga

SEQ ID NO: 95656 - DNA, 20 bp, Artificial
  CRISPR gRNA sequence
ggcccgccctccccgctcct

SEQ ID NO: 95657 - DNA, 20 bp, Artificial
  CRISPR gRNA sequence
tccccgctcctcagtctttg

SEQ ID NO: 95658 - DNA, 20 bp, Artificial
  CRISPR gRNA sequence
gctcctcagtctttgcggac

SEQ ID NO: 95659 - DNA, 20 bp, Artificial
  CRISPR gRNA sequence
ctcagtctttgcggacaaga

SEQ ID NO: 95660 - DNA, 20 bp, Artificial
  CRISPR gRNA sequence
tcagtctttgcggacaagaa

SEQ ID NO: 95661 - DNA, 20 bp, Artificial
  CRISPR gRNA sequence
cagtctttgcggacaagaaa

SEQ ID NO: 95662 - DNA, 20 bp, Artificial
  CRISPR gRNA sequence
agtctttgcggacaagaaag

SEQ ID NO: 95663 - DNA, 20 bp, Artificial
  CRISPR gRNA sequence
ggacaagaaaggggctgtgt

SEQ ID NO: 95664 - DNA, 20 bp, Artificial
  CRISPR gRNA sequence
gaaaggggctgtgtgagacg

SEQ ID NO: 95665 - DNA, 20 bp, Artificial
  CRISPR gRNA sequence
aaaggggctgtgtgagacgc

SEQ ID NO: 95666 - DNA, 20 bp, Artificial
  CRISPR gRNA sequence
aaggggctgtgtgagacgca

SEQ ID NO: 95667 - DNA, 20 bp, Artificial
  CRISPR gRNA sequence
gggctgtgtgagacgcaggg

SEQ ID NO: 95668 - DNA, 20 bp, Artificial
  CRISPR gRNA sequence
ggctgtgtgagacgcaggga

SEQ ID NO: 95669 - DNA, 20 bp, Artificial
  CRISPR gRNA sequence
ctgtgtgagacgcagggaag

SEQ ID NO: 95670 - DNA, 20 bp, Artificial
  CRISPR gRNA sequence
tgtgtgagacgcagggaagg

SEQ ID NO: 95671 - DNA, 20 bp, Artificial
  CRISPR gRNA sequence
cgcagggaaggaggcacacc

SEQ ID NO: 95672 - DNA, 20 bp, Artificial
  CRISPR gRNA sequence
gcagggaaggaggcacaccc

SEQ ID NO: 95673 - DNA, 20 bp, Artificial
  CRISPR gRNA sequence
cagggaaggaggcacacccg

SEQ ID NO: 95674 - DNA, 20 bp, Artificial
  CRISPR gRNA sequence
agggaaggaggcacacccgg

SEQ ID NO: 95675 - DNA, 20 bp, Artificial
  CRISPR gRNA sequence
gaaggaggcacacccggggg

SEQ ID NO: 95676 - DNA, 20 bp, Artificial
  CRISPR gRNA sequence
aggcacacccgggggtggcg

SEQ ID NO: 95677 - DNA, 20 bp, Artificial
  CRISPR gRNA sequence
acacccgggggtggcgcagt

SEQ ID NO: 95678 - DNA, 20 bp, Artificial
  CRISPR gRNA sequence
cacccgggggtggcgcagtg

SEQ ID NO: 95679 - DNA, 20 bp, Artificial
  CRISPR gRNA sequence
cccgggggtggcgcagtgag

SEQ ID NO: 95680 - DNA, 20 bp, Artificial
  CRISPR gRNA sequence
ccgggggtggcgcagtgagg

SEQ ID NO: 95681 - DNA, 20 bp, Artificial
  CRISPR gRNA sequence
cgggggtggcgcagtgagga

SEQ ID NO: 95682 - DNA, 20 bp, Artificial
  CRISPR gRNA sequence
gggggtggcgcagtgaggag

SEQ ID NO: 95683 - DNA, 20 bp, Artificial
  CRISPR gRNA sequence
ggggtggcgcagtgaggagg

SEQ ID NO: 95684 - DNA, 20 bp, Artificial
  CRISPR gRNA sequence
gcagtgaggagggggcgcga

SEQ ID NO: 95685 - DNA, 20 bp, Artificial
  CRISPR gRNA sequence
tgaggagggggcgcgacggc

SEQ ID NO: 95686 - DNA, 20 bp, Artificial
  CRISPR gRNA sequence
gaggagggggcgcgacggcc

SEQ ID NO: 95687 - DNA, 20 bp, Artificial
  CRISPR gRNA sequence
ggagggggcgcgacggccag

SEQ ID NO: 95688 - DNA, 20 bp, Artificial
  CRISPR gRNA sequence
gagggggcgcgacggccagg

SEQ ID NO: 95689 - DNA, 20 bp, Artificial
  CRISPR gRNA sequence
gggcgcgacggccaggaggc

SEQ ID NO: 95690 - DNA, 20 bp, Artificial
  CRISPR gRNA sequence
cgcgacggccaggaggctgg

SEQ ID NO: 95691 - DNA, 20 bp, Artificial
  CRISPR gRNA sequence
cgacggccaggaggctggtg

SEQ ID NO: 95692 - DNA, 20 bp, Artificial
  CRISPR gRNA sequence
gaggctggtggagcgacacc

SEQ ID NO: 95693 - DNA, 20 bp, Artificial
  CRISPR gRNA sequence
aggctggtggagcgacaccc

SEQ ID NO: 95694 - DNA, 20 bp, Artificial
  CRISPR gRNA sequence
ctggtggagcgacacccagg

SEQ ID NO: 95695 - DNA, 20 bp, Artificial
  CRISPR gRNA sequence
tggtggagcgacacccaggc

SEQ ID NO: 95696 - DNA, 20 bp, Artificial
  CRISPR gRNA sequence
gtggagcgacacccaggcag

SEQ ID NO: 95697 - DNA, 20 bp, Artificial
  CRISPR gRNA sequence
ggagcgacacccaggcagga

SEQ ID NO: 95698 - DNA, 20 bp, Artificial
  CRISPR gRNA sequence
gagcgacacccaggcaggag

SEQ ID NO: 95699 - DNA, 20 bp, Artificial
  CRISPR gRNA sequence
agcgacacccaggcaggaga

SEQ ID NO: 95700 - DNA, 20 bp, Artificial
  CRISPR gRNA sequence
gcgacacccaggcaggagag

SEQ ID NO: 95701 - DNA, 20 bp, Artificial
  CRISPR gRNA sequence
cgacacccaggcaggagagg

SEQ ID NO: 95702 - DNA, 20 bp, Artificial
  CRISPR gRNA sequence
cacccaggcaggagaggggg

SEQ ID NO: 95703 - DNA, 20 bp, Artificial
  CRISPR gRNA sequence
ttctgaacccccttttcctt

SEQ ID NO: 95704 - DNA, 20 bp, Artificial
  CRISPR gRNA sequence
ctgaacccccttttccttga

SEQ ID NO: 95705 - DNA, 20 bp, Artificial
  CRISPR gRNA sequence
cccccttttccttgagagac

SEQ ID NO: 95706 - DNA, 20 bp, Artificial
  CRISPR gRNA sequence
cttttccttgagagacgagt

SEQ ID NO: 95707 - DNA, 20 bp, Artificial
  CRISPR gRNA sequence
ttttccttgagagacgagtt

SEQ ID NO: 95708 - DNA, 20 bp, Artificial
  CRISPR gRNA sequence
tttccttgagagacgagttg

SEQ ID NO: 95709 - DNA, 20 bp, Artificial
  CRISPR gRNA sequence
ttccttgagagacgagttgg

SEQ ID NO: 95710 - DNA, 20 bp, Artificial
  CRISPR gRNA sequence
ccttgagagacgagttgggg

SEQ ID NO: 95711 - DNA, 20 bp, Artificial
  CRISPR gRNA sequence
tcctccacgcattacccact

SEQ ID NO: 95712 - DNA, 20 bp, Artificial
  CRISPR gRNA sequence
cctccacgcattacccactc

SEQ ID NO: 95713 - DNA, 20 bp, Artificial
  CRISPR gRNA sequence
gccgcaaaaactcccttctt

SEQ ID NO: 95714 - DNA, 20 bp, Artificial
  CRISPR gRNA sequence
ctgcccccgcccttgcttat

SEQ ID NO: 95715 - DNA, 20 bp, Artificial
  CRISPR gRNA sequence
gcccttgcttataagccttt

SEQ ID NO: 95716 - DNA, 20 bp, Artificial
  CRISPR gRNA sequence
cttataagcctttgagaccg

SEQ ID NO: 95717 - DNA, 20 bp, Artificial
  CRISPR gRNA sequence
ataagcctttgagaccgcag

SEQ ID NO: 95718 - DNA, 20 bp, Artificial
  CRISPR gRNA sequence
taagcctttgagaccgcaga

SEQ ID NO: 95719 - DNA, 20 bp, Artificial
  CRISPR gRNA sequence
aagcctttgagaccgcagaa

SEQ ID NO: 95720 - DNA, 20 bp, Artificial
  CRISPR gRNA sequence
ccgcagaagggaccttgttg

SEQ ID NO: 95721 - DNA, 20 bp, Artificial
  CRISPR gRNA sequence
gaagggaccttgttgtggaa

SEQ ID NO: 95722 - DNA, 20 bp, Artificial
  CRISPR gRNA sequence
aagggaccttgttgtggaac

SEQ ID NO: 95723 - DNA, 20 bp, Artificial
  CRISPR gRNA sequence
gaccttgttgtggaacggga

SEQ ID NO: 95724 - DNA, 20 bp, Artificial
  CRISPR gRNA sequence
tgttgtggaacgggacggcc

SEQ ID NO: 95725 - DNA, 20 bp, Artificial
  CRISPR gRNA sequence
gttgtggaacgggacggcca

SEQ ID NO: 95726 - DNA, 20 bp, Artificial
  CRISPR gRNA sequence
ccaaggtacgctgccccttt

SEQ ID NO: 95727 - DNA, 20 bp, Artificial
  CRISPR gRNA sequence
tacgctgcccctttaagttc

SEQ ID NO: 95728 - DNA, 20 bp, Artificial
  CRISPR gRNA sequence
ttcccctacttcttcttctt

SEQ ID NO: 95729 - DNA, 20 bp, Artificial
  CRISPR gRNA sequence
cctacttcttcttcttgaga

SEQ ID NO: 95730 - DNA, 20 bp, Artificial
  CRISPR gRNA sequence
tagccccgcccatctacccg

SEQ ID NO: 95731 - DNA, 20 bp, Artificial
  CRISPR gRNA sequence
cccgcccatctacccgaagc

SEQ ID NO: 95732 - DNA, 20 bp, Artificial
  CRISPR gRNA sequence
cgcccatctacccgaagccg

SEQ ID NO: 95733 - DNA, 20 bp, Artificial
  CRISPR gRNA sequence
tacccgaagccggagccaat

SEQ ID NO: 95734 - DNA, 20 bp, Artificial
  CRISPR gRNA sequence
cggagccaattggctccctc

SEQ ID NO: 95735 - DNA, 20 bp, Artificial
  CRISPR gRNA sequence
gctccctctggaaaaatctg

SEQ ID NO: 95736 - DNA, 20 bp, Artificial
  CRISPR gRNA sequence
ctccctctggaaaaatctgt

SEQ ID NO: 95737 - DNA, 20 bp, Artificial
  CRISPR gRNA sequence
cctctggaaaaatctgtggg

SEQ ID NO: 95738 - DNA, 20 bp, Artificial
  CRISPR gRNA sequence
ctctggaaaaatctgtgggc

SEQ ID NO: 95739 - DNA, 20 bp, Artificial
  CRISPR gRNA sequence
tctggaaaaatctgtgggca

SEQ ID NO: 95740 - DNA, 20 bp, Artificial
  CRISPR gRNA sequence
aaaaatctgtgggcagggta

SEQ ID NO: 95741 - DNA, 20 bp, Artificial
  CRISPR gRNA sequence
aaaatctgtgggcagggtaa

SEQ ID NO: 95742 - DNA, 20 bp, Artificial
  CRISPR gRNA sequence
tctgtgggcagggtaaaggt

SEQ ID NO: 95743 - DNA, 20 bp, Artificial
  CRISPR gRNA sequence
gtgggcagggtaaaggtgag

SEQ ID NO: 95744 - DNA, 20 bp, Artificial
  CRISPR gRNA sequence
tgggcagggtaaaggtgagc

SEQ ID NO: 95745 - DNA, 20 bp, Artificial
  CRISPR gRNA sequence
agggtaaaggtgagcgggcg

SEQ ID NO: 95746 - DNA, 20 bp, Artificial
  CRISPR gRNA sequence
gggtaaaggtgagcgggcgc

SEQ ID NO: 95747 - DNA, 20 bp, Artificial
  CRISPR gRNA sequence
aaggtgagcgggcgcaggcg

SEQ ID NO: 95748 - DNA, 20 bp, Artificial
  CRISPR gRNA sequence
cgcaggcgtagtgaaattct

SEQ ID NO: 95749 - DNA, 20 bp, Artificial
  CRISPR gRNA sequence
caggcgtagtgaaattctca

SEQ ID NO: 95750 - DNA, 20 bp, Artificial
  CRISPR gRNA sequence
gtgaaattctcagagccctt

SEQ ID NO: 95751 - DNA, 20 bp, Artificial
  CRISPR gRNA sequence
tgaaattctcagagcccttt

SEQ ID NO: 95752 - DNA, 20 bp, Artificial
  CRISPR gRNA sequence
aggccccgcccattccctcc

SEQ ID NO: 95753 - DNA, 20 bp, Artificial
  CRISPR gRNA sequence
cccgcccattccctccgagt

SEQ ID NO: 95754 - DNA, 20 bp, Artificial
  CRISPR gRNA sequence
cccattccctccgagtcggt

SEQ ID NO: 95755 - DNA, 20 bp, Artificial
  CRISPR gRNA sequence
ccattccctccgagtcggtg

SEQ ID NO: 95756 - DNA, 20 bp, Artificial
  CRISPR gRNA sequence
attccctccgagtcggtgag

SEQ ID NO: 95757 - DNA, 20 bp, Artificial
  CRISPR gRNA sequence
ttccctccgagtcggtgagg

SEQ ID NO: 95758 - DNA, 20 bp, Artificial
  CRISPR gRNA sequence
tccctccgagtcggtgagga

SEQ ID NO: 95759 - DNA, 20 bp, Artificial
  CRISPR gRNA sequence
ccctccgagtcggtgaggag

SEQ ID NO: 95760 - DNA, 20 bp, Artificial
  CRISPR gRNA sequence
cgagtcggtgaggaggggaa

SEQ ID NO: 95761 - DNA, 20 bp, Artificial
  CRISPR gRNA sequence
gtcggtgaggaggggaaaag

SEQ ID NO: 95762 - DNA, 20 bp, Artificial
  CRISPR gRNA sequence
tcggtgaggaggggaaaaga

SEQ ID NO: 95763 - DNA, 20 bp, Artificial
  CRISPR gRNA sequence
gaggaggggaaaagaaggcg

SEQ ID NO: 95764 - DNA, 20 bp, Artificial
  CRISPR gRNA sequence
aggaggggaaaagaaggcgc

SEQ ID NO: 95765 - DNA, 20 bp, Artificial
  CRISPR gRNA sequence
cgcaggcgcaactgccctcc

SEQ ID NO: 95766 - DNA, 20 bp, Artificial
  CRISPR gRNA sequence
gcaggcgcaactgccctccc

SEQ ID NO: 95767 - DNA, 20 bp, Artificial
  CRISPR gRNA sequence
caactgccctcccaggaccc

SEQ ID NO: 95768 - DNA, 20 bp, Artificial
  CRISPR gRNA sequence
ctgccctcccaggaccccag

SEQ ID NO: 95769 - DNA, 20 bp, Artificial
  CRISPR gRNA sequence
cggaacccacgccctcccct

SEQ ID NO: 95770 - DNA, 20 bp, Artificial
  CRISPR gRNA sequence
acgccctcccctaagtctta

SEQ ID NO: 95771 - DNA, 20 bp, Artificial
  CRISPR gRNA sequence
cgccctcccctaagtcttaa

SEQ ID NO: 95772 - DNA, 20 bp, Artificial
  CRISPR gRNA sequence
gccctcccctaagtcttaaa

SEQ ID NO: 95773 - DNA, 20 bp, Artificial
  CRISPR gRNA sequence
tcccctaagtcttaaagggc

SEQ ID NO: 95774 - DNA, 20 bp, Artificial
  CRISPR gRNA sequence
ccctaagtcttaaagggcca

SEQ ID NO: 95775 - DNA, 20 bp, Artificial
  CRISPR gRNA sequence
cctaagtcttaaagggccag

SEQ ID NO: 95776 - DNA, 20 bp, Artificial
  CRISPR gRNA sequence
aagtcttaaagggccagagg

SEQ ID NO: 95777 - DNA, 20 bp, Artificial
  CRISPR gRNA sequence
cagaggcagcacttactgcc

SEQ ID NO: 95778 - DNA, 20 bp, Artificial
  CRISPR gRNA sequence
agaggcagcacttactgccc

SEQ ID NO: 95779 - DNA, 20 bp, Artificial
  CRISPR gRNA sequence
cccgggcccttcctcacttt

SEQ ID NO: 95780 - DNA, 20 bp, Artificial
  CRISPR gRNA sequence
ccgggcccttcctcactttt

SEQ ID NO: 95781 - DNA, 20 bp, Artificial
  CRISPR gRNA sequence
cgggcccttcctcacttttg

SEQ ID NO: 95782 - DNA, 20 bp, Artificial
  CRISPR gRNA sequence
gggcccttcctcacttttgg

SEQ ID NO: 95783 - DNA, 20 bp, Artificial
  CRISPR gRNA sequence
ggcccttcctcacttttggg

SEQ ID NO: 95784 - DNA, 20 bp, Artificial
  CRISPR gRNA sequence
ccttcctcacttttgggggg

SEQ ID NO: 95785 - DNA, 20 bp, Artificial
  CRISPR gRNA sequence
cttcctcacttttggggggc

SEQ ID NO: 95786 - DNA, 20 bp, Artificial
  CRISPR gRNA sequence
ttcctcacttttggggggcg

SEQ ID NO: 95787 - DNA, 20 bp, Artificial
  CRISPR gRNA sequence
tcctcacttttggggggcgg

SEQ ID NO: 95788 - DNA, 20 bp, Artificial
  CRISPR gRNA sequence
tttggggggcgggggtgcgc

SEQ ID NO: 95789 - DNA, 20 bp, Artificial
  CRISPR gRNA sequence
ggggcgggggtgcgcaagcg

SEQ ID NO: 95790 - DNA, 20 bp, Artificial
  CRISPR gRNA sequence
gcgggggtgcgcaagcgcag

SEQ ID NO: 95791 - DNA, 20 bp, Artificial
  CRISPR gRNA sequence
cgggggtgcgcaagcgcagt

SEQ ID NO: 95792 - DNA, 20 bp, Artificial
  CRISPR gRNA sequence
gggggtgcgcaagcgcagtg

SEQ ID NO: 95793 - DNA, 20 bp, Artificial
  CRISPR gRNA sequence
ggggtgcgcaagcgcagtgg

SEQ ID NO: 95794 - DNA, 20 bp, Artificial
  CRISPR gRNA sequence
ggtgcgcaagcgcagtgggg

SEQ ID NO: 95795 - DNA, 20 bp, Artificial
  CRISPR gRNA sequence
caagcgcagtgggggagctc

SEQ ID NO: 95796 - DNA, 20 bp, Artificial
  CRISPR gRNA sequence
aagcgcagtgggggagctct

SEQ ID NO: 95797 - DNA, 20 bp, Artificial
  CRISPR gRNA sequence
agcgcagtgggggagctctg

SEQ ID NO: 95798 - DNA, 20 bp, Artificial
  CRISPR gRNA sequence
gcagtgggggagctctgggg

SEQ ID NO: 95799 - DNA, 20 bp, Artificial
  CRISPR gRNA sequence
cagtgggggagctctggggt

SEQ ID NO: 95800 - DNA, 20 bp, Artificial
  CRISPR gRNA sequence
agtgggggagctctggggtg

SEQ ID NO: 95801 - DNA, 20 bp, Artificial
  CRISPR gRNA sequence
gtgggggagctctggggtgg

SEQ ID NO: 95802 - DNA, 20 bp, Artificial
  CRISPR gRNA sequence
ggggagctctggggtggggg

SEQ ID NO: 95803 - DNA, 20 bp, Artificial
  CRISPR gRNA sequence
gagctctggggtgggggtag

SEQ ID NO: 95804 - DNA, 20 bp, Artificial
  CRISPR gRNA sequence
ctggggtgggggtagcggtc

SEQ ID NO: 95805 - DNA, 20 bp, Artificial
  CRISPR gRNA sequence
gggggtagcggtcgagtatc

SEQ ID NO: 95806 - DNA, 20 bp, Artificial
  CRISPR gRNA sequence
tatcaagttgctttctgtcc

SEQ ID NO: 95807 - DNA, 20 bp, Artificial
  CRISPR gRNA sequence
caagttgctttctgtcccgg

SEQ ID NO: 95808 - DNA, 20 bp, Artificial
  CRISPR gRNA sequence
agttgctttctgtcccggca

SEQ ID NO: 95809 - DNA, 20 bp, Artificial
  CRISPR gRNA sequence
gttgctttctgtcccggcag

SEQ ID NO: 95810 - DNA, 20 bp, Artificial
  CRISPR gRNA sequence
gctttctgtcccggcagagg

SEQ ID NO: 95811 - DNA, 20 bp, Artificial
  CRISPR gRNA sequence
tctgtcccggcagaggaagc

SEQ ID NO: 95812 - DNA, 20 bp, Artificial
  CRISPR gRNA sequence
gcagaggaagccagatcgct

SEQ ID NO: 95813 - DNA, 20 bp, Artificial
  CRISPR gRNA sequence
cagaggaagccagatcgctg

SEQ ID NO: 95814 - DNA, 20 bp, Artificial
  CRISPR gRNA sequence
agaggaagccagatcgctga

SEQ ID NO: 95815 - DNA, 20 bp, Artificial
  CRISPR gRNA sequence
aagccagatcgctgagggtc

SEQ ID NO: 95816 - DNA, 20 bp, Artificial
  CRISPR gRNA sequence
atcgctgagggtccggtctc

SEQ ID NO: 95817 - DNA, 20 bp, Artificial
  CRISPR gRNA sequence
ttgcctcctgctatatccat

SEQ ID NO: 95818 - DNA, 20 bp, Artificial
  CRISPR gRNA sequence
cctcctgctatatccattgg

SEQ ID NO: 95819 - DNA, 20 bp, Artificial
  CRISPR gRNA sequence
tcctgctatatccattggaa

SEQ ID NO: 95820 - DNA, 20 bp, Artificial
  CRISPR gRNA sequence
ctatatccattggaagagaa

SEQ ID NO: 95821 - DNA, 20 bp, Artificial
  CRISPR gRNA sequence
gaagagaaaagtttgtgact

SEQ ID NO: 95822 - DNA, 20 bp, Artificial
  CRISPR gRNA sequence
aagagaaaagtttgtgactt

SEQ ID NO: 95823 - DNA, 20 bp, Artificial
  CRISPR gRNA sequence
agtttgtgacttgggccccc

SEQ ID NO: 95824 - DNA, 20 bp, Artificial
  CRISPR gRNA sequence
gacttgggcccccaagtttt

SEQ ID NO: 95825 - DNA, 20 bp, Artificial
  CRISPR gRNA sequence
cttgggcccccaagttttga

SEQ ID NO: 95826 - DNA, 20 bp, Artificial
  CRISPR gRNA sequence
cccccaagttttgagagaac

SEQ ID NO: 95827 - DNA, 20 bp, Artificial
  CRISPR gRNA sequence
ccccaagttttgagagaact

SEQ ID NO: 95828 - DNA, 20 bp, Artificial
  CRISPR gRNA sequence
ttttgagagaactgggcttt

SEQ ID NO: 95829 - DNA, 20 bp, Artificial
  CRISPR gRNA sequence
agagaactgggctttcggcg

SEQ ID NO: 95830 - DNA, 20 bp, Artificial
  CRISPR gRNA sequence
gagaactgggctttcggcgc

SEQ ID NO: 95831 - DNA, 20 bp, Artificial
  CRISPR gRNA sequence
agaactgggctttcggcgcg

SEQ ID NO: 95832 - DNA, 20 bp, Artificial
  CRISPR gRNA sequence
gaactgggctttcggcgcgg

SEQ ID NO: 95833 - DNA, 20 bp, Artificial
  CRISPR gRNA sequence
aactgggctttcggcgcggg

SEQ ID NO: 95834 - DNA, 20 bp, Artificial
  CRISPR gRNA sequence
gggctttcggcgcgggggga

SEQ ID NO: 95835 - DNA, 20 bp, Artificial
  CRISPR gRNA sequence
gctttcggcgcggggggaca

SEQ ID NO: 95836 - DNA, 20 bp, Artificial
  CRISPR gRNA sequence
ctttcggcgcggggggacag

SEQ ID NO: 95837 - DNA, 20 bp, Artificial
  CRISPR gRNA sequence
ttcggcgcggggggacagag

SEQ ID NO: 95838 - DNA, 20 bp, Artificial
  CRISPR gRNA sequence
tcggcgcggggggacagagg

SEQ ID NO: 95839 - DNA, 20 bp, Artificial
  CRISPR gRNA sequence
ggggggacagaggaggctcg

SEQ ID NO: 95840 - DNA, 20 bp, Artificial
  CRISPR gRNA sequence
gggggacagaggaggctcgt

SEQ ID NO: 95841 - DNA, 20 bp, Artificial
  CRISPR gRNA sequence
ggggacagaggaggctcgtg

SEQ ID NO: 95842 - DNA, 20 bp, Artificial
  CRISPR gRNA sequence
ggacagaggaggctcgtggg

SEQ ID NO: 95843 - DNA, 20 bp, Artificial
  CRISPR gRNA sequence
gacagaggaggctcgtgggg

SEQ ID NO: 95844 - DNA, 20 bp, Artificial
  CRISPR gRNA sequence
gaggaggctcgtggggaggt

SEQ ID NO: 95845 - DNA, 20 bp, Artificial
  CRISPR gRNA sequence
gaggctcgtggggaggtgag

SEQ ID NO: 95846 - DNA, 20 bp, Artificial
  CRISPR gRNA sequence
ggggaggtgagtggacctcc

SEQ ID NO: 95847 - DNA, 20 bp, Artificial
  CRISPR gRNA sequence
gtggacctcctggatcgatt

SEQ ID NO: 95848 - DNA, 20 bp, Artificial
  CRISPR gRNA sequence
tggacctcctggatcgattt

SEQ ID NO: 95849 - DNA, 20 bp, Artificial
  CRISPR gRNA sequence
gacctcctggatcgatttag

SEQ ID NO: 95850 - DNA, 20 bp, Artificial
  CRISPR gRNA sequence
acctcctggatcgatttagg

SEQ ID NO: 95851 - DNA, 20 bp, Artificial
  CRISPR gRNA sequence
ctggatcgatttaggaggct

SEQ ID NO: 95852 - DNA, 20 bp, Artificial
  CRISPR gRNA sequence
tggatcgatttaggaggctc

SEQ ID NO: 95853 - DNA, 20 bp, Artificial
  CRISPR gRNA sequence
atcgatttaggaggctcggg

SEQ ID NO: 95854 - DNA, 20 bp, Artificial
  CRISPR gRNA sequence
tcgatttaggaggctcgggt

SEQ ID NO: 95855 - DNA, 20 bp, Artificial
  CRISPR gRNA sequence
ttaggaggctcgggtgggac

SEQ ID NO: 95856 - DNA, 20 bp, Artificial
  CRISPR gRNA sequence
taggaggctcgggtgggact

SEQ ID NO: 95857 - DNA, 20 bp, Artificial
  CRISPR gRNA sequence
ggaccaatcgcacctttgtt

SEQ ID NO: 95858 - DNA, 20 bp, Artificial
  CRISPR gRNA sequence
tgttgagccgtcactcatta

SEQ ID NO: 95859 - DNA, 20 bp, Artificial
  CRISPR gRNA sequence
gttgagccgtcactcattat

SEQ ID NO: 95860 - DNA, 20 bp, Artificial
  CRISPR gRNA sequence
ttgagccgtcactcattatg

SEQ ID NO: 95861 - DNA, 20 bp, Artificial
  CRISPR gRNA sequence
gagccgtcactcattatggg

SEQ ID NO: 95862 - DNA, 20 bp, Artificial
  CRISPR gRNA sequence
ggagcccctcccaacaacca

SEQ ID NO: 95863 - DNA, 20 bp, Artificial
  CRISPR gRNA sequence
aaccatagcgaatatttatt

SEQ ID NO: 95864 - DNA, 20 bp, Artificial
  CRISPR gRNA sequence
tatttattgagctccacgct

SEQ ID NO: 95865 - DNA, 20 bp, Artificial
  CRISPR gRNA sequence
ttattgagctccacgcttag

SEQ ID NO: 95866 - DNA, 20 bp, Artificial
  CRISPR gRNA sequence
cgcttagcagatcccccgat

SEQ ID NO: 95867 - DNA, 20 bp, Artificial
  CRISPR gRNA sequence
atcccccgataagctatgta

SEQ ID NO: 95868 - DNA, 20 bp, Artificial
  CRISPR gRNA sequence
tgtacagacataattcgttg

SEQ ID NO: 95869 - DNA, 20 bp, Artificial
  CRISPR gRNA sequence
gtacagacataattcgttgt

SEQ ID NO: 95870 - DNA, 20 bp, Artificial
  CRISPR gRNA sequence
ctcatttccacattttgtcg

SEQ ID NO: 95871 - DNA, 20 bp, Artificial
  CRISPR gRNA sequence
catttccacattttgtcgtg

SEQ ID NO: 95872 - DNA, 20 bp, Artificial
  CRISPR gRNA sequence
atttccacattttgtcgtgg

SEQ ID NO: 95873 - DNA, 20 bp, Artificial
  CRISPR gRNA sequence
attttgtcgtggaggaaact

SEQ ID NO: 95874 - DNA, 20 bp, Artificial
  CRISPR gRNA sequence
ttttgtcgtggaggaaactg

SEQ ID NO: 95875 - DNA, 20 bp, Artificial
  CRISPR gRNA sequence
gtggaggaaactgaggctca

SEQ ID NO: 95876 - DNA, 20 bp, Artificial
  CRISPR gRNA sequence
tggaggaaactgaggctcaa

SEQ ID NO: 95877 - DNA, 20 bp, Artificial
  CRISPR gRNA sequence
gaaactgaggctcaaaggtt

SEQ ID NO: 95878 - DNA, 20 bp, Artificial
  CRISPR gRNA sequence
aaaggttaagtcacgtgccc

SEQ ID NO: 95879 - DNA, 20 bp, Artificial
  CRISPR gRNA sequence
gtcacgtgcccaagttctca

SEQ ID NO: 95880 - DNA, 20 bp, Artificial
  CRISPR gRNA sequence
gttctcacggcctataaatt

SEQ ID NO: 95881 - DNA, 20 bp, Artificial
  CRISPR gRNA sequence
ttctcacggcctataaattg

SEQ ID NO: 95882 - DNA, 20 bp, Artificial
  CRISPR gRNA sequence
tctcacggcctataaattga

SEQ ID NO: 95883 - DNA, 20 bp, Artificial
  CRISPR gRNA sequence
taaattgagggattcgaacc

SEQ ID NO: 95884 - DNA, 20 bp, Artificial
  CRISPR gRNA sequence
ttgagggattcgaacccaga

SEQ ID NO: 95885 - DNA, 20 bp, Artificial
  CRISPR gRNA sequence
cgaacccagacagctgaccc

SEQ ID NO: 95886 - DNA, 20 bp, Artificial
  CRISPR gRNA sequence
aacccagacagctgacccca

SEQ ID NO: 95887 - DNA, 20 bp, Artificial
  CRISPR gRNA sequence
gacagctgaccccagagccc

SEQ ID NO: 95888 - DNA, 20 bp, Artificial
  CRISPR gRNA sequence
tttttttttttttttttttt

SEQ ID NO: 95889 - DNA, 20 bp, Artificial
  CRISPR gRNA sequence
ttttttttttttttttgaga

SEQ ID NO: 95890 - DNA, 20 bp, Artificial
  CRISPR gRNA sequence
ttttttttttttttgagaca

SEQ ID NO: 95891 - DNA, 20 bp, Artificial
  CRISPR gRNA sequence
agagtcttgctctgtcgccc

SEQ ID NO: 95892 - DNA, 20 bp, Artificial
  CRISPR gRNA sequence
ttgctctgtcgccccagcta

SEQ ID NO: 95893 - DNA, 20 bp, Artificial
  CRISPR gRNA sequence
ctgtcgccccagctacagtg

SEQ ID NO: 95894 - DNA, 20 bp, Artificial
  CRISPR gRNA sequence
tcgccccagctacagtgcag

SEQ ID NO: 95895 - DNA, 20 bp, Artificial
  CRISPR gRNA sequence
caccgcaacctccacctccc

SEQ ID NO: 95896 - DNA, 20 bp, Artificial
  CRISPR gRNA sequence
aacctccacctcccgagttc

SEQ ID NO: 95897 - DNA, 20 bp, Artificial
  CRISPR gRNA sequence
gagttcaagcaattctgcct

SEQ ID NO: 95898 - DNA, 20 bp, Artificial
  CRISPR gRNA sequence
caattctgcctcagcctccc

SEQ ID NO: 95899 - DNA, 20 bp, Artificial
  CRISPR gRNA sequence
ttctgcctcagcctcccgag

SEQ ID NO: 95900 - DNA, 20 bp, Artificial
  CRISPR gRNA sequence
gcctcagcctcccgagtagc

SEQ ID NO: 95901 - DNA, 20 bp, Artificial
  CRISPR gRNA sequence
cctcagcctcccgagtagct

SEQ ID NO: 95902 - DNA, 20 bp, Artificial
  CRISPR gRNA sequence
ctcccgagtagctgggatca

SEQ ID NO: 95903 - DNA, 20 bp, Artificial
  CRISPR gRNA sequence
tcccgagtagctgggatcac

SEQ ID NO: 95904 - DNA, 20 bp, Artificial
  CRISPR gRNA sequence
caggcgcccgccaccgcgct

SEQ ID NO: 95905 - DNA, 20 bp, Artificial
  CRISPR gRNA sequence
ttggctaatttttgtatttt

SEQ ID NO: 95906 - DNA, 20 bp, Artificial
  CRISPR gRNA sequence
taatttttgtatttttagta

SEQ ID NO: 95907 - DNA, 20 bp, Artificial
  CRISPR gRNA sequence
ttttgtatttttagtacaga

SEQ ID NO: 95908 - DNA, 20 bp, Artificial
  CRISPR gRNA sequence
tttgtatttttagtacagat

SEQ ID NO: 95909 - DNA, 20 bp, Artificial
  CRISPR gRNA sequence
ttgtatttttagtacagatg

SEQ ID NO: 95910 - DNA, 20 bp, Artificial
  CRISPR gRNA sequence
gtacagatggggtttcacca

SEQ ID NO: 95911 - DNA, 20 bp, Artificial
  CRISPR gRNA sequence
cagatggggtttcaccatgg

SEQ ID NO: 95912 - DNA, 20 bp, Artificial
  CRISPR gRNA sequence
tggggtttcaccatggtggc

SEQ ID NO: 95913 - DNA, 20 bp, Artificial
  CRISPR gRNA sequence
tttcaccatggtggccagcc

SEQ ID NO: 95914 - DNA, 20 bp, Artificial
  CRISPR gRNA sequence
acctcatgatccaccctcct

SEQ ID NO: 95915 - DNA, 20 bp, Artificial
  CRISPR gRNA sequence
ccaccctcctcggcctccca

SEQ ID NO: 95916 - DNA, 20 bp, Artificial
  CRISPR gRNA sequence
tcctcggcctcccaaagtgc

SEQ ID NO: 95917 - DNA, 20 bp, Artificial
  CRISPR gRNA sequence
cctcggcctcccaaagtgct

SEQ ID NO: 95918 - DNA, 20 bp, Artificial
  CRISPR gRNA sequence
ctcccaaagtgctgggatta

SEQ ID NO: 95919 - DNA, 20 bp, Artificial
  CRISPR gRNA sequence
agtgctgggattacagccgt

SEQ ID NO: 95920 - DNA, 20 bp, Artificial
  CRISPR gRNA sequence
cgtgagccactgtgccctgc

SEQ ID NO: 95921 - DNA, 20 bp, Artificial
  CRISPR gRNA sequence
tgagccactgtgccctgcca

SEQ ID NO: 95922 - DNA, 20 bp, Artificial
  CRISPR gRNA sequence
cactgtgccctgccagagcc

SEQ ID NO: 95923 - DNA, 20 bp, Artificial
  CRISPR gRNA sequence
actgtgccctgccagagccc

SEQ ID NO: 95924 - DNA, 20 bp, Artificial
  CRISPR gRNA sequence
ctcttaaacattgcacattg

SEQ ID NO: 95925 - DNA, 20 bp, Artificial
  CRISPR gRNA sequence
tcttaaacattgcacattgt

SEQ ID NO: 95926 - DNA, 20 bp, Artificial
  CRISPR gRNA sequence
attgcacattgtaggtgctt

SEQ ID NO: 95927 - DNA, 20 bp, Artificial
  CRISPR gRNA sequence
gcacattgtaggtgctttgg

SEQ ID NO: 95928 - DNA, 20 bp, Artificial
  CRISPR gRNA sequence
cattgtaggtgctttggtgg

SEQ ID NO: 95929 - DNA, 20 bp, Artificial
  CRISPR gRNA sequence
attgtaggtgctttggtggt

SEQ ID NO: 95930 - DNA, 20 bp, Artificial
  CRISPR gRNA sequence
ttgtaggtgctttggtggtg

SEQ ID NO: 95931 - DNA, 20 bp, Artificial
  CRISPR gRNA sequence
ggtgctttggtggtggggaa

SEQ ID NO: 95932 - DNA, 20 bp, Artificial
  CRISPR gRNA sequence
gctttggtggtggggaatgg

SEQ ID NO: 95933 - DNA, 20 bp, Artificial
  CRISPR gRNA sequence
tggggaatggtagacctcga

SEQ ID NO: 95934 - DNA, 20 bp, Artificial
  CRISPR gRNA sequence
ggaatggtagacctcgaaag

SEQ ID NO: 95935 - DNA, 20 bp, Artificial
  CRISPR gRNA sequence
tggtagacctcgaaagcagt

SEQ ID NO: 95936 - DNA, 20 bp, Artificial
  CRISPR gRNA sequence
cctcgaaagcagttggactc

SEQ ID NO: 95937 - DNA, 20 bp, Artificial
  CRISPR gRNA sequence
gactctggttttcatttccc

SEQ ID NO: 95938 - DNA, 20 bp, Artificial
  CRISPR gRNA sequence
ggttttcatttccctggctc

SEQ ID NO: 95939 - DNA, 20 bp, Artificial
  CRISPR gRNA sequence
cctggctctggtaattaacc

SEQ ID NO: 95940 - DNA, 20 bp, Artificial
  CRISPR gRNA sequence
ctggtaattaacctggacct

SEQ ID NO: 95941 - DNA, 20 bp, Artificial
  CRISPR gRNA sequence
cctcagtttacccaccctca

SEQ ID NO: 95942 - DNA, 20 bp, Artificial
  CRISPR gRNA sequence
tttacccaccctcacagtgc

SEQ ID NO: 95943 - DNA, 20 bp, Artificial
  CRISPR gRNA sequence
ttacccaccctcacagtgca

SEQ ID NO: 95944 - DNA, 20 bp, Artificial
  CRISPR gRNA sequence
ccaccctcacagtgcaaggc

SEQ ID NO: 95945 - DNA, 20 bp, Artificial
  CRISPR gRNA sequence
caccctcacagtgcaaggct

SEQ ID NO: 95946 - DNA, 20 bp, Artificial
  CRISPR gRNA sequence
acagtgcaaggctaggtatg

SEQ ID NO: 95947 - DNA, 20 bp, Artificial
  CRISPR gRNA sequence
tgcaaggctaggtatgcagt

SEQ ID NO: 95948 - DNA, 20 bp, Artificial
  CRISPR gRNA sequence
tccccttctgacacctccgc

SEQ ID NO: 95949 - DNA, 20 bp, Artificial
  CRISPR gRNA sequence
acctccgccagctttcccca

SEQ ID NO: 95950 - DNA, 20 bp, Artificial
  CRISPR gRNA sequence
ctccgccagctttccccatg

SEQ ID NO: 95951 - DNA, 20 bp, Artificial
  CRISPR gRNA sequence
ctttccccatggagcttacc

SEQ ID NO: 95952 - DNA, 20 bp, Artificial
  CRISPR gRNA sequence
catggagcttacccagcctg

SEQ ID NO: 95953 - DNA, 20 bp, Artificial
  CRISPR gRNA sequence
ggagcttacccagcctgcag

SEQ ID NO: 95954 - DNA, 20 bp, Artificial
  CRISPR gRNA sequence
agcctgcagaagacctcatc

SEQ ID NO: 95955 - DNA, 20 bp, Artificial
  CRISPR gRNA sequence
cagaagacctcatccagacc

SEQ ID NO: 95956 - DNA, 20 bp, Artificial
  CRISPR gRNA sequence
aagacctcatccagacccag

SEQ ID NO: 95957 - DNA, 20 bp, Artificial
  CRISPR gRNA sequence
gacccagcagacccctgcct

SEQ ID NO: 95958 - DNA, 20 bp, Artificial
  CRISPR gRNA sequence
cagacccctgcctcagaact

SEQ ID NO: 95959 - DNA, 20 bp, Artificial
  CRISPR gRNA sequence
agacccctgcctcagaactt

SEQ ID NO: 95960 - DNA, 20 bp, Artificial
  CRISPR gRNA sequence
gacccctgcctcagaacttg

SEQ ID NO: 95961 - DNA, 20 bp, Artificial
  CRISPR gRNA sequence
ctcagaacttggggaccctg

SEQ ID NO: 95962 - DNA, 20 bp, Artificial
  CRISPR gRNA sequence
cttggggaccctgaagaccc

SEQ ID NO: 95963 - DNA, 20 bp, Artificial
  CRISPR gRNA sequence
tggggaccctgaagaccccg

SEQ ID NO: 95964 - DNA, 20 bp, Artificial
  CRISPR gRNA sequence
gggaccctgaagaccccgga

SEQ ID NO: 95965 - DNA, 20 bp, Artificial
  CRISPR gRNA sequence
ggaccctgaagaccccggag

SEQ ID NO: 95966 - DNA, 20 bp, Artificial
  CRISPR gRNA sequence
accctgaagaccccggagag

SEQ ID NO: 95967 - DNA, 20 bp, Artificial
  CRISPR gRNA sequence
ccctgaagaccccggagagg

SEQ ID NO: 95968 - DNA, 20 bp, Artificial
  CRISPR gRNA sequence
agaccccggagaggaggctg

SEQ ID NO: 95969 - DNA, 20 bp, Artificial
  CRISPR gRNA sequence
cccggagaggaggctgcaga

SEQ ID NO: 95970 - DNA, 20 bp, Artificial
  CRISPR gRNA sequence
agaggaggctgcagatggct

SEQ ID NO: 95971 - DNA, 20 bp, Artificial
  CRISPR gRNA sequence
tgcagatggctcagacactg

SEQ ID NO: 95972 - DNA, 20 bp, Artificial
  CRISPR gRNA sequence
ggctcagacactgtggtcct

SEQ ID NO: 95973 - DNA, 20 bp, Artificial
  CRISPR gRNA sequence
agtctctttccctgcacaac

SEQ ID NO: 95974 - DNA, 20 bp, Artificial
  CRISPR gRNA sequence
ttccctgcacaaccggatgc

SEQ ID NO: 95975 - DNA, 20 bp, Artificial
  CRISPR gRNA sequence
atgccagtgtttcctctcca

SEQ ID NO: 95976 - DNA, 20 bp, Artificial
  CRISPR gRNA sequence
tgccagtgtttcctctccac

SEQ ID NO: 95977 - DNA, 20 bp, Artificial
  CRISPR gRNA sequence
gccagtgtttcctctccaca

SEQ ID NO: 95978 - DNA, 20 bp, Artificial
  CRISPR gRNA sequence
agtgtttcctctccacaggg

SEQ ID NO: 95979 - DNA, 20 bp, Artificial
  CRISPR gRNA sequence
gtgtttcctctccacagggt

SEQ ID NO: 95980 - DNA, 20 bp, Artificial
  CRISPR gRNA sequence
acagggtaggatacctcctc

SEQ ID NO: 95981 - DNA, 20 bp, Artificial
  CRISPR gRNA sequence
cagggtaggatacctcctct

SEQ ID NO: 95982 - DNA, 20 bp, Artificial
  CRISPR gRNA sequence
taggatacctcctctgggat

SEQ ID NO: 95983 - DNA, 20 bp, Artificial
  CRISPR gRNA sequence
ctcctctgggattagccctc

SEQ ID NO: 95984 - DNA, 20 bp, Artificial
  CRISPR gRNA sequence
tcctctgggattagccctct

SEQ ID NO: 95985 - DNA, 20 bp, Artificial
  CRISPR gRNA sequence
cctctgggattccatgatga

SEQ ID NO: 95986 - DNA, 20 bp, Artificial
  CRISPR gRNA sequence
attccatgatgatggaatgt

SEQ ID NO: 95987 - DNA, 20 bp, Artificial
  CRISPR gRNA sequence
ttccatgatgatggaatgtc

SEQ ID NO: 95988 - DNA, 20 bp, Artificial
  CRISPR gRNA sequence
atggaatgtcaggcctcaca

SEQ ID NO: 95989 - DNA, 20 bp, Artificial
  CRISPR gRNA sequence
gttttgttttgttgtttttt

SEQ ID NO: 95990 - DNA, 20 bp, Artificial
  CRISPR gRNA sequence
tgttttgttgttttttgaga

SEQ ID NO: 95991 - DNA, 20 bp, Artificial
  CRISPR gRNA sequence
ttttgttgttttttgagatg

SEQ ID NO: 95992 - DNA, 20 bp, Artificial
  CRISPR gRNA sequence
tttgctcttgttgcccatgc

SEQ ID NO: 95993 - DNA, 20 bp, Artificial
  CRISPR gRNA sequence
tgctcttgttgcccatgctg

SEQ ID NO: 95994 - DNA, 20 bp, Artificial
  CRISPR gRNA sequence
ttgcccatgctggagtgcaa

SEQ ID NO: 95995 - DNA, 20 bp, Artificial
  CRISPR gRNA sequence
ggagtgcaatggcgtgatct

SEQ ID NO: 95996 - DNA, 20 bp, Artificial
  CRISPR gRNA sequence
tcactgcaacctctgcctcc

SEQ ID NO: 95997 - DNA, 20 bp, Artificial
  CRISPR gRNA sequence
cactgcaacctctgcctcct

SEQ ID NO: 95998 - DNA, 20 bp, Artificial
  CRISPR gRNA sequence
ttcaactgattctcctgtct

SEQ ID NO: 95999 - DNA, 20 bp, Artificial
  CRISPR gRNA sequence
ttctcctgtctcagcctcct

SEQ ID NO: 96000 - DNA, 20 bp, Artificial
  CRISPR gRNA sequence
tcctgtctcagcctcctgag

SEQ ID NO: 96001 - DNA, 20 bp, Artificial
  CRISPR gRNA sequence
gtctcagcctcctgagtagc

SEQ ID NO: 96002 - DNA, 20 bp, Artificial
  CRISPR gRNA sequence
tctcagcctcctgagtagct

SEQ ID NO: 96003 - DNA, 20 bp, Artificial
  CRISPR gRNA sequence
ctcctgagtagctgggatta

SEQ ID NO: 96004 - DNA, 20 bp, Artificial
  CRISPR gRNA sequence
tcctgagtagctgggattac

SEQ ID NO: 96005 - DNA, 20 bp, Artificial
  CRISPR gRNA sequence
caggcttccgccactacgcc

SEQ ID NO: 96006 - DNA, 20 bp, Artificial
  CRISPR gRNA sequence
actacgcccagctaattttt

SEQ ID NO: 96007 - DNA, 20 bp, Artificial
  CRISPR gRNA sequence
ctacgcccagctaatttttt

SEQ ID NO: 96008 - DNA, 20 bp, Artificial
  CRISPR gRNA sequence
gctaattttttgggtatttt

SEQ ID NO: 96009 - DNA, 20 bp, Artificial
  CRISPR gRNA sequence
aattttttgggtatttttag

SEQ ID NO: 96010 - DNA, 20 bp, Artificial
  CRISPR gRNA sequence
ttttttgggtatttttagta

SEQ ID NO: 96011 - DNA, 20 bp, Artificial
  CRISPR gRNA sequence
ttgggtatttttagtagaga

SEQ ID NO: 96012 - DNA, 20 bp, Artificial
  CRISPR gRNA sequence
tgggtatttttagtagagac

SEQ ID NO: 96013 - DNA, 20 bp, Artificial
  CRISPR gRNA sequence
gggtatttttagtagagacg

SEQ ID NO: 96014 - DNA, 20 bp, Artificial
  CRISPR gRNA sequence
gagacggggtttcaccatgt

SEQ ID NO: 96015 - DNA, 20 bp, Artificial
  CRISPR gRNA sequence
cggggtttcaccatgttggc

SEQ ID NO: 96016 - DNA, 20 bp, Artificial
  CRISPR gRNA sequence
ggggtttcaccatgttggcc

SEQ ID NO: 96017 - DNA, 20 bp, Artificial
  CRISPR gRNA sequence
tttcaccatgttggccaggc

SEQ ID NO: 96018 - DNA, 20 bp, Artificial
  CRISPR gRNA sequence
tggtcttgaactcctgacct

SEQ ID NO: 96019 - DNA, 20 bp, Artificial
  CRISPR gRNA sequence
ggtcttgaactcctgacctc

SEQ ID NO: 96020 - DNA, 20 bp, Artificial
  CRISPR gRNA sequence
ctcaggtgatccgcccacct

SEQ ID NO: 96021 - DNA, 20 bp, Artificial
  CRISPR gRNA sequence
ccgcccacctcggcctccca

SEQ ID NO: 96022 - DNA, 20 bp, Artificial
  CRISPR gRNA sequence
acctcggcctcccaaagtgc

SEQ ID NO: 96023 - DNA, 20 bp, Artificial
  CRISPR gRNA sequence
cctcggcctcccaaagtgct

SEQ ID NO: 96024 - DNA, 20 bp, Artificial
  CRISPR gRNA sequence
ctcccaaagtgctgggatta

SEQ ID NO: 96025 - DNA, 20 bp, Artificial
  CRISPR gRNA sequence
tcccaaagtgctgggattac

SEQ ID NO: 96026 - DNA, 20 bp, Artificial
  CRISPR gRNA sequence
agtgctgggattacaggcat

SEQ ID NO: 96027 - DNA, 20 bp, Artificial
  CRISPR gRNA sequence
caggcatgagccactgtgcc

SEQ ID NO: 96028 - DNA, 20 bp, Artificial
  CRISPR gRNA sequence
cctgtttttgttttttgata

SEQ ID NO: 96029 - DNA, 20 bp, Artificial
  CRISPR gRNA sequence
ctgtttttgttttttgatac

SEQ ID NO: 96030 - DNA, 20 bp, Artificial
  CRISPR gRNA sequence
tgtttttgttttttgataca

SEQ ID NO: 96031 - DNA, 20 bp, Artificial
  CRISPR gRNA sequence
cagggtctcgctctgttact

SEQ ID NO: 96032 - DNA, 20 bp, Artificial
  CRISPR gRNA sequence
agggtctcgctctgttacta

SEQ ID NO: 96033 - DNA, 20 bp, Artificial
  CRISPR gRNA sequence
tctcgctctgttactaaggc

SEQ ID NO: 96034 - DNA, 20 bp, Artificial
  CRISPR gRNA sequence
tcgctctgttactaaggctg

SEQ ID NO: 96035 - DNA, 20 bp, Artificial
  CRISPR gRNA sequence
ctgttactaaggctggagtg

SEQ ID NO: 96036 - DNA, 20 bp, Artificial
  CRISPR gRNA sequence
ggagtgcagtgatgcaatca

SEQ ID NO: 96037 - DNA, 20 bp, Artificial
  CRISPR gRNA sequence
gatgcaatcatagttcactg

SEQ ID NO: 96038 - DNA, 20 bp, Artificial
  CRISPR gRNA sequence
tcactgcagcctcaacttcc

SEQ ID NO: 96039 - DNA, 20 bp, Artificial
  CRISPR gRNA sequence
cactgcagcctcaacttcct

SEQ ID NO: 96040 - DNA, 20 bp, Artificial
  CRISPR gRNA sequence
agcctcaacttcctgggctg

SEQ ID NO: 96041 - DNA, 20 bp, Artificial
  CRISPR gRNA sequence
cctgggctgaagccatcact

SEQ ID NO: 96042 - DNA, 20 bp, Artificial
  CRISPR gRNA sequence
aagccatcactcagcctccc

SEQ ID NO: 96043 - DNA, 20 bp, Artificial
  CRISPR gRNA sequence
agccatcactcagcctccct

SEQ ID NO: 96044 - DNA, 20 bp, Artificial
  CRISPR gRNA sequence
ccatcactcagcctccctag

SEQ ID NO: 96045 - DNA, 20 bp, Artificial
  CRISPR gRNA sequence
cactcagcctccctaggagc

SEQ ID NO: 96046 - DNA, 20 bp, Artificial
  CRISPR gRNA sequence
actcagcctccctaggagct

SEQ ID NO: 96047 - DNA, 20 bp, Artificial
  CRISPR gRNA sequence
ctccctaggagctgggacta

SEQ ID NO: 96048 - DNA, 20 bp, Artificial
  CRISPR gRNA sequence
tccctaggagctgggactat

SEQ ID NO: 96049 - DNA, 20 bp, Artificial
  CRISPR gRNA sequence
tataggcatgcaaccacacc

SEQ ID NO: 96050 - DNA, 20 bp, Artificial
  CRISPR gRNA sequence
gctaattttttttttttttt

SEQ ID NO: 96051 - DNA, 20 bp, Artificial
  CRISPR gRNA sequence
ctaatttttttttttttttt

SEQ ID NO: 96052 - DNA, 20 bp, Artificial
  CRISPR gRNA sequence
aattttttttttttttttgg

SEQ ID NO: 96053 - DNA, 20 bp, Artificial
  CRISPR gRNA sequence
attttttttttttttttggg

SEQ ID NO: 96054 - DNA, 20 bp, Artificial
  CRISPR gRNA sequence
tttttttttttttgggaggc

SEQ ID NO: 96055 - DNA, 20 bp, Artificial
  CRISPR gRNA sequence
ggaggctggtctccacctcc

SEQ ID NO: 96056 - DNA, 20 bp, Artificial
  CRISPR gRNA sequence
gaggctggtctccacctcct

SEQ ID NO: 96057 - DNA, 20 bp, Artificial
  CRISPR gRNA sequence
ggtctccacctcctgggctc

SEQ ID NO: 96058 - DNA, 20 bp, Artificial
  CRISPR gRNA sequence
tcctgggctcaagtgatctg

SEQ ID NO: 96059 - DNA, 20 bp, Artificial
  CRISPR gRNA sequence
cctgggctcaagtgatctgc

SEQ ID NO: 96060 - DNA, 20 bp, Artificial
  CRISPR gRNA sequence
ctgcaggcctccacttccga

SEQ ID NO: 96061 - DNA, 20 bp, Artificial
  CRISPR gRNA sequence
gcctccacttccgaaagtgc

SEQ ID NO: 96062 - DNA, 20 bp, Artificial
  CRISPR gRNA sequence
cctccacttccgaaagtgct

SEQ ID NO: 96063 - DNA, 20 bp, Artificial
  CRISPR gRNA sequence
ttccgaaagtgctgggatta

SEQ ID NO: 96064 - DNA, 20 bp, Artificial
  CRISPR gRNA sequence
tccgaaagtgctgggattac

SEQ ID NO: 96065 - DNA, 20 bp, Artificial
  CRISPR gRNA sequence
agtgctgggattacaggtgt

SEQ ID NO: 96066 - DNA, 20 bp, Artificial
  CRISPR gRNA sequence
gggattacaggtgtgagcca

SEQ ID NO: 96067 - DNA, 20 bp, Artificial
  CRISPR gRNA sequence
caggtgtgagccacagtgcc

SEQ ID NO: 96068 - DNA, 20 bp, Artificial
  CRISPR gRNA sequence
acacctgtttttaactcttt

SEQ ID NO: 96069 - DNA, 20 bp, Artificial
  CRISPR gRNA sequence
cacctgtttttaactctttg

SEQ ID NO: 96070 - DNA, 20 bp, Artificial
  CRISPR gRNA sequence
acctgtttttaactctttga

SEQ ID NO: 96071 - DNA, 20 bp, Artificial
  CRISPR gRNA sequence
tgtttttaactctttgaggg

SEQ ID NO: 96072 - DNA, 20 bp, Artificial
  CRISPR gRNA sequence
tttaactctttgagggtaga

SEQ ID NO: 96073 - DNA, 20 bp, Artificial
  CRISPR gRNA sequence
actctttgagggtagatagc

SEQ ID NO: 96074 - DNA, 20 bp, Artificial
  CRISPR gRNA sequence
ctctttgagggtagatagct

SEQ ID NO: 96075 - DNA, 20 bp, Artificial
  CRISPR gRNA sequence
ctttgagggtagatagctag

SEQ ID NO: 96076 - DNA, 20 bp, Artificial
  CRISPR gRNA sequence
atagctaggagtgaaattac

SEQ ID NO: 96077 - DNA, 20 bp, Artificial
  CRISPR gRNA sequence
tagctaggagtgaaattact

SEQ ID NO: 96078 - DNA, 20 bp, Artificial
  CRISPR gRNA sequence
taggagtgaaattactgggt

SEQ ID NO: 96079 - DNA, 20 bp, Artificial
  CRISPR gRNA sequence
agtgaaattactgggtcaga

SEQ ID NO: 96080 - DNA, 20 bp, Artificial
  CRISPR gRNA sequence
gtcatcctgttttacttact

SEQ ID NO: 96081 - DNA, 20 bp, Artificial
  CRISPR gRNA sequence
tcatcctgttttacttactg

SEQ ID NO: 96082 - DNA, 20 bp, Artificial
  CRISPR gRNA sequence
gttttacttactgaggaact

SEQ ID NO: 96083 - DNA, 20 bp, Artificial
  CRISPR gRNA sequence
ttttacttactgaggaactg

SEQ ID NO: 96084 - DNA, 20 bp, Artificial
  CRISPR gRNA sequence
actgaggatttatttttgat

SEQ ID NO: 96085 - DNA, 20 bp, Artificial
  CRISPR gRNA sequence
tgaggatttatttttgattg

SEQ ID NO: 96086 - DNA, 20 bp, Artificial
  CRISPR gRNA sequence
tttatttttgattggagtcc

SEQ ID NO: 96087 - DNA, 20 bp, Artificial
  CRISPR gRNA sequence
gtccaagaatatgcctaatt

SEQ ID NO: 96088 - DNA, 20 bp, Artificial
  CRISPR gRNA sequence
ttgttgctgccactcctgtc

SEQ ID NO: 96089 - DNA, 20 bp, Artificial
  CRISPR gRNA sequence
tcttcctacacttcttccta

SEQ ID NO: 96090 - DNA, 20 bp, Artificial
  CRISPR gRNA sequence
ctttctttctttcttttttt

SEQ ID NO: 96091 - DNA, 20 bp, Artificial
  CRISPR gRNA sequence
ctttctttctttttttgaga

SEQ ID NO: 96092 - DNA, 20 bp, Artificial
  CRISPR gRNA sequence
ttctttctttttttgagatg

SEQ ID NO: 96093 - DNA, 20 bp, Artificial
  CRISPR gRNA sequence
tggagtctcgctctgtcgcc

SEQ ID NO: 96094 - DNA, 20 bp, Artificial
  CRISPR gRNA sequence
ggagtctcgctctgtcgccc

SEQ ID NO: 96095 - DNA, 20 bp, Artificial
  CRISPR gRNA sequence
tctcgctctgtcgcccaggc

SEQ ID NO: 96096 - DNA, 20 bp, Artificial
  CRISPR gRNA sequence
tcgctctgtcgcccaggctg

SEQ ID NO: 96097 - DNA, 20 bp, Artificial
  CRISPR gRNA sequence
gtcgcccaggctggagtgca

SEQ ID NO: 96098 - DNA, 20 bp, Artificial
  CRISPR gRNA sequence
cgcccaggctggagtgcatg

SEQ ID NO: 96099 - DNA, 20 bp, Artificial
  CRISPR gRNA sequence
aggctggagtgcatggagtg

SEQ ID NO: 96100 - DNA, 20 bp, Artificial
  CRISPR gRNA sequence
ctggagtgcatggagtgcag

SEQ ID NO: 96101 - DNA, 20 bp, Artificial
  CRISPR gRNA sequence
ggagtgcagtggcgcaatct

SEQ ID NO: 96102 - DNA, 20 bp, Artificial
  CRISPR gRNA sequence
gcgcaatcttggctcactgc

SEQ ID NO: 96103 - DNA, 20 bp, Artificial
  CRISPR gRNA sequence
ttcacgccattctcctgctt

SEQ ID NO: 96104 - DNA, 20 bp, Artificial
  CRISPR gRNA sequence
ttctcctgcttcagcctccc

SEQ ID NO: 96105 - DNA, 20 bp, Artificial
  CRISPR gRNA sequence
tcctgcttcagcctcccgag

SEQ ID NO: 96106 - DNA, 20 bp, Artificial
  CRISPR gRNA sequence
gcttcagcctcccgagtagc

SEQ ID NO: 96107 - DNA, 20 bp, Artificial
  CRISPR gRNA sequence
cttcagcctcccgagtagct

SEQ ID NO: 96108 - DNA, 20 bp, Artificial
  CRISPR gRNA sequence
ctcccgagtagctgggacta

SEQ ID NO: 96109 - DNA, 20 bp, Artificial
  CRISPR gRNA sequence
tttttttttttttttttaaa

SEQ ID NO: 96110 - DNA, 20 bp, Artificial
  CRISPR gRNA sequence
tttttttttttttttaaatg

SEQ ID NO: 96111 - DNA, 20 bp, Artificial
  CRISPR gRNA sequence
ttttttttttttttaaatgg

SEQ ID NO: 96112 - DNA, 20 bp, Artificial
  CRISPR gRNA sequence
ggaggtttgcttttgttgcc

SEQ ID NO: 96113 - DNA, 20 bp, Artificial
  CRISPR gRNA sequence
gaggtttgcttttgttgccc

SEQ ID NO: 96114 - DNA, 20 bp, Artificial
  CRISPR gRNA sequence
tttcccctctccccactctc

SEQ ID NO: 96115 - DNA, 20 bp, Artificial
  CRISPR gRNA sequence
cccactctcgagacgcctcc

SEQ ID NO: 96116 - DNA, 20 bp, Artificial
  CRISPR gRNA sequence
cctggatcccctctcttctt

SEQ ID NO: 96117 - DNA, 20 bp, Artificial
  CRISPR gRNA sequence
gatcccctctcttcttgaga

SEQ ID NO: 96118 - DNA, 20 bp, Artificial
  CRISPR gRNA sequence
cagaatcttgctctgttgtc

SEQ ID NO: 96119 - DNA, 20 bp, Artificial
  CRISPR gRNA sequence
agaatcttgctctgttgtcc

SEQ ID NO: 96120 - DNA, 20 bp, Artificial
  CRISPR gRNA sequence
gaatcttgctctgttgtcca

SEQ ID NO: 96121 - DNA, 20 bp, Artificial
  CRISPR gRNA sequence
tcttgctctgttgtccaggg

SEQ ID NO: 96122 - DNA, 20 bp, Artificial
  CRISPR gRNA sequence
ttgctctgttgtccagggtg

SEQ ID NO: 96123 - DNA, 20 bp, Artificial
  CRISPR gRNA sequence
ctgttgtccagggtggagtg

SEQ ID NO: 96124 - DNA, 20 bp, Artificial
  CRISPR gRNA sequence
ttgtccagggtggagtgcag

SEQ ID NO: 96125 - DNA, 20 bp, Artificial
  CRISPR gRNA sequence
ctcactgcaactccctctcc

SEQ ID NO: 96126 - DNA, 20 bp, Artificial
  CRISPR gRNA sequence
tcactgcaactccctctcct

SEQ ID NO: 96127 - DNA, 20 bp, Artificial
  CRISPR gRNA sequence
gcaactccctctcctgggtt

SEQ ID NO: 96128 - DNA, 20 bp, Artificial
  CRISPR gRNA sequence
caactccctctcctgggtta

SEQ ID NO: 96129 - DNA, 20 bp, Artificial
  CRISPR gRNA sequence
ttaaggtgattctcctgcct

SEQ ID NO: 96130 - DNA, 20 bp, Artificial
  CRISPR gRNA sequence
ttctcctgcctcagcctccc

SEQ ID NO: 96131 - DNA, 20 bp, Artificial
  CRISPR gRNA sequence
tcctgcctcagcctcccaag

SEQ ID NO: 96132 - DNA, 20 bp, Artificial
  CRISPR gRNA sequence
gcctcagcctcccaagtagc

SEQ ID NO: 96133 - DNA, 20 bp, Artificial
  CRISPR gRNA sequence
ctggcatgcaccaccacatc

SEQ ID NO: 96134 - DNA, 20 bp, Artificial
  CRISPR gRNA sequence
ccagctaatttttgtgtttt

SEQ ID NO: 96135 - DNA, 20 bp, Artificial
  CRISPR gRNA sequence
gctaatttttgtgtttttag

SEQ ID NO: 96136 - DNA, 20 bp, Artificial
  CRISPR gRNA sequence
taatttttgtgtttttagta

SEQ ID NO: 96137 - DNA, 20 bp, Artificial
  CRISPR gRNA sequence
ttttgtgtttttagtagaga

SEQ ID NO: 96138 - DNA, 20 bp, Artificial
  CRISPR gRNA sequence
ttgtgtttttagtagagatg

SEQ ID NO: 96139 - DNA, 20 bp, Artificial
  CRISPR gRNA sequence
tggagttttgccatgttgcc

SEQ ID NO: 96140 - DNA, 20 bp, Artificial
  CRISPR gRNA sequence
ggagttttgccatgttgccc

SEQ ID NO: 96141 - DNA, 20 bp, Artificial
  CRISPR gRNA sequence
ttttgccatgttgcccaggc

SEQ ID NO: 96142 - DNA, 20 bp, Artificial
  CRISPR gRNA sequence
tggtctcgaactcctgacct

SEQ ID NO: 96143 - DNA, 20 bp, Artificial
  CRISPR gRNA sequence
ggtctcgaactcctgacctc

SEQ ID NO: 96144 - DNA, 20 bp, Artificial
  CRISPR gRNA sequence
cctcaggtgattgcccgcct

SEQ ID NO: 96145 - DNA, 20 bp, Artificial
  CRISPR gRNA sequence
ttgcccgcctcggcctccca

SEQ ID NO: 96146 - DNA, 20 bp, Artificial
  CRISPR gRNA sequence
gcctcggcctcccaaagtgc

SEQ ID NO: 96147 - DNA, 20 bp, Artificial
  CRISPR gRNA sequence
cctcggcctcccaaagtgct

SEQ ID NO: 96148 - DNA, 20 bp, Artificial
  CRISPR gRNA sequence
ctcccaaagtgctgggatta

SEQ ID NO: 96149 - DNA, 20 bp, Artificial
  CRISPR gRNA sequence
tcccaaagtgctgggattac

SEQ ID NO: 96150 - DNA, 20 bp, Artificial
  CRISPR gRNA sequence
agtgctgggattacaggcgt

SEQ ID NO: 96151 - DNA, 20 bp, Artificial
  CRISPR gRNA sequence
caggcgtgagccaccgcgcc

SEQ ID NO: 96152 - DNA, 20 bp, Artificial
  CRISPR gRNA sequence
gccaccgcgcccagtccctg

SEQ ID NO: 96153 - DNA, 20 bp, Artificial
  CRISPR gRNA sequence
accgcgcccagtccctgtag

SEQ ID NO: 96154 - DNA, 20 bp, Artificial
  CRISPR gRNA sequence
gcggatttctttgacttcct

SEQ ID NO: 96155 - DNA, 20 bp, Artificial
  CRISPR gRNA sequence
tctttgacttcctaagatct

SEQ ID NO: 96156 - DNA, 20 bp, Artificial
  CRISPR gRNA sequence
ttgacttcctaagatctcgg

SEQ ID NO: 96157 - DNA, 20 bp, Artificial
  CRISPR gRNA sequence
agatctcggtggtgtcacct

SEQ ID NO: 96158 - DNA, 20 bp, Artificial
  CRISPR gRNA sequence
gatctcggtggtgtcacctt

SEQ ID NO: 96159 - DNA, 20 bp, Artificial
  CRISPR gRNA sequence
atctcggtggtgtcaccttg

SEQ ID NO: 96160 - DNA, 20 bp, Artificial
  CRISPR gRNA sequence
ctcggtggtgtcaccttggg

SEQ ID NO: 96161 - DNA, 20 bp, Artificial
  CRISPR gRNA sequence
tcggtggtgtcaccttgggg

SEQ ID NO: 96162 - DNA, 20 bp, Artificial
  CRISPR gRNA sequence
ctcctgttaccaccttgtct

SEQ ID NO: 96163 - DNA, 20 bp, Artificial
  CRISPR gRNA sequence
ctgttaccaccttgtctaag

SEQ ID NO: 96164 - DNA, 20 bp, Artificial
  CRISPR gRNA sequence
tgttaccaccttgtctaaga

SEQ ID NO: 96165 - DNA, 20 bp, Artificial
  CRISPR gRNA sequence
tttttttttttttttttttt

SEQ ID NO: 96166 - DNA, 20 bp, Artificial
  CRISPR gRNA sequence
ttttttttttttttttgaga

SEQ ID NO: 96167 - DNA, 20 bp, Artificial
  CRISPR gRNA sequence
ttttttttttttttgagatg

SEQ ID NO: 96168 - DNA, 20 bp, Artificial
  CRISPR gRNA sequence
ggagtctcactcttgttgcc

SEQ ID NO: 96169 - DNA, 20 bp, Artificial
  CRISPR gRNA sequence
gagtctcactcttgttgccc

SEQ ID NO: 96170 - DNA, 20 bp, Artificial
  CRISPR gRNA sequence
ctcactcttgttgcccaggc

SEQ ID NO: 96171 - DNA, 20 bp, Artificial
  CRISPR gRNA sequence
cactcttgttgcccaggctg

SEQ ID NO: 96172 - DNA, 20 bp, Artificial
  CRISPR gRNA sequence
ttgttgcccaggctggagtg

SEQ ID NO: 96173 - DNA, 20 bp, Artificial
  CRISPR gRNA sequence
ttgcccaggctggagtgcag

SEQ ID NO: 96174 - DNA, 20 bp, Artificial
  CRISPR gRNA sequence
tcactgcaacctccacctcc

SEQ ID NO: 96175 - DNA, 20 bp, Artificial
  CRISPR gRNA sequence
aacctccacctcctggattc

SEQ ID NO: 96176 - DNA, 20 bp, Artificial
  CRISPR gRNA sequence
ttcaagcgattctcctgcct

SEQ ID NO: 96177 - DNA, 20 bp, Artificial
  CRISPR gRNA sequence
ttctcctgcctcagcctccc

SEQ ID NO: 96178 - DNA, 20 bp, Artificial
  CRISPR gRNA sequence
tcctgcctcagcctcccgag

SEQ ID NO: 96179 - DNA, 20 bp, Artificial
  CRISPR gRNA sequence
gcctcagcctcccgagtagc

SEQ ID NO: 96180 - DNA, 20 bp, Artificial
  CRISPR gRNA sequence
cctcagcctcccgagtagct

SEQ ID NO: 96181 - DNA, 20 bp, Artificial
  CRISPR gRNA sequence
ctcccgagtagctgggatta

SEQ ID NO: 96182 - DNA, 20 bp, Artificial
  CRISPR gRNA sequence
tcccgagtagctgggattac

SEQ ID NO: 96183 - DNA, 20 bp, Artificial
  CRISPR gRNA sequence
caggcatctgccaccatgca

SEQ ID NO: 96184 - DNA, 20 bp, Artificial
  CRISPR gRNA sequence
catggctaattttgtgtttt

SEQ ID NO: 96185 - DNA, 20 bp, Artificial
  CRISPR gRNA sequence
ggctaattttgtgtttttag

SEQ ID NO: 96186 - DNA, 20 bp, Artificial
  CRISPR gRNA sequence
ctaattttgtgtttttagta

SEQ ID NO: 96187 - DNA, 20 bp, Artificial
  CRISPR gRNA sequence
taattttgtgtttttagtag

SEQ ID NO: 96188 - DNA, 20 bp, Artificial
  CRISPR gRNA sequence
ttttgtgtttttagtagagg

SEQ ID NO: 96189 - DNA, 20 bp, Artificial
  CRISPR gRNA sequence
gaggtggaatttcaccatgt

SEQ ID NO: 96190 - DNA, 20 bp, Artificial
  CRISPR gRNA sequence
tggaatttcaccatgttagt

SEQ ID NO: 96191 - DNA, 20 bp, Artificial
  CRISPR gRNA sequence
ggaatttcaccatgttagtc

SEQ ID NO: 96192 - DNA, 20 bp, Artificial
  CRISPR gRNA sequence
tttcaccatgttagtcaggc

SEQ ID NO: 96193 - DNA, 20 bp, Artificial
  CRISPR gRNA sequence
tggtctcaaactcctgacct

SEQ ID NO: 96194 - DNA, 20 bp, Artificial
  CRISPR gRNA sequence
ggtctcaaactcctgacctc

SEQ ID NO: 96195 - DNA, 20 bp, Artificial
  CRISPR gRNA sequence
ctcaggtgatccacccacct

SEQ ID NO: 96196 - DNA, 20 bp, Artificial
  CRISPR gRNA sequence
ccacccacctcagcctccca

SEQ ID NO: 96197 - DNA, 20 bp, Artificial
  CRISPR gRNA sequence
acctcagcctcccaaagtgc

SEQ ID NO: 96198 - DNA, 20 bp, Artificial
  CRISPR gRNA sequence
cctcagcctcccaaagtgct

SEQ ID NO: 96199 - DNA, 20 bp, Artificial
  CRISPR gRNA sequence
ctcccaaagtgctgggatta

SEQ ID NO: 96200 - DNA, 20 bp, Artificial
  CRISPR gRNA sequence
tcccaaagtgctgggattac

SEQ ID NO: 96201 - DNA, 20 bp, Artificial
  CRISPR gRNA sequence
agtgctgggattacaggcat

SEQ ID NO: 96202 - DNA, 20 bp, Artificial
  CRISPR gRNA sequence
caggcatgagccactgtgcc

SEQ ID NO: 96203 - DNA, 20 bp, Artificial
  CRISPR gRNA sequence
gagccactgtgcccggcctt

SEQ ID NO: 96204 - DNA, 20 bp, Artificial
  CRISPR gRNA sequence
tgaacacttatttcaacttg

SEQ ID NO: 96205 - DNA, 20 bp, Artificial
  CRISPR gRNA sequence
ctacttgacccccgactccc

SEQ ID NO: 96206 - DNA, 20 bp, Artificial
  CRISPR gRNA sequence
acttgacccccgactcccta

SEQ ID NO: 96207 - DNA, 20 bp, Artificial
  CRISPR gRNA sequence
cttgacccccgactccctag

SEQ ID NO: 96208 - DNA, 20 bp, Artificial
  CRISPR gRNA sequence
ttgacccccgactccctaga

SEQ ID NO: 96209 - DNA, 20 bp, Artificial
  CRISPR gRNA sequence
aaaactatgtcttgtttgct

SEQ ID NO: 96210 - DNA, 20 bp, Artificial
  CRISPR gRNA sequence
ttgtttgctcagaacattgc

SEQ ID NO: 96211 - DNA, 20 bp, Artificial
  CRISPR gRNA sequence
tgtttgctcagaacattgcc

SEQ ID NO: 96212 - DNA, 20 bp, Artificial
  CRISPR gRNA sequence
ttgctcagaacattgccagg

SEQ ID NO: 96213 - DNA, 20 bp, Artificial
  CRISPR gRNA sequence
tgctcagaacattgccaggc

SEQ ID NO: 96214 - DNA, 20 bp, Artificial
  CRISPR gRNA sequence
gctcagaacattgccaggca

SEQ ID NO: 96215 - DNA, 20 bp, Artificial
  CRISPR gRNA sequence
tcagaacattgccaggcagg

SEQ ID NO: 96216 - DNA, 20 bp, Artificial
  CRISPR gRNA sequence
cagaacattgccaggcaggg

SEQ ID NO: 96217 - DNA, 20 bp, Artificial
  CRISPR gRNA sequence
gaacattgccaggcagggag

SEQ ID NO: 96218 - DNA, 20 bp, Artificial
  CRISPR gRNA sequence
attgccaggcagggaggaga

SEQ ID NO: 96219 - DNA, 20 bp, Artificial
  CRISPR gRNA sequence
gggaggagaaagatgcaccc

SEQ ID NO: 96220 - DNA, 20 bp, Artificial
  CRISPR gRNA sequence
ggaggagaaagatgcaccct

SEQ ID NO: 96221 - DNA, 20 bp, Artificial
  CRISPR gRNA sequence
aagatgcaccctgggtattc

SEQ ID NO: 96222 - DNA, 20 bp, Artificial
  CRISPR gRNA sequence
gatgcaccctgggtattcaa

SEQ ID NO: 96223 - DNA, 20 bp, Artificial
  CRISPR gRNA sequence
tgcaccctgggtattcaaga

SEQ ID NO: 96224 - DNA, 20 bp, Artificial
  CRISPR gRNA sequence
accctgggtattcaagagag

SEQ ID NO: 96225 - DNA, 20 bp, Artificial
  CRISPR gRNA sequence
cctgggtattcaagagagta
